United States Patent 11,254,933 (CRISPR/CAS TRANSCRIPTIONAL MODULATION) - sequence listing, part 17

SEQ ID NO: 738803 - DNA, 20 bp, mouse
gcaggtgtcaagcagtttca

SEQ ID NO: 738804 - DNA, 20 bp, mouse
gtttggggagactgacggag

SEQ ID NO: 738805 - DNA, 20 bp, mouse
ggagacttagaagggggagt

SEQ ID NO: 738806 - DNA, 20 bp, mouse
ggggcaagggctcacgctga

SEQ ID NO: 738807 - DNA, 20 bp, mouse
gagcggggcagcgagacttc

SEQ ID NO: 738808 - DNA, 20 bp, mouse
gcccacaaagtcctcgacac

SEQ ID NO: 738809 - DNA, 20 bp, mouse
gccccccgtaactcaaactc

SEQ ID NO: 738810 - DNA, 20 bp, mouse
gggattacggaagtagtgta

SEQ ID NO: 738811 - DNA, 20 bp, mouse
gtggagtcaattaacctgga

SEQ ID NO: 738812 - DNA, 20 bp, mouse
gaagcctgagtttgagttac

SEQ ID NO: 738813 - DNA, 20 bp, mouse
gcggaagtagtgtagggtgg

SEQ ID NO: 738814 - DNA, 20 bp, mouse
gactaaccagggcggggcaa

SEQ ID NO: 738815 - DNA, 20 bp, mouse
gccggccgccgcaactgcgc

SEQ ID NO: 738816 - DNA, 20 bp, mouse
gacgctcccaggaacagcgc

SEQ ID NO: 738817 - DNA, 20 bp, mouse
gcccaggaacagcgcaggaa

SEQ ID NO: 738818 - DNA, 20 bp, mouse
gcgacagctacagtctgcgc

SEQ ID NO: 738819 - DNA, 20 bp, mouse
gtcactgccccctggaggat

SEQ ID NO: 738820 - DNA, 20 bp, mouse
gggagcgtcagatttgtcgc

SEQ ID NO: 738821 - DNA, 20 bp, mouse
ggaagggtttggtactgatc

SEQ ID NO: 738822 - DNA, 20 bp, mouse
gctcctgggccccaaaacac

SEQ ID NO: 738823 - DNA, 20 bp, mouse
ggcggagagttcggccctga

SEQ ID NO: 738824 - DNA, 20 bp, mouse
gagttcggccctgacggctc

SEQ ID NO: 738825 - DNA, 20 bp, mouse
gcggccctgacggctctggg

SEQ ID NO: 738826 - DNA, 20 bp, mouse
ggatccaaggggtctagttc

SEQ ID NO: 738827 - DNA, 20 bp, mouse
gcgcggcttcctgaggtctc

SEQ ID NO: 738828 - DNA, 20 bp, mouse
gtaacagtctccagtctaca

SEQ ID NO: 738829 - DNA, 20 bp, mouse
ggaagccgcgctcggcgctc

SEQ ID NO: 738830 - DNA, 20 bp, mouse
gccgcgctcggcgctcggga

SEQ ID NO: 738831 - DNA, 20 bp, mouse
gcgccgagcgcggcttcctg

SEQ ID NO: 738832 - DNA, 20 bp, mouse
gaattcaaaagtggcgggtg

SEQ ID NO: 738833 - DNA, 20 bp, mouse
gcatgtgcctgagcggggtc

SEQ ID NO: 738834 - DNA, 20 bp, mouse
ggacctcaggaagccgcgct

SEQ ID NO: 738835 - DNA, 20 bp, mouse
gtgacgcaaccagagacctc

SEQ ID NO: 738836 - DNA, 20 bp, mouse
gaacccgtgccgaagatcat

SEQ ID NO: 738837 - DNA, 20 bp, mouse
ggggtccggctcccggggag

SEQ ID NO: 738838 - DNA, 20 bp, mouse
gcgtcacagcccatgatctt

SEQ ID NO: 738839 - DNA, 20 bp, mouse
ggggcgaggttatgaccgaa

SEQ ID NO: 738840 - DNA, 20 bp, mouse
ggtctgggcggggctatcga

SEQ ID NO: 738841 - DNA, 20 bp, mouse
gaaaagaggcggcacttcga

SEQ ID NO: 738842 - DNA, 20 bp, mouse
ggcacttcgaggggtctagg

SEQ ID NO: 738843 - DNA, 20 bp, mouse
gcccaccaagaaacgcgcaa

SEQ ID NO: 738844 - DNA, 20 bp, mouse
ggggctgggtccggctcccg

SEQ ID NO: 738845 - DNA, 20 bp, mouse
ggcggagggccctcactgag

SEQ ID NO: 738846 - DNA, 20 bp, mouse
gctacccatccacccgacac

SEQ ID NO: 738847 - DNA, 20 bp, mouse
gtggatgggtaggataagag

SEQ ID NO: 738848 - DNA, 20 bp, mouse
gggcgcgttcccatggtaac

SEQ ID NO: 738849 - DNA, 20 bp, mouse
gggaggcatgcgcctggggt

SEQ ID NO: 738850 - DNA, 20 bp, mouse
gagaggggaggcatgcgcct

SEQ ID NO: 738851 - DNA, 20 bp, mouse
gctcccgagcccgttaccat

SEQ ID NO: 738852 - DNA, 20 bp, mouse
gtgtaccagcctgtgtcggg

SEQ ID NO: 738853 - DNA, 20 bp, mouse
gggtaacgggctcgggaggg

SEQ ID NO: 738854 - DNA, 20 bp, mouse
ggggcaggcaaggtgcgcct

SEQ ID NO: 738855 - DNA, 20 bp, mouse
ggtacgcggtgtgcagtgga

SEQ ID NO: 738856 - DNA, 20 bp, mouse
ggggtctagttctcttgctc

SEQ ID NO: 738857 - DNA, 20 bp, mouse
gaggcaatacgcatgtgcaa

SEQ ID NO: 738858 - DNA, 20 bp, mouse
gtctagttctcttgctccgg

SEQ ID NO: 738859 - DNA, 20 bp, mouse
ggagcgcggagctaggcctc

SEQ ID NO: 738860 - DNA, 20 bp, mouse
gagtctagagcaggtccggg

SEQ ID NO: 738861 - DNA, 20 bp, mouse
gaaaggtgcctgagcggtgt

SEQ ID NO: 738862 - DNA, 20 bp, mouse
gccctccggagcgcggagct

SEQ ID NO: 738863 - DNA, 20 bp, mouse
ggcacttctgacgcaaccag

SEQ ID NO: 738864 - DNA, 20 bp, mouse
gccagtctacaggtttgtcg

SEQ ID NO: 738865 - DNA, 20 bp, mouse
gcctctccccctccggagcg

SEQ ID NO: 738866 - DNA, 20 bp, mouse
gctcgcccgcgagaacatgg

SEQ ID NO: 738867 - DNA, 20 bp, mouse
gtgcgcgtgcgcgggagctc

SEQ ID NO: 738868 - DNA, 20 bp, mouse
gcccgctccgcctgcgtcct

SEQ ID NO: 738869 - DNA, 20 bp, mouse
ggggagggatgcgggggctc

SEQ ID NO: 738870 - DNA, 20 bp, mouse
gcgcaatggtaggaccacat

SEQ ID NO: 738871 - DNA, 20 bp, mouse
gggtggggccagggaactcg

SEQ ID NO: 738872 - DNA, 20 bp, mouse
gcgcgggagctcaggcgccc

SEQ ID NO: 738873 - DNA, 20 bp, mouse
gtggtaggaccacatcggga

SEQ ID NO: 738874 - DNA, 20 bp, mouse
gcattgcggctgcacggcgc

SEQ ID NO: 738875 - DNA, 20 bp, mouse
gaccgaggacgcaggcggag

SEQ ID NO: 738876 - DNA, 20 bp, mouse
gtgtgatctgttggtgagcc

SEQ ID NO: 738877 - DNA, 20 bp, mouse
gctgcaaaccacgggaagcc

SEQ ID NO: 738878 - DNA, 20 bp, mouse
gtggtgagcctggcttcccg

SEQ ID NO: 738879 - DNA, 20 bp, mouse
gactttgcctcccaagtgag

SEQ ID NO: 738880 - DNA, 20 bp, mouse
gaacaacaatccactcactt

SEQ ID NO: 738881 - DNA, 20 bp, mouse
gtcaaaaaagagagaccttg

SEQ ID NO: 738882 - DNA, 20 bp, mouse
gccatcttgcagcaagagac

SEQ ID NO: 738883 - DNA, 20 bp, mouse
ggagcatgagtgtgatctgt

SEQ ID NO: 738884 - DNA, 20 bp, mouse
gcagaggagctgcaaaccac

SEQ ID NO: 738885 - DNA, 20 bp, mouse
gtggatgcactgatttattg

SEQ ID NO: 738886 - DNA, 20 bp, mouse
gtgtgatctgttggtgaatc

SEQ ID NO: 738887 - DNA, 20 bp, mouse
gccaagacataactcagttg

SEQ ID NO: 738888 - DNA, 20 bp, mouse
gttctaaacctgagcatcaa

SEQ ID NO: 738889 - DNA, 20 bp, mouse
gtgagcatcaatggttcctg

SEQ ID NO: 738890 - DNA, 20 bp, mouse
gtcaaacatttagaacaaga

SEQ ID NO: 738891 - DNA, 20 bp, mouse
gaaggaacagagtacataaa

SEQ ID NO: 738892 - DNA, 20 bp, mouse
gtagaaaatgttgtgtctga

SEQ ID NO: 738893 - DNA, 20 bp, mouse
gacatcacgcataacaccac

SEQ ID NO: 738894 - DNA, 20 bp, mouse
gcatttagaacaagaaggtt

SEQ ID NO: 738895 - DNA, 20 bp, mouse
gtggtgaatctggcttcccg

SEQ ID NO: 738896 - DNA, 20 bp, mouse
gcgaacacgggacactgtgc

SEQ ID NO: 738897 - DNA, 20 bp, mouse
gctctctcttcttagtaaac

SEQ ID NO: 738898 - DNA, 20 bp, mouse
gcagcctggtcatgtctata

SEQ ID NO: 738899 - DNA, 20 bp, mouse
gactgtgctggcaagaacac

SEQ ID NO: 738900 - DNA, 20 bp, mouse
gggctggactctccagacta

SEQ ID NO: 738901 - DNA, 20 bp, mouse
gagatgttgggaatcgaaca

SEQ ID NO: 738902 - DNA, 20 bp, mouse
gtagaaaaagacctcgagag

SEQ ID NO: 738903 - DNA, 20 bp, mouse
gactctaaaacacatttctg

SEQ ID NO: 738904 - DNA, 20 bp, mouse
gcccactaggaaactcccac

SEQ ID NO: 738905 - DNA, 20 bp, mouse
gtgagcaaatcgctgctttc

SEQ ID NO: 738906 - DNA, 20 bp, mouse
gcggagggagagcagacgtc

SEQ ID NO: 738907 - DNA, 20 bp, mouse
gggagggaggcgccgtcgga

SEQ ID NO: 738908 - DNA, 20 bp, mouse
gcgctcgctggaaccgagat

SEQ ID NO: 738909 - DNA, 20 bp, mouse
gtcgctggaaccgagatggg

SEQ ID NO: 738910 - DNA, 20 bp, mouse
gggggagaacgaggcgtcgc

SEQ ID NO: 738911 - DNA, 20 bp, mouse
ggctctggagcaaggaccgc

SEQ ID NO: 738912 - DNA, 20 bp, mouse
gaactcgagagtgttggaga

SEQ ID NO: 738913 - DNA, 20 bp, mouse
gccggagggcagaaattatt

SEQ ID NO: 738914 - DNA, 20 bp, mouse
gcagtggagggaggcgccgt

SEQ ID NO: 738915 - DNA, 20 bp, mouse
gaggccccgagagataaagc

SEQ ID NO: 738916 - DNA, 20 bp, mouse
gggcgcccctgcattatcag

SEQ ID NO: 738917 - DNA, 20 bp, mouse
gtatcagggggtctgagagt

SEQ ID NO: 738918 - DNA, 20 bp, mouse
gttggggcccttgttcgagt

SEQ ID NO: 738919 - DNA, 20 bp, mouse
gggcctgcgggtcggagaga

SEQ ID NO: 738920 - DNA, 20 bp, mouse
gggaccctgagctcactgaa

SEQ ID NO: 738921 - DNA, 20 bp, mouse
gaagaggccgggactctagg

SEQ ID NO: 738922 - DNA, 20 bp, mouse
gagaccccctgataatgcag

SEQ ID NO: 738923 - DNA, 20 bp, mouse
ggaaaggaggaactcctgga

SEQ ID NO: 738924 - DNA, 20 bp, mouse
gtcgaacaagggccccaact

SEQ ID NO: 738925 - DNA, 20 bp, mouse
gggtcggagagagggcaccc

SEQ ID NO: 738926 - DNA, 20 bp, mouse
gaaacgggagggttgcagaa

SEQ ID NO: 738927 - DNA, 20 bp, mouse
gcggtgctcactatacgttc

SEQ ID NO: 738928 - DNA, 20 bp, mouse
gcgagtgacgagtgacagaa

SEQ ID NO: 738929 - DNA, 20 bp, mouse
gcagagtatccccctgttta

SEQ ID NO: 738930 - DNA, 20 bp, mouse
gaacgctttgcaaaacggga

SEQ ID NO: 738931 - DNA, 20 bp, mouse
gtgtgcacgagtctaatcat

SEQ ID NO: 738932 - DNA, 20 bp, mouse
gttcacagaagctggggcgg

SEQ ID NO: 738933 - DNA, 20 bp, mouse
gtagctcgttcgctcgctgt

SEQ ID NO: 738934 - DNA, 20 bp, mouse
gactggctaagtccctgctg

SEQ ID NO: 738935 - DNA, 20 bp, mouse
gacgtatagtgagcaccgag

SEQ ID NO: 738936 - DNA, 20 bp, mouse
gcacctcctctgaacaacgt

SEQ ID NO: 738937 - DNA, 20 bp, mouse
gtgggcacagctggttttct

SEQ ID NO: 738938 - DNA, 20 bp, mouse
gccattcccacgttgttcag

SEQ ID NO: 738939 - DNA, 20 bp, mouse
gacagctggttttctcggag

SEQ ID NO: 738940 - DNA, 20 bp, mouse
ggagaggtggaatggcgccc

SEQ ID NO: 738941 - DNA, 20 bp, mouse
ggctggttttctcggagagg

SEQ ID NO: 738942 - DNA, 20 bp, mouse
gttttctcggagaggtggaa

SEQ ID NO: 738943 - DNA, 20 bp, mouse
gaataaaatccgaagggccg

SEQ ID NO: 738944 - DNA, 20 bp, mouse
ggaatggcgccccggccctt

SEQ ID NO: 738945 - DNA, 20 bp, mouse
gttcccacgttgttcagagg

SEQ ID NO: 738946 - DNA, 20 bp, mouse
gtaccccgagcggggagacc

SEQ ID NO: 738947 - DNA, 20 bp, mouse
gtggctctggacaactcaga

SEQ ID NO: 738948 - DNA, 20 bp, mouse
gccggaggctaccccgagcg

SEQ ID NO: 738949 - DNA, 20 bp, mouse
gaggctgtgagcagggccgc

SEQ ID NO: 738950 - DNA, 20 bp, mouse
gtccggccgggctgcaacag

SEQ ID NO: 738951 - DNA, 20 bp, mouse
gaggagaccccagcccgggg

SEQ ID NO: 738952 - DNA, 20 bp, mouse
gagcctggtctccccgctcg

SEQ ID NO: 738953 - DNA, 20 bp, mouse
gaggagagaccccaacagcc

SEQ ID NO: 738954 - DNA, 20 bp, mouse
gcctagccctgacgaggagg

SEQ ID NO: 738955 - DNA, 20 bp, mouse
gaaggaagtgacgcgcgggg

SEQ ID NO: 738956 - DNA, 20 bp, mouse
ggaagaggatccagggtgga

SEQ ID NO: 738957 - DNA, 20 bp, mouse
gggagggagtgcgacccggg

SEQ ID NO: 738958 - DNA, 20 bp, mouse
gtgcaataagctgatcccgg

SEQ ID NO: 738959 - DNA, 20 bp, mouse
ggcctagtgcccggggctct

SEQ ID NO: 738960 - DNA, 20 bp, mouse
gccagggtggagggcctgtg

SEQ ID NO: 738961 - DNA, 20 bp, mouse
gcctcccgctgcctagtgcc

SEQ ID NO: 738962 - DNA, 20 bp, mouse
gggtggtccttcagtccagg

SEQ ID NO: 738963 - DNA, 20 bp, mouse
gtggactgaaggaccaccga

SEQ ID NO: 738964 - DNA, 20 bp, mouse
gactgaaggaccaccgatgg

SEQ ID NO: 738965 - DNA, 20 bp, mouse
gtgcgacccgggcgggagaa

SEQ ID NO: 738966 - DNA, 20 bp, mouse
ggacccgggagcgcgctgaa

SEQ ID NO: 738967 - DNA, 20 bp, mouse
ggggacgcaccaggctcgat

SEQ ID NO: 738968 - DNA, 20 bp, mouse
gactgtgcgcggtgcaacga

SEQ ID NO: 738969 - DNA, 20 bp, mouse
gagggcggggatcttcccag

SEQ ID NO: 738970 - DNA, 20 bp, mouse
gctcgatcggtccaacctct

SEQ ID NO: 738971 - DNA, 20 bp, mouse
gctggccagtacccagacag

SEQ ID NO: 738972 - DNA, 20 bp, mouse
gcccttccggagcctcgggg

SEQ ID NO: 738973 - DNA, 20 bp, mouse
gaggttggaccgatcgagcc

SEQ ID NO: 738974 - DNA, 20 bp, mouse
gcctggtgcgtcccctgtct

SEQ ID NO: 738975 - DNA, 20 bp, mouse
ggcgtcccctgtctgggtac

SEQ ID NO: 738976 - DNA, 20 bp, mouse
gacgcggggacatctcagga

SEQ ID NO: 738977 - DNA, 20 bp, mouse
gggcgacgcggggacatctc

SEQ ID NO: 738978 - DNA, 20 bp, mouse
ggcaggggtcatagggacgt

SEQ ID NO: 738979 - DNA, 20 bp, mouse
gccccactccggcctggcac

SEQ ID NO: 738980 - DNA, 20 bp, mouse
ggagcacagcaggggtcata

SEQ ID NO: 738981 - DNA, 20 bp, mouse
gccccgtgccaggccggagt

SEQ ID NO: 738982 - DNA, 20 bp, mouse
gctccaggaacaccagtccc

SEQ ID NO: 738983 - DNA, 20 bp, mouse
ggcggggcgcgggcatatag

SEQ ID NO: 738984 - DNA, 20 bp, mouse
gtcccgcccccgtgccaggc

SEQ ID NO: 738985 - DNA, 20 bp, mouse
gccccgccgccctccctacg

SEQ ID NO: 738986 - DNA, 20 bp, mouse
gagacgacacaggttgttga

SEQ ID NO: 738987 - DNA, 20 bp, mouse
ggatcgggagacttaggatg

SEQ ID NO: 738988 - DNA, 20 bp, mouse
gagcctggatcgggagactt

SEQ ID NO: 738989 - DNA, 20 bp, mouse
ggggatgaggaaaatccgac

SEQ ID NO: 738990 - DNA, 20 bp, mouse
ggagccacgcaatttgaggg

SEQ ID NO: 738991 - DNA, 20 bp, mouse
gccacctccctcaaattgcg

SEQ ID NO: 738992 - DNA, 20 bp, mouse
ggtgtcgtcttcttgggatg

SEQ ID NO: 738993 - DNA, 20 bp, mouse
gcaacctgtgtcgtcttctt

SEQ ID NO: 738994 - DNA, 20 bp, mouse
gaccggtgaaaaatgcaccc

SEQ ID NO: 738995 - DNA, 20 bp, mouse
gtcggccatgtgaaagacta

SEQ ID NO: 738996 - DNA, 20 bp, mouse
gagggaagcctcccggtctg

SEQ ID NO: 738997 - DNA, 20 bp, mouse
gcgcggcgagggaagcctcc

SEQ ID NO: 738998 - DNA, 20 bp, mouse
gccggcgacgccattttcgg

SEQ ID NO: 738999 - DNA, 20 bp, mouse
ggcctccacccgtggaggac

SEQ ID NO: 739000 - DNA, 20 bp, mouse
gcaccacacacagattagag

SEQ ID NO: 739001 - DNA, 20 bp, mouse
gcgccgccgggcggggctca

SEQ ID NO: 739002 - DNA, 20 bp, mouse
ggcgagggcgggtgacgtca

SEQ ID NO: 739003 - DNA, 20 bp, mouse
gctcgccgcgcctccacccg

SEQ ID NO: 739004 - DNA, 20 bp, mouse
gtgtgtggtggcctcagacc

SEQ ID NO: 739005 - DNA, 20 bp, mouse
gtcacggcgcacagcattgt

SEQ ID NO: 739006 - DNA, 20 bp, mouse
gcagcccagacgggacgcag

SEQ ID NO: 739007 - DNA, 20 bp, mouse
ggcccctctgcgtcccgtct

SEQ ID NO: 739008 - DNA, 20 bp, mouse
gaatgtggaccgactcgctc

SEQ ID NO: 739009 - DNA, 20 bp, mouse
gtggaagctctggtccgagg

SEQ ID NO: 739010 - DNA, 20 bp, mouse
ggcctggccggcttcggggt

SEQ ID NO: 739011 - DNA, 20 bp, mouse
gggcctgcggggccccttta

SEQ ID NO: 739012 - DNA, 20 bp, mouse
gggggtggggccagcccaga

SEQ ID NO: 739013 - DNA, 20 bp, mouse
gccgcaggcctggccggctt

SEQ ID NO: 739014 - DNA, 20 bp, mouse
gctctgcggagctccgaccc

SEQ ID NO: 739015 - DNA, 20 bp, mouse
gagtcactctggtccggggt

SEQ ID NO: 739016 - DNA, 20 bp, mouse
ggtgcagacgggagggatga

SEQ ID NO: 739017 - DNA, 20 bp, mouse
gggggccgacagcttgtcta

SEQ ID NO: 739018 - DNA, 20 bp, mouse
gtcgctggaggtgtctagag

SEQ ID NO: 739019 - DNA, 20 bp, mouse
ggggctggagaaaggatcgc

SEQ ID NO: 739020 - DNA, 20 bp, mouse
gaccccgagtcctgtccgtc

SEQ ID NO: 739021 - DNA, 20 bp, mouse
gcccccctcagtggcctgac

SEQ ID NO: 739022 - DNA, 20 bp, mouse
gaccagtcaggccactgagg

SEQ ID NO: 739023 - DNA, 20 bp, mouse
gctggagaaaggatcgctgg

SEQ ID NO: 739024 - DNA, 20 bp, mouse
gtgacacctgagcactgctg

SEQ ID NO: 739025 - DNA, 20 bp, mouse
gagccccctagacaagctgt

SEQ ID NO: 739026 - DNA, 20 bp, mouse
gcacgcccccgcaggcgccc

SEQ ID NO: 739027 - DNA, 20 bp, mouse
gaatgctgcggcagagggcg

SEQ ID NO: 739028 - DNA, 20 bp, mouse
ggcggcctgcgcacctgcgg

SEQ ID NO: 739029 - DNA, 20 bp, mouse
gtcgatccctgagaccttca

SEQ ID NO: 739030 - DNA, 20 bp, mouse
gaggcaacgcacgcccccgc

SEQ ID NO: 739031 - DNA, 20 bp, mouse
gactgtctgagccttctcga

SEQ ID NO: 739032 - DNA, 20 bp, mouse
gtcaccgaatgctgcggcag

SEQ ID NO: 739033 - DNA, 20 bp, mouse
gtatctgggggccttcgaga

SEQ ID NO: 739034 - DNA, 20 bp, mouse
gcaggtttcaccgaatgctg

SEQ ID NO: 739035 - DNA, 20 bp, mouse
gggcgtggcctgggcgcctg

SEQ ID NO: 739036 - DNA, 20 bp, mouse
ggggcggggaagaatcgcgg

SEQ ID NO: 739037 - DNA, 20 bp, mouse
ggaagcccgtatctgagatc

SEQ ID NO: 739038 - DNA, 20 bp, mouse
gcgggattgacggagaacga

SEQ ID NO: 739039 - DNA, 20 bp, mouse
ggtccctgagaagggagacc

SEQ ID NO: 739040 - DNA, 20 bp, mouse
gactgcaccgagctggaatg

SEQ ID NO: 739041 - DNA, 20 bp, mouse
ggagggagggtgtttgtcct

SEQ ID NO: 739042 - DNA, 20 bp, mouse
gagcgccaggctctggatga

SEQ ID NO: 739043 - DNA, 20 bp, mouse
gggtccggctaccgcctccg

SEQ ID NO: 739044 - DNA, 20 bp, mouse
gtaaggagacctgcagcaag

SEQ ID NO: 739045 - DNA, 20 bp, mouse
gacagtggggtcacggagca

SEQ ID NO: 739046 - DNA, 20 bp, mouse
gaaagcaaaacggcaaagga

SEQ ID NO: 739047 - DNA, 20 bp, mouse
gaggcaaagcaaaacggcaa

SEQ ID NO: 739048 - DNA, 20 bp, mouse
ggctaggaaagtttcttgga

SEQ ID NO: 739049 - DNA, 20 bp, mouse
gctgtctgcccacatctgat

SEQ ID NO: 739050 - DNA, 20 bp, mouse
gggtctacataagccagtcc

SEQ ID NO: 739051 - DNA, 20 bp, mouse
gcagggaccagtttgaaaac

SEQ ID NO: 739052 - DNA, 20 bp, mouse
gcaatcagatgtcaaggaat

SEQ ID NO: 739053 - DNA, 20 bp, mouse
gttgtgatgtgtcactttca

SEQ ID NO: 739054 - DNA, 20 bp, mouse
gcatacagggttggttttca

SEQ ID NO: 739055 - DNA, 20 bp, mouse
gaccagtttgaaaacaggcc

SEQ ID NO: 739056 - DNA, 20 bp, mouse
ggggctggaccgagggaaca

SEQ ID NO: 739057 - DNA, 20 bp, mouse
gttccccggggctggaccga

SEQ ID NO: 739058 - DNA, 20 bp, mouse
ggctacctgcacggggaggg

SEQ ID NO: 739059 - DNA, 20 bp, mouse
gcagagccacgcgtgatcag

SEQ ID NO: 739060 - DNA, 20 bp, mouse
gggagcgtgtacacaacccg

SEQ ID NO: 739061 - DNA, 20 bp, mouse
gccagccccggggaactccg

SEQ ID NO: 739062 - DNA, 20 bp, mouse
gggcatgggcggaggactga

SEQ ID NO: 739063 - DNA, 20 bp, mouse
ggaaggctagggttgggcga

SEQ ID NO: 739064 - DNA, 20 bp, mouse
gtggtccccggagttccccg

SEQ ID NO: 739065 - DNA, 20 bp, mouse
gcgccgcccccgggcatggg

SEQ ID NO: 739066 - DNA, 20 bp, mouse
gtggctgcggcgtgatccgg

SEQ ID NO: 739067 - DNA, 20 bp, mouse
gcgccaggccggcaagaagc

SEQ ID NO: 739068 - DNA, 20 bp, mouse
gggcccgcttcttgccggcc

SEQ ID NO: 739069 - DNA, 20 bp, mouse
gcggcaagaagcgggccaat

SEQ ID NO: 739070 - DNA, 20 bp, mouse
gaggggaaaggtcccggcgg

SEQ ID NO: 739071 - DNA, 20 bp, mouse
ggcagaagaggaccttactg

SEQ ID NO: 739072 - DNA, 20 bp, mouse
ggaggggcggggcgccacgg

SEQ ID NO: 739073 - DNA, 20 bp, mouse
gcagagccgcgcggcaagga

SEQ ID NO: 739074 - DNA, 20 bp, mouse
gcgtgaggcctggaaagtag

SEQ ID NO: 739075 - DNA, 20 bp, mouse
gccgatcacgcgcccccccg

SEQ ID NO: 739076 - DNA, 20 bp, mouse
gggaagccacctgacgatgg

SEQ ID NO: 739077 - DNA, 20 bp, mouse
ggggggaagccacctgacga

SEQ ID NO: 739078 - DNA, 20 bp, mouse
gaacgacgcagcatggggag

SEQ ID NO: 739079 - DNA, 20 bp, mouse
gctgacgatggaggcaatgg

SEQ ID NO: 739080 - DNA, 20 bp, mouse
gcacctgacgatggaggcaa

SEQ ID NO: 739081 - DNA, 20 bp, mouse
ggagatggtcaaatcctaga

SEQ ID NO: 739082 - DNA, 20 bp, mouse
gtccttatcgggaaaagtgg

SEQ ID NO: 739083 - DNA, 20 bp, mouse
gtcccccacttttcccgata

SEQ ID NO: 739084 - DNA, 20 bp, mouse
gtaggacaacattccttatc

SEQ ID NO: 739085 - DNA, 20 bp, mouse
ggacagtctgacaataacct

SEQ ID NO: 739086 - DNA, 20 bp, mouse
gggagcagcgcgcacgaagg

SEQ ID NO: 739087 - DNA, 20 bp, mouse
gagcctggagcgcctcagga

SEQ ID NO: 739088 - DNA, 20 bp, mouse
gcgccagtgggcgtgcccct

SEQ ID NO: 739089 - DNA, 20 bp, mouse
gggccagtagaaccctctcg

SEQ ID NO: 739090 - DNA, 20 bp, mouse
gtggcggcgcaggttacagg

SEQ ID NO: 739091 - DNA, 20 bp, mouse
gcccctgggcctgcaagagg

SEQ ID NO: 739092 - DNA, 20 bp, mouse
gaacctgcgccgccaggatg

SEQ ID NO: 739093 - DNA, 20 bp, mouse
gaccctctcgaggaccggat

SEQ ID NO: 739094 - DNA, 20 bp, mouse
ggcccctcctgaggcgctcc

SEQ ID NO: 739095 - DNA, 20 bp, mouse
ggcagcgcgcacgaaggggg

SEQ ID NO: 739096 - DNA, 20 bp, mouse
gcgcgcggcagcgcgatcca

SEQ ID NO: 739097 - DNA, 20 bp, mouse
ggggaatgccatagcccgcg

SEQ ID NO: 739098 - DNA, 20 bp, mouse
gcccggcccgaggacacccc

SEQ ID NO: 739099 - DNA, 20 bp, mouse
gccagctggccagagaccag

SEQ ID NO: 739100 - DNA, 20 bp, mouse
ggcagacaagataatttccc

SEQ ID NO: 739101 - DNA, 20 bp, mouse
gcgcgatccaggggtgtcct

SEQ ID NO: 739102 - DNA, 20 bp, mouse
ggtcccggatcgcaacttct

SEQ ID NO: 739103 - DNA, 20 bp, mouse
gctgcccagaagttgcgatc

SEQ ID NO: 739104 - DNA, 20 bp, mouse
gctctggccagctgggtgtc

SEQ ID NO: 739105 - DNA, 20 bp, mouse
gccaccgctcacagctcaaa

SEQ ID NO: 739106 - DNA, 20 bp, mouse
gccgctgcccacgcgctctc

SEQ ID NO: 739107 - DNA, 20 bp, mouse
gaagagaccggagagcgcgt

SEQ ID NO: 739108 - DNA, 20 bp, mouse
ggagcgcgtgggcagcggga

SEQ ID NO: 739109 - DNA, 20 bp, mouse
gcagcgggagggtgcggccg

SEQ ID NO: 739110 - DNA, 20 bp, mouse
ggacgcgcggcgctagccaa

SEQ ID NO: 739111 - DNA, 20 bp, mouse
gggactctgcgggctttcag

SEQ ID NO: 739112 - DNA, 20 bp, mouse
gccgctcccgaggtcccacg

SEQ ID NO: 739113 - DNA, 20 bp, mouse
gtgcagatccacgaagagac

SEQ ID NO: 739114 - DNA, 20 bp, mouse
ggcagaccacgtgggacctc

SEQ ID NO: 739115 - DNA, 20 bp, mouse
ggcgctctccggtctcttcg

SEQ ID NO: 739116 - DNA, 20 bp, mouse
gcgtgtccgcggtggggaga

SEQ ID NO: 739117 - DNA, 20 bp, mouse
gcgactctctggaggaccga

SEQ ID NO: 739118 - DNA, 20 bp, mouse
ggtggcgcgcgactctctgg

SEQ ID NO: 739119 - DNA, 20 bp, mouse
gcctggaggacgccccctcg

SEQ ID NO: 739120 - DNA, 20 bp, mouse
gaggagggacgagttgggga

SEQ ID NO: 739121 - DNA, 20 bp, mouse
gtgctctgctggtacacgag

SEQ ID NO: 739122 - DNA, 20 bp, mouse
ggtaggaggcggagcatccg

SEQ ID NO: 739123 - DNA, 20 bp, mouse
gaccgagggcgcggcaggag

SEQ ID NO: 739124 - DNA, 20 bp, mouse
gtgggaggagggacgagttg

SEQ ID NO: 739125 - DNA, 20 bp, mouse
ggcggtggcgcgcgactctc

SEQ ID NO: 739126 - DNA, 20 bp, mouse
gataaggcctacagagttct

SEQ ID NO: 739127 - DNA, 20 bp, mouse
ggactccgcccagtgctcag

SEQ ID NO: 739128 - DNA, 20 bp, mouse
gctacgccataatcccacaa

SEQ ID NO: 739129 - DNA, 20 bp, mouse
ggaagggcggagtggggtag

SEQ ID NO: 739130 - DNA, 20 bp, mouse
gccggcccttacaccgtcac

SEQ ID NO: 739131 - DNA, 20 bp, mouse
gggtagagaagggcggagtg

SEQ ID NO: 739132 - DNA, 20 bp, mouse
ggattgcatggatgctgagt

SEQ ID NO: 739133 - DNA, 20 bp, mouse
gatggatgctgagttgggag

SEQ ID NO: 739134 - DNA, 20 bp, mouse
gcacgcctgtgacggtgtaa

SEQ ID NO: 739135 - DNA, 20 bp, mouse
gccctccagaccaacacagt

SEQ ID NO: 739136 - DNA, 20 bp, mouse
ggggactccgcggggaacac

SEQ ID NO: 739137 - DNA, 20 bp, mouse
gggcttgaggagcgcagtcc

SEQ ID NO: 739138 - DNA, 20 bp, mouse
gtcgccatagggacggtcgg

SEQ ID NO: 739139 - DNA, 20 bp, mouse
gcggaaacgcgtcccggatg

SEQ ID NO: 739140 - DNA, 20 bp, mouse
ggaaacctggaccgatgcat

SEQ ID NO: 739141 - DNA, 20 bp, mouse
gactccccatgcatcggtcc

SEQ ID NO: 739142 - DNA, 20 bp, mouse
gccgatgcatggggagtctg

SEQ ID NO: 739143 - DNA, 20 bp, mouse
gcatcggtccaggtttccag

SEQ ID NO: 739144 - DNA, 20 bp, mouse
gtaggcgcggcaggcacaga

SEQ ID NO: 739145 - DNA, 20 bp, mouse
gccgcccccgaccgtcccta

SEQ ID NO: 739146 - DNA, 20 bp, mouse
gggaggggtcggcgagtcac

SEQ ID NO: 739147 - DNA, 20 bp, mouse
gggagccgccacagccgccc

SEQ ID NO: 739148 - DNA, 20 bp, mouse
ggactcgccgacccctccgg

SEQ ID NO: 739149 - DNA, 20 bp, mouse
ggaggggtccccacccactt

SEQ ID NO: 739150 - DNA, 20 bp, mouse
gcggctcgacctgtcccggg

SEQ ID NO: 739151 - DNA, 20 bp, mouse
gggaataatgagtgtctgtc

SEQ ID NO: 739152 - DNA, 20 bp, mouse
gaggcagccgccggaggggt

SEQ ID NO: 739153 - DNA, 20 bp, mouse
gaggctggccccgggtgact

SEQ ID NO: 739154 - DNA, 20 bp, mouse
ggctgggagccggggtggga

SEQ ID NO: 739155 - DNA, 20 bp, mouse
ggcgccccgcccagtcaccc

SEQ ID NO: 739156 - DNA, 20 bp, mouse
gctactcggggtcctctggg

SEQ ID NO: 739157 - DNA, 20 bp, mouse
gccatggcaacgcgcagtgg

SEQ ID NO: 739158 - DNA, 20 bp, mouse
gcgcagtgggggctgcggga

SEQ ID NO: 739159 - DNA, 20 bp, mouse
gtgcgtatgcgagagagggc

SEQ ID NO: 739160 - DNA, 20 bp, mouse
gtgggggctgcgggaaggcg

SEQ ID NO: 739161 - DNA, 20 bp, mouse
gcgtacgcgagcaggggtag

SEQ ID NO: 739162 - DNA, 20 bp, mouse
gaccgccgccggcgtcagca

SEQ ID NO: 739163 - DNA, 20 bp, mouse
gaccccgagtagcgcggcca

SEQ ID NO: 739164 - DNA, 20 bp, mouse
gagccccgcgcgccgccaca

SEQ ID NO: 739165 - DNA, 20 bp, mouse
gggctccggcgctgggagta

SEQ ID NO: 739166 - DNA, 20 bp, mouse
ggggccgaccgcacccctcg

SEQ ID NO: 739167 - DNA, 20 bp, mouse
gcgaagctcctggcccgcga

SEQ ID NO: 739168 - DNA, 20 bp, mouse
gaggggtgcggtcggcccgt

SEQ ID NO: 739169 - DNA, 20 bp, mouse
gggtgcggtcggcccgtcgg

SEQ ID NO: 739170 - DNA, 20 bp, mouse
gggccggcggagcacggggc

SEQ ID NO: 739171 - DNA, 20 bp, mouse
ggggtagccagtaggaaaga

SEQ ID NO: 739172 - DNA, 20 bp, mouse
ggccctgcgcgcgaagctcc

SEQ ID NO: 739173 - DNA, 20 bp, mouse
ggggccagagggtagccagt

SEQ ID NO: 739174 - DNA, 20 bp, mouse
gacgaggtcccgcctccgac

SEQ ID NO: 739175 - DNA, 20 bp, mouse
gtcctggcccgcgaggggtg

SEQ ID NO: 739176 - DNA, 20 bp, mouse
ggtacaggagcggcaggatt

SEQ ID NO: 739177 - DNA, 20 bp, mouse
ggcagccccgggtacaggag

SEQ ID NO: 739178 - DNA, 20 bp, mouse
gcctgccgctcctgtacccg

SEQ ID NO: 739179 - DNA, 20 bp, mouse
gagctccaagctggtcacgt

SEQ ID NO: 739180 - DNA, 20 bp, mouse
gcgccggtgcggacacacag

SEQ ID NO: 739181 - DNA, 20 bp, mouse
ggtcgcgcagccccgggtac

SEQ ID NO: 739182 - DNA, 20 bp, mouse
ggtcagctcgcaccaatcgc

SEQ ID NO: 739183 - DNA, 20 bp, mouse
gaacccagcgggaggaaatg

SEQ ID NO: 739184 - DNA, 20 bp, mouse
gtccaagctggtcacgtggg

SEQ ID NO: 739185 - DNA, 20 bp, mouse
gcaggattgggtaccgtggg

SEQ ID NO: 739186 - DNA, 20 bp, mouse
gggacagcgtgcagcgtcgg

SEQ ID NO: 739187 - DNA, 20 bp, mouse
gtgcgcgcaaaacggggcgg

SEQ ID NO: 739188 - DNA, 20 bp, mouse
ggagggcggtaggcgatcgg

SEQ ID NO: 739189 - DNA, 20 bp, mouse
ggggcggggcctggccccga

SEQ ID NO: 739190 - DNA, 20 bp, mouse
gcaaactagcgaggatgggg

SEQ ID NO: 739191 - DNA, 20 bp, mouse
gcacggctgcgcgcaaaacg

SEQ ID NO: 739192 - DNA, 20 bp, mouse
gcgggcgagccctgcagcga

SEQ ID NO: 739193 - DNA, 20 bp, mouse
gcggggacagcgtgcagcgt

SEQ ID NO: 739194 - DNA, 20 bp, mouse
gtcggaggagggcgtccatt

SEQ ID NO: 739195 - DNA, 20 bp, mouse
gggggctcatgaagtcactg

SEQ ID NO: 739196 - DNA, 20 bp, mouse
gctgtccgcccattcagaga

SEQ ID NO: 739197 - DNA, 20 bp, mouse
gaatgggcggacagaatcct

SEQ ID NO: 739198 - DNA, 20 bp, mouse
gtcgggccagaggtagggag

SEQ ID NO: 739199 - DNA, 20 bp, mouse
gaagagacccgggtgtggtg

SEQ ID NO: 739200 - DNA, 20 bp, mouse
gcagcttcgggccagaggta

SEQ ID NO: 739201 - DNA, 20 bp, mouse
ggtgccaagcagggcgttac

SEQ ID NO: 739202 - DNA, 20 bp, mouse
gaagttaagagacccgggtg

SEQ ID NO: 739203 - DNA, 20 bp, mouse
ggtgtgatgcagctttaaag

SEQ ID NO: 739204 - DNA, 20 bp, mouse
gagagtgggcggtgccaagc

SEQ ID NO: 739205 - DNA, 20 bp, mouse
ggctgggtggggtctgggac

SEQ ID NO: 739206 - DNA, 20 bp, mouse
gagtcagaagggcccttcgg

SEQ ID NO: 739207 - DNA, 20 bp, mouse
gcccactggccaattggagg

SEQ ID NO: 739208 - DNA, 20 bp, mouse
ggaggggcagcacgcggcgg

SEQ ID NO: 739209 - DNA, 20 bp, mouse
gcggaacggaacggtcggat

SEQ ID NO: 739210 - DNA, 20 bp, mouse
ggcagcacgcggcggcggaa

SEQ ID NO: 739211 - DNA, 20 bp, mouse
gggcggcggaacggaacggt

SEQ ID NO: 739212 - DNA, 20 bp, mouse
gacgcggcggcggaacggaa

SEQ ID NO: 739213 - DNA, 20 bp, mouse
gctggaggggcagcacgcgg

SEQ ID NO: 739214 - DNA, 20 bp, mouse
ggggctggaggggcagcacg

SEQ ID NO: 739215 - DNA, 20 bp, mouse
gcggtctgggcggcatctgc

SEQ ID NO: 739216 - DNA, 20 bp, mouse
gctctctgcagccactgtct

SEQ ID NO: 739217 - DNA, 20 bp, mouse
gccctaagaagcccagacag

SEQ ID NO: 739218 - DNA, 20 bp, mouse
ggagcggccaggccccggtc

SEQ ID NO: 739219 - DNA, 20 bp, mouse
ggccaggccccggtccgggg

SEQ ID NO: 739220 - DNA, 20 bp, mouse
gcgcagcgcccggtgctccc

SEQ ID NO: 739221 - DNA, 20 bp, mouse
gacgcgaggagggtccagat

SEQ ID NO: 739222 - DNA, 20 bp, mouse
gcgaggagggtccagattgg

SEQ ID NO: 739223 - DNA, 20 bp, mouse
ggggtccagattggcggagg

SEQ ID NO: 739224 - DNA, 20 bp, mouse
gcgcggccaccgccccggac

SEQ ID NO: 739225 - DNA, 20 bp, mouse
gggagggtccagattggcgg

SEQ ID NO: 739226 - DNA, 20 bp, mouse
ggggctgcggcaatcgttag

SEQ ID NO: 739227 - DNA, 20 bp, mouse
gcggagctcgcccgcttctc

SEQ ID NO: 739228 - DNA, 20 bp, mouse
gcgcttctccgggatgctgg

SEQ ID NO: 739229 - DNA, 20 bp, mouse
gaccccggcccccgtctccc

SEQ ID NO: 739230 - DNA, 20 bp, mouse
gctctccagcaaccaatggc

SEQ ID NO: 739231 - DNA, 20 bp, mouse
gttggtgacagtggaccaat

SEQ ID NO: 739232 - DNA, 20 bp, mouse
gcgggctctccagcaaccaa

SEQ ID NO: 739233 - DNA, 20 bp, mouse
gccggccccgctaaccccgc

SEQ ID NO: 739234 - DNA, 20 bp, mouse
ggggcagtctctttcttggc

SEQ ID NO: 739235 - DNA, 20 bp, mouse
gagcggggaggctacgccag

SEQ ID NO: 739236 - DNA, 20 bp, mouse
gaggcgggaggacggatgtt

SEQ ID NO: 739237 - DNA, 20 bp, mouse
ggggaggactacacagcagt

SEQ ID NO: 739238 - DNA, 20 bp, mouse
ggcccaagggcccgactggg

SEQ ID NO: 739239 - DNA, 20 bp, mouse
ggatgcccaagggcccgact

SEQ ID NO: 739240 - DNA, 20 bp, mouse
gaatcccagactcacaatct

SEQ ID NO: 739241 - DNA, 20 bp, mouse
gcagtaggacagcactgcgg

SEQ ID NO: 739242 - DNA, 20 bp, mouse
ggcaccctgaggcgggagga

SEQ ID NO: 739243 - DNA, 20 bp, mouse
gagagcgcttccggagcgtg

SEQ ID NO: 739244 - DNA, 20 bp, mouse
gcgggaggacggatgttggg

SEQ ID NO: 739245 - DNA, 20 bp, mouse
gctgcggtgggaccggacga

SEQ ID NO: 739246 - DNA, 20 bp, mouse
gggaagtgaaggtgcgggtc

SEQ ID NO: 739247 - DNA, 20 bp, mouse
gaccccagggccgaaagatg

SEQ ID NO: 739248 - DNA, 20 bp, mouse
gggcggggcaggacatgctg

SEQ ID NO: 739249 - DNA, 20 bp, mouse
gtcagtctcgggcacggggc

SEQ ID NO: 739250 - DNA, 20 bp, mouse
gccaacgccgagaatcagtg

SEQ ID NO: 739251 - DNA, 20 bp, mouse
gagaatcagtggggcgggta

SEQ ID NO: 739252 - DNA, 20 bp, mouse
gtcgcacgcctgagggtcac

SEQ ID NO: 739253 - DNA, 20 bp, mouse
gccggctgtgggctctgaga

SEQ ID NO: 739254 - DNA, 20 bp, mouse
gtcaggcgtgcgacgtgaac

SEQ ID NO: 739255 - DNA, 20 bp, mouse
gtagtccacgaattacccca

SEQ ID NO: 739256 - DNA, 20 bp, mouse
ggagcggctccctactcacg

SEQ ID NO: 739257 - DNA, 20 bp, mouse
gtaaacgagacgcgagcatg

SEQ ID NO: 739258 - DNA, 20 bp, mouse
gagtactttgggtccgtctc

SEQ ID NO: 739259 - DNA, 20 bp, mouse
gccacggaacaccagagcaa

SEQ ID NO: 739260 - DNA, 20 bp, mouse
ggtctcgggccgcgtgagta

SEQ ID NO: 739261 - DNA, 20 bp, mouse
gtgctggtgtgccagcggag

SEQ ID NO: 739262 - DNA, 20 bp, mouse
gaggaatttccacgtactta

SEQ ID NO: 739263 - DNA, 20 bp, mouse
ggggagacccgggctggtga

SEQ ID NO: 739264 - DNA, 20 bp, mouse
gttagagtcacgcagcttgc

SEQ ID NO: 739265 - DNA, 20 bp, mouse
gtgaccgcctcatcccacag

SEQ ID NO: 739266 - DNA, 20 bp, mouse
gaccaggagcagcgcagctg

SEQ ID NO: 739267 - DNA, 20 bp, mouse
gtggccagcatgctccccac

SEQ ID NO: 739268 - DNA, 20 bp, mouse
gccaggaactggtccctatt

SEQ ID NO: 739269 - DNA, 20 bp, mouse
ggcggacagcaccaccttgc

SEQ ID NO: 739270 - DNA, 20 bp, mouse
gagggagggtcccgactgga

SEQ ID NO: 739271 - DNA, 20 bp, mouse
gagacctgccccagtcgggc

SEQ ID NO: 739272 - DNA, 20 bp, mouse
gtgagtcggcaatggggcag

SEQ ID NO: 739273 - DNA, 20 bp, mouse
gcgctggccagatccggcta

SEQ ID NO: 739274 - DNA, 20 bp, mouse
gggacactccctcccaccag

SEQ ID NO: 739275 - DNA, 20 bp, mouse
gaagctcgggcccctccagt

SEQ ID NO: 739276 - DNA, 20 bp, mouse
ggaggggtaatgttagagat

SEQ ID NO: 739277 - DNA, 20 bp, mouse
ggggcagaggctagagctgg

SEQ ID NO: 739278 - DNA, 20 bp, mouse
gggtgtcgaggttgtggtta

SEQ ID NO: 739279 - DNA, 20 bp, mouse
gttgtggttaaggctgtaac

SEQ ID NO: 739280 - DNA, 20 bp, mouse
ggagatgctaggatcactgt

SEQ ID NO: 739281 - DNA, 20 bp, mouse
gtaaggctgtaaccggggct

SEQ ID NO: 739282 - DNA, 20 bp, mouse
gactgtgggagctgaagttg

SEQ ID NO: 739283 - DNA, 20 bp, mouse
gcctgctgaggttaaagttg

SEQ ID NO: 739284 - DNA, 20 bp, mouse
ggtgggagcagaggctggaa

SEQ ID NO: 739285 - DNA, 20 bp, mouse
gtgcccctggacgttagcca

SEQ ID NO: 739286 - DNA, 20 bp, mouse
gcccacggggtcctcctctc

SEQ ID NO: 739287 - DNA, 20 bp, mouse
gcacagacccagttcgtgac

SEQ ID NO: 739288 - DNA, 20 bp, mouse
gtggacgtctccacttagga

SEQ ID NO: 739289 - DNA, 20 bp, mouse
gggcggagaggccaattacc

SEQ ID NO: 739290 - DNA, 20 bp, mouse
gacaggctggctttgtttgg

SEQ ID NO: 739291 - DNA, 20 bp, mouse
ggacccagttcgtgacaggc

SEQ ID NO: 739292 - DNA, 20 bp, mouse
gagccagcctgtcacgaact

SEQ ID NO: 739293 - DNA, 20 bp, mouse
gtaggaggcacagatgtggc

SEQ ID NO: 739294 - DNA, 20 bp, mouse
gacctcagaagccagttagg

SEQ ID NO: 739295 - DNA, 20 bp, mouse
gcgagtgagaattgttagat

SEQ ID NO: 739296 - DNA, 20 bp, mouse
gtcacccaaaatgaacagac

SEQ ID NO: 739297 - DNA, 20 bp, mouse
gtggggcgatgatagaaatg

SEQ ID NO: 739298 - DNA, 20 bp, mouse
gtggagactagcagcttgta

SEQ ID NO: 739299 - DNA, 20 bp, mouse
ggcggcgagcaacacaacac

SEQ ID NO: 739300 - DNA, 20 bp, mouse
gaacaccggtatggtgggat

SEQ ID NO: 739301 - DNA, 20 bp, mouse
gagtagggcgcaccgaccca

SEQ ID NO: 739302 - DNA, 20 bp, mouse
gaacacaacaccggtatggt

SEQ ID NO: 739303 - DNA, 20 bp, mouse
ggcccaggctacagccctag

SEQ ID NO: 739304 - DNA, 20 bp, mouse
ggggctagccagtggaacct

SEQ ID NO: 739305 - DNA, 20 bp, mouse
gggcgggtgtcgttgtgagt

SEQ ID NO: 739306 - DNA, 20 bp, mouse
gtcgtcaggggaacgagatg

SEQ ID NO: 739307 - DNA, 20 bp, mouse
gggcgacggcggtggagaga

SEQ ID NO: 739308 - DNA, 20 bp, mouse
gtcgcccagcaaccactgca

SEQ ID NO: 739309 - DNA, 20 bp, mouse
ggctccgaaaggctagaaac

SEQ ID NO: 739310 - DNA, 20 bp, mouse
gtggagagaaggggtggttt

SEQ ID NO: 739311 - DNA, 20 bp, mouse
gggttcgtctaacgaactgc

SEQ ID NO: 739312 - DNA, 20 bp, mouse
gcttacagtgatgtcgtcag

SEQ ID NO: 739313 - DNA, 20 bp, mouse
gtagtccctgcagtggttgc

SEQ ID NO: 739314 - DNA, 20 bp, mouse
gaggctagttagcggctatt

SEQ ID NO: 739315 - DNA, 20 bp, mouse
gaccttggaaacaagagacc

SEQ ID NO: 739316 - DNA, 20 bp, mouse
gtgtgcaggttgcaggttaa

SEQ ID NO: 739317 - DNA, 20 bp, mouse
gggcctatactgagagatgg

SEQ ID NO: 739318 - DNA, 20 bp, mouse
gcacaggcttggcaaaatca

SEQ ID NO: 739319 - DNA, 20 bp, mouse
gaggtgacagacttacgcaa

SEQ ID NO: 739320 - DNA, 20 bp, mouse
gcacatctgcgtcacttaca

SEQ ID NO: 739321 - DNA, 20 bp, mouse
gagacagtgcctcacctccg

SEQ ID NO: 739322 - DNA, 20 bp, mouse
ggtgacgcagatgtgcactg

SEQ ID NO: 739323 - DNA, 20 bp, mouse
ggcgtcacttacaggggagg

SEQ ID NO: 739324 - DNA, 20 bp, mouse
ggcagagatgctgtcatcga

SEQ ID NO: 739325 - DNA, 20 bp, mouse
gtctgcgtcacttacagggg

SEQ ID NO: 739326 - DNA, 20 bp, mouse
gggtctacctgtatgttctg

SEQ ID NO: 739327 - DNA, 20 bp, mouse
gttcctcgacctcagaccta

SEQ ID NO: 739328 - DNA, 20 bp, mouse
gctgggcagtgagatcactc

SEQ ID NO: 739329 - DNA, 20 bp, mouse
gagtaaaggctcaattgtgt

SEQ ID NO: 739330 - DNA, 20 bp, mouse
gccctccccccagaacatac

SEQ ID NO: 739331 - DNA, 20 bp, mouse
gtgccctaggtctgaggtcg

SEQ ID NO: 739332 - DNA, 20 bp, mouse
gaggcagtaaggcatctcag

SEQ ID NO: 739333 - DNA, 20 bp, mouse
gcaagcagcagactcagtaa

SEQ ID NO: 739334 - DNA, 20 bp, mouse
gctcaggggctggaagaccc

SEQ ID NO: 739335 - DNA, 20 bp, mouse
ggcttgttgcatcttcaggt

SEQ ID NO: 739336 - DNA, 20 bp, mouse
gataatggaggggcgagaaa

SEQ ID NO: 739337 - DNA, 20 bp, mouse
gtcaacaaaacaagcacagg

SEQ ID NO: 739338 - DNA, 20 bp, mouse
gcaagtgctgggattggcac

SEQ ID NO: 739339 - DNA, 20 bp, mouse
gtctcgcccctccattatgg

SEQ ID NO: 739340 - DNA, 20 bp, mouse
ggcgaggcaagcgcagttct

SEQ ID NO: 739341 - DNA, 20 bp, mouse
ggcacagggggccaccataa

SEQ ID NO: 739342 - DNA, 20 bp, mouse
gtcgctagagggcgtaagca

SEQ ID NO: 739343 - DNA, 20 bp, mouse
gaagcacggcagaagtgcgc

SEQ ID NO: 739344 - DNA, 20 bp, mouse
ggattggcacaggccagcag

SEQ ID NO: 739345 - DNA, 20 bp, mouse
gtgggattaaatagtgcgcg

SEQ ID NO: 739346 - DNA, 20 bp, mouse
gagacctgagagtgggtaga

SEQ ID NO: 739347 - DNA, 20 bp, mouse
gcacccgtctacccactctc

SEQ ID NO: 739348 - DNA, 20 bp, mouse
gaacgaccatggtgagtcag

SEQ ID NO: 739349 - DNA, 20 bp, mouse
gcgtggggaccgccagtctt

SEQ ID NO: 739350 - DNA, 20 bp, mouse
ggccgcgtgtgacagtgcgc

SEQ ID NO: 739351 - DNA, 20 bp, mouse
gtgggtctcccgagtgtggc

SEQ ID NO: 739352 - DNA, 20 bp, mouse
gggaggggcgggcctctcct

SEQ ID NO: 739353 - DNA, 20 bp, mouse
gcccgtgggtctcccgagtg

SEQ ID NO: 739354 - DNA, 20 bp, mouse
gagcgcctgccataccgcgt

SEQ ID NO: 739355 - DNA, 20 bp, mouse
gtggcggtccccacgcggta

SEQ ID NO: 739356 - DNA, 20 bp, mouse
gtcaaaagaagaatgttcag

SEQ ID NO: 739357 - DNA, 20 bp, mouse
ggtggcctaaggctatgctg

SEQ ID NO: 739358 - DNA, 20 bp, mouse
ggagctgcaacagtacaaat

SEQ ID NO: 739359 - DNA, 20 bp, mouse
gctgctgtgtcagtacactg

SEQ ID NO: 739360 - DNA, 20 bp, mouse
gggacaggacgatttaaagg

SEQ ID NO: 739361 - DNA, 20 bp, mouse
ggtgtcagtacactgtggaa

SEQ ID NO: 739362 - DNA, 20 bp, mouse
gttactattggttagaaatc

SEQ ID NO: 739363 - DNA, 20 bp, mouse
gggtggcactattgttgagt

SEQ ID NO: 739364 - DNA, 20 bp, mouse
ggcactattgttgagttgga

SEQ ID NO: 739365 - DNA, 20 bp, mouse
gaatcatcttattgctttag

SEQ ID NO: 739366 - DNA, 20 bp, mouse
ggtggggtgtggtgtggtcg

SEQ ID NO: 739367 - DNA, 20 bp, mouse
gcccggctggatgaacggaa

SEQ ID NO: 739368 - DNA, 20 bp, mouse
gcacacctccctcttaggtt

SEQ ID NO: 739369 - DNA, 20 bp, mouse
ggcagcggcggcaaaagtgg

SEQ ID NO: 739370 - DNA, 20 bp, mouse
ggatcctaagagcgcaggga

SEQ ID NO: 739371 - DNA, 20 bp, mouse
gggtagcagggaggtgtagg

SEQ ID NO: 739372 - DNA, 20 bp, mouse
gccccagacgaggacccttc

SEQ ID NO: 739373 - DNA, 20 bp, mouse
ggttccctccctgcgctctt

SEQ ID NO: 739374 - DNA, 20 bp, mouse
gggatccgaacctaagaggg

SEQ ID NO: 739375 - DNA, 20 bp, mouse
gttaggatccgaacctaaga

SEQ ID NO: 739376 - DNA, 20 bp, mouse
ggggcggggcccacgggcta

SEQ ID NO: 739377 - DNA, 20 bp, mouse
ggggctaggggcccgggcca

SEQ ID NO: 739378 - DNA, 20 bp, mouse
gccgcccggggcccgcccag

SEQ ID NO: 739379 - DNA, 20 bp, mouse
gccccacggggcgccttcag

SEQ ID NO: 739380 - DNA, 20 bp, mouse
gcgagcctgtccccgagaga

SEQ ID NO: 739381 - DNA, 20 bp, mouse
ggcccgggcccctagcccgt

SEQ ID NO: 739382 - DNA, 20 bp, mouse
gtgggccccgcccccctggg

SEQ ID NO: 739383 - DNA, 20 bp, mouse
ggtgagagggccacgagcca

SEQ ID NO: 739384 - DNA, 20 bp, mouse
gtgggaaccgggtagaggga

SEQ ID NO: 739385 - DNA, 20 bp, mouse
gggcccgggccagggtctcg

SEQ ID NO: 739386 - DNA, 20 bp, mouse
gagctctagcaggtgagaac

SEQ ID NO: 739387 - DNA, 20 bp, mouse
ggaaggaaggcgctcctggg

SEQ ID NO: 739388 - DNA, 20 bp, mouse
gtaacctaggcgccacacga

SEQ ID NO: 739389 - DNA, 20 bp, mouse
gctgccgcacgcaaggttgc

SEQ ID NO: 739390 - DNA, 20 bp, mouse
gaggagagcggggacgcacg

SEQ ID NO: 739391 - DNA, 20 bp, mouse
gcgccgagaaacagggtctg

SEQ ID NO: 739392 - DNA, 20 bp, mouse
gcacgaaggaaggcgctcct

SEQ ID NO: 739393 - DNA, 20 bp, mouse
gctaggcgccacacgaagga

SEQ ID NO: 739394 - DNA, 20 bp, mouse
gcgggcggcgccgagaaaca

SEQ ID NO: 739395 - DNA, 20 bp, mouse
gacaaagctccatagcacgg

SEQ ID NO: 739396 - DNA, 20 bp, mouse
gagcggggcagcgagacttc

SEQ ID NO: 739397 - DNA, 20 bp, mouse
ggggcaagggctcacgctga

SEQ ID NO: 739398 - DNA, 20 bp, mouse
gcccacaaagtcctcgacac

SEQ ID NO: 739399 - DNA, 20 bp, mouse
gtgccccgcgaggtgagcag

SEQ ID NO: 739400 - DNA, 20 bp, mouse
gaagcctgagtttgagttac

SEQ ID NO: 739401 - DNA, 20 bp, mouse
gactaaccagggcggggcaa

SEQ ID NO: 739402 - DNA, 20 bp, mouse
gccccccgtaactcaaactc

SEQ ID NO: 739403 - DNA, 20 bp, mouse
gggattacggaagtagtgta

SEQ ID NO: 739404 - DNA, 20 bp, mouse
gcggaagtagtgtagggtgg

SEQ ID NO: 739405 - DNA, 20 bp, mouse
ggtcgaggactttgtgggta

SEQ ID NO: 739406 - DNA, 20 bp, mouse
ggggggagggagtagacccg

SEQ ID NO: 739407 - DNA, 20 bp, mouse
ggccgaggctgggagctcgg

SEQ ID NO: 739408 - DNA, 20 bp, mouse
gcctccgcggcgtctggagg

SEQ ID NO: 739409 - DNA, 20 bp, mouse
gtagacccggggccgaggct

SEQ ID NO: 739410 - DNA, 20 bp, mouse
gctcccccgcatccccacgg

SEQ ID NO: 739411 - DNA, 20 bp, mouse
gcctcctcctccagacgccg

SEQ ID NO: 739412 - DNA, 20 bp, mouse
ggcgcggaaggggtgctctc

SEQ ID NO: 739413 - DNA, 20 bp, mouse
ggcactcggacgccaagaca

SEQ ID NO: 739414 - DNA, 20 bp, mouse
gcgggcgctgcggcctcccg

SEQ ID NO: 739415 - DNA, 20 bp, mouse
gcacccccgtggggatgcgg

SEQ ID NO: 739416 - DNA, 20 bp, mouse
gcgggcaagtagttccgtca

SEQ ID NO: 739417 - DNA, 20 bp, mouse
gcgaacacgtgcagttccgt

SEQ ID NO: 739418 - DNA, 20 bp, mouse
ggactaatggtaccagtcct

SEQ ID NO: 739419 - DNA, 20 bp, mouse
gcgaaaggcacagctacttc

SEQ ID NO: 739420 - DNA, 20 bp, mouse
ggctacttccggagccatga

SEQ ID NO: 739421 - DNA, 20 bp, mouse
gtaaaagtcagatcgactaa

SEQ ID NO: 739422 - DNA, 20 bp, mouse
gcccgcccagatccagaaac

SEQ ID NO: 739423 - DNA, 20 bp, mouse
ggaaacaggaagcggtccga

SEQ ID NO: 739424 - DNA, 20 bp, mouse
gagtagttccgtcatggctc

SEQ ID NO: 739425 - DNA, 20 bp, mouse
gacctcatacatattttatt

SEQ ID NO: 739426 - DNA, 20 bp, mouse
gacgactggaacccccggaa

SEQ ID NO: 739427 - DNA, 20 bp, mouse
gggaaaggggccggcgtagg

SEQ ID NO: 739428 - DNA, 20 bp, mouse
ggacgctccgctgagaacgg

SEQ ID NO: 739429 - DNA, 20 bp, mouse
gacccccggaagggaggaaa

SEQ ID NO: 739430 - DNA, 20 bp, mouse
gaacggcgggtgacaagtga

SEQ ID NO: 739431 - DNA, 20 bp, mouse
gggaggaaaggggccggcgt

SEQ ID NO: 739432 - DNA, 20 bp, mouse
gagcgtcagctggagacgac

SEQ ID NO: 739433 - DNA, 20 bp, mouse
gactggaacccccggaaggg

SEQ ID NO: 739434 - DNA, 20 bp, mouse
gcagccgcagcctccgtggg

SEQ ID NO: 739435 - DNA, 20 bp, mouse
gtaaccactcaccagcccag

SEQ ID NO: 739436 - DNA, 20 bp, mouse
gcaggcgcaaggggactcta

SEQ ID NO: 739437 - DNA, 20 bp, mouse
gccttcaataggcacctcga

SEQ ID NO: 739438 - DNA, 20 bp, mouse
gtccggaagctccaccctcg

SEQ ID NO: 739439 - DNA, 20 bp, mouse
ggcgcaaggggactctaggg

SEQ ID NO: 739440 - DNA, 20 bp, mouse
ggggtggagcttccggacag

SEQ ID NO: 739441 - DNA, 20 bp, mouse
gtcaataggcacctcgaggg

SEQ ID NO: 739442 - DNA, 20 bp, mouse
gttccgaaggatccgctgtc

SEQ ID NO: 739443 - DNA, 20 bp, mouse
ggggaaggaaggagtcgatg

SEQ ID NO: 739444 - DNA, 20 bp, mouse
gacaataaatagggctgtga

SEQ ID NO: 739445 - DNA, 20 bp, mouse
gggaggaaacgggaaagtga

SEQ ID NO: 739446 - DNA, 20 bp, mouse
ggcctccaatcagatatctg

SEQ ID NO: 739447 - DNA, 20 bp, mouse
gtgggggtagaaacccaagt

SEQ ID NO: 739448 - DNA, 20 bp, mouse
gggctgggaaagccgggggt

SEQ ID NO: 739449 - DNA, 20 bp, mouse
ggctaccccagatatctgat

SEQ ID NO: 739450 - DNA, 20 bp, mouse
gaccccagatatctgattgg

SEQ ID NO: 739451 - DNA, 20 bp, mouse
gtccctggttggtcctgaag

SEQ ID NO: 739452 - DNA, 20 bp, mouse
gaaccaggaccggagagcta

SEQ ID NO: 739453 - DNA, 20 bp, mouse
gtgtcagggagcttactgga

SEQ ID NO: 739454 - DNA, 20 bp, mouse
ggaacacaagcagctaaaag

SEQ ID NO: 739455 - DNA, 20 bp, mouse
gaaggacgagtgatggtgat

SEQ ID NO: 739456 - DNA, 20 bp, mouse
gagggcggaaacccaacccc

SEQ ID NO: 739457 - DNA, 20 bp, mouse
gccctctagcggaacccaga

SEQ ID NO: 739458 - DNA, 20 bp, mouse
gcctcccccccattggccaa

SEQ ID NO: 739459 - DNA, 20 bp, mouse
gcgccttcccggagcattct

SEQ ID NO: 739460 - DNA, 20 bp, mouse
gttactgccggtgggctctc

SEQ ID NO: 739461 - DNA, 20 bp, mouse
gctcccagaatgctccggga

SEQ ID NO: 739462 - DNA, 20 bp, mouse
gcacccacccttggccaatg

SEQ ID NO: 739463 - DNA, 20 bp, mouse
ggaattagcagcccggggtt

SEQ ID NO: 739464 - DNA, 20 bp, mouse
gccccccattggccaagggt

SEQ ID NO: 739465 - DNA, 20 bp, mouse
gaaccttagagcttggaata

SEQ ID NO: 739466 - DNA, 20 bp, mouse
gccgccttccgcggcaccga

SEQ ID NO: 739467 - DNA, 20 bp, mouse
gggtgccgcggaaggcgggg

SEQ ID NO: 739468 - DNA, 20 bp, mouse
gactgccaccagattcttaa

SEQ ID NO: 739469 - DNA, 20 bp, mouse
gataaaccgcgcctctgtga

SEQ ID NO: 739470 - DNA, 20 bp, mouse
gacagtcgcgtgagaagaaa

SEQ ID NO: 739471 - DNA, 20 bp, mouse
gaggccatcggtgccgcgga

SEQ ID NO: 739472 - DNA, 20 bp, mouse
gaagaaagggacggtcgtcc

SEQ ID NO: 739473 - DNA, 20 bp, mouse
gccctcgcatcgaaactagc

SEQ ID NO: 739474 - DNA, 20 bp, mouse
gggacggtcgtccaggccat

SEQ ID NO: 739475 - DNA, 20 bp, mouse
gttctcacgcgactgtatta

SEQ ID NO: 739476 - DNA, 20 bp, mouse
ggggcctgaggagagcaggt

SEQ ID NO: 739477 - DNA, 20 bp, mouse
ggtaaggccaaagaaagtga

SEQ ID NO: 739478 - DNA, 20 bp, mouse
gaggtaggcggggattgggg

SEQ ID NO: 739479 - DNA, 20 bp, mouse
gcggagaagaacatcgagta

SEQ ID NO: 739480 - DNA, 20 bp, mouse
gcaaagaggtaggcggggat

SEQ ID NO: 739481 - DNA, 20 bp, mouse
ggggcggagcttgggatcag

SEQ ID NO: 739482 - DNA, 20 bp, mouse
gagggagggactcgagtggt

SEQ ID NO: 739483 - DNA, 20 bp, mouse
ggtacctgaagtgggggtaa

SEQ ID NO: 739484 - DNA, 20 bp, mouse
gaaggagggagggactcgag

SEQ ID NO: 739485 - DNA, 20 bp, mouse
gggagcttgggatcaggggc

SEQ ID NO: 739486 - DNA, 20 bp, mouse
gcatggtgatgcacccagag

SEQ ID NO: 739487 - DNA, 20 bp, mouse
ggcgccacccggcgtaacca

SEQ ID NO: 739488 - DNA, 20 bp, mouse
gcccggaaaccaatctgccg

SEQ ID NO: 739489 - DNA, 20 bp, mouse
gcgggtcaagaggtccgctc

SEQ ID NO: 739490 - DNA, 20 bp, mouse
gaatctgccgcggtggatgc

SEQ ID NO: 739491 - DNA, 20 bp, mouse
gtccaagccccgagctgcag

SEQ ID NO: 739492 - DNA, 20 bp, mouse
gggaagagaaggaacggctc

SEQ ID NO: 739493 - DNA, 20 bp, mouse
gcactcccggagccagcctc

SEQ ID NO: 739494 - DNA, 20 bp, mouse
gtgaccccgcctcttcattc

SEQ ID NO: 739495 - DNA, 20 bp, mouse
gaaggcgcggccgccatgga

SEQ ID NO: 739496 - DNA, 20 bp, mouse
gcggctgcaggggatccctg

SEQ ID NO: 739497 - DNA, 20 bp, mouse
gtcggcgcgcagccagggac

SEQ ID NO: 739498 - DNA, 20 bp, mouse
ggccccaggctcaatgccag

SEQ ID NO: 739499 - DNA, 20 bp, mouse
gcagacgcccgagtaggcgg

SEQ ID NO: 739500 - DNA, 20 bp, mouse
gcaaccacggacacacccgc

SEQ ID NO: 739501 - DNA, 20 bp, mouse
gctactcgggcgtctgtgat

SEQ ID NO: 739502 - DNA, 20 bp, mouse
ggagccgggtatctttgcag

SEQ ID NO: 739503 - DNA, 20 bp, mouse
gatcccctgcagccgcgcgc

SEQ ID NO: 739504 - DNA, 20 bp, mouse
gcacccgctggcattgagcc

SEQ ID NO: 739505 - DNA, 20 bp, mouse
gcaaagatacccggctcgcc

SEQ ID NO: 739506 - DNA, 20 bp, mouse
gaactaccgtgggctcgggg

SEQ ID NO: 739507 - DNA, 20 bp, mouse
gacaagtgggttggaatgtg

SEQ ID NO: 739508 - DNA, 20 bp, mouse
gagactcacagcttaggagg

SEQ ID NO: 739509 - DNA, 20 bp, mouse
gcgcatctcagaactaccgt

SEQ ID NO: 739510 - DNA, 20 bp, mouse
gtggaagtgcagtaagtcac

SEQ ID NO: 739511 - DNA, 20 bp, mouse
ggggccagatgcgttatgtg

SEQ ID NO: 739512 - DNA, 20 bp, mouse
gtctccgcacataacgcatc

SEQ ID NO: 739513 - DNA, 20 bp, mouse
gcagaactaccgtgggctcg

SEQ ID NO: 739514 - DNA, 20 bp, mouse
gcacagactcacagcttagg

SEQ ID NO: 739515 - DNA, 20 bp, mouse
gttccccctccccgagccca

SEQ ID NO: 739516 - DNA, 20 bp, mouse
gacagcaggagtctgtactg

SEQ ID NO: 739517 - DNA, 20 bp, mouse
ggaggtctctgggttacagt

SEQ ID NO: 739518 - DNA, 20 bp, mouse
gagacagtgtagcttttcaa

SEQ ID NO: 739519 - DNA, 20 bp, mouse
gtctgtatgggtgaaagggg

SEQ ID NO: 739520 - DNA, 20 bp, mouse
gcacctcagcctaactgccc

SEQ ID NO: 739521 - DNA, 20 bp, mouse
ggggccatagaaggttgctc

SEQ ID NO: 739522 - DNA, 20 bp, mouse
ggggtctgtcgggccataga

SEQ ID NO: 739523 - DNA, 20 bp, mouse
gatcccgggcagttaggctg

SEQ ID NO: 739524 - DNA, 20 bp, mouse
gctatcacacaggaggtctc

SEQ ID NO: 739525 - DNA, 20 bp, mouse
ggaccccaagctttgagact

SEQ ID NO: 739526 - DNA, 20 bp, mouse
gcagctcgagggcaacgctg

SEQ ID NO: 739527 - DNA, 20 bp, mouse
gtcgagctgaagaccaaaga

SEQ ID NO: 739528 - DNA, 20 bp, mouse
gaagagggcggtgccctggt

SEQ ID NO: 739529 - DNA, 20 bp, mouse
gagggcaacgctggggaaga

SEQ ID NO: 739530 - DNA, 20 bp, mouse
gctgctccaggccagcacgc

SEQ ID NO: 739531 - DNA, 20 bp, mouse
gctgaagaccaaagagggag

SEQ ID NO: 739532 - DNA, 20 bp, mouse
gagggcggtgccctggttgg

SEQ ID NO: 739533 - DNA, 20 bp, mouse
gaacccctctccaccaacca

SEQ ID NO: 739534 - DNA, 20 bp, mouse
ggccgcctgacaaaccctag

SEQ ID NO: 739535 - DNA, 20 bp, mouse
gcctttggggaggtgatctg

SEQ ID NO: 739536 - DNA, 20 bp, mouse
gcacccgagccgcttgtcgc

SEQ ID NO: 739537 - DNA, 20 bp, mouse
ggcggagcggctgtgagggg

SEQ ID NO: 739538 - DNA, 20 bp, mouse
gggagcgcgctccatgggga

SEQ ID NO: 739539 - DNA, 20 bp, mouse
ggggaccaggatttagtgtc

SEQ ID NO: 739540 - DNA, 20 bp, mouse
gggagcgcgcaccggcagga

SEQ ID NO: 739541 - DNA, 20 bp, mouse
gagggccatagtagcagcag

SEQ ID NO: 739542 - DNA, 20 bp, mouse
gagggcggagcggctgtgag

SEQ ID NO: 739543 - DNA, 20 bp, mouse
gacttggctgacttattcag

SEQ ID NO: 739544 - DNA, 20 bp, mouse
ggggtcgcacgcgccacctg

SEQ ID NO: 739545 - DNA, 20 bp, mouse
gcgcgtgtcacgggcgaacg

SEQ ID NO: 739546 - DNA, 20 bp, mouse
gctgcagtggagcacgtgtc

SEQ ID NO: 739547 - DNA, 20 bp, mouse
ggccaagccacggaatacat

SEQ ID NO: 739548 - DNA, 20 bp, mouse
gtggacccaaaccgcgaatt

SEQ ID NO: 739549 - DNA, 20 bp, mouse
ggcagtgcaccgagtagccc

SEQ ID NO: 739550 - DNA, 20 bp, mouse
ggctattccaatgtattccg

SEQ ID NO: 739551 - DNA, 20 bp, mouse
gtcggtgcactgcagtagag

SEQ ID NO: 739552 - DNA, 20 bp, mouse
gtggaatcattatccaggga

SEQ ID NO: 739553 - DNA, 20 bp, mouse
gcgcttgcagctttcatgct

SEQ ID NO: 739554 - DNA, 20 bp, mouse
gactatggaatcattatcca

SEQ ID NO: 739555 - DNA, 20 bp, mouse
gagctgtcttgcaacactct

SEQ ID NO: 739556 - DNA, 20 bp, mouse
ggggtcgcccgagagccagc

SEQ ID NO: 739557 - DNA, 20 bp, mouse
gggagagcaggtcagcttag

SEQ ID NO: 739558 - DNA, 20 bp, mouse
gccttggccggctggctctc

SEQ ID NO: 739559 - DNA, 20 bp, mouse
gcgccctgcgtcccagctgc

SEQ ID NO: 739560 - DNA, 20 bp, mouse
gagccagcagctgggacgca

SEQ ID NO: 739561 - DNA, 20 bp, mouse
gggcgctgtacataacaagc

SEQ ID NO: 739562 - DNA, 20 bp, mouse
gacaggaatagtgctcgcct

SEQ ID NO: 739563 - DNA, 20 bp, mouse
gtcctgtcgctgtgagctac

SEQ ID NO: 739564 - DNA, 20 bp, mouse
ggcctccaggaaccgcaggg

SEQ ID NO: 739565 - DNA, 20 bp, mouse
gagtgctcgccttggccggc

SEQ ID NO: 739566 - DNA, 20 bp, mouse
gagagggagccggtaggaat

SEQ ID NO: 739567 - DNA, 20 bp, mouse
ggggaggagagggagccggt

SEQ ID NO: 739568 - DNA, 20 bp, mouse
gtctgtctgggcgccagggg

SEQ ID NO: 739569 - DNA, 20 bp, mouse
gtgggccagttttggaaggg

SEQ ID NO: 739570 - DNA, 20 bp, mouse
gctgggcgccagggggggag

SEQ ID NO: 739571 - DNA, 20 bp, mouse
gtgagcccaagtgggagtct

SEQ ID NO: 739572 - DNA, 20 bp, mouse
ggtgtagataagcgtggaat

SEQ ID NO: 739573 - DNA, 20 bp, mouse
gtctgcttcaggtagatggg

SEQ ID NO: 739574 - DNA, 20 bp, mouse
gcacacagtgactgtagtac

SEQ ID NO: 739575 - DNA, 20 bp, mouse
gagtgacaggaacgctgtga

SEQ ID NO: 739576 - DNA, 20 bp, mouse
ggccgcgcgctctggacgac

SEQ ID NO: 739577 - DNA, 20 bp, mouse
gcggcggcggtggtcccggt

SEQ ID NO: 739578 - DNA, 20 bp, mouse
gtagtcgagcaccacggcca

SEQ ID NO: 739579 - DNA, 20 bp, mouse
gccagggccgccgccgtccc

SEQ ID NO: 739580 - DNA, 20 bp, mouse
gcggccagcgcccacttccg

SEQ ID NO: 739581 - DNA, 20 bp, mouse
gggacccgagacgccgggga

SEQ ID NO: 739582 - DNA, 20 bp, mouse
gacggcggccgcctcgtcct

SEQ ID NO: 739583 - DNA, 20 bp, mouse
gcacttccgcggcctgttcg

SEQ ID NO: 739584 - DNA, 20 bp, mouse
gccggcgcgcagcaccacgt

SEQ ID NO: 739585 - DNA, 20 bp, mouse
gccggtaggacccgagacgc

SEQ ID NO: 739586 - DNA, 20 bp, mouse
ggcggggtctgcaggataag

SEQ ID NO: 739587 - DNA, 20 bp, mouse
gcggagtgcagcttcagagg

SEQ ID NO: 739588 - DNA, 20 bp, mouse
ggggcgccagcaagcttctg

SEQ ID NO: 739589 - DNA, 20 bp, mouse
gaggggcggggtctgtggat

SEQ ID NO: 739590 - DNA, 20 bp, mouse
gaggcaggaggtgtagcctt

SEQ ID NO: 739591 - DNA, 20 bp, mouse
ggaggtgtagccttaggggc

SEQ ID NO: 739592 - DNA, 20 bp, mouse
gtgggtcgggaactccggga

SEQ ID NO: 739593 - DNA, 20 bp, mouse
gcaggctccaggatatgagg

SEQ ID NO: 739594 - DNA, 20 bp, mouse
gaggcggagtgcagcttcag

SEQ ID NO: 739595 - DNA, 20 bp, mouse
gtcccaggctccaggatatg

SEQ ID NO: 739596 - DNA, 20 bp, mouse
gggctcgggatgtgtccaaa

SEQ ID NO: 739597 - DNA, 20 bp, mouse
gtgggcatgcgcagccctgc

SEQ ID NO: 739598 - DNA, 20 bp, mouse
ggccttttgcagccacccga

SEQ ID NO: 739599 - DNA, 20 bp, mouse
gaacactcgccaaggaaaca

SEQ ID NO: 739600 - DNA, 20 bp, mouse
gggaacgcgttctctgaaca

SEQ ID NO: 739601 - DNA, 20 bp, mouse
gggtggctgcaaaaggcaac

SEQ ID NO: 739602 - DNA, 20 bp, mouse
gagccacccgagggcctgca

SEQ ID NO: 739603 - DNA, 20 bp, mouse
ggagccctgggtgctcttca

SEQ ID NO: 739604 - DNA, 20 bp, mouse
gccgatgtaaacactcgcca

SEQ ID NO: 739605 - DNA, 20 bp, mouse
gcaggcactcttaggacaag

SEQ ID NO: 739606 - DNA, 20 bp, mouse
gggtgggaacccatactgac

SEQ ID NO: 739607 - DNA, 20 bp, mouse
gaagctgccgctaacagtgt

SEQ ID NO: 739608 - DNA, 20 bp, mouse
gtatcacaggcagaggggga

SEQ ID NO: 739609 - DNA, 20 bp, mouse
gttcccacctacactgttag

SEQ ID NO: 739610 - DNA, 20 bp, mouse
gtgccgctaacagtgtaggt

SEQ ID NO: 739611 - DNA, 20 bp, mouse
ggaactccataaggggactg

SEQ ID NO: 739612 - DNA, 20 bp, mouse
gaagctgatttacttgttta

SEQ ID NO: 739613 - DNA, 20 bp, mouse
gacagtgtatcacaggcaga

SEQ ID NO: 739614 - DNA, 20 bp, mouse
gagtattcacagtgtatcac

SEQ ID NO: 739615 - DNA, 20 bp, mouse
gactgttagcggcagctttc

SEQ ID NO: 739616 - DNA, 20 bp, mouse
gagcccccatagctgactca

SEQ ID NO: 739617 - DNA, 20 bp, mouse
gaggaaggctgtgagcactc

SEQ ID NO: 739618 - DNA, 20 bp, mouse
gggggctcatggggcgaggg

SEQ ID NO: 739619 - DNA, 20 bp, mouse
gatgggggctcatggggcga

SEQ ID NO: 739620 - DNA, 20 bp, mouse
gccagaggcaactgggttct

SEQ ID NO: 739621 - DNA, 20 bp, mouse
gcagccttgagtcagctatg

SEQ ID NO: 739622 - DNA, 20 bp, mouse
ggagatacggtctgtgagga

SEQ ID NO: 739623 - DNA, 20 bp, mouse
gtcagctatgggggctcatg

SEQ ID NO: 739624 - DNA, 20 bp, mouse
gtcgagagaccttccagttc

SEQ ID NO: 739625 - DNA, 20 bp, mouse
gcagcagcatttctagacta

SEQ ID NO: 739626 - DNA, 20 bp, mouse
gtaggagagctagtttggaa

SEQ ID NO: 739627 - DNA, 20 bp, mouse
gtgagctaacagaaacaaaa

SEQ ID NO: 739628 - DNA, 20 bp, mouse
gacagggcattcaggtgaag

SEQ ID NO: 739629 - DNA, 20 bp, mouse
gaccggctaaatatagacac

SEQ ID NO: 739630 - DNA, 20 bp, mouse
gagacaccggctctaacaac

SEQ ID NO: 739631 - DNA, 20 bp, mouse
gtgagattgaaaataacaac

SEQ ID NO: 739632 - DNA, 20 bp, mouse
gtttattaacatatgtttca

SEQ ID NO: 739633 - DNA, 20 bp, mouse
ggtctgaattaatgatgcca

SEQ ID NO: 739634 - DNA, 20 bp, mouse
gcaaaggcttcaggctgcgc

SEQ ID NO: 739635 - DNA, 20 bp, mouse
gcagggctctctgtatttcg

SEQ ID NO: 739636 - DNA, 20 bp, mouse
ggcccgcggcggcggaagga

SEQ ID NO: 739637 - DNA, 20 bp, mouse
gagggcgtgtgacgcaccgg

SEQ ID NO: 739638 - DNA, 20 bp, mouse
gagagaggccgtttactcgg

SEQ ID NO: 739639 - DNA, 20 bp, mouse
gcacacgccctccgagtaaa

SEQ ID NO: 739640 - DNA, 20 bp, mouse
gcgcaggccgggctcggcgg

SEQ ID NO: 739641 - DNA, 20 bp, mouse
ggtgctggagaaatgcacag

SEQ ID NO: 739642 - DNA, 20 bp, mouse
gcggagggcgtgtgacgcac

SEQ ID NO: 739643 - DNA, 20 bp, mouse
gggcacctgcattgtagcgg

SEQ ID NO: 739644 - DNA, 20 bp, mouse
gtctccagcacggtgttgtt

SEQ ID NO: 739645 - DNA, 20 bp, mouse
gtcacaaccgcccttacctc

SEQ ID NO: 739646 - DNA, 20 bp, mouse
gcccctgctcccagtttcta

SEQ ID NO: 739647 - DNA, 20 bp, mouse
gcggagccccgcccagtatg

SEQ ID NO: 739648 - DNA, 20 bp, mouse
ggcaggcagagcgtactcta

SEQ ID NO: 739649 - DNA, 20 bp, mouse
ggtcccggctgggagagccg

SEQ ID NO: 739650 - DNA, 20 bp, mouse
ggggacatcctcatactggg

SEQ ID NO: 739651 - DNA, 20 bp, mouse
gaaggggacaggtcccggct

SEQ ID NO: 739652 - DNA, 20 bp, mouse
gccgttctccagaaggggac

SEQ ID NO: 739653 - DNA, 20 bp, mouse
gcaggggaattcttggggat

SEQ ID NO: 739654 - DNA, 20 bp, mouse
gcggccgcgccgggactaac

SEQ ID NO: 739655 - DNA, 20 bp, mouse
gcggagcgggcgggactcgg

SEQ ID NO: 739656 - DNA, 20 bp, mouse
gcgtagatcagggatctggt

SEQ ID NO: 739657 - DNA, 20 bp, mouse
gtgagtgggtgcgtagatca

SEQ ID NO: 739658 - DNA, 20 bp, mouse
gtggtggtgtttgtagtaac

SEQ ID NO: 739659 - DNA, 20 bp, mouse
gggttaggaatgtctttgag

SEQ ID NO: 739660 - DNA, 20 bp, mouse
gaggactaaaccgtactccc

SEQ ID NO: 739661 - DNA, 20 bp, mouse
gggtgcgtagatcagggatc

SEQ ID NO: 739662 - DNA, 20 bp, mouse
gtgtggactgtcacagggtt

SEQ ID NO: 739663 - DNA, 20 bp, mouse
gtgtgacagctggtgataag

SEQ ID NO: 739664 - DNA, 20 bp, mouse
gcaaaggggtctcagatagt

SEQ ID NO: 739665 - DNA, 20 bp, mouse
gcagagaggaactgcatagg

SEQ ID NO: 739666 - DNA, 20 bp, mouse
ggtgcggcgtcctcaacagt

SEQ ID NO: 739667 - DNA, 20 bp, mouse
gggggtgcgctctaaggagg

SEQ ID NO: 739668 - DNA, 20 bp, mouse
ggcgacgcagccggttgcta

SEQ ID NO: 739669 - DNA, 20 bp, mouse
gctcaacagtgggtaccctt

SEQ ID NO: 739670 - DNA, 20 bp, mouse
gaagaactgaccctgttctc

SEQ ID NO: 739671 - DNA, 20 bp, mouse
gcacgcgacgccctagcaac

SEQ ID NO: 739672 - DNA, 20 bp, mouse
gtaccaaaggccgacttccc

SEQ ID NO: 739673 - DNA, 20 bp, mouse
ggggggggtgcgctctaagg

SEQ ID NO: 739674 - DNA, 20 bp, mouse
gcgacccagtgcgcatgctt

SEQ ID NO: 739675 - DNA, 20 bp, mouse
gtaaacaggcaggcatgtca

SEQ ID NO: 739676 - DNA, 20 bp, mouse
ggcaggggatgaatactggg

SEQ ID NO: 739677 - DNA, 20 bp, mouse
gaatactgggagggatggaa

SEQ ID NO: 739678 - DNA, 20 bp, mouse
gccacgcaggggatgaatac

SEQ ID NO: 739679 - DNA, 20 bp, mouse
gggatgaatactgggaggga

SEQ ID NO: 739680 - DNA, 20 bp, mouse
ggcaggcgcgctcttcaaag

SEQ ID NO: 739681 - DNA, 20 bp, mouse
ggtgctgcgcgccgcactct

SEQ ID NO: 739682 - DNA, 20 bp, mouse
gtgggatattccccacgcag

SEQ ID NO: 739683 - DNA, 20 bp, mouse
gccgaccgctcgctcgtgcc

SEQ ID NO: 739684 - DNA, 20 bp, mouse
gcaccaagccacctggtcta

SEQ ID NO: 739685 - DNA, 20 bp, mouse
gcgctcgctcgtgcccggct

SEQ ID NO: 739686 - DNA, 20 bp, mouse
gagggcgcgggcgggactgg

SEQ ID NO: 739687 - DNA, 20 bp, mouse
ggaccctgcaccggcctcgc

SEQ ID NO: 739688 - DNA, 20 bp, mouse
gggccagcgaggccggtgca

SEQ ID NO: 739689 - DNA, 20 bp, mouse
ggcaagggggcggtggatgg

SEQ ID NO: 739690 - DNA, 20 bp, mouse
ggtccattatgtaagcttgt

SEQ ID NO: 739691 - DNA, 20 bp, mouse
gtacataatggaccctgcac

SEQ ID NO: 739692 - DNA, 20 bp, mouse
gttgcctttcgttgctgctc

SEQ ID NO: 739693 - DNA, 20 bp, mouse
gtgcagccgctcctagcccg

SEQ ID NO: 739694 - DNA, 20 bp, mouse
gttgccagagcagcaacgaa

SEQ ID NO: 739695 - DNA, 20 bp, mouse
gttcctacaagcttacataa

SEQ ID NO: 739696 - DNA, 20 bp, mouse
gcctcccacagccatgaggg

SEQ ID NO: 739697 - DNA, 20 bp, mouse
gcagcccttgtggctatcaa

SEQ ID NO: 739698 - DNA, 20 bp, mouse
gcagggctttggccaacatc

SEQ ID NO: 739699 - DNA, 20 bp, mouse
gcctggagctgttagtgtta

SEQ ID NO: 739700 - DNA, 20 bp, mouse
gcgtgttggcagccagatgt

SEQ ID NO: 739701 - DNA, 20 bp, mouse
gttgccgttgatagccacaa

SEQ ID NO: 739702 - DNA, 20 bp, mouse
gttgtttagagcagtggatt

SEQ ID NO: 739703 - DNA, 20 bp, mouse
ggccaaaattattacctttt

SEQ ID NO: 739704 - DNA, 20 bp, mouse
gaagaatttctactaactgc

SEQ ID NO: 739705 - DNA, 20 bp, mouse
gattattacctttttggact

SEQ ID NO: 739706 - DNA, 20 bp, mouse
ggggaggggccctggaatac

SEQ ID NO: 739707 - DNA, 20 bp, mouse
gcctccctgagcaggaatct

SEQ ID NO: 739708 - DNA, 20 bp, mouse
gagagggagtgaagccctaa

SEQ ID NO: 739709 - DNA, 20 bp, mouse
gtggggctggcattcaacca

SEQ ID NO: 739710 - DNA, 20 bp, mouse
ggagtgaagccctaagggga

SEQ ID NO: 739711 - DNA, 20 bp, mouse
gaagtgttctcaggtgtggt

SEQ ID NO: 739712 - DNA, 20 bp, mouse
gccccacccacgttataatt

SEQ ID NO: 739713 - DNA, 20 bp, mouse
ggaagcttccgggatcttga

SEQ ID NO: 739714 - DNA, 20 bp, mouse
ggaagccctaaggggaaggg

SEQ ID NO: 739715 - DNA, 20 bp, mouse
gaggtgggaagagttcaagt

SEQ ID NO: 739716 - DNA, 20 bp, mouse
gtgaactgccaaggggatgt

SEQ ID NO: 739717 - DNA, 20 bp, mouse
ggggtgccggccctgccttg

SEQ ID NO: 739718 - DNA, 20 bp, mouse
gccctgccttggggtggagt

SEQ ID NO: 739719 - DNA, 20 bp, mouse
gagtggggatgaactgccaa

SEQ ID NO: 739720 - DNA, 20 bp, mouse
ggccaaggggatgttggaaa

SEQ ID NO: 739721 - DNA, 20 bp, mouse
gtgtgctgaccccaaagcac

SEQ ID NO: 739722 - DNA, 20 bp, mouse
gtgccggccctgccttgggg

SEQ ID NO: 739723 - DNA, 20 bp, mouse
ggagacaggaccagtggggt

SEQ ID NO: 739724 - DNA, 20 bp, mouse
gtacccaggtgacgtgggac

SEQ ID NO: 739725 - DNA, 20 bp, mouse
gaagaggggacctagtgtgc

SEQ ID NO: 739726 - DNA, 20 bp, mouse
gaggttgagctgctcggaga

SEQ ID NO: 739727 - DNA, 20 bp, mouse
gaactgggagccccacaact

SEQ ID NO: 739728 - DNA, 20 bp, mouse
gaggggctaactactgggta

SEQ ID NO: 739729 - DNA, 20 bp, mouse
gccacaactgggaagacaag

SEQ ID NO: 739730 - DNA, 20 bp, mouse
gcagtccagctgtccttcac

SEQ ID NO: 739731 - DNA, 20 bp, mouse
gctggtgcctacagctgccc

SEQ ID NO: 739732 - DNA, 20 bp, mouse
gcccagttgtggaacaagcc

SEQ ID NO: 739733 - DNA, 20 bp, mouse
gctggagttcagcaaggtgg

SEQ ID NO: 739734 - DNA, 20 bp, mouse
gggagagacttcactggttg

SEQ ID NO: 739735 - DNA, 20 bp, mouse
gaaggacagctggactgggc

SEQ ID NO: 739736 - DNA, 20 bp, mouse
ggtggggcatcatgtgtgac

SEQ ID NO: 739737 - DNA, 20 bp, mouse
ggcccaggggatgggcccag

SEQ ID NO: 739738 - DNA, 20 bp, mouse
gcccaggggacaatgactca

SEQ ID NO: 739739 - DNA, 20 bp, mouse
gccccaatggcccaggggat

SEQ ID NO: 739740 - DNA, 20 bp, mouse
ggattctaatccccactcta

SEQ ID NO: 739741 - DNA, 20 bp, mouse
gagggctgggagtcgctcat

SEQ ID NO: 739742 - DNA, 20 bp, mouse
gagctggatgcagtgtatga

SEQ ID NO: 739743 - DNA, 20 bp, mouse
gactctagggaggaatgagc

SEQ ID NO: 739744 - DNA, 20 bp, mouse
gtgacacaaagggatcaggt

SEQ ID NO: 739745 - DNA, 20 bp, mouse
gaccccacccccaatggccc

SEQ ID NO: 739746 - DNA, 20 bp, mouse
gagggcaagcccggatggga

SEQ ID NO: 739747 - DNA, 20 bp, mouse
ggccccatgagttaatccca

SEQ ID NO: 739748 - DNA, 20 bp, mouse
gccccctgggattaactcat

SEQ ID NO: 739749 - DNA, 20 bp, mouse
gggaataagtaggtggcttc

SEQ ID NO: 739750 - DNA, 20 bp, mouse
gaggggagggcaagcccgga

SEQ ID NO: 739751 - DNA, 20 bp, mouse
gcagaggtggggtcaaaatt

SEQ ID NO: 739752 - DNA, 20 bp, mouse
gcctgccccgtccaccccct

SEQ ID NO: 739753 - DNA, 20 bp, mouse
ggcaggattagggattaaga

SEQ ID NO: 739754 - DNA, 20 bp, mouse
gttaatcccagggggtggac

SEQ ID NO: 739755 - DNA, 20 bp, mouse
gctggaactgtggctaggtg

SEQ ID NO: 739756 - DNA, 20 bp, mouse
gtctctggtcagagatggga

SEQ ID NO: 739757 - DNA, 20 bp, mouse
gtgggcagggagattgagag

SEQ ID NO: 739758 - DNA, 20 bp, mouse
ggaggcagaagggcggtcgg

SEQ ID NO: 739759 - DNA, 20 bp, mouse
gctaaggatgatactgggag

SEQ ID NO: 739760 - DNA, 20 bp, mouse
gcagaagggcggtcgggggt

SEQ ID NO: 739761 - DNA, 20 bp, mouse
gaatctggaaagaatggagt

SEQ ID NO: 739762 - DNA, 20 bp, mouse
ggggccctaaggatgatact

SEQ ID NO: 739763 - DNA, 20 bp, mouse
gtgcccagaccagggataaa

SEQ ID NO: 739764 - DNA, 20 bp, mouse
gcaaagagcatgcagtagat

SEQ ID NO: 739765 - DNA, 20 bp, mouse
gtactgcatgctctttgacc

SEQ ID NO: 739766 - DNA, 20 bp, mouse
ggtagacagaagtgcatctc

SEQ ID NO: 739767 - DNA, 20 bp, mouse
gtcggggatgacaaaaactg

SEQ ID NO: 739768 - DNA, 20 bp, mouse
gggtcctctcaacagtcagg

SEQ ID NO: 739769 - DNA, 20 bp, mouse
gcagcctcctgactgttgag

SEQ ID NO: 739770 - DNA, 20 bp, mouse
gagaagtgcatctctggtgt

SEQ ID NO: 739771 - DNA, 20 bp, mouse
gatgcacttctgtctacaga

SEQ ID NO: 739772 - DNA, 20 bp, mouse
gagaatgatgttagactaag

SEQ ID NO: 739773 - DNA, 20 bp, mouse
ggtgttttcctatatgtccc

SEQ ID NO: 739774 - DNA, 20 bp, mouse
gaggccagcctgggacatat

SEQ ID NO: 739775 - DNA, 20 bp, mouse
gctggaggagcttgagtttg

SEQ ID NO: 739776 - DNA, 20 bp, mouse
gaagccctgcccttgctgac

SEQ ID NO: 739777 - DNA, 20 bp, mouse
gctgcccttgctgacagggt

SEQ ID NO: 739778 - DNA, 20 bp, mouse
ggtgacttggtatgaatggt

SEQ ID NO: 739779 - DNA, 20 bp, mouse
ggttgcacccactgtccaga

SEQ ID NO: 739780 - DNA, 20 bp, mouse
ggccatctggctccagtacc

SEQ ID NO: 739781 - DNA, 20 bp, mouse
gtaacccacaactttaagga

SEQ ID NO: 739782 - DNA, 20 bp, mouse
gtggtatgaatggtgggtag

SEQ ID NO: 739783 - DNA, 20 bp, mouse
ggtcatcccttaccacagcc

SEQ ID NO: 739784 - DNA, 20 bp, mouse
gaatggtgacttggtatgaa

SEQ ID NO: 739785 - DNA, 20 bp, mouse
ggaatccaaccctgtcagca

SEQ ID NO: 739786 - DNA, 20 bp, mouse
gaccttcctagggatgaaac

SEQ ID NO: 739787 - DNA, 20 bp, mouse
gaccagtttcatccctagga

SEQ ID NO: 739788 - DNA, 20 bp, mouse
gccaaaccagtttcatccct

SEQ ID NO: 739789 - DNA, 20 bp, mouse
gcagccgtctcatctatcac

SEQ ID NO: 739790 - DNA, 20 bp, mouse
gctgtacagcgggcgcaacg

SEQ ID NO: 739791 - DNA, 20 bp, mouse
gtcaccagtgatagatgaga

SEQ ID NO: 739792 - DNA, 20 bp, mouse
gaattgtatatacagtgaac

SEQ ID NO: 739793 - DNA, 20 bp, mouse
gtgcaaaaaggcaagaactt

SEQ ID NO: 739794 - DNA, 20 bp, mouse
gtcaccctggataccttcct

SEQ ID NO: 739795 - DNA, 20 bp, mouse
gaggtatccagggtgaacta

SEQ ID NO: 739796 - DNA, 20 bp, mouse
gcccgaaccaatctcattcc

SEQ ID NO: 739797 - DNA, 20 bp, mouse
gcattcctgggaaggtattc

SEQ ID NO: 739798 - DNA, 20 bp, mouse
gctgtacagtgggtacaacg

SEQ ID NO: 739799 - DNA, 20 bp, mouse
gcctggagccatttgagttc

SEQ ID NO: 739800 - DNA, 20 bp, mouse
gttctgacagctactttctt

SEQ ID NO: 739801 - DNA, 20 bp, mouse
ggagttttctcagctatcac

SEQ ID NO: 739802 - DNA, 20 bp, mouse
gaaggtccccagaactcaaa

SEQ ID NO: 739803 - DNA, 20 bp, mouse
gggagctgtggggagaactc

SEQ ID NO: 739804 - DNA, 20 bp, mouse
gggtgagttggtgttaaatg

SEQ ID NO: 739805 - DNA, 20 bp, mouse
gcagctcccaaacttctcaa

SEQ ID NO: 739806 - DNA, 20 bp, mouse
gccacccaatctccctggga

SEQ ID NO: 739807 - DNA, 20 bp, mouse
gcagctcccaaacttttcat

SEQ ID NO: 739808 - DNA, 20 bp, mouse
gttgttcctatgaaaagttt

SEQ ID NO: 739809 - DNA, 20 bp, mouse
gtggtgtgaaaggcagattg

SEQ ID NO: 739810 - DNA, 20 bp, mouse
gtcaccagtgatatccaaaa

SEQ ID NO: 739811 - DNA, 20 bp, mouse
gcagccgttttggatatcac

SEQ ID NO: 739812 - DNA, 20 bp, mouse
gcagagttcaaagtgaaaaa

SEQ ID NO: 739813 - DNA, 20 bp, mouse
gctgccccacccaatctccc

SEQ ID NO: 739814 - DNA, 20 bp, mouse
ggataccttcccagggagat

SEQ ID NO: 739815 - DNA, 20 bp, mouse
ggcaggtcatgctgttcctg

SEQ ID NO: 739816 - DNA, 20 bp, mouse
gccaaggataaaatcgggtg

SEQ ID NO: 739817 - DNA, 20 bp, mouse
gtccctgctgtggtaagggg

SEQ ID NO: 739818 - DNA, 20 bp, mouse
gagcagggagggtaagtgca

SEQ ID NO: 739819 - DNA, 20 bp, mouse
ggaccgccccttaccacagc

SEQ ID NO: 739820 - DNA, 20 bp, mouse
gccctccctgctgtggtaag

SEQ ID NO: 739821 - DNA, 20 bp, mouse
ggtcagcaagggaagagctt

SEQ ID NO: 739822 - DNA, 20 bp, mouse
gctagggcctactggacatc

SEQ ID NO: 739823 - DNA, 20 bp, mouse
gccttcccaaggataaaatc

SEQ ID NO: 739824 - DNA, 20 bp, mouse
gaagagctttggtcagcatt

SEQ ID NO: 739825 - DNA, 20 bp, mouse
ggataaaatcgggtggggca

SEQ ID NO: 739826 - DNA, 20 bp, mouse
gtggagctcttggtgttctg

SEQ ID NO: 739827 - DNA, 20 bp, mouse
ggggaactggcagccgtttt

SEQ ID NO: 739828 - DNA, 20 bp, mouse
gtccaaaaaagcaagaattt

SEQ ID NO: 739829 - DNA, 20 bp, mouse
ggccaaaattcttgcttttt

SEQ ID NO: 739830 - DNA, 20 bp, mouse
gttttggcattttcagaaat

SEQ ID NO: 739831 - DNA, 20 bp, mouse
gtattttcctattagaagtt

SEQ ID NO: 739832 - DNA, 20 bp, mouse
gcagctcccaaacttctaat

SEQ ID NO: 739833 - DNA, 20 bp, mouse
gttaccagtgatacccaaaa

SEQ ID NO: 739834 - DNA, 20 bp, mouse
gatgctgttcttggagctct

SEQ ID NO: 739835 - DNA, 20 bp, mouse
gaataggatttgtatgtaca

SEQ ID NO: 739836 - DNA, 20 bp, mouse
gcccaacccaatatcatccc

SEQ ID NO: 739837 - DNA, 20 bp, mouse
gctgtacagagggtgcaatg

SEQ ID NO: 739838 - DNA, 20 bp, mouse
gcatgtccaagattatccca

SEQ ID NO: 739839 - DNA, 20 bp, mouse
ggagatgtcttggctatcac

SEQ ID NO: 739840 - DNA, 20 bp, mouse
gccaggaacttccttagtac

SEQ ID NO: 739841 - DNA, 20 bp, mouse
gttctaactgctacttcctt

SEQ ID NO: 739842 - DNA, 20 bp, mouse
ggtcaaaatgctagtctttc

SEQ ID NO: 739843 - DNA, 20 bp, mouse
gatttgggagctaggtatag

SEQ ID NO: 739844 - DNA, 20 bp, mouse
gttgttcctatgagaaattt

SEQ ID NO: 739845 - DNA, 20 bp, mouse
gcccagggatgatattgggt

SEQ ID NO: 739846 - DNA, 20 bp, mouse
gccagggaggagattgtgta

SEQ ID NO: 739847 - DNA, 20 bp, mouse
gcacaatctcctccctggga

SEQ ID NO: 739848 - DNA, 20 bp, mouse
gttgtacagagggtacaaca

SEQ ID NO: 739849 - DNA, 20 bp, mouse
gggaggagattgtgtagggc

SEQ ID NO: 739850 - DNA, 20 bp, mouse
ggaagacaatcttggacatg

SEQ ID NO: 739851 - DNA, 20 bp, mouse
gactggcagcggttttggac

SEQ ID NO: 739852 - DNA, 20 bp, mouse
gcctggctgtgggaaatgga

SEQ ID NO: 739853 - DNA, 20 bp, mouse
gaggataggggaggggctat

SEQ ID NO: 739854 - DNA, 20 bp, mouse
gtctgggtggcaacaggata

SEQ ID NO: 739855 - DNA, 20 bp, mouse
gggtggcaacaggatagggg

SEQ ID NO: 739856 - DNA, 20 bp, mouse
gtcaggggcaatgttgagtt

SEQ ID NO: 739857 - DNA, 20 bp, mouse
gtcttcccagggatgcgatt

SEQ ID NO: 739858 - DNA, 20 bp, mouse
gtagccaggtgacaaggtca

SEQ ID NO: 739859 - DNA, 20 bp, mouse
gtgcccctgaccttgtcacc

SEQ ID NO: 739860 - DNA, 20 bp, mouse
gggaacttagccaggtgaca

SEQ ID NO: 739861 - DNA, 20 bp, mouse
gccccacccaatcgcatccc

SEQ ID NO: 739862 - DNA, 20 bp, mouse
gctgctgtcctgtaggcctt

SEQ ID NO: 739863 - DNA, 20 bp, mouse
gaatctaggtattgaggtac

SEQ ID NO: 739864 - DNA, 20 bp, mouse
ggagaataatctaggtattg

SEQ ID NO: 739865 - DNA, 20 bp, mouse
gcaccagtgatagccaaaat

SEQ ID NO: 739866 - DNA, 20 bp, mouse
gccagggatgagattggttg

SEQ ID NO: 739867 - DNA, 20 bp, mouse
ggttgcacctgctctacagt

SEQ ID NO: 739868 - DNA, 20 bp, mouse
gggtcctgcacctcaataaa

SEQ ID NO: 739869 - DNA, 20 bp, mouse
gtaaccttttattgaggtgc

SEQ ID NO: 739870 - DNA, 20 bp, mouse
gcaactcacagctctaaata

SEQ ID NO: 739871 - DNA, 20 bp, mouse
gaaggtcaggggtgatggtc

SEQ ID NO: 739872 - DNA, 20 bp, mouse
ggccatctggctacagtccc

SEQ ID NO: 739873 - DNA, 20 bp, mouse
ggatggtcaggaagtgtgaa

SEQ ID NO: 739874 - DNA, 20 bp, mouse
gggtcaggaagtgtgaaagg

SEQ ID NO: 739875 - DNA, 20 bp, mouse
gaggaagtgtgaaaggagga

SEQ ID NO: 739876 - DNA, 20 bp, mouse
gtgcactagtgatagccaag

SEQ ID NO: 739877 - DNA, 20 bp, mouse
gtcagcatctgagcggcaac

SEQ ID NO: 739878 - DNA, 20 bp, mouse
gattgttcctatgagtagtt

SEQ ID NO: 739879 - DNA, 20 bp, mouse
gctgctgtgcagtagtccct

SEQ ID NO: 739880 - DNA, 20 bp, mouse
ggtcagaaaggacagagctt

SEQ ID NO: 739881 - DNA, 20 bp, mouse
gaagtataactctgtcagaa

SEQ ID NO: 739882 - DNA, 20 bp, mouse
gttggcattatttaaaaaaa

SEQ ID NO: 739883 - DNA, 20 bp, mouse
gtcccagggatgagattagg

SEQ ID NO: 739884 - DNA, 20 bp, mouse
gtgcccctgaccttgccctc

SEQ ID NO: 739885 - DNA, 20 bp, mouse
gggcctcctctcccacagcc

SEQ ID NO: 739886 - DNA, 20 bp, mouse
gtccctgctgtggtaagcat

SEQ ID NO: 739887 - DNA, 20 bp, mouse
gtggtgtgaacgatgggtag

SEQ ID NO: 739888 - DNA, 20 bp, mouse
ggtgaattggtgtgaacgat

SEQ ID NO: 739889 - DNA, 20 bp, mouse
ggacatctggcaatggtccc

SEQ ID NO: 739890 - DNA, 20 bp, mouse
gtggaactgttagtgttccg

SEQ ID NO: 739891 - DNA, 20 bp, mouse
gagccaatgcttaccacagc

SEQ ID NO: 739892 - DNA, 20 bp, mouse
gcacttctgtcagcaagaga

SEQ ID NO: 739893 - DNA, 20 bp, mouse
gtaacagttccaacaccagg

SEQ ID NO: 739894 - DNA, 20 bp, mouse
ggggcaattcctcctggtgt

SEQ ID NO: 739895 - DNA, 20 bp, mouse
gttgggagggcaattcctcc

SEQ ID NO: 739896 - DNA, 20 bp, mouse
ggggcaggtcctgctattcc

SEQ ID NO: 739897 - DNA, 20 bp, mouse
ggccatctggctacggctcc

SEQ ID NO: 739898 - DNA, 20 bp, mouse
gtcctggagccgtagccaga

SEQ ID NO: 739899 - DNA, 20 bp, mouse
gctgtacagtgggtgcaaca

SEQ ID NO: 739900 - DNA, 20 bp, mouse
gcaggaactcaaacagcacc

SEQ ID NO: 739901 - DNA, 20 bp, mouse
gcagtgatccagaattctat

SEQ ID NO: 739902 - DNA, 20 bp, mouse
gggctttggcttcaaattgc

SEQ ID NO: 739903 - DNA, 20 bp, mouse
gcctttttcccatagaattc

SEQ ID NO: 739904 - DNA, 20 bp, mouse
gaaaatcacacagatctact

SEQ ID NO: 739905 - DNA, 20 bp, mouse
gctcccctcccacagcaggg

SEQ ID NO: 739906 - DNA, 20 bp, mouse
gccaagtcaggtggagtctg

SEQ ID NO: 739907 - DNA, 20 bp, mouse
gaggctgcctccaagtcagg

SEQ ID NO: 739908 - DNA, 20 bp, mouse
gagaacatgagggggggcaa

SEQ ID NO: 739909 - DNA, 20 bp, mouse
gttcaggctgcctccaagtc

SEQ ID NO: 739910 - DNA, 20 bp, mouse
ggagactacgggagtgaggt

SEQ ID NO: 739911 - DNA, 20 bp, mouse
gggacacagagggagactac

SEQ ID NO: 739912 - DNA, 20 bp, mouse
gcagaggctcctaggaacga

SEQ ID NO: 739913 - DNA, 20 bp, mouse
gcagcctgaaggctttgagc

SEQ ID NO: 739914 - DNA, 20 bp, mouse
gactacgggagtgaggtagg

SEQ ID NO: 739915 - DNA, 20 bp, mouse
ggcctgcagcatctgacgta

SEQ ID NO: 739916 - DNA, 20 bp, mouse
gtggcgctcaacactgggtg

SEQ ID NO: 739917 - DNA, 20 bp, mouse
gagggagtggcgctcaacac

SEQ ID NO: 739918 - DNA, 20 bp, mouse
gctggccccaaggatgggga

SEQ ID NO: 739919 - DNA, 20 bp, mouse
gaggacccctccccatcctt

SEQ ID NO: 739920 - DNA, 20 bp, mouse
gaggcaggaagagtgagtgc

SEQ ID NO: 739921 - DNA, 20 bp, mouse
gggaacaggggcaaagtggc

SEQ ID NO: 739922 - DNA, 20 bp, mouse
gaatgagtgaatgtgactcg

SEQ ID NO: 739923 - DNA, 20 bp, mouse
gaatgtgccccagggaccag

SEQ ID NO: 739924 - DNA, 20 bp, mouse
gaaccacccactggtccctg

SEQ ID NO: 739925 - DNA, 20 bp, mouse
gtgctggggcccagactgac

SEQ ID NO: 739926 - DNA, 20 bp, mouse
gcccaggttcagtggggtca

SEQ ID NO: 739927 - DNA, 20 bp, mouse
gagaaaggctggacataaat

SEQ ID NO: 739928 - DNA, 20 bp, mouse
ggccatgctcccaggaagat

SEQ ID NO: 739929 - DNA, 20 bp, mouse
gttcctgggagcatggcacc

SEQ ID NO: 739930 - DNA, 20 bp, mouse
gaagcggcatgagcaatatg

SEQ ID NO: 739931 - DNA, 20 bp, mouse
ggaccagagaacgggaaagt

SEQ ID NO: 739932 - DNA, 20 bp, mouse
gaacctgggcagctggttcc

SEQ ID NO: 739933 - DNA, 20 bp, mouse
ggggcagaaggaatgcatgt

SEQ ID NO: 739934 - DNA, 20 bp, mouse
gggaagccagtgacccactc

SEQ ID NO: 739935 - DNA, 20 bp, mouse
gaggctggacataaatagga

SEQ ID NO: 739936 - DNA, 20 bp, mouse
ggtgatgctagaatgtgtgg

SEQ ID NO: 739937 - DNA, 20 bp, mouse
gtgcctgactgcagtaaaga

SEQ ID NO: 739938 - DNA, 20 bp, mouse
gctgactgcagtaaagaggg

SEQ ID NO: 739939 - DNA, 20 bp, mouse
ggggcaggggaggtataaaa

SEQ ID NO: 739940 - DNA, 20 bp, mouse
gactgcagtaaagagggtgg

SEQ ID NO: 739941 - DNA, 20 bp, mouse
ggggttatctgaaatccctg

SEQ ID NO: 739942 - DNA, 20 bp, mouse
gttactgcagtcaggcaggg

SEQ ID NO: 739943 - DNA, 20 bp, mouse
gtctgtgataccaactgttg

SEQ ID NO: 739944 - DNA, 20 bp, mouse
gtggtcctggtcacggtgtg

SEQ ID NO: 739945 - DNA, 20 bp, mouse
gacctcgtcaaggattgagt

SEQ ID NO: 739946 - DNA, 20 bp, mouse
gaggcccccggacttccctt

SEQ ID NO: 739947 - DNA, 20 bp, mouse
gcgcctgaggtccgtgtctg

SEQ ID NO: 739948 - DNA, 20 bp, mouse
ggcaaggtgcgggcagaagg

SEQ ID NO: 739949 - DNA, 20 bp, mouse
gacaccgaagggaagtccgg

SEQ ID NO: 739950 - DNA, 20 bp, mouse
gttgctggaggatggagcta

SEQ ID NO: 739951 - DNA, 20 bp, mouse
gaacccgcaagcgctcgagg

SEQ ID NO: 739952 - DNA, 20 bp, mouse
ggaactaagaggaagtccga

SEQ ID NO: 739953 - DNA, 20 bp, mouse
gaaaccgaggtgaggactag

SEQ ID NO: 739954 - DNA, 20 bp, mouse
ggggtcctgggctcagagaa

SEQ ID NO: 739955 - DNA, 20 bp, mouse
gcgtcccatggtggcctctg

SEQ ID NO: 739956 - DNA, 20 bp, mouse
ggggccccctccccttccag

SEQ ID NO: 739957 - DNA, 20 bp, mouse
gaggcagaaggccttatgac

SEQ ID NO: 739958 - DNA, 20 bp, mouse
gtgacagggtcctctggaag

SEQ ID NO: 739959 - DNA, 20 bp, mouse
gagttgggaaatgtccccgg

SEQ ID NO: 739960 - DNA, 20 bp, mouse
gagggcggccccaacggagg

SEQ ID NO: 739961 - DNA, 20 bp, mouse
gtccagaggaccctgtcata

SEQ ID NO: 739962 - DNA, 20 bp, mouse
gcagcagaattggctaaatg

SEQ ID NO: 739963 - DNA, 20 bp, mouse
gaatcacagggcggccccaa

SEQ ID NO: 739964 - DNA, 20 bp, mouse
gaattggctaaatgggggaa

SEQ ID NO: 739965 - DNA, 20 bp, mouse
gctggattcaaaatgctcta

SEQ ID NO: 739966 - DNA, 20 bp, mouse
gagagctggaggctccaaaa

SEQ ID NO: 739967 - DNA, 20 bp, mouse
gtccacggacatcccagtcc

SEQ ID NO: 739968 - DNA, 20 bp, mouse
gcctctgaatatggcaccga

SEQ ID NO: 739969 - DNA, 20 bp, mouse
gtctgcaaagggacccattt

SEQ ID NO: 739970 - DNA, 20 bp, mouse
gtaagtagctgaacctggac

SEQ ID NO: 739971 - DNA, 20 bp, mouse
gcccatggattcttctgcaa

SEQ ID NO: 739972 - DNA, 20 bp, mouse
gataaacacgatgacagagc

SEQ ID NO: 739973 - DNA, 20 bp, mouse
gaacctgtcaatatagtcca

SEQ ID NO: 739974 - DNA, 20 bp, mouse
ggctccaggatgttaacctc

SEQ ID NO: 739975 - DNA, 20 bp, mouse
ggggtagtagacccggtgac

SEQ ID NO: 739976 - DNA, 20 bp, mouse
ggcaccaagaggtggggcac

SEQ ID NO: 739977 - DNA, 20 bp, mouse
gaagaggtggggcactggac

SEQ ID NO: 739978 - DNA, 20 bp, mouse
gacagatgcaccaagaggtg

SEQ ID NO: 739979 - DNA, 20 bp, mouse
gggctcaagcactaagagca

SEQ ID NO: 739980 - DNA, 20 bp, mouse
gtaaacacatagtccttcat

SEQ ID NO: 739981 - DNA, 20 bp, mouse
gttagtgcttgagcccatga

SEQ ID NO: 739982 - DNA, 20 bp, mouse
gcgtattcttgtgggatggc

SEQ ID NO: 739983 - DNA, 20 bp, mouse
gggtaaacttcacagatctt

SEQ ID NO: 739984 - DNA, 20 bp, mouse
ggtgatcagcgtattcttgt

SEQ ID NO: 739985 - DNA, 20 bp, mouse
gtcagcgtattcttgtggga

SEQ ID NO: 739986 - DNA, 20 bp, mouse
gcagtccatgtcagggtatt

SEQ ID NO: 739987 - DNA, 20 bp, mouse
gtaatccaaataccctgaca

SEQ ID NO: 739988 - DNA, 20 bp, mouse
gcttacctgtgatggaaatt

SEQ ID NO: 739989 - DNA, 20 bp, mouse
ggatacagagagattaaaaa

SEQ ID NO: 739990 - DNA, 20 bp, mouse
gtcacctatgggaacataac

SEQ ID NO: 739991 - DNA, 20 bp, mouse
gaaaaaataggctttatcaa

SEQ ID NO: 739992 - DNA, 20 bp, mouse
gtatccagttatgttcccat

SEQ ID NO: 739993 - DNA, 20 bp, mouse
gtgatcccaatttccatcac

SEQ ID NO: 739994 - DNA, 20 bp, mouse
gtaatactgcaggtgatcca

SEQ ID NO: 739995 - DNA, 20 bp, mouse
gaaggcacataaatatctat

SEQ ID NO: 739996 - DNA, 20 bp, mouse
gtcagctccaggtttgtaat

SEQ ID NO: 739997 - DNA, 20 bp, mouse
gagcagagggagagttgaga

SEQ ID NO: 739998 - DNA, 20 bp, mouse
gcaacagcctattacaaacc

SEQ ID NO: 739999 - DNA, 20 bp, mouse
gagtttggggaagtgataat

SEQ ID NO: 740000 - DNA, 20 bp, mouse
gttcgatttggtcaaggagg

SEQ ID NO: 740001 - DNA, 20 bp, mouse
gctagaaaaatgtgcagctc

SEQ ID NO: 740002 - DNA, 20 bp, mouse
gagggagagttgagagggta

SEQ ID NO: 740003 - DNA, 20 bp, mouse
gcctcttttcgatttggtca

SEQ ID NO: 740004 - DNA, 20 bp, mouse
gttcctttgctttcagagtc

SEQ ID NO: 740005 - DNA, 20 bp, mouse
gaaagcacacatatttccac

SEQ ID NO: 740006 - DNA, 20 bp, mouse
ggactctgacagcaaaggaa

SEQ ID NO: 740007 - DNA, 20 bp, mouse
gaagctgactctgacagcaa

SEQ ID NO: 740008 - DNA, 20 bp, mouse
gaaccataggaaaagaatgg

SEQ ID NO: 740009 - DNA, 20 bp, mouse
gggggccgaatgttatgagc

SEQ ID NO: 740010 - DNA, 20 bp, mouse
ggtcccccattcttttccta

SEQ ID NO: 740011 - DNA, 20 bp, mouse
gagtatatgccagaatacat

SEQ ID NO: 740012 - DNA, 20 bp, mouse
gctgcttctaattttgtaat

SEQ ID NO: 740013 - DNA, 20 bp, mouse
gtactccagctcataacatt

SEQ ID NO: 740014 - DNA, 20 bp, mouse
gtttatgcaggggaatgaat

SEQ ID NO: 740015 - DNA, 20 bp, mouse
gagtattcaactatcaatta

SEQ ID NO: 740016 - DNA, 20 bp, mouse
gtttgctttggtgacgagga

SEQ ID NO: 740017 - DNA, 20 bp, mouse
gtctttttgctttggtgacg

SEQ ID NO: 740018 - DNA, 20 bp, mouse
gtgcacactgctgcagagag

SEQ ID NO: 740019 - DNA, 20 bp, mouse
gagtcctgagtctgtagctc

SEQ ID NO: 740020 - DNA, 20 bp, mouse
gttccctgagctacagactc

SEQ ID NO: 740021 - DNA, 20 bp, mouse
gaagagggactgaagttcgt

SEQ ID NO: 740022 - DNA, 20 bp, mouse
gcatgaggttgagtatcacc

SEQ ID NO: 740023 - DNA, 20 bp, mouse
ggaggttgagtatcacccgg

SEQ ID NO: 740024 - DNA, 20 bp, mouse
ggaatgacattaatattcaa

SEQ ID NO: 740025 - DNA, 20 bp, mouse
gaacaacatatagtattgga

SEQ ID NO: 740026 - DNA, 20 bp, mouse
gaaaatctagaagcatgtac

SEQ ID NO: 740027 - DNA, 20 bp, mouse
gaaagctgagtctgaaggca

SEQ ID NO: 740028 - DNA, 20 bp, mouse
gtacaggcagactttaccag

SEQ ID NO: 740029 - DNA, 20 bp, mouse
gcaggttttgctctctgtgc

SEQ ID NO: 740030 - DNA, 20 bp, mouse
gaagtccatctttttcccaa

SEQ ID NO: 740031 - DNA, 20 bp, mouse
gaaaaccattgggaaaaaga

SEQ ID NO: 740032 - DNA, 20 bp, mouse
ggagattgagtgttgctcag

SEQ ID NO: 740033 - DNA, 20 bp, mouse
ggatgtcattccatataaag

SEQ ID NO: 740034 - DNA, 20 bp, mouse
gtgtctttagcaaaaccatt

SEQ ID NO: 740035 - DNA, 20 bp, mouse
gtcagcaaatactttatccc

SEQ ID NO: 740036 - DNA, 20 bp, mouse
gtcctctttatctaagcaaa

SEQ ID NO: 740037 - DNA, 20 bp, mouse
gatagacactcctacagaga

SEQ ID NO: 740038 - DNA, 20 bp, mouse
gagtgttttgccttctctgt

SEQ ID NO: 740039 - DNA, 20 bp, mouse
gttcctatttgttttgctaa

SEQ ID NO: 740040 - DNA, 20 bp, mouse
gtccttttgcttagataaag

SEQ ID NO: 740041 - DNA, 20 bp, mouse
ggaggttgagtatcactagg

SEQ ID NO: 740042 - DNA, 20 bp, mouse
gtgaaacaacatatagtatc

SEQ ID NO: 740043 - DNA, 20 bp, mouse
gaagagggactgaagtttgt

SEQ ID NO: 740044 - DNA, 20 bp, mouse
gaacaacatatagtatcagg

SEQ ID NO: 740045 - DNA, 20 bp, mouse
gtttgatgcttatgttgtca

SEQ ID NO: 740046 - DNA, 20 bp, mouse
gcatccagggttatgtgtat

SEQ ID NO: 740047 - DNA, 20 bp, mouse
gaacaggggcccaggatatc

SEQ ID NO: 740048 - DNA, 20 bp, mouse
gctgccaatacacataaccc

SEQ ID NO: 740049 - DNA, 20 bp, mouse
gcagtgctttagcccatcca

SEQ ID NO: 740050 - DNA, 20 bp, mouse
gaacatgataacaggggccc

SEQ ID NO: 740051 - DNA, 20 bp, mouse
gacagaggatgcagtagagc

SEQ ID NO: 740052 - DNA, 20 bp, mouse
gtaaagagtcctgatatcct

SEQ ID NO: 740053 - DNA, 20 bp, mouse
gttatgtgtattggcagata

SEQ ID NO: 740054 - DNA, 20 bp, mouse
gctacagcagaccatacact

SEQ ID NO: 740055 - DNA, 20 bp, mouse
gggctaaagcactgagagca

SEQ ID NO: 740056 - DNA, 20 bp, mouse
gaagtgggagagaagttcgt

SEQ ID NO: 740057 - DNA, 20 bp, mouse
ggatggacactcctgctgag

SEQ ID NO: 740058 - DNA, 20 bp, mouse
gaatgctttctcctctcagc

SEQ ID NO: 740059 - DNA, 20 bp, mouse
gtatttgaagacagagatga

SEQ ID NO: 740060 - DNA, 20 bp, mouse
gagtcctgagtctgtatttc

SEQ ID NO: 740061 - DNA, 20 bp, mouse
gttccctgaaatacagactc

SEQ ID NO: 740062 - DNA, 20 bp, mouse
gttagcataattctaattca

SEQ ID NO: 740063 - DNA, 20 bp, mouse
gtttgctttgatgaagagga

SEQ ID NO: 740064 - DNA, 20 bp, mouse
gtgaaacaacatatagtatc

SEQ ID NO: 740065 - DNA, 20 bp, mouse
gaacaacatatagtatcagg

SEQ ID NO: 740066 - DNA, 20 bp, mouse
gtatgatgatacagaggtct

SEQ ID NO: 740067 - DNA, 20 bp, mouse
gactagatatgatgatacag

SEQ ID NO: 740068 - DNA, 20 bp, mouse
gctcacctgtaacggaaatt

SEQ ID NO: 740069 - DNA, 20 bp, mouse
gtgctataaacaccctgaca

SEQ ID NO: 740070 - DNA, 20 bp, mouse
gtacttacccggttgaagca

SEQ ID NO: 740071 - DNA, 20 bp, mouse
gaatttggtcagtccatgtc

SEQ ID NO: 740072 - DNA, 20 bp, mouse
gtatctagttatcttcctat

SEQ ID NO: 740073 - DNA, 20 bp, mouse
gctgaccaaatttccgttac

SEQ ID NO: 740074 - DNA, 20 bp, mouse
ggttagacattagctcattg

SEQ ID NO: 740075 - DNA, 20 bp, mouse
gctctactccatgcttcaac

SEQ ID NO: 740076 - DNA, 20 bp, mouse
ggctactggttagtttttaa

SEQ ID NO: 740077 - DNA, 20 bp, mouse
gacacatgttttgctctctc

SEQ ID NO: 740078 - DNA, 20 bp, mouse
ggagtctgagaacaaattaa

SEQ ID NO: 740079 - DNA, 20 bp, mouse
gattaaaggagcaaaatatt

SEQ ID NO: 740080 - DNA, 20 bp, mouse
gtttcatatttgatttgctg

SEQ ID NO: 740081 - DNA, 20 bp, mouse
ggtatcaaagatgccctagt

SEQ ID NO: 740082 - DNA, 20 bp, mouse
gtaatggttttccacatata

SEQ ID NO: 740083 - DNA, 20 bp, mouse
gatgtttcttttgcaacatc

SEQ ID NO: 740084 - DNA, 20 bp, mouse
gtcgatttggtcaagaggag

SEQ ID NO: 740085 - DNA, 20 bp, mouse
gcatgttttgctctctctgg

SEQ ID NO: 740086 - DNA, 20 bp, mouse
gaagaggtactgaagttcat

SEQ ID NO: 740087 - DNA, 20 bp, mouse
gaagacacactcctgcagag

SEQ ID NO: 740088 - DNA, 20 bp, mouse
gaatcctgagtctgtagctc

SEQ ID NO: 740089 - DNA, 20 bp, mouse
gctgatgttgtcacggtgat

SEQ ID NO: 740090 - DNA, 20 bp, mouse
gaatgttttcccctctctgc

SEQ ID NO: 740091 - DNA, 20 bp, mouse
gttccctgagctacagactc

SEQ ID NO: 740092 - DNA, 20 bp, mouse
ggaatgacatcaatgttcat

SEQ ID NO: 740093 - DNA, 20 bp, mouse
gatttgcttttattttgttc

SEQ ID NO: 740094 - DNA, 20 bp, mouse
gaagatctagaaaatcaaaa

SEQ ID NO: 740095 - DNA, 20 bp, mouse
gctctttttcctatttgttt

SEQ ID NO: 740096 - DNA, 20 bp, mouse
ggacccacatttaatatctt

SEQ ID NO: 740097 - DNA, 20 bp, mouse
gatcaacattatgctctctg

SEQ ID NO: 740098 - DNA, 20 bp, mouse
gaccagttgcaaatgtgagt

SEQ ID NO: 740099 - DNA, 20 bp, mouse
gtctccaaagatattaaatg

SEQ ID NO: 740100 - DNA, 20 bp, mouse
gggcaaatgtcagtgtaaat

SEQ ID NO: 740101 - DNA, 20 bp, mouse
ggaaggaaggtgtggaatgt

SEQ ID NO: 740102 - DNA, 20 bp, mouse
ggagagcataatgttgatag

SEQ ID NO: 740103 - DNA, 20 bp, mouse
gtacactgacatttgccttg

SEQ ID NO: 740104 - DNA, 20 bp, mouse
gagagtatggctgacacaat

SEQ ID NO: 740105 - DNA, 20 bp, mouse
gttcttatcgttaaaactga

SEQ ID NO: 740106 - DNA, 20 bp, mouse
gtggtcagagtgttttgcgt

SEQ ID NO: 740107 - DNA, 20 bp, mouse
gtatgctatagctgtaagct

SEQ ID NO: 740108 - DNA, 20 bp, mouse
gacaaaggagcagtggatgg

SEQ ID NO: 740109 - DNA, 20 bp, mouse
ggtggagaggaaggggaact

SEQ ID NO: 740110 - DNA, 20 bp, mouse
gaagaagggagggaaggctg

SEQ ID NO: 740111 - DNA, 20 bp, mouse
ggataagacagtccagtagg

SEQ ID NO: 740112 - DNA, 20 bp, mouse
gttatccagccctggtaaga

SEQ ID NO: 740113 - DNA, 20 bp, mouse
gggagcagtggatgggggag

SEQ ID NO: 740114 - DNA, 20 bp, mouse
gcaaaccctcttaccagggc

SEQ ID NO: 740115 - DNA, 20 bp, mouse
gctggataagacagtccagt

SEQ ID NO: 740116 - DNA, 20 bp, mouse
ggtgccacatacagaacgta

SEQ ID NO: 740117 - DNA, 20 bp, mouse
gactcataacggatggttag

SEQ ID NO: 740118 - DNA, 20 bp, mouse
ggacaccaggtcaatagcta

SEQ ID NO: 740119 - DNA, 20 bp, mouse
gaaaccgtacgttctgtatg

SEQ ID NO: 740120 - DNA, 20 bp, mouse
gctgagaggataactcataa

SEQ ID NO: 740121 - DNA, 20 bp, mouse
gccacacccgcccacactgg

SEQ ID NO: 740122 - DNA, 20 bp, mouse
ggctcagaacagcactgagt

SEQ ID NO: 740123 - DNA, 20 bp, mouse
ggaggataactcataacgga

SEQ ID NO: 740124 - DNA, 20 bp, mouse
gcactcattggagatctgag

SEQ ID NO: 740125 - DNA, 20 bp, mouse
gtcacacatcttaatccctg

SEQ ID NO: 740126 - DNA, 20 bp, mouse
gtggatctgggggagcggag

SEQ ID NO: 740127 - DNA, 20 bp, mouse
gggtcatggtgttttgtatg

SEQ ID NO: 740128 - DNA, 20 bp, mouse
ggcactgtcttatccaaccc

SEQ ID NO: 740129 - DNA, 20 bp, mouse
gttggataagacagtgcagc

SEQ ID NO: 740130 - DNA, 20 bp, mouse
gcaaatcctcttaccagggt

SEQ ID NO: 740131 - DNA, 20 bp, mouse
gtatttcacctcaaaggcct

SEQ ID NO: 740132 - DNA, 20 bp, mouse
gcaaaggagcagtggatctg

SEQ ID NO: 740133 - DNA, 20 bp, mouse
ggcggagaggaaggggaagt

SEQ ID NO: 740134 - DNA, 20 bp, mouse
gagacaggaatcagtgggtg

SEQ ID NO: 740135 - DNA, 20 bp, mouse
gcctttctgaagggagacaa

SEQ ID NO: 740136 - DNA, 20 bp, mouse
gaaaccctcagttgcaagtg

SEQ ID NO: 740137 - DNA, 20 bp, mouse
gcgcccacacttgcaactga

SEQ ID NO: 740138 - DNA, 20 bp, mouse
gtacaacacatgatctactc

SEQ ID NO: 740139 - DNA, 20 bp, mouse
gtctctgtagttactgaact

SEQ ID NO: 740140 - DNA, 20 bp, mouse
gttgtagtcatcatggtcat

SEQ ID NO: 740141 - DNA, 20 bp, mouse
gaccacagaaagcatcttta

SEQ ID NO: 740142 - DNA, 20 bp, mouse
gttgcaagtgtgggcgggtg

SEQ ID NO: 740143 - DNA, 20 bp, mouse
ggctgtgagacccctcacac

SEQ ID NO: 740144 - DNA, 20 bp, mouse
ggtcagagtggaatttgacc

SEQ ID NO: 740145 - DNA, 20 bp, mouse
gcacttgtgatagttaaaga

SEQ ID NO: 740146 - DNA, 20 bp, mouse
gacaatgaatacgagtgctg

SEQ ID NO: 740147 - DNA, 20 bp, mouse
ggataaggcaacaacttaat

SEQ ID NO: 740148 - DNA, 20 bp, mouse
gggaatgaaacaggttggaa

SEQ ID NO: 740149 - DNA, 20 bp, mouse
gactcgtattcattgtccaa

SEQ ID NO: 740150 - DNA, 20 bp, mouse
gaggactaacaccatgaaat

SEQ ID NO: 740151 - DNA, 20 bp, mouse
gtggcaaaatatttttgata

SEQ ID NO: 740152 - DNA, 20 bp, mouse
gagatcatgaatttcagaga

SEQ ID NO: 740153 - DNA, 20 bp, mouse
gaaaggtacacaatctgatg

SEQ ID NO: 740154 - DNA, 20 bp, mouse
ggtaagcattacctatttca

SEQ ID NO: 740155 - DNA, 20 bp, mouse
gctattagtgttgggatctt

SEQ ID NO: 740156 - DNA, 20 bp, mouse
gcctccctttttattgcgtc

SEQ ID NO: 740157 - DNA, 20 bp, mouse
gggaaaaatgaaaaaaaatt

SEQ ID NO: 740158 - DNA, 20 bp, mouse
gtattataaatgttggaaaa

SEQ ID NO: 740159 - DNA, 20 bp, mouse
gagagaaattacaaaaagtg

SEQ ID NO: 740160 - DNA, 20 bp, mouse
ggtgaggctattataaatgt

SEQ ID NO: 740161 - DNA, 20 bp, mouse
gcatcctgacgcaataaaaa

SEQ ID NO: 740162 - DNA, 20 bp, mouse
gcacgtgatctcaaaatcca

SEQ ID NO: 740163 - DNA, 20 bp, mouse
gagggaggagaccaaagaat

SEQ ID NO: 740164 - DNA, 20 bp, mouse
gtacaaaagcaccaattctt

SEQ ID NO: 740165 - DNA, 20 bp, mouse
ggccatgtttgaatttaata

SEQ ID NO: 740166 - DNA, 20 bp, mouse
ggaaaaatgaaaaaaaaatt

SEQ ID NO: 740167 - DNA, 20 bp, mouse
gagagaaattacaaaaagtg

SEQ ID NO: 740168 - DNA, 20 bp, mouse
gacattctgacacaataaaa

SEQ ID NO: 740169 - DNA, 20 bp, mouse
gcacgtgatctcaaaatcca

SEQ ID NO: 740170 - DNA, 20 bp, mouse
gtctgacacaataaaaaggg

SEQ ID NO: 740171 - DNA, 20 bp, mouse
gagggaggagaccaaagaat

SEQ ID NO: 740172 - DNA, 20 bp, mouse
gtacaaaagcgccaattctt

SEQ ID NO: 740173 - DNA, 20 bp, mouse
gctacttgtgttctatgctg

SEQ ID NO: 740174 - DNA, 20 bp, mouse
gattttgagatcacgtgata

SEQ ID NO: 740175 - DNA, 20 bp, mouse
ggccatgtttgaatttaata

SEQ ID NO: 740176 - DNA, 20 bp, mouse
gtgggacacagatgcacagt

SEQ ID NO: 740177 - DNA, 20 bp, mouse
gcacagcaaaataaggttgg

SEQ ID NO: 740178 - DNA, 20 bp, mouse
gctattgaatcatctgttgg

SEQ ID NO: 740179 - DNA, 20 bp, mouse
gagacagtaagcattaaaag

SEQ ID NO: 740180 - DNA, 20 bp, mouse
gcaagctttgaacaagaccc

SEQ ID NO: 740181 - DNA, 20 bp, mouse
gcaccacagcaaaataaggt

SEQ ID NO: 740182 - DNA, 20 bp, mouse
ggtgctattgaatcatctgt

SEQ ID NO: 740183 - DNA, 20 bp, mouse
gtcctgtgtgcagtggttcc

SEQ ID NO: 740184 - DNA, 20 bp, mouse
gcccaggaaccactgcacac

SEQ ID NO: 740185 - DNA, 20 bp, mouse
gaaagaacggtgtggaccac

SEQ ID NO: 740186 - DNA, 20 bp, mouse
gaggctgtgcattcattccc

SEQ ID NO: 740187 - DNA, 20 bp, mouse
gccactactcaatactcatg

SEQ ID NO: 740188 - DNA, 20 bp, mouse
gccgtttagcacccataata

SEQ ID NO: 740189 - DNA, 20 bp, mouse
gtagtgaggactttgctatg

SEQ ID NO: 740190 - DNA, 20 bp, mouse
gaaacacaatcgagtcagaa

SEQ ID NO: 740191 - DNA, 20 bp, mouse
gtatgctctcacccatatta

SEQ ID NO: 740192 - DNA, 20 bp, mouse
gaggtcagccagtaatagtc

SEQ ID NO: 740193 - DNA, 20 bp, mouse
gaatgtactacagtcttcaa

SEQ ID NO: 740194 - DNA, 20 bp, mouse
ggtgtgctattgtgtgaata

SEQ ID NO: 740195 - DNA, 20 bp, mouse
gatccatgacttgctgtgcc

SEQ ID NO: 740196 - DNA, 20 bp, mouse
ggggaatgtgggctgtaagt

SEQ ID NO: 740197 - DNA, 20 bp, mouse
gggaagtgattcaggttcga

SEQ ID NO: 740198 - DNA, 20 bp, mouse
gtctccgaggtgtgctgcag

SEQ ID NO: 740199 - DNA, 20 bp, mouse
gggtgcctgtctcttgtaga

SEQ ID NO: 740200 - DNA, 20 bp, mouse
gcctgtaaagtagtgcaagt

SEQ ID NO: 740201 - DNA, 20 bp, mouse
gatctaaggagcaatctccg

SEQ ID NO: 740202 - DNA, 20 bp, mouse
gggggtgagaaacacccatg

SEQ ID NO: 740203 - DNA, 20 bp, mouse
ggtccatgggatgaagaaat

SEQ ID NO: 740204 - DNA, 20 bp, mouse
gcgcagaacaagatgagctt

SEQ ID NO: 740205 - DNA, 20 bp, mouse
ggctatgcgggcctatttta

SEQ ID NO: 740206 - DNA, 20 bp, mouse
gccagcaggggtaacgggtg

SEQ ID NO: 740207 - DNA, 20 bp, mouse
gcgggtggggctcgggatga

SEQ ID NO: 740208 - DNA, 20 bp, mouse
ggcgacagggtcaccggttg

SEQ ID NO: 740209 - DNA, 20 bp, mouse
gggggtaacgggtggggctc

SEQ ID NO: 740210 - DNA, 20 bp, mouse
ggttgagcgagtcacagagt

SEQ ID NO: 740211 - DNA, 20 bp, mouse
gaaggaatctgccagtctct

SEQ ID NO: 740212 - DNA, 20 bp, mouse
gcagagccagcaggggtaac

SEQ ID NO: 740213 - DNA, 20 bp, mouse
gggccaggctggagttccga

SEQ ID NO: 740214 - DNA, 20 bp, mouse
gagggtcaccggttgtggtt

SEQ ID NO: 740215 - DNA, 20 bp, mouse
ggagtgggcggtggctctta

SEQ ID NO: 740216 - DNA, 20 bp, mouse
gggacacagagagaaaaagt

SEQ ID NO: 740217 - DNA, 20 bp, mouse
gaagttgttggggaaaatgg

SEQ ID NO: 740218 - DNA, 20 bp, mouse
gtctctgtgtccatttttaa

SEQ ID NO: 740219 - DNA, 20 bp, mouse
gaatgtatcgaactcagaga

SEQ ID NO: 740220 - DNA, 20 bp, mouse
gtggagtaaaatattcatat

SEQ ID NO: 740221 - DNA, 20 bp, mouse
gagtaggtttgagctttttg

SEQ ID NO: 740222 - DNA, 20 bp, mouse
gtctgagttcgatacattta

SEQ ID NO: 740223 - DNA, 20 bp, mouse
gtagaagctgatcttatgaa

SEQ ID NO: 740224 - DNA, 20 bp, mouse
gcagaatttgttaagtttct

SEQ ID NO: 740225 - DNA, 20 bp, mouse
gcaatgttgtatgaaattac

SEQ ID NO: 740226 - DNA, 20 bp, mouse
gcatctctcactggtgcagt

SEQ ID NO: 740227 - DNA, 20 bp, mouse
gctgatacagtctatgcaga

SEQ ID NO: 740228 - DNA, 20 bp, mouse
gcatagactgtatcagaact

SEQ ID NO: 740229 - DNA, 20 bp, mouse
gagttatataattttatagg

SEQ ID NO: 740230 - DNA, 20 bp, mouse
gattagtttacttcaaggag

SEQ ID NO: 740231 - DNA, 20 bp, mouse
ggataaattgtttaagcttt

SEQ ID NO: 740232 - DNA, 20 bp, mouse
gtatataattttataggggg

SEQ ID NO: 740233 - DNA, 20 bp, mouse
gacaatgaaaagcttgctac

SEQ ID NO: 740234 - DNA, 20 bp, mouse
gcacacattagtttacttca

SEQ ID NO: 740235 - DNA, 20 bp, mouse
gtatagttatataattttat

SEQ ID NO: 740236 - DNA, 20 bp, mouse
gacagctcatccaagacagg

SEQ ID NO: 740237 - DNA, 20 bp, mouse
gacagaaattaggacagatt

SEQ ID NO: 740238 - DNA, 20 bp, mouse
gataacagctcatccaagac

SEQ ID NO: 740239 - DNA, 20 bp, mouse
gggggaatttaatattttta

SEQ ID NO: 740240 - DNA, 20 bp, mouse
gtattaaattccccctgtct

SEQ ID NO: 740241 - DNA, 20 bp, mouse
gattaggacagattcggaag

SEQ ID NO: 740242 - DNA, 20 bp, mouse
gtgtagtttttacttggtga

SEQ ID NO: 740243 - DNA, 20 bp, mouse
ggttttattgttacattgag

SEQ ID NO: 740244 - DNA, 20 bp, mouse
gcaaaagactcatatagaca

SEQ ID NO: 740245 - DNA, 20 bp, mouse
gtttttttctgctgtctcta

SEQ ID NO: 740246 - DNA, 20 bp, mouse
gtgacctgaaaggactttgt

SEQ ID NO: 740247 - DNA, 20 bp, mouse
gaaggtgtctcatatgagac

SEQ ID NO: 740248 - DNA, 20 bp, mouse
gcctttgtgagccagaagca

SEQ ID NO: 740249 - DNA, 20 bp, mouse
gtgtttaaatagcatcctcg

SEQ ID NO: 740250 - DNA, 20 bp, mouse
gtcctgagtaggatttctag

SEQ ID NO: 740251 - DNA, 20 bp, mouse
gtgagttaaacacttatcag

SEQ ID NO: 740252 - DNA, 20 bp, mouse
ggtctaatcagcttggctct

SEQ ID NO: 740253 - DNA, 20 bp, mouse
gatgaaacttgtgttatctg

SEQ ID NO: 740254 - DNA, 20 bp, mouse
gagctagattctaaagtcct

SEQ ID NO: 740255 - DNA, 20 bp, mouse
gtttgaaattttggttatcg

SEQ ID NO: 740256 - DNA, 20 bp, mouse
gtagagcagcggcctccggg

SEQ ID NO: 740257 - DNA, 20 bp, mouse
ggcagcgccagggaagatga

SEQ ID NO: 740258 - DNA, 20 bp, mouse
gggcccgctatgccgagcgc

SEQ ID NO: 740259 - DNA, 20 bp, mouse
gggctcatatgcagattgca

SEQ ID NO: 740260 - DNA, 20 bp, mouse
gtcccgggaacgtgtgtaat

SEQ ID NO: 740261 - DNA, 20 bp, mouse
ggggcggcgccaggcgggtt

SEQ ID NO: 740262 - DNA, 20 bp, mouse
gacccggcgctcggcatagc

SEQ ID NO: 740263 - DNA, 20 bp, mouse
ggcggggcatgcacttatcc

SEQ ID NO: 740264 - DNA, 20 bp, mouse
gcccagatggccgtaccccg

SEQ ID NO: 740265 - DNA, 20 bp, mouse
ggaggcgggttccggggaga

SEQ ID NO: 740266 - DNA, 20 bp, mouse
ggtggggcgggcaggagccg

SEQ ID NO: 740267 - DNA, 20 bp, mouse
gggaggcgcaaggtcttctg

SEQ ID NO: 740268 - DNA, 20 bp, mouse
ggccacgcgcggggcaccac

SEQ ID NO: 740269 - DNA, 20 bp, mouse
gaaccagcgccgctgtgggg

SEQ ID NO: 740270 - DNA, 20 bp, mouse
gcccgtgcgcagggccgggg

SEQ ID NO: 740271 - DNA, 20 bp, mouse
gcgcggggcaccacgggagc

SEQ ID NO: 740272 - DNA, 20 bp, mouse
gagaactgggaataccgggt

SEQ ID NO: 740273 - DNA, 20 bp, mouse
ggctcctgcccgccccacag

SEQ ID NO: 740274 - DNA, 20 bp, mouse
ggggagcaggagtcctgggc

SEQ ID NO: 740275 - DNA, 20 bp, mouse
gggctgggctggccacgcgc

SEQ ID NO: 740276 - DNA, 20 bp, mouse
gggagagcgggcaaacgata

SEQ ID NO: 740277 - DNA, 20 bp, mouse
gcccgctcggcgccgccctc

SEQ ID NO: 740278 - DNA, 20 bp, mouse
gggccgggcggagacccctg

SEQ ID NO: 740279 - DNA, 20 bp, mouse
gggaggagaaagggccgcgg

SEQ ID NO: 740280 - DNA, 20 bp, mouse
ggggcgccgcggccaaggct

SEQ ID NO: 740281 - DNA, 20 bp, mouse
gtgacgggctgacggcgcgg

SEQ ID NO: 740282 - DNA, 20 bp, mouse
ggcgggaggagaaagggccg

SEQ ID NO: 740283 - DNA, 20 bp, mouse
gcggccaaggctggggccgg

SEQ ID NO: 740284 - DNA, 20 bp, mouse
gggcccgccgcccccctccg

SEQ ID NO: 740285 - DNA, 20 bp, mouse
gtcccccaggccgcccgcgg

SEQ ID NO: 740286 - DNA, 20 bp, mouse
ggggcggcctctcagtccta

SEQ ID NO: 740287 - DNA, 20 bp, mouse
gccgccccgcgacgcggatg

SEQ ID NO: 740288 - DNA, 20 bp, mouse
ggacacaaagagagcaccgg

SEQ ID NO: 740289 - DNA, 20 bp, mouse
ggcggcgcggcattccttcc

SEQ ID NO: 740290 - DNA, 20 bp, mouse
ggggctcgggcggaacgtcg

SEQ ID NO: 740291 - DNA, 20 bp, mouse
gcggggagaggggctcggcg

SEQ ID NO: 740292 - DNA, 20 bp, mouse
ggccgggccctaggactgag

SEQ ID NO: 740293 - DNA, 20 bp, mouse
gaggggctcacgttccatcc

SEQ ID NO: 740294 - DNA, 20 bp, mouse
gcagggcggcgaatcccgag

SEQ ID NO: 740295 - DNA, 20 bp, mouse
ggagaggccgccccgcgacg

SEQ ID NO: 740296 - DNA, 20 bp, mouse
gcgacgcggcctctccgccg

SEQ ID NO: 740297 - DNA, 20 bp, mouse
gccgcagcccataaccaaga

SEQ ID NO: 740298 - DNA, 20 bp, mouse
gcgtggagacgtcacgctag

SEQ ID NO: 740299 - DNA, 20 bp, mouse
gagacctccccaaccgtcgg

SEQ ID NO: 740300 - DNA, 20 bp, mouse
gagggctactcggggacaac

SEQ ID NO: 740301 - DNA, 20 bp, mouse
gtgacgtctccacgcctcgg

SEQ ID NO: 740302 - DNA, 20 bp, mouse
gtcgccgccatcttggttat

SEQ ID NO: 740303 - DNA, 20 bp, mouse
ggatgctactagtgggtaga

SEQ ID NO: 740304 - DNA, 20 bp, mouse
gtctccacgcctcggcggag

SEQ ID NO: 740305 - DNA, 20 bp, mouse
gcccccctgcccctgcggag

SEQ ID NO: 740306 - DNA, 20 bp, mouse
gtgcctgcccactggaccct

SEQ ID NO: 740307 - DNA, 20 bp, mouse
gggaaccaacagtggaacct

SEQ ID NO: 740308 - DNA, 20 bp, mouse
ggcttcgtatgaagctcaga

SEQ ID NO: 740309 - DNA, 20 bp, mouse
gtgcatccccagggtccagt

SEQ ID NO: 740310 - DNA, 20 bp, mouse
gcctgctcaggaaccaacag

SEQ ID NO: 740311 - DNA, 20 bp, mouse
gggaggtacaggcagcaagc

SEQ ID NO: 740312 - DNA, 20 bp, mouse
gagcaggaaggctgggctta

SEQ ID NO: 740313 - DNA, 20 bp, mouse
ggcagcctaggttccactgt

SEQ ID NO: 740314 - DNA, 20 bp, mouse
ggcaccgggaagagtagacc

SEQ ID NO: 740315 - DNA, 20 bp, mouse
gcgaccctgctcagttgcct

SEQ ID NO: 740316 - DNA, 20 bp, mouse
gggcgcagggtgcaccccgg

SEQ ID NO: 740317 - DNA, 20 bp, mouse
ggggaactgcgaaagtcctg

SEQ ID NO: 740318 - DNA, 20 bp, mouse
gcgcgcagcggccatcctag

SEQ ID NO: 740319 - DNA, 20 bp, mouse
gtaggtgcagacccctagga

SEQ ID NO: 740320 - DNA, 20 bp, mouse
gtgcgctgtctgtgacagtt

SEQ ID NO: 740321 - DNA, 20 bp, mouse
gggaccagtgtgatctaggt

SEQ ID NO: 740322 - DNA, 20 bp, mouse
ggcgggccggggccgagttt

SEQ ID NO: 740323 - DNA, 20 bp, mouse
gagacagcgcaggcaggcgc

SEQ ID NO: 740324 - DNA, 20 bp, mouse
ggcaggcgcagggtgcaccc

SEQ ID NO: 740325 - DNA, 20 bp, mouse
ggcaaccccgcccctgggtt

SEQ ID NO: 740326 - DNA, 20 bp, mouse
gagctggagaattgcaacat

SEQ ID NO: 740327 - DNA, 20 bp, mouse
gacacaaggggcgtgacctc

SEQ ID NO: 740328 - DNA, 20 bp, mouse
ggtccaaccaggtatggagc

SEQ ID NO: 740329 - DNA, 20 bp, mouse
gtttacaaaggcagacaaac

SEQ ID NO: 740330 - DNA, 20 bp, mouse
gctcaatgtccaaccaggta

SEQ ID NO: 740331 - DNA, 20 bp, mouse
gtgagcaatgttttagaaat

SEQ ID NO: 740332 - DNA, 20 bp, mouse
gacaagcaatattgtgtagg

SEQ ID NO: 740333 - DNA, 20 bp, mouse
gctctgctcaatgtccaacc

SEQ ID NO: 740334 - DNA, 20 bp, mouse
ggccacaagcaatattgtgt

SEQ ID NO: 740335 - DNA, 20 bp, mouse
ggcccctatttagattcctg

SEQ ID NO: 740336 - DNA, 20 bp, mouse
gaacaagagcattgcaacat

SEQ ID NO: 740337 - DNA, 20 bp, mouse
gtctgcgtacgtgaacaatg

SEQ ID NO: 740338 - DNA, 20 bp, mouse
gctcttgttccatacctggc

SEQ ID NO: 740339 - DNA, 20 bp, mouse
gacaagcaatattgtgtggt

SEQ ID NO: 740340 - DNA, 20 bp, mouse
gttgagcaatgcttgagaaa

SEQ ID NO: 740341 - DNA, 20 bp, mouse
gaatgctcttgttccatacc

SEQ ID NO: 740342 - DNA, 20 bp, mouse
gttgttgacctgtttgcctt

SEQ ID NO: 740343 - DNA, 20 bp, mouse
ggcaagcagagtttgaagcc

SEQ ID NO: 740344 - DNA, 20 bp, mouse
gggagttcacagaacacctc

SEQ ID NO: 740345 - DNA, 20 bp, mouse
gttcacagaacacctctgga

SEQ ID NO: 740346 - DNA, 20 bp, mouse
gccggcgtgcgcgtagtgat

SEQ ID NO: 740347 - DNA, 20 bp, mouse
gccgccggggaagagcctat

SEQ ID NO: 740348 - DNA, 20 bp, mouse
gtcacccgcctggcgcacag

SEQ ID NO: 740349 - DNA, 20 bp, mouse
gggtgcccgcagtgtcgccc

SEQ ID NO: 740350 - DNA, 20 bp, mouse
gtgctgcgtgaggaggcgag

SEQ ID NO: 740351 - DNA, 20 bp, mouse
ggtagtgatcggcgaatccg

SEQ ID NO: 740352 - DNA, 20 bp, mouse
gggatcagatctgcgagggt

SEQ ID NO: 740353 - DNA, 20 bp, mouse
ggagacccgggcgacactgc

SEQ ID NO: 740354 - DNA, 20 bp, mouse
gccggcggctcgacgacctg

SEQ ID NO: 740355 - DNA, 20 bp, mouse
gtatgggatcagatctgcga

SEQ ID NO: 740356 - DNA, 20 bp, mouse
gtggcccagcctcgaccagc

SEQ ID NO: 740357 - DNA, 20 bp, mouse
gtgtaggcggccctgttgta

SEQ ID NO: 740358 - DNA, 20 bp, mouse
gagccgccatgctgtacgga

SEQ ID NO: 740359 - DNA, 20 bp, mouse
ggcggcggcagactctaacg

SEQ ID NO: 740360 - DNA, 20 bp, mouse
gggcggccctgttgtacgga

SEQ ID NO: 740361 - DNA, 20 bp, mouse
gggcgcggctccgagtctgt

SEQ ID NO: 740362 - DNA, 20 bp, mouse
gccagcctcgaccagcaggc

SEQ ID NO: 740363 - DNA, 20 bp, mouse
ggcggctccgagtctgtagg

SEQ ID NO: 740364 - DNA, 20 bp, mouse
gggcctgaatagaaactacc

SEQ ID NO: 740365 - DNA, 20 bp, mouse
gcacgtgtctgccttctggc

SEQ ID NO: 740366 - DNA, 20 bp, mouse
ggaagcctacgaagtgggtg

SEQ ID NO: 740367 - DNA, 20 bp, mouse
gggcgtgaagcctacgaagt

SEQ ID NO: 740368 - DNA, 20 bp, mouse
gttggccccacccacttcgt

SEQ ID NO: 740369 - DNA, 20 bp, mouse
gaccgagcatccattctggg

SEQ ID NO: 740370 - DNA, 20 bp, mouse
ggattggttagtctctcgaa

SEQ ID NO: 740371 - DNA, 20 bp, mouse
ggcgcaagagattcagtctg

SEQ ID NO: 740372 - DNA, 20 bp, mouse
ggggaattcaatttagttta

SEQ ID NO: 740373 - DNA, 20 bp, mouse
gagaatggatgctcggtatc

SEQ ID NO: 740374 - DNA, 20 bp, mouse
gccaaggatacctcccagaa

SEQ ID NO: 740375 - DNA, 20 bp, mouse
gacctcccagaatggatgct

SEQ ID NO: 740376 - DNA, 20 bp, mouse
gtctccgccgcctgccgcag

SEQ ID NO: 740377 - DNA, 20 bp, mouse
gcgtggacgccctaggctag

SEQ ID NO: 740378 - DNA, 20 bp, mouse
gctagcggcggccagggaaa

SEQ ID NO: 740379 - DNA, 20 bp, mouse
gcctggccgccgctagccta

SEQ ID NO: 740380 - DNA, 20 bp, mouse
gggacgccctaggctagcgg

SEQ ID NO: 740381 - DNA, 20 bp, mouse
gagcctagggcgtccacgct

SEQ ID NO: 740382 - DNA, 20 bp, mouse
ggccagggcgtgggtctctg

SEQ ID NO: 740383 - DNA, 20 bp, mouse
gctggccgccgccttttccc

SEQ ID NO: 740384 - DNA, 20 bp, mouse
ggggtctctgcggaccaggt

SEQ ID NO: 740385 - DNA, 20 bp, mouse
ggcgtgggtctctgcggacc

SEQ ID NO: 740386 - DNA, 20 bp, mouse
ggggaagcgtcgcgagatga

SEQ ID NO: 740387 - DNA, 20 bp, mouse
ggagcggccgggcaatccca

SEQ ID NO: 740388 - DNA, 20 bp, mouse
gggacgcagacgcaggtcgt

SEQ ID NO: 740389 - DNA, 20 bp, mouse
gcccagggtgccttgcagaa

SEQ ID NO: 740390 - DNA, 20 bp, mouse
ggcgtcgcgagatgagggag

SEQ ID NO: 740391 - DNA, 20 bp, mouse
gaatcggaacgcggcgtcac

SEQ ID NO: 740392 - DNA, 20 bp, mouse
gtgaaaaacacgttaggcgg

SEQ ID NO: 740393 - DNA, 20 bp, mouse
gagggaaagcaaacagggta

SEQ ID NO: 740394 - DNA, 20 bp, mouse
gaagctgcgcgttcattggt

SEQ ID NO: 740395 - DNA, 20 bp, mouse
gtggcctggctgtataaacc

SEQ ID NO: 740396 - DNA, 20 bp, mouse
gaggccctacgaaggggtga

SEQ ID NO: 740397 - DNA, 20 bp, mouse
gtgtggggaggccctacgaa

SEQ ID NO: 740398 - DNA, 20 bp, mouse
gtcgagcgggaggggacgaa

SEQ ID NO: 740399 - DNA, 20 bp, mouse
gcgcgcgccggagaaggcca

SEQ ID NO: 740400 - DNA, 20 bp, mouse
ggacgagaagcatgccggga

SEQ ID NO: 740401 - DNA, 20 bp, mouse
gatgactagcggctgtgggg

SEQ ID NO: 740402 - DNA, 20 bp, mouse
gctgccctcaccccttcgta

SEQ ID NO: 740403 - DNA, 20 bp, mouse
ggcggtaaaagcgactaggt

SEQ ID NO: 740404 - DNA, 20 bp, mouse
gaccgctgaagcggggcgga

SEQ ID NO: 740405 - DNA, 20 bp, mouse
gagcgcgcgcacagccctcc

SEQ ID NO: 740406 - DNA, 20 bp, mouse
gggacggggcgcaggagctt

SEQ ID NO: 740407 - DNA, 20 bp, mouse
gcggaagagcgaaaggaaag

SEQ ID NO: 740408 - DNA, 20 bp, mouse
gggggcgcaggagcttggga

SEQ ID NO: 740409 - DNA, 20 bp, mouse
gtctggggcaggaaagggac

SEQ ID NO: 740410 - DNA, 20 bp, mouse
gcaaaagggacgatggagag

SEQ ID NO: 740411 - DNA, 20 bp, mouse
gaagccgggccctcagatcg

SEQ ID NO: 740412 - DNA, 20 bp, mouse
ggggaggggtcacgcgcgga

SEQ ID NO: 740413 - DNA, 20 bp, mouse
gggaggggaggggtcacgcg

SEQ ID NO: 740414 - DNA, 20 bp, mouse
gagcccggccggccaatcgg

SEQ ID NO: 740415 - DNA, 20 bp, mouse
gcgcaggagcttgggagggg

SEQ ID NO: 740416 - DNA, 20 bp, mouse
ggccactaaagatggcaatt

SEQ ID NO: 740417 - DNA, 20 bp, mouse
gagaacgcagccactaaaga

SEQ ID NO: 740418 - DNA, 20 bp, mouse
gatagacagccgaggctgga

SEQ ID NO: 740419 - DNA, 20 bp, mouse
gtggagggaagggggcgtga

SEQ ID NO: 740420 - DNA, 20 bp, mouse
gatatcccttggagggaagg

SEQ ID NO: 740421 - DNA, 20 bp, mouse
gtatcctgatatcccttgga

SEQ ID NO: 740422 - DNA, 20 bp, mouse
ggggatggaatagacagccg

SEQ ID NO: 740423 - DNA, 20 bp, mouse
ggggatatcaggataggggc

SEQ ID NO: 740424 - DNA, 20 bp, mouse
ggcagaaggggcagaacgat

SEQ ID NO: 740425 - DNA, 20 bp, mouse
gccctaattgccatctttag

SEQ ID NO: 740426 - DNA, 20 bp, mouse
ggacccagaggccatctcat

SEQ ID NO: 740427 - DNA, 20 bp, mouse
gcccccccacagaactcagc

SEQ ID NO: 740428 - DNA, 20 bp, mouse
gggctggaatcaggtctgtg

SEQ ID NO: 740429 - DNA, 20 bp, mouse
gcatggacattcagcatcga

SEQ ID NO: 740430 - DNA, 20 bp, mouse
gtgcacattgagaacacatg

SEQ ID NO: 740431 - DNA, 20 bp, mouse
gtgaacagggccgtgggaga

SEQ ID NO: 740432 - DNA, 20 bp, mouse
gagctggacatgagaatcac

SEQ ID NO: 740433 - DNA, 20 bp, mouse
gagagaaaggatgaatgaac

SEQ ID NO: 740434 - DNA, 20 bp, mouse
gatgtccagctgagttctgt

SEQ ID NO: 740435 - DNA, 20 bp, mouse
ggatgaatgaacagggccgt

SEQ ID NO: 740436 - DNA, 20 bp, mouse
ggccacgcggaacccccgat

SEQ ID NO: 740437 - DNA, 20 bp, mouse
gcggctgtgcgcggggagaa

SEQ ID NO: 740438 - DNA, 20 bp, mouse
gtgtgcgcggggagaagggt

SEQ ID NO: 740439 - DNA, 20 bp, mouse
gtagccgtccggccaatcgg

SEQ ID NO: 740440 - DNA, 20 bp, mouse
ggtgccgccgcggagaggtc

SEQ ID NO: 740441 - DNA, 20 bp, mouse
ggggcgtgcttattggtcga

SEQ ID NO: 740442 - DNA, 20 bp, mouse
ggaacccccgattggccgga

SEQ ID NO: 740443 - DNA, 20 bp, mouse
gcaccgcgctgcccagcgat

SEQ ID NO: 740444 - DNA, 20 bp, mouse
ggctgggcgggcagcgggat

SEQ ID NO: 740445 - DNA, 20 bp, mouse
gcccttcaacgctagccgtc

SEQ ID NO: 740446 - DNA, 20 bp, mouse
gaactctgtaggtgactaga

SEQ ID NO: 740447 - DNA, 20 bp, mouse
gcaggactcaatggtgaagg

SEQ ID NO: 740448 - DNA, 20 bp, mouse
gcagcaggactcaatggtga

SEQ ID NO: 740449 - DNA, 20 bp, mouse
gactagatggacagcacaca

SEQ ID NO: 740450 - DNA, 20 bp, mouse
gggatggaaaggaacctgat

SEQ ID NO: 740451 - DNA, 20 bp, mouse
gcagggaggaaattacgtgg

SEQ ID NO: 740452 - DNA, 20 bp, mouse
gacacagggaggaaattacg

SEQ ID NO: 740453 - DNA, 20 bp, mouse
ggcctggaaactctggcacc

SEQ ID NO: 740454 - DNA, 20 bp, mouse
gacgtggtggaatgttacct

SEQ ID NO: 740455 - DNA, 20 bp, mouse
gacactatgagacaactggt

SEQ ID NO: 740456 - DNA, 20 bp, mouse
ggccttccaggatttgagat

SEQ ID NO: 740457 - DNA, 20 bp, mouse
gggggaatggaggcgtctct

SEQ ID NO: 740458 - DNA, 20 bp, mouse
gctctccatagctccgaaat

SEQ ID NO: 740459 - DNA, 20 bp, mouse
gccccatctcaaatcctgga

SEQ ID NO: 740460 - DNA, 20 bp, mouse
gctagtggaggtttcctgac

SEQ ID NO: 740461 - DNA, 20 bp, mouse
gctctgaaagcagtgtgtaa

SEQ ID NO: 740462 - DNA, 20 bp, mouse
gagtgtctcctgcagaccga

SEQ ID NO: 740463 - DNA, 20 bp, mouse
gcatagctccgaaatgggca

SEQ ID NO: 740464 - DNA, 20 bp, mouse
ggcagaagggcaattttgtc

SEQ ID NO: 740465 - DNA, 20 bp, mouse
gtgtctgggccgcccagtca

SEQ ID NO: 740466 - DNA, 20 bp, mouse
gcgcgagggtggtgccgaga

SEQ ID NO: 740467 - DNA, 20 bp, mouse
gcccgggtcggggtccgcgt

SEQ ID NO: 740468 - DNA, 20 bp, mouse
ggagcccaggagagcgaggg

SEQ ID NO: 740469 - DNA, 20 bp, mouse
ggggaagcggcggccaggac

SEQ ID NO: 740470 - DNA, 20 bp, mouse
ggagcaccgagcgcatcgat

SEQ ID NO: 740471 - DNA, 20 bp, mouse
gcctcccgcgcgcgcggccg

SEQ ID NO: 740472 - DNA, 20 bp, mouse
gcccccgcccgggcccgtcc

SEQ ID NO: 740473 - DNA, 20 bp, mouse
gggagcgccagccccgggtc

SEQ ID NO: 740474 - DNA, 20 bp, mouse
gtcctgggctcccagcgctg

SEQ ID NO: 740475 - DNA, 20 bp, mouse
gcggcggccaggacgggccc

SEQ ID NO: 740476 - DNA, 20 bp, mouse
gcggatgctaaagagaacgg

SEQ ID NO: 740477 - DNA, 20 bp, mouse
gcgcaagccgcaagctcgac

SEQ ID NO: 740478 - DNA, 20 bp, mouse
gctaacctggcacctgtaca

SEQ ID NO: 740479 - DNA, 20 bp, mouse
gcgccggatgctaaagagaa

SEQ ID NO: 740480 - DNA, 20 bp, mouse
gaggcgggtgcctgaacctg

SEQ ID NO: 740481 - DNA, 20 bp, mouse
ggggcgcactcagaaagcgc

SEQ ID NO: 740482 - DNA, 20 bp, mouse
gtgcctggggcgtggcttca

SEQ ID NO: 740483 - DNA, 20 bp, mouse
ggtaactaaccagtgccagg

SEQ ID NO: 740484 - DNA, 20 bp, mouse
gttgcggcttgcgcatgctc

SEQ ID NO: 740485 - DNA, 20 bp, mouse
gtcaggcacccgcctggcac

SEQ ID NO: 740486 - DNA, 20 bp, mouse
ggggctagaaaatttcccga

SEQ ID NO: 740487 - DNA, 20 bp, mouse
gtccgtgtgggtaggagctt

SEQ ID NO: 740488 - DNA, 20 bp, mouse
ggcggagcacacatggaggg

SEQ ID NO: 740489 - DNA, 20 bp, mouse
gtagtccgaaatggcgggaa

SEQ ID NO: 740490 - DNA, 20 bp, mouse
gggggcggagcacacatgga

SEQ ID NO: 740491 - DNA, 20 bp, mouse
gcccgccatttcggactaac

SEQ ID NO: 740492 - DNA, 20 bp, mouse
gtaaccggctctgtccgtgt

SEQ ID NO: 740493 - DNA, 20 bp, mouse
gcggctctgtccgtgtgggt

SEQ ID NO: 740494 - DNA, 20 bp, mouse
gaagctgagttcgacttctg

SEQ ID NO: 740495 - DNA, 20 bp, mouse
ggcagggcggccgagccctc

SEQ ID NO: 740496 - DNA, 20 bp, mouse
gaatccgggcggtgctgagg

SEQ ID NO: 740497 - DNA, 20 bp, mouse
gaggcgtcaggcaatccggg

SEQ ID NO: 740498 - DNA, 20 bp, mouse
ggtgtggagtctacaggtga

SEQ ID NO: 740499 - DNA, 20 bp, mouse
gcggcctgccactcacgcgc

SEQ ID NO: 740500 - DNA, 20 bp, mouse
ggacggggcggcgctgagga

SEQ ID NO: 740501 - DNA, 20 bp, mouse
gggggcgggccgggcggcga

SEQ ID NO: 740502 - DNA, 20 bp, mouse
gcctctgagtccccacgctg

SEQ ID NO: 740503 - DNA, 20 bp, mouse
ggctcccgcgcgtgagtggc

SEQ ID NO: 740504 - DNA, 20 bp, mouse
gggcgcggtgaggccacccg

SEQ ID NO: 740505 - DNA, 20 bp, mouse
ggcgggctcccgcgcgtgag

SEQ ID NO: 740506 - DNA, 20 bp, mouse
ggacccggggagggagatgg

SEQ ID NO: 740507 - DNA, 20 bp, mouse
gagcaggcccaggcaagcgt

SEQ ID NO: 740508 - DNA, 20 bp, mouse
gagcctgggctggggtccta

SEQ ID NO: 740509 - DNA, 20 bp, mouse
gcaggtgcgtgggagggcgg

SEQ ID NO: 740510 - DNA, 20 bp, mouse
gggcagcactgggagatcag

SEQ ID NO: 740511 - DNA, 20 bp, mouse
gaaggggtctggacagggta

SEQ ID NO: 740512 - DNA, 20 bp, mouse
gactgggagatcagaggact

SEQ ID NO: 740513 - DNA, 20 bp, mouse
ggcaaggctccggagagcct

SEQ ID NO: 740514 - DNA, 20 bp, mouse
gcagaggactcggaggagtc

SEQ ID NO: 740515 - DNA, 20 bp, mouse
gcggaggagtcgggctcagg

SEQ ID NO: 740516 - DNA, 20 bp, mouse
gtgggtgccgggagccgtca

SEQ ID NO: 740517 - DNA, 20 bp, mouse
gcggtcgggtgctgtcggaa

SEQ ID NO: 740518 - DNA, 20 bp, mouse
gaggcttgtcccggtgggtg

SEQ ID NO: 740519 - DNA, 20 bp, mouse
gctacgggatcctggaagaa

SEQ ID NO: 740520 - DNA, 20 bp, mouse
ggacaagcctctgcggggaa

SEQ ID NO: 740521 - DNA, 20 bp, mouse
gccgcagaggcttgtcccgg

SEQ ID NO: 740522 - DNA, 20 bp, mouse
gcaaccgcccctccggggtg

SEQ ID NO: 740523 - DNA, 20 bp, mouse
gcgggatcctggaagaacgg

SEQ ID NO: 740524 - DNA, 20 bp, mouse
gttgtggcctttccccgcag

SEQ ID NO: 740525 - DNA, 20 bp, mouse
ggggcccccagatgtcagct

SEQ ID NO: 740526 - DNA, 20 bp, mouse
gctagctatagcaaggacgg

SEQ ID NO: 740527 - DNA, 20 bp, mouse
ggaagggaggtcggcctccg

SEQ ID NO: 740528 - DNA, 20 bp, mouse
ggctctcaggctatggagga

SEQ ID NO: 740529 - DNA, 20 bp, mouse
gcgtgcgcacgcagccgcgg

SEQ ID NO: 740530 - DNA, 20 bp, mouse
ggcgcgcagcgggagaagat

SEQ ID NO: 740531 - DNA, 20 bp, mouse
gcgccgccgctctcaggcta

SEQ ID NO: 740532 - DNA, 20 bp, mouse
ggccgcagctgtctgggagc

SEQ ID NO: 740533 - DNA, 20 bp, mouse
gcccgacgctagctatagca

SEQ ID NO: 740534 - DNA, 20 bp, mouse
gacgaacggcggctccccgc

SEQ ID NO: 740535 - DNA, 20 bp, mouse
ggtgagctcgcggggtttgg

SEQ ID NO: 740536 - DNA, 20 bp, mouse
ggaacaggaagccgatgggg

SEQ ID NO: 740537 - DNA, 20 bp, mouse
ggacgaacaggaagccgatg

SEQ ID NO: 740538 - DNA, 20 bp, mouse
gaagccgatggggcggggac

SEQ ID NO: 740539 - DNA, 20 bp, mouse
gcgaggttgcaatgcatcct

SEQ ID NO: 740540 - DNA, 20 bp, mouse
gagaccacgcaggtctcata

SEQ ID NO: 740541 - DNA, 20 bp, mouse
gggtctctgctctgacgaac

SEQ ID NO: 740542 - DNA, 20 bp, mouse
gggaacttcttttttgagag

SEQ ID NO: 740543 - DNA, 20 bp, mouse
gaacctcggtgttgcacgct

SEQ ID NO: 740544 - DNA, 20 bp, mouse
gaggtctcatagggattatc

SEQ ID NO: 740545 - DNA, 20 bp, mouse
gtcaaaaaagaagttcccac

SEQ ID NO: 740546 - DNA, 20 bp, mouse
gcatgtgagcccatgagctg

SEQ ID NO: 740547 - DNA, 20 bp, mouse
gagagcccatcctgggagct

SEQ ID NO: 740548 - DNA, 20 bp, mouse
ggcaaagcctgcaaagggtt

SEQ ID NO: 740549 - DNA, 20 bp, mouse
gcagacaagaatggctcgtg

SEQ ID NO: 740550 - DNA, 20 bp, mouse
gtacagctcgacagtgctgg

SEQ ID NO: 740551 - DNA, 20 bp, mouse
gaataccctagtgagtgtgt

SEQ ID NO: 740552 - DNA, 20 bp, mouse
ggctgtaatccccagctcat

SEQ ID NO: 740553 - DNA, 20 bp, mouse
ggagatgcaaagcctgcaaa

SEQ ID NO: 740554 - DNA, 20 bp, mouse
ggacccccacactgacttct

SEQ ID NO: 740555 - DNA, 20 bp, mouse
gcatgcccacacactcacta

SEQ ID NO: 740556 - DNA, 20 bp, mouse
gctgagagggcgtgtctcac

SEQ ID NO: 740557 - DNA, 20 bp, mouse
gacgccctctcagtatataa

SEQ ID NO: 740558 - DNA, 20 bp, mouse
ggagcctttatatactgaga

SEQ ID NO: 740559 - DNA, 20 bp, mouse
gctatgttgaaactgagaat

SEQ ID NO: 740560 - DNA, 20 bp, mouse
gaatttcccatctgtactca

SEQ ID NO: 740561 - DNA, 20 bp, mouse
gtaagccaaagatgctatgc

SEQ ID NO: 740562 - DNA, 20 bp, mouse
gtttgccagcatagcatctt

SEQ ID NO: 740563 - DNA, 20 bp, mouse
gaaaagcattgaaaaggtat

SEQ ID NO: 740564 - DNA, 20 bp, mouse
gctgaaattgagctgtaaga

SEQ ID NO: 740565 - DNA, 20 bp, mouse
gcttgtacttagtacttgct

SEQ ID NO: 740566 - DNA, 20 bp, mouse
ggagctggccaactgggtgt

SEQ ID NO: 740567 - DNA, 20 bp, mouse
gtggccaactgggtgtgggt

SEQ ID NO: 740568 - DNA, 20 bp, mouse
ggagcagataggctgtcgta

SEQ ID NO: 740569 - DNA, 20 bp, mouse
gacaccagaagagtgacgac

SEQ ID NO: 740570 - DNA, 20 bp, mouse
gaaccgaaagaaatagacag

SEQ ID NO: 740571 - DNA, 20 bp, mouse
gacagagcttcaggaagcat

SEQ ID NO: 740572 - DNA, 20 bp, mouse
gatgcccacccacacccagt

SEQ ID NO: 740573 - DNA, 20 bp, mouse
gggaagcatggggcttcgga

SEQ ID NO: 740574 - DNA, 20 bp, mouse
gcccacctcccagcctataa

SEQ ID NO: 740575 - DNA, 20 bp, mouse
ggctccagtcgtcactcttc

SEQ ID NO: 740576 - DNA, 20 bp, mouse
gctagagagtagaggtaact

SEQ ID NO: 740577 - DNA, 20 bp, mouse
gggcatcaggtcagagggtg

SEQ ID NO: 740578 - DNA, 20 bp, mouse
gtagaggtaactgggcttgt

SEQ ID NO: 740579 - DNA, 20 bp, mouse
gaacagggactgaaccacaa

SEQ ID NO: 740580 - DNA, 20 bp, mouse
gacagctggcatcaggtcag

SEQ ID NO: 740581 - DNA, 20 bp, mouse
gaacccaccctagagagtag

SEQ ID NO: 740582 - DNA, 20 bp, mouse
gagaggatgtcccacccctg

SEQ ID NO: 740583 - DNA, 20 bp, mouse
gtggaacttcttaactggaa

SEQ ID NO: 740584 - DNA, 20 bp, mouse
gtacctctactctctagggt

SEQ ID NO: 740585 - DNA, 20 bp, mouse
gccctgcccagtattagaac

SEQ ID NO: 740586 - DNA, 20 bp, mouse
ggacagacatgatgaggcgg

SEQ ID NO: 740587 - DNA, 20 bp, mouse
gaggcatgattcaccagggg

SEQ ID NO: 740588 - DNA, 20 bp, mouse
gccagagtgtgggttcctaa

SEQ ID NO: 740589 - DNA, 20 bp, mouse
ggattcaccaggggaggggt

SEQ ID NO: 740590 - DNA, 20 bp, mouse
gtatgacagacatgatgagg

SEQ ID NO: 740591 - DNA, 20 bp, mouse
gccgccaggcatgattcacc

SEQ ID NO: 740592 - DNA, 20 bp, mouse
gtgtgggttcctaagggctg

SEQ ID NO: 740593 - DNA, 20 bp, mouse
gggagaggagggatctgatc

SEQ ID NO: 740594 - DNA, 20 bp, mouse
ggactctcccacccatttaa

SEQ ID NO: 740595 - DNA, 20 bp, mouse
gcctgggagccacagccctt

SEQ ID NO: 740596 - DNA, 20 bp, mouse
gacagaaggatctctgaagc

SEQ ID NO: 740597 - DNA, 20 bp, mouse
ggcccaggggattagaaaag

SEQ ID NO: 740598 - DNA, 20 bp, mouse
gcccatggggcatggaccaa

SEQ ID NO: 740599 - DNA, 20 bp, mouse
gtacgggtcttgatagttgt

SEQ ID NO: 740600 - DNA, 20 bp, mouse
gctgaagctggctggaattc

SEQ ID NO: 740601 - DNA, 20 bp, mouse
gataagttacggaaattaga

SEQ ID NO: 740602 - DNA, 20 bp, mouse
gagctccgccaggctccctc

SEQ ID NO: 740603 - DNA, 20 bp, mouse
gtggtgccaaggttcatggg

SEQ ID NO: 740604 - DNA, 20 bp, mouse
ggccaagcaggtttaacagg

SEQ ID NO: 740605 - DNA, 20 bp, mouse
gagcttgttagtctgggctg

SEQ ID NO: 740606 - DNA, 20 bp, mouse
gggcccccaccccctctgaa

SEQ ID NO: 740607 - DNA, 20 bp, mouse
gcccacaagctgtcagtggg

SEQ ID NO: 740608 - DNA, 20 bp, mouse
gaggcccacaagctgtcagt

SEQ ID NO: 740609 - DNA, 20 bp, mouse
gaggagttggctccgctcaa

SEQ ID NO: 740610 - DNA, 20 bp, mouse
gtccacagaactcacttgta

SEQ ID NO: 740611 - DNA, 20 bp, mouse
ggggggcctagctgctctaa

SEQ ID NO: 740612 - DNA, 20 bp, mouse
gcaccatagcacactttctg

SEQ ID NO: 740613 - DNA, 20 bp, mouse
gaacccttcagagggggtgg

SEQ ID NO: 740614 - DNA, 20 bp, mouse
gcctagctgctctaacggga

SEQ ID NO: 740615 - DNA, 20 bp, mouse
ggcagggagctacctaccta

SEQ ID NO: 740616 - DNA, 20 bp, mouse
gagttcctgcccagatctgt

SEQ ID NO: 740617 - DNA, 20 bp, mouse
ggaagagagagagtccaccc

SEQ ID NO: 740618 - DNA, 20 bp, mouse
gggccccacacccacagatc

SEQ ID NO: 740619 - DNA, 20 bp, mouse
ggggctgaacaacccagaat

SEQ ID NO: 740620 - DNA, 20 bp, mouse
gacgttgtgtagtcagaaat

SEQ ID NO: 740621 - DNA, 20 bp, mouse
gctgactgaggaaatcccca

SEQ ID NO: 740622 - DNA, 20 bp, mouse
gctgtctaacaccctattct

SEQ ID NO: 740623 - DNA, 20 bp, mouse
gaactggagtcagcagttgg

SEQ ID NO: 740624 - DNA, 20 bp, mouse
gcagaggttgcctgcaccta

SEQ ID NO: 740625 - DNA, 20 bp, mouse
gctctggcaggcgcgtcctc

SEQ ID NO: 740626 - DNA, 20 bp, mouse
ggaccatgatacccaggaca

SEQ ID NO: 740627 - DNA, 20 bp, mouse
gacacccgccagctcccagg

SEQ ID NO: 740628 - DNA, 20 bp, mouse
gggagctggcgggtgtccag

SEQ ID NO: 740629 - DNA, 20 bp, mouse
ggggtggcagctgcctggga

SEQ ID NO: 740630 - DNA, 20 bp, mouse
gcccactggctgccctataa

SEQ ID NO: 740631 - DNA, 20 bp, mouse
gaggggtgatgaaagcccag

SEQ ID NO: 740632 - DNA, 20 bp, mouse
gtgggcgtagcgattacaac

SEQ ID NO: 740633 - DNA, 20 bp, mouse
gaaccctgtcctgggtatca

SEQ ID NO: 740634 - DNA, 20 bp, mouse
gccagctcccaggtggctat

SEQ ID NO: 740635 - DNA, 20 bp, mouse
gtgcctgaatcacaggtgac

SEQ ID NO: 740636 - DNA, 20 bp, mouse
gacagggagtggataactaa

SEQ ID NO: 740637 - DNA, 20 bp, mouse
gctgagggcgtgtgcagaag

SEQ ID NO: 740638 - DNA, 20 bp, mouse
gtgccatcctcaccgacaca

SEQ ID NO: 740639 - DNA, 20 bp, mouse
gacagaagaggggttcacta

SEQ ID NO: 740640 - DNA, 20 bp, mouse
gataactaaggggtgcacaa

SEQ ID NO: 740641 - DNA, 20 bp, mouse
gagaagggctgcgacctgtt

SEQ ID NO: 740642 - DNA, 20 bp, mouse
ggggattcctgtgacctaac

SEQ ID NO: 740643 - DNA, 20 bp, mouse
gctgcgacctgttaggtcac

SEQ ID NO: 740644 - DNA, 20 bp, mouse
gtccactccctgtgtcggtg

SEQ ID NO: 740645 - DNA, 20 bp, mouse
gccaccacgcccggaataaa

SEQ ID NO: 740646 - DNA, 20 bp, mouse
ggggctgaagggccagaaaa

SEQ ID NO: 740647 - DNA, 20 bp, mouse
gggctggggcggggcagctc

SEQ ID NO: 740648 - DNA, 20 bp, mouse
gttggcagtagctttggagt

SEQ ID NO: 740649 - DNA, 20 bp, mouse
gtgtgtagtaaggggctgaa

SEQ ID NO: 740650 - DNA, 20 bp, mouse
ggacatgttggcagtagctt

SEQ ID NO: 740651 - DNA, 20 bp, mouse
gcactgagttggggctcaga

SEQ ID NO: 740652 - DNA, 20 bp, mouse
gtcagagtaagtcactgagt

SEQ ID NO: 740653 - DNA, 20 bp, mouse
gtgtctaagcctgtgtagta

SEQ ID NO: 740654 - DNA, 20 bp, mouse
gatcgccaggaattgaccaa

SEQ ID NO: 740655 - DNA, 20 bp, mouse
ggaaaagggacgtgacatgt

SEQ ID NO: 740656 - DNA, 20 bp, mouse
gtgtgggcccacttacgcat

SEQ ID NO: 740657 - DNA, 20 bp, mouse
gctagcttgccagggaacgg

SEQ ID NO: 740658 - DNA, 20 bp, mouse
gcgcaaatcaaagcaggttc

SEQ ID NO: 740659 - DNA, 20 bp, mouse
gagaagaggagattagtctt

SEQ ID NO: 740660 - DNA, 20 bp, mouse
gcatgggtcggtccataaca

SEQ ID NO: 740661 - DNA, 20 bp, mouse
ggtggtggccagcttcccat

SEQ ID NO: 740662 - DNA, 20 bp, mouse
gaagccagacctccgttccc

SEQ ID NO: 740663 - DNA, 20 bp, mouse
gccaccacccaggcctgtgt

SEQ ID NO: 740664 - DNA, 20 bp, mouse
gggtccctccaccatagtca

SEQ ID NO: 740665 - DNA, 20 bp, mouse
gctagatgggaagcccacac

SEQ ID NO: 740666 - DNA, 20 bp, mouse
gtgcctctggtagaaatttc

SEQ ID NO: 740667 - DNA, 20 bp, mouse
gtaccagaggcactttttaa

SEQ ID NO: 740668 - DNA, 20 bp, mouse
gtattgccgtacaaaagagg

SEQ ID NO: 740669 - DNA, 20 bp, mouse
ggaaatgtcttgagtgaagc

SEQ ID NO: 740670 - DNA, 20 bp, mouse
gagagataacaaaaaggacg

SEQ ID NO: 740671 - DNA, 20 bp, mouse
gctggtagaaatttctggaa

SEQ ID NO: 740672 - DNA, 20 bp, mouse
gtctgctgccgtgtcacctc

SEQ ID NO: 740673 - DNA, 20 bp, mouse
ggaggaaggggtgtcctttc

SEQ ID NO: 740674 - DNA, 20 bp, mouse
ggtggactgtgtcattcctg

SEQ ID NO: 740675 - DNA, 20 bp, mouse
gtttttaaaggctttcctgt

SEQ ID NO: 740676 - DNA, 20 bp, mouse
ggaagccgggggaaactcca

SEQ ID NO: 740677 - DNA, 20 bp, mouse
gttcccccaccagaagccgg

SEQ ID NO: 740678 - DNA, 20 bp, mouse
gacccacagggtcactgcaa

SEQ ID NO: 740679 - DNA, 20 bp, mouse
gtctgctgtatcaacaacaa

SEQ ID NO: 740680 - DNA, 20 bp, mouse
gagggcaggctctgccgcag

SEQ ID NO: 740681 - DNA, 20 bp, mouse
gcaacaacaatgggcgggaa

SEQ ID NO: 740682 - DNA, 20 bp, mouse
ggtagttagccagtcacagt

SEQ ID NO: 740683 - DNA, 20 bp, mouse
gtatgcctgcccactgtgac

SEQ ID NO: 740684 - DNA, 20 bp, mouse
ggaggaaaatgacacccaca

SEQ ID NO: 740685 - DNA, 20 bp, mouse
gctgtatcaacaacaatggg

SEQ ID NO: 740686 - DNA, 20 bp, mouse
gcctcccagtggtaacccgg

SEQ ID NO: 740687 - DNA, 20 bp, mouse
gcacgcctccgggttaccac

SEQ ID NO: 740688 - DNA, 20 bp, mouse
gctgggagggaggtggtaac

SEQ ID NO: 740689 - DNA, 20 bp, mouse
gctccctcccagtggtaacc

SEQ ID NO: 740690 - DNA, 20 bp, mouse
gaggcgtggcccaggccacc

SEQ ID NO: 740691 - DNA, 20 bp, mouse
ggcagagtgtgttggcccag

SEQ ID NO: 740692 - DNA, 20 bp, mouse
gtcaatccggaggtgcccct

SEQ ID NO: 740693 - DNA, 20 bp, mouse
gcacaatgataggatcttgt

SEQ ID NO: 740694 - DNA, 20 bp, mouse
gtaacccggaggcgtggccc

SEQ ID NO: 740695 - DNA, 20 bp, mouse
gctgagatctgctacccacc

SEQ ID NO: 740696 - DNA, 20 bp, mouse
gctactggctcttttttatg

SEQ ID NO: 740697 - DNA, 20 bp, mouse
gagccagtagagtaggttcg

SEQ ID NO: 740698 - DNA, 20 bp, mouse
gaggatgtgctctgccatcg

SEQ ID NO: 740699 - DNA, 20 bp, mouse
ggagaaaaggaacaccctat

SEQ ID NO: 740700 - DNA, 20 bp, mouse
gtgtcccatggtttccccga

SEQ ID NO: 740701 - DNA, 20 bp, mouse
gttccacgaacctactctac

SEQ ID NO: 740702 - DNA, 20 bp, mouse
gaaaccctcagtgtggtgac

SEQ ID NO: 740703 - DNA, 20 bp, mouse
gctgccatcggggaaaccat

SEQ ID NO: 740704 - DNA, 20 bp, mouse
gggctcttttttatgaggct

SEQ ID NO: 740705 - DNA, 20 bp, mouse
gagaccaaaagataaccggt

SEQ ID NO: 740706 - DNA, 20 bp, mouse
ggcggctccatcatggagaa

SEQ ID NO: 740707 - DNA, 20 bp, mouse
gaacgcttgcggctccatca

SEQ ID NO: 740708 - DNA, 20 bp, mouse
gatccgggtggagcaatgtc

SEQ ID NO: 740709 - DNA, 20 bp, mouse
gcaattacgttaacttgctg

SEQ ID NO: 740710 - DNA, 20 bp, mouse
gccgcaagcgttatctgctt

SEQ ID NO: 740711 - DNA, 20 bp, mouse
gtcagataaacactaaccta

SEQ ID NO: 740712 - DNA, 20 bp, mouse
gtctgagaaatggatccggg

SEQ ID NO: 740713 - DNA, 20 bp, mouse
gagcctgacattgctccacc

SEQ ID NO: 740714 - DNA, 20 bp, mouse
gcctcatcacagttcccgat

SEQ ID NO: 740715 - DNA, 20 bp, mouse
ggaagtaaccgatgactcac

SEQ ID NO: 740716 - DNA, 20 bp, mouse
gcacggggcgacaacttcac

SEQ ID NO: 740717 - DNA, 20 bp, mouse
ggggagcgctaagtaaatta

SEQ ID NO: 740718 - DNA, 20 bp, mouse
gtaggtggcaaggagccccg

SEQ ID NO: 740719 - DNA, 20 bp, mouse
gtagtgttactaacactgtg

SEQ ID NO: 740720 - DNA, 20 bp, mouse
gcactgtgaggctatgaatt

SEQ ID NO: 740721 - DNA, 20 bp, mouse
gttacaagggtgagtgtggg

SEQ ID NO: 740722 - DNA, 20 bp, mouse
gttgtctccacccttttcca

SEQ ID NO: 740723 - DNA, 20 bp, mouse
gttgttacaagggtgagtgt

SEQ ID NO: 740724 - DNA, 20 bp, mouse
gccttttgacccctggaaaa

SEQ ID NO: 740725 - DNA, 20 bp, mouse
ggaattaggatcactgtccc

SEQ ID NO: 740726 - DNA, 20 bp, mouse
gctgctgcgtccacttccgt

SEQ ID NO: 740727 - DNA, 20 bp, mouse
ggcgtaaagacattcattag

SEQ ID NO: 740728 - DNA, 20 bp, mouse
gccagagataacaaacatca

SEQ ID NO: 740729 - DNA, 20 bp, mouse
gcaaggtaactatccaccta

SEQ ID NO: 740730 - DNA, 20 bp, mouse
ggggaaaatgtcacccactt

SEQ ID NO: 740731 - DNA, 20 bp, mouse
gctgcgtccacttccgtagg

SEQ ID NO: 740732 - DNA, 20 bp, mouse
ggcagggtggagtgttatca

SEQ ID NO: 740733 - DNA, 20 bp, mouse
gtatactgctgaggcctaga

SEQ ID NO: 740734 - DNA, 20 bp, mouse
gtgttatcaaggttattata

SEQ ID NO: 740735 - DNA, 20 bp, mouse
gaactatccacctacggaag

SEQ ID NO: 740736 - DNA, 20 bp, mouse
gatcctgaagcgatgagggg

SEQ ID NO: 740737 - DNA, 20 bp, mouse
gggggctaatccagtgtcaa

SEQ ID NO: 740738 - DNA, 20 bp, mouse
gggtctctagatgaaagaaa

SEQ ID NO: 740739 - DNA, 20 bp, mouse
gtgttatcgtacataaagtc

SEQ ID NO: 740740 - DNA, 20 bp, mouse
gtgaacacactgtcattatc

SEQ ID NO: 740741 - DNA, 20 bp, mouse
gaatatcctgaagcgatgag

SEQ ID NO: 740742 - DNA, 20 bp, mouse
gactgtcattatctggtcca

SEQ ID NO: 740743 - DNA, 20 bp, mouse
gacacggtttttgttctcat

SEQ ID NO: 740744 - DNA, 20 bp, mouse
ggcatgaaatgatgcataat

SEQ ID NO: 740745 - DNA, 20 bp, mouse
gggggctgtctcgagttgag

SEQ ID NO: 740746 - DNA, 20 bp, mouse
ggggaccagggactcttctg

SEQ ID NO: 740747 - DNA, 20 bp, mouse
ggaccaacacccaactgacc

SEQ ID NO: 740748 - DNA, 20 bp, mouse
gtgtccacaccctctgtaga

SEQ ID NO: 740749 - DNA, 20 bp, mouse
gggcccagccctggtcagtt

SEQ ID NO: 740750 - DNA, 20 bp, mouse
gaagtcacatggcccagccc

SEQ ID NO: 740751 - DNA, 20 bp, mouse
gctgcagaactctgtttcat

SEQ ID NO: 740752 - DNA, 20 bp, mouse
gtctctcaggatagggcatt

SEQ ID NO: 740753 - DNA, 20 bp, mouse
gtaacacaaaagaatgtcac

SEQ ID NO: 740754 - DNA, 20 bp, mouse
gcacccaactgaccagggct

SEQ ID NO: 740755 - DNA, 20 bp, mouse
ggccatgtgacttctttgaa

SEQ ID NO: 740756 - DNA, 20 bp, mouse
ggtaatgagggcccaggtgt

SEQ ID NO: 740757 - DNA, 20 bp, mouse
gcccgcctgcacctgcccta

SEQ ID NO: 740758 - DNA, 20 bp, mouse
gtgtcttgatgctctccccc

SEQ ID NO: 740759 - DNA, 20 bp, mouse
gaggctgcaagcctgcagaa

SEQ ID NO: 740760 - DNA, 20 bp, mouse
gcatcaagacacatcttcaa

SEQ ID NO: 740761 - DNA, 20 bp, mouse
gacctgggccctcattacca

SEQ ID NO: 740762 - DNA, 20 bp, mouse
gttggctaaagcaggactct

SEQ ID NO: 740763 - DNA, 20 bp, mouse
ggtgcagtgggcaaggtccg

SEQ ID NO: 740764 - DNA, 20 bp, mouse
ggaggaaaggaactccttat

SEQ ID NO: 740765 - DNA, 20 bp, mouse
gctgccacaccctggtaatg

SEQ ID NO: 740766 - DNA, 20 bp, mouse
gggcaaggagtcccgactga

SEQ ID NO: 740767 - DNA, 20 bp, mouse
ggaagcagagcaaatgaatg

SEQ ID NO: 740768 - DNA, 20 bp, mouse
ggaggtaagggagtcttctg

SEQ ID NO: 740769 - DNA, 20 bp, mouse
ggactcccttacctcataaa

SEQ ID NO: 740770 - DNA, 20 bp, mouse
gtggctcactcaagtgtcag

SEQ ID NO: 740771 - DNA, 20 bp, mouse
gcttggtggtatgacttcaa

SEQ ID NO: 740772 - DNA, 20 bp, mouse
gtatacgtccccacccaatt

SEQ ID NO: 740773 - DNA, 20 bp, mouse
gggcccaaccttcattaata

SEQ ID NO: 740774 - DNA, 20 bp, mouse
gctcataaaaggctttactt

SEQ ID NO: 740775 - DNA, 20 bp, mouse
gaatagggtgtggtaggtca

SEQ ID NO: 740776 - DNA, 20 bp, mouse
gctaaccagcatgattggtg

SEQ ID NO: 740777 - DNA, 20 bp, mouse
gctgaactaaccagcatgat

SEQ ID NO: 740778 - DNA, 20 bp, mouse
gctaaaggactcatgcgagg

SEQ ID NO: 740779 - DNA, 20 bp, mouse
ggactcctcaccaatcatgc

SEQ ID NO: 740780 - DNA, 20 bp, mouse
gtgaggagtcctgacatagc

SEQ ID NO: 740781 - DNA, 20 bp, mouse
gactgccataccatccaagt

SEQ ID NO: 740782 - DNA, 20 bp, mouse
gcatcccagtgaggagtcta

SEQ ID NO: 740783 - DNA, 20 bp, mouse
ggaggtggctaaataacaaa

SEQ ID NO: 740784 - DNA, 20 bp, mouse
gcagaagtgctcccagatct

SEQ ID NO: 740785 - DNA, 20 bp, mouse
gtagttcagaaagagcttca

SEQ ID NO: 740786 - DNA, 20 bp, mouse
gggctcaccccattactcag

SEQ ID NO: 740787 - DNA, 20 bp, mouse
ggtaatggggtgagccttat

SEQ ID NO: 740788 - DNA, 20 bp, mouse
gcaaccccacctaatgtcac

SEQ ID NO: 740789 - DNA, 20 bp, mouse
gtatccttccctctgagtaa

SEQ ID NO: 740790 - DNA, 20 bp, mouse
gtagcctgtgacattaggtg

SEQ ID NO: 740791 - DNA, 20 bp, mouse
gtaaatcagcagaacctccg

SEQ ID NO: 740792 - DNA, 20 bp, mouse
gcccataaaattattccatt

SEQ ID NO: 740793 - DNA, 20 bp, mouse
gataaaaagaccacgaagga

SEQ ID NO: 740794 - DNA, 20 bp, mouse
ggattcatcacagtcccata

SEQ ID NO: 740795 - DNA, 20 bp, mouse
gagcctccacccactggtat

SEQ ID NO: 740796 - DNA, 20 bp, mouse
gccccatagtcctacatcct

SEQ ID NO: 740797 - DNA, 20 bp, mouse
gagaagccccgttggacgag

SEQ ID NO: 740798 - DNA, 20 bp, mouse
ggaggccgggctatgttcac

SEQ ID NO: 740799 - DNA, 20 bp, mouse
gggctggagaaggcaagaca

SEQ ID NO: 740800 - DNA, 20 bp, mouse
gaggtctgggttctgatgac

SEQ ID NO: 740801 - DNA, 20 bp, mouse
gggggcccactcgtccaacg

SEQ ID NO: 740802 - DNA, 20 bp, mouse
gctgcactagctcttcaaag

SEQ ID NO: 740803 - DNA, 20 bp, mouse
gacccccggctgtccatcaa

SEQ ID NO: 740804 - DNA, 20 bp, mouse
gcgtaaaacagaagccccgt

SEQ ID NO: 740805 - DNA, 20 bp, mouse
ggtgcagactgggtcttccc

SEQ ID NO: 740806 - DNA, 20 bp, mouse
ggtctgctaggaaatgacga

SEQ ID NO: 740807 - DNA, 20 bp, mouse
gggtagaatggcttcctcag

SEQ ID NO: 740808 - DNA, 20 bp, mouse
gtggccttgcatatgacatt

SEQ ID NO: 740809 - DNA, 20 bp, mouse
gtcccagtttatgaggtctt

SEQ ID NO: 740810 - DNA, 20 bp, mouse
gcctcagggggaggcaggta

SEQ ID NO: 740811 - DNA, 20 bp, mouse
ggggagtgaaggattcacga

SEQ ID NO: 740812 - DNA, 20 bp, mouse
ggccactagagcaacgaaaa

SEQ ID NO: 740813 - DNA, 20 bp, mouse
gggctttctgggaccggaca

SEQ ID NO: 740814 - DNA, 20 bp, mouse
gtacaatcttcatggggtgt

SEQ ID NO: 740815 - DNA, 20 bp, mouse
gaggccactcccagtttatg

SEQ ID NO: 740816 - DNA, 20 bp, mouse
gccagtgcgaagctctggac

SEQ ID NO: 740817 - DNA, 20 bp, mouse
ggcaactgctacttgtcatc

SEQ ID NO: 740818 - DNA, 20 bp, mouse
gtgacaagtagcagttgcga

SEQ ID NO: 740819 - DNA, 20 bp, mouse
gggtgctgttaagagtgtgg

SEQ ID NO: 740820 - DNA, 20 bp, mouse
gctcacacctgcttaatgat

SEQ ID NO: 740821 - DNA, 20 bp, mouse
gaaacgtcagccagaaaggt

SEQ ID NO: 740822 - DNA, 20 bp, mouse
gattaatgaggagttcctgt

SEQ ID NO: 740823 - DNA, 20 bp, mouse
gttcgcactgggtcttcaaa

SEQ ID NO: 740824 - DNA, 20 bp, mouse
gatgggtgctgttaagagtg

SEQ ID NO: 740825 - DNA, 20 bp, mouse
ggtgtcaccacctggaagga

SEQ ID NO: 740826 - DNA, 20 bp, mouse
gggtctgtggcatgcaagta

SEQ ID NO: 740827 - DNA, 20 bp, mouse
gtcagcaggtgcaagagaga

SEQ ID NO: 740828 - DNA, 20 bp, mouse
gtgggctgggcctttggcaa

SEQ ID NO: 740829 - DNA, 20 bp, mouse
gcctagaaaagtcactggga

SEQ ID NO: 740830 - DNA, 20 bp, mouse
gcacacctagaaaagtcact

SEQ ID NO: 740831 - DNA, 20 bp, mouse
gttgcaagtctgagtcaggt

SEQ ID NO: 740832 - DNA, 20 bp, mouse
gtatatgcgctggagcagca

SEQ ID NO: 740833 - DNA, 20 bp, mouse
ggcaggagccccatgaggct

SEQ ID NO: 740834 - DNA, 20 bp, mouse
gaggtgggcagtgatacagg

SEQ ID NO: 740835 - DNA, 20 bp, mouse
ggtcaggtgggcagtgatac

SEQ ID NO: 740836 - DNA, 20 bp, mouse
ggtagcactagagaaaacat

SEQ ID NO: 740837 - DNA, 20 bp, mouse
gactgtggaaatggtcattg

SEQ ID NO: 740838 - DNA, 20 bp, mouse
gaagttttatgcctcgtaaa

SEQ ID NO: 740839 - DNA, 20 bp, mouse
gcctgtaaatacccatttga

SEQ ID NO: 740840 - DNA, 20 bp, mouse
gtccaagcagcatgtggaaa

SEQ ID NO: 740841 - DNA, 20 bp, mouse
gaagttatcctccttttacg

SEQ ID NO: 740842 - DNA, 20 bp, mouse
ggcttgcatggcataggaaa

SEQ ID NO: 740843 - DNA, 20 bp, mouse
gcattagtgttgattattta

SEQ ID NO: 740844 - DNA, 20 bp, mouse
gtcgagccatcagtaattat

SEQ ID NO: 740845 - DNA, 20 bp, mouse
gttatccttttgaacgaata

SEQ ID NO: 740846 - DNA, 20 bp, mouse
ggagggggcctcaggataca

SEQ ID NO: 740847 - DNA, 20 bp, mouse
gtaagaggtcacccatgctc

SEQ ID NO: 740848 - DNA, 20 bp, mouse
gatacaggggtgaattacac

SEQ ID NO: 740849 - DNA, 20 bp, mouse
ggccacccggcctgaggctt

SEQ ID NO: 740850 - DNA, 20 bp, mouse
gccagcccaagcctcaggcc

SEQ ID NO: 740851 - DNA, 20 bp, mouse
ggagctgtagccccaggcta

SEQ ID NO: 740852 - DNA, 20 bp, mouse
gcagccagccacccggcctg

SEQ ID NO: 740853 - DNA, 20 bp, mouse
gagacacaggagggggcctc

SEQ ID NO: 740854 - DNA, 20 bp, mouse
gggaagatcaccctagcctg

SEQ ID NO: 740855 - DNA, 20 bp, mouse
gcaggtccagcccaagcctc

SEQ ID NO: 740856 - DNA, 20 bp, mouse
gcacacctgcacagtggtgt

SEQ ID NO: 740857 - DNA, 20 bp, mouse
gacaccccacaccactgtgc

SEQ ID NO: 740858 - DNA, 20 bp, mouse
gacaccagctctgtaaggaa

SEQ ID NO: 740859 - DNA, 20 bp, mouse
gtcctggcagtgtgttgggg

SEQ ID NO: 740860 - DNA, 20 bp, mouse
gacccccccaacacactgcc

SEQ ID NO: 740861 - DNA, 20 bp, mouse
gtgtaaatgctgctcccagc

SEQ ID NO: 740862 - DNA, 20 bp, mouse
gacacacaaagcccagatct

SEQ ID NO: 740863 - DNA, 20 bp, mouse
gtcgagctgtgaatgattag

SEQ ID NO: 740864 - DNA, 20 bp, mouse
gggtgtcctggcagtgtgtt

SEQ ID NO: 740865 - DNA, 20 bp, mouse
gcataagggctatttgtctc

SEQ ID NO: 740866 - DNA, 20 bp, mouse
gcacacagggagtgtctaca

SEQ ID NO: 740867 - DNA, 20 bp, mouse
gtgtggtgagggggcacaca

SEQ ID NO: 740868 - DNA, 20 bp, mouse
ggggaaaacctgtgtggtga

SEQ ID NO: 740869 - DNA, 20 bp, mouse
gttgcagagtgggtagggca

SEQ ID NO: 740870 - DNA, 20 bp, mouse
ggggagagacttagtggctg

SEQ ID NO: 740871 - DNA, 20 bp, mouse
ggagacttagtggctgggga

SEQ ID NO: 740872 - DNA, 20 bp, mouse
ggagtgtctacatgggcaga

SEQ ID NO: 740873 - DNA, 20 bp, mouse
ggaatttgctccgtgactaa

SEQ ID NO: 740874 - DNA, 20 bp, mouse
gcagcaggcaatttccagaa

SEQ ID NO: 740875 - DNA, 20 bp, mouse
ggatacatgaagattgcttt

SEQ ID NO: 740876 - DNA, 20 bp, mouse
ggggctgggtcctgaaggtg

SEQ ID NO: 740877 - DNA, 20 bp, mouse
gtgggtctccagaagctcta

SEQ ID NO: 740878 - DNA, 20 bp, mouse
ggagcattttccctgactaa

SEQ ID NO: 740879 - DNA, 20 bp, mouse
gttgctgagtgggtcgggca

SEQ ID NO: 740880 - DNA, 20 bp, mouse
gttactgatcaagtcaaaac

SEQ ID NO: 740881 - DNA, 20 bp, mouse
gtgaggttgctgagtgggtc

SEQ ID NO: 740882 - DNA, 20 bp, mouse
gtgtgggcacagaacaacag

SEQ ID NO: 740883 - DNA, 20 bp, mouse
ggaaggtgaggttgctgagt

SEQ ID NO: 740884 - DNA, 20 bp, mouse
gctgatcaagtcaaaactgg

SEQ ID NO: 740885 - DNA, 20 bp, mouse
gtatatatggacatatgggc

SEQ ID NO: 740886 - DNA, 20 bp, mouse
ggacgaagagccttgggcgg

SEQ ID NO: 740887 - DNA, 20 bp, mouse
gaggtgtgggtgtctcacga

SEQ ID NO: 740888 - DNA, 20 bp, mouse
gcaaggctcttcgtccactc

SEQ ID NO: 740889 - DNA, 20 bp, mouse
ggggcagaaggcaggcggac

SEQ ID NO: 740890 - DNA, 20 bp, mouse
gagcgcacacaggtggggac

SEQ ID NO: 740891 - DNA, 20 bp, mouse
gcctgcagacacttcccgag

SEQ ID NO: 740892 - DNA, 20 bp, mouse
gggggcggtgcgagggcaga

SEQ ID NO: 740893 - DNA, 20 bp, mouse
ggtggacgaagagccttggg

SEQ ID NO: 740894 - DNA, 20 bp, mouse
gcagcctccgccccgcatgg

SEQ ID NO: 740895 - DNA, 20 bp, mouse
ggtgtctcacgacggcgtct

SEQ ID NO: 740896 - DNA, 20 bp, mouse
gatgggaggtgtggtgtcag

SEQ ID NO: 740897 - DNA, 20 bp, mouse
gggggcaggaatttgatggg

SEQ ID NO: 740898 - DNA, 20 bp, mouse
ggcagatgtggggtaggctc

SEQ ID NO: 740899 - DNA, 20 bp, mouse
gactgagtggcctctcaggt

SEQ ID NO: 740900 - DNA, 20 bp, mouse
gtgtgtgtgttgcctccacc

SEQ ID NO: 740901 - DNA, 20 bp, mouse
ggcctccacctggcactgag

SEQ ID NO: 740902 - DNA, 20 bp, mouse
ggccactcagtgccaggtgg

SEQ ID NO: 740903 - DNA, 20 bp, mouse
gtgagaggccactcagtgcc

SEQ ID NO: 740904 - DNA, 20 bp, mouse
gcctgtgtgtggtggttata

SEQ ID NO: 740905 - DNA, 20 bp, mouse
gcctctgtgaaacacttcaa

SEQ ID NO: 740906 - DNA, 20 bp, mouse
gagtggagagcttaattcgt

SEQ ID NO: 740907 - DNA, 20 bp, mouse
gggtggggagggccgatctc

SEQ ID NO: 740908 - DNA, 20 bp, mouse
gtcctggtgacattcccctg

SEQ ID NO: 740909 - DNA, 20 bp, mouse
gccagccgcagagatgaatc

SEQ ID NO: 740910 - DNA, 20 bp, mouse
gtcctcaggggaatgtcacc

SEQ ID NO: 740911 - DNA, 20 bp, mouse
gctgggagatggtgaagtcc

SEQ ID NO: 740912 - DNA, 20 bp, mouse
gtggcattgggctagcagat

SEQ ID NO: 740913 - DNA, 20 bp, mouse
gtctcccagattcatctctg

SEQ ID NO: 740914 - DNA, 20 bp, mouse
ggggcttgcaaactttgctc

SEQ ID NO: 740915 - DNA, 20 bp, mouse
gccaggccacagcctcctca

SEQ ID NO: 740916 - DNA, 20 bp, mouse
ggagacgagcacgggaaatt

SEQ ID NO: 740917 - DNA, 20 bp, mouse
gcaccccaatgacccaaaag

SEQ ID NO: 740918 - DNA, 20 bp, mouse
gataatgcaggagacgagca

SEQ ID NO: 740919 - DNA, 20 bp, mouse
gagggaagcctatggagata

SEQ ID NO: 740920 - DNA, 20 bp, mouse
ggcccccagggactgcccca

SEQ ID NO: 740921 - DNA, 20 bp, mouse
gcccaagcaggactatttaa

SEQ ID NO: 740922 - DNA, 20 bp, mouse
gaacaagccttggtatgttg

SEQ ID NO: 740923 - DNA, 20 bp, mouse
gctaggggagatgtctaggt

SEQ ID NO: 740924 - DNA, 20 bp, mouse
gtaaggaagagccctgtctg

SEQ ID NO: 740925 - DNA, 20 bp, mouse
gaaccccttttgggtcattg

SEQ ID NO: 740926 - DNA, 20 bp, mouse
gttcctagccaagatcattc

SEQ ID NO: 740927 - DNA, 20 bp, mouse
gccccagaatgatcttggct

SEQ ID NO: 740928 - DNA, 20 bp, mouse
gcctctggagaatgacagct

SEQ ID NO: 740929 - DNA, 20 bp, mouse
gagtcttatcttattagcat

SEQ ID NO: 740930 - DNA, 20 bp, mouse
ggatcctgggacctatctga

SEQ ID NO: 740931 - DNA, 20 bp, mouse
ggttctcttgagctctataa

SEQ ID NO: 740932 - DNA, 20 bp, mouse
ggggattgtaggagttctga

SEQ ID NO: 740933 - DNA, 20 bp, mouse
gctatcgaaatcataggcat

SEQ ID NO: 740934 - DNA, 20 bp, mouse
gtagcatggggtaattagct

SEQ ID NO: 740935 - DNA, 20 bp, mouse
ggctgctgaaaacatttctc

SEQ ID NO: 740936 - DNA, 20 bp, mouse
gaagcccagggcaccggaaa

SEQ ID NO: 740937 - DNA, 20 bp, mouse
gctgaaggggataactctgc

SEQ ID NO: 740938 - DNA, 20 bp, mouse
ggcttggtggggataaaagg

SEQ ID NO: 740939 - DNA, 20 bp, mouse
gttgtcgcagataagcaaga

SEQ ID NO: 740940 - DNA, 20 bp, mouse
ggaggggaagcctgagtgtt

SEQ ID NO: 740941 - DNA, 20 bp, mouse
ggtggagagacgcccttttc

SEQ ID NO: 740942 - DNA, 20 bp, mouse
gtctgcctcatctgggggtt

SEQ ID NO: 740943 - DNA, 20 bp, mouse
ggagcccttttaatagaaag

SEQ ID NO: 740944 - DNA, 20 bp, mouse
gccggtgccctgggcttggt

SEQ ID NO: 740945 - DNA, 20 bp, mouse
ggctctgttgctcaaaggct

SEQ ID NO: 740946 - DNA, 20 bp, mouse
ggggtactcagggtgagctc

SEQ ID NO: 740947 - DNA, 20 bp, mouse
gcctgctgatggcatcccct

SEQ ID NO: 740948 - DNA, 20 bp, mouse
gcagggctggcagatgccta

SEQ ID NO: 740949 - DNA, 20 bp, mouse
gggcggagcttgattaatga

SEQ ID NO: 740950 - DNA, 20 bp, mouse
gtaaaaaaaaagccaccggt

SEQ ID NO: 740951 - DNA, 20 bp, mouse
ggcattaaaaaaaaagccac

SEQ ID NO: 740952 - DNA, 20 bp, mouse
gaaaaaagccaccggttggt

SEQ ID NO: 740953 - DNA, 20 bp, mouse
gggtcctgcgcctaagaaag

SEQ ID NO: 740954 - DNA, 20 bp, mouse
gaagtttccacgtgggggag

SEQ ID NO: 740955 - DNA, 20 bp, mouse
gagaaagaagtttccacgtg

SEQ ID NO: 740956 - DNA, 20 bp, mouse
gaagggcccctaatccctta

SEQ ID NO: 740957 - DNA, 20 bp, mouse
gagctggctctagaccctaa

SEQ ID NO: 740958 - DNA, 20 bp, mouse
gaactggtcaacctcttcca

SEQ ID NO: 740959 - DNA, 20 bp, mouse
gacttgcctcagttgacaaa

SEQ ID NO: 740960 - DNA, 20 bp, mouse
gattacctgagagtcatctc

SEQ ID NO: 740961 - DNA, 20 bp, mouse
gaggaaatcacacgttggga

SEQ ID NO: 740962 - DNA, 20 bp, mouse
gcaaacccgagatgactctc

SEQ ID NO: 740963 - DNA, 20 bp, mouse
gacctcaaagataatcctct

SEQ ID NO: 740964 - DNA, 20 bp, mouse
gcttgaggaaatcacacgtt

SEQ ID NO: 740965 - DNA, 20 bp, mouse
gacttggcagaaggagacgt

SEQ ID NO: 740966 - DNA, 20 bp, mouse
gcaaaggatagcaatctctc

SEQ ID NO: 740967 - DNA, 20 bp, mouse
gtcagcaacacataggtatg

SEQ ID NO: 740968 - DNA, 20 bp, mouse
gaatgataaatgatcaagtt

SEQ ID NO: 740969 - DNA, 20 bp, mouse
ggggtgtgccagagagatct

SEQ ID NO: 740970 - DNA, 20 bp, mouse
gggcaaatactcccctccca

SEQ ID NO: 740971 - DNA, 20 bp, mouse
gcttactacggagagaccaa

SEQ ID NO: 740972 - DNA, 20 bp, mouse
gtgaccttggggccacagct

SEQ ID NO: 740973 - DNA, 20 bp, mouse
gcatccaagctgtggcccca

SEQ ID NO: 740974 - DNA, 20 bp, mouse
ggcttgtaagcagatgctac

SEQ ID NO: 740975 - DNA, 20 bp, mouse
gtatcattcatctcttacta

SEQ ID NO: 740976 - DNA, 20 bp, mouse
gacctgctctgacacacctg

SEQ ID NO: 740977 - DNA, 20 bp, mouse
gcacctggggaatgggtacg

SEQ ID NO: 740978 - DNA, 20 bp, mouse
gcccagcccaaggacgggag

SEQ ID NO: 740979 - DNA, 20 bp, mouse
gcacgtgcagagcctgaggt

SEQ ID NO: 740980 - DNA, 20 bp, mouse
ggcatggggaagttggacaa

SEQ ID NO: 740981 - DNA, 20 bp, mouse
gtctgacacacctggggaat

SEQ ID NO: 740982 - DNA, 20 bp, mouse
gtccccaggtgtgtcagagc

SEQ ID NO: 740983 - DNA, 20 bp, mouse
gtgcttctgccctggggccc

SEQ ID NO: 740984 - DNA, 20 bp, mouse
gtgccacgtacccattcccc

SEQ ID NO: 740985 - DNA, 20 bp, mouse
ggggtctgtgctgtctctgt

SEQ ID NO: 740986 - DNA, 20 bp, mouse
ggggcaacgggttgtagaga

SEQ ID NO: 740987 - DNA, 20 bp, mouse
gagccctcctcacttggaac

SEQ ID NO: 740988 - DNA, 20 bp, mouse
gtctcccccaggatgtggga

SEQ ID NO: 740989 - DNA, 20 bp, mouse
gcaagtgaggagggcttacg

SEQ ID NO: 740990 - DNA, 20 bp, mouse
ggaggccctcccacatcctg

SEQ ID NO: 740991 - DNA, 20 bp, mouse
gcacttggaacaggatgata

SEQ ID NO: 740992 - DNA, 20 bp, mouse
ggaggagggcttacggggtg

SEQ ID NO: 740993 - DNA, 20 bp, mouse
ggggtggtgagggtagctgt

SEQ ID NO: 740994 - DNA, 20 bp, mouse
gcaggccatcagggctgcgt

SEQ ID NO: 740995 - DNA, 20 bp, mouse
gagcacttcagtctcagtga

SEQ ID NO: 740996 - DNA, 20 bp, mouse
gcctcctgtgagaactactt

SEQ ID NO: 740997 - DNA, 20 bp, mouse
gctggagagggatcccgggt

SEQ ID NO: 740998 - DNA, 20 bp, mouse
gggggctggagagggatccc

SEQ ID NO: 740999 - DNA, 20 bp, mouse
gcagcccaagtagttctcac

SEQ ID NO: 741000 - DNA, 20 bp, mouse
ggcaggagataagacagctt

SEQ ID NO: 741001 - DNA, 20 bp, mouse
ggctctctcctggattttta

SEQ ID NO: 741002 - DNA, 20 bp, mouse
ggcagagagctgttcccacc

SEQ ID NO: 741003 - DNA, 20 bp, mouse
gctctcctggatttttaggg

SEQ ID NO: 741004 - DNA, 20 bp, mouse
gggcccttttccctcccctg

SEQ ID NO: 741005 - DNA, 20 bp, mouse
gagccccaccctaaaaatcc

SEQ ID NO: 741006 - DNA, 20 bp, mouse
ggaaagctgtggtacgggga

SEQ ID NO: 741007 - DNA, 20 bp, mouse
gcgggtggtcagtgccaaga

SEQ ID NO: 741008 - DNA, 20 bp, mouse
gcggtatgcagcgtgatctg

SEQ ID NO: 741009 - DNA, 20 bp, mouse
gcagtcaggcccctcttgca

SEQ ID NO: 741010 - DNA, 20 bp, mouse
gcagacagaaagctgtggta

SEQ ID NO: 741011 - DNA, 20 bp, mouse
ggtcacagtcccctgcaaga

SEQ ID NO: 741012 - DNA, 20 bp, mouse
gccgaaaggctgacgtatct

SEQ ID NO: 741013 - DNA, 20 bp, mouse
gggggctctgccttgttgaa

SEQ ID NO: 741014 - DNA, 20 bp, mouse
ggatcacgctgcataccgaa

SEQ ID NO: 741015 - DNA, 20 bp, mouse
gtctaactaacaggttggtc

SEQ ID NO: 741016 - DNA, 20 bp, mouse
gtggaatgcctgcctgtcat

SEQ ID NO: 741017 - DNA, 20 bp, mouse
gtgggagagcccaaaaacag

SEQ ID NO: 741018 - DNA, 20 bp, mouse
gcagggcttccatccaatga

SEQ ID NO: 741019 - DNA, 20 bp, mouse
gagcccaaaaacagaggcac

SEQ ID NO: 741020 - DNA, 20 bp, mouse
gggcttccatccaatgaggg

SEQ ID NO: 741021 - DNA, 20 bp, mouse
gctcccgtgcctctgttttt

SEQ ID NO: 741022 - DNA, 20 bp, mouse
gttaggaagccgtcaatctc

SEQ ID NO: 741023 - DNA, 20 bp, mouse
gcataggctggtgcaggact

SEQ ID NO: 741024 - DNA, 20 bp, mouse
gaagatgcagagataaggag

SEQ ID NO: 741025 - DNA, 20 bp, mouse
gcagaggcacgggagacatc

SEQ ID NO: 741026 - DNA, 20 bp, mouse
gagtgcgcatgcccaacctc

SEQ ID NO: 741027 - DNA, 20 bp, mouse
gcactctgaggcttcagctt

SEQ ID NO: 741028 - DNA, 20 bp, mouse
gggcacgccttacaaagagg

SEQ ID NO: 741029 - DNA, 20 bp, mouse
gtgaggcaattggactttat

SEQ ID NO: 741030 - DNA, 20 bp, mouse
gggaaggtgccacgcataga

SEQ ID NO: 741031 - DNA, 20 bp, mouse
ggaggcttcagcttcgggga

SEQ ID NO: 741032 - DNA, 20 bp, mouse
gactgaagacacaactgcat

SEQ ID NO: 741033 - DNA, 20 bp, mouse
gtggcagcttcataggggtt

SEQ ID NO: 741034 - DNA, 20 bp, mouse
gctagaatgtgctttaatgg

SEQ ID NO: 741035 - DNA, 20 bp, mouse
gcttacaaagaggagggtgc

SEQ ID NO: 741036 - DNA, 20 bp, mouse
gagggtagccaggagcaaga

SEQ ID NO: 741037 - DNA, 20 bp, mouse
gggagccagtggtcaatgcc

SEQ ID NO: 741038 - DNA, 20 bp, mouse
ggtggtcaatgccgggagga

SEQ ID NO: 741039 - DNA, 20 bp, mouse
gtgtcctccttccttgttta

SEQ ID NO: 741040 - DNA, 20 bp, mouse
gatgggacaacccctcctcc

SEQ ID NO: 741041 - DNA, 20 bp, mouse
gctcctgcacagctaggtca

SEQ ID NO: 741042 - DNA, 20 bp, mouse
gcctccgtggatccgtctaa

SEQ ID NO: 741043 - DNA, 20 bp, mouse
gtaggtacagggtgcaaatt

SEQ ID NO: 741044 - DNA, 20 bp, mouse
gggagtagtgaagtgcctat

SEQ ID NO: 741045 - DNA, 20 bp, mouse
ggccagtggtcaatgccggg

SEQ ID NO: 741046 - DNA, 20 bp, mouse
gtcagggtggagaaccaggt

SEQ ID NO: 741047 - DNA, 20 bp, mouse
gctccctcctgcacgatata

SEQ ID NO: 741048 - DNA, 20 bp, mouse
ggggcactgtgggcatcggg

SEQ ID NO: 741049 - DNA, 20 bp, mouse
ggctccccacaggacttcta

SEQ ID NO: 741050 - DNA, 20 bp, mouse
ggggtcactgtctccatccc

SEQ ID NO: 741051 - DNA, 20 bp, mouse
gcccagccccggagctgacc

SEQ ID NO: 741052 - DNA, 20 bp, mouse
ggaccctcgtgtcgcgctat

SEQ ID NO: 741053 - DNA, 20 bp, mouse
gaagcgcctggtcagctccg

SEQ ID NO: 741054 - DNA, 20 bp, mouse
gtcgtggcaccataaagcca

SEQ ID NO: 741055 - DNA, 20 bp, mouse
gtcccaatagcgcgacacga

SEQ ID NO: 741056 - DNA, 20 bp, mouse
gagaataggtgtgtctgaat

SEQ ID NO: 741057 - DNA, 20 bp, mouse
gggcaattgcggtggactta

SEQ ID NO: 741058 - DNA, 20 bp, mouse
gtgtgtgtggacatgaggat

SEQ ID NO: 741059 - DNA, 20 bp, mouse
gacctattctcatcaggatg

SEQ ID NO: 741060 - DNA, 20 bp, mouse
ggtccccataatggcaattg

SEQ ID NO: 741061 - DNA, 20 bp, mouse
gccaccgcaattgccattat

SEQ ID NO: 741062 - DNA, 20 bp, mouse
gtggttagccacacttaaag

SEQ ID NO: 741063 - DNA, 20 bp, mouse
gaagggtagacagaatgcta

SEQ ID NO: 741064 - DNA, 20 bp, mouse
gtcaggatgcgggctggagc

SEQ ID NO: 741065 - DNA, 20 bp, mouse
gagtctcttaaggcaggagg

SEQ ID NO: 741066 - DNA, 20 bp, mouse
ggccacccgcatccctagct

SEQ ID NO: 741067 - DNA, 20 bp, mouse
gcggagctgttgttccaatc

SEQ ID NO: 741068 - DNA, 20 bp, mouse
ggatgcgggtggcatggaac

SEQ ID NO: 741069 - DNA, 20 bp, mouse
gtgagctggccctttgaagg

SEQ ID NO: 741070 - DNA, 20 bp, mouse
ggaccacgtggtcacagtca

SEQ ID NO: 741071 - DNA, 20 bp, mouse
ggggtccccacatatataaa

SEQ ID NO: 741072 - DNA, 20 bp, mouse
ggggaaggataaggatcagt

SEQ ID NO: 741073 - DNA, 20 bp, mouse
ggtgtcaggacctcggacag

SEQ ID NO: 741074 - DNA, 20 bp, mouse
ggaccatttgctggtgtttg

SEQ ID NO: 741075 - DNA, 20 bp, mouse
gctccttaaatgtgctaaat

SEQ ID NO: 741076 - DNA, 20 bp, mouse
ggaaaggctgggctgctgac

SEQ ID NO: 741077 - DNA, 20 bp, mouse
gggagcagcagagaagcccc

SEQ ID NO: 741078 - DNA, 20 bp, mouse
ggctgacgggcagtcaccaa

SEQ ID NO: 741079 - DNA, 20 bp, mouse
gtagccaggaagcggtctca

SEQ ID NO: 741080 - DNA, 20 bp, mouse
gtacctcacacaatggagaa

SEQ ID NO: 741081 - DNA, 20 bp, mouse
gcagcagcagggctgattta

SEQ ID NO: 741082 - DNA, 20 bp, mouse
ggtgagggagttttgatctt

SEQ ID NO: 741083 - DNA, 20 bp, mouse
gccccaggctctgcgtccct

SEQ ID NO: 741084 - DNA, 20 bp, mouse
gtcagagaaggtctaggata

SEQ ID NO: 741085 - DNA, 20 bp, mouse
gacaccagactgtaggatat

SEQ ID NO: 741086 - DNA, 20 bp, mouse
gtcaattagtcgttggcggt

SEQ ID NO: 741087 - DNA, 20 bp, mouse
gttcccaggtgcagagaagg

SEQ ID NO: 741088 - DNA, 20 bp, mouse
ggcattagtcaattagtcgt

SEQ ID NO: 741089 - DNA, 20 bp, mouse
gcatcccagtcaaaggaaac

SEQ ID NO: 741090 - DNA, 20 bp, mouse
gttagtcaattagtcgttgg

SEQ ID NO: 741091 - DNA, 20 bp, mouse
gcgaaccattcacatttccc

SEQ ID NO: 741092 - DNA, 20 bp, mouse
gaataaaatcagctttttac

SEQ ID NO: 741093 - DNA, 20 bp, mouse
gagtagtcattagcgttcat

SEQ ID NO: 741094 - DNA, 20 bp, mouse
ggaagacactttggaaatta

SEQ ID NO: 741095 - DNA, 20 bp, mouse
gcacctttcatcccagtcaa

SEQ ID NO: 741096 - DNA, 20 bp, mouse
gaggggaaagaggaagcaca

SEQ ID NO: 741097 - DNA, 20 bp, mouse
gtcccctctggtctaaggga

SEQ ID NO: 741098 - DNA, 20 bp, mouse
gtaccttcccttagaccaga

SEQ ID NO: 741099 - DNA, 20 bp, mouse
gactttgcaacttgcgtcaa

SEQ ID NO: 741100 - DNA, 20 bp, mouse
gcttagaccagaggggaaag

SEQ ID NO: 741101 - DNA, 20 bp, mouse
gtgcaaagtcagtctttgat

SEQ ID NO: 741102 - DNA, 20 bp, mouse
gttgtgcctaaggttatcaa

SEQ ID NO: 741103 - DNA, 20 bp, mouse
gagatgaatacgcagctata

SEQ ID NO: 741104 - DNA, 20 bp, mouse
gcactgactatagcagatga

SEQ ID NO: 741105 - DNA, 20 bp, mouse
gtatagagggctgctgtgtt

SEQ ID NO: 741106 - DNA, 20 bp, mouse
gtcgctgtgactcgttctat

SEQ ID NO: 741107 - DNA, 20 bp, mouse
ggggatggttttgttttata

SEQ ID NO: 741108 - DNA, 20 bp, mouse
gctattggccgcatactctt

SEQ ID NO: 741109 - DNA, 20 bp, mouse
gtatggtgacagtgtcgatg

SEQ ID NO: 741110 - DNA, 20 bp, mouse
gttgtgacatattatgggga

SEQ ID NO: 741111 - DNA, 20 bp, mouse
gaatacttgtgacatattat

SEQ ID NO: 741112 - DNA, 20 bp, mouse
gcgctactccaaagagtatg

SEQ ID NO: 741113 - DNA, 20 bp, mouse
ggccaatcagaggaccactg

SEQ ID NO: 741114 - DNA, 20 bp, mouse
gctctttggagtagcgtttg

SEQ ID NO: 741115 - DNA, 20 bp, mouse
gcttcagaggtttggctaga

SEQ ID NO: 741116 - DNA, 20 bp, mouse
gccacctcgagaatgtcacc

SEQ ID NO: 741117 - DNA, 20 bp, mouse
ggggcctgtcacgggcatga

SEQ ID NO: 741118 - DNA, 20 bp, mouse
gctgcaatctggtgaggctc

SEQ ID NO: 741119 - DNA, 20 bp, mouse
gagctcttttttaatccctg

SEQ ID NO: 741120 - DNA, 20 bp, mouse
gctcagtgcaatctccccca

SEQ ID NO: 741121 - DNA, 20 bp, mouse
ggcacccaggctttgaggat

SEQ ID NO: 741122 - DNA, 20 bp, mouse
gcagctcaggagtataaagg

SEQ ID NO: 741123 - DNA, 20 bp, mouse
gtcagattacataagaggca

SEQ ID NO: 741124 - DNA, 20 bp, mouse
gtccaaacacaatgaggaaa

SEQ ID NO: 741125 - DNA, 20 bp, mouse
gtcagctccaggcagactcc

SEQ ID NO: 741126 - DNA, 20 bp, mouse
gctgcactgtactttagtct

SEQ ID NO: 741127 - DNA, 20 bp, mouse
gaagccaagggaaccagcac

SEQ ID NO: 741128 - DNA, 20 bp, mouse
gtcatcggatgcaagataaa

SEQ ID NO: 741129 - DNA, 20 bp, mouse
gctaacggggcttctcataa

SEQ ID NO: 741130 - DNA, 20 bp, mouse
gtaaatgggggatgaaatgt

SEQ ID NO: 741131 - DNA, 20 bp, mouse
gctggttcccttggcttctt

SEQ ID NO: 741132 - DNA, 20 bp, mouse
gtgtgagccaaagaagccaa

SEQ ID NO: 741133 - DNA, 20 bp, mouse
ggctggacacggacactcat

SEQ ID NO: 741134 - DNA, 20 bp, mouse
ggaagccttctccctcgtaa

SEQ ID NO: 741135 - DNA, 20 bp, mouse
gtctccagggacaattaact

SEQ ID NO: 741136 - DNA, 20 bp, mouse
gactcagcaggagctgaaac

SEQ ID NO: 741137 - DNA, 20 bp, mouse
ggacagaagcaaggtcataa

SEQ ID NO: 741138 - DNA, 20 bp, mouse
gcatgcgcgcgcgcgcatat

SEQ ID NO: 741139 - DNA, 20 bp, mouse
gcttctcatgatccacagat

SEQ ID NO: 741140 - DNA, 20 bp, mouse
gtgaagggaggctgaacaca

SEQ ID NO: 741141 - DNA, 20 bp, mouse
gcacttcctgtttctgcata

SEQ ID NO: 741142 - DNA, 20 bp, mouse
gcagataactgacagaagca

SEQ ID NO: 741143 - DNA, 20 bp, mouse
ggaacttggtagactccaaa

SEQ ID NO: 741144 - DNA, 20 bp, mouse
gacaatagcaaagctaactt

SEQ ID NO: 741145 - DNA, 20 bp, mouse
gcatctcccctggggccatt

SEQ ID NO: 741146 - DNA, 20 bp, mouse
ggtagataggagtagctctt

SEQ ID NO: 741147 - DNA, 20 bp, mouse
gagggcttccatagctagga

SEQ ID NO: 741148 - DNA, 20 bp, mouse
ggaaatgtacaatcaagcac

SEQ ID NO: 741149 - DNA, 20 bp, mouse
gggaaagggcttccatagct

SEQ ID NO: 741150 - DNA, 20 bp, mouse
gggatttggcaatatggcag

SEQ ID NO: 741151 - DNA, 20 bp, mouse
ggtagtatattctacaggag

SEQ ID NO: 741152 - DNA, 20 bp, mouse
gaagaacccttccccagcag

SEQ ID NO: 741153 - DNA, 20 bp, mouse
ggtcatagcattttgtagat

SEQ ID NO: 741154 - DNA, 20 bp, mouse
gtttatgggtgttgtaacaa

SEQ ID NO: 741155 - DNA, 20 bp, mouse
gctgaatacaattatagcat

SEQ ID NO: 741156 - DNA, 20 bp, mouse
gttcctgaccataatggcag

SEQ ID NO: 741157 - DNA, 20 bp, mouse
gatactctcagcaatgggtg

SEQ ID NO: 741158 - DNA, 20 bp, mouse
gtgcctctgccattatggtc

SEQ ID NO: 741159 - DNA, 20 bp, mouse
gcccttaaacgaaagattaa

SEQ ID NO: 741160 - DNA, 20 bp, mouse
gggggatttcctgaccataa

SEQ ID NO: 741161 - DNA, 20 bp, mouse
ggtcatagacagtgaacagt

SEQ ID NO: 741162 - DNA, 20 bp, mouse
gtcctttaatctttcgttta

SEQ ID NO: 741163 - DNA, 20 bp, mouse
ggctccctcatctgcatgcc

SEQ ID NO: 741164 - DNA, 20 bp, mouse
ggtacaatgtcccatttttt

SEQ ID NO: 741165 - DNA, 20 bp, mouse
gcaaccattgtttccatatg

SEQ ID NO: 741166 - DNA, 20 bp, mouse
gatgacgcacccaaggacag

SEQ ID NO: 741167 - DNA, 20 bp, mouse
ggcagggtgaccttttgctg

SEQ ID NO: 741168 - DNA, 20 bp, mouse
gtaaatatgcgtgactagga

SEQ ID NO: 741169 - DNA, 20 bp, mouse
gactcagaaaactgctttag

SEQ ID NO: 741170 - DNA, 20 bp, mouse
ggtctgcggccctggaattc

SEQ ID NO: 741171 - DNA, 20 bp, mouse
ggcagtgatgtctgcggccc

SEQ ID NO: 741172 - DNA, 20 bp, mouse
gaaagtaaatatgcgtgact

SEQ ID NO: 741173 - DNA, 20 bp, mouse
gcactattacctgaattcca

SEQ ID NO: 741174 - DNA, 20 bp, mouse
gcttgggtgcgtcatcccca

SEQ ID NO: 741175 - DNA, 20 bp, mouse
gttcggacagattgtgcaac

SEQ ID NO: 741176 - DNA, 20 bp, mouse
gaaacagcatgcgccagtga

SEQ ID NO: 741177 - DNA, 20 bp, mouse
ggcgcctaggccaggagaag

SEQ ID NO: 741178 - DNA, 20 bp, mouse
gcggagagcatccatggtga

SEQ ID NO: 741179 - DNA, 20 bp, mouse
gcttgggcggagagcatcca

SEQ ID NO: 741180 - DNA, 20 bp, mouse
gcaaagctacaggtagtccc

SEQ ID NO: 741181 - DNA, 20 bp, mouse
gtggatggcagctaaattat

SEQ ID NO: 741182 - DNA, 20 bp, mouse
gctgacttgcatgctaaata

SEQ ID NO: 741183 - DNA, 20 bp, mouse
gcagggcccaaacaacaatg

SEQ ID NO: 741184 - DNA, 20 bp, mouse
gctggcgcatgctgtttggc

SEQ ID NO: 741185 - DNA, 20 bp, mouse
gatggaatcctcaaagctac

SEQ ID NO: 741186 - DNA, 20 bp, mouse
gggccagcatccatgaaaac

SEQ ID NO: 741187 - DNA, 20 bp, mouse
gcattagccaggttggagag

SEQ ID NO: 741188 - DNA, 20 bp, mouse
gctggccaaggaatctgctc

SEQ ID NO: 741189 - DNA, 20 bp, mouse
gcacccaggggtgtaggcac

SEQ ID NO: 741190 - DNA, 20 bp, mouse
gagccaggttggagagagga

SEQ ID NO: 741191 - DNA, 20 bp, mouse
gtacccggtgcctacacccc

SEQ ID NO: 741192 - DNA, 20 bp, mouse
gtaatgacaggtcttttccc

SEQ ID NO: 741193 - DNA, 20 bp, mouse
gggagccagagcagattcct

SEQ ID NO: 741194 - DNA, 20 bp, mouse
gccaactgctatttgtccag

SEQ ID NO: 741195 - DNA, 20 bp, mouse
gtacctcaactcataaaaaa

SEQ ID NO: 741196 - DNA, 20 bp, mouse
gataaaaagaaattctgtta

SEQ ID NO: 741197 - DNA, 20 bp, mouse
gcttctaataaattctcata

SEQ ID NO: 741198 - DNA, 20 bp, mouse
gacatgttttttcacatcca

SEQ ID NO: 741199 - DNA, 20 bp, mouse
gtgcttgtccttgccttgca

SEQ ID NO: 741200 - DNA, 20 bp, mouse
gtacatttcaatcttgatct

SEQ ID NO: 741201 - DNA, 20 bp, mouse
gttttgtaccatgcaaggca

SEQ ID NO: 741202 - DNA, 20 bp, mouse
ggtgaatcccaaaagaaaga

SEQ ID NO: 741203 - DNA, 20 bp, mouse
gtgattgccatctttctttt

SEQ ID NO: 741204 - DNA, 20 bp, mouse
gatttggccaacatctgtta

SEQ ID NO: 741205 - DNA, 20 bp, mouse
gaaggatgtttaagattatt

SEQ ID NO: 741206 - DNA, 20 bp, mouse
gacaatgactccttctaata

SEQ ID NO: 741207 - DNA, 20 bp, mouse
gataataagtaattctatta

SEQ ID NO: 741208 - DNA, 20 bp, mouse
gatgctttaaccttattaga

SEQ ID NO: 741209 - DNA, 20 bp, mouse
ggaaatcaggtgaaaattcc

SEQ ID NO: 741210 - DNA, 20 bp, mouse
gggcttaaccttacctttca

SEQ ID NO: 741211 - DNA, 20 bp, mouse
gttttgtaccatgaaaggta

SEQ ID NO: 741212 - DNA, 20 bp, mouse
gaggttaaagcattaagttc

SEQ ID NO: 741213 - DNA, 20 bp, mouse
ggtgaatcccaaaagaaaga

SEQ ID NO: 741214 - DNA, 20 bp, mouse
gtgattgccatctttctttt

SEQ ID NO: 741215 - DNA, 20 bp, mouse
gcatagaatgacacaaagga

SEQ ID NO: 741216 - DNA, 20 bp, mouse
gaactcacaggtattcaaag

SEQ ID NO: 741217 - DNA, 20 bp, mouse
gtgtttgctaacacaaggat

SEQ ID NO: 741218 - DNA, 20 bp, mouse
gtgaatgaataacttggaat

SEQ ID NO: 741219 - DNA, 20 bp, mouse
ggttagcaaacagattaatg

SEQ ID NO: 741220 - DNA, 20 bp, mouse
gtaatctgtttgctaacaca

SEQ ID NO: 741221 - DNA, 20 bp, mouse
gctctagtgaatgaataact

SEQ ID NO: 741222 - DNA, 20 bp, mouse
gcaaatatgaattctactat

SEQ ID NO: 741223 - DNA, 20 bp, mouse
gacaatccccaaaacacatt

SEQ ID NO: 741224 - DNA, 20 bp, mouse
gtcacttattagaatttaga

SEQ ID NO: 741225 - DNA, 20 bp, mouse
ggttctctttcaaatgaaga

SEQ ID NO: 741226 - DNA, 20 bp, mouse
gtatgaggagaactcttagg

SEQ ID NO: 741227 - DNA, 20 bp, mouse
gcactgtccactggcaagga

SEQ ID NO: 741228 - DNA, 20 bp, mouse
gaggagaactcttaggcggt

SEQ ID NO: 741229 - DNA, 20 bp, mouse
ggtgatgagaggaattttaa

SEQ ID NO: 741230 - DNA, 20 bp, mouse
gtttaagggctgtgctaatt

SEQ ID NO: 741231 - DNA, 20 bp, mouse
gtacttactacactgtccac

SEQ ID NO: 741232 - DNA, 20 bp, mouse
gtaagagttctcctcatacc

SEQ ID NO: 741233 - DNA, 20 bp, mouse
gactacactgtccactggca

SEQ ID NO: 741234 - DNA, 20 bp, mouse
gaatgatgcaagaagagcga

SEQ ID NO: 741235 - DNA, 20 bp, mouse
gacacaccacgtgttcttct

SEQ ID NO: 741236 - DNA, 20 bp, mouse
gcgacagtgacacaacggaa

SEQ ID NO: 741237 - DNA, 20 bp, mouse
ggtgctgaacaaatagccat

SEQ ID NO: 741238 - DNA, 20 bp, mouse
gaagcaaaacaataagttca

SEQ ID NO: 741239 - DNA, 20 bp, mouse
gcagatctaaagtacagatc

SEQ ID NO: 741240 - DNA, 20 bp, mouse
gtaaagtacagatcaggtga

SEQ ID NO: 741241 - DNA, 20 bp, mouse
gttgctttcatgaggagaaa

SEQ ID NO: 741242 - DNA, 20 bp, mouse
ggtagatgatgtaatactct

SEQ ID NO: 741243 - DNA, 20 bp, mouse
gtgattcagtatatatttga

SEQ ID NO: 741244 - DNA, 20 bp, mouse
gaaatagccatgggtatagt

SEQ ID NO: 741245 - DNA, 20 bp, mouse
ggtattacatcatctacatg

SEQ ID NO: 741246 - DNA, 20 bp, mouse
gtgtgtggcttaacagttaa

SEQ ID NO: 741247 - DNA, 20 bp, mouse
gaagagggggcactttgttg

SEQ ID NO: 741248 - DNA, 20 bp, mouse
gacatcttccaacaatttca

SEQ ID NO: 741249 - DNA, 20 bp, mouse
gaattaaaacatatatgttt

SEQ ID NO: 741250 - DNA, 20 bp, mouse
ggtggatctttcaaaattca

SEQ ID NO: 741251 - DNA, 20 bp, mouse
gacatatatgtttgggtatg

SEQ ID NO: 741252 - DNA, 20 bp, mouse
ggttatttcctctattttgt

SEQ ID NO: 741253 - DNA, 20 bp, mouse
gcacacacacacatgaagac

SEQ ID NO: 741254 - DNA, 20 bp, mouse
ggaaatacttttaataagaa

SEQ ID NO: 741255 - DNA, 20 bp, mouse
gtggtttgacacacctgcac

SEQ ID NO: 741256 - DNA, 20 bp, mouse
gtacagtaatagacatgcct

SEQ ID NO: 741257 - DNA, 20 bp, mouse
gagcacttagcatatcgtag

SEQ ID NO: 741258 - DNA, 20 bp, mouse
gttaaagcaaacctaactct

SEQ ID NO: 741259 - DNA, 20 bp, mouse
gatcaacaatattcaggagg

SEQ ID NO: 741260 - DNA, 20 bp, mouse
gcaaatcagaagtgggactt

SEQ ID NO: 741261 - DNA, 20 bp, mouse
gctgtttatgacctagagtt

SEQ ID NO: 741262 - DNA, 20 bp, mouse
gtatacatcaaatcagaagt

SEQ ID NO: 741263 - DNA, 20 bp, mouse
gacttactagtaaagcgtga

SEQ ID NO: 741264 - DNA, 20 bp, mouse
ggtttgcaattcctttgatg

SEQ ID NO: 741265 - DNA, 20 bp, mouse
ggacatcaacaatattcagg

SEQ ID NO: 741266 - DNA, 20 bp, mouse
gattccaagggaataggaga

SEQ ID NO: 741267 - DNA, 20 bp, mouse
gttgcctggcaactgaatcc

SEQ ID NO: 741268 - DNA, 20 bp, mouse
gtagccttctcctattccct

SEQ ID NO: 741269 - DNA, 20 bp, mouse
gtcacatggtctagcctggg

SEQ ID NO: 741270 - DNA, 20 bp, mouse
gtggatgtcactcagagctc

SEQ ID NO: 741271 - DNA, 20 bp, mouse
gccccagggcttctggaaaa

SEQ ID NO: 741272 - DNA, 20 bp, mouse
gggtgactcatgtgcattgt

SEQ ID NO: 741273 - DNA, 20 bp, mouse
gcctgtcagtcaatcctccc

SEQ ID NO: 741274 - DNA, 20 bp, mouse
gctcttcaggaattgttact

SEQ ID NO: 741275 - DNA, 20 bp, mouse
gcaagatggctcataaaagt

SEQ ID NO: 741276 - DNA, 20 bp, mouse
gagattccctgatttgactg

SEQ ID NO: 741277 - DNA, 20 bp, mouse
gtattcactaatctactata

SEQ ID NO: 741278 - DNA, 20 bp, mouse
gtttgactgtggaatcatgt

SEQ ID NO: 741279 - DNA, 20 bp, mouse
gtgtggtgctgcaacgcctg

SEQ ID NO: 741280 - DNA, 20 bp, mouse
gcctaagtgttgtcatgtac

SEQ ID NO: 741281 - DNA, 20 bp, mouse
gtatgccagggttattgttg

SEQ ID NO: 741282 - DNA, 20 bp, mouse
gactaatctactataaggaa

SEQ ID NO: 741283 - DNA, 20 bp, mouse
gatgattccacagtcaaatc

SEQ ID NO: 741284 - DNA, 20 bp, mouse
gagtctttctcgtgaacaat

SEQ ID NO: 741285 - DNA, 20 bp, mouse
ggttaagttgtttgttattt

SEQ ID NO: 741286 - DNA, 20 bp, mouse
gagagaacagagcccatgtg

SEQ ID NO: 741287 - DNA, 20 bp, mouse
gtataccctacagagattga

SEQ ID NO: 741288 - DNA, 20 bp, mouse
gtggagaatgaatccatttc

SEQ ID NO: 741289 - DNA, 20 bp, mouse
gttagtggtaaaatcgaggt

SEQ ID NO: 741290 - DNA, 20 bp, mouse
gctactctaggaactttaaa

SEQ ID NO: 741291 - DNA, 20 bp, mouse
gtcgtgaaatgaattaatag

SEQ ID NO: 741292 - DNA, 20 bp, mouse
gtgatggctcatacctcaca

SEQ ID NO: 741293 - DNA, 20 bp, mouse
gaatggaaagtgttcatgca

SEQ ID NO: 741294 - DNA, 20 bp, mouse
gcttctgctacaactattaa

SEQ ID NO: 741295 - DNA, 20 bp, mouse
gttaatggtgattatttcca

SEQ ID NO: 741296 - DNA, 20 bp, mouse
gtggctggcatgtttgttga

SEQ ID NO: 741297 - DNA, 20 bp, mouse
gagatgaaattgtcagtgtc

SEQ ID NO: 741298 - DNA, 20 bp, mouse
ggaggaagcgagccgtctaa

SEQ ID NO: 741299 - DNA, 20 bp, mouse
gaaggcttctcagatggaca

SEQ ID NO: 741300 - DNA, 20 bp, mouse
gttagcccagagatagaaac

SEQ ID NO: 741301 - DNA, 20 bp, mouse
ggagcagacaagaagaacgg

SEQ ID NO: 741302 - DNA, 20 bp, mouse
gaaagtgttgctttgttcag

SEQ ID NO: 741303 - DNA, 20 bp, mouse
gctagagcagacaagaagaa

SEQ ID NO: 741304 - DNA, 20 bp, mouse
gaacaaagcaacactttgat

SEQ ID NO: 741305 - DNA, 20 bp, mouse
gcgtctaaaggcttctcaga

SEQ ID NO: 741306 - DNA, 20 bp, mouse
ggtctacagaagttgacggg

SEQ ID NO: 741307 - DNA, 20 bp, mouse
gtatggctgctcgtgtctcc

SEQ ID NO: 741308 - DNA, 20 bp, mouse
gatagtctacagaagttgac

SEQ ID NO: 741309 - DNA, 20 bp, mouse
gctacagcgtggttattaaa

SEQ ID NO: 741310 - DNA, 20 bp, mouse
gttactgcattgtttagcta

SEQ ID NO: 741311 - DNA, 20 bp, mouse
gaggttcgttgtaatcacca

SEQ ID NO: 741312 - DNA, 20 bp, mouse
ggaagggtaagagtctggag

SEQ ID NO: 741313 - DNA, 20 bp, mouse
gatggtcaaagtagtgatta

SEQ ID NO: 741314 - DNA, 20 bp, mouse
gattgtgtcagaccaagaga

SEQ ID NO: 741315 - DNA, 20 bp, mouse
gcaaactctcctatgccaat

SEQ ID NO: 741316 - DNA, 20 bp, mouse
gtatggttatactcaatcga

SEQ ID NO: 741317 - DNA, 20 bp, mouse
gggcaggagcgctacttcct

SEQ ID NO: 741318 - DNA, 20 bp, mouse
gagggatcatccggttttat

SEQ ID NO: 741319 - DNA, 20 bp, mouse
gatcgatggaaggtatttca

SEQ ID NO: 741320 - DNA, 20 bp, mouse
gaccataaatcagagtgtct

SEQ ID NO: 741321 - DNA, 20 bp, mouse
gacaaagtgtctgtttgggt

SEQ ID NO: 741322 - DNA, 20 bp, mouse
gactctctgagaatatataa

SEQ ID NO: 741323 - DNA, 20 bp, mouse
gtctaaactctctcataccc

SEQ ID NO: 741324 - DNA, 20 bp, mouse
gacccagacactctgattta

SEQ ID NO: 741325 - DNA, 20 bp, mouse
gaggtatttcagggatcatc

SEQ ID NO: 741326 - DNA, 20 bp, mouse
gtgagcttgggtgacacatg

SEQ ID NO: 741327 - DNA, 20 bp, mouse
gtcacccaagctcactatta

SEQ ID NO: 741328 - DNA, 20 bp, mouse
gcacccttatgattcagtta

SEQ ID NO: 741329 - DNA, 20 bp, mouse
ggatggacaatgaagagtat

SEQ ID NO: 741330 - DNA, 20 bp, mouse
ggaggacaatatctgatggt

SEQ ID NO: 741331 - DNA, 20 bp, mouse
gtgcttcattccatatgaaa

SEQ ID NO: 741332 - DNA, 20 bp, mouse
gtgccataactgaatcataa

SEQ ID NO: 741333 - DNA, 20 bp, mouse
gactggaggacaatatctga

SEQ ID NO: 741334 - DNA, 20 bp, mouse
gacagccataatagtgagct

SEQ ID NO: 741335 - DNA, 20 bp, mouse
gaataagacaccatttcata

SEQ ID NO: 741336 - DNA, 20 bp, mouse
gccagtggcggcctcgtcca

SEQ ID NO: 741337 - DNA, 20 bp, mouse
gggaaaagcttgctttggtg

SEQ ID NO: 741338 - DNA, 20 bp, mouse
gcccagagtgcatccaaatt

SEQ ID NO: 741339 - DNA, 20 bp, mouse
gtcctgatgagagggtactg

SEQ ID NO: 741340 - DNA, 20 bp, mouse
gtctgtgccatcagatgcgg

SEQ ID NO: 741341 - DNA, 20 bp, mouse
ggcagggccaacaacacccc

SEQ ID NO: 741342 - DNA, 20 bp, mouse
gaacatcaggtgagggcttt

SEQ ID NO: 741343 - DNA, 20 bp, mouse
gaggaagccgctcttcctcc

SEQ ID NO: 741344 - DNA, 20 bp, mouse
ggctttaggagccctggacg

SEQ ID NO: 741345 - DNA, 20 bp, mouse
ggcacagaactgcgtcctgg

SEQ ID NO: 741346 - DNA, 20 bp, mouse
gctccctgggcgtcaaccta

SEQ ID NO: 741347 - DNA, 20 bp, mouse
ggggaaaatatcttgaccat

SEQ ID NO: 741348 - DNA, 20 bp, mouse
gcattccacatcactaatag

SEQ ID NO: 741349 - DNA, 20 bp, mouse
gggcgggtatataaaagcca

SEQ ID NO: 741350 - DNA, 20 bp, mouse
gaagtaaggactcttcacat

SEQ ID NO: 741351 - DNA, 20 bp, mouse
gcaagccactattagtgatg

SEQ ID NO: 741352 - DNA, 20 bp, mouse
gtacctcataaaagggattc

SEQ ID NO: 741353 - DNA, 20 bp, mouse
gtcatcattttggtcttcaa

SEQ ID NO: 741354 - DNA, 20 bp, mouse
gccaaggcgttgacttgaaa

SEQ ID NO: 741355 - DNA, 20 bp, mouse
gagagagcaggttgggcaat

SEQ ID NO: 741356 - DNA, 20 bp, mouse
gagggtgtcacaaacaaaac

SEQ ID NO: 741357 - DNA, 20 bp, mouse
gtgctcaagtgacaactcat

SEQ ID NO: 741358 - DNA, 20 bp, mouse
gtagataatctcagtggaat

SEQ ID NO: 741359 - DNA, 20 bp, mouse
ggggtatgagtccaatcaga

SEQ ID NO: 741360 - DNA, 20 bp, mouse
gctgtaaaggtaaactgtga

SEQ ID NO: 741361 - DNA, 20 bp, mouse
ggactcatacccactgagga

SEQ ID NO: 741362 - DNA, 20 bp, mouse
gcaactcatgggcactttta

SEQ ID NO: 741363 - DNA, 20 bp, mouse
gcagttggagttttgactca

SEQ ID NO: 741364 - DNA, 20 bp, mouse
gaactccaactgaattaata

SEQ ID NO: 741365 - DNA, 20 bp, mouse
gattggactcatacccactg

SEQ ID NO: 741366 - DNA, 20 bp, mouse
gagggtgtcacaaacaaaac

SEQ ID NO: 741367 - DNA, 20 bp, mouse
gtgctcaagtgacaactcat

SEQ ID NO: 741368 - DNA, 20 bp, mouse
gtagataatctcagtggaat

SEQ ID NO: 741369 - DNA, 20 bp, mouse
ggggtatgagtccaatcaga

SEQ ID NO: 741370 - DNA, 20 bp, mouse
gctgtaaaggtaaactgtga

SEQ ID NO: 741371 - DNA, 20 bp, mouse
ggactcatacccactgagga

SEQ ID NO: 741372 - DNA, 20 bp, mouse
gcaactcatgggcactttta

SEQ ID NO: 741373 - DNA, 20 bp, mouse
gcagttggagttttgactca

SEQ ID NO: 741374 - DNA, 20 bp, mouse
gaactccaactgaattaata

SEQ ID NO: 741375 - DNA, 20 bp, mouse
gattggactcatacccactg

SEQ ID NO: 741376 - DNA, 20 bp, mouse
gtgaaggtgctgtgtgatag

SEQ ID NO: 741377 - DNA, 20 bp, mouse
gtctatctgtggcacagtga

SEQ ID NO: 741378 - DNA, 20 bp, mouse
gttgaccttctcatataatc

SEQ ID NO: 741379 - DNA, 20 bp, mouse
gactccatgggcaaatagac

SEQ ID NO: 741380 - DNA, 20 bp, mouse
gtacatagcagggtagaacc

SEQ ID NO: 741381 - DNA, 20 bp, mouse
ggctgggaattggactccat

SEQ ID NO: 741382 - DNA, 20 bp, mouse
gagctcctgattatatgaga

SEQ ID NO: 741383 - DNA, 20 bp, mouse
gagcagggtagaaccaggtg

SEQ ID NO: 741384 - DNA, 20 bp, mouse
gtataatcaggagctaacaa

SEQ ID NO: 741385 - DNA, 20 bp, mouse
gtggaaaataataaacaagg

SEQ ID NO: 741386 - DNA, 20 bp, mouse
gtgattcagagcattgggta

SEQ ID NO: 741387 - DNA, 20 bp, mouse
gtacagtcaggagctaacga

SEQ ID NO: 741388 - DNA, 20 bp, mouse
ggagttataacaaaactggt

SEQ ID NO: 741389 - DNA, 20 bp, mouse
gagtaagggtgctgtgagct

SEQ ID NO: 741390 - DNA, 20 bp, mouse
gacattgcgggcaaaaagac

SEQ ID NO: 741391 - DNA, 20 bp, mouse
gatcagagttataacaaaac

SEQ ID NO: 741392 - DNA, 20 bp, mouse
gtgctgtgagctagggtttc

SEQ ID NO: 741393 - DNA, 20 bp, mouse
ggaagtttttccaacaaatc

SEQ ID NO: 741394 - DNA, 20 bp, mouse
gtataactctgatggtcatc

SEQ ID NO: 741395 - DNA, 20 bp, mouse
gtacttctaagtagggatat

SEQ ID NO: 741396 - DNA, 20 bp, mouse
ggctacaagtaacttgtcac

SEQ ID NO: 741397 - DNA, 20 bp, mouse
gagcaacaggtgacccacta

SEQ ID NO: 741398 - DNA, 20 bp, mouse
gaacttgtcacaggactctc

SEQ ID NO: 741399 - DNA, 20 bp, mouse
gtgttcagcgaggtataaaa

SEQ ID NO: 741400 - DNA, 20 bp, mouse
gtgcaaacacaggagccatc

SEQ ID NO: 741401 - DNA, 20 bp, mouse
gcctcccaggtgagattaga

SEQ ID NO: 741402 - DNA, 20 bp, mouse
gacaagttacttgtagcaac

SEQ ID NO: 741403 - DNA, 20 bp, mouse
ggagattagaaggagttaga

SEQ ID NO: 741404 - DNA, 20 bp, mouse
gactccttctaatctcacct

SEQ ID NO: 741405 - DNA, 20 bp, mouse
ggataatttagaatgttctc

SEQ ID NO: 741406 - DNA, 20 bp, mouse
gaggcccatcatagtgactc

SEQ ID NO: 741407 - DNA, 20 bp, mouse
gtaccatctagcttactatc

SEQ ID NO: 741408 - DNA, 20 bp, mouse
gaactcttttacattaacct

SEQ ID NO: 741409 - DNA, 20 bp, mouse
gtcacctgagtcactatgat

SEQ ID NO: 741410 - DNA, 20 bp, mouse
gctcacaaacctagcacact

SEQ ID NO: 741411 - DNA, 20 bp, mouse
gctacacagggaggtgtctg

SEQ ID NO: 741412 - DNA, 20 bp, mouse
ggataatagtctacacaggg

SEQ ID NO: 741413 - DNA, 20 bp, mouse
gctggataatagtctacaca

SEQ ID NO: 741414 - DNA, 20 bp, mouse
gtaaccttggtaatttagct

SEQ ID NO: 741415 - DNA, 20 bp, mouse
gctccagatagtaagctaga

SEQ ID NO: 741416 - DNA, 20 bp, mouse
gactccatgtaagtgttaga

SEQ ID NO: 741417 - DNA, 20 bp, mouse
gttactaaagtggctaatta

SEQ ID NO: 741418 - DNA, 20 bp, mouse
gtaccctgatactgttacca

SEQ ID NO: 741419 - DNA, 20 bp, mouse
gtaccctggtaacagtatca

SEQ ID NO: 741420 - DNA, 20 bp, mouse
gagaggcacagacccatcgc

SEQ ID NO: 741421 - DNA, 20 bp, mouse
gaatggcaacagtataggaa

SEQ ID NO: 741422 - DNA, 20 bp, mouse
gttttctttctcaggggtca

SEQ ID NO: 741423 - DNA, 20 bp, mouse
gaaatttgatgatacacata

SEQ ID NO: 741424 - DNA, 20 bp, mouse
gagataaacagttactaaag

SEQ ID NO: 741425 - DNA, 20 bp, mouse
gacagtataggaagggacac

SEQ ID NO: 741426 - DNA, 20 bp, mouse
gaaggaaagttgattctctt

SEQ ID NO: 741427 - DNA, 20 bp, mouse
gggatagcttggaatatagc

SEQ ID NO: 741428 - DNA, 20 bp, mouse
gagtccatgacttgtctctt

SEQ ID NO: 741429 - DNA, 20 bp, mouse
gagtcatgtgaccctcagca

SEQ ID NO: 741430 - DNA, 20 bp, mouse
gtggggaaatatgttcagaa

SEQ ID NO: 741431 - DNA, 20 bp, mouse
ggagatacaagtgggaaaac

SEQ ID NO: 741432 - DNA, 20 bp, mouse
gacccagttctaacctgttg

SEQ ID NO: 741433 - DNA, 20 bp, mouse
gtggactgtgtctactttag

SEQ ID NO: 741434 - DNA, 20 bp, mouse
gtattccaagctatccaatt

SEQ ID NO: 741435 - DNA, 20 bp, mouse
gtatttctggtcttatcctg

SEQ ID NO: 741436 - DNA, 20 bp, mouse
gtggggctcatagtcagttc

SEQ ID NO: 741437 - DNA, 20 bp, mouse
gacccagaatgtcaggtgac

SEQ ID NO: 741438 - DNA, 20 bp, mouse
gggctcatgcgtaataggtc

SEQ ID NO: 741439 - DNA, 20 bp, mouse
gcaaaagtgtgactacttac

SEQ ID NO: 741440 - DNA, 20 bp, mouse
gctatgagccccaacacacc

SEQ ID NO: 741441 - DNA, 20 bp, mouse
ggacctgtcacctgacattc

SEQ ID NO: 741442 - DNA, 20 bp, mouse
gctgatggctcatgcgtaat

SEQ ID NO: 741443 - DNA, 20 bp, mouse
gaaagcgtctttatcttctg

SEQ ID NO: 741444 - DNA, 20 bp, mouse
gagaccactggctcaggaac

SEQ ID NO: 741445 - DNA, 20 bp, mouse
gcactaaaacccagaatgtc

SEQ ID NO: 741446 - DNA, 20 bp, mouse
gcaatgaatcataagaatgt

SEQ ID NO: 741447 - DNA, 20 bp, mouse
ggatccctagggggagaagt

SEQ ID NO: 741448 - DNA, 20 bp, mouse
ggtgctagtttcagtttaga

SEQ ID NO: 741449 - DNA, 20 bp, mouse
gctattgcctggtagagcat

SEQ ID NO: 741450 - DNA, 20 bp, mouse
gcacagagaggatccctagg

SEQ ID NO: 741451 - DNA, 20 bp, mouse
gaggaagggagctttgctca

SEQ ID NO: 741452 - DNA, 20 bp, mouse
ggagccaacttctcccccta

SEQ ID NO: 741453 - DNA, 20 bp, mouse
ggatgccctttctaaacatt

SEQ ID NO: 741454 - DNA, 20 bp, mouse
gacacacagagaggatccct

SEQ ID NO: 741455 - DNA, 20 bp, mouse
gggctccttaaacgagtctt

SEQ ID NO: 741456 - DNA, 20 bp, mouse
gaagaaagacacttcgaaga

SEQ ID NO: 741457 - DNA, 20 bp, mouse
gagtagagctgtctaatatg

SEQ ID NO: 741458 - DNA, 20 bp, mouse
gtagtcccaatggttatcta

SEQ ID NO: 741459 - DNA, 20 bp, mouse
gggagcccagtttcttttcc

SEQ ID NO: 741460 - DNA, 20 bp, mouse
ggtaggagatatggcttaac

SEQ ID NO: 741461 - DNA, 20 bp, mouse
gtaaattatgaaggtaattg

SEQ ID NO: 741462 - DNA, 20 bp, mouse
gactgatggctcatccataa

SEQ ID NO: 741463 - DNA, 20 bp, mouse
gtatggacctgtagtcccaa

SEQ ID NO: 741464 - DNA, 20 bp, mouse
gggacagcaaccactcagca

SEQ ID NO: 741465 - DNA, 20 bp, mouse
gtcctaccccatgtggacta

SEQ ID NO: 741466 - DNA, 20 bp, mouse
gtcaatatgggaaactgaat

SEQ ID NO: 741467 - DNA, 20 bp, mouse
gattgaggcaggaaagactt

SEQ ID NO: 741468 - DNA, 20 bp, mouse
gcagtacccacctgacccac

SEQ ID NO: 741469 - DNA, 20 bp, mouse
gcagtttcccatattgaaat

SEQ ID NO: 741470 - DNA, 20 bp, mouse
gcctgtaccaatttcaatat

SEQ ID NO: 741471 - DNA, 20 bp, mouse
gccaacaactcatccccagt

SEQ ID NO: 741472 - DNA, 20 bp, mouse
gtgatggtgactcttaaccc

SEQ ID NO: 741473 - DNA, 20 bp, mouse
gtaagagtcaccatcagctc

SEQ ID NO: 741474 - DNA, 20 bp, mouse
gtgacagttggaagaaattg

SEQ ID NO: 741475 - DNA, 20 bp, mouse
gcacaagatcatgtgacagt

SEQ ID NO: 741476 - DNA, 20 bp, mouse
gcagcaggaagcactagtga

SEQ ID NO: 741477 - DNA, 20 bp, mouse
ggagcacttgctggaagatg

SEQ ID NO: 741478 - DNA, 20 bp, mouse
gagttaatgggagcacttgc

SEQ ID NO: 741479 - DNA, 20 bp, mouse
gcatgggctatggcagtcct

SEQ ID NO: 741480 - DNA, 20 bp, mouse
gctggtcctcttcttcacat

SEQ ID NO: 741481 - DNA, 20 bp, mouse
gctcttcttcacatgggcta

SEQ ID NO: 741482 - DNA, 20 bp, mouse
gctgtgactcacaggtcacc

SEQ ID NO: 741483 - DNA, 20 bp, mouse
ggaaaacaaaagtaatatat

SEQ ID NO: 741484 - DNA, 20 bp, mouse
gcagtcctgggtttccacaa

SEQ ID NO: 741485 - DNA, 20 bp, mouse
ggtcacaggggtcaggtcag

SEQ ID NO: 741486 - DNA, 20 bp, mouse
gaacacatgagcttccactc

SEQ ID NO: 741487 - DNA, 20 bp, mouse
gtcaagcaggaggctgcatg

SEQ ID NO: 741488 - DNA, 20 bp, mouse
gcctgcccaggtcaagcagg

SEQ ID NO: 741489 - DNA, 20 bp, mouse
gtgggaagaagaccagatct

SEQ ID NO: 741490 - DNA, 20 bp, mouse
gacccctgcccaggtcaagc

SEQ ID NO: 741491 - DNA, 20 bp, mouse
gatggaagcatgtgtctggg

SEQ ID NO: 741492 - DNA, 20 bp, mouse
gagcatgtgtctggggggtc

SEQ ID NO: 741493 - DNA, 20 bp, mouse
gtgcagcctcctgcttgacc

SEQ ID NO: 741494 - DNA, 20 bp, mouse
gcaggatttcctgggggaaa

SEQ ID NO: 741495 - DNA, 20 bp, mouse
gtgacaggaggcatgtgtag

SEQ ID NO: 741496 - DNA, 20 bp, mouse
gacagggagatcaacacatg

SEQ ID NO: 741497 - DNA, 20 bp, mouse
gaacaacaggggaggagcaa

SEQ ID NO: 741498 - DNA, 20 bp, mouse
gggggcttagagaacaacag

SEQ ID NO: 741499 - DNA, 20 bp, mouse
ggcaaaacagaagccacatt

SEQ ID NO: 741500 - DNA, 20 bp, mouse
gggggaggaagctgatcatt

SEQ ID NO: 741501 - DNA, 20 bp, mouse
gatagaaggggcactaacta

SEQ ID NO: 741502 - DNA, 20 bp, mouse
ggctctatctccacagggac

SEQ ID NO: 741503 - DNA, 20 bp, mouse
gagaaaactcatggacacat

SEQ ID NO: 741504 - DNA, 20 bp, mouse
gtcgctcctaaacacacata

SEQ ID NO: 741505 - DNA, 20 bp, mouse
gcagaaagctctatctccac

SEQ ID NO: 741506 - DNA, 20 bp, mouse
gcaaaccgccacatctccaa

SEQ ID NO: 741507 - DNA, 20 bp, mouse
ggaaaacagaagtaacagat

SEQ ID NO: 741508 - DNA, 20 bp, mouse
gcagaggggcagaattccct

SEQ ID NO: 741509 - DNA, 20 bp, mouse
ggagatgtggcggtttgctc

SEQ ID NO: 741510 - DNA, 20 bp, mouse
gtggcggtttgctcaggaat

SEQ ID NO: 741511 - DNA, 20 bp, mouse
gtcagtccgaactacatcgt

SEQ ID NO: 741512 - DNA, 20 bp, mouse
gcacttgttagtgtttacag

SEQ ID NO: 741513 - DNA, 20 bp, mouse
gcagaattcccttggagatg

SEQ ID NO: 741514 - DNA, 20 bp, mouse
gcctatagccccaaataaag

SEQ ID NO: 741515 - DNA, 20 bp, mouse
gctgcctcagaccctcgagt

SEQ ID NO: 741516 - DNA, 20 bp, mouse
gggagtgtcaacagaccaaa

SEQ ID NO: 741517 - DNA, 20 bp, mouse
ggaagagcccactgctcaaa

SEQ ID NO: 741518 - DNA, 20 bp, mouse
ggtaacttcacacctgacct

SEQ ID NO: 741519 - DNA, 20 bp, mouse
gagggaagacaacaacatgg

SEQ ID NO: 741520 - DNA, 20 bp, mouse
gtggctcatgttggagagca

SEQ ID NO: 741521 - DNA, 20 bp, mouse
gcatggcctggttgggactc

SEQ ID NO: 741522 - DNA, 20 bp, mouse
gtcaggtgtgaagttacacg

SEQ ID NO: 741523 - DNA, 20 bp, mouse
ggctaccagagtgtcctata

SEQ ID NO: 741524 - DNA, 20 bp, mouse
ggggagtgagaggcttaaga

SEQ ID NO: 741525 - DNA, 20 bp, mouse
gatgacatggctctggataa

SEQ ID NO: 741526 - DNA, 20 bp, mouse
gaatagcatgggtgcatggt

SEQ ID NO: 741527 - DNA, 20 bp, mouse
gctgcgaagtattttcatga

SEQ ID NO: 741528 - DNA, 20 bp, mouse
ggccaagcaagttcctttaa

SEQ ID NO: 741529 - DNA, 20 bp, mouse
ggtgatgtacactactacct

SEQ ID NO: 741530 - DNA, 20 bp, mouse
gagtcaatagcatgggtgca

SEQ ID NO: 741531 - DNA, 20 bp, mouse
gtaaaattagtcaatagcat

SEQ ID NO: 741532 - DNA, 20 bp, mouse
gaagactatactatatgcag

SEQ ID NO: 741533 - DNA, 20 bp, mouse
gaatacttcgcagccattaa

SEQ ID NO: 741534 - DNA, 20 bp, mouse
gaacattctttgtctagttt

SEQ ID NO: 741535 - DNA, 20 bp, mouse
gtgtctagtttagggttcca

SEQ ID NO: 741536 - DNA, 20 bp, mouse
gctagacaagctgttgaaaa

SEQ ID NO: 741537 - DNA, 20 bp, mouse
gtctctatgtcacaattcta

SEQ ID NO: 741538 - DNA, 20 bp, mouse
gtacactgagatgtttggga

SEQ ID NO: 741539 - DNA, 20 bp, mouse
gggacagaagaaacttcagg

SEQ ID NO: 741540 - DNA, 20 bp, mouse
gaaacttcaggtggcatatc

SEQ ID NO: 741541 - DNA, 20 bp, mouse
gagatgtgtgataatacctg

SEQ ID NO: 741542 - DNA, 20 bp, mouse
gtgtactgcatgactaaacc

SEQ ID NO: 741543 - DNA, 20 bp, mouse
gggtcaaataatgatatatc

SEQ ID NO: 741544 - DNA, 20 bp, mouse
gtgtgaattactgaatatat

SEQ ID NO: 741545 - DNA, 20 bp, mouse
ggtttgggagggaaaaccac

SEQ ID NO: 741546 - DNA, 20 bp, mouse
gtatgtctgagtcattaaag

SEQ ID NO: 741547 - DNA, 20 bp, mouse
ggcttggtatttggcctttg

SEQ ID NO: 741548 - DNA, 20 bp, mouse
gagagacatgagcccccccc

SEQ ID NO: 741549 - DNA, 20 bp, mouse
gattaaagaggcttggtatt

SEQ ID NO: 741550 - DNA, 20 bp, mouse
gctgagtcattaaagaggct

SEQ ID NO: 741551 - DNA, 20 bp, mouse
gaaagaaagaaaaacctcaa

SEQ ID NO: 741552 - DNA, 20 bp, mouse
gaaccaatacccccccgggg

SEQ ID NO: 741553 - DNA, 20 bp, mouse
ggacatgagcccccccccgg

SEQ ID NO: 741554 - DNA, 20 bp, mouse
gtgctagggacatgagcaca

SEQ ID NO: 741555 - DNA, 20 bp, mouse
gaatcagaagatagcctatt

SEQ ID NO: 741556 - DNA, 20 bp, mouse
gcaatgtcaaggatggtcac

SEQ ID NO: 741557 - DNA, 20 bp, mouse
gaggacagtagttaaaccgt

SEQ ID NO: 741558 - DNA, 20 bp, mouse
gagggaaggtatgcagtgac

SEQ ID NO: 741559 - DNA, 20 bp, mouse
gcctcccagttgacataact

SEQ ID NO: 741560 - DNA, 20 bp, mouse
gtgcactgaatgcttttcat

SEQ ID NO: 741561 - DNA, 20 bp, mouse
gtgtgtgctatcttcaaagc

SEQ ID NO: 741562 - DNA, 20 bp, mouse
gtagcctagttatgtcaact

SEQ ID NO: 741563 - DNA, 20 bp, mouse
gtcagagggtggttatgtct

SEQ ID NO: 741564 - DNA, 20 bp, mouse
gagcctcagatgatgcaatc

SEQ ID NO: 741565 - DNA, 20 bp, mouse
gttcagtgcaatgtcaagga

SEQ ID NO: 741566 - DNA, 20 bp, mouse
gaggcacataacttgtttga

SEQ ID NO: 741567 - DNA, 20 bp, mouse
gagctttttcatagactctt

SEQ ID NO: 741568 - DNA, 20 bp, mouse
gaagccacaccccccagtcg

SEQ ID NO: 741569 - DNA, 20 bp, mouse
gtccaaaatgggttattaca

SEQ ID NO: 741570 - DNA, 20 bp, mouse
ggttatgtgccttccaaaat

SEQ ID NO: 741571 - DNA, 20 bp, mouse
gtttatataccccgactggg

SEQ ID NO: 741572 - DNA, 20 bp, mouse
ggctctgaatttatacaacc

SEQ ID NO: 741573 - DNA, 20 bp, mouse
gacaacactagactctttct

SEQ ID NO: 741574 - DNA, 20 bp, mouse
gagctttgtgtagtgcaaat

SEQ ID NO: 741575 - DNA, 20 bp, mouse
gaattctttaatccagtaaa

SEQ ID NO: 741576 - DNA, 20 bp, mouse
gcaccactaccctcaggctt

SEQ ID NO: 741577 - DNA, 20 bp, mouse
gggtcatgtgatggctctgt

SEQ ID NO: 741578 - DNA, 20 bp, mouse
gaatctgatccaaagcctga

SEQ ID NO: 741579 - DNA, 20 bp, mouse
gcttaccaacattcctattc

SEQ ID NO: 741580 - DNA, 20 bp, mouse
gatccaaagcctgagggtag

SEQ ID NO: 741581 - DNA, 20 bp, mouse
ggcacttccgaaactgtatc

SEQ ID NO: 741582 - DNA, 20 bp, mouse
gattgtggctcgttctttga

SEQ ID NO: 741583 - DNA, 20 bp, mouse
gacagtttcggaagtgcttg

SEQ ID NO: 741584 - DNA, 20 bp, mouse
gtttatccaccactaccctc

SEQ ID NO: 741585 - DNA, 20 bp, mouse
gttgtttcctggtcatgtga

SEQ ID NO: 741586 - DNA, 20 bp, mouse
gcattacatatgctcatctg

SEQ ID NO: 741587 - DNA, 20 bp, mouse
gttacctgtcgcagagtgac

SEQ ID NO: 741588 - DNA, 20 bp, mouse
gggaaagagttgttgaccct

SEQ ID NO: 741589 - DNA, 20 bp, mouse
gctgacaaggtgactctcat

SEQ ID NO: 741590 - DNA, 20 bp, mouse
gtggaaatcacaactctgtt

SEQ ID NO: 741591 - DNA, 20 bp, mouse
gggccagaaagtctggtttt

SEQ ID NO: 741592 - DNA, 20 bp, mouse
gtcatcggaattataataat

SEQ ID NO: 741593 - DNA, 20 bp, mouse
gctcagagggccagaaagtc

SEQ ID NO: 741594 - DNA, 20 bp, mouse
gctcctaaaaccagactttc

SEQ ID NO: 741595 - DNA, 20 bp, mouse
gcaccaaatctcaagtattc

SEQ ID NO: 741596 - DNA, 20 bp, mouse
gatcaaggatacagcgagaa

SEQ ID NO: 741597 - DNA, 20 bp, mouse
gggtccaaaccttggaggtc

SEQ ID NO: 741598 - DNA, 20 bp, mouse
gtggtaggccttaaaatctt

SEQ ID NO: 741599 - DNA, 20 bp, mouse
gcatgggaactctttcaaca

SEQ ID NO: 741600 - DNA, 20 bp, mouse
gcctgggctaatctgaagta

SEQ ID NO: 741601 - DNA, 20 bp, mouse
gagatgataaacagatccct

SEQ ID NO: 741602 - DNA, 20 bp, mouse
gggaggtctggcatataaaa

SEQ ID NO: 741603 - DNA, 20 bp, mouse
gttattccagagtaaatcat

SEQ ID NO: 741604 - DNA, 20 bp, mouse
gtgactctcccaagatttta

SEQ ID NO: 741605 - DNA, 20 bp, mouse
gtagaggagtaatatgggca

SEQ ID NO: 741606 - DNA, 20 bp, mouse
gggaagggaggggatgtaaa

SEQ ID NO: 741607 - DNA, 20 bp, mouse
gaggtctgaggaagttgtac

SEQ ID NO: 741608 - DNA, 20 bp, mouse
gtggagaccaagcagggcgg

SEQ ID NO: 741609 - DNA, 20 bp, mouse
gcggactagtgcatccatga

SEQ ID NO: 741610 - DNA, 20 bp, mouse
ggaaggctggagaccaagca

SEQ ID NO: 741611 - DNA, 20 bp, mouse
gggcggagacgcaagtgtgg

SEQ ID NO: 741612 - DNA, 20 bp, mouse
gaggagccgggtggggtgaa

SEQ ID NO: 741613 - DNA, 20 bp, mouse
gcgaacccggggcttaatgc

SEQ ID NO: 741614 - DNA, 20 bp, mouse
gggcgggcacagtagggcca

SEQ ID NO: 741615 - DNA, 20 bp, mouse
ggcaccagggctatgagaag

SEQ ID NO: 741616 - DNA, 20 bp, mouse
gcgccccgccccaaccgaag

SEQ ID NO: 741617 - DNA, 20 bp, mouse
gctaaggcccggcctccaag

SEQ ID NO: 741618 - DNA, 20 bp, mouse
gcggaagcggcgcttgaggt

SEQ ID NO: 741619 - DNA, 20 bp, mouse
ggcgcatgggcaggagagaa

SEQ ID NO: 741620 - DNA, 20 bp, mouse
gaggccgggccttaggtcag

SEQ ID NO: 741621 - DNA, 20 bp, mouse
gagagaaaggtggtgctgca

SEQ ID NO: 741622 - DNA, 20 bp, mouse
gctgcaggggtggccccccg

SEQ ID NO: 741623 - DNA, 20 bp, mouse
gtccaaggggccaccctacc

SEQ ID NO: 741624 - DNA, 20 bp, mouse
gtggcaccgccgcttcggtt

SEQ ID NO: 741625 - DNA, 20 bp, mouse
ggcctcctgccctacttgtg

SEQ ID NO: 741626 - DNA, 20 bp, mouse
ggggtgggcgacatgatccg

SEQ ID NO: 741627 - DNA, 20 bp, mouse
gcaagagcttggggagtaat

SEQ ID NO: 741628 - DNA, 20 bp, mouse
gcctcccggagccccagggg

SEQ ID NO: 741629 - DNA, 20 bp, mouse
gcaccctagtgactcatccc

SEQ ID NO: 741630 - DNA, 20 bp, mouse
ggatccggggatgagtcact

SEQ ID NO: 741631 - DNA, 20 bp, mouse
gtactccccaagctcttgca

SEQ ID NO: 741632 - DNA, 20 bp, mouse
ggcaaggggtggctatgaga

SEQ ID NO: 741633 - DNA, 20 bp, mouse
gagggtaatgggatggaatc

SEQ ID NO: 741634 - DNA, 20 bp, mouse
gatcatgtcgcccacccctg

SEQ ID NO: 741635 - DNA, 20 bp, mouse
gtgcaaggtgaggccaccat

SEQ ID NO: 741636 - DNA, 20 bp, mouse
gcccgcctgacgtctagaag

SEQ ID NO: 741637 - DNA, 20 bp, mouse
ggacgcgcacgaattggagc

SEQ ID NO: 741638 - DNA, 20 bp, mouse
gcggggccgaagtgcgggcg

SEQ ID NO: 741639 - DNA, 20 bp, mouse
ggccccttctagacgtcagg

SEQ ID NO: 741640 - DNA, 20 bp, mouse
ggaccacgacgcgcacgaat

SEQ ID NO: 741641 - DNA, 20 bp, mouse
gctacaagacaggggttatc

SEQ ID NO: 741642 - DNA, 20 bp, mouse
gtcaggcggggccgaagtgc

SEQ ID NO: 741643 - DNA, 20 bp, mouse
ggagactggcgaatggggtg

SEQ ID NO: 741644 - DNA, 20 bp, mouse
ggcagccccttctagacgtc

SEQ ID NO: 741645 - DNA, 20 bp, mouse
gaagtgcgggcggggccccg

SEQ ID NO: 741646 - DNA, 20 bp, mouse
gggcggggagaggtactcgg

SEQ ID NO: 741647 - DNA, 20 bp, mouse
gcggggaggcggggtccctt

SEQ ID NO: 741648 - DNA, 20 bp, mouse
gcacccccacggcatcgtag

SEQ ID NO: 741649 - DNA, 20 bp, mouse
gagtgcggggacccggggac

SEQ ID NO: 741650 - DNA, 20 bp, mouse
gcggctggagggtggcccgg

SEQ ID NO: 741651 - DNA, 20 bp, mouse
gggactgaggggcttgcgtg

SEQ ID NO: 741652 - DNA, 20 bp, mouse
gggccaccctccagccgggg

SEQ ID NO: 741653 - DNA, 20 bp, mouse
ggcaagcccctcagtcccaa

SEQ ID NO: 741654 - DNA, 20 bp, mouse
gcgtgcgcgcagccggtccc

SEQ ID NO: 741655 - DNA, 20 bp, mouse
gggcgcgtgcacctgcccgc

SEQ ID NO: 741656 - DNA, 20 bp, mouse
gagaatgttggtccttgatc

SEQ ID NO: 741657 - DNA, 20 bp, mouse
gaaacgttaaaggcctcaac

SEQ ID NO: 741658 - DNA, 20 bp, mouse
gaggtcccgtaagagtgtaa

SEQ ID NO: 741659 - DNA, 20 bp, mouse
ggtcaacttccggcaggaac

SEQ ID NO: 741660 - DNA, 20 bp, mouse
gactctaaccaaccagatca

SEQ ID NO: 741661 - DNA, 20 bp, mouse
gggagacgcaaagattagaa

SEQ ID NO: 741662 - DNA, 20 bp, mouse
gacgggaccttttgtttcta

SEQ ID NO: 741663 - DNA, 20 bp, mouse
gcgtaagagtgtaagggaac

SEQ ID NO: 741664 - DNA, 20 bp, mouse
gatctggttggttagagttc

SEQ ID NO: 741665 - DNA, 20 bp, mouse
ggaagctcggttttctcttc

SEQ ID NO: 741666 - DNA, 20 bp, mouse
gcagcccagcgcggggcatc

SEQ ID NO: 741667 - DNA, 20 bp, mouse
ggcctccagatgccccgcgc

SEQ ID NO: 741668 - DNA, 20 bp, mouse
gcggagaccggccccttaaa

SEQ ID NO: 741669 - DNA, 20 bp, mouse
ggccagaggggcccggagac

SEQ ID NO: 741670 - DNA, 20 bp, mouse
ggaaacgggcggcttcgggg

SEQ ID NO: 741671 - DNA, 20 bp, mouse
gaccacttggcccccgacac

SEQ ID NO: 741672 - DNA, 20 bp, mouse
gcgagggtcacgtgagacca

SEQ ID NO: 741673 - DNA, 20 bp, mouse
gcgtcgcggccagaggggcc

SEQ ID NO: 741674 - DNA, 20 bp, mouse
ggtgagaccaaggccgactg

SEQ ID NO: 741675 - DNA, 20 bp, mouse
gaagtggtacttttgtgcga

SEQ ID NO: 741676 - DNA, 20 bp, mouse
gcgtactcaccgcgaggagg

SEQ ID NO: 741677 - DNA, 20 bp, mouse
gccagctcgccatggagcct

SEQ ID NO: 741678 - DNA, 20 bp, mouse
gacgcgctgtgtcccaaaca

SEQ ID NO: 741679 - DNA, 20 bp, mouse
gccttttggcgttcacgtta

SEQ ID NO: 741680 - DNA, 20 bp, mouse
gcctgcgcgtactcaccgcg

SEQ ID NO: 741681 - DNA, 20 bp, mouse
ggctcctaggcgccaggaca

SEQ ID NO: 741682 - DNA, 20 bp, mouse
ggacaaggtcatatgtactc

SEQ ID NO: 741683 - DNA, 20 bp, mouse
gccacgagcgccccctgtcc

SEQ ID NO: 741684 - DNA, 20 bp, mouse
gcacacatggtggcatacaa

SEQ ID NO: 741685 - DNA, 20 bp, mouse
gcttttaagcaatccggaag

SEQ ID NO: 741686 - DNA, 20 bp, mouse
gcccggggatttcctttcaa

SEQ ID NO: 741687 - DNA, 20 bp, mouse
gaaactgcgcccggcggacc

SEQ ID NO: 741688 - DNA, 20 bp, mouse
gagggcgagggcgcgggaga

SEQ ID NO: 741689 - DNA, 20 bp, mouse
gtctcttaggggatagatgg

SEQ ID NO: 741690 - DNA, 20 bp, mouse
ggccccgccgccaggtccgc

SEQ ID NO: 741691 - DNA, 20 bp, mouse
gcctcccgggcgggttctaa

SEQ ID NO: 741692 - DNA, 20 bp, mouse
ggacttagaggcacttcagg

SEQ ID NO: 741693 - DNA, 20 bp, mouse
gaggatagcgccctcccggg

SEQ ID NO: 741694 - DNA, 20 bp, mouse
gctggcgcgggagagggcga

SEQ ID NO: 741695 - DNA, 20 bp, mouse
gttccgttgtacagggagga

SEQ ID NO: 741696 - DNA, 20 bp, mouse
gcaggggtctagaacccaca

SEQ ID NO: 741697 - DNA, 20 bp, mouse
gagaacccacaaggaagaat

SEQ ID NO: 741698 - DNA, 20 bp, mouse
gtgtttggcaacctggggtg

SEQ ID NO: 741699 - DNA, 20 bp, mouse
gcaacctgattcaacagggt

SEQ ID NO: 741700 - DNA, 20 bp, mouse
gtcaaggagagcattcctct

SEQ ID NO: 741701 - DNA, 20 bp, mouse
gtcttccaattcttccttgt

SEQ ID NO: 741702 - DNA, 20 bp, mouse
gccccaggttgccaaacatc

SEQ ID NO: 741703 - DNA, 20 bp, mouse
ggagacttgcttgacctatg

SEQ ID NO: 741704 - DNA, 20 bp, mouse
ggacaggcaaaatccccaca

SEQ ID NO: 741705 - DNA, 20 bp, mouse
gtgcaatcaaagttgatcag

SEQ ID NO: 741706 - DNA, 20 bp, mouse
ggcagcgtgcgcggggaagt

SEQ ID NO: 741707 - DNA, 20 bp, mouse
ggaaacaaggaacgagggtg

SEQ ID NO: 741708 - DNA, 20 bp, mouse
gcgtgatagggacctcgtgg

SEQ ID NO: 741709 - DNA, 20 bp, mouse
gaacgagggtgtggcgaggc

SEQ ID NO: 741710 - DNA, 20 bp, mouse
gcagatgaaacaaggaacga

SEQ ID NO: 741711 - DNA, 20 bp, mouse
ggcagagccccgcgcgtgat

SEQ ID NO: 741712 - DNA, 20 bp, mouse
ggccaggttcagatgaaaca

SEQ ID NO: 741713 - DNA, 20 bp, mouse
ggcggggatccttgatagtg

SEQ ID NO: 741714 - DNA, 20 bp, mouse
ggatctcggggctggacagt

SEQ ID NO: 741715 - DNA, 20 bp, mouse
ggaggtccctatcacgcgcg

SEQ ID NO: 741716 - DNA, 20 bp, mouse
gccctcccaaaactcagtgg

SEQ ID NO: 741717 - DNA, 20 bp, mouse
gaactggctcctagcgagta

SEQ ID NO: 741718 - DNA, 20 bp, mouse
gaggccctggagagtgagaa

SEQ ID NO: 741719 - DNA, 20 bp, mouse
ggcccccactgagttttggg

SEQ ID NO: 741720 - DNA, 20 bp, mouse
gcccagaagccatactcgct

SEQ ID NO: 741721 - DNA, 20 bp, mouse
gaacctgcaaacttcgccta

SEQ ID NO: 741722 - DNA, 20 bp, mouse
gaaggaagcgggtggcgagg

SEQ ID NO: 741723 - DNA, 20 bp, mouse
gcaggcccccactgagtttt

SEQ ID NO: 741724 - DNA, 20 bp, mouse
ggagtatggcttctgggcgt

SEQ ID NO: 741725 - DNA, 20 bp, mouse
gcggctcactccactatcta

SEQ ID NO: 741726 - DNA, 20 bp, mouse
ggcagcacgccgtgagtaag

SEQ ID NO: 741727 - DNA, 20 bp, mouse
gaatgagcgagcgccgtgga

SEQ ID NO: 741728 - DNA, 20 bp, mouse
gcgtggaaggaaaagaccga

SEQ ID NO: 741729 - DNA, 20 bp, mouse
ggtaagaggagctagggcga

SEQ ID NO: 741730 - DNA, 20 bp, mouse
gccctagctcctcttactca

SEQ ID NO: 741731 - DNA, 20 bp, mouse
gccagcacccgcaacctgaa

SEQ ID NO: 741732 - DNA, 20 bp, mouse
gaacctgcgggcaatcagca

SEQ ID NO: 741733 - DNA, 20 bp, mouse
gacagcgtcgccaaccgacc

SEQ ID NO: 741734 - DNA, 20 bp, mouse
gagaggagctagggcgaagg

SEQ ID NO: 741735 - DNA, 20 bp, mouse
gcggagaccacgcccacgtc

SEQ ID NO: 741736 - DNA, 20 bp, mouse
gaggctggactgctcggcgg

SEQ ID NO: 741737 - DNA, 20 bp, mouse
gaggaccgcccccatcgtgc

SEQ ID NO: 741738 - DNA, 20 bp, mouse
ggagactagacacgcggcag

SEQ ID NO: 741739 - DNA, 20 bp, mouse
ggcctcggagactagacacg

SEQ ID NO: 741740 - DNA, 20 bp, mouse
gggctccagagactactctg

SEQ ID NO: 741741 - DNA, 20 bp, mouse
ggccgcgtgtctagtctccg

SEQ ID NO: 741742 - DNA, 20 bp, mouse
ggagcctgggcgacaggaca

SEQ ID NO: 741743 - DNA, 20 bp, mouse
gcgacttgaatgcacggggt

SEQ ID NO: 741744 - DNA, 20 bp, mouse
gaaaaggagccaataaaata

SEQ ID NO: 741745 - DNA, 20 bp, mouse
ggcgacaggacagggagcgt

SEQ ID NO: 741746 - DNA, 20 bp, mouse
gcgcgcctgcgcacacaggg

SEQ ID NO: 741747 - DNA, 20 bp, mouse
gcttgctgcgctggagaagt

SEQ ID NO: 741748 - DNA, 20 bp, mouse
gcagctggaggagatccatc

SEQ ID NO: 741749 - DNA, 20 bp, mouse
gcgcagcaagcgggttttac

SEQ ID NO: 741750 - DNA, 20 bp, mouse
gttgccgggtacagaccagc

SEQ ID NO: 741751 - DNA, 20 bp, mouse
gctgcacccccaggctccga

SEQ ID NO: 741752 - DNA, 20 bp, mouse
gcaaatggggaacccgactt

SEQ ID NO: 741753 - DNA, 20 bp, mouse
gtggggaacccgacttaggc

SEQ ID NO: 741754 - DNA, 20 bp, mouse
ggcgccgagctcctttgctg

SEQ ID NO: 741755 - DNA, 20 bp, mouse
gcctccagctggtctgtacc

SEQ ID NO: 741756 - DNA, 20 bp, mouse
ggccccgcctccattaagga

SEQ ID NO: 741757 - DNA, 20 bp, mouse
gctacccagcccctccttaa

SEQ ID NO: 741758 - DNA, 20 bp, mouse
gctgggtagccgtgaggatt

SEQ ID NO: 741759 - DNA, 20 bp, mouse
ggaggggctgggtagccgtg

SEQ ID NO: 741760 - DNA, 20 bp, mouse
gtctcctgggtgcacgaaaa

SEQ ID NO: 741761 - DNA, 20 bp, mouse
gacaactcccctaatcctca

SEQ ID NO: 741762 - DNA, 20 bp, mouse
gaggagatttcgcattacta

SEQ ID NO: 741763 - DNA, 20 bp, mouse
gtctccgagagtgtgctcat

SEQ ID NO: 741764 - DNA, 20 bp, mouse
ggagagcggcgagggcaata

SEQ ID NO: 741765 - DNA, 20 bp, mouse
gcactctcggagagcggcga

SEQ ID NO: 741766 - DNA, 20 bp, mouse
gaaggcgcagcagcagtcag

SEQ ID NO: 741767 - DNA, 20 bp, mouse
gggagcagcgacaaggatcg

SEQ ID NO: 741768 - DNA, 20 bp, mouse
gcggccgagccgctcaatcg

SEQ ID NO: 741769 - DNA, 20 bp, mouse
gctggaaagccgcgattgag

SEQ ID NO: 741770 - DNA, 20 bp, mouse
ggcccgcacacaactgcttc

SEQ ID NO: 741771 - DNA, 20 bp, mouse
gaaggcagtgcgagcctcct

SEQ ID NO: 741772 - DNA, 20 bp, mouse
gcgagcctcctcggcagcgg

SEQ ID NO: 741773 - DNA, 20 bp, mouse
gtccagggcccactctttaa

SEQ ID NO: 741774 - DNA, 20 bp, mouse
ggcagctcggagcagcgaca

SEQ ID NO: 741775 - DNA, 20 bp, mouse
gcggtctttcacatttgttt

SEQ ID NO: 741776 - DNA, 20 bp, mouse
gtgcgccgatctgcgctcat

SEQ ID NO: 741777 - DNA, 20 bp, mouse
ggggaagtagaggccggcgg

SEQ ID NO: 741778 - DNA, 20 bp, mouse
gcgggcccaggacgcgagcg

SEQ ID NO: 741779 - DNA, 20 bp, mouse
gcgccggcctcggccacccg

SEQ ID NO: 741780 - DNA, 20 bp, mouse
gggtggggatcgggaagcgc

SEQ ID NO: 741781 - DNA, 20 bp, mouse
ggcggcggtaaacaagttgc

SEQ ID NO: 741782 - DNA, 20 bp, mouse
ggtagcccatgagcgcagat

SEQ ID NO: 741783 - DNA, 20 bp, mouse
gggaccccggccgccggcct

SEQ ID NO: 741784 - DNA, 20 bp, mouse
gcgcagatcggcgcacgcac

SEQ ID NO: 741785 - DNA, 20 bp, mouse
gtggtccacgctcgcgtcct

SEQ ID NO: 741786 - DNA, 20 bp, mouse
ggtgcaggaggtgtaggcag

SEQ ID NO: 741787 - DNA, 20 bp, mouse
gaggagacagtgcgagggtg

SEQ ID NO: 741788 - DNA, 20 bp, mouse
gtgcagggaaaggctggcgg

SEQ ID NO: 741789 - DNA, 20 bp, mouse
gaaagaggatgggtgagagg

SEQ ID NO: 741790 - DNA, 20 bp, mouse
gtacacctcctgcaccctgg

SEQ ID NO: 741791 - DNA, 20 bp, mouse
gcaatgaggagacagtgcga

SEQ ID NO: 741792 - DNA, 20 bp, mouse
gtgtaggcaggggaatgcct

SEQ ID NO: 741793 - DNA, 20 bp, mouse
gagtggcagggcgtgcgact

SEQ ID NO: 741794 - DNA, 20 bp, mouse
gtgtctcctcattgactact

SEQ ID NO: 741795 - DNA, 20 bp, mouse
gaccgcgtggcattcagtcc

SEQ ID NO: 741796 - DNA, 20 bp, mouse
gtggaggcaaggctctgcta

SEQ ID NO: 741797 - DNA, 20 bp, mouse
gtcaggcttagggaccaaag

SEQ ID NO: 741798 - DNA, 20 bp, mouse
gaaggctctgctagggactc

SEQ ID NO: 741799 - DNA, 20 bp, mouse
gcaggcaggaggcatagcac

SEQ ID NO: 741800 - DNA, 20 bp, mouse
gaggaggcatagcacaggca

SEQ ID NO: 741801 - DNA, 20 bp, mouse
gctgctagggactcaggctt

SEQ ID NO: 741802 - DNA, 20 bp, mouse
gttggagaaccaggatctgt

SEQ ID NO: 741803 - DNA, 20 bp, mouse
gtagtcccggatatgggaga

SEQ ID NO: 741804 - DNA, 20 bp, mouse
ggaaccaggatctgtgggac

SEQ ID NO: 741805 - DNA, 20 bp, mouse
gaaggtatctggtgacccct

SEQ ID NO: 741806 - DNA, 20 bp, mouse
ggggccgtggcgactccaga

SEQ ID NO: 741807 - DNA, 20 bp, mouse
gtcccgtgaggcgcccggaa

SEQ ID NO: 741808 - DNA, 20 bp, mouse
gcccccgcgcctcagcgccc

SEQ ID NO: 741809 - DNA, 20 bp, mouse
gtggaggccgcctgaggccc

SEQ ID NO: 741810 - DNA, 20 bp, mouse
gtcagcgcccgggcctcagg

SEQ ID NO: 741811 - DNA, 20 bp, mouse
gaggcccgggcgctgaggcg

SEQ ID NO: 741812 - DNA, 20 bp, mouse
gtacttgagcccggattgga

SEQ ID NO: 741813 - DNA, 20 bp, mouse
gagggcgctaagtgacaagc

SEQ ID NO: 741814 - DNA, 20 bp, mouse
ggtgaggcgcccggaaggga

SEQ ID NO: 741815 - DNA, 20 bp, mouse
gtcaccgtggaggccgcctg

SEQ ID NO: 741816 - DNA, 20 bp, mouse
ggcccaccggaaggcgtgaa

SEQ ID NO: 741817 - DNA, 20 bp, mouse
ggaggcctcgcgccttgagg

SEQ ID NO: 741818 - DNA, 20 bp, mouse
gtcaaggcgcgaggcctctc

SEQ ID NO: 741819 - DNA, 20 bp, mouse
gagtcccaaggcccaccgga

SEQ ID NO: 741820 - DNA, 20 bp, mouse
ggggcgcacccgcgactgtc

SEQ ID NO: 741821 - DNA, 20 bp, mouse
gacgccttccggtgggcctt

SEQ ID NO: 741822 - DNA, 20 bp, mouse
gtgcccttcacgccttccgg

SEQ ID NO: 741823 - DNA, 20 bp, mouse
gggcgtgtcctgacagtcgc

SEQ ID NO: 741824 - DNA, 20 bp, mouse
gggttctagccgcctctcag

SEQ ID NO: 741825 - DNA, 20 bp, mouse
ggccccaccccgctgagagg

SEQ ID NO: 741826 - DNA, 20 bp, mouse
gccacccggccttgactgag

SEQ ID NO: 741827 - DNA, 20 bp, mouse
gagagggaggttagagctaa

SEQ ID NO: 741828 - DNA, 20 bp, mouse
gtagaaaggagacgaggacc

SEQ ID NO: 741829 - DNA, 20 bp, mouse
gaagaggattagtagccaga

SEQ ID NO: 741830 - DNA, 20 bp, mouse
ggaaggctagaaaggagacg

SEQ ID NO: 741831 - DNA, 20 bp, mouse
gagtacctctcagtcaaggc

SEQ ID NO: 741832 - DNA, 20 bp, mouse
gggacaggtagaaactaaag

SEQ ID NO: 741833 - DNA, 20 bp, mouse
gttacagtacctctcagtca

SEQ ID NO: 741834 - DNA, 20 bp, mouse
ggggcgagtgttgttaacat

SEQ ID NO: 741835 - DNA, 20 bp, mouse
gcaagccggagcaagctagg

SEQ ID NO: 741836 - DNA, 20 bp, mouse
gcccgtcagccaagtgacgg

SEQ ID NO: 741837 - DNA, 20 bp, mouse
gccagcaagtcgtaagatag

SEQ ID NO: 741838 - DNA, 20 bp, mouse
ggatgagttcgcggtgactg

SEQ ID NO: 741839 - DNA, 20 bp, mouse
ggggtggagggatgagttcg

SEQ ID NO: 741840 - DNA, 20 bp, mouse
gcggctgaggccagtgcggg

SEQ ID NO: 741841 - DNA, 20 bp, mouse
gtggcctgacccgcccgcac

SEQ ID NO: 741842 - DNA, 20 bp, mouse
gacgcccgtcagccaagtga

SEQ ID NO: 741843 - DNA, 20 bp, mouse
gtcagtggcccggagcggat

SEQ ID NO: 741844 - DNA, 20 bp, mouse
gccaccccacccccgtcact

SEQ ID NO: 741845 - DNA, 20 bp, mouse
gttcgctcagtggcccggag

SEQ ID NO: 741846 - DNA, 20 bp, mouse
ggtcacatggcatagatgtc

SEQ ID NO: 741847 - DNA, 20 bp, mouse
gctaccaggatctgaccctc

SEQ ID NO: 741848 - DNA, 20 bp, mouse
gaagtaggagagtgcttcta

SEQ ID NO: 741849 - DNA, 20 bp, mouse
gggcagatgtatcagagtgc

SEQ ID NO: 741850 - DNA, 20 bp, mouse
gcctgggaagctaatcctct

SEQ ID NO: 741851 - DNA, 20 bp, mouse
gaccacagaagctatagtcc

SEQ ID NO: 741852 - DNA, 20 bp, mouse
ggacagcgagggattagagc

SEQ ID NO: 741853 - DNA, 20 bp, mouse
gaagctaatcctctaggcag

SEQ ID NO: 741854 - DNA, 20 bp, mouse
gaaagggttctaagggcctg

SEQ ID NO: 741855 - DNA, 20 bp, mouse
gccgtgacctgcccctagga

SEQ ID NO: 741856 - DNA, 20 bp, mouse
gccgccgcgctcccattcgc

SEQ ID NO: 741857 - DNA, 20 bp, mouse
gggacggtcgcaccgagctg

SEQ ID NO: 741858 - DNA, 20 bp, mouse
ggaacccaaagatcggggtc

SEQ ID NO: 741859 - DNA, 20 bp, mouse
gggcgccgagctggtccaac

SEQ ID NO: 741860 - DNA, 20 bp, mouse
gagtgccagggagtcgggga

SEQ ID NO: 741861 - DNA, 20 bp, mouse
gccacgccggggctagcgcg

SEQ ID NO: 741862 - DNA, 20 bp, mouse
gggagcggcctctgaggtgt

SEQ ID NO: 741863 - DNA, 20 bp, mouse
gaaaaccagcccctcctcaa

SEQ ID NO: 741864 - DNA, 20 bp, mouse
ggccgcgctgatcaccgctg

SEQ ID NO: 741865 - DNA, 20 bp, mouse
gccagagtgccagggagtcg

SEQ ID NO: 741866 - DNA, 20 bp, mouse
ggtagggagacccgagtctg

SEQ ID NO: 741867 - DNA, 20 bp, mouse
gcgcagtggaaagtgtgagg

SEQ ID NO: 741868 - DNA, 20 bp, mouse
gagccgagccctcctctcgg

SEQ ID NO: 741869 - DNA, 20 bp, mouse
gcccgcgccttggtctgggg

SEQ ID NO: 741870 - DNA, 20 bp, mouse
gaggtgaagagggggcggta

SEQ ID NO: 741871 - DNA, 20 bp, mouse
gagtctgaggaagtaaacaa

SEQ ID NO: 741872 - DNA, 20 bp, mouse
gaaccccgcgccttggtctg

SEQ ID NO: 741873 - DNA, 20 bp, mouse
gcgagccctcctctcggtgg

SEQ ID NO: 741874 - DNA, 20 bp, mouse
gagcagccgagccctcctct

SEQ ID NO: 741875 - DNA, 20 bp, mouse
gagatgctgaaaggctaggc

SEQ ID NO: 741876 - DNA, 20 bp, mouse
gcctgcgcgaacggggaagg

SEQ ID NO: 741877 - DNA, 20 bp, mouse
gggactctccagggatttat

SEQ ID NO: 741878 - DNA, 20 bp, mouse
ggcgcctgcgcgaacgggga

SEQ ID NO: 741879 - DNA, 20 bp, mouse
gcgcgaacggggaaggtggt

SEQ ID NO: 741880 - DNA, 20 bp, mouse
ggaagctccgcccctcgcac

SEQ ID NO: 741881 - DNA, 20 bp, mouse
gcgcgcaggcgcgtgtggaa

SEQ ID NO: 741882 - DNA, 20 bp, mouse
gggaaactgtagggacaact

SEQ ID NO: 741883 - DNA, 20 bp, mouse
gcacacgcgcctgcgcgaac

SEQ ID NO: 741884 - DNA, 20 bp, mouse
ggcggagcttccggaggata

SEQ ID NO: 741885 - DNA, 20 bp, mouse
gcgaggggcggagcttccgg

SEQ ID NO: 741886 - DNA, 20 bp, mouse
gtccccacatggagaggaag

SEQ ID NO: 741887 - DNA, 20 bp, mouse
gctcctgaagccagtgacta

SEQ ID NO: 741888 - DNA, 20 bp, mouse
gcagctacatctaaacatag

SEQ ID NO: 741889 - DNA, 20 bp, mouse
gtaaggttccccacatggag

SEQ ID NO: 741890 - DNA, 20 bp, mouse
gtggcctttgctttctacag

SEQ ID NO: 741891 - DNA, 20 bp, mouse
gagcttctaaaacagtgtct

SEQ ID NO: 741892 - DNA, 20 bp, mouse
gccaaggaaatgtgagcttt

SEQ ID NO: 741893 - DNA, 20 bp, mouse
gctaggacctacattgtcga

SEQ ID NO: 741894 - DNA, 20 bp, mouse
gttcttgcatatttacagac

SEQ ID NO: 741895 - DNA, 20 bp, mouse
gaggtttctcttctgggcgt

SEQ ID NO: 741896 - DNA, 20 bp, mouse
ggggagggtggcaggatgga

SEQ ID NO: 741897 - DNA, 20 bp, mouse
gactggatgcaggagatggg

SEQ ID NO: 741898 - DNA, 20 bp, mouse
ggtcatgtgtggaattatgt

SEQ ID NO: 741899 - DNA, 20 bp, mouse
gccagcttctcacttggctc

SEQ ID NO: 741900 - DNA, 20 bp, mouse
gaggctcagggtttctattt

SEQ ID NO: 741901 - DNA, 20 bp, mouse
gttgactggatgcaggagat

SEQ ID NO: 741902 - DNA, 20 bp, mouse
gggcttcagagacaatacaa

SEQ ID NO: 741903 - DNA, 20 bp, mouse
gttcagagacaatacaaggg

SEQ ID NO: 741904 - DNA, 20 bp, mouse
ggtgggaagaaaacaatact

SEQ ID NO: 741905 - DNA, 20 bp, mouse
gggtgactggaaaacacagt

SEQ ID NO: 741906 - DNA, 20 bp, mouse
ggggcagaacagatcccctt

SEQ ID NO: 741907 - DNA, 20 bp, mouse
gcgcccaggtctgtcctcca

SEQ ID NO: 741908 - DNA, 20 bp, mouse
gctaggggtctcttcccaag

SEQ ID NO: 741909 - DNA, 20 bp, mouse
gcgtgcggagtccttcctag

SEQ ID NO: 741910 - DNA, 20 bp, mouse
gccccctggaggacagacct

SEQ ID NO: 741911 - DNA, 20 bp, mouse
gcagggtccaatagggagga

SEQ ID NO: 741912 - DNA, 20 bp, mouse
ggtggcggggtgcctctcct

SEQ ID NO: 741913 - DNA, 20 bp, mouse
ggggcctgcgcaccaggcca

SEQ ID NO: 741914 - DNA, 20 bp, mouse
gtgggaagagacccctagga

SEQ ID NO: 741915 - DNA, 20 bp, mouse
gcagttggggtgagcattca

SEQ ID NO: 741916 - DNA, 20 bp, mouse
gccagcgtgaggttccccgt

SEQ ID NO: 741917 - DNA, 20 bp, mouse
gctgccctgccaccgcccaa

SEQ ID NO: 741918 - DNA, 20 bp, mouse
gccctgccaccgcccaaggg

SEQ ID NO: 741919 - DNA, 20 bp, mouse
gcccaggcctgggcctttaa

SEQ ID NO: 741920 - DNA, 20 bp, mouse
gtctgtgcttcctctgtcaa

SEQ ID NO: 741921 - DNA, 20 bp, mouse
gggccctattcccttgacag

SEQ ID NO: 741922 - DNA, 20 bp, mouse
gcctttaaagggtccttggt

SEQ ID NO: 741923 - DNA, 20 bp, mouse
gtgggcctttaaagggtcct

SEQ ID NO: 741924 - DNA, 20 bp, mouse
gctgaaatgagcagctgcag

SEQ ID NO: 741925 - DNA, 20 bp, mouse
gtagttagcaccatgacctt

SEQ ID NO: 741926 - DNA, 20 bp, mouse
gctcgggatcaggaaatgtc

SEQ ID NO: 741927 - DNA, 20 bp, mouse
ggctggctgcaaactttccc

SEQ ID NO: 741928 - DNA, 20 bp, mouse
gggctcatcgcgtggacaga

SEQ ID NO: 741929 - DNA, 20 bp, mouse
gagggcgccgcccactcccg

SEQ ID NO: 741930 - DNA, 20 bp, mouse
gccgagggtgccagcaacag

SEQ ID NO: 741931 - DNA, 20 bp, mouse
gcccactcccggggctgtcc

SEQ ID NO: 741932 - DNA, 20 bp, mouse
gtagcggcaaggtagaagaa

SEQ ID NO: 741933 - DNA, 20 bp, mouse
gtccccaaatccagaagacc

SEQ ID NO: 741934 - DNA, 20 bp, mouse
gtcccctggtcttctggatt

SEQ ID NO: 741935 - DNA, 20 bp, mouse
gaggaactcccctggtcttc

SEQ ID NO: 741936 - DNA, 20 bp, mouse
ggagagactccaaactgcga

SEQ ID NO: 741937 - DNA, 20 bp, mouse
ggggaggcggcgtctaggaa

SEQ ID NO: 741938 - DNA, 20 bp, mouse
gaggccctcccacttcaagt

SEQ ID NO: 741939 - DNA, 20 bp, mouse
gtgcgtaaataagggatgtg

SEQ ID NO: 741940 - DNA, 20 bp, mouse
gggagtggtgagaatgagtg

SEQ ID NO: 741941 - DNA, 20 bp, mouse
gactccaaactgcgaggggg

SEQ ID NO: 741942 - DNA, 20 bp, mouse
gacctcagtcccagccgcca

SEQ ID NO: 741943 - DNA, 20 bp, mouse
ggccttggctgcgtaaataa

SEQ ID NO: 741944 - DNA, 20 bp, mouse
gactgaggtcggcgcggctc

SEQ ID NO: 741945 - DNA, 20 bp, mouse
gtctaggaaaggcctgacct

SEQ ID NO: 741946 - DNA, 20 bp, mouse
gggtctggccggggtcggaa

SEQ ID NO: 741947 - DNA, 20 bp, mouse
ggccggggtcggaagggtta

SEQ ID NO: 741948 - DNA, 20 bp, mouse
gaggcaggcccggcatgctg

SEQ ID NO: 741949 - DNA, 20 bp, mouse
gaaaagcaaggggtctcagt

SEQ ID NO: 741950 - DNA, 20 bp, mouse
ggggatcgaagccaccacct

SEQ ID NO: 741951 - DNA, 20 bp, mouse
gtgggggagggcataagaga

SEQ ID NO: 741952 - DNA, 20 bp, mouse
ggcaacggggaggcgccagg

SEQ ID NO: 741953 - DNA, 20 bp, mouse
ggcgcccgagccttatgccc

SEQ ID NO: 741954 - DNA, 20 bp, mouse
gacgctggtctggccggggt

SEQ ID NO: 741955 - DNA, 20 bp, mouse
ggggcctgacgtcctcggac

SEQ ID NO: 741956 - DNA, 20 bp, mouse
ggaggacagcaagttggcta

SEQ ID NO: 741957 - DNA, 20 bp, mouse
gaagctggggagggatgcgt

SEQ ID NO: 741958 - DNA, 20 bp, mouse
gtctgggcgcgcttcccaag

SEQ ID NO: 741959 - DNA, 20 bp, mouse
gtcgcctagggaggaaccga

SEQ ID NO: 741960 - DNA, 20 bp, mouse
gaagaggcgcctggggaggt

SEQ ID NO: 741961 - DNA, 20 bp, mouse
gtgcccaaggctaggaactc

SEQ ID NO: 741962 - DNA, 20 bp, mouse
gcgcacatggagagcggggg

SEQ ID NO: 741963 - DNA, 20 bp, mouse
gaaaacaaaagaggcgcctg

SEQ ID NO: 741964 - DNA, 20 bp, mouse
gggacccgccagcccacgct

SEQ ID NO: 741965 - DNA, 20 bp, mouse
gcggaggtaggtgtgtagat

SEQ ID NO: 741966 - DNA, 20 bp, mouse
gtaaccaaagtctggttctt

SEQ ID NO: 741967 - DNA, 20 bp, mouse
gcatcagtcgggagatggat

SEQ ID NO: 741968 - DNA, 20 bp, mouse
gggttcacatcgggacttaa

SEQ ID NO: 741969 - DNA, 20 bp, mouse
gcaggggtatggtagggggt

SEQ ID NO: 741970 - DNA, 20 bp, mouse
gctggtccacatatcttcat

SEQ ID NO: 741971 - DNA, 20 bp, mouse
gttagttcgaggaactaaaa

SEQ ID NO: 741972 - DNA, 20 bp, mouse
gggttgtctgcagcgggcag

SEQ ID NO: 741973 - DNA, 20 bp, mouse
gcacggagtggatctaaaat

SEQ ID NO: 741974 - DNA, 20 bp, mouse
ggagccccgcggctgatttg

SEQ ID NO: 741975 - DNA, 20 bp, mouse
gtggagttggcgggtggcag

SEQ ID NO: 741976 - DNA, 20 bp, mouse
gcagccctctagacacctaa

SEQ ID NO: 741977 - DNA, 20 bp, mouse
gaggacaggactaggcaagt

SEQ ID NO: 741978 - DNA, 20 bp, mouse
ggcaagtgggttggtcttgg

SEQ ID NO: 741979 - DNA, 20 bp, mouse
gctgcccttaggtgtctaga

SEQ ID NO: 741980 - DNA, 20 bp, mouse
gttgcctagtcctgtcctga

SEQ ID NO: 741981 - DNA, 20 bp, mouse
gggggggggtgttgtccttg

SEQ ID NO: 741982 - DNA, 20 bp, mouse
gccagccagggagtctccag

SEQ ID NO: 741983 - DNA, 20 bp, mouse
gtagtcctgtcctgagggtg

SEQ ID NO: 741984 - DNA, 20 bp, mouse
gtaggcaagtgggttggtct

SEQ ID NO: 741985 - DNA, 20 bp, mouse
ggcaacaggggcttcagaaa

SEQ ID NO: 741986 - DNA, 20 bp, mouse
gtcgctggggaggacgcgta

SEQ ID NO: 741987 - DNA, 20 bp, mouse
gcctccccagcgactcccgg

SEQ ID NO: 741988 - DNA, 20 bp, mouse
gcctcctcggcagctcacgc

SEQ ID NO: 741989 - DNA, 20 bp, mouse
gccagagaagcgagatggga

SEQ ID NO: 741990 - DNA, 20 bp, mouse
gtggcggtggagaaaaccca

SEQ ID NO: 741991 - DNA, 20 bp, mouse
gtgggccagagaagcgagat

SEQ ID NO: 741992 - DNA, 20 bp, mouse
gaagaggcaaggggtcaagt

SEQ ID NO: 741993 - DNA, 20 bp, mouse
gcacctcgcgcccggtcctc

SEQ ID NO: 741994 - DNA, 20 bp, mouse
gcgccgccgccgggagtcgc

SEQ ID NO: 741995 - DNA, 20 bp, mouse
gggaccggcagcaaaaggga

SEQ ID NO: 741996 - DNA, 20 bp, mouse
gacacaccagggtgacccaa

SEQ ID NO: 741997 - DNA, 20 bp, mouse
gacccaaaggttgctctcct

SEQ ID NO: 741998 - DNA, 20 bp, mouse
gtaagggggtagatagaccc

SEQ ID NO: 741999 - DNA, 20 bp, mouse
gacccaggagagcaaccttt

SEQ ID NO: 742000 - DNA, 20 bp, mouse
gtgctagttcaaggttaagg

SEQ ID NO: 742001 - DNA, 20 bp, mouse
ggaagtgagtaacaccaagt

SEQ ID NO: 742002 - DNA, 20 bp, mouse
gggggaggggatgcaaatct

SEQ ID NO: 742003 - DNA, 20 bp, mouse
gagtaacaccaagtggggga

SEQ ID NO: 742004 - DNA, 20 bp, mouse
gcagaagtgactgtcagaga

SEQ ID NO: 742005 - DNA, 20 bp, mouse
gcactgtaggagaagttccc

SEQ ID NO: 742006 - DNA, 20 bp, mouse
gagaacaagcaggcactccc

SEQ ID NO: 742007 - DNA, 20 bp, mouse
gcctccctgcaaaatggtct

SEQ ID NO: 742008 - DNA, 20 bp, mouse
gcgaagggacggagctcgga

SEQ ID NO: 742009 - DNA, 20 bp, mouse
gaggtgggggtgagcacgaa

SEQ ID NO: 742010 - DNA, 20 bp, mouse
gggaacccgacggcatctga

SEQ ID NO: 742011 - DNA, 20 bp, mouse
gctggctgggtcgtggactc

SEQ ID NO: 742012 - DNA, 20 bp, mouse
gccacctgctggacgtgcct

SEQ ID NO: 742013 - DNA, 20 bp, mouse
gagtgcctgcttgttctggc

SEQ ID NO: 742014 - DNA, 20 bp, mouse
gggacggagctcggatggtg

SEQ ID NO: 742015 - DNA, 20 bp, mouse
gactcccaggcacgtccagc

SEQ ID NO: 742016 - DNA, 20 bp, mouse
ggggctcagtccagccttca

SEQ ID NO: 742017 - DNA, 20 bp, mouse
gggagcctcccgaagaagtg

SEQ ID NO: 742018 - DNA, 20 bp, mouse
ggtgtcccgaaatggaaagt

SEQ ID NO: 742019 - DNA, 20 bp, mouse
gtactcctcacttcttcggg

SEQ ID NO: 742020 - DNA, 20 bp, mouse
ggagagggcaagatatcacg

SEQ ID NO: 742021 - DNA, 20 bp, mouse
gcacgtgaccacatcacgtg

SEQ ID NO: 742022 - DNA, 20 bp, mouse
gcactcgggagaaaggccgt

SEQ ID NO: 742023 - DNA, 20 bp, mouse
gtctcccgagtgtcccgaaa

SEQ ID NO: 742024 - DNA, 20 bp, mouse
ggaccacatcacgtgcggaa

SEQ ID NO: 742025 - DNA, 20 bp, mouse
gtcgggagaaaggccgtggg

SEQ ID NO: 742026 - DNA, 20 bp, mouse
gagagggaggcggtgatgtc

SEQ ID NO: 742027 - DNA, 20 bp, mouse
gactctttctagtttaataa

SEQ ID NO: 742028 - DNA, 20 bp, mouse
ggaggcggtgatgtccgggc

SEQ ID NO: 742029 - DNA, 20 bp, mouse
gtgatgtccgggcaggaggg

SEQ ID NO: 742030 - DNA, 20 bp, mouse
gggagtcataagaccagggg

SEQ ID NO: 742031 - DNA, 20 bp, mouse
gcagctggagtcataagacc

SEQ ID NO: 742032 - DNA, 20 bp, mouse
ggaaccaaaaagccagggcg

SEQ ID NO: 742033 - DNA, 20 bp, mouse
ggcatgcttagaaactgaga

SEQ ID NO: 742034 - DNA, 20 bp, mouse
gtagaaagagttgtgcgagg

SEQ ID NO: 742035 - DNA, 20 bp, mouse
gtcaagagcatggtctgatc

SEQ ID NO: 742036 - DNA, 20 bp, mouse
gtgggggctagttagggtga

SEQ ID NO: 742037 - DNA, 20 bp, mouse
gtgtgggtgggggctagtta

SEQ ID NO: 742038 - DNA, 20 bp, mouse
gagacccatctcataaggga

SEQ ID NO: 742039 - DNA, 20 bp, mouse
gaggaatggtggcaaatctg

SEQ ID NO: 742040 - DNA, 20 bp, mouse
ggagatgaaagtgtgggtgg

SEQ ID NO: 742041 - DNA, 20 bp, mouse
ggtggagacccatctcataa

SEQ ID NO: 742042 - DNA, 20 bp, mouse
gtctccttcccttatgagat

SEQ ID NO: 742043 - DNA, 20 bp, mouse
gaagctcatccacttatggc

SEQ ID NO: 742044 - DNA, 20 bp, mouse
gtgtttactttctcactatg

SEQ ID NO: 742045 - DNA, 20 bp, mouse
gtcagtttccctgccataag

SEQ ID NO: 742046 - DNA, 20 bp, mouse
gtggacagctcctgcatcct

SEQ ID NO: 742047 - DNA, 20 bp, mouse
gtggccggtagagtgagcta

SEQ ID NO: 742048 - DNA, 20 bp, mouse
gtctagaaggccaatgggat

SEQ ID NO: 742049 - DNA, 20 bp, mouse
gggatagtcgcgtgctgcac

SEQ ID NO: 742050 - DNA, 20 bp, mouse
ggagagttctggaaataacg

SEQ ID NO: 742051 - DNA, 20 bp, mouse
gctaagggagggggcggact

SEQ ID NO: 742052 - DNA, 20 bp, mouse
gcatactggctgtacctggt

SEQ ID NO: 742053 - DNA, 20 bp, mouse
gggaaatccctcaaagtggc

SEQ ID NO: 742054 - DNA, 20 bp, mouse
gcagagcagtatacagaccc

SEQ ID NO: 742055 - DNA, 20 bp, mouse
gtagagtgagctaagggagg

SEQ ID NO: 742056 - DNA, 20 bp, mouse
gcggacccgcggcacgtgat

SEQ ID NO: 742057 - DNA, 20 bp, mouse
ggggaccggaaggcaagatt

SEQ ID NO: 742058 - DNA, 20 bp, mouse
gcccgcggcacgtgatagga

SEQ ID NO: 742059 - DNA, 20 bp, mouse
ggccgcgggtccgctcacgt

SEQ ID NO: 742060 - DNA, 20 bp, mouse
gaaagtgcgtcctacgtgag

SEQ ID NO: 742061 - DNA, 20 bp, mouse
gcagccgcgggtcatgtgac

SEQ ID NO: 742062 - DNA, 20 bp, mouse
gtaggacaggctaggcgagg

SEQ ID NO: 742063 - DNA, 20 bp, mouse
gcgtgacaatcgccaaccaa

SEQ ID NO: 742064 - DNA, 20 bp, mouse
gcggcacgtgataggaaggc

SEQ ID NO: 742065 - DNA, 20 bp, mouse
gcactggccactaaagctaa

SEQ ID NO: 742066 - DNA, 20 bp, mouse
gtcaccgggcccatctactg

SEQ ID NO: 742067 - DNA, 20 bp, mouse
gccactggaacgctgaacta

SEQ ID NO: 742068 - DNA, 20 bp, mouse
gggccaccggaagcgactga

SEQ ID NO: 742069 - DNA, 20 bp, mouse
gcaagaggctgcgactgtag

SEQ ID NO: 742070 - DNA, 20 bp, mouse
gctcgcgcggggcgggaatt

SEQ ID NO: 742071 - DNA, 20 bp, mouse
gagcgggagcgcaaggacag

SEQ ID NO: 742072 - DNA, 20 bp, mouse
gcacaaccacatggtcccac

SEQ ID NO: 742073 - DNA, 20 bp, mouse
gttcccagaggccctcgcgc

SEQ ID NO: 742074 - DNA, 20 bp, mouse
ggcccaggagcccagctacg

SEQ ID NO: 742075 - DNA, 20 bp, mouse
gccgagggagccattaagga

SEQ ID NO: 742076 - DNA, 20 bp, mouse
ggcgccacgagcagctgggt

SEQ ID NO: 742077 - DNA, 20 bp, mouse
gtacataatgggtctgggaa

SEQ ID NO: 742078 - DNA, 20 bp, mouse
gggaacttccggggagaccc

SEQ ID NO: 742079 - DNA, 20 bp, mouse
gaacggaagatgatcctgtg

SEQ ID NO: 742080 - DNA, 20 bp, mouse
gccatccaactcacctacaa

SEQ ID NO: 742081 - DNA, 20 bp, mouse
gcaggatcatcttccgttgt

SEQ ID NO: 742082 - DNA, 20 bp, mouse
gaccgggactcggaacttcc

SEQ ID NO: 742083 - DNA, 20 bp, mouse
gcgcgcgcgcaatttccgcc

SEQ ID NO: 742084 - DNA, 20 bp, mouse
ggtgtacacatactccgcac

SEQ ID NO: 742085 - DNA, 20 bp, mouse
ggtgagttggatggaaatta

SEQ ID NO: 742086 - DNA, 20 bp, mouse
gggaaagcggggctccgcag

SEQ ID NO: 742087 - DNA, 20 bp, mouse
gacactgccccgcgactctc

SEQ ID NO: 742088 - DNA, 20 bp, mouse
gtagcccagcccttcgcttg

SEQ ID NO: 742089 - DNA, 20 bp, mouse
gctctccggacaactctcgc

SEQ ID NO: 742090 - DNA, 20 bp, mouse
gtctcgcaggcaaatcctga

SEQ ID NO: 742091 - DNA, 20 bp, mouse
ggcaggcaaatcctgagggg

SEQ ID NO: 742092 - DNA, 20 bp, mouse
gcagcccttcgcttgaggat

SEQ ID NO: 742093 - DNA, 20 bp, mouse
gcacgaatgtgttcggaaag

SEQ ID NO: 742094 - DNA, 20 bp, mouse
gaggaatatgcatctgccgg

SEQ ID NO: 742095 - DNA, 20 bp, mouse
ggaagcagtgcacgttcgtg

SEQ ID NO: 742096 - DNA, 20 bp, mouse
gttaaagtaaccagcaggtc

SEQ ID NO: 742097 - DNA, 20 bp, mouse
gcaagtgctaggtcaggaaa

SEQ ID NO: 742098 - DNA, 20 bp, mouse
gatggtctcatctatgcaat

SEQ ID NO: 742099 - DNA, 20 bp, mouse
gaactgagggatgcagaacc

SEQ ID NO: 742100 - DNA, 20 bp, mouse
ggcactgtcttcttagcgat

SEQ ID NO: 742101 - DNA, 20 bp, mouse
gtttctgaccctaggtcaag

SEQ ID NO: 742102 - DNA, 20 bp, mouse
gtgagggatgcagaacctgg

SEQ ID NO: 742103 - DNA, 20 bp, mouse
ggtgctcagtttctgaccct

SEQ ID NO: 742104 - DNA, 20 bp, mouse
ggtaaccagcaggtctggca

SEQ ID NO: 742105 - DNA, 20 bp, mouse
gaaggccagcgaagtttcct

SEQ ID NO: 742106 - DNA, 20 bp, mouse
gccggtgggcagcggtggtg

SEQ ID NO: 742107 - DNA, 20 bp, mouse
gtgtaggcctggccaatcaa

SEQ ID NO: 742108 - DNA, 20 bp, mouse
gtaaacgagtgtcggaaacc

SEQ ID NO: 742109 - DNA, 20 bp, mouse
gctttcccggtgggcagcgg

SEQ ID NO: 742110 - DNA, 20 bp, mouse
gccaatcaacgggcacgaga

SEQ ID NO: 742111 - DNA, 20 bp, mouse
gaaaggggacttcgaactcc

SEQ ID NO: 742112 - DNA, 20 bp, mouse
gggccaggcctacaggaagt

SEQ ID NO: 742113 - DNA, 20 bp, mouse
ggcggcgacaataacagatg

SEQ ID NO: 742114 - DNA, 20 bp, mouse
gatgctttcccggtgggcag

SEQ ID NO: 742115 - DNA, 20 bp, mouse
gtttctgatgctttcccggt

SEQ ID NO: 742116 - DNA, 20 bp, mouse
gctgagagctgctgctggga

SEQ ID NO: 742117 - DNA, 20 bp, mouse
ggctgctgggagggcgtgac

SEQ ID NO: 742118 - DNA, 20 bp, mouse
ggggagaggcgagggtaact

SEQ ID NO: 742119 - DNA, 20 bp, mouse
gctccgcggcgaagccttcc

SEQ ID NO: 742120 - DNA, 20 bp, mouse
gaaggacacggccacgggag

SEQ ID NO: 742121 - DNA, 20 bp, mouse
gacggccacgggagaggcga

SEQ ID NO: 742122 - DNA, 20 bp, mouse
ggggagactgtgcggctcgg

SEQ ID NO: 742123 - DNA, 20 bp, mouse
gcgccgtgccctgagctctc

SEQ ID NO: 742124 - DNA, 20 bp, mouse
gcgtgactggcgaaggctgg

SEQ ID NO: 742125 - DNA, 20 bp, mouse
gcccccccacccccttcggg

SEQ ID NO: 742126 - DNA, 20 bp, mouse
ggacgtgcagggcacggatc

SEQ ID NO: 742127 - DNA, 20 bp, mouse
gagaaggcctgggacgtgca

SEQ ID NO: 742128 - DNA, 20 bp, mouse
gctctgaggacacaggggac

SEQ ID NO: 742129 - DNA, 20 bp, mouse
gagctgcggcagcgcaagag

SEQ ID NO: 742130 - DNA, 20 bp, mouse
gctgctgccaggtgtgctaa

SEQ ID NO: 742131 - DNA, 20 bp, mouse
ggagtggcgcggccccgcgt

SEQ ID NO: 742132 - DNA, 20 bp, mouse
gtccgtgccctgcacgtccc

SEQ ID NO: 742133 - DNA, 20 bp, mouse
ggcaaagactctgaggacac

SEQ ID NO: 742134 - DNA, 20 bp, mouse
gcccgcgtgggtcctgcctg

SEQ ID NO: 742135 - DNA, 20 bp, mouse
gctgcctgaggagatcacct

SEQ ID NO: 742136 - DNA, 20 bp, mouse
ggggccagagaccgattggt

SEQ ID NO: 742137 - DNA, 20 bp, mouse
gggaaagtggattgaaagtg

SEQ ID NO: 742138 - DNA, 20 bp, mouse
gaaccaaggcctgacccgtc

SEQ ID NO: 742139 - DNA, 20 bp, mouse
gaaggcctgacccgtcaggt

SEQ ID NO: 742140 - DNA, 20 bp, mouse
gttctagaagagactgtcag

SEQ ID NO: 742141 - DNA, 20 bp, mouse
ggcaaggtggccctgaacca

SEQ ID NO: 742142 - DNA, 20 bp, mouse
gcgggtcaggccttggttca

SEQ ID NO: 742143 - DNA, 20 bp, mouse
gctaaggagcaagaggggaa

SEQ ID NO: 742144 - DNA, 20 bp, mouse
gttgcttggctgagtcaata

SEQ ID NO: 742145 - DNA, 20 bp, mouse
gtatcccaccaatcggtctc

SEQ ID NO: 742146 - DNA, 20 bp, mouse
gggcctgccgcccttcccta

SEQ ID NO: 742147 - DNA, 20 bp, mouse
gcctggaggcgggacctccg

SEQ ID NO: 742148 - DNA, 20 bp, mouse
gggcggggccgtcggcaact

SEQ ID NO: 742149 - DNA, 20 bp, mouse
gcttccctaaggctcagtag

SEQ ID NO: 742150 - DNA, 20 bp, mouse
ggacctgtgcggggccttgg

SEQ ID NO: 742151 - DNA, 20 bp, mouse
ggtctccgcccagttgccga

SEQ ID NO: 742152 - DNA, 20 bp, mouse
gttggaaagccggacctgtg

SEQ ID NO: 742153 - DNA, 20 bp, mouse
ggaaaccacgcccacgacgc

SEQ ID NO: 742154 - DNA, 20 bp, mouse
ggacccgctactgagcctta

SEQ ID NO: 742155 - DNA, 20 bp, mouse
gggacgcgcgcttggaaagc

SEQ ID NO: 742156 - DNA, 20 bp, mouse
ggggctcgcaagtaggctaa

SEQ ID NO: 742157 - DNA, 20 bp, mouse
gtctctgaagcctacttaga

SEQ ID NO: 742158 - DNA, 20 bp, mouse
gcgcaagtaggctaaaggat

SEQ ID NO: 742159 - DNA, 20 bp, mouse
gaagtaggcttcagagagat

SEQ ID NO: 742160 - DNA, 20 bp, mouse
gggactctgccaaaggccaa

SEQ ID NO: 742161 - DNA, 20 bp, mouse
gttattggctccctctaagt

SEQ ID NO: 742162 - DNA, 20 bp, mouse
gcattctggcgtggccctct

SEQ ID NO: 742163 - DNA, 20 bp, mouse
ggaaaggagggctcgcaagt

SEQ ID NO: 742164 - DNA, 20 bp, mouse
ggccaaaggccaagggatta

SEQ ID NO: 742165 - DNA, 20 bp, mouse
gaggggcgtggctaccattc

SEQ ID NO: 742166 - DNA, 20 bp, mouse
gcggaaatggggtgcacctt

SEQ ID NO: 742167 - DNA, 20 bp, mouse
ggggcaggccacgtgaccca

SEQ ID NO: 742168 - DNA, 20 bp, mouse
gtatttgcaagctagatgtg

SEQ ID NO: 742169 - DNA, 20 bp, mouse
ggggctcgtgatgtcaccac

SEQ ID NO: 742170 - DNA, 20 bp, mouse
gcaaataaatgcttccttgc

SEQ ID NO: 742171 - DNA, 20 bp, mouse
gccagccagctgcgggcgct

SEQ ID NO: 742172 - DNA, 20 bp, mouse
ggagcccaggcagaggacta

SEQ ID NO: 742173 - DNA, 20 bp, mouse
gaaccggtgaatgctgtgct

SEQ ID NO: 742174 - DNA, 20 bp, mouse
gttgcaaactggcggaagga

SEQ ID NO: 742175 - DNA, 20 bp, mouse
gagaccgcggcgacgctagg

SEQ ID NO: 742176 - DNA, 20 bp, mouse
ggggctccaatgcttcacca

SEQ ID NO: 742177 - DNA, 20 bp, mouse
ggaggcatctaccactccca

SEQ ID NO: 742178 - DNA, 20 bp, mouse
gagtggtagatgcctcagtc

SEQ ID NO: 742179 - DNA, 20 bp, mouse
gggggccaggtctgtaagtc

SEQ ID NO: 742180 - DNA, 20 bp, mouse
gcccagccctggtgaagcat

SEQ ID NO: 742181 - DNA, 20 bp, mouse
gacctggcccctaccgtctg

SEQ ID NO: 742182 - DNA, 20 bp, mouse
ggtgaagcattggagcccct

SEQ ID NO: 742183 - DNA, 20 bp, mouse
gtgggttgtagcagctgcag

SEQ ID NO: 742184 - DNA, 20 bp, mouse
gccctcagacggtaggggcc

SEQ ID NO: 742185 - DNA, 20 bp, mouse
ggccttgccctcagacggta

SEQ ID NO: 742186 - DNA, 20 bp, mouse
ggagggaggcgcttggtcgt

SEQ ID NO: 742187 - DNA, 20 bp, mouse
ggggccgggtctcgggaaaa

SEQ ID NO: 742188 - DNA, 20 bp, mouse
gcgtaggcgtagcctaggca

SEQ ID NO: 742189 - DNA, 20 bp, mouse
gtctagtgcccgccctgcct

SEQ ID NO: 742190 - DNA, 20 bp, mouse
gactccggctaccccagatt

SEQ ID NO: 742191 - DNA, 20 bp, mouse
gacagccaatgggtagcgcc

SEQ ID NO: 742192 - DNA, 20 bp, mouse
gtgtccatgcgatcacgggg

SEQ ID NO: 742193 - DNA, 20 bp, mouse
gcattcctggcgctacccat

SEQ ID NO: 742194 - DNA, 20 bp, mouse
ggggaccggagcccgcctcg

SEQ ID NO: 742195 - DNA, 20 bp, mouse
gcctccgctccttggttcat

SEQ ID NO: 742196 - DNA, 20 bp, mouse
gctgtggcgcggcaagtgga

SEQ ID NO: 742197 - DNA, 20 bp, mouse
gcacgtgcctgatgcaactt

SEQ ID NO: 742198 - DNA, 20 bp, mouse
ggggccaaggtcatcggagt

SEQ ID NO: 742199 - DNA, 20 bp, mouse
ggtgcctgatgcaacttcgg

SEQ ID NO: 742200 - DNA, 20 bp, mouse
gtggcgcggcaagtggacgg

SEQ ID NO: 742201 - DNA, 20 bp, mouse
ggccccagaacggtcgcagg

SEQ ID NO: 742202 - DNA, 20 bp, mouse
gctggggcgctggcccttta

SEQ ID NO: 742203 - DNA, 20 bp, mouse
ggcagctgggccaaggtcat

SEQ ID NO: 742204 - DNA, 20 bp, mouse
gatgcaacttcggagggcgg

SEQ ID NO: 742205 - DNA, 20 bp, mouse
gagggcggaaggtcccgccc

SEQ ID NO: 742206 - DNA, 20 bp, mouse
gaagacaataaggatgtagt

SEQ ID NO: 742207 - DNA, 20 bp, mouse
gtctgacttagtttgagtac

SEQ ID NO: 742208 - DNA, 20 bp, mouse
gtaaagacatcactacagtg

SEQ ID NO: 742209 - DNA, 20 bp, mouse
gacggcctcagtgtaagagg

SEQ ID NO: 742210 - DNA, 20 bp, mouse
ggagctgtgccttcttttca

SEQ ID NO: 742211 - DNA, 20 bp, mouse
gcatgtggttaaagacaata

SEQ ID NO: 742212 - DNA, 20 bp, mouse
ggagaggcaggcactgcgaa

SEQ ID NO: 742213 - DNA, 20 bp, mouse
gagtccgagcctcatagtcc

SEQ ID NO: 742214 - DNA, 20 bp, mouse
gcatgagtgtacaaacaccc

SEQ ID NO: 742215 - DNA, 20 bp, mouse
gacaacaggacaaaatctcg

SEQ ID NO: 742216 - DNA, 20 bp, mouse
ggctccggcaggctcgtctg

SEQ ID NO: 742217 - DNA, 20 bp, mouse
gcggagcgaagcacgcacag

SEQ ID NO: 742218 - DNA, 20 bp, mouse
gagcgaagcacgcacagggg

SEQ ID NO: 742219 - DNA, 20 bp, mouse
gggaggaaaactgcttccgg

SEQ ID NO: 742220 - DNA, 20 bp, mouse
gccggcaggctcgtctgtgg

SEQ ID NO: 742221 - DNA, 20 bp, mouse
gagggcgcagcggctgacgg

SEQ ID NO: 742222 - DNA, 20 bp, mouse
gggctcgtctgtggcggcga

SEQ ID NO: 742223 - DNA, 20 bp, mouse
gagcacgcacaggggcgggc

SEQ ID NO: 742224 - DNA, 20 bp, mouse
ggggaagcaacaactgtttc

SEQ ID NO: 742225 - DNA, 20 bp, mouse
gtctggaggaaaactgcttc

SEQ ID NO: 742226 - DNA, 20 bp, mouse
gggtgcgcgccgagaggccg

SEQ ID NO: 742227 - DNA, 20 bp, mouse
ggaggccgggggaagtagaa

SEQ ID NO: 742228 - DNA, 20 bp, mouse
gcgtagcgattggctaagag

SEQ ID NO: 742229 - DNA, 20 bp, mouse
gggaggcgctgcgtagcgat

SEQ ID NO: 742230 - DNA, 20 bp, mouse
gtcggcgcgcacccatctcg

SEQ ID NO: 742231 - DNA, 20 bp, mouse
gcggcccgccgactggcgtt

SEQ ID NO: 742232 - DNA, 20 bp, mouse
ggccgggggaagtagaaggg

SEQ ID NO: 742233 - DNA, 20 bp, mouse
ggggtgagggcgccggggta

SEQ ID NO: 742234 - DNA, 20 bp, mouse
gcggggcttgcagaatgggc

SEQ ID NO: 742235 - DNA, 20 bp, mouse
gggagagcctagcgtcatgg

SEQ ID NO: 742236 - DNA, 20 bp, mouse
ggctccacaggcctgtcccg

SEQ ID NO: 742237 - DNA, 20 bp, mouse
ggctggggcgccaccagaca

SEQ ID NO: 742238 - DNA, 20 bp, mouse
gcggccccggggagggacgg

SEQ ID NO: 742239 - DNA, 20 bp, mouse
gccggggtaaaacccagacc

SEQ ID NO: 742240 - DNA, 20 bp, mouse
gagagactcggccccgggga

SEQ ID NO: 742241 - DNA, 20 bp, mouse
gcgcgcgcgcggcagagact

SEQ ID NO: 742242 - DNA, 20 bp, mouse
gtgcgtctctgcgccgggtg

SEQ ID NO: 742243 - DNA, 20 bp, mouse
gactcggccccggggaggga

SEQ ID NO: 742244 - DNA, 20 bp, mouse
gcgccaccagacagggacgc

SEQ ID NO: 742245 - DNA, 20 bp, mouse
gacaggcctgtggagcgcgg

SEQ ID NO: 742246 - DNA, 20 bp, mouse
gcataggcggagcatctcgg

SEQ ID NO: 742247 - DNA, 20 bp, mouse
gagcagggacggtaccgcgg

SEQ ID NO: 742248 - DNA, 20 bp, mouse
gagccacgcggtgactgcgc

SEQ ID NO: 742249 - DNA, 20 bp, mouse
gtaagtgacgtcatcaagca

SEQ ID NO: 742250 - DNA, 20 bp, mouse
gggttcgttgctgacgtcat

SEQ ID NO: 742251 - DNA, 20 bp, mouse
gctggcacgcggagttccat

SEQ ID NO: 742252 - DNA, 20 bp, mouse
ggcacgcggagttccattgg

SEQ ID NO: 742253 - DNA, 20 bp, mouse
gcactctaacggcgcctcgt

SEQ ID NO: 742254 - DNA, 20 bp, mouse
ggccgttcgcaaaccaccaa

SEQ ID NO: 742255 - DNA, 20 bp, mouse
gtccgccgaccgcaggggtc

SEQ ID NO: 742256 - DNA, 20 bp, mouse
ggaagtccaacaagcgtccg

SEQ ID NO: 742257 - DNA, 20 bp, mouse
gtagacatacgcctactccc

SEQ ID NO: 742258 - DNA, 20 bp, mouse
ggcctactcccaggcgacac

SEQ ID NO: 742259 - DNA, 20 bp, mouse
gctcgaaagtaggtagaatt

SEQ ID NO: 742260 - DNA, 20 bp, mouse
ggtagtccacggacgcttgt

SEQ ID NO: 742261 - DNA, 20 bp, mouse
gttcaagcgcgctcgaaagt

SEQ ID NO: 742262 - DNA, 20 bp, mouse
gccagaagacaaagcgatac

SEQ ID NO: 742263 - DNA, 20 bp, mouse
ggccggtgtcgcctgggagt

SEQ ID NO: 742264 - DNA, 20 bp, mouse
gatcactgccggtgtcgcct

SEQ ID NO: 742265 - DNA, 20 bp, mouse
gtagacttccacgagtggga

SEQ ID NO: 742266 - DNA, 20 bp, mouse
gcccccaagctgctcgccca

SEQ ID NO: 742267 - DNA, 20 bp, mouse
gagccctgggcgagcagctt

SEQ ID NO: 742268 - DNA, 20 bp, mouse
ggaaacgagggagatgctaa

SEQ ID NO: 742269 - DNA, 20 bp, mouse
gtaccgatagcaggcgtaga

SEQ ID NO: 742270 - DNA, 20 bp, mouse
gatagcaggcgtagagggcg

SEQ ID NO: 742271 - DNA, 20 bp, mouse
gaagagggaaaggcgagatg

SEQ ID NO: 742272 - DNA, 20 bp, mouse
gaggcggagccaagagggaa

SEQ ID NO: 742273 - DNA, 20 bp, mouse
gggcgtagagggcgaggcct

SEQ ID NO: 742274 - DNA, 20 bp, mouse
gacagaagctgctactgggc

SEQ ID NO: 742275 - DNA, 20 bp, mouse
gccgcggacacagacaggag

SEQ ID NO: 742276 - DNA, 20 bp, mouse
ggggacacaggtctgacgtg

SEQ ID NO: 742277 - DNA, 20 bp, mouse
gtgagaggcgggctgacgtc

SEQ ID NO: 742278 - DNA, 20 bp, mouse
gtggctacagtcacgttgag

SEQ ID NO: 742279 - DNA, 20 bp, mouse
gccagcgtgtatggacttta

SEQ ID NO: 742280 - DNA, 20 bp, mouse
gctgtgtcccacgttcctat

SEQ ID NO: 742281 - DNA, 20 bp, mouse
ggactgtgtttctgggtagg

SEQ ID NO: 742282 - DNA, 20 bp, mouse
gtgggaacctagaagctgaa

SEQ ID NO: 742283 - DNA, 20 bp, mouse
gagacgacgctcaacaagac

SEQ ID NO: 742284 - DNA, 20 bp, mouse
gggtgtgccgtttggagcaa

SEQ ID NO: 742285 - DNA, 20 bp, mouse
gactgtagccaataggaacg

SEQ ID NO: 742286 - DNA, 20 bp, mouse
ggcgacgtggggctgcgtgg

SEQ ID NO: 742287 - DNA, 20 bp, mouse
gcgcgctccccgggcgacgt

SEQ ID NO: 742288 - DNA, 20 bp, mouse
ggcgaccaggcgcgctcccc

SEQ ID NO: 742289 - DNA, 20 bp, mouse
gggaggggctgcactggcta

SEQ ID NO: 742290 - DNA, 20 bp, mouse
gtgcgtgggggcgggttcca

SEQ ID NO: 742291 - DNA, 20 bp, mouse
gccagggaggactgcgggac

SEQ ID NO: 742292 - DNA, 20 bp, mouse
ggtgcaccccgagagctcag

SEQ ID NO: 742293 - DNA, 20 bp, mouse
gtggggttgccccctctcat

SEQ ID NO: 742294 - DNA, 20 bp, mouse
ggggctccgcgaccgaggac

SEQ ID NO: 742295 - DNA, 20 bp, mouse
gccccctctcatgggaaatc

SEQ ID NO: 742296 - DNA, 20 bp, mouse
ggcagcccgtccactaggaa

SEQ ID NO: 742297 - DNA, 20 bp, mouse
gcccgggtgggagaactgca

SEQ ID NO: 742298 - DNA, 20 bp, mouse
gccacccagttgtgggaagg

SEQ ID NO: 742299 - DNA, 20 bp, mouse
gggcatggggagggtaccgc

SEQ ID NO: 742300 - DNA, 20 bp, mouse
ggggtgggagaactgcaagg

SEQ ID NO: 742301 - DNA, 20 bp, mouse
gtaccctccccatgcccggg

SEQ ID NO: 742302 - DNA, 20 bp, mouse
gtcccacccgggcatgggga

SEQ ID NO: 742303 - DNA, 20 bp, mouse
gtagttaagcctgggagctg

SEQ ID NO: 742304 - DNA, 20 bp, mouse
gaggaagggtctaaggctgc

SEQ ID NO: 742305 - DNA, 20 bp, mouse
gatgaggcagcccgtccact

SEQ ID NO: 742306 - DNA, 20 bp, mouse
gcgcctcggccagactacta

SEQ ID NO: 742307 - DNA, 20 bp, mouse
gtggttaatgacaaagtggg

SEQ ID NO: 742308 - DNA, 20 bp, mouse
gacaaagcgaagttaaagct

SEQ ID NO: 742309 - DNA, 20 bp, mouse
ggggtggttaatgacaaagt

SEQ ID NO: 742310 - DNA, 20 bp, mouse
gcaccctagtagtctggccg

SEQ ID NO: 742311 - DNA, 20 bp, mouse
gagcaaggtcacatggagga

SEQ ID NO: 742312 - DNA, 20 bp, mouse
gctgttaaatgcctgcactt

SEQ ID NO: 742313 - DNA, 20 bp, mouse
gctggccgaggcggatgtag

SEQ ID NO: 742314 - DNA, 20 bp, mouse
gaaccagggttcctatcacc

SEQ ID NO: 742315 - DNA, 20 bp, mouse
ggagatgattcagtagtgac

SEQ ID NO: 742316 - DNA, 20 bp, mouse
ggaagcgggcgagcgagtct

SEQ ID NO: 742317 - DNA, 20 bp, mouse
ggggcgagcgagtctcggtc

SEQ ID NO: 742318 - DNA, 20 bp, mouse
gcgtgggtcgcaccaggaaa

SEQ ID NO: 742319 - DNA, 20 bp, mouse
gcgcccgcttccccgagccg

SEQ ID NO: 742320 - DNA, 20 bp, mouse
gacgcgcccgcgtctccgtg

SEQ ID NO: 742321 - DNA, 20 bp, mouse
gtccgtgcggagccagaacg

SEQ ID NO: 742322 - DNA, 20 bp, mouse
ggaacggcgctccgagaccg

SEQ ID NO: 742323 - DNA, 20 bp, mouse
gggcgcgtcgcggcgagcgt

SEQ ID NO: 742324 - DNA, 20 bp, mouse
ggtgcggagccagaacgtgg

SEQ ID NO: 742325 - DNA, 20 bp, mouse
gcccacatccgggaaacccg

SEQ ID NO: 742326 - DNA, 20 bp, mouse
gcagccggctgcactttccg

SEQ ID NO: 742327 - DNA, 20 bp, mouse
gccccgcccgggctggtatg

SEQ ID NO: 742328 - DNA, 20 bp, mouse
gcaggaagcggcccgtgggg

SEQ ID NO: 742329 - DNA, 20 bp, mouse
gcggccacctgccctgcgct

SEQ ID NO: 742330 - DNA, 20 bp, mouse
gtccgacgcgagcccagcgc

SEQ ID NO: 742331 - DNA, 20 bp, mouse
gcggcgcaggaagcggcccg

SEQ ID NO: 742332 - DNA, 20 bp, mouse
gccctgcgctgggctcgcgt

SEQ ID NO: 742333 - DNA, 20 bp, mouse
gcctgcgtccggttaagccc

SEQ ID NO: 742334 - DNA, 20 bp, mouse
ggcggcgggtagcaaggccg

SEQ ID NO: 742335 - DNA, 20 bp, mouse
gcccggccgcataccagccc

SEQ ID NO: 742336 - DNA, 20 bp, mouse
gcaaggccgtgatttctcga

SEQ ID NO: 742337 - DNA, 20 bp, mouse
ggggagggactttcaatgat

SEQ ID NO: 742338 - DNA, 20 bp, mouse
gagggactttcaatgatggg

SEQ ID NO: 742339 - DNA, 20 bp, mouse
gaaatcacggccttggtggg

SEQ ID NO: 742340 - DNA, 20 bp, mouse
gctgttgaacgaattcacca

SEQ ID NO: 742341 - DNA, 20 bp, mouse
ggagaaatcacggccttggt

SEQ ID NO: 742342 - DNA, 20 bp, mouse
gtaaatgtaaattggagctg

SEQ ID NO: 742343 - DNA, 20 bp, mouse
gttcagcttcgccatctagt

SEQ ID NO: 742344 - DNA, 20 bp, mouse
gagtgctaaatctggagaca

SEQ ID NO: 742345 - DNA, 20 bp, mouse
gtcaaaatgtcagcttcata

SEQ ID NO: 742346 - DNA, 20 bp, mouse
gtggggaacaggagggctga

SEQ ID NO: 742347 - DNA, 20 bp, mouse
ggacaggaagcaccctccac

SEQ ID NO: 742348 - DNA, 20 bp, mouse
gacaggcactctggcatctg

SEQ ID NO: 742349 - DNA, 20 bp, mouse
gcaggtgtgaatcaggctca

SEQ ID NO: 742350 - DNA, 20 bp, mouse
gtgaaaacagcaaaccactc

SEQ ID NO: 742351 - DNA, 20 bp, mouse
gcttgcgtagctattgtcat

SEQ ID NO: 742352 - DNA, 20 bp, mouse
gcggtgtgctaataaggcca

SEQ ID NO: 742353 - DNA, 20 bp, mouse
gctgttccccacaggcactc

SEQ ID NO: 742354 - DNA, 20 bp, mouse
gctctagggtcaaaattcga

SEQ ID NO: 742355 - DNA, 20 bp, mouse
gtctgactcttcaaccacat

SEQ ID NO: 742356 - DNA, 20 bp, mouse
gcgggggaaggcagcccctt

SEQ ID NO: 742357 - DNA, 20 bp, mouse
gccctgggacgtcactgcgg

SEQ ID NO: 742358 - DNA, 20 bp, mouse
gggggagtagccaacggaag

SEQ ID NO: 742359 - DNA, 20 bp, mouse
gcactgggcggagtccggga

SEQ ID NO: 742360 - DNA, 20 bp, mouse
gaccccctgggacgtcactg

SEQ ID NO: 742361 - DNA, 20 bp, mouse
ggggggcgggccagcccaag

SEQ ID NO: 742362 - DNA, 20 bp, mouse
gggcggctctctgcaaagag

SEQ ID NO: 742363 - DNA, 20 bp, mouse
gggaaggcagccccttgggc

SEQ ID NO: 742364 - DNA, 20 bp, mouse
gcccccaacgtctagtgctc

SEQ ID NO: 742365 - DNA, 20 bp, mouse
gaaagagcggccccttccgt

SEQ ID NO: 742366 - DNA, 20 bp, mouse
ggaacacgcgtgtgtgtcaa

SEQ ID NO: 742367 - DNA, 20 bp, mouse
gtgtgtgtcaacggtgggga

SEQ ID NO: 742368 - DNA, 20 bp, mouse
gactctaagggctacgggga

SEQ ID NO: 742369 - DNA, 20 bp, mouse
ggcagccgagagcgggtact

SEQ ID NO: 742370 - DNA, 20 bp, mouse
gtgtgggacccggagatcgg

SEQ ID NO: 742371 - DNA, 20 bp, mouse
gaagggctacggggatgggt

SEQ ID NO: 742372 - DNA, 20 bp, mouse
gcgcgtgtgtgtcaacggtg

SEQ ID NO: 742373 - DNA, 20 bp, mouse
ggcctcgctgccaacggcgt

SEQ ID NO: 742374 - DNA, 20 bp, mouse
ggctgggagccagctcaggc

SEQ ID NO: 742375 - DNA, 20 bp, mouse
gggaagagacagatcgccgg

SEQ ID NO: 742376 - DNA, 20 bp, mouse
gctgcacaggttaggagggc

SEQ ID NO: 742377 - DNA, 20 bp, mouse
gaccctcttgcgacaccaca

SEQ ID NO: 742378 - DNA, 20 bp, mouse
ggctagggggcggttcttga

SEQ ID NO: 742379 - DNA, 20 bp, mouse
gtctcccctgcatggagaag

SEQ ID NO: 742380 - DNA, 20 bp, mouse
gacccctgtggtgtcgcaag

SEQ ID NO: 742381 - DNA, 20 bp, mouse
gttcccccttctccatgcag

SEQ ID NO: 742382 - DNA, 20 bp, mouse
gatcactgcacaggttagga

SEQ ID NO: 742383 - DNA, 20 bp, mouse
gggggaaaccccacactctc

SEQ ID NO: 742384 - DNA, 20 bp, mouse
gagcagagagtcaagaaggt

SEQ ID NO: 742385 - DNA, 20 bp, mouse
gttaaaagaacggagagcag

SEQ ID NO: 742386 - DNA, 20 bp, mouse
gggcgctggcgattggtcga

SEQ ID NO: 742387 - DNA, 20 bp, mouse
gccgcccgctcgtgagcgtc

SEQ ID NO: 742388 - DNA, 20 bp, mouse
gtgggctgcggagataaacc

SEQ ID NO: 742389 - DNA, 20 bp, mouse
ggacgccggacgctcacgag

SEQ ID NO: 742390 - DNA, 20 bp, mouse
gaaagcgcggcttggtgcct

SEQ ID NO: 742391 - DNA, 20 bp, mouse
gagcgtccggcgtccccacc

SEQ ID NO: 742392 - DNA, 20 bp, mouse
gccctcctgcggagcgatct

SEQ ID NO: 742393 - DNA, 20 bp, mouse
ggctgcggagataaaccggg

SEQ ID NO: 742394 - DNA, 20 bp, mouse
ggagggcgcgagccaaagcg

SEQ ID NO: 742395 - DNA, 20 bp, mouse
gaggccggcggtctgggagg

SEQ ID NO: 742396 - DNA, 20 bp, mouse
gcggcgaccgcgtcactccg

SEQ ID NO: 742397 - DNA, 20 bp, mouse
ggggcacacccgtctcccgc

SEQ ID NO: 742398 - DNA, 20 bp, mouse
ggcaccagcccggagatctc

SEQ ID NO: 742399 - DNA, 20 bp, mouse
gctgctctcagtttggggtg

SEQ ID NO: 742400 - DNA, 20 bp, mouse
ggcgcgggccaggtaagaac

SEQ ID NO: 742401 - DNA, 20 bp, mouse
ggatcccggactgcgagggg

SEQ ID NO: 742402 - DNA, 20 bp, mouse
gactgacaggcgcattaggc

SEQ ID NO: 742403 - DNA, 20 bp, mouse
ggcgtagagccgggactgac

SEQ ID NO: 742404 - DNA, 20 bp, mouse
ggccgagcacggcgtagagc

SEQ ID NO: 742405 - DNA, 20 bp, mouse
ggggccgtgagcccgagaaa

SEQ ID NO: 742406 - DNA, 20 bp, mouse
gtgcaggaggaggggacgtg

SEQ ID NO: 742407 - DNA, 20 bp, mouse
gaggctgccagtacacctat

SEQ ID NO: 742408 - DNA, 20 bp, mouse
gcactgaggcccttggaagg

SEQ ID NO: 742409 - DNA, 20 bp, mouse
gtgagcgctgggggcctagg

SEQ ID NO: 742410 - DNA, 20 bp, mouse
gtccaagggcctcagtgaat

SEQ ID NO: 742411 - DNA, 20 bp, mouse
ggttctgagaaacaggatca

SEQ ID NO: 742412 - DNA, 20 bp, mouse
gcagtgaatcgggtgcccat

SEQ ID NO: 742413 - DNA, 20 bp, mouse
gtatgagccagagtttaagt

SEQ ID NO: 742414 - DNA, 20 bp, mouse
gtccccagtccttgaggcca

SEQ ID NO: 742415 - DNA, 20 bp, mouse
gcaagcagcatgcaatccag

SEQ ID NO: 742416 - DNA, 20 bp, mouse
ggggacgccggctccagaaa

SEQ ID NO: 742417 - DNA, 20 bp, mouse
gcgcctcaccggcccaccaa

SEQ ID NO: 742418 - DNA, 20 bp, mouse
gaaccattggtgggccggtg

SEQ ID NO: 742419 - DNA, 20 bp, mouse
ggtggcatcggaaggcggga

SEQ ID NO: 742420 - DNA, 20 bp, mouse
gacccgcgaggacagttgca

SEQ ID NO: 742421 - DNA, 20 bp, mouse
gagaagggttggcattcttt

SEQ ID NO: 742422 - DNA, 20 bp, mouse
gagaggcatcaaccattggt

SEQ ID NO: 742423 - DNA, 20 bp, mouse
gtccgtgcaactgtcctcgc

SEQ ID NO: 742424 - DNA, 20 bp, mouse
gcggcgtccctctatgagaa

SEQ ID NO: 742425 - DNA, 20 bp, mouse
gcaactgtcctcgcgggtcg

SEQ ID NO: 742426 - DNA, 20 bp, mouse
gtgggccaagggcgcctggg

SEQ ID NO: 742427 - DNA, 20 bp, mouse
ggaatggcagggttcggggc

SEQ ID NO: 742428 - DNA, 20 bp, mouse
gaaaccacgcggggcctcct

SEQ ID NO: 742429 - DNA, 20 bp, mouse
gtagacctcccaggcgccct

SEQ ID NO: 742430 - DNA, 20 bp, mouse
gcgcatgcgtacttgggcca

SEQ ID NO: 742431 - DNA, 20 bp, mouse
gcgcagagaagctggaaccc

SEQ ID NO: 742432 - DNA, 20 bp, mouse
ggtctagatcgcagagaagc

SEQ ID NO: 742433 - DNA, 20 bp, mouse
gtctgcgatctagacctccc

SEQ ID NO: 742434 - DNA, 20 bp, mouse
gtgtgcgcacgcgtagtact

SEQ ID NO: 742435 - DNA, 20 bp, mouse
ggttgcgcgcatgcgtactt

SEQ ID NO: 742436 - DNA, 20 bp, mouse
ggggatctggctctggactg

SEQ ID NO: 742437 - DNA, 20 bp, mouse
gtggccggctccattccact

SEQ ID NO: 742438 - DNA, 20 bp, mouse
gggcccccggggccagtggg

SEQ ID NO: 742439 - DNA, 20 bp, mouse
gggaagaggggcacagtaag

SEQ ID NO: 742440 - DNA, 20 bp, mouse
gagggacagacggccaatgg

SEQ ID NO: 742441 - DNA, 20 bp, mouse
gccttcctggccacccccat

SEQ ID NO: 742442 - DNA, 20 bp, mouse
gaagccaagtggaatggagc

SEQ ID NO: 742443 - DNA, 20 bp, mouse
gaggccctcatcaagccaag

SEQ ID NO: 742444 - DNA, 20 bp, mouse
ggacagacggccaatggggg

SEQ ID NO: 742445 - DNA, 20 bp, mouse
ggggagggacagacggccaa

SEQ ID NO: 742446 - DNA, 20 bp, mouse
gtgagcaatgagatactcta

SEQ ID NO: 742447 - DNA, 20 bp, mouse
ggcatccatgagctccacag

SEQ ID NO: 742448 - DNA, 20 bp, mouse
gatggatgctacatccagca

SEQ ID NO: 742449 - DNA, 20 bp, mouse
gatgtgagatgaaggttaac

SEQ ID NO: 742450 - DNA, 20 bp, mouse
gatgatgtagacataagatg

SEQ ID NO: 742451 - DNA, 20 bp, mouse
gcttcaggtatgtgagatga

SEQ ID NO: 742452 - DNA, 20 bp, mouse
gaaacctgtgagacagtggt

SEQ ID NO: 742453 - DNA, 20 bp, mouse
gagaactaatgatagtgtta

SEQ ID NO: 742454 - DNA, 20 bp, mouse
ggatactctatggatccttc

SEQ ID NO: 742455 - DNA, 20 bp, mouse
ggacagtggttgggcatgag

SEQ ID NO: 742456 - DNA, 20 bp, mouse
gtcatggaggaaggctggta

SEQ ID NO: 742457 - DNA, 20 bp, mouse
gtaagcataaagctagcagg

SEQ ID NO: 742458 - DNA, 20 bp, mouse
gcatagtccaagatgaatga

SEQ ID NO: 742459 - DNA, 20 bp, mouse
gggatccatgaacctcatgg

SEQ ID NO: 742460 - DNA, 20 bp, mouse
gccttcctccatgaggttca

SEQ ID NO: 742461 - DNA, 20 bp, mouse
ggccactgtctcacaggcta

SEQ ID NO: 742462 - DNA, 20 bp, mouse
gcatgtgagtgtcagaaggc

SEQ ID NO: 742463 - DNA, 20 bp, mouse
ggacagtggctgggtatgac

SEQ ID NO: 742464 - DNA, 20 bp, mouse
gaaggctggtaaggaacatt

SEQ ID NO: 742465 - DNA, 20 bp, mouse
gaatgagaattattcataaa

SEQ ID NO: 742466 - DNA, 20 bp, mouse
gaagcaagtgagatagacta

SEQ ID NO: 742467 - DNA, 20 bp, mouse
ggccttccttcatgggtctc

SEQ ID NO: 742468 - DNA, 20 bp, mouse
gttagcttcacatacctgaa

SEQ ID NO: 742469 - DNA, 20 bp, mouse
gtctaaagcacatgcccttc

SEQ ID NO: 742470 - DNA, 20 bp, mouse
gcacatgggtgtcaggagtc

SEQ ID NO: 742471 - DNA, 20 bp, mouse
gtctcaccagccttccttca

SEQ ID NO: 742472 - DNA, 20 bp, mouse
gatgtgaagctaagggtgcc

SEQ ID NO: 742473 - DNA, 20 bp, mouse
gcaggcatggactatgattt

SEQ ID NO: 742474 - DNA, 20 bp, mouse
gccttcatgggtctcaggca

SEQ ID NO: 742475 - DNA, 20 bp, mouse
gatttaggtatgagatgagg

SEQ ID NO: 742476 - DNA, 20 bp, mouse
ggcacgccttggtctcgaga

SEQ ID NO: 742477 - DNA, 20 bp, mouse
gaagatgacttaggcgtgaa

SEQ ID NO: 742478 - DNA, 20 bp, mouse
gacttaggcgtgaagggaag

SEQ ID NO: 742479 - DNA, 20 bp, mouse
gtaaacctggcattcctaca

SEQ ID NO: 742480 - DNA, 20 bp, mouse
gagggtgatggaaaaatggc

SEQ ID NO: 742481 - DNA, 20 bp, mouse
gtctctagccactgtatcac

SEQ ID NO: 742482 - DNA, 20 bp, mouse
gctgcctcatgacacccaca

SEQ ID NO: 742483 - DNA, 20 bp, mouse
gacccacatggttttgtgat

SEQ ID NO: 742484 - DNA, 20 bp, mouse
ggacctatcacaaaaccatg

SEQ ID NO: 742485 - DNA, 20 bp, mouse
gactagccgtctcgagacca

SEQ ID NO: 742486 - DNA, 20 bp, mouse
ggacctgtgagacagtgact

SEQ ID NO: 742487 - DNA, 20 bp, mouse
ggatgcttgagcctggacta

SEQ ID NO: 742488 - DNA, 20 bp, mouse
gacaagacaaggaaggtgtc

SEQ ID NO: 742489 - DNA, 20 bp, mouse
gcatgctgaaaccatagtcc

SEQ ID NO: 742490 - DNA, 20 bp, mouse
gggtttgctccatgagttca

SEQ ID NO: 742491 - DNA, 20 bp, mouse
gtcaagcatccctgaactca

SEQ ID NO: 742492 - DNA, 20 bp, mouse
gccttagctggtcccctaca

SEQ ID NO: 742493 - DNA, 20 bp, mouse
gatctgcaggggcaaaatct

SEQ ID NO: 742494 - DNA, 20 bp, mouse
gctacacatagctatatagc

SEQ ID NO: 742495 - DNA, 20 bp, mouse
gaaacctggtgaggaatatt

SEQ ID NO: 742496 - DNA, 20 bp, mouse
gtaggcatgagataaggaag

SEQ ID NO: 742497 - DNA, 20 bp, mouse
gcagtgagaaccatcagaaa

SEQ ID NO: 742498 - DNA, 20 bp, mouse
gatgacttaggcatgagata

SEQ ID NO: 742499 - DNA, 20 bp, mouse
gatgatgatgatgaaatcag

SEQ ID NO: 742500 - DNA, 20 bp, mouse
gagatacgctgcaggaatta

SEQ ID NO: 742501 - DNA, 20 bp, mouse
gatgtgactgtcagtaggaa

SEQ ID NO: 742502 - DNA, 20 bp, mouse
gttccatgggaatagttaag

SEQ ID NO: 742503 - DNA, 20 bp, mouse
ggagccagagccatcatgca

SEQ ID NO: 742504 - DNA, 20 bp, mouse
gaaaccatgtgactgtcagt

SEQ ID NO: 742505 - DNA, 20 bp, mouse
gcctgcagcgtatctgcatt

SEQ ID NO: 742506 - DNA, 20 bp, mouse
ggcagcatgccttgacatca

SEQ ID NO: 742507 - DNA, 20 bp, mouse
gcagcagaaaagttgtatga

SEQ ID NO: 742508 - DNA, 20 bp, mouse
ggcatgccttgacatcaggg

SEQ ID NO: 742509 - DNA, 20 bp, mouse
gcatgactgaagcatgaact

SEQ ID NO: 742510 - DNA, 20 bp, mouse
gtgtctagccattatctcac

SEQ ID NO: 742511 - DNA, 20 bp, mouse
gcctaatgcggatagtctgt

SEQ ID NO: 742512 - DNA, 20 bp, mouse
gatgacagctttaaggatct

SEQ ID NO: 742513 - DNA, 20 bp, mouse
gaaaaaatcctgtgggtgtc

SEQ ID NO: 742514 - DNA, 20 bp, mouse
ggtctaaagtgtacccacat

SEQ ID NO: 742515 - DNA, 20 bp, mouse
gttgccaaatgtacctatgt

SEQ ID NO: 742516 - DNA, 20 bp, mouse
gctatcttagggcattgctt

SEQ ID NO: 742517 - DNA, 20 bp, mouse
gagcttgcttgcccacaaag

SEQ ID NO: 742518 - DNA, 20 bp, mouse
gatgtgggaatcacttggca

SEQ ID NO: 742519 - DNA, 20 bp, mouse
gcccacaaaatacttccatt

SEQ ID NO: 742520 - DNA, 20 bp, mouse
gtcccaatggaagtattttg

SEQ ID NO: 742521 - DNA, 20 bp, mouse
gcagtaaccacaagcaaaat

SEQ ID NO: 742522 - DNA, 20 bp, mouse
gagtcactgtctcactggct

SEQ ID NO: 742523 - DNA, 20 bp, mouse
gcatcctccaattttgcttg

SEQ ID NO: 742524 - DNA, 20 bp, mouse
gctgtggtaatagtttaatt

SEQ ID NO: 742525 - DNA, 20 bp, mouse
gcagacattcaagatactaa

SEQ ID NO: 742526 - DNA, 20 bp, mouse
gcatcagctttcatctttga

SEQ ID NO: 742527 - DNA, 20 bp, mouse
ggcatgacaggcatgcaatg

SEQ ID NO: 742528 - DNA, 20 bp, mouse
gagctttcatctttgagggc

SEQ ID NO: 742529 - DNA, 20 bp, mouse
ggacctagttagtgttcggt

SEQ ID NO: 742530 - DNA, 20 bp, mouse
ggtaggaataccaggtttaa

SEQ ID NO: 742531 - DNA, 20 bp, mouse
gtagtctcagggagcccggg

SEQ ID NO: 742532 - DNA, 20 bp, mouse
gatctgttagaaaaccatgt

SEQ ID NO: 742533 - DNA, 20 bp, mouse
gctcccaccgaacactaact

SEQ ID NO: 742534 - DNA, 20 bp, mouse
gatctatcttaaggcatgac

SEQ ID NO: 742535 - DNA, 20 bp, mouse
gatgcctactgacacccaca

SEQ ID NO: 742536 - DNA, 20 bp, mouse
gcccaatgggagtactttgt

SEQ ID NO: 742537 - DNA, 20 bp, mouse
gtaagaaccagtagaattgg

SEQ ID NO: 742538 - DNA, 20 bp, mouse
gagcttgcctgcttacaaag

SEQ ID NO: 742539 - DNA, 20 bp, mouse
gaaaccatctgggtatgagt

SEQ ID NO: 742540 - DNA, 20 bp, mouse
gcagtaagaaccagtagaat

SEQ ID NO: 742541 - DNA, 20 bp, mouse
gatctgtcacaaaaccatct

SEQ ID NO: 742542 - DNA, 20 bp, mouse
ggaattaagtgattcccaat

SEQ ID NO: 742543 - DNA, 20 bp, mouse
gcagcctgtgagacagtcac

SEQ ID NO: 742544 - DNA, 20 bp, mouse
gaaatcaggaaatagatgct

SEQ ID NO: 742545 - DNA, 20 bp, mouse
gtcccacaaagtactcccat

SEQ ID NO: 742546 - DNA, 20 bp, mouse
gtcaggtaaccatatctcat

SEQ ID NO: 742547 - DNA, 20 bp, mouse
gaacatgagcccatgagata

SEQ ID NO: 742548 - DNA, 20 bp, mouse
gtaaggggtcagtatggcct

SEQ ID NO: 742549 - DNA, 20 bp, mouse
ggcagggtaaggggtcagta

SEQ ID NO: 742550 - DNA, 20 bp, mouse
gcagttctgggcagggtaag

SEQ ID NO: 742551 - DNA, 20 bp, mouse
gtctcatgggctcatgtttc

SEQ ID NO: 742552 - DNA, 20 bp, mouse
ggggaacacaagcccctgtt

SEQ ID NO: 742553 - DNA, 20 bp, mouse
gaacacaagcccctgttggg

SEQ ID NO: 742554 - DNA, 20 bp, mouse
gttaccaactgctcaggcta

SEQ ID NO: 742555 - DNA, 20 bp, mouse
gcaactgctcaggctaaggg

SEQ ID NO: 742556 - DNA, 20 bp, mouse
ggactccagtcatgtattcc

SEQ ID NO: 742557 - DNA, 20 bp, mouse
gactggagtccagtggaggg

SEQ ID NO: 742558 - DNA, 20 bp, mouse
gaccctgtctcatatgccaa

SEQ ID NO: 742559 - DNA, 20 bp, mouse
gagcacattaccaggcatga

SEQ ID NO: 742560 - DNA, 20 bp, mouse
gatacatgactggagtccag

SEQ ID NO: 742561 - DNA, 20 bp, mouse
gctctgtgacaggtcatgac

SEQ ID NO: 742562 - DNA, 20 bp, mouse
gtgaaggggaaaaggacttc

SEQ ID NO: 742563 - DNA, 20 bp, mouse
gatgagacagggtttgggca

SEQ ID NO: 742564 - DNA, 20 bp, mouse
ggagaagatgtggatgaggt

SEQ ID NO: 742565 - DNA, 20 bp, mouse
gagcaaacacattataaccc

SEQ ID NO: 742566 - DNA, 20 bp, mouse
gtctctgggaatagttcaag

SEQ ID NO: 742567 - DNA, 20 bp, mouse
gggaactctcggatctctct

SEQ ID NO: 742568 - DNA, 20 bp, mouse
gggctggcctgcaatagact

SEQ ID NO: 742569 - DNA, 20 bp, mouse
gctccctagtctggaactct

SEQ ID NO: 742570 - DNA, 20 bp, mouse
gtgcttgaaggtggaatggc

SEQ ID NO: 742571 - DNA, 20 bp, mouse
gtaaatgagtgagtgcttga

SEQ ID NO: 742572 - DNA, 20 bp, mouse
gctcctcatactccctagtc

SEQ ID NO: 742573 - DNA, 20 bp, mouse
ggtagagcagtcactttcac

SEQ ID NO: 742574 - DNA, 20 bp, mouse
gagcatgagtatgcaagcaa

SEQ ID NO: 742575 - DNA, 20 bp, mouse
ggatccgagagttccagact

SEQ ID NO: 742576 - DNA, 20 bp, mouse
ggagggaggaattagatctt

SEQ ID NO: 742577 - DNA, 20 bp, mouse
ggaccatagcagagctgctt

SEQ ID NO: 742578 - DNA, 20 bp, mouse
gtggctcatctcaggaaata

SEQ ID NO: 742579 - DNA, 20 bp, mouse
gctgagaattgcaagcctgt

SEQ ID NO: 742580 - DNA, 20 bp, mouse
gaattgaactggctcatctc

SEQ ID NO: 742581 - DNA, 20 bp, mouse
ggaagatgatagaggtggtt

SEQ ID NO: 742582 - DNA, 20 bp, mouse
gtgttctatcaccatcctac

SEQ ID NO: 742583 - DNA, 20 bp, mouse
gtatcagtatcccacacatg

SEQ ID NO: 742584 - DNA, 20 bp, mouse
gtcccacacatggggatctc

SEQ ID NO: 742585 - DNA, 20 bp, mouse
ggacctgagatccccatgtg

SEQ ID NO: 742586 - DNA, 20 bp, mouse
gaaaggtgggtcaatgtctg

SEQ ID NO: 742587 - DNA, 20 bp, mouse
gcacgtgtacaggaaagcac

SEQ ID NO: 742588 - DNA, 20 bp, mouse
gctaaacacttcccagttac

SEQ ID NO: 742589 - DNA, 20 bp, mouse
ggatcccttaatgtggaacc

SEQ ID NO: 742590 - DNA, 20 bp, mouse
gcttgtgaatgaatggggaa

SEQ ID NO: 742591 - DNA, 20 bp, mouse
gatgtctggggaagaacaaa

SEQ ID NO: 742592 - DNA, 20 bp, mouse
gtagagcttgtgaatgaatg

SEQ ID NO: 742593 - DNA, 20 bp, mouse
gttgctgttttcacaactag

SEQ ID NO: 742594 - DNA, 20 bp, mouse
ggcttcctggttccacatta

SEQ ID NO: 742595 - DNA, 20 bp, mouse
gtgaaaacagcaacatgctt

SEQ ID NO: 742596 - DNA, 20 bp, mouse
gtccaactgaagattgaacc

SEQ ID NO: 742597 - DNA, 20 bp, mouse
gtggggcacctggaagtgat

SEQ ID NO: 742598 - DNA, 20 bp, mouse
gggaaggaagagcagtttcc

SEQ ID NO: 742599 - DNA, 20 bp, mouse
ggtgacatcagcaactgcac

SEQ ID NO: 742600 - DNA, 20 bp, mouse
ggaagattgaaccaggaacc

SEQ ID NO: 742601 - DNA, 20 bp, mouse
ggtcccctgagctctatcag

SEQ ID NO: 742602 - DNA, 20 bp, mouse
ggtctaggtaacacctcctc

SEQ ID NO: 742603 - DNA, 20 bp, mouse
gtaccagaaaaaaatcccac

SEQ ID NO: 742604 - DNA, 20 bp, mouse
gtgccccactgatagagctc

SEQ ID NO: 742605 - DNA, 20 bp, mouse
gcttctgctttcacaaccag

SEQ ID NO: 742606 - DNA, 20 bp, mouse
gctagtaaggatatgaggta

SEQ ID NO: 742607 - DNA, 20 bp, mouse
gcctgcctagtaaggatatg

SEQ ID NO: 742608 - DNA, 20 bp, mouse
gaacataaacagactaagta

SEQ ID NO: 742609 - DNA, 20 bp, mouse
gaccggaatgcataaagttt

SEQ ID NO: 742610 - DNA, 20 bp, mouse
ggctgagataggctgcactg

SEQ ID NO: 742611 - DNA, 20 bp, mouse
gaggagcatgtgattcttca

SEQ ID NO: 742612 - DNA, 20 bp, mouse
gactacaattaccaccagca

SEQ ID NO: 742613 - DNA, 20 bp, mouse
gatgctgttctttctcaaca

SEQ ID NO: 742614 - DNA, 20 bp, mouse
gtctaggaaatgtgcttgaa

SEQ ID NO: 742615 - DNA, 20 bp, mouse
gatgatccaagtcagcaaca

SEQ ID NO: 742616 - DNA, 20 bp, mouse
gctgacaatgagaagatatg

SEQ ID NO: 742617 - DNA, 20 bp, mouse
gggtaattgtagtaggaaca

SEQ ID NO: 742618 - DNA, 20 bp, mouse
ggtctgtgaagccatagcat

SEQ ID NO: 742619 - DNA, 20 bp, mouse
gcagacatgacaggatactg

SEQ ID NO: 742620 - DNA, 20 bp, mouse
gctgatgctttcacaacaga

SEQ ID NO: 742621 - DNA, 20 bp, mouse
gtgtctctgacttttcactc

SEQ ID NO: 742622 - DNA, 20 bp, mouse
gggcttcatccagacatgac

SEQ ID NO: 742623 - DNA, 20 bp, mouse
ggttcatcacacatctacca

SEQ ID NO: 742624 - DNA, 20 bp, mouse
ggggttgattatgatctatt

SEQ ID NO: 742625 - DNA, 20 bp, mouse
gatcatagtaacccatgcta

SEQ ID NO: 742626 - DNA, 20 bp, mouse
gccggcctagtaagggaaag

SEQ ID NO: 742627 - DNA, 20 bp, mouse
ggagaaccaggaaattttga

SEQ ID NO: 742628 - DNA, 20 bp, mouse
gtgggtttatatggtaaagg

SEQ ID NO: 742629 - DNA, 20 bp, mouse
gatggcttcagagaagacac

SEQ ID NO: 742630 - DNA, 20 bp, mouse
ggctctctgatttctcactc

SEQ ID NO: 742631 - DNA, 20 bp, mouse
gactcaggccggcctagtaa

SEQ ID NO: 742632 - DNA, 20 bp, mouse
gttctctgaagccataatgt

SEQ ID NO: 742633 - DNA, 20 bp, mouse
ggggtagattatgatctctt

SEQ ID NO: 742634 - DNA, 20 bp, mouse
gagttcaagagtatagtcac

SEQ ID NO: 742635 - DNA, 20 bp, mouse
gaccaaagtaacccacatta

SEQ ID NO: 742636 - DNA, 20 bp, mouse
gtaaagggctgagtgatcag

SEQ ID NO: 742637 - DNA, 20 bp, mouse
gggaagatgctgggagcatt

SEQ ID NO: 742638 - DNA, 20 bp, mouse
ggctgctttcacaacagagg

SEQ ID NO: 742639 - DNA, 20 bp, mouse
gaggatgggtcgaagtcctg

SEQ ID NO: 742640 - DNA, 20 bp, mouse
gctaatgcattccacttaaa

SEQ ID NO: 742641 - DNA, 20 bp, mouse
gtcttccttgtcagaaatct

SEQ ID NO: 742642 - DNA, 20 bp, mouse
gcagaaatcttggaaacatg

SEQ ID NO: 742643 - DNA, 20 bp, mouse
gtagctaacggactgaggat

SEQ ID NO: 742644 - DNA, 20 bp, mouse
gacaatattgaaatggtcag

SEQ ID NO: 742645 - DNA, 20 bp, mouse
gcagcaaaaatacaaggaac

SEQ ID NO: 742646 - DNA, 20 bp, mouse
gcagctgtggtgcatttcaa

SEQ ID NO: 742647 - DNA, 20 bp, mouse
gtctacgtaagctagcctga

SEQ ID NO: 742648 - DNA, 20 bp, mouse
gataacacaggatgggaaat

SEQ ID NO: 742649 - DNA, 20 bp, mouse
gaagtcctgtgagataacac

SEQ ID NO: 742650 - DNA, 20 bp, mouse
gttgaagggctgtcatagag

SEQ ID NO: 742651 - DNA, 20 bp, mouse
gggggtgcaaggtgatgggc

SEQ ID NO: 742652 - DNA, 20 bp, mouse
gctttggggtgcaaggtgat

SEQ ID NO: 742653 - DNA, 20 bp, mouse
gtaggctacttattattgaa

SEQ ID NO: 742654 - DNA, 20 bp, mouse
gagatgagaaatcgtgcctt

SEQ ID NO: 742655 - DNA, 20 bp, mouse
ggcatttcaaagggaattcc

SEQ ID NO: 742656 - DNA, 20 bp, mouse
gagctggggcggcaggaagt

SEQ ID NO: 742657 - DNA, 20 bp, mouse
ggaggaggctagcagagctg

SEQ ID NO: 742658 - DNA, 20 bp, mouse
gaggctgagggttgactcta

SEQ ID NO: 742659 - DNA, 20 bp, mouse
gctcccaggtagtcccccaa

SEQ ID NO: 742660 - DNA, 20 bp, mouse
gcaccctcctccaccaagga

SEQ ID NO: 742661 - DNA, 20 bp, mouse
gccaccctcccacctgggat

SEQ ID NO: 742662 - DNA, 20 bp, mouse
gaggggagttgtaatgaaga

SEQ ID NO: 742663 - DNA, 20 bp, mouse
gctctgctagcctcctcctt

SEQ ID NO: 742664 - DNA, 20 bp, mouse
ggtaccctccttggtggagg

SEQ ID NO: 742665 - DNA, 20 bp, mouse
gagtgtgtgtgatgtctccc

SEQ ID NO: 742666 - DNA, 20 bp, mouse
ggagatgtatgggacccaag

SEQ ID NO: 742667 - DNA, 20 bp, mouse
gaggctgtgtgtgatggcat

SEQ ID NO: 742668 - DNA, 20 bp, mouse
gcctcagtatgagtagaagc

SEQ ID NO: 742669 - DNA, 20 bp, mouse
gagctggcctagagatgtat

SEQ ID NO: 742670 - DNA, 20 bp, mouse
ggtgctggaggcttgtggtt

SEQ ID NO: 742671 - DNA, 20 bp, mouse
gggacttgaggggtctaggc

SEQ ID NO: 742672 - DNA, 20 bp, mouse
gctgagggggtctaggtcta

SEQ ID NO: 742673 - DNA, 20 bp, mouse
gcatactgagggaggcactt

SEQ ID NO: 742674 - DNA, 20 bp, mouse
gggtctaggtctatggcagc

SEQ ID NO: 742675 - DNA, 20 bp, mouse
gggaagtcagggtggaacgt

SEQ ID NO: 742676 - DNA, 20 bp, mouse
gcagtgacgcaaggcgtctc

SEQ ID NO: 742677 - DNA, 20 bp, mouse
gccgcagtggggagagaccc

SEQ ID NO: 742678 - DNA, 20 bp, mouse
gtccgcccctgctccgcagt

SEQ ID NO: 742679 - DNA, 20 bp, mouse
gcgcctggccacactgatct

SEQ ID NO: 742680 - DNA, 20 bp, mouse
gaaggcgtctccggctgcgt

SEQ ID NO: 742681 - DNA, 20 bp, mouse
ggggaatctagtggttgcgt

SEQ ID NO: 742682 - DNA, 20 bp, mouse
ggcgtgggaagcccttgaac

SEQ ID NO: 742683 - DNA, 20 bp, mouse
gccccactgcggagcagggg

SEQ ID NO: 742684 - DNA, 20 bp, mouse
gtggtctccggggaatctag

SEQ ID NO: 742685 - DNA, 20 bp, mouse
gtggggcgcggttcctttaa

SEQ ID NO: 742686 - DNA, 20 bp, mouse
ggcggcgccaccagcatgtc

SEQ ID NO: 742687 - DNA, 20 bp, mouse
gaatcctccaatggtctgac

SEQ ID NO: 742688 - DNA, 20 bp, mouse
ggggctctctagaaacttcc

SEQ ID NO: 742689 - DNA, 20 bp, mouse
gcagtcaattcagggctgaa

SEQ ID NO: 742690 - DNA, 20 bp, mouse
gcctcgtccagtcagaccat

SEQ ID NO: 742691 - DNA, 20 bp, mouse
gccgacaaacgtcatgtccc

SEQ ID NO: 742692 - DNA, 20 bp, mouse
gcgggagccagtcagctgaa

SEQ ID NO: 742693 - DNA, 20 bp, mouse
gagcctaaagaatcctccaa

SEQ ID NO: 742694 - DNA, 20 bp, mouse
gaacttccgggttgtgcggg

SEQ ID NO: 742695 - DNA, 20 bp, mouse
gagtcagctgaaaggtgggt

SEQ ID NO: 742696 - DNA, 20 bp, mouse
gtcgcgggcccatgacgaga

SEQ ID NO: 742697 - DNA, 20 bp, mouse
ggaggctgacgacctgatac

SEQ ID NO: 742698 - DNA, 20 bp, mouse
gaagcagctggcgtgttccc

SEQ ID NO: 742699 - DNA, 20 bp, mouse
gccggcgctggcggcctcgc

SEQ ID NO: 742700 - DNA, 20 bp, mouse
ggcaagcgatcgtttgctga

SEQ ID NO: 742701 - DNA, 20 bp, mouse
ggcacccagaagcggatgag

SEQ ID NO: 742702 - DNA, 20 bp, mouse
gagaaaatgcctgtacaaag

SEQ ID NO: 742703 - DNA, 20 bp, mouse
ggggaccagcagcgccgcaa

SEQ ID NO: 742704 - DNA, 20 bp, mouse
gtggcagagagcggtcttct

SEQ ID NO: 742705 - DNA, 20 bp, mouse
ggaagtgacgcacccagaag

SEQ ID NO: 742706 - DNA, 20 bp, mouse
gtgggtgggtcctcaagctc

SEQ ID NO: 742707 - DNA, 20 bp, mouse
gatgaggtgtccatcttcag

SEQ ID NO: 742708 - DNA, 20 bp, mouse
ggctgcttcgatgggtgggg

SEQ ID NO: 742709 - DNA, 20 bp, mouse
gtatctgtcctgttgtaggg

SEQ ID NO: 742710 - DNA, 20 bp, mouse
gcaagctcaggctgcttcga

SEQ ID NO: 742711 - DNA, 20 bp, mouse
gcagacactggctgcctggg

SEQ ID NO: 742712 - DNA, 20 bp, mouse
gggaaggcctcacctacccc

SEQ ID NO: 742713 - DNA, 20 bp, mouse
gtctagccctttagtagtga

SEQ ID NO: 742714 - DNA, 20 bp, mouse
ggacccacccaccctacaac

SEQ ID NO: 742715 - DNA, 20 bp, mouse
gtgtctgagacgagcttctt

SEQ ID NO: 742716 - DNA, 20 bp, mouse
gggaagaacatggagtccag

SEQ ID NO: 742717 - DNA, 20 bp, mouse
ggtcccaggcttacctacta

SEQ ID NO: 742718 - DNA, 20 bp, mouse
gggcccttggctatctctcc

SEQ ID NO: 742719 - DNA, 20 bp, mouse
gtggactgaggtgccttagt

SEQ ID NO: 742720 - DNA, 20 bp, mouse
ggtcacatctaaagtgtccc

SEQ ID NO: 742721 - DNA, 20 bp, mouse
gactgggacactatttatct

SEQ ID NO: 742722 - DNA, 20 bp, mouse
ggggaggatgctgtcaggcc

SEQ ID NO: 742723 - DNA, 20 bp, mouse
gtttagatgtgacatctcat

SEQ ID NO: 742724 - DNA, 20 bp, mouse
gttcacttgttgagacttca

SEQ ID NO: 742725 - DNA, 20 bp, mouse
gtgccttagtaggtaagcct

SEQ ID NO: 742726 - DNA, 20 bp, mouse
gacacagcctgcccgaggag

SEQ ID NO: 742727 - DNA, 20 bp, mouse
gaggctagatagggtgaatg

SEQ ID NO: 742728 - DNA, 20 bp, mouse
gctcagggccctggccacgt

SEQ ID NO: 742729 - DNA, 20 bp, mouse
gacaggtgggtgtagaaaca

SEQ ID NO: 742730 - DNA, 20 bp, mouse
gtcacaggatgaccccagtt

SEQ ID NO: 742731 - DNA, 20 bp, mouse
gccacccctcccatctgcaa

SEQ ID NO: 742732 - DNA, 20 bp, mouse
gtcaccagcagccgctcctc

SEQ ID NO: 742733 - DNA, 20 bp, mouse
gaaaacttactggacccaac

SEQ ID NO: 742734 - DNA, 20 bp, mouse
gcagcagccgctcctcgggc

SEQ ID NO: 742735 - DNA, 20 bp, mouse
gagatcctaaacacttgcca

SEQ ID NO: 742736 - DNA, 20 bp, mouse
gaaccctgtaggagtcctag

SEQ ID NO: 742737 - DNA, 20 bp, mouse
gaggactcctacagggttat

SEQ ID NO: 742738 - DNA, 20 bp, mouse
gtggctgccagcccccctgt

SEQ ID NO: 742739 - DNA, 20 bp, mouse
gttccgacctgggggagaga

SEQ ID NO: 742740 - DNA, 20 bp, mouse
gactaccccgcccaacaggg

SEQ ID NO: 742741 - DNA, 20 bp, mouse
gaccctctaggactcctaca

SEQ ID NO: 742742 - DNA, 20 bp, mouse
gaccttgcacagttccgacc

SEQ ID NO: 742743 - DNA, 20 bp, mouse
gtgggtcagcagctcagatc

SEQ ID NO: 742744 - DNA, 20 bp, mouse
gtgccagcccccctgttggg

SEQ ID NO: 742745 - DNA, 20 bp, mouse
gagggacattcccagggctt

SEQ ID NO: 742746 - DNA, 20 bp, mouse
ggggtgagttggagctcata

SEQ ID NO: 742747 - DNA, 20 bp, mouse
gtggctgccactctaatcaa

SEQ ID NO: 742748 - DNA, 20 bp, mouse
gttcctcaaggaccctgcat

SEQ ID NO: 742749 - DNA, 20 bp, mouse
ggggacaattggaaactcag

SEQ ID NO: 742750 - DNA, 20 bp, mouse
gacaacgtctgatctgttgt

SEQ ID NO: 742751 - DNA, 20 bp, mouse
gagcgagtgccggactcagg

SEQ ID NO: 742752 - DNA, 20 bp, mouse
gagggcccagctgttcaact

SEQ ID NO: 742753 - DNA, 20 bp, mouse
gtccttgaggaacttggcag

SEQ ID NO: 742754 - DNA, 20 bp, mouse
gcatggagagcgtttctaga

SEQ ID NO: 742755 - DNA, 20 bp, mouse
gggaccacccagcagtcact

SEQ ID NO: 742756 - DNA, 20 bp, mouse
ggaaactaagactgtgttaa

SEQ ID NO: 742757 - DNA, 20 bp, mouse
gctgaatcgttcaatctctc

SEQ ID NO: 742758 - DNA, 20 bp, mouse
gagattgaacgattcaggtt

SEQ ID NO: 742759 - DNA, 20 bp, mouse
ggggaacacagtctgcattg

SEQ ID NO: 742760 - DNA, 20 bp, mouse
ggaacgattcaggtttgggg

SEQ ID NO: 742761 - DNA, 20 bp, mouse
ggggatcccaaaacagagtg

SEQ ID NO: 742762 - DNA, 20 bp, mouse
gagccaagtcccttcttgag

SEQ ID NO: 742763 - DNA, 20 bp, mouse
gagtcatcgccatctcgtga

SEQ ID NO: 742764 - DNA, 20 bp, mouse
gtcttgagtggcagagaagg

SEQ ID NO: 742765 - DNA, 20 bp, mouse
gattgtggaccagaaaagga

SEQ ID NO: 742766 - DNA, 20 bp, mouse
gcacccacctgctagatagt

SEQ ID NO: 742767 - DNA, 20 bp, mouse
gggctcaattactgagtgga

SEQ ID NO: 742768 - DNA, 20 bp, mouse
gctagatagtgggaccctag

SEQ ID NO: 742769 - DNA, 20 bp, mouse
gtacatgagtggacacccag

SEQ ID NO: 742770 - DNA, 20 bp, mouse
gtcctggaggcagtccccta

SEQ ID NO: 742771 - DNA, 20 bp, mouse
gaataggctcaattactgag

SEQ ID NO: 742772 - DNA, 20 bp, mouse
gcatagaaggttctcatagg

SEQ ID NO: 742773 - DNA, 20 bp, mouse
gctgcatagaaggttctcat

SEQ ID NO: 742774 - DNA, 20 bp, mouse
gatggcgggggcaggactga

SEQ ID NO: 742775 - DNA, 20 bp, mouse
ggctctgtcacccacacatc

SEQ ID NO: 742776 - DNA, 20 bp, mouse
gggagggcgctgttaaactg

SEQ ID NO: 742777 - DNA, 20 bp, mouse
gtggtgcccagctcaaccaa

SEQ ID NO: 742778 - DNA, 20 bp, mouse
gtctctctcgtctctgccat

SEQ ID NO: 742779 - DNA, 20 bp, mouse
gggagccagtggaaggacat

SEQ ID NO: 742780 - DNA, 20 bp, mouse
ggggcgctgttaaactgtgg

SEQ ID NO: 742781 - DNA, 20 bp, mouse
ggctactcctaaactttcta

SEQ ID NO: 742782 - DNA, 20 bp, mouse
gaattactcagggtggagga

SEQ ID NO: 742783 - DNA, 20 bp, mouse
gtctctgccattggttgagc

SEQ ID NO: 742784 - DNA, 20 bp, mouse
ggtgaagaacagactcagct

SEQ ID NO: 742785 - DNA, 20 bp, mouse
gagactcagctggggggaaa

SEQ ID NO: 742786 - DNA, 20 bp, mouse
gcctacacctctctggatgg

SEQ ID NO: 742787 - DNA, 20 bp, mouse
gtatcaacccccatccagag

SEQ ID NO: 742788 - DNA, 20 bp, mouse
ggcgtggggctggacttggt

SEQ ID NO: 742789 - DNA, 20 bp, mouse
gcagaatgctgcaaggtata

SEQ ID NO: 742790 - DNA, 20 bp, mouse
gtgtccacatgctaggatgg

SEQ ID NO: 742791 - DNA, 20 bp, mouse
ggcttggtcctacacctctc

SEQ ID NO: 742792 - DNA, 20 bp, mouse
gggtcctacacctctctgga

SEQ ID NO: 742793 - DNA, 20 bp, mouse
gcactgtccacatgctagga

SEQ ID NO: 742794 - DNA, 20 bp, mouse
gcacgctctgagctatgaac

SEQ ID NO: 742795 - DNA, 20 bp, mouse
ggaggcctgagtctccaacc

SEQ ID NO: 742796 - DNA, 20 bp, mouse
ggcacaggatgtgtgtggac

SEQ ID NO: 742797 - DNA, 20 bp, mouse
gggggaagttgggaccaaca

SEQ ID NO: 742798 - DNA, 20 bp, mouse
ggccacagaacccacttgaa

SEQ ID NO: 742799 - DNA, 20 bp, mouse
gtctcccacatgatctcagc

SEQ ID NO: 742800 - DNA, 20 bp, mouse
gagctgggtcagaaagtgac

SEQ ID NO: 742801 - DNA, 20 bp, mouse
ggctacatatccattcaagt

SEQ ID NO: 742802 - DNA, 20 bp, mouse
gagttgggaccaacagggtt

SEQ ID NO: 742803 - DNA, 20 bp, mouse
gagaacagaaaggggcataa

SEQ ID NO: 742804 - DNA, 20 bp, mouse
ggaaagtgacaggggaagtt

SEQ ID NO: 742805 - DNA, 20 bp, mouse
gtggcaaccgcagaacagaa

SEQ ID NO: 742806 - DNA, 20 bp, mouse
ggggcggcagaagatggcga

SEQ ID NO: 742807 - DNA, 20 bp, mouse
gtggcctgcctggagagcga

SEQ ID NO: 742808 - DNA, 20 bp, mouse
gaggcgcgacgcccaggcca

SEQ ID NO: 742809 - DNA, 20 bp, mouse
ggggacgcagagctggtgcg

SEQ ID NO: 742810 - DNA, 20 bp, mouse
ggcgtcgcgcctcccgccgg

SEQ ID NO: 742811 - DNA, 20 bp, mouse
ggggccgccacggggccacg

SEQ ID NO: 742812 - DNA, 20 bp, mouse
gaggaggagcgggccgccac

SEQ ID NO: 742813 - DNA, 20 bp, mouse
gtgggcgtcgcgcctcccgc

SEQ ID NO: 742814 - DNA, 20 bp, mouse
gggcccggggcaccggtgga

SEQ ID NO: 742815 - DNA, 20 bp, mouse
gcgaaagccgcgtctctcaa

SEQ ID NO: 742816 - DNA, 20 bp, mouse
gagcgcgcgccccccggagg

SEQ ID NO: 742817 - DNA, 20 bp, mouse
gcctccccgcctctccccga

SEQ ID NO: 742818 - DNA, 20 bp, mouse
gggtaaggaggcggggtcag

SEQ ID NO: 742819 - DNA, 20 bp, mouse
ggctccgcgcgagggcagaa

SEQ ID NO: 742820 - DNA, 20 bp, mouse
gtccccgagggagcggtggg

SEQ ID NO: 742821 - DNA, 20 bp, mouse
gaacccgcgtgctgaaggag

SEQ ID NO: 742822 - DNA, 20 bp, mouse
ggctccggggctcgcgccga

SEQ ID NO: 742823 - DNA, 20 bp, mouse
ggctccctcggggagaggcg

SEQ ID NO: 742824 - DNA, 20 bp, mouse
gcttgcctgagtaaactctg

SEQ ID NO: 742825 - DNA, 20 bp, mouse
ggtggacggcgggagcagta

SEQ ID NO: 742826 - DNA, 20 bp, mouse
gtgcgcctgcgcttcttacc

SEQ ID NO: 742827 - DNA, 20 bp, mouse
gaagaagcgcaggcgcacga

SEQ ID NO: 742828 - DNA, 20 bp, mouse
gctaaggtggcgaaatcagt

SEQ ID NO: 742829 - DNA, 20 bp, mouse
gctagcccggtaagaagcgc

SEQ ID NO: 742830 - DNA, 20 bp, mouse
ggacctcgctagacagtcac

SEQ ID NO: 742831 - DNA, 20 bp, mouse
gcaggcagggaaccctggtg

SEQ ID NO: 742832 - DNA, 20 bp, mouse
gcccggcaggcagggaaccc

SEQ ID NO: 742833 - DNA, 20 bp, mouse
ggcgcaggcgcacgagggtt

SEQ ID NO: 742834 - DNA, 20 bp, mouse
gggcttggggatgctgctaa

SEQ ID NO: 742835 - DNA, 20 bp, mouse
ggcacgtcgggaactagggg

SEQ ID NO: 742836 - DNA, 20 bp, mouse
gaaaggggaaagagttctct

SEQ ID NO: 742837 - DNA, 20 bp, mouse
gcagcctccgccataggagg

SEQ ID NO: 742838 - DNA, 20 bp, mouse
gcaagagcctcctcctatgg

SEQ ID NO: 742839 - DNA, 20 bp, mouse
gcacagagacattagcctga

SEQ ID NO: 742840 - DNA, 20 bp, mouse
gtgagacgtgccaagtcctt

SEQ ID NO: 742841 - DNA, 20 bp, mouse
gcaacagaaagtagaacgag

SEQ ID NO: 742842 - DNA, 20 bp, mouse
gaaatcccagcctccgccat

SEQ ID NO: 742843 - DNA, 20 bp, mouse
gcttcaagagcctcctccta

SEQ ID NO: 742844 - DNA, 20 bp, mouse
gaagctttcaaagccccatc

SEQ ID NO: 742845 - DNA, 20 bp, mouse
gtcccagcctccgccatagg

SEQ ID NO: 742846 - DNA, 20 bp, mouse
gtcatccactagtgaactgt

SEQ ID NO: 742847 - DNA, 20 bp, mouse
gtcaataagaacaaactggt

SEQ ID NO: 742848 - DNA, 20 bp, mouse
ggttcctcttcctgcttggc

SEQ ID NO: 742849 - DNA, 20 bp, mouse
gttctcccacagttcactag

SEQ ID NO: 742850 - DNA, 20 bp, mouse
gctaaataagtaaacaagga

SEQ ID NO: 742851 - DNA, 20 bp, mouse
gctggggtgtctgggccagt

SEQ ID NO: 742852 - DNA, 20 bp, mouse
gtgagtgtctgtaatactaa

SEQ ID NO: 742853 - DNA, 20 bp, mouse
gaacaccaagaagcagctga

SEQ ID NO: 742854 - DNA, 20 bp, mouse
ggccagatccccaaaagcag

SEQ ID NO: 742855 - DNA, 20 bp, mouse
ggagattgttaattccccac

SEQ ID NO: 742856 - DNA, 20 bp, mouse
gtccctggaactagcagttg

SEQ ID NO: 742857 - DNA, 20 bp, mouse
gacaggccagaggtagatct

SEQ ID NO: 742858 - DNA, 20 bp, mouse
gaactggtataaccttcaag

SEQ ID NO: 742859 - DNA, 20 bp, mouse
gtccccaactgctagttcca

SEQ ID NO: 742860 - DNA, 20 bp, mouse
gctgtaattctgcactgaag

SEQ ID NO: 742861 - DNA, 20 bp, mouse
gtggctgtgctcataaagtc

SEQ ID NO: 742862 - DNA, 20 bp, mouse
gggaacactttcccccttga

SEQ ID NO: 742863 - DNA, 20 bp, mouse
ggacagccaagatctacctc

SEQ ID NO: 742864 - DNA, 20 bp, mouse
gaactcggccagcactcagg

SEQ ID NO: 742865 - DNA, 20 bp, mouse
gcagacgttcgtcatcacaa

SEQ ID NO: 742866 - DNA, 20 bp, mouse
gggaagaagggcggcatcgg

SEQ ID NO: 742867 - DNA, 20 bp, mouse
ggtagcctggcactgggcct

SEQ ID NO: 742868 - DNA, 20 bp, mouse
ggctccttcccaaggaagaa

SEQ ID NO: 742869 - DNA, 20 bp, mouse
gcaaggaagaagggcggcat

SEQ ID NO: 742870 - DNA, 20 bp, mouse
ggtgctgaaggttacatgtg

SEQ ID NO: 742871 - DNA, 20 bp, mouse
gccccccgtggcagcaagaa

SEQ ID NO: 742872 - DNA, 20 bp, mouse
gtagtcaggggtgtgatctg

SEQ ID NO: 742873 - DNA, 20 bp, mouse
gccgcccttcttccttggga

SEQ ID NO: 742874 - DNA, 20 bp, mouse
gagaagggcggcatcggggg

SEQ ID NO: 742875 - DNA, 20 bp, mouse
ggttacatgtgaggcccaga

SEQ ID NO: 742876 - DNA, 20 bp, mouse
gagagccggcgcttgcgaga

SEQ ID NO: 742877 - DNA, 20 bp, mouse
gagaggacgcgcgaacgaac

SEQ ID NO: 742878 - DNA, 20 bp, mouse
gcggctctccggccagagtc

SEQ ID NO: 742879 - DNA, 20 bp, mouse
gcgaacgggagcgagcgcga

SEQ ID NO: 742880 - DNA, 20 bp, mouse
gcggcgcttgcgagagggag

SEQ ID NO: 742881 - DNA, 20 bp, mouse
gcccgcgcgtacacacgcag

SEQ ID NO: 742882 - DNA, 20 bp, mouse
gtgcgtgcgccgcgcggcga

SEQ ID NO: 742883 - DNA, 20 bp, mouse
ggaggcagagaccccggcga

SEQ ID NO: 742884 - DNA, 20 bp, mouse
gacgggagcgagcgcgaggg

SEQ ID NO: 742885 - DNA, 20 bp, mouse
gaggggcagggagcgctccc

SEQ ID NO: 742886 - DNA, 20 bp, mouse
gactggggattgaagggatc

SEQ ID NO: 742887 - DNA, 20 bp, mouse
gcccctccccgcgagcgagg

SEQ ID NO: 742888 - DNA, 20 bp, mouse
gccaaccgaggggaggccgg

SEQ ID NO: 742889 - DNA, 20 bp, mouse
gccgaaggaggccccagggc

SEQ ID NO: 742890 - DNA, 20 bp, mouse
gtctccgagcctctctccga

SEQ ID NO: 742891 - DNA, 20 bp, mouse
gtcctcctcgctcgcgggga

SEQ ID NO: 742892 - DNA, 20 bp, mouse
ggagacctgaaccaaccgag

SEQ ID NO: 742893 - DNA, 20 bp, mouse
gtggggcctccttcggagag

SEQ ID NO: 742894 - DNA, 20 bp, mouse
ggcctcccctcggttggttc

SEQ ID NO: 742895 - DNA, 20 bp, mouse
gcgctcttcctcctcgctcg

SEQ ID NO: 742896 - DNA, 20 bp, mouse
gtagtctgacaagaagtcta

SEQ ID NO: 742897 - DNA, 20 bp, mouse
gtacaacagtgtggctgtca

SEQ ID NO: 742898 - DNA, 20 bp, mouse
ggagccctctatagcgagag

SEQ ID NO: 742899 - DNA, 20 bp, mouse
gctctatagcgagagaggag

SEQ ID NO: 742900 - DNA, 20 bp, mouse
gcgagagaggagagggaacg

SEQ ID NO: 742901 - DNA, 20 bp, mouse
gtgtcaggggcgagaggctt

SEQ ID NO: 742902 - DNA, 20 bp, mouse
ggagagagctggatagctag

SEQ ID NO: 742903 - DNA, 20 bp, mouse
gactctggtccctctgattt

SEQ ID NO: 742904 - DNA, 20 bp, mouse
ggacttcttgtcagactagg

SEQ ID NO: 742905 - DNA, 20 bp, mouse
gtgtggctgtcaggggcgag

SEQ ID NO: 742906 - DNA, 20 bp, mouse
ggcagctaatatagtccctg

SEQ ID NO: 742907 - DNA, 20 bp, mouse
gacacccatccccaaggggc

SEQ ID NO: 742908 - DNA, 20 bp, mouse
gggcaggcgggcccagtgta

SEQ ID NO: 742909 - DNA, 20 bp, mouse
ggactctgcagagggtacaa

SEQ ID NO: 742910 - DNA, 20 bp, mouse
gatgcctgccccttggggat

SEQ ID NO: 742911 - DNA, 20 bp, mouse
gtctgcagagggtacaaggg

SEQ ID NO: 742912 - DNA, 20 bp, mouse
gcctccatgcctgccccttg

SEQ ID NO: 742913 - DNA, 20 bp, mouse
gtggggccctacaagggata

SEQ ID NO: 742914 - DNA, 20 bp, mouse
gtggaccggctgggaggcca

SEQ ID NO: 742915 - DNA, 20 bp, mouse
gcccttggggatgggtgttc

SEQ ID NO: 742916 - DNA, 20 bp, mouse
gcgcgccgccccggtctcgg

SEQ ID NO: 742917 - DNA, 20 bp, mouse
gcccggcccagcctacacgt

SEQ ID NO: 742918 - DNA, 20 bp, mouse
gcgtgcgggaacccacgtgt

SEQ ID NO: 742919 - DNA, 20 bp, mouse
gtgaggctgaggagcatgtc

SEQ ID NO: 742920 - DNA, 20 bp, mouse
gctaggcgccaccgagaccg

SEQ ID NO: 742921 - DNA, 20 bp, mouse
gcacgtggagccactcttgc

SEQ ID NO: 742922 - DNA, 20 bp, mouse
gtgggagcccagcggacgtg

SEQ ID NO: 742923 - DNA, 20 bp, mouse
gggcgccaccgagaccgggg

SEQ ID NO: 742924 - DNA, 20 bp, mouse
gcacgatgtccctgcaagag

SEQ ID NO: 742925 - DNA, 20 bp, mouse
gtcgggttggcctttctttg

SEQ ID NO: 742926 - DNA, 20 bp, mouse
gctgccagaggtctcatcca

SEQ ID NO: 742927 - DNA, 20 bp, mouse
gacgccgaactgcctgccag

SEQ ID NO: 742928 - DNA, 20 bp, mouse
gtggccatggatgagacctc

SEQ ID NO: 742929 - DNA, 20 bp, mouse
gtcactctggcaccaggcta

SEQ ID NO: 742930 - DNA, 20 bp, mouse
gagacctctggcaggcagtt

SEQ ID NO: 742931 - DNA, 20 bp, mouse
gagagcccaaagcacaagcg

SEQ ID NO: 742932 - DNA, 20 bp, mouse
gctctggcaccaggctaagg

SEQ ID NO: 742933 - DNA, 20 bp, mouse
gcagcccagatccagaagac

SEQ ID NO: 742934 - DNA, 20 bp, mouse
ggggaaaggtggccatcgcg

SEQ ID NO: 742935 - DNA, 20 bp, mouse
gcgtgcgcaatttcagaatc

SEQ ID NO: 742936 - DNA, 20 bp, mouse
gggagggatagacccgtctc

SEQ ID NO: 742937 - DNA, 20 bp, mouse
ggacctctaactttagagag

SEQ ID NO: 742938 - DNA, 20 bp, mouse
gtacggaataagtgcctcag

SEQ ID NO: 742939 - DNA, 20 bp, mouse
gccccgctctctaaagttag

SEQ ID NO: 742940 - DNA, 20 bp, mouse
gtacagaaggccagagaggc

SEQ ID NO: 742941 - DNA, 20 bp, mouse
gaccgtacagaaggccagag

SEQ ID NO: 742942 - DNA, 20 bp, mouse
ggactgctctaaagtggagc

SEQ ID NO: 742943 - DNA, 20 bp, mouse
gtagaggtcaccttccgctg

SEQ ID NO: 742944 - DNA, 20 bp, mouse
gaaggagattgaacgagccg

SEQ ID NO: 742945 - DNA, 20 bp, mouse
gacgggtctatccctcccct

SEQ ID NO: 742946 - DNA, 20 bp, mouse
gcacctgcatggcctacctc

SEQ ID NO: 742947 - DNA, 20 bp, mouse
gcagaaaagtggcctttaaa

SEQ ID NO: 742948 - DNA, 20 bp, mouse
ggtaagggcaaagggtccat

SEQ ID NO: 742949 - DNA, 20 bp, mouse
gaaagggatgctggccaaac

SEQ ID NO: 742950 - DNA, 20 bp, mouse
gcgactccagacggtttcca

SEQ ID NO: 742951 - DNA, 20 bp, mouse
gttggccagcatccctttaa

SEQ ID NO: 742952 - DNA, 20 bp, mouse
gcatgcaggtgcacgcacca

SEQ ID NO: 742953 - DNA, 20 bp, mouse
gtttaggagacgactccaga

SEQ ID NO: 742954 - DNA, 20 bp, mouse
gagaggccttggaaaccgtc

SEQ ID NO: 742955 - DNA, 20 bp, mouse
gctggctgccatcttctgtg

SEQ ID NO: 742956 - DNA, 20 bp, mouse
gacaaagtccgagtgcccgg

SEQ ID NO: 742957 - DNA, 20 bp, mouse
gtgcaggccggcctgagctc

SEQ ID NO: 742958 - DNA, 20 bp, mouse
gtccacccagggcagctatt

SEQ ID NO: 742959 - DNA, 20 bp, mouse
ggaggctttcaagtcccacc

SEQ ID NO: 742960 - DNA, 20 bp, mouse
gaaacaaacatcgtgtacgg

SEQ ID NO: 742961 - DNA, 20 bp, mouse
gaaggtggcctctgcagatc

SEQ ID NO: 742962 - DNA, 20 bp, mouse
gattgggcacagcgagaggc

SEQ ID NO: 742963 - DNA, 20 bp, mouse
gaggtggagccggtttaagg

SEQ ID NO: 742964 - DNA, 20 bp, mouse
gactctgtggcatgctgttg

SEQ ID NO: 742965 - DNA, 20 bp, mouse
ggtacacgatgtttgtttgg

SEQ ID NO: 742966 - DNA, 20 bp, mouse
gggaagcggtgaaattctgt

SEQ ID NO: 742967 - DNA, 20 bp, mouse
gggcgacccagggtgtggaa

SEQ ID NO: 742968 - DNA, 20 bp, mouse
gcgggggaggagtctgcaat

SEQ ID NO: 742969 - DNA, 20 bp, mouse
gcggctaagtgtccgggaag

SEQ ID NO: 742970 - DNA, 20 bp, mouse
ggcaagaagtgtaggggtcg

SEQ ID NO: 742971 - DNA, 20 bp, mouse
gaaaagagacgatgtcacat

SEQ ID NO: 742972 - DNA, 20 bp, mouse
gactgctgcgggagcttcag

SEQ ID NO: 742973 - DNA, 20 bp, mouse
gacgcgggcggctaagtgtc

SEQ ID NO: 742974 - DNA, 20 bp, mouse
gaacactcaaacagcaacgc

SEQ ID NO: 742975 - DNA, 20 bp, mouse
gccagggtgtggaagggcgt

SEQ ID NO: 742976 - DNA, 20 bp, mouse
gcctgtggcactctcctccc

SEQ ID NO: 742977 - DNA, 20 bp, mouse
gcaggctgcctcccccacgg

SEQ ID NO: 742978 - DNA, 20 bp, mouse
gacagcaacaggctttgcta

SEQ ID NO: 742979 - DNA, 20 bp, mouse
gtgcctcccccacggaggaa

SEQ ID NO: 742980 - DNA, 20 bp, mouse
gacctagggaaagacgtggt

SEQ ID NO: 742981 - DNA, 20 bp, mouse
gcccccacggaggaaaggac

SEQ ID NO: 742982 - DNA, 20 bp, mouse
gtgcaacctagggaaagacg

SEQ ID NO: 742983 - DNA, 20 bp, mouse
gagggctgtgccctctcctg

SEQ ID NO: 742984 - DNA, 20 bp, mouse
gaccaagggcagcctgtggg

SEQ ID NO: 742985 - DNA, 20 bp, mouse
gcctcaagtcacactatatg

SEQ ID NO: 742986 - DNA, 20 bp, mouse
gctgtctgacagcatgttca

SEQ ID NO: 742987 - DNA, 20 bp, mouse
gccacaacactgtggtccca

SEQ ID NO: 742988 - DNA, 20 bp, mouse
gagtaggtgccgcaagaccc

SEQ ID NO: 742989 - DNA, 20 bp, mouse
gggtgagagaaatgggggac

SEQ ID NO: 742990 - DNA, 20 bp, mouse
gtaacagtatacaatcttta

SEQ ID NO: 742991 - DNA, 20 bp, mouse
gcctacttccgctgtcggaa

SEQ ID NO: 742992 - DNA, 20 bp, mouse
ggtgttgtgggatctagtct

SEQ ID NO: 742993 - DNA, 20 bp, mouse
ggcagaggtcataggaccag

SEQ ID NO: 742994 - DNA, 20 bp, mouse
gtgggaatacggcaccatcc

SEQ ID NO: 742995 - DNA, 20 bp, mouse
gacacagtgaaaactggttg

SEQ ID NO: 742996 - DNA, 20 bp, mouse
gggaccgtggaggagagctc

SEQ ID NO: 742997 - DNA, 20 bp, mouse
ggcacgctcacagttgaatg

SEQ ID NO: 742998 - DNA, 20 bp, mouse
gccgccggacctttgtaacc

SEQ ID NO: 742999 - DNA, 20 bp, mouse
gggtccaggttacaaaggtc

SEQ ID NO: 743000 - DNA, 20 bp, mouse
ggagaggcggggtctgaccg

SEQ ID NO: 743001 - DNA, 20 bp, mouse
gcgcggggcagcaacgtcgc

SEQ ID NO: 743002 - DNA, 20 bp, mouse
gagaccccgcctctcggcgc

SEQ ID NO: 743003 - DNA, 20 bp, mouse
gccggccgagagaagagccg

SEQ ID NO: 743004 - DNA, 20 bp, mouse
gccgcctgagctctcctcca

SEQ ID NO: 743005 - DNA, 20 bp, mouse
gtccacggtccaggttacaa

SEQ ID NO: 743006 - DNA, 20 bp, mouse
ggggctcccaggaggagaga

SEQ ID NO: 743007 - DNA, 20 bp, mouse
gcccccaggctgcgggtccg

SEQ ID NO: 743008 - DNA, 20 bp, mouse
gagccccggacccgcagcct

SEQ ID NO: 743009 - DNA, 20 bp, mouse
gtgggcggggccgcatcccc

SEQ ID NO: 743010 - DNA, 20 bp, mouse
gggggaggtcgcagcacacc

SEQ ID NO: 743011 - DNA, 20 bp, mouse
gcaagcgctcgctgcgggta

SEQ ID NO: 743012 - DNA, 20 bp, mouse
ggaagagggcgtgataccag

SEQ ID NO: 743013 - DNA, 20 bp, mouse
ggtaggccacaggaggtttg

SEQ ID NO: 743014 - DNA, 20 bp, mouse
ggcgtgcggccagacggcgg

SEQ ID NO: 743015 - DNA, 20 bp, mouse
ggggaagggttaaacgtctg

SEQ ID NO: 743016 - DNA, 20 bp, mouse
gagccggtccaggtccggga

SEQ ID NO: 743017 - DNA, 20 bp, mouse
gcggacctggaccggctccg

SEQ ID NO: 743018 - DNA, 20 bp, mouse
ggccctccccgcgacgtcta

SEQ ID NO: 743019 - DNA, 20 bp, mouse
gaacaccgcgcgtgcagcct

SEQ ID NO: 743020 - DNA, 20 bp, mouse
ggagaacggggaaaggcgct

SEQ ID NO: 743021 - DNA, 20 bp, mouse
gctgggctgggagccttggt

SEQ ID NO: 743022 - DNA, 20 bp, mouse
gaagggcggggttgcgctct

SEQ ID NO: 743023 - DNA, 20 bp, mouse
ggatcccgtagctagagaac

SEQ ID NO: 743024 - DNA, 20 bp, mouse
ggtagctagagaacggggaa

SEQ ID NO: 743025 - DNA, 20 bp, mouse
ggcggtgggcgtagcccctc

SEQ ID NO: 743026 - DNA, 20 bp, mouse
gtggagcaggccagccctga

SEQ ID NO: 743027 - DNA, 20 bp, mouse
gtgacccaggagcttcgctg

SEQ ID NO: 743028 - DNA, 20 bp, mouse
ggaagggtgcgggatggcgt

SEQ ID NO: 743029 - DNA, 20 bp, mouse
gtagcgcagtgcggtaagga

SEQ ID NO: 743030 - DNA, 20 bp, mouse
gtcctcagccacatccactc

SEQ ID NO: 743031 - DNA, 20 bp, mouse
gcggtaaggaaggtgtggct

SEQ ID NO: 743032 - DNA, 20 bp, mouse
gggagcaaagcttgccacag

SEQ ID NO: 743033 - DNA, 20 bp, mouse
gcttccacctggaagtagga

SEQ ID NO: 743034 - DNA, 20 bp, mouse
ggaggagcagggcgtgaccc

SEQ ID NO: 743035 - DNA, 20 bp, mouse
gggctgggaagggtgcggga

SEQ ID NO: 743036 - DNA, 20 bp, mouse
gcacccggggtggcaaccga

SEQ ID NO: 743037 - DNA, 20 bp, mouse
gcgagagcgagcggtctcta

SEQ ID NO: 743038 - DNA, 20 bp, mouse
gcggccgggaccttgccttc

SEQ ID NO: 743039 - DNA, 20 bp, mouse
gccgctgctccgagagcgag

SEQ ID NO: 743040 - DNA, 20 bp, mouse
ggaacctggcaactgggcca

SEQ ID NO: 743041 - DNA, 20 bp, mouse
gctccgcgagcggcctgggt

SEQ ID NO: 743042 - DNA, 20 bp, mouse
gaggctgttgagaaaggcgc

SEQ ID NO: 743043 - DNA, 20 bp, mouse
gaggccctggcccagttgcc

SEQ ID NO: 743044 - DNA, 20 bp, mouse
gtagacggccgctgggaacc

SEQ ID NO: 743045 - DNA, 20 bp, mouse
ggctgcccggaaagcagttc

SEQ ID NO: 743046 - DNA, 20 bp, mouse
gtactcaaggactacactcc

SEQ ID NO: 743047 - DNA, 20 bp, mouse
gcaggctgggaatgtaacag

SEQ ID NO: 743048 - DNA, 20 bp, mouse
gtgaatccatgagggagact

SEQ ID NO: 743049 - DNA, 20 bp, mouse
gtactgctcgtggactttga

SEQ ID NO: 743050 - DNA, 20 bp, mouse
gactctgggaattgaaccag

SEQ ID NO: 743051 - DNA, 20 bp, mouse
gtctccctcatggattcaca

SEQ ID NO: 743052 - DNA, 20 bp, mouse
gacactgtgcttactgctcg

SEQ ID NO: 743053 - DNA, 20 bp, mouse
gatggttgccagctgagatg

SEQ ID NO: 743054 - DNA, 20 bp, mouse
gagtccttgagtacattctc

SEQ ID NO: 743055 - DNA, 20 bp, mouse
gtgtgtacaggcaattaggg

SEQ ID NO: 743056 - DNA, 20 bp, mouse
gctggcaagctagtaactgg

SEQ ID NO: 743057 - DNA, 20 bp, mouse
gcccagagggacatccagac

SEQ ID NO: 743058 - DNA, 20 bp, mouse
ggtaactgggggtgctggtg

SEQ ID NO: 743059 - DNA, 20 bp, mouse
gtccctctgggtttttggag

SEQ ID NO: 743060 - DNA, 20 bp, mouse
gcctggaagcagaatgagag

SEQ ID NO: 743061 - DNA, 20 bp, mouse
gtcccctccaaaaacccaga

SEQ ID NO: 743062 - DNA, 20 bp, mouse
gaacacaggataagctgagt

SEQ ID NO: 743063 - DNA, 20 bp, mouse
gagctgagtaggctgctcca

SEQ ID NO: 743064 - DNA, 20 bp, mouse
gagacaggtttgagtatgta

SEQ ID NO: 743065 - DNA, 20 bp, mouse
gcagggccccttggagaaat

SEQ ID NO: 743066 - DNA, 20 bp, mouse
gggccggccgaggtctcagt

SEQ ID NO: 743067 - DNA, 20 bp, mouse
ggggatcagacagctctcca

SEQ ID NO: 743068 - DNA, 20 bp, mouse
gccggccaaagcctttgatc

SEQ ID NO: 743069 - DNA, 20 bp, mouse
gatcccactgagacctcggc

SEQ ID NO: 743070 - DNA, 20 bp, mouse
gtcagtatttctgatagcgt

SEQ ID NO: 743071 - DNA, 20 bp, mouse
ggatgccttttggttggggc

SEQ ID NO: 743072 - DNA, 20 bp, mouse
ggattgatgccttttggttg

SEQ ID NO: 743073 - DNA, 20 bp, mouse
gtctgatcccactgagacct

SEQ ID NO: 743074 - DNA, 20 bp, mouse
ggatgcagattgatgccttt

SEQ ID NO: 743075 - DNA, 20 bp, mouse
gaagagctgactagtaacac

SEQ ID NO: 743076 - DNA, 20 bp, mouse
ggctgcctgctggaggggtg

SEQ ID NO: 743077 - DNA, 20 bp, mouse
ggaggagggagtctgttagg

SEQ ID NO: 743078 - DNA, 20 bp, mouse
gaggacgagtcatacttggg

SEQ ID NO: 743079 - DNA, 20 bp, mouse
gcgcccgcctgttcatgcct

SEQ ID NO: 743080 - DNA, 20 bp, mouse
gcccccaggcatgaacaggc

SEQ ID NO: 743081 - DNA, 20 bp, mouse
gcaaaggacgagtcatactt

SEQ ID NO: 743082 - DNA, 20 bp, mouse
gctaggaaatgaactagggc

SEQ ID NO: 743083 - DNA, 20 bp, mouse
gcactctagccccctcactc

SEQ ID NO: 743084 - DNA, 20 bp, mouse
gacgagtcatacttgggggg

SEQ ID NO: 743085 - DNA, 20 bp, mouse
gtgggccacactgttctttg

SEQ ID NO: 743086 - DNA, 20 bp, mouse
gccgcgcgcgagcatcggat

SEQ ID NO: 743087 - DNA, 20 bp, mouse
gagagtggccgctaaggtgt

SEQ ID NO: 743088 - DNA, 20 bp, mouse
gcccggccgcgcgcgagcat

SEQ ID NO: 743089 - DNA, 20 bp, mouse
gagctgaggaaacctcacgg

SEQ ID NO: 743090 - DNA, 20 bp, mouse
gtctggaaggaaaaaacgtt

SEQ ID NO: 743091 - DNA, 20 bp, mouse
gtgagacagagtggccgcta

SEQ ID NO: 743092 - DNA, 20 bp, mouse
gtctactggatgcccccgtg

SEQ ID NO: 743093 - DNA, 20 bp, mouse
gcaaagaaagggtggtttcg

SEQ ID NO: 743094 - DNA, 20 bp, mouse
gggaagccgggcggcggcta

SEQ ID NO: 743095 - DNA, 20 bp, mouse
gggcggaaggactgcggtat

SEQ ID NO: 743096 - DNA, 20 bp, mouse
gcggaagcgcagccattcaa

SEQ ID NO: 743097 - DNA, 20 bp, mouse
ggataggggtgtgtaccaga

SEQ ID NO: 743098 - DNA, 20 bp, mouse
gagctctccggaggcaaaag

SEQ ID NO: 743099 - DNA, 20 bp, mouse
gtcgataagggcagtgcggt

SEQ ID NO: 743100 - DNA, 20 bp, mouse
gactatacctagaatcgata

SEQ ID NO: 743101 - DNA, 20 bp, mouse
gggctgcgcttccgcgacga

SEQ ID NO: 743102 - DNA, 20 bp, mouse
gcactgcccttatcgattct

SEQ ID NO: 743103 - DNA, 20 bp, mouse
gctcagggagagttgtaagc

SEQ ID NO: 743104 - DNA, 20 bp, mouse
gaatcttggccattggtctt

SEQ ID NO: 743105 - DNA, 20 bp, mouse
ggcggttggagccgtcgtcg

SEQ ID NO: 743106 - DNA, 20 bp, mouse
ggcccctgcgccctgaggag

SEQ ID NO: 743107 - DNA, 20 bp, mouse
gaggaggggctgtctaagaa

SEQ ID NO: 743108 - DNA, 20 bp, mouse
ggagctgtctggaagacaca

SEQ ID NO: 743109 - DNA, 20 bp, mouse
gagcgaacagtatcgttgag

SEQ ID NO: 743110 - DNA, 20 bp, mouse
ggactgagatttctgtctgt

SEQ ID NO: 743111 - DNA, 20 bp, mouse
ggacaagcccctgcgccctg

SEQ ID NO: 743112 - DNA, 20 bp, mouse
gtgggatagagaattcctcg

SEQ ID NO: 743113 - DNA, 20 bp, mouse
gactctggaagattctccat

SEQ ID NO: 743114 - DNA, 20 bp, mouse
gagcccctcctcagggcgca

SEQ ID NO: 743115 - DNA, 20 bp, mouse
gtgtctcatgctgagttccc

SEQ ID NO: 743116 - DNA, 20 bp, mouse
gtggaacccgcggggacgac

SEQ ID NO: 743117 - DNA, 20 bp, mouse
gtggcgggggtcgaaggaga

SEQ ID NO: 743118 - DNA, 20 bp, mouse
gaagctggagcgggtggcgg

SEQ ID NO: 743119 - DNA, 20 bp, mouse
gtctgtgacggacggggatg

SEQ ID NO: 743120 - DNA, 20 bp, mouse
gcccgcctcttcatcagcct

SEQ ID NO: 743121 - DNA, 20 bp, mouse
ggagagggcggatttacgcg

SEQ ID NO: 743122 - DNA, 20 bp, mouse
gtccgcttccgcgtcggcgg

SEQ ID NO: 743123 - DNA, 20 bp, mouse
gtttacgcgcggttctgtga

SEQ ID NO: 743124 - DNA, 20 bp, mouse
gagcgggtggcgggggtcga

SEQ ID NO: 743125 - DNA, 20 bp, mouse
gcggggacgacgggcagccg

SEQ ID NO: 743126 - DNA, 20 bp, mouse
gctgctaggagtggaaaagc

SEQ ID NO: 743127 - DNA, 20 bp, mouse
gatgactgagaatctaagga

SEQ ID NO: 743128 - DNA, 20 bp, mouse
ggaagaatcctgagtgctga

SEQ ID NO: 743129 - DNA, 20 bp, mouse
gggaaatgactgagaatcta

SEQ ID NO: 743130 - DNA, 20 bp, mouse
gcatcatgagtagtgaatgt

SEQ ID NO: 743131 - DNA, 20 bp, mouse
gtagctagattctcatgtcc

SEQ ID NO: 743132 - DNA, 20 bp, mouse
gggctcattgctgctaggag

SEQ ID NO: 743133 - DNA, 20 bp, mouse
gcatctcctagaaagtttgt

SEQ ID NO: 743134 - DNA, 20 bp, mouse
ggctgtaatgatgtcataaa

SEQ ID NO: 743135 - DNA, 20 bp, mouse
gggacttctaactcaagtcc

SEQ ID NO: 743136 - DNA, 20 bp, mouse
ggccgagaatcagaccggga

SEQ ID NO: 743137 - DNA, 20 bp, mouse
gtccctgaagttcagcgcgt

SEQ ID NO: 743138 - DNA, 20 bp, mouse
gcctccggcgccccctgcgg

SEQ ID NO: 743139 - DNA, 20 bp, mouse
gcagggagcaagcgggagag

SEQ ID NO: 743140 - DNA, 20 bp, mouse
gtggcccctgcgagccccgg

SEQ ID NO: 743141 - DNA, 20 bp, mouse
gggggtctgccccaccgcag

SEQ ID NO: 743142 - DNA, 20 bp, mouse
gggctcgcaggggccatcgc

SEQ ID NO: 743143 - DNA, 20 bp, mouse
gcggaggtgcggggagttcc

SEQ ID NO: 743144 - DNA, 20 bp, mouse
gaacctctgcggatgactcc

SEQ ID NO: 743145 - DNA, 20 bp, mouse
ggagcaagcgggagaggggc

SEQ ID NO: 743146 - DNA, 20 bp, mouse
gccgcgcgccatgatgggaa

SEQ ID NO: 743147 - DNA, 20 bp, mouse
gcggggccgcgcgccatgat

SEQ ID NO: 743148 - DNA, 20 bp, mouse
ggacgccatattgggaaggg

SEQ ID NO: 743149 - DNA, 20 bp, mouse
gatgatgggaagggcgacca

SEQ ID NO: 743150 - DNA, 20 bp, mouse
gcttcccaatatggcgtccg

SEQ ID NO: 743151 - DNA, 20 bp, mouse
gtgggaagggcggcgcatgg

SEQ ID NO: 743152 - DNA, 20 bp, mouse
gtgccggcgggagcagttcc

SEQ ID NO: 743153 - DNA, 20 bp, mouse
gcacccggaactgctcccgc

SEQ ID NO: 743154 - DNA, 20 bp, mouse
gacacagacgcctttcatca

SEQ ID NO: 743155 - DNA, 20 bp, mouse
gcgaccacggacgccatatt

SEQ ID NO: 743156 - DNA, 20 bp, mouse
gcgggaaggcgccacctgag

SEQ ID NO: 743157 - DNA, 20 bp, mouse
ggtgacaggcaggacctccg

SEQ ID NO: 743158 - DNA, 20 bp, mouse
gcgggaggagctcacctgag

SEQ ID NO: 743159 - DNA, 20 bp, mouse
ggcgcggcggcaggagcccg

SEQ ID NO: 743160 - DNA, 20 bp, mouse
gaggtggcgccttcccgctc

SEQ ID NO: 743161 - DNA, 20 bp, mouse
gcgaacccggcggtggcgag

SEQ ID NO: 743162 - DNA, 20 bp, mouse
ggcgcgcggcggtgacaggc

SEQ ID NO: 743163 - DNA, 20 bp, mouse
gcggtctagttcagggtcta

SEQ ID NO: 743164 - DNA, 20 bp, mouse
gggagggagcgcggtcacgc

SEQ ID NO: 743165 - DNA, 20 bp, mouse
gggtgtggctacgaacccgg

SEQ ID NO: 743166 - DNA, 20 bp, mouse
gcagacaggaatggtggtta

SEQ ID NO: 743167 - DNA, 20 bp, mouse
gaccaccattcctgtctgaa

SEQ ID NO: 743168 - DNA, 20 bp, mouse
ggaggctgacagatctgaac

SEQ ID NO: 743169 - DNA, 20 bp, mouse
gagagcactgcctgcatgga

SEQ ID NO: 743170 - DNA, 20 bp, mouse
gcctggtccgaggtcaaggg

SEQ ID NO: 743171 - DNA, 20 bp, mouse
ggagcccaccaaaggagagg

SEQ ID NO: 743172 - DNA, 20 bp, mouse
gacgggaagttgagctttcc

SEQ ID NO: 743173 - DNA, 20 bp, mouse
gacaggaatggtggttaggg

SEQ ID NO: 743174 - DNA, 20 bp, mouse
gagaaaggagctgctccaga

SEQ ID NO: 743175 - DNA, 20 bp, mouse
ggaactggcagtgctccctc

SEQ ID NO: 743176 - DNA, 20 bp, mouse
gtccgggggtggagcaactc

SEQ ID NO: 743177 - DNA, 20 bp, mouse
gcctcatcaagcagcgtccg

SEQ ID NO: 743178 - DNA, 20 bp, mouse
gcgagcaagggtggaaccat

SEQ ID NO: 743179 - DNA, 20 bp, mouse
gcctccccaaaccccgtccg

SEQ ID NO: 743180 - DNA, 20 bp, mouse
gtaggatgggacgtgacaat

SEQ ID NO: 743181 - DNA, 20 bp, mouse
gctaggttatgtctgcttaa

SEQ ID NO: 743182 - DNA, 20 bp, mouse
gtctgcttaaaggaatagac

SEQ ID NO: 743183 - DNA, 20 bp, mouse
gaagcctcggacggggtttg

SEQ ID NO: 743184 - DNA, 20 bp, mouse
gtgagagtgtagcattcggg

SEQ ID NO: 743185 - DNA, 20 bp, mouse
gccgtccgaggcttcagaac

SEQ ID NO: 743186 - DNA, 20 bp, mouse
gcccacggggccaccgtcta

SEQ ID NO: 743187 - DNA, 20 bp, mouse
gggaagctggccctagacgg

SEQ ID NO: 743188 - DNA, 20 bp, mouse
gtgagcgcgcacgagaggct

SEQ ID NO: 743189 - DNA, 20 bp, mouse
ggctgtgcgcgacacagggc

SEQ ID NO: 743190 - DNA, 20 bp, mouse
gagggcggggacagacgtcc

SEQ ID NO: 743191 - DNA, 20 bp, mouse
gaccggctggctctagtctg

SEQ ID NO: 743192 - DNA, 20 bp, mouse
gcaagacagcgctcagtcac

SEQ ID NO: 743193 - DNA, 20 bp, mouse
gagccctggcctgtttggta

SEQ ID NO: 743194 - DNA, 20 bp, mouse
gcgctcccgggactcgttac

SEQ ID NO: 743195 - DNA, 20 bp, mouse
gtgttgtgagcgcgcacgag

SEQ ID NO: 743196 - DNA, 20 bp, mouse
gctgcggagtatatgtaaat

SEQ ID NO: 743197 - DNA, 20 bp, mouse
ggctgtcagggccccaagaa

SEQ ID NO: 743198 - DNA, 20 bp, mouse
gtacatatgtccagcccctc

SEQ ID NO: 743199 - DNA, 20 bp, mouse
ggcttgacgcacacataaat

SEQ ID NO: 743200 - DNA, 20 bp, mouse
ggccctgccaggctccctag

SEQ ID NO: 743201 - DNA, 20 bp, mouse
gtctcgctaaagtccccaaa

SEQ ID NO: 743202 - DNA, 20 bp, mouse
ggacgcacacataaattggc

SEQ ID NO: 743203 - DNA, 20 bp, mouse
gtgtgcgtcaagcttctctc

SEQ ID NO: 743204 - DNA, 20 bp, mouse
ggctccctagaggtctcgag

SEQ ID NO: 743205 - DNA, 20 bp, mouse
gcagcctctcgagacctcta

SEQ ID NO: 743206 - DNA, 20 bp, mouse
gcgagcgcagacaccggggc

SEQ ID NO: 743207 - DNA, 20 bp, mouse
gcgggcgagcgcagacaccg

SEQ ID NO: 743208 - DNA, 20 bp, mouse
gagcccgctcgcacgctgtg

SEQ ID NO: 743209 - DNA, 20 bp, mouse
gagcgggctaacggagtagc

SEQ ID NO: 743210 - DNA, 20 bp, mouse
gcgcacgctgtgcggagctt

SEQ ID NO: 743211 - DNA, 20 bp, mouse
gcagcgtgcgagcgggctaa

SEQ ID NO: 743212 - DNA, 20 bp, mouse
gtacgtatgtagacatatgc

SEQ ID NO: 743213 - DNA, 20 bp, mouse
ggcaacttcaagagcagcgt

SEQ ID NO: 743214 - DNA, 20 bp, mouse
gaaacctggccgcagctgac

SEQ ID NO: 743215 - DNA, 20 bp, mouse
ggggtgtggtcgctctgctc

SEQ ID NO: 743216 - DNA, 20 bp, mouse
gcggctgaagttctccctcg

SEQ ID NO: 743217 - DNA, 20 bp, mouse
gccctcgagtgcaagtttgg

SEQ ID NO: 743218 - DNA, 20 bp, mouse
ggcgccctcgagtgcaagtt

SEQ ID NO: 743219 - DNA, 20 bp, mouse
gttggcgctcgcagggactg

SEQ ID NO: 743220 - DNA, 20 bp, mouse
gagcagcggtagtttaagga

SEQ ID NO: 743221 - DNA, 20 bp, mouse
ggcactggggcagttataag

SEQ ID NO: 743222 - DNA, 20 bp, mouse
ggccggacctcgaggattac

SEQ ID NO: 743223 - DNA, 20 bp, mouse
gcccagcgggccagcaacag

SEQ ID NO: 743224 - DNA, 20 bp, mouse
gtccctcgaggcgcctagaa

SEQ ID NO: 743225 - DNA, 20 bp, mouse
ggcccccaaacttgcactcg

SEQ ID NO: 743226 - DNA, 20 bp, mouse
gtccgcctccgggacttaag

SEQ ID NO: 743227 - DNA, 20 bp, mouse
gagtcccggaggcggaaaga

SEQ ID NO: 743228 - DNA, 20 bp, mouse
gcccggaggcggaaagaggg

SEQ ID NO: 743229 - DNA, 20 bp, mouse
gtaaaggagtgctccggctg

SEQ ID NO: 743230 - DNA, 20 bp, mouse
ggggaccaggcagcagactg

SEQ ID NO: 743231 - DNA, 20 bp, mouse
gggaagaaaaatgtgctgtg

SEQ ID NO: 743232 - DNA, 20 bp, mouse
gtggggctttggttggccgg

SEQ ID NO: 743233 - DNA, 20 bp, mouse
gtcaaccccttaagtcccgg

SEQ ID NO: 743234 - DNA, 20 bp, mouse
gcagactggggcggtacctg

SEQ ID NO: 743235 - DNA, 20 bp, mouse
gactactttggaaactgccc

SEQ ID NO: 743236 - DNA, 20 bp, mouse
ggcaacccgtaaggcggcgg

SEQ ID NO: 743237 - DNA, 20 bp, mouse
gctcacgaagagtaagtgtt

SEQ ID NO: 743238 - DNA, 20 bp, mouse
ggaagagtaagtgtttggat

SEQ ID NO: 743239 - DNA, 20 bp, mouse
ggggctgccacgtcccatcc

SEQ ID NO: 743240 - DNA, 20 bp, mouse
gcaggcgcacaacagcttgt

SEQ ID NO: 743241 - DNA, 20 bp, mouse
gaagtggtacgggaaatctg

SEQ ID NO: 743242 - DNA, 20 bp, mouse
ggagcagagcagggatgaga

SEQ ID NO: 743243 - DNA, 20 bp, mouse
ggacccggtgggtgtggtag

SEQ ID NO: 743244 - DNA, 20 bp, mouse
ggagcgacctggggaacttg

SEQ ID NO: 743245 - DNA, 20 bp, mouse
gcgagcgccacgaggtctaa

SEQ ID NO: 743246 - DNA, 20 bp, mouse
gccccaggggtcggcctctc

SEQ ID NO: 743247 - DNA, 20 bp, mouse
gtgcgtgtggggtcccttgt

SEQ ID NO: 743248 - DNA, 20 bp, mouse
ggggacaagttttgcgtgtg

SEQ ID NO: 743249 - DNA, 20 bp, mouse
gaaaacttgtccccaggggt

SEQ ID NO: 743250 - DNA, 20 bp, mouse
gggcccctggccagttgagt

SEQ ID NO: 743251 - DNA, 20 bp, mouse
ggcaggaggagcgtgtgagc

SEQ ID NO: 743252 - DNA, 20 bp, mouse
gtgtgggtggcagaagacga

SEQ ID NO: 743253 - DNA, 20 bp, mouse
gctctcaggcagctggagcg

SEQ ID NO: 743254 - DNA, 20 bp, mouse
gggaggcgtccctttaagag

SEQ ID NO: 743255 - DNA, 20 bp, mouse
gaaaagctctagagaagggg

SEQ ID NO: 743256 - DNA, 20 bp, mouse
ggggacacatgggtctagtg

SEQ ID NO: 743257 - DNA, 20 bp, mouse
gagacggagtgagaaatccg

SEQ ID NO: 743258 - DNA, 20 bp, mouse
ggggaaatgcggagacggga

SEQ ID NO: 743259 - DNA, 20 bp, mouse
gtgggaaaaccgaagtgaga

SEQ ID NO: 743260 - DNA, 20 bp, mouse
gggtgggttggcaggagcgt

SEQ ID NO: 743261 - DNA, 20 bp, mouse
gggctcctggcctgtgacgt

SEQ ID NO: 743262 - DNA, 20 bp, mouse
gtgggtagatgaacgtgtga

SEQ ID NO: 743263 - DNA, 20 bp, mouse
ggtctagtgtgggtaagaaa

SEQ ID NO: 743264 - DNA, 20 bp, mouse
ggaagttacccccacgtcac

SEQ ID NO: 743265 - DNA, 20 bp, mouse
gtacccccacgtcacaggcc

SEQ ID NO: 743266 - DNA, 20 bp, mouse
gcacccgtgtctgccaggga

SEQ ID NO: 743267 - DNA, 20 bp, mouse
ggtggtgtaagcattgctag

SEQ ID NO: 743268 - DNA, 20 bp, mouse
gacgacactgctgtggggag

SEQ ID NO: 743269 - DNA, 20 bp, mouse
gcgagggccagcccacgtag

SEQ ID NO: 743270 - DNA, 20 bp, mouse
gacgctcgagtccactacgt

SEQ ID NO: 743271 - DNA, 20 bp, mouse
ggacagaggtggcacttaag

SEQ ID NO: 743272 - DNA, 20 bp, mouse
gaagcattgctagtggtcga

SEQ ID NO: 743273 - DNA, 20 bp, mouse
gggactcgagcgtcaactga

SEQ ID NO: 743274 - DNA, 20 bp, mouse
gggggagcagaggagactcg

SEQ ID NO: 743275 - DNA, 20 bp, mouse
gccacccacccgtgtctgcc

SEQ ID NO: 743276 - DNA, 20 bp, mouse
ggggcggagtctaaaatcag

SEQ ID NO: 743277 - DNA, 20 bp, mouse
ggggcggtgctgaacaaact

SEQ ID NO: 743278 - DNA, 20 bp, mouse
gaagtggaggaaggcgttgg

SEQ ID NO: 743279 - DNA, 20 bp, mouse
gggagccccgccccttcatt

SEQ ID NO: 743280 - DNA, 20 bp, mouse
ggggcagaatctggcataat

SEQ ID NO: 743281 - DNA, 20 bp, mouse
gcaggggcggggcctaatga

SEQ ID NO: 743282 - DNA, 20 bp, mouse
ggggcgggaagccacgggat

SEQ ID NO: 743283 - DNA, 20 bp, mouse
gcggagtctaaaatcagggg

SEQ ID NO: 743284 - DNA, 20 bp, mouse
gaggcgggatcagtccaatg

SEQ ID NO: 743285 - DNA, 20 bp, mouse
gtgaaggggcggggctccgt

SEQ ID NO: 743286 - DNA, 20 bp, mouse
ggggacgtgcggggcagctc

SEQ ID NO: 743287 - DNA, 20 bp, mouse
gtgcggagctcgtgaagatg

SEQ ID NO: 743288 - DNA, 20 bp, mouse
ggtctcgagaagagagcgtg

SEQ ID NO: 743289 - DNA, 20 bp, mouse
gctccggcccggagtccccg

SEQ ID NO: 743290 - DNA, 20 bp, mouse
gggggtggaggggacctcat

SEQ ID NO: 743291 - DNA, 20 bp, mouse
gggccagctggggacgtgcg

SEQ ID NO: 743292 - DNA, 20 bp, mouse
ggctcgcggggcagaaagtg

SEQ ID NO: 743293 - DNA, 20 bp, mouse
ggggaggagaaatgggctcg

SEQ ID NO: 743294 - DNA, 20 bp, mouse
gcccctcagccgcggaagga

SEQ ID NO: 743295 - DNA, 20 bp, mouse
ggaccgcggggactccgggc

SEQ ID NO: 743296 - DNA, 20 bp, mouse
gccagcgtgcgccgagtctt

SEQ ID NO: 743297 - DNA, 20 bp, mouse
gtaaggaagggtggtgggta

SEQ ID NO: 743298 - DNA, 20 bp, mouse
gcccatgagccatctgctat

SEQ ID NO: 743299 - DNA, 20 bp, mouse
ggtgcctagcttctgatttg

SEQ ID NO: 743300 - DNA, 20 bp, mouse
gcgggtgccgcagggccaat

SEQ ID NO: 743301 - DNA, 20 bp, mouse
gggcccagcgtgcatccggg

SEQ ID NO: 743302 - DNA, 20 bp, mouse
ggacgagcaaccttagtagt

SEQ ID NO: 743303 - DNA, 20 bp, mouse
gcaaggcccagcgtgcatcc

SEQ ID NO: 743304 - DNA, 20 bp, mouse
gtgggacttgtagtcgggag

SEQ ID NO: 743305 - DNA, 20 bp, mouse
gggaacaggcctggccggca

SEQ ID NO: 743306 - DNA, 20 bp, mouse
gaaggacgcgagccagtccc

SEQ ID NO: 743307 - DNA, 20 bp, mouse
gagcccgcgaagtcacttct

SEQ ID NO: 743308 - DNA, 20 bp, mouse
ggacccagaagtgacttcgc

SEQ ID NO: 743309 - DNA, 20 bp, mouse
gtggctagactacagaatgt

SEQ ID NO: 743310 - DNA, 20 bp, mouse
gtcactcggagtgacgtcac

SEQ ID NO: 743311 - DNA, 20 bp, mouse
gaggtggaaccatggagact

SEQ ID NO: 743312 - DNA, 20 bp, mouse
gttccgcgcggctgccgtga

SEQ ID NO: 743313 - DNA, 20 bp, mouse
gcaatgagctctcaaatcct

SEQ ID NO: 743314 - DNA, 20 bp, mouse
gacttcgcgggctcgtgcgg

SEQ ID NO: 743315 - DNA, 20 bp, mouse
gagagctcattggatggtag

SEQ ID NO: 743316 - DNA, 20 bp, mouse
gggcgctcgctccctcgggg

SEQ ID NO: 743317 - DNA, 20 bp, mouse
gcggggacccggattggacg

SEQ ID NO: 743318 - DNA, 20 bp, mouse
gcggaagcgagcctccccga

SEQ ID NO: 743319 - DNA, 20 bp, mouse
gagcccccagggaccgacga

SEQ ID NO: 743320 - DNA, 20 bp, mouse
gcccgggcggggacccggat

SEQ ID NO: 743321 - DNA, 20 bp, mouse
gtgccctcgtcggtccctgg

SEQ ID NO: 743322 - DNA, 20 bp, mouse
gacgcttccgcgcgcaggac

SEQ ID NO: 743323 - DNA, 20 bp, mouse
ggcccctccacgccgacagg

SEQ ID NO: 743324 - DNA, 20 bp, mouse
ggcggctcgcagccgcctgt

SEQ ID NO: 743325 - DNA, 20 bp, mouse
ggggccggcgctcgctccct

SEQ ID NO: 743326 - DNA, 20 bp, mouse
ggggacaggctcgtgcacaa

SEQ ID NO: 743327 - DNA, 20 bp, mouse
gtcaccctccggagctgctc

SEQ ID NO: 743328 - DNA, 20 bp, mouse
gacaggctcgtgcacaaagg

SEQ ID NO: 743329 - DNA, 20 bp, mouse
ggactcggcgcaggcgggac

SEQ ID NO: 743330 - DNA, 20 bp, mouse
gccacgtgggatacggacaa

SEQ ID NO: 743331 - DNA, 20 bp, mouse
gcctgcgccgagtcaccctc

SEQ ID NO: 743332 - DNA, 20 bp, mouse
gcgcccccgaagctgggacc

SEQ ID NO: 743333 - DNA, 20 bp, mouse
ggggctgggaaccacccagc

SEQ ID NO: 743334 - DNA, 20 bp, mouse
gcctccgcgggcgacatcct

SEQ ID NO: 743335 - DNA, 20 bp, mouse
gctcccagagcagctccgga

SEQ ID NO: 743336 - DNA, 20 bp, mouse
gccaccagaagtggagtcta

SEQ ID NO: 743337 - DNA, 20 bp, mouse
gggcggcgccaggaccctga

SEQ ID NO: 743338 - DNA, 20 bp, mouse
gcatgtcaggacaaggatgg

SEQ ID NO: 743339 - DNA, 20 bp, mouse
gtgtgctgtggcagagattg

SEQ ID NO: 743340 - DNA, 20 bp, mouse
gagggatggagaagaataag

SEQ ID NO: 743341 - DNA, 20 bp, mouse
gggggggtctcctctctgac

SEQ ID NO: 743342 - DNA, 20 bp, mouse
gcagctgcgctgggacctag

SEQ ID NO: 743343 - DNA, 20 bp, mouse
gatagggcctggggccagca

SEQ ID NO: 743344 - DNA, 20 bp, mouse
ggggtctgatccagttaaaa

SEQ ID NO: 743345 - DNA, 20 bp, mouse
gaaagtcaattttggagcag

SEQ ID NO: 743346 - DNA, 20 bp, mouse
gtcaagggactgaacaactt

SEQ ID NO: 743347 - DNA, 20 bp, mouse
gagagaggggaaagcaacca

SEQ ID NO: 743348 - DNA, 20 bp, mouse
ggtgacaccgggatgaacaa

SEQ ID NO: 743349 - DNA, 20 bp, mouse
gcaaatgccagggaccagct

SEQ ID NO: 743350 - DNA, 20 bp, mouse
ggtctcagacaaagcagcac

SEQ ID NO: 743351 - DNA, 20 bp, mouse
gagctagggtcacaagaaag

SEQ ID NO: 743352 - DNA, 20 bp, mouse
gtgtgaccctagctggtccc

SEQ ID NO: 743353 - DNA, 20 bp, mouse
ggataagagcgccatgtgag

SEQ ID NO: 743354 - DNA, 20 bp, mouse
gaagtggagtgacaaaggcc

SEQ ID NO: 743355 - DNA, 20 bp, mouse
ggttcatcccggtgtcacaa

SEQ ID NO: 743356 - DNA, 20 bp, mouse
gtgtggagtactgaccacgg

SEQ ID NO: 743357 - DNA, 20 bp, mouse
gtgccagaagcggggccaga

SEQ ID NO: 743358 - DNA, 20 bp, mouse
gggtaggaattgccagaagc

SEQ ID NO: 743359 - DNA, 20 bp, mouse
ggatcgagtcagagtgagtg

SEQ ID NO: 743360 - DNA, 20 bp, mouse
gtcacccggtctgtatatgc

SEQ ID NO: 743361 - DNA, 20 bp, mouse
gactccacaaagcccaaggg

SEQ ID NO: 743362 - DNA, 20 bp, mouse
gtcgatcgtgagcatccctc

SEQ ID NO: 743363 - DNA, 20 bp, mouse
gactgaccacggaggctggt

SEQ ID NO: 743364 - DNA, 20 bp, mouse
gcctacaaccacaaaaagac

SEQ ID NO: 743365 - DNA, 20 bp, mouse
gcaccccgaggccataaata

SEQ ID NO: 743366 - DNA, 20 bp, mouse
gccactgcggggcacaggtg

SEQ ID NO: 743367 - DNA, 20 bp, mouse
gagggcccactgcggggcac

SEQ ID NO: 743368 - DNA, 20 bp, mouse
gtgggtgagtctgagagtct

SEQ ID NO: 743369 - DNA, 20 bp, mouse
ggggaagctccgtggtccgt

SEQ ID NO: 743370 - DNA, 20 bp, mouse
gccactgtggggaagctccg

SEQ ID NO: 743371 - DNA, 20 bp, mouse
ggcttcaggtgaaggaatta

SEQ ID NO: 743372 - DNA, 20 bp, mouse
ggagtctgagagtctgggtg

SEQ ID NO: 743373 - DNA, 20 bp, mouse
gtcggctagggcccactgcg

SEQ ID NO: 743374 - DNA, 20 bp, mouse
ggggaaaagagtactagaag

SEQ ID NO: 743375 - DNA, 20 bp, mouse
gagtctgggtgcggtcggct

SEQ ID NO: 743376 - DNA, 20 bp, mouse
gaaccggtcagggaaggtag

SEQ ID NO: 743377 - DNA, 20 bp, mouse
ggctctggggctaccttgaa

SEQ ID NO: 743378 - DNA, 20 bp, mouse
ggataagaaccggtcaggga

SEQ ID NO: 743379 - DNA, 20 bp, mouse
gagtctgtaacagtgtgaca

SEQ ID NO: 743380 - DNA, 20 bp, mouse
gtctctgaggaatgtctttc

SEQ ID NO: 743381 - DNA, 20 bp, mouse
gcaaggtagccccagagcta

SEQ ID NO: 743382 - DNA, 20 bp, mouse
gagcttaggccctagctctg

SEQ ID NO: 743383 - DNA, 20 bp, mouse
gaactgataagaaccggtca

SEQ ID NO: 743384 - DNA, 20 bp, mouse
gcaagcctatgccttcctgg

SEQ ID NO: 743385 - DNA, 20 bp, mouse
gccttgaagggccaccctaa

SEQ ID NO: 743386 - DNA, 20 bp, mouse
gaccctgtggggcagcttgg

SEQ ID NO: 743387 - DNA, 20 bp, mouse
gatgacagaggctgcttctg

SEQ ID NO: 743388 - DNA, 20 bp, mouse
gcaggcaggcatcctggcga

SEQ ID NO: 743389 - DNA, 20 bp, mouse
ggccaggcaggcaccctgtg

SEQ ID NO: 743390 - DNA, 20 bp, mouse
gatcccccaagctgccccac

SEQ ID NO: 743391 - DNA, 20 bp, mouse
gtgtctgtgaatgtggatgt

SEQ ID NO: 743392 - DNA, 20 bp, mouse
ggggcagcttgggggatggt

SEQ ID NO: 743393 - DNA, 20 bp, mouse
gccttctgcttgctgctctg

SEQ ID NO: 743394 - DNA, 20 bp, mouse
ggggcctaggagcagcagct

SEQ ID NO: 743395 - DNA, 20 bp, mouse
ggcgcagagcgaaggtatgt

SEQ ID NO: 743396 - DNA, 20 bp, mouse
gcctctgccaacagtcctct

SEQ ID NO: 743397 - DNA, 20 bp, mouse
gagggatgctgaccctctta

SEQ ID NO: 743398 - DNA, 20 bp, mouse
gtctctggtggagacttcta

SEQ ID NO: 743399 - DNA, 20 bp, mouse
gaccctgcccagaggactgt

SEQ ID NO: 743400 - DNA, 20 bp, mouse
ggcaacagaagcagagtaaa

SEQ ID NO: 743401 - DNA, 20 bp, mouse
gcctgctaggatgggagaca

SEQ ID NO: 743402 - DNA, 20 bp, mouse
gctagagggagtggctggca

SEQ ID NO: 743403 - DNA, 20 bp, mouse
gccttgtctgggccctaaga

SEQ ID NO: 743404 - DNA, 20 bp, mouse
ggccacaggaatgtctgaac

SEQ ID NO: 743405 - DNA, 20 bp, mouse
gtcctctgggcagggtttta

SEQ ID NO: 743406 - DNA, 20 bp, mouse
gggcggtaggggtatgaaag

SEQ ID NO: 743407 - DNA, 20 bp, mouse
gtctctaagcctaggaaaag

SEQ ID NO: 743408 - DNA, 20 bp, mouse
gggcacagacccctgcccta

SEQ ID NO: 743409 - DNA, 20 bp, mouse
ggggcaggaggagactcgcc

SEQ ID NO: 743410 - DNA, 20 bp, mouse
ggactcccctggagatctag

SEQ ID NO: 743411 - DNA, 20 bp, mouse
gtgtgggcgttggatggaaa

SEQ ID NO: 743412 - DNA, 20 bp, mouse
gggtaggggtatgaaagggg

SEQ ID NO: 743413 - DNA, 20 bp, mouse
ggtgtctgacagggcggtag

SEQ ID NO: 743414 - DNA, 20 bp, mouse
gagatctagtggatccagaa

SEQ ID NO: 743415 - DNA, 20 bp, mouse
gaagaggctcctttcagaaa

SEQ ID NO: 743416 - DNA, 20 bp, mouse
gtgggtggaaatcaacctgg

SEQ ID NO: 743417 - DNA, 20 bp, mouse
gtccgcgagaacgactgcag

SEQ ID NO: 743418 - DNA, 20 bp, mouse
gcagctctgcacaaatcggt

SEQ ID NO: 743419 - DNA, 20 bp, mouse
ggctgcgagctggggctgtt

SEQ ID NO: 743420 - DNA, 20 bp, mouse
gcgtccgagtgctgcgagct

SEQ ID NO: 743421 - DNA, 20 bp, mouse
gcagacctatggctggctgt

SEQ ID NO: 743422 - DNA, 20 bp, mouse
gtcgcagggctggaactaca

SEQ ID NO: 743423 - DNA, 20 bp, mouse
gtccgtcaggggacacaagt

SEQ ID NO: 743424 - DNA, 20 bp, mouse
gtgtcacacacgcagaccta

SEQ ID NO: 743425 - DNA, 20 bp, mouse
gaaccggacggcgtccgtca

SEQ ID NO: 743426 - DNA, 20 bp, mouse
gtgggaggacctaggaccag

SEQ ID NO: 743427 - DNA, 20 bp, mouse
ggggaggagctcagtggctg

SEQ ID NO: 743428 - DNA, 20 bp, mouse
gccacccagaggacaaatga

SEQ ID NO: 743429 - DNA, 20 bp, mouse
gtccacggatgcccacccag

SEQ ID NO: 743430 - DNA, 20 bp, mouse
gcgcctgctggccatgtgac

SEQ ID NO: 743431 - DNA, 20 bp, mouse
gggttctctgggcagagcac

SEQ ID NO: 743432 - DNA, 20 bp, mouse
gcccagtgtccactggtcct

SEQ ID NO: 743433 - DNA, 20 bp, mouse
gcgacagcctcggccagaag

SEQ ID NO: 743434 - DNA, 20 bp, mouse
gacctaggaccagtggacac

SEQ ID NO: 743435 - DNA, 20 bp, mouse
gtcctctgggtgggcatccg

SEQ ID NO: 743436 - DNA, 20 bp, mouse
gggcggcgcggagatcgcgg

SEQ ID NO: 743437 - DNA, 20 bp, mouse
gggcgagggccgcagtgcgt

SEQ ID NO: 743438 - DNA, 20 bp, mouse
ggaaccgagaaccgggaaca

SEQ ID NO: 743439 - DNA, 20 bp, mouse
ggaggggatgacggtggcga

SEQ ID NO: 743440 - DNA, 20 bp, mouse
gggcggcgaggggatgacgg

SEQ ID NO: 743441 - DNA, 20 bp, mouse
gccctacggccattggacca

SEQ ID NO: 743442 - DNA, 20 bp, mouse
ggcgggcggcgcggagatcg

SEQ ID NO: 743443 - DNA, 20 bp, mouse
gctggggtggcatttaaagg

SEQ ID NO: 743444 - DNA, 20 bp, mouse
gggcctggggtggcatttaa

SEQ ID NO: 743445 - DNA, 20 bp, mouse
gggcctgtcggcgggaaggt

SEQ ID NO: 743446 - DNA, 20 bp, mouse
gccacctcgcagcacctcac

SEQ ID NO: 743447 - DNA, 20 bp, mouse
gggagcgagccaactgctgg

SEQ ID NO: 743448 - DNA, 20 bp, mouse
gtcaggcagcgcactgctgg

SEQ ID NO: 743449 - DNA, 20 bp, mouse
gagcacagaccagtcttcga

SEQ ID NO: 743450 - DNA, 20 bp, mouse
ggtgggagcgagccaactgc

SEQ ID NO: 743451 - DNA, 20 bp, mouse
gagacctgtgaggtgctgcg

SEQ ID NO: 743452 - DNA, 20 bp, mouse
gttccctggcagagcccacc

SEQ ID NO: 743453 - DNA, 20 bp, mouse
gcgtgagctgttcctcgctc

SEQ ID NO: 743454 - DNA, 20 bp, mouse
gcggcattatgtcttattag

SEQ ID NO: 743455 - DNA, 20 bp, mouse
gttcgcttgccttcgaagac

SEQ ID NO: 743456 - DNA, 20 bp, mouse
gaggcgcgggtgctgatgtc

SEQ ID NO: 743457 - DNA, 20 bp, mouse
gtgcgggtccctgctcccag

SEQ ID NO: 743458 - DNA, 20 bp, mouse
gccccgcgtgcattattcat

SEQ ID NO: 743459 - DNA, 20 bp, mouse
gccgcagccgagcagcatgc

SEQ ID NO: 743460 - DNA, 20 bp, mouse
gcagcacccgcgcctgccgc

SEQ ID NO: 743461 - DNA, 20 bp, mouse
gtgcagccacagaaggattg

SEQ ID NO: 743462 - DNA, 20 bp, mouse
ggctcggcctcccacacccg

SEQ ID NO: 743463 - DNA, 20 bp, mouse
gggaaaagttggatgacctt

SEQ ID NO: 743464 - DNA, 20 bp, mouse
gcacgcgggggcccgccccg

SEQ ID NO: 743465 - DNA, 20 bp, mouse
gtgctgatgtcaggccagcg

SEQ ID NO: 743466 - DNA, 20 bp, mouse
gagagcctggtggcctggta

SEQ ID NO: 743467 - DNA, 20 bp, mouse
gcgggagagcagccaaagga

SEQ ID NO: 743468 - DNA, 20 bp, mouse
gggcctggtagggcacgctg

SEQ ID NO: 743469 - DNA, 20 bp, mouse
gcgtgccctaccaggccacc

SEQ ID NO: 743470 - DNA, 20 bp, mouse
ggtccgcagcgtgccctacc

SEQ ID NO: 743471 - DNA, 20 bp, mouse
gcaggttggcatgagagatt

SEQ ID NO: 743472 - DNA, 20 bp, mouse
ggactcatgtacatccaggt

SEQ ID NO: 743473 - DNA, 20 bp, mouse
gttctctgcacacacaactc

SEQ ID NO: 743474 - DNA, 20 bp, mouse
gtggacgcggactgcggcgc

SEQ ID NO: 743475 - DNA, 20 bp, mouse
gagcttgtttgcatcagctg

SEQ ID NO: 743476 - DNA, 20 bp, mouse
gagtgggaaggatgtcccca

SEQ ID NO: 743477 - DNA, 20 bp, mouse
gaaccccagttggggagagt

SEQ ID NO: 743478 - DNA, 20 bp, mouse
gggccctgagccaacgtcct

SEQ ID NO: 743479 - DNA, 20 bp, mouse
gagtggggactctgatgagg

SEQ ID NO: 743480 - DNA, 20 bp, mouse
gtccccaactggggttgagt

SEQ ID NO: 743481 - DNA, 20 bp, mouse
ggccagccccttctcttgga

SEQ ID NO: 743482 - DNA, 20 bp, mouse
gctgccaaggctgccaccct

SEQ ID NO: 743483 - DNA, 20 bp, mouse
gacaagggatcttctggagg

SEQ ID NO: 743484 - DNA, 20 bp, mouse
gccccagggtggagaccaga

SEQ ID NO: 743485 - DNA, 20 bp, mouse
gggctctgcagactgcagat

SEQ ID NO: 743486 - DNA, 20 bp, mouse
gacagcggggcggactctag

SEQ ID NO: 743487 - DNA, 20 bp, mouse
gcctcggagtgtggcgtata

SEQ ID NO: 743488 - DNA, 20 bp, mouse
ggggccctgtggtcagaggt

SEQ ID NO: 743489 - DNA, 20 bp, mouse
ggggcttcggaccctgtggg

SEQ ID NO: 743490 - DNA, 20 bp, mouse
gtacgaatcccagtgtgcgt

SEQ ID NO: 743491 - DNA, 20 bp, mouse
gaagccccgcccacgcacac

SEQ ID NO: 743492 - DNA, 20 bp, mouse
ggccctaaagctccgcccac

SEQ ID NO: 743493 - DNA, 20 bp, mouse
gaatcccagtgtgcgtgggc

SEQ ID NO: 743494 - DNA, 20 bp, mouse
gagccccaacctctgaccac

SEQ ID NO: 743495 - DNA, 20 bp, mouse
ggcggggcttcggaccctgt

SEQ ID NO: 743496 - DNA, 20 bp, mouse
gggaatggggcgtgtttctc

SEQ ID NO: 743497 - DNA, 20 bp, mouse
gcaggcagtggagccattat

SEQ ID NO: 743498 - DNA, 20 bp, mouse
gcgggagcgctattggtcag

SEQ ID NO: 743499 - DNA, 20 bp, mouse
ggagcgctattggtcagggg

SEQ ID NO: 743500 - DNA, 20 bp, mouse
gggagccattattggtcaag

SEQ ID NO: 743501 - DNA, 20 bp, mouse
gttaggagatccaatttctg

SEQ ID NO: 743502 - DNA, 20 bp, mouse
gctgctgctggggctggtag

SEQ ID NO: 743503 - DNA, 20 bp, mouse
gcccgctccgggagcgctat

SEQ ID NO: 743504 - DNA, 20 bp, mouse
ggactcttcgctgttcttaa

SEQ ID NO: 743505 - DNA, 20 bp, mouse
gttctctggaatgagtgaca

SEQ ID NO: 743506 - DNA, 20 bp, mouse
gcagccgggtccagggatgg

SEQ ID NO: 743507 - DNA, 20 bp, mouse
ggggtacccaggaactgtag

SEQ ID NO: 743508 - DNA, 20 bp, mouse
ggcccgcgcagccgggtcca

SEQ ID NO: 743509 - DNA, 20 bp, mouse
gtctctgcgcggtccccacg

SEQ ID NO: 743510 - DNA, 20 bp, mouse
gctggcagcctgaggtcttg

SEQ ID NO: 743511 - DNA, 20 bp, mouse
gtacctgcacccagcgtccc

SEQ ID NO: 743512 - DNA, 20 bp, mouse
ggggaccgcgcagagaatcg

SEQ ID NO: 743513 - DNA, 20 bp, mouse
gcaacctaaggggacactta

SEQ ID NO: 743514 - DNA, 20 bp, mouse
gagtgctgggcgcttccaat

SEQ ID NO: 743515 - DNA, 20 bp, mouse
gcagacgtctgcaaccccaa

SEQ ID NO: 743516 - DNA, 20 bp, mouse
gctggcaggaatttcatcgg

SEQ ID NO: 743517 - DNA, 20 bp, mouse
gcccaagccaagtcgagcgg

SEQ ID NO: 743518 - DNA, 20 bp, mouse
gcagctggcaggaatttcat

SEQ ID NO: 743519 - DNA, 20 bp, mouse
ggcgcccaagccaagtcgag

SEQ ID NO: 743520 - DNA, 20 bp, mouse
gaacagccacagggtctcaa

SEQ ID NO: 743521 - DNA, 20 bp, mouse
gggcccgagggctgcgccgt

SEQ ID NO: 743522 - DNA, 20 bp, mouse
ggtagtggggctcaagtctg

SEQ ID NO: 743523 - DNA, 20 bp, mouse
ggggacggtgcagtcagaga

SEQ ID NO: 743524 - DNA, 20 bp, mouse
gtggtcccgggcgggcccga

SEQ ID NO: 743525 - DNA, 20 bp, mouse
gcggctcacctcctggtccc

SEQ ID NO: 743526 - DNA, 20 bp, mouse
gttgctgctgggctattcta

SEQ ID NO: 743527 - DNA, 20 bp, mouse
gccccctggaaagaacctcc

SEQ ID NO: 743528 - DNA, 20 bp, mouse
gcctgactccctgcaaacaa

SEQ ID NO: 743529 - DNA, 20 bp, mouse
gaggataatgaggatggcct

SEQ ID NO: 743530 - DNA, 20 bp, mouse
gtccaggaggttctttccag

SEQ ID NO: 743531 - DNA, 20 bp, mouse
gataaatgagcatttgctgc

SEQ ID NO: 743532 - DNA, 20 bp, mouse
gaaagaatcaataggttgga

SEQ ID NO: 743533 - DNA, 20 bp, mouse
gtggctcatatcctgtgcct

SEQ ID NO: 743534 - DNA, 20 bp, mouse
gtaacaaagaatcaataggt

SEQ ID NO: 743535 - DNA, 20 bp, mouse
gaagggtcagcataacctgg

SEQ ID NO: 743536 - DNA, 20 bp, mouse
gcgagagccagggaccctat

SEQ ID NO: 743537 - DNA, 20 bp, mouse
gccagccaatggcgtgtgga

SEQ ID NO: 743538 - DNA, 20 bp, mouse
gtggagactcccaacagagg

SEQ ID NO: 743539 - DNA, 20 bp, mouse
gagacagacaggctgactcg

SEQ ID NO: 743540 - DNA, 20 bp, mouse
gttagagaggagggtcggag

SEQ ID NO: 743541 - DNA, 20 bp, mouse
ggacttttagagaggagggt

SEQ ID NO: 743542 - DNA, 20 bp, mouse
gcctggcaatgcgagagcca

SEQ ID NO: 743543 - DNA, 20 bp, mouse
gaatggcgtgtggagggcta

SEQ ID NO: 743544 - DNA, 20 bp, mouse
ggctaggggaacccccaact

SEQ ID NO: 743545 - DNA, 20 bp, mouse
gtaaacgcccctttcccata

SEQ ID NO: 743546 - DNA, 20 bp, mouse
gacactcggcccaggtgtca

SEQ ID NO: 743547 - DNA, 20 bp, mouse
gggacactggagctagtccc

SEQ ID NO: 743548 - DNA, 20 bp, mouse
gagtgtgaggccaattcact

SEQ ID NO: 743549 - DNA, 20 bp, mouse
gtccatcagacccactctga

SEQ ID NO: 743550 - DNA, 20 bp, mouse
gtggcaaggccactaagtag

SEQ ID NO: 743551 - DNA, 20 bp, mouse
gagcacgggaaacaaggtaa

SEQ ID NO: 743552 - DNA, 20 bp, mouse
gtggttgggtacaactaaat

SEQ ID NO: 743553 - DNA, 20 bp, mouse
gagggcacagcttcaacctt

SEQ ID NO: 743554 - DNA, 20 bp, mouse
gtgtacccaaccatcagagt

SEQ ID NO: 743555 - DNA, 20 bp, mouse
gttagctgacattggaagca

SEQ ID NO: 743556 - DNA, 20 bp, mouse
ggtggtaagcgcttagagtg

SEQ ID NO: 743557 - DNA, 20 bp, mouse
gagagcagagggcaagtctt

SEQ ID NO: 743558 - DNA, 20 bp, mouse
gtaagcttgcaaatgaactg

SEQ ID NO: 743559 - DNA, 20 bp, mouse
gggtgggaaggcaggccgag

SEQ ID NO: 743560 - DNA, 20 bp, mouse
gaaccaagacaagtctcatg

SEQ ID NO: 743561 - DNA, 20 bp, mouse
gtcccaggtcaaggagaaca

SEQ ID NO: 743562 - DNA, 20 bp, mouse
gaacagggacaggcggtgag

SEQ ID NO: 743563 - DNA, 20 bp, mouse
ggaaacagcaatggggtggc

SEQ ID NO: 743564 - DNA, 20 bp, mouse
gagtcttagggaaacagcaa

SEQ ID NO: 743565 - DNA, 20 bp, mouse
gtctctgtccatatccacat

SEQ ID NO: 743566 - DNA, 20 bp, mouse
gactgcgcggcggggccgag

SEQ ID NO: 743567 - DNA, 20 bp, mouse
ggagaagtggtcactttgga

SEQ ID NO: 743568 - DNA, 20 bp, mouse
ggcgcccccggggagctgcg

SEQ ID NO: 743569 - DNA, 20 bp, mouse
gtgtggcctcggcgcccccg

SEQ ID NO: 743570 - DNA, 20 bp, mouse
gactgcagccccagacccca

SEQ ID NO: 743571 - DNA, 20 bp, mouse
gggacgcgcgagagtggggg

SEQ ID NO: 743572 - DNA, 20 bp, mouse
gcagacagactgagaatcca

SEQ ID NO: 743573 - DNA, 20 bp, mouse
gtcctggacgcgcgagagtg

SEQ ID NO: 743574 - DNA, 20 bp, mouse
gttaaggggctcttgagaag

SEQ ID NO: 743575 - DNA, 20 bp, mouse
gaggctgctggattccgtgg

SEQ ID NO: 743576 - DNA, 20 bp, mouse
gtcaagtgcctgcatgtcag

SEQ ID NO: 743577 - DNA, 20 bp, mouse
gtgggatgtgggtggtgaaa

SEQ ID NO: 743578 - DNA, 20 bp, mouse
ggggaggagtccagcttaat

SEQ ID NO: 743579 - DNA, 20 bp, mouse
gcccacatcccagctgccaa

SEQ ID NO: 743580 - DNA, 20 bp, mouse
gccagagtgcctaatacttg

SEQ ID NO: 743581 - DNA, 20 bp, mouse
gaactcaccctctgacatgc

SEQ ID NO: 743582 - DNA, 20 bp, mouse
gaatggcagctgtggaacag

SEQ ID NO: 743583 - DNA, 20 bp, mouse
gttgaagcctccagcgtagt

SEQ ID NO: 743584 - DNA, 20 bp, mouse
gggtgttcggggaaaagtta

SEQ ID NO: 743585 - DNA, 20 bp, mouse
gttaactccaactacgctgg

SEQ ID NO: 743586 - DNA, 20 bp, mouse
gtccggccgccgctcgggga

SEQ ID NO: 743587 - DNA, 20 bp, mouse
gcggaggcggggatgctgag

SEQ ID NO: 743588 - DNA, 20 bp, mouse
gccgccgctcggggaggggt

SEQ ID NO: 743589 - DNA, 20 bp, mouse
ggctccgggaccccttctca

SEQ ID NO: 743590 - DNA, 20 bp, mouse
ggacccgcaggggcgagggc

SEQ ID NO: 743591 - DNA, 20 bp, mouse
gacagggcccgggagagtgt

SEQ ID NO: 743592 - DNA, 20 bp, mouse
gtggccccggcggacccgca

SEQ ID NO: 743593 - DNA, 20 bp, mouse
ggcgaagcccggcctccggg

SEQ ID NO: 743594 - DNA, 20 bp, mouse
ggagtggcagcggccggcct

SEQ ID NO: 743595 - DNA, 20 bp, mouse
ggcgtcgcccacactctccc

SEQ ID NO: 743596 - DNA, 20 bp, mouse
gcgcccggggccatctggct

SEQ ID NO: 743597 - DNA, 20 bp, mouse
gggaaggtggcgggcgtccc

SEQ ID NO: 743598 - DNA, 20 bp, mouse
gaaggtgggcgggaaggtgg

SEQ ID NO: 743599 - DNA, 20 bp, mouse
ggctgctggggtagtgtccc

SEQ ID NO: 743600 - DNA, 20 bp, mouse
gccccagcagccaaccgtta

SEQ ID NO: 743601 - DNA, 20 bp, mouse
gagtgctgcctcaaaaaatg

SEQ ID NO: 743602 - DNA, 20 bp, mouse
gccaggtagcgagtggcaga

SEQ ID NO: 743603 - DNA, 20 bp, mouse
gtagtgtcccaggtagcgag

SEQ ID NO: 743604 - DNA, 20 bp, mouse
gtggcgggcgtcccgggtgg

SEQ ID NO: 743605 - DNA, 20 bp, mouse
ggcactgagtggcaggcggt

SEQ ID NO: 743606 - DNA, 20 bp, mouse
ggaagggagtcccagtagtc

SEQ ID NO: 743607 - DNA, 20 bp, mouse
gggggtagaggctatgtttc

SEQ ID NO: 743608 - DNA, 20 bp, mouse
ggacagtcagaggtacggtc

SEQ ID NO: 743609 - DNA, 20 bp, mouse
gggagggaaaggggccctcc

SEQ ID NO: 743610 - DNA, 20 bp, mouse
ggtcaggcacggtgaccctg

SEQ ID NO: 743611 - DNA, 20 bp, mouse
gagtcaggaggcctgaagcc

SEQ ID NO: 743612 - DNA, 20 bp, mouse
gtctgactgtcagaacctgg

SEQ ID NO: 743613 - DNA, 20 bp, mouse
gccggggcgcgttcccgcgc

SEQ ID NO: 743614 - DNA, 20 bp, mouse
gtcagaggtacggtcaggca

SEQ ID NO: 743615 - DNA, 20 bp, mouse
gtttctggctgagggacctc

SEQ ID NO: 743616 - DNA, 20 bp, mouse
gcggccgcgcagagcctgga

SEQ ID NO: 743617 - DNA, 20 bp, mouse
ggtccccgaagggtgactag

SEQ ID NO: 743618 - DNA, 20 bp, mouse
gcctggaggggcgacttgga

SEQ ID NO: 743619 - DNA, 20 bp, mouse
gagagcctggaggggcgact

SEQ ID NO: 743620 - DNA, 20 bp, mouse
ggggaggtggaggtccccga

SEQ ID NO: 743621 - DNA, 20 bp, mouse
gcggccagcgccagagttcg

SEQ ID NO: 743622 - DNA, 20 bp, mouse
gaccgccgagaccagagtgg

SEQ ID NO: 743623 - DNA, 20 bp, mouse
gcgggggcgtggcctggtag

SEQ ID NO: 743624 - DNA, 20 bp, mouse
gcgcccctccaggctctgcg

SEQ ID NO: 743625 - DNA, 20 bp, mouse
gagggtgactaggggtgtag

SEQ ID NO: 743626 - DNA, 20 bp, mouse
gggcgggccgggagcaaact

SEQ ID NO: 743627 - DNA, 20 bp, mouse
ggggtttgaactccttccgc

SEQ ID NO: 743628 - DNA, 20 bp, mouse
gtgcactcgtggggagatct

SEQ ID NO: 743629 - DNA, 20 bp, mouse
gagtgaacgcatcctgcgga

SEQ ID NO: 743630 - DNA, 20 bp, mouse
gaagccaagatgccacaagg

SEQ ID NO: 743631 - DNA, 20 bp, mouse
gcctcccgcgcggggttgcc

SEQ ID NO: 743632 - DNA, 20 bp, mouse
ggcctgggaaatgtaatccg

SEQ ID NO: 743633 - DNA, 20 bp, mouse
ggagatctggggacaatgtc

SEQ ID NO: 743634 - DNA, 20 bp, mouse
gctcacctgtaatccccagc

SEQ ID NO: 743635 - DNA, 20 bp, mouse
gttcctgatagtcaagcgtc

SEQ ID NO: 743636 - DNA, 20 bp, mouse
gccccggccggggagaatgc

SEQ ID NO: 743637 - DNA, 20 bp, mouse
ggggaggaagcgcggaaagg

SEQ ID NO: 743638 - DNA, 20 bp, mouse
ggtagctcgagtctaaggag

SEQ ID NO: 743639 - DNA, 20 bp, mouse
gctagtcgccggcaccgcgc

SEQ ID NO: 743640 - DNA, 20 bp, mouse
gacatctcgctgctagtcgc

SEQ ID NO: 743641 - DNA, 20 bp, mouse
ggggcgctgcattaaggcga

SEQ ID NO: 743642 - DNA, 20 bp, mouse
gtctgcgtcccccccggccg

SEQ ID NO: 743643 - DNA, 20 bp, mouse
ggccactgatcctctaaacg

SEQ ID NO: 743644 - DNA, 20 bp, mouse
gaccgcgtttagaggatcag

SEQ ID NO: 743645 - DNA, 20 bp, mouse
gggtctccccgcattctccc

SEQ ID NO: 743646 - DNA, 20 bp, mouse
gtcaggcgcggctgtagaaa

SEQ ID NO: 743647 - DNA, 20 bp, mouse
gggaaggcgggagacccaaa

SEQ ID NO: 743648 - DNA, 20 bp, mouse
gaaggcgcggaggcttgcgc

SEQ ID NO: 743649 - DNA, 20 bp, mouse
gcgggcggccaatggcacgg

SEQ ID NO: 743650 - DNA, 20 bp, mouse
gcgcggctgtagaaaaggcg

SEQ ID NO: 743651 - DNA, 20 bp, mouse
gagcgcgtgctccgggaagg

SEQ ID NO: 743652 - DNA, 20 bp, mouse
gcggctgggcccgcggccgt

SEQ ID NO: 743653 - DNA, 20 bp, mouse
gcgcccgccgccccaggcct

SEQ ID NO: 743654 - DNA, 20 bp, mouse
gggcggcaggacgtgatgtc

SEQ ID NO: 743655 - DNA, 20 bp, mouse
ggccttggcagcgcgtgctc

SEQ ID NO: 743656 - DNA, 20 bp, mouse
ggggtcgcagagacgctccc

SEQ ID NO: 743657 - DNA, 20 bp, mouse
gacgctcccggggccactgg

SEQ ID NO: 743658 - DNA, 20 bp, mouse
ggaggtgcctagaagccgtc

SEQ ID NO: 743659 - DNA, 20 bp, mouse
gcggaaggctgaggtcccga

SEQ ID NO: 743660 - DNA, 20 bp, mouse
gtcgggaagtgcaagccaga

SEQ ID NO: 743661 - DNA, 20 bp, mouse
ggggacctcagccttccggg

SEQ ID NO: 743662 - DNA, 20 bp, mouse
ggagacgctcccggggccac

SEQ ID NO: 743663 - DNA, 20 bp, mouse
gcttctaggcacctcggttc

SEQ ID NO: 743664 - DNA, 20 bp, mouse
gacagcgcagtaaccactca

SEQ ID NO: 743665 - DNA, 20 bp, mouse
gcacctcggttccggctgaa

SEQ ID NO: 743666 - DNA, 20 bp, mouse
gtcaggctggcgtcactcta

SEQ ID NO: 743667 - DNA, 20 bp, mouse
gggctccaacttgctgtcgt

SEQ ID NO: 743668 - DNA, 20 bp, mouse
ggggtgaggagtgcagtccc

SEQ ID NO: 743669 - DNA, 20 bp, mouse
gggacccagaatctattcca

SEQ ID NO: 743670 - DNA, 20 bp, mouse
gctggcgtcactctagggct

SEQ ID NO: 743671 - DNA, 20 bp, mouse
gctctgtaacaggtaaagga

SEQ ID NO: 743672 - DNA, 20 bp, mouse
gcccgcccttggccccttcc

SEQ ID NO: 743673 - DNA, 20 bp, mouse
gggcctgggcaggcggagtc

SEQ ID NO: 743674 - DNA, 20 bp, mouse
gagagcccacgacagcaagt

SEQ ID NO: 743675 - DNA, 20 bp, mouse
gcactatgctactctgtaac

SEQ ID NO: 743676 - DNA, 20 bp, mouse
gggcacgcgaagggtggagg

SEQ ID NO: 743677 - DNA, 20 bp, mouse
gcgcgtgccggctgccctgg

SEQ ID NO: 743678 - DNA, 20 bp, mouse
gagcccgcacggcagggtgg

SEQ ID NO: 743679 - DNA, 20 bp, mouse
gccccggctagccagagtag

SEQ ID NO: 743680 - DNA, 20 bp, mouse
gagggcggggccgcctgata

SEQ ID NO: 743681 - DNA, 20 bp, mouse
gtagccccgaatctggtcgg

SEQ ID NO: 743682 - DNA, 20 bp, mouse
gcctgcggaaagcgacgtca

SEQ ID NO: 743683 - DNA, 20 bp, mouse
gccgggagagcgagatcaaa

SEQ ID NO: 743684 - DNA, 20 bp, mouse
gcaacagtgtctcctcaacc

SEQ ID NO: 743685 - DNA, 20 bp, mouse
gctgcagcgggctgcccggt

SEQ ID NO: 743686 - DNA, 20 bp, mouse
gggctacagcgttgcggtca

SEQ ID NO: 743687 - DNA, 20 bp, mouse
gcctccagacccaaactaga

SEQ ID NO: 743688 - DNA, 20 bp, mouse
ggggcgcgatgcgaaaacca

SEQ ID NO: 743689 - DNA, 20 bp, mouse
gacgtggtgcggcacgtagg

SEQ ID NO: 743690 - DNA, 20 bp, mouse
gctggtgggaggtttctccc

SEQ ID NO: 743691 - DNA, 20 bp, mouse
gcaacttctacaggttgcga

SEQ ID NO: 743692 - DNA, 20 bp, mouse
gtaaattggctacagcgttg

SEQ ID NO: 743693 - DNA, 20 bp, mouse
gagggggccgggcggccaat

SEQ ID NO: 743694 - DNA, 20 bp, mouse
ggacaaaagaagccaccgta

SEQ ID NO: 743695 - DNA, 20 bp, mouse
gttaccttctagtttgggtc

SEQ ID NO: 743696 - DNA, 20 bp, mouse
ggggaggaggacaacgagga

SEQ ID NO: 743697 - DNA, 20 bp, mouse
ggaacggagcggggctccag

SEQ ID NO: 743698 - DNA, 20 bp, mouse
gagtgggtgcccttgaggga

SEQ ID NO: 743699 - DNA, 20 bp, mouse
ggtcgtcgccgcagctggaa

SEQ ID NO: 743700 - DNA, 20 bp, mouse
gcggcagtgggtgcccttga

SEQ ID NO: 743701 - DNA, 20 bp, mouse
ggactcatcttgaacggagc

SEQ ID NO: 743702 - DNA, 20 bp, mouse
gcggggctccagcggcaggg

SEQ ID NO: 743703 - DNA, 20 bp, mouse
gagtgtctcgctcttcttag

SEQ ID NO: 743704 - DNA, 20 bp, mouse
gcgctcttcttagcggggag

SEQ ID NO: 743705 - DNA, 20 bp, mouse
ggaagagcgagacactccaa

SEQ ID NO: 743706 - DNA, 20 bp, mouse
gacgggttaagtgcagggag

SEQ ID NO: 743707 - DNA, 20 bp, mouse
gagagccacgggttaagtgc

SEQ ID NO: 743708 - DNA, 20 bp, mouse
gtgtaccgagagtaggagaa

SEQ ID NO: 743709 - DNA, 20 bp, mouse
gacaccgcttttgtggggaa

SEQ ID NO: 743710 - DNA, 20 bp, mouse
ggcaatccaagcctctgagg

SEQ ID NO: 743711 - DNA, 20 bp, mouse
gaggactcattgttcagcgc

SEQ ID NO: 743712 - DNA, 20 bp, mouse
gcgtgaatgcccaagataag

SEQ ID NO: 743713 - DNA, 20 bp, mouse
gaagcccttccccacaaaag

SEQ ID NO: 743714 - DNA, 20 bp, mouse
gcgattacttcaagagccac

SEQ ID NO: 743715 - DNA, 20 bp, mouse
gacagttggaattgacactc

SEQ ID NO: 743716 - DNA, 20 bp, mouse
ggaacctcgcagagaggagg

SEQ ID NO: 743717 - DNA, 20 bp, mouse
gagaaggcgggtttttcata

SEQ ID NO: 743718 - DNA, 20 bp, mouse
ggaactcagagtaagttgtc

SEQ ID NO: 743719 - DNA, 20 bp, mouse
gagttcagtgttaaaggtgg

SEQ ID NO: 743720 - DNA, 20 bp, mouse
ggtaacccgaatctttgttt

SEQ ID NO: 743721 - DNA, 20 bp, mouse
ggtggaacctcgcagagagg

SEQ ID NO: 743722 - DNA, 20 bp, mouse
gagggaaagcggaggtcttc

SEQ ID NO: 743723 - DNA, 20 bp, mouse
gttagggagacctaagactt

SEQ ID NO: 743724 - DNA, 20 bp, mouse
gaggcgggtttttcataagg

SEQ ID NO: 743725 - DNA, 20 bp, mouse
gagggtggaacctcgcagag

SEQ ID NO: 743726 - DNA, 20 bp, mouse
ggggaacacccggctaaagg

SEQ ID NO: 743727 - DNA, 20 bp, mouse
gctaaagggggcacggggcg

SEQ ID NO: 743728 - DNA, 20 bp, mouse
gcccgggagcggggaacacc

SEQ ID NO: 743729 - DNA, 20 bp, mouse
gacccggctaaagggggcac

SEQ ID NO: 743730 - DNA, 20 bp, mouse
gggggtacccagctaataac

SEQ ID NO: 743731 - DNA, 20 bp, mouse
gagaaaagatgactgaggag

SEQ ID NO: 743732 - DNA, 20 bp, mouse
ggccgggtgttccccgctcc

SEQ ID NO: 743733 - DNA, 20 bp, mouse
ggacgtcaatcacccgggag

SEQ ID NO: 743734 - DNA, 20 bp, mouse
gtagctgggtacccccggtg

SEQ ID NO: 743735 - DNA, 20 bp, mouse
ggcggggaacacccggctaa

SEQ ID NO: 743736 - DNA, 20 bp, mouse
gtgcaggcgcgcatgtgggg

SEQ ID NO: 743737 - DNA, 20 bp, mouse
gcagggacaaacattacaaa

SEQ ID NO: 743738 - DNA, 20 bp, mouse
gcctgcttgcccatcaccag

SEQ ID NO: 743739 - DNA, 20 bp, mouse
gacaaaggggtgggggactg

SEQ ID NO: 743740 - DNA, 20 bp, mouse
gctctcaaccccctggtgat

SEQ ID NO: 743741 - DNA, 20 bp, mouse
gcaaacattacaaaggggtg

SEQ ID NO: 743742 - DNA, 20 bp, mouse
gtggaaagatgtatgcttga

SEQ ID NO: 743743 - DNA, 20 bp, mouse
gtagatgagaaggaaactta

SEQ ID NO: 743744 - DNA, 20 bp, mouse
ggtaggaggagtcctctccc

SEQ ID NO: 743745 - DNA, 20 bp, mouse
gggttgagaggaggtatgac

SEQ ID NO: 743746 - DNA, 20 bp, mouse
gaggtgaggagcttagggac

SEQ ID NO: 743747 - DNA, 20 bp, mouse
ggcgacacgcagggccctga

SEQ ID NO: 743748 - DNA, 20 bp, mouse
gtcggtgcgccatggcggaa

SEQ ID NO: 743749 - DNA, 20 bp, mouse
gcctcacctcgcagtagatg

SEQ ID NO: 743750 - DNA, 20 bp, mouse
gctctgtttggggaccccgg

SEQ ID NO: 743751 - DNA, 20 bp, mouse
gactgcgaggtgaggagctt

SEQ ID NO: 743752 - DNA, 20 bp, mouse
ggggtcgtgacgcgacacgc

SEQ ID NO: 743753 - DNA, 20 bp, mouse
ggaagggctacgaccgagat

SEQ ID NO: 743754 - DNA, 20 bp, mouse
gtgaacccatcctctgtttg

SEQ ID NO: 743755 - DNA, 20 bp, mouse
gcgagctggaagtggcgttc

SEQ ID NO: 743756 - DNA, 20 bp, mouse
gcggggcagcaaaaggagtc

SEQ ID NO: 743757 - DNA, 20 bp, mouse
ggtctcagggggattcagag

SEQ ID NO: 743758 - DNA, 20 bp, mouse
gtagccgggatccccagtcc

SEQ ID NO: 743759 - DNA, 20 bp, mouse
ggaaactggaacgtctgaag

SEQ ID NO: 743760 - DNA, 20 bp, mouse
ggccctgtggttttcctaag

SEQ ID NO: 743761 - DNA, 20 bp, mouse
gcagtccaggaagttgtttg

SEQ ID NO: 743762 - DNA, 20 bp, mouse
gaacgtctgaaggggggcac

SEQ ID NO: 743763 - DNA, 20 bp, mouse
gccaccaccaggggacacaa

SEQ ID NO: 743764 - DNA, 20 bp, mouse
gtgggagggtggcaacagac

SEQ ID NO: 743765 - DNA, 20 bp, mouse
gtctctctgtcttacaacac

SEQ ID NO: 743766 - DNA, 20 bp, mouse
gtcggcagaggcacctccct

SEQ ID NO: 743767 - DNA, 20 bp, mouse
gttgcaaggtcaccgagcgg

SEQ ID NO: 743768 - DNA, 20 bp, mouse
ggcgaccggagtctcggcag

SEQ ID NO: 743769 - DNA, 20 bp, mouse
ggggacggcggagaaggctg

SEQ ID NO: 743770 - DNA, 20 bp, mouse
gcagactgcgcgcccggagg

SEQ ID NO: 743771 - DNA, 20 bp, mouse
ggcgcctgcgaggagctcgg

SEQ ID NO: 743772 - DNA, 20 bp, mouse
ggaggcacctccctgggcgc

SEQ ID NO: 743773 - DNA, 20 bp, mouse
ggcggcagggacggcggaga

SEQ ID NO: 743774 - DNA, 20 bp, mouse
gcgcgaggccgcgcgtgagt

SEQ ID NO: 743775 - DNA, 20 bp, mouse
gcgagagcgcagcggccctg

SEQ ID NO: 743776 - DNA, 20 bp, mouse
gaggtcgtaagggtgacagt

SEQ ID NO: 743777 - DNA, 20 bp, mouse
gtgagcctgcgaggtcgtaa

SEQ ID NO: 743778 - DNA, 20 bp, mouse
gcggggcatcccgggagcaa

SEQ ID NO: 743779 - DNA, 20 bp, mouse
gctgtcccgcacagcatgct

SEQ ID NO: 743780 - DNA, 20 bp, mouse
gataccgcgcggggcatccc

SEQ ID NO: 743781 - DNA, 20 bp, mouse
gctagaaatgggacagagtg

SEQ ID NO: 743782 - DNA, 20 bp, mouse
gcggagacgagcaagggcgg

SEQ ID NO: 743783 - DNA, 20 bp, mouse
gccaccttgccaggcactag

SEQ ID NO: 743784 - DNA, 20 bp, mouse
ggtcacccttacgacctcgc

SEQ ID NO: 743785 - DNA, 20 bp, mouse
gcgtgaggcagcctagaaat

SEQ ID NO: 743786 - DNA, 20 bp, mouse
gcccacgtggcgaccggagg

SEQ ID NO: 743787 - DNA, 20 bp, mouse
gcctgcggtgcggaagacac

SEQ ID NO: 743788 - DNA, 20 bp, mouse
ggcggtgcggaagacacagg

SEQ ID NO: 743789 - DNA, 20 bp, mouse
gcgacccacgtggcgaccgg

SEQ ID NO: 743790 - DNA, 20 bp, mouse
gaatcattgcagtgatccta

SEQ ID NO: 743791 - DNA, 20 bp, mouse
gaaatcttgaactgagtgtt

SEQ ID NO: 743792 - DNA, 20 bp, mouse
gctgggaagggcaaacagtt

SEQ ID NO: 743793 - DNA, 20 bp, mouse
gaatagaacagcgacccacg

SEQ ID NO: 743794 - DNA, 20 bp, mouse
gcagcaaaactcctgcggtg

SEQ ID NO: 743795 - DNA, 20 bp, mouse
gcagttcaagatttccgggt

SEQ ID NO: 743796 - DNA, 20 bp, mouse
gctcccacctaaaaagtcta

SEQ ID NO: 743797 - DNA, 20 bp, mouse
gaaaggcacaggcgaggcag

SEQ ID NO: 743798 - DNA, 20 bp, mouse
gcgagcctgccggcttttaa

SEQ ID NO: 743799 - DNA, 20 bp, mouse
gaccgaacatcctttgctac

SEQ ID NO: 743800 - DNA, 20 bp, mouse
gcgcctgcgcggcaagcagc

SEQ ID NO: 743801 - DNA, 20 bp, mouse
ggcgctctgagccgccgcgc

SEQ ID NO: 743802 - DNA, 20 bp, mouse
gcccggccggcttcttgtgg

SEQ ID NO: 743803 - DNA, 20 bp, mouse
gtgccccgccccactccgac

SEQ ID NO: 743804 - DNA, 20 bp, mouse
gcagtggaggcgcgctgcgc

SEQ ID NO: 743805 - DNA, 20 bp, mouse
gtgtggcggcagcttccggt

SEQ ID NO: 743806 - DNA, 20 bp, mouse
ggaggggaacacacagagat

SEQ ID NO: 743807 - DNA, 20 bp, mouse
gtggaagagtggattctcta

SEQ ID NO: 743808 - DNA, 20 bp, mouse
gagctggaaggggccagcaa

SEQ ID NO: 743809 - DNA, 20 bp, mouse
gggagcttcattctggggat

SEQ ID NO: 743810 - DNA, 20 bp, mouse
gagccaccctcagctggaag

SEQ ID NO: 743811 - DNA, 20 bp, mouse
gaagggaaacagccctcctt

SEQ ID NO: 743812 - DNA, 20 bp, mouse
ggagaggcagttgcctaagg

SEQ ID NO: 743813 - DNA, 20 bp, mouse
gaatgagaggcagttgccta

SEQ ID NO: 743814 - DNA, 20 bp, mouse
ggagctttggaaggatgagc

SEQ ID NO: 743815 - DNA, 20 bp, mouse
gcagcaaaggaaggtaacaa

SEQ ID NO: 743816 - DNA, 20 bp, mouse
gtgaaagagcagaatgactt

SEQ ID NO: 743817 - DNA, 20 bp, mouse
ggtgtgtcaaagcacgtgta

SEQ ID NO: 743818 - DNA, 20 bp, mouse
gtgtcaaagcacgtgtatgg

SEQ ID NO: 743819 - DNA, 20 bp, mouse
gctgttgacaggatccacac

SEQ ID NO: 743820 - DNA, 20 bp, mouse
gacaggatccacactggaca

SEQ ID NO: 743821 - DNA, 20 bp, mouse
gcaacaagttatcttgtcat

SEQ ID NO: 743822 - DNA, 20 bp, mouse
gtatcttgtcatggggttac

SEQ ID NO: 743823 - DNA, 20 bp, mouse
gtgacttaggaaaacgatga

SEQ ID NO: 743824 - DNA, 20 bp, mouse
gaagacctgatcctgttgac

SEQ ID NO: 743825 - DNA, 20 bp, mouse
gacaggatcaggtcttattt

SEQ ID NO: 743826 - DNA, 20 bp, mouse
ggaggaatggaacagaaatt

SEQ ID NO: 743827 - DNA, 20 bp, mouse
gtttcctaagagcagatgat

SEQ ID NO: 743828 - DNA, 20 bp, mouse
gcataaagatctttaacccc

SEQ ID NO: 743829 - DNA, 20 bp, mouse
gattgtagtgcagaataatg

SEQ ID NO: 743830 - DNA, 20 bp, mouse
gtatgactcatgtgatatct

SEQ ID NO: 743831 - DNA, 20 bp, mouse
gactttctctttttctgatg

SEQ ID NO: 743832 - DNA, 20 bp, mouse
gaagacagagaatgtgatag

SEQ ID NO: 743833 - DNA, 20 bp, mouse
gggatgtcagagttgcagcg

SEQ ID NO: 743834 - DNA, 20 bp, mouse
gtacccaatcatctgctctt

SEQ ID NO: 743835 - DNA, 20 bp, mouse
gcccaggatatgtgtcctaa

SEQ ID NO: 743836 - DNA, 20 bp, mouse
gaactcctctgtgaagaatc

SEQ ID NO: 743837 - DNA, 20 bp, mouse
gtataaaggtgtttaacccc

SEQ ID NO: 743838 - DNA, 20 bp, mouse
gactatctctttttctgctg

SEQ ID NO: 743839 - DNA, 20 bp, mouse
gtatgacacatgtgatatct

SEQ ID NO: 743840 - DNA, 20 bp, mouse
gacatcctgattcttcacag

SEQ ID NO: 743841 - DNA, 20 bp, mouse
gataaatgtttaaaatataa

SEQ ID NO: 743842 - DNA, 20 bp, mouse
gaagacagagaatgtgataa

SEQ ID NO: 743843 - DNA, 20 bp, mouse
gggatgtcagagttgcagtg

SEQ ID NO: 743844 - DNA, 20 bp, mouse
gcccaggatatgtgtcctaa

SEQ ID NO: 743845 - DNA, 20 bp, mouse
gtgctcttaggaaattacag

SEQ ID NO: 743846 - DNA, 20 bp, mouse
gtgctgaagcaggggacaaa

SEQ ID NO: 743847 - DNA, 20 bp, mouse
gagtcaggatacccagggtg

SEQ ID NO: 743848 - DNA, 20 bp, mouse
ggatacccagggtggggact

SEQ ID NO: 743849 - DNA, 20 bp, mouse
ggtcacagacaagaggttga

SEQ ID NO: 743850 - DNA, 20 bp, mouse
gcaatggcacgggtggatat

SEQ ID NO: 743851 - DNA, 20 bp, mouse
ggggaataaaacctgggaaa

SEQ ID NO: 743852 - DNA, 20 bp, mouse
ggcttcagcaaattccattg

SEQ ID NO: 743853 - DNA, 20 bp, mouse
gcctgggcttcccagctcaa

SEQ ID NO: 743854 - DNA, 20 bp, mouse
gcaggaagcagcaatggcac

SEQ ID NO: 743855 - DNA, 20 bp, mouse
gtcaagggcttgtcagagca

SEQ ID NO: 743856 - DNA, 20 bp, mouse
gcgaacgtgctcgctcccgg

SEQ ID NO: 743857 - DNA, 20 bp, mouse
gggcgtgttcaactcgtgac

SEQ ID NO: 743858 - DNA, 20 bp, mouse
gaaaggggacacgaccaagt

SEQ ID NO: 743859 - DNA, 20 bp, mouse
gtgcaacaccaccgctacta

SEQ ID NO: 743860 - DNA, 20 bp, mouse
gggggacacgaccaagttgg

SEQ ID NO: 743861 - DNA, 20 bp, mouse
gcggagcgtcgccctagtag

SEQ ID NO: 743862 - DNA, 20 bp, mouse
ggtagcggtggtgttgcagg

SEQ ID NO: 743863 - DNA, 20 bp, mouse
gcacgagttgaacacgccgc

SEQ ID NO: 743864 - DNA, 20 bp, mouse
gagcgtcgccctagtagcgg

SEQ ID NO: 743865 - DNA, 20 bp, mouse
gggagacgggcgcgcctccg

SEQ ID NO: 743866 - DNA, 20 bp, mouse
gagctccgggcgtccttccc

SEQ ID NO: 743867 - DNA, 20 bp, mouse
gcgcaggtcccggaggacag

SEQ ID NO: 743868 - DNA, 20 bp, mouse
gcggcgggcccgggcgccac

SEQ ID NO: 743869 - DNA, 20 bp, mouse
ggcactgccggaggacaccg

SEQ ID NO: 743870 - DNA, 20 bp, mouse
gagtgcgcgccgctgtcctc

SEQ ID NO: 743871 - DNA, 20 bp, mouse
gcggccggaggcaggacaag

SEQ ID NO: 743872 - DNA, 20 bp, mouse
gcggggaaacagcactactg

SEQ ID NO: 743873 - DNA, 20 bp, mouse
gccccaccgagcgcaggtcc

SEQ ID NO: 743874 - DNA, 20 bp, mouse
gggaggcaggacaagcgggg

SEQ ID NO: 743875 - DNA, 20 bp, mouse
gccactggctgaggtggcca

SEQ ID NO: 743876 - DNA, 20 bp, mouse
gcgcgcgggtcgtcagtccc

SEQ ID NO: 743877 - DNA, 20 bp, mouse
ggccgctgctggagagtcaa

SEQ ID NO: 743878 - DNA, 20 bp, mouse
gggcgtccctctctgggcac

SEQ ID NO: 743879 - DNA, 20 bp, mouse
gaactcggcgtgcgcatcac

SEQ ID NO: 743880 - DNA, 20 bp, mouse
gcgggaaactgaacagtccg

SEQ ID NO: 743881 - DNA, 20 bp, mouse
gcgaatgagagcatctgtgt

SEQ ID NO: 743882 - DNA, 20 bp, mouse
ggtcctaagtgtgcccagag

SEQ ID NO: 743883 - DNA, 20 bp, mouse
gacagatgctctcattcgag

SEQ ID NO: 743884 - DNA, 20 bp, mouse
ggggttcaagaaacccagta

SEQ ID NO: 743885 - DNA, 20 bp, mouse
ggagttttggcgtccctctc

SEQ ID NO: 743886 - DNA, 20 bp, mouse
gggctgtgaaagcgatgtgg

SEQ ID NO: 743887 - DNA, 20 bp, mouse
gcacagaggggggtcggcgg

SEQ ID NO: 743888 - DNA, 20 bp, mouse
gtgggggcagacaaaggcgg

SEQ ID NO: 743889 - DNA, 20 bp, mouse
gccgggaggcgggagagcgc

SEQ ID NO: 743890 - DNA, 20 bp, mouse
gggaccgaatcgcagatctc

SEQ ID NO: 743891 - DNA, 20 bp, mouse
gagcaacaggaaatgactta

SEQ ID NO: 743892 - DNA, 20 bp, mouse
gaggggcgggtaggctgttg

SEQ ID NO: 743893 - DNA, 20 bp, mouse
ggctcgtggagaagggacga

SEQ ID NO: 743894 - DNA, 20 bp, mouse
gcgtggagaagggacgacgg

SEQ ID NO: 743895 - DNA, 20 bp, mouse
ggctgccgctcggggaccac

SEQ ID NO: 743896 - DNA, 20 bp, mouse
gaggcagatacccattaatg

SEQ ID NO: 743897 - DNA, 20 bp, mouse
gcaactgcgcaagagctgtg

SEQ ID NO: 743898 - DNA, 20 bp, mouse
gtgaggagagcagagactgt

SEQ ID NO: 743899 - DNA, 20 bp, mouse
gggtatctgcctcattgggg

SEQ ID NO: 743900 - DNA, 20 bp, mouse
gtgaactggatggattatcg

SEQ ID NO: 743901 - DNA, 20 bp, mouse
gggggtggaggggactgtgc

SEQ ID NO: 743902 - DNA, 20 bp, mouse
ggagctgtgtggctgctggg

SEQ ID NO: 743903 - DNA, 20 bp, mouse
gtaatgggtatctgcctcat

SEQ ID NO: 743904 - DNA, 20 bp, mouse
ggggactgtgctggtctttg

SEQ ID NO: 743905 - DNA, 20 bp, mouse
gcctacctgcttgtgagtac

SEQ ID NO: 743906 - DNA, 20 bp, mouse
gccctctgcagggtgagaag

SEQ ID NO: 743907 - DNA, 20 bp, mouse
gagggcggatctgtctccga

SEQ ID NO: 743908 - DNA, 20 bp, mouse
gagacagatccgccctctgc

SEQ ID NO: 743909 - DNA, 20 bp, mouse
gcggcggagtctgtgaacag

SEQ ID NO: 743910 - DNA, 20 bp, mouse
gggcgggattgttgcttgat

SEQ ID NO: 743911 - DNA, 20 bp, mouse
gagggcgtggctgttattaa

SEQ ID NO: 743912 - DNA, 20 bp, mouse
gcagctgcagcctcgcccct

SEQ ID NO: 743913 - DNA, 20 bp, mouse
gccctctccaggccagttta

SEQ ID NO: 743914 - DNA, 20 bp, mouse
gtgttggaactgtcattggg

SEQ ID NO: 743915 - DNA, 20 bp, mouse
gaagacttggtcaccgctcc

SEQ ID NO: 743916 - DNA, 20 bp, mouse
gccagcaggcgccagagatg

SEQ ID NO: 743917 - DNA, 20 bp, mouse
ggcgaactctgccgcatctc

SEQ ID NO: 743918 - DNA, 20 bp, mouse
gcgcctgcggtctagagaag

SEQ ID NO: 743919 - DNA, 20 bp, mouse
ggaccagggtgattcagttt

SEQ ID NO: 743920 - DNA, 20 bp, mouse
ggatgcggcagagttcgcgc

SEQ ID NO: 743921 - DNA, 20 bp, mouse
gaggctggaggtcgcaacac

SEQ ID NO: 743922 - DNA, 20 bp, mouse
gcgggtccccgtgccaggtg

SEQ ID NO: 743923 - DNA, 20 bp, mouse
gggcgactggcgacctctag

SEQ ID NO: 743924 - DNA, 20 bp, mouse
gggactaacctgagcgccga

SEQ ID NO: 743925 - DNA, 20 bp, mouse
gagaggcgttcggattgacc

SEQ ID NO: 743926 - DNA, 20 bp, mouse
gggggcgaagttttctgaga

SEQ ID NO: 743927 - DNA, 20 bp, mouse
ggcccgccaaagccggacta

SEQ ID NO: 743928 - DNA, 20 bp, mouse
gccagcctaggctcgcgagg

SEQ ID NO: 743929 - DNA, 20 bp, mouse
ggagcgaagtcaaggggcag

SEQ ID NO: 743930 - DNA, 20 bp, mouse
gaaacctcgcgtgggtagga

SEQ ID NO: 743931 - DNA, 20 bp, mouse
gccccgaagagcgccagcct

SEQ ID NO: 743932 - DNA, 20 bp, mouse
gacggggcggagcgaagtca

SEQ ID NO: 743933 - DNA, 20 bp, mouse
gccccgccctagtccggctt

SEQ ID NO: 743934 - DNA, 20 bp, mouse
gggtagtggcccgcaaatgg

SEQ ID NO: 743935 - DNA, 20 bp, mouse
gcgccaaagccggactaggg

SEQ ID NO: 743936 - DNA, 20 bp, mouse
gacagcctcacggggcacag

SEQ ID NO: 743937 - DNA, 20 bp, mouse
gtgaccgacccactcaagtc

SEQ ID NO: 743938 - DNA, 20 bp, mouse
ggggaggtggcaacagagtc

SEQ ID NO: 743939 - DNA, 20 bp, mouse
gtggaagggagggcgagtgg

SEQ ID NO: 743940 - DNA, 20 bp, mouse
gagtgcaggggacagcctca

SEQ ID NO: 743941 - DNA, 20 bp, mouse
gcgtgtgcgcgctcgctccc

SEQ ID NO: 743942 - DNA, 20 bp, mouse
gccgaagctagtgtcaaccc

SEQ ID NO: 743943 - DNA, 20 bp, mouse
gacagaggactcacggtccg

SEQ ID NO: 743944 - DNA, 20 bp, mouse
gcaacagagtccgggtagtg

SEQ ID NO: 743945 - DNA, 20 bp, mouse
gaggggacagcacagactag

SEQ ID NO: 743946 - DNA, 20 bp, mouse
gagggcccacggcttttcaa

SEQ ID NO: 743947 - DNA, 20 bp, mouse
ggtgtcagagaccagagcag

SEQ ID NO: 743948 - DNA, 20 bp, mouse
gaagtccggaggcaaagggg

SEQ ID NO: 743949 - DNA, 20 bp, mouse
ggggccgaagccagagccag

SEQ ID NO: 743950 - DNA, 20 bp, mouse
gtgcaggatcccaaattctg

SEQ ID NO: 743951 - DNA, 20 bp, mouse
gcggaggcaaaggggtggtt

SEQ ID NO: 743952 - DNA, 20 bp, mouse
gtggccccagagaagtccgg

SEQ ID NO: 743953 - DNA, 20 bp, mouse
gaaggggtggttcggagaag

SEQ ID NO: 743954 - DNA, 20 bp, mouse
gttcccccgcacaatagcgg

SEQ ID NO: 743955 - DNA, 20 bp, mouse
gccctcccaccgctattgtg

SEQ ID NO: 743956 - DNA, 20 bp, mouse
gtgaaatagcagaatcccta

SEQ ID NO: 743957 - DNA, 20 bp, mouse
gaagggcccttgtgaatcgc

SEQ ID NO: 743958 - DNA, 20 bp, mouse
ggtgaatcgctggtttaaaa

SEQ ID NO: 743959 - DNA, 20 bp, mouse
gttaaaccagcgattcacaa

SEQ ID NO: 743960 - DNA, 20 bp, mouse
gcaagcttctctaatctcat

SEQ ID NO: 743961 - DNA, 20 bp, mouse
gcacagcaccaaaccacctt

SEQ ID NO: 743962 - DNA, 20 bp, mouse
gtaatgtccctaaggtggtt

SEQ ID NO: 743963 - DNA, 20 bp, mouse
ggtaacataaacctaccaaa

SEQ ID NO: 743964 - DNA, 20 bp, mouse
ggcacagatgaaatggcgat

SEQ ID NO: 743965 - DNA, 20 bp, mouse
gaatattaatgtccctaagg

SEQ ID NO: 743966 - DNA, 20 bp, mouse
gtgagcgggtcaggagatgg

SEQ ID NO: 743967 - DNA, 20 bp, mouse
gcgctcaggcgcgtccccga

SEQ ID NO: 743968 - DNA, 20 bp, mouse
gcgacaggacgcggagagaa

SEQ ID NO: 743969 - DNA, 20 bp, mouse
gaggcagcgggcgcactctc

SEQ ID NO: 743970 - DNA, 20 bp, mouse
ggaagcttcccgaagaaccg

SEQ ID NO: 743971 - DNA, 20 bp, mouse
gcgcgcgccccgtgggtcgc

SEQ ID NO: 743972 - DNA, 20 bp, mouse
ggcgctcggggcaggagtcc

SEQ ID NO: 743973 - DNA, 20 bp, mouse
ggagagaaaggccgcggctc

SEQ ID NO: 743974 - DNA, 20 bp, mouse
gcgcggctccgcggttcttc

SEQ ID NO: 743975 - DNA, 20 bp, mouse
gctcacggcccgcggctccg

SEQ ID NO: 743976 - DNA, 20 bp, mouse
gcaggtgcctggcttgtcgt

SEQ ID NO: 743977 - DNA, 20 bp, mouse
gggctgggagccaatagtac

SEQ ID NO: 743978 - DNA, 20 bp, mouse
ggcgccgcaaggagcactat

SEQ ID NO: 743979 - DNA, 20 bp, mouse
gcggatacagggcctcggga

SEQ ID NO: 743980 - DNA, 20 bp, mouse
ggaaggtggagcctaaggct

SEQ ID NO: 743981 - DNA, 20 bp, mouse
gatacagggcctcgggaagg

SEQ ID NO: 743982 - DNA, 20 bp, mouse
gaatagtacaggctgtcaat

SEQ ID NO: 743983 - DNA, 20 bp, mouse
ggcacctggggggcggaggt

SEQ ID NO: 743984 - DNA, 20 bp, mouse
ggttgtgattcaaacttccg

SEQ ID NO: 743985 - DNA, 20 bp, mouse
gcttaggctccaccttcccg

SEQ ID NO: 743986 - DNA, 20 bp, mouse
gtcccaggggtgggaatgat

SEQ ID NO: 743987 - DNA, 20 bp, mouse
gaggtcccgcccccttgcta

SEQ ID NO: 743988 - DNA, 20 bp, mouse
ggggaactccgattggctgt

SEQ ID NO: 743989 - DNA, 20 bp, mouse
ggctgtaggtaggctctcta

SEQ ID NO: 743990 - DNA, 20 bp, mouse
gcctaaccgggaactccgat

SEQ ID NO: 743991 - DNA, 20 bp, mouse
ggaagtagggaaacgagacc

SEQ ID NO: 743992 - DNA, 20 bp, mouse
gactccgattggctgtaggt

SEQ ID NO: 743993 - DNA, 20 bp, mouse
gagggaagacgccccctaac

SEQ ID NO: 743994 - DNA, 20 bp, mouse
gacccacggagtggttaaag

SEQ ID NO: 743995 - DNA, 20 bp, mouse
gtcaaaggtggaagcgttct

SEQ ID NO: 743996 - DNA, 20 bp, mouse
gctcctggggcctccgtcaa

SEQ ID NO: 743997 - DNA, 20 bp, mouse
gaaggcggggaactccaagt

SEQ ID NO: 743998 - DNA, 20 bp, mouse
gggggcctccgtcaaaggga

SEQ ID NO: 743999 - DNA, 20 bp, mouse
gcggagcaggggcgcggaag

SEQ ID NO: 744000 - DNA, 20 bp, mouse
ggggctgggggagcgctctg

SEQ ID NO: 744001 - DNA, 20 bp, mouse
gctggaaaccgcactgaccg

SEQ ID NO: 744002 - DNA, 20 bp, mouse
gcaggcgcatcaccaagcgg

SEQ ID NO: 744003 - DNA, 20 bp, mouse
gctgcgcaaagacgcgactc

SEQ ID NO: 744004 - DNA, 20 bp, mouse
gcccgccttccctttgacgg

SEQ ID NO: 744005 - DNA, 20 bp, mouse
gttgccagggggcggagcag

SEQ ID NO: 744006 - DNA, 20 bp, mouse
ggggggagggagaggttcta

SEQ ID NO: 744007 - DNA, 20 bp, mouse
gcaaacgcactcagggggga

SEQ ID NO: 744008 - DNA, 20 bp, mouse
ggagacccgcaggaacgcca

SEQ ID NO: 744009 - DNA, 20 bp, mouse
gcaaccttcaaacgcactca

SEQ ID NO: 744010 - DNA, 20 bp, mouse
gaggttctagggctcaccgg

SEQ ID NO: 744011 - DNA, 20 bp, mouse
ggtgccgagtgtttggtatt

SEQ ID NO: 744012 - DNA, 20 bp, mouse
ggcgcacacccacatatccg

SEQ ID NO: 744013 - DNA, 20 bp, mouse
gagtgcgtttgaaggttggc

SEQ ID NO: 744014 - DNA, 20 bp, mouse
gggcggacgggaggtttccc

SEQ ID NO: 744015 - DNA, 20 bp, mouse
gcgtttgaaggttggcgggg

SEQ ID NO: 744016 - DNA, 20 bp, mouse
ggtgggcgagcaaagttcta

SEQ ID NO: 744017 - DNA, 20 bp, mouse
gaggagaagaaagctcgggt

SEQ ID NO: 744018 - DNA, 20 bp, mouse
ggaacagttgagtctccatc

SEQ ID NO: 744019 - DNA, 20 bp, mouse
gagactcaactgttccgccg

SEQ ID NO: 744020 - DNA, 20 bp, mouse
ggtggagagggaagacggaa

SEQ ID NO: 744021 - DNA, 20 bp, mouse
gagctctgggtggctgtagc

SEQ ID NO: 744022 - DNA, 20 bp, mouse
ggcccacccgtcagtagctc

SEQ ID NO: 744023 - DNA, 20 bp, mouse
gttggccaggcaggcgctcg

SEQ ID NO: 744024 - DNA, 20 bp, mouse
gccgcggcgaatcttcagtg

SEQ ID NO: 744025 - DNA, 20 bp, mouse
gacccagagctactgacggg

SEQ ID NO: 744026 - DNA, 20 bp, mouse
gtaggagcgagacacccaga

SEQ ID NO: 744027 - DNA, 20 bp, mouse
ggggcagcagatagtgatgt

SEQ ID NO: 744028 - DNA, 20 bp, mouse
gcaacggagtaacaagatcg

SEQ ID NO: 744029 - DNA, 20 bp, mouse
gacaggaggcggtgctgcgc

SEQ ID NO: 744030 - DNA, 20 bp, mouse
gctgccctcacactgacagg

SEQ ID NO: 744031 - DNA, 20 bp, mouse
gccgggctctgggctccgtt

SEQ ID NO: 744032 - DNA, 20 bp, mouse
ggaagaggatcgctgtgact

SEQ ID NO: 744033 - DNA, 20 bp, mouse
gcgagacacccagaggggga

SEQ ID NO: 744034 - DNA, 20 bp, mouse
gcgcagggtcccgcccactc

SEQ ID NO: 744035 - DNA, 20 bp, mouse
gggtctctagagttccggag

SEQ ID NO: 744036 - DNA, 20 bp, mouse
gagcacagacccacgaaagg

SEQ ID NO: 744037 - DNA, 20 bp, mouse
ggctgccgtcggtcgggtaa

SEQ ID NO: 744038 - DNA, 20 bp, mouse
gcgggtaagggccggaacta

SEQ ID NO: 744039 - DNA, 20 bp, mouse
ggggacgctttgcgaccgac

SEQ ID NO: 744040 - DNA, 20 bp, mouse
gaaccagcctagacggtcag

SEQ ID NO: 744041 - DNA, 20 bp, mouse
gacgggtggcctcctttcgt

SEQ ID NO: 744042 - DNA, 20 bp, mouse
ggcgagagctagaaggatgc

SEQ ID NO: 744043 - DNA, 20 bp, mouse
gtcccgagtgtcccctgcct

SEQ ID NO: 744044 - DNA, 20 bp, mouse
gacgctttgcgaccgacggg

SEQ ID NO: 744045 - DNA, 20 bp, mouse
ggtggaccaggccgagaaag

SEQ ID NO: 744046 - DNA, 20 bp, mouse
gcgggcgggcgcatcggtgc

SEQ ID NO: 744047 - DNA, 20 bp, mouse
gctcgccgagaggcccggta

SEQ ID NO: 744048 - DNA, 20 bp, mouse
gcccccgcgctcggccctac

SEQ ID NO: 744049 - DNA, 20 bp, mouse
gcccgccccggtgcattgtg

SEQ ID NO: 744050 - DNA, 20 bp, mouse
gccgcccgagcccggcggga

SEQ ID NO: 744051 - DNA, 20 bp, mouse
gcccgaggccccctcccgcc

SEQ ID NO: 744052 - DNA, 20 bp, mouse
gtgcgagggaggttcgaatg

SEQ ID NO: 744053 - DNA, 20 bp, mouse
gcgggagcgagcgcaggcga

SEQ ID NO: 744054 - DNA, 20 bp, mouse
ggagcgagcgcaggcgaggg

SEQ ID NO: 744055 - DNA, 20 bp, mouse
gtcccgctcccctcgggaac

SEQ ID NO: 744056 - DNA, 20 bp, mouse
gcggccgcaaaacctgggtg

SEQ ID NO: 744057 - DNA, 20 bp, mouse
ggcccagggcgcagcgagag

SEQ ID NO: 744058 - DNA, 20 bp, mouse
gcggtccgcgcgccctcgca

SEQ ID NO: 744059 - DNA, 20 bp, mouse
gtcagagaaccggacgaaga

SEQ ID NO: 744060 - DNA, 20 bp, mouse
gggcgcagcgagagtggcag

SEQ ID NO: 744061 - DNA, 20 bp, mouse
gtgagccccgcgtcgggaga

SEQ ID NO: 744062 - DNA, 20 bp, mouse
gaaggcgcggccgcaaaacc

SEQ ID NO: 744063 - DNA, 20 bp, mouse
gaggggcgctgcgtggtgca

SEQ ID NO: 744064 - DNA, 20 bp, mouse
ggggcccctctcccgacgcg

SEQ ID NO: 744065 - DNA, 20 bp, mouse
gagtgagcgagctctggagc

SEQ ID NO: 744066 - DNA, 20 bp, mouse
gtgcggaggcactgaggaca

SEQ ID NO: 744067 - DNA, 20 bp, mouse
gacgtgttggagcaggtctg

SEQ ID NO: 744068 - DNA, 20 bp, mouse
ggcaccctggccatgcgcac

SEQ ID NO: 744069 - DNA, 20 bp, mouse
gcaaactgtcgtatctgggg

SEQ ID NO: 744070 - DNA, 20 bp, mouse
gggggcccccaagtatttct

SEQ ID NO: 744071 - DNA, 20 bp, mouse
ggggacaaactgtcgtatct

SEQ ID NO: 744072 - DNA, 20 bp, mouse
gagtgtctgcggaggcactg

SEQ ID NO: 744073 - DNA, 20 bp, mouse
gcgacaacacgtgttggagc

SEQ ID NO: 744074 - DNA, 20 bp, mouse
ggacgcgcacggcggagccc

SEQ ID NO: 744075 - DNA, 20 bp, mouse
ggagcaggtctggggcagat

SEQ ID NO: 744076 - DNA, 20 bp, mouse
ggcgtagagactgaagtcaa

SEQ ID NO: 744077 - DNA, 20 bp, mouse
gtgatggagagactaggaac

SEQ ID NO: 744078 - DNA, 20 bp, mouse
gtctacgctatgaggaagga

SEQ ID NO: 744079 - DNA, 20 bp, mouse
ggaaattctgagcaagacta

SEQ ID NO: 744080 - DNA, 20 bp, mouse
gtgctgctgactccacatga

SEQ ID NO: 744081 - DNA, 20 bp, mouse
gagtctctacgctatgagga

SEQ ID NO: 744082 - DNA, 20 bp, mouse
gttcccgggtgctggtcctt

SEQ ID NO: 744083 - DNA, 20 bp, mouse
gggtataagcagcagatgag

SEQ ID NO: 744084 - DNA, 20 bp, mouse
gggtccttgggttttccggc

SEQ ID NO: 744085 - DNA, 20 bp, mouse
gggaccggatactaaccagc

SEQ ID NO: 744086 - DNA, 20 bp, mouse
gggagcctggagaaccgctg

SEQ ID NO: 744087 - DNA, 20 bp, mouse
ggattcgcgacagttagagg

SEQ ID NO: 744088 - DNA, 20 bp, mouse
gagaggaggcgggctaatag

SEQ ID NO: 744089 - DNA, 20 bp, mouse
gccaccgcggatctggttta

SEQ ID NO: 744090 - DNA, 20 bp, mouse
gcgaagggagagcgaccaat

SEQ ID NO: 744091 - DNA, 20 bp, mouse
gccgctgcggggaagcggag

SEQ ID NO: 744092 - DNA, 20 bp, mouse
gagacactgtactacgaatg

SEQ ID NO: 744093 - DNA, 20 bp, mouse
gcgcgacagttagaggaggc

SEQ ID NO: 744094 - DNA, 20 bp, mouse
gaggcgggctaatagaggct

SEQ ID NO: 744095 - DNA, 20 bp, mouse
ggcagctgattggctgtcga

SEQ ID NO: 744096 - DNA, 20 bp, mouse
gcctggggaagcggactcag

SEQ ID NO: 744097 - DNA, 20 bp, mouse
gaggaggggtggagtcacca

SEQ ID NO: 744098 - DNA, 20 bp, mouse
gtcaccagggcacttcccgg

SEQ ID NO: 744099 - DNA, 20 bp, mouse
ggggctgggctgaatctttt

SEQ ID NO: 744100 - DNA, 20 bp, mouse
gctaggccgatggccaggag

SEQ ID NO: 744101 - DNA, 20 bp, mouse
gtggccatcggcctagccct

SEQ ID NO: 744102 - DNA, 20 bp, mouse
gccaccaccgggaagtgccc

SEQ ID NO: 744103 - DNA, 20 bp, mouse
gaatcagggcagtccaccac

SEQ ID NO: 744104 - DNA, 20 bp, mouse
ggcaggaggaagctctggct

SEQ ID NO: 744105 - DNA, 20 bp, mouse
gttccccagggctaggccga

SEQ ID NO: 744106 - DNA, 20 bp, mouse
gcccccccatagtacttgaa

SEQ ID NO: 744107 - DNA, 20 bp, mouse
ggagataaaaagtgcttctg

SEQ ID NO: 744108 - DNA, 20 bp, mouse
gtcccattcaagtactatgg

SEQ ID NO: 744109 - DNA, 20 bp, mouse
gaaagcaggcaataatacag

SEQ ID NO: 744110 - DNA, 20 bp, mouse
ggatagatttggactggaga

SEQ ID NO: 744111 - DNA, 20 bp, mouse
gtggtgaggtcaggttaaga

SEQ ID NO: 744112 - DNA, 20 bp, mouse
gtgtttggacatttgaccaa

SEQ ID NO: 744113 - DNA, 20 bp, mouse
ggctggagcctggtgaggtc

SEQ ID NO: 744114 - DNA, 20 bp, mouse
gacctcccattcaagtacta

SEQ ID NO: 744115 - DNA, 20 bp, mouse
gaccacaggtgccagaaaca

SEQ ID NO: 744116 - DNA, 20 bp, mouse
gccctggtgtaagcaaggag

SEQ ID NO: 744117 - DNA, 20 bp, mouse
gagcctggggcgataaactg

SEQ ID NO: 744118 - DNA, 20 bp, mouse
gctctgaggaagaacctagc

SEQ ID NO: 744119 - DNA, 20 bp, mouse
ggggagggactagtggggta

SEQ ID NO: 744120 - DNA, 20 bp, mouse
gtcaacagagtcctcctgct

SEQ ID NO: 744121 - DNA, 20 bp, mouse
ggctctccttgctcagactc

SEQ ID NO: 744122 - DNA, 20 bp, mouse
gccagggccaatgtcgggag

SEQ ID NO: 744123 - DNA, 20 bp, mouse
gcagccctgctgtcccctct

SEQ ID NO: 744124 - DNA, 20 bp, mouse
gtggggcgataaactggggg

SEQ ID NO: 744125 - DNA, 20 bp, mouse
gcagatgtctccagctgtta

SEQ ID NO: 744126 - DNA, 20 bp, mouse
ggagcctgcccaggattgga

SEQ ID NO: 744127 - DNA, 20 bp, mouse
ggctccgcctttaatgggtg

SEQ ID NO: 744128 - DNA, 20 bp, mouse
gaaggtgaatgagatggcga

SEQ ID NO: 744129 - DNA, 20 bp, mouse
gcgtgggcggggaccgactt

SEQ ID NO: 744130 - DNA, 20 bp, mouse
gcagccccacccattaaagg

SEQ ID NO: 744131 - DNA, 20 bp, mouse
gggtcctaggctgtagttga

SEQ ID NO: 744132 - DNA, 20 bp, mouse
ggcggagctccgcctttaat

SEQ ID NO: 744133 - DNA, 20 bp, mouse
gcctcacagcaggaatagtg

SEQ ID NO: 744134 - DNA, 20 bp, mouse
gcttcagccccacccattaa

SEQ ID NO: 744135 - DNA, 20 bp, mouse
gcggtccccgcccacgcctt

SEQ ID NO: 744136 - DNA, 20 bp, mouse
ggatcagagtagccagtggt

SEQ ID NO: 744137 - DNA, 20 bp, mouse
gtaggtttgtgctttaatat

SEQ ID NO: 744138 - DNA, 20 bp, mouse
gtaactggtcttagattaaa

SEQ ID NO: 744139 - DNA, 20 bp, mouse
gcaacttggcacagaaaaat

SEQ ID NO: 744140 - DNA, 20 bp, mouse
gagatgactgcacttggcat

SEQ ID NO: 744141 - DNA, 20 bp, mouse
gatcttaggtccttcatatc

SEQ ID NO: 744142 - DNA, 20 bp, mouse
gagttgcagggcaaaagaca

SEQ ID NO: 744143 - DNA, 20 bp, mouse
gcattgtaagtcatgctcaa

SEQ ID NO: 744144 - DNA, 20 bp, mouse
gcattgattagaagtaattt

SEQ ID NO: 744145 - DNA, 20 bp, mouse
gttattaatcaaactatctt

SEQ ID NO: 744146 - DNA, 20 bp, mouse
ggcaccgcggacccgctcca

SEQ ID NO: 744147 - DNA, 20 bp, mouse
gccaccgcgtggacgcctgc

SEQ ID NO: 744148 - DNA, 20 bp, mouse
ggcgagtcccgacttcgcag

SEQ ID NO: 744149 - DNA, 20 bp, mouse
ggggaaagcgagcgtgtgga

SEQ ID NO: 744150 - DNA, 20 bp, mouse
ggctctgggagaggacaggt

SEQ ID NO: 744151 - DNA, 20 bp, mouse
gtgtcggccagaaggtgatg

SEQ ID NO: 744152 - DNA, 20 bp, mouse
gtctccgcacccaggactga

SEQ ID NO: 744153 - DNA, 20 bp, mouse
gggagaggacaggtcgggct

SEQ ID NO: 744154 - DNA, 20 bp, mouse
gagcccgtggagcgggtccg

SEQ ID NO: 744155 - DNA, 20 bp, mouse
gcgcacccaggactgagggt

SEQ ID NO: 744156 - DNA, 20 bp, mouse
gaggaaaccgcccacgaaga

SEQ ID NO: 744157 - DNA, 20 bp, mouse
gaaaaggtttccttcttcgt

SEQ ID NO: 744158 - DNA, 20 bp, mouse
ggggcggtttcctagctgtt

SEQ ID NO: 744159 - DNA, 20 bp, mouse
gactatgcaacggaaggaca

SEQ ID NO: 744160 - DNA, 20 bp, mouse
gttagtcctgtcaggatctt

SEQ ID NO: 744161 - DNA, 20 bp, mouse
gaacaggaagtccccgaggg

SEQ ID NO: 744162 - DNA, 20 bp, mouse
ggacaacaggaagtccccga

SEQ ID NO: 744163 - DNA, 20 bp, mouse
gtggccctgttagtcctgtc

SEQ ID NO: 744164 - DNA, 20 bp, mouse
ggggccacagagcctccctc

SEQ ID NO: 744165 - DNA, 20 bp, mouse
ggatcctgacaggactaaca

SEQ ID NO: 744166 - DNA, 20 bp, mouse
gaaaacccaggcagtttcat

SEQ ID NO: 744167 - DNA, 20 bp, mouse
gttattacgaagtctttctt

SEQ ID NO: 744168 - DNA, 20 bp, mouse
gaatgaagacatctacaatt

SEQ ID NO: 744169 - DNA, 20 bp, mouse
gcacacccatgaaactgcct

SEQ ID NO: 744170 - DNA, 20 bp, mouse
gctctcttaacacacgctag

SEQ ID NO: 744171 - DNA, 20 bp, mouse
ggcatgggaggatatgtttg

SEQ ID NO: 744172 - DNA, 20 bp, mouse
gtgccacttctaaaattctg

SEQ ID NO: 744173 - DNA, 20 bp, mouse
gctcctcccccggctggaaa

SEQ ID NO: 744174 - DNA, 20 bp, mouse
gccaggcagcatacactcgc

SEQ ID NO: 744175 - DNA, 20 bp, mouse
gctcttgctcctcccccggc

SEQ ID NO: 744176 - DNA, 20 bp, mouse
gactgccagaacaatcttgc

SEQ ID NO: 744177 - DNA, 20 bp, mouse
gccttgaggcccagtactta

SEQ ID NO: 744178 - DNA, 20 bp, mouse
gtcacccagcaagattgttc

SEQ ID NO: 744179 - DNA, 20 bp, mouse
gccgtcccacatcttccttg

SEQ ID NO: 744180 - DNA, 20 bp, mouse
gcagtacttaaggtctgatt

SEQ ID NO: 744181 - DNA, 20 bp, mouse
ggtaggaaaagcaaaatagt

SEQ ID NO: 744182 - DNA, 20 bp, mouse
gacttaaggtctgatttggc

SEQ ID NO: 744183 - DNA, 20 bp, mouse
ggaacccattaggagtttta

SEQ ID NO: 744184 - DNA, 20 bp, mouse
gctgggcctcaaggaagatg

SEQ ID NO: 744185 - DNA, 20 bp, mouse
gagcagaggcaggttaatta

SEQ ID NO: 744186 - DNA, 20 bp, mouse
gacggggaacaggagtttgt

SEQ ID NO: 744187 - DNA, 20 bp, mouse
gatgagaactaagcataagg

SEQ ID NO: 744188 - DNA, 20 bp, mouse
gatggcctctacatggtgac

SEQ ID NO: 744189 - DNA, 20 bp, mouse
gaacatgcagaatacactgg

SEQ ID NO: 744190 - DNA, 20 bp, mouse
ggttccccgtcaccatgtag

SEQ ID NO: 744191 - DNA, 20 bp, mouse
gaagggggctgtgcttttta

SEQ ID NO: 744192 - DNA, 20 bp, mouse
ggttccatagttacatgtga

SEQ ID NO: 744193 - DNA, 20 bp, mouse
gttccatcatctctgttctg

SEQ ID NO: 744194 - DNA, 20 bp, mouse
gaagccatcacatgtaacta

SEQ ID NO: 744195 - DNA, 20 bp, mouse
ggctttttatggcctctaca

SEQ ID NO: 744196 - DNA, 20 bp, mouse
gcctcccatcaatgacagac

SEQ ID NO: 744197 - DNA, 20 bp, mouse
ggaaaatgacacgcccaagg

SEQ ID NO: 744198 - DNA, 20 bp, mouse
ggctcctgtctgtcattgat

SEQ ID NO: 744199 - DNA, 20 bp, mouse
gtcataggagtgcttcaaat

SEQ ID NO: 744200 - DNA, 20 bp, mouse
gggtggaaatgaggaaacct

SEQ ID NO: 744201 - DNA, 20 bp, mouse
gcttgtaggttgggaaatag

SEQ ID NO: 744202 - DNA, 20 bp, mouse
ggcatgatacacttgtaggt

SEQ ID NO: 744203 - DNA, 20 bp, mouse
ggtagagatgcatgcctaaa

SEQ ID NO: 744204 - DNA, 20 bp, mouse
gttggaaaatgacacgccca

SEQ ID NO: 744205 - DNA, 20 bp, mouse
gtacaagtgtatcatgcatt

SEQ ID NO: 744206 - DNA, 20 bp, mouse
gaaaacctgcaaaccgatct

SEQ ID NO: 744207 - DNA, 20 bp, mouse
gcggaccaagatcggtttgc

SEQ ID NO: 744208 - DNA, 20 bp, mouse
ggcgggtctcggaccaagat

SEQ ID NO: 744209 - DNA, 20 bp, mouse
gcctcagtgaccgcaaaata

SEQ ID NO: 744210 - DNA, 20 bp, mouse
gatgggatcactatgatcga

SEQ ID NO: 744211 - DNA, 20 bp, mouse
ggatgacagggcaatggtca

SEQ ID NO: 744212 - DNA, 20 bp, mouse
gcgcagctggatttcttttg

SEQ ID NO: 744213 - DNA, 20 bp, mouse
gttaggacaaagttgatgac

SEQ ID NO: 744214 - DNA, 20 bp, mouse
gtattattttccatattttg

SEQ ID NO: 744215 - DNA, 20 bp, mouse
ggggttttataggccacttc

SEQ ID NO: 744216 - DNA, 20 bp, mouse
gtagctgggaagggagatag

SEQ ID NO: 744217 - DNA, 20 bp, mouse
gagatagaggctgaactttt

SEQ ID NO: 744218 - DNA, 20 bp, mouse
gtgtcataaagtgctgcttt

SEQ ID NO: 744219 - DNA, 20 bp, mouse
gatatagacaatagctggga

SEQ ID NO: 744220 - DNA, 20 bp, mouse
ggcctccagctggctttaat

SEQ ID NO: 744221 - DNA, 20 bp, mouse
gttgctatatagacaatagc

SEQ ID NO: 744222 - DNA, 20 bp, mouse
ggagagtcactgcctccagc

SEQ ID NO: 744223 - DNA, 20 bp, mouse
ggctgaacttttaggtttgc

SEQ ID NO: 744224 - DNA, 20 bp, mouse
gcttaccaattaaagccagc

SEQ ID NO: 744225 - DNA, 20 bp, mouse
gacataatttgtagtctctc

SEQ ID NO: 744226 - DNA, 20 bp, mouse
gaaaacctgcaaaccgatct

SEQ ID NO: 744227 - DNA, 20 bp, mouse
gcggaccaagatcggtttgc

SEQ ID NO: 744228 - DNA, 20 bp, mouse
ggcgggtctcggaccaagat

SEQ ID NO: 744229 - DNA, 20 bp, mouse
gcctcagtgaccgcaaaata

SEQ ID NO: 744230 - DNA, 20 bp, mouse
gatgggatcactatgatcga

SEQ ID NO: 744231 - DNA, 20 bp, mouse
ggatgacagggcaatggtca

SEQ ID NO: 744232 - DNA, 20 bp, mouse
gcgcagctggatttcttttg

SEQ ID NO: 744233 - DNA, 20 bp, mouse
gttaggacaaagttgatgac

SEQ ID NO: 744234 - DNA, 20 bp, mouse
gtattattttccatattttg

SEQ ID NO: 744235 - DNA, 20 bp, mouse
ggggttttataggccacttc

SEQ ID NO: 744236 - DNA, 20 bp, mouse
gacccacagcagaaatttac

SEQ ID NO: 744237 - DNA, 20 bp, mouse
gtaagaaacacctaagggac

SEQ ID NO: 744238 - DNA, 20 bp, mouse
gaatatgaaaattttcacta

SEQ ID NO: 744239 - DNA, 20 bp, mouse
gcactaaggatggttacata

SEQ ID NO: 744240 - DNA, 20 bp, mouse
gaggacttagattagtatat

SEQ ID NO: 744241 - DNA, 20 bp, mouse
gtcctgtaaatttctgctgt

SEQ ID NO: 744242 - DNA, 20 bp, mouse
gtatcagttttaattatatc

SEQ ID NO: 744243 - DNA, 20 bp, mouse
gagctatctgcctgtccctt

SEQ ID NO: 744244 - DNA, 20 bp, mouse
gtctgatgaaaataatataa

SEQ ID NO: 744245 - DNA, 20 bp, mouse
gaaagaaattattaattcaa

SEQ ID NO: 744246 - DNA, 20 bp, mouse
gcccagcaactgcgtctaga

SEQ ID NO: 744247 - DNA, 20 bp, mouse
gggtctcttgggcggggctg

SEQ ID NO: 744248 - DNA, 20 bp, mouse
gtcttgagggcgggtctctt

SEQ ID NO: 744249 - DNA, 20 bp, mouse
gagggcgggtctcttgggcg

SEQ ID NO: 744250 - DNA, 20 bp, mouse
gagtgttctgggttccacgt

SEQ ID NO: 744251 - DNA, 20 bp, mouse
gggggtgtggcttatccagg

SEQ ID NO: 744252 - DNA, 20 bp, mouse
gtctagagggctgagtgttc

SEQ ID NO: 744253 - DNA, 20 bp, mouse
gaggtgctgtctagctgctg

SEQ ID NO: 744254 - DNA, 20 bp, mouse
ggggcgtggcctcttgaggg

SEQ ID NO: 744255 - DNA, 20 bp, mouse
gcagggggcgagctttacgg

SEQ ID NO: 744256 - DNA, 20 bp, mouse
gaccaatcctgcctggactt

SEQ ID NO: 744257 - DNA, 20 bp, mouse
ggacttcgggtcacacaggt

SEQ ID NO: 744258 - DNA, 20 bp, mouse
ggtgaacacctaagcttcca

SEQ ID NO: 744259 - DNA, 20 bp, mouse
gagaaacgaagatccaaccc

SEQ ID NO: 744260 - DNA, 20 bp, mouse
gcctggacttcgggtcacac

SEQ ID NO: 744261 - DNA, 20 bp, mouse
gcatactaaaaaatgattat

SEQ ID NO: 744262 - DNA, 20 bp, mouse
gccctgagcttcagcccgag

SEQ ID NO: 744263 - DNA, 20 bp, mouse
gacgccttctggcgggtctc

SEQ ID NO: 744264 - DNA, 20 bp, mouse
gttctggcgggtctcggggc

SEQ ID NO: 744265 - DNA, 20 bp, mouse
gttcgggtcacacaggtagg

SEQ ID NO: 744266 - DNA, 20 bp, mouse
ggaggcggggccaaaaggtc

SEQ ID NO: 744267 - DNA, 20 bp, mouse
ggccagatggggtggggtct

SEQ ID NO: 744268 - DNA, 20 bp, mouse
gatgaagctacgacctgagt

SEQ ID NO: 744269 - DNA, 20 bp, mouse
ggcggggccaaaaggtcggg

SEQ ID NO: 744270 - DNA, 20 bp, mouse
gtggaaagggccagatgggg

SEQ ID NO: 744271 - DNA, 20 bp, mouse
gcgggggcggagatgtttcg

SEQ ID NO: 744272 - DNA, 20 bp, mouse
ggccttgaggcaggaggagt

SEQ ID NO: 744273 - DNA, 20 bp, mouse
gtcgggcgggaggcggactc

SEQ ID NO: 744274 - DNA, 20 bp, mouse
gggagtaacagccttgaggc

SEQ ID NO: 744275 - DNA, 20 bp, mouse
gggccaaaaggtcgggcggg

SEQ ID NO: 744276 - DNA, 20 bp, mouse
gcatccaggcaaaatctggt

SEQ ID NO: 744277 - DNA, 20 bp, mouse
gctgaaagaaatgcccaaat

SEQ ID NO: 744278 - DNA, 20 bp, mouse
gggggcagcacatttaaaga

SEQ ID NO: 744279 - DNA, 20 bp, mouse
gaatgtgctgcccccggaat

SEQ ID NO: 744280 - DNA, 20 bp, mouse
gttcttgagtacctattccg

SEQ ID NO: 744281 - DNA, 20 bp, mouse
gaagaaatgcccaaatggga

SEQ ID NO: 744282 - DNA, 20 bp, mouse
gacagcatccaggcaaaatc

SEQ ID NO: 744283 - DNA, 20 bp, mouse
gttcctaaattacaagggga

SEQ ID NO: 744284 - DNA, 20 bp, mouse
ggggaacgatttgtcttgga

SEQ ID NO: 744285 - DNA, 20 bp, mouse
gaattacaaggggaaggctt

SEQ ID NO: 744286 - DNA, 20 bp, mouse
gccctggggcggggcttgaa

SEQ ID NO: 744287 - DNA, 20 bp, mouse
gcagatgccatgccaatcac

SEQ ID NO: 744288 - DNA, 20 bp, mouse
gttcctcaatcatttgccta

SEQ ID NO: 744289 - DNA, 20 bp, mouse
gcaccttaggcaaatgattg

SEQ ID NO: 744290 - DNA, 20 bp, mouse
gagagcttcggagcatcttt

SEQ ID NO: 744291 - DNA, 20 bp, mouse
gatgccatgccaatcactgg

SEQ ID NO: 744292 - DNA, 20 bp, mouse
ggtggtaagcgatagaaatc

SEQ ID NO: 744293 - DNA, 20 bp, mouse
ggcaagagccaggggattga

SEQ ID NO: 744294 - DNA, 20 bp, mouse
gctccctctccaccagtgat

SEQ ID NO: 744295 - DNA, 20 bp, mouse
gaaatgattgaggaaggcgg

SEQ ID NO: 744296 - DNA, 20 bp, mouse
ggggacttgtagtccgaagg

SEQ ID NO: 744297 - DNA, 20 bp, mouse
gcccttgctcgccagacaat

SEQ ID NO: 744298 - DNA, 20 bp, mouse
gggctcgccgggctcgccgg

SEQ ID NO: 744299 - DNA, 20 bp, mouse
ggggggaagtgggaccggga

SEQ ID NO: 744300 - DNA, 20 bp, mouse
gacgcatgcgcaatggtgcg

SEQ ID NO: 744301 - DNA, 20 bp, mouse
gcgaaggtgggtcccaaccg

SEQ ID NO: 744302 - DNA, 20 bp, mouse
gggcagtcacgcatgcgcaa

SEQ ID NO: 744303 - DNA, 20 bp, mouse
gggtcccaaccgtgggaagc

SEQ ID NO: 744304 - DNA, 20 bp, mouse
gcagacaatgggcgaggacg

SEQ ID NO: 744305 - DNA, 20 bp, mouse
ggcgggcacgctcacgtcgt

SEQ ID NO: 744306 - DNA, 20 bp, mouse
ggccacgattggttggagag

SEQ ID NO: 744307 - DNA, 20 bp, mouse
gcggggcaggagcgcatcct

SEQ ID NO: 744308 - DNA, 20 bp, mouse
gaccaggtgcgcacaggtga

SEQ ID NO: 744309 - DNA, 20 bp, mouse
gcctgtgcgcacctggtcac

SEQ ID NO: 744310 - DNA, 20 bp, mouse
gcctcctaggccgagccgac

SEQ ID NO: 744311 - DNA, 20 bp, mouse
ggggcatgctgcgctaggtg

SEQ ID NO: 744312 - DNA, 20 bp, mouse
gtactggggccacgattggt

SEQ ID NO: 744313 - DNA, 20 bp, mouse
gctgccccgccccacactac

SEQ ID NO: 744314 - DNA, 20 bp, mouse
gttggagagcggccccgctc

SEQ ID NO: 744315 - DNA, 20 bp, mouse
gcgctcctgccccgtcggct

SEQ ID NO: 744316 - DNA, 20 bp, mouse
gcagtgggttggcagaagcg

SEQ ID NO: 744317 - DNA, 20 bp, mouse
gacccaggtcggggtaagat

SEQ ID NO: 744318 - DNA, 20 bp, mouse
gcagaagcggggctgtcctg

SEQ ID NO: 744319 - DNA, 20 bp, mouse
gcaactggacatgcagggga

SEQ ID NO: 744320 - DNA, 20 bp, mouse
gcagcctccctccgtgcagt

SEQ ID NO: 744321 - DNA, 20 bp, mouse
gccccgtggtgctggggacc

SEQ ID NO: 744322 - DNA, 20 bp, mouse
gtgcctcaactggacatgca

SEQ ID NO: 744323 - DNA, 20 bp, mouse
gctccctccgtgcagtgggt

SEQ ID NO: 744324 - DNA, 20 bp, mouse
ggccaagccccgtggtgctg

SEQ ID NO: 744325 - DNA, 20 bp, mouse
gtccccagcaccacggggct

SEQ ID NO: 744326 - DNA, 20 bp, mouse
ggccaggcttggcccatcca

SEQ ID NO: 744327 - DNA, 20 bp, mouse
ggaggatcctaggaggtacg

SEQ ID NO: 744328 - DNA, 20 bp, mouse
gtgtgacagcctcacgagaa

SEQ ID NO: 744329 - DNA, 20 bp, mouse
gaggaatttcctgtcgggag

SEQ ID NO: 744330 - DNA, 20 bp, mouse
gggccagcgcacagcatgcc

SEQ ID NO: 744331 - DNA, 20 bp, mouse
gctgtgcgctggcccctgaa

SEQ ID NO: 744332 - DNA, 20 bp, mouse
gtcacgagaaaggataccaa

SEQ ID NO: 744333 - DNA, 20 bp, mouse
ggatgggccaagcctggccg

SEQ ID NO: 744334 - DNA, 20 bp, mouse
gaggggtcagccaaagcctc

SEQ ID NO: 744335 - DNA, 20 bp, mouse
gagaggcgtggtctttgggg

SEQ ID NO: 744336 - DNA, 20 bp, mouse
gtgtgggcggggctacagga

SEQ ID NO: 744337 - DNA, 20 bp, mouse
ggagccgcggatggccaaca

SEQ ID NO: 744338 - DNA, 20 bp, mouse
gcctggcccgcgggtctctc

SEQ ID NO: 744339 - DNA, 20 bp, mouse
gactcggtatagtagaggtg

SEQ ID NO: 744340 - DNA, 20 bp, mouse
gcagtctggggtccggggca

SEQ ID NO: 744341 - DNA, 20 bp, mouse
gcctggcctcctcgctactg

SEQ ID NO: 744342 - DNA, 20 bp, mouse
ggtggcccccagtagcgagg

SEQ ID NO: 744343 - DNA, 20 bp, mouse
ggggactggagacagaggcg

SEQ ID NO: 744344 - DNA, 20 bp, mouse
gcagatgctcacagtcctag

SEQ ID NO: 744345 - DNA, 20 bp, mouse
ggctggagttgtgagctctt

SEQ ID NO: 744346 - DNA, 20 bp, mouse
ggaagccttggctatcccct

SEQ ID NO: 744347 - DNA, 20 bp, mouse
gacaggggcaaagctcaagt

SEQ ID NO: 744348 - DNA, 20 bp, mouse
gggcaaagctcaagttggct

SEQ ID NO: 744349 - DNA, 20 bp, mouse
gtgaagggacgcaaggctca

SEQ ID NO: 744350 - DNA, 20 bp, mouse
gactggcagaaggagttatt

SEQ ID NO: 744351 - DNA, 20 bp, mouse
gtcaagttggctaggagccc

SEQ ID NO: 744352 - DNA, 20 bp, mouse
gcatgtgctcttaaaggagc

SEQ ID NO: 744353 - DNA, 20 bp, mouse
gagaagggtgaagggacgca

SEQ ID NO: 744354 - DNA, 20 bp, mouse
gagaaacaggatgtgtgttt

SEQ ID NO: 744355 - DNA, 20 bp, mouse
ggctatgcatgtgctcttaa

SEQ ID NO: 744356 - DNA, 20 bp, mouse
gggaggctggccagccaata

SEQ ID NO: 744357 - DNA, 20 bp, mouse
ggagaaccctcggccgtggc

SEQ ID NO: 744358 - DNA, 20 bp, mouse
gagcgggatggcagccttat

SEQ ID NO: 744359 - DNA, 20 bp, mouse
gaaatgcagaggtctctcct

SEQ ID NO: 744360 - DNA, 20 bp, mouse
ggacagccggccacggccga

SEQ ID NO: 744361 - DNA, 20 bp, mouse
gaatcatggagcagcacgtt

SEQ ID NO: 744362 - DNA, 20 bp, mouse
gtatggagccgcgctctact

SEQ ID NO: 744363 - DNA, 20 bp, mouse
gggttctcatgagcgacaag

SEQ ID NO: 744364 - DNA, 20 bp, mouse
gtaggactgagcagggtgct

SEQ ID NO: 744365 - DNA, 20 bp, mouse
gccaccgagtcactccagtg

SEQ ID NO: 744366 - DNA, 20 bp, mouse
gagaagggagtctggacatt

SEQ ID NO: 744367 - DNA, 20 bp, mouse
gtcggcaacgccccttgcct

SEQ ID NO: 744368 - DNA, 20 bp, mouse
ggccttgccaacccaggcaa

SEQ ID NO: 744369 - DNA, 20 bp, mouse
gctactagtcagccaatcgg

SEQ ID NO: 744370 - DNA, 20 bp, mouse
gcatcggcccgatctcccat

SEQ ID NO: 744371 - DNA, 20 bp, mouse
ggccaagctaacagccaaga

SEQ ID NO: 744372 - DNA, 20 bp, mouse
gaggtgagtatcccaccgat

SEQ ID NO: 744373 - DNA, 20 bp, mouse
ggccccgtggcccaacccat

SEQ ID NO: 744374 - DNA, 20 bp, mouse
gcgtgactaaaatgagtgga

SEQ ID NO: 744375 - DNA, 20 bp, mouse
ggcggccaggtaggtacaaa

SEQ ID NO: 744376 - DNA, 20 bp, mouse
gaacgggggcggggttttta

SEQ ID NO: 744377 - DNA, 20 bp, mouse
gaagagcgcctctgcgcgtg

SEQ ID NO: 744378 - DNA, 20 bp, mouse
gcgggccgaagctccaggca

SEQ ID NO: 744379 - DNA, 20 bp, mouse
gggagagagactggaggaac

SEQ ID NO: 744380 - DNA, 20 bp, mouse
gtgggcggggcttgaggtcg

SEQ ID NO: 744381 - DNA, 20 bp, mouse
gcgccttggagagagactgg

SEQ ID NO: 744382 - DNA, 20 bp, mouse
gcagaaggccacttcagtcc

SEQ ID NO: 744383 - DNA, 20 bp, mouse
gcctctgcgcgtggggcgct

SEQ ID NO: 744384 - DNA, 20 bp, mouse
gtgcagcaggacataaatct

SEQ ID NO: 744385 - DNA, 20 bp, mouse
gcgctgggccgaaggtcgct

SEQ ID NO: 744386 - DNA, 20 bp, mouse
gcctgggcgggtttcttcag

SEQ ID NO: 744387 - DNA, 20 bp, mouse
gttaaaggggaggggaccga

SEQ ID NO: 744388 - DNA, 20 bp, mouse
gccaggccttgtgtcgtcac

SEQ ID NO: 744389 - DNA, 20 bp, mouse
gtgcgctgataggacattct

SEQ ID NO: 744390 - DNA, 20 bp, mouse
gtacgcggaagtgccaggct

SEQ ID NO: 744391 - DNA, 20 bp, mouse
gaaaggaggcgggatgtttt

SEQ ID NO: 744392 - DNA, 20 bp, mouse
ggtcccctcccctttaaggt

SEQ ID NO: 744393 - DNA, 20 bp, mouse
gggaaactcaaggtaatctg

SEQ ID NO: 744394 - DNA, 20 bp, mouse
gtacccgccgcccggctacg

SEQ ID NO: 744395 - DNA, 20 bp, mouse
gccggctacgcggaagtgcc

SEQ ID NO: 744396 - DNA, 20 bp, mouse
gggtgcgccccgcctcggct

SEQ ID NO: 744397 - DNA, 20 bp, mouse
gtcggctcggctggtcgcca

SEQ ID NO: 744398 - DNA, 20 bp, mouse
gtggtgacgtcacggtgcgt

SEQ ID NO: 744399 - DNA, 20 bp, mouse
ggggagggaaggcacgggac

SEQ ID NO: 744400 - DNA, 20 bp, mouse
gggacgggacggaacgaaga

SEQ ID NO: 744401 - DNA, 20 bp, mouse
gcgtcgggtgcgccccgcct

SEQ ID NO: 744402 - DNA, 20 bp, mouse
gctcgcgggccgggtctcct

SEQ ID NO: 744403 - DNA, 20 bp, mouse
ggcagagcggagggttgcca

SEQ ID NO: 744404 - DNA, 20 bp, mouse
ggagggttgccaaggagacc

SEQ ID NO: 744405 - DNA, 20 bp, mouse
gtggcacgcaggccgcgcgt

SEQ ID NO: 744406 - DNA, 20 bp, mouse
ggcaacggggcgtcagaagg

SEQ ID NO: 744407 - DNA, 20 bp, mouse
gactccctgcggcgccgggc

SEQ ID NO: 744408 - DNA, 20 bp, mouse
gcaggcaacggggcgtcaga

SEQ ID NO: 744409 - DNA, 20 bp, mouse
gtccgcgcgcgcggtggtga

SEQ ID NO: 744410 - DNA, 20 bp, mouse
gcggcgccgcagggagttgt

SEQ ID NO: 744411 - DNA, 20 bp, mouse
gctagctcgtagtcctgcct

SEQ ID NO: 744412 - DNA, 20 bp, mouse
gcggcgccgggcgggattga

SEQ ID NO: 744413 - DNA, 20 bp, mouse
gcgccgggcgggattgaagg

SEQ ID NO: 744414 - DNA, 20 bp, mouse
gggttggtccgaaatcagag

SEQ ID NO: 744415 - DNA, 20 bp, mouse
gcgggcgggattgaaggagg

SEQ ID NO: 744416 - DNA, 20 bp, mouse
gcctgcagaggccaccctaa

SEQ ID NO: 744417 - DNA, 20 bp, mouse
ggcagaggccaccctaaggg

SEQ ID NO: 744418 - DNA, 20 bp, mouse
ggacagctgtgagcccgagg

SEQ ID NO: 744419 - DNA, 20 bp, mouse
gtgcccccgcgcacccccct

SEQ ID NO: 744420 - DNA, 20 bp, mouse
gctgtgagcccgaggtggca

SEQ ID NO: 744421 - DNA, 20 bp, mouse
gctcacagctgtcccctagg

SEQ ID NO: 744422 - DNA, 20 bp, mouse
gcccgaggtggcagggcagc

SEQ ID NO: 744423 - DNA, 20 bp, mouse
gctgcatccctcccttaggg

SEQ ID NO: 744424 - DNA, 20 bp, mouse
gaaaggagaagggcgtgggg

SEQ ID NO: 744425 - DNA, 20 bp, mouse
ggacctgaatggatctgcct

SEQ ID NO: 744426 - DNA, 20 bp, mouse
gaggagagaccgcccagaga

SEQ ID NO: 744427 - DNA, 20 bp, mouse
ggcgccacgccctctctggg

SEQ ID NO: 744428 - DNA, 20 bp, mouse
gctagcggtgggcgtctccg

SEQ ID NO: 744429 - DNA, 20 bp, mouse
gcgcccagacagcctagtaa

SEQ ID NO: 744430 - DNA, 20 bp, mouse
gcacgcgccacgccctctct

SEQ ID NO: 744431 - DNA, 20 bp, mouse
gaaggcgcagattatactat

SEQ ID NO: 744432 - DNA, 20 bp, mouse
gtgcagagagtgaagcgaca

SEQ ID NO: 744433 - DNA, 20 bp, mouse
ggcgggcagcagaggaatac

SEQ ID NO: 744434 - DNA, 20 bp, mouse
ggggcggtctctcctagcgg

SEQ ID NO: 744435 - DNA, 20 bp, mouse
gagagtgaagcgacagggga

SEQ ID NO: 744436 - DNA, 20 bp, mouse
gggggcggggcctacaccgg

SEQ ID NO: 744437 - DNA, 20 bp, mouse
gcgcgcacacgtatgacgtc

SEQ ID NO: 744438 - DNA, 20 bp, mouse
gccctggctacgtacttccg

SEQ ID NO: 744439 - DNA, 20 bp, mouse
gggagccccgcccccggtgt

SEQ ID NO: 744440 - DNA, 20 bp, mouse
gcacacgtatgacgtcaggc

SEQ ID NO: 744441 - DNA, 20 bp, mouse
gcggggctccgtgtctaggg

SEQ ID NO: 744442 - DNA, 20 bp, mouse
gaaagaagcgggcccgacgg

SEQ ID NO: 744443 - DNA, 20 bp, mouse
ggggcggggctccgtgtcta

SEQ ID NO: 744444 - DNA, 20 bp, mouse
gtggctacgtacttccgggg

SEQ ID NO: 744445 - DNA, 20 bp, mouse
gggctccgtgtctagggggg

SEQ ID NO: 744446 - DNA, 20 bp, mouse
gcccacagctcagttcacgt

SEQ ID NO: 744447 - DNA, 20 bp, mouse
gtagctgctacggaatgaag

SEQ ID NO: 744448 - DNA, 20 bp, mouse
gagctggccaatgagcgccg

SEQ ID NO: 744449 - DNA, 20 bp, mouse
ggggattagtgcaaagcggt

SEQ ID NO: 744450 - DNA, 20 bp, mouse
gcggcggaggacgagggcag

SEQ ID NO: 744451 - DNA, 20 bp, mouse
gcgggtccggcggaggacga

SEQ ID NO: 744452 - DNA, 20 bp, mouse
ggcccacgtgaactgagctg

SEQ ID NO: 744453 - DNA, 20 bp, mouse
ggctgccccgcggcgctcat

SEQ ID NO: 744454 - DNA, 20 bp, mouse
gcgccctcgccgcggacagg

SEQ ID NO: 744455 - DNA, 20 bp, mouse
gacggcccgccacctgtccg

SEQ ID NO: 744456 - DNA, 20 bp, mouse
gataggccctcctctacagg

SEQ ID NO: 744457 - DNA, 20 bp, mouse
gcctgtacccaaaggggcgg

SEQ ID NO: 744458 - DNA, 20 bp, mouse
gcccacccactcaaattctt

SEQ ID NO: 744459 - DNA, 20 bp, mouse
gggcaagcttagagttgagt

SEQ ID NO: 744460 - DNA, 20 bp, mouse
gtgttctgcagagtgagggt

SEQ ID NO: 744461 - DNA, 20 bp, mouse
gctaataggccctcctctac

SEQ ID NO: 744462 - DNA, 20 bp, mouse
ggagccatcctgtacccaaa

SEQ ID NO: 744463 - DNA, 20 bp, mouse
ggggagccagtggtggaagt

SEQ ID NO: 744464 - DNA, 20 bp, mouse
gggggtgttctgcagagtga

SEQ ID NO: 744465 - DNA, 20 bp, mouse
gaatttgagtgggtgggcaa

SEQ ID NO: 744466 - DNA, 20 bp, mouse
ggccgcgctccgcaacatgg

SEQ ID NO: 744467 - DNA, 20 bp, mouse
ggaggccgacggttgcccga

SEQ ID NO: 744468 - DNA, 20 bp, mouse
gctcgccattggttcggcgg

SEQ ID NO: 744469 - DNA, 20 bp, mouse
gggttcggcggcggtcacgt

SEQ ID NO: 744470 - DNA, 20 bp, mouse
gcggccgctcgccattggtt

SEQ ID NO: 744471 - DNA, 20 bp, mouse
ggtgaccgccgccgaaccaa

SEQ ID NO: 744472 - DNA, 20 bp, mouse
gcgcgccggccgctcgccat

SEQ ID NO: 744473 - DNA, 20 bp, mouse
gccgctcgccattggttcgg

SEQ ID NO: 744474 - DNA, 20 bp, mouse
gctgaccctcgggcaaccgt

SEQ ID NO: 744475 - DNA, 20 bp, mouse
gccttccaaggggtccgcac

SEQ ID NO: 744476 - DNA, 20 bp, mouse
gcctcctccacccgcaatca

SEQ ID NO: 744477 - DNA, 20 bp, mouse
ggcggcggcgccatcttccg

SEQ ID NO: 744478 - DNA, 20 bp, mouse
gcaagctgccctgtggacta

SEQ ID NO: 744479 - DNA, 20 bp, mouse
ggcagggagccgtagtccac

SEQ ID NO: 744480 - DNA, 20 bp, mouse
gaacaaaaagacagcaaggg

SEQ ID NO: 744481 - DNA, 20 bp, mouse
gtggcagttaccctgattgc

SEQ ID NO: 744482 - DNA, 20 bp, mouse
gagggtaactgccaaacccc

SEQ ID NO: 744483 - DNA, 20 bp, mouse
ggccaaaccccgggttttac

SEQ ID NO: 744484 - DNA, 20 bp, mouse
gccaaggagactacaaattc

SEQ ID NO: 744485 - DNA, 20 bp, mouse
gtgcctcgcaagctgccctg

SEQ ID NO: 744486 - DNA, 20 bp, mouse
gaggcctctccgctccagtt

SEQ ID NO: 744487 - DNA, 20 bp, mouse
gcctccctgccgggttaatg

SEQ ID NO: 744488 - DNA, 20 bp, mouse
ggggtaccaaggtttcttcc

SEQ ID NO: 744489 - DNA, 20 bp, mouse
gaaacagaaaccaaggttga

SEQ ID NO: 744490 - DNA, 20 bp, mouse
gtcgccgaactggagcggag

SEQ ID NO: 744491 - DNA, 20 bp, mouse
gaccaaggttgaagggtgtg

SEQ ID NO: 744492 - DNA, 20 bp, mouse
gaagaaaccttggtacccat

SEQ ID NO: 744493 - DNA, 20 bp, mouse
gctggtctcccatgtcactc

SEQ ID NO: 744494 - DNA, 20 bp, mouse
ggttcggcgaatgactccga

SEQ ID NO: 744495 - DNA, 20 bp, mouse
ggtctcccatgtcactctgg

SEQ ID NO: 744496 - DNA, 20 bp, mouse
ggcaggccgggctttggcat

SEQ ID NO: 744497 - DNA, 20 bp, mouse
gatagaggataggggctggg

SEQ ID NO: 744498 - DNA, 20 bp, mouse
ggcaaggaaaagtgccctcg

SEQ ID NO: 744499 - DNA, 20 bp, mouse
gtgtccttgatagaggatag

SEQ ID NO: 744500 - DNA, 20 bp, mouse
gcctcctaccagcttgttaa

SEQ ID NO: 744501 - DNA, 20 bp, mouse
gcagcccctatcctctatca

SEQ ID NO: 744502 - DNA, 20 bp, mouse
gacgcctgggtgcttgaaga

SEQ ID NO: 744503 - DNA, 20 bp, mouse
ggcacccaggcgttcgagga

SEQ ID NO: 744504 - DNA, 20 bp, mouse
gctgctatcagaagccccga

SEQ ID NO: 744505 - DNA, 20 bp, mouse
ggcaaagagatggattctaa

SEQ ID NO: 744506 - DNA, 20 bp, mouse
gctgccgccagcagatggag

SEQ ID NO: 744507 - DNA, 20 bp, mouse
gggagttcgctctttgaaag

SEQ ID NO: 744508 - DNA, 20 bp, mouse
ggcagctaatcccgcaggga

SEQ ID NO: 744509 - DNA, 20 bp, mouse
gcgaactccagcggtgaggc

SEQ ID NO: 744510 - DNA, 20 bp, mouse
gcgctctttgaaagaggcta

SEQ ID NO: 744511 - DNA, 20 bp, mouse
gttcaaagagcgaactccag

SEQ ID NO: 744512 - DNA, 20 bp, mouse
gatcccgcagggagggtgtc

SEQ ID NO: 744513 - DNA, 20 bp, mouse
gtgggagggaccacgttgtc

SEQ ID NO: 744514 - DNA, 20 bp, mouse
gagagggccagcctcaccgc

SEQ ID NO: 744515 - DNA, 20 bp, mouse
gagagcgaactccagcggtg

SEQ ID NO: 744516 - DNA, 20 bp, mouse
ggctgtacttgactgagctg

SEQ ID NO: 744517 - DNA, 20 bp, mouse
gaaagcctggatctgtctcg

SEQ ID NO: 744518 - DNA, 20 bp, mouse
ggctgcttttgcactttccg

SEQ ID NO: 744519 - DNA, 20 bp, mouse
gtgggcgagtcctggaggta

SEQ ID NO: 744520 - DNA, 20 bp, mouse
ggcagccacgagacagatcc

SEQ ID NO: 744521 - DNA, 20 bp, mouse
ggctccaaaggagaagggta

SEQ ID NO: 744522 - DNA, 20 bp, mouse
gtcaagcaagctagcgagca

SEQ ID NO: 744523 - DNA, 20 bp, mouse
gaacgggggcattttggaat

SEQ ID NO: 744524 - DNA, 20 bp, mouse
gaaagagctccaaaggagaa

SEQ ID NO: 744525 - DNA, 20 bp, mouse
gcttttgcactttccgaggg

SEQ ID NO: 744526 - DNA, 20 bp, mouse
gcggggtcggggcacgagaa

SEQ ID NO: 744527 - DNA, 20 bp, mouse
gctcccgggccgcaggtcgc

SEQ ID NO: 744528 - DNA, 20 bp, mouse
ggcagagccggggagtagtt

SEQ ID NO: 744529 - DNA, 20 bp, mouse
gtacgaggacgcacggagtg

SEQ ID NO: 744530 - DNA, 20 bp, mouse
ggggccgcaggtcgcgggag

SEQ ID NO: 744531 - DNA, 20 bp, mouse
gtgagggtcgctgacgtcgg

SEQ ID NO: 744532 - DNA, 20 bp, mouse
gcagcagcggggcagccgat

SEQ ID NO: 744533 - DNA, 20 bp, mouse
gtgactgaaacgagactcgg

SEQ ID NO: 744534 - DNA, 20 bp, mouse
gagcctgcaccgccgctccc

SEQ ID NO: 744535 - DNA, 20 bp, mouse
gccgggagcgctggaccgat

SEQ ID NO: 744536 - DNA, 20 bp, mouse
gggggcggggctactgtcga

SEQ ID NO: 744537 - DNA, 20 bp, mouse
gaaggcgggtagaggcggga

SEQ ID NO: 744538 - DNA, 20 bp, mouse
ggcgggaaggatgccggctg

SEQ ID NO: 744539 - DNA, 20 bp, mouse
gtgggaaggcgggtagaggc

SEQ ID NO: 744540 - DNA, 20 bp, mouse
gtcccgagagagcccgggac

SEQ ID NO: 744541 - DNA, 20 bp, mouse
ggagcccgggactgggaagg

SEQ ID NO: 744542 - DNA, 20 bp, mouse
gaagctgggaccggcccgta

SEQ ID NO: 744543 - DNA, 20 bp, mouse
gtctctggtcagaattatct

SEQ ID NO: 744544 - DNA, 20 bp, mouse
gcccagtcccgggctctctc

SEQ ID NO: 744545 - DNA, 20 bp, mouse
gcctccacgccactaccctc

SEQ ID NO: 744546 - DNA, 20 bp, mouse
ggaaacttgaggacattcca

SEQ ID NO: 744547 - DNA, 20 bp, mouse
ggcagcgctccaagattccc

SEQ ID NO: 744548 - DNA, 20 bp, mouse
gtagcagggaccgggaggtg

SEQ ID NO: 744549 - DNA, 20 bp, mouse
gtggcccccttgtctttaaa

SEQ ID NO: 744550 - DNA, 20 bp, mouse
gaggcccgccccctggcttg

SEQ ID NO: 744551 - DNA, 20 bp, mouse
gggcagaagccgcaggacac

SEQ ID NO: 744552 - DNA, 20 bp, mouse
gcgccccctggcttggggat

SEQ ID NO: 744553 - DNA, 20 bp, mouse
ggaagccaatccccaagcca

SEQ ID NO: 744554 - DNA, 20 bp, mouse
gaggacattccagggaatct

SEQ ID NO: 744555 - DNA, 20 bp, mouse
gtgcacgctcaccacctctc

SEQ ID NO: 744556 - DNA, 20 bp, mouse
gacaaagaatgtcacatcag

SEQ ID NO: 744557 - DNA, 20 bp, mouse
gatcaggcacaagctaaata

SEQ ID NO: 744558 - DNA, 20 bp, mouse
ggggccgtgacaatgtggag

SEQ ID NO: 744559 - DNA, 20 bp, mouse
gcacaagctaaatatggctc

SEQ ID NO: 744560 - DNA, 20 bp, mouse
gggaggtctcagaaccagca

SEQ ID NO: 744561 - DNA, 20 bp, mouse
ggtggagagggtgaaggcat

SEQ ID NO: 744562 - DNA, 20 bp, mouse
gttagcttgtgcctgatagc

SEQ ID NO: 744563 - DNA, 20 bp, mouse
gaagaatgtcacatcagtgg

SEQ ID NO: 744564 - DNA, 20 bp, mouse
gatgtcacatcagtggtgga

SEQ ID NO: 744565 - DNA, 20 bp, mouse
ggcggagtgtctcagatagg

SEQ ID NO: 744566 - DNA, 20 bp, mouse
ggggctagacagcgagtagc

SEQ ID NO: 744567 - DNA, 20 bp, mouse
ggatctagagcatggggtgt

SEQ ID NO: 744568 - DNA, 20 bp, mouse
gacagcgagtagccgggcta

SEQ ID NO: 744569 - DNA, 20 bp, mouse
gggtgtgggctccctggggt

SEQ ID NO: 744570 - DNA, 20 bp, mouse
gccccgggagatctagagca

SEQ ID NO: 744571 - DNA, 20 bp, mouse
gatggggtgtgggctccctg

SEQ ID NO: 744572 - DNA, 20 bp, mouse
gcgggctatggaatctctgc

SEQ ID NO: 744573 - DNA, 20 bp, mouse
gtgactcaagttgccaaaaa

SEQ ID NO: 744574 - DNA, 20 bp, mouse
gtctgggcagagtcaagttg

SEQ ID NO: 744575 - DNA, 20 bp, mouse
ggctcaccggccaccttcag

SEQ ID NO: 744576 - DNA, 20 bp, mouse
gcagacagaggaatgaggcg

SEQ ID NO: 744577 - DNA, 20 bp, mouse
gccaccctctcagccatagg

SEQ ID NO: 744578 - DNA, 20 bp, mouse
gtaacatcgacaattatttt

SEQ ID NO: 744579 - DNA, 20 bp, mouse
gatcgccaccttgccgccta

SEQ ID NO: 744580 - DNA, 20 bp, mouse
gtcagccataggcggcaagg

SEQ ID NO: 744581 - DNA, 20 bp, mouse
gctctcagccataggcggca

SEQ ID NO: 744582 - DNA, 20 bp, mouse
ggtcatgtgacgtagagctg

SEQ ID NO: 744583 - DNA, 20 bp, mouse
gggggctcccggagtcagta

SEQ ID NO: 744584 - DNA, 20 bp, mouse
ggtcagtatggattgacgat

SEQ ID NO: 744585 - DNA, 20 bp, mouse
ggccccaccctctcagccat

SEQ ID NO: 744586 - DNA, 20 bp, mouse
ggggcagggtccacagtgcg

SEQ ID NO: 744587 - DNA, 20 bp, mouse
gcccccctccaagggtctgt

SEQ ID NO: 744588 - DNA, 20 bp, mouse
gcccgcccccgaggacaatc

SEQ ID NO: 744589 - DNA, 20 bp, mouse
gcccgaggacaatcgggatt

SEQ ID NO: 744590 - DNA, 20 bp, mouse
gttagcatgtagcacacgtg

SEQ ID NO: 744591 - DNA, 20 bp, mouse
gaactggttcccggttgcat

SEQ ID NO: 744592 - DNA, 20 bp, mouse
gcattggctgccaggcggga

SEQ ID NO: 744593 - DNA, 20 bp, mouse
ggcctggcagccaatgcaac

SEQ ID NO: 744594 - DNA, 20 bp, mouse
gtgggggggggagagaacga

SEQ ID NO: 744595 - DNA, 20 bp, mouse
gcggggttgctggggtaggg

SEQ ID NO: 744596 - DNA, 20 bp, mouse
gaatgggattgcagtgaccg

SEQ ID NO: 744597 - DNA, 20 bp, mouse
gaggaggggaagcctcgcgg

SEQ ID NO: 744598 - DNA, 20 bp, mouse
gaactgaggcaggatcatcg

SEQ ID NO: 744599 - DNA, 20 bp, mouse
ggaagctcacagggagtcgt

SEQ ID NO: 744600 - DNA, 20 bp, mouse
gaggcaggatcatcgtggaa

SEQ ID NO: 744601 - DNA, 20 bp, mouse
gcctcctcgctagaccaaca

SEQ ID NO: 744602 - DNA, 20 bp, mouse
ggcgcagcacggctcactgg

SEQ ID NO: 744603 - DNA, 20 bp, mouse
gggggagtgagcacgcaaag

SEQ ID NO: 744604 - DNA, 20 bp, mouse
gcgcccggcctgtcaccctc

SEQ ID NO: 744605 - DNA, 20 bp, mouse
ggctcactgggggcacgggg

SEQ ID NO: 744606 - DNA, 20 bp, mouse
ggatcccaccactagaacta

SEQ ID NO: 744607 - DNA, 20 bp, mouse
gtatactaatgtggccccta

SEQ ID NO: 744608 - DNA, 20 bp, mouse
ggcggagtcggtcttggaat

SEQ ID NO: 744609 - DNA, 20 bp, mouse
gaatgggaaacctggggaca

SEQ ID NO: 744610 - DNA, 20 bp, mouse
gctagtggtgggatccctag

SEQ ID NO: 744611 - DNA, 20 bp, mouse
gagtaccatagttctagtgg

SEQ ID NO: 744612 - DNA, 20 bp, mouse
ggggccacattagtatagga

SEQ ID NO: 744613 - DNA, 20 bp, mouse
ggttggtcccggcttggccc

SEQ ID NO: 744614 - DNA, 20 bp, mouse
gttaggagaacgcagttagg

SEQ ID NO: 744615 - DNA, 20 bp, mouse
ggccactgggatatcggacc

SEQ ID NO: 744616 - DNA, 20 bp, mouse
gggcgtcgcagcagggtccc

SEQ ID NO: 744617 - DNA, 20 bp, mouse
ggcggggcgcagcaggccgc

SEQ ID NO: 744618 - DNA, 20 bp, mouse
ggagcgcgcctggagccccg

SEQ ID NO: 744619 - DNA, 20 bp, mouse
gtggcggcggagggatactc

SEQ ID NO: 744620 - DNA, 20 bp, mouse
gtcgcagcagggtcccgggc

SEQ ID NO: 744621 - DNA, 20 bp, mouse
gctcgggcgcaccatggcac

SEQ ID NO: 744622 - DNA, 20 bp, mouse
gggtgcaggggcggccccgc

SEQ ID NO: 744623 - DNA, 20 bp, mouse
gaggaggggtgaggcggctc

SEQ ID NO: 744624 - DNA, 20 bp, mouse
ggccccagctctaaaccgag

SEQ ID NO: 744625 - DNA, 20 bp, mouse
ggggcgcgggcgtcgcagca

SEQ ID NO: 744626 - DNA, 20 bp, mouse
gtcagagcggcgggtgtggc

SEQ ID NO: 744627 - DNA, 20 bp, mouse
gccggccggatcacgtgatg

SEQ ID NO: 744628 - DNA, 20 bp, mouse
gcgttggtgcctcagagcgg

SEQ ID NO: 744629 - DNA, 20 bp, mouse
gcaggagcgcggggtttgat

SEQ ID NO: 744630 - DNA, 20 bp, mouse
ggctcccccatcacgtgatc

SEQ ID NO: 744631 - DNA, 20 bp, mouse
gacagctgatctgggatctc

SEQ ID NO: 744632 - DNA, 20 bp, mouse
gctaaagccctcatggggta

SEQ ID NO: 744633 - DNA, 20 bp, mouse
gcaaaggggagggacgttga

SEQ ID NO: 744634 - DNA, 20 bp, mouse
ggggagttgttcatgagaaa

SEQ ID NO: 744635 - DNA, 20 bp, mouse
ggctctgaggcaccaacggc

SEQ ID NO: 744636 - DNA, 20 bp, mouse
gcctgggcggagtgggccta

SEQ ID NO: 744637 - DNA, 20 bp, mouse
gccactccgcccaggggcgg

SEQ ID NO: 744638 - DNA, 20 bp, mouse
gcctccccgccgcccctggg

SEQ ID NO: 744639 - DNA, 20 bp, mouse
gggcccactccgcccagggg

SEQ ID NO: 744640 - DNA, 20 bp, mouse
gcggtctctacgtgtctcgt

SEQ ID NO: 744641 - DNA, 20 bp, mouse
ggcaaaggcgcgagtactag

SEQ ID NO: 744642 - DNA, 20 bp, mouse
gtgctgcaaaagacccactg

SEQ ID NO: 744643 - DNA, 20 bp, mouse
gccgcagagctgtagtaccc

SEQ ID NO: 744644 - DNA, 20 bp, mouse
ggcggctagaagtgagctcc

SEQ ID NO: 744645 - DNA, 20 bp, mouse
gggggacgaagcagtgagtg

SEQ ID NO: 744646 - DNA, 20 bp, mouse
ggggactaaaacatccccag

SEQ ID NO: 744647 - DNA, 20 bp, mouse
ggtagtcaggtaattgacgg

SEQ ID NO: 744648 - DNA, 20 bp, mouse
ggacgggggcggagcctctg

SEQ ID NO: 744649 - DNA, 20 bp, mouse
gtacctgctccaaggtagtc

SEQ ID NO: 744650 - DNA, 20 bp, mouse
gctgtgacatcacggaagtc

SEQ ID NO: 744651 - DNA, 20 bp, mouse
gtacctgactaccttggagc

SEQ ID NO: 744652 - DNA, 20 bp, mouse
ggaagaagaagggtattggt

SEQ ID NO: 744653 - DNA, 20 bp, mouse
gcaggaaatctgtgacatca

SEQ ID NO: 744654 - DNA, 20 bp, mouse
gaaggtagtcaggtaattga

SEQ ID NO: 744655 - DNA, 20 bp, mouse
gacacgtgctatgctcagaa

SEQ ID NO: 744656 - DNA, 20 bp, mouse
gcaaaggcgggactaagagc

SEQ ID NO: 744657 - DNA, 20 bp, mouse
ggcccggcgcggcgctccag

SEQ ID NO: 744658 - DNA, 20 bp, mouse
ggcccctcgaactccttgat

SEQ ID NO: 744659 - DNA, 20 bp, mouse
gcgggcgtgggacagctgaa

SEQ ID NO: 744660 - DNA, 20 bp, mouse
gaactccttgattggtcgag

SEQ ID NO: 744661 - DNA, 20 bp, mouse
gacgcacctgagccaatcaa

SEQ ID NO: 744662 - DNA, 20 bp, mouse
gaacgcgctcactctaacac

SEQ ID NO: 744663 - DNA, 20 bp, mouse
ggaccaatcaaggagttcga

SEQ ID NO: 744664 - DNA, 20 bp, mouse
gtaacacgggggtgatgagc

SEQ ID NO: 744665 - DNA, 20 bp, mouse
gcacctgagccaatcaacgg

SEQ ID NO: 744666 - DNA, 20 bp, mouse
ggtcccgcctccaaacccga

SEQ ID NO: 744667 - DNA, 20 bp, mouse
gcggcgctgctgtcattcac

SEQ ID NO: 744668 - DNA, 20 bp, mouse
gccgccccacccctcgggtt

SEQ ID NO: 744669 - DNA, 20 bp, mouse
gcctccaaacccgaggggtg

SEQ ID NO: 744670 - DNA, 20 bp, mouse
gaatgcgcggccttcagttc

SEQ ID NO: 744671 - DNA, 20 bp, mouse
gggcaagagacgcgcgctgg

SEQ ID NO: 744672 - DNA, 20 bp, mouse
gggggcggcgctgccttaaa

SEQ ID NO: 744673 - DNA, 20 bp, mouse
gcggggcaagagacgcgcgc

SEQ ID NO: 744674 - DNA, 20 bp, mouse
gtggccgggccggcaatgcg

SEQ ID NO: 744675 - DNA, 20 bp, mouse
gcggccttcagttccgggtt

SEQ ID NO: 744676 - DNA, 20 bp, mouse
gtggttcaaggctcagagcg

SEQ ID NO: 744677 - DNA, 20 bp, mouse
ggggggcgctccaccaggca

SEQ ID NO: 744678 - DNA, 20 bp, mouse
ggagaggcggagcttgaata

SEQ ID NO: 744679 - DNA, 20 bp, mouse
ggggatgggagggcggagta

SEQ ID NO: 744680 - DNA, 20 bp, mouse
gggcgagcacaggctacgtg

SEQ ID NO: 744681 - DNA, 20 bp, mouse
gtggctgcgccgaggatgtc

SEQ ID NO: 744682 - DNA, 20 bp, mouse
gggcgtggtcagagggagac

SEQ ID NO: 744683 - DNA, 20 bp, mouse
gcccgagcgcgtccgggtcg

SEQ ID NO: 744684 - DNA, 20 bp, mouse
ggcttggagttggacggcaa

SEQ ID NO: 744685 - DNA, 20 bp, mouse
gagcagagatgacgtaagtg

SEQ ID NO: 744686 - DNA, 20 bp, mouse
ggggcgagtccgaagcgtcc

SEQ ID NO: 744687 - DNA, 20 bp, mouse
gggcccgcccacaacccttc

SEQ ID NO: 744688 - DNA, 20 bp, mouse
gaacagcagcacatggcccg

SEQ ID NO: 744689 - DNA, 20 bp, mouse
ggggagagtgacagaccgga

SEQ ID NO: 744690 - DNA, 20 bp, mouse
gcctccggaagggttgtggg

SEQ ID NO: 744691 - DNA, 20 bp, mouse
gggaagcggcggcaggcctg

SEQ ID NO: 744692 - DNA, 20 bp, mouse
gaagcgtccgggcagaagtc

SEQ ID NO: 744693 - DNA, 20 bp, mouse
ggcggcctccggaagggttg

SEQ ID NO: 744694 - DNA, 20 bp, mouse
gcaccgcagccgtcactcga

SEQ ID NO: 744695 - DNA, 20 bp, mouse
ggatgcagccagaaattgag

SEQ ID NO: 744696 - DNA, 20 bp, mouse
ggtaaccgaggtccatcccc

SEQ ID NO: 744697 - DNA, 20 bp, mouse
gtgcacagcgcccaagttat

SEQ ID NO: 744698 - DNA, 20 bp, mouse
gacaagaggtgtcagctcga

SEQ ID NO: 744699 - DNA, 20 bp, mouse
gatccccaggcctataactt

SEQ ID NO: 744700 - DNA, 20 bp, mouse
gtctggccggccgtaaccca

SEQ ID NO: 744701 - DNA, 20 bp, mouse
gtccccagcggggatctaat

SEQ ID NO: 744702 - DNA, 20 bp, mouse
ggatggacctcggttacaag

SEQ ID NO: 744703 - DNA, 20 bp, mouse
gcgcccaagttataggcctg

SEQ ID NO: 744704 - DNA, 20 bp, mouse
gctgacacctcttgtaaccg

SEQ ID NO: 744705 - DNA, 20 bp, mouse
gctcaggtgctgcaggtttg

SEQ ID NO: 744706 - DNA, 20 bp, mouse
gcatgctcttcccgccgctg

SEQ ID NO: 744707 - DNA, 20 bp, mouse
gcacgcgcggggccgcctgc

SEQ ID NO: 744708 - DNA, 20 bp, mouse
gatgctgcatagatgaccct

SEQ ID NO: 744709 - DNA, 20 bp, mouse
ggcacgaccttattatctta

SEQ ID NO: 744710 - DNA, 20 bp, mouse
gctgcgcaacgactccgcag

SEQ ID NO: 744711 - DNA, 20 bp, mouse
gacgtcagccaagtgaccgt

SEQ ID NO: 744712 - DNA, 20 bp, mouse
gggagggtcacgaggacact

SEQ ID NO: 744713 - DNA, 20 bp, mouse
gggacgccggcgctgtgagg

SEQ ID NO: 744714 - DNA, 20 bp, mouse
gggcgaccacctcacagcgc

SEQ ID NO: 744715 - DNA, 20 bp, mouse
gtatcttagggatgatctaa

SEQ ID NO: 744716 - DNA, 20 bp, mouse
ggcggggggactccaacaag

SEQ ID NO: 744717 - DNA, 20 bp, mouse
ggctttgcgcttgcttcttt

SEQ ID NO: 744718 - DNA, 20 bp, mouse
ggaccggcctctctcgggcg

SEQ ID NO: 744719 - DNA, 20 bp, mouse
gggcacttaacgctcttcta

SEQ ID NO: 744720 - DNA, 20 bp, mouse
gaacccaggagcttcagcag

SEQ ID NO: 744721 - DNA, 20 bp, mouse
gacctctccccagtccagaa

SEQ ID NO: 744722 - DNA, 20 bp, mouse
gcagcgtggtaggagtcacg

SEQ ID NO: 744723 - DNA, 20 bp, mouse
ggaacaaatgaggacttctt

SEQ ID NO: 744724 - DNA, 20 bp, mouse
gtgtgattttgggtcctttc

SEQ ID NO: 744725 - DNA, 20 bp, mouse
ggactggagccgatagggac

SEQ ID NO: 744726 - DNA, 20 bp, mouse
gaggcagtttggtgtatgac

SEQ ID NO: 744727 - DNA, 20 bp, mouse
gaaccagagggctattctag

SEQ ID NO: 744728 - DNA, 20 bp, mouse
ggggatagggataggcagtt

SEQ ID NO: 744729 - DNA, 20 bp, mouse
gcactgttacatcagagaag

SEQ ID NO: 744730 - DNA, 20 bp, mouse
ggcaggttggtcattagaga

SEQ ID NO: 744731 - DNA, 20 bp, mouse
gctcctccctgtgattgcag

SEQ ID NO: 744732 - DNA, 20 bp, mouse
gtccctgtgattgcagggga

SEQ ID NO: 744733 - DNA, 20 bp, mouse
gaaattcttgggatagggat

SEQ ID NO: 744734 - DNA, 20 bp, mouse
gagggctattctagaggatt

SEQ ID NO: 744735 - DNA, 20 bp, mouse
gctctgatgtaacagtgagc

SEQ ID NO: 744736 - DNA, 20 bp, mouse
gtccctgtgcaacgtgtctg

SEQ ID NO: 744737 - DNA, 20 bp, mouse
gctgtgcaacgtgtctgggg

SEQ ID NO: 744738 - DNA, 20 bp, mouse
ggttgcacagggagagttaa

SEQ ID NO: 744739 - DNA, 20 bp, mouse
gattaagtcgagtgtgtctc

SEQ ID NO: 744740 - DNA, 20 bp, mouse
gtgattggaaacgtgcaagg

SEQ ID NO: 744741 - DNA, 20 bp, mouse
gttggcttgggcccatggcc

SEQ ID NO: 744742 - DNA, 20 bp, mouse
gaggaggtggggagagtggt

SEQ ID NO: 744743 - DNA, 20 bp, mouse
gtacgtgaacaaatagcgga

SEQ ID NO: 744744 - DNA, 20 bp, mouse
gtggagaggcgggaagcagg

SEQ ID NO: 744745 - DNA, 20 bp, mouse
gacgaaggcagccaggccat

SEQ ID NO: 744746 - DNA, 20 bp, mouse
gtcccacctggcctcacgac

SEQ ID NO: 744747 - DNA, 20 bp, mouse
gcccctccaggccactccaa

SEQ ID NO: 744748 - DNA, 20 bp, mouse
gccactccaagggcatgtag

SEQ ID NO: 744749 - DNA, 20 bp, mouse
gtagtgtgcagtgctctcat

SEQ ID NO: 744750 - DNA, 20 bp, mouse
gcacgacagggagggagacg

SEQ ID NO: 744751 - DNA, 20 bp, mouse
gcgtgaggccaggtgggaag

SEQ ID NO: 744752 - DNA, 20 bp, mouse
gggggaggaaggacccctcc

SEQ ID NO: 744753 - DNA, 20 bp, mouse
gtctgcaaaggggagtgacg

SEQ ID NO: 744754 - DNA, 20 bp, mouse
gtgcccttggagtggcctgg

SEQ ID NO: 744755 - DNA, 20 bp, mouse
gccctgtcgtgaggccaggt

SEQ ID NO: 744756 - DNA, 20 bp, mouse
gctaagggagcactgatctg

SEQ ID NO: 744757 - DNA, 20 bp, mouse
gaccaggcctgagtccccag

SEQ ID NO: 744758 - DNA, 20 bp, mouse
ggggccgtagggccccgcgg

SEQ ID NO: 744759 - DNA, 20 bp, mouse
gaatgaggtagggcggagga

SEQ ID NO: 744760 - DNA, 20 bp, mouse
ggggacgggcaggacctcct

SEQ ID NO: 744761 - DNA, 20 bp, mouse
ggggactcaggcctggtaag

SEQ ID NO: 744762 - DNA, 20 bp, mouse
gcctgctggggcctcctccg

SEQ ID NO: 744763 - DNA, 20 bp, mouse
gtgtggggctggccatgtaa

SEQ ID NO: 744764 - DNA, 20 bp, mouse
gggactgagtggaaccagca

SEQ ID NO: 744765 - DNA, 20 bp, mouse
gaggccacatagctaaaacc

SEQ ID NO: 744766 - DNA, 20 bp, mouse
ggtctacccaaagacttctc

SEQ ID NO: 744767 - DNA, 20 bp, mouse
gctcttgcctgagaagtctt

SEQ ID NO: 744768 - DNA, 20 bp, mouse
ggaatgaaatagcctaatgc

SEQ ID NO: 744769 - DNA, 20 bp, mouse
gctttgggtagaccagcatt

SEQ ID NO: 744770 - DNA, 20 bp, mouse
gagctaaaaataaattaagc

SEQ ID NO: 744771 - DNA, 20 bp, mouse
ggggtggggtggatcagcaa

SEQ ID NO: 744772 - DNA, 20 bp, mouse
ggatcagcaagggttggggc

SEQ ID NO: 744773 - DNA, 20 bp, mouse
ggggtggatcagcaagggtt

SEQ ID NO: 744774 - DNA, 20 bp, mouse
ggtgcagaatccactagtgg

SEQ ID NO: 744775 - DNA, 20 bp, mouse
gagagtgcagaatccactag

SEQ ID NO: 744776 - DNA, 20 bp, mouse
gtgggagggaccaacgaaga

SEQ ID NO: 744777 - DNA, 20 bp, mouse
gaggagggaactggcctggc

SEQ ID NO: 744778 - DNA, 20 bp, mouse
gaggggaggggaagatctag

SEQ ID NO: 744779 - DNA, 20 bp, mouse
gggctctaggggacgtggga

SEQ ID NO: 744780 - DNA, 20 bp, mouse
gggaactggcctggccggaa

SEQ ID NO: 744781 - DNA, 20 bp, mouse
ggagggagaaagcggaatgt

SEQ ID NO: 744782 - DNA, 20 bp, mouse
gaagatctagaggagggaac

SEQ ID NO: 744783 - DNA, 20 bp, mouse
gtcattgagccgggaggagt

SEQ ID NO: 744784 - DNA, 20 bp, mouse
gaggcccggcagccgtattc

SEQ ID NO: 744785 - DNA, 20 bp, mouse
ggggagggctctaggggacg

SEQ ID NO: 744786 - DNA, 20 bp, mouse
ggtgggtggcatcagatcta

SEQ ID NO: 744787 - DNA, 20 bp, mouse
gagggaattcccaccctggg

SEQ ID NO: 744788 - DNA, 20 bp, mouse
gtccttgtcttcaaaggtca

SEQ ID NO: 744789 - DNA, 20 bp, mouse
gaagacaaggaaccttccag

SEQ ID NO: 744790 - DNA, 20 bp, mouse
gtctgggccagcatcctatg

SEQ ID NO: 744791 - DNA, 20 bp, mouse
gttaactagagaccgggcta

SEQ ID NO: 744792 - DNA, 20 bp, mouse
gaggtcacatttactgtctt

SEQ ID NO: 744793 - DNA, 20 bp, mouse
gtagtccggagagctgaatg

SEQ ID NO: 744794 - DNA, 20 bp, mouse
gcaacactctaagcctcaag

SEQ ID NO: 744795 - DNA, 20 bp, mouse
gtcacatttactgtcttggg

SEQ ID NO: 744796 - DNA, 20 bp, mouse
ggtcccccgccatgcgtctc

SEQ ID NO: 744797 - DNA, 20 bp, mouse
gcaggcgcgcagctcgggac

SEQ ID NO: 744798 - DNA, 20 bp, mouse
ggagtcccggagacgcatgg

SEQ ID NO: 744799 - DNA, 20 bp, mouse
gcaggcgctgcggggagcgt

SEQ ID NO: 744800 - DNA, 20 bp, mouse
gggccaagttgggaagtccc

SEQ ID NO: 744801 - DNA, 20 bp, mouse
gtgggaagtcccaggcgctg

SEQ ID NO: 744802 - DNA, 20 bp, mouse
gggaaggcccggacttgggg

SEQ ID NO: 744803 - DNA, 20 bp, mouse
ggggcctgcgacctcccccg

SEQ ID NO: 744804 - DNA, 20 bp, mouse
gtcccggagacgcatggcgg

SEQ ID NO: 744805 - DNA, 20 bp, mouse
gcggggctgcccgtgcacac

SEQ ID NO: 744806 - DNA, 20 bp, mouse
gcacgcgcacggctacaaag

SEQ ID NO: 744807 - DNA, 20 bp, mouse
gctagcaggtaaagacacgg

SEQ ID NO: 744808 - DNA, 20 bp, mouse
gagccgatcgcgccgatggg

SEQ ID NO: 744809 - DNA, 20 bp, mouse
gacaacccggagcctacgga

SEQ ID NO: 744810 - DNA, 20 bp, mouse
gctacaaagcggcgggtggt

SEQ ID NO: 744811 - DNA, 20 bp, mouse
ggtgtcccttggcgcggcgc

SEQ ID NO: 744812 - DNA, 20 bp, mouse
gcgatcgcgccgatgggagg

SEQ ID NO: 744813 - DNA, 20 bp, mouse
gcgcacggctacaaagcggc

SEQ ID NO: 744814 - DNA, 20 bp, mouse
gcgaccgccccgcctcccat

SEQ ID NO: 744815 - DNA, 20 bp, mouse
gaaagcgccagaaggaggag

SEQ ID NO: 744816 - DNA, 20 bp, mouse
gggtgccccacgtgggaaaa

SEQ ID NO: 744817 - DNA, 20 bp, mouse
gggggcttgcagctcggtaa

SEQ ID NO: 744818 - DNA, 20 bp, mouse
ggaaagtcccacccccacgt

SEQ ID NO: 744819 - DNA, 20 bp, mouse
gggcaagcacgtgagatgtg

SEQ ID NO: 744820 - DNA, 20 bp, mouse
gtagaaagggtgccccacgt

SEQ ID NO: 744821 - DNA, 20 bp, mouse
gccccaagggccaagagcta

SEQ ID NO: 744822 - DNA, 20 bp, mouse
ggggctgtgtgctgcgaacc

SEQ ID NO: 744823 - DNA, 20 bp, mouse
ggcaggctggggcgagactt

SEQ ID NO: 744824 - DNA, 20 bp, mouse
gaagcacgtgagatgtgcgg

SEQ ID NO: 744825 - DNA, 20 bp, mouse
ggtgaaatgaccacagtttc

SEQ ID NO: 744826 - DNA, 20 bp, mouse
ggaggcgctctgccttggtt

SEQ ID NO: 744827 - DNA, 20 bp, mouse
gggcaccaggtccccaacca

SEQ ID NO: 744828 - DNA, 20 bp, mouse
gccaaggcagagcgcctcca

SEQ ID NO: 744829 - DNA, 20 bp, mouse
gctcccgtgggaacttgcag

SEQ ID NO: 744830 - DNA, 20 bp, mouse
gactacctaaggtcccctaa

SEQ ID NO: 744831 - DNA, 20 bp, mouse
ggaaggccagcggtccatgg

SEQ ID NO: 744832 - DNA, 20 bp, mouse
gggccaggctcggatcggca

SEQ ID NO: 744833 - DNA, 20 bp, mouse
ggcagaaggccagcggtcca

SEQ ID NO: 744834 - DNA, 20 bp, mouse
gccgccggccaggctcggat

SEQ ID NO: 744835 - DNA, 20 bp, mouse
gagctctgagagactaccta

SEQ ID NO: 744836 - DNA, 20 bp, mouse
ggccgccgggggaactcttg

SEQ ID NO: 744837 - DNA, 20 bp, mouse
gagcgattggtggtgactaa

SEQ ID NO: 744838 - DNA, 20 bp, mouse
gaggggattgggcgggatca

SEQ ID NO: 744839 - DNA, 20 bp, mouse
ggaagcacaggggattgggc

SEQ ID NO: 744840 - DNA, 20 bp, mouse
gctatgaagcacaggggatt

SEQ ID NO: 744841 - DNA, 20 bp, mouse
gtacaattctaatgagaagg

SEQ ID NO: 744842 - DNA, 20 bp, mouse
gtcttcagtccagcgattgg

SEQ ID NO: 744843 - DNA, 20 bp, mouse
gtggataaggaggcattatt

SEQ ID NO: 744844 - DNA, 20 bp, mouse
gacttcttcagtccagcgat

SEQ ID NO: 744845 - DNA, 20 bp, mouse
gaaaaggcccaaagtcttgc

SEQ ID NO: 744846 - DNA, 20 bp, mouse
gtgactctgtggggttggtt

SEQ ID NO: 744847 - DNA, 20 bp, mouse
gtcacctaactctgcaacta

SEQ ID NO: 744848 - DNA, 20 bp, mouse
ggggttggttgggtgagtgc

SEQ ID NO: 744849 - DNA, 20 bp, mouse
gggtaaggttggattttcac

SEQ ID NO: 744850 - DNA, 20 bp, mouse
gcacctagctgacccaagag

SEQ ID NO: 744851 - DNA, 20 bp, mouse
gcaaagctctttgactctgt

SEQ ID NO: 744852 - DNA, 20 bp, mouse
gtcatcaggtatcagtgggt

SEQ ID NO: 744853 - DNA, 20 bp, mouse
gagaagcaagctctaaaagc

SEQ ID NO: 744854 - DNA, 20 bp, mouse
gccaggagcaggtcctacca

SEQ ID NO: 744855 - DNA, 20 bp, mouse
gttcccggaaactgcacatc

SEQ ID NO: 744856 - DNA, 20 bp, mouse
ggggacacagagagtgtggt

SEQ ID NO: 744857 - DNA, 20 bp, mouse
gccccagcacgcagccaata

SEQ ID NO: 744858 - DNA, 20 bp, mouse
gtggccctgtgaaggcagga

SEQ ID NO: 744859 - DNA, 20 bp, mouse
gtgtgcccacaattacctgt

SEQ ID NO: 744860 - DNA, 20 bp, mouse
gttccccatgctcggctcag

SEQ ID NO: 744861 - DNA, 20 bp, mouse
ggctcctctgagccgagcat

SEQ ID NO: 744862 - DNA, 20 bp, mouse
gtgtccctcctgccttcaca

SEQ ID NO: 744863 - DNA, 20 bp, mouse
gctatcccacaggtaattgt

SEQ ID NO: 744864 - DNA, 20 bp, mouse
gagcatggggaacagtgtgc

SEQ ID NO: 744865 - DNA, 20 bp, mouse
gtgccttattggctgcgtgc

SEQ ID NO: 744866 - DNA, 20 bp, mouse
gtacctaggaggcttgcaaa

SEQ ID NO: 744867 - DNA, 20 bp, mouse
gtatgccaaaatgctttccg

SEQ ID NO: 744868 - DNA, 20 bp, mouse
ggaccatttgcaagcctcct

SEQ ID NO: 744869 - DNA, 20 bp, mouse
gaaaggaactgcaaacaact

SEQ ID NO: 744870 - DNA, 20 bp, mouse
gaaagcaaatcaaaccactt

SEQ ID NO: 744871 - DNA, 20 bp, mouse
gaatctgataatgtgtctgc

SEQ ID NO: 744872 - DNA, 20 bp, mouse
ggtctgctgggaatgtacct

SEQ ID NO: 744873 - DNA, 20 bp, mouse
ggaaatgtaggcgatatgag

SEQ ID NO: 744874 - DNA, 20 bp, mouse
gctggctgcccagctgagtt

SEQ ID NO: 744875 - DNA, 20 bp, mouse
gagttaacacccaactcagc

SEQ ID NO: 744876 - DNA, 20 bp, mouse
gaatgcgcctgcgcgtctta

SEQ ID NO: 744877 - DNA, 20 bp, mouse
gcagcgttgcgctgagaagt

SEQ ID NO: 744878 - DNA, 20 bp, mouse
ggggaggggcggcgtgacgt

SEQ ID NO: 744879 - DNA, 20 bp, mouse
ggccccgcccagaccgctct

SEQ ID NO: 744880 - DNA, 20 bp, mouse
gcgccatcgagggagaagat

SEQ ID NO: 744881 - DNA, 20 bp, mouse
ggggcggcgtgacgtgggtg

SEQ ID NO: 744882 - DNA, 20 bp, mouse
gttaaggctcctggacttag

SEQ ID NO: 744883 - DNA, 20 bp, mouse
ggattacaatggttagggga

SEQ ID NO: 744884 - DNA, 20 bp, mouse
gtctgggcggggcaccccgt

SEQ ID NO: 744885 - DNA, 20 bp, mouse
gcctacacatgcaaattcgc

SEQ ID NO: 744886 - DNA, 20 bp, mouse
gaagccgggagcggcgcctg

SEQ ID NO: 744887 - DNA, 20 bp, mouse
gtactagattgggatccaag

SEQ ID NO: 744888 - DNA, 20 bp, mouse
gcggagggcggggcagctag

SEQ ID NO: 744889 - DNA, 20 bp, mouse
gagcccggggtgcgtcccgg

SEQ ID NO: 744890 - DNA, 20 bp, mouse
ggccctccgggacgcacccc

SEQ ID NO: 744891 - DNA, 20 bp, mouse
gcagagcccggggtgcgtcc

SEQ ID NO: 744892 - DNA, 20 bp, mouse
gccgctcccggcttctgcgc

SEQ ID NO: 744893 - DNA, 20 bp, mouse
ggggagcggcgcctggggct

SEQ ID NO: 744894 - DNA, 20 bp, mouse
gctgggaggagaggtagcca

SEQ ID NO: 744895 - DNA, 20 bp, mouse
gtccaaaagcaggttcctag

SEQ ID NO: 744896 - DNA, 20 bp, mouse
ggatcagtgctgctctagtc

SEQ ID NO: 744897 - DNA, 20 bp, mouse
ggaaagctgagggagtagaa

SEQ ID NO: 744898 - DNA, 20 bp, mouse
gtgtataacaaggcacagaa

SEQ ID NO: 744899 - DNA, 20 bp, mouse
gtgtcttgggatagcctctc

SEQ ID NO: 744900 - DNA, 20 bp, mouse
gaacggtgcattgtataaca

SEQ ID NO: 744901 - DNA, 20 bp, mouse
gtcagggctgtccactgtct

SEQ ID NO: 744902 - DNA, 20 bp, mouse
gtgactaagaccatggatga

SEQ ID NO: 744903 - DNA, 20 bp, mouse
gatagcctctctggcaaaag

SEQ ID NO: 744904 - DNA, 20 bp, mouse
gaaagaggcaattagtaaca

SEQ ID NO: 744905 - DNA, 20 bp, mouse
gctcatagtgaaggagaacg

SEQ ID NO: 744906 - DNA, 20 bp, mouse
ggggccgagcgcagcaaggt

SEQ ID NO: 744907 - DNA, 20 bp, mouse
ggcaaggtaggaagagggcg

SEQ ID NO: 744908 - DNA, 20 bp, mouse
ggcgaggtgacagtacaact

SEQ ID NO: 744909 - DNA, 20 bp, mouse
gaggtgactcccgtgaggaa

SEQ ID NO: 744910 - DNA, 20 bp, mouse
gggcccccggccggaattgg

SEQ ID NO: 744911 - DNA, 20 bp, mouse
ggcggggccgagcgtttgta

SEQ ID NO: 744912 - DNA, 20 bp, mouse
gttgctcgctgccttcccat

SEQ ID NO: 744913 - DNA, 20 bp, mouse
ggctcgaccaataatcgggt

SEQ ID NO: 744914 - DNA, 20 bp, mouse
gtggtcgagccagccggggg

SEQ ID NO: 744915 - DNA, 20 bp, mouse
gaataatcgggtgggtctag

SEQ ID NO: 744916 - DNA, 20 bp, mouse
ggcccctttcccagggtctc

SEQ ID NO: 744917 - DNA, 20 bp, mouse
gcgggccgctcgcgttgtca

SEQ ID NO: 744918 - DNA, 20 bp, mouse
gacgctccgaatggcgcgag

SEQ ID NO: 744919 - DNA, 20 bp, mouse
gggggtggagccctgtgtca

SEQ ID NO: 744920 - DNA, 20 bp, mouse
gcccggagatggggaaagtg

SEQ ID NO: 744921 - DNA, 20 bp, mouse
gcctcggccggcaccaggcg

SEQ ID NO: 744922 - DNA, 20 bp, mouse
gtctctgccccgcttccagc

SEQ ID NO: 744923 - DNA, 20 bp, mouse
gcggagaacgcggctgaacg

SEQ ID NO: 744924 - DNA, 20 bp, mouse
ggccggagaccctgggaaag

SEQ ID NO: 744925 - DNA, 20 bp, mouse
gggcgccctgacaacgcgag

SEQ ID NO: 744926 - DNA, 20 bp, mouse
gcctgcccaaggtaaacctg

SEQ ID NO: 744927 - DNA, 20 bp, mouse
gcgcgccccaggtttacctt

SEQ ID NO: 744928 - DNA, 20 bp, mouse
ggcgccgcgccttcgttaga

SEQ ID NO: 744929 - DNA, 20 bp, mouse
gcatggccggcggaaggagg

SEQ ID NO: 744930 - DNA, 20 bp, mouse
gcctgagcgccctctaacga

SEQ ID NO: 744931 - DNA, 20 bp, mouse
gtggctgaaaggggtccagg

SEQ ID NO: 744932 - DNA, 20 bp, mouse
gtggctgcgtgcgccccggc

SEQ ID NO: 744933 - DNA, 20 bp, mouse
ggggtccaggagggcccgaa

SEQ ID NO: 744934 - DNA, 20 bp, mouse
gcccggctccaggtcccggg

SEQ ID NO: 744935 - DNA, 20 bp, mouse
gccccctagtgcgcggtcga

SEQ ID NO: 744936 - DNA, 20 bp, mouse
ggggaggcgagtggaactcc

SEQ ID NO: 744937 - DNA, 20 bp, mouse
gctagccggtgaggggtaaa

SEQ ID NO: 744938 - DNA, 20 bp, mouse
ggatccccctagttgggctg

SEQ ID NO: 744939 - DNA, 20 bp, mouse
ggcgctagatccccctagtt

SEQ ID NO: 744940 - DNA, 20 bp, mouse
gaaggcgcctagccggtgag

SEQ ID NO: 744941 - DNA, 20 bp, mouse
ggaggaagggcccggaaacc

SEQ ID NO: 744942 - DNA, 20 bp, mouse
gccccccccagcccaactag

SEQ ID NO: 744943 - DNA, 20 bp, mouse
ggggcccgccggctccggga

SEQ ID NO: 744944 - DNA, 20 bp, mouse
gtgcgccccgaggaagggcc

SEQ ID NO: 744945 - DNA, 20 bp, mouse
gtcccgtgcgccccgaggaa

SEQ ID NO: 744946 - DNA, 20 bp, mouse
gttgctgtgacgacatacaa

SEQ ID NO: 744947 - DNA, 20 bp, mouse
ggacggatgtattctctcaa

SEQ ID NO: 744948 - DNA, 20 bp, mouse
gtcttaggcattgtgtatgt

SEQ ID NO: 744949 - DNA, 20 bp, mouse
gtgctgggttcgatgaagct

SEQ ID NO: 744950 - DNA, 20 bp, mouse
gatcaatgatgcagactgct

SEQ ID NO: 744951 - DNA, 20 bp, mouse
gctagtaatgatagtatctc

SEQ ID NO: 744952 - DNA, 20 bp, mouse
gacatgctgatcgcatatcc

SEQ ID NO: 744953 - DNA, 20 bp, mouse
gacagaaaatctctagataa

SEQ ID NO: 744954 - DNA, 20 bp, mouse
ggtatttcatagctaagaaa

SEQ ID NO: 744955 - DNA, 20 bp, mouse
gtattcatagatatatgtgt

SEQ ID NO: 744956 - DNA, 20 bp, mouse
ggggaaccgtggggcggcta

SEQ ID NO: 744957 - DNA, 20 bp, mouse
gccgctccgcagaatcttgg

SEQ ID NO: 744958 - DNA, 20 bp, mouse
gcgcgcccgcggagccctcg

SEQ ID NO: 744959 - DNA, 20 bp, mouse
gtagccgctccgcagaatct

SEQ ID NO: 744960 - DNA, 20 bp, mouse
gacaaagggtatctctctcc

SEQ ID NO: 744961 - DNA, 20 bp, mouse
gtgtctgacaaaccctgcaa

SEQ ID NO: 744962 - DNA, 20 bp, mouse
gtccgcagaatcttggaggt

SEQ ID NO: 744963 - DNA, 20 bp, mouse
ggggctccaaggccgggaaa

SEQ ID NO: 744964 - DNA, 20 bp, mouse
gggccggcaaaacccggatc

SEQ ID NO: 744965 - DNA, 20 bp, mouse
gctcccaggaccagggaggg

SEQ ID NO: 744966 - DNA, 20 bp, mouse
gcagcggcgaggaccagtag

SEQ ID NO: 744967 - DNA, 20 bp, mouse
gaggcggaaaggggaggacg

SEQ ID NO: 744968 - DNA, 20 bp, mouse
gtgggcggagaagccactac

SEQ ID NO: 744969 - DNA, 20 bp, mouse
ggctcggaggcggaaagggg

SEQ ID NO: 744970 - DNA, 20 bp, mouse
gctctcgctcggaggcggaa

SEQ ID NO: 744971 - DNA, 20 bp, mouse
ggcctccgagcgagagggag

SEQ ID NO: 744972 - DNA, 20 bp, mouse
gtgctgcccccgaggtgctc

SEQ ID NO: 744973 - DNA, 20 bp, mouse
gaggttggcggtgacggcat

SEQ ID NO: 744974 - DNA, 20 bp, mouse
gcctcctcctgctgcccccg

SEQ ID NO: 744975 - DNA, 20 bp, mouse
gggcgagccccgagctccgg

SEQ ID NO: 744976 - DNA, 20 bp, mouse
gagacagtccagtctgggga

SEQ ID NO: 744977 - DNA, 20 bp, mouse
gaaaggaggcggagtctccg

SEQ ID NO: 744978 - DNA, 20 bp, mouse
gcggggatatgagagggagg

SEQ ID NO: 744979 - DNA, 20 bp, mouse
gaggcggggatatgagaggg

SEQ ID NO: 744980 - DNA, 20 bp, mouse
gcgacgccaggggactctgg

SEQ ID NO: 744981 - DNA, 20 bp, mouse
gagtctccggggcgacgcca

SEQ ID NO: 744982 - DNA, 20 bp, mouse
gggggaggcggggatatgag

SEQ ID NO: 744983 - DNA, 20 bp, mouse
gctaaagcacggcaaggggc

SEQ ID NO: 744984 - DNA, 20 bp, mouse
gggcggggcctgaaaggagg

SEQ ID NO: 744985 - DNA, 20 bp, mouse
gaggcagacagtccagtctg

SEQ ID NO: 744986 - DNA, 20 bp, mouse
ggcaaggttgccatggggac

SEQ ID NO: 744987 - DNA, 20 bp, mouse
gaacgcgagtgcaccatcat

SEQ ID NO: 744988 - DNA, 20 bp, mouse
gggagagagcagctcgacgc

SEQ ID NO: 744989 - DNA, 20 bp, mouse
ggcgccgcaaggttgccatg

SEQ ID NO: 744990 - DNA, 20 bp, mouse
ggccggcgccggcctcagaa

SEQ ID NO: 744991 - DNA, 20 bp, mouse
ggccgcgcgcctggagccct

SEQ ID NO: 744992 - DNA, 20 bp, mouse
gcgagctgctctctccccgg

SEQ ID NO: 744993 - DNA, 20 bp, mouse
gcaaccttgcggcgctgcgt

SEQ ID NO: 744994 - DNA, 20 bp, mouse
gctctccccggaggggccca

SEQ ID NO: 744995 - DNA, 20 bp, mouse
gcagctgcgagtgttagtga

SEQ ID NO: 744996 - DNA, 20 bp, mouse
gtggggagcaacagacttcg

SEQ ID NO: 744997 - DNA, 20 bp, mouse
gaaaaagggcgccctggagt

SEQ ID NO: 744998 - DNA, 20 bp, mouse
ggcgccctggagtgggacca

SEQ ID NO: 744999 - DNA, 20 bp, mouse
ggtcccgtggtcccactcca

SEQ ID NO: 745000 - DNA, 20 bp, mouse
ggtagtaaggaacaggacgt

SEQ ID NO: 745001 - DNA, 20 bp, mouse
ggagtgggaccacgggacgg

SEQ ID NO: 745002 - DNA, 20 bp, mouse
gcagggcgccctttttccta

SEQ ID NO: 745003 - DNA, 20 bp, mouse
ggtcacagaggcaggtagta

SEQ ID NO: 745004 - DNA, 20 bp, mouse
gggggtcttctcgaagtgaa

SEQ ID NO: 745005 - DNA, 20 bp, mouse
ggctggtgtggccacgggtg

SEQ ID NO: 745006 - DNA, 20 bp, mouse
ggggaggaatctggtcccta

SEQ ID NO: 745007 - DNA, 20 bp, mouse
gaaggggcagaattcctcgg

SEQ ID NO: 745008 - DNA, 20 bp, mouse
gggaccagattcctcccggt

SEQ ID NO: 745009 - DNA, 20 bp, mouse
gtccctagggacccctatag

SEQ ID NO: 745010 - DNA, 20 bp, mouse
ggcctctataggggtcccta

SEQ ID NO: 745011 - DNA, 20 bp, mouse
gaattcctcggaggaggagt

SEQ ID NO: 745012 - DNA, 20 bp, mouse
gttgcctaccgggaggaatc

SEQ ID NO: 745013 - DNA, 20 bp, mouse
gtacaaggggcagaattcct

SEQ ID NO: 745014 - DNA, 20 bp, mouse
gaacggtgccagcgagaaga

SEQ ID NO: 745015 - DNA, 20 bp, mouse
gggagggcagaacagttaca

SEQ ID NO: 745016 - DNA, 20 bp, mouse
gactccaggcacacgcaata

SEQ ID NO: 745017 - DNA, 20 bp, mouse
gcacgcaataaggaaaccat

SEQ ID NO: 745018 - DNA, 20 bp, mouse
gtgcgtgtgcctggagtcac

SEQ ID NO: 745019 - DNA, 20 bp, mouse
gcagagggaaggattttgcg

SEQ ID NO: 745020 - DNA, 20 bp, mouse
gaagctggcagattttaagc

SEQ ID NO: 745021 - DNA, 20 bp, mouse
gcacgcatgcacaagacttg

SEQ ID NO: 745022 - DNA, 20 bp, mouse
gttccctgcctagatcaagc

SEQ ID NO: 745023 - DNA, 20 bp, mouse
gcccataagtacattcttac

SEQ ID NO: 745024 - DNA, 20 bp, mouse
gcgaggtcgaagtggcttaa

SEQ ID NO: 745025 - DNA, 20 bp, mouse
gtggcagattttaagctgga

SEQ ID NO: 745026 - DNA, 20 bp, mouse
gtctcctccttgggattcat

SEQ ID NO: 745027 - DNA, 20 bp, mouse
gcagccaatgaatcccaagg

SEQ ID NO: 745028 - DNA, 20 bp, mouse
gaacatacggagccttcctc

SEQ ID NO: 745029 - DNA, 20 bp, mouse
gagcctccattctctgaggt

SEQ ID NO: 745030 - DNA, 20 bp, mouse
ggtcctacctcagagaatgg

SEQ ID NO: 745031 - DNA, 20 bp, mouse
gcgtactggtctagagccca

SEQ ID NO: 745032 - DNA, 20 bp, mouse
ggaatagacttcctgacctg

SEQ ID NO: 745033 - DNA, 20 bp, mouse
gtcctctgaaagcagccacc

SEQ ID NO: 745034 - DNA, 20 bp, mouse
gtatgttagtgtctcctcct

SEQ ID NO: 745035 - DNA, 20 bp, mouse
gcccttgtgctgtacgatgt

SEQ ID NO: 745036 - DNA, 20 bp, mouse
gggcccgctcgagctttccc

SEQ ID NO: 745037 - DNA, 20 bp, mouse
ggcaaggtaagggccggcag

SEQ ID NO: 745038 - DNA, 20 bp, mouse
gtaagggccggcagcggggc

SEQ ID NO: 745039 - DNA, 20 bp, mouse
gagcgctggaggctgacgtc

SEQ ID NO: 745040 - DNA, 20 bp, mouse
ggggcagcggcggctcgagg

SEQ ID NO: 745041 - DNA, 20 bp, mouse
gtatcccgggaaagctcgag

SEQ ID NO: 745042 - DNA, 20 bp, mouse
ggcaccgcacgggagaccgc

SEQ ID NO: 745043 - DNA, 20 bp, mouse
gcgcactagccggacgggga

SEQ ID NO: 745044 - DNA, 20 bp, mouse
ggcacgggagaccgcgggga

SEQ ID NO: 745045 - DNA, 20 bp, mouse
gcgggccgggacaatgggag

SEQ ID NO: 745046 - DNA, 20 bp, mouse
gaaacacctactgtattcaa

SEQ ID NO: 745047 - DNA, 20 bp, mouse
gaatagcctgcagtgggcaa

SEQ ID NO: 745048 - DNA, 20 bp, mouse
gataagcccttgaatacagt

SEQ ID NO: 745049 - DNA, 20 bp, mouse
gtgaagttttgatgctacat

SEQ ID NO: 745050 - DNA, 20 bp, mouse
gacagaaaatagcctgcagt

SEQ ID NO: 745051 - DNA, 20 bp, mouse
ggatgctacattggccaagg

SEQ ID NO: 745052 - DNA, 20 bp, mouse
gagcaaatacaggaaccaaa

SEQ ID NO: 745053 - DNA, 20 bp, mouse
gtagaagaccatggaagtac

SEQ ID NO: 745054 - DNA, 20 bp, mouse
ggaaaggacctgtacttcca

SEQ ID NO: 745055 - DNA, 20 bp, mouse
gtttcttttctagtagctca

SEQ ID NO: 745056 - DNA, 20 bp, mouse
gagcgctcgaggagaagtca

SEQ ID NO: 745057 - DNA, 20 bp, mouse
gcgagcgctctgcttcacta

SEQ ID NO: 745058 - DNA, 20 bp, mouse
gaggccggagaacacggatt

SEQ ID NO: 745059 - DNA, 20 bp, mouse
ggaaagatcctgcacctgcc

SEQ ID NO: 745060 - DNA, 20 bp, mouse
ggtgcccaatccgtgttctc

SEQ ID NO: 745061 - DNA, 20 bp, mouse
gatcctgcacctgccaggaa

SEQ ID NO: 745062 - DNA, 20 bp, mouse
gaatggagcacctttcttgg

SEQ ID NO: 745063 - DNA, 20 bp, mouse
gaggtgcaggatctttcgcg

SEQ ID NO: 745064 - DNA, 20 bp, mouse
gggtcacaggccggagaaca

SEQ ID NO: 745065 - DNA, 20 bp, mouse
gctaaccgataataataccg

SEQ ID NO: 745066 - DNA, 20 bp, mouse
ggctcccggggagcggacta

SEQ ID NO: 745067 - DNA, 20 bp, mouse
ggccctcggcgctgtcatgg

SEQ ID NO: 745068 - DNA, 20 bp, mouse
ggcggactagggaaacttga

SEQ ID NO: 745069 - DNA, 20 bp, mouse
ggacgggaccggggagagaa

SEQ ID NO: 745070 - DNA, 20 bp, mouse
ggggcgggcccggagaatcg

SEQ ID NO: 745071 - DNA, 20 bp, mouse
gcctgagctcggctgaggag

SEQ ID NO: 745072 - DNA, 20 bp, mouse
ggagaatcgcgggtgagtgg

SEQ ID NO: 745073 - DNA, 20 bp, mouse
gagctcggctgaggagagga

SEQ ID NO: 745074 - DNA, 20 bp, mouse
gtcgcccgggcacctgagct

SEQ ID NO: 745075 - DNA, 20 bp, mouse
gtagggaagcacggagttct

SEQ ID NO: 745076 - DNA, 20 bp, mouse
gcagttccagccagcttcgg

SEQ ID NO: 745077 - DNA, 20 bp, mouse
gtatgaaaacccaggcgagg

SEQ ID NO: 745078 - DNA, 20 bp, mouse
gcgaggcgggagacaagatt

SEQ ID NO: 745079 - DNA, 20 bp, mouse
gacagggaggagagtggttc

SEQ ID NO: 745080 - DNA, 20 bp, mouse
gtcgcctgggttttcataaa

SEQ ID NO: 745081 - DNA, 20 bp, mouse
ggcgggccagggtattttgt

SEQ ID NO: 745082 - DNA, 20 bp, mouse
ggtgtaaactacaaggggtc

SEQ ID NO: 745083 - DNA, 20 bp, mouse
gtggaactggatgcacattc

SEQ ID NO: 745084 - DNA, 20 bp, mouse
ggagcgccaacaagctgcgg

SEQ ID NO: 745085 - DNA, 20 bp, mouse
gaattctgcaggggtgatcg

SEQ ID NO: 745086 - DNA, 20 bp, mouse
gaggacgcatgcgcaggctg

SEQ ID NO: 745087 - DNA, 20 bp, mouse
gacaaccgaggatccgagga

SEQ ID NO: 745088 - DNA, 20 bp, mouse
gacctcatagccactggccc

SEQ ID NO: 745089 - DNA, 20 bp, mouse
gcctgggccgcgagtggagg

SEQ ID NO: 745090 - DNA, 20 bp, mouse
gtgaggtgtcgcgcacacag

SEQ ID NO: 745091 - DNA, 20 bp, mouse
gtgggtaccaaagtcttaag

SEQ ID NO: 745092 - DNA, 20 bp, mouse
gccccgggccagtggctatg

SEQ ID NO: 745093 - DNA, 20 bp, mouse
gaatccagggtccgctgctt

SEQ ID NO: 745094 - DNA, 20 bp, mouse
gaaaaacaaccgaggatccg

SEQ ID NO: 745095 - DNA, 20 bp, mouse
ggatggtaggaaggaacccc

SEQ ID NO: 745096 - DNA, 20 bp, mouse
gcccacaagcaggttttcca

SEQ ID NO: 745097 - DNA, 20 bp, mouse
gttagggagcccagggtacc

SEQ ID NO: 745098 - DNA, 20 bp, mouse
gtgctccagctctgcgaagt

SEQ ID NO: 745099 - DNA, 20 bp, mouse
gcagctctgcgaagtcggtt

SEQ ID NO: 745100 - DNA, 20 bp, mouse
gtggagcagcccggtaccct

SEQ ID NO: 745101 - DNA, 20 bp, mouse
gcgtccgggagagctgtccc

SEQ ID NO: 745102 - DNA, 20 bp, mouse
ggagagttggagcgctgtta

SEQ ID NO: 745103 - DNA, 20 bp, mouse
gcgctgggtgggcggggaaa

SEQ ID NO: 745104 - DNA, 20 bp, mouse
gttggagcgctgttaaggac

SEQ ID NO: 745105 - DNA, 20 bp, mouse
ggggaaaggggctcgcggac

SEQ ID NO: 745106 - DNA, 20 bp, mouse
gctagattacactgagggaa

SEQ ID NO: 745107 - DNA, 20 bp, mouse
gcctcctgggcgggtctcat

SEQ ID NO: 745108 - DNA, 20 bp, mouse
gagcaccccgccaacggccg

SEQ ID NO: 745109 - DNA, 20 bp, mouse
gaacggccgcggttcctggt

SEQ ID NO: 745110 - DNA, 20 bp, mouse
gggcacttctaacgcgtctc

SEQ ID NO: 745111 - DNA, 20 bp, mouse
ggaagtgcccaatcagaaaa

SEQ ID NO: 745112 - DNA, 20 bp, mouse
gcgccgtagtccccactgaa

SEQ ID NO: 745113 - DNA, 20 bp, mouse
gaggaaccgcggccgttggc

SEQ ID NO: 745114 - DNA, 20 bp, mouse
ggcccaatcagaaaacggca

SEQ ID NO: 745115 - DNA, 20 bp, mouse
ggcgggccgaccaggaaccg

SEQ ID NO: 745116 - DNA, 20 bp, mouse
gtcaaccttgagttgagggg

SEQ ID NO: 745117 - DNA, 20 bp, mouse
gttaaaaggctgcacctcca

SEQ ID NO: 745118 - DNA, 20 bp, mouse
gttgacctcccctcaactca

SEQ ID NO: 745119 - DNA, 20 bp, mouse
gttgaggggaggtcaaagca

SEQ ID NO: 745120 - DNA, 20 bp, mouse
ggaagagtgttgtctaacct

SEQ ID NO: 745121 - DNA, 20 bp, mouse
gcagaaggtcagctgggaga

SEQ ID NO: 745122 - DNA, 20 bp, mouse
gagaaaatgaaaagaggtgc

SEQ ID NO: 745123 - DNA, 20 bp, mouse
gggtgctcagaaggtcagct

SEQ ID NO: 745124 - DNA, 20 bp, mouse
gctcttcaaccttgagttga

SEQ ID NO: 745125 - DNA, 20 bp, mouse
gaaagtgtctgtcctaggcc

SEQ ID NO: 745126 - DNA, 20 bp, mouse
gtccgggcgggccacccgtc

SEQ ID NO: 745127 - DNA, 20 bp, mouse
gagggaagccggtgacccgc

SEQ ID NO: 745128 - DNA, 20 bp, mouse
gagcgtggcaggtactcaat

SEQ ID NO: 745129 - DNA, 20 bp, mouse
ggcagtgccaccacaggtct

SEQ ID NO: 745130 - DNA, 20 bp, mouse
gcggaggggcggagcccgac

SEQ ID NO: 745131 - DNA, 20 bp, mouse
gaacctcggagaattcctac

SEQ ID NO: 745132 - DNA, 20 bp, mouse
gtcctagagcggttcccccc

SEQ ID NO: 745133 - DNA, 20 bp, mouse
gaggggcggagcccgacggg

SEQ ID NO: 745134 - DNA, 20 bp, mouse
gagccagtaggaattctccg

SEQ ID NO: 745135 - DNA, 20 bp, mouse
ggaaggagccataagaacct

SEQ ID NO: 745136 - DNA, 20 bp, mouse
gggaccagggcgctctgcag

SEQ ID NO: 745137 - DNA, 20 bp, mouse
gccccctcccccccttgcgg

SEQ ID NO: 745138 - DNA, 20 bp, mouse
gggctctccaacatggtctg

SEQ ID NO: 745139 - DNA, 20 bp, mouse
gagggcgctctgcagtggag

SEQ ID NO: 745140 - DNA, 20 bp, mouse
gggggcgtggtctaggggac

SEQ ID NO: 745141 - DNA, 20 bp, mouse
gcccctagaccacgccccag

SEQ ID NO: 745142 - DNA, 20 bp, mouse
ggcgtcgccgccgcaagggg

SEQ ID NO: 745143 - DNA, 20 bp, mouse
gtcgccgccgcaaggggggg

SEQ ID NO: 745144 - DNA, 20 bp, mouse
gtgagccttgggtatgattt

SEQ ID NO: 745145 - DNA, 20 bp, mouse
ggggagggggcgcggaccgg

SEQ ID NO: 745146 - DNA, 20 bp, mouse
gcctccggggctgtggatcc

SEQ ID NO: 745147 - DNA, 20 bp, mouse
gcacgcgtggggggggccag

SEQ ID NO: 745148 - DNA, 20 bp, mouse
ggctccgccagcggccactg

SEQ ID NO: 745149 - DNA, 20 bp, mouse
gggggcgccttgggtttcta

SEQ ID NO: 745150 - DNA, 20 bp, mouse
ggtgcatgcggggagtgcgg

SEQ ID NO: 745151 - DNA, 20 bp, mouse
gtcgcacgcacggatctgtg

SEQ ID NO: 745152 - DNA, 20 bp, mouse
gcacgcagcggtcgcacgca

SEQ ID NO: 745153 - DNA, 20 bp, mouse
ggggccagtggtgtgcatgc

SEQ ID NO: 745154 - DNA, 20 bp, mouse
ggctttgcgcgcacgcgtgg

SEQ ID NO: 745155 - DNA, 20 bp, mouse
gtagaaccgaggatcctccg

SEQ ID NO: 745156 - DNA, 20 bp, mouse
ggagacgccctggagctact

SEQ ID NO: 745157 - DNA, 20 bp, mouse
gagggcgtctccatggtagg

SEQ ID NO: 745158 - DNA, 20 bp, mouse
gtagctccagggcgtctcca

SEQ ID NO: 745159 - DNA, 20 bp, mouse
gcgcccgcgcttaaaggcgt

SEQ ID NO: 745160 - DNA, 20 bp, mouse
gcccctagcaccacctacca

SEQ ID NO: 745161 - DNA, 20 bp, mouse
ggggcgcgtctttgagagga

SEQ ID NO: 745162 - DNA, 20 bp, mouse
ggggcaggagacagagacgc

SEQ ID NO: 745163 - DNA, 20 bp, mouse
gagactcagaaatagagatg

SEQ ID NO: 745164 - DNA, 20 bp, mouse
gtccagggcgtctccatggt

SEQ ID NO: 745165 - DNA, 20 bp, mouse
gctaggggcgcgtctttgag

SEQ ID NO: 745166 - DNA, 20 bp, mouse
ggtgacgcggtgatgcagaa

SEQ ID NO: 745167 - DNA, 20 bp, mouse
gggggtcccagtaacagtgc

SEQ ID NO: 745168 - DNA, 20 bp, mouse
gcgtgggtgcggggacgtgt

SEQ ID NO: 745169 - DNA, 20 bp, mouse
gaggcggcccctctggaaga

SEQ ID NO: 745170 - DNA, 20 bp, mouse
ggtccccgcacccacgggca

SEQ ID NO: 745171 - DNA, 20 bp, mouse
gtggggtggcgcccccaaca

SEQ ID NO: 745172 - DNA, 20 bp, mouse
gtgcacccggccctgcccgt

SEQ ID NO: 745173 - DNA, 20 bp, mouse
gtgcaaacccgcactgttac

SEQ ID NO: 745174 - DNA, 20 bp, mouse
ggggcctgagggcttggcca

SEQ ID NO: 745175 - DNA, 20 bp, mouse
gaaagggcccgggcctgtgg

SEQ ID NO: 745176 - DNA, 20 bp, mouse
gagcacagctgctactgctt

SEQ ID NO: 745177 - DNA, 20 bp, mouse
gttccgcgggcgcaaggaga

SEQ ID NO: 745178 - DNA, 20 bp, mouse
gatccagcccgaagtctcaa

SEQ ID NO: 745179 - DNA, 20 bp, mouse
gcgcgggggcgttgcaggaa

SEQ ID NO: 745180 - DNA, 20 bp, mouse
gctcccagaaccctagaaac

SEQ ID NO: 745181 - DNA, 20 bp, mouse
ggggggcgttgcaggaaggg

SEQ ID NO: 745182 - DNA, 20 bp, mouse
gccttgcgcccgcggaaaat

SEQ ID NO: 745183 - DNA, 20 bp, mouse
ggggagaaagctaacttctg

SEQ ID NO: 745184 - DNA, 20 bp, mouse
gcctacaaatccctaagcag

SEQ ID NO: 745185 - DNA, 20 bp, mouse
gccctaagcagaggaggcgc

SEQ ID NO: 745186 - DNA, 20 bp, mouse
ggctctacccaatgtctcct

SEQ ID NO: 745187 - DNA, 20 bp, mouse
gtcagtccctggatcctggt

SEQ ID NO: 745188 - DNA, 20 bp, mouse
gctgcagaaagtctgggaaa

SEQ ID NO: 745189 - DNA, 20 bp, mouse
gcctagttaagggtgaggtg

SEQ ID NO: 745190 - DNA, 20 bp, mouse
gactcagcctaggagacatt

SEQ ID NO: 745191 - DNA, 20 bp, mouse
gcagaaagtctgggaaaggg

SEQ ID NO: 745192 - DNA, 20 bp, mouse
gtcctctcccaccaggatcc

SEQ ID NO: 745193 - DNA, 20 bp, mouse
gcaggtgacaggaaatgtgt

SEQ ID NO: 745194 - DNA, 20 bp, mouse
gaaactcagtccctggatcc

SEQ ID NO: 745195 - DNA, 20 bp, mouse
gaagttcagctgtgcaggca

SEQ ID NO: 745196 - DNA, 20 bp, mouse
gggcgctgcaaggaactctg

SEQ ID NO: 745197 - DNA, 20 bp, mouse
gctagccactgaacgtaaag

SEQ ID NO: 745198 - DNA, 20 bp, mouse
gcacacaagcatctccagtc

SEQ ID NO: 745199 - DNA, 20 bp, mouse
gaggtgaacaagctcaaaga

SEQ ID NO: 745200 - DNA, 20 bp, mouse
gttgacagaatgtgcaagta

SEQ ID NO: 745201 - DNA, 20 bp, mouse
gctgcaaaagtgaacgccaa

SEQ ID NO: 745202 - DNA, 20 bp, mouse
gggtgtgaatgaagccagac

SEQ ID NO: 745203 - DNA, 20 bp, mouse
gaagaaagtgggtggagaaa

SEQ ID NO: 745204 - DNA, 20 bp, mouse
gacactatgcacagcgccgt

SEQ ID NO: 745205 - DNA, 20 bp, mouse
gaccagactcagagttggac

SEQ ID NO: 745206 - DNA, 20 bp, mouse
gcccccacgtcctctctgac

SEQ ID NO: 745207 - DNA, 20 bp, mouse
gtccgatcaggccctgtcgt

SEQ ID NO: 745208 - DNA, 20 bp, mouse
gagccagtcagagaggacgt

SEQ ID NO: 745209 - DNA, 20 bp, mouse
ggtagccagaagagactcgc

SEQ ID NO: 745210 - DNA, 20 bp, mouse
ggggaagtggctgtagaagc

SEQ ID NO: 745211 - DNA, 20 bp, mouse
gggaccacgtcataagggcg

SEQ ID NO: 745212 - DNA, 20 bp, mouse
gttttccggcgagtctcttc

SEQ ID NO: 745213 - DNA, 20 bp, mouse
gctaggagctcggttttagt

SEQ ID NO: 745214 - DNA, 20 bp, mouse
gaatagcaccacccacgaca

SEQ ID NO: 745215 - DNA, 20 bp, mouse
gacccacgacagggcctgat

SEQ ID NO: 745216 - DNA, 20 bp, mouse
gccccggggccccatcggag

SEQ ID NO: 745217 - DNA, 20 bp, mouse
gcgccctgcccgttgctcat

SEQ ID NO: 745218 - DNA, 20 bp, mouse
gagccaatgagcaacgggca

SEQ ID NO: 745219 - DNA, 20 bp, mouse
ggtagccctgcagccaacgt

SEQ ID NO: 745220 - DNA, 20 bp, mouse
gggcgcagatcggcccacgt

SEQ ID NO: 745221 - DNA, 20 bp, mouse
gccatcggaggggtgtgtga

SEQ ID NO: 745222 - DNA, 20 bp, mouse
gctgcgccccggggccccat

SEQ ID NO: 745223 - DNA, 20 bp, mouse
ggggtgggaaaagcgagcgg

SEQ ID NO: 745224 - DNA, 20 bp, mouse
gggtgtgaaaggcggggacg

SEQ ID NO: 745225 - DNA, 20 bp, mouse
gtccaggagccaatgagcaa

SEQ ID NO: 745226 - DNA, 20 bp, mouse
gctagtgcgcccacaagcgg

SEQ ID NO: 745227 - DNA, 20 bp, mouse
gccgacgcaacctcatcccg

SEQ ID NO: 745228 - DNA, 20 bp, mouse
gtgaggttgcgtcggaaatt

SEQ ID NO: 745229 - DNA, 20 bp, mouse
ggtaatgctcgcctcctagg

SEQ ID NO: 745230 - DNA, 20 bp, mouse
gtagggggcggggcaatcgt

SEQ ID NO: 745231 - DNA, 20 bp, mouse
gtgcagaagcagctcggaaa

SEQ ID NO: 745232 - DNA, 20 bp, mouse
gagccagccaatcggagccc

SEQ ID NO: 745233 - DNA, 20 bp, mouse
gctcatcccggggctccgat

SEQ ID NO: 745234 - DNA, 20 bp, mouse
gagtacgttgcgtcgcgggg

SEQ ID NO: 745235 - DNA, 20 bp, mouse
gtaggaggcgagcattacag

SEQ ID NO: 745236 - DNA, 20 bp, mouse
ggccggcgcccgggagaaag

SEQ ID NO: 745237 - DNA, 20 bp, mouse
ggcgaggcggggcgagaagg

SEQ ID NO: 745238 - DNA, 20 bp, mouse
gcgcggcggaacggcgaggc

SEQ ID NO: 745239 - DNA, 20 bp, mouse
gaaagtggagctgagattgt

SEQ ID NO: 745240 - DNA, 20 bp, mouse
gcggccacgtgacaataaca

SEQ ID NO: 745241 - DNA, 20 bp, mouse
ggcggcggggcgcgatgtcc

SEQ ID NO: 745242 - DNA, 20 bp, mouse
gagccggctcagtccttcgc

SEQ ID NO: 745243 - DNA, 20 bp, mouse
gttggcccgcctggcacccg

SEQ ID NO: 745244 - DNA, 20 bp, mouse
gatgtcccggcgcggcggaa

SEQ ID NO: 745245 - DNA, 20 bp, mouse
ggacgctggaaaatgtaact

SEQ ID NO: 745246 - DNA, 20 bp, mouse
gctggggttgatgctataga

SEQ ID NO: 745247 - DNA, 20 bp, mouse
gagtaagctgctgagtgcta

SEQ ID NO: 745248 - DNA, 20 bp, mouse
ggaggcaagtgactagtgac

SEQ ID NO: 745249 - DNA, 20 bp, mouse
gaactctggcctctaaataa

SEQ ID NO: 745250 - DNA, 20 bp, mouse
ggctagggcacagaaagata

SEQ ID NO: 745251 - DNA, 20 bp, mouse
gccctagcttcttctggcct

SEQ ID NO: 745252 - DNA, 20 bp, mouse
gaacccccatccaaggccat

SEQ ID NO: 745253 - DNA, 20 bp, mouse
gtgaatcacccagtcttgag

SEQ ID NO: 745254 - DNA, 20 bp, mouse
gtaaacacaggctggggatt

SEQ ID NO: 745255 - DNA, 20 bp, mouse
gaaggccatgggataaacac

SEQ ID NO: 745256 - DNA, 20 bp, mouse
ggtggttcttaaggttgcaa

SEQ ID NO: 745257 - DNA, 20 bp, mouse
gtgggctgtaacagacctcg

SEQ ID NO: 745258 - DNA, 20 bp, mouse
gatcccgagctatggtactc

SEQ ID NO: 745259 - DNA, 20 bp, mouse
gctgttacagcccagctccc

SEQ ID NO: 745260 - DNA, 20 bp, mouse
gtaaagcactgaatgccccg

SEQ ID NO: 745261 - DNA, 20 bp, mouse
gagcctgagtaccatagctc

SEQ ID NO: 745262 - DNA, 20 bp, mouse
gtggtaatccataaagatgt

SEQ ID NO: 745263 - DNA, 20 bp, mouse
gagcttcttacaaagaagcc

SEQ ID NO: 745264 - DNA, 20 bp, mouse
ggtctgccagcaccgcacca

SEQ ID NO: 745265 - DNA, 20 bp, mouse
gatcacccatggtgcggtgc

SEQ ID NO: 745266 - DNA, 20 bp, mouse
ggggaaaggtacctgatacg

SEQ ID NO: 745267 - DNA, 20 bp, mouse
gcggttgaggccatattcaa

SEQ ID NO: 745268 - DNA, 20 bp, mouse
gtgcagggaaaccccgtatc

SEQ ID NO: 745269 - DNA, 20 bp, mouse
gtccctgcaaatttagacat

SEQ ID NO: 745270 - DNA, 20 bp, mouse
gcgagtaacacacttactaa

SEQ ID NO: 745271 - DNA, 20 bp, mouse
ggcaccactggtaactctat

SEQ ID NO: 745272 - DNA, 20 bp, mouse
gactcaggacaggttctcac

SEQ ID NO: 745273 - DNA, 20 bp, mouse
gccgccaggacaatttcaat

SEQ ID NO: 745274 - DNA, 20 bp, mouse
gtaaccttcaagtgtcttgc

SEQ ID NO: 745275 - DNA, 20 bp, mouse
gagtgggctgaggagtctta

SEQ ID NO: 745276 - DNA, 20 bp, mouse
gcctgcgcagaggaagtgca

SEQ ID NO: 745277 - DNA, 20 bp, mouse
ggcagggcgcaagggtgcag

SEQ ID NO: 745278 - DNA, 20 bp, mouse
gtatggaccttcttcctagt

SEQ ID NO: 745279 - DNA, 20 bp, mouse
gcatagagccaggggtccgg

SEQ ID NO: 745280 - DNA, 20 bp, mouse
ggcacatagagccaggggtc

SEQ ID NO: 745281 - DNA, 20 bp, mouse
ggccaaggcctccggacccc

SEQ ID NO: 745282 - DNA, 20 bp, mouse
gggaactattcaattgtccc

SEQ ID NO: 745283 - DNA, 20 bp, mouse
ggaggaagtgcagggcgcaa

SEQ ID NO: 745284 - DNA, 20 bp, mouse
gcctggctctatgtgctctc

SEQ ID NO: 745285 - DNA, 20 bp, mouse
gcctgagtttcatattgcca

SEQ ID NO: 745286 - DNA, 20 bp, mouse
gcccccgcggcacttcagtc

SEQ ID NO: 745287 - DNA, 20 bp, mouse
gtgcactgaggaggcggaaa

SEQ ID NO: 745288 - DNA, 20 bp, mouse
gtctagggagcgctgggatg

SEQ ID NO: 745289 - DNA, 20 bp, mouse
ggagcagcggtgcgagctcc

SEQ ID NO: 745290 - DNA, 20 bp, mouse
ggggtcccgagccgctgtct

SEQ ID NO: 745291 - DNA, 20 bp, mouse
gggggggcgtggacccgatg

SEQ ID NO: 745292 - DNA, 20 bp, mouse
gagccggtagagccaagggt

SEQ ID NO: 745293 - DNA, 20 bp, mouse
gggcgcgctgccctggggag

SEQ ID NO: 745294 - DNA, 20 bp, mouse
gacagtgcctccctagccta

SEQ ID NO: 745295 - DNA, 20 bp, mouse
gactgaggaggcggaaacgg

SEQ ID NO: 745296 - DNA, 20 bp, mouse
gttcagatgtgtcttgtcaa

SEQ ID NO: 745297 - DNA, 20 bp, mouse
gcggcagccaaagggcgatc

SEQ ID NO: 745298 - DNA, 20 bp, mouse
gtggccgcgcggtgactggc

SEQ ID NO: 745299 - DNA, 20 bp, mouse
gagaagcgctacgggatcta

SEQ ID NO: 745300 - DNA, 20 bp, mouse
ggcccagcagccggcgacga

SEQ ID NO: 745301 - DNA, 20 bp, mouse
gaacgcaggcggcagccaaa

SEQ ID NO: 745302 - DNA, 20 bp, mouse
ggggtgaagaaaaagtactg

SEQ ID NO: 745303 - DNA, 20 bp, mouse
gcacgctccggatcgccctt

SEQ ID NO: 745304 - DNA, 20 bp, mouse
ggacacgtagcagttacggc

SEQ ID NO: 745305 - DNA, 20 bp, mouse
gctacgggatctaaggcgct

SEQ ID NO: 745306 - DNA, 20 bp, mouse
ggagcagccaggcaactccg

SEQ ID NO: 745307 - DNA, 20 bp, mouse
gcggtctccggcgcccggtg

SEQ ID NO: 745308 - DNA, 20 bp, mouse
gccggcgcccggtggggagg

SEQ ID NO: 745309 - DNA, 20 bp, mouse
gtctccggcgcccggtgggg

SEQ ID NO: 745310 - DNA, 20 bp, mouse
ggggacttccgcaggtctgt

SEQ ID NO: 745311 - DNA, 20 bp, mouse
ggggactccccggagttgcc

SEQ ID NO: 745312 - DNA, 20 bp, mouse
gccaaacacccacgctgctt

SEQ ID NO: 745313 - DNA, 20 bp, mouse
gagggcagggcactcggggt

SEQ ID NO: 745314 - DNA, 20 bp, mouse
gtcacagggcagggcactcg

SEQ ID NO: 745315 - DNA, 20 bp, mouse
gccggagaccgacagacctg

SEQ ID NO: 745316 - DNA, 20 bp, mouse
ggggaaggccggcccgctag

SEQ ID NO: 745317 - DNA, 20 bp, mouse
gtccctgcccccgggaaggc

SEQ ID NO: 745318 - DNA, 20 bp, mouse
ggcgccagccgcaggcgaca

SEQ ID NO: 745319 - DNA, 20 bp, mouse
gcgcgcgcgctccctcccgc

SEQ ID NO: 745320 - DNA, 20 bp, mouse
gggctcgcgctcagtctggc

SEQ ID NO: 745321 - DNA, 20 bp, mouse
ggcgacagggccggcaactg

SEQ ID NO: 745322 - DNA, 20 bp, mouse
gactgagcgcgagccggcac

SEQ ID NO: 745323 - DNA, 20 bp, mouse
gttgccggccctgtcgcctg

SEQ ID NO: 745324 - DNA, 20 bp, mouse
gggctcgcgcgaccgacgca

SEQ ID NO: 745325 - DNA, 20 bp, mouse
gacaccaaggccggggactg

SEQ ID NO: 745326 - DNA, 20 bp, mouse
gaagcggcagttaacatgat

SEQ ID NO: 745327 - DNA, 20 bp, mouse
ggcaacagaggagagtgcgg

SEQ ID NO: 745328 - DNA, 20 bp, mouse
gtagagaaggggaactgcag

SEQ ID NO: 745329 - DNA, 20 bp, mouse
gcagatctactactagtaag

SEQ ID NO: 745330 - DNA, 20 bp, mouse
ggtagtagatctgatttctg

SEQ ID NO: 745331 - DNA, 20 bp, mouse
gcagagagatgcccgccgat

SEQ ID NO: 745332 - DNA, 20 bp, mouse
gaaagaaagtaactccgcgc

SEQ ID NO: 745333 - DNA, 20 bp, mouse
ggcgctcgcacgctctccgc

SEQ ID NO: 745334 - DNA, 20 bp, mouse
gatcttacatcacgcaagag

SEQ ID NO: 745335 - DNA, 20 bp, mouse
gctgagaagtccctactttt

SEQ ID NO: 745336 - DNA, 20 bp, mouse
gctagcgcgcaagtgtccga

SEQ ID NO: 745337 - DNA, 20 bp, mouse
ggggcgggccgggcagtagg

SEQ ID NO: 745338 - DNA, 20 bp, mouse
ggactggcgcgggtagaaaa

SEQ ID NO: 745339 - DNA, 20 bp, mouse
gtgctcgtgcgagcgagggg

SEQ ID NO: 745340 - DNA, 20 bp, mouse
gtgtgtgctcgtgcgagcga

SEQ ID NO: 745341 - DNA, 20 bp, mouse
gtagcatgcgggaatccagt

SEQ ID NO: 745342 - DNA, 20 bp, mouse
gccctgcactttgcgactct

SEQ ID NO: 745343 - DNA, 20 bp, mouse
gtgcactttgcgactctggg

SEQ ID NO: 745344 - DNA, 20 bp, mouse
gcgccccggaactagcatgc

SEQ ID NO: 745345 - DNA, 20 bp, mouse
gagtcgcaaagtgcaggggg

SEQ ID NO: 745346 - DNA, 20 bp, mouse
gaggcaacacgctgcttcat

SEQ ID NO: 745347 - DNA, 20 bp, mouse
gcaggccaggtctctctgat

SEQ ID NO: 745348 - DNA, 20 bp, mouse
gaagagaagctttgtgtgat

SEQ ID NO: 745349 - DNA, 20 bp, mouse
gggcgctggctcctgattgg

SEQ ID NO: 745350 - DNA, 20 bp, mouse
gagagacctggcctgggcgc

SEQ ID NO: 745351 - DNA, 20 bp, mouse
gcactgaaatgtctgtatgt

SEQ ID NO: 745352 - DNA, 20 bp, mouse
gctgcttcattggatgagag

SEQ ID NO: 745353 - DNA, 20 bp, mouse
gttggtctttgacattctac

SEQ ID NO: 745354 - DNA, 20 bp, mouse
gggcgaaatgtctttaattc

SEQ ID NO: 745355 - DNA, 20 bp, mouse
gacttacaggatactatttt

SEQ ID NO: 745356 - DNA, 20 bp, mouse
gtgtccgtgcagacactggg

SEQ ID NO: 745357 - DNA, 20 bp, mouse
gccaactgaaacggacatct

SEQ ID NO: 745358 - DNA, 20 bp, mouse
gtcaaccaggaaatagtatg

SEQ ID NO: 745359 - DNA, 20 bp, mouse
gcggttacctagttacctgt

SEQ ID NO: 745360 - DNA, 20 bp, mouse
gatactgcaagatggtaact

SEQ ID NO: 745361 - DNA, 20 bp, mouse
gcgtttcagttggtataaac

SEQ ID NO: 745362 - DNA, 20 bp, mouse
ggaaatgtccgtgcagacac

SEQ ID NO: 745363 - DNA, 20 bp, mouse
gcaggcatataggaatttcc

SEQ ID NO: 745364 - DNA, 20 bp, mouse
gcctccacccagtgtctgca

SEQ ID NO: 745365 - DNA, 20 bp, mouse
gtactggaagaattgatggt

SEQ ID NO: 745366 - DNA, 20 bp, mouse
gaggtgggatggcgtggaaa

SEQ ID NO: 745367 - DNA, 20 bp, mouse
gaagccaggcgactgtgctg

SEQ ID NO: 745368 - DNA, 20 bp, mouse
ggggcgggcggaggaggctg

SEQ ID NO: 745369 - DNA, 20 bp, mouse
gagccgcagtggcgctgaca

SEQ ID NO: 745370 - DNA, 20 bp, mouse
ggggcgcacgccccgcctcg

SEQ ID NO: 745371 - DNA, 20 bp, mouse
ggggaaagagaccagatctt

SEQ ID NO: 745372 - DNA, 20 bp, mouse
ggtggcgctgacagggcggg

SEQ ID NO: 745373 - DNA, 20 bp, mouse
gagagctagcgggttccggt

SEQ ID NO: 745374 - DNA, 20 bp, mouse
ggcattgcgcctatggtccg

SEQ ID NO: 745375 - DNA, 20 bp, mouse
gagggctggcattgcgccta

SEQ ID NO: 745376 - DNA, 20 bp, mouse
gcggaaggctaggaatgtta

SEQ ID NO: 745377 - DNA, 20 bp, mouse
gcaagaggcacaggcgggtg

SEQ ID NO: 745378 - DNA, 20 bp, mouse
gcgagcgcaagaggcacagg

SEQ ID NO: 745379 - DNA, 20 bp, mouse
ggggtggggtcctgggactg

SEQ ID NO: 745380 - DNA, 20 bp, mouse
ggactggggggcgagggcag

SEQ ID NO: 745381 - DNA, 20 bp, mouse
gacagataaggggctctctc

SEQ ID NO: 745382 - DNA, 20 bp, mouse
gccccgccaggggaccggga

SEQ ID NO: 745383 - DNA, 20 bp, mouse
gtcctgggactggggggcga

SEQ ID NO: 745384 - DNA, 20 bp, mouse
gaggcgagcgcaagaggcac

SEQ ID NO: 745385 - DNA, 20 bp, mouse
ggagctaaggcgagcgcaag

SEQ ID NO: 745386 - DNA, 20 bp, mouse
gagaggccgggcaagcaggt

SEQ ID NO: 745387 - DNA, 20 bp, mouse
ggcccggcctctcctgtcgc

SEQ ID NO: 745388 - DNA, 20 bp, mouse
gtccgggcccgcgacaggag

SEQ ID NO: 745389 - DNA, 20 bp, mouse
ggccaagtctctgtactgac

SEQ ID NO: 745390 - DNA, 20 bp, mouse
gccgggcaggcgggtctctc

SEQ ID NO: 745391 - DNA, 20 bp, mouse
gcccgcgtgcatcccaagtg

SEQ ID NO: 745392 - DNA, 20 bp, mouse
gggccaggtggctacagttg

SEQ ID NO: 745393 - DNA, 20 bp, mouse
ggtctctccgggcccgcgac

SEQ ID NO: 745394 - DNA, 20 bp, mouse
gaagtggggcggtatgtctc

SEQ ID NO: 745395 - DNA, 20 bp, mouse
gctgaggcctcctgactgtg

SEQ ID NO: 745396 - DNA, 20 bp, mouse
gcgcgaggctcaacccgcgg

SEQ ID NO: 745397 - DNA, 20 bp, mouse
ggccgcgcgcgccgactccc

SEQ ID NO: 745398 - DNA, 20 bp, mouse
gcccggggaaagaatcccat

SEQ ID NO: 745399 - DNA, 20 bp, mouse
gggagggcgtgaggcgacgt

SEQ ID NO: 745400 - DNA, 20 bp, mouse
gcgggcgcgcagggagacgg

SEQ ID NO: 745401 - DNA, 20 bp, mouse
gcgcggcgcgctgaggacgg

SEQ ID NO: 745402 - DNA, 20 bp, mouse
gtcggcgcgcgcggcggtcg

SEQ ID NO: 745403 - DNA, 20 bp, mouse
ggcgcgctgaggacgggggt

SEQ ID NO: 745404 - DNA, 20 bp, mouse
gcggccgggcgcacaaagag

SEQ ID NO: 745405 - DNA, 20 bp, mouse
gactccccggagagcccccg

SEQ ID NO: 745406 - DNA, 20 bp, mouse
gcacacagagcaggatcatg

SEQ ID NO: 745407 - DNA, 20 bp, mouse
gatggggctcggaccgagag

SEQ ID NO: 745408 - DNA, 20 bp, mouse
ggggctcggaccgagagagg

SEQ ID NO: 745409 - DNA, 20 bp, mouse
gtccccgtggaggtggcaag

SEQ ID NO: 745410 - DNA, 20 bp, mouse
gcacctccacggggaaacca

SEQ ID NO: 745411 - DNA, 20 bp, mouse
ggctaagagctgtagacgct

SEQ ID NO: 745412 - DNA, 20 bp, mouse
ggtagacgctaggacgagcc

SEQ ID NO: 745413 - DNA, 20 bp, mouse
gcctgagagaggtgagtgtc

SEQ ID NO: 745414 - DNA, 20 bp, mouse
gctccacggggaaaccaggg

SEQ ID NO: 745415 - DNA, 20 bp, mouse
gctctgcgcgttcactgcaa

SEQ ID NO: 745416 - DNA, 20 bp, mouse
ggaaaagtgggcagtcatat

SEQ ID NO: 745417 - DNA, 20 bp, mouse
gatggcgcctcgaagagaga

SEQ ID NO: 745418 - DNA, 20 bp, mouse
ggatgggcggggctacagat

SEQ ID NO: 745419 - DNA, 20 bp, mouse
ggagccagagaccgaaaagt

SEQ ID NO: 745420 - DNA, 20 bp, mouse
gcagtctgctagcgcttcag

SEQ ID NO: 745421 - DNA, 20 bp, mouse
gggcgggatcggattgagaa

SEQ ID NO: 745422 - DNA, 20 bp, mouse
ggaagcgctagcagactgac

SEQ ID NO: 745423 - DNA, 20 bp, mouse
gaagtgggcagtcatatggg

SEQ ID NO: 745424 - DNA, 20 bp, mouse
gaccccggaggggaagtgtc

SEQ ID NO: 745425 - DNA, 20 bp, mouse
gtgtagccccgcccatcaac

SEQ ID NO: 745426 - DNA, 20 bp, mouse
gaaaacagaaggcggatcca

SEQ ID NO: 745427 - DNA, 20 bp, mouse
gaggaggcagatccccgcca

SEQ ID NO: 745428 - DNA, 20 bp, mouse
gcgcaaggctggaacgtcgt

SEQ ID NO: 745429 - DNA, 20 bp, mouse
gggcgctggacaagggaaca

SEQ ID NO: 745430 - DNA, 20 bp, mouse
gtccgcccatgcgcgcgcaa

SEQ ID NO: 745431 - DNA, 20 bp, mouse
gcgcgcgcaagggcttgtgg

SEQ ID NO: 745432 - DNA, 20 bp, mouse
gggcggagccgacctctagt

SEQ ID NO: 745433 - DNA, 20 bp, mouse
gcaactaggagcgacaccga

SEQ ID NO: 745434 - DNA, 20 bp, mouse
gccgccaaggctcacgggag

SEQ ID NO: 745435 - DNA, 20 bp, mouse
gagagccggggcgctggaca

SEQ ID NO: 745436 - DNA, 20 bp, mouse
gggcgctccggagcacgcag

SEQ ID NO: 745437 - DNA, 20 bp, mouse
gtccgctggcctctagcaaa

SEQ ID NO: 745438 - DNA, 20 bp, mouse
ggccgcctgtccgaaaacag

SEQ ID NO: 745439 - DNA, 20 bp, mouse
gggcctctagcaaagggcgc

SEQ ID NO: 745440 - DNA, 20 bp, mouse
gcgtgctccggagcgcccgg

SEQ ID NO: 745441 - DNA, 20 bp, mouse
ggcaccatgtccttaagctg

SEQ ID NO: 745442 - DNA, 20 bp, mouse
ggcggtgggagataccctgg

SEQ ID NO: 745443 - DNA, 20 bp, mouse
gctagaggccagcggacccg

SEQ ID NO: 745444 - DNA, 20 bp, mouse
gatggtgcgcctaaacccat

SEQ ID NO: 745445 - DNA, 20 bp, mouse
gggccagcggacccggggat

SEQ ID NO: 745446 - DNA, 20 bp, mouse
gactgtgcgactccccgcgg

SEQ ID NO: 745447 - DNA, 20 bp, mouse
gcacactgtgcgactccccg

SEQ ID NO: 745448 - DNA, 20 bp, mouse
gcccaaaaagctcctaagga

SEQ ID NO: 745449 - DNA, 20 bp, mouse
ggcactcggcggcacgcaga

SEQ ID NO: 745450 - DNA, 20 bp, mouse
gtcccgggagggtcgggaga

SEQ ID NO: 745451 - DNA, 20 bp, mouse
gacccggctcccgggagggt

SEQ ID NO: 745452 - DNA, 20 bp, mouse
gagagggcgtgtcccggccg

SEQ ID NO: 745453 - DNA, 20 bp, mouse
gtctccaggaaaacccggag

SEQ ID NO: 745454 - DNA, 20 bp, mouse
ggcgccccaaaaagctccta

SEQ ID NO: 745455 - DNA, 20 bp, mouse
gacccggagcggagcatccc

SEQ ID NO: 745456 - DNA, 20 bp, mouse
ggtgacaggccggacaggca

SEQ ID NO: 745457 - DNA, 20 bp, mouse
gaggccggacaggcagggtc

SEQ ID NO: 745458 - DNA, 20 bp, mouse
ggtcccagaccctgcctgtc

SEQ ID NO: 745459 - DNA, 20 bp, mouse
ggagagtagataagagatca

SEQ ID NO: 745460 - DNA, 20 bp, mouse
gttgaagcagggccttgttc

SEQ ID NO: 745461 - DNA, 20 bp, mouse
ggccctgcttcaatcctgag

SEQ ID NO: 745462 - DNA, 20 bp, mouse
gagacactcaagctgctatc

SEQ ID NO: 745463 - DNA, 20 bp, mouse
gtaggtgagttgtaacacaa

SEQ ID NO: 745464 - DNA, 20 bp, mouse
ggtctggtgacaggccggac

SEQ ID NO: 745465 - DNA, 20 bp, mouse
gagcttgagtgtctggtgac

SEQ ID NO: 745466 - DNA, 20 bp, mouse
gccaaggaggaccgtgagaa

SEQ ID NO: 745467 - DNA, 20 bp, mouse
gcgtgagccagcctgagccc

SEQ ID NO: 745468 - DNA, 20 bp, mouse
gctcaggctggctcacggat

SEQ ID NO: 745469 - DNA, 20 bp, mouse
gtcagccgccgcctgggctc

SEQ ID NO: 745470 - DNA, 20 bp, mouse
ggcaacccccgacgcgcgtg

SEQ ID NO: 745471 - DNA, 20 bp, mouse
gccgccgcctgggctcaggc

SEQ ID NO: 745472 - DNA, 20 bp, mouse
gctgccaataggcaaaggga

SEQ ID NO: 745473 - DNA, 20 bp, mouse
gtgagcgcaaacccggcaca

SEQ ID NO: 745474 - DNA, 20 bp, mouse
gtgcggctgccaataggcaa

SEQ ID NO: 745475 - DNA, 20 bp, mouse
ggagccagcctgagcccagg

SEQ ID NO: 745476 - DNA, 20 bp, mouse
gcgcgcgcggctacaggagt

SEQ ID NO: 745477 - DNA, 20 bp, mouse
gcggccgctctcattggcta

SEQ ID NO: 745478 - DNA, 20 bp, mouse
ggcagcccgaacgtgagttt

SEQ ID NO: 745479 - DNA, 20 bp, mouse
gcgaaggtgaggtggagtta

SEQ ID NO: 745480 - DNA, 20 bp, mouse
gcatctgcagcaccgcccgg

SEQ ID NO: 745481 - DNA, 20 bp, mouse
gttcccctaaactcacgttc

SEQ ID NO: 745482 - DNA, 20 bp, mouse
ggcccggcggccgctctcat

SEQ ID NO: 745483 - DNA, 20 bp, mouse
ggcgacggccagcgaaggtg

SEQ ID NO: 745484 - DNA, 20 bp, mouse
gcggacaggggcggcaagtg

SEQ ID NO: 745485 - DNA, 20 bp, mouse
gcacgggcgacggccagcga

SEQ ID NO: 745486 - DNA, 20 bp, mouse
gcctcttagtggtcccactt

SEQ ID NO: 745487 - DNA, 20 bp, mouse
gtggtccttaggtaccagtt

SEQ ID NO: 745488 - DNA, 20 bp, mouse
gtacttgcacaagtagccta

SEQ ID NO: 745489 - DNA, 20 bp, mouse
gggccagtttaccactttct

SEQ ID NO: 745490 - DNA, 20 bp, mouse
gagcagtcagatgaccacaa

SEQ ID NO: 745491 - DNA, 20 bp, mouse
gtggactcaagcccagaaag

SEQ ID NO: 745492 - DNA, 20 bp, mouse
gactgccaaactggtaccta

SEQ ID NO: 745493 - DNA, 20 bp, mouse
gactgggataggccccatct

SEQ ID NO: 745494 - DNA, 20 bp, mouse
gagcccagaaagtggtaaac

SEQ ID NO: 745495 - DNA, 20 bp, mouse
gatcccagtcaaaagatctg

SEQ ID NO: 745496 - DNA, 20 bp, mouse
gtcaccgcacggggcagtgt

SEQ ID NO: 745497 - DNA, 20 bp, mouse
gttactcagtcctactgcgg

SEQ ID NO: 745498 - DNA, 20 bp, mouse
gcagcgagtccgaaggagat

SEQ ID NO: 745499 - DNA, 20 bp, mouse
gaggaggcggaggaccggac

SEQ ID NO: 745500 - DNA, 20 bp, mouse
gaagactgcagcatgagtga

SEQ ID NO: 745501 - DNA, 20 bp, mouse
gacctctgggagcatcatca

SEQ ID NO: 745502 - DNA, 20 bp, mouse
gcccgtgcggtgactcacga

SEQ ID NO: 745503 - DNA, 20 bp, mouse
gtcaggttgtgattgaagtc

SEQ ID NO: 745504 - DNA, 20 bp, mouse
ggctgtgtccagtgtgacac

SEQ ID NO: 745505 - DNA, 20 bp, mouse
gtgcggggcggggcaacctc

SEQ ID NO: 745506 - DNA, 20 bp, mouse
gtaggtgaagcggaaggcga

SEQ ID NO: 745507 - DNA, 20 bp, mouse
ggaagcggaaggcgagggtt

SEQ ID NO: 745508 - DNA, 20 bp, mouse
gtcaggggccgaacgcaagg

SEQ ID NO: 745509 - DNA, 20 bp, mouse
gtgggcgtaggtgaagcgga

SEQ ID NO: 745510 - DNA, 20 bp, mouse
gacaccggcttcttcccggg

SEQ ID NO: 745511 - DNA, 20 bp, mouse
gaccgtgcgcccaggcccgg

SEQ ID NO: 745512 - DNA, 20 bp, mouse
gtctcggctcgctgcttcag

SEQ ID NO: 745513 - DNA, 20 bp, mouse
ggcccagcccagcccgcagg

SEQ ID NO: 745514 - DNA, 20 bp, mouse
gaaggtgcggcgcagaggcc

SEQ ID NO: 745515 - DNA, 20 bp, mouse
gcgcaaggcggctgcaacac

SEQ ID NO: 745516 - DNA, 20 bp, mouse
ggcgcgcgcggggtctcacg

SEQ ID NO: 745517 - DNA, 20 bp, mouse
gggtgtccgagctatctcag

SEQ ID NO: 745518 - DNA, 20 bp, mouse
gacaccaggcgccgcgctcc

SEQ ID NO: 745519 - DNA, 20 bp, mouse
gacaagaatgacccggggag

SEQ ID NO: 745520 - DNA, 20 bp, mouse
gcggagcccgctcccgtcag

SEQ ID NO: 745521 - DNA, 20 bp, mouse
ggcgctccgggcttctcacg

SEQ ID NO: 745522 - DNA, 20 bp, mouse
ggtccgagctatctcagggg

SEQ ID NO: 745523 - DNA, 20 bp, mouse
gctcgcgacgacccctcccg

SEQ ID NO: 745524 - DNA, 20 bp, mouse
gtcacgaggtagtccgcggg

SEQ ID NO: 745525 - DNA, 20 bp, mouse
gcagccgcccctgacgggag

SEQ ID NO: 745526 - DNA, 20 bp, mouse
ggggacctaactgccttgtc

SEQ ID NO: 745527 - DNA, 20 bp, mouse
gcaaatggggtgggatacac

SEQ ID NO: 745528 - DNA, 20 bp, mouse
ggcgcgtcacatcaacaaac

SEQ ID NO: 745529 - DNA, 20 bp, mouse
ggaaggatagcttaagtcta

SEQ ID NO: 745530 - DNA, 20 bp, mouse
gaggcagttaggtcccccgt

SEQ ID NO: 745531 - DNA, 20 bp, mouse
gacccagagaaaagcccacg

SEQ ID NO: 745532 - DNA, 20 bp, mouse
gagatacaaacaaatggggt

SEQ ID NO: 745533 - DNA, 20 bp, mouse
gactaagatacaaacaaatg

SEQ ID NO: 745534 - DNA, 20 bp, mouse
gatacacaggattcctgaca

SEQ ID NO: 745535 - DNA, 20 bp, mouse
ggcgcctatagtagcaatcc

SEQ ID NO: 745536 - DNA, 20 bp, mouse
gagaaggctcagaacattca

SEQ ID NO: 745537 - DNA, 20 bp, mouse
gccccacagtcatacatgac

SEQ ID NO: 745538 - DNA, 20 bp, mouse
gtcacttcctgaactctgaa

SEQ ID NO: 745539 - DNA, 20 bp, mouse
gaacattcagggctatctgg

SEQ ID NO: 745540 - DNA, 20 bp, mouse
gaatggagctggggagagca

SEQ ID NO: 745541 - DNA, 20 bp, mouse
ggacatgtgtattggggagt

SEQ ID NO: 745542 - DNA, 20 bp, mouse
ggacagtgatcactgctact

SEQ ID NO: 745543 - DNA, 20 bp, mouse
gcagaacattcagggctatc

SEQ ID NO: 745544 - DNA, 20 bp, mouse
gagccaagaacatgtggacc

SEQ ID NO: 745545 - DNA, 20 bp, mouse
gctgaaaggacaggtgatag

SEQ ID NO: 745546 - DNA, 20 bp, mouse
gaaaatattgagagtatttt

SEQ ID NO: 745547 - DNA, 20 bp, mouse
gctcgtaaacaagtgattaa

SEQ ID NO: 745548 - DNA, 20 bp, mouse
gcacttgtttacgagttcaa

SEQ ID NO: 745549 - DNA, 20 bp, mouse
gtgttatacttaaaaagtca

SEQ ID NO: 745550 - DNA, 20 bp, mouse
gcaagtgattaaaggcaagc

SEQ ID NO: 745551 - DNA, 20 bp, mouse
ggatattactgtctaagtta

SEQ ID NO: 745552 - DNA, 20 bp, mouse
gtctagtcaatcttttgcta

SEQ ID NO: 745553 - DNA, 20 bp, mouse
gtggtcatgatgtctgtgca

SEQ ID NO: 745554 - DNA, 20 bp, mouse
gtattaacaatttaattttg

SEQ ID NO: 745555 - DNA, 20 bp, mouse
gcttactggattgctttccc

SEQ ID NO: 745556 - DNA, 20 bp, mouse
ggtgggagagcaagcggcaa

SEQ ID NO: 745557 - DNA, 20 bp, mouse
gagcaagcggcaagggctcc

SEQ ID NO: 745558 - DNA, 20 bp, mouse
gcatctgcaggctaaaactc

SEQ ID NO: 745559 - DNA, 20 bp, mouse
gccagctacggagcactgga

SEQ ID NO: 745560 - DNA, 20 bp, mouse
gctaaaactccggccaacct

SEQ ID NO: 745561 - DNA, 20 bp, mouse
gtacgcagcagccccagcta

SEQ ID NO: 745562 - DNA, 20 bp, mouse
gtctgctggggtatctgtga

SEQ ID NO: 745563 - DNA, 20 bp, mouse
gtgaggaccatcagtagccc

SEQ ID NO: 745564 - DNA, 20 bp, mouse
gagccccagctacggagcac

SEQ ID NO: 745565 - DNA, 20 bp, mouse
gtctctacatacatcgtgaa

SEQ ID NO: 745566 - DNA, 20 bp, mouse
ggacaccaggatacgaccca

SEQ ID NO: 745567 - DNA, 20 bp, mouse
gatacgacccagggcgggga

SEQ ID NO: 745568 - DNA, 20 bp, mouse
gcgcgctcgggaaccaaggg

SEQ ID NO: 745569 - DNA, 20 bp, mouse
gctgcgcgctcgggaaccaa

SEQ ID NO: 745570 - DNA, 20 bp, mouse
gaaagccagcgcgctagggg

SEQ ID NO: 745571 - DNA, 20 bp, mouse
gtcagcagatcggggaactt

SEQ ID NO: 745572 - DNA, 20 bp, mouse
ggccctgcatcttcttgtgt

SEQ ID NO: 745573 - DNA, 20 bp, mouse
gagccgggttcagcagatcg

SEQ ID NO: 745574 - DNA, 20 bp, mouse
gcggcaaagccagcgcgcta

SEQ ID NO: 745575 - DNA, 20 bp, mouse
gttgccgactccacacaaag

SEQ ID NO: 745576 - DNA, 20 bp, mouse
gcccgctgagggtggaaaga

SEQ ID NO: 745577 - DNA, 20 bp, mouse
ggtgtcaaggagttaattgt

SEQ ID NO: 745578 - DNA, 20 bp, mouse
gactactgagctacccgctg

SEQ ID NO: 745579 - DNA, 20 bp, mouse
ggggtagctcagtagttgcc

SEQ ID NO: 745580 - DNA, 20 bp, mouse
gtcgccttctcctggttcct

SEQ ID NO: 745581 - DNA, 20 bp, mouse
gggtggaaagaggggcgtta

SEQ ID NO: 745582 - DNA, 20 bp, mouse
gtcaaggagttaattgtcgg

SEQ ID NO: 745583 - DNA, 20 bp, mouse
gcagtagttgccaggttacg

SEQ ID NO: 745584 - DNA, 20 bp, mouse
gaggccaaatttctaatccc

SEQ ID NO: 745585 - DNA, 20 bp, mouse
ggtcggcggacataaaacaa

SEQ ID NO: 745586 - DNA, 20 bp, mouse
gaggacctctgtagggacag

SEQ ID NO: 745587 - DNA, 20 bp, mouse
gccggtgtaagggttagagg

SEQ ID NO: 745588 - DNA, 20 bp, mouse
ggaggtgagcccagggtggt

SEQ ID NO: 745589 - DNA, 20 bp, mouse
ggggacgcaaagccggtgta

SEQ ID NO: 745590 - DNA, 20 bp, mouse
gggacagcgccaaccaccct

SEQ ID NO: 745591 - DNA, 20 bp, mouse
ggccgagagaggacctctgt

SEQ ID NO: 745592 - DNA, 20 bp, mouse
gcgcagaggtgagcccaggg

SEQ ID NO: 745593 - DNA, 20 bp, mouse
gtgtagggacagaggatagc

SEQ ID NO: 745594 - DNA, 20 bp, mouse
gactccagctggggctgtgt

SEQ ID NO: 745595 - DNA, 20 bp, mouse
gtacgtgagaggggaccgta

SEQ ID NO: 745596 - DNA, 20 bp, mouse
ggctctgggcaggtactcgg

SEQ ID NO: 745597 - DNA, 20 bp, mouse
gccccgccccaaatagaggc

SEQ ID NO: 745598 - DNA, 20 bp, mouse
gagaactggacagtgatcag

SEQ ID NO: 745599 - DNA, 20 bp, mouse
ggcaaagatcaggaagcggg

SEQ ID NO: 745600 - DNA, 20 bp, mouse
gagcctcaggctctcacgag

SEQ ID NO: 745601 - DNA, 20 bp, mouse
gaagatcaggaagcgggtgg

SEQ ID NO: 745602 - DNA, 20 bp, mouse
ggaggggaagctgcgggcca

SEQ ID NO: 745603 - DNA, 20 bp, mouse
gggacatctggtcctggaaa

SEQ ID NO: 745604 - DNA, 20 bp, mouse
gcaggtactcgggggacatc

SEQ ID NO: 745605 - DNA, 20 bp, mouse
gccccaaatagaggcaggac

SEQ ID NO: 745606 - DNA, 20 bp, mouse
gcaagactggagctctggac

SEQ ID NO: 745607 - DNA, 20 bp, mouse
ggcattgtatgcagaactgg

SEQ ID NO: 745608 - DNA, 20 bp, mouse
ggtcacatcagctctattct

SEQ ID NO: 745609 - DNA, 20 bp, mouse
gggttcctcaacttgggcgg

SEQ ID NO: 745610 - DNA, 20 bp, mouse
gggaccccacagatcctaaa

SEQ ID NO: 745611 - DNA, 20 bp, mouse
gctcaaggccaagccaagac

SEQ ID NO: 745612 - DNA, 20 bp, mouse
gggttggcagtgctgggcat

SEQ ID NO: 745613 - DNA, 20 bp, mouse
gtaggaggaaaacgcatcta

SEQ ID NO: 745614 - DNA, 20 bp, mouse
gggagctctggacaggtggt

SEQ ID NO: 745615 - DNA, 20 bp, mouse
gcatctaaggcaaaagaggg

SEQ ID NO: 745616 - DNA, 20 bp, mouse
ggggctggtggattcgggga

SEQ ID NO: 745617 - DNA, 20 bp, mouse
ggggcagcggtcagttccag

SEQ ID NO: 745618 - DNA, 20 bp, mouse
gctgaccagaccgtcttcca

SEQ ID NO: 745619 - DNA, 20 bp, mouse
gaaagaaacttcgagaggat

SEQ ID NO: 745620 - DNA, 20 bp, mouse
gccggaaggcatcaagtcgc

SEQ ID NO: 745621 - DNA, 20 bp, mouse
gaggatgggctggtggattc

SEQ ID NO: 745622 - DNA, 20 bp, mouse
gaggcatcaagtcgcaggtc

SEQ ID NO: 745623 - DNA, 20 bp, mouse
gggagggcttggggacccga

SEQ ID NO: 745624 - DNA, 20 bp, mouse
gtggattcggggagggcttg

SEQ ID NO: 745625 - DNA, 20 bp, mouse
gaaacttcgagaggatgggc

SEQ ID NO: 745626 - DNA, 20 bp, mouse
gggcctggctaactggagta

SEQ ID NO: 745627 - DNA, 20 bp, mouse
gctaactggagtagggttcg

SEQ ID NO: 745628 - DNA, 20 bp, mouse
gtgtaggacagcgagaactg

SEQ ID NO: 745629 - DNA, 20 bp, mouse
gctctcagccaataagcgtc

SEQ ID NO: 745630 - DNA, 20 bp, mouse
gccggaagccaggacgctag

SEQ ID NO: 745631 - DNA, 20 bp, mouse
gggagggcggggctacgggg

SEQ ID NO: 745632 - DNA, 20 bp, mouse
gttcagaaccagacgcttat

SEQ ID NO: 745633 - DNA, 20 bp, mouse
gctcgctgtcctacaatagg

SEQ ID NO: 745634 - DNA, 20 bp, mouse
ggtagggttcggggaagaag

SEQ ID NO: 745635 - DNA, 20 bp, mouse
gggtggaacagtagccggaa

SEQ ID NO: 745636 - DNA, 20 bp, mouse
gacacccagccactgaaaca

SEQ ID NO: 745637 - DNA, 20 bp, mouse
gtgtctgctgcgcaccatgg

SEQ ID NO: 745638 - DNA, 20 bp, mouse
gagagaggggcgccacccaa

SEQ ID NO: 745639 - DNA, 20 bp, mouse
gtcggcagcacatgcacttc

SEQ ID NO: 745640 - DNA, 20 bp, mouse
ggacaaggcgtggtctgcac

SEQ ID NO: 745641 - DNA, 20 bp, mouse
gctgcgcaccatggcggtaa

SEQ ID NO: 745642 - DNA, 20 bp, mouse
gagtgcatgtgctgccgatg

SEQ ID NO: 745643 - DNA, 20 bp, mouse
gggactgtgctagaccgaac

SEQ ID NO: 745644 - DNA, 20 bp, mouse
ggctcgaaggcataaggcac

SEQ ID NO: 745645 - DNA, 20 bp, mouse
gtaaaaacagaagggctcga

SEQ ID NO: 745646 - DNA, 20 bp, mouse
ggaggggcggggtctctaaa

SEQ ID NO: 745647 - DNA, 20 bp, mouse
ggaggggccggcaagaggag

SEQ ID NO: 745648 - DNA, 20 bp, mouse
gaggacggcgccggtgaaaa

SEQ ID NO: 745649 - DNA, 20 bp, mouse
gaggggccttgcgataagga

SEQ ID NO: 745650 - DNA, 20 bp, mouse
gtgcgagaggcggggaagag

SEQ ID NO: 745651 - DNA, 20 bp, mouse
ggtgaaaaggggtcctagta

SEQ ID NO: 745652 - DNA, 20 bp, mouse
gccttgagagggttttggga

SEQ ID NO: 745653 - DNA, 20 bp, mouse
gcctacggggcgaacaccga

SEQ ID NO: 745654 - DNA, 20 bp, mouse
gggcccctcccctatagcaa

SEQ ID NO: 745655 - DNA, 20 bp, mouse
gaacaccaaggtcccttact

SEQ ID NO: 745656 - DNA, 20 bp, mouse
gctgtcttgtgctgcacgga

SEQ ID NO: 745657 - DNA, 20 bp, mouse
gacaggggatcatagcgtgg

SEQ ID NO: 745658 - DNA, 20 bp, mouse
gggaagtgagcagttctgtt

SEQ ID NO: 745659 - DNA, 20 bp, mouse
ggagctggacctgtttctgg

SEQ ID NO: 745660 - DNA, 20 bp, mouse
ggccttgcagatgacgaggt

SEQ ID NO: 745661 - DNA, 20 bp, mouse
gtgacctgtgagcacatacc

SEQ ID NO: 745662 - DNA, 20 bp, mouse
gacgaggtcggaaacctaca

SEQ ID NO: 745663 - DNA, 20 bp, mouse
gtgacctggtatgtgctcac

SEQ ID NO: 745664 - DNA, 20 bp, mouse
gagctctcctgcaaccatgt

SEQ ID NO: 745665 - DNA, 20 bp, mouse
ggaggtggtttctctctgag

SEQ ID NO: 745666 - DNA, 20 bp, mouse
gaaggctcgttaactgggtg

SEQ ID NO: 745667 - DNA, 20 bp, mouse
gcacctgaaagcaaagagtc

SEQ ID NO: 745668 - DNA, 20 bp, mouse
gctggcaaggctcgttaact

SEQ ID NO: 745669 - DNA, 20 bp, mouse
gatctgacaaggttcgttaa

SEQ ID NO: 745670 - DNA, 20 bp, mouse
ggccttgccaggctatttgc

SEQ ID NO: 745671 - DNA, 20 bp, mouse
gacaaggttcgttaatgggt

SEQ ID NO: 745672 - DNA, 20 bp, mouse
gtggggcatcgaacttgctc

SEQ ID NO: 745673 - DNA, 20 bp, mouse
gcagatgatgtacaaggctc

SEQ ID NO: 745674 - DNA, 20 bp, mouse
gccttgtcagatgatgtaca

SEQ ID NO: 745675 - DNA, 20 bp, mouse
gcgaacttgctcaggaccaa

SEQ ID NO: 745676 - DNA, 20 bp, mouse
gtcaggggagctgagagtag

SEQ ID NO: 745677 - DNA, 20 bp, mouse
ggggtgctgctgtcggtggg

SEQ ID NO: 745678 - DNA, 20 bp, mouse
gccagggattgcaagtttga

SEQ ID NO: 745679 - DNA, 20 bp, mouse
ggggccgtgcgcgggcctca

SEQ ID NO: 745680 - DNA, 20 bp, mouse
ggctgagagtagtggtattc

SEQ ID NO: 745681 - DNA, 20 bp, mouse
gtccccgagggagggcaagt

SEQ ID NO: 745682 - DNA, 20 bp, mouse
gtgaaaaggcccaggggtaa

SEQ ID NO: 745683 - DNA, 20 bp, mouse
ggagctgagtcattgctcag

SEQ ID NO: 745684 - DNA, 20 bp, mouse
gcacccacttgccctccctc

SEQ ID NO: 745685 - DNA, 20 bp, mouse
gagccacgtgggccgtgcgc

SEQ ID NO: 745686 - DNA, 20 bp, mouse
gcctcgaggcctgaagtggg

SEQ ID NO: 745687 - DNA, 20 bp, mouse
gtctgatggtggagcttcga

SEQ ID NO: 745688 - DNA, 20 bp, mouse
ggtccctagcccagcagatg

SEQ ID NO: 745689 - DNA, 20 bp, mouse
ggatcactgcctcccacttc

SEQ ID NO: 745690 - DNA, 20 bp, mouse
gaggcggggccaccgttaag

SEQ ID NO: 745691 - DNA, 20 bp, mouse
gtaacctcgaggcctgaagt

SEQ ID NO: 745692 - DNA, 20 bp, mouse
ggggccaccgttaagagggc

SEQ ID NO: 745693 - DNA, 20 bp, mouse
gtaccccgccctcttaacgg

SEQ ID NO: 745694 - DNA, 20 bp, mouse
gggaaaaggtgagacaggct

SEQ ID NO: 745695 - DNA, 20 bp, mouse
gccttcggaaaaggtgagac

SEQ ID NO: 745696 - DNA, 20 bp, mouse
ggcaggtgaaccagtggcag

SEQ ID NO: 745697 - DNA, 20 bp, mouse
gcactgggaactagtcgtca

SEQ ID NO: 745698 - DNA, 20 bp, mouse
gctagctcactctaaggaat

SEQ ID NO: 745699 - DNA, 20 bp, mouse
gggagcccagtataattcac

SEQ ID NO: 745700 - DNA, 20 bp, mouse
gagcaaacaatcacattgtc

SEQ ID NO: 745701 - DNA, 20 bp, mouse
gtggttcacctgctccttca

SEQ ID NO: 745702 - DNA, 20 bp, mouse
gcccagctccacttccctga

SEQ ID NO: 745703 - DNA, 20 bp, mouse
ggttcccagtgaattatact

SEQ ID NO: 745704 - DNA, 20 bp, mouse
gaagttaaaaattgtttcag

SEQ ID NO: 745705 - DNA, 20 bp, mouse
gaattctattatgttgtcac

SEQ ID NO: 745706 - DNA, 20 bp, mouse
gctctcgggagggggagaca

SEQ ID NO: 745707 - DNA, 20 bp, mouse
gaagaacaccgatttcttcg

SEQ ID NO: 745708 - DNA, 20 bp, mouse
gacctaagtttccattaccc

SEQ ID NO: 745709 - DNA, 20 bp, mouse
gtatccaggctctctcggga

SEQ ID NO: 745710 - DNA, 20 bp, mouse
ggaaccttccgcactatgaa

SEQ ID NO: 745711 - DNA, 20 bp, mouse
gcataggtctttgtttttgt

SEQ ID NO: 745712 - DNA, 20 bp, mouse
gttcttctcagcctgggtaa

SEQ ID NO: 745713 - DNA, 20 bp, mouse
gttaggtcctgtcacgtaga

SEQ ID NO: 745714 - DNA, 20 bp, mouse
gtatgaatgagacttaaatc

SEQ ID NO: 745715 - DNA, 20 bp, mouse
gtaaagagccagaccgggac

SEQ ID NO: 745716 - DNA, 20 bp, mouse
ggggctgcgaagttgagctt

SEQ ID NO: 745717 - DNA, 20 bp, mouse
gaggggaagcccaaccatcc

SEQ ID NO: 745718 - DNA, 20 bp, mouse
ggctgtcaagtccccgcctg

SEQ ID NO: 745719 - DNA, 20 bp, mouse
gtggggcaaaagcaggtggg

SEQ ID NO: 745720 - DNA, 20 bp, mouse
gggtgggaggagggggtcga

SEQ ID NO: 745721 - DNA, 20 bp, mouse
gtcaacttcgcagccccagg

SEQ ID NO: 745722 - DNA, 20 bp, mouse
gagggtgtgagctaggcggg

SEQ ID NO: 745723 - DNA, 20 bp, mouse
gccctggagcgatttccatg

SEQ ID NO: 745724 - DNA, 20 bp, mouse
ggtgactggaaggatagcca

SEQ ID NO: 745725 - DNA, 20 bp, mouse
ggaccctttggcagagatga

SEQ ID NO: 745726 - DNA, 20 bp, mouse
gcaggccagaagaacttgtt

SEQ ID NO: 745727 - DNA, 20 bp, mouse
gacgtggggcttctgtgcaa

SEQ ID NO: 745728 - DNA, 20 bp, mouse
gagaatagcaagagtcacgt

SEQ ID NO: 745729 - DNA, 20 bp, mouse
gcaaacaccaggaaagtctc

SEQ ID NO: 745730 - DNA, 20 bp, mouse
gaggagctaaaattagaagt

SEQ ID NO: 745731 - DNA, 20 bp, mouse
ggttctcccagagactttcc

SEQ ID NO: 745732 - DNA, 20 bp, mouse
gatctctccggcctcttgga

SEQ ID NO: 745733 - DNA, 20 bp, mouse
ggctattctcagccttgtcc

SEQ ID NO: 745734 - DNA, 20 bp, mouse
gtgttctccctccaagaggc

SEQ ID NO: 745735 - DNA, 20 bp, mouse
gcatgcatgcagtgccctgc

SEQ ID NO: 745736 - DNA, 20 bp, mouse
gtagctggagatcctgaata

SEQ ID NO: 745737 - DNA, 20 bp, mouse
ggaggaggggcgaggcttca

SEQ ID NO: 745738 - DNA, 20 bp, mouse
gtagagcgagtgaacgtgac

SEQ ID NO: 745739 - DNA, 20 bp, mouse
ggggccatagcaacatgtcc

SEQ ID NO: 745740 - DNA, 20 bp, mouse
gtgaacgtgactggtggagc

SEQ ID NO: 745741 - DNA, 20 bp, mouse
gagcgagtgaacgtgactgg

SEQ ID NO: 745742 - DNA, 20 bp, mouse
gcagaagagcagtgccagtt

SEQ ID NO: 745743 - DNA, 20 bp, mouse
gtggagatcctgaataagga

SEQ ID NO: 745744 - DNA, 20 bp, mouse
gtgtcctggaactgggcaag

SEQ ID NO: 745745 - DNA, 20 bp, mouse
gtccaaacctggactgggaa

SEQ ID NO: 745746 - DNA, 20 bp, mouse
ggctcctcgggctctcgggg

SEQ ID NO: 745747 - DNA, 20 bp, mouse
gaaggcccggcgggctatgc

SEQ ID NO: 745748 - DNA, 20 bp, mouse
gctggcgcgcctcaactccg

SEQ ID NO: 745749 - DNA, 20 bp, mouse
gaagctggtgccagggtcca

SEQ ID NO: 745750 - DNA, 20 bp, mouse
ggctggtggcgccgctcctc

SEQ ID NO: 745751 - DNA, 20 bp, mouse
ggccgctcctcgggctctcg

SEQ ID NO: 745752 - DNA, 20 bp, mouse
gcggcgaagccgcggagttg

SEQ ID NO: 745753 - DNA, 20 bp, mouse
gtgcacctgcatagcccgcc

SEQ ID NO: 745754 - DNA, 20 bp, mouse
gtctccctgggccgccgcgg

SEQ ID NO: 745755 - DNA, 20 bp, mouse
gaagcgccttctcccgcgac

SEQ ID NO: 745756 - DNA, 20 bp, mouse
ggggctgagaggtcctcgtg

SEQ ID NO: 745757 - DNA, 20 bp, mouse
gagcgcgcgcagctagggca

SEQ ID NO: 745758 - DNA, 20 bp, mouse
ggttggtgagggcaacggaa

SEQ ID NO: 745759 - DNA, 20 bp, mouse
gctgagggcgaggttggtga

SEQ ID NO: 745760 - DNA, 20 bp, mouse
ggaagggctcgtcggtcctg

SEQ ID NO: 745761 - DNA, 20 bp, mouse
gtcgtcggtcctgcggtccc

SEQ ID NO: 745762 - DNA, 20 bp, mouse
gtcgggtaagtgcgtctaac

SEQ ID NO: 745763 - DNA, 20 bp, mouse
ggcgaggttggtgagggcaa

SEQ ID NO: 745764 - DNA, 20 bp, mouse
ggtcctcgtggggggaacat

SEQ ID NO: 745765 - DNA, 20 bp, mouse
ggggcaacggaagggctcgt

SEQ ID NO: 745766 - DNA, 20 bp, mouse
ggcccgcgggtgtcattctc

SEQ ID NO: 745767 - DNA, 20 bp, mouse
gaccatggaggccacgtccc

SEQ ID NO: 745768 - DNA, 20 bp, mouse
ggaccgctccataagggata

SEQ ID NO: 745769 - DNA, 20 bp, mouse
gagcccgagaatgacacccg

SEQ ID NO: 745770 - DNA, 20 bp, mouse
gtgggcaagaagtgaccgaa

SEQ ID NO: 745771 - DNA, 20 bp, mouse
gttaaaagatcgtcaaacag

SEQ ID NO: 745772 - DNA, 20 bp, mouse
gtcccgggacgtggcctcca

SEQ ID NO: 745773 - DNA, 20 bp, mouse
gctggcgcgcccggagttgc

SEQ ID NO: 745774 - DNA, 20 bp, mouse
ggctagctacgagacgtagg

SEQ ID NO: 745775 - DNA, 20 bp, mouse
gccagcgaagagctcggcct

SEQ ID NO: 745776 - DNA, 20 bp, mouse
gtgcgcggggccggcatgag

SEQ ID NO: 745777 - DNA, 20 bp, mouse
gcgtgtgcgtgcccgcgcga

SEQ ID NO: 745778 - DNA, 20 bp, mouse
gggtcgcaggaagggtgaaa

SEQ ID NO: 745779 - DNA, 20 bp, mouse
ggggcctccaagagatctcg

SEQ ID NO: 745780 - DNA, 20 bp, mouse
gaagccgggcggtcgcagga

SEQ ID NO: 745781 - DNA, 20 bp, mouse
ggagaaagccgggcggtcgc

SEQ ID NO: 745782 - DNA, 20 bp, mouse
gcgggactgaggtaccagca

SEQ ID NO: 745783 - DNA, 20 bp, mouse
ggaaagacgcgcaagtgagg

SEQ ID NO: 745784 - DNA, 20 bp, mouse
gcggagcccctgccaggaga

SEQ ID NO: 745785 - DNA, 20 bp, mouse
gtgaggggcgtggtctgatc

SEQ ID NO: 745786 - DNA, 20 bp, mouse
gctgtgtggcggagctacaa

SEQ ID NO: 745787 - DNA, 20 bp, mouse
gcagcaggggtccccacctg

SEQ ID NO: 745788 - DNA, 20 bp, mouse
gagggatggcaagataagat

SEQ ID NO: 745789 - DNA, 20 bp, mouse
gtagctccgccacacagcag

SEQ ID NO: 745790 - DNA, 20 bp, mouse
gtacctcagccagcctgggt

SEQ ID NO: 745791 - DNA, 20 bp, mouse
gcggccagacgcgttaccct

SEQ ID NO: 745792 - DNA, 20 bp, mouse
ggtggcggagctacaaggga

SEQ ID NO: 745793 - DNA, 20 bp, mouse
gaccttgcaaaaacaagtgg

SEQ ID NO: 745794 - DNA, 20 bp, mouse
ggcacccagggtaacgcgtc

SEQ ID NO: 745795 - DNA, 20 bp, mouse
gggtaccttgcaaaaacaag

SEQ ID NO: 745796 - DNA, 20 bp, mouse
gaacgtggaacgcgaccctg

SEQ ID NO: 745797 - DNA, 20 bp, mouse
gtggggaacgcttggatgat

SEQ ID NO: 745798 - DNA, 20 bp, mouse
gggtcgcgttccacgttcat

SEQ ID NO: 745799 - DNA, 20 bp, mouse
gtggccatggagggaaacag

SEQ ID NO: 745800 - DNA, 20 bp, mouse
gacacggtaacacatcgata

SEQ ID NO: 745801 - DNA, 20 bp, mouse
gtcccggcttggggaacgct

SEQ ID NO: 745802 - DNA, 20 bp, mouse
gtcccaggaggcattgcgga

SEQ ID NO: 745803 - DNA, 20 bp, mouse
ggtgcctcgcgcactcccat

SEQ ID NO: 745804 - DNA, 20 bp, mouse
gggaaacagtggcttccgga

SEQ ID NO: 745805 - DNA, 20 bp, mouse
gaggcctctggaatagtggc

SEQ ID NO: 745806 - DNA, 20 bp, mouse
gccggggcgggagacctcca

SEQ ID NO: 745807 - DNA, 20 bp, mouse
ggcgccacgcccactatttc

SEQ ID NO: 745808 - DNA, 20 bp, mouse
gacccgggcccggaaatagt

SEQ ID NO: 745809 - DNA, 20 bp, mouse
ggggcgggagacctccacgg

SEQ ID NO: 745810 - DNA, 20 bp, mouse
gaaggaaaggagggtggcga

SEQ ID NO: 745811 - DNA, 20 bp, mouse
ggccccgggcgggtaaggag

SEQ ID NO: 745812 - DNA, 20 bp, mouse
ggctgtggaagggatgtcac

SEQ ID NO: 745813 - DNA, 20 bp, mouse
gagtgggcgtggcgcctgat

SEQ ID NO: 745814 - DNA, 20 bp, mouse
ggcggagacggaagtagcta

SEQ ID NO: 745815 - DNA, 20 bp, mouse
gcatgcgcgctgcgcggaga

SEQ ID NO: 745816 - DNA, 20 bp, mouse
gtggctgcgtggagtcccac

SEQ ID NO: 745817 - DNA, 20 bp, mouse
ggcgtggagtcccacaggtt

SEQ ID NO: 745818 - DNA, 20 bp, mouse
gccagagagtctggacgcaa

SEQ ID NO: 745819 - DNA, 20 bp, mouse
gcgcaaggggtttgtgggac

SEQ ID NO: 745820 - DNA, 20 bp, mouse
gaggtgaccacctaacctgt

SEQ ID NO: 745821 - DNA, 20 bp, mouse
gtctggacgcaaggggtttg

SEQ ID NO: 745822 - DNA, 20 bp, mouse
gtaaagacacgattattctg

SEQ ID NO: 745823 - DNA, 20 bp, mouse
gtctttagttggtatctggg

SEQ ID NO: 745824 - DNA, 20 bp, mouse
gtgcggcgccacacttccgg

SEQ ID NO: 745825 - DNA, 20 bp, mouse
gcgtgtctttagttggtatc

SEQ ID NO: 745826 - DNA, 20 bp, mouse
gccaccccgcggcgtccgat

SEQ ID NO: 745827 - DNA, 20 bp, mouse
gagcctagcggcacaacccc

SEQ ID NO: 745828 - DNA, 20 bp, mouse
gggacccgcctccaaacgag

SEQ ID NO: 745829 - DNA, 20 bp, mouse
gtaaccagcccacttccgat

SEQ ID NO: 745830 - DNA, 20 bp, mouse
gcggcctgacctcgccctct

SEQ ID NO: 745831 - DNA, 20 bp, mouse
gggttgtgccgctaggctga

SEQ ID NO: 745832 - DNA, 20 bp, mouse
gctggttggtgttagaaata

SEQ ID NO: 745833 - DNA, 20 bp, mouse
gcgtttggaggcgggtccgg

SEQ ID NO: 745834 - DNA, 20 bp, mouse
gccgccacttggttgctaag

SEQ ID NO: 745835 - DNA, 20 bp, mouse
ggtgtcgtccaatcggaagt

SEQ ID NO: 745836 - DNA, 20 bp, mouse
gcggacggcccaaagatcta

SEQ ID NO: 745837 - DNA, 20 bp, mouse
gtagcctcggggagtatctg

SEQ ID NO: 745838 - DNA, 20 bp, mouse
gaagagggaggacacatcgg

SEQ ID NO: 745839 - DNA, 20 bp, mouse
gtgaaaacagcgggaggatc

SEQ ID NO: 745840 - DNA, 20 bp, mouse
gtcctcccgctgttttcaag

SEQ ID NO: 745841 - DNA, 20 bp, mouse
gaaacagcgggaggatccgg

SEQ ID NO: 745842 - DNA, 20 bp, mouse
ggccccacagatactccccg

SEQ ID NO: 745843 - DNA, 20 bp, mouse
gtcccaggcaacccgctcag

SEQ ID NO: 745844 - DNA, 20 bp, mouse
gcccgcgggcagtgttgagg

SEQ ID NO: 745845 - DNA, 20 bp, mouse
gaggaaaggaccggaagtca

SEQ ID NO: 745846 - DNA, 20 bp, mouse
gcccctcccccgctaatcaa

SEQ ID NO: 745847 - DNA, 20 bp, mouse
gggcagtcagggaaggtcgg

SEQ ID NO: 745848 - DNA, 20 bp, mouse
ggggaggggggagttgagtg

SEQ ID NO: 745849 - DNA, 20 bp, mouse
gtaattaacccgttggttct

SEQ ID NO: 745850 - DNA, 20 bp, mouse
gctgggcagtcagggaaggt

SEQ ID NO: 745851 - DNA, 20 bp, mouse
gctgtgctgccaggggagag

SEQ ID NO: 745852 - DNA, 20 bp, mouse
gcctgactgcccagaaccaa

SEQ ID NO: 745853 - DNA, 20 bp, mouse
gaccccctggccgagctagc

SEQ ID NO: 745854 - DNA, 20 bp, mouse
gcaacgggttaattagataa

SEQ ID NO: 745855 - DNA, 20 bp, mouse
gggagggggaggccaccccc

SEQ ID NO: 745856 - DNA, 20 bp, mouse
ggagcaaaatgcagtagagc

SEQ ID NO: 745857 - DNA, 20 bp, mouse
gggcaagaatactaataagg

SEQ ID NO: 745858 - DNA, 20 bp, mouse
gggaggcaagaatactaata

SEQ ID NO: 745859 - DNA, 20 bp, mouse
gctggcaatcatctcaatgc

SEQ ID NO: 745860 - DNA, 20 bp, mouse
ggttagctacagtttcctca

SEQ ID NO: 745861 - DNA, 20 bp, mouse
ggcagggacagacacggctc

SEQ ID NO: 745862 - DNA, 20 bp, mouse
ggcacgcagtacagtaaatg

SEQ ID NO: 745863 - DNA, 20 bp, mouse
gctgcgtgctgactgccttg

SEQ ID NO: 745864 - DNA, 20 bp, mouse
gtgtgtgcctgtgagtctgc

SEQ ID NO: 745865 - DNA, 20 bp, mouse
gtaaagctggtatttgaaaa

SEQ ID NO: 745866 - DNA, 20 bp, mouse
gccgactggggccaatgaga

SEQ ID NO: 745867 - DNA, 20 bp, mouse
gcgagaaacaagttgaggtg

SEQ ID NO: 745868 - DNA, 20 bp, mouse
gccgggaaaaggaagtacaa

SEQ ID NO: 745869 - DNA, 20 bp, mouse
gggccactgttaagggaaat

SEQ ID NO: 745870 - DNA, 20 bp, mouse
gccagcaaaccccgcggctt

SEQ ID NO: 745871 - DNA, 20 bp, mouse
ggtacaagggccactgttaa

SEQ ID NO: 745872 - DNA, 20 bp, mouse
gtcaaggcgagtccgggatc

SEQ ID NO: 745873 - DNA, 20 bp, mouse
gcagcgcgcggccaggtaac

SEQ ID NO: 745874 - DNA, 20 bp, mouse
gtggtccggcgggctcgagg

SEQ ID NO: 745875 - DNA, 20 bp, mouse
ggcggcctgggtgctctcag

SEQ ID NO: 745876 - DNA, 20 bp, mouse
gcagggtactcagatggaaa

SEQ ID NO: 745877 - DNA, 20 bp, mouse
gaggcagcaggcagtctcta

SEQ ID NO: 745878 - DNA, 20 bp, mouse
gtagaagcagggtactcaga

SEQ ID NO: 745879 - DNA, 20 bp, mouse
gtacctagctgtgtcagaaa

SEQ ID NO: 745880 - DNA, 20 bp, mouse
gggttcagggaaggtcttca

SEQ ID NO: 745881 - DNA, 20 bp, mouse
gtcaacagagactaggcagc

SEQ ID NO: 745882 - DNA, 20 bp, mouse
gtcaaacacccatcaggttc

SEQ ID NO: 745883 - DNA, 20 bp, mouse
ggaccttccctgaacctgat

SEQ ID NO: 745884 - DNA, 20 bp, mouse
gttgacaagctgcacagaga

SEQ ID NO: 745885 - DNA, 20 bp, mouse
gccaagctgtgactagaagc

SEQ ID NO: 745886 - DNA, 20 bp, mouse
gtcgggagactctgaggcag

SEQ ID NO: 745887 - DNA, 20 bp, mouse
gagtcaggcatgcaggtgtg

SEQ ID NO: 745888 - DNA, 20 bp, mouse
ggtggggggaacacacatga

SEQ ID NO: 745889 - DNA, 20 bp, mouse
gatagggctggagacatccc

SEQ ID NO: 745890 - DNA, 20 bp, mouse
gggctccccttcacttacaa

SEQ ID NO: 745891 - DNA, 20 bp, mouse
gtgtaggtaagcttgctctc

SEQ ID NO: 745892 - DNA, 20 bp, mouse
gccacacggaggtgtcagag

SEQ ID NO: 745893 - DNA, 20 bp, mouse
gctggaggagtcaggcatgc

SEQ ID NO: 745894 - DNA, 20 bp, mouse
gtaaaagctgatcaccagaa

SEQ ID NO: 745895 - DNA, 20 bp, mouse
gggagaaccgcatgacaatg

SEQ ID NO: 745896 - DNA, 20 bp, mouse
ggacccagttgaggtacccc

SEQ ID NO: 745897 - DNA, 20 bp, mouse
gaccctggggtacctcaact

SEQ ID NO: 745898 - DNA, 20 bp, mouse
gctgtcagcaggccctggaa

SEQ ID NO: 745899 - DNA, 20 bp, mouse
gactgggtccatgctcccca

SEQ ID NO: 745900 - DNA, 20 bp, mouse
ggggtgttgagaggctctca

SEQ ID NO: 745901 - DNA, 20 bp, mouse
ggctccccagggtctacaaa

SEQ ID NO: 745902 - DNA, 20 bp, mouse
gtgtccctttgtagaccctg

SEQ ID NO: 745903 - DNA, 20 bp, mouse
ggggacatcctatgaatctt

SEQ ID NO: 745904 - DNA, 20 bp, mouse
ggacctggggccagagattt

SEQ ID NO: 745905 - DNA, 20 bp, mouse
ggggagaagtatgttcccat

SEQ ID NO: 745906 - DNA, 20 bp, mouse
ggagccccgccccctagcaa

SEQ ID NO: 745907 - DNA, 20 bp, mouse
gacaacaggtcgcggtgcgg

SEQ ID NO: 745908 - DNA, 20 bp, mouse
gccgcggggcgcagagtctc

SEQ ID NO: 745909 - DNA, 20 bp, mouse
ggccgcctcgagttgacgga

SEQ ID NO: 745910 - DNA, 20 bp, mouse
ggcagtgaaggcactcacgg

SEQ ID NO: 745911 - DNA, 20 bp, mouse
gcccgtccgtcaactcgagg

SEQ ID NO: 745912 - DNA, 20 bp, mouse
gacgggccgcctcgagttga

SEQ ID NO: 745913 - DNA, 20 bp, mouse
gcggacggcggggacttggc

SEQ ID NO: 745914 - DNA, 20 bp, mouse
ggccacaaggacacccgcgt

SEQ ID NO: 745915 - DNA, 20 bp, mouse
ggaggagttcgaccaatcac

SEQ ID NO: 745916 - DNA, 20 bp, mouse
ggaactggcgcgaggagtga

SEQ ID NO: 745917 - DNA, 20 bp, mouse
ggacgctgggtcccacgggt

SEQ ID NO: 745918 - DNA, 20 bp, mouse
gggcggcgatggcgtcatca

SEQ ID NO: 745919 - DNA, 20 bp, mouse
gcgaggacgctgggtcccac

SEQ ID NO: 745920 - DNA, 20 bp, mouse
gctgcagtctgcgaggacgc

SEQ ID NO: 745921 - DNA, 20 bp, mouse
gaggtgtgcggaagccatgg

SEQ ID NO: 745922 - DNA, 20 bp, mouse
gaacccagctgcagtctgcg

SEQ ID NO: 745923 - DNA, 20 bp, mouse
gatggcggccgccaacccgt

SEQ ID NO: 745924 - DNA, 20 bp, mouse
gagccctgggagcgcgtctc

SEQ ID NO: 745925 - DNA, 20 bp, mouse
gcgcctgagacgcgctccca

SEQ ID NO: 745926 - DNA, 20 bp, mouse
ggctcccgggaaccgtgtga

SEQ ID NO: 745927 - DNA, 20 bp, mouse
gccgcgccgtgcgccacgtg

SEQ ID NO: 745928 - DNA, 20 bp, mouse
gcgccctccgagtcacgcga

SEQ ID NO: 745929 - DNA, 20 bp, mouse
gtgctcgcccgggcgtcgcg

SEQ ID NO: 745930 - DNA, 20 bp, mouse
gggccgggctccgcctcacg

SEQ ID NO: 745931 - DNA, 20 bp, mouse
ggtccgctgcgcaggagccg

SEQ ID NO: 745932 - DNA, 20 bp, mouse
gggcctgaggctccccggag

SEQ ID NO: 745933 - DNA, 20 bp, mouse
gaccgggtgccacactataa

SEQ ID NO: 745934 - DNA, 20 bp, mouse
gcgccgtgcgccacgtgagg

SEQ ID NO: 745935 - DNA, 20 bp, mouse
gggcgcggcgtccgctgcgc

SEQ ID NO: 745936 - DNA, 20 bp, mouse
gggcgcgccctctgccgtcc

SEQ ID NO: 745937 - DNA, 20 bp, mouse
gggcgcgccggtacacgctc

SEQ ID NO: 745938 - DNA, 20 bp, mouse
ggcaactcagctcctcccgg

SEQ ID NO: 745939 - DNA, 20 bp, mouse
gcttccgcggccactgagat

SEQ ID NO: 745940 - DNA, 20 bp, mouse
gtgcggggcgccacctccgc

SEQ ID NO: 745941 - DNA, 20 bp, mouse
gactcagctcctcccggcgg

SEQ ID NO: 745942 - DNA, 20 bp, mouse
ggctagacgtggcagtccgg

SEQ ID NO: 745943 - DNA, 20 bp, mouse
gctggcaaactgcatctgcg

SEQ ID NO: 745944 - DNA, 20 bp, mouse
gtatagggatgatcttatga

SEQ ID NO: 745945 - DNA, 20 bp, mouse
gggagctgagttgctagacg

SEQ ID NO: 745946 - DNA, 20 bp, mouse
gggagcctttacttcctaat

SEQ ID NO: 745947 - DNA, 20 bp, mouse
gcccagggaaagatcccatt

SEQ ID NO: 745948 - DNA, 20 bp, mouse
ggcagccgcaggaggtcagg

SEQ ID NO: 745949 - DNA, 20 bp, mouse
ggcccagatcaaagagtcac

SEQ ID NO: 745950 - DNA, 20 bp, mouse
ggaagcagtaagaatagcag

SEQ ID NO: 745951 - DNA, 20 bp, mouse
gtccaaagaaagccacaggt

SEQ ID NO: 745952 - DNA, 20 bp, mouse
ggcaggaggtcaggtggcgc

SEQ ID NO: 745953 - DNA, 20 bp, mouse
gacaggcagaaaacacgccc

SEQ ID NO: 745954 - DNA, 20 bp, mouse
gccctgtgactctttgatct

SEQ ID NO: 745955 - DNA, 20 bp, mouse
gatggcagccgcaggaggtc

SEQ ID NO: 745956 - DNA, 20 bp, mouse
gaacccgcggccagtgctgc

SEQ ID NO: 745957 - DNA, 20 bp, mouse
gaacctgcgaaaggccggaa

SEQ ID NO: 745958 - DNA, 20 bp, mouse
ggaggggcagggttcggaga

SEQ ID NO: 745959 - DNA, 20 bp, mouse
gccgacccggaacctgcgaa

SEQ ID NO: 745960 - DNA, 20 bp, mouse
gagggcgtggccactaaccg

SEQ ID NO: 745961 - DNA, 20 bp, mouse
gaaagagctagaagctcctc

SEQ ID NO: 745962 - DNA, 20 bp, mouse
gctccagcagcactggccgc

SEQ ID NO: 745963 - DNA, 20 bp, mouse
gtcacagaacacattcgtta

SEQ ID NO: 745964 - DNA, 20 bp, mouse
gacgcagattacacaaccag

SEQ ID NO: 745965 - DNA, 20 bp, mouse
gacgttgggaaaggcattta

SEQ ID NO: 745966 - DNA, 20 bp, mouse
gctaaggtggcgaaatcagt

SEQ ID NO: 745967 - DNA, 20 bp, mouse
ggctgcccgcagcagaatta

SEQ ID NO: 745968 - DNA, 20 bp, mouse
gagtgggtggatcgagtggg

SEQ ID NO: 745969 - DNA, 20 bp, mouse
gaagaagcgcaggcgcacga

SEQ ID NO: 745970 - DNA, 20 bp, mouse
gtgcgcctgcgcttcttacc

SEQ ID NO: 745971 - DNA, 20 bp, mouse
gaggggccactggcctaagg

SEQ ID NO: 745972 - DNA, 20 bp, mouse
gggcagcgcaggatgcccgg

SEQ ID NO: 745973 - DNA, 20 bp, mouse
gaatcagtgggtggatcgag

SEQ ID NO: 745974 - DNA, 20 bp, mouse
ggcacgtcgggaactagggg

SEQ ID NO: 745975 - DNA, 20 bp, mouse
gaggtggcgaaatcagtggg

SEQ ID NO: 745976 - DNA, 20 bp, mouse
ggaacagaaagtgcgatcac

SEQ ID NO: 745977 - DNA, 20 bp, mouse
gacggcagcctcactaaagc

SEQ ID NO: 745978 - DNA, 20 bp, mouse
ggcgatcacaggccaggcac

SEQ ID NO: 745979 - DNA, 20 bp, mouse
gtacacaaggtaaataaaaa

SEQ ID NO: 745980 - DNA, 20 bp, mouse
gtggtttataccatgaatga

SEQ ID NO: 745981 - DNA, 20 bp, mouse
gaaagtttgtggctctagtg

SEQ ID NO: 745982 - DNA, 20 bp, mouse
gcatggtataaaccacatga

SEQ ID NO: 745983 - DNA, 20 bp, mouse
gaaagcacctgcaagaggtg

SEQ ID NO: 745984 - DNA, 20 bp, mouse
ggaaagtgcgatcacaggcc

SEQ ID NO: 745985 - DNA, 20 bp, mouse
gcagttgcttcccaagagtg

SEQ ID NO: 745986 - DNA, 20 bp, mouse
gaaggtgggcggagtctcaa

SEQ ID NO: 745987 - DNA, 20 bp, mouse
gctccgagtggccgaggaaa

SEQ ID NO: 745988 - DNA, 20 bp, mouse
gaatctaaactgagattggg

SEQ ID NO: 745989 - DNA, 20 bp, mouse
ggcgacctctctgcaggcag

SEQ ID NO: 745990 - DNA, 20 bp, mouse
gaaagggtgtggactcagta

SEQ ID NO: 745991 - DNA, 20 bp, mouse
gctgcagagctgggtaaggt

SEQ ID NO: 745992 - DNA, 20 bp, mouse
gaagaaggcttctctccgag

SEQ ID NO: 745993 - DNA, 20 bp, mouse
gtctaaatatggctggagac

SEQ ID NO: 745994 - DNA, 20 bp, mouse
gccttcttctaaggcccaga

SEQ ID NO: 745995 - DNA, 20 bp, mouse
gagcccaaccctttcatctc

SEQ ID NO: 745996 - DNA, 20 bp, mouse
gaccagaagcatacaagaca

SEQ ID NO: 745997 - DNA, 20 bp, mouse
gaggaaggctaaacatctgg

SEQ ID NO: 745998 - DNA, 20 bp, mouse
gagacagggcatgctgaaac

SEQ ID NO: 745999 - DNA, 20 bp, mouse
gggggggaaatagtcactgc

SEQ ID NO: 746000 - DNA, 20 bp, mouse
gtcctagcttcatcataatg

SEQ ID NO: 746001 - DNA, 20 bp, mouse
gggtgatttcctaagtagag

SEQ ID NO: 746002 - DNA, 20 bp, mouse
gaggcaactgggccagcttt

SEQ ID NO: 746003 - DNA, 20 bp, mouse
gttgatattgtccatgtgtc

SEQ ID NO: 746004 - DNA, 20 bp, mouse
gggaagtaatactgaagcct

SEQ ID NO: 746005 - DNA, 20 bp, mouse
gaatcatacttggagtgggt

SEQ ID NO: 746006 - DNA, 20 bp, mouse
gccaagccgcggcaccacgg

SEQ ID NO: 746007 - DNA, 20 bp, mouse
ggggtccctcgcctcttcag

SEQ ID NO: 746008 - DNA, 20 bp, mouse
gagtccaagtagaggtcata

SEQ ID NO: 746009 - DNA, 20 bp, mouse
gcagctgcagctggtgtcgt

SEQ ID NO: 746010 - DNA, 20 bp, mouse
gggctcgcacggggcagcgc

SEQ ID NO: 746011 - DNA, 20 bp, mouse
gtaaaagctgcgggtggtaa

SEQ ID NO: 746012 - DNA, 20 bp, mouse
gggcgcagcaagcactggct

SEQ ID NO: 746013 - DNA, 20 bp, mouse
gggtagtccaagaatggctg

SEQ ID NO: 746014 - DNA, 20 bp, mouse
gcccggaacggggtcctccg

SEQ ID NO: 746015 - DNA, 20 bp, mouse
gtggctgaggtctggcaagg

SEQ ID NO: 746016 - DNA, 20 bp, mouse
gaagacaggggcttgttcaa

SEQ ID NO: 746017 - DNA, 20 bp, mouse
gcccatgacagcaagataaa

SEQ ID NO: 746018 - DNA, 20 bp, mouse
gatgggacacgagtttaatc

SEQ ID NO: 746019 - DNA, 20 bp, mouse
gggacacgagtttaatcagg

SEQ ID NO: 746020 - DNA, 20 bp, mouse
gtgtataagcataaagacag

SEQ ID NO: 746021 - DNA, 20 bp, mouse
gaaattaggaactgaaacta

SEQ ID NO: 746022 - DNA, 20 bp, mouse
gaaaatataacatttctttc

SEQ ID NO: 746023 - DNA, 20 bp, mouse
gacttattgttacacaaatt

SEQ ID NO: 746024 - DNA, 20 bp, mouse
ggtctgtatgcttaaattta

SEQ ID NO: 746025 - DNA, 20 bp, mouse
gagcttctaaagaactatat

SEQ ID NO: 746026 - DNA, 20 bp, mouse
gagtgcagctagggccctaa

SEQ ID NO: 746027 - DNA, 20 bp, mouse
gtgaagggcccaagtggtaa

SEQ ID NO: 746028 - DNA, 20 bp, mouse
gtcgcagaggaggttgtggg

SEQ ID NO: 746029 - DNA, 20 bp, mouse
gcatagatgcgtggaatcta

SEQ ID NO: 746030 - DNA, 20 bp, mouse
gactgagctagaaggttgta

SEQ ID NO: 746031 - DNA, 20 bp, mouse
gggcgtagggcatagatgcg

SEQ ID NO: 746032 - DNA, 20 bp, mouse
gatctagggcagtgcagcta

SEQ ID NO: 746033 - DNA, 20 bp, mouse
gaactcaaaggggcccggga

SEQ ID NO: 746034 - DNA, 20 bp, mouse
gacagagagtacagaccatt

SEQ ID NO: 746035 - DNA, 20 bp, mouse
gaggagccaagcaactcaaa

SEQ ID NO: 746036 - DNA, 20 bp, mouse
ggggttaaggacctggtcga

SEQ ID NO: 746037 - DNA, 20 bp, mouse
gtgtctctaaggctccacta

SEQ ID NO: 746038 - DNA, 20 bp, mouse
gggagcaagagaatgggtta

SEQ ID NO: 746039 - DNA, 20 bp, mouse
gtaagtgaaagccatcgacc

SEQ ID NO: 746040 - DNA, 20 bp, mouse
gcgccagcgtgccttactta

SEQ ID NO: 746041 - DNA, 20 bp, mouse
ggctaagtgcgtttagtgaa

SEQ ID NO: 746042 - DNA, 20 bp, mouse
gttcacttactattgtgtgc

SEQ ID NO: 746043 - DNA, 20 bp, mouse
gacacttaagagtgaagtgt

SEQ ID NO: 746044 - DNA, 20 bp, mouse
gatgttggggattgtctcta

SEQ ID NO: 746045 - DNA, 20 bp, mouse
gatcacaaaggcctccctag

SEQ ID NO: 746046 - DNA, 20 bp, mouse
gaacgcgggaagtaagtaga

SEQ ID NO: 746047 - DNA, 20 bp, mouse
ggaaggatgcagtttcacgt

SEQ ID NO: 746048 - DNA, 20 bp, mouse
gggcaaagaactaggatctg

SEQ ID NO: 746049 - DNA, 20 bp, mouse
gtgtcttagggcaaagaact

SEQ ID NO: 746050 - DNA, 20 bp, mouse
gcgtccctgcatggaccacg

SEQ ID NO: 746051 - DNA, 20 bp, mouse
ggggcaggatccctaggtta

SEQ ID NO: 746052 - DNA, 20 bp, mouse
ggctcgcgttgcgtgtctta

SEQ ID NO: 746053 - DNA, 20 bp, mouse
gtggtccatgcagggacggg

SEQ ID NO: 746054 - DNA, 20 bp, mouse
gtctgagggccgaacaacgc

SEQ ID NO: 746055 - DNA, 20 bp, mouse
gatgcagtttcacgtgggga

SEQ ID NO: 746056 - DNA, 20 bp, mouse
gtgcctgcgccaagccactt

SEQ ID NO: 746057 - DNA, 20 bp, mouse
gcacttcggggcggaagtaa

SEQ ID NO: 746058 - DNA, 20 bp, mouse
ggcgccaagccacttcgggg

SEQ ID NO: 746059 - DNA, 20 bp, mouse
ggcgatcggaacccgaacaa

SEQ ID NO: 746060 - DNA, 20 bp, mouse
gaagcccccttaaagggaca

SEQ ID NO: 746061 - DNA, 20 bp, mouse
gaggcacgtggacgggagta

SEQ ID NO: 746062 - DNA, 20 bp, mouse
gttaaggggaaagcttgagg

SEQ ID NO: 746063 - DNA, 20 bp, mouse
gctgttaaggggaaagcttg

SEQ ID NO: 746064 - DNA, 20 bp, mouse
gaggcagagtggtgcagtga

SEQ ID NO: 746065 - DNA, 20 bp, mouse
ggtggcttggcgcaggcacg

SEQ ID NO: 746066 - DNA, 20 bp, mouse
gggagcgatccgggtaaggg

SEQ ID NO: 746067 - DNA, 20 bp, mouse
gaggcggcgctgcgcgtccc

SEQ ID NO: 746068 - DNA, 20 bp, mouse
gtggcggagcgatccgggta

SEQ ID NO: 746069 - DNA, 20 bp, mouse
ggcccccgcggttcgtccca

SEQ ID NO: 746070 - DNA, 20 bp, mouse
gcgcgcgcgaacttagtcag

SEQ ID NO: 746071 - DNA, 20 bp, mouse
gcaaggccgggtggactctc

SEQ ID NO: 746072 - DNA, 20 bp, mouse
ggaggaggagcggagcgcgc

SEQ ID NO: 746073 - DNA, 20 bp, mouse
ggccgggtggcggagcgatc

SEQ ID NO: 746074 - DNA, 20 bp, mouse
ggcgccgcgtcacaatggag

SEQ ID NO: 746075 - DNA, 20 bp, mouse
gtcgcccagcctggcatccg

SEQ ID NO: 746076 - DNA, 20 bp, mouse
gccagccccggggtcgccgt

SEQ ID NO: 746077 - DNA, 20 bp, mouse
ggcagccgacggcgaccccg

SEQ ID NO: 746078 - DNA, 20 bp, mouse
ggccagccccgctgtgacgc

SEQ ID NO: 746079 - DNA, 20 bp, mouse
ggggaaatcaagcctctccg

SEQ ID NO: 746080 - DNA, 20 bp, mouse
ggcggcggctcggcagccga

SEQ ID NO: 746081 - DNA, 20 bp, mouse
gcgggccccgggttccccac

SEQ ID NO: 746082 - DNA, 20 bp, mouse
ggagaggcttgatttcccgg

SEQ ID NO: 746083 - DNA, 20 bp, mouse
gaggagctgcggtgtaagag

SEQ ID NO: 746084 - DNA, 20 bp, mouse
gcccgcctgccctggacgcc

SEQ ID NO: 746085 - DNA, 20 bp, mouse
gcgctgcctgcgtcacagcg

SEQ ID NO: 746086 - DNA, 20 bp, mouse
gcctgcctagggggtcggtc

SEQ ID NO: 746087 - DNA, 20 bp, mouse
gaggcccgggcccgccccat

SEQ ID NO: 746088 - DNA, 20 bp, mouse
gtcggtccggctgacccgag

SEQ ID NO: 746089 - DNA, 20 bp, mouse
gcccagcccggttgcttcaa

SEQ ID NO: 746090 - DNA, 20 bp, mouse
gtccgtgcgcgcgaacgcag

SEQ ID NO: 746091 - DNA, 20 bp, mouse
gtcagccggaccgaccccct

SEQ ID NO: 746092 - DNA, 20 bp, mouse
gaccccgccgcgcctgccta

SEQ ID NO: 746093 - DNA, 20 bp, mouse
ggggaggtgaccgggattct

SEQ ID NO: 746094 - DNA, 20 bp, mouse
gtgcacgaggcggagaagaa

SEQ ID NO: 746095 - DNA, 20 bp, mouse
ggccgcggactcagggtcca

SEQ ID NO: 746096 - DNA, 20 bp, mouse
gagagatattcctgagacaa

SEQ ID NO: 746097 - DNA, 20 bp, mouse
gggccagagagggtgagtca

SEQ ID NO: 746098 - DNA, 20 bp, mouse
gcggggccgaacaatcccgg

SEQ ID NO: 746099 - DNA, 20 bp, mouse
gtggacaggtgtcagcgaag

SEQ ID NO: 746100 - DNA, 20 bp, mouse
gaggcggggccgaacaatcc

SEQ ID NO: 746101 - DNA, 20 bp, mouse
gttctacagacccttgtctc

SEQ ID NO: 746102 - DNA, 20 bp, mouse
gtggcactaaagctcagtgg

SEQ ID NO: 746103 - DNA, 20 bp, mouse
gttcccgggcgggccagaga

SEQ ID NO: 746104 - DNA, 20 bp, mouse
gagagagggtgagtcagggc

SEQ ID NO: 746105 - DNA, 20 bp, mouse
ggccagctggggatgcttag

SEQ ID NO: 746106 - DNA, 20 bp, mouse
gctgacccagaggtcaaggg

SEQ ID NO: 746107 - DNA, 20 bp, mouse
gaggggaggtcttccggaag

SEQ ID NO: 746108 - DNA, 20 bp, mouse
gggaccgaggccatcagcgg

SEQ ID NO: 746109 - DNA, 20 bp, mouse
gcggtctggcgcttgccctt

SEQ ID NO: 746110 - DNA, 20 bp, mouse
gaccggctgccaccgctccg

SEQ ID NO: 746111 - DNA, 20 bp, mouse
gcgggagtcttaacaaaggt

SEQ ID NO: 746112 - DNA, 20 bp, mouse
gctaagaactaggcagcgac

SEQ ID NO: 746113 - DNA, 20 bp, mouse
gtaagaggacagggggagac

SEQ ID NO: 746114 - DNA, 20 bp, mouse
ggaaggggatggcgaggacg

SEQ ID NO: 746115 - DNA, 20 bp, mouse
gagtcttaacaaaggtggga

SEQ ID NO: 746116 - DNA, 20 bp, mouse
gcaacggcgccgctcaaaga

SEQ ID NO: 746117 - DNA, 20 bp, mouse
ggggagcggggagtgagcaa

SEQ ID NO: 746118 - DNA, 20 bp, mouse
gaacgcctccatatggcagt

SEQ ID NO: 746119 - DNA, 20 bp, mouse
ggtaaagcctttccatttgt

SEQ ID NO: 746120 - DNA, 20 bp, mouse
gaaagagggcttgactttta

SEQ ID NO: 746121 - DNA, 20 bp, mouse
gagggcggggaaagtgcggc

SEQ ID NO: 746122 - DNA, 20 bp, mouse
ggcggggagtgagcaagggg

SEQ ID NO: 746123 - DNA, 20 bp, mouse
gccctgcgcggccgcaaagc

SEQ ID NO: 746124 - DNA, 20 bp, mouse
ggcggggaaagtgcggcagg

SEQ ID NO: 746125 - DNA, 20 bp, mouse
gaagtcaagccctctttgag

SEQ ID NO: 746126 - DNA, 20 bp, mouse
gtaggctgcaagatctccta

SEQ ID NO: 746127 - DNA, 20 bp, mouse
gtggtcgcaagggttgcttt

SEQ ID NO: 746128 - DNA, 20 bp, mouse
gctggccagagaaggctgct

SEQ ID NO: 746129 - DNA, 20 bp, mouse
gagagggaggcgggacacaa

SEQ ID NO: 746130 - DNA, 20 bp, mouse
ggtggcgatggtggttgcgc

SEQ ID NO: 746131 - DNA, 20 bp, mouse
ggagctggctttggtcgcaa

SEQ ID NO: 746132 - DNA, 20 bp, mouse
gccagctcataaacgccaga

SEQ ID NO: 746133 - DNA, 20 bp, mouse
ggatgggtgtggataaacat

SEQ ID NO: 746134 - DNA, 20 bp, mouse
gtgcaagatctcctaaggag

SEQ ID NO: 746135 - DNA, 20 bp, mouse
gtctgtgattgtggcgatgg

SEQ ID NO: 746136 - DNA, 20 bp, mouse
gtgggtggaaccatagagga

SEQ ID NO: 746137 - DNA, 20 bp, mouse
gtggaaagagcgcgggaaag

SEQ ID NO: 746138 - DNA, 20 bp, mouse
gaggctgggtggaaccatag

SEQ ID NO: 746139 - DNA, 20 bp, mouse
gaggagctggggtcccgggt

SEQ ID NO: 746140 - DNA, 20 bp, mouse
gaggaaggagaggcgggcat

SEQ ID NO: 746141 - DNA, 20 bp, mouse
gaggaaggggtacaaccccc

SEQ ID NO: 746142 - DNA, 20 bp, mouse
gagcgtgggtggggctacgg

SEQ ID NO: 746143 - DNA, 20 bp, mouse
gtggctgagagtgccatcgt

SEQ ID NO: 746144 - DNA, 20 bp, mouse
gactcagctggggacggcca

SEQ ID NO: 746145 - DNA, 20 bp, mouse
gcgactaaagtggcagaatg

SEQ ID NO: 746146 - DNA, 20 bp, mouse
gtaccccgagaccgcgaggt

SEQ ID NO: 746147 - DNA, 20 bp, mouse
gagaccgcgaggtgggacgc

SEQ ID NO: 746148 - DNA, 20 bp, mouse
gaggccggggccaggaccgc

SEQ ID NO: 746149 - DNA, 20 bp, mouse
ggggacgcagggacgcatgg

SEQ ID NO: 746150 - DNA, 20 bp, mouse
gaagctgaggatagggacac

SEQ ID NO: 746151 - DNA, 20 bp, mouse
gtggcagggaagctgaggat

SEQ ID NO: 746152 - DNA, 20 bp, mouse
gcgcggggctgggaacgcgg

SEQ ID NO: 746153 - DNA, 20 bp, mouse
gcaggaccgcggggatcctc

SEQ ID NO: 746154 - DNA, 20 bp, mouse
gaaagtggaacccacaaaag

SEQ ID NO: 746155 - DNA, 20 bp, mouse
gggagaaactcaggcggtgg

SEQ ID NO: 746156 - DNA, 20 bp, mouse
gtagccaggtggcctcaaag

SEQ ID NO: 746157 - DNA, 20 bp, mouse
gcgcagggctcgcgggtgac

SEQ ID NO: 746158 - DNA, 20 bp, mouse
gcgggcctggtcccgagcgt

SEQ ID NO: 746159 - DNA, 20 bp, mouse
ggtggcaggcggcggggtag

SEQ ID NO: 746160 - DNA, 20 bp, mouse
ggaggctactggctggaccg

SEQ ID NO: 746161 - DNA, 20 bp, mouse
gccgcggagcgcagggctcg

SEQ ID NO: 746162 - DNA, 20 bp, mouse
gagacacgctcgacacgcac

SEQ ID NO: 746163 - DNA, 20 bp, mouse
ggcggggtagcggacgcgcg

SEQ ID NO: 746164 - DNA, 20 bp, mouse
gcggaagtacttgtggcagg

SEQ ID NO: 746165 - DNA, 20 bp, mouse
ggcacctggcgcgcagtctg

SEQ ID NO: 746166 - DNA, 20 bp, mouse
gctagggcaccggtaaggaa

SEQ ID NO: 746167 - DNA, 20 bp, mouse
gtggagcagcccttccttac

SEQ ID NO: 746168 - DNA, 20 bp, mouse
gtcctgctagggcaccggta

SEQ ID NO: 746169 - DNA, 20 bp, mouse
gtggaattagaattgcattt

SEQ ID NO: 746170 - DNA, 20 bp, mouse
gaaagttgtttgtcctgcta

SEQ ID NO: 746171 - DNA, 20 bp, mouse
gtgctccacagtctgcagat

SEQ ID NO: 746172 - DNA, 20 bp, mouse
gttggctgttgccatggcta

SEQ ID NO: 746173 - DNA, 20 bp, mouse
ggctcaacaaaccgtagcca

SEQ ID NO: 746174 - DNA, 20 bp, mouse
gaacaactttgattctactt

SEQ ID NO: 746175 - DNA, 20 bp, mouse
gagaattgcatttcgggacc

SEQ ID NO: 746176 - DNA, 20 bp, mouse
gtggcctggccaggacggag

SEQ ID NO: 746177 - DNA, 20 bp, mouse
gtgcgtgctaagtgtgctcc

SEQ ID NO: 746178 - DNA, 20 bp, mouse
gacaggaaggggtatcggac

SEQ ID NO: 746179 - DNA, 20 bp, mouse
gtctccgcgaagccaccctg

SEQ ID NO: 746180 - DNA, 20 bp, mouse
ggcttcgcggagagacgcca

SEQ ID NO: 746181 - DNA, 20 bp, mouse
gggaaggcgctctccgtgca

SEQ ID NO: 746182 - DNA, 20 bp, mouse
gaggacggagcggacaggaa

SEQ ID NO: 746183 - DNA, 20 bp, mouse
gctgcgcggggtccttggga

SEQ ID NO: 746184 - DNA, 20 bp, mouse
ggaagctgcgcggggtcctt

SEQ ID NO: 746185 - DNA, 20 bp, mouse
gaatctgcgcagtttccgca

SEQ ID NO: 746186 - DNA, 20 bp, mouse
gcggacctcgacctctaaag

SEQ ID NO: 746187 - DNA, 20 bp, mouse
gggcaccgggctctaggcga

SEQ ID NO: 746188 - DNA, 20 bp, mouse
gctaaagaggaaggccgccg

SEQ ID NO: 746189 - DNA, 20 bp, mouse
gcgagctgggtaaggggcac

SEQ ID NO: 746190 - DNA, 20 bp, mouse
ggcagaagccccaggtatgg

SEQ ID NO: 746191 - DNA, 20 bp, mouse
gcgcaaagcgagctgggtaa

SEQ ID NO: 746192 - DNA, 20 bp, mouse
ggaagacaggggaccagcgt

SEQ ID NO: 746193 - DNA, 20 bp, mouse
gggggaccagcgttggtcaa

SEQ ID NO: 746194 - DNA, 20 bp, mouse
gtagtgggccgagccctgtg

SEQ ID NO: 746195 - DNA, 20 bp, mouse
gtggttactggactcgtagt

SEQ ID NO: 746196 - DNA, 20 bp, mouse
gcatccaggggaggtcgggg

SEQ ID NO: 746197 - DNA, 20 bp, mouse
gcaggccatccaggggaggt

SEQ ID NO: 746198 - DNA, 20 bp, mouse
ggaagcagggctgtgccaga

SEQ ID NO: 746199 - DNA, 20 bp, mouse
gcggccgccccgacctcccc

SEQ ID NO: 746200 - DNA, 20 bp, mouse
gaaccgaggcaggccatcca

SEQ ID NO: 746201 - DNA, 20 bp, mouse
gttccctagctgcaagatgt

SEQ ID NO: 746202 - DNA, 20 bp, mouse
ggcagcaaagcattcaaatt

SEQ ID NO: 746203 - DNA, 20 bp, mouse
gtgtgcctcggtagacgctt

SEQ ID NO: 746204 - DNA, 20 bp, mouse
gcaccgacatcttgcagcta

SEQ ID NO: 746205 - DNA, 20 bp, mouse
gggcacaagagcagtgagct

SEQ ID NO: 746206 - DNA, 20 bp, mouse
ggcgccgctgggaactccgc

SEQ ID NO: 746207 - DNA, 20 bp, mouse
gttcctgaaaggggccaact

SEQ ID NO: 746208 - DNA, 20 bp, mouse
gccgccactaagaatagcaa

SEQ ID NO: 746209 - DNA, 20 bp, mouse
gtccccggcggagttcccag

SEQ ID NO: 746210 - DNA, 20 bp, mouse
gagaatagcaaaggggcgtt

SEQ ID NO: 746211 - DNA, 20 bp, mouse
gctgaaaggggccaactggg

SEQ ID NO: 746212 - DNA, 20 bp, mouse
ggcccctttgctattcttag

SEQ ID NO: 746213 - DNA, 20 bp, mouse
gcggcgcgatgcggctgggc

SEQ ID NO: 746214 - DNA, 20 bp, mouse
ggtccccagccgcgcccaga

SEQ ID NO: 746215 - DNA, 20 bp, mouse
ggggcgcggctggggaccga

SEQ ID NO: 746216 - DNA, 20 bp, mouse
gtaggcgcagtcccgcgctg

SEQ ID NO: 746217 - DNA, 20 bp, mouse
gccgcccgctacgcccgcct

SEQ ID NO: 746218 - DNA, 20 bp, mouse
gtgtagcccgcccaacaaag

SEQ ID NO: 746219 - DNA, 20 bp, mouse
gcccgagctgcccctttgtt

SEQ ID NO: 746220 - DNA, 20 bp, mouse
gacagatggtgccccagcgc

SEQ ID NO: 746221 - DNA, 20 bp, mouse
gggagaggaaggcaaggaca

SEQ ID NO: 746222 - DNA, 20 bp, mouse
gagggacgaaagactgtgac

SEQ ID NO: 746223 - DNA, 20 bp, mouse
gctgcggggagcacaaagcg

SEQ ID NO: 746224 - DNA, 20 bp, mouse
gtgcgcctaggcgggcgtag

SEQ ID NO: 746225 - DNA, 20 bp, mouse
gcagcgatctggcaggccca

SEQ ID NO: 746226 - DNA, 20 bp, mouse
gccagaggaaggagttgggt

SEQ ID NO: 746227 - DNA, 20 bp, mouse
gtcagcttgtaggacaggtg

SEQ ID NO: 746228 - DNA, 20 bp, mouse
ggggaggaggcgaccggagt

SEQ ID NO: 746229 - DNA, 20 bp, mouse
ggcgtggcaagcagacaggg

SEQ ID NO: 746230 - DNA, 20 bp, mouse
gaccgctcaaactacagcat

SEQ ID NO: 746231 - DNA, 20 bp, mouse
gcgaccggagtgggctaggg

SEQ ID NO: 746232 - DNA, 20 bp, mouse
gccttctgcatcaagaccca

SEQ ID NO: 746233 - DNA, 20 bp, mouse
ggagaagggcatagcgcttg

SEQ ID NO: 746234 - DNA, 20 bp, mouse
gcgagcgcgagcagccagga

SEQ ID NO: 746235 - DNA, 20 bp, mouse
gcgcggcggagcagctagtg

SEQ ID NO: 746236 - DNA, 20 bp, mouse
gcaggctgcttcagccaacc

SEQ ID NO: 746237 - DNA, 20 bp, mouse
gtcctatgacagtgctgctt

SEQ ID NO: 746238 - DNA, 20 bp, mouse
ggactgatcacattccaaat

SEQ ID NO: 746239 - DNA, 20 bp, mouse
gctgaacttcacagacaggg

SEQ ID NO: 746240 - DNA, 20 bp, mouse
gctgcttcagccaaccaggc

SEQ ID NO: 746241 - DNA, 20 bp, mouse
gcaccctccactccccagag

SEQ ID NO: 746242 - DNA, 20 bp, mouse
ggaagcgattggctcctctc

SEQ ID NO: 746243 - DNA, 20 bp, mouse
gcgctgcacattgctccaaa

SEQ ID NO: 746244 - DNA, 20 bp, mouse
gtggaatgtgatcagtcatt

SEQ ID NO: 746245 - DNA, 20 bp, mouse
gctattagctgcatgcacat

SEQ ID NO: 746246 - DNA, 20 bp, mouse
ggaggcctgaggcgagaggg

SEQ ID NO: 746247 - DNA, 20 bp, mouse
ggctgggaatgccaggtcta

SEQ ID NO: 746248 - DNA, 20 bp, mouse
gttagcaaagaaagaggacg

SEQ ID NO: 746249 - DNA, 20 bp, mouse
gtggctggaatcacctagaa

SEQ ID NO: 746250 - DNA, 20 bp, mouse
gaattcttggtggggaagga

SEQ ID NO: 746251 - DNA, 20 bp, mouse
gcgtcctggtgggcctggga

SEQ ID NO: 746252 - DNA, 20 bp, mouse
gagagaggcctgaggcgaga

SEQ ID NO: 746253 - DNA, 20 bp, mouse
gaaacaacagaattcttggt

SEQ ID NO: 746254 - DNA, 20 bp, mouse
gggagactaagattcctgtg

SEQ ID NO: 746255 - DNA, 20 bp, mouse
ggtcagctctgaatgtcaga

SEQ ID NO: 746256 - DNA, 20 bp, mouse
ggggagaggagtattatcgg

SEQ ID NO: 746257 - DNA, 20 bp, mouse
gggactgagtcacggggcca

SEQ ID NO: 746258 - DNA, 20 bp, mouse
gctgacagaggaatgaaatg

SEQ ID NO: 746259 - DNA, 20 bp, mouse
gcacctggctggtatcagac

SEQ ID NO: 746260 - DNA, 20 bp, mouse
ggatgcctgggttctgacag

SEQ ID NO: 746261 - DNA, 20 bp, mouse
gatggggagaggagtattat

SEQ ID NO: 746262 - DNA, 20 bp, mouse
gcacatgcagcggtttcagc

SEQ ID NO: 746263 - DNA, 20 bp, mouse
gccaggaactgagaatccaa

SEQ ID NO: 746264 - DNA, 20 bp, mouse
ggggagggagggcacctggc

SEQ ID NO: 746265 - DNA, 20 bp, mouse
gcctcccaatggacagaaaa

SEQ ID NO: 746266 - DNA, 20 bp, mouse
gaacaccggcagattgaaaa

SEQ ID NO: 746267 - DNA, 20 bp, mouse
gcaggctcgcgcacactcct

SEQ ID NO: 746268 - DNA, 20 bp, mouse
gctccgagcacctccaacac

SEQ ID NO: 746269 - DNA, 20 bp, mouse
gagtgtgcgcgagcctgcac

SEQ ID NO: 746270 - DNA, 20 bp, mouse
gcccaaagaaaggttggcgg

SEQ ID NO: 746271 - DNA, 20 bp, mouse
ggctcgcgcacactcctcgg

SEQ ID NO: 746272 - DNA, 20 bp, mouse
gccggcagattgaaaagggg

SEQ ID NO: 746273 - DNA, 20 bp, mouse
gacaagatatatctaaatga

SEQ ID NO: 746274 - DNA, 20 bp, mouse
gtgccggtgttggaggtgct

SEQ ID NO: 746275 - DNA, 20 bp, mouse
gagaaaggttggcggtgggg

SEQ ID NO: 746276 - DNA, 20 bp, mouse
gagtgtaggaagcaacaatg

SEQ ID NO: 746277 - DNA, 20 bp, mouse
gaccacacagcactgtatat

SEQ ID NO: 746278 - DNA, 20 bp, mouse
ggtatataggctgacgtcac

SEQ ID NO: 746279 - DNA, 20 bp, mouse
gtccaactcactgttcagat

SEQ ID NO: 746280 - DNA, 20 bp, mouse
gacaaggtacgcctctgctc

SEQ ID NO: 746281 - DNA, 20 bp, mouse
ggtgctttgtaacagtgtca

SEQ ID NO: 746282 - DNA, 20 bp, mouse
ggcagaggcgtaccttgtat

SEQ ID NO: 746283 - DNA, 20 bp, mouse
ggggtgacgtgtcttttgtt

SEQ ID NO: 746284 - DNA, 20 bp, mouse
gaaagtgtgactgactgtgt

SEQ ID NO: 746285 - DNA, 20 bp, mouse
gtctcatctcttgtaaacag

SEQ ID NO: 746286 - DNA, 20 bp, mouse
gtggctcaataggaagtgaa

SEQ ID NO: 746287 - DNA, 20 bp, mouse
ggtaaagctgcccccagtgg

SEQ ID NO: 746288 - DNA, 20 bp, mouse
gggaaaatgaatggttcttt

SEQ ID NO: 746289 - DNA, 20 bp, mouse
ggcaaatgagcaggctctgc

SEQ ID NO: 746290 - DNA, 20 bp, mouse
gttcttttgggtggctcaat

SEQ ID NO: 746291 - DNA, 20 bp, mouse
gcagctcaaagcctacactg

SEQ ID NO: 746292 - DNA, 20 bp, mouse
gagcagacgcagacagttac

SEQ ID NO: 746293 - DNA, 20 bp, mouse
gtatgtaaagctgcccccag

SEQ ID NO: 746294 - DNA, 20 bp, mouse
gtgactccgagaggtcaaac

SEQ ID NO: 746295 - DNA, 20 bp, mouse
gatagtgttccccaccactg

SEQ ID NO: 746296 - DNA, 20 bp, mouse
gtatactactggagcggcgg

SEQ ID NO: 746297 - DNA, 20 bp, mouse
gcagccttccctgctcagaa

SEQ ID NO: 746298 - DNA, 20 bp, mouse
gcagctgttagcaacttcct

SEQ ID NO: 746299 - DNA, 20 bp, mouse
gaggaacaagtgagcttgtc

SEQ ID NO: 746300 - DNA, 20 bp, mouse
gacggatcacagacatttgg

SEQ ID NO: 746301 - DNA, 20 bp, mouse
gactggagcggcggggggtt

SEQ ID NO: 746302 - DNA, 20 bp, mouse
gaatgaggacatatcactcg

SEQ ID NO: 746303 - DNA, 20 bp, mouse
gttccctttctgagcaggga

SEQ ID NO: 746304 - DNA, 20 bp, mouse
gagtgtgctctctctcgaat

SEQ ID NO: 746305 - DNA, 20 bp, mouse
ggactgatggtgctcagagc

SEQ ID NO: 746306 - DNA, 20 bp, mouse
gggcctggcgggtctccctt

SEQ ID NO: 746307 - DNA, 20 bp, mouse
gccgcgcccgggtgctgtcc

SEQ ID NO: 746308 - DNA, 20 bp, mouse
gcagcacccgggcgcggcga

SEQ ID NO: 746309 - DNA, 20 bp, mouse
gaccccaacgaggtcaaagt

SEQ ID NO: 746310 - DNA, 20 bp, mouse
gcgcccacgccggatatagg

SEQ ID NO: 746311 - DNA, 20 bp, mouse
gggctgccacgtgtgtaaga

SEQ ID NO: 746312 - DNA, 20 bp, mouse
gaggccccgggacagcaccc

SEQ ID NO: 746313 - DNA, 20 bp, mouse
gcacgggccgccagagcgtc

SEQ ID NO: 746314 - DNA, 20 bp, mouse
ggtgtcgcccagagactggg

SEQ ID NO: 746315 - DNA, 20 bp, mouse
gagggagcccgacgctctgg

SEQ ID NO: 746316 - DNA, 20 bp, mouse
gcccccaccaccaccagtga

SEQ ID NO: 746317 - DNA, 20 bp, mouse
gagtgagggttgactcagca

SEQ ID NO: 746318 - DNA, 20 bp, mouse
gagtcaaccctcactggtgg

SEQ ID NO: 746319 - DNA, 20 bp, mouse
gctgagtcaaccctcactgg

SEQ ID NO: 746320 - DNA, 20 bp, mouse
gaaccctcactggtggtggt

SEQ ID NO: 746321 - DNA, 20 bp, mouse
gggtacgaatccctaaccta

SEQ ID NO: 746322 - DNA, 20 bp, mouse
ggaaactgtcagcctccagc

SEQ ID NO: 746323 - DNA, 20 bp, mouse
ggttgcaagaccctaggtta

SEQ ID NO: 746324 - DNA, 20 bp, mouse
gtcaacgcagctaatctcca

SEQ ID NO: 746325 - DNA, 20 bp, mouse
gagccacagccggattaaga

SEQ ID NO: 746326 - DNA, 20 bp, mouse
gagctggggcgcatctgcga

SEQ ID NO: 746327 - DNA, 20 bp, mouse
ggcagcaggagagcgtttgt

SEQ ID NO: 746328 - DNA, 20 bp, mouse
gtcccaggagcggccatctc

SEQ ID NO: 746329 - DNA, 20 bp, mouse
gggaggaagacagaccgaag

SEQ ID NO: 746330 - DNA, 20 bp, mouse
ggggtcctgtaccccttgga

SEQ ID NO: 746331 - DNA, 20 bp, mouse
gggggcgcatctgcgatggc

SEQ ID NO: 746332 - DNA, 20 bp, mouse
gctgtagtacctgtagtctg

SEQ ID NO: 746333 - DNA, 20 bp, mouse
gtagaaggcaggaccttcca

SEQ ID NO: 746334 - DNA, 20 bp, mouse
gtgtgcacacggggaactga

SEQ ID NO: 746335 - DNA, 20 bp, mouse
ggccagagatggccgctcct

SEQ ID NO: 746336 - DNA, 20 bp, mouse
gtgcgctcttaactgatcgg

SEQ ID NO: 746337 - DNA, 20 bp, mouse
gcctgaaggcagatctgcca

SEQ ID NO: 746338 - DNA, 20 bp, mouse
gtgcaggagtgcggctgtaa

SEQ ID NO: 746339 - DNA, 20 bp, mouse
ggcgcaggcgcgagacgcag

SEQ ID NO: 746340 - DNA, 20 bp, mouse
gaagcaggaggtggggcgta

SEQ ID NO: 746341 - DNA, 20 bp, mouse
gctcgcagataagacaggtc

SEQ ID NO: 746342 - DNA, 20 bp, mouse
gaactgatcggaggacgcga

SEQ ID NO: 746343 - DNA, 20 bp, mouse
gctgccttcaggtacggact

SEQ ID NO: 746344 - DNA, 20 bp, mouse
gtgtctctcgcagataagac

SEQ ID NO: 746345 - DNA, 20 bp, mouse
gtgatcggaggacgcgatgg

SEQ ID NO: 746346 - DNA, 20 bp, mouse
gaagcaaggggccacgctga

SEQ ID NO: 746347 - DNA, 20 bp, mouse
gaggggccacgctgaggggt

SEQ ID NO: 746348 - DNA, 20 bp, mouse
ggaaaaccagcagggtaggg

SEQ ID NO: 746349 - DNA, 20 bp, mouse
ggcagtagcggcagcaaccc

SEQ ID NO: 746350 - DNA, 20 bp, mouse
gaaccagcagggtagggggg

SEQ ID NO: 746351 - DNA, 20 bp, mouse
gggcagttgtgcaaagcaag

SEQ ID NO: 746352 - DNA, 20 bp, mouse
ggcgcatcaggctttcattg

SEQ ID NO: 746353 - DNA, 20 bp, mouse
gggaggaggggatgacgtgg

SEQ ID NO: 746354 - DNA, 20 bp, mouse
ggtactgttaagacagggaa

SEQ ID NO: 746355 - DNA, 20 bp, mouse
gaggacaacagctccatctg

SEQ ID NO: 746356 - DNA, 20 bp, mouse
gaaacagtggagtacaagtc

SEQ ID NO: 746357 - DNA, 20 bp, mouse
gcagtccggaagtgtaacag

SEQ ID NO: 746358 - DNA, 20 bp, mouse
gtcaaaatggaaacagtcgt

SEQ ID NO: 746359 - DNA, 20 bp, mouse
gtaccccgctgttacacttc

SEQ ID NO: 746360 - DNA, 20 bp, mouse
ggcgaggcttccggtttctc

SEQ ID NO: 746361 - DNA, 20 bp, mouse
gtaaagtccggcgggaaatt

SEQ ID NO: 746362 - DNA, 20 bp, mouse
gagtcgtaggagtagccata

SEQ ID NO: 746363 - DNA, 20 bp, mouse
gactaactccatcttccccg

SEQ ID NO: 746364 - DNA, 20 bp, mouse
gttttctcggtgattcctta

SEQ ID NO: 746365 - DNA, 20 bp, mouse
gcccgccggactttaaacag

SEQ ID NO: 746366 - DNA, 20 bp, mouse
ggaagtccaggtcggaaggg

SEQ ID NO: 746367 - DNA, 20 bp, mouse
gggtcgggaaagcgaggcga

SEQ ID NO: 746368 - DNA, 20 bp, mouse
gtcaatccgggcctcgggtc

SEQ ID NO: 746369 - DNA, 20 bp, mouse
ggggaggctccggacgaaga

SEQ ID NO: 746370 - DNA, 20 bp, mouse
ggaacggtcatggacggtac

SEQ ID NO: 746371 - DNA, 20 bp, mouse
gcaaggggcgggaccggctc

SEQ ID NO: 746372 - DNA, 20 bp, mouse
gtgcgcaatgggacggtcgt

SEQ ID NO: 746373 - DNA, 20 bp, mouse
gcagtgaagtccaggtcgga

SEQ ID NO: 746374 - DNA, 20 bp, mouse
ggcagcgctcgtcacgcgtg

SEQ ID NO: 746375 - DNA, 20 bp, mouse
gagcgcctcagggccgacat

SEQ ID NO: 746376 - DNA, 20 bp, mouse
ggatgcggactacaagtccc

SEQ ID NO: 746377 - DNA, 20 bp, mouse
gcaaaacccgcccgtgtcta

SEQ ID NO: 746378 - DNA, 20 bp, mouse
ggggtggtgcccctagacac

SEQ ID NO: 746379 - DNA, 20 bp, mouse
gtgagctcatggcgttaagt

SEQ ID NO: 746380 - DNA, 20 bp, mouse
ggtgtggcgcgcggcctcct

SEQ ID NO: 746381 - DNA, 20 bp, mouse
gagccggagcctacaaaggt

SEQ ID NO: 746382 - DNA, 20 bp, mouse
gtgatgctctgggtcttccg

SEQ ID NO: 746383 - DNA, 20 bp, mouse
gtccaagccggagcctacaa

SEQ ID NO: 746384 - DNA, 20 bp, mouse
gtggaggcgtagcgcgcgga

SEQ ID NO: 746385 - DNA, 20 bp, mouse
ggtagcgcgcggaaggcgga

SEQ ID NO: 746386 - DNA, 20 bp, mouse
ggggcagcatagattcgctc

SEQ ID NO: 746387 - DNA, 20 bp, mouse
gggggcgtggcgcaaggcag

SEQ ID NO: 746388 - DNA, 20 bp, mouse
gaaggcaggggcgtgctgag

SEQ ID NO: 746389 - DNA, 20 bp, mouse
ggagccgagccgccagaggg

SEQ ID NO: 746390 - DNA, 20 bp, mouse
gtccccttgagccgcggctg

SEQ ID NO: 746391 - DNA, 20 bp, mouse
gaaggagccgagccgccaga

SEQ ID NO: 746392 - DNA, 20 bp, mouse
ggctgcgcagtgccgccctc

SEQ ID NO: 746393 - DNA, 20 bp, mouse
gagtgcgtccccttgagccg

SEQ ID NO: 746394 - DNA, 20 bp, mouse
gtgagaggcgtgacctgctc

SEQ ID NO: 746395 - DNA, 20 bp, mouse
ggcctccacagacagcagac

SEQ ID NO: 746396 - DNA, 20 bp, mouse
gtggccgagcagaccggcag

SEQ ID NO: 746397 - DNA, 20 bp, mouse
gggaacttggccgagcagac

SEQ ID NO: 746398 - DNA, 20 bp, mouse
ggtgccgctgccggtctgct

SEQ ID NO: 746399 - DNA, 20 bp, mouse
ggtgctgacgtcatgcgcag

SEQ ID NO: 746400 - DNA, 20 bp, mouse
ggcgtggcctggcgctgggt

SEQ ID NO: 746401 - DNA, 20 bp, mouse
gaaggctaaatgatttacgt

SEQ ID NO: 746402 - DNA, 20 bp, mouse
ggtaaaaaatgtgccgctgc

SEQ ID NO: 746403 - DNA, 20 bp, mouse
gcgcctcgcgcgtcgcgtcg

SEQ ID NO: 746404 - DNA, 20 bp, mouse
gcgggagccttaggtagaag

SEQ ID NO: 746405 - DNA, 20 bp, mouse
ggcttccaacagagctttgc

SEQ ID NO: 746406 - DNA, 20 bp, mouse
gtcgcgggaagactagacga

SEQ ID NO: 746407 - DNA, 20 bp, mouse
gcgagctcacggacggtccc

SEQ ID NO: 746408 - DNA, 20 bp, mouse
gtcccgggctctttccgcgg

SEQ ID NO: 746409 - DNA, 20 bp, mouse
ggactcgccgagctcacgga

SEQ ID NO: 746410 - DNA, 20 bp, mouse
gcaagcgctctgggccgccg

SEQ ID NO: 746411 - DNA, 20 bp, mouse
ggccgccgcggaaagagccc

SEQ ID NO: 746412 - DNA, 20 bp, mouse
gctccggagccgctctccgc

SEQ ID NO: 746413 - DNA, 20 bp, mouse
gggagagcggctccggagct

SEQ ID NO: 746414 - DNA, 20 bp, mouse
gcggtcccgggctctttccg

SEQ ID NO: 746415 - DNA, 20 bp, mouse
gcacggcacctagatgtcgc

SEQ ID NO: 746416 - DNA, 20 bp, mouse
gacccggagaggcaggtccc

SEQ ID NO: 746417 - DNA, 20 bp, mouse
gagcgaggcccgccgggaac

SEQ ID NO: 746418 - DNA, 20 bp, mouse
gggccggggacctgcctctc

SEQ ID NO: 746419 - DNA, 20 bp, mouse
ggggcctcgctcaccgcttc

SEQ ID NO: 746420 - DNA, 20 bp, mouse
gggcccgccgggaaccggct

SEQ ID NO: 746421 - DNA, 20 bp, mouse
gccggcagcgaggagccaat

SEQ ID NO: 746422 - DNA, 20 bp, mouse
gtgggaagacccggagaggc

SEQ ID NO: 746423 - DNA, 20 bp, mouse
gcggcagcttccaaatgcgc

SEQ ID NO: 746424 - DNA, 20 bp, mouse
gtggccgcgccgcaggcggt

SEQ ID NO: 746425 - DNA, 20 bp, mouse
gtcagtctcaggccccgaag

SEQ ID NO: 746426 - DNA, 20 bp, mouse
gagactacgagctaatcacg

SEQ ID NO: 746427 - DNA, 20 bp, mouse
gttttctatggggaattatt

SEQ ID NO: 746428 - DNA, 20 bp, mouse
gtcaactccaggattccagt

SEQ ID NO: 746429 - DNA, 20 bp, mouse
gcggctgctcgggaggaagt

SEQ ID NO: 746430 - DNA, 20 bp, mouse
gaggaccgccaaaccggtag

SEQ ID NO: 746431 - DNA, 20 bp, mouse
gttctcacaagcgcatgcgt

SEQ ID NO: 746432 - DNA, 20 bp, mouse
ggcatgcgcttgtgagaaag

SEQ ID NO: 746433 - DNA, 20 bp, mouse
gtgtgagaaagcggctgctc

SEQ ID NO: 746434 - DNA, 20 bp, mouse
gtcgtagtctacgttttcta

SEQ ID NO: 746435 - DNA, 20 bp, mouse
gagttgagacgggaggattc

SEQ ID NO: 746436 - DNA, 20 bp, mouse
gggggcggggcttccttcga

SEQ ID NO: 746437 - DNA, 20 bp, mouse
gtggccgcgcccccagccca

SEQ ID NO: 746438 - DNA, 20 bp, mouse
ggccaggcgtggcccgcctc

SEQ ID NO: 746439 - DNA, 20 bp, mouse
gctagccagaggcgttcctc

SEQ ID NO: 746440 - DNA, 20 bp, mouse
gcgcgcccccagcccagggt

SEQ ID NO: 746441 - DNA, 20 bp, mouse
gtagtcccgaggaacgcctc

SEQ ID NO: 746442 - DNA, 20 bp, mouse
gcaaactacgagggcgcgaa

SEQ ID NO: 746443 - DNA, 20 bp, mouse
ggcgggcacgcggagacctg

SEQ ID NO: 746444 - DNA, 20 bp, mouse
ggtcctgcgcggtagtcccg

SEQ ID NO: 746445 - DNA, 20 bp, mouse
gcgtggcccgcctccgggcg

SEQ ID NO: 746446 - DNA, 20 bp, mouse
gacggggtgtatgttgggaa

SEQ ID NO: 746447 - DNA, 20 bp, mouse
gccactacggggtgtatgtt

SEQ ID NO: 746448 - DNA, 20 bp, mouse
gccaccgtagaaatacggtg

SEQ ID NO: 746449 - DNA, 20 bp, mouse
gcaggagagcacctctgcgc

SEQ ID NO: 746450 - DNA, 20 bp, mouse
gtaggcgccgaaccagatcc

SEQ ID NO: 746451 - DNA, 20 bp, mouse
gcggcctcaccgtatttcta

SEQ ID NO: 746452 - DNA, 20 bp, mouse
gcaatcgggacgggctaggg

SEQ ID NO: 746453 - DNA, 20 bp, mouse
ggcacaagttacgcccacta

SEQ ID NO: 746454 - DNA, 20 bp, mouse
gacctacggaacaagacgga

SEQ ID NO: 746455 - DNA, 20 bp, mouse
gcgggctagggcggtaccta

SEQ ID NO: 746456 - DNA, 20 bp, mouse
gtccctgccaccaacccaac

SEQ ID NO: 746457 - DNA, 20 bp, mouse
gtaggtgcctgttgggttgg

SEQ ID NO: 746458 - DNA, 20 bp, mouse
ggggtaccataggtgcctgt

SEQ ID NO: 746459 - DNA, 20 bp, mouse
gaatctgtctgcgatccatt

SEQ ID NO: 746460 - DNA, 20 bp, mouse
gcaaaacttgggggtaccat

SEQ ID NO: 746461 - DNA, 20 bp, mouse
gatcctctggatctcaagat

SEQ ID NO: 746462 - DNA, 20 bp, mouse
ggcagacagattcgatagag

SEQ ID NO: 746463 - DNA, 20 bp, mouse
gtcgtatgctggtcttccgg

SEQ ID NO: 746464 - DNA, 20 bp, mouse
gatctcgtatgctggtcttc

SEQ ID NO: 746465 - DNA, 20 bp, mouse
gaaccagctgtggaaaaggg

SEQ ID NO: 746466 - DNA, 20 bp, mouse
gtaccgtcggcacccagcca

SEQ ID NO: 746467 - DNA, 20 bp, mouse
gggacctttacttcaagccc

SEQ ID NO: 746468 - DNA, 20 bp, mouse
gtcagaacgcgttagtgagc

SEQ ID NO: 746469 - DNA, 20 bp, mouse
gtgagctggcttccaagacc

SEQ ID NO: 746470 - DNA, 20 bp, mouse
ggatccccgcgggtcgccat

SEQ ID NO: 746471 - DNA, 20 bp, mouse
gggcaaggaggacgctgatt

SEQ ID NO: 746472 - DNA, 20 bp, mouse
gcagccagggcttgaagtaa

SEQ ID NO: 746473 - DNA, 20 bp, mouse
ggacgctgattgggtgagat

SEQ ID NO: 746474 - DNA, 20 bp, mouse
gagccctggctgggtgccga

SEQ ID NO: 746475 - DNA, 20 bp, mouse
gcaagaccgggtttgtttaa

SEQ ID NO: 746476 - DNA, 20 bp, mouse
gttggtggtggcagctgtaa

SEQ ID NO: 746477 - DNA, 20 bp, mouse
gctcccagcgccctaacatg

SEQ ID NO: 746478 - DNA, 20 bp, mouse
ggtgtcgtgtgtgacacatt

SEQ ID NO: 746479 - DNA, 20 bp, mouse
ggtgtgtgacacattaggac

SEQ ID NO: 746480 - DNA, 20 bp, mouse
gatgtcagttgttgatgagt

SEQ ID NO: 746481 - DNA, 20 bp, mouse
gtgtgacacattaggacagg

SEQ ID NO: 746482 - DNA, 20 bp, mouse
gtctataaatgccacatgtt

SEQ ID NO: 746483 - DNA, 20 bp, mouse
gtgccacttacacacgaatg

SEQ ID NO: 746484 - DNA, 20 bp, mouse
gtatgtctatatcacttttt

SEQ ID NO: 746485 - DNA, 20 bp, mouse
gaacttcgaaccaacaaagc

SEQ ID NO: 746486 - DNA, 20 bp, mouse
ggcggcccaggtgagcgcca

SEQ ID NO: 746487 - DNA, 20 bp, mouse
ggagtggaccgcaaggtcaa

SEQ ID NO: 746488 - DNA, 20 bp, mouse
gaggctggcaggaacagcgg

SEQ ID NO: 746489 - DNA, 20 bp, mouse
gtcggccgtggcgctcacct

SEQ ID NO: 746490 - DNA, 20 bp, mouse
gccaccgcagacttctggcg

SEQ ID NO: 746491 - DNA, 20 bp, mouse
gggaccggcggacatggccg

SEQ ID NO: 746492 - DNA, 20 bp, mouse
gcaagggcacggtcaggagt

SEQ ID NO: 746493 - DNA, 20 bp, mouse
gcttccgcctagagctgcgg

SEQ ID NO: 746494 - DNA, 20 bp, mouse
ggaccgcaaggtcaagggca

SEQ ID NO: 746495 - DNA, 20 bp, mouse
gttgctgctactcgcggccc

SEQ ID NO: 746496 - DNA, 20 bp, mouse
gccagcgccggggttagcgt

SEQ ID NO: 746497 - DNA, 20 bp, mouse
gaggtccctacatgcctact

SEQ ID NO: 746498 - DNA, 20 bp, mouse
gtaggctcgaagccggaatc

SEQ ID NO: 746499 - DNA, 20 bp, mouse
gagatctgcagtggcggaac

SEQ ID NO: 746500 - DNA, 20 bp, mouse
gaggtcccagggccaatggc

SEQ ID NO: 746501 - DNA, 20 bp, mouse
gcagctccggccattggccc

SEQ ID NO: 746502 - DNA, 20 bp, mouse
ggtagcccagtaggcatgta

SEQ ID NO: 746503 - DNA, 20 bp, mouse
gaggcccaaaagaggtccca

SEQ ID NO: 746504 - DNA, 20 bp, mouse
gagcagtcggggagcgacac

SEQ ID NO: 746505 - DNA, 20 bp, mouse
gtctgcagtggcggaaccgg

SEQ ID NO: 746506 - DNA, 20 bp, mouse
gttaaactcggacatgagag

SEQ ID NO: 746507 - DNA, 20 bp, mouse
ggagagcggaagccactgca

SEQ ID NO: 746508 - DNA, 20 bp, mouse
ggctcacaagtgctcccctg

SEQ ID NO: 746509 - DNA, 20 bp, mouse
gcaactgaatccaggcttgc

SEQ ID NO: 746510 - DNA, 20 bp, mouse
ggagctgccactgggacatc

SEQ ID NO: 746511 - DNA, 20 bp, mouse
gcgtaaacccagcacataat

SEQ ID NO: 746512 - DNA, 20 bp, mouse
gattcagttggtaactgatg

SEQ ID NO: 746513 - DNA, 20 bp, mouse
ggagacctcagtaaacaggg

SEQ ID NO: 746514 - DNA, 20 bp, mouse
gctgcagggtatttatacac

SEQ ID NO: 746515 - DNA, 20 bp, mouse
gccgagtttaagatacgaat

SEQ ID NO: 746516 - DNA, 20 bp, mouse
gtaaacccaaaccactcatc

SEQ ID NO: 746517 - DNA, 20 bp, mouse
gctcctggaatgacagaaaa

SEQ ID NO: 746518 - DNA, 20 bp, mouse
ggaaggaggaagtgaaacct

SEQ ID NO: 746519 - DNA, 20 bp, mouse
ggggagacatagctactctc

SEQ ID NO: 746520 - DNA, 20 bp, mouse
gctgagggtagaggtgagta

SEQ ID NO: 746521 - DNA, 20 bp, mouse
gacctggggcgggaagggtg

SEQ ID NO: 746522 - DNA, 20 bp, mouse
gtcaacctgctacaggaagg

SEQ ID NO: 746523 - DNA, 20 bp, mouse
gactaggggagcaccacatg

SEQ ID NO: 746524 - DNA, 20 bp, mouse
ggtgaaacctggggcgggaa

SEQ ID NO: 746525 - DNA, 20 bp, mouse
gaaaaaaacccaagccccat

SEQ ID NO: 746526 - DNA, 20 bp, mouse
gaagctgccaagatggtctg

SEQ ID NO: 746527 - DNA, 20 bp, mouse
ggcacccagagtgaagtggt

SEQ ID NO: 746528 - DNA, 20 bp, mouse
gtgccaagatggtctgaggg

SEQ ID NO: 746529 - DNA, 20 bp, mouse
gtcccagccccgcagtgtgg

SEQ ID NO: 746530 - DNA, 20 bp, mouse
ggcagctgaggcccagacct

SEQ ID NO: 746531 - DNA, 20 bp, mouse
ggggcaagaggctctgatga

SEQ ID NO: 746532 - DNA, 20 bp, mouse
gcagccaggcccccacactg

SEQ ID NO: 746533 - DNA, 20 bp, mouse
ggacctccacgcccgcttgt

SEQ ID NO: 746534 - DNA, 20 bp, mouse
gcgggcgtggaggtccagcc

SEQ ID NO: 746535 - DNA, 20 bp, mouse
gccaccatgctgcccacaag

SEQ ID NO: 746536 - DNA, 20 bp, mouse
gggcctccctccccggaagt

SEQ ID NO: 746537 - DNA, 20 bp, mouse
ggaaccgcccaggtacacaa

SEQ ID NO: 746538 - DNA, 20 bp, mouse
gcccggaagtgggctgactc

SEQ ID NO: 746539 - DNA, 20 bp, mouse
gtggctgcacaggtcgccta

SEQ ID NO: 746540 - DNA, 20 bp, mouse
gcaggtggagcacgcccaga

SEQ ID NO: 746541 - DNA, 20 bp, mouse
gtacacaagggtgggagccc

SEQ ID NO: 746542 - DNA, 20 bp, mouse
gtggttcaggccctggaggc

SEQ ID NO: 746543 - DNA, 20 bp, mouse
gcgcccaggtacacaagggt

SEQ ID NO: 746544 - DNA, 20 bp, mouse
gaggagggcgtctgcaccat

SEQ ID NO: 746545 - DNA, 20 bp, mouse
gcaaagcggtcacttggttc

SEQ ID NO: 746546 - DNA, 20 bp, mouse
ggggccgcccgacgccgcga

SEQ ID NO: 746547 - DNA, 20 bp, mouse
gacgccgcgagggcaccagg

SEQ ID NO: 746548 - DNA, 20 bp, mouse
gacgccccctggtgccctcg

SEQ ID NO: 746549 - DNA, 20 bp, mouse
gccgaccggaactactgggt

SEQ ID NO: 746550 - DNA, 20 bp, mouse
ggggccttgacccgagtgaa

SEQ ID NO: 746551 - DNA, 20 bp, mouse
gcgcccagccactgtggtcg

SEQ ID NO: 746552 - DNA, 20 bp, mouse
ggaggcggggcctatgaaag

SEQ ID NO: 746553 - DNA, 20 bp, mouse
ggcaccgcgaccacagtggc

SEQ ID NO: 746554 - DNA, 20 bp, mouse
gagacgcaccgcgaccacag

SEQ ID NO: 746555 - DNA, 20 bp, mouse
ggtgccctcgcggcgtcggg

SEQ ID NO: 746556 - DNA, 20 bp, mouse
gtgaggatgaggactgtaaa

SEQ ID NO: 746557 - DNA, 20 bp, mouse
ggggccccttgcctcagaga

SEQ ID NO: 746558 - DNA, 20 bp, mouse
gaagcccaacgcagccctat

SEQ ID NO: 746559 - DNA, 20 bp, mouse
gagatccatctctaccaata

SEQ ID NO: 746560 - DNA, 20 bp, mouse
gcccaagttccccatctctg

SEQ ID NO: 746561 - DNA, 20 bp, mouse
gtacagtcctcatcctcact

SEQ ID NO: 746562 - DNA, 20 bp, mouse
gggctcctggcctggaaaat

SEQ ID NO: 746563 - DNA, 20 bp, mouse
gaagaagcgaacaaaagccg

SEQ ID NO: 746564 - DNA, 20 bp, mouse
ggcagccctattggtagaga

SEQ ID NO: 746565 - DNA, 20 bp, mouse
gtctaccaatagggctgcgt

SEQ ID NO: 746566 - DNA, 20 bp, mouse
ggggcctaggagagaaccgc

SEQ ID NO: 746567 - DNA, 20 bp, mouse
gggagagaaccgcaggctaa

SEQ ID NO: 746568 - DNA, 20 bp, mouse
gtgggccgcagggactagca

SEQ ID NO: 746569 - DNA, 20 bp, mouse
ggggcttggggaagccccca

SEQ ID NO: 746570 - DNA, 20 bp, mouse
gggaaagggagtcgggtccg

SEQ ID NO: 746571 - DNA, 20 bp, mouse
gactactgcgttctgggaaa

SEQ ID NO: 746572 - DNA, 20 bp, mouse
gagtcgggtccggggaactg

SEQ ID NO: 746573 - DNA, 20 bp, mouse
gcgttctgggaaagggagtc

SEQ ID NO: 746574 - DNA, 20 bp, mouse
gtatagaggaagcggcagtg

SEQ ID NO: 746575 - DNA, 20 bp, mouse
ggccgagcaattcgtggaga

SEQ ID NO: 746576 - DNA, 20 bp, mouse
gaggtgcggggaggaaccga

SEQ ID NO: 746577 - DNA, 20 bp, mouse
gctagacagcatgggattgg

SEQ ID NO: 746578 - DNA, 20 bp, mouse
gctccgaggggcttagtgga

SEQ ID NO: 746579 - DNA, 20 bp, mouse
gcctgatcgcgctgcatcat

SEQ ID NO: 746580 - DNA, 20 bp, mouse
ggcgctagacagcatgggat

SEQ ID NO: 746581 - DNA, 20 bp, mouse
gggagtggggacacagctaa

SEQ ID NO: 746582 - DNA, 20 bp, mouse
gggctagcgctagacagcat

SEQ ID NO: 746583 - DNA, 20 bp, mouse
ggaggcaccgagcctccgag

SEQ ID NO: 746584 - DNA, 20 bp, mouse
ggaggaaccgaggggtgtct

SEQ ID NO: 746585 - DNA, 20 bp, mouse
ggaaaacgctgagtggagtg

SEQ ID NO: 746586 - DNA, 20 bp, mouse
gttacccagcgctggggccg

SEQ ID NO: 746587 - DNA, 20 bp, mouse
gtcaaggtaaagatgaagag

SEQ ID NO: 746588 - DNA, 20 bp, mouse
ggttgggtggctggatgcct

SEQ ID NO: 746589 - DNA, 20 bp, mouse
ggggaaaggcagaattaagt

SEQ ID NO: 746590 - DNA, 20 bp, mouse
gcgctgggtaaacaggaagc

SEQ ID NO: 746591 - DNA, 20 bp, mouse
gtggggagagggtcgtatca

SEQ ID NO: 746592 - DNA, 20 bp, mouse
ggaaggccaggcaacaaaca

SEQ ID NO: 746593 - DNA, 20 bp, mouse
gtccccagttcagagaaccc

SEQ ID NO: 746594 - DNA, 20 bp, mouse
ggcctgggttctctgaactg

SEQ ID NO: 746595 - DNA, 20 bp, mouse
gcaggtgtgtgggtctgcgg

SEQ ID NO: 746596 - DNA, 20 bp, mouse
ggaggaagactctttgggtg

SEQ ID NO: 746597 - DNA, 20 bp, mouse
gaggggtgccaggagtgact

SEQ ID NO: 746598 - DNA, 20 bp, mouse
gcgggggagcatcttcctga

SEQ ID NO: 746599 - DNA, 20 bp, mouse
gccaccccaacagtgaaggg

SEQ ID NO: 746600 - DNA, 20 bp, mouse
gtgtcccaccccaacagtga

SEQ ID NO: 746601 - DNA, 20 bp, mouse
gccaacgcagtccaaaagag

SEQ ID NO: 746602 - DNA, 20 bp, mouse
gaaaagagaggaagactctt

SEQ ID NO: 746603 - DNA, 20 bp, mouse
gaagtgagtagtagccagaa

SEQ ID NO: 746604 - DNA, 20 bp, mouse
gctctgtggtacttcctctc

SEQ ID NO: 746605 - DNA, 20 bp, mouse
ggggtgtggtctaaaagtgc

SEQ ID NO: 746606 - DNA, 20 bp, mouse
gaggaagcaggataaggctg

SEQ ID NO: 746607 - DNA, 20 bp, mouse
gtacaactgctcttctccgc

SEQ ID NO: 746608 - DNA, 20 bp, mouse
gaggtgggctgaaaggactg

SEQ ID NO: 746609 - DNA, 20 bp, mouse
gtgtgggagcagtcgttagc

SEQ ID NO: 746610 - DNA, 20 bp, mouse
gagaacataaacattgcagg

SEQ ID NO: 746611 - DNA, 20 bp, mouse
ggggcctgtcagtgatggga

SEQ ID NO: 746612 - DNA, 20 bp, mouse
gggagatcataacactgggg

SEQ ID NO: 746613 - DNA, 20 bp, mouse
ggacactccgcaggaacgga

SEQ ID NO: 746614 - DNA, 20 bp, mouse
gttgcaggaggtgggctgaa

SEQ ID NO: 746615 - DNA, 20 bp, mouse
ggcagaagaggacactccgc

SEQ ID NO: 746616 - DNA, 20 bp, mouse
ggggttggccccgcacctag

SEQ ID NO: 746617 - DNA, 20 bp, mouse
gaggcagatgtaatgcagag

SEQ ID NO: 746618 - DNA, 20 bp, mouse
gcacacgtcaggggcatcat

SEQ ID NO: 746619 - DNA, 20 bp, mouse
gcgggaaagtatgcatgttg

SEQ ID NO: 746620 - DNA, 20 bp, mouse
gccacagctgcgtcatacat

SEQ ID NO: 746621 - DNA, 20 bp, mouse
gcaaacagtgacttaataag

SEQ ID NO: 746622 - DNA, 20 bp, mouse
gagacaaagagcaacatcca

SEQ ID NO: 746623 - DNA, 20 bp, mouse
gaatgctgcactttattcac

SEQ ID NO: 746624 - DNA, 20 bp, mouse
ggcagcccgacccctggaaa

SEQ ID NO: 746625 - DNA, 20 bp, mouse
ggagccaacccccgacagac

SEQ ID NO: 746626 - DNA, 20 bp, mouse
ggcgaggggattaacccgtg

SEQ ID NO: 746627 - DNA, 20 bp, mouse
gagaagcgagcgggcggcga

SEQ ID NO: 746628 - DNA, 20 bp, mouse
gacagggcagacccggggac

SEQ ID NO: 746629 - DNA, 20 bp, mouse
gattccagcaacaccctctt

SEQ ID NO: 746630 - DNA, 20 bp, mouse
gcagctcggcccccttatta

SEQ ID NO: 746631 - DNA, 20 bp, mouse
ggacaggaaaaaggcagctc

SEQ ID NO: 746632 - DNA, 20 bp, mouse
ggtacccagaccggagtaat

SEQ ID NO: 746633 - DNA, 20 bp, mouse
gcgggcgacagggcagaccc

SEQ ID NO: 746634 - DNA, 20 bp, mouse
gcgcttctcggtgccaaaga

SEQ ID NO: 746635 - DNA, 20 bp, mouse
gtgaggagctgcgggcgaca

SEQ ID NO: 746636 - DNA, 20 bp, mouse
gcagggggtggtaatctgat

SEQ ID NO: 746637 - DNA, 20 bp, mouse
gcctctccaggggaatcagg

SEQ ID NO: 746638 - DNA, 20 bp, mouse
ggtagcttcggagggactga

SEQ ID NO: 746639 - DNA, 20 bp, mouse
ggtaatctgatgggaagagg

SEQ ID NO: 746640 - DNA, 20 bp, mouse
gcatgccaggccctctccag

SEQ ID NO: 746641 - DNA, 20 bp, mouse
ggcctggcatgaaccagact

SEQ ID NO: 746642 - DNA, 20 bp, mouse
gtactgctgcaatgctggca

SEQ ID NO: 746643 - DNA, 20 bp, mouse
ggtggtaatctgatgggaag

SEQ ID NO: 746644 - DNA, 20 bp, mouse
ggtgacctctgtgtcccaag

SEQ ID NO: 746645 - DNA, 20 bp, mouse
ggtagggctaagggtgacca

SEQ ID NO: 746646 - DNA, 20 bp, mouse
ggggcctatggggagtagca

SEQ ID NO: 746647 - DNA, 20 bp, mouse
gcggccgcgcgggggcgcgt

SEQ ID NO: 746648 - DNA, 20 bp, mouse
gcacttgttggagcacgggt

SEQ ID NO: 746649 - DNA, 20 bp, mouse
ggggcgctagactcgcaggg

SEQ ID NO: 746650 - DNA, 20 bp, mouse
ggctgggcgctagactcgca

SEQ ID NO: 746651 - DNA, 20 bp, mouse
gccgcccgggagggagcgat

SEQ ID NO: 746652 - DNA, 20 bp, mouse
gtagccagaggcgcgaaggc

SEQ ID NO: 746653 - DNA, 20 bp, mouse
gtacccccgtgcctggtcag

SEQ ID NO: 746654 - DNA, 20 bp, mouse
gctccccatcgctccctccc

SEQ ID NO: 746655 - DNA, 20 bp, mouse
gaacaagtggatggggccta

SEQ ID NO: 746656 - DNA, 20 bp, mouse
gtcggagcgctgacagtgca

SEQ ID NO: 746657 - DNA, 20 bp, mouse
gagtgcagggctctgattgg

SEQ ID NO: 746658 - DNA, 20 bp, mouse
gtgggaggggctagatggac

SEQ ID NO: 746659 - DNA, 20 bp, mouse
gtcggtaagcgacatgggag

SEQ ID NO: 746660 - DNA, 20 bp, mouse
ggacagtgcagggctctgat

SEQ ID NO: 746661 - DNA, 20 bp, mouse
ggccaatcggtaagcgacat

SEQ ID NO: 746662 - DNA, 20 bp, mouse
ggggctagatggacaggtgc

SEQ ID NO: 746663 - DNA, 20 bp, mouse
gaggtcccaagtgacacaag

SEQ ID NO: 746664 - DNA, 20 bp, mouse
gactgtcagcgctccgagtg

SEQ ID NO: 746665 - DNA, 20 bp, mouse
gccaggagaactcaccgccc

SEQ ID NO: 746666 - DNA, 20 bp, mouse
gtggctctcagaggggattg

SEQ ID NO: 746667 - DNA, 20 bp, mouse
gtgggccgacgtgcccccgg

SEQ ID NO: 746668 - DNA, 20 bp, mouse
gtggccgcctcgacgcaggg

SEQ ID NO: 746669 - DNA, 20 bp, mouse
gtgtcgcaatcgcgacgggg

SEQ ID NO: 746670 - DNA, 20 bp, mouse
gcggcccagccgccaggctt

SEQ ID NO: 746671 - DNA, 20 bp, mouse
gtcagaggggattgcggatt

SEQ ID NO: 746672 - DNA, 20 bp, mouse
ggagccaggcttccgaagaa

SEQ ID NO: 746673 - DNA, 20 bp, mouse
ggcctcgacgcagggcggga

SEQ ID NO: 746674 - DNA, 20 bp, mouse
gcccctcccgccctgcgtcg

SEQ ID NO: 746675 - DNA, 20 bp, mouse
gcggcctgtcgcaatcgcga

SEQ ID NO: 746676 - DNA, 20 bp, mouse
gaaggtagaaaccagtgctg

SEQ ID NO: 746677 - DNA, 20 bp, mouse
gggcatgggtgagcagtcag

SEQ ID NO: 746678 - DNA, 20 bp, mouse
gcacaggactaagcacggaa

SEQ ID NO: 746679 - DNA, 20 bp, mouse
ggatatgactgtatccacaa

SEQ ID NO: 746680 - DNA, 20 bp, mouse
ggaactcatgctgctcaccc

SEQ ID NO: 746681 - DNA, 20 bp, mouse
gggaaactaccaaggatgca

SEQ ID NO: 746682 - DNA, 20 bp, mouse
gctggggtaggggaagtcag

SEQ ID NO: 746683 - DNA, 20 bp, mouse
ggggcctcaggatgccaagg

SEQ ID NO: 746684 - DNA, 20 bp, mouse
gtcagacgctggcccaggag

SEQ ID NO: 746685 - DNA, 20 bp, mouse
gagggtaaaccctggatgaa

SEQ ID NO: 746686 - DNA, 20 bp, mouse
gagcccagaaggaggaaaca

SEQ ID NO: 746687 - DNA, 20 bp, mouse
ggtaccccctacacaggcgc

SEQ ID NO: 746688 - DNA, 20 bp, mouse
gtgtaccagcgcctgtgtag

SEQ ID NO: 746689 - DNA, 20 bp, mouse
gcacctggttgagggcaatg

SEQ ID NO: 746690 - DNA, 20 bp, mouse
gggagattaaggaaatcact

SEQ ID NO: 746691 - DNA, 20 bp, mouse
gaactagcacacctggttga

SEQ ID NO: 746692 - DNA, 20 bp, mouse
gcaggtgtgctagttcttag

SEQ ID NO: 746693 - DNA, 20 bp, mouse
gagccccattgccctcaacc

SEQ ID NO: 746694 - DNA, 20 bp, mouse
gtctccctgcggctgtcacc

SEQ ID NO: 746695 - DNA, 20 bp, mouse
gaagggacacaggtcaaccc

SEQ ID NO: 746696 - DNA, 20 bp, mouse
gtcaccttggtgccacccag

SEQ ID NO: 746697 - DNA, 20 bp, mouse
gtaagcggggcgagtgggac

SEQ ID NO: 746698 - DNA, 20 bp, mouse
gacagacgagttggctctca

SEQ ID NO: 746699 - DNA, 20 bp, mouse
ggcgcccggtccgagagctg

SEQ ID NO: 746700 - DNA, 20 bp, mouse
gctctcccagacagacgagt

SEQ ID NO: 746701 - DNA, 20 bp, mouse
gagagccaactcgtctgtct

SEQ ID NO: 746702 - DNA, 20 bp, mouse
ggtgaaatgctgcgtgacca

SEQ ID NO: 746703 - DNA, 20 bp, mouse
ggaggaagaagactgctgag

SEQ ID NO: 746704 - DNA, 20 bp, mouse
ggccccgcttactccgggac

SEQ ID NO: 746705 - DNA, 20 bp, mouse
ggtcacgcagcatttcacct

SEQ ID NO: 746706 - DNA, 20 bp, mouse
gaaggccacgcctgcctgag

SEQ ID NO: 746707 - DNA, 20 bp, mouse
gcgaaaggctgggagggcga

SEQ ID NO: 746708 - DNA, 20 bp, mouse
ggcctgaaacgtaacaaaga

SEQ ID NO: 746709 - DNA, 20 bp, mouse
ggcggaagtaggaagccgaa

SEQ ID NO: 746710 - DNA, 20 bp, mouse
gccgctcccgcctccctgtc

SEQ ID NO: 746711 - DNA, 20 bp, mouse
gggcgccacgggctcaacgc

SEQ ID NO: 746712 - DNA, 20 bp, mouse
gggtcagagtcctgacaggg

SEQ ID NO: 746713 - DNA, 20 bp, mouse
ggtcagcagtgacgccactc

SEQ ID NO: 746714 - DNA, 20 bp, mouse
ggacgccactcaggcaggcg

SEQ ID NO: 746715 - DNA, 20 bp, mouse
gctctccactacaaatatct

SEQ ID NO: 746716 - DNA, 20 bp, mouse
gcggggacttccgggaggtg

SEQ ID NO: 746717 - DNA, 20 bp, mouse
ggggctagcaggaccttcag

SEQ ID NO: 746718 - DNA, 20 bp, mouse
ggagtagcctacttacctga

SEQ ID NO: 746719 - DNA, 20 bp, mouse
ggaaccttcccggggacttc

SEQ ID NO: 746720 - DNA, 20 bp, mouse
ggaacctgaaacttgccctc

SEQ ID NO: 746721 - DNA, 20 bp, mouse
gctcccggaagtccccggga

SEQ ID NO: 746722 - DNA, 20 bp, mouse
gcgcggtgacagaaccttcc

SEQ ID NO: 746723 - DNA, 20 bp, mouse
gtagcaggaccttcagtggg

SEQ ID NO: 746724 - DNA, 20 bp, mouse
gaatatctgaagccccaggt

SEQ ID NO: 746725 - DNA, 20 bp, mouse
ggctttctggctggagttgg

SEQ ID NO: 746726 - DNA, 20 bp, mouse
gggcctgtcgggaagtgtac

SEQ ID NO: 746727 - DNA, 20 bp, mouse
gatgctgggaggaagttctt

SEQ ID NO: 746728 - DNA, 20 bp, mouse
gaaagcgccgtgcgggcttc

SEQ ID NO: 746729 - DNA, 20 bp, mouse
gatcaggcttgagtagttca

SEQ ID NO: 746730 - DNA, 20 bp, mouse
gcggccggaaagcgccgtgc

SEQ ID NO: 746731 - DNA, 20 bp, mouse
gattacaggcataccacgac

SEQ ID NO: 746732 - DNA, 20 bp, mouse
gaactactcaagcctgatcc

SEQ ID NO: 746733 - DNA, 20 bp, mouse
gggccgcggggaatgctggg

SEQ ID NO: 746734 - DNA, 20 bp, mouse
ggtgcgggcttcaggctgat

SEQ ID NO: 746735 - DNA, 20 bp, mouse
gcaaagaccacgcttccaca

SEQ ID NO: 746736 - DNA, 20 bp, mouse
gtagacgcccggggccgaag

SEQ ID NO: 746737 - DNA, 20 bp, mouse
ggccgaagaggcttcggagt

SEQ ID NO: 746738 - DNA, 20 bp, mouse
gacgaagggtcccaccctaa

SEQ ID NO: 746739 - DNA, 20 bp, mouse
gaacgcgctcgggagccgtt

SEQ ID NO: 746740 - DNA, 20 bp, mouse
ggggtgggacccttcgtagg

SEQ ID NO: 746741 - DNA, 20 bp, mouse
gagcagacgtgaacgcgctc

SEQ ID NO: 746742 - DNA, 20 bp, mouse
gcgccctgcccctcctacga

SEQ ID NO: 746743 - DNA, 20 bp, mouse
gccagggcggcaaacagcaa

SEQ ID NO: 746744 - DNA, 20 bp, mouse
ggtgcgcgctcccgtcgcgg

SEQ ID NO: 746745 - DNA, 20 bp, mouse
gcggagcgcagcgacgtgga

SEQ ID NO: 746746 - DNA, 20 bp, mouse
gtgggtggaaggcacggcgg

SEQ ID NO: 746747 - DNA, 20 bp, mouse
gggagcggtggacgctctaa

SEQ ID NO: 746748 - DNA, 20 bp, mouse
gcgtccaccgctccgttggg

SEQ ID NO: 746749 - DNA, 20 bp, mouse
ggcgggcagcgcggcttctc

SEQ ID NO: 746750 - DNA, 20 bp, mouse
gagagcgtccaccgctccgt

SEQ ID NO: 746751 - DNA, 20 bp, mouse
gtggagacacgcctaggccc

SEQ ID NO: 746752 - DNA, 20 bp, mouse
gtgccttccacccaacggag

SEQ ID NO: 746753 - DNA, 20 bp, mouse
ggcctggcggggctttgccc

SEQ ID NO: 746754 - DNA, 20 bp, mouse
gtaggcccgggctgcgaggg

SEQ ID NO: 746755 - DNA, 20 bp, mouse
gcaccgctccgttgggtgga

SEQ ID NO: 746756 - DNA, 20 bp, mouse
gactctggaatcggggttgg

SEQ ID NO: 746757 - DNA, 20 bp, mouse
ggaggcagttcggtgtgaga

SEQ ID NO: 746758 - DNA, 20 bp, mouse
gaagagctgaggagcgtggg

SEQ ID NO: 746759 - DNA, 20 bp, mouse
gaaaacagacccttccactc

SEQ ID NO: 746760 - DNA, 20 bp, mouse
ggacccttccactctggaat

SEQ ID NO: 746761 - DNA, 20 bp, mouse
gaaacagagcaaagaatctc

SEQ ID NO: 746762 - DNA, 20 bp, mouse
gaccccgattccagagtgga

SEQ ID NO: 746763 - DNA, 20 bp, mouse
gcacgttgagacaactgata

SEQ ID NO: 746764 - DNA, 20 bp, mouse
ggtagcaagctcgattctta

SEQ ID NO: 746765 - DNA, 20 bp, mouse
gcttctctctaacgaagtgc

SEQ ID NO: 746766 - DNA, 20 bp, mouse
ggggggagcgaggtaccgag

SEQ ID NO: 746767 - DNA, 20 bp, mouse
gacctagtcgaacgcctcca

SEQ ID NO: 746768 - DNA, 20 bp, mouse
gagccccaatcgaggtaaca

SEQ ID NO: 746769 - DNA, 20 bp, mouse
gcagaaaagccgcgcagttg

SEQ ID NO: 746770 - DNA, 20 bp, mouse
ggccctggaggcgttcgact

SEQ ID NO: 746771 - DNA, 20 bp, mouse
gggggcgggcggggatccac

SEQ ID NO: 746772 - DNA, 20 bp, mouse
gaagttgtgtgcataccact

SEQ ID NO: 746773 - DNA, 20 bp, mouse
gcgttcgtagcagagaaggg

SEQ ID NO: 746774 - DNA, 20 bp, mouse
gaggcactgagctttctttg

SEQ ID NO: 746775 - DNA, 20 bp, mouse
gccgcgcagttgggggagcg

SEQ ID NO: 746776 - DNA, 20 bp, mouse
gtcggaggaacacaatgact

SEQ ID NO: 746777 - DNA, 20 bp, mouse
gtgacatacggtacaggggt

SEQ ID NO: 746778 - DNA, 20 bp, mouse
gttggatgagaccgactaaa

SEQ ID NO: 746779 - DNA, 20 bp, mouse
gtaacttagtaacctaatat

SEQ ID NO: 746780 - DNA, 20 bp, mouse
gacaggggttggctctgctt

SEQ ID NO: 746781 - DNA, 20 bp, mouse
gcgtatgtcacagacaagaa

SEQ ID NO: 746782 - DNA, 20 bp, mouse
gtggcttttaggaaagttgg

SEQ ID NO: 746783 - DNA, 20 bp, mouse
ggctgtcaggggacttcagc

SEQ ID NO: 746784 - DNA, 20 bp, mouse
gtaaagtttccgaggctcgg

SEQ ID NO: 746785 - DNA, 20 bp, mouse
ggtctgtgacatacggtaca

SEQ ID NO: 746786 - DNA, 20 bp, mouse
gccggggcacctagctagga

SEQ ID NO: 746787 - DNA, 20 bp, mouse
gttggctgggttcaaacctt

SEQ ID NO: 746788 - DNA, 20 bp, mouse
gttcctccggagcctagccc

SEQ ID NO: 746789 - DNA, 20 bp, mouse
ggacctgggctaggctccgg

SEQ ID NO: 746790 - DNA, 20 bp, mouse
gtaggaaggcaatgaaaact

SEQ ID NO: 746791 - DNA, 20 bp, mouse
gaaaccttgggcttggaagt

SEQ ID NO: 746792 - DNA, 20 bp, mouse
gaggtccggggcacctagct

SEQ ID NO: 746793 - DNA, 20 bp, mouse
gggcttaaaaaaaggaccaa

SEQ ID NO: 746794 - DNA, 20 bp, mouse
gcggtcttgccttccaagtc

SEQ ID NO: 746795 - DNA, 20 bp, mouse
gtcactgagtaagaggtgtt

SEQ ID NO: 746796 - DNA, 20 bp, mouse
gagggtgagagacaattcgc

SEQ ID NO: 746797 - DNA, 20 bp, mouse
ggctctgattagaggcataa

SEQ ID NO: 746798 - DNA, 20 bp, mouse
gtggtgagagacgcctgctc

SEQ ID NO: 746799 - DNA, 20 bp, mouse
gtgagctggcgtgctccgca

SEQ ID NO: 746800 - DNA, 20 bp, mouse
ggagagacaattcgctggga

SEQ ID NO: 746801 - DNA, 20 bp, mouse
gagacaggaggggagggcgg

SEQ ID NO: 746802 - DNA, 20 bp, mouse
ggtggtctctagcgtagaaa

SEQ ID NO: 746803 - DNA, 20 bp, mouse
gctctggaccctaaagagtc

SEQ ID NO: 746804 - DNA, 20 bp, mouse
gagaaccaacacaaagtccg

SEQ ID NO: 746805 - DNA, 20 bp, mouse
gccccgctcctactgaagac

SEQ ID NO: 746806 - DNA, 20 bp, mouse
gcagacccgcgggagccgga

SEQ ID NO: 746807 - DNA, 20 bp, mouse
gcacacctgcccagacccgc

SEQ ID NO: 746808 - DNA, 20 bp, mouse
gaaagctcgggcattccctc

SEQ ID NO: 746809 - DNA, 20 bp, mouse
gctgccggatgaggaatcgc

SEQ ID NO: 746810 - DNA, 20 bp, mouse
gctaccccagggcggggccg

SEQ ID NO: 746811 - DNA, 20 bp, mouse
gacctccgggagaaaagctc

SEQ ID NO: 746812 - DNA, 20 bp, mouse
gccctcagaaggacccatcg

SEQ ID NO: 746813 - DNA, 20 bp, mouse
gcattccctccggctcccgc

SEQ ID NO: 746814 - DNA, 20 bp, mouse
ggtgcccgcctaccccaggg

SEQ ID NO: 746815 - DNA, 20 bp, mouse
ggaggtgcccgcctacccca

SEQ ID NO: 746816 - DNA, 20 bp, mouse
gtcttcccttgctttctaat

SEQ ID NO: 746817 - DNA, 20 bp, mouse
gagcccagggatgtgattgg

SEQ ID NO: 746818 - DNA, 20 bp, mouse
gaactgtggcctctggccct

SEQ ID NO: 746819 - DNA, 20 bp, mouse
gacaagtcaactgtggcctc

SEQ ID NO: 746820 - DNA, 20 bp, mouse
gcttgccaattagaaagcaa

SEQ ID NO: 746821 - DNA, 20 bp, mouse
gtcctctcagacaaggttgc

SEQ ID NO: 746822 - DNA, 20 bp, mouse
gtggcaagttctgtcagatg

SEQ ID NO: 746823 - DNA, 20 bp, mouse
gaaacatgatggcctggaaa

SEQ ID NO: 746824 - DNA, 20 bp, mouse
gagcagttggggaggaacca

SEQ ID NO: 746825 - DNA, 20 bp, mouse
gaagccagatttatagcagt

SEQ ID NO: 746826 - DNA, 20 bp, mouse
gaacaaaacaatactaggaa

SEQ ID NO: 746827 - DNA, 20 bp, mouse
gccaacacacagcaatcaaa

SEQ ID NO: 746828 - DNA, 20 bp, mouse
gaactgtggcctctggccct

SEQ ID NO: 746829 - DNA, 20 bp, mouse
gacaagtcaactgtggcctc

SEQ ID NO: 746830 - DNA, 20 bp, mouse
gtcttcccttgctttctagt

SEQ ID NO: 746831 - DNA, 20 bp, mouse
gggccctccttcctataagc

SEQ ID NO: 746832 - DNA, 20 bp, mouse
gcttgccaactagaaagcaa

SEQ ID NO: 746833 - DNA, 20 bp, mouse
gttataggaaggagggccat

SEQ ID NO: 746834 - DNA, 20 bp, mouse
gggtctactgatcaagtcct

SEQ ID NO: 746835 - DNA, 20 bp, mouse
gtgcctgcttataggaagga

SEQ ID NO: 746836 - DNA, 20 bp, mouse
gaataaacatgttggccctg

SEQ ID NO: 746837 - DNA, 20 bp, mouse
gtttggttcttacttcctca

SEQ ID NO: 746838 - DNA, 20 bp, mouse
gttggagagggaggactctg

SEQ ID NO: 746839 - DNA, 20 bp, mouse
gaggactctgtggttgggaa

SEQ ID NO: 746840 - DNA, 20 bp, mouse
gccagctggcatcttgaaaa

SEQ ID NO: 746841 - DNA, 20 bp, mouse
ggagggaggactctgtggtt

SEQ ID NO: 746842 - DNA, 20 bp, mouse
ggacacgcctatgatggcta

SEQ ID NO: 746843 - DNA, 20 bp, mouse
ggcatcttgaaaagggagga

SEQ ID NO: 746844 - DNA, 20 bp, mouse
ggtatagcagttggagaggg

SEQ ID NO: 746845 - DNA, 20 bp, mouse
gtccaacccatagccatcat

SEQ ID NO: 746846 - DNA, 20 bp, mouse
gggccccatgccctcagtac

SEQ ID NO: 746847 - DNA, 20 bp, mouse
gcctgctcaggaaggctgcg

SEQ ID NO: 746848 - DNA, 20 bp, mouse
ggaagccaagcctgtactga

SEQ ID NO: 746849 - DNA, 20 bp, mouse
gcagccttcctgagcagggt

SEQ ID NO: 746850 - DNA, 20 bp, mouse
gcagccaaccctgctcagga

SEQ ID NO: 746851 - DNA, 20 bp, mouse
gctgcggggctgaggggacc

SEQ ID NO: 746852 - DNA, 20 bp, mouse
gagaaccagaatggtctgcc

SEQ ID NO: 746853 - DNA, 20 bp, mouse
gcatgccctcagtacaggct

SEQ ID NO: 746854 - DNA, 20 bp, mouse
ggaagcctggcagaccattc

SEQ ID NO: 746855 - DNA, 20 bp, mouse
gagaaagcagcatgcaaatc

SEQ ID NO: 746856 - DNA, 20 bp, mouse
gacccctgtcgtagtctcag

SEQ ID NO: 746857 - DNA, 20 bp, mouse
gctggtggggagaacgaccc

SEQ ID NO: 746858 - DNA, 20 bp, mouse
gcgcccacggcggcggtccc

SEQ ID NO: 746859 - DNA, 20 bp, mouse
gtgcaggcggggcgtttcat

SEQ ID NO: 746860 - DNA, 20 bp, mouse
gtgctggcctctggcaactc

SEQ ID NO: 746861 - DNA, 20 bp, mouse
gctcctctgagactacgaca

SEQ ID NO: 746862 - DNA, 20 bp, mouse
ggcacagccggagttgccag

SEQ ID NO: 746863 - DNA, 20 bp, mouse
ggcaactccggctgtgccct

SEQ ID NO: 746864 - DNA, 20 bp, mouse
ggtcccaagctatgcgccca

SEQ ID NO: 746865 - DNA, 20 bp, mouse
gccggtggtacccagaagcc

SEQ ID NO: 746866 - DNA, 20 bp, mouse
ggagatggaggggccacagt

SEQ ID NO: 746867 - DNA, 20 bp, mouse
ggcaagatttatagctgttg

SEQ ID NO: 746868 - DNA, 20 bp, mouse
gttgtctctccccaactgag

SEQ ID NO: 746869 - DNA, 20 bp, mouse
ggcttgccctcagaaagcaa

SEQ ID NO: 746870 - DNA, 20 bp, mouse
gggccctcctttttataagc

SEQ ID NO: 746871 - DNA, 20 bp, mouse
gtgtaactttggctgtccgg

SEQ ID NO: 746872 - DNA, 20 bp, mouse
gcaaacaactgacaaatacc

SEQ ID NO: 746873 - DNA, 20 bp, mouse
ggtatacagagcaagtcccc

SEQ ID NO: 746874 - DNA, 20 bp, mouse
gttataaaaaggagggccct

SEQ ID NO: 746875 - DNA, 20 bp, mouse
gctgacaaatacctggcgac

SEQ ID NO: 746876 - DNA, 20 bp, mouse
ggggccagctctgaagttgt

SEQ ID NO: 746877 - DNA, 20 bp, mouse
ggtctgctgaataggtgagt

SEQ ID NO: 746878 - DNA, 20 bp, mouse
gtgtgtggaagtaaaggcat

SEQ ID NO: 746879 - DNA, 20 bp, mouse
gggtactggggcaaccaagt

SEQ ID NO: 746880 - DNA, 20 bp, mouse
ggtggctcttggttcacctt

SEQ ID NO: 746881 - DNA, 20 bp, mouse
gtggggcaaccaagtgggga

SEQ ID NO: 746882 - DNA, 20 bp, mouse
gggagtccaggactcttgtc

SEQ ID NO: 746883 - DNA, 20 bp, mouse
gtgggtgtataagcaggtac

SEQ ID NO: 746884 - DNA, 20 bp, mouse
gaatatgctgactgtctctc

SEQ ID NO: 746885 - DNA, 20 bp, mouse
gaacagctgtgtggaagtaa

SEQ ID NO: 746886 - DNA, 20 bp, mouse
ggaaccagacaatgtgggtg

SEQ ID NO: 746887 - DNA, 20 bp, mouse
ggccaagcctactgtgtggg

SEQ ID NO: 746888 - DNA, 20 bp, mouse
gagagacaggtccctgaagt

SEQ ID NO: 746889 - DNA, 20 bp, mouse
gccgtctggaaaaggttgga

SEQ ID NO: 746890 - DNA, 20 bp, mouse
gcaacctctcccagcataat

SEQ ID NO: 746891 - DNA, 20 bp, mouse
gagccccaactgttgctcag

SEQ ID NO: 746892 - DNA, 20 bp, mouse
gtgtcctcacccacattgtc

SEQ ID NO: 746893 - DNA, 20 bp, mouse
ggaaactgatgtgggtgcag

SEQ ID NO: 746894 - DNA, 20 bp, mouse
ggggagacctgagagccgtc

SEQ ID NO: 746895 - DNA, 20 bp, mouse
gtgggggtacaggcctttca

SEQ ID NO: 746896 - DNA, 20 bp, mouse
gggagaacggcaccagaaca

SEQ ID NO: 746897 - DNA, 20 bp, mouse
gcccaaggagctgtgggttg

SEQ ID NO: 746898 - DNA, 20 bp, mouse
gctccttgggcctaatatcc

SEQ ID NO: 746899 - DNA, 20 bp, mouse
ggtggggcaccagtctgagg

SEQ ID NO: 746900 - DNA, 20 bp, mouse
gtgcctccagccaggatatt

SEQ ID NO: 746901 - DNA, 20 bp, mouse
gaccagtctgaggtggagaa

SEQ ID NO: 746902 - DNA, 20 bp, mouse
gggcctaatatcctggctgg

SEQ ID NO: 746903 - DNA, 20 bp, mouse
gctctgacaaaagcaaccgg

SEQ ID NO: 746904 - DNA, 20 bp, mouse
gcactctgcacgccctgttc

SEQ ID NO: 746905 - DNA, 20 bp, mouse
ggacaaaagcaaccgggggg

SEQ ID NO: 746906 - DNA, 20 bp, mouse
ggactaaagagaaagactag

SEQ ID NO: 746907 - DNA, 20 bp, mouse
ggacaggagagggagatagg

SEQ ID NO: 746908 - DNA, 20 bp, mouse
gagagggcacaggcccggaa

SEQ ID NO: 746909 - DNA, 20 bp, mouse
gagggggaaagtgtcactag

SEQ ID NO: 746910 - DNA, 20 bp, mouse
gcccacagagggcacaggcc

SEQ ID NO: 746911 - DNA, 20 bp, mouse
gagaaagactagaggtggaa

SEQ ID NO: 746912 - DNA, 20 bp, mouse
gtagtcagctgggaataaat

SEQ ID NO: 746913 - DNA, 20 bp, mouse
ggaaagggtccaagagggcc

SEQ ID NO: 746914 - DNA, 20 bp, mouse
gctagcagaaactagtgttg

SEQ ID NO: 746915 - DNA, 20 bp, mouse
ggggcacaggcccggaaggg

SEQ ID NO: 746916 - DNA, 20 bp, mouse
gaggggtagcagagtcatga

SEQ ID NO: 746917 - DNA, 20 bp, mouse
gcgtccacggctgtcaaccc

SEQ ID NO: 746918 - DNA, 20 bp, mouse
gaggtcgcatggcccagcag

SEQ ID NO: 746919 - DNA, 20 bp, mouse
gcactggtgccggagagagt

SEQ ID NO: 746920 - DNA, 20 bp, mouse
gtagcagagtcatgagggga

SEQ ID NO: 746921 - DNA, 20 bp, mouse
ggtcacggtcctactctctc

SEQ ID NO: 746922 - DNA, 20 bp, mouse
gcctctagcccatgcgtcca

SEQ ID NO: 746923 - DNA, 20 bp, mouse
gatgctgtggagacacgctc

SEQ ID NO: 746924 - DNA, 20 bp, mouse
gtctgtagaggtactgggat

SEQ ID NO: 746925 - DNA, 20 bp, mouse
gcaggattccagtgtcaccg

SEQ ID NO: 746926 - DNA, 20 bp, mouse
ggggagggggcccccatggg

SEQ ID NO: 746927 - DNA, 20 bp, mouse
gcagggccccaatggggata

SEQ ID NO: 746928 - DNA, 20 bp, mouse
ggggccctggtgcttgttgg

SEQ ID NO: 746929 - DNA, 20 bp, mouse
gatagggagggggcccccat

SEQ ID NO: 746930 - DNA, 20 bp, mouse
ggggtcttgggccactattc

SEQ ID NO: 746931 - DNA, 20 bp, mouse
gaagcaccagggccccaatg

SEQ ID NO: 746932 - DNA, 20 bp, mouse
ggctgcgaagggggagtttg

SEQ ID NO: 746933 - DNA, 20 bp, mouse
gtctggaactactgctgcga

SEQ ID NO: 746934 - DNA, 20 bp, mouse
gcccctggggggggggtctt

SEQ ID NO: 746935 - DNA, 20 bp, mouse
gggaactactgctgcgaagg

SEQ ID NO: 746936 - DNA, 20 bp, mouse
ggacagagggagagaatctg

SEQ ID NO: 746937 - DNA, 20 bp, mouse
gagtgagagcgcctcaggtg

SEQ ID NO: 746938 - DNA, 20 bp, mouse
gagaccctcaaggcaagcat

SEQ ID NO: 746939 - DNA, 20 bp, mouse
ggggaacagcttgagcggga

SEQ ID NO: 746940 - DNA, 20 bp, mouse
ggaaccgggaacagcttgag

SEQ ID NO: 746941 - DNA, 20 bp, mouse
gctgcccatgcttgccttga

SEQ ID NO: 746942 - DNA, 20 bp, mouse
gtgacctctagggcagggga

SEQ ID NO: 746943 - DNA, 20 bp, mouse
gcctcaggtgtgggaacata

SEQ ID NO: 746944 - DNA, 20 bp, mouse
gtgggctgagttaacaaaca

SEQ ID NO: 746945 - DNA, 20 bp, mouse
ggtgtggagaagcgagagat

SEQ ID NO: 746946 - DNA, 20 bp, mouse
gggctcttggctgatgtctc

SEQ ID NO: 746947 - DNA, 20 bp, mouse
gtggagtcaggtcccagcgc

SEQ ID NO: 746948 - DNA, 20 bp, mouse
gatagatgagaagctacaag

SEQ ID NO: 746949 - DNA, 20 bp, mouse
gcaggctgctctcgtgtgca

SEQ ID NO: 746950 - DNA, 20 bp, mouse
gataaaggcccacagttcct

SEQ ID NO: 746951 - DNA, 20 bp, mouse
ggaacagcctctgatatgtc

SEQ ID NO: 746952 - DNA, 20 bp, mouse
gaggccaagtggttcagccc

SEQ ID NO: 746953 - DNA, 20 bp, mouse
gaggcttctccgtgaagaag

SEQ ID NO: 746954 - DNA, 20 bp, mouse
gaggggacctcgattattca

SEQ ID NO: 746955 - DNA, 20 bp, mouse
gcacgagagcagcctgcgct

SEQ ID NO: 746956 - DNA, 20 bp, mouse
gaaggcgccgaggccgggta

SEQ ID NO: 746957 - DNA, 20 bp, mouse
gcaggagcgggagacctaga

SEQ ID NO: 746958 - DNA, 20 bp, mouse
ggacctcggccaagcagagt

SEQ ID NO: 746959 - DNA, 20 bp, mouse
ggatcctcccacgccgggta

SEQ ID NO: 746960 - DNA, 20 bp, mouse
gtgccggtgggcgtcgtcat

SEQ ID NO: 746961 - DNA, 20 bp, mouse
gcacagctgggagacgcgcg

SEQ ID NO: 746962 - DNA, 20 bp, mouse
gtagggaggtggaaaagggt

SEQ ID NO: 746963 - DNA, 20 bp, mouse
ggggctggaggccactcagc

SEQ ID NO: 746964 - DNA, 20 bp, mouse
ggacgaaaggcgccgaggcc

SEQ ID NO: 746965 - DNA, 20 bp, mouse
gccacctccctacccggcgt

SEQ ID NO: 746966 - DNA, 20 bp, mouse
gagaagaaggaccctacagt

SEQ ID NO: 746967 - DNA, 20 bp, mouse
gttggaagagaccatggtac

SEQ ID NO: 746968 - DNA, 20 bp, mouse
gagcaagctgtcgccttccc

SEQ ID NO: 746969 - DNA, 20 bp, mouse
gctacagttggaagagacca

SEQ ID NO: 746970 - DNA, 20 bp, mouse
ggtatagcagttggagaaga

SEQ ID NO: 746971 - DNA, 20 bp, mouse
gctgcagcacacacctttga

SEQ ID NO: 746972 - DNA, 20 bp, mouse
gacgaaaaatccccgatttc

SEQ ID NO: 746973 - DNA, 20 bp, mouse
gagctggcatcctgaaatcg

SEQ ID NO: 746974 - DNA, 20 bp, mouse
gtctcttagctcctctcagc

SEQ ID NO: 746975 - DNA, 20 bp, mouse
gaataaacatgttggcctaa

SEQ ID NO: 746976 - DNA, 20 bp, mouse
gtctcattgaggtccgccca

SEQ ID NO: 746977 - DNA, 20 bp, mouse
gggagccggaatgttccaga

SEQ ID NO: 746978 - DNA, 20 bp, mouse
gagtggggctgtctggtgtc

SEQ ID NO: 746979 - DNA, 20 bp, mouse
gggacctcaatgagacgcgg

SEQ ID NO: 746980 - DNA, 20 bp, mouse
gggaccaacggcaccctgta

SEQ ID NO: 746981 - DNA, 20 bp, mouse
gggcggacctcaatgagacg

SEQ ID NO: 746982 - DNA, 20 bp, mouse
gaccacatcttgtcagagtg

SEQ ID NO: 746983 - DNA, 20 bp, mouse
gttagcaagaaccttcttcc

SEQ ID NO: 746984 - DNA, 20 bp, mouse
ggcagagggcgctgttagct

SEQ ID NO: 746985 - DNA, 20 bp, mouse
gaagatgtgagtaactatcg

SEQ ID NO: 746986 - DNA, 20 bp, mouse
gccaaggcagacctctgcga

SEQ ID NO: 746987 - DNA, 20 bp, mouse
gaaggctcgggacctccaga

SEQ ID NO: 746988 - DNA, 20 bp, mouse
ggggacctccagaaggcggg

SEQ ID NO: 746989 - DNA, 20 bp, mouse
ggagacaaggcggtgagcta

SEQ ID NO: 746990 - DNA, 20 bp, mouse
gctgggcccgggacccaaag

SEQ ID NO: 746991 - DNA, 20 bp, mouse
gcagacctctgcgaaggctc

SEQ ID NO: 746992 - DNA, 20 bp, mouse
ggctcgggacctccagaagg

SEQ ID NO: 746993 - DNA, 20 bp, mouse
ggcagaggtctgccttgggt

SEQ ID NO: 746994 - DNA, 20 bp, mouse
gaggtctgccttgggtgggt

SEQ ID NO: 746995 - DNA, 20 bp, mouse
gcaaagcctccgctgggccc

SEQ ID NO: 746996 - DNA, 20 bp, mouse
gaacatgcgcatgcgcatat

SEQ ID NO: 746997 - DNA, 20 bp, mouse
gtgcgcatatgggcaggtat

SEQ ID NO: 746998 - DNA, 20 bp, mouse
gtgcgcatgcgcatatgggc

SEQ ID NO: 746999 - DNA, 20 bp, mouse
gaagacaaagacagacagcg

SEQ ID NO: 747000 - DNA, 20 bp, mouse
gtcacaggaagaggtcctgc

SEQ ID NO: 747001 - DNA, 20 bp, mouse
ggggacaaagattctaaaag

SEQ ID NO: 747002 - DNA, 20 bp, mouse
gtgaacatactactccttca

SEQ ID NO: 747003 - DNA, 20 bp, mouse
gcttcggaggtctttttatt

SEQ ID NO: 747004 - DNA, 20 bp, mouse
gcggaacaggagcttgtcct

SEQ ID NO: 747005 - DNA, 20 bp, mouse
gaagctcgtcctccccctga

SEQ ID NO: 747006 - DNA, 20 bp, mouse
gtcagcctgaatccaagaag

SEQ ID NO: 747007 - DNA, 20 bp, mouse
gcacgcgcatgcgtggtttg

SEQ ID NO: 747008 - DNA, 20 bp, mouse
gcctgcatctgctcagactg

SEQ ID NO: 747009 - DNA, 20 bp, mouse
gggattcaggctgagattag

SEQ ID NO: 747010 - DNA, 20 bp, mouse
ggtttgtggtgcacggtttg

SEQ ID NO: 747011 - DNA, 20 bp, mouse
gaaatgggggaattggaaat

SEQ ID NO: 747012 - DNA, 20 bp, mouse
ggcgtgcactcacatacttc

SEQ ID NO: 747013 - DNA, 20 bp, mouse
gggaaattgtaaaccagtgc

SEQ ID NO: 747014 - DNA, 20 bp, mouse
gagcacatccagatcctgca

SEQ ID NO: 747015 - DNA, 20 bp, mouse
gcatgacatgaattagagga

SEQ ID NO: 747016 - DNA, 20 bp, mouse
ggtactgggtgtgtgtacta

SEQ ID NO: 747017 - DNA, 20 bp, mouse
gtaagtaagggtttcctgta

SEQ ID NO: 747018 - DNA, 20 bp, mouse
gcacacacccagtacttgac

SEQ ID NO: 747019 - DNA, 20 bp, mouse
gacacccagtacttgacagg

SEQ ID NO: 747020 - DNA, 20 bp, mouse
ggatccgcctgtcaagtact

SEQ ID NO: 747021 - DNA, 20 bp, mouse
gtatctggagaaggctaacc

SEQ ID NO: 747022 - DNA, 20 bp, mouse
gggaactcactatctggaga

SEQ ID NO: 747023 - DNA, 20 bp, mouse
gagacaattagctgccttac

SEQ ID NO: 747024 - DNA, 20 bp, mouse
gacacagaaaagtagtatac

SEQ ID NO: 747025 - DNA, 20 bp, mouse
gcaggagaaaccgttgtatg

SEQ ID NO: 747026 - DNA, 20 bp, mouse
ggcgacgagaaagggtgtca

SEQ ID NO: 747027 - DNA, 20 bp, mouse
gcctacccgcgccaacccac

SEQ ID NO: 747028 - DNA, 20 bp, mouse
gcacgggagtcgagtgtccc

SEQ ID NO: 747029 - DNA, 20 bp, mouse
gccaacgcgcgtgcgcgcag

SEQ ID NO: 747030 - DNA, 20 bp, mouse
gcactctcggtgtcaactgc

SEQ ID NO: 747031 - DNA, 20 bp, mouse
ggactcccgtgggttggcgc

SEQ ID NO: 747032 - DNA, 20 bp, mouse
gaccgagagtgcgacgagaa

SEQ ID NO: 747033 - DNA, 20 bp, mouse
gcgagggggcgttgtcggaa

SEQ ID NO: 747034 - DNA, 20 bp, mouse
gacactcgactcccgtgggt

SEQ ID NO: 747035 - DNA, 20 bp, mouse
gagagcggcctccgcgggta

SEQ ID NO: 747036 - DNA, 20 bp, mouse
gaaagagctaattggttgat

SEQ ID NO: 747037 - DNA, 20 bp, mouse
gcataattgcaggttcttga

SEQ ID NO: 747038 - DNA, 20 bp, mouse
gggtgtggtaaagagctaat

SEQ ID NO: 747039 - DNA, 20 bp, mouse
gagaggagggatattgaggc

SEQ ID NO: 747040 - DNA, 20 bp, mouse
gtaaggaatcaagaaaggga

SEQ ID NO: 747041 - DNA, 20 bp, mouse
gaatactttgaactcatatg

SEQ ID NO: 747042 - DNA, 20 bp, mouse
ggaggacaaatcataattgc

SEQ ID NO: 747043 - DNA, 20 bp, mouse
gtccttacatgacaataaat

SEQ ID NO: 747044 - DNA, 20 bp, mouse
ggatttattcaagaatgtcc

SEQ ID NO: 747045 - DNA, 20 bp, mouse
gacccatttattgtcatgta

SEQ ID NO: 747046 - DNA, 20 bp, mouse
gtgcactggaggcatctatt

SEQ ID NO: 747047 - DNA, 20 bp, mouse
gaccccccaggttgcactgg

SEQ ID NO: 747048 - DNA, 20 bp, mouse
ggatgcctccagtgcaacct

SEQ ID NO: 747049 - DNA, 20 bp, mouse
ggaggcatctatttggtgga

SEQ ID NO: 747050 - DNA, 20 bp, mouse
gagacatgctggcataagat

SEQ ID NO: 747051 - DNA, 20 bp, mouse
gtgaatctaacgaacccccc

SEQ ID NO: 747052 - DNA, 20 bp, mouse
ggtgtgcctaagaccatttt

SEQ ID NO: 747053 - DNA, 20 bp, mouse
gccaaagtagcactataatc

SEQ ID NO: 747054 - DNA, 20 bp, mouse
gatagtgctactttggattt

SEQ ID NO: 747055 - DNA, 20 bp, mouse
gttgtcgagaagaaacacaa

SEQ ID NO: 747056 - DNA, 20 bp, mouse
gacactcatctcacccgcct

SEQ ID NO: 747057 - DNA, 20 bp, mouse
gacacccaggaatagggctc

SEQ ID NO: 747058 - DNA, 20 bp, mouse
ggctgaggctcatgggtcat

SEQ ID NO: 747059 - DNA, 20 bp, mouse
gataccacctagttgtggta

SEQ ID NO: 747060 - DNA, 20 bp, mouse
gccacccccatcagcatagg

SEQ ID NO: 747061 - DNA, 20 bp, mouse
gggggggggtgcagtccaca

SEQ ID NO: 747062 - DNA, 20 bp, mouse
gccaggaatagggctccgga

SEQ ID NO: 747063 - DNA, 20 bp, mouse
gggtggaaggggcccctttc

SEQ ID NO: 747064 - DNA, 20 bp, mouse
ggcccctttccggtcctctg

SEQ ID NO: 747065 - DNA, 20 bp, mouse
ggggggatctgtaaaaaaag

SEQ ID NO: 747066 - DNA, 20 bp, mouse
ggggctgcgtggaagatcta

SEQ ID NO: 747067 - DNA, 20 bp, mouse
gaagatctaggggttctcga

SEQ ID NO: 747068 - DNA, 20 bp, mouse
ggagacccagaccgcaagtt

SEQ ID NO: 747069 - DNA, 20 bp, mouse
gcctcaatgcactgtgtctt

SEQ ID NO: 747070 - DNA, 20 bp, mouse
ggatcttccacgcagccctg

SEQ ID NO: 747071 - DNA, 20 bp, mouse
gggggagaatgttgtttccg

SEQ ID NO: 747072 - DNA, 20 bp, mouse
ggggcggggaagtgaccgtt

SEQ ID NO: 747073 - DNA, 20 bp, mouse
gactctcccaacttgcggtc

SEQ ID NO: 747074 - DNA, 20 bp, mouse
gacacagtgcattgaggagt

SEQ ID NO: 747075 - DNA, 20 bp, mouse
gcctaaggaacagtgaagta

SEQ ID NO: 747076 - DNA, 20 bp, mouse
gctgatgcccagcgatgccc

SEQ ID NO: 747077 - DNA, 20 bp, mouse
gagagctacggcaaaacctg

SEQ ID NO: 747078 - DNA, 20 bp, mouse
gcagtcgtgagcaggcactg

SEQ ID NO: 747079 - DNA, 20 bp, mouse
gagcaaagcctgggcatcgc

SEQ ID NO: 747080 - DNA, 20 bp, mouse
gaagccttagaggaatccaa

SEQ ID NO: 747081 - DNA, 20 bp, mouse
gtgggaatcttcacatgagt

SEQ ID NO: 747082 - DNA, 20 bp, mouse
gtaagggcagaggtgcggtg

SEQ ID NO: 747083 - DNA, 20 bp, mouse
gggggcggagcgtgtgtcct

SEQ ID NO: 747084 - DNA, 20 bp, mouse
gcagtgcagcttggtctgtg

SEQ ID NO: 747085 - DNA, 20 bp, mouse
gtctcctctgggtcgctact

SEQ ID NO: 747086 - DNA, 20 bp, mouse
ggggcgagacccaattgcaa

SEQ ID NO: 747087 - DNA, 20 bp, mouse
gacggctgctgagttgtggt

SEQ ID NO: 747088 - DNA, 20 bp, mouse
gtcgggagtagtgttgacag

SEQ ID NO: 747089 - DNA, 20 bp, mouse
gctcctgtgaggtctcccga

SEQ ID NO: 747090 - DNA, 20 bp, mouse
gtagaggaggtaggctaaaa

SEQ ID NO: 747091 - DNA, 20 bp, mouse
gtctagctggttaactcctt

SEQ ID NO: 747092 - DNA, 20 bp, mouse
ggggaagtggtctctcagct

SEQ ID NO: 747093 - DNA, 20 bp, mouse
ggctaaaagggtggcagaaa

SEQ ID NO: 747094 - DNA, 20 bp, mouse
gtaaccagctagaaatgagg

SEQ ID NO: 747095 - DNA, 20 bp, mouse
gcccaggtggccagtgaggt

SEQ ID NO: 747096 - DNA, 20 bp, mouse
gggagctcgaacagtctgag

SEQ ID NO: 747097 - DNA, 20 bp, mouse
gataacctatggggaggaga

SEQ ID NO: 747098 - DNA, 20 bp, mouse
gagggctgggtagggtccga

SEQ ID NO: 747099 - DNA, 20 bp, mouse
ggtggaacagcagctttgag

SEQ ID NO: 747100 - DNA, 20 bp, mouse
gaaagacgacccataaccta

SEQ ID NO: 747101 - DNA, 20 bp, mouse
gcagtctgagagggctgggt

SEQ ID NO: 747102 - DNA, 20 bp, mouse
gcgacccataacctatgggg

SEQ ID NO: 747103 - DNA, 20 bp, mouse
ggaacagcagctttgagggg

SEQ ID NO: 747104 - DNA, 20 bp, mouse
ggtgtggaagggtccccagt

SEQ ID NO: 747105 - DNA, 20 bp, mouse
gcgaacagtctgagagggct

SEQ ID NO: 747106 - DNA, 20 bp, mouse
gtctaggtgcgtcacccaca

SEQ ID NO: 747107 - DNA, 20 bp, mouse
gagggaaagggcgggagtag

SEQ ID NO: 747108 - DNA, 20 bp, mouse
ggggcattcagggtctgcta

SEQ ID NO: 747109 - DNA, 20 bp, mouse
gcaggggccgctctccctgt

SEQ ID NO: 747110 - DNA, 20 bp, mouse
gccaactcagcgtccgctgt

SEQ ID NO: 747111 - DNA, 20 bp, mouse
ggtggggcgggcccgcctct

SEQ ID NO: 747112 - DNA, 20 bp, mouse
ggcccttgccaaggagggaa

SEQ ID NO: 747113 - DNA, 20 bp, mouse
gtgggtgacgcacctagagg

SEQ ID NO: 747114 - DNA, 20 bp, mouse
gcctccttggcaagggcaca

SEQ ID NO: 747115 - DNA, 20 bp, mouse
gggggctcaaagagagacag

SEQ ID NO: 747116 - DNA, 20 bp, mouse
gcggcgccgcgcagccaata

SEQ ID NO: 747117 - DNA, 20 bp, mouse
gcgggtaggcaagaaagggg

SEQ ID NO: 747118 - DNA, 20 bp, mouse
gacacagtggcgaagaggaa

SEQ ID NO: 747119 - DNA, 20 bp, mouse
gacccagctcaggagaggcg

SEQ ID NO: 747120 - DNA, 20 bp, mouse
gaggtcattcgacgccccat

SEQ ID NO: 747121 - DNA, 20 bp, mouse
gaagcgggtaggcaagaaag

SEQ ID NO: 747122 - DNA, 20 bp, mouse
gagaaaggggcgggccatcg

SEQ ID NO: 747123 - DNA, 20 bp, mouse
gaggaccgcgctcaggaggt

SEQ ID NO: 747124 - DNA, 20 bp, mouse
gaggagaggcggggcaagga

SEQ ID NO: 747125 - DNA, 20 bp, mouse
gttgccgcggagaagcgggt

SEQ ID NO: 747126 - DNA, 20 bp, mouse
gtggagctgccggattaaga

SEQ ID NO: 747127 - DNA, 20 bp, mouse
ggccctgaggaaggcattag

SEQ ID NO: 747128 - DNA, 20 bp, mouse
gctgccggattaagagggtg

SEQ ID NO: 747129 - DNA, 20 bp, mouse
gacacagcccacgtgaagga

SEQ ID NO: 747130 - DNA, 20 bp, mouse
gagtccccaccctcttaatc

SEQ ID NO: 747131 - DNA, 20 bp, mouse
gagggtggggtggagaatcc

SEQ ID NO: 747132 - DNA, 20 bp, mouse
ggggaaaggggcaggaatca

SEQ ID NO: 747133 - DNA, 20 bp, mouse
gcttccgccctccttcacgt

SEQ ID NO: 747134 - DNA, 20 bp, mouse
gaaggacacagcccacgtga

SEQ ID NO: 747135 - DNA, 20 bp, mouse
gtgaaggagggcggaagggt

SEQ ID NO: 747136 - DNA, 20 bp, mouse
gtctcccagacccagacctg

SEQ ID NO: 747137 - DNA, 20 bp, mouse
ggcacacaggtggcggaaaa

SEQ ID NO: 747138 - DNA, 20 bp, mouse
gtggcctcaggtctgggtct

SEQ ID NO: 747139 - DNA, 20 bp, mouse
gcactcgcgcccggcctcga

SEQ ID NO: 747140 - DNA, 20 bp, mouse
gggaggagccgagccctctg

SEQ ID NO: 747141 - DNA, 20 bp, mouse
gcacaggtggcggaaaaagg

SEQ ID NO: 747142 - DNA, 20 bp, mouse
ggaggtccgccgcacacagg

SEQ ID NO: 747143 - DNA, 20 bp, mouse
gaatgaacgcatcccgcaga

SEQ ID NO: 747144 - DNA, 20 bp, mouse
gagggccaatcagcgtgtgc

SEQ ID NO: 747145 - DNA, 20 bp, mouse
gcaagtctgcaaaactcagg

SEQ ID NO: 747146 - DNA, 20 bp, mouse
gcccgcgcggagcagctaga

SEQ ID NO: 747147 - DNA, 20 bp, mouse
gaccgggcgcaggacccagg

SEQ ID NO: 747148 - DNA, 20 bp, mouse
gccgcccgggtgcccgcttg

SEQ ID NO: 747149 - DNA, 20 bp, mouse
gtgttcccacctagcctggc

SEQ ID NO: 747150 - DNA, 20 bp, mouse
ggggcacccgggcggctccc

SEQ ID NO: 747151 - DNA, 20 bp, mouse
ggcacgccggggagccgccc

SEQ ID NO: 747152 - DNA, 20 bp, mouse
gcgacccaggtggctcgggg

SEQ ID NO: 747153 - DNA, 20 bp, mouse
gaagcaaggaaggggtacga

SEQ ID NO: 747154 - DNA, 20 bp, mouse
gggacgacccaggtggctcg

SEQ ID NO: 747155 - DNA, 20 bp, mouse
ggtgaggtggagtcactctg

SEQ ID NO: 747156 - DNA, 20 bp, mouse
gacacaggggcaagggttaa

SEQ ID NO: 747157 - DNA, 20 bp, mouse
gaccacctacacaggggcaa

SEQ ID NO: 747158 - DNA, 20 bp, mouse
ggctgacattggaagatggt

SEQ ID NO: 747159 - DNA, 20 bp, mouse
gaaagaacaccacctacaca

SEQ ID NO: 747160 - DNA, 20 bp, mouse
gtggggcttggctaacaaaa

SEQ ID NO: 747161 - DNA, 20 bp, mouse
gtgttctctcacacactaag

SEQ ID NO: 747162 - DNA, 20 bp, mouse
gttagccaagccccagctta

SEQ ID NO: 747163 - DNA, 20 bp, mouse
gaatcccagctatggacgga

SEQ ID NO: 747164 - DNA, 20 bp, mouse
ggttaagggtcactacagtt

SEQ ID NO: 747165 - DNA, 20 bp, mouse
gtacagctgacattggaaga

SEQ ID NO: 747166 - DNA, 20 bp, mouse
gcctgagcgcgcgcccggag

SEQ ID NO: 747167 - DNA, 20 bp, mouse
gcgaacgcgaggaacagtgc

SEQ ID NO: 747168 - DNA, 20 bp, mouse
gccgagctcgcgccccgatt

SEQ ID NO: 747169 - DNA, 20 bp, mouse
gcggacgcatccacgcgcgg

SEQ ID NO: 747170 - DNA, 20 bp, mouse
gacaacggcgggcatcggag

SEQ ID NO: 747171 - DNA, 20 bp, mouse
gacagtgcagggcggcgcgg

SEQ ID NO: 747172 - DNA, 20 bp, mouse
ggagccttcccgcaccgcgc

SEQ ID NO: 747173 - DNA, 20 bp, mouse
gctgcctggggaagtgaaat

SEQ ID NO: 747174 - DNA, 20 bp, mouse
gtggaccagcggcaggtagc

SEQ ID NO: 747175 - DNA, 20 bp, mouse
gcgggcgccgccactcaccg

SEQ ID NO: 747176 - DNA, 20 bp, mouse
gacagggagtggtcccactg

SEQ ID NO: 747177 - DNA, 20 bp, mouse
gcggccagcagtacggaacc

SEQ ID NO: 747178 - DNA, 20 bp, mouse
gggacgcaggtccaccagga

SEQ ID NO: 747179 - DNA, 20 bp, mouse
gggtggcagcgtcgcatcac

SEQ ID NO: 747180 - DNA, 20 bp, mouse
ggacctgcgtcctggaggag

SEQ ID NO: 747181 - DNA, 20 bp, mouse
gctgccatgttgcccacagt

SEQ ID NO: 747182 - DNA, 20 bp, mouse
gggtcccactgtgggcaaca

SEQ ID NO: 747183 - DNA, 20 bp, mouse
gggaacggaagttccggcgg

SEQ ID NO: 747184 - DNA, 20 bp, mouse
gtgccatgtccagacgctgt

SEQ ID NO: 747185 - DNA, 20 bp, mouse
gcatgtccagacgctgtagg

SEQ ID NO: 747186 - DNA, 20 bp, mouse
gccgcccctaaatctgacga

SEQ ID NO: 747187 - DNA, 20 bp, mouse
gaatggaggaacctgaccta

SEQ ID NO: 747188 - DNA, 20 bp, mouse
ggcgcggccccgtgacgcta

SEQ ID NO: 747189 - DNA, 20 bp, mouse
gcgcatgcgcacacccatgc

SEQ ID NO: 747190 - DNA, 20 bp, mouse
gcaggcaagcagcaccagca

SEQ ID NO: 747191 - DNA, 20 bp, mouse
gtgtgcgcatgcgccgtgcc

SEQ ID NO: 747192 - DNA, 20 bp, mouse
gactccttcgtcagatttag

SEQ ID NO: 747193 - DNA, 20 bp, mouse
gaaaacctgcagcaaattct

SEQ ID NO: 747194 - DNA, 20 bp, mouse
gggaatgctttccttaggtc

SEQ ID NO: 747195 - DNA, 20 bp, mouse
gaggggcggggcgccaggca

SEQ ID NO: 747196 - DNA, 20 bp, mouse
ggcggccgcggtggcagaaa

SEQ ID NO: 747197 - DNA, 20 bp, mouse
gcggtgggctgcagatgagg

SEQ ID NO: 747198 - DNA, 20 bp, mouse
ggggcaaggggataacgaaa

SEQ ID NO: 747199 - DNA, 20 bp, mouse
ggctcgaggagggagagaat

SEQ ID NO: 747200 - DNA, 20 bp, mouse
gccggccgctggctcgagga

SEQ ID NO: 747201 - DNA, 20 bp, mouse
ggcggtggcagaaaaggcgg

SEQ ID NO: 747202 - DNA, 20 bp, mouse
gcgccggtgggctgcagatg

SEQ ID NO: 747203 - DNA, 20 bp, mouse
gcggggcggccgccgccggt

SEQ ID NO: 747204 - DNA, 20 bp, mouse
gcagcggccggcggggttac

SEQ ID NO: 747205 - DNA, 20 bp, mouse
gttaccggaagtgatgatgc

SEQ ID NO: 747206 - DNA, 20 bp, mouse
gcacggagtcgcaacgatcg

SEQ ID NO: 747207 - DNA, 20 bp, mouse
gcacagcaagggtgctcaaa

SEQ ID NO: 747208 - DNA, 20 bp, mouse
gggcaccctggtcacggaag

SEQ ID NO: 747209 - DNA, 20 bp, mouse
gcgagctcctgggttctccg

SEQ ID NO: 747210 - DNA, 20 bp, mouse
ggcgagagggcacacgagta

SEQ ID NO: 747211 - DNA, 20 bp, mouse
gccctggtcacggaagcgga

SEQ ID NO: 747212 - DNA, 20 bp, mouse
gggagctcggtcgcttttac

SEQ ID NO: 747213 - DNA, 20 bp, mouse
gccgtgaccagggtgcccga

SEQ ID NO: 747214 - DNA, 20 bp, mouse
gtggtcacggaagcggaagg

SEQ ID NO: 747215 - DNA, 20 bp, mouse
gagacggatgcgcgagtcct

SEQ ID NO: 747216 - DNA, 20 bp, mouse
ggggcctaggcaggtgtagg

SEQ ID NO: 747217 - DNA, 20 bp, mouse
gctgctgtgcacgaaaacga

SEQ ID NO: 747218 - DNA, 20 bp, mouse
gtgcctaggccccgttgcct

SEQ ID NO: 747219 - DNA, 20 bp, mouse
gaacccaggcaacggggcct

SEQ ID NO: 747220 - DNA, 20 bp, mouse
gggagcgcggctcgtaaccc

SEQ ID NO: 747221 - DNA, 20 bp, mouse
gcccaggctcgctcctcggg

SEQ ID NO: 747222 - DNA, 20 bp, mouse
ggcgtggtgtcaggagacac

SEQ ID NO: 747223 - DNA, 20 bp, mouse
ggaggctccgcgttcctcac

SEQ ID NO: 747224 - DNA, 20 bp, mouse
ggcagggcggcgggcagcta

SEQ ID NO: 747225 - DNA, 20 bp, mouse
gcggctcgtaacccaggcaa

SEQ ID NO: 747226 - DNA, 20 bp, mouse
gactacaggcagcagtgtat

SEQ ID NO: 747227 - DNA, 20 bp, mouse
gcggggcatcaggcggaaat

SEQ ID NO: 747228 - DNA, 20 bp, mouse
gaacactgggagttgtgagt

SEQ ID NO: 747229 - DNA, 20 bp, mouse
gcagcagtgtatgggactcg

SEQ ID NO: 747230 - DNA, 20 bp, mouse
gaccgtctgccggaagtggg

SEQ ID NO: 747231 - DNA, 20 bp, mouse
gtaggtaaaagccgcgatgt

SEQ ID NO: 747232 - DNA, 20 bp, mouse
gcgacttgggcagtactcac

SEQ ID NO: 747233 - DNA, 20 bp, mouse
ggcatcaggcggaaatgggc

SEQ ID NO: 747234 - DNA, 20 bp, mouse
ggaggccgctttctttgctg

SEQ ID NO: 747235 - DNA, 20 bp, mouse
gataaggtacgcccacatcg

SEQ ID NO: 747236 - DNA, 20 bp, mouse
gaagccgcggtgccaaatta

SEQ ID NO: 747237 - DNA, 20 bp, mouse
gcggggaaggcgggctagga

SEQ ID NO: 747238 - DNA, 20 bp, mouse
ggcggtgccaaattacggac

SEQ ID NO: 747239 - DNA, 20 bp, mouse
gccctcttggcaaccaatca

SEQ ID NO: 747240 - DNA, 20 bp, mouse
gttcctcctgcggggaaggc

SEQ ID NO: 747241 - DNA, 20 bp, mouse
gagcggcacgctaggcgcgg

SEQ ID NO: 747242 - DNA, 20 bp, mouse
ggctgtgccccggccctgat

SEQ ID NO: 747243 - DNA, 20 bp, mouse
gtccccgcaggaggaagttc

SEQ ID NO: 747244 - DNA, 20 bp, mouse
ggtgccaaattacggacagg

SEQ ID NO: 747245 - DNA, 20 bp, mouse
gagcgtcgccagctgtgccc

SEQ ID NO: 747246 - DNA, 20 bp, mouse
gtactagtaaccacgtttct

SEQ ID NO: 747247 - DNA, 20 bp, mouse
gtctacagaactcaccatat

SEQ ID NO: 747248 - DNA, 20 bp, mouse
ggtgggggacttcaagtttg

SEQ ID NO: 747249 - DNA, 20 bp, mouse
gatgactggaggatctccat

SEQ ID NO: 747250 - DNA, 20 bp, mouse
ggaaggaagttgaaaacaaa

SEQ ID NO: 747251 - DNA, 20 bp, mouse
gtggaagtaactttgtaccc

SEQ ID NO: 747252 - DNA, 20 bp, mouse
gaacaaaaggcagagtacca

SEQ ID NO: 747253 - DNA, 20 bp, mouse
gcctagcaggagatgactgg

SEQ ID NO: 747254 - DNA, 20 bp, mouse
gacgtttctcggtgaatcta

SEQ ID NO: 747255 - DNA, 20 bp, mouse
ggagaaatgagtgacaagca

SEQ ID NO: 747256 - DNA, 20 bp, mouse
gaactgggcggggtcggatc

SEQ ID NO: 747257 - DNA, 20 bp, mouse
gccggccatccgcgggactc

SEQ ID NO: 747258 - DNA, 20 bp, mouse
gtcggggtcctactgggtgc

SEQ ID NO: 747259 - DNA, 20 bp, mouse
gcaggaagcccgcacccagt

SEQ ID NO: 747260 - DNA, 20 bp, mouse
gagggcgctagggtaccagg

SEQ ID NO: 747261 - DNA, 20 bp, mouse
gccctctgccggccatccgc

SEQ ID NO: 747262 - DNA, 20 bp, mouse
gcgggactcggggtcctact

SEQ ID NO: 747263 - DNA, 20 bp, mouse
gcctaatattctccattcgt

SEQ ID NO: 747264 - DNA, 20 bp, mouse
ggcgctagggtaccaggcgg

SEQ ID NO: 747265 - DNA, 20 bp, mouse
gtcccgcggatggccggcag

SEQ ID NO: 747266 - DNA, 20 bp, mouse
gtctggcgacatctagggga

SEQ ID NO: 747267 - DNA, 20 bp, mouse
ggagcagcgaagtaggcgta

SEQ ID NO: 747268 - DNA, 20 bp, mouse
gtaagagggaaggggacgac

SEQ ID NO: 747269 - DNA, 20 bp, mouse
gggtgatcagactctcacta

SEQ ID NO: 747270 - DNA, 20 bp, mouse
gcggggctatgcagatcata

SEQ ID NO: 747271 - DNA, 20 bp, mouse
gcctaaaggagcagcgaagt

SEQ ID NO: 747272 - DNA, 20 bp, mouse
ggacatctaggggagggctt

SEQ ID NO: 747273 - DNA, 20 bp, mouse
gaagcgtggaacatcatccc

SEQ ID NO: 747274 - DNA, 20 bp, mouse
gttaggggaccagaactgag

SEQ ID NO: 747275 - DNA, 20 bp, mouse
gggacgaggcactgatgctg

SEQ ID NO: 747276 - DNA, 20 bp, mouse
ggacccgcacactgcagtcc

SEQ ID NO: 747277 - DNA, 20 bp, mouse
gtccgcggccggcttctcca

SEQ ID NO: 747278 - DNA, 20 bp, mouse
gggtcccaggactcctccgt

SEQ ID NO: 747279 - DNA, 20 bp, mouse
gcgggcgccgagctcgccaa

SEQ ID NO: 747280 - DNA, 20 bp, mouse
gagccgacagaggcccacgg

SEQ ID NO: 747281 - DNA, 20 bp, mouse
gaggcccacggaggagtcct

SEQ ID NO: 747282 - DNA, 20 bp, mouse
ggaggcccgtgagccgacag

SEQ ID NO: 747283 - DNA, 20 bp, mouse
ggtcccgcagctccccgcct

SEQ ID NO: 747284 - DNA, 20 bp, mouse
gcggaagcgggagctcgccg

SEQ ID NO: 747285 - DNA, 20 bp, mouse
gccaccagcacacggacctc

SEQ ID NO: 747286 - DNA, 20 bp, mouse
gtaaacccaacgggtcctcc

SEQ ID NO: 747287 - DNA, 20 bp, mouse
gcgcgcctgcgtgctggcgt

SEQ ID NO: 747288 - DNA, 20 bp, mouse
gttagccaggaggacccgtt

SEQ ID NO: 747289 - DNA, 20 bp, mouse
gagagtaggcggaggtgcga

SEQ ID NO: 747290 - DNA, 20 bp, mouse
gtctagccccgcccgtccgg

SEQ ID NO: 747291 - DNA, 20 bp, mouse
gaagaaacgtactgagcgga

SEQ ID NO: 747292 - DNA, 20 bp, mouse
gcatcggcgcgcctgcgtgc

SEQ ID NO: 747293 - DNA, 20 bp, mouse
gcggcggcccccggacgggc

SEQ ID NO: 747294 - DNA, 20 bp, mouse
gtgggcctgcggttggccgc

SEQ ID NO: 747295 - DNA, 20 bp, mouse
gcgcgccgatgcggccgggg

SEQ ID NO: 747296 - DNA, 20 bp, mouse
gaatgagggcgggccctgat

SEQ ID NO: 747297 - DNA, 20 bp, mouse
gtgctgagaggtcagaatga

SEQ ID NO: 747298 - DNA, 20 bp, mouse
gccgaggaggccaagatacc

SEQ ID NO: 747299 - DNA, 20 bp, mouse
ggggtcgaagattcaggttg

SEQ ID NO: 747300 - DNA, 20 bp, mouse
gaagatacctggctcagaag

SEQ ID NO: 747301 - DNA, 20 bp, mouse
gacataggagcacaagtcca

SEQ ID NO: 747302 - DNA, 20 bp, mouse
gcgccctcctctgaagtcat

SEQ ID NO: 747303 - DNA, 20 bp, mouse
gcagaaagctgtggccaccg

SEQ ID NO: 747304 - DNA, 20 bp, mouse
ggatactgggtcgaagattc

SEQ ID NO: 747305 - DNA, 20 bp, mouse
ggcacctcccggctctgcca

SEQ ID NO: 747306 - DNA, 20 bp, mouse
ggggacaaatgcagcgagga

SEQ ID NO: 747307 - DNA, 20 bp, mouse
gccaccgggagggcacgctg

SEQ ID NO: 747308 - DNA, 20 bp, mouse
gaagtcccgccccaccggga

SEQ ID NO: 747309 - DNA, 20 bp, mouse
gtaggcgctcgaggcgggga

SEQ ID NO: 747310 - DNA, 20 bp, mouse
gtgcgcacgcgcagaggagc

SEQ ID NO: 747311 - DNA, 20 bp, mouse
gcgaccccagcgtgccctcc

SEQ ID NO: 747312 - DNA, 20 bp, mouse
gcccgccttcttcctctcat

SEQ ID NO: 747313 - DNA, 20 bp, mouse
gcgcgcagaggagcgggtct

SEQ ID NO: 747314 - DNA, 20 bp, mouse
ggattctccacgcatcacgt

SEQ ID NO: 747315 - DNA, 20 bp, mouse
gcctaaagtcccgccccacc

SEQ ID NO: 747316 - DNA, 20 bp, mouse
ggaaagcacacgggtgagga

SEQ ID NO: 747317 - DNA, 20 bp, mouse
gtagcggcagagccagtcac

SEQ ID NO: 747318 - DNA, 20 bp, mouse
ggctgactcagaaagcacac

SEQ ID NO: 747319 - DNA, 20 bp, mouse
gcggcagagccagtcacggg

SEQ ID NO: 747320 - DNA, 20 bp, mouse
ggtacagcctgggcgttcaa

SEQ ID NO: 747321 - DNA, 20 bp, mouse
gcaggggaatatgggaactg

SEQ ID NO: 747322 - DNA, 20 bp, mouse
gacgcccaggctgtactttg

SEQ ID NO: 747323 - DNA, 20 bp, mouse
gcgggcggacatgaatgaat

SEQ ID NO: 747324 - DNA, 20 bp, mouse
ggctccgcaaagcatcacac

SEQ ID NO: 747325 - DNA, 20 bp, mouse
ggtgtgggaactgagtccac

SEQ ID NO: 747326 - DNA, 20 bp, mouse
gggctcattaggaatggaga

SEQ ID NO: 747327 - DNA, 20 bp, mouse
gcttaaagattgggctcatt

SEQ ID NO: 747328 - DNA, 20 bp, mouse
gggccgcaagctgttggcaa

SEQ ID NO: 747329 - DNA, 20 bp, mouse
ggtaggaggccgcaagctgt

SEQ ID NO: 747330 - DNA, 20 bp, mouse
ggacttctgtttctaagtga

SEQ ID NO: 747331 - DNA, 20 bp, mouse
gctaaagtccatagatctgt

SEQ ID NO: 747332 - DNA, 20 bp, mouse
gaattctgtgcatttattcc

SEQ ID NO: 747333 - DNA, 20 bp, mouse
gcgcacagatcaaatgtagg

SEQ ID NO: 747334 - DNA, 20 bp, mouse
gttacgcacagatcaaatgt

SEQ ID NO: 747335 - DNA, 20 bp, mouse
gcgcaagctgttggcaaagg

SEQ ID NO: 747336 - DNA, 20 bp, mouse
gatactgtatgcttattctt

SEQ ID NO: 747337 - DNA, 20 bp, mouse
gtaggaaaccacaagctgtt

SEQ ID NO: 747338 - DNA, 20 bp, mouse
gcagactagctaaaggcaga

SEQ ID NO: 747339 - DNA, 20 bp, mouse
gacaagctgttgggaaagga

SEQ ID NO: 747340 - DNA, 20 bp, mouse
gttgaacacgatcaagaaaa

SEQ ID NO: 747341 - DNA, 20 bp, mouse
gtcccagctcaggaatcaag

SEQ ID NO: 747342 - DNA, 20 bp, mouse
gctgaagtccatagatcggt

SEQ ID NO: 747343 - DNA, 20 bp, mouse
gttgcacacagctcaaatgt

SEQ ID NO: 747344 - DNA, 20 bp, mouse
gaaccacaagctgttgggaa

SEQ ID NO: 747345 - DNA, 20 bp, mouse
gtgagtgtattagtcagtag

SEQ ID NO: 747346 - DNA, 20 bp, mouse
gccattagacagcttatcca

SEQ ID NO: 747347 - DNA, 20 bp, mouse
gggaacctgtaattagaatt

SEQ ID NO: 747348 - DNA, 20 bp, mouse
gaatcccaaattctaattac

SEQ ID NO: 747349 - DNA, 20 bp, mouse
gaagttctgaacagtcttgt

SEQ ID NO: 747350 - DNA, 20 bp, mouse
gaacagtcttgttggatgtc

SEQ ID NO: 747351 - DNA, 20 bp, mouse
ggtgatatcacttgcatggg

SEQ ID NO: 747352 - DNA, 20 bp, mouse
gtccacttagttatgggtgt

SEQ ID NO: 747353 - DNA, 20 bp, mouse
ggaggtgatatcacttgcat

SEQ ID NO: 747354 - DNA, 20 bp, mouse
gtccaacacccataactaag

SEQ ID NO: 747355 - DNA, 20 bp, mouse
gtggtaaagtatgaaagtat

SEQ ID NO: 747356 - DNA, 20 bp, mouse
gagagcgcctacggggtctg

SEQ ID NO: 747357 - DNA, 20 bp, mouse
ggcagccgagagcgcctacg

SEQ ID NO: 747358 - DNA, 20 bp, mouse
gggcaggcggtaggctcgga

SEQ ID NO: 747359 - DNA, 20 bp, mouse
ggggcggcggggttagccaa

SEQ ID NO: 747360 - DNA, 20 bp, mouse
gaggcacagctccaggctag

SEQ ID NO: 747361 - DNA, 20 bp, mouse
gcacccagatcccacggatg

SEQ ID NO: 747362 - DNA, 20 bp, mouse
gctaacgcagcgcgggagag

SEQ ID NO: 747363 - DNA, 20 bp, mouse
ggaggggcacacactcaccg

SEQ ID NO: 747364 - DNA, 20 bp, mouse
gggtgagaaggtgatgtggg

SEQ ID NO: 747365 - DNA, 20 bp, mouse
ggccggtagcgggtgatctg

SEQ ID NO: 747366 - DNA, 20 bp, mouse
ggcccaggggcaggatgtgt

SEQ ID NO: 747367 - DNA, 20 bp, mouse
ggtctggaaggcaaggtgta

SEQ ID NO: 747368 - DNA, 20 bp, mouse
gttaggtagaaatggtagat

SEQ ID NO: 747369 - DNA, 20 bp, mouse
gaatggtagatgggtctgga

SEQ ID NO: 747370 - DNA, 20 bp, mouse
gtggaaggcaaggtgtaagg

SEQ ID NO: 747371 - DNA, 20 bp, mouse
gaaggtgtaaggcggaccaa

SEQ ID NO: 747372 - DNA, 20 bp, mouse
gtagaaatggtagatgggtc

SEQ ID NO: 747373 - DNA, 20 bp, mouse
gggtccttgaaggttgtttc

SEQ ID NO: 747374 - DNA, 20 bp, mouse
ggacctacacatcctgcccc

SEQ ID NO: 747375 - DNA, 20 bp, mouse
gcacaaaccctgcagcccag

SEQ ID NO: 747376 - DNA, 20 bp, mouse
gtcgtctcctaggacctcgg

SEQ ID NO: 747377 - DNA, 20 bp, mouse
gagcaacccaccgaggtcct

SEQ ID NO: 747378 - DNA, 20 bp, mouse
gccgggccgaggttgtctcc

SEQ ID NO: 747379 - DNA, 20 bp, mouse
gtcgcacaggctcgtctcct

SEQ ID NO: 747380 - DNA, 20 bp, mouse
gcctggtaagcaacccaccg

SEQ ID NO: 747381 - DNA, 20 bp, mouse
gtggcaaagtacgggtcacc

SEQ ID NO: 747382 - DNA, 20 bp, mouse
gcggaagtgcgcgaatccag

SEQ ID NO: 747383 - DNA, 20 bp, mouse
ggtcctccaggagacaacct

SEQ ID NO: 747384 - DNA, 20 bp, mouse
gcaaacggccctagtcctcc

SEQ ID NO: 747385 - DNA, 20 bp, mouse
gtccgccaggccggggagtc

SEQ ID NO: 747386 - DNA, 20 bp, mouse
gggctctcagtgtcacgtga

SEQ ID NO: 747387 - DNA, 20 bp, mouse
gtctctgttgccattggcaa

SEQ ID NO: 747388 - DNA, 20 bp, mouse
gctcgcttgcacgctatcat

SEQ ID NO: 747389 - DNA, 20 bp, mouse
gttagcgtggcaagaaaagg

SEQ ID NO: 747390 - DNA, 20 bp, mouse
gacggatgatgttgcgtaac

SEQ ID NO: 747391 - DNA, 20 bp, mouse
ggcaccgccccaggttagcg

SEQ ID NO: 747392 - DNA, 20 bp, mouse
gcgcgcgttgccaatgggaa

SEQ ID NO: 747393 - DNA, 20 bp, mouse
gaatgggaacggagacacgt

SEQ ID NO: 747394 - DNA, 20 bp, mouse
gcgtaactggctaatttccg

SEQ ID NO: 747395 - DNA, 20 bp, mouse
gcaggacagaagttgggctt

SEQ ID NO: 747396 - DNA, 20 bp, mouse
ggggaagcgcgaggtttgtc

SEQ ID NO: 747397 - DNA, 20 bp, mouse
ggctgccttgagaatgtcag

SEQ ID NO: 747398 - DNA, 20 bp, mouse
gacaggaggggtacgctcca

SEQ ID NO: 747399 - DNA, 20 bp, mouse
gaccgcccgggcagagccaa

SEQ ID NO: 747400 - DNA, 20 bp, mouse
ggcgacgcggctcgctatcg

SEQ ID NO: 747401 - DNA, 20 bp, mouse
gcagcggcgcagggctctct

SEQ ID NO: 747402 - DNA, 20 bp, mouse
ggccggaagtgctacaccag

SEQ ID NO: 747403 - DNA, 20 bp, mouse
gtcaaggccccggacccaat

SEQ ID NO: 747404 - DNA, 20 bp, mouse
ggcctatccagcctgaacaa

SEQ ID NO: 747405 - DNA, 20 bp, mouse
gtccggggccttgacaggag

SEQ ID NO: 747406 - DNA, 20 bp, mouse
ggtggggcggggcacgagtg

SEQ ID NO: 747407 - DNA, 20 bp, mouse
gcccaaagcccgcgccggtc

SEQ ID NO: 747408 - DNA, 20 bp, mouse
gccggggagagagcaggaca

SEQ ID NO: 747409 - DNA, 20 bp, mouse
gtgttccagactgacagctg

SEQ ID NO: 747410 - DNA, 20 bp, mouse
gtcagtctggaacaaaggcc

SEQ ID NO: 747411 - DNA, 20 bp, mouse
gtggggttgctccgacctcc

SEQ ID NO: 747412 - DNA, 20 bp, mouse
ggcgctgggtccctggccgc

SEQ ID NO: 747413 - DNA, 20 bp, mouse
gtggagaaatcaccggtaag

SEQ ID NO: 747414 - DNA, 20 bp, mouse
ggacagggtgcaggcagtgc

SEQ ID NO: 747415 - DNA, 20 bp, mouse
ggacagagaaagcaagaacg

SEQ ID NO: 747416 - DNA, 20 bp, mouse
gccagccagggcgcacgcgg

SEQ ID NO: 747417 - DNA, 20 bp, mouse
gtgggcggtgcgcactgatg

SEQ ID NO: 747418 - DNA, 20 bp, mouse
gtggctggcacgcgtgacgt

SEQ ID NO: 747419 - DNA, 20 bp, mouse
ggcacgcgggggctgctcgg

SEQ ID NO: 747420 - DNA, 20 bp, mouse
gccgaggggcgttcccgccc

SEQ ID NO: 747421 - DNA, 20 bp, mouse
gtatccctgccggagcccaa

SEQ ID NO: 747422 - DNA, 20 bp, mouse
ggtgccagccagggcgcacg

SEQ ID NO: 747423 - DNA, 20 bp, mouse
ggccgctggcccttgggctc

SEQ ID NO: 747424 - DNA, 20 bp, mouse
gcggcgcccccggccctgac

SEQ ID NO: 747425 - DNA, 20 bp, mouse
gtccgcccagccggcgcccc

SEQ ID NO: 747426 - DNA, 20 bp, mouse
gaggccagccctggaagagt

SEQ ID NO: 747427 - DNA, 20 bp, mouse
gtggcctaaggctgtctctc

SEQ ID NO: 747428 - DNA, 20 bp, mouse
gaagccgcgcccccccccag

SEQ ID NO: 747429 - DNA, 20 bp, mouse
gttggactgggtactgggtc

SEQ ID NO: 747430 - DNA, 20 bp, mouse
ggtagcctggtggtggccta

SEQ ID NO: 747431 - DNA, 20 bp, mouse
gcagtccaaaagtagcctgg

SEQ ID NO: 747432 - DNA, 20 bp, mouse
ggccaccaccaggctacttt

SEQ ID NO: 747433 - DNA, 20 bp, mouse
gactgggtcaggctactttt

SEQ ID NO: 747434 - DNA, 20 bp, mouse
gagaccactcccctctgggg

SEQ ID NO: 747435 - DNA, 20 bp, mouse
ggggcagaccactcccctct

SEQ ID NO: 747436 - DNA, 20 bp, mouse
ggacccgccaatcctggacg

SEQ ID NO: 747437 - DNA, 20 bp, mouse
gcaaacgcgggcccgccctc

SEQ ID NO: 747438 - DNA, 20 bp, mouse
gtcccacccccgtccaggat

SEQ ID NO: 747439 - DNA, 20 bp, mouse
ggccggcccgcctgcccaaa

SEQ ID NO: 747440 - DNA, 20 bp, mouse
gcgcccggcccgcccaccag

SEQ ID NO: 747441 - DNA, 20 bp, mouse
gcaggattggcgggtcccgg

SEQ ID NO: 747442 - DNA, 20 bp, mouse
gcacccccgtccaggattgg

SEQ ID NO: 747443 - DNA, 20 bp, mouse
gcccgcctgcccaaaaggct

SEQ ID NO: 747444 - DNA, 20 bp, mouse
gtcagcgaccaaaggggtta

SEQ ID NO: 747445 - DNA, 20 bp, mouse
gccgcgccgcgcgccctgtg

SEQ ID NO: 747446 - DNA, 20 bp, mouse
ggcctgatgcctcacaccct

SEQ ID NO: 747447 - DNA, 20 bp, mouse
ggggaggggcggtgctacaa

SEQ ID NO: 747448 - DNA, 20 bp, mouse
gagttgtcgctcaagttcta

SEQ ID NO: 747449 - DNA, 20 bp, mouse
gcggcgggagactcagtggg

SEQ ID NO: 747450 - DNA, 20 bp, mouse
gtccggagctcgcgggtgag

SEQ ID NO: 747451 - DNA, 20 bp, mouse
gtgaacttgaggagcctgag

SEQ ID NO: 747452 - DNA, 20 bp, mouse
gcctgaggggaagaaggccc

SEQ ID NO: 747453 - DNA, 20 bp, mouse
gaccctagaggactattctc

SEQ ID NO: 747454 - DNA, 20 bp, mouse
gtcccgaggtccggagctcg

SEQ ID NO: 747455 - DNA, 20 bp, mouse
ggtagcaccgcccctcccag

SEQ ID NO: 747456 - DNA, 20 bp, mouse
gcggctcaacagaccatcgg

SEQ ID NO: 747457 - DNA, 20 bp, mouse
ggcgctgcgcggacagtact

SEQ ID NO: 747458 - DNA, 20 bp, mouse
gcgcatacggggcactggag

SEQ ID NO: 747459 - DNA, 20 bp, mouse
gcggaggaggcggcgcatac

SEQ ID NO: 747460 - DNA, 20 bp, mouse
gaccgggggcgcgcaggaag

SEQ ID NO: 747461 - DNA, 20 bp, mouse
gggcactggagcggctggtg

SEQ ID NO: 747462 - DNA, 20 bp, mouse
gcgctcgtgctcgtcgccgc

SEQ ID NO: 747463 - DNA, 20 bp, mouse
ggcgcggctcaacagaccat

SEQ ID NO: 747464 - DNA, 20 bp, mouse
ggcggacgaccgctgggcca

SEQ ID NO: 747465 - DNA, 20 bp, mouse
gtacggggcactggagcggc

SEQ ID NO: 747466 - DNA, 20 bp, mouse
gggtctgaagacagtacgtg

SEQ ID NO: 747467 - DNA, 20 bp, mouse
gcgggcgctcctcatccacg

SEQ ID NO: 747468 - DNA, 20 bp, mouse
ggcgtgtgaccgcagaacct

SEQ ID NO: 747469 - DNA, 20 bp, mouse
gagtacgtgagggcgatctg

SEQ ID NO: 747470 - DNA, 20 bp, mouse
ggtactgtcttcagacctat

SEQ ID NO: 747471 - DNA, 20 bp, mouse
gttgacaatctccgagtgat

SEQ ID NO: 747472 - DNA, 20 bp, mouse
gacacgccgcggagtctagt

SEQ ID NO: 747473 - DNA, 20 bp, mouse
gccgagtgattggagttgat

SEQ ID NO: 747474 - DNA, 20 bp, mouse
ggactctgctacccagacag

SEQ ID NO: 747475 - DNA, 20 bp, mouse
ggttctgcggtcacacgccg

SEQ ID NO: 747476 - DNA, 20 bp, mouse
gtattggggtattgtgtagt

SEQ ID NO: 747477 - DNA, 20 bp, mouse
gcaggcgcccggtgtgagtg

SEQ ID NO: 747478 - DNA, 20 bp, mouse
gaaaatcgcagacgccgggg

SEQ ID NO: 747479 - DNA, 20 bp, mouse
ggggaaaatcgcagacgccg

SEQ ID NO: 747480 - DNA, 20 bp, mouse
gcgcgggcaagcggcaggag

SEQ ID NO: 747481 - DNA, 20 bp, mouse
ggaaccgcgctggacagcca

SEQ ID NO: 747482 - DNA, 20 bp, mouse
ggcgtcgcgcggcgccccca

SEQ ID NO: 747483 - DNA, 20 bp, mouse
gtaaaggcgaacccgggcga

SEQ ID NO: 747484 - DNA, 20 bp, mouse
gcacaagccgcactcacacc

SEQ ID NO: 747485 - DNA, 20 bp, mouse
gctgacccgggcacgaagcg

SEQ ID NO: 747486 - DNA, 20 bp, mouse
gaatgaagaggcaagacgtg

SEQ ID NO: 747487 - DNA, 20 bp, mouse
ggcggggcggagaagtgaaa

SEQ ID NO: 747488 - DNA, 20 bp, mouse
ggaggagctgggtactggaa

SEQ ID NO: 747489 - DNA, 20 bp, mouse
gaagaagaggctaagggata

SEQ ID NO: 747490 - DNA, 20 bp, mouse
gcaagacgtggggcgacctg

SEQ ID NO: 747491 - DNA, 20 bp, mouse
ggggcggggcgagtttcagg

SEQ ID NO: 747492 - DNA, 20 bp, mouse
gagggaatagtcaagagaaa

SEQ ID NO: 747493 - DNA, 20 bp, mouse
ggcagggggaaaggctctgg

SEQ ID NO: 747494 - DNA, 20 bp, mouse
ggagcgacagagtagatttt

SEQ ID NO: 747495 - DNA, 20 bp, mouse
gggccaggaagaagaggcta

SEQ ID NO: 747496 - DNA, 20 bp, mouse
gcagaggtgaacagacaagt

SEQ ID NO: 747497 - DNA, 20 bp, mouse
gtgccggcagaaacccaccc

SEQ ID NO: 747498 - DNA, 20 bp, mouse
gaaaggtaggaaactgctgc

SEQ ID NO: 747499 - DNA, 20 bp, mouse
gtctatgcttctatccacga

SEQ ID NO: 747500 - DNA, 20 bp, mouse
gcgggcggccaatcgccact

SEQ ID NO: 747501 - DNA, 20 bp, mouse
gcttcaagttataccaaagc

SEQ ID NO: 747502 - DNA, 20 bp, mouse
gcaccaattagcgaagtcaa

SEQ ID NO: 747503 - DNA, 20 bp, mouse
gtgacgagcccagtggcgat

SEQ ID NO: 747504 - DNA, 20 bp, mouse
gtgactgctggcttcagctg

SEQ ID NO: 747505 - DNA, 20 bp, mouse
ggctaattaatcccccctcg

SEQ ID NO: 747506 - DNA, 20 bp, mouse
ggggcaggtatcagaggaca

SEQ ID NO: 747507 - DNA, 20 bp, mouse
gtggaggcgttgtttggatt

SEQ ID NO: 747508 - DNA, 20 bp, mouse
gcaaacgcaacccagaggag

SEQ ID NO: 747509 - DNA, 20 bp, mouse
ggccaaaagtataaataacg

SEQ ID NO: 747510 - DNA, 20 bp, mouse
gaagctccaccccttcacgg

SEQ ID NO: 747511 - DNA, 20 bp, mouse
gtatctggtgtgcaggtcta

SEQ ID NO: 747512 - DNA, 20 bp, mouse
gtcctactggaggcgttgtt

SEQ ID NO: 747513 - DNA, 20 bp, mouse
ggactgcaaacgcaacccag

SEQ ID NO: 747514 - DNA, 20 bp, mouse
gccagaggagaggaaaaacc

SEQ ID NO: 747515 - DNA, 20 bp, mouse
gacgcctccagtaggaagcc

SEQ ID NO: 747516 - DNA, 20 bp, mouse
gctccctcctccaggcgctg

SEQ ID NO: 747517 - DNA, 20 bp, mouse
gaaaagcaggtggaaagtca

SEQ ID NO: 747518 - DNA, 20 bp, mouse
gcctcctccaggcgctgggg

SEQ ID NO: 747519 - DNA, 20 bp, mouse
gagaaggccgccccagcgcc

SEQ ID NO: 747520 - DNA, 20 bp, mouse
gtcaaggcagtcagcgtgga

SEQ ID NO: 747521 - DNA, 20 bp, mouse
gaaaaactgaggatccacaa

SEQ ID NO: 747522 - DNA, 20 bp, mouse
gtcagcgtggagggggattc

SEQ ID NO: 747523 - DNA, 20 bp, mouse
gctgcggttgagcattgagg

SEQ ID NO: 747524 - DNA, 20 bp, mouse
ggggaggatatgcaaatttg

SEQ ID NO: 747525 - DNA, 20 bp, mouse
gtggctgcggttgagcattg

SEQ ID NO: 747526 - DNA, 20 bp, mouse
gctgcatatgtctctcattc

SEQ ID NO: 747527 - DNA, 20 bp, mouse
gagtccagttggatgactgt

SEQ ID NO: 747528 - DNA, 20 bp, mouse
gagtcatccaactggactta

SEQ ID NO: 747529 - DNA, 20 bp, mouse
gaaatgctaacacacatgtc

SEQ ID NO: 747530 - DNA, 20 bp, mouse
gcatataagtaagttgacag

SEQ ID NO: 747531 - DNA, 20 bp, mouse
gtaaggcctacataatagaa

SEQ ID NO: 747532 - DNA, 20 bp, mouse
gtaaccaacagtcatccaac

SEQ ID NO: 747533 - DNA, 20 bp, mouse
gagtttctcctcatttgact

SEQ ID NO: 747534 - DNA, 20 bp, mouse
ggaataatcacagtttaacc

SEQ ID NO: 747535 - DNA, 20 bp, mouse
gcattaatgaattctttacc

SEQ ID NO: 747536 - DNA, 20 bp, mouse
ggggctgaggacgcgcccgg

SEQ ID NO: 747537 - DNA, 20 bp, mouse
gcgcccgggcggtggtcggt

SEQ ID NO: 747538 - DNA, 20 bp, mouse
gcgccccggcgcgacggcgg

SEQ ID NO: 747539 - DNA, 20 bp, mouse
gttcctcggcgtccccgctc

SEQ ID NO: 747540 - DNA, 20 bp, mouse
ggcccggcgctcctgacagg

SEQ ID NO: 747541 - DNA, 20 bp, mouse
gcggggacgccgaggaaggc

SEQ ID NO: 747542 - DNA, 20 bp, mouse
gggcccgcccgggcggtggt

SEQ ID NO: 747543 - DNA, 20 bp, mouse
ggccccctgcacgtccgaac

SEQ ID NO: 747544 - DNA, 20 bp, mouse
ggcccagcccgggtcggccc

SEQ ID NO: 747545 - DNA, 20 bp, mouse
gggcggcgggcctcaggcga

SEQ ID NO: 747546 - DNA, 20 bp, mouse
gccgcccgcggtctctaagc

SEQ ID NO: 747547 - DNA, 20 bp, mouse
gtctctaagcaggtcgccac

SEQ ID NO: 747548 - DNA, 20 bp, mouse
ggacggaactacaagttcca

SEQ ID NO: 747549 - DNA, 20 bp, mouse
gaccagtgcgtgagcgcagt

SEQ ID NO: 747550 - DNA, 20 bp, mouse
ggcgacctgcttagagaccg

SEQ ID NO: 747551 - DNA, 20 bp, mouse
gtcggtcccttatttactct

SEQ ID NO: 747552 - DNA, 20 bp, mouse
gtgagcgcagtgggccggga

SEQ ID NO: 747553 - DNA, 20 bp, mouse
gtggcgggaaaacccacgca

SEQ ID NO: 747554 - DNA, 20 bp, mouse
gtaagcaggtcgccacgggc

SEQ ID NO: 747555 - DNA, 20 bp, mouse
gttgtcgaatcaccgagctt

SEQ ID NO: 747556 - DNA, 20 bp, mouse
gcaggcgcaggcgcaggctt

SEQ ID NO: 747557 - DNA, 20 bp, mouse
gtccagctccccaacgtcct

SEQ ID NO: 747558 - DNA, 20 bp, mouse
ggacgttggggagctggaag

SEQ ID NO: 747559 - DNA, 20 bp, mouse
gcggggaggctgcttcacga

SEQ ID NO: 747560 - DNA, 20 bp, mouse
gaggcagcgccgccgcccat

SEQ ID NO: 747561 - DNA, 20 bp, mouse
ggggccagagctcgaggagc

SEQ ID NO: 747562 - DNA, 20 bp, mouse
gcagagctcgaggagcgggg

SEQ ID NO: 747563 - DNA, 20 bp, mouse
gcgcccctacttcagcctca

SEQ ID NO: 747564 - DNA, 20 bp, mouse
gggaggctgcttcacgacgg

SEQ ID NO: 747565 - DNA, 20 bp, mouse
gggctcgacgccgaggacgt

SEQ ID NO: 747566 - DNA, 20 bp, mouse
ggaagagcgccctgcgggac

SEQ ID NO: 747567 - DNA, 20 bp, mouse
gacggcgcaccccggggcag

SEQ ID NO: 747568 - DNA, 20 bp, mouse
ggcagtggaagagcgccctg

SEQ ID NO: 747569 - DNA, 20 bp, mouse
ggggactgcggtttgttctc

SEQ ID NO: 747570 - DNA, 20 bp, mouse
gaggcagaggcaggcacggg

SEQ ID NO: 747571 - DNA, 20 bp, mouse
ggggcgctcttccactgccc

SEQ ID NO: 747572 - DNA, 20 bp, mouse
gacaaaccgcagtcccgcca

SEQ ID NO: 747573 - DNA, 20 bp, mouse
gccgggcccagtttggttcc

SEQ ID NO: 747574 - DNA, 20 bp, mouse
gtggttccgggtcccctggc

SEQ ID NO: 747575 - DNA, 20 bp, mouse
gggtgctattccatacatta

SEQ ID NO: 747576 - DNA, 20 bp, mouse
gcggaagagccgatgtggag

SEQ ID NO: 747577 - DNA, 20 bp, mouse
gagacccggctctctaatgt

SEQ ID NO: 747578 - DNA, 20 bp, mouse
gcggctctctaatgtgggag

SEQ ID NO: 747579 - DNA, 20 bp, mouse
gagcaagcgcagagtggttg

SEQ ID NO: 747580 - DNA, 20 bp, mouse
gaggggcttagggaacaaaa

SEQ ID NO: 747581 - DNA, 20 bp, mouse
gtagggcggaagagccgatg

SEQ ID NO: 747582 - DNA, 20 bp, mouse
gggtgcaactgggcataggg

SEQ ID NO: 747583 - DNA, 20 bp, mouse
ggaagcctgaggcggcctta

SEQ ID NO: 747584 - DNA, 20 bp, mouse
ggaaactggcgacgtaggtg

SEQ ID NO: 747585 - DNA, 20 bp, mouse
gtgggcggggctttaacccg

SEQ ID NO: 747586 - DNA, 20 bp, mouse
ggccaagagctccccggctt

SEQ ID NO: 747587 - DNA, 20 bp, mouse
gccagccccaggggacgact

SEQ ID NO: 747588 - DNA, 20 bp, mouse
ggcgacccagtcgtcccctg

SEQ ID NO: 747589 - DNA, 20 bp, mouse
ggacgactgggtcgcctaag

SEQ ID NO: 747590 - DNA, 20 bp, mouse
gactgggtcgcctaagtggg

SEQ ID NO: 747591 - DNA, 20 bp, mouse
gcgcagccgctgaatggtgg

SEQ ID NO: 747592 - DNA, 20 bp, mouse
gcagcgcagccgctgaatgg

SEQ ID NO: 747593 - DNA, 20 bp, mouse
gtccaacctccaccattcag

SEQ ID NO: 747594 - DNA, 20 bp, mouse
gactcagcgcagccgctgaa

SEQ ID NO: 747595 - DNA, 20 bp, mouse
ggccgctgaatggtggaggt

SEQ ID NO: 747596 - DNA, 20 bp, mouse
gcgttaggggtctcagacgg

SEQ ID NO: 747597 - DNA, 20 bp, mouse
gcggagccggcgaatcgggg

SEQ ID NO: 747598 - DNA, 20 bp, mouse
gggaaacgcagcccggtcgg

SEQ ID NO: 747599 - DNA, 20 bp, mouse
gagcaccgcggtggttactg

SEQ ID NO: 747600 - DNA, 20 bp, mouse
gaaccaccgcggtgctcccg

SEQ ID NO: 747601 - DNA, 20 bp, mouse
gtcggggaggagcgtagaga

SEQ ID NO: 747602 - DNA, 20 bp, mouse
gtactgaggccaggggattc

SEQ ID NO: 747603 - DNA, 20 bp, mouse
gaacagggcgaggttctgat

SEQ ID NO: 747604 - DNA, 20 bp, mouse
ggaccgcgggagcaccgcgg

SEQ ID NO: 747605 - DNA, 20 bp, mouse
gaaccggagccggcgaatcg

SEQ ID NO: 747606 - DNA, 20 bp, mouse
gggcggagggagaggtgcac

SEQ ID NO: 747607 - DNA, 20 bp, mouse
gcgcagggaggggacgtagg

SEQ ID NO: 747608 - DNA, 20 bp, mouse
gggaggggaccgagggctca

SEQ ID NO: 747609 - DNA, 20 bp, mouse
gcccgtccgcccgacaggta

SEQ ID NO: 747610 - DNA, 20 bp, mouse
gggccgagcgcctgcgggag

SEQ ID NO: 747611 - DNA, 20 bp, mouse
ggaggctgctcgggctgcga

SEQ ID NO: 747612 - DNA, 20 bp, mouse
gccgcccgacaggtaaggct

SEQ ID NO: 747613 - DNA, 20 bp, mouse
ggctgctcgggctgcgaagg

SEQ ID NO: 747614 - DNA, 20 bp, mouse
gtggtccaccaggtgagcga

SEQ ID NO: 747615 - DNA, 20 bp, mouse
gaagccgagccttacctgtc

SEQ ID NO: 747616 - DNA, 20 bp, mouse
gccgacccccactttgtagg

SEQ ID NO: 747617 - DNA, 20 bp, mouse
ggaacacagtcattacagat

SEQ ID NO: 747618 - DNA, 20 bp, mouse
ggaagctaaaagctggaggt

SEQ ID NO: 747619 - DNA, 20 bp, mouse
ggggcggggcaacctaggac

SEQ ID NO: 747620 - DNA, 20 bp, mouse
gaggcagggtctcagacagt

SEQ ID NO: 747621 - DNA, 20 bp, mouse
gcagatggggagggaaggtc

SEQ ID NO: 747622 - DNA, 20 bp, mouse
gccacagagccggcagaagg

SEQ ID NO: 747623 - DNA, 20 bp, mouse
ggcagagaatcagaggctag

SEQ ID NO: 747624 - DNA, 20 bp, mouse
gaggccccggttctatgtac

SEQ ID NO: 747625 - DNA, 20 bp, mouse
gggaggtgggtcaccatggt

SEQ ID NO: 747626 - DNA, 20 bp, mouse
gcagtccaggtaggtgtcaa

SEQ ID NO: 747627 - DNA, 20 bp, mouse
gtgtcaaggggaggactcac

SEQ ID NO: 747628 - DNA, 20 bp, mouse
ggggacggggctgcaccgag

SEQ ID NO: 747629 - DNA, 20 bp, mouse
ggcctcctcctcccgcctcg

SEQ ID NO: 747630 - DNA, 20 bp, mouse
gtccccactcccacgacgaa

SEQ ID NO: 747631 - DNA, 20 bp, mouse
gcgctcacacctttcgtcgt

SEQ ID NO: 747632 - DNA, 20 bp, mouse
ggctccccctgcacgctgtt

SEQ ID NO: 747633 - DNA, 20 bp, mouse
gtggatgtgcccagccgccc

SEQ ID NO: 747634 - DNA, 20 bp, mouse
gacctttcgtcgtgggagtg

SEQ ID NO: 747635 - DNA, 20 bp, mouse
gtaaactgtcagaaagtctt

SEQ ID NO: 747636 - DNA, 20 bp, mouse
gcgccggcagctctagagag

SEQ ID NO: 747637 - DNA, 20 bp, mouse
gccaaccctccgaacgtcca

SEQ ID NO: 747638 - DNA, 20 bp, mouse
ggggccgcccgagcggaaga

SEQ ID NO: 747639 - DNA, 20 bp, mouse
gcacgggctcgaccaatcgc

SEQ ID NO: 747640 - DNA, 20 bp, mouse
gcgagcccgtgaaagatgat

SEQ ID NO: 747641 - DNA, 20 bp, mouse
gctacgggaggcgacttcgg

SEQ ID NO: 747642 - DNA, 20 bp, mouse
ggccaccgagcgctgaggca

SEQ ID NO: 747643 - DNA, 20 bp, mouse
gagagccaatcatctttcac

SEQ ID NO: 747644 - DNA, 20 bp, mouse
gtgtcaccgggccgcccgag

SEQ ID NO: 747645 - DNA, 20 bp, mouse
ggccagcggacaattcaatg

SEQ ID NO: 747646 - DNA, 20 bp, mouse
ggaggagcgaggcgcaggtg

SEQ ID NO: 747647 - DNA, 20 bp, mouse
ggcggggattgtcacgtggt

SEQ ID NO: 747648 - DNA, 20 bp, mouse
gcgccccctcacgcacgagg

SEQ ID NO: 747649 - DNA, 20 bp, mouse
gctgcgcgctgcaccctgat

SEQ ID NO: 747650 - DNA, 20 bp, mouse
ggattccacctcgtgcgtga

SEQ ID NO: 747651 - DNA, 20 bp, mouse
ggctgactcgcttgcccggt

SEQ ID NO: 747652 - DNA, 20 bp, mouse
gcgcgcgcaggctccgagct

SEQ ID NO: 747653 - DNA, 20 bp, mouse
gcactgagagggaaaaggtg

SEQ ID NO: 747654 - DNA, 20 bp, mouse
gagtcctcttcctactaacg

SEQ ID NO: 747655 - DNA, 20 bp, mouse
ggctccgagctcggttacta

SEQ ID NO: 747656 - DNA, 20 bp, mouse
gcaatgggaggcggcgagag

SEQ ID NO: 747657 - DNA, 20 bp, mouse
gagctgacagtcagctgatt

SEQ ID NO: 747658 - DNA, 20 bp, mouse
ggaatccggtaggacccggg

SEQ ID NO: 747659 - DNA, 20 bp, mouse
gggtggggggtgttgctccc

SEQ ID NO: 747660 - DNA, 20 bp, mouse
gcccagtagcagcgccgcaa

SEQ ID NO: 747661 - DNA, 20 bp, mouse
ggaaagcaaaccatcctccc

SEQ ID NO: 747662 - DNA, 20 bp, mouse
ggggacagagtttactaaaa

SEQ ID NO: 747663 - DNA, 20 bp, mouse
gaggcctctctcgaactccg

SEQ ID NO: 747664 - DNA, 20 bp, mouse
gccggtaggacccgggagga

SEQ ID NO: 747665 - DNA, 20 bp, mouse
ggagcaacaccccccaccac

SEQ ID NO: 747666 - DNA, 20 bp, mouse
gggaaggtgaagccgagtgg

SEQ ID NO: 747667 - DNA, 20 bp, mouse
gcaacaccaagaggggaggc

SEQ ID NO: 747668 - DNA, 20 bp, mouse
ggtggaccactctaggaaga

SEQ ID NO: 747669 - DNA, 20 bp, mouse
gctcccctcttggtgttgat

SEQ ID NO: 747670 - DNA, 20 bp, mouse
gaggtgaagccgagtggcgg

SEQ ID NO: 747671 - DNA, 20 bp, mouse
gaccactctaggaagagggt

SEQ ID NO: 747672 - DNA, 20 bp, mouse
gagaccacgagaaaccttat

SEQ ID NO: 747673 - DNA, 20 bp, mouse
gtaggaagagggttggctcc

SEQ ID NO: 747674 - DNA, 20 bp, mouse
gacgaacccgcctcccctct

SEQ ID NO: 747675 - DNA, 20 bp, mouse
ggaagagggttggctcctgg

SEQ ID NO: 747676 - DNA, 20 bp, mouse
ggggaagggccgtcggcaag

SEQ ID NO: 747677 - DNA, 20 bp, mouse
ggctgtgcagtcccatgcgg

SEQ ID NO: 747678 - DNA, 20 bp, mouse
gggcccgcctccccaggtgg

SEQ ID NO: 747679 - DNA, 20 bp, mouse
gcccagctgtcaatctcctg

SEQ ID NO: 747680 - DNA, 20 bp, mouse
gcagaagcgcgtctctataa

SEQ ID NO: 747681 - DNA, 20 bp, mouse
gcccctggtggccgccgcat

SEQ ID NO: 747682 - DNA, 20 bp, mouse
gggccgtcggcaagaggagt

SEQ ID NO: 747683 - DNA, 20 bp, mouse
gcatggggataggcaaatga

SEQ ID NO: 747684 - DNA, 20 bp, mouse
ggggcgtcggcccccacctg

SEQ ID NO: 747685 - DNA, 20 bp, mouse
gtcggcaagaggagtgggca

SEQ ID NO: 747686 - DNA, 20 bp, mouse
gaggagccccgaagccgttg

SEQ ID NO: 747687 - DNA, 20 bp, mouse
gtcagctgactggagaccgg

SEQ ID NO: 747688 - DNA, 20 bp, mouse
gacgccccgcccagcgtcgc

SEQ ID NO: 747689 - DNA, 20 bp, mouse
ggacagcggggtgggaacgg

SEQ ID NO: 747690 - DNA, 20 bp, mouse
gtgagtgcagacagcggggt

SEQ ID NO: 747691 - DNA, 20 bp, mouse
ggcgtcagctgactggagac

SEQ ID NO: 747692 - DNA, 20 bp, mouse
gcccccccgcgtcagctgac

SEQ ID NO: 747693 - DNA, 20 bp, mouse
gggggggcgggggagctgtc

SEQ ID NO: 747694 - DNA, 20 bp, mouse
gccccgaagccgttgaggcc

SEQ ID NO: 747695 - DNA, 20 bp, mouse
gctccaggcctcaacggctt

SEQ ID NO: 747696 - DNA, 20 bp, mouse
gccagcacggagaaccgtgg

SEQ ID NO: 747697 - DNA, 20 bp, mouse
ggctccaggcggccgctctg

SEQ ID NO: 747698 - DNA, 20 bp, mouse
gctacagcggggtctactgg

SEQ ID NO: 747699 - DNA, 20 bp, mouse
gtggctgtgggctcctacag

SEQ ID NO: 747700 - DNA, 20 bp, mouse
gccgtggcggctctggctgt

SEQ ID NO: 747701 - DNA, 20 bp, mouse
gcacctctggagaacggcgt

SEQ ID NO: 747702 - DNA, 20 bp, mouse
ggtcccagcacggagaaccg

SEQ ID NO: 747703 - DNA, 20 bp, mouse
gccccgcccacgcccgagtg

SEQ ID NO: 747704 - DNA, 20 bp, mouse
gtgggggcggcgcctcactc

SEQ ID NO: 747705 - DNA, 20 bp, mouse
gggagccgcgcgcagttgta

SEQ ID NO: 747706 - DNA, 20 bp, mouse
gaccccgccccgggtgtgtt

SEQ ID NO: 747707 - DNA, 20 bp, mouse
gcgaggggcgtggccatcag

SEQ ID NO: 747708 - DNA, 20 bp, mouse
ggcacgtggaagcatgtagg

SEQ ID NO: 747709 - DNA, 20 bp, mouse
gacaccccctaccttgggaa

SEQ ID NO: 747710 - DNA, 20 bp, mouse
gaacaggggcgtgatcacta

SEQ ID NO: 747711 - DNA, 20 bp, mouse
gaagcatgtaggaggaccca

SEQ ID NO: 747712 - DNA, 20 bp, mouse
gactgcacgtggaagcatgt

SEQ ID NO: 747713 - DNA, 20 bp, mouse
gcgaagaagcgtgagcaaca

SEQ ID NO: 747714 - DNA, 20 bp, mouse
ggccgacgcgcggccagaga

SEQ ID NO: 747715 - DNA, 20 bp, mouse
gcggaagcggtgtcagtact

SEQ ID NO: 747716 - DNA, 20 bp, mouse
gccctagcccgatggtgaca

SEQ ID NO: 747717 - DNA, 20 bp, mouse
gtcaccatcgggctagggct

SEQ ID NO: 747718 - DNA, 20 bp, mouse
gaaggggcccttgtcaccat

SEQ ID NO: 747719 - DNA, 20 bp, mouse
gcccttgtcaccatcgggct

SEQ ID NO: 747720 - DNA, 20 bp, mouse
gttggggtgtatattaatgg

SEQ ID NO: 747721 - DNA, 20 bp, mouse
ggcggcccctggcacccagg

SEQ ID NO: 747722 - DNA, 20 bp, mouse
gcctccctgcccccggggga

SEQ ID NO: 747723 - DNA, 20 bp, mouse
ggaaggagctagtaggaccc

SEQ ID NO: 747724 - DNA, 20 bp, mouse
ggggggaggggggcacaaag

SEQ ID NO: 747725 - DNA, 20 bp, mouse
gagctcctccctgcccccgg

SEQ ID NO: 747726 - DNA, 20 bp, mouse
gaggaattgacccagatatt

SEQ ID NO: 747727 - DNA, 20 bp, mouse
gggctgcactccaaatatct

SEQ ID NO: 747728 - DNA, 20 bp, mouse
gaatgagggcactatctcag

SEQ ID NO: 747729 - DNA, 20 bp, mouse
gctggtgtcaaataatctga

SEQ ID NO: 747730 - DNA, 20 bp, mouse
gactgactctccacattccc

SEQ ID NO: 747731 - DNA, 20 bp, mouse
ggaatatgaaagcctgtaac

SEQ ID NO: 747732 - DNA, 20 bp, mouse
ggatgcagccaccatcccat

SEQ ID NO: 747733 - DNA, 20 bp, mouse
gctgggtcaattcctgttac

SEQ ID NO: 747734 - DNA, 20 bp, mouse
gcatagggagaaatgacctg

SEQ ID NO: 747735 - DNA, 20 bp, mouse
gattagttctttaagatcac

SEQ ID NO: 747736 - DNA, 20 bp, mouse
gaacccagatatcaaagctt

SEQ ID NO: 747737 - DNA, 20 bp, mouse
gaaactctaggccaccatgt

SEQ ID NO: 747738 - DNA, 20 bp, mouse
gtccccaagctttgatatct

SEQ ID NO: 747739 - DNA, 20 bp, mouse
gcacacggtccactcctctc

SEQ ID NO: 747740 - DNA, 20 bp, mouse
gcacactctcagctccgatc

SEQ ID NO: 747741 - DNA, 20 bp, mouse
ggaggctcattcccacatgg

SEQ ID NO: 747742 - DNA, 20 bp, mouse
ggtgactttctgatccagat

SEQ ID NO: 747743 - DNA, 20 bp, mouse
ggaggtcaagcataaactct

SEQ ID NO: 747744 - DNA, 20 bp, mouse
gatacattgtatccttttgg

SEQ ID NO: 747745 - DNA, 20 bp, mouse
gtcccacagcccatactctc

SEQ ID NO: 747746 - DNA, 20 bp, mouse
gtctctccctatcatacatt

SEQ ID NO: 747747 - DNA, 20 bp, mouse
ggcttccctgtccaccaata

SEQ ID NO: 747748 - DNA, 20 bp, mouse
gtggttctcagacctaacca

SEQ ID NO: 747749 - DNA, 20 bp, mouse
gtgtctgagcttctggatcc

SEQ ID NO: 747750 - DNA, 20 bp, mouse
gatctaagacccggtcctaa

SEQ ID NO: 747751 - DNA, 20 bp, mouse
ggcttaattgtctgagcttc

SEQ ID NO: 747752 - DNA, 20 bp, mouse
gatttaaactatagtatttt

SEQ ID NO: 747753 - DNA, 20 bp, mouse
gttggtggacagggaagcta

SEQ ID NO: 747754 - DNA, 20 bp, mouse
ggtcttagatgaagagggat

SEQ ID NO: 747755 - DNA, 20 bp, mouse
gggtattttaagctaaatcc

SEQ ID NO: 747756 - DNA, 20 bp, mouse
ggatatggaaactgccgttc

SEQ ID NO: 747757 - DNA, 20 bp, mouse
gtatgctttaggattgccat

SEQ ID NO: 747758 - DNA, 20 bp, mouse
gtatgctagccttgtaccca

SEQ ID NO: 747759 - DNA, 20 bp, mouse
gcagatacgattggctggcg

SEQ ID NO: 747760 - DNA, 20 bp, mouse
gtttctaaaaaccgcataat

SEQ ID NO: 747761 - DNA, 20 bp, mouse
gagagtccttaggactgaca

SEQ ID NO: 747762 - DNA, 20 bp, mouse
gaggctgaggtcggtttttg

SEQ ID NO: 747763 - DNA, 20 bp, mouse
gtactggaaaagagcctgaa

SEQ ID NO: 747764 - DNA, 20 bp, mouse
gtaggattgccatgggtaca

SEQ ID NO: 747765 - DNA, 20 bp, mouse
gcataaatgagcccacttac

SEQ ID NO: 747766 - DNA, 20 bp, mouse
gagactcagggacctctgtg

SEQ ID NO: 747767 - DNA, 20 bp, mouse
ggtggtgatatgtgagactc

SEQ ID NO: 747768 - DNA, 20 bp, mouse
gaaggacagagtccccagat

SEQ ID NO: 747769 - DNA, 20 bp, mouse
gtacacttcagaatggacac

SEQ ID NO: 747770 - DNA, 20 bp, mouse
gtgtaagcgaacccacttac

SEQ ID NO: 747771 - DNA, 20 bp, mouse
gatacccaggcctccctatc

SEQ ID NO: 747772 - DNA, 20 bp, mouse
gtcagggattctcaaaaatg

SEQ ID NO: 747773 - DNA, 20 bp, mouse
ggtgggatgtgtcagagttt

SEQ ID NO: 747774 - DNA, 20 bp, mouse
gtgcatttaggagaggcatt

SEQ ID NO: 747775 - DNA, 20 bp, mouse
ggatattgaaactgctgatc

SEQ ID NO: 747776 - DNA, 20 bp, mouse
gggagagatgacctgggttg

SEQ ID NO: 747777 - DNA, 20 bp, mouse
ggacctgggttggggggcat

SEQ ID NO: 747778 - DNA, 20 bp, mouse
gtggctgcactccaaatggc

SEQ ID NO: 747779 - DNA, 20 bp, mouse
ggatctggctgcactccaaa

SEQ ID NO: 747780 - DNA, 20 bp, mouse
gaggaagttaccctgccatt

SEQ ID NO: 747781 - DNA, 20 bp, mouse
gggtgagggctctaatgcag

SEQ ID NO: 747782 - DNA, 20 bp, mouse
ggggagtgttttaaggtcac

SEQ ID NO: 747783 - DNA, 20 bp, mouse
gctggtgtcaaatattccca

SEQ ID NO: 747784 - DNA, 20 bp, mouse
gtgaccttgtaaaaaggtga

SEQ ID NO: 747785 - DNA, 20 bp, mouse
gacagactctccacaatacc

SEQ ID NO: 747786 - DNA, 20 bp, mouse
gtggctgcacccaaaatagt

SEQ ID NO: 747787 - DNA, 20 bp, mouse
gcacagagctggtagcctca

SEQ ID NO: 747788 - DNA, 20 bp, mouse
gaaatgacatgactttgtga

SEQ ID NO: 747789 - DNA, 20 bp, mouse
ggaagtgacccaactatttt

SEQ ID NO: 747790 - DNA, 20 bp, mouse
gtattctgatggtatccctg

SEQ ID NO: 747791 - DNA, 20 bp, mouse
ggtgcagcctcagaagattg

SEQ ID NO: 747792 - DNA, 20 bp, mouse
gagaggatatacacacctgg

SEQ ID NO: 747793 - DNA, 20 bp, mouse
gttcctctttcaggctttca

SEQ ID NO: 747794 - DNA, 20 bp, mouse
gggctaccagctctgtgact

SEQ ID NO: 747795 - DNA, 20 bp, mouse
gtgcagccaagtcacagagc

SEQ ID NO: 747796 - DNA, 20 bp, mouse
ggcgaggggccttttttttg

SEQ ID NO: 747797 - DNA, 20 bp, mouse
gtcagggaaccgcaaaaaaa

SEQ ID NO: 747798 - DNA, 20 bp, mouse
gagtgtcgatattggcggac

SEQ ID NO: 747799 - DNA, 20 bp, mouse
gcatctaagacttggtccta

SEQ ID NO: 747800 - DNA, 20 bp, mouse
gcctccctatcatacatctg

SEQ ID NO: 747801 - DNA, 20 bp, mouse
ggactggggaagccttggtt

SEQ ID NO: 747802 - DNA, 20 bp, mouse
gtctgagcctctaggatcct

SEQ ID NO: 747803 - DNA, 20 bp, mouse
gttattactggaaagttctt

SEQ ID NO: 747804 - DNA, 20 bp, mouse
gtggttctcagacctaacca

SEQ ID NO: 747805 - DNA, 20 bp, mouse
gatttaaactatagtatttt

SEQ ID NO: 747806 - DNA, 20 bp, mouse
gcagaggccctggaagtctg

SEQ ID NO: 747807 - DNA, 20 bp, mouse
gacttccagggcctctgata

SEQ ID NO: 747808 - DNA, 20 bp, mouse
gaagtgcccccagacttcca

SEQ ID NO: 747809 - DNA, 20 bp, mouse
ggcctctgatatggaaactg

SEQ ID NO: 747810 - DNA, 20 bp, mouse
gggcttgctgaagcataaga

SEQ ID NO: 747811 - DNA, 20 bp, mouse
ggccccagtttccatatcag

SEQ ID NO: 747812 - DNA, 20 bp, mouse
ggggtgcttcagagctgact

SEQ ID NO: 747813 - DNA, 20 bp, mouse
gcaggggagttggttgtttg

SEQ ID NO: 747814 - DNA, 20 bp, mouse
ggatatggaaactggggccc

SEQ ID NO: 747815 - DNA, 20 bp, mouse
gtgtctgggcctggggatct

SEQ ID NO: 747816 - DNA, 20 bp, mouse
ggtcatgagaccagagtggt

SEQ ID NO: 747817 - DNA, 20 bp, mouse
gtgtccaaggcggaaaagaa

SEQ ID NO: 747818 - DNA, 20 bp, mouse
gaggacagagagcagagtac

SEQ ID NO: 747819 - DNA, 20 bp, mouse
gttaaatatgccaaccactc

SEQ ID NO: 747820 - DNA, 20 bp, mouse
gccatctggatgtattaatg

SEQ ID NO: 747821 - DNA, 20 bp, mouse
gggactgtatctgtccaagg

SEQ ID NO: 747822 - DNA, 20 bp, mouse
gtggggactgtatctgtcca

SEQ ID NO: 747823 - DNA, 20 bp, mouse
ggtttgttgggcccatgaat

SEQ ID NO: 747824 - DNA, 20 bp, mouse
ggcactcatctagtctgata

SEQ ID NO: 747825 - DNA, 20 bp, mouse
gagtcccttcttttccgcct

SEQ ID NO: 747826 - DNA, 20 bp, mouse
ggacccagttccgaaatcag

SEQ ID NO: 747827 - DNA, 20 bp, mouse
gtcagaggacatggtattct

SEQ ID NO: 747828 - DNA, 20 bp, mouse
gacctgtactgaaactgcga

SEQ ID NO: 747829 - DNA, 20 bp, mouse
ggttccgaaatcagaggaca

SEQ ID NO: 747830 - DNA, 20 bp, mouse
gacctcaatgtcacttgcta

SEQ ID NO: 747831 - DNA, 20 bp, mouse
gtgaaactgcgagggattgt

SEQ ID NO: 747832 - DNA, 20 bp, mouse
gaggttgcttaaactaatcc

SEQ ID NO: 747833 - DNA, 20 bp, mouse
gtcagagggtcaaagaaatg

SEQ ID NO: 747834 - DNA, 20 bp, mouse
ggatttcggaactgggtccc

SEQ ID NO: 747835 - DNA, 20 bp, mouse
gcaagtgacattgaggtctc

SEQ ID NO: 747836 - DNA, 20 bp, mouse
gatgtccccagatataagat

SEQ ID NO: 747837 - DNA, 20 bp, mouse
gcccagatataagataggga

SEQ ID NO: 747838 - DNA, 20 bp, mouse
gtccctccctatcttatatc

SEQ ID NO: 747839 - DNA, 20 bp, mouse
ggaaatggtgatcacattac

SEQ ID NO: 747840 - DNA, 20 bp, mouse
gtgttgatattgccagacag

SEQ ID NO: 747841 - DNA, 20 bp, mouse
ggtcccctcgctcccctgtc

SEQ ID NO: 747842 - DNA, 20 bp, mouse
gtgtgatcaccatttcattc

SEQ ID NO: 747843 - DNA, 20 bp, mouse
gatttaaagtatagtgtttt

SEQ ID NO: 747844 - DNA, 20 bp, mouse
ggactggggaagccttggtt

SEQ ID NO: 747845 - DNA, 20 bp, mouse
gtggttctcagacctaacca

SEQ ID NO: 747846 - DNA, 20 bp, mouse
gagcctaagtctatgtgcac

SEQ ID NO: 747847 - DNA, 20 bp, mouse
gtaagcagacagaaaaactt

SEQ ID NO: 747848 - DNA, 20 bp, mouse
gaccctaagtggctttgcat

SEQ ID NO: 747849 - DNA, 20 bp, mouse
ggaaagatctaacccacttt

SEQ ID NO: 747850 - DNA, 20 bp, mouse
gtgcccatgcaaagccactt

SEQ ID NO: 747851 - DNA, 20 bp, mouse
gttcactagcttcacttgga

SEQ ID NO: 747852 - DNA, 20 bp, mouse
ggaagaaattaaaacttgtt

SEQ ID NO: 747853 - DNA, 20 bp, mouse
gagcctgtgcacatagactt

SEQ ID NO: 747854 - DNA, 20 bp, mouse
gaacttaggcctgcatacaa

SEQ ID NO: 747855 - DNA, 20 bp, mouse
gggtctctgcccttgtatgc

SEQ ID NO: 747856 - DNA, 20 bp, mouse
gcactgttgtactgattctg

SEQ ID NO: 747857 - DNA, 20 bp, mouse
gagaaaaggaacctctggta

SEQ ID NO: 747858 - DNA, 20 bp, mouse
gaacctctggtagggaaccc

SEQ ID NO: 747859 - DNA, 20 bp, mouse
gctcctgggttccctaccag

SEQ ID NO: 747860 - DNA, 20 bp, mouse
gataagacagaagaaagccg

SEQ ID NO: 747861 - DNA, 20 bp, mouse
gcagaagaaagccggggggt

SEQ ID NO: 747862 - DNA, 20 bp, mouse
gtgattctgcggctgcgaac

SEQ ID NO: 747863 - DNA, 20 bp, mouse
gttcttctgtcttatcaaat

SEQ ID NO: 747864 - DNA, 20 bp, mouse
gcggccatgactagtcacgg

SEQ ID NO: 747865 - DNA, 20 bp, mouse
gaatccgccgtgactagtca

SEQ ID NO: 747866 - DNA, 20 bp, mouse
gaattggcaatgtgtctagg

SEQ ID NO: 747867 - DNA, 20 bp, mouse
gagggcgtcttattccacag

SEQ ID NO: 747868 - DNA, 20 bp, mouse
gttcatgagcctgtccatta

SEQ ID NO: 747869 - DNA, 20 bp, mouse
gtaaaattggcaatgtgtct

SEQ ID NO: 747870 - DNA, 20 bp, mouse
gtacatagctcctctgggaa

SEQ ID NO: 747871 - DNA, 20 bp, mouse
gtacagttaaaggttgcaga

SEQ ID NO: 747872 - DNA, 20 bp, mouse
gcacgattgagacagacacc

SEQ ID NO: 747873 - DNA, 20 bp, mouse
gtgcagaaaaattaagagta

SEQ ID NO: 747874 - DNA, 20 bp, mouse
gccaggatgccaactgatta

SEQ ID NO: 747875 - DNA, 20 bp, mouse
gtaactgtacatagctcctc

SEQ ID NO: 747876 - DNA, 20 bp, mouse
ggtggccttagttggtctaa

SEQ ID NO: 747877 - DNA, 20 bp, mouse
gacaacctttagaccaacta

SEQ ID NO: 747878 - DNA, 20 bp, mouse
ggatctatatccctgtatgg

SEQ ID NO: 747879 - DNA, 20 bp, mouse
gcctgtatggtggccttagt

SEQ ID NO: 747880 - DNA, 20 bp, mouse
gtcctgctagaaagaggaag

SEQ ID NO: 747881 - DNA, 20 bp, mouse
gcaattatcctgctagaaag

SEQ ID NO: 747882 - DNA, 20 bp, mouse
gacagatctatatccctgta

SEQ ID NO: 747883 - DNA, 20 bp, mouse
gagcctaagtctatgtgtac

SEQ ID NO: 747884 - DNA, 20 bp, mouse
gtaagcagacagaaaaactt

SEQ ID NO: 747885 - DNA, 20 bp, mouse
gaccctaagtggctttgcat

SEQ ID NO: 747886 - DNA, 20 bp, mouse
gacgctccgagccccatcgg

SEQ ID NO: 747887 - DNA, 20 bp, mouse
ggagggctcggctagagaag

SEQ ID NO: 747888 - DNA, 20 bp, mouse
gaaagcgttagcagcggagg

SEQ ID NO: 747889 - DNA, 20 bp, mouse
gaggaaagcgttagcagcgg

SEQ ID NO: 747890 - DNA, 20 bp, mouse
ggggctgcggggtggtcgca

SEQ ID NO: 747891 - DNA, 20 bp, mouse
gggtggtcgcagggggagta

SEQ ID NO: 747892 - DNA, 20 bp, mouse
gaccaccccgcagcccgcta

SEQ ID NO: 747893 - DNA, 20 bp, mouse
gtaggcggttccgttagcgg

SEQ ID NO: 747894 - DNA, 20 bp, mouse
gtgggtggagccggcgggaa

SEQ ID NO: 747895 - DNA, 20 bp, mouse
ggcgcgctctccttgtcgcc

SEQ ID NO: 747896 - DNA, 20 bp, mouse
gtgtgtgtgggcggggcggc

SEQ ID NO: 747897 - DNA, 20 bp, mouse
gggaaaatcgaaaatcaggt

SEQ ID NO: 747898 - DNA, 20 bp, mouse
ggtatggaaaatcgaaaatc

SEQ ID NO: 747899 - DNA, 20 bp, mouse
gaaactactcaggtaatctc

SEQ ID NO: 747900 - DNA, 20 bp, mouse
ggggctgcggaggtttattt

SEQ ID NO: 747901 - DNA, 20 bp, mouse
ggaagagacttgagagactt

SEQ ID NO: 747902 - DNA, 20 bp, mouse
ggcagcccccgcataggcaa

SEQ ID NO: 747903 - DNA, 20 bp, mouse
ggaccctgggccaacagcgc

SEQ ID NO: 747904 - DNA, 20 bp, mouse
gtgcagaaggcattctctga

SEQ ID NO: 747905 - DNA, 20 bp, mouse
gcgcaggggtgcgttgccta

SEQ ID NO: 747906 - DNA, 20 bp, mouse
gtgtgtgtgggcggggcggc

SEQ ID NO: 747907 - DNA, 20 bp, mouse
gggaaaatcgaaaatcaggt

SEQ ID NO: 747908 - DNA, 20 bp, mouse
ggtatggaaaatcgaaaatc

SEQ ID NO: 747909 - DNA, 20 bp, mouse
ggggctgcggaggtttattt

SEQ ID NO: 747910 - DNA, 20 bp, mouse
ggaagagacttgagagactt

SEQ ID NO: 747911 - DNA, 20 bp, mouse
ggcagcccccgcataggcaa

SEQ ID NO: 747912 - DNA, 20 bp, mouse
ggaccctgggccaacagcgc

SEQ ID NO: 747913 - DNA, 20 bp, mouse
gtgcagaaggcattctctga

SEQ ID NO: 747914 - DNA, 20 bp, mouse
gcgcaggggtgcgttgccta

SEQ ID NO: 747915 - DNA, 20 bp, mouse
ggacttgggtgaataaggtg

SEQ ID NO: 747916 - DNA, 20 bp, mouse
gcaacttaatagctgcttat

SEQ ID NO: 747917 - DNA, 20 bp, mouse
ggaaaagaatcagtttttat

SEQ ID NO: 747918 - DNA, 20 bp, mouse
gaagagcagggaattaccta

SEQ ID NO: 747919 - DNA, 20 bp, mouse
gccctgctcttagagctgag

SEQ ID NO: 747920 - DNA, 20 bp, mouse
gttaggactgagacttcatg

SEQ ID NO: 747921 - DNA, 20 bp, mouse
ggggaattaagttgcagtta

SEQ ID NO: 747922 - DNA, 20 bp, mouse
gcccagtaatcagtattgcc

SEQ ID NO: 747923 - DNA, 20 bp, mouse
gtcccattactcgttatcca

SEQ ID NO: 747924 - DNA, 20 bp, mouse
gaaccctggataacgagtaa

SEQ ID NO: 747925 - DNA, 20 bp, mouse
gtcctctcagctctaagagc

SEQ ID NO: 747926 - DNA, 20 bp, mouse
gtggcggtgggatagtgtgc

SEQ ID NO: 747927 - DNA, 20 bp, mouse
ggcattgcggagaaaggtag

SEQ ID NO: 747928 - DNA, 20 bp, mouse
gaggcggtgggtggtatatt

SEQ ID NO: 747929 - DNA, 20 bp, mouse
gcatgcgcaacaatggctct

SEQ ID NO: 747930 - DNA, 20 bp, mouse
ggagtggatgcgtaaggaga

SEQ ID NO: 747931 - DNA, 20 bp, mouse
gggcgctgcgcatctgttga

SEQ ID NO: 747932 - DNA, 20 bp, mouse
gggatagtgtgctggcaagg

SEQ ID NO: 747933 - DNA, 20 bp, mouse
gcactatcccaccgccaacc

SEQ ID NO: 747934 - DNA, 20 bp, mouse
ggggctggtgtgtcgggcca

SEQ ID NO: 747935 - DNA, 20 bp, mouse
ggccagggggtgggaccgaa

SEQ ID NO: 747936 - DNA, 20 bp, mouse
gggtacagaggcataaacat

SEQ ID NO: 747937 - DNA, 20 bp, mouse
gccccctagggaggcggaaa

SEQ ID NO: 747938 - DNA, 20 bp, mouse
gaagggcttcagaccgaacc

SEQ ID NO: 747939 - DNA, 20 bp, mouse
gcagaccgaacctggtacag

SEQ ID NO: 747940 - DNA, 20 bp, mouse
gtctgcagctctagtccagg

SEQ ID NO: 747941 - DNA, 20 bp, mouse
gggaaatgcgatgggaaata

SEQ ID NO: 747942 - DNA, 20 bp, mouse
ggggaactgtgcatgcttgg

SEQ ID NO: 747943 - DNA, 20 bp, mouse
gagatccagggacaagaata

SEQ ID NO: 747944 - DNA, 20 bp, mouse
gtgccccacccccgaggaag

SEQ ID NO: 747945 - DNA, 20 bp, mouse
ggggaataaggagtgttgag

SEQ ID NO: 747946 - DNA, 20 bp, mouse
gctgcgcaatggcaggaggg

SEQ ID NO: 747947 - DNA, 20 bp, mouse
ggcaggagggaggctttgat

SEQ ID NO: 747948 - DNA, 20 bp, mouse
gaaactgcgcaatggcagga

SEQ ID NO: 747949 - DNA, 20 bp, mouse
gagtcagggtacctactaga

SEQ ID NO: 747950 - DNA, 20 bp, mouse
gtccactttcgcaaacccac

SEQ ID NO: 747951 - DNA, 20 bp, mouse
gggagcagatgggtaaatgg

SEQ ID NO: 747952 - DNA, 20 bp, mouse
gccacgggagaggctgggtt

SEQ ID NO: 747953 - DNA, 20 bp, mouse
gcggactgcggcagaaggcg

SEQ ID NO: 747954 - DNA, 20 bp, mouse
gcaaggagcttggagcagat

SEQ ID NO: 747955 - DNA, 20 bp, mouse
gagtccgcgcaggcgcagtt

SEQ ID NO: 747956 - DNA, 20 bp, mouse
ggtaaggcttaatagaggat

SEQ ID NO: 747957 - DNA, 20 bp, mouse
ggtggggttcgaacttatta

SEQ ID NO: 747958 - DNA, 20 bp, mouse
gagtgcgcctgcgtaggatg

SEQ ID NO: 747959 - DNA, 20 bp, mouse
gaggaagcctgagcggggcg

SEQ ID NO: 747960 - DNA, 20 bp, mouse
ggggagaggaagcctgagcg

SEQ ID NO: 747961 - DNA, 20 bp, mouse
gtggcctttcagtcagtagt

SEQ ID NO: 747962 - DNA, 20 bp, mouse
gcctctattaagccttacca

SEQ ID NO: 747963 - DNA, 20 bp, mouse
ggcactcaagctctgcaatg

SEQ ID NO: 747964 - DNA, 20 bp, mouse
gggttggcgcgcatcaccac

SEQ ID NO: 747965 - DNA, 20 bp, mouse
gctagtaagggctagataaa

SEQ ID NO: 747966 - DNA, 20 bp, mouse
gtagccgaaaggaaaaggag

SEQ ID NO: 747967 - DNA, 20 bp, mouse
gcctgcgcgcaagagaatgt

SEQ ID NO: 747968 - DNA, 20 bp, mouse
gcacacgccaaacacccaag

SEQ ID NO: 747969 - DNA, 20 bp, mouse
gcaaacacccaagaggaagt

SEQ ID NO: 747970 - DNA, 20 bp, mouse
gtccgctagccgaaaggaaa

SEQ ID NO: 747971 - DNA, 20 bp, mouse
ggctgtcttaactaccattg

SEQ ID NO: 747972 - DNA, 20 bp, mouse
ggctagcggaagttcctgtg

SEQ ID NO: 747973 - DNA, 20 bp, mouse
gagttaagacagctaggggg

SEQ ID NO: 747974 - DNA, 20 bp, mouse
gggtagttaagacagctagg

SEQ ID NO: 747975 - DNA, 20 bp, mouse
gagcccgctccttttccttt

SEQ ID NO: 747976 - DNA, 20 bp, mouse
gcacaagtggattgttcaga

SEQ ID NO: 747977 - DNA, 20 bp, mouse
ggctctccgcagtaagaagg

SEQ ID NO: 747978 - DNA, 20 bp, mouse
gggaacatgtccaaaggtgg

SEQ ID NO: 747979 - DNA, 20 bp, mouse
gcgcccccgaccaccacaag

SEQ ID NO: 747980 - DNA, 20 bp, mouse
gaagggatattgagtcagtc

SEQ ID NO: 747981 - DNA, 20 bp, mouse
ggatctataccgcaggagaa

SEQ ID NO: 747982 - DNA, 20 bp, mouse
gcaacatggaacatgtccaa

SEQ ID NO: 747983 - DNA, 20 bp, mouse
ggtatgaactagcttagttg

SEQ ID NO: 747984 - DNA, 20 bp, mouse
gatccacttgtggtggtcgg

SEQ ID NO: 747985 - DNA, 20 bp, mouse
ggaagtacattgacgtaaga

SEQ ID NO: 747986 - DNA, 20 bp, mouse
gcgcctcccgcggggtccta

SEQ ID NO: 747987 - DNA, 20 bp, mouse
gtgcaagaggaggaattcta

SEQ ID NO: 747988 - DNA, 20 bp, mouse
ggaccccgcgggaggcgcgt

SEQ ID NO: 747989 - DNA, 20 bp, mouse
gcactagcggaggacgagga

SEQ ID NO: 747990 - DNA, 20 bp, mouse
ggcaagttggcgtcaatgaa

SEQ ID NO: 747991 - DNA, 20 bp, mouse
gcctcctcttgcagtgtggt

SEQ ID NO: 747992 - DNA, 20 bp, mouse
ggaggaattctaggggtgca

SEQ ID NO: 747993 - DNA, 20 bp, mouse
gccgcgccgtcgcgtctcca

SEQ ID NO: 747994 - DNA, 20 bp, mouse
gtcaatgaagggtcggccct

SEQ ID NO: 747995 - DNA, 20 bp, mouse
ggggagcaggcgcggaaatg

SEQ ID NO: 747996 - DNA, 20 bp, mouse
gcaggcgtggggttcgtctg

SEQ ID NO: 747997 - DNA, 20 bp, mouse
ggggacggaaccccggggtg

SEQ ID NO: 747998 - DNA, 20 bp, mouse
gacccccatgccggggaccc

SEQ ID NO: 747999 - DNA, 20 bp, mouse
ggccaggcggctgctctcaa

SEQ ID NO: 748000 - DNA, 20 bp, mouse
gtggctgcccgggacgggtg

SEQ ID NO: 748001 - DNA, 20 bp, mouse
gcagcccgggtccccggcat

SEQ ID NO: 748002 - DNA, 20 bp, mouse
gggagagaggatgtcttcga

SEQ ID NO: 748003 - DNA, 20 bp, mouse
gtccggcaggcctggggcgg

SEQ ID NO: 748004 - DNA, 20 bp, mouse
ggtgggaagggtcggagggt

SEQ ID NO: 748005 - DNA, 20 bp, mouse
gctgccctctgggcagttga

SEQ ID NO: 748006 - DNA, 20 bp, mouse
ggggcgctgcgctgcgggag

SEQ ID NO: 748007 - DNA, 20 bp, mouse
ggctgccagaacccaatcca

SEQ ID NO: 748008 - DNA, 20 bp, mouse
ggggtcctccggagcagagc

SEQ ID NO: 748009 - DNA, 20 bp, mouse
ggggagaggccctccagcca

SEQ ID NO: 748010 - DNA, 20 bp, mouse
gcggctccgcaccgtggatt

SEQ ID NO: 748011 - DNA, 20 bp, mouse
gacggtgcggagccgagaac

SEQ ID NO: 748012 - DNA, 20 bp, mouse
gcagaacccaatccacggtg

SEQ ID NO: 748013 - DNA, 20 bp, mouse
gggagcccgaaggcgatcct

SEQ ID NO: 748014 - DNA, 20 bp, mouse
ggcggagccgagaactgggc

SEQ ID NO: 748015 - DNA, 20 bp, mouse
gagcggggaggaggttgcgg

SEQ ID NO: 748016 - DNA, 20 bp, mouse
gtacctggccgcaggcaagg

SEQ ID NO: 748017 - DNA, 20 bp, mouse
gcaggcctggcgcccggacc

SEQ ID NO: 748018 - DNA, 20 bp, mouse
ggccggctggacatggacaa

SEQ ID NO: 748019 - DNA, 20 bp, mouse
gaggtgacctacctggccgc

SEQ ID NO: 748020 - DNA, 20 bp, mouse
gaagagaagcagatgtactt

SEQ ID NO: 748021 - DNA, 20 bp, mouse
gaggcaaggaggcctggttg

SEQ ID NO: 748022 - DNA, 20 bp, mouse
gaacagcagcgtccaggcct

SEQ ID NO: 748023 - DNA, 20 bp, mouse
gcctggacgctgctgttgtc

SEQ ID NO: 748024 - DNA, 20 bp, mouse
ggaccaggaggtgacctacc

SEQ ID NO: 748025 - DNA, 20 bp, mouse
gtctctgtcaacccagtgta

SEQ ID NO: 748026 - DNA, 20 bp, mouse
ggagagttctggaagatctt

SEQ ID NO: 748027 - DNA, 20 bp, mouse
gacccagcgtctaggggagg

SEQ ID NO: 748028 - DNA, 20 bp, mouse
ggactctagcgctcagtgtt

SEQ ID NO: 748029 - DNA, 20 bp, mouse
gttgacccagcgtctagggg

SEQ ID NO: 748030 - DNA, 20 bp, mouse
ggaaacccagatgcagttct

SEQ ID NO: 748031 - DNA, 20 bp, mouse
ggatcttgacccagcgtcta

SEQ ID NO: 748032 - DNA, 20 bp, mouse
gtctcgatatacaaccaagg

SEQ ID NO: 748033 - DNA, 20 bp, mouse
ggggatccgagaactgcatc

SEQ ID NO: 748034 - DNA, 20 bp, mouse
ggccccctcccctagacgct

SEQ ID NO: 748035 - DNA, 20 bp, mouse
gggttgtatatcgagagttc

SEQ ID NO: 748036 - DNA, 20 bp, mouse
gcgaaccttcagttctcttg

SEQ ID NO: 748037 - DNA, 20 bp, mouse
gaaagcgctcgagatcgtgg

SEQ ID NO: 748038 - DNA, 20 bp, mouse
ggagaactgaaggttcgcat

SEQ ID NO: 748039 - DNA, 20 bp, mouse
gaaatcccggaaaactgaag

SEQ ID NO: 748040 - DNA, 20 bp, mouse
gaagactggttcagcggaga

SEQ ID NO: 748041 - DNA, 20 bp, mouse
gaggcaaagcgcgtcaccaa

SEQ ID NO: 748042 - DNA, 20 bp, mouse
gagggcgcgtttactccggt

SEQ ID NO: 748043 - DNA, 20 bp, mouse
gaccaagggcgcgtttactc

SEQ ID NO: 748044 - DNA, 20 bp, mouse
gcgcgaggtagtgacgtcac

SEQ ID NO: 748045 - DNA, 20 bp, mouse
gtcaccgagtttaataaggg

SEQ ID NO: 748046 - DNA, 20 bp, mouse
ggagcgtgaggtcacgtgag

SEQ ID NO: 748047 - DNA, 20 bp, mouse
gagccaatggggagcggcaa

SEQ ID NO: 748048 - DNA, 20 bp, mouse
gtggctgggagaaatcacga

SEQ ID NO: 748049 - DNA, 20 bp, mouse
gcgagggtggggcgtgagaa

SEQ ID NO: 748050 - DNA, 20 bp, mouse
gcccgggagccaatcggaaa

SEQ ID NO: 748051 - DNA, 20 bp, mouse
gttggctcccgggaaccaat

SEQ ID NO: 748052 - DNA, 20 bp, mouse
gcgtgaggggtcgagcggca

SEQ ID NO: 748053 - DNA, 20 bp, mouse
gtggcctgggatccggacaa

SEQ ID NO: 748054 - DNA, 20 bp, mouse
gccagcacggtccgagggtg

SEQ ID NO: 748055 - DNA, 20 bp, mouse
gcacatgcgcaggtttgaaa

SEQ ID NO: 748056 - DNA, 20 bp, mouse
gaaagcgaggctaacgatgg

SEQ ID NO: 748057 - DNA, 20 bp, mouse
gttcgcaaagtcaggattca

SEQ ID NO: 748058 - DNA, 20 bp, mouse
ggctcggccccgccctccat

SEQ ID NO: 748059 - DNA, 20 bp, mouse
ggcaaccaaaaaagattgac

SEQ ID NO: 748060 - DNA, 20 bp, mouse
gagtcaggattcagggaacc

SEQ ID NO: 748061 - DNA, 20 bp, mouse
gggcgtggcgtgagcgggct

SEQ ID NO: 748062 - DNA, 20 bp, mouse
gcgcgccctggccgtttcct

SEQ ID NO: 748063 - DNA, 20 bp, mouse
ggcgaaagcgaggctaacga

SEQ ID NO: 748064 - DNA, 20 bp, mouse
ggtgagcgggctaggtgcgc

SEQ ID NO: 748065 - DNA, 20 bp, mouse
gtctacctgtcaatcttttt

SEQ ID NO: 748066 - DNA, 20 bp, mouse
gccagcgcacgcttggatcc

SEQ ID NO: 748067 - DNA, 20 bp, mouse
gcgtgcacaagtgactcgga

SEQ ID NO: 748068 - DNA, 20 bp, mouse
gatgtgcgctcctagggcaa

SEQ ID NO: 748069 - DNA, 20 bp, mouse
gctagggcaagggctgccgg

SEQ ID NO: 748070 - DNA, 20 bp, mouse
gggtgcgccttgggttagag

SEQ ID NO: 748071 - DNA, 20 bp, mouse
gctgtgcccggggacgtcac

SEQ ID NO: 748072 - DNA, 20 bp, mouse
gctcctagggcaagggctgc

SEQ ID NO: 748073 - DNA, 20 bp, mouse
gaagaagccccactttttag

SEQ ID NO: 748074 - DNA, 20 bp, mouse
gcgcatgctcactgtgcccg

SEQ ID NO: 748075 - DNA, 20 bp, mouse
ggactcggagggtgcgcctt

SEQ ID NO: 748076 - DNA, 20 bp, mouse
ggcgccgccctgaaacccga

SEQ ID NO: 748077 - DNA, 20 bp, mouse
gctcaggcaggtggcaacta

SEQ ID NO: 748078 - DNA, 20 bp, mouse
ggcaggtggcaactagggtt

SEQ ID NO: 748079 - DNA, 20 bp, mouse
gtggcaactagggttaggtc

SEQ ID NO: 748080 - DNA, 20 bp, mouse
gtctgaagatctgcaggact

SEQ ID NO: 748081 - DNA, 20 bp, mouse
gctgagggcagtggatggag

SEQ ID NO: 748082 - DNA, 20 bp, mouse
gcccgggtctactgccctag

SEQ ID NO: 748083 - DNA, 20 bp, mouse
gtcctctagggcagtagacc

SEQ ID NO: 748084 - DNA, 20 bp, mouse
gactccgtcgggtttcaggg

SEQ ID NO: 748085 - DNA, 20 bp, mouse
gaatctgagaggctgtctgg

SEQ ID NO: 748086 - DNA, 20 bp, mouse
gtccgccctagcgacagtca

SEQ ID NO: 748087 - DNA, 20 bp, mouse
gcacctgtgcccacgtgacg

SEQ ID NO: 748088 - DNA, 20 bp, mouse
ggtgaccctgactgtcgcta

SEQ ID NO: 748089 - DNA, 20 bp, mouse
gggctgcagagctggcgctg

SEQ ID NO: 748090 - DNA, 20 bp, mouse
gcagtcagggtcaccagcac

SEQ ID NO: 748091 - DNA, 20 bp, mouse
gaccagcggggagacttgag

SEQ ID NO: 748092 - DNA, 20 bp, mouse
ggatccgatccgtggggttc

SEQ ID NO: 748093 - DNA, 20 bp, mouse
gagagctggcgctgaggctg

SEQ ID NO: 748094 - DNA, 20 bp, mouse
ggccgccgatccgatccgtg

SEQ ID NO: 748095 - DNA, 20 bp, mouse
gaccctgactgtcgctaggg

SEQ ID NO: 748096 - DNA, 20 bp, mouse
gggtcggagggacgtcgcct

SEQ ID NO: 748097 - DNA, 20 bp, mouse
gaaaggttccagtagagcgg

SEQ ID NO: 748098 - DNA, 20 bp, mouse
gtctagaaagaccctctgcg

SEQ ID NO: 748099 - DNA, 20 bp, mouse
ggcgacgtccctccgaccga

SEQ ID NO: 748100 - DNA, 20 bp, mouse
gactgtgctagccaggagag

SEQ ID NO: 748101 - DNA, 20 bp, mouse
ggaaagaccctctgcgaggc

SEQ ID NO: 748102 - DNA, 20 bp, mouse
ggacaggaccagcctcgcag

SEQ ID NO: 748103 - DNA, 20 bp, mouse
ggagggacgtcgcctgggag

SEQ ID NO: 748104 - DNA, 20 bp, mouse
gagaagggcccccgctctac

SEQ ID NO: 748105 - DNA, 20 bp, mouse
gagacacacccatcggtcgg

SEQ ID NO: 748106 - DNA, 20 bp, mouse
gaggaggaccgtgtggatgg

SEQ ID NO: 748107 - DNA, 20 bp, mouse
gaagtcgcggcgagagctat

SEQ ID NO: 748108 - DNA, 20 bp, mouse
gaggaccgtgtggatggtgg

SEQ ID NO: 748109 - DNA, 20 bp, mouse
gaagtgggcgggtctgtaac

SEQ ID NO: 748110 - DNA, 20 bp, mouse
gcggcgagagctatgggtcc

SEQ ID NO: 748111 - DNA, 20 bp, mouse
gtctcgccgcgacttctctg

SEQ ID NO: 748112 - DNA, 20 bp, mouse
gaggaatgaggaggaccgtg

SEQ ID NO: 748113 - DNA, 20 bp, mouse
gtaagccaccaccatccaca

SEQ ID NO: 748114 - DNA, 20 bp, mouse
gttgcctggggagtagttta

SEQ ID NO: 748115 - DNA, 20 bp, mouse
gtccgcggctggcagagcga

SEQ ID NO: 748116 - DNA, 20 bp, mouse
ggacccgggccgggaggcaa

SEQ ID NO: 748117 - DNA, 20 bp, mouse
gcaagggcggggcttgactt

SEQ ID NO: 748118 - DNA, 20 bp, mouse
gggcaaggagcgaagagttc

SEQ ID NO: 748119 - DNA, 20 bp, mouse
ggccccgcgcggcttcacag

SEQ ID NO: 748120 - DNA, 20 bp, mouse
gaagccgcgcggggcgccag

SEQ ID NO: 748121 - DNA, 20 bp, mouse
ggggcgccagcggagaagag

SEQ ID NO: 748122 - DNA, 20 bp, mouse
ggtcctgcctgctagtgtat

SEQ ID NO: 748123 - DNA, 20 bp, mouse
gtcccggcccgggtcgctac

SEQ ID NO: 748124 - DNA, 20 bp, mouse
gttgggtggcgcttccccac

SEQ ID NO: 748125 - DNA, 20 bp, mouse
gggagcgaagagttcggggg

SEQ ID NO: 748126 - DNA, 20 bp, mouse
gctgccccgcccatccacgg

SEQ ID NO: 748127 - DNA, 20 bp, mouse
ggggaaacagcttatttcag

SEQ ID NO: 748128 - DNA, 20 bp, mouse
gctcctgccccgcccatcca

SEQ ID NO: 748129 - DNA, 20 bp, mouse
gtaagtgtatgcaagaggtc

SEQ ID NO: 748130 - DNA, 20 bp, mouse
gaaggaatggaattctctta

SEQ ID NO: 748131 - DNA, 20 bp, mouse
gttccctggtccagtgaaat

SEQ ID NO: 748132 - DNA, 20 bp, mouse
gctggtctcaacccagcaga

SEQ ID NO: 748133 - DNA, 20 bp, mouse
gagctgtttcccaccgtgga

SEQ ID NO: 748134 - DNA, 20 bp, mouse
gatagttacaagctacatgc

SEQ ID NO: 748135 - DNA, 20 bp, mouse
gtttcccaccgtggatgggc

SEQ ID NO: 748136 - DNA, 20 bp, mouse
gcagggctgggtagacacac

SEQ ID NO: 748137 - DNA, 20 bp, mouse
gcaaggggctgcaagtataa

SEQ ID NO: 748138 - DNA, 20 bp, mouse
gaggctctaagattctcttg

SEQ ID NO: 748139 - DNA, 20 bp, mouse
gccaagtagaggccccctct

SEQ ID NO: 748140 - DNA, 20 bp, mouse
ggcaggggaccccactcgca

SEQ ID NO: 748141 - DNA, 20 bp, mouse
gcggatggggacccagccaa

SEQ ID NO: 748142 - DNA, 20 bp, mouse
ggcggcaggctgctggtact

SEQ ID NO: 748143 - DNA, 20 bp, mouse
gcctaccctggtgcaggtca

SEQ ID NO: 748144 - DNA, 20 bp, mouse
gatgtccaagagccgacctt

SEQ ID NO: 748145 - DNA, 20 bp, mouse
ggtccccatccgatgatgac

SEQ ID NO: 748146 - DNA, 20 bp, mouse
gcccaaagctgcaaagaact

SEQ ID NO: 748147 - DNA, 20 bp, mouse
gggcccgcctccctacgcat

SEQ ID NO: 748148 - DNA, 20 bp, mouse
ggccacggccaatcccgtga

SEQ ID NO: 748149 - DNA, 20 bp, mouse
gcagttgtacctccaatctg

SEQ ID NO: 748150 - DNA, 20 bp, mouse
gccgacccaggcctatgcgt

SEQ ID NO: 748151 - DNA, 20 bp, mouse
ggaggcccgagggtgtgaag

SEQ ID NO: 748152 - DNA, 20 bp, mouse
ggctcatgagtcccagttaa

SEQ ID NO: 748153 - DNA, 20 bp, mouse
gcctgggtcgggtttggtaa

SEQ ID NO: 748154 - DNA, 20 bp, mouse
gcaaagaactgggttgcaat

SEQ ID NO: 748155 - DNA, 20 bp, mouse
gtaggacccaggagtggaac

SEQ ID NO: 748156 - DNA, 20 bp, mouse
gaacccgctgcccgagggcg

SEQ ID NO: 748157 - DNA, 20 bp, mouse
gtaaactgaacactctggcg

SEQ ID NO: 748158 - DNA, 20 bp, mouse
ggcccgaggcgggctcagtg

SEQ ID NO: 748159 - DNA, 20 bp, mouse
ggggcggtgttcagaaaacg

SEQ ID NO: 748160 - DNA, 20 bp, mouse
ggttcctcacgaacccggaa

SEQ ID NO: 748161 - DNA, 20 bp, mouse
gtaaagaatgaggtcggaaa

SEQ ID NO: 748162 - DNA, 20 bp, mouse
ggctgacctcgaaatagtgt

SEQ ID NO: 748163 - DNA, 20 bp, mouse
gcggaagggactgctttcag

SEQ ID NO: 748164 - DNA, 20 bp, mouse
ggggttaagtctgagtgagg

SEQ ID NO: 748165 - DNA, 20 bp, mouse
gcgtgggggacaagcacgtc

SEQ ID NO: 748166 - DNA, 20 bp, mouse
gcagagtggacccaggtgat

SEQ ID NO: 748167 - DNA, 20 bp, mouse
gtgggaaagtgtccctgggg

SEQ ID NO: 748168 - DNA, 20 bp, mouse
gctaatgcaaatttggaggg

SEQ ID NO: 748169 - DNA, 20 bp, mouse
ggtagtggagaaaggaaaca

SEQ ID NO: 748170 - DNA, 20 bp, mouse
gagttcctctgtcctcccca

SEQ ID NO: 748171 - DNA, 20 bp, mouse
gagtccctccattaaaagag

SEQ ID NO: 748172 - DNA, 20 bp, mouse
gttcaaggagcctatcacct

SEQ ID NO: 748173 - DNA, 20 bp, mouse
gtgggcttctgaggagggtg

SEQ ID NO: 748174 - DNA, 20 bp, mouse
gtgataggctccttgaatgc

SEQ ID NO: 748175 - DNA, 20 bp, mouse
gagcgctagtccagcaaaac

SEQ ID NO: 748176 - DNA, 20 bp, mouse
gctggggagcagctggattg

SEQ ID NO: 748177 - DNA, 20 bp, mouse
gcgtcctgatatcactccgc

SEQ ID NO: 748178 - DNA, 20 bp, mouse
gagggaggcgggagtcaggt

SEQ ID NO: 748179 - DNA, 20 bp, mouse
gagcagctggattggggaag

SEQ ID NO: 748180 - DNA, 20 bp, mouse
gccgcgcccgctcccgccag

SEQ ID NO: 748181 - DNA, 20 bp, mouse
gtcccgccaggggagagtcc

SEQ ID NO: 748182 - DNA, 20 bp, mouse
gaaagattggggggaatctt

SEQ ID NO: 748183 - DNA, 20 bp, mouse
gtgggaagccccgacctgcc

SEQ ID NO: 748184 - DNA, 20 bp, mouse
gggtccccgggcttgtctca

SEQ ID NO: 748185 - DNA, 20 bp, mouse
gagctcagtaaacacggcag

SEQ ID NO: 748186 - DNA, 20 bp, mouse
ggctcgtcgccgtgagtgtg

SEQ ID NO: 748187 - DNA, 20 bp, mouse
gcgcccggaaggtggagttt

SEQ ID NO: 748188 - DNA, 20 bp, mouse
gtctcactgctgtgtcactc

SEQ ID NO: 748189 - DNA, 20 bp, mouse
gactgctgtgtcactcgggg

SEQ ID NO: 748190 - DNA, 20 bp, mouse
ggctggtggggtcgcaggca

SEQ ID NO: 748191 - DNA, 20 bp, mouse
gtcgaggctggtggggtcgc

SEQ ID NO: 748192 - DNA, 20 bp, mouse
gaaaaagtgtctggaggatt

SEQ ID NO: 748193 - DNA, 20 bp, mouse
gtagccataacagagaaagg

SEQ ID NO: 748194 - DNA, 20 bp, mouse
gagccacagaagaccctgct

SEQ ID NO: 748195 - DNA, 20 bp, mouse
gccggaaggtggagtttcgg

SEQ ID NO: 748196 - DNA, 20 bp, mouse
gcggcccggggaacgtaaag

SEQ ID NO: 748197 - DNA, 20 bp, mouse
ggggacagggaaagcgggaa

SEQ ID NO: 748198 - DNA, 20 bp, mouse
gctggctagcttacagtctc

SEQ ID NO: 748199 - DNA, 20 bp, mouse
gccggggaacgtaaaggggc

SEQ ID NO: 748200 - DNA, 20 bp, mouse
gtggtcacagactcctgaag

SEQ ID NO: 748201 - DNA, 20 bp, mouse
gcaccagccaagtcaggctc

SEQ ID NO: 748202 - DNA, 20 bp, mouse
gtgggagctgcagttgttgg

SEQ ID NO: 748203 - DNA, 20 bp, mouse
gcatggttgcctctcggctg

SEQ ID NO: 748204 - DNA, 20 bp, mouse
gaaaggggtgcgtggataaa

SEQ ID NO: 748205 - DNA, 20 bp, mouse
ggggtgggagctgcagttgt

SEQ ID NO: 748206 - DNA, 20 bp, mouse
gcctctgccgggtcccggag

SEQ ID NO: 748207 - DNA, 20 bp, mouse
gaccctgggaggcgtaagat

SEQ ID NO: 748208 - DNA, 20 bp, mouse
ggcctcccagggtcccgcgg

SEQ ID NO: 748209 - DNA, 20 bp, mouse
gggcagaggcggggaggtcg

SEQ ID NO: 748210 - DNA, 20 bp, mouse
ggcacggggcggggagttta

SEQ ID NO: 748211 - DNA, 20 bp, mouse
gtcccgcgggggtggagccg

SEQ ID NO: 748212 - DNA, 20 bp, mouse
ggcactgccggtctcccgag

SEQ ID NO: 748213 - DNA, 20 bp, mouse
ggagcggtcggaaacgaggg

SEQ ID NO: 748214 - DNA, 20 bp, mouse
gcccgagcggtcggaaacga

SEQ ID NO: 748215 - DNA, 20 bp, mouse
gcggacgcgctgtcactctc

SEQ ID NO: 748216 - DNA, 20 bp, mouse
ggcggcggggctagctgagg

SEQ ID NO: 748217 - DNA, 20 bp, mouse
ggcggggctagctgaggagg

SEQ ID NO: 748218 - DNA, 20 bp, mouse
gcggccgagcccctgcgcct

SEQ ID NO: 748219 - DNA, 20 bp, mouse
ggccccgggctgtcggtctg

SEQ ID NO: 748220 - DNA, 20 bp, mouse
ggctgggctcggccgagaag

SEQ ID NO: 748221 - DNA, 20 bp, mouse
ggggctcggccgccgcggct

SEQ ID NO: 748222 - DNA, 20 bp, mouse
gagccccgccgcccgcttct

SEQ ID NO: 748223 - DNA, 20 bp, mouse
gacctcgcacgccgccaccg

SEQ ID NO: 748224 - DNA, 20 bp, mouse
gccctgccggagccgccctg

SEQ ID NO: 748225 - DNA, 20 bp, mouse
gcgagcgtgcgagccacccg

SEQ ID NO: 748226 - DNA, 20 bp, mouse
gcgcgcgattcagcgacgta

SEQ ID NO: 748227 - DNA, 20 bp, mouse
gacgtcaacggcacaggggc

SEQ ID NO: 748228 - DNA, 20 bp, mouse
gaggcgcggtgcttagacta

SEQ ID NO: 748229 - DNA, 20 bp, mouse
gcgcgatgaaataacgtcaa

SEQ ID NO: 748230 - DNA, 20 bp, mouse
gggaagggacggccctgctg

SEQ ID NO: 748231 - DNA, 20 bp, mouse
gccagcacaagggtgtacgc

SEQ ID NO: 748232 - DNA, 20 bp, mouse
ggtcctgcagactccctgtt

SEQ ID NO: 748233 - DNA, 20 bp, mouse
gcaggacgcctgcaatggag

SEQ ID NO: 748234 - DNA, 20 bp, mouse
gcccccaacagggagtctgc

SEQ ID NO: 748235 - DNA, 20 bp, mouse
gcgcacgcgccgcgtcttat

SEQ ID NO: 748236 - DNA, 20 bp, mouse
gcagctgcgcgctgtggaga

SEQ ID NO: 748237 - DNA, 20 bp, mouse
gaacgctgggcagaaaccaa

SEQ ID NO: 748238 - DNA, 20 bp, mouse
ggtgacccgcccatctttcc

SEQ ID NO: 748239 - DNA, 20 bp, mouse
gttccccattggccgaactg

SEQ ID NO: 748240 - DNA, 20 bp, mouse
gggccaatggggaacctagc

SEQ ID NO: 748241 - DNA, 20 bp, mouse
gccgccgcggcaccgcagtt

SEQ ID NO: 748242 - DNA, 20 bp, mouse
gtcccggctaggttccccat

SEQ ID NO: 748243 - DNA, 20 bp, mouse
gctagccgggaaagatgggc

SEQ ID NO: 748244 - DNA, 20 bp, mouse
gtggcccatcggggatccct

SEQ ID NO: 748245 - DNA, 20 bp, mouse
ggcaccgcagttcggccaat

SEQ ID NO: 748246 - DNA, 20 bp, mouse
gccgacgcgccgggatgagg

SEQ ID NO: 748247 - DNA, 20 bp, mouse
gcagcagagaggtgcctcca

SEQ ID NO: 748248 - DNA, 20 bp, mouse
gggcggctttgcaggaattg

SEQ ID NO: 748249 - DNA, 20 bp, mouse
gacaagggaggcggctttgc

SEQ ID NO: 748250 - DNA, 20 bp, mouse
gctactgtcagggcccagtg

SEQ ID NO: 748251 - DNA, 20 bp, mouse
ggcccagcgcctgcctcact

SEQ ID NO: 748252 - DNA, 20 bp, mouse
ggcgacaagaggatggaatc

SEQ ID NO: 748253 - DNA, 20 bp, mouse
gggtctgtgcagggctggaa

SEQ ID NO: 748254 - DNA, 20 bp, mouse
gtaggctgctggagccctgg

SEQ ID NO: 748255 - DNA, 20 bp, mouse
gtgaggtcttcctactgtca

SEQ ID NO: 748256 - DNA, 20 bp, mouse
gtcggtgccggggtccgcta

SEQ ID NO: 748257 - DNA, 20 bp, mouse
gggtgcgcccggcaggagga

SEQ ID NO: 748258 - DNA, 20 bp, mouse
gtgacccggcagggcgggag

SEQ ID NO: 748259 - DNA, 20 bp, mouse
gcggcgggacccggcactag

SEQ ID NO: 748260 - DNA, 20 bp, mouse
gccggggtccgctatggctg

SEQ ID NO: 748261 - DNA, 20 bp, mouse
ggaccccggcaccgacccag

SEQ ID NO: 748262 - DNA, 20 bp, mouse
gcagcgggaggcgaccgagt

SEQ ID NO: 748263 - DNA, 20 bp, mouse
gcggctgcggggccgagcag

SEQ ID NO: 748264 - DNA, 20 bp, mouse
gcgccccctggcacccgact

SEQ ID NO: 748265 - DNA, 20 bp, mouse
gtcccgctgggtcggtgccg

SEQ ID NO: 748266 - DNA, 20 bp, mouse
gtctcctgccaaaagagctc

SEQ ID NO: 748267 - DNA, 20 bp, mouse
gggcagggcctgggtcatca

SEQ ID NO: 748268 - DNA, 20 bp, mouse
gcacccagagctcttttggc

SEQ ID NO: 748269 - DNA, 20 bp, mouse
gaccgccaatcggtgaggaa

SEQ ID NO: 748270 - DNA, 20 bp, mouse
gaaggagtgaaagtgtagat

SEQ ID NO: 748271 - DNA, 20 bp, mouse
ggctctgggtggaatggggg

SEQ ID NO: 748272 - DNA, 20 bp, mouse
gctagagtggatagaagctg

SEQ ID NO: 748273 - DNA, 20 bp, mouse
ggtggcagtagactgagcac

SEQ ID NO: 748274 - DNA, 20 bp, mouse
gcccgaaccgccaatcggtg

SEQ ID NO: 748275 - DNA, 20 bp, mouse
gattctcagggatttagcta

SEQ ID NO: 748276 - DNA, 20 bp, mouse
gaaagctcgtgccctgcccg

SEQ ID NO: 748277 - DNA, 20 bp, mouse
gagcgctgccagccacgggc

SEQ ID NO: 748278 - DNA, 20 bp, mouse
gagctgcaagaccaccatat

SEQ ID NO: 748279 - DNA, 20 bp, mouse
gtgaggctagaggtctgcgt

SEQ ID NO: 748280 - DNA, 20 bp, mouse
ggtggtacggcgccccttgt

SEQ ID NO: 748281 - DNA, 20 bp, mouse
ggcgccgcgggtcccggacc

SEQ ID NO: 748282 - DNA, 20 bp, mouse
gacacagagggaaaccttcc

SEQ ID NO: 748283 - DNA, 20 bp, mouse
ggcagggcacgagctttgtg

SEQ ID NO: 748284 - DNA, 20 bp, mouse
gcaagccaccctgaggctag

SEQ ID NO: 748285 - DNA, 20 bp, mouse
gacacagcgacgaaagggtc

SEQ ID NO: 748286 - DNA, 20 bp, mouse
ggctgaggtgagaaccgcga

SEQ ID NO: 748287 - DNA, 20 bp, mouse
gctgtctgacagcaaggctg

SEQ ID NO: 748288 - DNA, 20 bp, mouse
gggagcctcccagtgaaacc

SEQ ID NO: 748289 - DNA, 20 bp, mouse
gtagctcaggctgtactcaa

SEQ ID NO: 748290 - DNA, 20 bp, mouse
ggttcccagaaaagctgctc

SEQ ID NO: 748291 - DNA, 20 bp, mouse
gacaccacggcttttgcaag

SEQ ID NO: 748292 - DNA, 20 bp, mouse
gtcagcttccgggtttcact

SEQ ID NO: 748293 - DNA, 20 bp, mouse
gctggtggtgtggttcggta

SEQ ID NO: 748294 - DNA, 20 bp, mouse
gcagacccgagcagcttttc

SEQ ID NO: 748295 - DNA, 20 bp, mouse
gtattctgaaggaagggcta

SEQ ID NO: 748296 - DNA, 20 bp, mouse
gcgggtacaagcaccgccca

SEQ ID NO: 748297 - DNA, 20 bp, mouse
gaagccgggacccgccacgc

SEQ ID NO: 748298 - DNA, 20 bp, mouse
gcagctcgatcctgtaagtg

SEQ ID NO: 748299 - DNA, 20 bp, mouse
gcaagcaccgcccagggcca

SEQ ID NO: 748300 - DNA, 20 bp, mouse
gaagcagagtctgaccattt

SEQ ID NO: 748301 - DNA, 20 bp, mouse
ggtctctgcgacctgtgagc

SEQ ID NO: 748302 - DNA, 20 bp, mouse
gggcggtgcttgtacccgcg

SEQ ID NO: 748303 - DNA, 20 bp, mouse
gggtgcttgtacccgcgtgg

SEQ ID NO: 748304 - DNA, 20 bp, mouse
gcatgtacaatctgctggtc

SEQ ID NO: 748305 - DNA, 20 bp, mouse
gtgacaaatcctggggccgg

SEQ ID NO: 748306 - DNA, 20 bp, mouse
gggggagaccggctgtaatc

SEQ ID NO: 748307 - DNA, 20 bp, mouse
gtgtctaattaggggagagc

SEQ ID NO: 748308 - DNA, 20 bp, mouse
gtcccctaattagacaccga

SEQ ID NO: 748309 - DNA, 20 bp, mouse
ggctcccagcacatcgcttc

SEQ ID NO: 748310 - DNA, 20 bp, mouse
gcaaccttcggtgtctaatt

SEQ ID NO: 748311 - DNA, 20 bp, mouse
ggaagacggcgaggaagcgg

SEQ ID NO: 748312 - DNA, 20 bp, mouse
gaactgagttctaaactggg

SEQ ID NO: 748313 - DNA, 20 bp, mouse
ggagaattgcccccagttcg

SEQ ID NO: 748314 - DNA, 20 bp, mouse
gggcgaggaagcggtggacc

SEQ ID NO: 748315 - DNA, 20 bp, mouse
gtagaactgagttctaaact

SEQ ID NO: 748316 - DNA, 20 bp, mouse
gtaagcgggcggggctttcg

SEQ ID NO: 748317 - DNA, 20 bp, mouse
gtactgcagggtcatggtgg

SEQ ID NO: 748318 - DNA, 20 bp, mouse
gaccccggtgagcaattgtg

SEQ ID NO: 748319 - DNA, 20 bp, mouse
gtgaccctgcagtagactcc

SEQ ID NO: 748320 - DNA, 20 bp, mouse
gagcgcggggcgtggctcca

SEQ ID NO: 748321 - DNA, 20 bp, mouse
gagcgcgcaggggttagctg

SEQ ID NO: 748322 - DNA, 20 bp, mouse
gcaggacaagctaggggact

SEQ ID NO: 748323 - DNA, 20 bp, mouse
gcaggcaggcggcccacgat

SEQ ID NO: 748324 - DNA, 20 bp, mouse
gcctgggaggggtagcggtg

SEQ ID NO: 748325 - DNA, 20 bp, mouse
gaggggttgaatctccgaga

SEQ ID NO: 748326 - DNA, 20 bp, mouse
gcgtacctgagatctgggtc

SEQ ID NO: 748327 - DNA, 20 bp, mouse
gcaagtgatcgcgagtggag

SEQ ID NO: 748328 - DNA, 20 bp, mouse
gaggaacgggaactcccacc

SEQ ID NO: 748329 - DNA, 20 bp, mouse
gccagccagggctcacaggg

SEQ ID NO: 748330 - DNA, 20 bp, mouse
gctcggccggggacgcgctg

SEQ ID NO: 748331 - DNA, 20 bp, mouse
ggcaagctggggtcctccac

SEQ ID NO: 748332 - DNA, 20 bp, mouse
gcgcacccgacccagatctc

SEQ ID NO: 748333 - DNA, 20 bp, mouse
ggccgagcgtacctgagatc

SEQ ID NO: 748334 - DNA, 20 bp, mouse
gccgaccaagtgatcgcgag

SEQ ID NO: 748335 - DNA, 20 bp, mouse
gaacagagctccgtggaagg

SEQ ID NO: 748336 - DNA, 20 bp, mouse
gagcagcagccaatgaggga

SEQ ID NO: 748337 - DNA, 20 bp, mouse
ggagcctgggcggtccatag

SEQ ID NO: 748338 - DNA, 20 bp, mouse
gccacgctaccctccctcat

SEQ ID NO: 748339 - DNA, 20 bp, mouse
gcggtccataggggtgcgga

SEQ ID NO: 748340 - DNA, 20 bp, mouse
ggcccaggagcccagaccgg

SEQ ID NO: 748341 - DNA, 20 bp, mouse
gtccgggcgtcgggaggagt

SEQ ID NO: 748342 - DNA, 20 bp, mouse
gcagacagcagcagccaatg

SEQ ID NO: 748343 - DNA, 20 bp, mouse
gcgcggggatcgcacaccaa

SEQ ID NO: 748344 - DNA, 20 bp, mouse
gcagcaaccgacaactgtct

SEQ ID NO: 748345 - DNA, 20 bp, mouse
ggggtcgccatgttgggtta

SEQ ID NO: 748346 - DNA, 20 bp, mouse
gcactgagagccactagagg

SEQ ID NO: 748347 - DNA, 20 bp, mouse
gcaacccggagctgcttccc

SEQ ID NO: 748348 - DNA, 20 bp, mouse
gttgggtgctggggatctgg

SEQ ID NO: 748349 - DNA, 20 bp, mouse
ggtggagcgggagtacacct

SEQ ID NO: 748350 - DNA, 20 bp, mouse
gcatcccggctggggcggtc

SEQ ID NO: 748351 - DNA, 20 bp, mouse
gagggggaggattgactctc

SEQ ID NO: 748352 - DNA, 20 bp, mouse
gcggcacggtttaagaccct

SEQ ID NO: 748353 - DNA, 20 bp, mouse
gaaaccgtgccgctcggccg

SEQ ID NO: 748354 - DNA, 20 bp, mouse
gcagcctgaccgccccagcc

SEQ ID NO: 748355 - DNA, 20 bp, mouse
ggtcaatcctccccctctag

SEQ ID NO: 748356 - DNA, 20 bp, mouse
gcccgccttcaaaagagcaa

SEQ ID NO: 748357 - DNA, 20 bp, mouse
gtcccggggcccagctggaa

SEQ ID NO: 748358 - DNA, 20 bp, mouse
ggaccctgtccagaaagttt

SEQ ID NO: 748359 - DNA, 20 bp, mouse
gcactctcccggggcccagc

SEQ ID NO: 748360 - DNA, 20 bp, mouse
gctgacccttgctcttttga

SEQ ID NO: 748361 - DNA, 20 bp, mouse
gcaaggccagcactctcccg

SEQ ID NO: 748362 - DNA, 20 bp, mouse
gggccttgctgctttctctc

SEQ ID NO: 748363 - DNA, 20 bp, mouse
gtgggctgctagggctgcaa

SEQ ID NO: 748364 - DNA, 20 bp, mouse
gagctggaaaggaacaaaaa

SEQ ID NO: 748365 - DNA, 20 bp, mouse
gcaccaaaactttctggaca

SEQ ID NO: 748366 - DNA, 20 bp, mouse
gctaggggagcgctcagggg

SEQ ID NO: 748367 - DNA, 20 bp, mouse
gcgctcttgtgcaaaagcta

SEQ ID NO: 748368 - DNA, 20 bp, mouse
gcagtcaaggggcggtacaa

SEQ ID NO: 748369 - DNA, 20 bp, mouse
gcctagcataggcacttgag

SEQ ID NO: 748370 - DNA, 20 bp, mouse
gagggagagccccatacgca

SEQ ID NO: 748371 - DNA, 20 bp, mouse
gaggggcgacacaatacgga

SEQ ID NO: 748372 - DNA, 20 bp, mouse
gcatccctgccctgcgtatg

SEQ ID NO: 748373 - DNA, 20 bp, mouse
gtcctccactgtatgatcaa

SEQ ID NO: 748374 - DNA, 20 bp, mouse
gaaagctaggggagcgctca

SEQ ID NO: 748375 - DNA, 20 bp, mouse
gccccttgactgaagtccga

SEQ ID NO: 748376 - DNA, 20 bp, mouse
ggcgagcaccccagctggga

SEQ ID NO: 748377 - DNA, 20 bp, mouse
gcgcaggcgcgcaagctggg

SEQ ID NO: 748378 - DNA, 20 bp, mouse
ggcaacagggtcttgacccc

SEQ ID NO: 748379 - DNA, 20 bp, mouse
ggagggcgagcaccccagct

SEQ ID NO: 748380 - DNA, 20 bp, mouse
gcccagctgggagggtgacc

SEQ ID NO: 748381 - DNA, 20 bp, mouse
gtgcctgtgttgtcgggctg

SEQ ID NO: 748382 - DNA, 20 bp, mouse
gcccctggggacggactttc

SEQ ID NO: 748383 - DNA, 20 bp, mouse
gcgacaacacaggcacaagg

SEQ ID NO: 748384 - DNA, 20 bp, mouse
gaacctgaaagtccgtcccc

SEQ ID NO: 748385 - DNA, 20 bp, mouse
gtgcgcgcctgcgggtggac

SEQ ID NO: 748386 - DNA, 20 bp, mouse
gagcagctgcgtgatgctga

SEQ ID NO: 748387 - DNA, 20 bp, mouse
gcaaccggaagcgggagcga

SEQ ID NO: 748388 - DNA, 20 bp, mouse
gcggaagtcaagtctcgcga

SEQ ID NO: 748389 - DNA, 20 bp, mouse
gcctaaagacgtaggacctg

SEQ ID NO: 748390 - DNA, 20 bp, mouse
gaggctgtagcttctgtcac

SEQ ID NO: 748391 - DNA, 20 bp, mouse
gtgctccgacaaaaccccat

SEQ ID NO: 748392 - DNA, 20 bp, mouse
gtcgctccgccaaccggaag

SEQ ID NO: 748393 - DNA, 20 bp, mouse
gtttgcctatggggttttgt

SEQ ID NO: 748394 - DNA, 20 bp, mouse
gaaaaggttgacttgagcag

SEQ ID NO: 748395 - DNA, 20 bp, mouse
gtccggccccgagtgctctt

SEQ ID NO: 748396 - DNA, 20 bp, mouse
gcggagaggggcacttggtc

SEQ ID NO: 748397 - DNA, 20 bp, mouse
ggaaactcccgcggagtgtt

SEQ ID NO: 748398 - DNA, 20 bp, mouse
gccctggctcaagtcggaga

SEQ ID NO: 748399 - DNA, 20 bp, mouse
gctgccaggccgcgcggtcc

SEQ ID NO: 748400 - DNA, 20 bp, mouse
gggtcactgccttctagggg

SEQ ID NO: 748401 - DNA, 20 bp, mouse
gccgacttgagccagggtaa

SEQ ID NO: 748402 - DNA, 20 bp, mouse
gcaagtcggagaggggcact

SEQ ID NO: 748403 - DNA, 20 bp, mouse
gttctgcgagacccagccga

SEQ ID NO: 748404 - DNA, 20 bp, mouse
gacttggtcaggaaaactgc

SEQ ID NO: 748405 - DNA, 20 bp, mouse
ggtcgccatggaaactcccg

SEQ ID NO: 748406 - DNA, 20 bp, mouse
gacccggcacgtcctcgtgg

SEQ ID NO: 748407 - DNA, 20 bp, mouse
gaccacccggcacgtcctcg

SEQ ID NO: 748408 - DNA, 20 bp, mouse
gactaggctaggagcctggg

SEQ ID NO: 748409 - DNA, 20 bp, mouse
gcccggaagctggaaggacg

SEQ ID NO: 748410 - DNA, 20 bp, mouse
gtgcgcggaagagaggagcg

SEQ ID NO: 748411 - DNA, 20 bp, mouse
gctctccctgcgcggaagag

SEQ ID NO: 748412 - DNA, 20 bp, mouse
ggacatcagccctgggctaa

SEQ ID NO: 748413 - DNA, 20 bp, mouse
gtcctccagcccttagccca

SEQ ID NO: 748414 - DNA, 20 bp, mouse
gggccaggagccaggctcta

SEQ ID NO: 748415 - DNA, 20 bp, mouse
gggaggcggtgccgtttata

SEQ ID NO: 748416 - DNA, 20 bp, mouse
gcccggcgcaggtcgtaagg

SEQ ID NO: 748417 - DNA, 20 bp, mouse
gccggcgcgccgctcccatt

SEQ ID NO: 748418 - DNA, 20 bp, mouse
gcgacctgcgccgggaatcc

SEQ ID NO: 748419 - DNA, 20 bp, mouse
ggtaaggaggcggagctcca

SEQ ID NO: 748420 - DNA, 20 bp, mouse
ggcagcgtcgagagactgga

SEQ ID NO: 748421 - DNA, 20 bp, mouse
gggcgcaggtcgtaaggagg

SEQ ID NO: 748422 - DNA, 20 bp, mouse
gattcccggcgcaggtcgta

SEQ ID NO: 748423 - DNA, 20 bp, mouse
gcgcagacagcccggattcc

SEQ ID NO: 748424 - DNA, 20 bp, mouse
gagtctgtggcgccaaagag

SEQ ID NO: 748425 - DNA, 20 bp, mouse
ggtctgcgccgtggcgtcac

SEQ ID NO: 748426 - DNA, 20 bp, mouse
gcgctcgctgggcacacgct

SEQ ID NO: 748427 - DNA, 20 bp, mouse
ggggtcgggcgctggtgcga

SEQ ID NO: 748428 - DNA, 20 bp, mouse
gagcgagcgcccagcgtagc

SEQ ID NO: 748429 - DNA, 20 bp, mouse
gaggcgcaggcgcatggctt

SEQ ID NO: 748430 - DNA, 20 bp, mouse
gaggcgtggcggaagctcgg

SEQ ID NO: 748431 - DNA, 20 bp, mouse
gggatcatgcaaggactgaa

SEQ ID NO: 748432 - DNA, 20 bp, mouse
gcgagggcggcccccgagag

SEQ ID NO: 748433 - DNA, 20 bp, mouse
gcgcccagcgtagctggcgt

SEQ ID NO: 748434 - DNA, 20 bp, mouse
gctgtcatggccgctctcgg

SEQ ID NO: 748435 - DNA, 20 bp, mouse
gttaactgtctgcgtgggtc

SEQ ID NO: 748436 - DNA, 20 bp, mouse
gctagcgggcattgacagag

SEQ ID NO: 748437 - DNA, 20 bp, mouse
ggcgggcattgacagagggg

SEQ ID NO: 748438 - DNA, 20 bp, mouse
gggcggggcgctcagagcgt

SEQ ID NO: 748439 - DNA, 20 bp, mouse
gcgggctcccaaagcctagc

SEQ ID NO: 748440 - DNA, 20 bp, mouse
gtcaatgcccgctaggcttt

SEQ ID NO: 748441 - DNA, 20 bp, mouse
gtgatggaatgagttttcgg

SEQ ID NO: 748442 - DNA, 20 bp, mouse
gaagcaccggagaccccggc

SEQ ID NO: 748443 - DNA, 20 bp, mouse
gcgcttccggccggggtctc

SEQ ID NO: 748444 - DNA, 20 bp, mouse
ggattctaagcgttgcttag

SEQ ID NO: 748445 - DNA, 20 bp, mouse
ggggagcttaccggaagcac

SEQ ID NO: 748446 - DNA, 20 bp, mouse
gccccagcctggctccgcca

SEQ ID NO: 748447 - DNA, 20 bp, mouse
gccaaggccaagggcggcga

SEQ ID NO: 748448 - DNA, 20 bp, mouse
gaccgtcgcagtgtagggga

SEQ ID NO: 748449 - DNA, 20 bp, mouse
ggggctgcgcgggctctcgg

SEQ ID NO: 748450 - DNA, 20 bp, mouse
gcagccgcggagcctggctg

SEQ ID NO: 748451 - DNA, 20 bp, mouse
gctgccaccgtcgcagtgta

SEQ ID NO: 748452 - DNA, 20 bp, mouse
gggcgagggcagtggagact

SEQ ID NO: 748453 - DNA, 20 bp, mouse
gcacggggcgggaacagccg

SEQ ID NO: 748454 - DNA, 20 bp, mouse
ggcccagccaaggccaaggg

SEQ ID NO: 748455 - DNA, 20 bp, mouse
gcaaggctggctgtccccgc

SEQ ID NO: 748456 - DNA, 20 bp, mouse
gagtccccgcagtggcggaa

SEQ ID NO: 748457 - DNA, 20 bp, mouse
gaccagatgatgacattcgt

SEQ ID NO: 748458 - DNA, 20 bp, mouse
gaaaatgcctgtcaggcatt

SEQ ID NO: 748459 - DNA, 20 bp, mouse
gcctctggcttaggatttag

SEQ ID NO: 748460 - DNA, 20 bp, mouse
gtggggacacatttggatgg

SEQ ID NO: 748461 - DNA, 20 bp, mouse
gtgactcctggggacacatt

SEQ ID NO: 748462 - DNA, 20 bp, mouse
ggacaaaaggatgctgcctc

SEQ ID NO: 748463 - DNA, 20 bp, mouse
gcttatagacttgactcctg

SEQ ID NO: 748464 - DNA, 20 bp, mouse
ggaaaaagtccccgcagtgg

SEQ ID NO: 748465 - DNA, 20 bp, mouse
ggatttagcggtttgccatg

SEQ ID NO: 748466 - DNA, 20 bp, mouse
gggcttggggcggagttaaa

SEQ ID NO: 748467 - DNA, 20 bp, mouse
gctgaccagcggtatccagg

SEQ ID NO: 748468 - DNA, 20 bp, mouse
gtccgcgtcatctgcctctg

SEQ ID NO: 748469 - DNA, 20 bp, mouse
gcaatggggactagcctcag

SEQ ID NO: 748470 - DNA, 20 bp, mouse
gaggcgcggcgcattggctt

SEQ ID NO: 748471 - DNA, 20 bp, mouse
gcacgggaggcgcggcgcat

SEQ ID NO: 748472 - DNA, 20 bp, mouse
gtcaaaatgacccagcccaa

SEQ ID NO: 748473 - DNA, 20 bp, mouse
gtggctgtcggcgaagcgac

SEQ ID NO: 748474 - DNA, 20 bp, mouse
ggcttcgccgacagccaatg

SEQ ID NO: 748475 - DNA, 20 bp, mouse
gttggggcggagttaaaggg

SEQ ID NO: 748476 - DNA, 20 bp, mouse
gcatgcgcgaggtggctccc

SEQ ID NO: 748477 - DNA, 20 bp, mouse
gggtcccagcggccaaatct

SEQ ID NO: 748478 - DNA, 20 bp, mouse
gcatgcgcctcggttgaggg

SEQ ID NO: 748479 - DNA, 20 bp, mouse
gcgggaggtcggggaacagg

SEQ ID NO: 748480 - DNA, 20 bp, mouse
gctccccggcctactgtaga

SEQ ID NO: 748481 - DNA, 20 bp, mouse
gacgatcagcttcccggggt

SEQ ID NO: 748482 - DNA, 20 bp, mouse
gcgcgcatgcgcctcggttg

SEQ ID NO: 748483 - DNA, 20 bp, mouse
gtgcgtgtgcgtctcaaacg

SEQ ID NO: 748484 - DNA, 20 bp, mouse
ggaagcaggtaaggtagctc

SEQ ID NO: 748485 - DNA, 20 bp, mouse
gacgcgggtggggttacaca

SEQ ID NO: 748486 - DNA, 20 bp, mouse
gggaaagctgggttggattc

SEQ ID NO: 748487 - DNA, 20 bp, mouse
gggagccgagctgtactaag

SEQ ID NO: 748488 - DNA, 20 bp, mouse
gagtccgggcggcgtctgat

SEQ ID NO: 748489 - DNA, 20 bp, mouse
gcatctagacggcaagaggg

SEQ ID NO: 748490 - DNA, 20 bp, mouse
ggactgccctacccactcgg

SEQ ID NO: 748491 - DNA, 20 bp, mouse
gggtagggcagtcatctaga

SEQ ID NO: 748492 - DNA, 20 bp, mouse
gttggattccggctcttgga

SEQ ID NO: 748493 - DNA, 20 bp, mouse
gacaatcccccgagtgggta

SEQ ID NO: 748494 - DNA, 20 bp, mouse
gcgcacacgctgtgccatag

SEQ ID NO: 748495 - DNA, 20 bp, mouse
gtggtcgccgctctcttcag

SEQ ID NO: 748496 - DNA, 20 bp, mouse
gctgcagcgcccagcactga

SEQ ID NO: 748497 - DNA, 20 bp, mouse
ggggcctgaagtcctggatc

SEQ ID NO: 748498 - DNA, 20 bp, mouse
ggacgcgcagcctgcaatac

SEQ ID NO: 748499 - DNA, 20 bp, mouse
gcaccctgatccaggacttc

SEQ ID NO: 748500 - DNA, 20 bp, mouse
gtgcgcgtcagtgctagtgg

SEQ ID NO: 748501 - DNA, 20 bp, mouse
gaccactcagggacccatag

SEQ ID NO: 748502 - DNA, 20 bp, mouse
ggactctcaacctaccactc

SEQ ID NO: 748503 - DNA, 20 bp, mouse
ggcagctcaacctgtattgc

SEQ ID NO: 748504 - DNA, 20 bp, mouse
ggcgccctcagcggagcgag

SEQ ID NO: 748505 - DNA, 20 bp, mouse
ggtgcccgggggcgtgacgg

SEQ ID NO: 748506 - DNA, 20 bp, mouse
gggggcgccatgttggaaga

SEQ ID NO: 748507 - DNA, 20 bp, mouse
gagggatctcgtgctaggac

SEQ ID NO: 748508 - DNA, 20 bp, mouse
gggagcagggatctcgtgct

SEQ ID NO: 748509 - DNA, 20 bp, mouse
gaacccggggagccgacatg

SEQ ID NO: 748510 - DNA, 20 bp, mouse
ggcgccgcgccctccggttc

SEQ ID NO: 748511 - DNA, 20 bp, mouse
gcccagggccgcggggtcaa

SEQ ID NO: 748512 - DNA, 20 bp, mouse
ggggcagctggggcggagca

SEQ ID NO: 748513 - DNA, 20 bp, mouse
gccaggaagacacggatcta

SEQ ID NO: 748514 - DNA, 20 bp, mouse
gaagacacggatctacggct

SEQ ID NO: 748515 - DNA, 20 bp, mouse
gggaggcgggtcccacatgt

SEQ ID NO: 748516 - DNA, 20 bp, mouse
gacactctttagtaagggaa

SEQ ID NO: 748517 - DNA, 20 bp, mouse
gcacgtacactctttagtaa

SEQ ID NO: 748518 - DNA, 20 bp, mouse
gtccacgcgtctctgattta

SEQ ID NO: 748519 - DNA, 20 bp, mouse
gagagacgcgtggactctac

SEQ ID NO: 748520 - DNA, 20 bp, mouse
gaaacagcgcggtccatgat

SEQ ID NO: 748521 - DNA, 20 bp, mouse
gtaaggaaacgtgctcctgt

SEQ ID NO: 748522 - DNA, 20 bp, mouse
gggaagggtgacaaacagcg

SEQ ID NO: 748523 - DNA, 20 bp, mouse
gccaattagaccttagtcta

SEQ ID NO: 748524 - DNA, 20 bp, mouse
gcagcgcggtccatgatagg

SEQ ID NO: 748525 - DNA, 20 bp, mouse
gctctaagctgttgattcag

SEQ ID NO: 748526 - DNA, 20 bp, mouse
gcacgcatgcgcactgcgga

SEQ ID NO: 748527 - DNA, 20 bp, mouse
gcactgcggaaggcagcgat

SEQ ID NO: 748528 - DNA, 20 bp, mouse
ggcacgcctgcgtgcagaag

SEQ ID NO: 748529 - DNA, 20 bp, mouse
gcgggcctcatgcattgtca

SEQ ID NO: 748530 - DNA, 20 bp, mouse
gtagccctgacaagtggaga

SEQ ID NO: 748531 - DNA, 20 bp, mouse
gaatgcatgaggcccgcctc

SEQ ID NO: 748532 - DNA, 20 bp, mouse
ggtgcgcactgggttccagt

SEQ ID NO: 748533 - DNA, 20 bp, mouse
ggcccgcctcgggctctagg

SEQ ID NO: 748534 - DNA, 20 bp, mouse
ggcagggcgggcacgcgctg

SEQ ID NO: 748535 - DNA, 20 bp, mouse
gtatgcacgcgaggcagggc

SEQ ID NO: 748536 - DNA, 20 bp, mouse
gggcgcgcggcgcaggtggg

SEQ ID NO: 748537 - DNA, 20 bp, mouse
gcgagcggggccgcgcctcc

SEQ ID NO: 748538 - DNA, 20 bp, mouse
gcggcgcaggtgggagggca

SEQ ID NO: 748539 - DNA, 20 bp, mouse
gcgggcgcgcgctgctgccg

SEQ ID NO: 748540 - DNA, 20 bp, mouse
ggggagggcaggggcaatgc

SEQ ID NO: 748541 - DNA, 20 bp, mouse
gccgccaggtagtgcgagac

SEQ ID NO: 748542 - DNA, 20 bp, mouse
gggcgatcgcgcctcgtcgt

SEQ ID NO: 748543 - DNA, 20 bp, mouse
gcctcgtcgtcgggattccc

SEQ ID NO: 748544 - DNA, 20 bp, mouse
gcgcctcccggccggggccc

SEQ ID NO: 748545 - DNA, 20 bp, mouse
gtctggaaggggacgcaagc

SEQ ID NO: 748546 - DNA, 20 bp, mouse
gtccccgccggggctcttgg

SEQ ID NO: 748547 - DNA, 20 bp, mouse
gaagagccccggcggggaga

SEQ ID NO: 748548 - DNA, 20 bp, mouse
ggggcgcgccaccccatccc

SEQ ID NO: 748549 - DNA, 20 bp, mouse
gacccaaggcctcgcagctt

SEQ ID NO: 748550 - DNA, 20 bp, mouse
ggtagcctgggacgaaccca

SEQ ID NO: 748551 - DNA, 20 bp, mouse
gctcccaggcggcatcgcgg

SEQ ID NO: 748552 - DNA, 20 bp, mouse
gcggcggggagagggactta

SEQ ID NO: 748553 - DNA, 20 bp, mouse
ggggaaatgtagttcgttcg

SEQ ID NO: 748554 - DNA, 20 bp, mouse
ggccgccggtggagctgcgc

SEQ ID NO: 748555 - DNA, 20 bp, mouse
gtcccaagctgcgaggcctt

SEQ ID NO: 748556 - DNA, 20 bp, mouse
gaaacagcatcagatgacgt

SEQ ID NO: 748557 - DNA, 20 bp, mouse
gcagaggagcacctaacgta

SEQ ID NO: 748558 - DNA, 20 bp, mouse
ggtaaggcttagagttgtgc

SEQ ID NO: 748559 - DNA, 20 bp, mouse
gggttgcaccgctcccctcc

SEQ ID NO: 748560 - DNA, 20 bp, mouse
gcccggggccaaagtacaaa

SEQ ID NO: 748561 - DNA, 20 bp, mouse
gtgcacgggagttcccgggg

SEQ ID NO: 748562 - DNA, 20 bp, mouse
gctctcttggccaacctccc

SEQ ID NO: 748563 - DNA, 20 bp, mouse
gggaggcgggaggaactacc

SEQ ID NO: 748564 - DNA, 20 bp, mouse
gcagcatcagatgacgtggg

SEQ ID NO: 748565 - DNA, 20 bp, mouse
gctcccctcccggaggctcc

SEQ ID NO: 748566 - DNA, 20 bp, mouse
gaccctgaggtccacttccg

SEQ ID NO: 748567 - DNA, 20 bp, mouse
ggaccccggaagtggacctc

SEQ ID NO: 748568 - DNA, 20 bp, mouse
gcaaaggggaggccggaaga

SEQ ID NO: 748569 - DNA, 20 bp, mouse
gagggctgggcacccgtcgg

SEQ ID NO: 748570 - DNA, 20 bp, mouse
ggtcgcaggtcactcgcttg

SEQ ID NO: 748571 - DNA, 20 bp, mouse
gcgccggcaccggtagaagc

SEQ ID NO: 748572 - DNA, 20 bp, mouse
gtgacctgcgaccccggaag

SEQ ID NO: 748573 - DNA, 20 bp, mouse
ggtcggcggcatccagaggt

SEQ ID NO: 748574 - DNA, 20 bp, mouse
gagggtcccaaggatttctc

SEQ ID NO: 748575 - DNA, 20 bp, mouse
ggagccaagggacctatcac

SEQ ID NO: 748576 - DNA, 20 bp, mouse
gttcaagtcgagtggggacg

SEQ ID NO: 748577 - DNA, 20 bp, mouse
gacggacacgccctgagcgg

SEQ ID NO: 748578 - DNA, 20 bp, mouse
gggagatgtcggtatgacaa

SEQ ID NO: 748579 - DNA, 20 bp, mouse
ggggacggggcttcgagtag

SEQ ID NO: 748580 - DNA, 20 bp, mouse
gcgggagttcaagtcgagtg

SEQ ID NO: 748581 - DNA, 20 bp, mouse
ggggacggacacgccctgag

SEQ ID NO: 748582 - DNA, 20 bp, mouse
gagggcgtgtccgtcccggg

SEQ ID NO: 748583 - DNA, 20 bp, mouse
ggaaggagcctggatcgcgc

SEQ ID NO: 748584 - DNA, 20 bp, mouse
gcatccaggagcacagaagt

SEQ ID NO: 748585 - DNA, 20 bp, mouse
gggggcttcgagtagggggt

SEQ ID NO: 748586 - DNA, 20 bp, mouse
gagagctgacagctattctg

SEQ ID NO: 748587 - DNA, 20 bp, mouse
gacagctattctggggacct

SEQ ID NO: 748588 - DNA, 20 bp, mouse
gtggaagagtgtaggtacta

SEQ ID NO: 748589 - DNA, 20 bp, mouse
ggaaaaaaagggagaccatg

SEQ ID NO: 748590 - DNA, 20 bp, mouse
gcaaaacactgaaacagggc

SEQ ID NO: 748591 - DNA, 20 bp, mouse
gcagaggtttgatgcaagag

SEQ ID NO: 748592 - DNA, 20 bp, mouse
gtccaaaacctggaaaaaaa

SEQ ID NO: 748593 - DNA, 20 bp, mouse
ggtaggtactaaggaaagag

SEQ ID NO: 748594 - DNA, 20 bp, mouse
gaagaggaggttgggtacaa

SEQ ID NO: 748595 - DNA, 20 bp, mouse
ggttgggtacaacggaatac

SEQ ID NO: 748596 - DNA, 20 bp, mouse
ggccaatcgctgctgaggag

SEQ ID NO: 748597 - DNA, 20 bp, mouse
gtaggaatgggtgggatcaa

SEQ ID NO: 748598 - DNA, 20 bp, mouse
ggggatcaagggtcgcggtg

SEQ ID NO: 748599 - DNA, 20 bp, mouse
gcggtgcggccaaagaaagg

SEQ ID NO: 748600 - DNA, 20 bp, mouse
gctaacttataggaatgggt

SEQ ID NO: 748601 - DNA, 20 bp, mouse
gggggcggggataggcacgg

SEQ ID NO: 748602 - DNA, 20 bp, mouse
gaagtcgcagccacgggggg

SEQ ID NO: 748603 - DNA, 20 bp, mouse
gggaaacagtgcccattttg

SEQ ID NO: 748604 - DNA, 20 bp, mouse
ggcaaagtcgcagccacggg

SEQ ID NO: 748605 - DNA, 20 bp, mouse
ggggtggatgggcggtctgt

SEQ ID NO: 748606 - DNA, 20 bp, mouse
ggcgcccccagcccggacgc

SEQ ID NO: 748607 - DNA, 20 bp, mouse
gcctcggggcagcaacgcca

SEQ ID NO: 748608 - DNA, 20 bp, mouse
ggctccgacgtcaggacggg

SEQ ID NO: 748609 - DNA, 20 bp, mouse
gggggctccgacgtcaggac

SEQ ID NO: 748610 - DNA, 20 bp, mouse
gaaagcccgcgagaaagagg

SEQ ID NO: 748611 - DNA, 20 bp, mouse
gcgggctgggggcgctgcgc

SEQ ID NO: 748612 - DNA, 20 bp, mouse
gcctccgcccgtcctgacgt

SEQ ID NO: 748613 - DNA, 20 bp, mouse
gcggccgaggcgaggattgc

SEQ ID NO: 748614 - DNA, 20 bp, mouse
gggaagaaagggaggaagtc

SEQ ID NO: 748615 - DNA, 20 bp, mouse
gaggcgggggctccgacgtc

SEQ ID NO: 748616 - DNA, 20 bp, mouse
gcctcgtgacatatctcaac

SEQ ID NO: 748617 - DNA, 20 bp, mouse
ggatccaatttggctaagat

SEQ ID NO: 748618 - DNA, 20 bp, mouse
gcactgaaatcacaaagctt

SEQ ID NO: 748619 - DNA, 20 bp, mouse
gaaagattattgatccaatt

SEQ ID NO: 748620 - DNA, 20 bp, mouse
gtagccaatcttagccaaat

SEQ ID NO: 748621 - DNA, 20 bp, mouse
gaatatgccaggtatgaact

SEQ ID NO: 748622 - DNA, 20 bp, mouse
gtgagaaatggtcattctct

SEQ ID NO: 748623 - DNA, 20 bp, mouse
gtatctgttacttaagtatg

SEQ ID NO: 748624 - DNA, 20 bp, mouse
gtcacaaagcttaggatctc

SEQ ID NO: 748625 - DNA, 20 bp, mouse
gtaggctggccattctaggc

SEQ ID NO: 748626 - DNA, 20 bp, mouse
gcatccgcgcgcccggctaa

SEQ ID NO: 748627 - DNA, 20 bp, mouse
ggcggtgaggaggtccgagt

SEQ ID NO: 748628 - DNA, 20 bp, mouse
ggtgaggaggtccgagtggg

SEQ ID NO: 748629 - DNA, 20 bp, mouse
gctgctcggcgcaacgtacc

SEQ ID NO: 748630 - DNA, 20 bp, mouse
ggccctggaaacggcgcagt

SEQ ID NO: 748631 - DNA, 20 bp, mouse
gcgcctgcgcagtctctgct

SEQ ID NO: 748632 - DNA, 20 bp, mouse
gctggaaacggcgcagtcgg

SEQ ID NO: 748633 - DNA, 20 bp, mouse
ggtacccggctccgcccact

SEQ ID NO: 748634 - DNA, 20 bp, mouse
gcgccgagcagagactgcgc

SEQ ID NO: 748635 - DNA, 20 bp, mouse
gcagcgggttccgctctcgg

SEQ ID NO: 748636 - DNA, 20 bp, mouse
gagctggcggatgagagtga

SEQ ID NO: 748637 - DNA, 20 bp, mouse
gcggatgagagtgagggcgt

SEQ ID NO: 748638 - DNA, 20 bp, mouse
gaagtcaaggcgatttccga

SEQ ID NO: 748639 - DNA, 20 bp, mouse
gcaatcccgcctactctcac

SEQ ID NO: 748640 - DNA, 20 bp, mouse
gtggctaggcgcgagaggac

SEQ ID NO: 748641 - DNA, 20 bp, mouse
ggcgttgggagagagcgggg

SEQ ID NO: 748642 - DNA, 20 bp, mouse
gctgacttcctcctggttat

SEQ ID NO: 748643 - DNA, 20 bp, mouse
ggtccgtcgtgattagctgg

SEQ ID NO: 748644 - DNA, 20 bp, mouse
gctggcgccgttcccctcgg

SEQ ID NO: 748645 - DNA, 20 bp, mouse
gggcatcctgtgagagtagg

SEQ ID NO: 748646 - DNA, 20 bp, mouse
gataaagctctcccacactc

SEQ ID NO: 748647 - DNA, 20 bp, mouse
gttgacgggtcccagagtgt

SEQ ID NO: 748648 - DNA, 20 bp, mouse
gcactctggacaactccaga

SEQ ID NO: 748649 - DNA, 20 bp, mouse
ggacaagacagtctatttga

SEQ ID NO: 748650 - DNA, 20 bp, mouse
ggggagatggccatttggaa

SEQ ID NO: 748651 - DNA, 20 bp, mouse
gtggtgtgcagcctatggac

SEQ ID NO: 748652 - DNA, 20 bp, mouse
gagagctttatcccgcactc

SEQ ID NO: 748653 - DNA, 20 bp, mouse
gagaatgtagtcttccatga

SEQ ID NO: 748654 - DNA, 20 bp, mouse
gctctgtggtgtgcagccta

SEQ ID NO: 748655 - DNA, 20 bp, mouse
gaccagaaacacctgtccat

SEQ ID NO: 748656 - DNA, 20 bp, mouse
gccgcgtcccggaacctccg

SEQ ID NO: 748657 - DNA, 20 bp, mouse
ggggtagccgagaggacggg

SEQ ID NO: 748658 - DNA, 20 bp, mouse
gaggacgggcggctgcgaga

SEQ ID NO: 748659 - DNA, 20 bp, mouse
gcggtgcaagggagctgttg

SEQ ID NO: 748660 - DNA, 20 bp, mouse
ggcgaaccggtgaaagagga

SEQ ID NO: 748661 - DNA, 20 bp, mouse
gcgcggcgaaccggtgaaag

SEQ ID NO: 748662 - DNA, 20 bp, mouse
gggagacggagtcggtgcaa

SEQ ID NO: 748663 - DNA, 20 bp, mouse
ggctaccccgagccgcgtcc

SEQ ID NO: 748664 - DNA, 20 bp, mouse
gaggttccgggacgcggctc

SEQ ID NO: 748665 - DNA, 20 bp, mouse
gaggcggatcctttcgggag

SEQ ID NO: 748666 - DNA, 20 bp, mouse
ggggcaatgaggctccccag

SEQ ID NO: 748667 - DNA, 20 bp, mouse
gaggttctagccggagagga

SEQ ID NO: 748668 - DNA, 20 bp, mouse
ggagctgaaaagcacttcta

SEQ ID NO: 748669 - DNA, 20 bp, mouse
ggggcccagcctacatgtga

SEQ ID NO: 748670 - DNA, 20 bp, mouse
ggcacaggctgttccggaag

SEQ ID NO: 748671 - DNA, 20 bp, mouse
gataggggcacaggctgttc

SEQ ID NO: 748672 - DNA, 20 bp, mouse
gaggagggagggagagccgc

SEQ ID NO: 748673 - DNA, 20 bp, mouse
gttggcccgaataggggcac

SEQ ID NO: 748674 - DNA, 20 bp, mouse
gacagcctgtgcccctattc

SEQ ID NO: 748675 - DNA, 20 bp, mouse
ggtaagcagtcaacagtgtt

SEQ ID NO: 748676 - DNA, 20 bp, mouse
gaggggcattagatggaggg

SEQ ID NO: 748677 - DNA, 20 bp, mouse
gagcaagcgccgggccatgc

SEQ ID NO: 748678 - DNA, 20 bp, mouse
gctggctgcggtgctggaac

SEQ ID NO: 748679 - DNA, 20 bp, mouse
ggcaccaggagagcaagcgc

SEQ ID NO: 748680 - DNA, 20 bp, mouse
ggacgcgggttcctcggcag

SEQ ID NO: 748681 - DNA, 20 bp, mouse
ggggcacactgggcacaatg

SEQ ID NO: 748682 - DNA, 20 bp, mouse
gcctcggcagcgggctcctc

SEQ ID NO: 748683 - DNA, 20 bp, mouse
gatgaggggcattagatgga

SEQ ID NO: 748684 - DNA, 20 bp, mouse
ggccccctggtggtcgagct

SEQ ID NO: 748685 - DNA, 20 bp, mouse
gtatcccagctcgaccacca

SEQ ID NO: 748686 - DNA, 20 bp, mouse
gtgacccggggagcgagtga

SEQ ID NO: 748687 - DNA, 20 bp, mouse
gtgagggagaagccggggta

SEQ ID NO: 748688 - DNA, 20 bp, mouse
gagcccgaaggcggaccggt

SEQ ID NO: 748689 - DNA, 20 bp, mouse
gtgcgcgatcggaactggcg

SEQ ID NO: 748690 - DNA, 20 bp, mouse
gagccgtgggcccgaggaac

SEQ ID NO: 748691 - DNA, 20 bp, mouse
gagcaggggaaggcacgacg

SEQ ID NO: 748692 - DNA, 20 bp, mouse
gagcgagcccgaaggcggac

SEQ ID NO: 748693 - DNA, 20 bp, mouse
gcgcctgccggacccgagcg

SEQ ID NO: 748694 - DNA, 20 bp, mouse
gcggggaatttcctgacccg

SEQ ID NO: 748695 - DNA, 20 bp, mouse
gctccactccgcccctaccc

SEQ ID NO: 748696 - DNA, 20 bp, mouse
gcggaacagggaggtcccgt

SEQ ID NO: 748697 - DNA, 20 bp, mouse
ggggatgggacagtggggtc

SEQ ID NO: 748698 - DNA, 20 bp, mouse
gcagctagacccagccaact

SEQ ID NO: 748699 - DNA, 20 bp, mouse
gtatgcgaggaagcggaaca

SEQ ID NO: 748700 - DNA, 20 bp, mouse
gagacccagccaacttggac

SEQ ID NO: 748701 - DNA, 20 bp, mouse
gaacatcctggctgtcggag

SEQ ID NO: 748702 - DNA, 20 bp, mouse
gatagacgcagacacggatt

SEQ ID NO: 748703 - DNA, 20 bp, mouse
ggcgaggaagcggaacaggg

SEQ ID NO: 748704 - DNA, 20 bp, mouse
gtatcaatgcttctgacagg

SEQ ID NO: 748705 - DNA, 20 bp, mouse
gcagggaggtcccgtgggat

SEQ ID NO: 748706 - DNA, 20 bp, mouse
gtgccctgagtgtgtttcag

SEQ ID NO: 748707 - DNA, 20 bp, mouse
gccaccggtgaacactcgag

SEQ ID NO: 748708 - DNA, 20 bp, mouse
gtgcccctgaaacacactca

SEQ ID NO: 748709 - DNA, 20 bp, mouse
gaggccactcgagtgttcac

SEQ ID NO: 748710 - DNA, 20 bp, mouse
ggcggggaggaggttggcgt

SEQ ID NO: 748711 - DNA, 20 bp, mouse
gctgccggacccaggcgtgt

SEQ ID NO: 748712 - DNA, 20 bp, mouse
gataggcagcgggaggacca

SEQ ID NO: 748713 - DNA, 20 bp, mouse
ggcacgctccgtttcagagt

SEQ ID NO: 748714 - DNA, 20 bp, mouse
gtggccagcctgccggaccc

SEQ ID NO: 748715 - DNA, 20 bp, mouse
gaggacagacggcggactgg

SEQ ID NO: 748716 - DNA, 20 bp, mouse
gggcgggccaatgggaggat

SEQ ID NO: 748717 - DNA, 20 bp, mouse
gggccaatgggaggatgggt

SEQ ID NO: 748718 - DNA, 20 bp, mouse
gacagccgcggcgggccaat

SEQ ID NO: 748719 - DNA, 20 bp, mouse
ggggcggcctcgcccctcgg

SEQ ID NO: 748720 - DNA, 20 bp, mouse
ggcggctgtccgtctcctga

SEQ ID NO: 748721 - DNA, 20 bp, mouse
gagggtggctgagacctcat

SEQ ID NO: 748722 - DNA, 20 bp, mouse
gaggagacggacagccgcgg

SEQ ID NO: 748723 - DNA, 20 bp, mouse
ggctcgcgtcaggtggtccc

SEQ ID NO: 748724 - DNA, 20 bp, mouse
gccccgcccccgggtccgca

SEQ ID NO: 748725 - DNA, 20 bp, mouse
gtggctgagacctcattggg

SEQ ID NO: 748726 - DNA, 20 bp, mouse
gtgggtaaaggggagtccca

SEQ ID NO: 748727 - DNA, 20 bp, mouse
gagccagccaggggtggcca

SEQ ID NO: 748728 - DNA, 20 bp, mouse
gggctccacccccgtcccct

SEQ ID NO: 748729 - DNA, 20 bp, mouse
gggggcaggaagcgagagtg

SEQ ID NO: 748730 - DNA, 20 bp, mouse
gtcctggcgcctgcgtagta

SEQ ID NO: 748731 - DNA, 20 bp, mouse
gtgggaggagtcataggtta

SEQ ID NO: 748732 - DNA, 20 bp, mouse
gcctcccaaaatagagtgtt

SEQ ID NO: 748733 - DNA, 20 bp, mouse
gcgtgcgctggagttgtacg

SEQ ID NO: 748734 - DNA, 20 bp, mouse
ggggagtcccatgggtccca

SEQ ID NO: 748735 - DNA, 20 bp, mouse
gtctcagaacccaggggacg

SEQ ID NO: 748736 - DNA, 20 bp, mouse
gcgcccgcctggccgagagg

SEQ ID NO: 748737 - DNA, 20 bp, mouse
gcaaccagggcgcctcctct

SEQ ID NO: 748738 - DNA, 20 bp, mouse
ggggcagcgccgagactcgg

SEQ ID NO: 748739 - DNA, 20 bp, mouse
gaggaggcgccctggttgcg

SEQ ID NO: 748740 - DNA, 20 bp, mouse
ggcgcggcgagaattgggag

SEQ ID NO: 748741 - DNA, 20 bp, mouse
gggacttccccgcgcaacca

SEQ ID NO: 748742 - DNA, 20 bp, mouse
gagggcgcctcctctcggcc

SEQ ID NO: 748743 - DNA, 20 bp, mouse
gcgggcgcaagctgcggagc

SEQ ID NO: 748744 - DNA, 20 bp, mouse
gctgtagcgcggcgagaatt

SEQ ID NO: 748745 - DNA, 20 bp, mouse
gccgagactcggaggccgta

SEQ ID NO: 748746 - DNA, 20 bp, mouse
ggcgtccggcgtgtcccgac

SEQ ID NO: 748747 - DNA, 20 bp, mouse
gcgcccgcacgccctccctc

SEQ ID NO: 748748 - DNA, 20 bp, mouse
ggcgcccggtcgggacacgc

SEQ ID NO: 748749 - DNA, 20 bp, mouse
ggagccgggtcacacccacc

SEQ ID NO: 748750 - DNA, 20 bp, mouse
gagactccgggtaacaaagt

SEQ ID NO: 748751 - DNA, 20 bp, mouse
gggaactgcaccccgagcga

SEQ ID NO: 748752 - DNA, 20 bp, mouse
gcccggctcgcgcgcccggt

SEQ ID NO: 748753 - DNA, 20 bp, mouse
gcgccggacgcgccagactc

SEQ ID NO: 748754 - DNA, 20 bp, mouse
gagggtggttgcagagggtg

SEQ ID NO: 748755 - DNA, 20 bp, mouse
gggcgagcggggccgggaac

SEQ ID NO: 748756 - DNA, 20 bp, mouse
gggcgagcgagcgagggcga

SEQ ID NO: 748757 - DNA, 20 bp, mouse
ggttccgcccgctctcccgg

SEQ ID NO: 748758 - DNA, 20 bp, mouse
ggccgggccaccatccgcgg

SEQ ID NO: 748759 - DNA, 20 bp, mouse
ggaccggcgccgctgaggag

SEQ ID NO: 748760 - DNA, 20 bp, mouse
gccctgctgaatattcacgc

SEQ ID NO: 748761 - DNA, 20 bp, mouse
ggtgaatattcagcaggggt

SEQ ID NO: 748762 - DNA, 20 bp, mouse
gcgggccgggccaccatccg

SEQ ID NO: 748763 - DNA, 20 bp, mouse
gtgcacgagcggcccggagc

SEQ ID NO: 748764 - DNA, 20 bp, mouse
ggtcgctcgcccctcctcag

SEQ ID NO: 748765 - DNA, 20 bp, mouse
gaggggtggggctcgaacaa

SEQ ID NO: 748766 - DNA, 20 bp, mouse
gggcccagactgccgccctg

SEQ ID NO: 748767 - DNA, 20 bp, mouse
ggaagcagaaggcagcgctc

SEQ ID NO: 748768 - DNA, 20 bp, mouse
gaatcctggccgaggctggg

SEQ ID NO: 748769 - DNA, 20 bp, mouse
gactgggcgaatcctggccg

SEQ ID NO: 748770 - DNA, 20 bp, mouse
gcgccccgcaagcagctggg

SEQ ID NO: 748771 - DNA, 20 bp, mouse
gcactcggcgggcctcaggg

SEQ ID NO: 748772 - DNA, 20 bp, mouse
ggccgcccgggcaggaggtg

SEQ ID NO: 748773 - DNA, 20 bp, mouse
gggcccgcggcctgcgttct

SEQ ID NO: 748774 - DNA, 20 bp, mouse
gggtggggaacgtggtgcgg

SEQ ID NO: 748775 - DNA, 20 bp, mouse
gtcaccgggagacacgttcg

SEQ ID NO: 748776 - DNA, 20 bp, mouse
gaaatcacctgctgtcgtca

SEQ ID NO: 748777 - DNA, 20 bp, mouse
gagcaagtcctcaggagctt

SEQ ID NO: 748778 - DNA, 20 bp, mouse
gacatgaagctggcaactca

SEQ ID NO: 748779 - DNA, 20 bp, mouse
gtgagccgcaaaaaagggtg

SEQ ID NO: 748780 - DNA, 20 bp, mouse
gtgcgcgccctgacgacagc

SEQ ID NO: 748781 - DNA, 20 bp, mouse
gacccagttctgctgttgcc

SEQ ID NO: 748782 - DNA, 20 bp, mouse
gagagaggagactcggttct

SEQ ID NO: 748783 - DNA, 20 bp, mouse
gttgggacttgaacctatca

SEQ ID NO: 748784 - DNA, 20 bp, mouse
gttaaaaaattagtattcat

SEQ ID NO: 748785 - DNA, 20 bp, mouse
ggggcgattttacgaaagag

SEQ ID NO: 748786 - DNA, 20 bp, mouse
gcgagagcgaggtcggaagg

SEQ ID NO: 748787 - DNA, 20 bp, mouse
ggcttcatcgagagcgaggt

SEQ ID NO: 748788 - DNA, 20 bp, mouse
gcatcgagagcgaggtcgga

SEQ ID NO: 748789 - DNA, 20 bp, mouse
gctcgctctcgatgaagccc

SEQ ID NO: 748790 - DNA, 20 bp, mouse
gagcaggcttagtgacggtg

SEQ ID NO: 748791 - DNA, 20 bp, mouse
ggccgccagagccttcttga

SEQ ID NO: 748792 - DNA, 20 bp, mouse
gactcagcgaccacccagag

SEQ ID NO: 748793 - DNA, 20 bp, mouse
gtgagctcagaaatcagacc

SEQ ID NO: 748794 - DNA, 20 bp, mouse
gtgcccgcaggccgtccttg

SEQ ID NO: 748795 - DNA, 20 bp, mouse
gcaggaccagagaactctgt

SEQ ID NO: 748796 - DNA, 20 bp, mouse
gggcccagacaggtgagcgg

SEQ ID NO: 748797 - DNA, 20 bp, mouse
gacgccgcacctgcccgcca

SEQ ID NO: 748798 - DNA, 20 bp, mouse
gcgctggcccgacgccgccg

SEQ ID NO: 748799 - DNA, 20 bp, mouse
ggcgccccgacggacgaggt

SEQ ID NO: 748800 - DNA, 20 bp, mouse
gcgggcaggtgcggcgtcgc

SEQ ID NO: 748801 - DNA, 20 bp, mouse
gaggtcggagctagtgtccc

SEQ ID NO: 748802 - DNA, 20 bp, mouse
gtagctccgacctcgtccgt

SEQ ID NO: 748803 - DNA, 20 bp, mouse
gaagccgccaggtcaccgtg

SEQ ID NO: 748804 - DNA, 20 bp, mouse
gcgcggcccagacaggtgag

SEQ ID NO: 748805 - DNA, 20 bp, mouse
gctcgctcgctcgggcgcgg

SEQ ID NO: 748806 - DNA, 20 bp, mouse
gcaccacgggcacaaccaga

SEQ ID NO: 748807 - DNA, 20 bp, mouse
gcagcccgggcggtacaata

SEQ ID NO: 748808 - DNA, 20 bp, mouse
gaggcggcggcgttccgagt

SEQ ID NO: 748809 - DNA, 20 bp, mouse
gcgggcggtacaatagggtt

SEQ ID NO: 748810 - DNA, 20 bp, mouse
ggccctgcggcgaccacaga

SEQ ID NO: 748811 - DNA, 20 bp, mouse
ggggcaaaggagcagaatcg

SEQ ID NO: 748812 - DNA, 20 bp, mouse
gcccgcgcacttggtacatt

SEQ ID NO: 748813 - DNA, 20 bp, mouse
ggtaccgcccgggctgggcc

SEQ ID NO: 748814 - DNA, 20 bp, mouse
gccgtactccatcactgcgg

SEQ ID NO: 748815 - DNA, 20 bp, mouse
gaggaccgacctcgggtagc

SEQ ID NO: 748816 - DNA, 20 bp, mouse
gggcgcgcgcacgcctgcgc

SEQ ID NO: 748817 - DNA, 20 bp, mouse
gagtgcgggagggtccggtg

SEQ ID NO: 748818 - DNA, 20 bp, mouse
gctcccggctcgcagcccct

SEQ ID NO: 748819 - DNA, 20 bp, mouse
gcctttcacagcagcccgag

SEQ ID NO: 748820 - DNA, 20 bp, mouse
gggccggcgcgcaaggtggg

SEQ ID NO: 748821 - DNA, 20 bp, mouse
ggcgcgccaagggaccgcac

SEQ ID NO: 748822 - DNA, 20 bp, mouse
ggctgtgaaaggcgcacccg

SEQ ID NO: 748823 - DNA, 20 bp, mouse
ggtggtgtgtgcggacactg

SEQ ID NO: 748824 - DNA, 20 bp, mouse
gcggcgagtgcgggagggtc

SEQ ID NO: 748825 - DNA, 20 bp, mouse
gcggagcccgtgcggtccct

SEQ ID NO: 748826 - DNA, 20 bp, mouse
gaccaaggaagtgacatcac

SEQ ID NO: 748827 - DNA, 20 bp, mouse
ggggacaaccgcacagacca

SEQ ID NO: 748828 - DNA, 20 bp, mouse
ggggcaatcaaggttccttg

SEQ ID NO: 748829 - DNA, 20 bp, mouse
ggaagtgacatcactggtgg

SEQ ID NO: 748830 - DNA, 20 bp, mouse
gccattgcacacaagctgat

SEQ ID NO: 748831 - DNA, 20 bp, mouse
gccggcggaaaggcggtgtt

SEQ ID NO: 748832 - DNA, 20 bp, mouse
gtggcgtgatggcagagggc

SEQ ID NO: 748833 - DNA, 20 bp, mouse
gaggcaacagcgtccccggg

SEQ ID NO: 748834 - DNA, 20 bp, mouse
gctctgagcaggggcaatca

SEQ ID NO: 748835 - DNA, 20 bp, mouse
gtgagtcagtgcagtgtcag

SEQ ID NO: 748836 - DNA, 20 bp, mouse
gacagtgggtgggactctgt

SEQ ID NO: 748837 - DNA, 20 bp, mouse
gcaagggcgtgcgtgttgat

SEQ ID NO: 748838 - DNA, 20 bp, mouse
gaggagcactgcggctgcgg

SEQ ID NO: 748839 - DNA, 20 bp, mouse
gcggcggaagcagcgaggtg

SEQ ID NO: 748840 - DNA, 20 bp, mouse
gagggcggagtctcgcgggt

SEQ ID NO: 748841 - DNA, 20 bp, mouse
gagagagggcggagtctcgc

SEQ ID NO: 748842 - DNA, 20 bp, mouse
ggtcccgtgtgagttcgttc

SEQ ID NO: 748843 - DNA, 20 bp, mouse
gagggaagggttcgcgtcga

SEQ ID NO: 748844 - DNA, 20 bp, mouse
gttcgcgtcgaagggcgcta

SEQ ID NO: 748845 - DNA, 20 bp, mouse
ggcggagtctcgcgggtcgg

SEQ ID NO: 748846 - DNA, 20 bp, mouse
gcccagagaggtctagggag

SEQ ID NO: 748847 - DNA, 20 bp, mouse
gcaaagcccagagaggtcta

SEQ ID NO: 748848 - DNA, 20 bp, mouse
gagaagcaggcttcggaact

SEQ ID NO: 748849 - DNA, 20 bp, mouse
gaaaggaaaaagtctatctg

SEQ ID NO: 748850 - DNA, 20 bp, mouse
ggagacggacagagggcttg

SEQ ID NO: 748851 - DNA, 20 bp, mouse
ggtgcagagctggagcagca

SEQ ID NO: 748852 - DNA, 20 bp, mouse
gttctggcaaaatgagaagc

SEQ ID NO: 748853 - DNA, 20 bp, mouse
gcgaattcagcgtgcggggg

SEQ ID NO: 748854 - DNA, 20 bp, mouse
gaccagaggagacggacaga

SEQ ID NO: 748855 - DNA, 20 bp, mouse
gacgctgaattcgcatattt

SEQ ID NO: 748856 - DNA, 20 bp, mouse
gtggcctgggacccggggaa

SEQ ID NO: 748857 - DNA, 20 bp, mouse
gaagctgtgcgtctgtctcc

SEQ ID NO: 748858 - DNA, 20 bp, mouse
gccccagcctggagaccgga

SEQ ID NO: 748859 - DNA, 20 bp, mouse
gaccggagggcggggaaacg

SEQ ID NO: 748860 - DNA, 20 bp, mouse
ggggactggcctgggacccg

SEQ ID NO: 748861 - DNA, 20 bp, mouse
gccctcggagaccgtgacaa

SEQ ID NO: 748862 - DNA, 20 bp, mouse
ggcctgcttccctcccatgg

SEQ ID NO: 748863 - DNA, 20 bp, mouse
gcacaaggcgccttcctcag

SEQ ID NO: 748864 - DNA, 20 bp, mouse
gggtggaggttgagggttcc

SEQ ID NO: 748865 - DNA, 20 bp, mouse
gtccccttcctcagaaatga

SEQ ID NO: 748866 - DNA, 20 bp, mouse
ggggccaagaagtctagcga

SEQ ID NO: 748867 - DNA, 20 bp, mouse
gaaacccgaggaggcctccg

SEQ ID NO: 748868 - DNA, 20 bp, mouse
gggcaggtggaccagacctg

SEQ ID NO: 748869 - DNA, 20 bp, mouse
gtcaggtcgagactgagcta

SEQ ID NO: 748870 - DNA, 20 bp, mouse
gcccctgcggaaacccgagg

SEQ ID NO: 748871 - DNA, 20 bp, mouse
gcaacgcctcctctcatctc

SEQ ID NO: 748872 - DNA, 20 bp, mouse
ggggcggaaggcttggaaag

SEQ ID NO: 748873 - DNA, 20 bp, mouse
gcgaggaggcctccggggtt

SEQ ID NO: 748874 - DNA, 20 bp, mouse
gagtctcgacctgagatgag

SEQ ID NO: 748875 - DNA, 20 bp, mouse
gagaatgggtccgacgttct

SEQ ID NO: 748876 - DNA, 20 bp, mouse
gcatcaccggcgaacgcccc

SEQ ID NO: 748877 - DNA, 20 bp, mouse
gccggggcgggaacgtacct

SEQ ID NO: 748878 - DNA, 20 bp, mouse
gtccggactccgcccatcac

SEQ ID NO: 748879 - DNA, 20 bp, mouse
gcgggaaaggggtgcctgcg

SEQ ID NO: 748880 - DNA, 20 bp, mouse
ggggcgggaggggaccgcgg

SEQ ID NO: 748881 - DNA, 20 bp, mouse
gcctgcagcaggtggctggt

SEQ ID NO: 748882 - DNA, 20 bp, mouse
gggcgttcgccggtgatggg

SEQ ID NO: 748883 - DNA, 20 bp, mouse
gggggggtgccctgcgggaa

SEQ ID NO: 748884 - DNA, 20 bp, mouse
ggaggctgcctagagactgt

SEQ ID NO: 748885 - DNA, 20 bp, mouse
gggaacgtacctgggcgagg

SEQ ID NO: 748886 - DNA, 20 bp, mouse
gaacctgcccacggggcggg

SEQ ID NO: 748887 - DNA, 20 bp, mouse
gctccccggggcgccaaggg

SEQ ID NO: 748888 - DNA, 20 bp, mouse
gtctcgcgagaagagggacg

SEQ ID NO: 748889 - DNA, 20 bp, mouse
ggggctccccggggcgccaa

SEQ ID NO: 748890 - DNA, 20 bp, mouse
ggcaggaactctcggggact

SEQ ID NO: 748891 - DNA, 20 bp, mouse
gcgcccgtgcgaccacagag

SEQ ID NO: 748892 - DNA, 20 bp, mouse
gggcagatctcgcgagaaga

SEQ ID NO: 748893 - DNA, 20 bp, mouse
gccgtgggcaggttccatat

SEQ ID NO: 748894 - DNA, 20 bp, mouse
gtggaacctgcccacggggc

SEQ ID NO: 748895 - DNA, 20 bp, mouse
gtccccgagagttcctgcct

SEQ ID NO: 748896 - DNA, 20 bp, mouse
gagaaaccgagtggagaggt

SEQ ID NO: 748897 - DNA, 20 bp, mouse
gctgactaggagaaaccgag

SEQ ID NO: 748898 - DNA, 20 bp, mouse
gggtggaggttgagctagga

SEQ ID NO: 748899 - DNA, 20 bp, mouse
gcacgtccaagggtacaagg

SEQ ID NO: 748900 - DNA, 20 bp, mouse
gttggacgtgcacaacccag

SEQ ID NO: 748901 - DNA, 20 bp, mouse
gcgcgcgtgcagcactgact

SEQ ID NO: 748902 - DNA, 20 bp, mouse
gtaggagaaaccgagtggag

SEQ ID NO: 748903 - DNA, 20 bp, mouse
gttggcaagatcagggtgtg

SEQ ID NO: 748904 - DNA, 20 bp, mouse
ggggtggtgtccatgctttt

SEQ ID NO: 748905 - DNA, 20 bp, mouse
ggcaaggggccaggaggtcg

SEQ ID NO: 748906 - DNA, 20 bp, mouse
ggggacatgctcaccctcca

SEQ ID NO: 748907 - DNA, 20 bp, mouse
ggaagagagtcctttaccct

SEQ ID NO: 748908 - DNA, 20 bp, mouse
gcacaacattggggcttgtc

SEQ ID NO: 748909 - DNA, 20 bp, mouse
gtctgggccctccaatccac

SEQ ID NO: 748910 - DNA, 20 bp, mouse
gttaccctgggaagactgaa

SEQ ID NO: 748911 - DNA, 20 bp, mouse
gcctgcctcaggtatacccc

SEQ ID NO: 748912 - DNA, 20 bp, mouse
gaagggtcctgtggattgga

SEQ ID NO: 748913 - DNA, 20 bp, mouse
ggcagcctgtctcaagacat

SEQ ID NO: 748914 - DNA, 20 bp, mouse
gctgaaagggtcctgtggat

SEQ ID NO: 748915 - DNA, 20 bp, mouse
gggaccctttcagtcttccc

SEQ ID NO: 748916 - DNA, 20 bp, mouse
gcccccgcggcactgaccgt

SEQ ID NO: 748917 - DNA, 20 bp, mouse
gcggcactgaccgtcggagg

SEQ ID NO: 748918 - DNA, 20 bp, mouse
gacgtcatccggcggggcga

SEQ ID NO: 748919 - DNA, 20 bp, mouse
ggggatgacgtcatccggcg

SEQ ID NO: 748920 - DNA, 20 bp, mouse
gggactggacggtggtgggg

SEQ ID NO: 748921 - DNA, 20 bp, mouse
gccggcggggcgacgggcat

SEQ ID NO: 748922 - DNA, 20 bp, mouse
gcccgcgccatggcaggtga

SEQ ID NO: 748923 - DNA, 20 bp, mouse
ggaaaaaattccctccccgg

SEQ ID NO: 748924 - DNA, 20 bp, mouse
gggacgcgcccagccgagcg

SEQ ID NO: 748925 - DNA, 20 bp, mouse
gccgcggcactgaccgtcgg

SEQ ID NO: 748926 - DNA, 20 bp, mouse
ggccctgcctgcagtttcgt

SEQ ID NO: 748927 - DNA, 20 bp, mouse
gtggaggcgcagtgcaagct

SEQ ID NO: 748928 - DNA, 20 bp, mouse
gcggccgcccacgaaactgc

SEQ ID NO: 748929 - DNA, 20 bp, mouse
gcggggcgggcggaaataac

SEQ ID NO: 748930 - DNA, 20 bp, mouse
ggggttgcggtgagcatcac

SEQ ID NO: 748931 - DNA, 20 bp, mouse
gaggcgcagtgcaagctggg

SEQ ID NO: 748932 - DNA, 20 bp, mouse
ggggaaacagcccaggctcc

SEQ ID NO: 748933 - DNA, 20 bp, mouse
gcgcccacgaaactgcaggc

SEQ ID NO: 748934 - DNA, 20 bp, mouse
gaactgcaggcagggccgcg

SEQ ID NO: 748935 - DNA, 20 bp, mouse
gcggccagggggtttccttt

SEQ ID NO: 748936 - DNA, 20 bp, mouse
gcggccccgcggtgacaggg

SEQ ID NO: 748937 - DNA, 20 bp, mouse
gtgacgtctcgggcccgcgc

SEQ ID NO: 748938 - DNA, 20 bp, mouse
gcaggctcgcccggcaggcg

SEQ ID NO: 748939 - DNA, 20 bp, mouse
gatgtgaggcaggtcttcaa

SEQ ID NO: 748940 - DNA, 20 bp, mouse
gtggggctgcagaactctct

SEQ ID NO: 748941 - DNA, 20 bp, mouse
gaaggaacagcgtaactagg

SEQ ID NO: 748942 - DNA, 20 bp, mouse
gtggccctcagtaatgctaa

SEQ ID NO: 748943 - DNA, 20 bp, mouse
ggggaaggaacagcgtaact

SEQ ID NO: 748944 - DNA, 20 bp, mouse
gtaaagtaccctagtggcca

SEQ ID NO: 748945 - DNA, 20 bp, mouse
ggaaagccgggtgcgcgccc

SEQ ID NO: 748946 - DNA, 20 bp, mouse
gggagccccagcaaccgcac

SEQ ID NO: 748947 - DNA, 20 bp, mouse
ggtccccggtgcggttgctg

SEQ ID NO: 748948 - DNA, 20 bp, mouse
gtccgggtctgggtcccagc

SEQ ID NO: 748949 - DNA, 20 bp, mouse
gggtctgggtcccagctgga

SEQ ID NO: 748950 - DNA, 20 bp, mouse
gtccggtcccggggcaacct

SEQ ID NO: 748951 - DNA, 20 bp, mouse
ggaccggacgtccacgcagg

SEQ ID NO: 748952 - DNA, 20 bp, mouse
gcaccggggaccatccagct

SEQ ID NO: 748953 - DNA, 20 bp, mouse
ggcaacctgggcttcccgct

SEQ ID NO: 748954 - DNA, 20 bp, mouse
gtccccgccgcagcaggtgg

SEQ ID NO: 748955 - DNA, 20 bp, mouse
gaagcccggtccttgaggaa

SEQ ID NO: 748956 - DNA, 20 bp, mouse
ggaggccgagtcacccgggc

SEQ ID NO: 748957 - DNA, 20 bp, mouse
gcccgcggcgcgcgcagtca

SEQ ID NO: 748958 - DNA, 20 bp, mouse
ggggcggtcggagctgcacg

SEQ ID NO: 748959 - DNA, 20 bp, mouse
gggtacgacactctgggcgg

SEQ ID NO: 748960 - DNA, 20 bp, mouse
ggcgggtcggggttacatgg

SEQ ID NO: 748961 - DNA, 20 bp, mouse
gagagggcgcggagagaagg

SEQ ID NO: 748962 - DNA, 20 bp, mouse
gtccggcgcgtgcggctccc

SEQ ID NO: 748963 - DNA, 20 bp, mouse
gactgcgcgcgccgcggggg

SEQ ID NO: 748964 - DNA, 20 bp, mouse
ggaccccggggaccgatccc

SEQ ID NO: 748965 - DNA, 20 bp, mouse
gaaccccgacccgccagaga

SEQ ID NO: 748966 - DNA, 20 bp, mouse
gcgcgcgcgcgtgattgaca

SEQ ID NO: 748967 - DNA, 20 bp, mouse
ggcgcccagctgtcccactc

SEQ ID NO: 748968 - DNA, 20 bp, mouse
gaaaggggtgggaacctcca

SEQ ID NO: 748969 - DNA, 20 bp, mouse
gggcggctcccgcccggagt

SEQ ID NO: 748970 - DNA, 20 bp, mouse
ggggtgatgcgtgctcctca

SEQ ID NO: 748971 - DNA, 20 bp, mouse
gggtcccggggcggccggtg

SEQ ID NO: 748972 - DNA, 20 bp, mouse
gtgcgtgagagcatggtgcg

SEQ ID NO: 748973 - DNA, 20 bp, mouse
gggagcacgcatcacccctt

SEQ ID NO: 748974 - DNA, 20 bp, mouse
ggtaaggcgtccagaacttc

SEQ ID NO: 748975 - DNA, 20 bp, mouse
gccagctgtcccactccggg

SEQ ID NO: 748976 - DNA, 20 bp, mouse
ggccgcgagcagcgtctggg

SEQ ID NO: 748977 - DNA, 20 bp, mouse
gtgggcgtggctacactggg

SEQ ID NO: 748978 - DNA, 20 bp, mouse
ggggccctgcgcgatgacgt

SEQ ID NO: 748979 - DNA, 20 bp, mouse
ggggccacgccctcgtaatc

SEQ ID NO: 748980 - DNA, 20 bp, mouse
gccgggggcccggattacga

SEQ ID NO: 748981 - DNA, 20 bp, mouse
gccggcgagcggcctagggg

SEQ ID NO: 748982 - DNA, 20 bp, mouse
gtggccccgcgacttgggcg

SEQ ID NO: 748983 - DNA, 20 bp, mouse
ggtagccacgcccaagtcgc

SEQ ID NO: 748984 - DNA, 20 bp, mouse
gggcggccgcgtgtgagggg

SEQ ID NO: 748985 - DNA, 20 bp, mouse
gggggggcgggctgcagtag

SEQ ID NO: 748986 - DNA, 20 bp, mouse
gaatgtccctgggatgtgta

SEQ ID NO: 748987 - DNA, 20 bp, mouse
ggtccctgggatgtgtaggg

SEQ ID NO: 748988 - DNA, 20 bp, mouse
gccagtgcttggaatgtccc

SEQ ID NO: 748989 - DNA, 20 bp, mouse
gggatgtgtagggaggccga

SEQ ID NO: 748990 - DNA, 20 bp, mouse
ggggaggccgaggggaccca

SEQ ID NO: 748991 - DNA, 20 bp, mouse
gcctagatcgagggcatcag

SEQ ID NO: 748992 - DNA, 20 bp, mouse
gcgaggggacccagggccac

SEQ ID NO: 748993 - DNA, 20 bp, mouse
gggcctccctacacatccca

SEQ ID NO: 748994 - DNA, 20 bp, mouse
gagagctggacctagatcga

SEQ ID NO: 748995 - DNA, 20 bp, mouse
gagcaactggggtaggaaaa

SEQ ID NO: 748996 - DNA, 20 bp, mouse
gtggtggtgagattctggtc

SEQ ID NO: 748997 - DNA, 20 bp, mouse
gagcgtggaataggcgagaa

SEQ ID NO: 748998 - DNA, 20 bp, mouse
ggtcgagccgagaaaggatg

SEQ ID NO: 748999 - DNA, 20 bp, mouse
gggtggaagcagagacacgc

SEQ ID NO: 749000 - DNA, 20 bp, mouse
gagccgcgccgcaggggtga

SEQ ID NO: 749001 - DNA, 20 bp, mouse
gcacgagcagtccacctccc

SEQ ID NO: 749002 - DNA, 20 bp, mouse
ggaggtggactgctcgtgga

SEQ ID NO: 749003 - DNA, 20 bp, mouse
gggcttgcgtggtcctagcg

SEQ ID NO: 749004 - DNA, 20 bp, mouse
gagaaaggatgcgggatgcg

SEQ ID NO: 749005 - DNA, 20 bp, mouse
ggcaggagccgagagaggtg

SEQ ID NO: 749006 - DNA, 20 bp, mouse
ggacgctaaaggaacgtttc

SEQ ID NO: 749007 - DNA, 20 bp, mouse
ggctcggggcggaactggat

SEQ ID NO: 749008 - DNA, 20 bp, mouse
gaaggcgctcggggcggaac

SEQ ID NO: 749009 - DNA, 20 bp, mouse
gcatgtcgcgtgaacgttga

SEQ ID NO: 749010 - DNA, 20 bp, mouse
gggacgtagctcagtctgat

SEQ ID NO: 749011 - DNA, 20 bp, mouse
ggtcgcgtgaacgttgaggg

SEQ ID NO: 749012 - DNA, 20 bp, mouse
gccgagcgccttgacgctaa

SEQ ID NO: 749013 - DNA, 20 bp, mouse
ggcgttgctggtggctcttg

SEQ ID NO: 749014 - DNA, 20 bp, mouse
gcagtctgattggagtgacc

SEQ ID NO: 749015 - DNA, 20 bp, mouse
gcaggcgggacttccggcaa

SEQ ID NO: 749016 - DNA, 20 bp, mouse
gaggctgggcagtacgggcg

SEQ ID NO: 749017 - DNA, 20 bp, mouse
gggggcgccactctgcacta

SEQ ID NO: 749018 - DNA, 20 bp, mouse
gtacgggcgtggctggaggc

SEQ ID NO: 749019 - DNA, 20 bp, mouse
gtgggcaaggctgggcagta

SEQ ID NO: 749020 - DNA, 20 bp, mouse
gagaactaggatatccagac

SEQ ID NO: 749021 - DNA, 20 bp, mouse
gcagagtggcgccccctagg

SEQ ID NO: 749022 - DNA, 20 bp, mouse
ggcagtacgggcgtggctgg

SEQ ID NO: 749023 - DNA, 20 bp, mouse
gctggaggctgggtgtgggc

SEQ ID NO: 749024 - DNA, 20 bp, mouse
gcagacggcgagccgcctag

SEQ ID NO: 749025 - DNA, 20 bp, mouse
gtggatgccctagtgcagag

SEQ ID NO: 749026 - DNA, 20 bp, mouse
gacaaggggcgggaactggt

SEQ ID NO: 749027 - DNA, 20 bp, mouse
gcctcccgggggcgggacaa

SEQ ID NO: 749028 - DNA, 20 bp, mouse
gcgggacaaggggcgggaac

SEQ ID NO: 749029 - DNA, 20 bp, mouse
gggtacgcggggtacggttc

SEQ ID NO: 749030 - DNA, 20 bp, mouse
ggcactgcgtccccagccaa

SEQ ID NO: 749031 - DNA, 20 bp, mouse
gctgctccagaaacggccaa

SEQ ID NO: 749032 - DNA, 20 bp, mouse
gccgggggcgggacaagggg

SEQ ID NO: 749033 - DNA, 20 bp, mouse
gacgagaagtcgctgcctcc

SEQ ID NO: 749034 - DNA, 20 bp, mouse
gtgctgcccttggccgtttc

SEQ ID NO: 749035 - DNA, 20 bp, mouse
gggcagcgacttctcgttcc

SEQ ID NO: 749036 - DNA, 20 bp, mouse
gcaagcagctggaggagtga

SEQ ID NO: 749037 - DNA, 20 bp, mouse
ggagcaagcgggcttgtgga

SEQ ID NO: 749038 - DNA, 20 bp, mouse
gccggcccgggttaagaact

SEQ ID NO: 749039 - DNA, 20 bp, mouse
ggatctagaagacaggtcat

SEQ ID NO: 749040 - DNA, 20 bp, mouse
gggggaggggtgggccttaa

SEQ ID NO: 749041 - DNA, 20 bp, mouse
gtaaaggggaggaagtccag

SEQ ID NO: 749042 - DNA, 20 bp, mouse
gttagggactgcgagcaagc

SEQ ID NO: 749043 - DNA, 20 bp, mouse
ggactgggaggcgtggacat

SEQ ID NO: 749044 - DNA, 20 bp, mouse
gccttaaaggggaggatcga

SEQ ID NO: 749045 - DNA, 20 bp, mouse
gaaaggggaggatcgagggt

SEQ ID NO: 749046 - DNA, 20 bp, mouse
gcaggccagggcagagcccc

SEQ ID NO: 749047 - DNA, 20 bp, mouse
gttaaagggccaggctagtc

SEQ ID NO: 749048 - DNA, 20 bp, mouse
gcggcgagactctgggtcca

SEQ ID NO: 749049 - DNA, 20 bp, mouse
gaggctggtacaacagttga

SEQ ID NO: 749050 - DNA, 20 bp, mouse
gtgccctggcctgcccaacc

SEQ ID NO: 749051 - DNA, 20 bp, mouse
gcccgctaggtcaaccttaa

SEQ ID NO: 749052 - DNA, 20 bp, mouse
gaggtcaaccttaaagggcc

SEQ ID NO: 749053 - DNA, 20 bp, mouse
gtcagaggcggagtctgcca

SEQ ID NO: 749054 - DNA, 20 bp, mouse
gggccaggctagtccgggtt

SEQ ID NO: 749055 - DNA, 20 bp, mouse
ggggtcacgtgggacgcggg

SEQ ID NO: 749056 - DNA, 20 bp, mouse
ggcgcgccccggggacgacc

SEQ ID NO: 749057 - DNA, 20 bp, mouse
gtcacccagcgccacgtcag

SEQ ID NO: 749058 - DNA, 20 bp, mouse
gtggcctgccgaaagagaag

SEQ ID NO: 749059 - DNA, 20 bp, mouse
gcgccagccgggtcgtcccc

SEQ ID NO: 749060 - DNA, 20 bp, mouse
ggggaaagcctcagaaaggc

SEQ ID NO: 749061 - DNA, 20 bp, mouse
gacgtcagtggaaggcccgg

SEQ ID NO: 749062 - DNA, 20 bp, mouse
ggccccggggacgacccggc

SEQ ID NO: 749063 - DNA, 20 bp, mouse
gggcgcgccgcacgcagcac

SEQ ID NO: 749064 - DNA, 20 bp, mouse
gaaagcctcagaaaggccgg

SEQ ID NO: 749065 - DNA, 20 bp, mouse
ggggaagtgggatggtaacg

SEQ ID NO: 749066 - DNA, 20 bp, mouse
ggagggcggggcctagtaaa

SEQ ID NO: 749067 - DNA, 20 bp, mouse
gtggcagattggttcccgat

SEQ ID NO: 749068 - DNA, 20 bp, mouse
ggcctatgggggcggaacca

SEQ ID NO: 749069 - DNA, 20 bp, mouse
ggtaaagggggtgcggtctg

SEQ ID NO: 749070 - DNA, 20 bp, mouse
gtggacgactgatgcctatg

SEQ ID NO: 749071 - DNA, 20 bp, mouse
gtggtgggcctaggagatta

SEQ ID NO: 749072 - DNA, 20 bp, mouse
gaaaacgcgaactagagcct

SEQ ID NO: 749073 - DNA, 20 bp, mouse
gaccaagaacgcagaggtct

SEQ ID NO: 749074 - DNA, 20 bp, mouse
gccgagctgcgctgggaggg

SEQ ID NO: 749075 - DNA, 20 bp, mouse
ggggtaccgctcctaaagga

SEQ ID NO: 749076 - DNA, 20 bp, mouse
gggcggggagcaagcctgtt

SEQ ID NO: 749077 - DNA, 20 bp, mouse
gcgacagctggcatgcccgg

SEQ ID NO: 749078 - DNA, 20 bp, mouse
gaagcattcggccccgcctc

SEQ ID NO: 749079 - DNA, 20 bp, mouse
gtcacggcggggtgcgtgtg

SEQ ID NO: 749080 - DNA, 20 bp, mouse
gagcaagcctgttgggcacg

SEQ ID NO: 749081 - DNA, 20 bp, mouse
gccgtgacgcgccgacgcag

SEQ ID NO: 749082 - DNA, 20 bp, mouse
gcgaatgcttgatcgacagc

SEQ ID NO: 749083 - DNA, 20 bp, mouse
gcagaggactcacacgtcat

SEQ ID NO: 749084 - DNA, 20 bp, mouse
gcagctggcatgcccggggg

SEQ ID NO: 749085 - DNA, 20 bp, mouse
ggccagtccgtctctataaa

SEQ ID NO: 749086 - DNA, 20 bp, mouse
gcaggcgccctgacgtggga

SEQ ID NO: 749087 - DNA, 20 bp, mouse
gaggcaagctgacgagttag

SEQ ID NO: 749088 - DNA, 20 bp, mouse
ggctgcaggcgccctgacgt

SEQ ID NO: 749089 - DNA, 20 bp, mouse
gcaaggggctggccggcatc

SEQ ID NO: 749090 - DNA, 20 bp, mouse
gcagcgcagcaagagcgccc

SEQ ID NO: 749091 - DNA, 20 bp, mouse
gacgagttagcgggttgcta

SEQ ID NO: 749092 - DNA, 20 bp, mouse
gtggggaagctccaaggcct

SEQ ID NO: 749093 - DNA, 20 bp, mouse
gaggaagagccattcgaatt

SEQ ID NO: 749094 - DNA, 20 bp, mouse
ggccacgccctcccacgtca

SEQ ID NO: 749095 - DNA, 20 bp, mouse
gaagctccaaggcctcggac

SEQ ID NO: 749096 - DNA, 20 bp, mouse
ggggacccataggtacgagg

SEQ ID NO: 749097 - DNA, 20 bp, mouse
gtagagaccccagctgggga

SEQ ID NO: 749098 - DNA, 20 bp, mouse
ggaggggacccataggtacg

SEQ ID NO: 749099 - DNA, 20 bp, mouse
gaggtggaggtggttcgctg

SEQ ID NO: 749100 - DNA, 20 bp, mouse
gcataggtacgaggtggagg

SEQ ID NO: 749101 - DNA, 20 bp, mouse
gcctccacccggggaagagg

SEQ ID NO: 749102 - DNA, 20 bp, mouse
gcaccctccacccggggaag

SEQ ID NO: 749103 - DNA, 20 bp, mouse
gccaagggggctctcccgag

SEQ ID NO: 749104 - DNA, 20 bp, mouse
gtacctgcaccctccacccg

SEQ ID NO: 749105 - DNA, 20 bp, mouse
gccaccgtcagagtccactc

SEQ ID NO: 749106 - DNA, 20 bp, mouse
ggctaggacgaggtagaggt

SEQ ID NO: 749107 - DNA, 20 bp, mouse
gcgcaggcgcgatgcggccg

SEQ ID NO: 749108 - DNA, 20 bp, mouse
gggggacgagagcactgcgc

SEQ ID NO: 749109 - DNA, 20 bp, mouse
ggcaaccgggcggccagaag

SEQ ID NO: 749110 - DNA, 20 bp, mouse
gtacctcgtcctagcaatgg

SEQ ID NO: 749111 - DNA, 20 bp, mouse
ggttgctatggcgatctaga

SEQ ID NO: 749112 - DNA, 20 bp, mouse
gccgtctccaggcaaccggg

SEQ ID NO: 749113 - DNA, 20 bp, mouse
ggggctgttcccagttgcca

SEQ ID NO: 749114 - DNA, 20 bp, mouse
gcgccgccattgctaggacg

SEQ ID NO: 749115 - DNA, 20 bp, mouse
gctgactggtaaacggacgg

SEQ ID NO: 749116 - DNA, 20 bp, mouse
gtggaccccgcggggaccga

SEQ ID NO: 749117 - DNA, 20 bp, mouse
gccctagcggtcggaagggg

SEQ ID NO: 749118 - DNA, 20 bp, mouse
gggagcgcgaacctccctag

SEQ ID NO: 749119 - DNA, 20 bp, mouse
gaacctccctaggggagggg

SEQ ID NO: 749120 - DNA, 20 bp, mouse
gcggagagaggagggttgag

SEQ ID NO: 749121 - DNA, 20 bp, mouse
gcgccccctagcggtcggaa

SEQ ID NO: 749122 - DNA, 20 bp, mouse
ggggagggaagcgcggagag

SEQ ID NO: 749123 - DNA, 20 bp, mouse
ggcgaacctccctaggggag

SEQ ID NO: 749124 - DNA, 20 bp, mouse
ggcgtgcgccccctagcggt

SEQ ID NO: 749125 - DNA, 20 bp, mouse
gggacccctggactagacaa

SEQ ID NO: 749126 - DNA, 20 bp, mouse
gggagagggtcagcgaggga

SEQ ID NO: 749127 - DNA, 20 bp, mouse
ggggaaggcagcggaaagta

SEQ ID NO: 749128 - DNA, 20 bp, mouse
gcctgggagagggtcagcga

SEQ ID NO: 749129 - DNA, 20 bp, mouse
gccgaagggggggaaggcag

SEQ ID NO: 749130 - DNA, 20 bp, mouse
ggagccaccacctcccgccc

SEQ ID NO: 749131 - DNA, 20 bp, mouse
gggcagcggaaagtaggggc

SEQ ID NO: 749132 - DNA, 20 bp, mouse
gaatagctgcagcccaggat

SEQ ID NO: 749133 - DNA, 20 bp, mouse
gggcctgggcctgagcccaa

SEQ ID NO: 749134 - DNA, 20 bp, mouse
gcgaatgaagatgcacaatt

SEQ ID NO: 749135 - DNA, 20 bp, mouse
ggagggaccgaaggggggga

SEQ ID NO: 749136 - DNA, 20 bp, mouse
ggggggagggatcactttaa

SEQ ID NO: 749137 - DNA, 20 bp, mouse
gccatcgcgggtgacagcgt

SEQ ID NO: 749138 - DNA, 20 bp, mouse
gtgtcacccgcgatgggcgt

SEQ ID NO: 749139 - DNA, 20 bp, mouse
gacgtccagatcagtgtcgg

SEQ ID NO: 749140 - DNA, 20 bp, mouse
gcgcgggtgacagcgtgggg

SEQ ID NO: 749141 - DNA, 20 bp, mouse
ggcctggcccacgcccatcg

SEQ ID NO: 749142 - DNA, 20 bp, mouse
gggagggatcactttaaagg

SEQ ID NO: 749143 - DNA, 20 bp, mouse
gggctccgccgacactgatc

SEQ ID NO: 749144 - DNA, 20 bp, mouse
gttgaagagtcatgggggga

SEQ ID NO: 749145 - DNA, 20 bp, mouse
ggtagcaggttgaagagtca

SEQ ID NO: 749146 - DNA, 20 bp, mouse
gagtggccaaacacactgaa

SEQ ID NO: 749147 - DNA, 20 bp, mouse
gcctcccctaagagcatcat

SEQ ID NO: 749148 - DNA, 20 bp, mouse
gggtgctccacagactccta

SEQ ID NO: 749149 - DNA, 20 bp, mouse
gggagtattacattctcaga

SEQ ID NO: 749150 - DNA, 20 bp, mouse
gtctcccatgatgctcttag

SEQ ID NO: 749151 - DNA, 20 bp, mouse
gtctgcaggagggtttctca

SEQ ID NO: 749152 - DNA, 20 bp, mouse
gcagggcgagtgaagccata

SEQ ID NO: 749153 - DNA, 20 bp, mouse
gtggatctaaataaaaaagg

SEQ ID NO: 749154 - DNA, 20 bp, mouse
gaaggaaacccaggtctcac

SEQ ID NO: 749155 - DNA, 20 bp, mouse
gaggatatgaacagttctgc

SEQ ID NO: 749156 - DNA, 20 bp, mouse
ggggtcctgagtccacacgt

SEQ ID NO: 749157 - DNA, 20 bp, mouse
ggcgagggaacgtggatcgt

SEQ ID NO: 749158 - DNA, 20 bp, mouse
gtggggcagggctacggccc

SEQ ID NO: 749159 - DNA, 20 bp, mouse
gaacgtggatcgtgggggtg

SEQ ID NO: 749160 - DNA, 20 bp, mouse
gcggcagagccgcccacgtg

SEQ ID NO: 749161 - DNA, 20 bp, mouse
gcggctctgccggttgccgt

SEQ ID NO: 749162 - DNA, 20 bp, mouse
gcctgtgccgctagtcgcga

SEQ ID NO: 749163 - DNA, 20 bp, mouse
ggttgccgtgggaacgagaa

SEQ ID NO: 749164 - DNA, 20 bp, mouse
ggccgcccacgtgtggactc

SEQ ID NO: 749165 - DNA, 20 bp, mouse
ggaaaggaaagcagtgatgg

SEQ ID NO: 749166 - DNA, 20 bp, mouse
gactaaggagagcaggaata

SEQ ID NO: 749167 - DNA, 20 bp, mouse
ggactgagacaccctgacta

SEQ ID NO: 749168 - DNA, 20 bp, mouse
gaaggagacagcatgtacac

SEQ ID NO: 749169 - DNA, 20 bp, mouse
gcaccctgactaaggagagc

SEQ ID NO: 749170 - DNA, 20 bp, mouse
gagcgagcattgcaagaaaa

SEQ ID NO: 749171 - DNA, 20 bp, mouse
gtgtctcagtctgaattccc

SEQ ID NO: 749172 - DNA, 20 bp, mouse
gttcctgctctccttagtca

SEQ ID NO: 749173 - DNA, 20 bp, mouse
ggtgtgatacttttagagac

SEQ ID NO: 749174 - DNA, 20 bp, mouse
gcatctgtgaaatttcaatg

SEQ ID NO: 749175 - DNA, 20 bp, mouse
gaaagcacttctttcaggtc

SEQ ID NO: 749176 - DNA, 20 bp, mouse
ggtaccgcgcgcttctgcga

SEQ ID NO: 749177 - DNA, 20 bp, mouse
gcaagtcgtgcgtgagagag

SEQ ID NO: 749178 - DNA, 20 bp, mouse
ggaatcccccagttccagca

SEQ ID NO: 749179 - DNA, 20 bp, mouse
gggaacaagcactggactgg

SEQ ID NO: 749180 - DNA, 20 bp, mouse
gcggcccggggcggggttag

SEQ ID NO: 749181 - DNA, 20 bp, mouse
ggccgctcacgtcggttccg

SEQ ID NO: 749182 - DNA, 20 bp, mouse
ggaggaccctgctggaactg

SEQ ID NO: 749183 - DNA, 20 bp, mouse
ggccccggaaccgacgtgag

SEQ ID NO: 749184 - DNA, 20 bp, mouse
gaaccgacgtgagcggcccg

SEQ ID NO: 749185 - DNA, 20 bp, mouse
gtgcgaggggcaatccgccc

SEQ ID NO: 749186 - DNA, 20 bp, mouse
gatgaggcggggtccatttt

SEQ ID NO: 749187 - DNA, 20 bp, mouse
gtggagccagaacgcagcag

SEQ ID NO: 749188 - DNA, 20 bp, mouse
gttgaaggccccaccttctt

SEQ ID NO: 749189 - DNA, 20 bp, mouse
ggaggagctgggatgaggcg

SEQ ID NO: 749190 - DNA, 20 bp, mouse
ggcggggcgtgtatgctgat

SEQ ID NO: 749191 - DNA, 20 bp, mouse
gcacgccccgcccaagaagg

SEQ ID NO: 749192 - DNA, 20 bp, mouse
gagccagaacgcagcagggg

SEQ ID NO: 749193 - DNA, 20 bp, mouse
gctacagccagagattggga

SEQ ID NO: 749194 - DNA, 20 bp, mouse
gcgcggggcctggaccgccc

SEQ ID NO: 749195 - DNA, 20 bp, mouse
gcaagtctacagccagagat

SEQ ID NO: 749196 - DNA, 20 bp, mouse
gggcctatgtgcctatgagt

SEQ ID NO: 749197 - DNA, 20 bp, mouse
gcacccactcataggcacat

SEQ ID NO: 749198 - DNA, 20 bp, mouse
gcaggtgttcataactcttg

SEQ ID NO: 749199 - DNA, 20 bp, mouse
gtttgcacacacccactcat

SEQ ID NO: 749200 - DNA, 20 bp, mouse
gctggatggttaatggaaaa

SEQ ID NO: 749201 - DNA, 20 bp, mouse
gagaaaacagttaacttggc

SEQ ID NO: 749202 - DNA, 20 bp, mouse
gatggaaaatggagaattat

SEQ ID NO: 749203 - DNA, 20 bp, mouse
ggtcaggagctctgctttct

SEQ ID NO: 749204 - DNA, 20 bp, mouse
gcaaagacttattgcatctc

SEQ ID NO: 749205 - DNA, 20 bp, mouse
gtgctgtcttgttcataagc

SEQ ID NO: 749206 - DNA, 20 bp, mouse
gtggacagggagcttacgaa

SEQ ID NO: 749207 - DNA, 20 bp, mouse
gaagcggtgagagggacgaa

SEQ ID NO: 749208 - DNA, 20 bp, mouse
ggctgagggaagcggtgaga

SEQ ID NO: 749209 - DNA, 20 bp, mouse
gcggtgagagggacgaacgg

SEQ ID NO: 749210 - DNA, 20 bp, mouse
gtctatctgggaaaagacat

SEQ ID NO: 749211 - DNA, 20 bp, mouse
gagaaggagggatttaggag

SEQ ID NO: 749212 - DNA, 20 bp, mouse
gcacccgaattctttctatc

SEQ ID NO: 749213 - DNA, 20 bp, mouse
gagagggacgaacggtggac

SEQ ID NO: 749214 - DNA, 20 bp, mouse
gaggaggcagaatgggaact

SEQ ID NO: 749215 - DNA, 20 bp, mouse
gtcacttggtagctttagaa

SEQ ID NO: 749216 - DNA, 20 bp, mouse
ggggacaagacgcggagaag

SEQ ID NO: 749217 - DNA, 20 bp, mouse
gcgcgccggggtcacgacgc

SEQ ID NO: 749218 - DNA, 20 bp, mouse
gagaggctgcacagcccgcc

SEQ ID NO: 749219 - DNA, 20 bp, mouse
gaccccggcgcgcacggagg

SEQ ID NO: 749220 - DNA, 20 bp, mouse
gctctagcggggacggtccg

SEQ ID NO: 749221 - DNA, 20 bp, mouse
gcggggtcacgacgcagggg

SEQ ID NO: 749222 - DNA, 20 bp, mouse
gggcacggcggcgggggtcc

SEQ ID NO: 749223 - DNA, 20 bp, mouse
gcggcccggcgtacttgacc

SEQ ID NO: 749224 - DNA, 20 bp, mouse
ggccccggcggtccatggac

SEQ ID NO: 749225 - DNA, 20 bp, mouse
gtcggcgccccggcggtcca

SEQ ID NO: 749226 - DNA, 20 bp, mouse
gacggcctgactggtggcga

SEQ ID NO: 749227 - DNA, 20 bp, mouse
ggcagccttcgccaccagtc

SEQ ID NO: 749228 - DNA, 20 bp, mouse
ggtgcgaaacacggcctgac

SEQ ID NO: 749229 - DNA, 20 bp, mouse
ggcggcaggcacctcgcgga

SEQ ID NO: 749230 - DNA, 20 bp, mouse
gccggcgcgagcgcgagcga

SEQ ID NO: 749231 - DNA, 20 bp, mouse
gcaggcacctcgcggagggg

SEQ ID NO: 749232 - DNA, 20 bp, mouse
ggcggggcgcgcggcggaaa

SEQ ID NO: 749233 - DNA, 20 bp, mouse
gagaaagcgagcgccgggga

SEQ ID NO: 749234 - DNA, 20 bp, mouse
gcgaaacacggcctgactgg

SEQ ID NO: 749235 - DNA, 20 bp, mouse
ggcaggcggcaggcacctcg

SEQ ID NO: 749236 - DNA, 20 bp, mouse
gcccccgaggcggccctcaa

SEQ ID NO: 749237 - DNA, 20 bp, mouse
ggtaagcggccgcagacggt

SEQ ID NO: 749238 - DNA, 20 bp, mouse
gtgactgcggcagccgttga

SEQ ID NO: 749239 - DNA, 20 bp, mouse
gtcagagcaccaccccgcgg

SEQ ID NO: 749240 - DNA, 20 bp, mouse
ggacgtgccccgccgcgggg

SEQ ID NO: 749241 - DNA, 20 bp, mouse
ggggaagctgcgaggcgcca

SEQ ID NO: 749242 - DNA, 20 bp, mouse
gcgtctgcggccgcttaccg

SEQ ID NO: 749243 - DNA, 20 bp, mouse
gctcgcagcttcccccgagg

SEQ ID NO: 749244 - DNA, 20 bp, mouse
ggcacgtcgccgaccgtctg

SEQ ID NO: 749245 - DNA, 20 bp, mouse
gtgcgaggcgccacggtaag

SEQ ID NO: 749246 - DNA, 20 bp, mouse
gggtgcgctagcaaatgaag

SEQ ID NO: 749247 - DNA, 20 bp, mouse
gcggcggccgcctggtagac

SEQ ID NO: 749248 - DNA, 20 bp, mouse
gcgctgggaaggcggggtag

SEQ ID NO: 749249 - DNA, 20 bp, mouse
gccgcctggtagactggcgc

SEQ ID NO: 749250 - DNA, 20 bp, mouse
gcacccagcgccagtctacc

SEQ ID NO: 749251 - DNA, 20 bp, mouse
gtggcgctgggtgaggctgc

SEQ ID NO: 749252 - DNA, 20 bp, mouse
gtagagaaaggtaaaccttc

SEQ ID NO: 749253 - DNA, 20 bp, mouse
gcgagaggacgccgactgac

SEQ ID NO: 749254 - DNA, 20 bp, mouse
gcaggctaaaagcgttgctt

SEQ ID NO: 749255 - DNA, 20 bp, mouse
gtcagagtctctctaggtta

SEQ ID NO: 749256 - DNA, 20 bp, mouse
gaacgaaggggagtgtgtac

SEQ ID NO: 749257 - DNA, 20 bp, mouse
gtgtaccggggtggaagaat

SEQ ID NO: 749258 - DNA, 20 bp, mouse
gtgtgcgagacgcgggagga

SEQ ID NO: 749259 - DNA, 20 bp, mouse
ggagaggagtggccaacgaa

SEQ ID NO: 749260 - DNA, 20 bp, mouse
ggggcgagtgtgcgagacgc

SEQ ID NO: 749261 - DNA, 20 bp, mouse
gggagccggggagccggtga

SEQ ID NO: 749262 - DNA, 20 bp, mouse
gcgagtgtgcgagacgcggg

SEQ ID NO: 749263 - DNA, 20 bp, mouse
gagggagtcgggtgtgagga

SEQ ID NO: 749264 - DNA, 20 bp, mouse
gcacctgctcgtgctgggca

SEQ ID NO: 749265 - DNA, 20 bp, mouse
gccggggagccggtgaggga

SEQ ID NO: 749266 - DNA, 20 bp, mouse
gcccaagtgcacagatgaat

SEQ ID NO: 749267 - DNA, 20 bp, mouse
gggagggggtacttatggat

SEQ ID NO: 749268 - DNA, 20 bp, mouse
gcatctgtgcacttgggcgt

SEQ ID NO: 749269 - DNA, 20 bp, mouse
gctgcgctccgggcgaacaa

SEQ ID NO: 749270 - DNA, 20 bp, mouse
ggcacacaaagcagggggcg

SEQ ID NO: 749271 - DNA, 20 bp, mouse
gcgcggctccattgttcgcc

SEQ ID NO: 749272 - DNA, 20 bp, mouse
ggggctcgcgggcgctgacg

SEQ ID NO: 749273 - DNA, 20 bp, mouse
gtggagccgcgctttgcaaa

SEQ ID NO: 749274 - DNA, 20 bp, mouse
gaaacacacgggaaagatgg

SEQ ID NO: 749275 - DNA, 20 bp, mouse
ggcgcgccgcacacaaagca

SEQ ID NO: 749276 - DNA, 20 bp, mouse
ggggcaagtagggttcagtg

SEQ ID NO: 749277 - DNA, 20 bp, mouse
gaatgagagaggttcccggt

SEQ ID NO: 749278 - DNA, 20 bp, mouse
ggctgtgcggccaccctggg

SEQ ID NO: 749279 - DNA, 20 bp, mouse
gtatgagttaggctgaaagt

SEQ ID NO: 749280 - DNA, 20 bp, mouse
ggcactgcccactgcacgag

SEQ ID NO: 749281 - DNA, 20 bp, mouse
gtcggtccgggagatggact

SEQ ID NO: 749282 - DNA, 20 bp, mouse
gcccgcctccaccccggatt

SEQ ID NO: 749283 - DNA, 20 bp, mouse
gtctggttcccccatcactt

SEQ ID NO: 749284 - DNA, 20 bp, mouse
ggggacgaccaggggcaagt

SEQ ID NO: 749285 - DNA, 20 bp, mouse
gtgggcagtgccaagctgtc

SEQ ID NO: 749286 - DNA, 20 bp, mouse
gtcagcctgaagtgggtcag

SEQ ID NO: 749287 - DNA, 20 bp, mouse
gaagggcctggggacatgga

SEQ ID NO: 749288 - DNA, 20 bp, mouse
gggggaagctgcctgttatg

SEQ ID NO: 749289 - DNA, 20 bp, mouse
gatggggaattgaagaagtt

SEQ ID NO: 749290 - DNA, 20 bp, mouse
ggatgaactcagcctgaagt

SEQ ID NO: 749291 - DNA, 20 bp, mouse
gcacatgtgaaactgttgtg

SEQ ID NO: 749292 - DNA, 20 bp, mouse
gtttcctggctgtggggacc

SEQ ID NO: 749293 - DNA, 20 bp, mouse
ggtagctaactggatctgga

SEQ ID NO: 749294 - DNA, 20 bp, mouse
gaaagaccctccatgtcccc

SEQ ID NO: 749295 - DNA, 20 bp, mouse
gactggatctggatggatgc

SEQ ID NO: 749296 - DNA, 20 bp, mouse
ggctactggaggaagcgact

SEQ ID NO: 749297 - DNA, 20 bp, mouse
ggactgggcggagtggggac

SEQ ID NO: 749298 - DNA, 20 bp, mouse
gactggaggaagcgactggg

SEQ ID NO: 749299 - DNA, 20 bp, mouse
ggaaagggagcggccatagg

SEQ ID NO: 749300 - DNA, 20 bp, mouse
gctgggaatgggcggagaaa

SEQ ID NO: 749301 - DNA, 20 bp, mouse
ggaatgggcggggctactgg

SEQ ID NO: 749302 - DNA, 20 bp, mouse
gcggggcgaaagaaaagact

SEQ ID NO: 749303 - DNA, 20 bp, mouse
ggagaaatacgcggaggcga

SEQ ID NO: 749304 - DNA, 20 bp, mouse
gggtggagccagaaagggga

SEQ ID NO: 749305 - DNA, 20 bp, mouse
gggaagcgactgggcggagt

SEQ ID NO: 749306 - DNA, 20 bp, mouse
gcgcccgccggaggttctga

SEQ ID NO: 749307 - DNA, 20 bp, mouse
gccggaggttctgaggggac

SEQ ID NO: 749308 - DNA, 20 bp, mouse
gaggggacaggctgatccgc

SEQ ID NO: 749309 - DNA, 20 bp, mouse
gcggccccgcatccctaatg

SEQ ID NO: 749310 - DNA, 20 bp, mouse
ggacaggctgatccgcgggt

SEQ ID NO: 749311 - DNA, 20 bp, mouse
gcggcggccgccaagagcct

SEQ ID NO: 749312 - DNA, 20 bp, mouse
gggccaagtggagagtagga

SEQ ID NO: 749313 - DNA, 20 bp, mouse
gctggcgcccgcccacccgg

SEQ ID NO: 749314 - DNA, 20 bp, mouse
gaatggagaggcccctcggc

SEQ ID NO: 749315 - DNA, 20 bp, mouse
gccggcactggggacacatg

SEQ ID NO: 749316 - DNA, 20 bp, mouse
gccagacgatgggtgaattc

SEQ ID NO: 749317 - DNA, 20 bp, mouse
gtcctctcggcccagacgat

SEQ ID NO: 749318 - DNA, 20 bp, mouse
gagagccgaacctcggtctt

SEQ ID NO: 749319 - DNA, 20 bp, mouse
gcgtctgggccgagaggaaa

SEQ ID NO: 749320 - DNA, 20 bp, mouse
ggaaacaactaggaacggga

SEQ ID NO: 749321 - DNA, 20 bp, mouse
gtaccgaagaaggtaatccc

SEQ ID NO: 749322 - DNA, 20 bp, mouse
gtgggcggagaaaggccggt

SEQ ID NO: 749323 - DNA, 20 bp, mouse
ggattccgaagaccgaggtt

SEQ ID NO: 749324 - DNA, 20 bp, mouse
gggtgcggggagtctcttcg

SEQ ID NO: 749325 - DNA, 20 bp, mouse
gtcggtcttcggaatctagg

SEQ ID NO: 749326 - DNA, 20 bp, mouse
gtcacttgttggtgagataa

SEQ ID NO: 749327 - DNA, 20 bp, mouse
ggaagagcagacttcagact

SEQ ID NO: 749328 - DNA, 20 bp, mouse
ggggtaggggcagatcaaca

SEQ ID NO: 749329 - DNA, 20 bp, mouse
gggccactgtgggattactg

SEQ ID NO: 749330 - DNA, 20 bp, mouse
ggagcaggaagggagaccta

SEQ ID NO: 749331 - DNA, 20 bp, mouse
gaacacgtgaaatcccttga

SEQ ID NO: 749332 - DNA, 20 bp, mouse
gagtgagagagacctgggta

SEQ ID NO: 749333 - DNA, 20 bp, mouse
gcggcagagcaccttgggga

SEQ ID NO: 749334 - DNA, 20 bp, mouse
gtccctccgtccccggaagt

SEQ ID NO: 749335 - DNA, 20 bp, mouse
ggaccccagtaatcccacag

SEQ ID NO: 749336 - DNA, 20 bp, mouse
ggctgccggaagtgacgcta

SEQ ID NO: 749337 - DNA, 20 bp, mouse
gagcgggcggagagttccaa

SEQ ID NO: 749338 - DNA, 20 bp, mouse
gaactctccgcccgctagag

SEQ ID NO: 749339 - DNA, 20 bp, mouse
gaggggcgactcgtcctgtt

SEQ ID NO: 749340 - DNA, 20 bp, mouse
gcggaaagcgagccggagaa

SEQ ID NO: 749341 - DNA, 20 bp, mouse
ggcgccgtgtcgagcccccg

SEQ ID NO: 749342 - DNA, 20 bp, mouse
gtgcaggcgccgaccatgga

SEQ ID NO: 749343 - DNA, 20 bp, mouse
gcagggatgcccaggcaatc

SEQ ID NO: 749344 - DNA, 20 bp, mouse
ggaagtggtccggaggggtc

SEQ ID NO: 749345 - DNA, 20 bp, mouse
gcccaggcaatctggaccat

SEQ ID NO: 749346 - DNA, 20 bp, mouse
ggtctccagcaagttctcac

SEQ ID NO: 749347 - DNA, 20 bp, mouse
gcacgggcagagagttgctg

SEQ ID NO: 749348 - DNA, 20 bp, mouse
ggaggcaggtctgggcgtgc

SEQ ID NO: 749349 - DNA, 20 bp, mouse
ggctggctccggggttctgg

SEQ ID NO: 749350 - DNA, 20 bp, mouse
gcggggaggaagggacgtca

SEQ ID NO: 749351 - DNA, 20 bp, mouse
gccctgccgccggcccttaa

SEQ ID NO: 749352 - DNA, 20 bp, mouse
gggacacacagacacgaggt

SEQ ID NO: 749353 - DNA, 20 bp, mouse
gcgccggcccttaaaggtac

SEQ ID NO: 749354 - DNA, 20 bp, mouse
gtgggctggctccggggttc

SEQ ID NO: 749355 - DNA, 20 bp, mouse
ggcagggggcggagtttaaa

SEQ ID NO: 749356 - DNA, 20 bp, mouse
gctagcgtggcactctgggt

SEQ ID NO: 749357 - DNA, 20 bp, mouse
gacccggaagttgacggtgc

SEQ ID NO: 749358 - DNA, 20 bp, mouse
gcgggctagcgtggcactct

SEQ ID NO: 749359 - DNA, 20 bp, mouse
ggtcaacttccgggtctcgt

SEQ ID NO: 749360 - DNA, 20 bp, mouse
gccgctgtaaagcgatccga

SEQ ID NO: 749361 - DNA, 20 bp, mouse
gagcccgcaccgtcaacttc

SEQ ID NO: 749362 - DNA, 20 bp, mouse
ggggtcggccggctccgaga

SEQ ID NO: 749363 - DNA, 20 bp, mouse
gtaacccaggagcgggaggc

SEQ ID NO: 749364 - DNA, 20 bp, mouse
ggccgacttcaacagttcaa

SEQ ID NO: 749365 - DNA, 20 bp, mouse
gcgtggcactctgggtcggc

SEQ ID NO: 749366 - DNA, 20 bp, mouse
ggcgcgctgcaggaaaccgg

SEQ ID NO: 749367 - DNA, 20 bp, mouse
ggcaggaaaccggtggaggc

SEQ ID NO: 749368 - DNA, 20 bp, mouse
gcgctgcaggaaaccggtgg

SEQ ID NO: 749369 - DNA, 20 bp, mouse
gaacaccgcctccagtgctg

SEQ ID NO: 749370 - DNA, 20 bp, mouse
gttcctgcagcgcgcagggg

SEQ ID NO: 749371 - DNA, 20 bp, mouse
gcggcgcggaagccaatgaa

SEQ ID NO: 749372 - DNA, 20 bp, mouse
ggtgttcccgagcacgggaa

SEQ ID NO: 749373 - DNA, 20 bp, mouse
gactactcaaaaactcccgc

SEQ ID NO: 749374 - DNA, 20 bp, mouse
gttccccaactgccctgaca

SEQ ID NO: 749375 - DNA, 20 bp, mouse
gggaaagaagagcgtatccc

SEQ ID NO: 749376 - DNA, 20 bp, mouse
gcaggcctgcgaggcaggaa

SEQ ID NO: 749377 - DNA, 20 bp, mouse
gagccctggctgcagaagga

SEQ ID NO: 749378 - DNA, 20 bp, mouse
gagctgggaggcgcgaggag

SEQ ID NO: 749379 - DNA, 20 bp, mouse
ggaggggtggagaccaacga

SEQ ID NO: 749380 - DNA, 20 bp, mouse
ggagaaagggggggtagcca

SEQ ID NO: 749381 - DNA, 20 bp, mouse
gggggggtagccagggtgga

SEQ ID NO: 749382 - DNA, 20 bp, mouse
gaaggaaggaatgggagcgg

SEQ ID NO: 749383 - DNA, 20 bp, mouse
gggcgcgacggcaggaagct

SEQ ID NO: 749384 - DNA, 20 bp, mouse
gtgactggagagaatcaaga

SEQ ID NO: 749385 - DNA, 20 bp, mouse
gcggccaaagagcgagtagg

SEQ ID NO: 749386 - DNA, 20 bp, mouse
ggcgcggtaggtaatgttaa

SEQ ID NO: 749387 - DNA, 20 bp, mouse
gacccaaggcagacagtgcg

SEQ ID NO: 749388 - DNA, 20 bp, mouse
gtggccacctagctgaggcc

SEQ ID NO: 749389 - DNA, 20 bp, mouse
gaaggcagacagtgcgcggt

SEQ ID NO: 749390 - DNA, 20 bp, mouse
gcactgtctgccttgggtcc

SEQ ID NO: 749391 - DNA, 20 bp, mouse
gtagagcaaatgttctaaaa

SEQ ID NO: 749392 - DNA, 20 bp, mouse
gaactgggaccgagctcccg

SEQ ID NO: 749393 - DNA, 20 bp, mouse
gccaggcgggcggggcactg

SEQ ID NO: 749394 - DNA, 20 bp, mouse
gcctcagctaggtggccagg

SEQ ID NO: 749395 - DNA, 20 bp, mouse
gcaaatgttctaaaatggga

SEQ ID NO: 749396 - DNA, 20 bp, mouse
gggtgggagtggggtggacg

SEQ ID NO: 749397 - DNA, 20 bp, mouse
gccctccagcggcccggaga

SEQ ID NO: 749398 - DNA, 20 bp, mouse
gcacctgccactggccgcca

SEQ ID NO: 749399 - DNA, 20 bp, mouse
gggcccagggagcaggcaaa

SEQ ID NO: 749400 - DNA, 20 bp, mouse
gcagtcgtggtgcggccaga

SEQ ID NO: 749401 - DNA, 20 bp, mouse
gcccgcccggaaacgatccg

SEQ ID NO: 749402 - DNA, 20 bp, mouse
gccccctggcggccagtggc

SEQ ID NO: 749403 - DNA, 20 bp, mouse
gcaccacgactgccccctgg

SEQ ID NO: 749404 - DNA, 20 bp, mouse
gtggcaggtgcgccctctcc

SEQ ID NO: 749405 - DNA, 20 bp, mouse
gcacctgcctgggaaactta

SEQ ID NO: 749406 - DNA, 20 bp, mouse
gccacagtgggaatgggctg

SEQ ID NO: 749407 - DNA, 20 bp, mouse
gtaagacagcataatgtctc

SEQ ID NO: 749408 - DNA, 20 bp, mouse
gcctgagccacagtgggaat

SEQ ID NO: 749409 - DNA, 20 bp, mouse
ggcaccgttctccttaaccc

SEQ ID NO: 749410 - DNA, 20 bp, mouse
gggctggcccttgtctttga

SEQ ID NO: 749411 - DNA, 20 bp, mouse
gtgcttctgctgataagcgt

SEQ ID NO: 749412 - DNA, 20 bp, mouse
gattttcacttgtgtgtcag

SEQ ID NO: 749413 - DNA, 20 bp, mouse
ggacacatagccgaacatgg

SEQ ID NO: 749414 - DNA, 20 bp, mouse
ggacattatgctgtcttaga

SEQ ID NO: 749415 - DNA, 20 bp, mouse
gcttagagggcagaatacat

SEQ ID NO: 749416 - DNA, 20 bp, mouse
gctcacttgagcatccccat

SEQ ID NO: 749417 - DNA, 20 bp, mouse
gctggacaacccataagcca

SEQ ID NO: 749418 - DNA, 20 bp, mouse
ggaagagggaccctggctta

SEQ ID NO: 749419 - DNA, 20 bp, mouse
gatgctcaagtgaggaatgt

SEQ ID NO: 749420 - DNA, 20 bp, mouse
gccagcttgaagactcattc

SEQ ID NO: 749421 - DNA, 20 bp, mouse
gcacactaacaaacttgaag

SEQ ID NO: 749422 - DNA, 20 bp, mouse
gcaagtgaggaatgtgggca

SEQ ID NO: 749423 - DNA, 20 bp, mouse
gaaacctcagagcagccaat

SEQ ID NO: 749424 - DNA, 20 bp, mouse
gagcaaacaaatcagttggt

SEQ ID NO: 749425 - DNA, 20 bp, mouse
gggaaactagtcacttctcg

SEQ ID NO: 749426 - DNA, 20 bp, mouse
gggagaaggcgtgacctgaa

SEQ ID NO: 749427 - DNA, 20 bp, mouse
ggggagaggggatctgttgc

SEQ ID NO: 749428 - DNA, 20 bp, mouse
gtgagcttatgtacactcgg

SEQ ID NO: 749429 - DNA, 20 bp, mouse
ggatgtccacgaacaggctg

SEQ ID NO: 749430 - DNA, 20 bp, mouse
gtgcagtccctccctaggag

SEQ ID NO: 749431 - DNA, 20 bp, mouse
ggccagtcccctcctaggga

SEQ ID NO: 749432 - DNA, 20 bp, mouse
gtatagccatcaggcaaggg

SEQ ID NO: 749433 - DNA, 20 bp, mouse
gctggctaacagatcttgca

SEQ ID NO: 749434 - DNA, 20 bp, mouse
gggacctcagaacaaagata

SEQ ID NO: 749435 - DNA, 20 bp, mouse
ggttagccagtcccctccta

SEQ ID NO: 749436 - DNA, 20 bp, mouse
gcaggcaggaaggttcggtt

SEQ ID NO: 749437 - DNA, 20 bp, mouse
ggcaggaaggttcggttcgg

SEQ ID NO: 749438 - DNA, 20 bp, mouse
gggaaggaagtgcagatggt

SEQ ID NO: 749439 - DNA, 20 bp, mouse
gccacccccaactcagggag

SEQ ID NO: 749440 - DNA, 20 bp, mouse
ggcctcccttccaggcagga

SEQ ID NO: 749441 - DNA, 20 bp, mouse
gcttcctggtcccactagga

SEQ ID NO: 749442 - DNA, 20 bp, mouse
gactaggaaggaagtgcaga

SEQ ID NO: 749443 - DNA, 20 bp, mouse
ggattctgggaatctaccca

SEQ ID NO: 749444 - DNA, 20 bp, mouse
ggaacaaaaggatacggaac

SEQ ID NO: 749445 - DNA, 20 bp, mouse
ggagagtctcagtgacgacg

SEQ ID NO: 749446 - DNA, 20 bp, mouse
gccaatgcacctctccccca

SEQ ID NO: 749447 - DNA, 20 bp, mouse
ggtgaacggagaggcatcgt

SEQ ID NO: 749448 - DNA, 20 bp, mouse
gcgcctgatgccctacctgg

SEQ ID NO: 749449 - DNA, 20 bp, mouse
gcatcaggcgtgcacacggg

SEQ ID NO: 749450 - DNA, 20 bp, mouse
gctcacctgctgcttttccg

SEQ ID NO: 749451 - DNA, 20 bp, mouse
ggaagctcaggtgaacggag

SEQ ID NO: 749452 - DNA, 20 bp, mouse
ggggaatcgggagaggaatc

SEQ ID NO: 749453 - DNA, 20 bp, mouse
gggagaggtgcattgggatg

SEQ ID NO: 749454 - DNA, 20 bp, mouse
gggcccccaggtagggcatc

SEQ ID NO: 749455 - DNA, 20 bp, mouse
gggtgatgctgatgaagctc

SEQ ID NO: 749456 - DNA, 20 bp, mouse
ggctcccggcgcgcccgcgt

SEQ ID NO: 749457 - DNA, 20 bp, mouse
gcgcgcgctctgaagcggaa

SEQ ID NO: 749458 - DNA, 20 bp, mouse
gcgcgccgcgcgctctgaag

SEQ ID NO: 749459 - DNA, 20 bp, mouse
ggcaggcagtgtgtaccaaa

SEQ ID NO: 749460 - DNA, 20 bp, mouse
gaaaagacttccaacgggag

SEQ ID NO: 749461 - DNA, 20 bp, mouse
ggctctgaagcggaaggggg

SEQ ID NO: 749462 - DNA, 20 bp, mouse
gggcgtcctgcagccgacgc

SEQ ID NO: 749463 - DNA, 20 bp, mouse
ggctggccgcgctctgtggg

SEQ ID NO: 749464 - DNA, 20 bp, mouse
gaaaccctcccattagttga

SEQ ID NO: 749465 - DNA, 20 bp, mouse
gcacggctggccgcgctctg

SEQ ID NO: 749466 - DNA, 20 bp, mouse
gacgccgcgccgatctgctc

SEQ ID NO: 749467 - DNA, 20 bp, mouse
gcacaggcaggggtttgcta

SEQ ID NO: 749468 - DNA, 20 bp, mouse
gtcggtgcccagcattgcca

SEQ ID NO: 749469 - DNA, 20 bp, mouse
ggctaggcggggcgttgcta

SEQ ID NO: 749470 - DNA, 20 bp, mouse
ggggcgtggcgtcgtgatgg

SEQ ID NO: 749471 - DNA, 20 bp, mouse
gtgggagccccgcccagtca

SEQ ID NO: 749472 - DNA, 20 bp, mouse
gagggggcgtggcgtcgtga

SEQ ID NO: 749473 - DNA, 20 bp, mouse
gtctgccggaagcgctggga

SEQ ID NO: 749474 - DNA, 20 bp, mouse
gttgctagggtccccaacta

SEQ ID NO: 749475 - DNA, 20 bp, mouse
gaatgctgggcaccgacagg

SEQ ID NO: 749476 - DNA, 20 bp, mouse
gggactacaaggttcgggtg

SEQ ID NO: 749477 - DNA, 20 bp, mouse
ggggacagacggtggaccga

SEQ ID NO: 749478 - DNA, 20 bp, mouse
gaggtcctgagtaagaacgt

SEQ ID NO: 749479 - DNA, 20 bp, mouse
ggggcgggactacaaggttc

SEQ ID NO: 749480 - DNA, 20 bp, mouse
ggaccgaggggcaggactat

SEQ ID NO: 749481 - DNA, 20 bp, mouse
gacaaggggagctataggtg

SEQ ID NO: 749482 - DNA, 20 bp, mouse
ggagttacaaggggagctat

SEQ ID NO: 749483 - DNA, 20 bp, mouse
gggtgtgggcggagttacaa

SEQ ID NO: 749484 - DNA, 20 bp, mouse
gagaacgtgggcgtggattc

SEQ ID NO: 749485 - DNA, 20 bp, mouse
ggggctgaactaaaggatga

SEQ ID NO: 749486 - DNA, 20 bp, mouse
ggccgcgcgggcgtcaggta

SEQ ID NO: 749487 - DNA, 20 bp, mouse
gcggggcagccccacggcgc

SEQ ID NO: 749488 - DNA, 20 bp, mouse
gcacggcgcggggatccaca

SEQ ID NO: 749489 - DNA, 20 bp, mouse
gcgcgggcgtcaggtagggg

SEQ ID NO: 749490 - DNA, 20 bp, mouse
gagcgggccacccgatcccg

SEQ ID NO: 749491 - DNA, 20 bp, mouse
ggcagcgcaggcgcgctggt

SEQ ID NO: 749492 - DNA, 20 bp, mouse
ggggatccacagggccgacg

SEQ ID NO: 749493 - DNA, 20 bp, mouse
gggtgcgcggggcagcccca

SEQ ID NO: 749494 - DNA, 20 bp, mouse
gaagtccgcggactccgcgt

SEQ ID NO: 749495 - DNA, 20 bp, mouse
gggagtggccgtctgtcctt

SEQ ID NO: 749496 - DNA, 20 bp, mouse
gcactgctgggcgcagtctg

SEQ ID NO: 749497 - DNA, 20 bp, mouse
gtaagcaggcatcgacgggt

SEQ ID NO: 749498 - DNA, 20 bp, mouse
gaaaacagcccgtgtatccg

SEQ ID NO: 749499 - DNA, 20 bp, mouse
gctgccggctccctgtaagc

SEQ ID NO: 749500 - DNA, 20 bp, mouse
gccctgtaagcaggcatcga

SEQ ID NO: 749501 - DNA, 20 bp, mouse
gccccttccggcagcgccgc

SEQ ID NO: 749502 - DNA, 20 bp, mouse
gagccggcggcgctgccgga

SEQ ID NO: 749503 - DNA, 20 bp, mouse
ggcgctgccggaaggggcgc

SEQ ID NO: 749504 - DNA, 20 bp, mouse
gccccgcccagcgccccttc

SEQ ID NO: 749505 - DNA, 20 bp, mouse
gctagcgaagccacagaatg

SEQ ID NO: 749506 - DNA, 20 bp, mouse
ggtctcaagtggcaagtctg

SEQ ID NO: 749507 - DNA, 20 bp, mouse
gctgtggtctaagtgagatt

SEQ ID NO: 749508 - DNA, 20 bp, mouse
ggagctgaaggaagtccgaa

SEQ ID NO: 749509 - DNA, 20 bp, mouse
gcagagtgggatggtatccc

SEQ ID NO: 749510 - DNA, 20 bp, mouse
gttagcccataccaaatctc

SEQ ID NO: 749511 - DNA, 20 bp, mouse
gaaggcacttccggtccgag

SEQ ID NO: 749512 - DNA, 20 bp, mouse
gtcagctctgatgtctcaag

SEQ ID NO: 749513 - DNA, 20 bp, mouse
gcccaatccagagcaggtgt

SEQ ID NO: 749514 - DNA, 20 bp, mouse
gcagtgaggctctgctgtga

SEQ ID NO: 749515 - DNA, 20 bp, mouse
ggctgcccatgagtaactcc

SEQ ID NO: 749516 - DNA, 20 bp, mouse
gtgaaccattctaccgatgg

SEQ ID NO: 749517 - DNA, 20 bp, mouse
gggtccgccgagccgagctc

SEQ ID NO: 749518 - DNA, 20 bp, mouse
gcgccgcgggcgggcggatg

SEQ ID NO: 749519 - DNA, 20 bp, mouse
gcgggcgggcggatgggggt

SEQ ID NO: 749520 - DNA, 20 bp, mouse
ggccccccccatcggtagaa

SEQ ID NO: 749521 - DNA, 20 bp, mouse
gggcgcgcgacgccgagggg

SEQ ID NO: 749522 - DNA, 20 bp, mouse
gcgcgccggcagacctccgt

SEQ ID NO: 749523 - DNA, 20 bp, mouse
gcatcaagatgactaactac

SEQ ID NO: 749524 - DNA, 20 bp, mouse
gctccgtgggcaacggtcgg

SEQ ID NO: 749525 - DNA, 20 bp, mouse
ggggggcgagcagagctaac

SEQ ID NO: 749526 - DNA, 20 bp, mouse
gaaaaggggcggaacctcaa

SEQ ID NO: 749527 - DNA, 20 bp, mouse
ggggctgacagcgtcccttg

SEQ ID NO: 749528 - DNA, 20 bp, mouse
gtctcgccacgcgttcaaaa

SEQ ID NO: 749529 - DNA, 20 bp, mouse
gggtgccaagcgatggatgc

SEQ ID NO: 749530 - DNA, 20 bp, mouse
ggtaaggaatcgattcgcct

SEQ ID NO: 749531 - DNA, 20 bp, mouse
gaggcactggtgccaagcga

SEQ ID NO: 749532 - DNA, 20 bp, mouse
gcggcagccggggtcggcct

SEQ ID NO: 749533 - DNA, 20 bp, mouse
gcctaggcccaggccgaccc

SEQ ID NO: 749534 - DNA, 20 bp, mouse
ggctctatctccttaagaac

SEQ ID NO: 749535 - DNA, 20 bp, mouse
gcgaacctcaggctggcctt

SEQ ID NO: 749536 - DNA, 20 bp, mouse
ggaaagctgcacgagattcc

SEQ ID NO: 749537 - DNA, 20 bp, mouse
ggggtagtttcaaaactagc

SEQ ID NO: 749538 - DNA, 20 bp, mouse
gtaagcatgaaacttctcat

SEQ ID NO: 749539 - DNA, 20 bp, mouse
gcgagattccagggttggaa

SEQ ID NO: 749540 - DNA, 20 bp, mouse
ggggcggagcgaacaaagac

SEQ ID NO: 749541 - DNA, 20 bp, mouse
gcttaactgcaagtcaaggg

SEQ ID NO: 749542 - DNA, 20 bp, mouse
gctgcacgagattccagggt

SEQ ID NO: 749543 - DNA, 20 bp, mouse
gtccgcccgcacggagcaca

SEQ ID NO: 749544 - DNA, 20 bp, mouse
gatgcttaactgcaagtcaa

SEQ ID NO: 749545 - DNA, 20 bp, mouse
ggagctgcgcctcacgtttt

SEQ ID NO: 749546 - DNA, 20 bp, mouse
gaaggaaggctaggattcag

SEQ ID NO: 749547 - DNA, 20 bp, mouse
gtcccagggtgggcgaagga

SEQ ID NO: 749548 - DNA, 20 bp, mouse
gtgcgcctcccactccgtcc

SEQ ID NO: 749549 - DNA, 20 bp, mouse
gtgggagcgcggaatggctc

SEQ ID NO: 749550 - DNA, 20 bp, mouse
gcgcgctcccagctttccca

SEQ ID NO: 749551 - DNA, 20 bp, mouse
gactcagcactctgcccgga

SEQ ID NO: 749552 - DNA, 20 bp, mouse
ggaaagctgggagcgcggaa

SEQ ID NO: 749553 - DNA, 20 bp, mouse
gcactctgcccggacggagt

SEQ ID NO: 749554 - DNA, 20 bp, mouse
gtctgcccggacggagtggg

SEQ ID NO: 749555 - DNA, 20 bp, mouse
gacggagtgggaggcgcagc

SEQ ID NO: 749556 - DNA, 20 bp, mouse
gtggaggtgtgtgtctgaaa

SEQ ID NO: 749557 - DNA, 20 bp, mouse
ggcggggccagtctgaatgg

SEQ ID NO: 749558 - DNA, 20 bp, mouse
gctggaattcaggaaatctc

SEQ ID NO: 749559 - DNA, 20 bp, mouse
gtgtctgaaagggagggtag

SEQ ID NO: 749560 - DNA, 20 bp, mouse
gcagactggccccgcctttg

SEQ ID NO: 749561 - DNA, 20 bp, mouse
gaggaaatctcaggtgggtg

SEQ ID NO: 749562 - DNA, 20 bp, mouse
gtgggcttggaattccgggt

SEQ ID NO: 749563 - DNA, 20 bp, mouse
gtgggaagaggggcagtgca

SEQ ID NO: 749564 - DNA, 20 bp, mouse
gaattcaggaaatctcaggt

SEQ ID NO: 749565 - DNA, 20 bp, mouse
gtgtaggtccaagtcagcac

SEQ ID NO: 749566 - DNA, 20 bp, mouse
gcaggcaaggagagcgtctt

SEQ ID NO: 749567 - DNA, 20 bp, mouse
gaggaggcggtgccgtacaa

SEQ ID NO: 749568 - DNA, 20 bp, mouse
ggaaggaggggtgtcctctt

SEQ ID NO: 749569 - DNA, 20 bp, mouse
gtacaggcagcccccagctc

SEQ ID NO: 749570 - DNA, 20 bp, mouse
gaaagggcggcgcgaggagg

SEQ ID NO: 749571 - DNA, 20 bp, mouse
gaagcgggcgggcggaagga

SEQ ID NO: 749572 - DNA, 20 bp, mouse
ggggggctgcctgtagcgtg

SEQ ID NO: 749573 - DNA, 20 bp, mouse
gccgtacaagggttggaagc

SEQ ID NO: 749574 - DNA, 20 bp, mouse
gtcctcgcgccgccctttca

SEQ ID NO: 749575 - DNA, 20 bp, mouse
gcagagctgccccacgctac

SEQ ID NO: 749576 - DNA, 20 bp, mouse
gcgagcccaccggactaggc

SEQ ID NO: 749577 - DNA, 20 bp, mouse
gagagcccgggaaccgccaa

SEQ ID NO: 749578 - DNA, 20 bp, mouse
gccactggaatgcacagaca

SEQ ID NO: 749579 - DNA, 20 bp, mouse
gcagccgagcccaccggact

SEQ ID NO: 749580 - DNA, 20 bp, mouse
gactgcccgcctagtccggt

SEQ ID NO: 749581 - DNA, 20 bp, mouse
gtggcaggagcggaatgtct

SEQ ID NO: 749582 - DNA, 20 bp, mouse
gtctgggactaggcggccag

SEQ ID NO: 749583 - DNA, 20 bp, mouse
gggtcactgcccgcctagtc

SEQ ID NO: 749584 - DNA, 20 bp, mouse
gaaaaccaggctaggattgg

SEQ ID NO: 749585 - DNA, 20 bp, mouse
gggcacccagccgagcccac

SEQ ID NO: 749586 - DNA, 20 bp, mouse
gcgagctgcgggccggaatt

SEQ ID NO: 749587 - DNA, 20 bp, mouse
gtccagctgtagcccaattc

SEQ ID NO: 749588 - DNA, 20 bp, mouse
gctggggcccgagtgttgag

SEQ ID NO: 749589 - DNA, 20 bp, mouse
gacagaggagggcaagagtc

SEQ ID NO: 749590 - DNA, 20 bp, mouse
gtctgggaagtgtctcgtgt

SEQ ID NO: 749591 - DNA, 20 bp, mouse
ggagtcgggcggcgacactc

SEQ ID NO: 749592 - DNA, 20 bp, mouse
ggggctgcgacccctcccac

SEQ ID NO: 749593 - DNA, 20 bp, mouse
gcccgagtgttgagaggaag

SEQ ID NO: 749594 - DNA, 20 bp, mouse
gaggaccgctccgcctcttg

SEQ ID NO: 749595 - DNA, 20 bp, mouse
gaggcaggccaggcaggcgg

SEQ ID NO: 749596 - DNA, 20 bp, mouse
ggggcctgggagaacaacgc

SEQ ID NO: 749597 - DNA, 20 bp, mouse
gggtaggcacgtgacgtacg

SEQ ID NO: 749598 - DNA, 20 bp, mouse
gcggccagcgttgttctccc

SEQ ID NO: 749599 - DNA, 20 bp, mouse
gtgccgaactagaactgggg

SEQ ID NO: 749600 - DNA, 20 bp, mouse
gccccgccccagttctagtt

SEQ ID NO: 749601 - DNA, 20 bp, mouse
gtcaggcgaaggcgggaaaa

SEQ ID NO: 749602 - DNA, 20 bp, mouse
gctctcgcgagattcatctc

SEQ ID NO: 749603 - DNA, 20 bp, mouse
gctaccccgcgcggggggag

SEQ ID NO: 749604 - DNA, 20 bp, mouse
gctgaagggggatccttcct

SEQ ID NO: 749605 - DNA, 20 bp, mouse
ggcgtgccgaactagaactg

SEQ ID NO: 749606 - DNA, 20 bp, mouse
gacgcccggtgtcctagaag

SEQ ID NO: 749607 - DNA, 20 bp, mouse
gggcggcgaagggaagtcgg

SEQ ID NO: 749608 - DNA, 20 bp, mouse
gaagatggcggcacaggcgg

SEQ ID NO: 749609 - DNA, 20 bp, mouse
ggcagccgagtcgtggtatc

SEQ ID NO: 749610 - DNA, 20 bp, mouse
ggcgccacctgagaagaggg

SEQ ID NO: 749611 - DNA, 20 bp, mouse
gtggacgagattgtcggaga

SEQ ID NO: 749612 - DNA, 20 bp, mouse
ggcgggcggcgaagggaagt

SEQ ID NO: 749613 - DNA, 20 bp, mouse
ggtctcggcagaccagagaa

SEQ ID NO: 749614 - DNA, 20 bp, mouse
gaggtccgtgacagaaagta

SEQ ID NO: 749615 - DNA, 20 bp, mouse
gcggtgtcctagaagggggt

SEQ ID NO: 749616 - DNA, 20 bp, mouse
gtggtcaggcgtggggagga

SEQ ID NO: 749617 - DNA, 20 bp, mouse
gggatcggaagcgcagtcat

SEQ ID NO: 749618 - DNA, 20 bp, mouse
gtacgcctgggagtccgcat

SEQ ID NO: 749619 - DNA, 20 bp, mouse
gggctgggctggggatgcct

SEQ ID NO: 749620 - DNA, 20 bp, mouse
ggcagctattggtcaggcgt

SEQ ID NO: 749621 - DNA, 20 bp, mouse
ggagccctcgcagatgaagg

SEQ ID NO: 749622 - DNA, 20 bp, mouse
gagccacgcagctattggtc

SEQ ID NO: 749623 - DNA, 20 bp, mouse
gaggccggtcgcagggccag

SEQ ID NO: 749624 - DNA, 20 bp, mouse
gccgcccccttcatctgcga

SEQ ID NO: 749625 - DNA, 20 bp, mouse
gctagcggctggtgccccgc

SEQ ID NO: 749626 - DNA, 20 bp, mouse
gcctgtgtgcggttcctgat

SEQ ID NO: 749627 - DNA, 20 bp, mouse
gggccccctaacacgtgacc

SEQ ID NO: 749628 - DNA, 20 bp, mouse
gagcccggtcacgtgttagg

SEQ ID NO: 749629 - DNA, 20 bp, mouse
gaagtggcgcggtgcctccc

SEQ ID NO: 749630 - DNA, 20 bp, mouse
ggcgcctgcgccccgggtgt

SEQ ID NO: 749631 - DNA, 20 bp, mouse
gggaagacaggacacgtgga

SEQ ID NO: 749632 - DNA, 20 bp, mouse
gccctggggcgtaaccctcc

SEQ ID NO: 749633 - DNA, 20 bp, mouse
ggcgcccggcccaagggatt

SEQ ID NO: 749634 - DNA, 20 bp, mouse
gagcctccacccaatccctt

SEQ ID NO: 749635 - DNA, 20 bp, mouse
gcgcccagagctcggaattg

SEQ ID NO: 749636 - DNA, 20 bp, mouse
gcccagccggcgcctcgggg

SEQ ID NO: 749637 - DNA, 20 bp, mouse
ggggcgcgcggagggggtgt

SEQ ID NO: 749638 - DNA, 20 bp, mouse
gcggcgacgccccctgggtg

SEQ ID NO: 749639 - DNA, 20 bp, mouse
gcgcggagggggtgtgggac

SEQ ID NO: 749640 - DNA, 20 bp, mouse
ggaggcgcgcaaggagggag

SEQ ID NO: 749641 - DNA, 20 bp, mouse
ggggagcgagggagcagctt

SEQ ID NO: 749642 - DNA, 20 bp, mouse
gtgctgggatccatggcgga

SEQ ID NO: 749643 - DNA, 20 bp, mouse
gcgcgcggggccagcgggag

SEQ ID NO: 749644 - DNA, 20 bp, mouse
ggggcctctcgcccccaccc

SEQ ID NO: 749645 - DNA, 20 bp, mouse
gctccagttgctgggatcca

SEQ ID NO: 749646 - DNA, 20 bp, mouse
ggtgggagctaggacagctt

SEQ ID NO: 749647 - DNA, 20 bp, mouse
gaggacagcttggggcagta

SEQ ID NO: 749648 - DNA, 20 bp, mouse
gttggggcaagtgccattgt

SEQ ID NO: 749649 - DNA, 20 bp, mouse
gctagtctggccaggatcac

SEQ ID NO: 749650 - DNA, 20 bp, mouse
gctaccgtgctcaaccctcc

SEQ ID NO: 749651 - DNA, 20 bp, mouse
gccctgtggggcagcagaca

SEQ ID NO: 749652 - DNA, 20 bp, mouse
ggcttcggtgccctttctgt

SEQ ID NO: 749653 - DNA, 20 bp, mouse
ggcagagattagacccctgg

SEQ ID NO: 749654 - DNA, 20 bp, mouse
ggagaggaggagacttctag

SEQ ID NO: 749655 - DNA, 20 bp, mouse
gttgagcacggtagcaggaa

SEQ ID NO: 749656 - DNA, 20 bp, mouse
ggaaccacccactgagccac

SEQ ID NO: 749657 - DNA, 20 bp, mouse
gcgtctgtgcggtaaaggag

SEQ ID NO: 749658 - DNA, 20 bp, mouse
gtgggtggttccccagctag

SEQ ID NO: 749659 - DNA, 20 bp, mouse
gcggccagtggctcagtggg

SEQ ID NO: 749660 - DNA, 20 bp, mouse
gcggtaaaggagaggtttcc

SEQ ID NO: 749661 - DNA, 20 bp, mouse
gaacacatcttggtggtagg

SEQ ID NO: 749662 - DNA, 20 bp, mouse
gtggctctgctggtccccac

SEQ ID NO: 749663 - DNA, 20 bp, mouse
ggaccagcagagccactagc

SEQ ID NO: 749664 - DNA, 20 bp, mouse
ggctcgcggcggatactgac

SEQ ID NO: 749665 - DNA, 20 bp, mouse
gtaccaccaagatgtgtttc

SEQ ID NO: 749666 - DNA, 20 bp, mouse
gtgcccctaaagaggggcgg

SEQ ID NO: 749667 - DNA, 20 bp, mouse
gcacttgccagtccgtactc

SEQ ID NO: 749668 - DNA, 20 bp, mouse
gtggactcgagcctccccgg

SEQ ID NO: 749669 - DNA, 20 bp, mouse
gcgtcagcccgagtacggac

SEQ ID NO: 749670 - DNA, 20 bp, mouse
gtacggactggcaagtgatc

SEQ ID NO: 749671 - DNA, 20 bp, mouse
gcacccccgcccctctttag

SEQ ID NO: 749672 - DNA, 20 bp, mouse
gtcccggcaggactcgagga

SEQ ID NO: 749673 - DNA, 20 bp, mouse
ggcaagccctgcccctaaag

SEQ ID NO: 749674 - DNA, 20 bp, mouse
gcccgcccgctgcgccgctg

SEQ ID NO: 749675 - DNA, 20 bp, mouse
gcgggcgaaaacgtgtctgt

SEQ ID NO: 749676 - DNA, 20 bp, mouse
gccgaggcgcgcagacgcac

SEQ ID NO: 749677 - DNA, 20 bp, mouse
gcgcaggcgctgaagatccc

SEQ ID NO: 749678 - DNA, 20 bp, mouse
gtggtcacgcgtgccctcat

SEQ ID NO: 749679 - DNA, 20 bp, mouse
gcgcggagcctccccaatga

SEQ ID NO: 749680 - DNA, 20 bp, mouse
gcagcggcgcgcggattccc

SEQ ID NO: 749681 - DNA, 20 bp, mouse
gtggaggtgcctgtgcaccg

SEQ ID NO: 749682 - DNA, 20 bp, mouse
ggcgcactgcggcttcacag

SEQ ID NO: 749683 - DNA, 20 bp, mouse
gcccgcagcccgccgggtct

SEQ ID NO: 749684 - DNA, 20 bp, mouse
gtctgcgcgcctcggtgcac

SEQ ID NO: 749685 - DNA, 20 bp, mouse
gcaggcaaccgagacccggc

SEQ ID NO: 749686 - DNA, 20 bp, mouse
ggggcggagcaggtggtcac

SEQ ID NO: 749687 - DNA, 20 bp, mouse
gcggagcaggtggtcacggg

SEQ ID NO: 749688 - DNA, 20 bp, mouse
gctagcttggaggacctaag

SEQ ID NO: 749689 - DNA, 20 bp, mouse
gggccccggccgcgcctctt

SEQ ID NO: 749690 - DNA, 20 bp, mouse
gagaggaggcggagacaata

SEQ ID NO: 749691 - DNA, 20 bp, mouse
gctgcccggagcaggaggag

SEQ ID NO: 749692 - DNA, 20 bp, mouse
ggacccgtgtcaagcgtggc

SEQ ID NO: 749693 - DNA, 20 bp, mouse
gcgggtctccgggattccaa

SEQ ID NO: 749694 - DNA, 20 bp, mouse
ggacctaagaggcgcggccg

SEQ ID NO: 749695 - DNA, 20 bp, mouse
gagagcgctgaaggctagac

SEQ ID NO: 749696 - DNA, 20 bp, mouse
ggggtcttgaaggcaagcga

SEQ ID NO: 749697 - DNA, 20 bp, mouse
gggagcggcccccctagcgg

SEQ ID NO: 749698 - DNA, 20 bp, mouse
gggagctgaagtgatctgat

SEQ ID NO: 749699 - DNA, 20 bp, mouse
gcgcggctgcgcagagagtc

SEQ ID NO: 749700 - DNA, 20 bp, mouse
gtggtcctgcgagcgcgaag

SEQ ID NO: 749701 - DNA, 20 bp, mouse
gcttgcgggagacgcccaca

SEQ ID NO: 749702 - DNA, 20 bp, mouse
gccaccccggccacgctgat

SEQ ID NO: 749703 - DNA, 20 bp, mouse
gagaagttaagcacagaacg

SEQ ID NO: 749704 - DNA, 20 bp, mouse
gggaagcaggactgcgtcga

SEQ ID NO: 749705 - DNA, 20 bp, mouse
gaggcaagcgaaggctgggt

SEQ ID NO: 749706 - DNA, 20 bp, mouse
gagctgctcaggtagttgaa

SEQ ID NO: 749707 - DNA, 20 bp, mouse
gtcttattttacaacttgag

SEQ ID NO: 749708 - DNA, 20 bp, mouse
gacatgctgtcatcattctg

SEQ ID NO: 749709 - DNA, 20 bp, mouse
gtaagactcacatctctgag

SEQ ID NO: 749710 - DNA, 20 bp, mouse
ggaatgatgacagcatgtga

SEQ ID NO: 749711 - DNA, 20 bp, mouse
gtgttcttttgggaggcaag

SEQ ID NO: 749712 - DNA, 20 bp, mouse
ggtttcacataatcttgaag

SEQ ID NO: 749713 - DNA, 20 bp, mouse
gtattactaagaaaaggaga

SEQ ID NO: 749714 - DNA, 20 bp, mouse
gcttttggatctaataacaa

SEQ ID NO: 749715 - DNA, 20 bp, mouse
gttctcttgaaaagtcacaa

SEQ ID NO: 749716 - DNA, 20 bp, mouse
ggaggcatttcctcaagcat

SEQ ID NO: 749717 - DNA, 20 bp, mouse
gagtcaatacagatcaccta

SEQ ID NO: 749718 - DNA, 20 bp, mouse
gaattgtagaccaagtcctt

SEQ ID NO: 749719 - DNA, 20 bp, mouse
gatcaaggaaaaccagccct

SEQ ID NO: 749720 - DNA, 20 bp, mouse
ggtctacaattgaccctaac

SEQ ID NO: 749721 - DNA, 20 bp, mouse
gtacagatcacctaaggact

SEQ ID NO: 749722 - DNA, 20 bp, mouse
gaatcatccaatatggaggc

SEQ ID NO: 749723 - DNA, 20 bp, mouse
gtgggaatcatccaatatgg

SEQ ID NO: 749724 - DNA, 20 bp, mouse
ggattgggaatcatccaata

SEQ ID NO: 749725 - DNA, 20 bp, mouse
ggttccatgctgtttgtttc

SEQ ID NO: 749726 - DNA, 20 bp, mouse
gtacgcgcccggcgcttcgg

SEQ ID NO: 749727 - DNA, 20 bp, mouse
ggtagcgcaggtagctgaag

SEQ ID NO: 749728 - DNA, 20 bp, mouse
gcaagtgcgcatgtacaaaa

SEQ ID NO: 749729 - DNA, 20 bp, mouse
ggcgcccggcgcttcggcgg

SEQ ID NO: 749730 - DNA, 20 bp, mouse
gcgcgtagggacgcaggagg

SEQ ID NO: 749731 - DNA, 20 bp, mouse
gaggaggggcccgaagcgtg

SEQ ID NO: 749732 - DNA, 20 bp, mouse
ggggcgcgtagggacgcagg

SEQ ID NO: 749733 - DNA, 20 bp, mouse
ggcggggaggcggcaggaac

SEQ ID NO: 749734 - DNA, 20 bp, mouse
gggggagtcttgacgacaga

SEQ ID NO: 749735 - DNA, 20 bp, mouse
gtcccagcctcggcagcaac

SEQ ID NO: 749736 - DNA, 20 bp, mouse
gcaacaccttggattcccat

SEQ ID NO: 749737 - DNA, 20 bp, mouse
gacctcgactatctagacac

SEQ ID NO: 749738 - DNA, 20 bp, mouse
gcagtactggagacattacc

SEQ ID NO: 749739 - DNA, 20 bp, mouse
gagcatgtggcctttaacgg

SEQ ID NO: 749740 - DNA, 20 bp, mouse
gcagtactgcccgccgttaa

SEQ ID NO: 749741 - DNA, 20 bp, mouse
gttacctggctgctggtgtc

SEQ ID NO: 749742 - DNA, 20 bp, mouse
gttgccttgaaccttgatac

SEQ ID NO: 749743 - DNA, 20 bp, mouse
gagggggaagagtagcccat

SEQ ID NO: 749744 - DNA, 20 bp, mouse
gtccctcaaactgctcccat

SEQ ID NO: 749745 - DNA, 20 bp, mouse
gtccccctgtcactcttaag

SEQ ID NO: 749746 - DNA, 20 bp, mouse
gcggaaggggcccctcccga

SEQ ID NO: 749747 - DNA, 20 bp, mouse
gccgctgcccggacgggaga

SEQ ID NO: 749748 - DNA, 20 bp, mouse
ggcactgcgtcccctcctgt

SEQ ID NO: 749749 - DNA, 20 bp, mouse
gtgcccggacgggagagggg

SEQ ID NO: 749750 - DNA, 20 bp, mouse
gggcccagatccttccgcgg

SEQ ID NO: 749751 - DNA, 20 bp, mouse
gcagcagcgagccaacagga

SEQ ID NO: 749752 - DNA, 20 bp, mouse
gcggacagcagcgagccaac

SEQ ID NO: 749753 - DNA, 20 bp, mouse
gcccgagggaggactgggat

SEQ ID NO: 749754 - DNA, 20 bp, mouse
gcccacccgccctccgcgga

SEQ ID NO: 749755 - DNA, 20 bp, mouse
ggccccgcccctctcccgtc

SEQ ID NO: 749756 - DNA, 20 bp, mouse
gagtgcgacgaagtccgcga

SEQ ID NO: 749757 - DNA, 20 bp, mouse
gtgtgtctgtcacacacaga

SEQ ID NO: 749758 - DNA, 20 bp, mouse
ggagcatctaagagccaagt

SEQ ID NO: 749759 - DNA, 20 bp, mouse
gcgacgaagtccgcgaggga

SEQ ID NO: 749760 - DNA, 20 bp, mouse
gaggctctgccaacattcac

SEQ ID NO: 749761 - DNA, 20 bp, mouse
gggaagaccaatcaagagca

SEQ ID NO: 749762 - DNA, 20 bp, mouse
gtcacatacacaagttccct

SEQ ID NO: 749763 - DNA, 20 bp, mouse
gcaaggatagctgtgctccg

SEQ ID NO: 749764 - DNA, 20 bp, mouse
ggggtgagcgctgttcgcgg

SEQ ID NO: 749765 - DNA, 20 bp, mouse
gtcacttagagcttgaggat

SEQ ID NO: 749766 - DNA, 20 bp, mouse
gagtgtctaagctatatgga

SEQ ID NO: 749767 - DNA, 20 bp, mouse
gggaagctgttcagagctgc

SEQ ID NO: 749768 - DNA, 20 bp, mouse
gccttggagctgttgtaatt

SEQ ID NO: 749769 - DNA, 20 bp, mouse
gatatggatggacctctggg

SEQ ID NO: 749770 - DNA, 20 bp, mouse
ggctatatggatggacctct

SEQ ID NO: 749771 - DNA, 20 bp, mouse
gaccgggaaccaagctggac

SEQ ID NO: 749772 - DNA, 20 bp, mouse
gctggagtgtctaagctata

SEQ ID NO: 749773 - DNA, 20 bp, mouse
gtggtgaccgggaaccaagc

SEQ ID NO: 749774 - DNA, 20 bp, mouse
ggatagttgcttattaaact

SEQ ID NO: 749775 - DNA, 20 bp, mouse
gttcccggtcaccaggctaa

SEQ ID NO: 749776 - DNA, 20 bp, mouse
ggggaaatggcgctgcatta

SEQ ID NO: 749777 - DNA, 20 bp, mouse
ggcctgcagtaagtgcagca

SEQ ID NO: 749778 - DNA, 20 bp, mouse
gcacttgaacctgcttgtta

SEQ ID NO: 749779 - DNA, 20 bp, mouse
gcacatgcatacactctaag

SEQ ID NO: 749780 - DNA, 20 bp, mouse
gtgtcagttgaagcgggaaa

SEQ ID NO: 749781 - DNA, 20 bp, mouse
ggccatgctgcacttactgc

SEQ ID NO: 749782 - DNA, 20 bp, mouse
gttttaggaggattcaccag

SEQ ID NO: 749783 - DNA, 20 bp, mouse
gctaagttgccctaacaagc

SEQ ID NO: 749784 - DNA, 20 bp, mouse
gaatgggtgtcagttgaagc

SEQ ID NO: 749785 - DNA, 20 bp, mouse
gtcatgagaattagcaaaat

SEQ ID NO: 749786 - DNA, 20 bp, mouse
gccccccttaggcttatagt

SEQ ID NO: 749787 - DNA, 20 bp, mouse
gcaccccaaggatactggtt

SEQ ID NO: 749788 - DNA, 20 bp, mouse
gggactgaccaaaagaatct

SEQ ID NO: 749789 - DNA, 20 bp, mouse
gaacgctgggaaaactcaaa

SEQ ID NO: 749790 - DNA, 20 bp, mouse
ggggctcaaggagaccaaga

SEQ ID NO: 749791 - DNA, 20 bp, mouse
gcctaccgactataagccta

SEQ ID NO: 749792 - DNA, 20 bp, mouse
gttttggtcagtcccccctt

SEQ ID NO: 749793 - DNA, 20 bp, mouse
gaccgactataagcctaagg

SEQ ID NO: 749794 - DNA, 20 bp, mouse
gataccatcttcagcagggg

SEQ ID NO: 749795 - DNA, 20 bp, mouse
ggggcgataccatcttcagc

SEQ ID NO: 749796 - DNA, 20 bp, mouse
gaacgcaggctgctgaagcg

SEQ ID NO: 749797 - DNA, 20 bp, mouse
ggaggggcggggatgcggaa

SEQ ID NO: 749798 - DNA, 20 bp, mouse
ggggtgcagcctgcgctctg

SEQ ID NO: 749799 - DNA, 20 bp, mouse
gggggccgggagagatgcgt

SEQ ID NO: 749800 - DNA, 20 bp, mouse
ggcagaagctgcggcaactg

SEQ ID NO: 749801 - DNA, 20 bp, mouse
gctctgcggctcggacggga

SEQ ID NO: 749802 - DNA, 20 bp, mouse
gccggaggaggtgcgatcga

SEQ ID NO: 749803 - DNA, 20 bp, mouse
ggaagcggggaggagacacc

SEQ ID NO: 749804 - DNA, 20 bp, mouse
ggggcgcggaacaggtgatc

SEQ ID NO: 749805 - DNA, 20 bp, mouse
gtgcgctctgcggctcggac

SEQ ID NO: 749806 - DNA, 20 bp, mouse
ggagctggagcggcggtgag

SEQ ID NO: 749807 - DNA, 20 bp, mouse
gcgtccgcgcgccttcctgg

SEQ ID NO: 749808 - DNA, 20 bp, mouse
gcctggaacctggaaggcga

SEQ ID NO: 749809 - DNA, 20 bp, mouse
ggcccgcaaggttagacgga

SEQ ID NO: 749810 - DNA, 20 bp, mouse
gcgaggcccgcaaggttaga

SEQ ID NO: 749811 - DNA, 20 bp, mouse
gccagcccgcgaggcccgca

SEQ ID NO: 749812 - DNA, 20 bp, mouse
ggaacctggaaggcgaaggg

SEQ ID NO: 749813 - DNA, 20 bp, mouse
ggcatcgcctggaacctgga

SEQ ID NO: 749814 - DNA, 20 bp, mouse
gcgcgccagccccgccagga

SEQ ID NO: 749815 - DNA, 20 bp, mouse
gaccggcgcgcggcgataag

SEQ ID NO: 749816 - DNA, 20 bp, mouse
ggaccagtttcagacgagga

SEQ ID NO: 749817 - DNA, 20 bp, mouse
ggtctgaaactggtcctcat

SEQ ID NO: 749818 - DNA, 20 bp, mouse
gacagcaacacagcgctggc

SEQ ID NO: 749819 - DNA, 20 bp, mouse
gaaagggatctccctctccg

SEQ ID NO: 749820 - DNA, 20 bp, mouse
gagccctcctcgtctgaaac

SEQ ID NO: 749821 - DNA, 20 bp, mouse
gtgacacagcaacacagcgc

SEQ ID NO: 749822 - DNA, 20 bp, mouse
gagacaaagtggcacataat

SEQ ID NO: 749823 - DNA, 20 bp, mouse
gcaactcccagctacgggct

SEQ ID NO: 749824 - DNA, 20 bp, mouse
gaatcacgaaactcctaaga

SEQ ID NO: 749825 - DNA, 20 bp, mouse
gtgacgagctggccggggat

SEQ ID NO: 749826 - DNA, 20 bp, mouse
gcgagcgagccgcaaggagg

SEQ ID NO: 749827 - DNA, 20 bp, mouse
gcctgctcgcgctccgactg

SEQ ID NO: 749828 - DNA, 20 bp, mouse
gcaaaagccactctcggcga

SEQ ID NO: 749829 - DNA, 20 bp, mouse
gaccgtcttccgcctccttg

SEQ ID NO: 749830 - DNA, 20 bp, mouse
gggccggggcgcgggaatcg

SEQ ID NO: 749831 - DNA, 20 bp, mouse
gaagcccacgccagcagtct

SEQ ID NO: 749832 - DNA, 20 bp, mouse
gtcgggaaaagcaagcgcga

SEQ ID NO: 749833 - DNA, 20 bp, mouse
gggaagaaagtgcccccagt

SEQ ID NO: 749834 - DNA, 20 bp, mouse
gaggaggcggaagacggtcc

SEQ ID NO: 749835 - DNA, 20 bp, mouse
ggcgtgggctttattctcag

SEQ ID NO: 749836 - DNA, 20 bp, mouse
ggcgaactggggaacagact

SEQ ID NO: 749837 - DNA, 20 bp, mouse
gtcctcctccggggcgtccc

SEQ ID NO: 749838 - DNA, 20 bp, mouse
gcggggagggcggcgaactg

SEQ ID NO: 749839 - DNA, 20 bp, mouse
gggaggagccgggcagagat

SEQ ID NO: 749840 - DNA, 20 bp, mouse
gcaggagccgggcctgaaac

SEQ ID NO: 749841 - DNA, 20 bp, mouse
ggggcctgaaactggagcac

SEQ ID NO: 749842 - DNA, 20 bp, mouse
gtctcccggtctcctgcccc

SEQ ID NO: 749843 - DNA, 20 bp, mouse
gagagatgggcgcggatccc

SEQ ID NO: 749844 - DNA, 20 bp, mouse
ggaggagggtgagacggctt

SEQ ID NO: 749845 - DNA, 20 bp, mouse
ggcccattggccagcagccg

SEQ ID NO: 749846 - DNA, 20 bp, mouse
gcgagtgcgcgaggtgggga

SEQ ID NO: 749847 - DNA, 20 bp, mouse
ggggccgcccggcggcgtga

SEQ ID NO: 749848 - DNA, 20 bp, mouse
ggggtcctcagcacggagga

SEQ ID NO: 749849 - DNA, 20 bp, mouse
gaggggctgaggctcgacca

SEQ ID NO: 749850 - DNA, 20 bp, mouse
ggggcagtgggcggagttag

SEQ ID NO: 749851 - DNA, 20 bp, mouse
ggtgctgaggaccccagcga

SEQ ID NO: 749852 - DNA, 20 bp, mouse
ggggcggggcgcccagcagt

SEQ ID NO: 749853 - DNA, 20 bp, mouse
ggccccctcacgccgccggg

SEQ ID NO: 749854 - DNA, 20 bp, mouse
gctggaagctgctggaaatc

SEQ ID NO: 749855 - DNA, 20 bp, mouse
ggcgcccctcctccgtgctg

SEQ ID NO: 749856 - DNA, 20 bp, mouse
gactgaaaagtcactctcag

SEQ ID NO: 749857 - DNA, 20 bp, mouse
gtggcttcccaacagagggg

SEQ ID NO: 749858 - DNA, 20 bp, mouse
gctcagaggctgtaccttgc

SEQ ID NO: 749859 - DNA, 20 bp, mouse
gttttcagtaaacactgcga

SEQ ID NO: 749860 - DNA, 20 bp, mouse
gagagaatgcctgcatactt

SEQ ID NO: 749861 - DNA, 20 bp, mouse
gatggctccgcccctctgtt

SEQ ID NO: 749862 - DNA, 20 bp, mouse
gggttggcttcccaacagag

SEQ ID NO: 749863 - DNA, 20 bp, mouse
gcagaaaggcttaggaccaa

SEQ ID NO: 749864 - DNA, 20 bp, mouse
gcaaaggaaggcagaaccac

SEQ ID NO: 749865 - DNA, 20 bp, mouse
gcatggaaaccaaagtatgc

SEQ ID NO: 749866 - DNA, 20 bp, mouse
gctgtggcactccatgccga

SEQ ID NO: 749867 - DNA, 20 bp, mouse
gaatgaccgagtgtgcccga

SEQ ID NO: 749868 - DNA, 20 bp, mouse
ggcatggagtgccacagctt

SEQ ID NO: 749869 - DNA, 20 bp, mouse
ggagctgccagtacgtgaag

SEQ ID NO: 749870 - DNA, 20 bp, mouse
gcctcctcctcaagtctcaa

SEQ ID NO: 749871 - DNA, 20 bp, mouse
gcgtacagccgcggctctcg

SEQ ID NO: 749872 - DNA, 20 bp, mouse
ggtccaggccccgagagccg

SEQ ID NO: 749873 - DNA, 20 bp, mouse
ggggtttcgggtcagagagg

SEQ ID NO: 749874 - DNA, 20 bp, mouse
gtccagaacgggcagtgcgg

SEQ ID NO: 749875 - DNA, 20 bp, mouse
gacagcttcggcttacttcg

SEQ ID NO: 749876 - DNA, 20 bp, mouse
gcgcccacccagctgaccca

SEQ ID NO: 749877 - DNA, 20 bp, mouse
ggaaaagaggcggatcaagt

SEQ ID NO: 749878 - DNA, 20 bp, mouse
gaccgccgtgtcctcagccg

SEQ ID NO: 749879 - DNA, 20 bp, mouse
gacccaaagaataactggca

SEQ ID NO: 749880 - DNA, 20 bp, mouse
gcaagtgggggcggttccct

SEQ ID NO: 749881 - DNA, 20 bp, mouse
gggcctgtacgaggcctaga

SEQ ID NO: 749882 - DNA, 20 bp, mouse
ggccttgccagttattcttt

SEQ ID NO: 749883 - DNA, 20 bp, mouse
gcggggcatctcgggaaaag

SEQ ID NO: 749884 - DNA, 20 bp, mouse
gtcccttcccggggcatctc

SEQ ID NO: 749885 - DNA, 20 bp, mouse
gaaaacgcacagttacgcgc

SEQ ID NO: 749886 - DNA, 20 bp, mouse
gcctgccgagggtcccacgc

SEQ ID NO: 749887 - DNA, 20 bp, mouse
gccgccgcaagccacgtgac

SEQ ID NO: 749888 - DNA, 20 bp, mouse
gagggcgcgcggcacgacgc

SEQ ID NO: 749889 - DNA, 20 bp, mouse
gcgcggggctcagaatcagc

SEQ ID NO: 749890 - DNA, 20 bp, mouse
gcggggccgccggacggagt

SEQ ID NO: 749891 - DNA, 20 bp, mouse
gcgttcgggcggcatcctca

SEQ ID NO: 749892 - DNA, 20 bp, mouse
ggggagagaggagggtacgt

SEQ ID NO: 749893 - DNA, 20 bp, mouse
gggggcgcgggtcacggcgc

SEQ ID NO: 749894 - DNA, 20 bp, mouse
gcccatgtgggagttcctca

SEQ ID NO: 749895 - DNA, 20 bp, mouse
gccgagggtcccacgctgga

SEQ ID NO: 749896 - DNA, 20 bp, mouse
gaggccaaatcgccctctct

SEQ ID NO: 749897 - DNA, 20 bp, mouse
gccctctctgggtatatata

SEQ ID NO: 749898 - DNA, 20 bp, mouse
gaccgaggcgagaggctgtg

SEQ ID NO: 749899 - DNA, 20 bp, mouse
gctggcctggaaactcagga

SEQ ID NO: 749900 - DNA, 20 bp, mouse
gtatatatagggaaccctgg

SEQ ID NO: 749901 - DNA, 20 bp, mouse
ggcgacatttgcggtcttgg

SEQ ID NO: 749902 - DNA, 20 bp, mouse
gggcccggcaccgaggcgag

SEQ ID NO: 749903 - DNA, 20 bp, mouse
gtccctatatatacccagag

SEQ ID NO: 749904 - DNA, 20 bp, mouse
gttgggggaggggtcgggaa

SEQ ID NO: 749905 - DNA, 20 bp, mouse
ggtgactgaagcaaacagga

SEQ ID NO: 749906 - DNA, 20 bp, mouse
gtccggagcccgagcgtccc

SEQ ID NO: 749907 - DNA, 20 bp, mouse
gcgcgcgggcttcttttcct

SEQ ID NO: 749908 - DNA, 20 bp, mouse
ggaagctcgggtcgtccgtc

SEQ ID NO: 749909 - DNA, 20 bp, mouse
gtcctgggacgctcgggctc

SEQ ID NO: 749910 - DNA, 20 bp, mouse
gtcacaagcacgctgccgga

SEQ ID NO: 749911 - DNA, 20 bp, mouse
ggaagcccgcgcgctttttc

SEQ ID NO: 749912 - DNA, 20 bp, mouse
gtatgccggaaaaagcgcgc

SEQ ID NO: 749913 - DNA, 20 bp, mouse
gtccggaatgctcgaagctc

SEQ ID NO: 749914 - DNA, 20 bp, mouse
gctcaccggaagggtccgga

SEQ ID NO: 749915 - DNA, 20 bp, mouse
gtgtcctcaccggaagggtc

SEQ ID NO: 749916 - DNA, 20 bp, mouse
ggccccaggctgcctctagg

SEQ ID NO: 749917 - DNA, 20 bp, mouse
ggagaggcaagaccctgtgt

SEQ ID NO: 749918 - DNA, 20 bp, mouse
gctgagggtggccacatgat

SEQ ID NO: 749919 - DNA, 20 bp, mouse
gctggagcccctcctcctga

SEQ ID NO: 749920 - DNA, 20 bp, mouse
gagagattggtaagtcacag

SEQ ID NO: 749921 - DNA, 20 bp, mouse
ggtgcctcattcacacccag

SEQ ID NO: 749922 - DNA, 20 bp, mouse
ggaaaccggaaaactagctt

SEQ ID NO: 749923 - DNA, 20 bp, mouse
gacatgatgggcatgtgcca

SEQ ID NO: 749924 - DNA, 20 bp, mouse
gagaggcagcaccgagaaac

SEQ ID NO: 749925 - DNA, 20 bp, mouse
gctggggcactacacatccc

SEQ ID NO: 749926 - DNA, 20 bp, mouse
gtgatgaagaccatagacct

SEQ ID NO: 749927 - DNA, 20 bp, mouse
gctatgtagacccaggtcta

SEQ ID NO: 749928 - DNA, 20 bp, mouse
gcagagttagagaggccaaa

SEQ ID NO: 749929 - DNA, 20 bp, mouse
gtggtaacacagagttagag

SEQ ID NO: 749930 - DNA, 20 bp, mouse
gtgcttcagggcacattgtg

SEQ ID NO: 749931 - DNA, 20 bp, mouse
gttcatcagagcctcccctt

SEQ ID NO: 749932 - DNA, 20 bp, mouse
gatcttatctatgtagaccc

SEQ ID NO: 749933 - DNA, 20 bp, mouse
gagagcaagtaaatgatcct

SEQ ID NO: 749934 - DNA, 20 bp, mouse
gcaatctgctatggacaacg

SEQ ID NO: 749935 - DNA, 20 bp, mouse
ggccggaacatatacatcac

SEQ ID NO: 749936 - DNA, 20 bp, mouse
gcgagcgcaggtgagcagtc

SEQ ID NO: 749937 - DNA, 20 bp, mouse
gcggggctccgggttccacc

SEQ ID NO: 749938 - DNA, 20 bp, mouse
gtgacagcaggtcggggctc

SEQ ID NO: 749939 - DNA, 20 bp, mouse
gactactcctacacgagcgc

SEQ ID NO: 749940 - DNA, 20 bp, mouse
gaatgctgatctctctttac

SEQ ID NO: 749941 - DNA, 20 bp, mouse
gtctgactgacagcaggtcg

SEQ ID NO: 749942 - DNA, 20 bp, mouse
ggagcagtccggactgcagg

SEQ ID NO: 749943 - DNA, 20 bp, mouse
gtgctcacctgcgctcgtgt

SEQ ID NO: 749944 - DNA, 20 bp, mouse
gggtgagcagtccggactgc

SEQ ID NO: 749945 - DNA, 20 bp, mouse
ggggttccaccggggagatg

SEQ ID NO: 749946 - DNA, 20 bp, mouse
gtggctagggctgctggggt

SEQ ID NO: 749947 - DNA, 20 bp, mouse
gagcgcagcaaccggctcag

SEQ ID NO: 749948 - DNA, 20 bp, mouse
ggcagccctagccactgagc

SEQ ID NO: 749949 - DNA, 20 bp, mouse
ggtctcagaaccactgaata

SEQ ID NO: 749950 - DNA, 20 bp, mouse
gtggggtgggaaggtatcac

SEQ ID NO: 749951 - DNA, 20 bp, mouse
gctgaccaatccgtattcag

SEQ ID NO: 749952 - DNA, 20 bp, mouse
gagcaaccggctcagtggct

SEQ ID NO: 749953 - DNA, 20 bp, mouse
gagaaccactgaatacggat

SEQ ID NO: 749954 - DNA, 20 bp, mouse
gctgtcctggctcccgaagc

SEQ ID NO: 749955 - DNA, 20 bp, mouse
gagagcctggctgattcccg

SEQ ID NO: 749956 - DNA, 20 bp, mouse
gggggcgggtatcatgtcac

SEQ ID NO: 749957 - DNA, 20 bp, mouse
gaactctgaagtccgagagg

SEQ ID NO: 749958 - DNA, 20 bp, mouse
gttagaagaaagtggcgggg

SEQ ID NO: 749959 - DNA, 20 bp, mouse
gcgttgcaacaacctagtgg

SEQ ID NO: 749960 - DNA, 20 bp, mouse
gcacctagtggtccaccact

SEQ ID NO: 749961 - DNA, 20 bp, mouse
gtagcggaaagacaaagaac

SEQ ID NO: 749962 - DNA, 20 bp, mouse
ggtgcgttgcaacaacctag

SEQ ID NO: 749963 - DNA, 20 bp, mouse
ggagaactctgaagtccgag

SEQ ID NO: 749964 - DNA, 20 bp, mouse
gcactgcacacacaactcct

SEQ ID NO: 749965 - DNA, 20 bp, mouse
ggtccgagaggcggcgatat

SEQ ID NO: 749966 - DNA, 20 bp, mouse
gctccccgatccaggcctag

SEQ ID NO: 749967 - DNA, 20 bp, mouse
gagctgctgctccccgatcc

SEQ ID NO: 749968 - DNA, 20 bp, mouse
gaaaacgggagttagcctct

SEQ ID NO: 749969 - DNA, 20 bp, mouse
ggtcctggggctcgaatgac

SEQ ID NO: 749970 - DNA, 20 bp, mouse
gagacctaggggtgcctgca

SEQ ID NO: 749971 - DNA, 20 bp, mouse
gttagcctctaggcctggat

SEQ ID NO: 749972 - DNA, 20 bp, mouse
ggtgaagcggtcattccaga

SEQ ID NO: 749973 - DNA, 20 bp, mouse
ggagcaatgacaggtgtcct

SEQ ID NO: 749974 - DNA, 20 bp, mouse
ggccaggccagcgaagactc

SEQ ID NO: 749975 - DNA, 20 bp, mouse
ggccccgtgagagagttgag

SEQ ID NO: 749976 - DNA, 20 bp, mouse
gtgcagttgcatgtcggtcc

SEQ ID NO: 749977 - DNA, 20 bp, mouse
gagagctggtaaagatgagt

SEQ ID NO: 749978 - DNA, 20 bp, mouse
gtcactatggaagctatctg

SEQ ID NO: 749979 - DNA, 20 bp, mouse
ggaaacgcacggaccactcc

SEQ ID NO: 749980 - DNA, 20 bp, mouse
ggtacggttggcagaatcat

SEQ ID NO: 749981 - DNA, 20 bp, mouse
ggtagaccgtgaaagtgctg

SEQ ID NO: 749982 - DNA, 20 bp, mouse
gacgcactgcggctgcgcag

SEQ ID NO: 749983 - DNA, 20 bp, mouse
gatgacccgacaggaaatac

SEQ ID NO: 749984 - DNA, 20 bp, mouse
gtccatagtgagccttcaat

SEQ ID NO: 749985 - DNA, 20 bp, mouse
gacctattgaaggctcacta

SEQ ID NO: 749986 - DNA, 20 bp, mouse
gggcacctgcggaacgaggg

SEQ ID NO: 749987 - DNA, 20 bp, mouse
gagggtggctctgggaatcg

SEQ ID NO: 749988 - DNA, 20 bp, mouse
gacctctccgggttttgctg

SEQ ID NO: 749989 - DNA, 20 bp, mouse
gtctgggaatcgcggagtct

SEQ ID NO: 749990 - DNA, 20 bp, mouse
gcctacctgaaagccaaaga

SEQ ID NO: 749991 - DNA, 20 bp, mouse
gactgggcatgctccgtcat

SEQ ID NO: 749992 - DNA, 20 bp, mouse
gcgtccaggaatcgcccaag

SEQ ID NO: 749993 - DNA, 20 bp, mouse
gccgtcatcgggcaggttcg

SEQ ID NO: 749994 - DNA, 20 bp, mouse
ggcggaacgagggtggctct

SEQ ID NO: 749995 - DNA, 20 bp, mouse
gcaagcgcctgcaacagcag

SEQ ID NO: 749996 - DNA, 20 bp, mouse
ggtggggagtgaactgtgag

SEQ ID NO: 749997 - DNA, 20 bp, mouse
gggctgggctccatctggag

SEQ ID NO: 749998 - DNA, 20 bp, mouse
gggtgtttcaaggtaccgat

SEQ ID NO: 749999 - DNA, 20 bp, mouse
gcaagagccaatcacaaaac

SEQ ID NO: 750000 - DNA, 20 bp, mouse
gcacaaaactgggtgtttca

SEQ ID NO: 750001 - DNA, 20 bp, mouse
gtgggctccatctggagggg

SEQ ID NO: 750002 - DNA, 20 bp, mouse
ggtagctccgaagagcaagt

SEQ ID NO: 750003 - DNA, 20 bp, mouse
ggagacgcctacttgctctt

SEQ ID NO: 750004 - DNA, 20 bp, mouse
gttgctcttcggagctacgg

SEQ ID NO: 750005 - DNA, 20 bp, mouse
ggggacaagaagcttgcgca

SEQ ID NO: 750006 - DNA, 20 bp, mouse
gctactcggcccagtgttcc

SEQ ID NO: 750007 - DNA, 20 bp, mouse
gcctctctactccgccaatg

SEQ ID NO: 750008 - DNA, 20 bp, mouse
gagtagagcgaacagataag

SEQ ID NO: 750009 - DNA, 20 bp, mouse
gctgctcttctgcgcctcat

SEQ ID NO: 750010 - DNA, 20 bp, mouse
gctcttctgcgcctcattgg

SEQ ID NO: 750011 - DNA, 20 bp, mouse
gagcgccgaccaattggagg

SEQ ID NO: 750012 - DNA, 20 bp, mouse
gctgaagctctgcagtacat

SEQ ID NO: 750013 - DNA, 20 bp, mouse
gcagtacatgggctagaggc

SEQ ID NO: 750014 - DNA, 20 bp, mouse
gcgcagcgccgaccaattgg

SEQ ID NO: 750015 - DNA, 20 bp, mouse
gcagaccacctccaattggt

SEQ ID NO: 750016 - DNA, 20 bp, mouse
gggcgtgtcaaagctgaagt

SEQ ID NO: 750017 - DNA, 20 bp, mouse
ggggcggggcgtgagacctg

SEQ ID NO: 750018 - DNA, 20 bp, mouse
ggggacggggcgcgagtccg

SEQ ID NO: 750019 - DNA, 20 bp, mouse
gagctgggcgagcaaggggc

SEQ ID NO: 750020 - DNA, 20 bp, mouse
gaagagagctgggcgagcaa

SEQ ID NO: 750021 - DNA, 20 bp, mouse
gtggaaacggggcagggacg

SEQ ID NO: 750022 - DNA, 20 bp, mouse
gcggggcgtgagacctgggg

SEQ ID NO: 750023 - DNA, 20 bp, mouse
gtgactgacggcgggacgag

SEQ ID NO: 750024 - DNA, 20 bp, mouse
ggggtgcccaatacccttca

SEQ ID NO: 750025 - DNA, 20 bp, mouse
gtgggcgtggaaacggggca

SEQ ID NO: 750026 - DNA, 20 bp, mouse
gcccatctagacagttctta

SEQ ID NO: 750027 - DNA, 20 bp, mouse
gagaactgtctagatgggac

SEQ ID NO: 750028 - DNA, 20 bp, mouse
gaactctctgtatacagggc

SEQ ID NO: 750029 - DNA, 20 bp, mouse
gcaaggcaaactttttaaga

SEQ ID NO: 750030 - DNA, 20 bp, mouse
gtggatttaagcattgagaa

SEQ ID NO: 750031 - DNA, 20 bp, mouse
gggggaaagttaatttgagt

SEQ ID NO: 750032 - DNA, 20 bp, mouse
ggtcttactactttctattc

SEQ ID NO: 750033 - DNA, 20 bp, mouse
gaaagcacattttgtcccat

SEQ ID NO: 750034 - DNA, 20 bp, mouse
gaaaaaatctaactacgcag

SEQ ID NO: 750035 - DNA, 20 bp, mouse
gttggaactctctgtataca

SEQ ID NO: 750036 - DNA, 20 bp, mouse
gtggcgcggagaccaatcct

SEQ ID NO: 750037 - DNA, 20 bp, mouse
gggtctccgcgccacaggga

SEQ ID NO: 750038 - DNA, 20 bp, mouse
gggggggcgctaggcggaag

SEQ ID NO: 750039 - DNA, 20 bp, mouse
gggtgcacacgcatgactcc

SEQ ID NO: 750040 - DNA, 20 bp, mouse
gcgcccccctccctgtggcg

SEQ ID NO: 750041 - DNA, 20 bp, mouse
gcgcgctttgcgttgatggg

SEQ ID NO: 750042 - DNA, 20 bp, mouse
gagcctcccaggtgctcagg

SEQ ID NO: 750043 - DNA, 20 bp, mouse
gcagcggcgggaggtaaagg

SEQ ID NO: 750044 - DNA, 20 bp, mouse
gcagcagctacttccaatcc

SEQ ID NO: 750045 - DNA, 20 bp, mouse
gagcacctctggtgcagcgg

SEQ ID NO: 750046 - DNA, 20 bp, mouse
gcggccagacccgcctcccg

SEQ ID NO: 750047 - DNA, 20 bp, mouse
ggggaggccaagaggcgagc

SEQ ID NO: 750048 - DNA, 20 bp, mouse
gcgcgtgcgcggctgggcga

SEQ ID NO: 750049 - DNA, 20 bp, mouse
gctggccgcgccagccacag

SEQ ID NO: 750050 - DNA, 20 bp, mouse
gtggatccacgtgtcccctg

SEQ ID NO: 750051 - DNA, 20 bp, mouse
ggtagggtgtcgccctcggg

SEQ ID NO: 750052 - DNA, 20 bp, mouse
ggcagtagggtgtcgccctc

SEQ ID NO: 750053 - DNA, 20 bp, mouse
gtccccagggccctagcagt

SEQ ID NO: 750054 - DNA, 20 bp, mouse
gccggaacgtggctcaccgt

SEQ ID NO: 750055 - DNA, 20 bp, mouse
gaggaggcggactccgaagc

SEQ ID NO: 750056 - DNA, 20 bp, mouse
gaaggcaggctcctccgcat

SEQ ID NO: 750057 - DNA, 20 bp, mouse
gaggctcaagccatcccatg

SEQ ID NO: 750058 - DNA, 20 bp, mouse
gctcaagccatcccatgcgg

SEQ ID NO: 750059 - DNA, 20 bp, mouse
gcaggctcctccgcatggga

SEQ ID NO: 750060 - DNA, 20 bp, mouse
ggatggccatgcaagataag

SEQ ID NO: 750061 - DNA, 20 bp, mouse
ggccgcagccgggaccgaag

SEQ ID NO: 750062 - DNA, 20 bp, mouse
gtcagtgggagctgggaagg

SEQ ID NO: 750063 - DNA, 20 bp, mouse
gtgcctttgcgctgtctccc

SEQ ID NO: 750064 - DNA, 20 bp, mouse
gcaggtctttgcaaaagcaa

SEQ ID NO: 750065 - DNA, 20 bp, mouse
gtagacacattaacattcgg

SEQ ID NO: 750066 - DNA, 20 bp, mouse
gcccgcgcgcagattgtccc

SEQ ID NO: 750067 - DNA, 20 bp, mouse
ggccccgcgctcacagctcc

SEQ ID NO: 750068 - DNA, 20 bp, mouse
gtggccgcgccaggcgaaag

SEQ ID NO: 750069 - DNA, 20 bp, mouse
ggggagggcctggaggacaa

SEQ ID NO: 750070 - DNA, 20 bp, mouse
ggggcgacggcgcgtggaag

SEQ ID NO: 750071 - DNA, 20 bp, mouse
gtggcaacctggcttccccc

SEQ ID NO: 750072 - DNA, 20 bp, mouse
gacaatctgcgcgcgggcgg

SEQ ID NO: 750073 - DNA, 20 bp, mouse
ggacaagggctgtgcgggag

SEQ ID NO: 750074 - DNA, 20 bp, mouse
gcgcgcctgagcgccagagg

SEQ ID NO: 750075 - DNA, 20 bp, mouse
gccgcgctcacagctcccgg

SEQ ID NO: 750076 - DNA, 20 bp, mouse
gagagcgctccggccggaag

SEQ ID NO: 750077 - DNA, 20 bp, mouse
gagcgctctcgcggcttccg

SEQ ID NO: 750078 - DNA, 20 bp, mouse
gcttccgcggctacggttgg

SEQ ID NO: 750079 - DNA, 20 bp, mouse
gcagcacggccctaaggcgg

SEQ ID NO: 750080 - DNA, 20 bp, mouse
gactccgcgcctcttccggc

SEQ ID NO: 750081 - DNA, 20 bp, mouse
ggctccgccaaccgtagccg

SEQ ID NO: 750082 - DNA, 20 bp, mouse
gggagcgcggtacctggcct

SEQ ID NO: 750083 - DNA, 20 bp, mouse
gggaaaggggcgggcgtttc

SEQ ID NO: 750084 - DNA, 20 bp, mouse
gaggggcgggcgtttccgga

SEQ ID NO: 750085 - DNA, 20 bp, mouse
gtgggctatgcagagttcca

SEQ ID NO: 750086 - DNA, 20 bp, mouse
gaggagcagcaaaactggtt

SEQ ID NO: 750087 - DNA, 20 bp, mouse
ggacataggagcagcaaaac

SEQ ID NO: 750088 - DNA, 20 bp, mouse
gcacacagatccttggctgg

SEQ ID NO: 750089 - DNA, 20 bp, mouse
gaacgcgtcgacgtcagagt

SEQ ID NO: 750090 - DNA, 20 bp, mouse
ggagtgttaacttacagaga

SEQ ID NO: 750091 - DNA, 20 bp, mouse
gaaagaacttccggttggtg

SEQ ID NO: 750092 - DNA, 20 bp, mouse
gctcagtagagcaacctgat

SEQ ID NO: 750093 - DNA, 20 bp, mouse
gtcgacgcgttcatttgtgg

SEQ ID NO: 750094 - DNA, 20 bp, mouse
gacgtcgacgcgttcatttg

SEQ ID NO: 750095 - DNA, 20 bp, mouse
gcgtcgacgtcagagttggg

SEQ ID NO: 750096 - DNA, 20 bp, mouse
gagaacgcacacggtagctg

SEQ ID NO: 750097 - DNA, 20 bp, mouse
gtggttctctaacagaaatt

SEQ ID NO: 750098 - DNA, 20 bp, mouse
gtgtctgccgaccacatggg

SEQ ID NO: 750099 - DNA, 20 bp, mouse
ggcagcgggctttgcacaca

SEQ ID NO: 750100 - DNA, 20 bp, mouse
gtactgcagaccacagccct

SEQ ID NO: 750101 - DNA, 20 bp, mouse
ggatggcactaaaagttgat

SEQ ID NO: 750102 - DNA, 20 bp, mouse
gaagctgtctgccgaccaca

SEQ ID NO: 750103 - DNA, 20 bp, mouse
gtctaacctgagaacgcaca

SEQ ID NO: 750104 - DNA, 20 bp, mouse
gagaaatacgcaatatgaaa

SEQ ID NO: 750105 - DNA, 20 bp, mouse
ggctgctattgcaaaattaa

SEQ ID NO: 750106 - DNA, 20 bp, mouse
gctaggtgtgcaggaggcga

SEQ ID NO: 750107 - DNA, 20 bp, mouse
gcccgcccacagctttcaaa

SEQ ID NO: 750108 - DNA, 20 bp, mouse
gtcaatctagagcggaagga

SEQ ID NO: 750109 - DNA, 20 bp, mouse
ggggttaagcctaggtgtgc

SEQ ID NO: 750110 - DNA, 20 bp, mouse
ggggcggggctttctggtgt

SEQ ID NO: 750111 - DNA, 20 bp, mouse
gacgctgaagggttaagcct

SEQ ID NO: 750112 - DNA, 20 bp, mouse
gcgggactttgggtcactag

SEQ ID NO: 750113 - DNA, 20 bp, mouse
gcgtcctcgtcaatctagag

SEQ ID NO: 750114 - DNA, 20 bp, mouse
gttaagcctaggtgtgcagg

SEQ ID NO: 750115 - DNA, 20 bp, mouse
gaaggagggctagaatgttt

SEQ ID NO: 750116 - DNA, 20 bp, mouse
gtggaaattgagcaacagga

SEQ ID NO: 750117 - DNA, 20 bp, mouse
gtaataggaagtctgaccaa

SEQ ID NO: 750118 - DNA, 20 bp, mouse
gctaggaagcactgcattct

SEQ ID NO: 750119 - DNA, 20 bp, mouse
gagcagagacgcgttatgat

SEQ ID NO: 750120 - DNA, 20 bp, mouse
gcccctggaaattgagcaac

SEQ ID NO: 750121 - DNA, 20 bp, mouse
gcggaagttaggatttactg

SEQ ID NO: 750122 - DNA, 20 bp, mouse
gttcccgccacggaagttta

SEQ ID NO: 750123 - DNA, 20 bp, mouse
gaatccaggcacggaatgaa

SEQ ID NO: 750124 - DNA, 20 bp, mouse
gtcactttctccgccctaat

SEQ ID NO: 750125 - DNA, 20 bp, mouse
ggtcagacttcctattaggg

SEQ ID NO: 750126 - DNA, 20 bp, mouse
gcgaccgtgaagaaggtcgg

SEQ ID NO: 750127 - DNA, 20 bp, mouse
ggtctctcgggcactcaggc

SEQ ID NO: 750128 - DNA, 20 bp, mouse
gaccaggtgaggatgagtgt

SEQ ID NO: 750129 - DNA, 20 bp, mouse
gtgagcaaatggggtcgctg

SEQ ID NO: 750130 - DNA, 20 bp, mouse
gaagaaggtcgggggtctgg

SEQ ID NO: 750131 - DNA, 20 bp, mouse
gggtctggcgggccgcctgc

SEQ ID NO: 750132 - DNA, 20 bp, mouse
ggcatccggcttccgctctc

SEQ ID NO: 750133 - DNA, 20 bp, mouse
gtgagtgtgggtgagcaaat

SEQ ID NO: 750134 - DNA, 20 bp, mouse
ggaggctgcacgcagactgt

SEQ ID NO: 750135 - DNA, 20 bp, mouse
ggagcggaagccggatgcgg

SEQ ID NO: 750136 - DNA, 20 bp, mouse
gcggtcgagaactccccctc

SEQ ID NO: 750137 - DNA, 20 bp, mouse
gttgcagtggcgccttccgg

SEQ ID NO: 750138 - DNA, 20 bp, mouse
gggggcgtgcaagtgaatct

SEQ ID NO: 750139 - DNA, 20 bp, mouse
gcggccaatcacagcggcaa

SEQ ID NO: 750140 - DNA, 20 bp, mouse
gctggcccatccaaggcgag

SEQ ID NO: 750141 - DNA, 20 bp, mouse
gggaaggcgccactgcaagc

SEQ ID NO: 750142 - DNA, 20 bp, mouse
gcacgcccctcgccttggat

SEQ ID NO: 750143 - DNA, 20 bp, mouse
gaggcgccactgcaagccgg

SEQ ID NO: 750144 - DNA, 20 bp, mouse
gaatctaggctgtaattcct

SEQ ID NO: 750145 - DNA, 20 bp, mouse
gctgcaggctggcccatcca

SEQ ID NO: 750146 - DNA, 20 bp, mouse
gacgccacagccaatcatct

SEQ ID NO: 750147 - DNA, 20 bp, mouse
ggcctggttcccaagatgat

SEQ ID NO: 750148 - DNA, 20 bp, mouse
gcttggaggcgggactcaac

SEQ ID NO: 750149 - DNA, 20 bp, mouse
gaataggagcgcagagaccg

SEQ ID NO: 750150 - DNA, 20 bp, mouse
gaattgcgggaccccgtcta

SEQ ID NO: 750151 - DNA, 20 bp, mouse
ggagtcccgcctccaaggcc

SEQ ID NO: 750152 - DNA, 20 bp, mouse
gagaccgcggtggacaaacg

SEQ ID NO: 750153 - DNA, 20 bp, mouse
ggcagctaaccgagcaaaga

SEQ ID NO: 750154 - DNA, 20 bp, mouse
gttctcagtaccctagtcag

SEQ ID NO: 750155 - DNA, 20 bp, mouse
gaagtcggcttcctctagga

SEQ ID NO: 750156 - DNA, 20 bp, mouse
gcggtgggcggggctctgta

SEQ ID NO: 750157 - DNA, 20 bp, mouse
gaaagtgcgtgcggtgggcg

SEQ ID NO: 750158 - DNA, 20 bp, mouse
ggaaccgccattgattggac

SEQ ID NO: 750159 - DNA, 20 bp, mouse
gttggcgcgaaaagtgcgtg

SEQ ID NO: 750160 - DNA, 20 bp, mouse
gagagggcggggctagccgg

SEQ ID NO: 750161 - DNA, 20 bp, mouse
gtcagctcctaccctgttat

SEQ ID NO: 750162 - DNA, 20 bp, mouse
ggcgcgaaaagtgcgtgcgg

SEQ ID NO: 750163 - DNA, 20 bp, mouse
gcctcagccaataacagggt

SEQ ID NO: 750164 - DNA, 20 bp, mouse
ggtacggaaccgccattgat

SEQ ID NO: 750165 - DNA, 20 bp, mouse
ggccaaacccgtccaatcaa

SEQ ID NO: 750166 - DNA, 20 bp, mouse
gaacccgccaatcagatagg

SEQ ID NO: 750167 - DNA, 20 bp, mouse
gaaagattgccagatcctgg

SEQ ID NO: 750168 - DNA, 20 bp, mouse
gtgaatgacaaggggcttga

SEQ ID NO: 750169 - DNA, 20 bp, mouse
gtgtccaacccgccaggatc

SEQ ID NO: 750170 - DNA, 20 bp, mouse
gtaggggcgtgcctagaatt

SEQ ID NO: 750171 - DNA, 20 bp, mouse
gtgggaaatcatggcggttc

SEQ ID NO: 750172 - DNA, 20 bp, mouse
gtctacttccgcttggaggg

SEQ ID NO: 750173 - DNA, 20 bp, mouse
ggtcacccatgtgacccgtg

SEQ ID NO: 750174 - DNA, 20 bp, mouse
gctgcctggaggcgagtccc

SEQ ID NO: 750175 - DNA, 20 bp, mouse
gctagcgccccgagcagcag

SEQ ID NO: 750176 - DNA, 20 bp, mouse
gaagcggcgtgcagcacgtg

SEQ ID NO: 750177 - DNA, 20 bp, mouse
ggagcccggcacgaccagga

SEQ ID NO: 750178 - DNA, 20 bp, mouse
gtccggtccggacctcggga

SEQ ID NO: 750179 - DNA, 20 bp, mouse
gcggaagccgtcccgaggtc

SEQ ID NO: 750180 - DNA, 20 bp, mouse
ggcttccggaagccgtcccg

SEQ ID NO: 750181 - DNA, 20 bp, mouse
ggcggctggagcaaaaacgg

SEQ ID NO: 750182 - DNA, 20 bp, mouse
gtaaggaagccacgcgacta

SEQ ID NO: 750183 - DNA, 20 bp, mouse
ggccgtcccgaggtccggac

SEQ ID NO: 750184 - DNA, 20 bp, mouse
gcagagagacggaagtcgcc

SEQ ID NO: 750185 - DNA, 20 bp, mouse
gggtccctcctggtcgtgcc

SEQ ID NO: 750186 - DNA, 20 bp, mouse
ggaacgcggggtggagacta

SEQ ID NO: 750187 - DNA, 20 bp, mouse
ggggccggacaagacgtctg

SEQ ID NO: 750188 - DNA, 20 bp, mouse
gcaggctggcaggaattccg

SEQ ID NO: 750189 - DNA, 20 bp, mouse
ggggcgggtctcggaggcat

SEQ ID NO: 750190 - DNA, 20 bp, mouse
gggacaagacgtctgagggg

SEQ ID NO: 750191 - DNA, 20 bp, mouse
gagcgggacaccggcttcga

SEQ ID NO: 750192 - DNA, 20 bp, mouse
ggtctcggaggcatggggcg

SEQ ID NO: 750193 - DNA, 20 bp, mouse
ggagactagggcggagagaa

SEQ ID NO: 750194 - DNA, 20 bp, mouse
gcggggtttgagcgggacac

SEQ ID NO: 750195 - DNA, 20 bp, mouse
gggcttcgagggcgggttta

SEQ ID NO: 750196 - DNA, 20 bp, mouse
gcgtgctgcgcactcccgga

SEQ ID NO: 750197 - DNA, 20 bp, mouse
gaatcccggggccgccatct

SEQ ID NO: 750198 - DNA, 20 bp, mouse
gaccgcgctgccagcgacct

SEQ ID NO: 750199 - DNA, 20 bp, mouse
gcctggtggcaaactccatc

SEQ ID NO: 750200 - DNA, 20 bp, mouse
ggccaccaggcgcgcacaca

SEQ ID NO: 750201 - DNA, 20 bp, mouse
ggacaggtcgggcaatcccg

SEQ ID NO: 750202 - DNA, 20 bp, mouse
gtcgctggcagcgcggtcgg

SEQ ID NO: 750203 - DNA, 20 bp, mouse
gagaggagcgcgtctgtgct

SEQ ID NO: 750204 - DNA, 20 bp, mouse
gggagcgtgctgcgcactcc

SEQ ID NO: 750205 - DNA, 20 bp, mouse
gttggagacggagacaggtc

SEQ ID NO: 750206 - DNA, 20 bp, mouse
gcccgcgcgcgcccgacagt

SEQ ID NO: 750207 - DNA, 20 bp, mouse
gggttgccctggtgacagaa

SEQ ID NO: 750208 - DNA, 20 bp, mouse
gggagcaaacagcactatat

SEQ ID NO: 750209 - DNA, 20 bp, mouse
ggacagaagggctgcggtcc

SEQ ID NO: 750210 - DNA, 20 bp, mouse
gactgtggtagcctctcaaa

SEQ ID NO: 750211 - DNA, 20 bp, mouse
gctcccgcaaggcaaagaga

SEQ ID NO: 750212 - DNA, 20 bp, mouse
ggaagtcaagacattcactt

SEQ ID NO: 750213 - DNA, 20 bp, mouse
gtcgtaaacttcggaaactg

SEQ ID NO: 750214 - DNA, 20 bp, mouse
gttggaattagccgtttgag

SEQ ID NO: 750215 - DNA, 20 bp, mouse
gaagggatagcacaatacta

SEQ ID NO: 750216 - DNA, 20 bp, mouse
gcatgtcagctgatgcggga

SEQ ID NO: 750217 - DNA, 20 bp, mouse
ggatgcgggagggtttgaag

SEQ ID NO: 750218 - DNA, 20 bp, mouse
gcatcgccggacactactga

SEQ ID NO: 750219 - DNA, 20 bp, mouse
ggtgcgcatgcgcccctcgc

SEQ ID NO: 750220 - DNA, 20 bp, mouse
gacaagcgcgaccctttcta

SEQ ID NO: 750221 - DNA, 20 bp, mouse
gtctggactcagaagttaca

SEQ ID NO: 750222 - DNA, 20 bp, mouse
ggcgggaactggatccgatc

SEQ ID NO: 750223 - DNA, 20 bp, mouse
gagggtaacaggtgaagctc

SEQ ID NO: 750224 - DNA, 20 bp, mouse
gtaggacgccggatcatcgc

SEQ ID NO: 750225 - DNA, 20 bp, mouse
gactctaacaaaaggtctga

SEQ ID NO: 750226 - DNA, 20 bp, mouse
gctcagggacaccttctcgg

SEQ ID NO: 750227 - DNA, 20 bp, mouse
ggggtccacgtgtgagctca

SEQ ID NO: 750228 - DNA, 20 bp, mouse
gcccggacgcgaggcagaat

SEQ ID NO: 750229 - DNA, 20 bp, mouse
ggggccacgcgtagcgacca

SEQ ID NO: 750230 - DNA, 20 bp, mouse
gacccagggcgctgtcacga

SEQ ID NO: 750231 - DNA, 20 bp, mouse
gggcgggagatattccagga

SEQ ID NO: 750232 - DNA, 20 bp, mouse
gggagtacccacctgtggtg

SEQ ID NO: 750233 - DNA, 20 bp, mouse
gtctcggcgggagatattcc

SEQ ID NO: 750234 - DNA, 20 bp, mouse
ggaagtcagcggccgagggt

SEQ ID NO: 750235 - DNA, 20 bp, mouse
ggtgtccctgagctcacacg

SEQ ID NO: 750236 - DNA, 20 bp, mouse
gcggtggaagcgcagggaat

SEQ ID NO: 750237 - DNA, 20 bp, mouse
gagaacggccgccccataaa

SEQ ID NO: 750238 - DNA, 20 bp, mouse
ggtaagccagtggggacgtt

SEQ ID NO: 750239 - DNA, 20 bp, mouse
gccgttctcagagacaggta

SEQ ID NO: 750240 - DNA, 20 bp, mouse
gagccagtggggacgttcgg

SEQ ID NO: 750241 - DNA, 20 bp, mouse
gtctcagagacaggtaggga

SEQ ID NO: 750242 - DNA, 20 bp, mouse
ggagccaagtagacgctagt

SEQ ID NO: 750243 - DNA, 20 bp, mouse
ggggaggggactccgtctga

SEQ ID NO: 750244 - DNA, 20 bp, mouse
gcgctggaaaacgacaggtg

SEQ ID NO: 750245 - DNA, 20 bp, mouse
ggacgttcggtggaagcgca

SEQ ID NO: 750246 - DNA, 20 bp, mouse
gttcgcgctggcagagtctg

SEQ ID NO: 750247 - DNA, 20 bp, mouse
gccaccacgggttgcccaag

SEQ ID NO: 750248 - DNA, 20 bp, mouse
ggaaaacagcaggttggaaa

SEQ ID NO: 750249 - DNA, 20 bp, mouse
gcttaagcaaaggttaattg

SEQ ID NO: 750250 - DNA, 20 bp, mouse
ggccgtgttacgaacccctt

SEQ ID NO: 750251 - DNA, 20 bp, mouse
ggaaccccttgggcaacccg

SEQ ID NO: 750252 - DNA, 20 bp, mouse
gcgaggtagagcagaaagac

SEQ ID NO: 750253 - DNA, 20 bp, mouse
gcagacttctagaaaacagc

SEQ ID NO: 750254 - DNA, 20 bp, mouse
ggctccagagatatcttaga

SEQ ID NO: 750255 - DNA, 20 bp, mouse
ggactaggaaatcctcttaa

SEQ ID NO: 750256 - DNA, 20 bp, mouse
gagccgggcgctctcggcga

SEQ ID NO: 750257 - DNA, 20 bp, mouse
gggcccgcctccccgcgcaa

SEQ ID NO: 750258 - DNA, 20 bp, mouse
gtgtgtgtgcgcaagggctc

SEQ ID NO: 750259 - DNA, 20 bp, mouse
ggggccgcccgtgagcgatc

SEQ ID NO: 750260 - DNA, 20 bp, mouse
ggacctgcgccctgaagccg

SEQ ID NO: 750261 - DNA, 20 bp, mouse
gaggtcgccggagagcttca

SEQ ID NO: 750262 - DNA, 20 bp, mouse
ggcgccctgaagccgcggtg

SEQ ID NO: 750263 - DNA, 20 bp, mouse
gcgcccgcgagtctgcgagg

SEQ ID NO: 750264 - DNA, 20 bp, mouse
gaggacgagcgaaccctgcg

SEQ ID NO: 750265 - DNA, 20 bp, mouse
gagtctgcgagggggcgggt

SEQ ID NO: 750266 - DNA, 20 bp, mouse
gtggttctgagtctgtggct

SEQ ID NO: 750267 - DNA, 20 bp, mouse
gaagtggctcccaggaagca

SEQ ID NO: 750268 - DNA, 20 bp, mouse
gtgctgcttaaacacaaaca

SEQ ID NO: 750269 - DNA, 20 bp, mouse
gattctcatactctgaccac

SEQ ID NO: 750270 - DNA, 20 bp, mouse
gaacagaaacaatggcctgc

SEQ ID NO: 750271 - DNA, 20 bp, mouse
ggtttctgttgaacactttg

SEQ ID NO: 750272 - DNA, 20 bp, mouse
ggagggctaatttagcctgc

SEQ ID NO: 750273 - DNA, 20 bp, mouse
gaagcagggcagcaacacaa

SEQ ID NO: 750274 - DNA, 20 bp, mouse
gtgttgctgccctgcttcct

SEQ ID NO: 750275 - DNA, 20 bp, mouse
gactggtggttctgagtctg

SEQ ID NO: 750276 - DNA, 20 bp, mouse
gaagcaggacagcacacaaa

SEQ ID NO: 750277 - DNA, 20 bp, mouse
ggtgtgctgtcctgcttcct

SEQ ID NO: 750278 - DNA, 20 bp, mouse
ggagacccatgctgcatatg

SEQ ID NO: 750279 - DNA, 20 bp, mouse
ggtagtgtatgagcatgtgg

SEQ ID NO: 750280 - DNA, 20 bp, mouse
gctgtgagggataaagatgt

SEQ ID NO: 750281 - DNA, 20 bp, mouse
gtctgtagtgtatgagcatg

SEQ ID NO: 750282 - DNA, 20 bp, mouse
gattgaatacacagcatata

SEQ ID NO: 750283 - DNA, 20 bp, mouse
gggacagcacacaaagggag

SEQ ID NO: 750284 - DNA, 20 bp, mouse
gactcctgcatcccatgata

SEQ ID NO: 750285 - DNA, 20 bp, mouse
gagtaggacatgatagaatg

SEQ ID NO: 750286 - DNA, 20 bp, mouse
gtctcctgcatcccataata

SEQ ID NO: 750287 - DNA, 20 bp, mouse
gaagcaggacaggagcacaa

SEQ ID NO: 750288 - DNA, 20 bp, mouse
ggagcacaaagggagttagt

SEQ ID NO: 750289 - DNA, 20 bp, mouse
ggttagttggaccttgatca

SEQ ID NO: 750290 - DNA, 20 bp, mouse
gcactggtcaatacaaacaa

SEQ ID NO: 750291 - DNA, 20 bp, mouse
gtgctcctgtcctgcttcct

SEQ ID NO: 750292 - DNA, 20 bp, mouse
gagtaggacatgatagaatg

SEQ ID NO: 750293 - DNA, 20 bp, mouse
gctgtgagggatgaaggtgt

SEQ ID NO: 750294 - DNA, 20 bp, mouse
gaaaaaaaaaaactgatggt

SEQ ID NO: 750295 - DNA, 20 bp, mouse
gtgatagaatgtggctgtga

SEQ ID NO: 750296 - DNA, 20 bp, mouse
gagaggggacttgtctagtg

SEQ ID NO: 750297 - DNA, 20 bp, mouse
gacacactgctgtcagttac

SEQ ID NO: 750298 - DNA, 20 bp, mouse
ggaggtggaagagcctattg

SEQ ID NO: 750299 - DNA, 20 bp, mouse
ggcatgaccacattccccac

SEQ ID NO: 750300 - DNA, 20 bp, mouse
gcagttccctgagcattgac

SEQ ID NO: 750301 - DNA, 20 bp, mouse
gtagtgtggaaggcctcaat

SEQ ID NO: 750302 - DNA, 20 bp, mouse
gagcactcgagagtcagggg

SEQ ID NO: 750303 - DNA, 20 bp, mouse
gacaggaaattagaggtctc

SEQ ID NO: 750304 - DNA, 20 bp, mouse
gggcctctttcctcacctga

SEQ ID NO: 750305 - DNA, 20 bp, mouse
gcctctcctgtcaatgctca

SEQ ID NO: 750306 - DNA, 20 bp, mouse
gaacagagatcctcaacgta

SEQ ID NO: 750307 - DNA, 20 bp, mouse
gcctgttcttccttacgttg

SEQ ID NO: 750308 - DNA, 20 bp, mouse
gcacagagaaaggctattag

SEQ ID NO: 750309 - DNA, 20 bp, mouse
gcaagagaaagcaaacacga

SEQ ID NO: 750310 - DNA, 20 bp, mouse
gccactgaaatatcagaatt

SEQ ID NO: 750311 - DNA, 20 bp, mouse
gagagaaaggctattagagg

SEQ ID NO: 750312 - DNA, 20 bp, mouse
gaatagcctttctctgtgga

SEQ ID NO: 750313 - DNA, 20 bp, mouse
ggctccatgagcttgtggac

SEQ ID NO: 750314 - DNA, 20 bp, mouse
ggcaatagccagggatggtg

SEQ ID NO: 750315 - DNA, 20 bp, mouse
gagcagccttccacagagaa

SEQ ID NO: 750316 - DNA, 20 bp, mouse
gaaaacgcagcgggagggcg

SEQ ID NO: 750317 - DNA, 20 bp, mouse
gttggcagaagcgcttaggg

SEQ ID NO: 750318 - DNA, 20 bp, mouse
gcctcccagcgtcgcctggg

SEQ ID NO: 750319 - DNA, 20 bp, mouse
gcggttggcagaagcgctta

SEQ ID NO: 750320 - DNA, 20 bp, mouse
gtccaacacggaaacctccg

SEQ ID NO: 750321 - DNA, 20 bp, mouse
ggactgctggggtcagtcgt

SEQ ID NO: 750322 - DNA, 20 bp, mouse
gaagcgcttagggaggcacc

SEQ ID NO: 750323 - DNA, 20 bp, mouse
ggcccctcccagcgtcgcct

SEQ ID NO: 750324 - DNA, 20 bp, mouse
gaccgcggaggtttccgtgt

SEQ ID NO: 750325 - DNA, 20 bp, mouse
gaccccgcccaggcgacgct

SEQ ID NO: 750326 - DNA, 20 bp, mouse
gcttgctgctgcactgtctg

SEQ ID NO: 750327 - DNA, 20 bp, mouse
ggccctcagccccagaaagg

SEQ ID NO: 750328 - DNA, 20 bp, mouse
ggccagagcaatgccacctg

SEQ ID NO: 750329 - DNA, 20 bp, mouse
gcccccaggtggcattgctc

SEQ ID NO: 750330 - DNA, 20 bp, mouse
gatccaggatgcactggcga

SEQ ID NO: 750331 - DNA, 20 bp, mouse
gctggcgagggacgcagcaa

SEQ ID NO: 750332 - DNA, 20 bp, mouse
gtacacaaggacttgggcgg

SEQ ID NO: 750333 - DNA, 20 bp, mouse
ggggtgtaaaaataaccccc

SEQ ID NO: 750334 - DNA, 20 bp, mouse
gcccacacggaatgcgatcc

SEQ ID NO: 750335 - DNA, 20 bp, mouse
gtgtaaaaataacccccagg

SEQ ID NO: 750336 - DNA, 20 bp, mouse
gagaagaggctgattagaaa

SEQ ID NO: 750337 - DNA, 20 bp, mouse
ggatatgactcaactctcaa

SEQ ID NO: 750338 - DNA, 20 bp, mouse
gtgtactaacagtttgcaaa

SEQ ID NO: 750339 - DNA, 20 bp, mouse
gagagttgagtcatatcctg

SEQ ID NO: 750340 - DNA, 20 bp, mouse
gataaaaaacatcattgctg

SEQ ID NO: 750341 - DNA, 20 bp, mouse
gggtggtatttaaacctcac

SEQ ID NO: 750342 - DNA, 20 bp, mouse
ggtgagaatcacgtcacaca

SEQ ID NO: 750343 - DNA, 20 bp, mouse
gtgtagtttgtaagaatttt

SEQ ID NO: 750344 - DNA, 20 bp, mouse
gacacatcatcatcatcttt

SEQ ID NO: 750345 - DNA, 20 bp, mouse
gtgattctcactttttactg

SEQ ID NO: 750346 - DNA, 20 bp, mouse
gttaaggcggggctcacaag

SEQ ID NO: 750347 - DNA, 20 bp, mouse
gctagcgcgggggcagctgc

SEQ ID NO: 750348 - DNA, 20 bp, mouse
ggtgtgacacgaaggagttt

SEQ ID NO: 750349 - DNA, 20 bp, mouse
gtagctgggaggcggctcca

SEQ ID NO: 750350 - DNA, 20 bp, mouse
gtgcccccgcgctagctggg

SEQ ID NO: 750351 - DNA, 20 bp, mouse
gcgcttggattggctcacgg

SEQ ID NO: 750352 - DNA, 20 bp, mouse
gtactccgaaatcattcgct

SEQ ID NO: 750353 - DNA, 20 bp, mouse
gcgcctcccagctagcgcgg

SEQ ID NO: 750354 - DNA, 20 bp, mouse
gtgtgagccccgccttaaag

SEQ ID NO: 750355 - DNA, 20 bp, mouse
gtcttccaggtgtgacacga

SEQ ID NO: 750356 - DNA, 20 bp, mouse
ggaaagggcgggacttcaga

SEQ ID NO: 750357 - DNA, 20 bp, mouse
gttgctggaagaatagagtg

SEQ ID NO: 750358 - DNA, 20 bp, mouse
gtaggctcaagcagcttgat

SEQ ID NO: 750359 - DNA, 20 bp, mouse
gacagcttagtctccattgg

SEQ ID NO: 750360 - DNA, 20 bp, mouse
ggactaagctgttactgaaa

SEQ ID NO: 750361 - DNA, 20 bp, mouse
ggcgtcaacgtggagtcgag

SEQ ID NO: 750362 - DNA, 20 bp, mouse
gccctttcggctacccccaa

SEQ ID NO: 750363 - DNA, 20 bp, mouse
gtcagttacgggttcctcaa

SEQ ID NO: 750364 - DNA, 20 bp, mouse
gaacgtggagtcgagaggag

SEQ ID NO: 750365 - DNA, 20 bp, mouse
gaaattgtggcagtcagtta

SEQ ID NO: 750366 - DNA, 20 bp, mouse
gcgtcagagcatccgagttg

SEQ ID NO: 750367 - DNA, 20 bp, mouse
gtgcaaccggaagtccggag

SEQ ID NO: 750368 - DNA, 20 bp, mouse
gtccggttgcaagaaagggt

SEQ ID NO: 750369 - DNA, 20 bp, mouse
gaggatcagcgcaaacgtgg

SEQ ID NO: 750370 - DNA, 20 bp, mouse
gcggaagtccggagaggagc

SEQ ID NO: 750371 - DNA, 20 bp, mouse
ggaaagggtggggtccgaac

SEQ ID NO: 750372 - DNA, 20 bp, mouse
gtcagtggagcggaagtcat

SEQ ID NO: 750373 - DNA, 20 bp, mouse
ggacttccggttgcaagaaa

SEQ ID NO: 750374 - DNA, 20 bp, mouse
gccagtggggtaatcacgtg

SEQ ID NO: 750375 - DNA, 20 bp, mouse
gtctgggatagcaaccacgc

SEQ ID NO: 750376 - DNA, 20 bp, mouse
ggcagcgcagcggacggcag

SEQ ID NO: 750377 - DNA, 20 bp, mouse
gaggctcgaacgccagagac

SEQ ID NO: 750378 - DNA, 20 bp, mouse
gtctgggaatggagcagtaa

SEQ ID NO: 750379 - DNA, 20 bp, mouse
ggagtcaagcctctgaggcg

SEQ ID NO: 750380 - DNA, 20 bp, mouse
ggcgttcgagcctctgggaa

SEQ ID NO: 750381 - DNA, 20 bp, mouse
gacttccagagttaccttac

SEQ ID NO: 750382 - DNA, 20 bp, mouse
gtcaaaaggcgggagaatcc

SEQ ID NO: 750383 - DNA, 20 bp, mouse
ggtcctgagtcaagcctctg

SEQ ID NO: 750384 - DNA, 20 bp, mouse
ggcggccgccatctctcaac

SEQ ID NO: 750385 - DNA, 20 bp, mouse
gaccttacgggcaaattcta

SEQ ID NO: 750386 - DNA, 20 bp, mouse
gaggcagggaacaggggcgt

SEQ ID NO: 750387 - DNA, 20 bp, mouse
gggctggggcgaccagacta

SEQ ID NO: 750388 - DNA, 20 bp, mouse
gcaggggcgtggggatgtaa

SEQ ID NO: 750389 - DNA, 20 bp, mouse
gtaaaggcggacccggcaga

SEQ ID NO: 750390 - DNA, 20 bp, mouse
ggggcgtggggatgtaaagg

SEQ ID NO: 750391 - DNA, 20 bp, mouse
gactaggggcgaggccaggg

SEQ ID NO: 750392 - DNA, 20 bp, mouse
ggctcaccctagttcctgtc

SEQ ID NO: 750393 - DNA, 20 bp, mouse
gtcgcctcgggagcgagcgt

SEQ ID NO: 750394 - DNA, 20 bp, mouse
gctgcagcggaaaatggcta

SEQ ID NO: 750395 - DNA, 20 bp, mouse
ggacgaggcccgcggcgatg

SEQ ID NO: 750396 - DNA, 20 bp, mouse
gaatcccggaagagagtcgg

SEQ ID NO: 750397 - DNA, 20 bp, mouse
ggcggctaccggcgggaaac

SEQ ID NO: 750398 - DNA, 20 bp, mouse
gaagaaaacgctaatcagga

SEQ ID NO: 750399 - DNA, 20 bp, mouse
gtaactggcgccagactctc

SEQ ID NO: 750400 - DNA, 20 bp, mouse
gcaaatgtgcggctaccggc

SEQ ID NO: 750401 - DNA, 20 bp, mouse
gctgcgcgggaagtagtccg

SEQ ID NO: 750402 - DNA, 20 bp, mouse
ggcgaatcccggaagagagt

SEQ ID NO: 750403 - DNA, 20 bp, mouse
gtccgtggatgacgtagcga

SEQ ID NO: 750404 - DNA, 20 bp, mouse
ggcgacggagggttggccta

SEQ ID NO: 750405 - DNA, 20 bp, mouse
ggtggatgacgtagcgacgg

SEQ ID NO: 750406 - DNA, 20 bp, mouse
ggggaggggacgcctgaggg

SEQ ID NO: 750407 - DNA, 20 bp, mouse
ggggaggaaaccagacgagc

SEQ ID NO: 750408 - DNA, 20 bp, mouse
gctgggtaggcggagatctg

SEQ ID NO: 750409 - DNA, 20 bp, mouse
gcagggccgggagaacctcg

SEQ ID NO: 750410 - DNA, 20 bp, mouse
ggcagcagcgagtcccgcac

SEQ ID NO: 750411 - DNA, 20 bp, mouse
gacggggtgggccagggaag

SEQ ID NO: 750412 - DNA, 20 bp, mouse
gacgggggaggggacgcctg

SEQ ID NO: 750413 - DNA, 20 bp, mouse
gggttctcccggccctgggt

SEQ ID NO: 750414 - DNA, 20 bp, mouse
gagatcctggctctgagcga

SEQ ID NO: 750415 - DNA, 20 bp, mouse
gcctggctctgagcgagggg

SEQ ID NO: 750416 - DNA, 20 bp, mouse
gaggagaggggctgcccgga

SEQ ID NO: 750417 - DNA, 20 bp, mouse
ggccctgagctcccttgcga

SEQ ID NO: 750418 - DNA, 20 bp, mouse
gcccaggcccaccaaggtta

SEQ ID NO: 750419 - DNA, 20 bp, mouse
gcatctggcctgtccagctc

SEQ ID NO: 750420 - DNA, 20 bp, mouse
gcgcgccgcccccaacctcg

SEQ ID NO: 750421 - DNA, 20 bp, mouse
gcgagggagctgtctgggtc

SEQ ID NO: 750422 - DNA, 20 bp, mouse
ggggccggagggacgtggtc

SEQ ID NO: 750423 - DNA, 20 bp, mouse
ggggcggcgcgacctaggtt

SEQ ID NO: 750424 - DNA, 20 bp, mouse
gcgaagggcaggattgaaag

SEQ ID NO: 750425 - DNA, 20 bp, mouse
ggcagacagccccgaggttg

SEQ ID NO: 750426 - DNA, 20 bp, mouse
ggagagcgagcgagcgacaa

SEQ ID NO: 750427 - DNA, 20 bp, mouse
gcgagcgagcgacaaagggt

SEQ ID NO: 750428 - DNA, 20 bp, mouse
gaggctgggccgggcgagct

SEQ ID NO: 750429 - DNA, 20 bp, mouse
gaagcaaggaaattggacag

SEQ ID NO: 750430 - DNA, 20 bp, mouse
gagagaccgatcgcggagat

SEQ ID NO: 750431 - DNA, 20 bp, mouse
ggcacagcgaagcccaagtt

SEQ ID NO: 750432 - DNA, 20 bp, mouse
gaactggaggggaatcaaac

SEQ ID NO: 750433 - DNA, 20 bp, mouse
ggcggaatgaaaagctcgga

SEQ ID NO: 750434 - DNA, 20 bp, mouse
ggatcgcggagatgggagga

SEQ ID NO: 750435 - DNA, 20 bp, mouse
gtccgctcgctccctaactt

SEQ ID NO: 750436 - DNA, 20 bp, mouse
gaggataaggtcaccttcga

SEQ ID NO: 750437 - DNA, 20 bp, mouse
gagggcttaagatagagatg

SEQ ID NO: 750438 - DNA, 20 bp, mouse
gagccacaaaagcacctgaa

SEQ ID NO: 750439 - DNA, 20 bp, mouse
ggaagggctcttttgtaccc

SEQ ID NO: 750440 - DNA, 20 bp, mouse
gtacatatagaagatattct

SEQ ID NO: 750441 - DNA, 20 bp, mouse
gatcccaacagcaccatcca

SEQ ID NO: 750442 - DNA, 20 bp, mouse
gaagaaagagtctttgtaaa

SEQ ID NO: 750443 - DNA, 20 bp, mouse
gcaaagcacaaagtcatggc

SEQ ID NO: 750444 - DNA, 20 bp, mouse
gtagagatgaggatgataac

SEQ ID NO: 750445 - DNA, 20 bp, mouse
gatgactttgtgctttgacg

SEQ ID NO: 750446 - DNA, 20 bp, mouse
gggagcgcgtctgtgagcag

SEQ ID NO: 750447 - DNA, 20 bp, mouse
gagaggaggcgttaactcga

SEQ ID NO: 750448 - DNA, 20 bp, mouse
gtcgctgcaaagtagtcccg

SEQ ID NO: 750449 - DNA, 20 bp, mouse
ggggctggcccgcaaaggtt

SEQ ID NO: 750450 - DNA, 20 bp, mouse
gactttgcagcgaggcgcgt

SEQ ID NO: 750451 - DNA, 20 bp, mouse
ggcgtaggaagaaggggttt

SEQ ID NO: 750452 - DNA, 20 bp, mouse
ggtcaggaatgcacgaaggt

SEQ ID NO: 750453 - DNA, 20 bp, mouse
gggtgggcgccagaggtcgc

SEQ ID NO: 750454 - DNA, 20 bp, mouse
gcgaggcgcgtaggaagaag

SEQ ID NO: 750455 - DNA, 20 bp, mouse
ggacgtgtgctgtcgctcag

SEQ ID NO: 750456 - DNA, 20 bp, mouse
gaggccatgtgcaaataggg

SEQ ID NO: 750457 - DNA, 20 bp, mouse
gcggaggccatgtgcaaata

SEQ ID NO: 750458 - DNA, 20 bp, mouse
ggcgcaggcgcgttcaaaag

SEQ ID NO: 750459 - DNA, 20 bp, mouse
ggcaagcagaagcggaatcg

SEQ ID NO: 750460 - DNA, 20 bp, mouse
gggttctgttcgaaggtgag

SEQ ID NO: 750461 - DNA, 20 bp, mouse
gcctcctcaagcggcgcgtc

SEQ ID NO: 750462 - DNA, 20 bp, mouse
gctgttcgaaggtgagtgga

SEQ ID NO: 750463 - DNA, 20 bp, mouse
gcatcggttctcagcgaccg

SEQ ID NO: 750464 - DNA, 20 bp, mouse
ggaaccccgtgactacacat

SEQ ID NO: 750465 - DNA, 20 bp, mouse
gtccgggatcttgatgaacc

SEQ ID NO: 750466 - DNA, 20 bp, mouse
gctgacgtcacgattctctc

SEQ ID NO: 750467 - DNA, 20 bp, mouse
ggcgagatctcggaagtggc

SEQ ID NO: 750468 - DNA, 20 bp, mouse
ggcctcgctcgccgggtcta

SEQ ID NO: 750469 - DNA, 20 bp, mouse
gagtgggcaaagctaacggt

SEQ ID NO: 750470 - DNA, 20 bp, mouse
gcggaagtgggcaaagctaa

SEQ ID NO: 750471 - DNA, 20 bp, mouse
gtctcgcgagatctcggaag

SEQ ID NO: 750472 - DNA, 20 bp, mouse
ggcaaagctaacggtgggga

SEQ ID NO: 750473 - DNA, 20 bp, mouse
gagcgctaggtcccggaagt

SEQ ID NO: 750474 - DNA, 20 bp, mouse
gggcctctctcgcgagatct

SEQ ID NO: 750475 - DNA, 20 bp, mouse
ggccctagacccggcgagcg

SEQ ID NO: 750476 - DNA, 20 bp, mouse
gggagtggaggcggggacta

SEQ ID NO: 750477 - DNA, 20 bp, mouse
gaggcctagaccaggggaag

SEQ ID NO: 750478 - DNA, 20 bp, mouse
gaggtgagaggcacagacgc

SEQ ID NO: 750479 - DNA, 20 bp, mouse
ggtggaggcggggactaggg

SEQ ID NO: 750480 - DNA, 20 bp, mouse
gggcacagacgcgggagtcc

SEQ ID NO: 750481 - DNA, 20 bp, mouse
gcctccccccatcccgtgga

SEQ ID NO: 750482 - DNA, 20 bp, mouse
gagagctgggcctgctacga

SEQ ID NO: 750483 - DNA, 20 bp, mouse
ggtcccggctcggcgagggg

SEQ ID NO: 750484 - DNA, 20 bp, mouse
gacaccaggacatactcccg

SEQ ID NO: 750485 - DNA, 20 bp, mouse
gggagtcccggctcggcgag

SEQ ID NO: 750486 - DNA, 20 bp, mouse
gcggccccgctccctaatgg

SEQ ID NO: 750487 - DNA, 20 bp, mouse
gctaatcgtaatgacggtga

SEQ ID NO: 750488 - DNA, 20 bp, mouse
ggcagctccggtatcctcat

SEQ ID NO: 750489 - DNA, 20 bp, mouse
gggcgaagagctggccaatg

SEQ ID NO: 750490 - DNA, 20 bp, mouse
gttcgcccgccattagggag

SEQ ID NO: 750491 - DNA, 20 bp, mouse
gaggataccggagctgcggt

SEQ ID NO: 750492 - DNA, 20 bp, mouse
gagctggccaatgaggatac

SEQ ID NO: 750493 - DNA, 20 bp, mouse
ggccgtgcccttacgagtgc

SEQ ID NO: 750494 - DNA, 20 bp, mouse
gcagggagctggaaccagtg

SEQ ID NO: 750495 - DNA, 20 bp, mouse
gctaatggcgggcgaagagc

SEQ ID NO: 750496 - DNA, 20 bp, mouse
gagcgcgcaggaggtgggga

SEQ ID NO: 750497 - DNA, 20 bp, mouse
gtggaccaataggaggcggg

SEQ ID NO: 750498 - DNA, 20 bp, mouse
gtgcgcgctccggcaccggg

SEQ ID NO: 750499 - DNA, 20 bp, mouse
ggccggagcgcgcaggaggt

SEQ ID NO: 750500 - DNA, 20 bp, mouse
ggccggggcctgagcgacca

SEQ ID NO: 750501 - DNA, 20 bp, mouse
gtggtccaggaggcggcgtc

SEQ ID NO: 750502 - DNA, 20 bp, mouse
gagaagggggtgtcccagaa

SEQ ID NO: 750503 - DNA, 20 bp, mouse
gggccagcgtagcctaggag

SEQ ID NO: 750504 - DNA, 20 bp, mouse
gctcctgcgcgctccggcac

SEQ ID NO: 750505 - DNA, 20 bp, mouse
gccgtccgcggagagaacgc

SEQ ID NO: 750506 - DNA, 20 bp, mouse
ggaggactagagagctagaa

SEQ ID NO: 750507 - DNA, 20 bp, mouse
gtatctctgtctgacctcgg

SEQ ID NO: 750508 - DNA, 20 bp, mouse
gcggactagtgtgtactcaa

SEQ ID NO: 750509 - DNA, 20 bp, mouse
gggtccggaggctctcttcc

SEQ ID NO: 750510 - DNA, 20 bp, mouse
gtctgacctcggaggtccgg

SEQ ID NO: 750511 - DNA, 20 bp, mouse
gttcgcaagagcttccgggg

SEQ ID NO: 750512 - DNA, 20 bp, mouse
gagagcttccggggaggccg

SEQ ID NO: 750513 - DNA, 20 bp, mouse
gtcctccagggtccgctcta

SEQ ID NO: 750514 - DNA, 20 bp, mouse
gggccgggggaaccatagag

SEQ ID NO: 750515 - DNA, 20 bp, mouse
ggtccgctctatggttcccc

SEQ ID NO: 750516 - DNA, 20 bp, mouse
ggcgccggcagctcctcgtt

SEQ ID NO: 750517 - DNA, 20 bp, mouse
ggcgccactgctagtaggaa

SEQ ID NO: 750518 - DNA, 20 bp, mouse
ggaagcggaagtagcttttg

SEQ ID NO: 750519 - DNA, 20 bp, mouse
gctgccgcgccactgctagt

SEQ ID NO: 750520 - DNA, 20 bp, mouse
gactactgccacgcccccgt

SEQ ID NO: 750521 - DNA, 20 bp, mouse
ggtcctgtgtgaaagataag

SEQ ID NO: 750522 - DNA, 20 bp, mouse
gtcgccaaacgaggagctgc

SEQ ID NO: 750523 - DNA, 20 bp, mouse
gagtaagtcactgtgcgctt

SEQ ID NO: 750524 - DNA, 20 bp, mouse
gctcagaaggatcagtcaac

SEQ ID NO: 750525 - DNA, 20 bp, mouse
gacttactctgtatcaacac

SEQ ID NO: 750526 - DNA, 20 bp, mouse
gagcgcaagagcgccttcgg

SEQ ID NO: 750527 - DNA, 20 bp, mouse
gcggggagaatagctgcaac

SEQ ID NO: 750528 - DNA, 20 bp, mouse
gctccccgcagagcctccga

SEQ ID NO: 750529 - DNA, 20 bp, mouse
gtggagggaggtgtggtcgc

SEQ ID NO: 750530 - DNA, 20 bp, mouse
gttgtggcccgcgccttgga

SEQ ID NO: 750531 - DNA, 20 bp, mouse
gaagtgagttgggtggtgta

SEQ ID NO: 750532 - DNA, 20 bp, mouse
gctctagtgagaagtgagtt

SEQ ID NO: 750533 - DNA, 20 bp, mouse
gcacacctccctccaaggcg

SEQ ID NO: 750534 - DNA, 20 bp, mouse
gagcgccttcggaggctctg

SEQ ID NO: 750535 - DNA, 20 bp, mouse
ggggctttgccggttctctg

SEQ ID NO: 750536 - DNA, 20 bp, mouse
ggagaagcgctgagtcacgg

SEQ ID NO: 750537 - DNA, 20 bp, mouse
gcggccgagccgccgtgcga

SEQ ID NO: 750538 - DNA, 20 bp, mouse
gaacgccaagcgagagacct

SEQ ID NO: 750539 - DNA, 20 bp, mouse
gcggcccgcccctcacccgt

SEQ ID NO: 750540 - DNA, 20 bp, mouse
gcccccgccccctcgcacgg

SEQ ID NO: 750541 - DNA, 20 bp, mouse
gcgagagacctgggccccga

SEQ ID NO: 750542 - DNA, 20 bp, mouse
gcgcgagaagcgctgagtca

SEQ ID NO: 750543 - DNA, 20 bp, mouse
gggccccgacgggtgagggg

SEQ ID NO: 750544 - DNA, 20 bp, mouse
ggaggacagtggacgagccg

SEQ ID NO: 750545 - DNA, 20 bp, mouse
gcgggcgtgggtggcgagag

SEQ ID NO: 750546 - DNA, 20 bp, mouse
gggccagcagccatggacga

SEQ ID NO: 750547 - DNA, 20 bp, mouse
ggggggagcagggttgtaat

SEQ ID NO: 750548 - DNA, 20 bp, mouse
gccagctccgagcctcccat

SEQ ID NO: 750549 - DNA, 20 bp, mouse
gaggcgcggcgctgggtcgg

SEQ ID NO: 750550 - DNA, 20 bp, mouse
gacacccaggaactcggcgc

SEQ ID NO: 750551 - DNA, 20 bp, mouse
gagctcacgtgcgaccccga

SEQ ID NO: 750552 - DNA, 20 bp, mouse
gcgcaggcgcggcgctgggt

SEQ ID NO: 750553 - DNA, 20 bp, mouse
ggcaggaaggtgccgccgag

SEQ ID NO: 750554 - DNA, 20 bp, mouse
gcacgtgcgaccccgacggc

SEQ ID NO: 750555 - DNA, 20 bp, mouse
gggctccatgggatagcgca

SEQ ID NO: 750556 - DNA, 20 bp, mouse
gtaggcaggtaagcggaaga

SEQ ID NO: 750557 - DNA, 20 bp, mouse
gccagaaagcagatcccgtg

SEQ ID NO: 750558 - DNA, 20 bp, mouse
gtgccccacctgctcgcagt

SEQ ID NO: 750559 - DNA, 20 bp, mouse
ggccaaaggcagcacctcac

SEQ ID NO: 750560 - DNA, 20 bp, mouse
ggacttcagcttctccagtt

SEQ ID NO: 750561 - DNA, 20 bp, mouse
gcagtcccactgcgagcagg

SEQ ID NO: 750562 - DNA, 20 bp, mouse
gctctccgagagctcaggtc

SEQ ID NO: 750563 - DNA, 20 bp, mouse
gtgcctccctgcccccatat

SEQ ID NO: 750564 - DNA, 20 bp, mouse
gtgagctctcggagaggctg

SEQ ID NO: 750565 - DNA, 20 bp, mouse
gtgagggtgcggggactcct

SEQ ID NO: 750566 - DNA, 20 bp, mouse
gaccccagggccgaaagatg

SEQ ID NO: 750567 - DNA, 20 bp, mouse
gctggcaggtagcctgggat

SEQ ID NO: 750568 - DNA, 20 bp, mouse
gtcgttggggaccgaggaat

SEQ ID NO: 750569 - DNA, 20 bp, mouse
gaggacccgcggccccaccc

SEQ ID NO: 750570 - DNA, 20 bp, mouse
gtgcccgccaaccgattcct

SEQ ID NO: 750571 - DNA, 20 bp, mouse
gccgccggaaggacgaagtc

SEQ ID NO: 750572 - DNA, 20 bp, mouse
gccggcctggcaggtagcct

SEQ ID NO: 750573 - DNA, 20 bp, mouse
gtcggccctggggtaattcg

SEQ ID NO: 750574 - DNA, 20 bp, mouse
gtggggaccgaggaatcggt

SEQ ID NO: 750575 - DNA, 20 bp, mouse
gtcgcacgcctgagggtcac

SEQ ID NO: 750576 - DNA, 20 bp, mouse
ggagaggcgcttgtacgtgt

SEQ ID NO: 750577 - DNA, 20 bp, mouse
gtacaagcgcctctccgcgc

SEQ ID NO: 750578 - DNA, 20 bp, mouse
gcgcgcaggcgcggtgtggg

SEQ ID NO: 750579 - DNA, 20 bp, mouse
gtcgatgtagtgaatgtctg

SEQ ID NO: 750580 - DNA, 20 bp, mouse
ggcgcggcttccggggaagc

SEQ ID NO: 750581 - DNA, 20 bp, mouse
gtcgtctgccgggagacata

SEQ ID NO: 750582 - DNA, 20 bp, mouse
gccagcggcgacagtgcgca

SEQ ID NO: 750583 - DNA, 20 bp, mouse
gcgcctgcgcgcgcggcttc

SEQ ID NO: 750584 - DNA, 20 bp, mouse
gcaaggttccgcccaccaac

SEQ ID NO: 750585 - DNA, 20 bp, mouse
gggcttccggggaagctggc

SEQ ID NO: 750586 - DNA, 20 bp, mouse
ggagaaagggagctacgggg

SEQ ID NO: 750587 - DNA, 20 bp, mouse
gagcgagcgcggggagctgg

SEQ ID NO: 750588 - DNA, 20 bp, mouse
gaagggagctacggggaggg

SEQ ID NO: 750589 - DNA, 20 bp, mouse
gcagatggcaatcgccgagg

SEQ ID NO: 750590 - DNA, 20 bp, mouse
gagctacggggagggcggca

SEQ ID NO: 750591 - DNA, 20 bp, mouse
gtgtctgtaggggaaccgag

SEQ ID NO: 750592 - DNA, 20 bp, mouse
ggcagaggactatgtctgtg

SEQ ID NO: 750593 - DNA, 20 bp, mouse
gggacagagaattgattcgt

SEQ ID NO: 750594 - DNA, 20 bp, mouse
gatggcaatcgccgaggagg

SEQ ID NO: 750595 - DNA, 20 bp, mouse
gaaggagagagcggcagcaa

SEQ ID NO: 750596 - DNA, 20 bp, mouse
gcgcaggtgcagcagcacac

SEQ ID NO: 750597 - DNA, 20 bp, mouse
gtgggctccacaaccaatga

SEQ ID NO: 750598 - DNA, 20 bp, mouse
gaggcggctagggcacagag

SEQ ID NO: 750599 - DNA, 20 bp, mouse
gtggaaaaaagaggcggcta

SEQ ID NO: 750600 - DNA, 20 bp, mouse
ggcacacaggctggtcggga

SEQ ID NO: 750601 - DNA, 20 bp, mouse
gtgtcgagattacccttcat

SEQ ID NO: 750602 - DNA, 20 bp, mouse
gaccccattcagctgcggat

SEQ ID NO: 750603 - DNA, 20 bp, mouse
gaatctcgacaaagagcaag

SEQ ID NO: 750604 - DNA, 20 bp, mouse
gagcagatgtcgcactctta

SEQ ID NO: 750605 - DNA, 20 bp, mouse
gccgtgcggggtcccggcat

SEQ ID NO: 750606 - DNA, 20 bp, mouse
gaaaccctacaccaatacct

SEQ ID NO: 750607 - DNA, 20 bp, mouse
gggactggtgtgaggattga

SEQ ID NO: 750608 - DNA, 20 bp, mouse
gagttctgaactctcttcat

SEQ ID NO: 750609 - DNA, 20 bp, mouse
ggggctcaggcttgctgtcg

SEQ ID NO: 750610 - DNA, 20 bp, mouse
gctggtgtgaggattgaggg

SEQ ID NO: 750611 - DNA, 20 bp, mouse
gtctgcccaggtattggtgt

SEQ ID NO: 750612 - DNA, 20 bp, mouse
gtacctgggcagagagcgag

SEQ ID NO: 750613 - DNA, 20 bp, mouse
gctgaactctcttcatgggt

SEQ ID NO: 750614 - DNA, 20 bp, mouse
gattgagggtgggctacgta

SEQ ID NO: 750615 - DNA, 20 bp, mouse
ggagtgcaaaggggatactg

SEQ ID NO: 750616 - DNA, 20 bp, mouse
ggggcctgctagagatcctg

SEQ ID NO: 750617 - DNA, 20 bp, mouse
gtagcaggcccggctccgat

SEQ ID NO: 750618 - DNA, 20 bp, mouse
gtccccgcaggatctctagc

SEQ ID NO: 750619 - DNA, 20 bp, mouse
gcacacacccttagacgcca

SEQ ID NO: 750620 - DNA, 20 bp, mouse
gtggctcagaattcacacct

SEQ ID NO: 750621 - DNA, 20 bp, mouse
ggccccgactcttccgggga

SEQ ID NO: 750622 - DNA, 20 bp, mouse
gagcggccccgactcttccg

SEQ ID NO: 750623 - DNA, 20 bp, mouse
gcccggcggcaagaagagaa

SEQ ID NO: 750624 - DNA, 20 bp, mouse
gcggggaagcggcgcaccag

SEQ ID NO: 750625 - DNA, 20 bp, mouse
gtctttgggaagttccgttg

SEQ ID NO: 750626 - DNA, 20 bp, mouse
ggggcccgggcgctatgggc

SEQ ID NO: 750627 - DNA, 20 bp, mouse
gtatgggcggggcaagagac

SEQ ID NO: 750628 - DNA, 20 bp, mouse
ggacggggtaagcctttgaa

SEQ ID NO: 750629 - DNA, 20 bp, mouse
gacagcaaaggcatgtgtaa

SEQ ID NO: 750630 - DNA, 20 bp, mouse
ggggcggggcccgggcgcta

SEQ ID NO: 750631 - DNA, 20 bp, mouse
gtgtgtgggaaatgttaacc

SEQ ID NO: 750632 - DNA, 20 bp, mouse
ggtaaagaaagctagattga

SEQ ID NO: 750633 - DNA, 20 bp, mouse
ggcttctgaactgtgtgtgt

SEQ ID NO: 750634 - DNA, 20 bp, mouse
gcagacaggtactgtgtcac

SEQ ID NO: 750635 - DNA, 20 bp, mouse
gctccagaatcctacatggc

SEQ ID NO: 750636 - DNA, 20 bp, mouse
gctaatgccaggccagacag

SEQ ID NO: 750637 - DNA, 20 bp, mouse
gtggtctagtctgactgcca

SEQ ID NO: 750638 - DNA, 20 bp, mouse
gtagaccaggtagactcgga

SEQ ID NO: 750639 - DNA, 20 bp, mouse
gatgccaggccagacagggg

SEQ ID NO: 750640 - DNA, 20 bp, mouse
gtggcctggcattagcgccc

SEQ ID NO: 750641 - DNA, 20 bp, mouse
gtcgcccttccgagtctacc

SEQ ID NO: 750642 - DNA, 20 bp, mouse
gagagatcctctggtgtaat

SEQ ID NO: 750643 - DNA, 20 bp, mouse
gagactagaccaggtagact

SEQ ID NO: 750644 - DNA, 20 bp, mouse
gtgcgcaggcgcacattaac

SEQ ID NO: 750645 - DNA, 20 bp, mouse
gataatgaatagtcagtgat

SEQ ID NO: 750646 - DNA, 20 bp, mouse
gaggaccgaggccgagagaa

SEQ ID NO: 750647 - DNA, 20 bp, mouse
gggaaactgccgagggacgc

SEQ ID NO: 750648 - DNA, 20 bp, mouse
ggagggacgctgggtaccgt

SEQ ID NO: 750649 - DNA, 20 bp, mouse
ggggcggagccccacagccc

SEQ ID NO: 750650 - DNA, 20 bp, mouse
gcctccagccccggccacgc

SEQ ID NO: 750651 - DNA, 20 bp, mouse
gtcacacactagaaatccac

SEQ ID NO: 750652 - DNA, 20 bp, mouse
gttactgccggaaactgccg

SEQ ID NO: 750653 - DNA, 20 bp, mouse
gagcacggggacagcgagcc

SEQ ID NO: 750654 - DNA, 20 bp, mouse
gaccccccttctctcggcct

SEQ ID NO: 750655 - DNA, 20 bp, mouse
gggagctttgggccctagga

SEQ ID NO: 750656 - DNA, 20 bp, mouse
gaaaacccggagaggcagat

SEQ ID NO: 750657 - DNA, 20 bp, mouse
gcgaggcccggggtccctcc

SEQ ID NO: 750658 - DNA, 20 bp, mouse
gaccccaggaggggtcgagg

SEQ ID NO: 750659 - DNA, 20 bp, mouse
gccgtggaatgcgcgctctg

SEQ ID NO: 750660 - DNA, 20 bp, mouse
ggggatggcgaccccaggag

SEQ ID NO: 750661 - DNA, 20 bp, mouse
ggcgaccccaggaggggtcg

SEQ ID NO: 750662 - DNA, 20 bp, mouse
gtccgcctcgacccctcctg

SEQ ID NO: 750663 - DNA, 20 bp, mouse
gcggctatggaaccagcccc

SEQ ID NO: 750664 - DNA, 20 bp, mouse
gctgccgggatggcgacccc

SEQ ID NO: 750665 - DNA, 20 bp, mouse
gctcacctgctcgcatcaca

SEQ ID NO: 750666 - DNA, 20 bp, mouse
ggcggacgcgcgtccctctc

SEQ ID NO: 750667 - DNA, 20 bp, mouse
ggctccgcagtcccggcggc

SEQ ID NO: 750668 - DNA, 20 bp, mouse
gcgtccctctccggagagga

SEQ ID NO: 750669 - DNA, 20 bp, mouse
gcgcgcgtccctctccggag

SEQ ID NO: 750670 - DNA, 20 bp, mouse
gtccgcgggctccgcagtcc

SEQ ID NO: 750671 - DNA, 20 bp, mouse
ggcgggctccgcagtcccgg

SEQ ID NO: 750672 - DNA, 20 bp, mouse
gcggaggcacccagccgccc

SEQ ID NO: 750673 - DNA, 20 bp, mouse
gggccgcggagaaccctccc

SEQ ID NO: 750674 - DNA, 20 bp, mouse
gcggggccgaggccgcaggc

SEQ ID NO: 750675 - DNA, 20 bp, mouse
gggcgcggccctcccgcctg

SEQ ID NO: 750676 - DNA, 20 bp, mouse
gagcgcggccctctcggagc

SEQ ID NO: 750677 - DNA, 20 bp, mouse
gccctctcggagcggggtga

SEQ ID NO: 750678 - DNA, 20 bp, mouse
gcgagcgagcgcggccctct

SEQ ID NO: 750679 - DNA, 20 bp, mouse
ggagcggggtgacggagcca

SEQ ID NO: 750680 - DNA, 20 bp, mouse
gggggtgacggagccaggga

SEQ ID NO: 750681 - DNA, 20 bp, mouse
gggcggcggtggtggctcgc

SEQ ID NO: 750682 - DNA, 20 bp, mouse
ggggcggccgtgggacgccg

SEQ ID NO: 750683 - DNA, 20 bp, mouse
ggacccgagatgctccccca

SEQ ID NO: 750684 - DNA, 20 bp, mouse
gggcggtggtggctcgcggg

SEQ ID NO: 750685 - DNA, 20 bp, mouse
ggtcgggcgcgggccgaaga

SEQ ID NO: 750686 - DNA, 20 bp, mouse
gtcgccaggcagaacggaag

SEQ ID NO: 750687 - DNA, 20 bp, mouse
gggccggccgccactcaagt

SEQ ID NO: 750688 - DNA, 20 bp, mouse
gacggtgaacggagaagggt

SEQ ID NO: 750689 - DNA, 20 bp, mouse
gcggaagtcgccaggcagaa

SEQ ID NO: 750690 - DNA, 20 bp, mouse
gcggggaaaaagagcgctta

SEQ ID NO: 750691 - DNA, 20 bp, mouse
gtccccgcgctgtgctgttc

SEQ ID NO: 750692 - DNA, 20 bp, mouse
gcagcgcggggaacggtcgc

SEQ ID NO: 750693 - DNA, 20 bp, mouse
gagaacggaaggggaacccg

SEQ ID NO: 750694 - DNA, 20 bp, mouse
ggcgggacggtgaacggaga

SEQ ID NO: 750695 - DNA, 20 bp, mouse
gccggcccggccctacatgg

SEQ ID NO: 750696 - DNA, 20 bp, mouse
gtgggccacgccggaagtac

SEQ ID NO: 750697 - DNA, 20 bp, mouse
gagccgagcgatcccgctac

SEQ ID NO: 750698 - DNA, 20 bp, mouse
gtccggcgtggcccagtagc

SEQ ID NO: 750699 - DNA, 20 bp, mouse
gtcccgctactgggccacgc

SEQ ID NO: 750700 - DNA, 20 bp, mouse
gtcttcctgtacttccggcg

SEQ ID NO: 750701 - DNA, 20 bp, mouse
gagcgggatcgctcggcttc

SEQ ID NO: 750702 - DNA, 20 bp, mouse
gtaaacctaacattgcttgt

SEQ ID NO: 750703 - DNA, 20 bp, mouse
gttagcaattatcccaacac

SEQ ID NO: 750704 - DNA, 20 bp, mouse
gttcaccaacaagcaatgtt

SEQ ID NO: 750705 - DNA, 20 bp, mouse
gacaattcttcctgtacttc

SEQ ID NO: 750706 - DNA, 20 bp, mouse
gcggggcggacaggttagta

SEQ ID NO: 750707 - DNA, 20 bp, mouse
gggcgcgggcctagagatgg

SEQ ID NO: 750708 - DNA, 20 bp, mouse
gcacactcgccccaacgccc

SEQ ID NO: 750709 - DNA, 20 bp, mouse
gggcttgcggggtcagaggg

SEQ ID NO: 750710 - DNA, 20 bp, mouse
ggtgcggggtacgggactcg

SEQ ID NO: 750711 - DNA, 20 bp, mouse
gggtagaggccgttgtggga

SEQ ID NO: 750712 - DNA, 20 bp, mouse
ggccgactgggcgcccgggg

SEQ ID NO: 750713 - DNA, 20 bp, mouse
ggcgtcggatcccgggcgtt

SEQ ID NO: 750714 - DNA, 20 bp, mouse
gttggggcgagtgtggaccg

SEQ ID NO: 750715 - DNA, 20 bp, mouse
gcaccctaacatcctattgg

SEQ ID NO: 750716 - DNA, 20 bp, mouse
ggctgcagtgcaagtggagt

SEQ ID NO: 750717 - DNA, 20 bp, mouse
gacgctgcgcggaggattgt

SEQ ID NO: 750718 - DNA, 20 bp, mouse
gccggtcagccggaagttcc

SEQ ID NO: 750719 - DNA, 20 bp, mouse
gctgcccggacatttcctgt

SEQ ID NO: 750720 - DNA, 20 bp, mouse
ggcaacctacaggaaatgtc

SEQ ID NO: 750721 - DNA, 20 bp, mouse
gagtgcaagtggagtgggct

SEQ ID NO: 750722 - DNA, 20 bp, mouse
gggtctgggagcccgtccgt

SEQ ID NO: 750723 - DNA, 20 bp, mouse
ggctcccagaccgaatcagc

SEQ ID NO: 750724 - DNA, 20 bp, mouse
gaccgaatcagcgggagtgc

SEQ ID NO: 750725 - DNA, 20 bp, mouse
gactcccgctgattcggtct

SEQ ID NO: 750726 - DNA, 20 bp, mouse
gagcgcacgcgcaaggttcg

SEQ ID NO: 750727 - DNA, 20 bp, mouse
gaaaagtaagggtgccgaga

SEQ ID NO: 750728 - DNA, 20 bp, mouse
gcgtggaaggtgactgtcat

SEQ ID NO: 750729 - DNA, 20 bp, mouse
gctaccgccccgaaaagtaa

SEQ ID NO: 750730 - DNA, 20 bp, mouse
gtctagagtggtaccgtgga

SEQ ID NO: 750731 - DNA, 20 bp, mouse
gtaagggtgccgagagggca

SEQ ID NO: 750732 - DNA, 20 bp, mouse
ggtgtcccggctgcccgcgt

SEQ ID NO: 750733 - DNA, 20 bp, mouse
gtcctaccggaagtgctgaa

SEQ ID NO: 750734 - DNA, 20 bp, mouse
gttggggtcctagtctagag

SEQ ID NO: 750735 - DNA, 20 bp, mouse
gcacggtaccactctagact

SEQ ID NO: 750736 - DNA, 20 bp, mouse
gggcgacggaagtaagttgc

SEQ ID NO: 750737 - DNA, 20 bp, mouse
gtctaagagtgtcccatcat

SEQ ID NO: 750738 - DNA, 20 bp, mouse
ggtcgcctgagagactggtt

SEQ ID NO: 750739 - DNA, 20 bp, mouse
gcctgagagactggttagga

SEQ ID NO: 750740 - DNA, 20 bp, mouse
ggaagtaagttgccggaaga

SEQ ID NO: 750741 - DNA, 20 bp, mouse
gtgccggaagatggtaggcg

SEQ ID NO: 750742 - DNA, 20 bp, mouse
gaggacgaagatttggggag

SEQ ID NO: 750743 - DNA, 20 bp, mouse
gtaagttgccggaagatggt

SEQ ID NO: 750744 - DNA, 20 bp, mouse
ggggacactcttagacgaag

SEQ ID NO: 750745 - DNA, 20 bp, mouse
gcttccgtcgcctgagagac

SEQ ID NO: 750746 - DNA, 20 bp, mouse
gcgcccccaaggcgtccaac

SEQ ID NO: 750747 - DNA, 20 bp, mouse
gtcaacccgttggacgcctt

SEQ ID NO: 750748 - DNA, 20 bp, mouse
ggggcgtcctgtcaacccgt

SEQ ID NO: 750749 - DNA, 20 bp, mouse
ggggcactgtgatctctcag

SEQ ID NO: 750750 - DNA, 20 bp, mouse
gccacagggagcgccatctc

SEQ ID NO: 750751 - DNA, 20 bp, mouse
ggacccgagaaaaacggcgg

SEQ ID NO: 750752 - DNA, 20 bp, mouse
gccccccagcgttaggaggc

SEQ ID NO: 750753 - DNA, 20 bp, mouse
gttctagaacgtcatcgact

SEQ ID NO: 750754 - DNA, 20 bp, mouse
gccctgtgggcgtgtcgccg

SEQ ID NO: 750755 - DNA, 20 bp, mouse
gaattcatgaaagtagccta

SEQ ID NO: 750756 - DNA, 20 bp, mouse
ggtcaggcgggtgggatcca

SEQ ID NO: 750757 - DNA, 20 bp, mouse
ggaggggcggggccagcctg

SEQ ID NO: 750758 - DNA, 20 bp, mouse
gcgggcctgctgacgtcagg

SEQ ID NO: 750759 - DNA, 20 bp, mouse
gctgcgggcctgctgacgtc

SEQ ID NO: 750760 - DNA, 20 bp, mouse
gggggaggagggacgcgtgc

SEQ ID NO: 750761 - DNA, 20 bp, mouse
gaaggaggaaggcctgtgat

SEQ ID NO: 750762 - DNA, 20 bp, mouse
gggaagcaccttcccttcac

SEQ ID NO: 750763 - DNA, 20 bp, mouse
gctgctgacgtcaggcgggt

SEQ ID NO: 750764 - DNA, 20 bp, mouse
gtcctcccccacaccagccc

SEQ ID NO: 750765 - DNA, 20 bp, mouse
gaggaagcatgctgccgggg

SEQ ID NO: 750766 - DNA, 20 bp, mouse
gcctctgtcagagtccgaag

SEQ ID NO: 750767 - DNA, 20 bp, mouse
gtcggactctgacagagggg

SEQ ID NO: 750768 - DNA, 20 bp, mouse
ggggaggcgccaggagtgaa

SEQ ID NO: 750769 - DNA, 20 bp, mouse
ggcccgacacgcccccgctc

SEQ ID NO: 750770 - DNA, 20 bp, mouse
gtaaatccgaaatcccgcga

SEQ ID NO: 750771 - DNA, 20 bp, mouse
gcctgctctcgcgatatctg

SEQ ID NO: 750772 - DNA, 20 bp, mouse
ggacgggcggcggatggagg

SEQ ID NO: 750773 - DNA, 20 bp, mouse
ggccgctgacgggcgacggg

SEQ ID NO: 750774 - DNA, 20 bp, mouse
gatggaggcggatagcgcgg

SEQ ID NO: 750775 - DNA, 20 bp, mouse
gcccgaggagacagggacgg

SEQ ID NO: 750776 - DNA, 20 bp, mouse
ggctgtggccagaaccaagt

SEQ ID NO: 750777 - DNA, 20 bp, mouse
ggacagcgctgcttgatccc

SEQ ID NO: 750778 - DNA, 20 bp, mouse
gctctacgagcggaaccaac

SEQ ID NO: 750779 - DNA, 20 bp, mouse
ggcagcgctgtcagcttacg

SEQ ID NO: 750780 - DNA, 20 bp, mouse
gaggacccatgtcttcacta

SEQ ID NO: 750781 - DNA, 20 bp, mouse
gtgagatacagatttcagag

SEQ ID NO: 750782 - DNA, 20 bp, mouse
ggtaacgggtaagcaccggg

SEQ ID NO: 750783 - DNA, 20 bp, mouse
gttgcagatccgaatcacaa

SEQ ID NO: 750784 - DNA, 20 bp, mouse
ggctggtaacgggtaagcac

SEQ ID NO: 750785 - DNA, 20 bp, mouse
gggccacagcccttgtgatt

SEQ ID NO: 750786 - DNA, 20 bp, mouse
gccagcgtacctcagctctt

SEQ ID NO: 750787 - DNA, 20 bp, mouse
gtatcagaatgattgaaggt

SEQ ID NO: 750788 - DNA, 20 bp, mouse
gcccagagtctcagggtcta

SEQ ID NO: 750789 - DNA, 20 bp, mouse
gacagtatcagaatgattga

SEQ ID NO: 750790 - DNA, 20 bp, mouse
gtccatagaccctgagactc

SEQ ID NO: 750791 - DNA, 20 bp, mouse
ggatagatggcaacatcact

SEQ ID NO: 750792 - DNA, 20 bp, mouse
ggagataatccgaagagctg

SEQ ID NO: 750793 - DNA, 20 bp, mouse
gaagctgccaaacaggcaga

SEQ ID NO: 750794 - DNA, 20 bp, mouse
ggcagaaggattaatctaat

SEQ ID NO: 750795 - DNA, 20 bp, mouse
gagagctctagtgcctacag

SEQ ID NO: 750796 - DNA, 20 bp, mouse
gcgactccgggctaaaggga

SEQ ID NO: 750797 - DNA, 20 bp, mouse
gaaagggagggtcgggaatc

SEQ ID NO: 750798 - DNA, 20 bp, mouse
gagcggtccaatcacatcat

SEQ ID NO: 750799 - DNA, 20 bp, mouse
gggcacaacgagccccttta

SEQ ID NO: 750800 - DNA, 20 bp, mouse
ggcacatccggtcaccatct

SEQ ID NO: 750801 - DNA, 20 bp, mouse
gcagggtagagataaaacca

SEQ ID NO: 750802 - DNA, 20 bp, mouse
gaacgcgtacccatccgttg

SEQ ID NO: 750803 - DNA, 20 bp, mouse
gaaaatgccccgcacaaaca

SEQ ID NO: 750804 - DNA, 20 bp, mouse
ggggacggcgacggcgtcag

SEQ ID NO: 750805 - DNA, 20 bp, mouse
gtctctgtgtgagaccacaa

SEQ ID NO: 750806 - DNA, 20 bp, mouse
gcgtgcgcacaatcaatagg

SEQ ID NO: 750807 - DNA, 20 bp, mouse
gaggacggagggaagcggag

SEQ ID NO: 750808 - DNA, 20 bp, mouse
gccaccgccgagcgaggagg

SEQ ID NO: 750809 - DNA, 20 bp, mouse
gctgaggaggttgggagatg

SEQ ID NO: 750810 - DNA, 20 bp, mouse
gggagacgccgggtttggga

SEQ ID NO: 750811 - DNA, 20 bp, mouse
gcatccctccagtcccgagt

SEQ ID NO: 750812 - DNA, 20 bp, mouse
ggggagatggcgaggacgga

SEQ ID NO: 750813 - DNA, 20 bp, mouse
gcggtggcggcggtggtccg

SEQ ID NO: 750814 - DNA, 20 bp, mouse
gagccggaccctcccaaacc

SEQ ID NO: 750815 - DNA, 20 bp, mouse
gcgtcggcgccacgctgagg

SEQ ID NO: 750816 - DNA, 20 bp, mouse
gacaaaatgacttccctaga

SEQ ID NO: 750817 - DNA, 20 bp, mouse
gcaggaagctctagcgaact

SEQ ID NO: 750818 - DNA, 20 bp, mouse
gcactattaagcaaaaggag

SEQ ID NO: 750819 - DNA, 20 bp, mouse
gtgcgacgtggctcccatcc

SEQ ID NO: 750820 - DNA, 20 bp, mouse
ggactcattcatgtactctg

SEQ ID NO: 750821 - DNA, 20 bp, mouse
gaagttatgatctccatcta

SEQ ID NO: 750822 - DNA, 20 bp, mouse
gttcgtgatgacgttgtcct

SEQ ID NO: 750823 - DNA, 20 bp, mouse
gagtccatattcataaataa

SEQ ID NO: 750824 - DNA, 20 bp, mouse
gcacatcccaataccctcct

SEQ ID NO: 750825 - DNA, 20 bp, mouse
gggatgtgtagtttgcgacg

SEQ ID NO: 750826 - DNA, 20 bp, mouse
gcccaggtcggctataaatt

SEQ ID NO: 750827 - DNA, 20 bp, mouse
gggcagaccgcacagaaaca

SEQ ID NO: 750828 - DNA, 20 bp, mouse
gggaggccagcgcccttgtt

SEQ ID NO: 750829 - DNA, 20 bp, mouse
gcacttgcagagaccgaaca

SEQ ID NO: 750830 - DNA, 20 bp, mouse
gcgcagaaaagactcggcta

SEQ ID NO: 750831 - DNA, 20 bp, mouse
gaaaaagagtaaacccaggt

SEQ ID NO: 750832 - DNA, 20 bp, mouse
gaactgcccgtcatgtgacc

SEQ ID NO: 750833 - DNA, 20 bp, mouse
gggcaggcctggtcacatga

SEQ ID NO: 750834 - DNA, 20 bp, mouse
gggcagcctgatcacgtggc

SEQ ID NO: 750835 - DNA, 20 bp, mouse
gaaggagcgcagaaaagact

SEQ ID NO: 750836 - DNA, 20 bp, mouse
gtgaaggggcggagccgtgg

SEQ ID NO: 750837 - DNA, 20 bp, mouse
gagctcgccaatcactgtga

SEQ ID NO: 750838 - DNA, 20 bp, mouse
gacagtgattggcgagctgt

SEQ ID NO: 750839 - DNA, 20 bp, mouse
gcggggaaaggggatgaagt

SEQ ID NO: 750840 - DNA, 20 bp, mouse
gacacccgagcccttctcgt

SEQ ID NO: 750841 - DNA, 20 bp, mouse
gaagacgcagaagactagac

SEQ ID NO: 750842 - DNA, 20 bp, mouse
gccgggctccgcggggaaag

SEQ ID NO: 750843 - DNA, 20 bp, mouse
gccaaatccgaggccatgag

SEQ ID NO: 750844 - DNA, 20 bp, mouse
gttggcgagctgtgggtgaa

SEQ ID NO: 750845 - DNA, 20 bp, mouse
gtgaagtgggccgacgagaa

SEQ ID NO: 750846 - DNA, 20 bp, mouse
ggggcggtaccagtgataga

SEQ ID NO: 750847 - DNA, 20 bp, mouse
gcagccagacacacaactta

SEQ ID NO: 750848 - DNA, 20 bp, mouse
gtaccagtgatagatggggt

SEQ ID NO: 750849 - DNA, 20 bp, mouse
gtagggcacagacagaactc

SEQ ID NO: 750850 - DNA, 20 bp, mouse
ggtgccctaagttgtgtgtc

SEQ ID NO: 750851 - DNA, 20 bp, mouse
gagaagtagagttctgccca

SEQ ID NO: 750852 - DNA, 20 bp, mouse
gcgcgatgcaagcgctgtac

SEQ ID NO: 750853 - DNA, 20 bp, mouse
gagcccaccccatctatcac

SEQ ID NO: 750854 - DNA, 20 bp, mouse
ggataggatgcaggttcaga

SEQ ID NO: 750855 - DNA, 20 bp, mouse
gtgcggagcccaatcgcgtc

SEQ ID NO: 750856 - DNA, 20 bp, mouse
gtgcgcgcgcagatatcgag

SEQ ID NO: 750857 - DNA, 20 bp, mouse
ggggtctgcacagataggtg

SEQ ID NO: 750858 - DNA, 20 bp, mouse
gtctgcgcgcgcagccggcc

SEQ ID NO: 750859 - DNA, 20 bp, mouse
gggggcagagtgggacacga

SEQ ID NO: 750860 - DNA, 20 bp, mouse
gtggtgtattacgtcggggt

SEQ ID NO: 750861 - DNA, 20 bp, mouse
gtcagggtggtgtattacgt

SEQ ID NO: 750862 - DNA, 20 bp, mouse
ggctctgcgtcacgtcacac

SEQ ID NO: 750863 - DNA, 20 bp, mouse
gcggggacaacctcacttat

SEQ ID NO: 750864 - DNA, 20 bp, mouse
gcgaagtcgcggttcggtcg

SEQ ID NO: 750865 - DNA, 20 bp, mouse
gcggccgggtctgcacagat

SEQ ID NO: 750866 - DNA, 20 bp, mouse
gaggtcgggacggagaggtc

SEQ ID NO: 750867 - DNA, 20 bp, mouse
gacatgctccaaccggaccc

SEQ ID NO: 750868 - DNA, 20 bp, mouse
gcggttggagcatgtcagat

SEQ ID NO: 750869 - DNA, 20 bp, mouse
ggaactgcatctctcatcct

SEQ ID NO: 750870 - DNA, 20 bp, mouse
ggaggggcggaaccggaaga

SEQ ID NO: 750871 - DNA, 20 bp, mouse
gagttctagcgccatctaca

SEQ ID NO: 750872 - DNA, 20 bp, mouse
gcacgagagaccaaacttga

SEQ ID NO: 750873 - DNA, 20 bp, mouse
gagaactgtagtgcacctcc

SEQ ID NO: 750874 - DNA, 20 bp, mouse
gaatagaggtcgggacggag

SEQ ID NO: 750875 - DNA, 20 bp, mouse
ggccatctacagggcaaagg

SEQ ID NO: 750876 - DNA, 20 bp, mouse
gcggggatgagacctaaagt

SEQ ID NO: 750877 - DNA, 20 bp, mouse
gaaggcgtgtcacagggtgg

SEQ ID NO: 750878 - DNA, 20 bp, mouse
gactaccgcgacggaagcgg

SEQ ID NO: 750879 - DNA, 20 bp, mouse
gaagaaggcgtgtcacaggg

SEQ ID NO: 750880 - DNA, 20 bp, mouse
gacacgcagaaggatggcgc

SEQ ID NO: 750881 - DNA, 20 bp, mouse
gcgggttgagctttggtcgt

SEQ ID NO: 750882 - DNA, 20 bp, mouse
ggtggagccgggttgagctt

SEQ ID NO: 750883 - DNA, 20 bp, mouse
gaagaagaaggcgtgtcaca

SEQ ID NO: 750884 - DNA, 20 bp, mouse
ggcagcctccgcttccgtcg

SEQ ID NO: 750885 - DNA, 20 bp, mouse
gggatggcgcagggaaggcg

SEQ ID NO: 750886 - DNA, 20 bp, mouse
gaatgagaggcccgcgtcag

SEQ ID NO: 750887 - DNA, 20 bp, mouse
gcgcatgtgcaacatcttta

SEQ ID NO: 750888 - DNA, 20 bp, mouse
gacctgctataggacagcct

SEQ ID NO: 750889 - DNA, 20 bp, mouse
ggcagcggaagcacaagttc

SEQ ID NO: 750890 - DNA, 20 bp, mouse
ggatctttcccgagagaagc

SEQ ID NO: 750891 - DNA, 20 bp, mouse
gcgcatctcctgcttctctc

SEQ ID NO: 750892 - DNA, 20 bp, mouse
gtataaaagtgggggctgca

SEQ ID NO: 750893 - DNA, 20 bp, mouse
gtcgggaaagatccgctgtc

SEQ ID NO: 750894 - DNA, 20 bp, mouse
ggctgtctggtttcttggtc

SEQ ID NO: 750895 - DNA, 20 bp, mouse
gcaggaagaagcctctgacg

SEQ ID NO: 750896 - DNA, 20 bp, mouse
gcgccccgagccagaggtga

SEQ ID NO: 750897 - DNA, 20 bp, mouse
gcccgcccatccctcacctc

SEQ ID NO: 750898 - DNA, 20 bp, mouse
ggacccggctagttctgtac

SEQ ID NO: 750899 - DNA, 20 bp, mouse
gaggagtggagcaacctccc

SEQ ID NO: 750900 - DNA, 20 bp, mouse
gacagaactagccgggtcag

SEQ ID NO: 750901 - DNA, 20 bp, mouse
gcggggccgaggcccgaggg

SEQ ID NO: 750902 - DNA, 20 bp, mouse
gtcggagcgccccgagccag

SEQ ID NO: 750903 - DNA, 20 bp, mouse
ggagggctgtgtgatggcct

SEQ ID NO: 750904 - DNA, 20 bp, mouse
gtggatgggcgacgaagatc

SEQ ID NO: 750905 - DNA, 20 bp, mouse
ggcaggaaccggaagttgtt

SEQ ID NO: 750906 - DNA, 20 bp, mouse
gcagtcccgggggtcctcgt

SEQ ID NO: 750907 - DNA, 20 bp, mouse
gttgctaggcgacgggtgtc

SEQ ID NO: 750908 - DNA, 20 bp, mouse
gcagtctggggccctcctgg

SEQ ID NO: 750909 - DNA, 20 bp, mouse
gagaggtcaaaacaccaacg

SEQ ID NO: 750910 - DNA, 20 bp, mouse
gtaggcgggcgggcgttgct

SEQ ID NO: 750911 - DNA, 20 bp, mouse
ggcccgcccgcctacgccca

SEQ ID NO: 750912 - DNA, 20 bp, mouse
gcaggaagaacggatgacgc

SEQ ID NO: 750913 - DNA, 20 bp, mouse
gcgttcttcctgccagtccc

SEQ ID NO: 750914 - DNA, 20 bp, mouse
ggagtctgcgccctgggcgt

SEQ ID NO: 750915 - DNA, 20 bp, mouse
gtgagcaccgtgtgaaactg

SEQ ID NO: 750916 - DNA, 20 bp, mouse
ggggatgactaagttagtct

SEQ ID NO: 750917 - DNA, 20 bp, mouse
gaggcctgggcatctgtcgt

SEQ ID NO: 750918 - DNA, 20 bp, mouse
ggctgagtgtctgacccgag

SEQ ID NO: 750919 - DNA, 20 bp, mouse
gctaacttagtcatcccact

SEQ ID NO: 750920 - DNA, 20 bp, mouse
gggctgtgagcaggcgaggt

SEQ ID NO: 750921 - DNA, 20 bp, mouse
gcccaggtggagaagtggtc

SEQ ID NO: 750922 - DNA, 20 bp, mouse
gctccccacgacagatgccc

SEQ ID NO: 750923 - DNA, 20 bp, mouse
gacagatgaggcatagaatg

SEQ ID NO: 750924 - DNA, 20 bp, mouse
gcggagcggaggagcatctg

SEQ ID NO: 750925 - DNA, 20 bp, mouse
ggcctggtgcctgataaaag

SEQ ID NO: 750926 - DNA, 20 bp, mouse
ggagaggcgaggcccgcgga

SEQ ID NO: 750927 - DNA, 20 bp, mouse
gtaccctaaaaggagagccc

SEQ ID NO: 750928 - DNA, 20 bp, mouse
ggagaggaagccgagaggaa

SEQ ID NO: 750929 - DNA, 20 bp, mouse
gtgtggcacaaggacaagag

SEQ ID NO: 750930 - DNA, 20 bp, mouse
gggtcctgaagggtttgtca

SEQ ID NO: 750931 - DNA, 20 bp, mouse
gacgtcttggtgtccctccg

SEQ ID NO: 750932 - DNA, 20 bp, mouse
ggctctcggtgggtcctgaa

SEQ ID NO: 750933 - DNA, 20 bp, mouse
gagcagaaatataccctaaa

SEQ ID NO: 750934 - DNA, 20 bp, mouse
ggcgcactgcgaggacgtct

SEQ ID NO: 750935 - DNA, 20 bp, mouse
gctcccgggctctcctttta

SEQ ID NO: 750936 - DNA, 20 bp, mouse
gtagcagggagtccttgacg

SEQ ID NO: 750937 - DNA, 20 bp, mouse
gacacgagatagacggaagg

SEQ ID NO: 750938 - DNA, 20 bp, mouse
gcagacacgagatagacgga

SEQ ID NO: 750939 - DNA, 20 bp, mouse
gccacggggcggagacacat

SEQ ID NO: 750940 - DNA, 20 bp, mouse
gcgattggggcagacaggag

SEQ ID NO: 750941 - DNA, 20 bp, mouse
gagtcctatgcgagcgtgtc

SEQ ID NO: 750942 - DNA, 20 bp, mouse
gtccgccctcccaccgtctg

SEQ ID NO: 750943 - DNA, 20 bp, mouse
gcctcccgacacgctcgcat

SEQ ID NO: 750944 - DNA, 20 bp, mouse
gtccacagacggtgggaggg

SEQ ID NO: 750945 - DNA, 20 bp, mouse
gcatgcgccactgtacccat

SEQ ID NO: 750946 - DNA, 20 bp, mouse
gccgaagccgctggaagagg

SEQ ID NO: 750947 - DNA, 20 bp, mouse
ggcaccgaagccgctggaag

SEQ ID NO: 750948 - DNA, 20 bp, mouse
gaggagaaagtggttgtctg

SEQ ID NO: 750949 - DNA, 20 bp, mouse
ggaagtgactggagacgaat

SEQ ID NO: 750950 - DNA, 20 bp, mouse
gactggagacgaatgggaaa

SEQ ID NO: 750951 - DNA, 20 bp, mouse
gaggtcgtgtaaaagagcgg

SEQ ID NO: 750952 - DNA, 20 bp, mouse
gggaggagaggcaacggttt

SEQ ID NO: 750953 - DNA, 20 bp, mouse
gcgcgcgagaggggggcaag

SEQ ID NO: 750954 - DNA, 20 bp, mouse
gatactgggaggggacgcgg

SEQ ID NO: 750955 - DNA, 20 bp, mouse
gcagaaaactgtgtccagga

SEQ ID NO: 750956 - DNA, 20 bp, mouse
ggtcgcgcgccccaaagggg

SEQ ID NO: 750957 - DNA, 20 bp, mouse
gccctgcggggccctcccat

SEQ ID NO: 750958 - DNA, 20 bp, mouse
gctagcttgcgagatgggag

SEQ ID NO: 750959 - DNA, 20 bp, mouse
ggggacctgtcacaggtaga

SEQ ID NO: 750960 - DNA, 20 bp, mouse
gtcccgcaggcggagggatc

SEQ ID NO: 750961 - DNA, 20 bp, mouse
gagagtgatggacaagcagg

SEQ ID NO: 750962 - DNA, 20 bp, mouse
gccgtggtcgcgcgccccaa

SEQ ID NO: 750963 - DNA, 20 bp, mouse
gtctggggagataagagtgt

SEQ ID NO: 750964 - DNA, 20 bp, mouse
gcagcctcgctctgtcccgc

SEQ ID NO: 750965 - DNA, 20 bp, mouse
gtacgtcggcctcgagtctg

SEQ ID NO: 750966 - DNA, 20 bp, mouse
gaaggtggagacctccccac

SEQ ID NO: 750967 - DNA, 20 bp, mouse
gctgctgcatactttctttg

SEQ ID NO: 750968 - DNA, 20 bp, mouse
gaaaaatgagggcgtgtcca

SEQ ID NO: 750969 - DNA, 20 bp, mouse
gcagactctaagggtagctc

SEQ ID NO: 750970 - DNA, 20 bp, mouse
gacaggcaggccagactcta

SEQ ID NO: 750971 - DNA, 20 bp, mouse
gtatgcagcaggctagaccc

SEQ ID NO: 750972 - DNA, 20 bp, mouse
gtgagagcaagcaagagctc

SEQ ID NO: 750973 - DNA, 20 bp, mouse
gggaactgagagtaaaaatg

SEQ ID NO: 750974 - DNA, 20 bp, mouse
gctccctcttccacagccta

SEQ ID NO: 750975 - DNA, 20 bp, mouse
gtgcttgctctcaggaccct

SEQ ID NO: 750976 - DNA, 20 bp, mouse
gcagtctggaggggcaaagt

SEQ ID NO: 750977 - DNA, 20 bp, mouse
gcgtcctgggcggtcggcag

SEQ ID NO: 750978 - DNA, 20 bp, mouse
gaggacgcccgggagacccg

SEQ ID NO: 750979 - DNA, 20 bp, mouse
gcccgcggggagttcggcga

SEQ ID NO: 750980 - DNA, 20 bp, mouse
gctccctctgccgaccgccc

SEQ ID NO: 750981 - DNA, 20 bp, mouse
gcgtccgaagtgatttcttg

SEQ ID NO: 750982 - DNA, 20 bp, mouse
gcagcgacccgcggggagtt

SEQ ID NO: 750983 - DNA, 20 bp, mouse
gcccgggcgtcctgggcggt

SEQ ID NO: 750984 - DNA, 20 bp, mouse
ggccgaccgcccaggacgcc

SEQ ID NO: 750985 - DNA, 20 bp, mouse
ggcggggagttcggcgacgg

SEQ ID NO: 750986 - DNA, 20 bp, mouse
gagggaatgcgcgcgatcgc

SEQ ID NO: 750987 - DNA, 20 bp, mouse
gaacgggtggatgcagagta

SEQ ID NO: 750988 - DNA, 20 bp, mouse
ggcagggtctgaaaagaggt

SEQ ID NO: 750989 - DNA, 20 bp, mouse
gaagctaggaaaaagagcga

SEQ ID NO: 750990 - DNA, 20 bp, mouse
gggagtcgcgaggggttaaa

SEQ ID NO: 750991 - DNA, 20 bp, mouse
ggatcgcagggtctgaaaag

SEQ ID NO: 750992 - DNA, 20 bp, mouse
gagggagaagggagtcgcga

SEQ ID NO: 750993 - DNA, 20 bp, mouse
ggccgtggcagcagtcgcag

SEQ ID NO: 750994 - DNA, 20 bp, mouse
gacggtaaaagaacgataac

SEQ ID NO: 750995 - DNA, 20 bp, mouse
ggtaaaagaacgataacggg

SEQ ID NO: 750996 - DNA, 20 bp, mouse
ggaggggaggggctgaagcg

SEQ ID NO: 750997 - DNA, 20 bp, mouse
gccaggagccggagagggga

SEQ ID NO: 750998 - DNA, 20 bp, mouse
gccgcccagacaatcccaat

SEQ ID NO: 750999 - DNA, 20 bp, mouse
gagcggggtcgggaaagagg

SEQ ID NO: 751000 - DNA, 20 bp, mouse
gaggaccaggagccggagag

SEQ ID NO: 751001 - DNA, 20 bp, mouse
ggctcctggtcctaccttta

SEQ ID NO: 751002 - DNA, 20 bp, mouse
gtagccttaaaggtaggacc

SEQ ID NO: 751003 - DNA, 20 bp, mouse
ggaagtgggctctccctatt

SEQ ID NO: 751004 - DNA, 20 bp, mouse
gactctcggttgcagagaga

SEQ ID NO: 751005 - DNA, 20 bp, mouse
ggggccaaaaggggcgggag

SEQ ID NO: 751006 - DNA, 20 bp, mouse
gcaagcgactgggaacagat

SEQ ID NO: 751007 - DNA, 20 bp, mouse
gcagcctctgaggggaggac

SEQ ID NO: 751008 - DNA, 20 bp, mouse
ggagccgcgcagcctctgag

SEQ ID NO: 751009 - DNA, 20 bp, mouse
ggaagagcggcgggtcagag

SEQ ID NO: 751010 - DNA, 20 bp, mouse
gtctcgctgcgcaagcgact

SEQ ID NO: 751011 - DNA, 20 bp, mouse
gagcggccctgagaggacta

SEQ ID NO: 751012 - DNA, 20 bp, mouse
gaggcgccctccagtggcaa

SEQ ID NO: 751013 - DNA, 20 bp, mouse
gccttctcgaggaagacttc

SEQ ID NO: 751014 - DNA, 20 bp, mouse
ggcgagaagaggaagagcgg

SEQ ID NO: 751015 - DNA, 20 bp, mouse
ggcgactgggaacagatggg

SEQ ID NO: 751016 - DNA, 20 bp, mouse
gggtctgcgccgttacaaag

SEQ ID NO: 751017 - DNA, 20 bp, mouse
ggggccggccgcctgtcaga

SEQ ID NO: 751018 - DNA, 20 bp, mouse
ggggagcgggcggatcacgt

SEQ ID NO: 751019 - DNA, 20 bp, mouse
gggcccgcgccccgctctgt

SEQ ID NO: 751020 - DNA, 20 bp, mouse
gcgggcgggcctcaacgcgg

SEQ ID NO: 751021 - DNA, 20 bp, mouse
ggggctgcgagctggacccg

SEQ ID NO: 751022 - DNA, 20 bp, mouse
gtacaaagaggccggggagc

SEQ ID NO: 751023 - DNA, 20 bp, mouse
gactgcccgccctcctcgat

SEQ ID NO: 751024 - DNA, 20 bp, mouse
gaacggcgcagaccaatcag

SEQ ID NO: 751025 - DNA, 20 bp, mouse
gcgggaggcgcgagaggtgt

SEQ ID NO: 751026 - DNA, 20 bp, mouse
gcgggcgagcagccactgca

SEQ ID NO: 751027 - DNA, 20 bp, mouse
gactgtgcgtggacctcatc

SEQ ID NO: 751028 - DNA, 20 bp, mouse
gctgcaaggcaaagtgttgg

SEQ ID NO: 751029 - DNA, 20 bp, mouse
gaacccaaaaggactgtgcg

SEQ ID NO: 751030 - DNA, 20 bp, mouse
ggctcgcccgcgcgtcgtcg

SEQ ID NO: 751031 - DNA, 20 bp, mouse
ggtccacgcacagtcctttt

SEQ ID NO: 751032 - DNA, 20 bp, mouse
gtgagcacacattcctgatg

SEQ ID NO: 751033 - DNA, 20 bp, mouse
gctgcgccccgacgacgcgc

SEQ ID NO: 751034 - DNA, 20 bp, mouse
gagagcgctccgagcgcacg

SEQ ID NO: 751035 - DNA, 20 bp, mouse
gcctggagctagcgttgggg

SEQ ID NO: 751036 - DNA, 20 bp, mouse
gctgcctagtccagccaaac

SEQ ID NO: 751037 - DNA, 20 bp, mouse
gtcctcggaggggcttggga

SEQ ID NO: 751038 - DNA, 20 bp, mouse
gtcggcgaggagcggttagc

SEQ ID NO: 751039 - DNA, 20 bp, mouse
ggaggagcggttagccggtt

SEQ ID NO: 751040 - DNA, 20 bp, mouse
gcaagcccctccgaggagag

SEQ ID NO: 751041 - DNA, 20 bp, mouse
gtgcgccactctcctcggag

SEQ ID NO: 751042 - DNA, 20 bp, mouse
gggcttgggaggggctccgg

SEQ ID NO: 751043 - DNA, 20 bp, mouse
ggcctctgcgccactctcct

SEQ ID NO: 751044 - DNA, 20 bp, mouse
gcgagcccgcccgagcccgc

SEQ ID NO: 751045 - DNA, 20 bp, mouse
gctcacggggcttgaaaaaa

SEQ ID NO: 751046 - DNA, 20 bp, mouse
gggcggggtcggaggaaact

SEQ ID NO: 751047 - DNA, 20 bp, mouse
gcacaaagacccagaagcgg

SEQ ID NO: 751048 - DNA, 20 bp, mouse
gtctttgtgcgcatgcacaa

SEQ ID NO: 751049 - DNA, 20 bp, mouse
ggcagaggggattccccggt

SEQ ID NO: 751050 - DNA, 20 bp, mouse
gcgaagagttctctgcagag

SEQ ID NO: 751051 - DNA, 20 bp, mouse
gttggctcgctcacgtggac

SEQ ID NO: 751052 - DNA, 20 bp, mouse
gggtcggaggaaactgggct

SEQ ID NO: 751053 - DNA, 20 bp, mouse
gtagtgagcagcgccaaccg

SEQ ID NO: 751054 - DNA, 20 bp, mouse
ggagaactcttcgcccagcc

SEQ ID NO: 751055 - DNA, 20 bp, mouse
gccaagcacacacttctatc

SEQ ID NO: 751056 - DNA, 20 bp, mouse
gagacccgcggccatagggg

SEQ ID NO: 751057 - DNA, 20 bp, mouse
gagaggcactacccattcct

SEQ ID NO: 751058 - DNA, 20 bp, mouse
gggtctcacgcacgtgttca

SEQ ID NO: 751059 - DNA, 20 bp, mouse
gtgggggcgcggtcagtagg

SEQ ID NO: 751060 - DNA, 20 bp, mouse
gtggaggccaagtcggccgt

SEQ ID NO: 751061 - DNA, 20 bp, mouse
gaacacgtgcgtgagacccg

SEQ ID NO: 751062 - DNA, 20 bp, mouse
ggggcggagtccacaagcgc

SEQ ID NO: 751063 - DNA, 20 bp, mouse
gcaggtggtggaggccaagt

SEQ ID NO: 751064 - DNA, 20 bp, mouse
gcgcacaggagctagtgaaa

SEQ ID NO: 751065 - DNA, 20 bp, mouse
gactccgcccccagcgcttg

SEQ ID NO: 751066 - DNA, 20 bp, mouse
gagctctggccgcactggag

SEQ ID NO: 751067 - DNA, 20 bp, mouse
gcaagtaggctcctcggcag

SEQ ID NO: 751068 - DNA, 20 bp, mouse
gaagcgagctctggccgcac

SEQ ID NO: 751069 - DNA, 20 bp, mouse
ggaaggggacgtaaagccgg

SEQ ID NO: 751070 - DNA, 20 bp, mouse
gtaggctcctcggcaggggt

SEQ ID NO: 751071 - DNA, 20 bp, mouse
ggccctgagcgaattaactc

SEQ ID NO: 751072 - DNA, 20 bp, mouse
gctggaaggggacgtaaagc

SEQ ID NO: 751073 - DNA, 20 bp, mouse
gcgcgtcttacacaatgcat

SEQ ID NO: 751074 - DNA, 20 bp, mouse
ggcattgggctgcagcaagt

SEQ ID NO: 751075 - DNA, 20 bp, mouse
gctgcagcaagtaggctcct

SEQ ID NO: 751076 - DNA, 20 bp, mouse
gagaacacgcgtgattggag

SEQ ID NO: 751077 - DNA, 20 bp, mouse
ggtcgtccccctggagaagc

SEQ ID NO: 751078 - DNA, 20 bp, mouse
gcgcactcgctgcatatcag

SEQ ID NO: 751079 - DNA, 20 bp, mouse
gaagagaggtggaagaggac

SEQ ID NO: 751080 - DNA, 20 bp, mouse
ggggaaggagggagagcgac

SEQ ID NO: 751081 - DNA, 20 bp, mouse
gcggtcggacggccccgggg

SEQ ID NO: 751082 - DNA, 20 bp, mouse
gttctccagggggacgacgc

SEQ ID NO: 751083 - DNA, 20 bp, mouse
gccctcccgcgtcgtccccc

SEQ ID NO: 751084 - DNA, 20 bp, mouse
gaatccgccggcagaggaag

SEQ ID NO: 751085 - DNA, 20 bp, mouse
ggatatgcagcgagtgcggt

SEQ ID NO: 751086 - DNA, 20 bp, mouse
gagggaggggacagcacgga

SEQ ID NO: 751087 - DNA, 20 bp, mouse
ggagaggggagggacaagac

SEQ ID NO: 751088 - DNA, 20 bp, mouse
gagacctggagtccaggaag

SEQ ID NO: 751089 - DNA, 20 bp, mouse
gagcggggcctcctcccgag

SEQ ID NO: 751090 - DNA, 20 bp, mouse
gaacccgctgtctgccggag

SEQ ID NO: 751091 - DNA, 20 bp, mouse
ggacatacaaaggccaaggt

SEQ ID NO: 751092 - DNA, 20 bp, mouse
ggacccctggcggccaggca

SEQ ID NO: 751093 - DNA, 20 bp, mouse
ggtccccccaggggagacaa

SEQ ID NO: 751094 - DNA, 20 bp, mouse
gcaggccgggcccgtgtgag

SEQ ID NO: 751095 - DNA, 20 bp, mouse
gaggagaggggccgctcggg

SEQ ID NO: 751096 - DNA, 20 bp, mouse
gagaaaactgggcggagcga

SEQ ID NO: 751097 - DNA, 20 bp, mouse
gcggaagaggcggggcccaa

SEQ ID NO: 751098 - DNA, 20 bp, mouse
gtggtggggcggggcgagat

SEQ ID NO: 751099 - DNA, 20 bp, mouse
ggagcccagtcccagggagg

SEQ ID NO: 751100 - DNA, 20 bp, mouse
gggcggagcgatggtggggc

SEQ ID NO: 751101 - DNA, 20 bp, mouse
gactgggcggagcgatggtg

SEQ ID NO: 751102 - DNA, 20 bp, mouse
gtgtaggatgtcaaatgctc

SEQ ID NO: 751103 - DNA, 20 bp, mouse
gccaagggagcccagtccca

SEQ ID NO: 751104 - DNA, 20 bp, mouse
gaaacctcgcgggccggaag

SEQ ID NO: 751105 - DNA, 20 bp, mouse
gataggctcaaacttttgat

SEQ ID NO: 751106 - DNA, 20 bp, mouse
ggggaagggcgcggagtcac

SEQ ID NO: 751107 - DNA, 20 bp, mouse
gggggcggggcggtggggaa

SEQ ID NO: 751108 - DNA, 20 bp, mouse
ggggaccagcccggcccagg

SEQ ID NO: 751109 - DNA, 20 bp, mouse
gtccgccggccgccggaaga

SEQ ID NO: 751110 - DNA, 20 bp, mouse
gcgtgggccccatcttccgg

SEQ ID NO: 751111 - DNA, 20 bp, mouse
gaagcagctcgggcaggggt

SEQ ID NO: 751112 - DNA, 20 bp, mouse
gcgccgtgggccccatcttc

SEQ ID NO: 751113 - DNA, 20 bp, mouse
gcgcggaagcagctcgggca

SEQ ID NO: 751114 - DNA, 20 bp, mouse
gaccagcccggcccaggagg

SEQ ID NO: 751115 - DNA, 20 bp, mouse
gggcgggagggaggcctcgg

SEQ ID NO: 751116 - DNA, 20 bp, mouse
gcctagatgaccaatcgttg

SEQ ID NO: 751117 - DNA, 20 bp, mouse
ggcgccgcggtgccttgtgt

SEQ ID NO: 751118 - DNA, 20 bp, mouse
gcaggcagtgcggccatagg

SEQ ID NO: 751119 - DNA, 20 bp, mouse
gccaaacccgcaatggctta

SEQ ID NO: 751120 - DNA, 20 bp, mouse
gccgccgcctgaagcctgct

SEQ ID NO: 751121 - DNA, 20 bp, mouse
gatgacagccaaacccgcaa

SEQ ID NO: 751122 - DNA, 20 bp, mouse
ggtcacggaggaacttcttc

SEQ ID NO: 751123 - DNA, 20 bp, mouse
gtgcgcctgagtttaatcct

SEQ ID NO: 751124 - DNA, 20 bp, mouse
gaatctcccagaagtcacgg

SEQ ID NO: 751125 - DNA, 20 bp, mouse
ggtgtgggatgtaagcgcgg

SEQ ID NO: 751126 - DNA, 20 bp, mouse
gtgcaaatgccattagatgt

SEQ ID NO: 751127 - DNA, 20 bp, mouse
gttggagtgaaatgtgagag

SEQ ID NO: 751128 - DNA, 20 bp, mouse
ggttggaggggactttgtgt

SEQ ID NO: 751129 - DNA, 20 bp, mouse
gggaggggactttgtgtcgg

SEQ ID NO: 751130 - DNA, 20 bp, mouse
gtgctcgggttttggttgga

SEQ ID NO: 751131 - DNA, 20 bp, mouse
gactctctacctctccctgg

SEQ ID NO: 751132 - DNA, 20 bp, mouse
gctccctgggggaacagaaa

SEQ ID NO: 751133 - DNA, 20 bp, mouse
gggagagagtgacaaatttt

SEQ ID NO: 751134 - DNA, 20 bp, mouse
gtgcctgctcgggttttggt

SEQ ID NO: 751135 - DNA, 20 bp, mouse
gcaccaaaagccaaattctg

SEQ ID NO: 751136 - DNA, 20 bp, mouse
gccaccgcaatctgtcccat

SEQ ID NO: 751137 - DNA, 20 bp, mouse
gactgagcgggagttttgga

SEQ ID NO: 751138 - DNA, 20 bp, mouse
gcggtggcccggagcgactg

SEQ ID NO: 751139 - DNA, 20 bp, mouse
gggagcaccactagctgtgg

SEQ ID NO: 751140 - DNA, 20 bp, mouse
gcacggtggcgctgactgag

SEQ ID NO: 751141 - DNA, 20 bp, mouse
ggaagctcccagggcccgac

SEQ ID NO: 751142 - DNA, 20 bp, mouse
gtctggccatgggaacctat

SEQ ID NO: 751143 - DNA, 20 bp, mouse
gctcctgtcctgccagcaat

SEQ ID NO: 751144 - DNA, 20 bp, mouse
gtcctgccagcaatgggaac

SEQ ID NO: 751145 - DNA, 20 bp, mouse
gtccagttcccattgctggc

SEQ ID NO: 751146 - DNA, 20 bp, mouse
gagcctgctctaaaagagac

SEQ ID NO: 751147 - DNA, 20 bp, mouse
gacggcgggtcaccaatgca

SEQ ID NO: 751148 - DNA, 20 bp, mouse
ggtagactacgcgtactaag

SEQ ID NO: 751149 - DNA, 20 bp, mouse
gtcccagtctcttttagagc

SEQ ID NO: 751150 - DNA, 20 bp, mouse
gagaatgaatgacacttttg

SEQ ID NO: 751151 - DNA, 20 bp, mouse
gcttttgtgggcatgtacaa

SEQ ID NO: 751152 - DNA, 20 bp, mouse
gcaccgcgacagtgagagca

SEQ ID NO: 751153 - DNA, 20 bp, mouse
ggcaaactttgaccgtgctg

SEQ ID NO: 751154 - DNA, 20 bp, mouse
gaaaggtgtgagccatgcat

SEQ ID NO: 751155 - DNA, 20 bp, mouse
gggtaggatctttactgaaa

SEQ ID NO: 751156 - DNA, 20 bp, mouse
gaatgttggcacagtaaaga

SEQ ID NO: 751157 - DNA, 20 bp, mouse
gatcaagaagctaaagtcca

SEQ ID NO: 751158 - DNA, 20 bp, mouse
gtccacgtgtgtgacccttc

SEQ ID NO: 751159 - DNA, 20 bp, mouse
gcaactaaaacttgtcactg

SEQ ID NO: 751160 - DNA, 20 bp, mouse
gacagagtcaagagggtatt

SEQ ID NO: 751161 - DNA, 20 bp, mouse
gctacaatacagagtcaaga

SEQ ID NO: 751162 - DNA, 20 bp, mouse
gagttttagttgttcaatgt

SEQ ID NO: 751163 - DNA, 20 bp, mouse
gaaactattattagagtctg

SEQ ID NO: 751164 - DNA, 20 bp, mouse
gaaacaatgttagtaatgtt

SEQ ID NO: 751165 - DNA, 20 bp, mouse
ggtgtgtgacccttcagggt

SEQ ID NO: 751166 - DNA, 20 bp, mouse
gtccccgcccctagagcgga

SEQ ID NO: 751167 - DNA, 20 bp, mouse
gtggacttgcgcgggttgaa

SEQ ID NO: 751168 - DNA, 20 bp, mouse
ggctgcgtgtaatgaaccta

SEQ ID NO: 751169 - DNA, 20 bp, mouse
gcaacccgcgcaagtccaaa

SEQ ID NO: 751170 - DNA, 20 bp, mouse
gttccgccccctccgctcta

SEQ ID NO: 751171 - DNA, 20 bp, mouse
gccccctccgctctaggggc

SEQ ID NO: 751172 - DNA, 20 bp, mouse
ggcgtcagcacgtttccaag

SEQ ID NO: 751173 - DNA, 20 bp, mouse
gcattcccagcgaaagaggc

SEQ ID NO: 751174 - DNA, 20 bp, mouse
ggctgggaatgcacgcccct

SEQ ID NO: 751175 - DNA, 20 bp, mouse
gagtgtgacgtcgtttcctt

SEQ ID NO: 751176 - DNA, 20 bp, mouse
gcatgctgattggacatcgg

SEQ ID NO: 751177 - DNA, 20 bp, mouse
ggggttgcatacgtgtaagt

SEQ ID NO: 751178 - DNA, 20 bp, mouse
gagaactattaactaggact

SEQ ID NO: 751179 - DNA, 20 bp, mouse
gggggctcaccatccaatga

SEQ ID NO: 751180 - DNA, 20 bp, mouse
gctaatgtccgccctatggt

SEQ ID NO: 751181 - DNA, 20 bp, mouse
ggctttgagcacctaccata

SEQ ID NO: 751182 - DNA, 20 bp, mouse
gtgcccacagatgaccacag

SEQ ID NO: 751183 - DNA, 20 bp, mouse
gaaaattaccataccccctg

SEQ ID NO: 751184 - DNA, 20 bp, mouse
gtaccccctgtggtcatctg

SEQ ID NO: 751185 - DNA, 20 bp, mouse
gggttcactcagtaccagca

SEQ ID NO: 751186 - DNA, 20 bp, mouse
ggcggggcagaatggaactt

SEQ ID NO: 751187 - DNA, 20 bp, mouse
gcagcaggttggagtggaca

SEQ ID NO: 751188 - DNA, 20 bp, mouse
gaggttggagtggacagggg

SEQ ID NO: 751189 - DNA, 20 bp, mouse
gggcccgcctcttctaactt

SEQ ID NO: 751190 - DNA, 20 bp, mouse
gaccgagagacggagaggaa

SEQ ID NO: 751191 - DNA, 20 bp, mouse
ggggtccagctgctttggag

SEQ ID NO: 751192 - DNA, 20 bp, mouse
gcgggcccagggctcaggcc

SEQ ID NO: 751193 - DNA, 20 bp, mouse
gggacaagccctagggaggg

SEQ ID NO: 751194 - DNA, 20 bp, mouse
gcttgagtgtgtaggaaatc

SEQ ID NO: 751195 - DNA, 20 bp, mouse
gcctcccgggcctgagccct

SEQ ID NO: 751196 - DNA, 20 bp, mouse
gtgggcgcggcgtcctccca

SEQ ID NO: 751197 - DNA, 20 bp, mouse
ggtggtccctgcatccggag

SEQ ID NO: 751198 - DNA, 20 bp, mouse
gagaggctgggaagcgtgtg

SEQ ID NO: 751199 - DNA, 20 bp, mouse
gggccccagggccgcagcgt

SEQ ID NO: 751200 - DNA, 20 bp, mouse
gacctcggccgtaacctccc

SEQ ID NO: 751201 - DNA, 20 bp, mouse
gcgcaagcatccgggatcgg

SEQ ID NO: 751202 - DNA, 20 bp, mouse
gggccggtggtccctgcatc

SEQ ID NO: 751203 - DNA, 20 bp, mouse
gctgcgccccggtgtcccca

SEQ ID NO: 751204 - DNA, 20 bp, mouse
gtcctcccccgggaagctgg

SEQ ID NO: 751205 - DNA, 20 bp, mouse
gacggcccccagcttcccgg

SEQ ID NO: 751206 - DNA, 20 bp, mouse
gtgggacggggtcaagtact

SEQ ID NO: 751207 - DNA, 20 bp, mouse
ggggtcggagctaccggatg

SEQ ID NO: 751208 - DNA, 20 bp, mouse
gagcctgcgcagacagcgtg

SEQ ID NO: 751209 - DNA, 20 bp, mouse
ggtaccctaggggcggagtc

SEQ ID NO: 751210 - DNA, 20 bp, mouse
gtaggctacggactcctcgg

SEQ ID NO: 751211 - DNA, 20 bp, mouse
gtctgcgcagaacacgctta

SEQ ID NO: 751212 - DNA, 20 bp, mouse
gggagctaccggatgaggtc

SEQ ID NO: 751213 - DNA, 20 bp, mouse
gtcaggagaccgtggctgag

SEQ ID NO: 751214 - DNA, 20 bp, mouse
gaggtgagctcccagagcta

SEQ ID NO: 751215 - DNA, 20 bp, mouse
gtgaggaggcggtaccctag

SEQ ID NO: 751216 - DNA, 20 bp, mouse
gcagagctccagtcatggga

SEQ ID NO: 751217 - DNA, 20 bp, mouse
ggacaccccagcaacctcac

SEQ ID NO: 751218 - DNA, 20 bp, mouse
gtcccatagcctggacatca

SEQ ID NO: 751219 - DNA, 20 bp, mouse
gaggccacatccaagcctct

SEQ ID NO: 751220 - DNA, 20 bp, mouse
gccccagcaacctcacaggt

SEQ ID NO: 751221 - DNA, 20 bp, mouse
gctccctgatgtccaggcta

SEQ ID NO: 751222 - DNA, 20 bp, mouse
ggaggtccctagtccacagt

SEQ ID NO: 751223 - DNA, 20 bp, mouse
ggcagcagagctccagtcat

SEQ ID NO: 751224 - DNA, 20 bp, mouse
gtgctggggtgtccgggcag

SEQ ID NO: 751225 - DNA, 20 bp, mouse
ggcaacctcacaggtcggtc

SEQ ID NO: 751226 - DNA, 20 bp, mouse
gcacaggcatagcccattaa

SEQ ID NO: 751227 - DNA, 20 bp, mouse
gaggcacgggatagacatcc

SEQ ID NO: 751228 - DNA, 20 bp, mouse
gaacccaccaccacggtaga

SEQ ID NO: 751229 - DNA, 20 bp, mouse
gtcccagcctggaaccctcc

SEQ ID NO: 751230 - DNA, 20 bp, mouse
gcagggcggagtgaaggtgg

SEQ ID NO: 751231 - DNA, 20 bp, mouse
gactccgccctgctactgca

SEQ ID NO: 751232 - DNA, 20 bp, mouse
gacccagcagccatctaccg

SEQ ID NO: 751233 - DNA, 20 bp, mouse
gtagcagggcggagtgaagg

SEQ ID NO: 751234 - DNA, 20 bp, mouse
ggtaagtgaaccagaggcac

SEQ ID NO: 751235 - DNA, 20 bp, mouse
gcaccacggtagatggctgc

SEQ ID NO: 751236 - DNA, 20 bp, mouse
gccaagggatatgttgggga

SEQ ID NO: 751237 - DNA, 20 bp, mouse
gtctctgcagcggtggggag

SEQ ID NO: 751238 - DNA, 20 bp, mouse
gcggcgggagcgagaaggag

SEQ ID NO: 751239 - DNA, 20 bp, mouse
gagcgggtcaatacccctgg

SEQ ID NO: 751240 - DNA, 20 bp, mouse
gaggggcgctgcggcaggat

SEQ ID NO: 751241 - DNA, 20 bp, mouse
gttcccgtgggcgcctccag

SEQ ID NO: 751242 - DNA, 20 bp, mouse
gaggccccccctctctgcag

SEQ ID NO: 751243 - DNA, 20 bp, mouse
ggcccgcggcattaacacat

SEQ ID NO: 751244 - DNA, 20 bp, mouse
gtacccctggaggcgcccac

SEQ ID NO: 751245 - DNA, 20 bp, mouse
gggtagcgggtcaatacccc

SEQ ID NO: 751246 - DNA, 20 bp, mouse
gggcaggggaggggtcgagt

SEQ ID NO: 751247 - DNA, 20 bp, mouse
gagagtggtgggtccaagta

SEQ ID NO: 751248 - DNA, 20 bp, mouse
ggaaacatgggtgggaaacc

SEQ ID NO: 751249 - DNA, 20 bp, mouse
gaaaaatcagaatgaaacat

SEQ ID NO: 751250 - DNA, 20 bp, mouse
gccacaggatgagagagtgg

SEQ ID NO: 751251 - DNA, 20 bp, mouse
gtccccacccaacgtgacaa

SEQ ID NO: 751252 - DNA, 20 bp, mouse
gtggggattcacttggtcag

SEQ ID NO: 751253 - DNA, 20 bp, mouse
gagtgactgccagatgtcaa

SEQ ID NO: 751254 - DNA, 20 bp, mouse
ggcagacagtagtgccaaat

SEQ ID NO: 751255 - DNA, 20 bp, mouse
gcacagccaggagccctact

SEQ ID NO: 751256 - DNA, 20 bp, mouse
gaaggggcggagcagtccga

SEQ ID NO: 751257 - DNA, 20 bp, mouse
ggggcagggcgcgtgtggga

SEQ ID NO: 751258 - DNA, 20 bp, mouse
gccctcctggggcccgagat

SEQ ID NO: 751259 - DNA, 20 bp, mouse
gaaagcgcatagctggggag

SEQ ID NO: 751260 - DNA, 20 bp, mouse
ggacgaacagacacgtgctg

SEQ ID NO: 751261 - DNA, 20 bp, mouse
ggctccgcacagggtcaccc

SEQ ID NO: 751262 - DNA, 20 bp, mouse
gaggccgtccgggtcacctg

SEQ ID NO: 751263 - DNA, 20 bp, mouse
ggctggaggcgaagagaccc

SEQ ID NO: 751264 - DNA, 20 bp, mouse
gcagctccggggtgcgccag

SEQ ID NO: 751265 - DNA, 20 bp, mouse
gagcgtactggctgcgggaa

SEQ ID NO: 751266 - DNA, 20 bp, mouse
gtgagcgcgcgctaaggggc

SEQ ID NO: 751267 - DNA, 20 bp, mouse
gggcaggggaggcggcgtaa

SEQ ID NO: 751268 - DNA, 20 bp, mouse
gggagagggcgtggctgtca

SEQ ID NO: 751269 - DNA, 20 bp, mouse
ggggggtcggccgaaccgga

SEQ ID NO: 751270 - DNA, 20 bp, mouse
gcaggtgagcgcgcgctaag

SEQ ID NO: 751271 - DNA, 20 bp, mouse
gtcggccgaaccggagggag

SEQ ID NO: 751272 - DNA, 20 bp, mouse
gggccctggtcctcccggtc

SEQ ID NO: 751273 - DNA, 20 bp, mouse
gggccctggccgcgcgtgcg

SEQ ID NO: 751274 - DNA, 20 bp, mouse
gggcgtggctgtcagggcgg

SEQ ID NO: 751275 - DNA, 20 bp, mouse
gcctctccgcgcacgcgtag

SEQ ID NO: 751276 - DNA, 20 bp, mouse
gaggccagcagctccgtctg

SEQ ID NO: 751277 - DNA, 20 bp, mouse
gagctcgcttccaccaggag

SEQ ID NO: 751278 - DNA, 20 bp, mouse
gcggccagctcgcttccacc

SEQ ID NO: 751279 - DNA, 20 bp, mouse
gcttccagacccatcaggga

SEQ ID NO: 751280 - DNA, 20 bp, mouse
gcgcgcgtgagctggcttgc

SEQ ID NO: 751281 - DNA, 20 bp, mouse
gtgagcttccagacccatca

SEQ ID NO: 751282 - DNA, 20 bp, mouse
gctgctggcctcgacaccag

SEQ ID NO: 751283 - DNA, 20 bp, mouse
ggaagcgagctggccgcaga

SEQ ID NO: 751284 - DNA, 20 bp, mouse
gagagcgcggctactccagt

SEQ ID NO: 751285 - DNA, 20 bp, mouse
gcagaggcactcgctagccc

SEQ ID NO: 751286 - DNA, 20 bp, mouse
gagcccccctgctttttccc

SEQ ID NO: 751287 - DNA, 20 bp, mouse
gggaagctgtcgagaagcgt

SEQ ID NO: 751288 - DNA, 20 bp, mouse
gtcccagcctgggaaaaagc

SEQ ID NO: 751289 - DNA, 20 bp, mouse
gagcctgggaaaaagcaggg

SEQ ID NO: 751290 - DNA, 20 bp, mouse
ggctgggaagatgcgcacag

SEQ ID NO: 751291 - DNA, 20 bp, mouse
gctacaggcagtgatgagag

SEQ ID NO: 751292 - DNA, 20 bp, mouse
ggagaagcgtgggataattt

SEQ ID NO: 751293 - DNA, 20 bp, mouse
gaggagatgccactaacacg

SEQ ID NO: 751294 - DNA, 20 bp, mouse
gtggcatctcctgcgcactc

SEQ ID NO: 751295 - DNA, 20 bp, mouse
gcatacgaaacgcggaattc

SEQ ID NO: 751296 - DNA, 20 bp, mouse
gcaattggaggaaagttctg

SEQ ID NO: 751297 - DNA, 20 bp, mouse
ggggtggggcgggctcaagg

SEQ ID NO: 751298 - DNA, 20 bp, mouse
gagcccgccccaccccctcg

SEQ ID NO: 751299 - DNA, 20 bp, mouse
gcgggagctcggtccaaggc

SEQ ID NO: 751300 - DNA, 20 bp, mouse
gctgccccctctgagctccg

SEQ ID NO: 751301 - DNA, 20 bp, mouse
gaaggcgggagctcggtcca

SEQ ID NO: 751302 - DNA, 20 bp, mouse
gccctagccccggagctcag

SEQ ID NO: 751303 - DNA, 20 bp, mouse
gccctcgagggtgctgcaat

SEQ ID NO: 751304 - DNA, 20 bp, mouse
gtcagagggggcagcggcga

SEQ ID NO: 751305 - DNA, 20 bp, mouse
gctgcggccccgaccctccc

SEQ ID NO: 751306 - DNA, 20 bp, mouse
gggaaagtgcagctcggagt

SEQ ID NO: 751307 - DNA, 20 bp, mouse
gggaacaaggtcagggagga

SEQ ID NO: 751308 - DNA, 20 bp, mouse
gtatctgcggcgtgacacca

SEQ ID NO: 751309 - DNA, 20 bp, mouse
gaacgggaacaaggtcaggg

SEQ ID NO: 751310 - DNA, 20 bp, mouse
ggggcagcatctcgccgcac

SEQ ID NO: 751311 - DNA, 20 bp, mouse
gtcacgccgcagatactcag

SEQ ID NO: 751312 - DNA, 20 bp, mouse
gcatctcgccgcacaggaca

SEQ ID NO: 751313 - DNA, 20 bp, mouse
gcgggggcggagctcggccg

SEQ ID NO: 751314 - DNA, 20 bp, mouse
gaactgctggcccgggccga

SEQ ID NO: 751315 - DNA, 20 bp, mouse
gcgaagaagctgtagggatg

SEQ ID NO: 751316 - DNA, 20 bp, mouse
ggaccctgaagggagtggga

SEQ ID NO: 751317 - DNA, 20 bp, mouse
gctaggccagaacgacccaa

SEQ ID NO: 751318 - DNA, 20 bp, mouse
gcgacccaagggaggatgcg

SEQ ID NO: 751319 - DNA, 20 bp, mouse
gacccccgagcccgggtacc

SEQ ID NO: 751320 - DNA, 20 bp, mouse
gggccagaacgacccaaggg

SEQ ID NO: 751321 - DNA, 20 bp, mouse
gtggggactgccagccatat

SEQ ID NO: 751322 - DNA, 20 bp, mouse
gtcaaccccgcaccgataga

SEQ ID NO: 751323 - DNA, 20 bp, mouse
gtgggagcagcccatatggc

SEQ ID NO: 751324 - DNA, 20 bp, mouse
gggcccgtatggtgttgtgt

SEQ ID NO: 751325 - DNA, 20 bp, mouse
ggaaggagagcgaactgggg

SEQ ID NO: 751326 - DNA, 20 bp, mouse
gtaaggggtaaatgtaatgt

SEQ ID NO: 751327 - DNA, 20 bp, mouse
gctcaaagtgaccaaatctg

SEQ ID NO: 751328 - DNA, 20 bp, mouse
gggcctcccaaggtctggtc

SEQ ID NO: 751329 - DNA, 20 bp, mouse
ggccagcattgcacacttag

SEQ ID NO: 751330 - DNA, 20 bp, mouse
ggccgctaagtgtgcaatgc

SEQ ID NO: 751331 - DNA, 20 bp, mouse
ggggtaaatgtaatgttggc

SEQ ID NO: 751332 - DNA, 20 bp, mouse
gggcctctctaggcaatagg

SEQ ID NO: 751333 - DNA, 20 bp, mouse
ggttggctggaaggctatct

SEQ ID NO: 751334 - DNA, 20 bp, mouse
gagtgagatgacaagcattt

SEQ ID NO: 751335 - DNA, 20 bp, mouse
ggagacgcgatttgggcaga

SEQ ID NO: 751336 - DNA, 20 bp, mouse
ggggaggggtagcagacatg

SEQ ID NO: 751337 - DNA, 20 bp, mouse
gcgcgcaagcaatcagacgg

SEQ ID NO: 751338 - DNA, 20 bp, mouse
ggtcccatctatatcaggac

SEQ ID NO: 751339 - DNA, 20 bp, mouse
gaagcaatcagacggtgggg

SEQ ID NO: 751340 - DNA, 20 bp, mouse
gtgtcgcgcaagcaatcaga

SEQ ID NO: 751341 - DNA, 20 bp, mouse
gtatcaggacaggctgtcat

SEQ ID NO: 751342 - DNA, 20 bp, mouse
gggctgtcatgggttgtagg

SEQ ID NO: 751343 - DNA, 20 bp, mouse
gctcctgggctgcttcaaac

SEQ ID NO: 751344 - DNA, 20 bp, mouse
gccgatgaaaggaatgtgag

SEQ ID NO: 751345 - DNA, 20 bp, mouse
gacaggctgtcatgggttgt

SEQ ID NO: 751346 - DNA, 20 bp, mouse
gtgagagcgcgaggggcaac

SEQ ID NO: 751347 - DNA, 20 bp, mouse
ggcccctcgcgctctcagct

SEQ ID NO: 751348 - DNA, 20 bp, mouse
ggatagagcgcagctcacag

SEQ ID NO: 751349 - DNA, 20 bp, mouse
gcacgtggggcgcggaccga

SEQ ID NO: 751350 - DNA, 20 bp, mouse
gccccagctgagagcgcgag

SEQ ID NO: 751351 - DNA, 20 bp, mouse
gtgtgtggctgctgcacgtg

SEQ ID NO: 751352 - DNA, 20 bp, mouse
ggcgggactccgggcagaag

SEQ ID NO: 751353 - DNA, 20 bp, mouse
ggcagaagaggcttgcttcg

SEQ ID NO: 751354 - DNA, 20 bp, mouse
gagcgggcgggacttcctgc

SEQ ID NO: 751355 - DNA, 20 bp, mouse
gaacgggagctgacctgcgc

SEQ ID NO: 751356 - DNA, 20 bp, mouse
ggggatgtagtggtggttga

SEQ ID NO: 751357 - DNA, 20 bp, mouse
gcccaatggggatgtagtgg

SEQ ID NO: 751358 - DNA, 20 bp, mouse
gtcacacgacgagacccaat

SEQ ID NO: 751359 - DNA, 20 bp, mouse
gaaaccgagcctaacccttc

SEQ ID NO: 751360 - DNA, 20 bp, mouse
gcaggcggacaattggttaa

SEQ ID NO: 751361 - DNA, 20 bp, mouse
gtcgtgtgacatcatatctt

SEQ ID NO: 751362 - DNA, 20 bp, mouse
gggactggcaggcggacaat

SEQ ID NO: 751363 - DNA, 20 bp, mouse
gaccaccactacatccccat

SEQ ID NO: 751364 - DNA, 20 bp, mouse
gctaagaagatagccaaaag

SEQ ID NO: 751365 - DNA, 20 bp, mouse
gaagtctttcctgaagggtt

SEQ ID NO: 751366 - DNA, 20 bp, mouse
gggaacttcccaaaagtaca

SEQ ID NO: 751367 - DNA, 20 bp, mouse
gctgggagcagcggaactaa

SEQ ID NO: 751368 - DNA, 20 bp, mouse
gtgctccgacggaaggacga

SEQ ID NO: 751369 - DNA, 20 bp, mouse
gacggccctcgtccttccgt

SEQ ID NO: 751370 - DNA, 20 bp, mouse
gcaaaagtacagggttaaga

SEQ ID NO: 751371 - DNA, 20 bp, mouse
gtgaaagggtgttgtgggtc

SEQ ID NO: 751372 - DNA, 20 bp, mouse
gtactttgaaagggtgttgt

SEQ ID NO: 751373 - DNA, 20 bp, mouse
gtcacttttaagggttttgg

SEQ ID NO: 751374 - DNA, 20 bp, mouse
gagagtatggatctcattag

SEQ ID NO: 751375 - DNA, 20 bp, mouse
gagtgagatcttgtttttcc

SEQ ID NO: 751376 - DNA, 20 bp, mouse
ggacgcgtgggttgattcga

SEQ ID NO: 751377 - DNA, 20 bp, mouse
ggctgtgtctggggacgcgt

SEQ ID NO: 751378 - DNA, 20 bp, mouse
ggggttgattcgagggtcgc

SEQ ID NO: 751379 - DNA, 20 bp, mouse
gtgtgacggtcacttcttgt

SEQ ID NO: 751380 - DNA, 20 bp, mouse
ggacaccggatcctccactc

SEQ ID NO: 751381 - DNA, 20 bp, mouse
gcgaacggcagccaatgaga

SEQ ID NO: 751382 - DNA, 20 bp, mouse
ggattcgagggtcgccggag

SEQ ID NO: 751383 - DNA, 20 bp, mouse
ggagggtcccctcggtattg

SEQ ID NO: 751384 - DNA, 20 bp, mouse
gggcgggcgatgcaggtcga

SEQ ID NO: 751385 - DNA, 20 bp, mouse
gtgaggtgggcgctgtgtct

SEQ ID NO: 751386 - DNA, 20 bp, mouse
ggtcggccgggagtcttctt

SEQ ID NO: 751387 - DNA, 20 bp, mouse
ggggagtcttcttaggttag

SEQ ID NO: 751388 - DNA, 20 bp, mouse
ggcatgccagcggactagtg

SEQ ID NO: 751389 - DNA, 20 bp, mouse
gcggcggtgagttttcaccc

SEQ ID NO: 751390 - DNA, 20 bp, mouse
gagttttcacccaggtttgg

SEQ ID NO: 751391 - DNA, 20 bp, mouse
ggattggctgcgcaagatgg

SEQ ID NO: 751392 - DNA, 20 bp, mouse
gtcacatagctgcatgccag

SEQ ID NO: 751393 - DNA, 20 bp, mouse
ggaagacctcactagtccgc

SEQ ID NO: 751394 - DNA, 20 bp, mouse
ggtcttcttaggttagcgga

SEQ ID NO: 751395 - DNA, 20 bp, mouse
gggaaataggaaggctagat

SEQ ID NO: 751396 - DNA, 20 bp, mouse
gtgcgaagaaggccgttcgt

SEQ ID NO: 751397 - DNA, 20 bp, mouse
ggagaccacgccccttctga

SEQ ID NO: 751398 - DNA, 20 bp, mouse
ggctgcgggcgagaccaacc

SEQ ID NO: 751399 - DNA, 20 bp, mouse
gcttgggcgtgttttgtgat

SEQ ID NO: 751400 - DNA, 20 bp, mouse
gaagaaggccgttcgtggga

SEQ ID NO: 751401 - DNA, 20 bp, mouse
gggcgagaccaacccggctt

SEQ ID NO: 751402 - DNA, 20 bp, mouse
gcagctaagagcatcttccg

SEQ ID NO: 751403 - DNA, 20 bp, mouse
gcagtctcacgggttagggg

SEQ ID NO: 751404 - DNA, 20 bp, mouse
ggagggggaagcagtctcac

SEQ ID NO: 751405 - DNA, 20 bp, mouse
gggtacataaggtcgcttat

SEQ ID NO: 751406 - DNA, 20 bp, mouse
gggtggcgaaagaatgtcgc

SEQ ID NO: 751407 - DNA, 20 bp, mouse
gtcgcaggacgatgcggagg

SEQ ID NO: 751408 - DNA, 20 bp, mouse
ggggacggcgttccaagctg

SEQ ID NO: 751409 - DNA, 20 bp, mouse
gcaccgaaggcagctcccga

SEQ ID NO: 751410 - DNA, 20 bp, mouse
ggtggcgagcggggtcgtgc

SEQ ID NO: 751411 - DNA, 20 bp, mouse
gggattcgttcgtctctcgg

SEQ ID NO: 751412 - DNA, 20 bp, mouse
gatgtcgcaggacgatgcgg

SEQ ID NO: 751413 - DNA, 20 bp, mouse
gggagccggggcagcaccga

SEQ ID NO: 751414 - DNA, 20 bp, mouse
gcctctctatggtttggtgg

SEQ ID NO: 751415 - DNA, 20 bp, mouse
ggcgagcggggtcgtgctgg

SEQ ID NO: 751416 - DNA, 20 bp, mouse
gtctccctggagatgcacaa

SEQ ID NO: 751417 - DNA, 20 bp, mouse
gggaagtagcgtcactggga

SEQ ID NO: 751418 - DNA, 20 bp, mouse
ggggcgggttccaagtgatt

SEQ ID NO: 751419 - DNA, 20 bp, mouse
gcgtgccggagaccgaggac

SEQ ID NO: 751420 - DNA, 20 bp, mouse
gacgcccttgtgcatctcca

SEQ ID NO: 751421 - DNA, 20 bp, mouse
gaagtgattgggaagctcag

SEQ ID NO: 751422 - DNA, 20 bp, mouse
gcacaagggcgtgcagcacg

SEQ ID NO: 751423 - DNA, 20 bp, mouse
gcagcggaggcgagtccgaa

SEQ ID NO: 751424 - DNA, 20 bp, mouse
gtgcacggaaccgtactcga

SEQ ID NO: 751425 - DNA, 20 bp, mouse
gcgaaggcgaggacttcctg

SEQ ID NO: 751426 - DNA, 20 bp, mouse
gctgaggagtcgccaggtta

SEQ ID NO: 751427 - DNA, 20 bp, mouse
ggaccgaagggcttacgcac

SEQ ID NO: 751428 - DNA, 20 bp, mouse
gcggcgttcccagttgcctt

SEQ ID NO: 751429 - DNA, 20 bp, mouse
ggaacgccgaagccctaacc

SEQ ID NO: 751430 - DNA, 20 bp, mouse
ggcgcttcattcaggtctat

SEQ ID NO: 751431 - DNA, 20 bp, mouse
gcctcggttcccaaggcaac

SEQ ID NO: 751432 - DNA, 20 bp, mouse
gcccgcgttccgcgtctcat

SEQ ID NO: 751433 - DNA, 20 bp, mouse
gcagcgtagtgggtacgtga

SEQ ID NO: 751434 - DNA, 20 bp, mouse
gagccggtgcgtaagccctt

SEQ ID NO: 751435 - DNA, 20 bp, mouse
ggtgcaattgcgcttcattc

SEQ ID NO: 751436 - DNA, 20 bp, mouse
gggcgagtgcacaggggcgt

SEQ ID NO: 751437 - DNA, 20 bp, mouse
gagggagggcgagtgcacag

SEQ ID NO: 751438 - DNA, 20 bp, mouse
gaaagcggcggtaccgggga

SEQ ID NO: 751439 - DNA, 20 bp, mouse
gcctggcgccccaaaaccgt

SEQ ID NO: 751440 - DNA, 20 bp, mouse
gagcacgggccaggggaaag

SEQ ID NO: 751441 - DNA, 20 bp, mouse
gccccagccgcgccgtggtt

SEQ ID NO: 751442 - DNA, 20 bp, mouse
gcaaaaccgtagggcctcac

SEQ ID NO: 751443 - DNA, 20 bp, mouse
ggaactacacagcacgggcc

SEQ ID NO: 751444 - DNA, 20 bp, mouse
gcaggggaaagcggcggtac

SEQ ID NO: 751445 - DNA, 20 bp, mouse
gcgcccgagcgcatgtggtc

SEQ ID NO: 751446 - DNA, 20 bp, mouse
gacccccgagcccgggtacc

SEQ ID NO: 751447 - DNA, 20 bp, mouse
gggcccgtatggtgttgtgt

SEQ ID NO: 751448 - DNA, 20 bp, mouse
ggaccctgaagggagtggga

SEQ ID NO: 751449 - DNA, 20 bp, mouse
gggactgcgtggcatgatgg

SEQ ID NO: 751450 - DNA, 20 bp, mouse
ggacccacacaacaccatac

SEQ ID NO: 751451 - DNA, 20 bp, mouse
gctaggccagaacgacccaa

SEQ ID NO: 751452 - DNA, 20 bp, mouse
gggcccggcggggtccggga

SEQ ID NO: 751453 - DNA, 20 bp, mouse
gtacctggcgcacacagaac

SEQ ID NO: 751454 - DNA, 20 bp, mouse
ggccggtagtagcgcttctg

SEQ ID NO: 751455 - DNA, 20 bp, mouse
gcgacccaagggaggatgcg

SEQ ID NO: 751456 - DNA, 20 bp, mouse
gctcctgccccaacctgaaa

SEQ ID NO: 751457 - DNA, 20 bp, mouse
gggacattccatttcaggtt

SEQ ID NO: 751458 - DNA, 20 bp, mouse
gctagtaatgtgtctgtgag

SEQ ID NO: 751459 - DNA, 20 bp, mouse
ggatagaaacaagttctctg

SEQ ID NO: 751460 - DNA, 20 bp, mouse
gaaacaagttctctgtggat

SEQ ID NO: 751461 - DNA, 20 bp, mouse
gtagacattatggatctttg

SEQ ID NO: 751462 - DNA, 20 bp, mouse
gaaatgggaggtcaataaat

SEQ ID NO: 751463 - DNA, 20 bp, mouse
gataaagcaaagtggtttcc

SEQ ID NO: 751464 - DNA, 20 bp, mouse
gaacaggagtatagcttgag

SEQ ID NO: 751465 - DNA, 20 bp, mouse
ggaaccacaggagtgtttgc

SEQ ID NO: 751466 - DNA, 20 bp, mouse
gagccgctggcgatagatct

SEQ ID NO: 751467 - DNA, 20 bp, mouse
ggaagcagcagaacctaccc

SEQ ID NO: 751468 - DNA, 20 bp, mouse
gtgcctagatctatcgccag

SEQ ID NO: 751469 - DNA, 20 bp, mouse
gggaggtacgggtgctgcgt

SEQ ID NO: 751470 - DNA, 20 bp, mouse
gcagccgccctgccgctggg

SEQ ID NO: 751471 - DNA, 20 bp, mouse
gacaacgcaacccacgcccc

SEQ ID NO: 751472 - DNA, 20 bp, mouse
ggccgtggagccggaggtgg

SEQ ID NO: 751473 - DNA, 20 bp, mouse
gtggccccgtgggatgtaaa

SEQ ID NO: 751474 - DNA, 20 bp, mouse
gggctgcagcagtacggctc

SEQ ID NO: 751475 - DNA, 20 bp, mouse
ggtacctcccagcggcaggg

SEQ ID NO: 751476 - DNA, 20 bp, mouse
gtagtctatgttctcactgc

SEQ ID NO: 751477 - DNA, 20 bp, mouse
gtagagaactacaagctcag

SEQ ID NO: 751478 - DNA, 20 bp, mouse
ggcaacaaacccaagcagaa

SEQ ID NO: 751479 - DNA, 20 bp, mouse
gaagctctagttgtgttccc

SEQ ID NO: 751480 - DNA, 20 bp, mouse
gaaccacaattccttctcac

SEQ ID NO: 751481 - DNA, 20 bp, mouse
gcacataggtatacatctca

SEQ ID NO: 751482 - DNA, 20 bp, mouse
gctagccttaatgctgcagg

SEQ ID NO: 751483 - DNA, 20 bp, mouse
ggaacaaacagagtaagata

SEQ ID NO: 751484 - DNA, 20 bp, mouse
gcatatggtgtctatttcat

SEQ ID NO: 751485 - DNA, 20 bp, mouse
gctgcttgggtttgttgcca

SEQ ID NO: 751486 - DNA, 20 bp, mouse
gtgcagaggcgtccccactc

SEQ ID NO: 751487 - DNA, 20 bp, mouse
ggaggcgtccccactctgga

SEQ ID NO: 751488 - DNA, 20 bp, mouse
gcatatggccgtccagagtg

SEQ ID NO: 751489 - DNA, 20 bp, mouse
ggtgcccgaaacatgtactt

SEQ ID NO: 751490 - DNA, 20 bp, mouse
gagcatcaggtgttagctag

SEQ ID NO: 751491 - DNA, 20 bp, mouse
gtccaaacaccgaagtgcag

SEQ ID NO: 751492 - DNA, 20 bp, mouse
ggcctctgcacttcggtgtt

SEQ ID NO: 751493 - DNA, 20 bp, mouse
ggcgcatgcgcgacccgagc

SEQ ID NO: 751494 - DNA, 20 bp, mouse
gtgggcatacttaggaacaa

SEQ ID NO: 751495 - DNA, 20 bp, mouse
gtcagccctgtggcggccac

SEQ ID NO: 751496 - DNA, 20 bp, mouse
ggccaccggagctttgggtt

SEQ ID NO: 751497 - DNA, 20 bp, mouse
gccggagcgaagggcgtctc

SEQ ID NO: 751498 - DNA, 20 bp, mouse
gcggccggaaggagaccgca

SEQ ID NO: 751499 - DNA, 20 bp, mouse
gaccgcatgaggcggtgggg

SEQ ID NO: 751500 - DNA, 20 bp, mouse
ggggaccagcggccctcgga

SEQ ID NO: 751501 - DNA, 20 bp, mouse
gggcggaccgcatgaggcgg

SEQ ID NO: 751502 - DNA, 20 bp, mouse
gtcccaacatggcgcccaat

SEQ ID NO: 751503 - DNA, 20 bp, mouse
gaattggcgtgcatgaaggc

SEQ ID NO: 751504 - DNA, 20 bp, mouse
gtctgcgcgtcgcttccctg

SEQ ID NO: 751505 - DNA, 20 bp, mouse
ggccaatggcggaccgcatg

SEQ ID NO: 751506 - DNA, 20 bp, mouse
gcacccaggctgccataaca

SEQ ID NO: 751507 - DNA, 20 bp, mouse
gcccactagccagactttac

SEQ ID NO: 751508 - DNA, 20 bp, mouse
gaggaagagcgaggggcggt

SEQ ID NO: 751509 - DNA, 20 bp, mouse
ggggcaggataaggttacgc

SEQ ID NO: 751510 - DNA, 20 bp, mouse
gaggacacccagccctgtta

SEQ ID NO: 751511 - DNA, 20 bp, mouse
gaatagagcacgttcctccg

SEQ ID NO: 751512 - DNA, 20 bp, mouse
gcaggctgccataacagggc

SEQ ID NO: 751513 - DNA, 20 bp, mouse
gcagcaggaagagcgagggg

SEQ ID NO: 751514 - DNA, 20 bp, mouse
gtacaggctggtcacaccta

SEQ ID NO: 751515 - DNA, 20 bp, mouse
gtccccggtcgcagggaaga

SEQ ID NO: 751516 - DNA, 20 bp, mouse
gcggtccgccacttggaaga

SEQ ID NO: 751517 - DNA, 20 bp, mouse
gcgtggggaagggatctctc

SEQ ID NO: 751518 - DNA, 20 bp, mouse
gaaggcgccatctttttcca

SEQ ID NO: 751519 - DNA, 20 bp, mouse
ggggcccgagcgctcctcca

SEQ ID NO: 751520 - DNA, 20 bp, mouse
gacttggaagacggccgcga

SEQ ID NO: 751521 - DNA, 20 bp, mouse
gaaccctccggtccgccact

SEQ ID NO: 751522 - DNA, 20 bp, mouse
ggcctcgtgacgtgttaggt

SEQ ID NO: 751523 - DNA, 20 bp, mouse
ggaaaaagatggcgccttcg

SEQ ID NO: 751524 - DNA, 20 bp, mouse
gttccaagtggcggaccgga

SEQ ID NO: 751525 - DNA, 20 bp, mouse
ggcggccgtcttccaagtgg

SEQ ID NO: 751526 - DNA, 20 bp, mouse
gaacaagtgtgagtgtttga

SEQ ID NO: 751527 - DNA, 20 bp, mouse
gacgacttaaagaaacaaca

SEQ ID NO: 751528 - DNA, 20 bp, mouse
gctaccgtgaggattacgtc

SEQ ID NO: 751529 - DNA, 20 bp, mouse
gcagccggacgtaatcctca

SEQ ID NO: 751530 - DNA, 20 bp, mouse
gagaaaatctggggccttaa

SEQ ID NO: 751531 - DNA, 20 bp, mouse
ggaggctgtgtttgccatgt

SEQ ID NO: 751532 - DNA, 20 bp, mouse
gacgagagagaactaccgtg

SEQ ID NO: 751533 - DNA, 20 bp, mouse
gtgtttgccatgttggtagc

SEQ ID NO: 751534 - DNA, 20 bp, mouse
gacaacgcatttaaaatagc

SEQ ID NO: 751535 - DNA, 20 bp, mouse
gaacacagcctcagcgctcc

SEQ ID NO: 751536 - DNA, 20 bp, mouse
ggctcctcccaggtcatcgt

SEQ ID NO: 751537 - DNA, 20 bp, mouse
gaaaaccagagcgtccgcct

SEQ ID NO: 751538 - DNA, 20 bp, mouse
gacaccgacgatgacctggg

SEQ ID NO: 751539 - DNA, 20 bp, mouse
gcgccgtgggttgaccaagg

SEQ ID NO: 751540 - DNA, 20 bp, mouse
gtcggcggctcaacgcgctc

SEQ ID NO: 751541 - DNA, 20 bp, mouse
gaaccgccgtgggttgacca

SEQ ID NO: 751542 - DNA, 20 bp, mouse
gttgaccaaggcggacgctc

SEQ ID NO: 751543 - DNA, 20 bp, mouse
gtcggtgtcggcgacctgaa

SEQ ID NO: 751544 - DNA, 20 bp, mouse
ggggaggagatgatgctaac

SEQ ID NO: 751545 - DNA, 20 bp, mouse
gtcctggaactagaaagcga

SEQ ID NO: 751546 - DNA, 20 bp, mouse
ggggctccctggttccgacg

SEQ ID NO: 751547 - DNA, 20 bp, mouse
gtgggcgccatcggaagaag

SEQ ID NO: 751548 - DNA, 20 bp, mouse
gcggaagaagcggtcttcat

SEQ ID NO: 751549 - DNA, 20 bp, mouse
gcggaccaaaaaaaccactc

SEQ ID NO: 751550 - DNA, 20 bp, mouse
gcgactggagaaggacgcag

SEQ ID NO: 751551 - DNA, 20 bp, mouse
gtcttccgatggcgcccacg

SEQ ID NO: 751552 - DNA, 20 bp, mouse
gctgaggcgtgggtggacac

SEQ ID NO: 751553 - DNA, 20 bp, mouse
gtatagacctgcaagggatg

SEQ ID NO: 751554 - DNA, 20 bp, mouse
ggcgttcccgggcttggtgg

SEQ ID NO: 751555 - DNA, 20 bp, mouse
gcaacctctgccgggctccc

SEQ ID NO: 751556 - DNA, 20 bp, mouse
gcgctccggagcggtgtccc

SEQ ID NO: 751557 - DNA, 20 bp, mouse
gcgctcccgggacaccgctc

SEQ ID NO: 751558 - DNA, 20 bp, mouse
gaacccgctgctggaccggg

SEQ ID NO: 751559 - DNA, 20 bp, mouse
gccgggaggaacactgtctg

SEQ ID NO: 751560 - DNA, 20 bp, mouse
gcgcgcggccgcagtccccc

SEQ ID NO: 751561 - DNA, 20 bp, mouse
ggcttgcgcggggatccggg

SEQ ID NO: 751562 - DNA, 20 bp, mouse
gcgggtgccgggcaagtgca

SEQ ID NO: 751563 - DNA, 20 bp, mouse
ggccgcttgcgcggggatcc

SEQ ID NO: 751564 - DNA, 20 bp, mouse
gcccgcaggaccgcgctccc

SEQ ID NO: 751565 - DNA, 20 bp, mouse
gcctgcgggccgcttgcgcg

SEQ ID NO: 751566 - DNA, 20 bp, mouse
gccgggtagggctccgattg

SEQ ID NO: 751567 - DNA, 20 bp, mouse
gaaaatagcagagccgggta

SEQ ID NO: 751568 - DNA, 20 bp, mouse
gctagccggccggtggggtt

SEQ ID NO: 751569 - DNA, 20 bp, mouse
gcggccggctagcagttggc

SEQ ID NO: 751570 - DNA, 20 bp, mouse
ggtcctgcctggctttgttt

SEQ ID NO: 751571 - DNA, 20 bp, mouse
gccaccctaaccccaccggc

SEQ ID NO: 751572 - DNA, 20 bp, mouse
ggtgggagtcaggccgcaat

SEQ ID NO: 751573 - DNA, 20 bp, mouse
gccaggcaggaccagggtca

SEQ ID NO: 751574 - DNA, 20 bp, mouse
gaactgctagccggccggtg

SEQ ID NO: 751575 - DNA, 20 bp, mouse
gggggtgggatggacggtgt

SEQ ID NO: 751576 - DNA, 20 bp, mouse
gccagatagccacaccctaa

SEQ ID NO: 751577 - DNA, 20 bp, mouse
ggggtctctcgcgtcctctg

SEQ ID NO: 751578 - DNA, 20 bp, mouse
ggttagcgggtcttcagcag

SEQ ID NO: 751579 - DNA, 20 bp, mouse
gagagacaacccttagggtg

SEQ ID NO: 751580 - DNA, 20 bp, mouse
ggcaaggcactgctgttagc

SEQ ID NO: 751581 - DNA, 20 bp, mouse
gagggcacaagattattgaa

SEQ ID NO: 751582 - DNA, 20 bp, mouse
gaagctgagagacaaccctt

SEQ ID NO: 751583 - DNA, 20 bp, mouse
ggagagacccctgagcagtc

SEQ ID NO: 751584 - DNA, 20 bp, mouse
gcaaagctaacgttgtggca

SEQ ID NO: 751585 - DNA, 20 bp, mouse
gtgtggctgtgatatccctg

SEQ ID NO: 751586 - DNA, 20 bp, mouse
gagtaacacatgctgttctt

SEQ ID NO: 751587 - DNA, 20 bp, mouse
gcctccggtgtgtcccatga

SEQ ID NO: 751588 - DNA, 20 bp, mouse
gtgggagtcagggcattacc

SEQ ID NO: 751589 - DNA, 20 bp, mouse
ggagtgagggcaggaccctg

SEQ ID NO: 751590 - DNA, 20 bp, mouse
gagatgcaggggttagcctc

SEQ ID NO: 751591 - DNA, 20 bp, mouse
ggtgttactgatgaccctca

SEQ ID NO: 751592 - DNA, 20 bp, mouse
ggtaccgggatacaatcccg

SEQ ID NO: 751593 - DNA, 20 bp, mouse
gtagcctcgggattgtatcc

SEQ ID NO: 751594 - DNA, 20 bp, mouse
gaacttctgttgttggaagc

SEQ ID NO: 751595 - DNA, 20 bp, mouse
gtaaactctttctttgccag

SEQ ID NO: 751596 - DNA, 20 bp, mouse
ggccaggggcagggtgtggt

SEQ ID NO: 751597 - DNA, 20 bp, mouse
gtgtaccgggatacaatccg

SEQ ID NO: 751598 - DNA, 20 bp, mouse
gtctcaaattccaagtttaa

SEQ ID NO: 751599 - DNA, 20 bp, mouse
gtgagcctccggtgtgaccc

SEQ ID NO: 751600 - DNA, 20 bp, mouse
gttagcctcggattgtatcc

SEQ ID NO: 751601 - DNA, 20 bp, mouse
ggggaccacacccttaaact

SEQ ID NO: 751602 - DNA, 20 bp, mouse
gtgacaacacatgacaagca

SEQ ID NO: 751603 - DNA, 20 bp, mouse
gggggtgaggtggggcgggt

SEQ ID NO: 751604 - DNA, 20 bp, mouse
gcctccggtgtgacccagga

SEQ ID NO: 751605 - DNA, 20 bp, mouse
gctgttactgatgaccctcc

SEQ ID NO: 751606 - DNA, 20 bp, mouse
gggaagggggccaggtgcgg

SEQ ID NO: 751607 - DNA, 20 bp, mouse
gccagcttttggcccccatg

SEQ ID NO: 751608 - DNA, 20 bp, mouse
gagcaaagtcctatccgagg

SEQ ID NO: 751609 - DNA, 20 bp, mouse
gatgggtcatacagtgtcac

SEQ ID NO: 751610 - DNA, 20 bp, mouse
gaagtcctatccgaggagga

SEQ ID NO: 751611 - DNA, 20 bp, mouse
ggatcagaagaaagattctg

SEQ ID NO: 751612 - DNA, 20 bp, mouse
gaagagcaaagtcctatccg

SEQ ID NO: 751613 - DNA, 20 bp, mouse
gttatgtcggtgaaggatca

SEQ ID NO: 751614 - DNA, 20 bp, mouse
gagaagatagttgagtattc

SEQ ID NO: 751615 - DNA, 20 bp, mouse
ggaggccctgaactgaaaga

SEQ ID NO: 751616 - DNA, 20 bp, mouse
gaccccgcgctggggactcg

SEQ ID NO: 751617 - DNA, 20 bp, mouse
gactcggggcagagatcaag

SEQ ID NO: 751618 - DNA, 20 bp, mouse
gttcccgtcaggcagagcga

SEQ ID NO: 751619 - DNA, 20 bp, mouse
ggccaaggggactacatttc

SEQ ID NO: 751620 - DNA, 20 bp, mouse
gggactacatttccgggaga

SEQ ID NO: 751621 - DNA, 20 bp, mouse
gggcgggctaggggcaggga

SEQ ID NO: 751622 - DNA, 20 bp, mouse
ggaagccataggggcggaaa

SEQ ID NO: 751623 - DNA, 20 bp, mouse
gataggggcggaaaaggcca

SEQ ID NO: 751624 - DNA, 20 bp, mouse
gttaccgcgtgcagcccgga

SEQ ID NO: 751625 - DNA, 20 bp, mouse
gtagggctgcgcagtgggtc

SEQ ID NO: 751626 - DNA, 20 bp, mouse
ggcgccgcctggactcataa

SEQ ID NO: 751627 - DNA, 20 bp, mouse
gccgcctggactcataatgg

SEQ ID NO: 751628 - DNA, 20 bp, mouse
gcctcccggtctccgctcat

SEQ ID NO: 751629 - DNA, 20 bp, mouse
gagtccaggcggcgccacgg

SEQ ID NO: 751630 - DNA, 20 bp, mouse
ggaccgggaggcccgggagt

SEQ ID NO: 751631 - DNA, 20 bp, mouse
gcataatggcggaagatccg

SEQ ID NO: 751632 - DNA, 20 bp, mouse
gagggcgtgcacgtcctccg

SEQ ID NO: 751633 - DNA, 20 bp, mouse
gggtctccgctcattgggca

SEQ ID NO: 751634 - DNA, 20 bp, mouse
gctggagtcgttggcgttcc

SEQ ID NO: 751635 - DNA, 20 bp, mouse
gctagagtctggcccctccg

SEQ ID NO: 751636 - DNA, 20 bp, mouse
gcggcggagggtagagactc

SEQ ID NO: 751637 - DNA, 20 bp, mouse
ggggctctgcccactggtca

SEQ ID NO: 751638 - DNA, 20 bp, mouse
gcacgggaaaagcctcgggt

SEQ ID NO: 751639 - DNA, 20 bp, mouse
gaggaaggggcgttcggttg

SEQ ID NO: 751640 - DNA, 20 bp, mouse
gcctcaacccgggcaagaag

SEQ ID NO: 751641 - DNA, 20 bp, mouse
ggaaaagcctcgggtgggtt

SEQ ID NO: 751642 - DNA, 20 bp, mouse
ggctcggtgcgggaacctaa

SEQ ID NO: 751643 - DNA, 20 bp, mouse
ggggaggaattcctcaaccc

SEQ ID NO: 751644 - DNA, 20 bp, mouse
gcctccccgcgcccgagggc

SEQ ID NO: 751645 - DNA, 20 bp, mouse
gggggcgtctgctcggcgga

SEQ ID NO: 751646 - DNA, 20 bp, mouse
ggagggaggcgcaacgtcac

SEQ ID NO: 751647 - DNA, 20 bp, mouse
ggaggcgcaacgtcaccggc

SEQ ID NO: 751648 - DNA, 20 bp, mouse
gcagccagacggctccggag

SEQ ID NO: 751649 - DNA, 20 bp, mouse
gctactgacactatcgctgg

SEQ ID NO: 751650 - DNA, 20 bp, mouse
ggggctgcggcgagctcgat

SEQ ID NO: 751651 - DNA, 20 bp, mouse
gaaaaagcgctgagtgaggg

SEQ ID NO: 751652 - DNA, 20 bp, mouse
gcagaggctcagtcaagagg

SEQ ID NO: 751653 - DNA, 20 bp, mouse
ggtccccctccggagccgtc

SEQ ID NO: 751654 - DNA, 20 bp, mouse
gcgcctccctcgtccccctc

SEQ ID NO: 751655 - DNA, 20 bp, mouse
gctctgcagccagacggctc

SEQ ID NO: 751656 - DNA, 20 bp, mouse
ggggcccatgaagagggcgg

SEQ ID NO: 751657 - DNA, 20 bp, mouse
gagaaggctgcgggacgaga

SEQ ID NO: 751658 - DNA, 20 bp, mouse
ggaaacgagcgagaaggctg

SEQ ID NO: 751659 - DNA, 20 bp, mouse
gccgagggaaacgagcgaga

SEQ ID NO: 751660 - DNA, 20 bp, mouse
gaggctgcgggacgagaggg

SEQ ID NO: 751661 - DNA, 20 bp, mouse
ggaagccggcgcgctctgat

SEQ ID NO: 751662 - DNA, 20 bp, mouse
gagcacgccccgcaagagga

SEQ ID NO: 751663 - DNA, 20 bp, mouse
gagagcgcgccggcttcatt

SEQ ID NO: 751664 - DNA, 20 bp, mouse
gcgccccagaccgttcggat

SEQ ID NO: 751665 - DNA, 20 bp, mouse
gcgcctcgccccagaccgtt

SEQ ID NO: 751666 - DNA, 20 bp, mouse
gtccccgggacgcaccaagg

SEQ ID NO: 751667 - DNA, 20 bp, mouse
gggtgcgtcccggggatatg

SEQ ID NO: 751668 - DNA, 20 bp, mouse
gcgtcaccgcggccaacaat

SEQ ID NO: 751669 - DNA, 20 bp, mouse
gggctccgccgacccacctg

SEQ ID NO: 751670 - DNA, 20 bp, mouse
gaggggagggtccgcaccct

SEQ ID NO: 751671 - DNA, 20 bp, mouse
gtgcgggaggcgccacaggt

SEQ ID NO: 751672 - DNA, 20 bp, mouse
gcagcggcgttgcccattgt

SEQ ID NO: 751673 - DNA, 20 bp, mouse
gggagggtccgcaccctggg

SEQ ID NO: 751674 - DNA, 20 bp, mouse
ggtggcgcctcccgcacgtg

SEQ ID NO: 751675 - DNA, 20 bp, mouse
gcgcacgtgcgggcgggcca

SEQ ID NO: 751676 - DNA, 20 bp, mouse
gcagttctggaaaatgtcga

SEQ ID NO: 751677 - DNA, 20 bp, mouse
gcggatcgcttaaagggcta

SEQ ID NO: 751678 - DNA, 20 bp, mouse
gtctggaaaatgtcgaaggc

SEQ ID NO: 751679 - DNA, 20 bp, mouse
gggcgggaaacttgctcgaa

SEQ ID NO: 751680 - DNA, 20 bp, mouse
gtaaaggaggaaatccgtta

SEQ ID NO: 751681 - DNA, 20 bp, mouse
gaagtgtaaagtgttttata

SEQ ID NO: 751682 - DNA, 20 bp, mouse
ggacattttccagaactgga

SEQ ID NO: 751683 - DNA, 20 bp, mouse
gtccgttaggggtcatttgt

SEQ ID NO: 751684 - DNA, 20 bp, mouse
gtttttggtaaggtccaaga

SEQ ID NO: 751685 - DNA, 20 bp, mouse
gcggatacgtgggtcacgca

SEQ ID NO: 751686 - DNA, 20 bp, mouse
gggaccttccagttcttgag

SEQ ID NO: 751687 - DNA, 20 bp, mouse
gcaaccgctcaagaactgga

SEQ ID NO: 751688 - DNA, 20 bp, mouse
gcagacgtgacccacgtatc

SEQ ID NO: 751689 - DNA, 20 bp, mouse
gccggcagaggtagaggaac

SEQ ID NO: 751690 - DNA, 20 bp, mouse
ggaagtgtggccgaaaatga

SEQ ID NO: 751691 - DNA, 20 bp, mouse
ggttttggtaaggtccagga

SEQ ID NO: 751692 - DNA, 20 bp, mouse
gtcttcaaccgctcaagaac

SEQ ID NO: 751693 - DNA, 20 bp, mouse
ggcttcttactgggattaaa

SEQ ID NO: 751694 - DNA, 20 bp, mouse
gctgtttaaagctagaagtg

SEQ ID NO: 751695 - DNA, 20 bp, mouse
gaggggtgcaccatcatttt

SEQ ID NO: 751696 - DNA, 20 bp, mouse
gtgaaagaggggtgtcccgt

SEQ ID NO: 751697 - DNA, 20 bp, mouse
gcctcctggcacaacagatg

SEQ ID NO: 751698 - DNA, 20 bp, mouse
gcccctccccaacaccgctg

SEQ ID NO: 751699 - DNA, 20 bp, mouse
gggaggggctggagcctcga

SEQ ID NO: 751700 - DNA, 20 bp, mouse
gccgagccccagcggtgttg

SEQ ID NO: 751701 - DNA, 20 bp, mouse
ggccccagcggtgttgggga

SEQ ID NO: 751702 - DNA, 20 bp, mouse
gccgccacgacgcaccctcg

SEQ ID NO: 751703 - DNA, 20 bp, mouse
ggagcctcgagggtgcgtcg

SEQ ID NO: 751704 - DNA, 20 bp, mouse
gatgggacacggagaacagg

SEQ ID NO: 751705 - DNA, 20 bp, mouse
gttccagccccgtgacctct

SEQ ID NO: 751706 - DNA, 20 bp, mouse
ggggcggtgtcggggttgtg

SEQ ID NO: 751707 - DNA, 20 bp, mouse
ggcggtgaggggcggtgtcg

SEQ ID NO: 751708 - DNA, 20 bp, mouse
gcggtggccgcggtgagggg

SEQ ID NO: 751709 - DNA, 20 bp, mouse
gttgtggggcttccgggtga

SEQ ID NO: 751710 - DNA, 20 bp, mouse
gtgagggcggcgaaggctgg

SEQ ID NO: 751711 - DNA, 20 bp, mouse
gtctcggggtcacgggttga

SEQ ID NO: 751712 - DNA, 20 bp, mouse
gccggcaagcccaccaaaca

SEQ ID NO: 751713 - DNA, 20 bp, mouse
gtggggcttccgggtgaggg

SEQ ID NO: 751714 - DNA, 20 bp, mouse
gccgcctccgcgctgaggtc

SEQ ID NO: 751715 - DNA, 20 bp, mouse
gagcggcggtggccgcggtg

SEQ ID NO: 751716 - DNA, 20 bp, mouse
gaagaggcagggtggagcgc

SEQ ID NO: 751717 - DNA, 20 bp, mouse
gggaccgggcggccactggg

SEQ ID NO: 751718 - DNA, 20 bp, mouse
gagactgcagggccagcccg

SEQ ID NO: 751719 - DNA, 20 bp, mouse
gccggtcccgcccagaggcc

SEQ ID NO: 751720 - DNA, 20 bp, mouse
ggccgcccggtcccgcccag

SEQ ID NO: 751721 - DNA, 20 bp, mouse
gcggagcccaccacccgcag

SEQ ID NO: 751722 - DNA, 20 bp, mouse
gctagcaccactgagtctgg

SEQ ID NO: 751723 - DNA, 20 bp, mouse
gtcccggcggcgccgaggtc

SEQ ID NO: 751724 - DNA, 20 bp, mouse
gcagcgtgactggtaattgt

SEQ ID NO: 751725 - DNA, 20 bp, mouse
gccactgagacgcgacgctc

SEQ ID NO: 751726 - DNA, 20 bp, mouse
gaggcctaatgagacccagg

SEQ ID NO: 751727 - DNA, 20 bp, mouse
gcatcagcttacactgtcag

SEQ ID NO: 751728 - DNA, 20 bp, mouse
gggggtccagggtacagttg

SEQ ID NO: 751729 - DNA, 20 bp, mouse
gggtgagcagaggccagcgg

SEQ ID NO: 751730 - DNA, 20 bp, mouse
gggaccacctgggtctcatt

SEQ ID NO: 751731 - DNA, 20 bp, mouse
gaccagccgcaactgtaccc

SEQ ID NO: 751732 - DNA, 20 bp, mouse
gacagtgtaagctgatgccg

SEQ ID NO: 751733 - DNA, 20 bp, mouse
gagggcctgtcaggaaacag

SEQ ID NO: 751734 - DNA, 20 bp, mouse
gggggccggttgttggggtg

SEQ ID NO: 751735 - DNA, 20 bp, mouse
ggacaggcctaatgagaccc

SEQ ID NO: 751736 - DNA, 20 bp, mouse
gagaaagcagtgttacaata

SEQ ID NO: 751737 - DNA, 20 bp, mouse
gaataaggctggaatgagaa

SEQ ID NO: 751738 - DNA, 20 bp, mouse
ggccggccctggcccttcga

SEQ ID NO: 751739 - DNA, 20 bp, mouse
gcagggaggggtggacacag

SEQ ID NO: 751740 - DNA, 20 bp, mouse
gccagtgtggtcataacctt

SEQ ID NO: 751741 - DNA, 20 bp, mouse
gagctcactgctccctcgaa

SEQ ID NO: 751742 - DNA, 20 bp, mouse
gagggggagcatgcttgggg

SEQ ID NO: 751743 - DNA, 20 bp, mouse
ggggaaagtggactgatgaa

SEQ ID NO: 751744 - DNA, 20 bp, mouse
gtgggggggacaggaacccg

SEQ ID NO: 751745 - DNA, 20 bp, mouse
gctgctccctcgaagggcca

SEQ ID NO: 751746 - DNA, 20 bp, mouse
gtggtcatgtgacgagagaa

SEQ ID NO: 751747 - DNA, 20 bp, mouse
gggctccgcgtcgacgtctc

SEQ ID NO: 751748 - DNA, 20 bp, mouse
ggcggagccatttttgtcgt

SEQ ID NO: 751749 - DNA, 20 bp, mouse
gcaggtgattcctgttgagg

SEQ ID NO: 751750 - DNA, 20 bp, mouse
gccaacttgtggctcccctc

SEQ ID NO: 751751 - DNA, 20 bp, mouse
gggctcctgagacgtcgacg

SEQ ID NO: 751752 - DNA, 20 bp, mouse
gggcaaagtacttccgtctc

SEQ ID NO: 751753 - DNA, 20 bp, mouse
gactttgcccacgacaaaaa

SEQ ID NO: 751754 - DNA, 20 bp, mouse
gtccgctacggctcctggaa

SEQ ID NO: 751755 - DNA, 20 bp, mouse
gagaaaaggggaagctgaat

SEQ ID NO: 751756 - DNA, 20 bp, mouse
gggagctccgagaccacagt

SEQ ID NO: 751757 - DNA, 20 bp, mouse
gtggcagcggcatcagggcg

SEQ ID NO: 751758 - DNA, 20 bp, mouse
gacagccccgggcggactct

SEQ ID NO: 751759 - DNA, 20 bp, mouse
gttaacaagtggctggataa

SEQ ID NO: 751760 - DNA, 20 bp, mouse
gagtccgcccggggctgtac

SEQ ID NO: 751761 - DNA, 20 bp, mouse
gttcctgaatagactggaca

SEQ ID NO: 751762 - DNA, 20 bp, mouse
gccgagaccacagtgggaag

SEQ ID NO: 751763 - DNA, 20 bp, mouse
ggctccgcccactggcccaa

SEQ ID NO: 751764 - DNA, 20 bp, mouse
gcagggcgtggctcgccggg

SEQ ID NO: 751765 - DNA, 20 bp, mouse
gcgcccggggctgtacgggg

SEQ ID NO: 751766 - DNA, 20 bp, mouse
gtcgccggccccactgtagc

SEQ ID NO: 751767 - DNA, 20 bp, mouse
gggagcggcccccacgtgac

SEQ ID NO: 751768 - DNA, 20 bp, mouse
ggcgccaggcgcaccagatg

SEQ ID NO: 751769 - DNA, 20 bp, mouse
gagggcgaagtccacgtcgc

SEQ ID NO: 751770 - DNA, 20 bp, mouse
gcggtcctcaaagctgatgt

SEQ ID NO: 751771 - DNA, 20 bp, mouse
ggggcggtgccgggaacaag

SEQ ID NO: 751772 - DNA, 20 bp, mouse
gaagcgcaggctttggggtt

SEQ ID NO: 751773 - DNA, 20 bp, mouse
gcaagtaagcgcaggctttg

SEQ ID NO: 751774 - DNA, 20 bp, mouse
ggggagttgcaagtaagcgc

SEQ ID NO: 751775 - DNA, 20 bp, mouse
gggggggtccagctacagtg

SEQ ID NO: 751776 - DNA, 20 bp, mouse
gacccgacctagctactccc

SEQ ID NO: 751777 - DNA, 20 bp, mouse
gccccctgccggccggtcca

SEQ ID NO: 751778 - DNA, 20 bp, mouse
gagccagggagtagctaggt

SEQ ID NO: 751779 - DNA, 20 bp, mouse
gcaccctgcactgaacacct

SEQ ID NO: 751780 - DNA, 20 bp, mouse
gacccttggaccggccggca

SEQ ID NO: 751781 - DNA, 20 bp, mouse
gaggtcgggtcagcaaccct

SEQ ID NO: 751782 - DNA, 20 bp, mouse
gggaaggaaaataagttgga

SEQ ID NO: 751783 - DNA, 20 bp, mouse
ggggcagaggaggcgtcagc

SEQ ID NO: 751784 - DNA, 20 bp, mouse
gcagtgcagggtgtgttgag

SEQ ID NO: 751785 - DNA, 20 bp, mouse
ggggaggtagcagtgaatta

SEQ ID NO: 751786 - DNA, 20 bp, mouse
gaaaaaccaaggggaggagt

SEQ ID NO: 751787 - DNA, 20 bp, mouse
gtgaaggcgaggtttgtttt

SEQ ID NO: 751788 - DNA, 20 bp, mouse
gaaagaggggaggtgcccag

SEQ ID NO: 751789 - DNA, 20 bp, mouse
ggtgcccagaggaggggcta

SEQ ID NO: 751790 - DNA, 20 bp, mouse
gacctcgccttcagccctga

SEQ ID NO: 751791 - DNA, 20 bp, mouse
gggcgcttcggatctcctat

SEQ ID NO: 751792 - DNA, 20 bp, mouse
gcgggaggatgagacagcca

SEQ ID NO: 751793 - DNA, 20 bp, mouse
gtctgaagggaaaaaccaag

SEQ ID NO: 751794 - DNA, 20 bp, mouse
ggcacctcccctctttcggg

SEQ ID NO: 751795 - DNA, 20 bp, mouse
gcccgcaatatatgcagttc

SEQ ID NO: 751796 - DNA, 20 bp, mouse
gagcgggcaggacacgacaa

SEQ ID NO: 751797 - DNA, 20 bp, mouse
gcgtccgtcagggtggggta

SEQ ID NO: 751798 - DNA, 20 bp, mouse
ggggtgggagaacgggacgg

SEQ ID NO: 751799 - DNA, 20 bp, mouse
gggggctcccagcgcgtcat

SEQ ID NO: 751800 - DNA, 20 bp, mouse
ggcagatgacgtaagctgta

SEQ ID NO: 751801 - DNA, 20 bp, mouse
gagcctcgagctgtcaagca

SEQ ID NO: 751802 - DNA, 20 bp, mouse
gttcctagacactgtggtat

SEQ ID NO: 751803 - DNA, 20 bp, mouse
gacggttaccaggcacgcgg

SEQ ID NO: 751804 - DNA, 20 bp, mouse
gagacactgtggtataggag

SEQ ID NO: 751805 - DNA, 20 bp, mouse
gctgtggtataggagtggta

SEQ ID NO: 751806 - DNA, 20 bp, mouse
gagaaaggactgtgaggcat

SEQ ID NO: 751807 - DNA, 20 bp, mouse
ggccctgtgcctcttccagt

SEQ ID NO: 751808 - DNA, 20 bp, mouse
gcctgcctcagcccgagggg

SEQ ID NO: 751809 - DNA, 20 bp, mouse
gctgtgaggcataggaaggc

SEQ ID NO: 751810 - DNA, 20 bp, mouse
gaggagctaagtggcccgga

SEQ ID NO: 751811 - DNA, 20 bp, mouse
gaggactgtgaggcatagga

SEQ ID NO: 751812 - DNA, 20 bp, mouse
gaccaaaccctccacgaggt

SEQ ID NO: 751813 - DNA, 20 bp, mouse
gtcccacctcgtggagggtt

SEQ ID NO: 751814 - DNA, 20 bp, mouse
gcttcttcccacctcgtgga

SEQ ID NO: 751815 - DNA, 20 bp, mouse
gccacaccaaaccctccacg

SEQ ID NO: 751816 - DNA, 20 bp, mouse
ggctctgtgggttgtggcga

SEQ ID NO: 751817 - DNA, 20 bp, mouse
gtatggagtgcgttcctggg

SEQ ID NO: 751818 - DNA, 20 bp, mouse
gggaacgcactccatacggt

SEQ ID NO: 751819 - DNA, 20 bp, mouse
ggccactgcctgtgccttta

SEQ ID NO: 751820 - DNA, 20 bp, mouse
ggcactccatacggtgggtg

SEQ ID NO: 751821 - DNA, 20 bp, mouse
ggcagcaagtgctggagtag

SEQ ID NO: 751822 - DNA, 20 bp, mouse
ggctgctcagtgccagggtc

SEQ ID NO: 751823 - DNA, 20 bp, mouse
gctgggggctctgtgggttg

SEQ ID NO: 751824 - DNA, 20 bp, mouse
gcactcagccggggagtagt

SEQ ID NO: 751825 - DNA, 20 bp, mouse
gcagcagtccttaaaggcac

SEQ ID NO: 751826 - DNA, 20 bp, mouse
gtgccgatggggtatagatc

SEQ ID NO: 751827 - DNA, 20 bp, mouse
gtatagatccggtcgggagt

SEQ ID NO: 751828 - DNA, 20 bp, mouse
gtgaacggttgctcacgtgg

SEQ ID NO: 751829 - DNA, 20 bp, mouse
gatggggtatagatccggtc

SEQ ID NO: 751830 - DNA, 20 bp, mouse
gccccatcggcagaacagaa

SEQ ID NO: 751831 - DNA, 20 bp, mouse
gggagtgggagtgagcgacc

SEQ ID NO: 751832 - DNA, 20 bp, mouse
ggtgcagaagtcgtggtgga

SEQ ID NO: 751833 - DNA, 20 bp, mouse
ggagttggcgaagtgaggga

SEQ ID NO: 751834 - DNA, 20 bp, mouse
ggctcactcccactcccgac

SEQ ID NO: 751835 - DNA, 20 bp, mouse
gctctccgtgctcacgtgaa

SEQ ID NO: 751836 - DNA, 20 bp, mouse
ggctccaggcggggacaaac

SEQ ID NO: 751837 - DNA, 20 bp, mouse
gctgtggcgggaactgggtt

SEQ ID NO: 751838 - DNA, 20 bp, mouse
gccgtgctgtggcgggaact

SEQ ID NO: 751839 - DNA, 20 bp, mouse
gacaaacgggtggatgaaca

SEQ ID NO: 751840 - DNA, 20 bp, mouse
gaccccggaggcttcggaac

SEQ ID NO: 751841 - DNA, 20 bp, mouse
gcacggcctcccggaagagg

SEQ ID NO: 751842 - DNA, 20 bp, mouse
ggtgtggctgctatccaggg

SEQ ID NO: 751843 - DNA, 20 bp, mouse
ggggagagctcccgccttgg

SEQ ID NO: 751844 - DNA, 20 bp, mouse
ggggagaagacgggaatccc

SEQ ID NO: 751845 - DNA, 20 bp, mouse
gacgcgggccgaggccgtat

SEQ ID NO: 751846 - DNA, 20 bp, mouse
gtagtcccggcgccccgtgg

SEQ ID NO: 751847 - DNA, 20 bp, mouse
ggggcgctgcgaccagactc

SEQ ID NO: 751848 - DNA, 20 bp, mouse
gagggtacggccgcacgctg

SEQ ID NO: 751849 - DNA, 20 bp, mouse
ggccccgagaagtgaaacca

SEQ ID NO: 751850 - DNA, 20 bp, mouse
gggcgggagaggggaacgtg

SEQ ID NO: 751851 - DNA, 20 bp, mouse
ggggagaggggaacgtgagg

SEQ ID NO: 751852 - DNA, 20 bp, mouse
gtcacagcagatcacgagac

SEQ ID NO: 751853 - DNA, 20 bp, mouse
ggagcctcagtcaggagcgg

SEQ ID NO: 751854 - DNA, 20 bp, mouse
ggtggccccgggacacagag

SEQ ID NO: 751855 - DNA, 20 bp, mouse
gagtcaggagcggcgggaga

SEQ ID NO: 751856 - DNA, 20 bp, mouse
ggcgcctggcagccagataa

SEQ ID NO: 751857 - DNA, 20 bp, mouse
gccgccccgccgccattatc

SEQ ID NO: 751858 - DNA, 20 bp, mouse
ggctgcgccggcgtcgccga

SEQ ID NO: 751859 - DNA, 20 bp, mouse
ggggacgtgaacgaagcgac

SEQ ID NO: 751860 - DNA, 20 bp, mouse
gcctggcagccagataatgg

SEQ ID NO: 751861 - DNA, 20 bp, mouse
gagaccccgcctcgcggcaa

SEQ ID NO: 751862 - DNA, 20 bp, mouse
gtcgaagccggagtcggtcc

SEQ ID NO: 751863 - DNA, 20 bp, mouse
ggtcgccgagggctgcgagt

SEQ ID NO: 751864 - DNA, 20 bp, mouse
gtcgcgacctggaccgactc

SEQ ID NO: 751865 - DNA, 20 bp, mouse
gtcgcagccctcggcgacgc

SEQ ID NO: 751866 - DNA, 20 bp, mouse
ggccctaacgccgccctctg

SEQ ID NO: 751867 - DNA, 20 bp, mouse
gcccgggagccgcctcaaca

SEQ ID NO: 751868 - DNA, 20 bp, mouse
gccggcgcccaatcagcaag

SEQ ID NO: 751869 - DNA, 20 bp, mouse
gtagggccgcgggagtgcgt

SEQ ID NO: 751870 - DNA, 20 bp, mouse
gggagccgcgcgtctcggcc

SEQ ID NO: 751871 - DNA, 20 bp, mouse
gtctgtccgacgcactcccg

SEQ ID NO: 751872 - DNA, 20 bp, mouse
ggcgcccaatcagcaagagg

SEQ ID NO: 751873 - DNA, 20 bp, mouse
gataaaagtcggagccgcag

SEQ ID NO: 751874 - DNA, 20 bp, mouse
gcctccctctggaactccat

SEQ ID NO: 751875 - DNA, 20 bp, mouse
ggggcggagcctcggagcaa

SEQ ID NO: 751876 - DNA, 20 bp, mouse
gggcaggcgcgtgcagggat

SEQ ID NO: 751877 - DNA, 20 bp, mouse
gcgcgcctgcccatctcggc

SEQ ID NO: 751878 - DNA, 20 bp, mouse
ggggccacaggctctactca

SEQ ID NO: 751879 - DNA, 20 bp, mouse
ggaactcgcaagttctaaga

SEQ ID NO: 751880 - DNA, 20 bp, mouse
gcagggaaaactcactctgg

SEQ ID NO: 751881 - DNA, 20 bp, mouse
gtgcacgcgcctgcccatct

SEQ ID NO: 751882 - DNA, 20 bp, mouse
gaacccacctgactcgcccg

SEQ ID NO: 751883 - DNA, 20 bp, mouse
gaggctccgccagccgagat

SEQ ID NO: 751884 - DNA, 20 bp, mouse
gttcctcgggcgagtcaggt

SEQ ID NO: 751885 - DNA, 20 bp, mouse
gtagttaggagcacgcggtg

SEQ ID NO: 751886 - DNA, 20 bp, mouse
gccacctgaggcagcagtgt

SEQ ID NO: 751887 - DNA, 20 bp, mouse
gagggtggatctggccaagt

SEQ ID NO: 751888 - DNA, 20 bp, mouse
gccaaggcggggttagctga

SEQ ID NO: 751889 - DNA, 20 bp, mouse
ggacttgaccgctttttccc

SEQ ID NO: 751890 - DNA, 20 bp, mouse
gaaaagcggtcaagtcctca

SEQ ID NO: 751891 - DNA, 20 bp, mouse
gggagattggagttcctcct

SEQ ID NO: 751892 - DNA, 20 bp, mouse
gggctactagagctcccgga

SEQ ID NO: 751893 - DNA, 20 bp, mouse
ggtgcaggcagcccgccctc

SEQ ID NO: 751894 - DNA, 20 bp, mouse
gactagagctcccggagggc

SEQ ID NO: 751895 - DNA, 20 bp, mouse
gcttcgggtcctcctctcca

SEQ ID NO: 751896 - DNA, 20 bp, mouse
gggcgccagagcagatgatt

SEQ ID NO: 751897 - DNA, 20 bp, mouse
gaggcggggcaacccgggct

SEQ ID NO: 751898 - DNA, 20 bp, mouse
gtgcgcaggggtcagggtga

SEQ ID NO: 751899 - DNA, 20 bp, mouse
ggccagcgggtagatgtgag

SEQ ID NO: 751900 - DNA, 20 bp, mouse
ggcgcccctcgtgccaaacc

SEQ ID NO: 751901 - DNA, 20 bp, mouse
ggcattgtggggcaaagtat

SEQ ID NO: 751902 - DNA, 20 bp, mouse
ggtgtccaggtttggcacga

SEQ ID NO: 751903 - DNA, 20 bp, mouse
ggggagaggcggggcaaccc

SEQ ID NO: 751904 - DNA, 20 bp, mouse
gaggctgtcgtgtccaggtt

SEQ ID NO: 751905 - DNA, 20 bp, mouse
gaaagcatgccggtagttat

SEQ ID NO: 751906 - DNA, 20 bp, mouse
gctgaaaggctgcgcggtgt

SEQ ID NO: 751907 - DNA, 20 bp, mouse
gacccgccagctagtgctaa

SEQ ID NO: 751908 - DNA, 20 bp, mouse
gccgcctcgcttcacgttcc

SEQ ID NO: 751909 - DNA, 20 bp, mouse
gcggggacgcctggaggtcc

SEQ ID NO: 751910 - DNA, 20 bp, mouse
ggttcctgggggccccacgt

SEQ ID NO: 751911 - DNA, 20 bp, mouse
ggacgcacgtgtcccgccgc

SEQ ID NO: 751912 - DNA, 20 bp, mouse
gcctccaggcgtccccgcgc

SEQ ID NO: 751913 - DNA, 20 bp, mouse
ggggtgaattaaccaacgtg

SEQ ID NO: 751914 - DNA, 20 bp, mouse
ggctggcgggtcgcgctccc

SEQ ID NO: 751915 - DNA, 20 bp, mouse
gtaaccaacgtggggccccc

SEQ ID NO: 751916 - DNA, 20 bp, mouse
gcctgggcggggcgccacga

SEQ ID NO: 751917 - DNA, 20 bp, mouse
gtgagcaggcgggtaccata

SEQ ID NO: 751918 - DNA, 20 bp, mouse
gccagcatcccgggccccat

SEQ ID NO: 751919 - DNA, 20 bp, mouse
ggacggggctatcatggcgg

SEQ ID NO: 751920 - DNA, 20 bp, mouse
gcaggagcggaagagcctat

SEQ ID NO: 751921 - DNA, 20 bp, mouse
gggccagctggaggacccta

SEQ ID NO: 751922 - DNA, 20 bp, mouse
gaggggaggtccaaacccta

SEQ ID NO: 751923 - DNA, 20 bp, mouse
gaggaagccactccccctcg

SEQ ID NO: 751924 - DNA, 20 bp, mouse
gactgctggccgggaggtca

SEQ ID NO: 751925 - DNA, 20 bp, mouse
gtccagctggccaatatccg

SEQ ID NO: 751926 - DNA, 20 bp, mouse
gcgagcgcaatggggtgtgg

SEQ ID NO: 751927 - DNA, 20 bp, mouse
gcaatggggtgtggcggaac

SEQ ID NO: 751928 - DNA, 20 bp, mouse
ggtgtggcggaacggggatg

SEQ ID NO: 751929 - DNA, 20 bp, mouse
gagggcgggaggccgagagg

SEQ ID NO: 751930 - DNA, 20 bp, mouse
gtcccccgggcggccccaga

SEQ ID NO: 751931 - DNA, 20 bp, mouse
ggcagccggggctggatacc

SEQ ID NO: 751932 - DNA, 20 bp, mouse
gtggggccgcccgggggacc

SEQ ID NO: 751933 - DNA, 20 bp, mouse
ggcccgagcgcaatggggtg

SEQ ID NO: 751934 - DNA, 20 bp, mouse
ggctccgcctcctgcggcgg

SEQ ID NO: 751935 - DNA, 20 bp, mouse
gcatccgccgccgcaggagg

SEQ ID NO: 751936 - DNA, 20 bp, mouse
gaatacagacctgaggacga

SEQ ID NO: 751937 - DNA, 20 bp, mouse
gcctcacctgcgccacctaa

SEQ ID NO: 751938 - DNA, 20 bp, mouse
gtgggcgcctggactgcctc

SEQ ID NO: 751939 - DNA, 20 bp, mouse
gcccgccgcgtctctctctt

SEQ ID NO: 751940 - DNA, 20 bp, mouse
ggtacagtcaacaggtgcgt

SEQ ID NO: 751941 - DNA, 20 bp, mouse
gaacgcgcccagcaaaccac

SEQ ID NO: 751942 - DNA, 20 bp, mouse
gcatgggggcaaatagccgt

SEQ ID NO: 751943 - DNA, 20 bp, mouse
gatggatgacggacgccctg

SEQ ID NO: 751944 - DNA, 20 bp, mouse
gtgcgccacctaatggatga

SEQ ID NO: 751945 - DNA, 20 bp, mouse
gggcggggccacttccggga

SEQ ID NO: 751946 - DNA, 20 bp, mouse
gtactcggcaaggtggaaac

SEQ ID NO: 751947 - DNA, 20 bp, mouse
gcggcaaggtggaaactgga

SEQ ID NO: 751948 - DNA, 20 bp, mouse
gagggcggggcggaatgatc

SEQ ID NO: 751949 - DNA, 20 bp, mouse
ggggaaaaattcccttttag

SEQ ID NO: 751950 - DNA, 20 bp, mouse
ggaaagaagccagaattact

SEQ ID NO: 751951 - DNA, 20 bp, mouse
gtgtgtgtgtggcctgtact

SEQ ID NO: 751952 - DNA, 20 bp, mouse
gggaacacgttcgcagtggt

SEQ ID NO: 751953 - DNA, 20 bp, mouse
gacgcgctgaggctgtaggc

SEQ ID NO: 751954 - DNA, 20 bp, mouse
ggctgtaggcaggctgtccc

SEQ ID NO: 751955 - DNA, 20 bp, mouse
gactaggaacacgttcgcag

SEQ ID NO: 751956 - DNA, 20 bp, mouse
ggcaggcgttctctacgctg

SEQ ID NO: 751957 - DNA, 20 bp, mouse
gggggagttgccgagaagag

SEQ ID NO: 751958 - DNA, 20 bp, mouse
gcgagcgcgctgaaccgggt

SEQ ID NO: 751959 - DNA, 20 bp, mouse
ggagttgccgagaagagggg

SEQ ID NO: 751960 - DNA, 20 bp, mouse
ggggactgccggcaagagcc

SEQ ID NO: 751961 - DNA, 20 bp, mouse
gcgtagagaacgcctgcctt

SEQ ID NO: 751962 - DNA, 20 bp, mouse
gagccggcgaggagcactaa

SEQ ID NO: 751963 - DNA, 20 bp, mouse
ggccccttagtgctcctcgc

SEQ ID NO: 751964 - DNA, 20 bp, mouse
ggcaggcgagcgcgctgaac

SEQ ID NO: 751965 - DNA, 20 bp, mouse
gttctcggcaactccccgat

SEQ ID NO: 751966 - DNA, 20 bp, mouse
gtcaaggaggcaggggatcc

SEQ ID NO: 751967 - DNA, 20 bp, mouse
ggacaccggggacgtcggag

SEQ ID NO: 751968 - DNA, 20 bp, mouse
gagccccgctcaaggaggca

SEQ ID NO: 751969 - DNA, 20 bp, mouse
gtcccctgcctccttgagcg

SEQ ID NO: 751970 - DNA, 20 bp, mouse
gtccatgacaccggggacgt

SEQ ID NO: 751971 - DNA, 20 bp, mouse
ggggcggtttccatgacacc

SEQ ID NO: 751972 - DNA, 20 bp, mouse
gtccttgagcggggctcgca

SEQ ID NO: 751973 - DNA, 20 bp, mouse
gggccagcgggcgtgcaccg

SEQ ID NO: 751974 - DNA, 20 bp, mouse
gcactcccagaggtcttcgt

SEQ ID NO: 751975 - DNA, 20 bp, mouse
gggggtgggggctaaccggg

SEQ ID NO: 751976 - DNA, 20 bp, mouse
gggtccccaacgccctctgt

SEQ ID NO: 751977 - DNA, 20 bp, mouse
gccaacgccctctgtcggac

SEQ ID NO: 751978 - DNA, 20 bp, mouse
gtacgtgcaaggcggcatga

SEQ ID NO: 751979 - DNA, 20 bp, mouse
gctgagagacttggaagtcg

SEQ ID NO: 751980 - DNA, 20 bp, mouse
gcatctgcttacgtgcaagg

SEQ ID NO: 751981 - DNA, 20 bp, mouse
gagggaaatgtgaagtgtgt

SEQ ID NO: 751982 - DNA, 20 bp, mouse
ggcagtgtcctgtccgacag

SEQ ID NO: 751983 - DNA, 20 bp, mouse
gcttccaagtctctcaggag

SEQ ID NO: 751984 - DNA, 20 bp, mouse
gcacatttcccttcggctgc

SEQ ID NO: 751985 - DNA, 20 bp, mouse
ggcacgtaagcagatgacag

SEQ ID NO: 751986 - DNA, 20 bp, mouse
ggaaggtcgcgccgctgggt

SEQ ID NO: 751987 - DNA, 20 bp, mouse
gggtgtgactactgttgtgg

SEQ ID NO: 751988 - DNA, 20 bp, mouse
ggacctggaacgagttaagg

SEQ ID NO: 751989 - DNA, 20 bp, mouse
gctgggcgtggccacggcgg

SEQ ID NO: 751990 - DNA, 20 bp, mouse
gaccagggagcgaggaaaga

SEQ ID NO: 751991 - DNA, 20 bp, mouse
gcatgggcgtggtcaatcct

SEQ ID NO: 751992 - DNA, 20 bp, mouse
gttcgtgccttacaccacca

SEQ ID NO: 751993 - DNA, 20 bp, mouse
gcaggtctgtagagccaagt

SEQ ID NO: 751994 - DNA, 20 bp, mouse
gctcgctccctggtggtgta

SEQ ID NO: 751995 - DNA, 20 bp, mouse
ggaacgagttaaggtggctg

SEQ ID NO: 751996 - DNA, 20 bp, mouse
gctccgtgggcggaacccaa

SEQ ID NO: 751997 - DNA, 20 bp, mouse
gacggcttcggctccgtggg

SEQ ID NO: 751998 - DNA, 20 bp, mouse
ggacccttgggttccgccca

SEQ ID NO: 751999 - DNA, 20 bp, mouse
ggagcagcgtcaggaccctt

SEQ ID NO: 752000 - DNA, 20 bp, mouse
gctaaaatgcgaaaaggcta

SEQ ID NO: 752001 - DNA, 20 bp, mouse
gtgcgaaaaggctacggctt

SEQ ID NO: 752002 - DNA, 20 bp, mouse
gcggtcggctccaagctggt

SEQ ID NO: 752003 - DNA, 20 bp, mouse
ggggccggtgagaagtctct

SEQ ID NO: 752004 - DNA, 20 bp, mouse
gaccgcgcaggcgcataggg

SEQ ID NO: 752005 - DNA, 20 bp, mouse
ggggctgggtacggcagggg

SEQ ID NO: 752006 - DNA, 20 bp, mouse
gacccaaaccgtctcgtcct

SEQ ID NO: 752007 - DNA, 20 bp, mouse
gagccggtcccaggacgaga

SEQ ID NO: 752008 - DNA, 20 bp, mouse
gaaaggctggtggttcttgt

SEQ ID NO: 752009 - DNA, 20 bp, mouse
gaggagggactgaaagtgcc

SEQ ID NO: 752010 - DNA, 20 bp, mouse
gggcaccgcttcacgaagga

SEQ ID NO: 752011 - DNA, 20 bp, mouse
gcctgggaccggctttcaga

SEQ ID NO: 752012 - DNA, 20 bp, mouse
gaggggcgccagacgcatcc

SEQ ID NO: 752013 - DNA, 20 bp, mouse
gtcccaggacgagacggttt

SEQ ID NO: 752014 - DNA, 20 bp, mouse
gacagccaggaaaacgggag

SEQ ID NO: 752015 - DNA, 20 bp, mouse
gaacaggcaccgcttcacga

SEQ ID NO: 752016 - DNA, 20 bp, mouse
gcatgtgcacgcagaaatca

SEQ ID NO: 752017 - DNA, 20 bp, mouse
gtagataacaacaggcccat

SEQ ID NO: 752018 - DNA, 20 bp, mouse
gtgctcttatctgtgcccag

SEQ ID NO: 752019 - DNA, 20 bp, mouse
gtaaaccctatcaataaatg

SEQ ID NO: 752020 - DNA, 20 bp, mouse
gcaaaggcagtataaaatgg

SEQ ID NO: 752021 - DNA, 20 bp, mouse
gttatctgtgcccaggggtg

SEQ ID NO: 752022 - DNA, 20 bp, mouse
gtcatctattagataacaac

SEQ ID NO: 752023 - DNA, 20 bp, mouse
gaagccacagagaaaataat

SEQ ID NO: 752024 - DNA, 20 bp, mouse
gaattcacgggtttatgttc

SEQ ID NO: 752025 - DNA, 20 bp, mouse
ggacaatagaatctaataac

SEQ ID NO: 752026 - DNA, 20 bp, mouse
gccccgggggatgtgggaag

SEQ ID NO: 752027 - DNA, 20 bp, mouse
gaatggctgcatctcagaag

SEQ ID NO: 752028 - DNA, 20 bp, mouse
gctccccagcagtcgcttaa

SEQ ID NO: 752029 - DNA, 20 bp, mouse
ggggaaggggatcgagttag

SEQ ID NO: 752030 - DNA, 20 bp, mouse
gtcccagccccgggggatgt

SEQ ID NO: 752031 - DNA, 20 bp, mouse
gatcccgtgcgtcccagccc

SEQ ID NO: 752032 - DNA, 20 bp, mouse
gggagcgccccgccccgggt

SEQ ID NO: 752033 - DNA, 20 bp, mouse
gtgctcgggagataactcca

SEQ ID NO: 752034 - DNA, 20 bp, mouse
gccccggggctgggacgcac

SEQ ID NO: 752035 - DNA, 20 bp, mouse
gccatgggacagagcgggtc

SEQ ID NO: 752036 - DNA, 20 bp, mouse
ggcagggcggggaccaacag

SEQ ID NO: 752037 - DNA, 20 bp, mouse
gcaaggctcagggtgtgagt

SEQ ID NO: 752038 - DNA, 20 bp, mouse
gaggaaggccctggaaggag

SEQ ID NO: 752039 - DNA, 20 bp, mouse
ggaccaacagaggggcctag

SEQ ID NO: 752040 - DNA, 20 bp, mouse
gacaggagctgcaactgaga

SEQ ID NO: 752041 - DNA, 20 bp, mouse
gaccactgcctttcgaagtt

SEQ ID NO: 752042 - DNA, 20 bp, mouse
gggaagtcagcagtagagga

SEQ ID NO: 752043 - DNA, 20 bp, mouse
gctggacaagggacactctt

SEQ ID NO: 752044 - DNA, 20 bp, mouse
gcaagtcccccaacttcgaa

SEQ ID NO: 752045 - DNA, 20 bp, mouse
gctgctgacttcctgatcac

SEQ ID NO: 752046 - DNA, 20 bp, mouse
gtcaaccgcacgcgccgaac

SEQ ID NO: 752047 - DNA, 20 bp, mouse
gcaaagagctaggtcggctc

SEQ ID NO: 752048 - DNA, 20 bp, mouse
gggacgaacagagcggaagt

SEQ ID NO: 752049 - DNA, 20 bp, mouse
ggcacgcgccgaacaggaaa

SEQ ID NO: 752050 - DNA, 20 bp, mouse
gggaggaggccgctgcttat

SEQ ID NO: 752051 - DNA, 20 bp, mouse
gcggaactgaacctgagcga

SEQ ID NO: 752052 - DNA, 20 bp, mouse
gatcgcggcggccggtctct

SEQ ID NO: 752053 - DNA, 20 bp, mouse
ggccggtctctcggtaagtc

SEQ ID NO: 752054 - DNA, 20 bp, mouse
gaatgcgaaccaataagcag

SEQ ID NO: 752055 - DNA, 20 bp, mouse
ggcggcttgaggtcagcccg

SEQ ID NO: 752056 - DNA, 20 bp, mouse
gactgcccgggcgtcctgtg

SEQ ID NO: 752057 - DNA, 20 bp, mouse
gccggcgcacgcacggtcac

SEQ ID NO: 752058 - DNA, 20 bp, mouse
gcgtactgtggcgtgattgt

SEQ ID NO: 752059 - DNA, 20 bp, mouse
gcgcacgcacggtcacaggc

SEQ ID NO: 752060 - DNA, 20 bp, mouse
ggattggcccttatgtgcat

SEQ ID NO: 752061 - DNA, 20 bp, mouse
ggtcgggctctgcgtgtgag

SEQ ID NO: 752062 - DNA, 20 bp, mouse
ggaggcagaaggatgtacag

SEQ ID NO: 752063 - DNA, 20 bp, mouse
gacagcacacacacccgcac

SEQ ID NO: 752064 - DNA, 20 bp, mouse
gcagtgggccggcgcacgca

SEQ ID NO: 752065 - DNA, 20 bp, mouse
gacacccgcacaggacgccc

SEQ ID NO: 752066 - DNA, 20 bp, mouse
gtgtcagggaaagaaacgaa

SEQ ID NO: 752067 - DNA, 20 bp, mouse
ggaaaactgcgaagacaatc

SEQ ID NO: 752068 - DNA, 20 bp, mouse
ggggctcacagattcccaaa

SEQ ID NO: 752069 - DNA, 20 bp, mouse
ggtcttcataagtacagttt

SEQ ID NO: 752070 - DNA, 20 bp, mouse
gcaggcagcaaagcaacagt

SEQ ID NO: 752071 - DNA, 20 bp, mouse
ggagagggggatgaaactta

SEQ ID NO: 752072 - DNA, 20 bp, mouse
gaataataactcggggagag

SEQ ID NO: 752073 - DNA, 20 bp, mouse
gcagaaccagccaggaagga

SEQ ID NO: 752074 - DNA, 20 bp, mouse
gtgcagcggaataataactc

SEQ ID NO: 752075 - DNA, 20 bp, mouse
gtaataaatggagaaacctc

SEQ ID NO: 752076 - DNA, 20 bp, mouse
ggggctggggagaaatatat

SEQ ID NO: 752077 - DNA, 20 bp, mouse
ggcaacaccgatgcaaaaag

SEQ ID NO: 752078 - DNA, 20 bp, mouse
gcaacctcgggaggcaacaa

SEQ ID NO: 752079 - DNA, 20 bp, mouse
gtgaccaggttgtattccgt

SEQ ID NO: 752080 - DNA, 20 bp, mouse
gcgcctggaccgccagaaga

SEQ ID NO: 752081 - DNA, 20 bp, mouse
ggctggccggccactggcag

SEQ ID NO: 752082 - DNA, 20 bp, mouse
gccgatgcaaaaaggggctg

SEQ ID NO: 752083 - DNA, 20 bp, mouse
gcctgagcgcatgcaacctc

SEQ ID NO: 752084 - DNA, 20 bp, mouse
gagcggcggcggggcgctta

SEQ ID NO: 752085 - DNA, 20 bp, mouse
gcaggggctgtccctggcga

SEQ ID NO: 752086 - DNA, 20 bp, mouse
ggccgctgggagcaccgcga

SEQ ID NO: 752087 - DNA, 20 bp, mouse
ggggtaggaggccagctccc

SEQ ID NO: 752088 - DNA, 20 bp, mouse
gcccctcgcggtgctcccag

SEQ ID NO: 752089 - DNA, 20 bp, mouse
ggatcccggcgggcccgcct

SEQ ID NO: 752090 - DNA, 20 bp, mouse
gtgctggcggcctcgatctg

SEQ ID NO: 752091 - DNA, 20 bp, mouse
ggcgggcccgccgggatccc

SEQ ID NO: 752092 - DNA, 20 bp, mouse
ggggaccgccgccgagtcga

SEQ ID NO: 752093 - DNA, 20 bp, mouse
gccggggccgagcagggttg

SEQ ID NO: 752094 - DNA, 20 bp, mouse
ggcgcgccccaggaaagtcg

SEQ ID NO: 752095 - DNA, 20 bp, mouse
gggggcggccgggatttaaa

SEQ ID NO: 752096 - DNA, 20 bp, mouse
gtaactcatggcataagggt

SEQ ID NO: 752097 - DNA, 20 bp, mouse
gaactcagttgagatagtag

SEQ ID NO: 752098 - DNA, 20 bp, mouse
gtggcataagggtaggagac

SEQ ID NO: 752099 - DNA, 20 bp, mouse
gaactgagttatgggccatt

SEQ ID NO: 752100 - DNA, 20 bp, mouse
gaaaggcatgatagctgaac

SEQ ID NO: 752101 - DNA, 20 bp, mouse
gataaaaaggaaggtgtctt

SEQ ID NO: 752102 - DNA, 20 bp, mouse
gtgcttcatcatgtcaggaa

SEQ ID NO: 752103 - DNA, 20 bp, mouse
gcatttaactcatggcataa

SEQ ID NO: 752104 - DNA, 20 bp, mouse
gaaggtaacagcaattctga

SEQ ID NO: 752105 - DNA, 20 bp, mouse
gtaacagcaattctgaaggg

SEQ ID NO: 752106 - DNA, 20 bp, mouse
gcaactgggtgtactctcat

SEQ ID NO: 752107 - DNA, 20 bp, mouse
gagtctaaataagttattgg

SEQ ID NO: 752108 - DNA, 20 bp, mouse
gaggtcttagccttcttgga

SEQ ID NO: 752109 - DNA, 20 bp, mouse
gagcagaaataatagcgaga

SEQ ID NO: 752110 - DNA, 20 bp, mouse
gcgaagtctaaataagttat

SEQ ID NO: 752111 - DNA, 20 bp, mouse
gtgtgacatcatcttcgagt

SEQ ID NO: 752112 - DNA, 20 bp, mouse
ggatgtcacaaacatcaact

SEQ ID NO: 752113 - DNA, 20 bp, mouse
gagggttaagatatgattcc

SEQ ID NO: 752114 - DNA, 20 bp, mouse
gctcattggcttctgttacc

SEQ ID NO: 752115 - DNA, 20 bp, mouse
gtttttaaaaagtgcacttg

SEQ ID NO: 752116 - DNA, 20 bp, mouse
gaagccgaggcgttccgaat

SEQ ID NO: 752117 - DNA, 20 bp, mouse
gaggcagagagctagaccga

SEQ ID NO: 752118 - DNA, 20 bp, mouse
gtctctgcctgtttctcctt

SEQ ID NO: 752119 - DNA, 20 bp, mouse
gcggaacgcctcggcttctc

SEQ ID NO: 752120 - DNA, 20 bp, mouse
gcaaactctagaccctgtac

SEQ ID NO: 752121 - DNA, 20 bp, mouse
ggctgcgcacggccccgaca

SEQ ID NO: 752122 - DNA, 20 bp, mouse
gcagccaattcggaacgcct

SEQ ID NO: 752123 - DNA, 20 bp, mouse
gggcccagagaccatcactc

SEQ ID NO: 752124 - DNA, 20 bp, mouse
gtgggtaggtcgatccggga

SEQ ID NO: 752125 - DNA, 20 bp, mouse
gcttgggctgcggaatggag

SEQ ID NO: 752126 - DNA, 20 bp, mouse
ggcatcgcgcaggggagatg

SEQ ID NO: 752127 - DNA, 20 bp, mouse
gtggaccatgcaacttccta

SEQ ID NO: 752128 - DNA, 20 bp, mouse
gaggactcggggagtttctc

SEQ ID NO: 752129 - DNA, 20 bp, mouse
gaagttgcatggtccaggga

SEQ ID NO: 752130 - DNA, 20 bp, mouse
gccagcagaccggagagccg

SEQ ID NO: 752131 - DNA, 20 bp, mouse
gcccgggctgtgcgaggagg

SEQ ID NO: 752132 - DNA, 20 bp, mouse
gcccgggccgcctcctcaga

SEQ ID NO: 752133 - DNA, 20 bp, mouse
ggaaacgcgaggccgctccc

SEQ ID NO: 752134 - DNA, 20 bp, mouse
gccggtaactgcatcgcgca

SEQ ID NO: 752135 - DNA, 20 bp, mouse
gtgctctgcaggagagacaa

SEQ ID NO: 752136 - DNA, 20 bp, mouse
ggtgtggcgctcatcccgga

SEQ ID NO: 752137 - DNA, 20 bp, mouse
gggcgccgtgaacaccgcgg

SEQ ID NO: 752138 - DNA, 20 bp, mouse
gccaccgccgcacacctccg

SEQ ID NO: 752139 - DNA, 20 bp, mouse
gtgaacaccgcggaggtgtg

SEQ ID NO: 752140 - DNA, 20 bp, mouse
ggcggtgggacgtaccattt

SEQ ID NO: 752141 - DNA, 20 bp, mouse
gcgggatgagcgccacactc

SEQ ID NO: 752142 - DNA, 20 bp, mouse
gacaccgcggaggtgtgcgg

SEQ ID NO: 752143 - DNA, 20 bp, mouse
gaagggcgccgtgaacaccg

SEQ ID NO: 752144 - DNA, 20 bp, mouse
gacccggaggaggggaacat

SEQ ID NO: 752145 - DNA, 20 bp, mouse
gaatggtccgacccagagtg

SEQ ID NO: 752146 - DNA, 20 bp, mouse
gggtctagaaagaggaatat

SEQ ID NO: 752147 - DNA, 20 bp, mouse
gtggaccactcaagatgcaa

SEQ ID NO: 752148 - DNA, 20 bp, mouse
ggacgcaaaggacatatatg

SEQ ID NO: 752149 - DNA, 20 bp, mouse
gcgtggaagggtctagaaag

SEQ ID NO: 752150 - DNA, 20 bp, mouse
gccacccagaaggatagaga

SEQ ID NO: 752151 - DNA, 20 bp, mouse
gtcccggagggttggtgtgt

SEQ ID NO: 752152 - DNA, 20 bp, mouse
gaaatgaggaagtcgtggaa

SEQ ID NO: 752153 - DNA, 20 bp, mouse
gtgtcagaagctgagagatt

SEQ ID NO: 752154 - DNA, 20 bp, mouse
ggcaaaggagaacagaccat

SEQ ID NO: 752155 - DNA, 20 bp, mouse
gaatctgatcctctgccagc

SEQ ID NO: 752156 - DNA, 20 bp, mouse
gaaagcgcgaggcaggtcgg

SEQ ID NO: 752157 - DNA, 20 bp, mouse
ggccgcgtgggggaccttca

SEQ ID NO: 752158 - DNA, 20 bp, mouse
gctggaagggccccataatt

SEQ ID NO: 752159 - DNA, 20 bp, mouse
gactgtgcgcatgggctgga

SEQ ID NO: 752160 - DNA, 20 bp, mouse
gagaccctcacactggtccc

SEQ ID NO: 752161 - DNA, 20 bp, mouse
gccggccgcgcgcagtagtc

SEQ ID NO: 752162 - DNA, 20 bp, mouse
gggcactgaaccgaattatg

SEQ ID NO: 752163 - DNA, 20 bp, mouse
gtgctcggggaacgtgacag

SEQ ID NO: 752164 - DNA, 20 bp, mouse
ggtgtgcccggcccccgggg

SEQ ID NO: 752165 - DNA, 20 bp, mouse
gcccacgtgtgcccggcccc

SEQ ID NO: 752166 - DNA, 20 bp, mouse
gggcgcccgcgcttctgctt

SEQ ID NO: 752167 - DNA, 20 bp, mouse
ggcccccgaagcagaagcgc

SEQ ID NO: 752168 - DNA, 20 bp, mouse
gagggccgcgacgggaacgc

SEQ ID NO: 752169 - DNA, 20 bp, mouse
ggcccgcgcttctgcttcgg

SEQ ID NO: 752170 - DNA, 20 bp, mouse
gtcgtgagcgcgacaacgcg

SEQ ID NO: 752171 - DNA, 20 bp, mouse
ggccacgcggacaccagcac

SEQ ID NO: 752172 - DNA, 20 bp, mouse
gccgcggcccgggcaattta

SEQ ID NO: 752173 - DNA, 20 bp, mouse
gtccgcgtggcgcggagcga

SEQ ID NO: 752174 - DNA, 20 bp, mouse
gtccccgcggccgtccatct

SEQ ID NO: 752175 - DNA, 20 bp, mouse
ggcgacgcgggcctcgagca

SEQ ID NO: 752176 - DNA, 20 bp, mouse
gcacccttgcgtcacacact

SEQ ID NO: 752177 - DNA, 20 bp, mouse
gtagtccgagggtgtaaagc

SEQ ID NO: 752178 - DNA, 20 bp, mouse
gggagctgccggaaaagggg

SEQ ID NO: 752179 - DNA, 20 bp, mouse
gctgggagctgccggaaaag

SEQ ID NO: 752180 - DNA, 20 bp, mouse
ggtaaagcgggcctggtacg

SEQ ID NO: 752181 - DNA, 20 bp, mouse
gggtacgcggggcgtggctc

SEQ ID NO: 752182 - DNA, 20 bp, mouse
gcggggcctagcacggggca

SEQ ID NO: 752183 - DNA, 20 bp, mouse
gctgtgggcttgtagtccga

SEQ ID NO: 752184 - DNA, 20 bp, mouse
gcgcccagtgtgtgacgcaa

SEQ ID NO: 752185 - DNA, 20 bp, mouse
ggtgggcgggggcggagtca

SEQ ID NO: 752186 - DNA, 20 bp, mouse
gtggacttgtgcccggggtc

SEQ ID NO: 752187 - DNA, 20 bp, mouse
gggtctggctcacaaacata

SEQ ID NO: 752188 - DNA, 20 bp, mouse
gggggaggaaccggcgggag

SEQ ID NO: 752189 - DNA, 20 bp, mouse
gagccaggcctggaagtgga

SEQ ID NO: 752190 - DNA, 20 bp, mouse
gtgtgtagatactatctgga

SEQ ID NO: 752191 - DNA, 20 bp, mouse
gacgctgtgtagatactatc

SEQ ID NO: 752192 - DNA, 20 bp, mouse
gttgtccaagggttcagtgg

SEQ ID NO: 752193 - DNA, 20 bp, mouse
gctggctcacaaacataggg

SEQ ID NO: 752194 - DNA, 20 bp, mouse
gggcctggctgtgctatagt

SEQ ID NO: 752195 - DNA, 20 bp, mouse
ggggcagttaccacaaacac

SEQ ID NO: 752196 - DNA, 20 bp, mouse
gtggctactcacgtgagagg

SEQ ID NO: 752197 - DNA, 20 bp, mouse
ggggtcgaaccaagaggctc

SEQ ID NO: 752198 - DNA, 20 bp, mouse
gcccccgccccgcagttcca

SEQ ID NO: 752199 - DNA, 20 bp, mouse
gctcacgtgagaggtggtgg

SEQ ID NO: 752200 - DNA, 20 bp, mouse
gtcccctggaactgcggggc

SEQ ID NO: 752201 - DNA, 20 bp, mouse
gcccgcagttccaggggaaa

SEQ ID NO: 752202 - DNA, 20 bp, mouse
gggagacgctcgaaattctg

SEQ ID NO: 752203 - DNA, 20 bp, mouse
gctaacctcggctgcccagc

SEQ ID NO: 752204 - DNA, 20 bp, mouse
gcaagaggctccggctaagg

SEQ ID NO: 752205 - DNA, 20 bp, mouse
gcttgggaagcgtagtacgc

SEQ ID NO: 752206 - DNA, 20 bp, mouse
gaatcgccccgaaactgctg

SEQ ID NO: 752207 - DNA, 20 bp, mouse
ggatcttggcagttctgttc

SEQ ID NO: 752208 - DNA, 20 bp, mouse
ggtggggcacaggtgtaaac

SEQ ID NO: 752209 - DNA, 20 bp, mouse
ggccccgaaactgctgtggc

SEQ ID NO: 752210 - DNA, 20 bp, mouse
gcagtttcggggcgattcag

SEQ ID NO: 752211 - DNA, 20 bp, mouse
ggcttggcacggtcaggagg

SEQ ID NO: 752212 - DNA, 20 bp, mouse
gggagcttggccattactgt

SEQ ID NO: 752213 - DNA, 20 bp, mouse
gggcagttctgttccggctc

SEQ ID NO: 752214 - DNA, 20 bp, mouse
gcaagggggcagggtcgtta

SEQ ID NO: 752215 - DNA, 20 bp, mouse
gcaccagccacagcagtttc

SEQ ID NO: 752216 - DNA, 20 bp, mouse
gaggctggaaggctcaccgc

SEQ ID NO: 752217 - DNA, 20 bp, mouse
gcacagaagcaggcaaggct

SEQ ID NO: 752218 - DNA, 20 bp, mouse
gaaaaaaaaagcaggattca

SEQ ID NO: 752219 - DNA, 20 bp, mouse
gggtgctttaggaccctgag

SEQ ID NO: 752220 - DNA, 20 bp, mouse
ggcaacagagttgagtcaac

SEQ ID NO: 752221 - DNA, 20 bp, mouse
gtgagtaacaacctttgcac

SEQ ID NO: 752222 - DNA, 20 bp, mouse
ggagttgagtcaacaggatt

SEQ ID NO: 752223 - DNA, 20 bp, mouse
ggttcagaaagaaacagata

SEQ ID NO: 752224 - DNA, 20 bp, mouse
gaggttttgggcagagtgaa

SEQ ID NO: 752225 - DNA, 20 bp, mouse
gaggagaagaccagcccctc

SEQ ID NO: 752226 - DNA, 20 bp, mouse
gagccggaaaagtagatatg

SEQ ID NO: 752227 - DNA, 20 bp, mouse
gaagtcagaggcggtctcgg

SEQ ID NO: 752228 - DNA, 20 bp, mouse
gctagaaccgccaaagtcag

SEQ ID NO: 752229 - DNA, 20 bp, mouse
gtcagaggcggtctcggggg

SEQ ID NO: 752230 - DNA, 20 bp, mouse
gccccacaggcgggctccta

SEQ ID NO: 752231 - DNA, 20 bp, mouse
ggtctcgggggcggtcccga

SEQ ID NO: 752232 - DNA, 20 bp, mouse
gtatgcgggctacccgacac

SEQ ID NO: 752233 - DNA, 20 bp, mouse
gaatatatacactggggagc

SEQ ID NO: 752234 - DNA, 20 bp, mouse
ggtagtcacgaaaagatact

SEQ ID NO: 752235 - DNA, 20 bp, mouse
ggtagagcaaatatatacac

SEQ ID NO: 752236 - DNA, 20 bp, mouse
gccaagtagcgatcaccccc

SEQ ID NO: 752237 - DNA, 20 bp, mouse
gtgcgtctctagttatccag

SEQ ID NO: 752238 - DNA, 20 bp, mouse
ggataactagagacgcagat

SEQ ID NO: 752239 - DNA, 20 bp, mouse
gggagaacaaccttggggag

SEQ ID NO: 752240 - DNA, 20 bp, mouse
gtacctgggaaccctggctg

SEQ ID NO: 752241 - DNA, 20 bp, mouse
ggctcctctagcttggtctc

SEQ ID NO: 752242 - DNA, 20 bp, mouse
gctcgagtaggcattttctt

SEQ ID NO: 752243 - DNA, 20 bp, mouse
gactagagacgcagataggc

SEQ ID NO: 752244 - DNA, 20 bp, mouse
gccagggtggttttctatac

SEQ ID NO: 752245 - DNA, 20 bp, mouse
gtctctaaaatggtactggc

SEQ ID NO: 752246 - DNA, 20 bp, mouse
gaagactgtggcagagattg

SEQ ID NO: 752247 - DNA, 20 bp, mouse
ggtgaaactgactcacttaa

SEQ ID NO: 752248 - DNA, 20 bp, mouse
gaagtgagtcagtttcacat

SEQ ID NO: 752249 - DNA, 20 bp, mouse
ggtagccggatgataccgaa

SEQ ID NO: 752250 - DNA, 20 bp, mouse
gtaagcccttcggtatcatc

SEQ ID NO: 752251 - DNA, 20 bp, mouse
gattgaggtaccttctttgg

SEQ ID NO: 752252 - DNA, 20 bp, mouse
ggagattgaggtaccttctt

SEQ ID NO: 752253 - DNA, 20 bp, mouse
ggtctgcagagtcaggtagc

SEQ ID NO: 752254 - DNA, 20 bp, mouse
gcctgcatgtagtaaatatt

SEQ ID NO: 752255 - DNA, 20 bp, mouse
gtcacaccgactgacagaaa

SEQ ID NO: 752256 - DNA, 20 bp, mouse
gcacccaggaagccagcgag

SEQ ID NO: 752257 - DNA, 20 bp, mouse
ggggaaggaccggctccggg

SEQ ID NO: 752258 - DNA, 20 bp, mouse
gtgaaacacgtcatcagaca

SEQ ID NO: 752259 - DNA, 20 bp, mouse
gcagcgagcggggagtgcgg

SEQ ID NO: 752260 - DNA, 20 bp, mouse
gccccgctcgctggcttcct

SEQ ID NO: 752261 - DNA, 20 bp, mouse
gcctaaccccactccgtggt

SEQ ID NO: 752262 - DNA, 20 bp, mouse
ggcggggggcgggactagtg

SEQ ID NO: 752263 - DNA, 20 bp, mouse
gagcaagccaaccacggagt

SEQ ID NO: 752264 - DNA, 20 bp, mouse
ggtgcgctgacgtcgttcct

SEQ ID NO: 752265 - DNA, 20 bp, mouse
gaccggaggcctagtgcgga

SEQ ID NO: 752266 - DNA, 20 bp, mouse
gtaccatccgagtcactcca

SEQ ID NO: 752267 - DNA, 20 bp, mouse
gcagggactcctccagacgg

SEQ ID NO: 752268 - DNA, 20 bp, mouse
gtgaaagctcctcctccgtc

SEQ ID NO: 752269 - DNA, 20 bp, mouse
ggaggattgcacactctttt

SEQ ID NO: 752270 - DNA, 20 bp, mouse
ggtccctggagtgactcgga

SEQ ID NO: 752271 - DNA, 20 bp, mouse
gtggtacggtgcttccccat

SEQ ID NO: 752272 - DNA, 20 bp, mouse
ggccctattcccgctctcgt

SEQ ID NO: 752273 - DNA, 20 bp, mouse
gcgcactccctcggcgtccc

SEQ ID NO: 752274 - DNA, 20 bp, mouse
gagtgcgcatgcgcacggtc

SEQ ID NO: 752275 - DNA, 20 bp, mouse
gctccagggactcctccaga

SEQ ID NO: 752276 - DNA, 20 bp, mouse
ggggacagacgactcccagg

SEQ ID NO: 752277 - DNA, 20 bp, mouse
gctggtagcaaagggaccga

SEQ ID NO: 752278 - DNA, 20 bp, mouse
gcgagcatgacgtacacgtc

SEQ ID NO: 752279 - DNA, 20 bp, mouse
gtagtcggggagccgtggtg

SEQ ID NO: 752280 - DNA, 20 bp, mouse
gacgcgttatgcatggtcag

SEQ ID NO: 752281 - DNA, 20 bp, mouse
ggcgccccgcgactgtagtc

SEQ ID NO: 752282 - DNA, 20 bp, mouse
gggcgggacagacgactccc

SEQ ID NO: 752283 - DNA, 20 bp, mouse
gacgcactatgcttagggtc

SEQ ID NO: 752284 - DNA, 20 bp, mouse
ggctccccgactacagtcgc

SEQ ID NO: 752285 - DNA, 20 bp, mouse
ggcggggcttatagctacca

SEQ ID NO: 752286 - DNA, 20 bp, mouse
gcctgccgggtggtgctgta

SEQ ID NO: 752287 - DNA, 20 bp, mouse
gtacagcgtgggtaccaccg

SEQ ID NO: 752288 - DNA, 20 bp, mouse
gagcgtgggtaccaccgggg

SEQ ID NO: 752289 - DNA, 20 bp, mouse
ggctgctgggggcctccaaa

SEQ ID NO: 752290 - DNA, 20 bp, mouse
gtggaagtggcctacagcgt

SEQ ID NO: 752291 - DNA, 20 bp, mouse
gcggggagttccaaagagtt

SEQ ID NO: 752292 - DNA, 20 bp, mouse
gtctcctgggacaggtcggc

SEQ ID NO: 752293 - DNA, 20 bp, mouse
gcctgcctggccagaccgtt

SEQ ID NO: 752294 - DNA, 20 bp, mouse
gaccgtgcctgagtccgccc

SEQ ID NO: 752295 - DNA, 20 bp, mouse
gcagaggaaggggtggcgca

SEQ ID NO: 752296 - DNA, 20 bp, mouse
gcgccctcccagttagtacc

SEQ ID NO: 752297 - DNA, 20 bp, mouse
gagcctggtactaactggga

SEQ ID NO: 752298 - DNA, 20 bp, mouse
gactaactgggagggcgctg

SEQ ID NO: 752299 - DNA, 20 bp, mouse
gactgggagggcgctggggt

SEQ ID NO: 752300 - DNA, 20 bp, mouse
ggaccaatggtcatgcagcg

SEQ ID NO: 752301 - DNA, 20 bp, mouse
ggtgacagcaacccccagcc

SEQ ID NO: 752302 - DNA, 20 bp, mouse
gggtgggagcggctagggca

SEQ ID NO: 752303 - DNA, 20 bp, mouse
ggccagggtgggagcggcta

SEQ ID NO: 752304 - DNA, 20 bp, mouse
gtggtcgcgcgtctcaagca

SEQ ID NO: 752305 - DNA, 20 bp, mouse
ggtcccaatcggatcctccg

SEQ ID NO: 752306 - DNA, 20 bp, mouse
gggcccggttgtcacctcca

SEQ ID NO: 752307 - DNA, 20 bp, mouse
gacttcttcaggaccgaccc

SEQ ID NO: 752308 - DNA, 20 bp, mouse
ggcggggccagcacatggga

SEQ ID NO: 752309 - DNA, 20 bp, mouse
gcctgaaagcccaacggagt

SEQ ID NO: 752310 - DNA, 20 bp, mouse
gcgaccctggaggtgacaac

SEQ ID NO: 752311 - DNA, 20 bp, mouse
gccagcacatgggagggcgg

SEQ ID NO: 752312 - DNA, 20 bp, mouse
gcggtcctgaagaagtctca

SEQ ID NO: 752313 - DNA, 20 bp, mouse
gaggagaggaacgaggtgat

SEQ ID NO: 752314 - DNA, 20 bp, mouse
gtggaccaccgaccccaacg

SEQ ID NO: 752315 - DNA, 20 bp, mouse
gagcacccgcacccccgttg

SEQ ID NO: 752316 - DNA, 20 bp, mouse
gtgaatgcttgggcactgag

SEQ ID NO: 752317 - DNA, 20 bp, mouse
ggtcagaggcccggctccat

SEQ ID NO: 752318 - DNA, 20 bp, mouse
gcatgggttctgtgaagctt

SEQ ID NO: 752319 - DNA, 20 bp, mouse
gggtcgagacatgtcccagg

SEQ ID NO: 752320 - DNA, 20 bp, mouse
gcagaaagtgaacgggaaga

SEQ ID NO: 752321 - DNA, 20 bp, mouse
gaggcggcaagcagcggtgg

SEQ ID NO: 752322 - DNA, 20 bp, mouse
gagagtccagcatggcacgg

SEQ ID NO: 752323 - DNA, 20 bp, mouse
gttgggtcgagacatgtccc

SEQ ID NO: 752324 - DNA, 20 bp, mouse
gtggtggtaataggccacgt

SEQ ID NO: 752325 - DNA, 20 bp, mouse
ggacagcaggcggcaagcag

SEQ ID NO: 752326 - DNA, 20 bp, mouse
gtggaggagaggggctatgt

SEQ ID NO: 752327 - DNA, 20 bp, mouse
gtccaggaggggctccccaa

SEQ ID NO: 752328 - DNA, 20 bp, mouse
gtggggcgtccgcccttccg

SEQ ID NO: 752329 - DNA, 20 bp, mouse
gcggggaaggggctcgacgg

SEQ ID NO: 752330 - DNA, 20 bp, mouse
ggggaagggttgactcgatc

SEQ ID NO: 752331 - DNA, 20 bp, mouse
gcgtccgcccttccggggaa

SEQ ID NO: 752332 - DNA, 20 bp, mouse
gggaaggggctcgacggcgg

SEQ ID NO: 752333 - DNA, 20 bp, mouse
gccagagtgtcccacctctt

SEQ ID NO: 752334 - DNA, 20 bp, mouse
gagactgcggggtggcgttg

SEQ ID NO: 752335 - DNA, 20 bp, mouse
gtcgagccccttccccggaa

SEQ ID NO: 752336 - DNA, 20 bp, mouse
gtggcctgaccaaactgggg

SEQ ID NO: 752337 - DNA, 20 bp, mouse
ggcaccgccccagtttggtc

SEQ ID NO: 752338 - DNA, 20 bp, mouse
gcacacccacgccccacaaa

SEQ ID NO: 752339 - DNA, 20 bp, mouse
ggggtgtggcctgaccaaac

SEQ ID NO: 752340 - DNA, 20 bp, mouse
ggggcggtgcggccggaaca

SEQ ID NO: 752341 - DNA, 20 bp, mouse
gagccaacgcccagagtacc

SEQ ID NO: 752342 - DNA, 20 bp, mouse
gaagaggcggggcctctagg

SEQ ID NO: 752343 - DNA, 20 bp, mouse
gcggccgcaccgccccagtt

SEQ ID NO: 752344 - DNA, 20 bp, mouse
gccagctccaagctccacac

SEQ ID NO: 752345 - DNA, 20 bp, mouse
gaccacgccccctctttcct

SEQ ID NO: 752346 - DNA, 20 bp, mouse
gagggcgggcccccaggcga

SEQ ID NO: 752347 - DNA, 20 bp, mouse
gagggcggagtcttgactcg

SEQ ID NO: 752348 - DNA, 20 bp, mouse
ggtgggcgggccccagagaa

SEQ ID NO: 752349 - DNA, 20 bp, mouse
gtggcaccgacgtgtgggcg

SEQ ID NO: 752350 - DNA, 20 bp, mouse
gccggcaggcccagcggcta

SEQ ID NO: 752351 - DNA, 20 bp, mouse
gagggcgtggcaccgacgtg

SEQ ID NO: 752352 - DNA, 20 bp, mouse
gcggagtcttgactcggggc

SEQ ID NO: 752353 - DNA, 20 bp, mouse
gcggggcgggatccgaagtg

SEQ ID NO: 752354 - DNA, 20 bp, mouse
gtagcagggaggaaccgagt

SEQ ID NO: 752355 - DNA, 20 bp, mouse
ggcgggatccgaagtgtggg

SEQ ID NO: 752356 - DNA, 20 bp, mouse
gcaccactgtgggccaagaa

SEQ ID NO: 752357 - DNA, 20 bp, mouse
gcacgcgcagagcacggtgg

SEQ ID NO: 752358 - DNA, 20 bp, mouse
ggcaaaggacatgagttagc

SEQ ID NO: 752359 - DNA, 20 bp, mouse
gaaactgtcaccggagccga

SEQ ID NO: 752360 - DNA, 20 bp, mouse
gagagcccaactctgttctc

SEQ ID NO: 752361 - DNA, 20 bp, mouse
gctcgggcaacagacggtga

SEQ ID NO: 752362 - DNA, 20 bp, mouse
gcaggtcaggtcaccactgt

SEQ ID NO: 752363 - DNA, 20 bp, mouse
gacgttcaagcgtggttttg

SEQ ID NO: 752364 - DNA, 20 bp, mouse
ggctctgcgcgtgtgttgct

SEQ ID NO: 752365 - DNA, 20 bp, mouse
gcttcctcgacgttcaagcg

SEQ ID NO: 752366 - DNA, 20 bp, mouse
gaggctggcttctggacttt

SEQ ID NO: 752367 - DNA, 20 bp, mouse
gatgactcaattgtgtgtgt

SEQ ID NO: 752368 - DNA, 20 bp, mouse
ggtataacgtgcataaaaga

SEQ ID NO: 752369 - DNA, 20 bp, mouse
gcagtcagtaaagctgatgc

SEQ ID NO: 752370 - DNA, 20 bp, mouse
gtacttgaagataaggggtg

SEQ ID NO: 752371 - DNA, 20 bp, mouse
ggtcaaatatgtgaaacaac

SEQ ID NO: 752372 - DNA, 20 bp, mouse
gggcttctggactttgggca

SEQ ID NO: 752373 - DNA, 20 bp, mouse
ggcctgcattgctctttgtg

SEQ ID NO: 752374 - DNA, 20 bp, mouse
ggaaacttttcaggggttcc

SEQ ID NO: 752375 - DNA, 20 bp, mouse
gaaaaccaagcaattaaact

SEQ ID NO: 752376 - DNA, 20 bp, mouse
gaggagcagtgggtggacct

SEQ ID NO: 752377 - DNA, 20 bp, mouse
ggtggacctgggtgcaggag

SEQ ID NO: 752378 - DNA, 20 bp, mouse
ggctgcctttaccaggatta

SEQ ID NO: 752379 - DNA, 20 bp, mouse
ggaactcatcctttactttg

SEQ ID NO: 752380 - DNA, 20 bp, mouse
gctcgccaatcaggagcagt

SEQ ID NO: 752381 - DNA, 20 bp, mouse
gttcacagggacgtcgtagg

SEQ ID NO: 752382 - DNA, 20 bp, mouse
gtcagagctccccaaagtaa

SEQ ID NO: 752383 - DNA, 20 bp, mouse
gtccacccactgctcctgat

SEQ ID NO: 752384 - DNA, 20 bp, mouse
gagtgggtggacctgggtgc

SEQ ID NO: 752385 - DNA, 20 bp, mouse
gaggcggcgggctccggtcg

SEQ ID NO: 752386 - DNA, 20 bp, mouse
gtcaactgactgagcacttc

SEQ ID NO: 752387 - DNA, 20 bp, mouse
gaaactcaggtcagcctaac

SEQ ID NO: 752388 - DNA, 20 bp, mouse
gtgactgagcacttctggca

SEQ ID NO: 752389 - DNA, 20 bp, mouse
gggcatggatagagttaact

SEQ ID NO: 752390 - DNA, 20 bp, mouse
gctaacaggtttccttatat

SEQ ID NO: 752391 - DNA, 20 bp, mouse
gatagagttaactaggttaa

SEQ ID NO: 752392 - DNA, 20 bp, mouse
gggtttggttgcagtacaaa

SEQ ID NO: 752393 - DNA, 20 bp, mouse
ggaatcgctccccctctcca

SEQ ID NO: 752394 - DNA, 20 bp, mouse
gcagtcagttgacctgcaga

SEQ ID NO: 752395 - DNA, 20 bp, mouse
gagggggagcgattcccagc

SEQ ID NO: 752396 - DNA, 20 bp, mouse
gccccgcggtagaaagggtt

SEQ ID NO: 752397 - DNA, 20 bp, mouse
gagcccgggtatcaggcgag

SEQ ID NO: 752398 - DNA, 20 bp, mouse
gcccgcccccgcggtagaaa

SEQ ID NO: 752399 - DNA, 20 bp, mouse
gagccgccgtccaaaccaga

SEQ ID NO: 752400 - DNA, 20 bp, mouse
gcgcctctcgcctgataccc

SEQ ID NO: 752401 - DNA, 20 bp, mouse
gcgcgcgccagtccgccctc

SEQ ID NO: 752402 - DNA, 20 bp, mouse
gcgccctctggtttggacgg

SEQ ID NO: 752403 - DNA, 20 bp, mouse
gagtccgggaaaggtgtccc

SEQ ID NO: 752404 - DNA, 20 bp, mouse
gtggcgcgcactctccgggt

SEQ ID NO: 752405 - DNA, 20 bp, mouse
gctgccttagcccgggtatc

SEQ ID NO: 752406 - DNA, 20 bp, mouse
gtaagcgcgcctccagagga

SEQ ID NO: 752407 - DNA, 20 bp, mouse
gaggaggggcacggggagtt

SEQ ID NO: 752408 - DNA, 20 bp, mouse
ggcaagcaaaggcagtgggt

SEQ ID NO: 752409 - DNA, 20 bp, mouse
ggaaggtgagcctaggaagg

SEQ ID NO: 752410 - DNA, 20 bp, mouse
gaccctacgggagcacgggg

SEQ ID NO: 752411 - DNA, 20 bp, mouse
ggaagccaggagcctcccat

SEQ ID NO: 752412 - DNA, 20 bp, mouse
gttcaccagtaggacctgtg

SEQ ID NO: 752413 - DNA, 20 bp, mouse
gggtgtgtgtgaagcgcaga

SEQ ID NO: 752414 - DNA, 20 bp, mouse
ggtgggggcaagcagagccg

SEQ ID NO: 752415 - DNA, 20 bp, mouse
gccctccccgtgctcccgta

SEQ ID NO: 752416 - DNA, 20 bp, mouse
gggacgcagaagggacgggg

SEQ ID NO: 752417 - DNA, 20 bp, mouse
ggccgcggggctaccccacg

SEQ ID NO: 752418 - DNA, 20 bp, mouse
ggccccgcggcgattctcat

SEQ ID NO: 752419 - DNA, 20 bp, mouse
ggggccaatgagaatcgccg

SEQ ID NO: 752420 - DNA, 20 bp, mouse
gagggtctcgctgccacgtg

SEQ ID NO: 752421 - DNA, 20 bp, mouse
ggccacgtggggtagccccg

SEQ ID NO: 752422 - DNA, 20 bp, mouse
gggcctcagcccaaccctct

SEQ ID NO: 752423 - DNA, 20 bp, mouse
gcggcggagtaagtagtgaa

SEQ ID NO: 752424 - DNA, 20 bp, mouse
gccattggacgcagaaggga

SEQ ID NO: 752425 - DNA, 20 bp, mouse
gggagcgggtggggggtcgc

SEQ ID NO: 752426 - DNA, 20 bp, mouse
gtccaggccagcaggcggtg

SEQ ID NO: 752427 - DNA, 20 bp, mouse
gtgggtgctgcgaagcccta

SEQ ID NO: 752428 - DNA, 20 bp, mouse
ggacagggacaccggcccta

SEQ ID NO: 752429 - DNA, 20 bp, mouse
gccacagagcagtgcctcag

SEQ ID NO: 752430 - DNA, 20 bp, mouse
gtgaggtgaaccccagtaca

SEQ ID NO: 752431 - DNA, 20 bp, mouse
gggggcgcccgcgtgtggaa

SEQ ID NO: 752432 - DNA, 20 bp, mouse
gcttccctggggtggagttt

SEQ ID NO: 752433 - DNA, 20 bp, mouse
gtcaggggtgtcaccgacct

SEQ ID NO: 752434 - DNA, 20 bp, mouse
gaggccagcaggcggtgggg

SEQ ID NO: 752435 - DNA, 20 bp, mouse
gtgaaccccagtacatgggg

SEQ ID NO: 752436 - DNA, 20 bp, mouse
ggaggcggggctgcgtctgt

SEQ ID NO: 752437 - DNA, 20 bp, mouse
ggtccagcgctgcccgtcgt

SEQ ID NO: 752438 - DNA, 20 bp, mouse
gtccggagggaggctacgga

SEQ ID NO: 752439 - DNA, 20 bp, mouse
gcccctccgtagcctccctc

SEQ ID NO: 752440 - DNA, 20 bp, mouse
gtgtgggcggggccccacga

SEQ ID NO: 752441 - DNA, 20 bp, mouse
gcggggctgcgtctgtgggc

SEQ ID NO: 752442 - DNA, 20 bp, mouse
ggtcgtgccccggaagtaga

SEQ ID NO: 752443 - DNA, 20 bp, mouse
gctccctgtcgcgtctccgt

SEQ ID NO: 752444 - DNA, 20 bp, mouse
ggagctaggtaacgtcacct

SEQ ID NO: 752445 - DNA, 20 bp, mouse
gcgtagcctccctccggagg

SEQ ID NO: 752446 - DNA, 20 bp, mouse
gcacgccccgggaccgtctg

SEQ ID NO: 752447 - DNA, 20 bp, mouse
gaggcggcaagtgacccgaa

SEQ ID NO: 752448 - DNA, 20 bp, mouse
ggccccgggaccgtctgggg

SEQ ID NO: 752449 - DNA, 20 bp, mouse
gtaacaggggcgaacttgag

SEQ ID NO: 752450 - DNA, 20 bp, mouse
ggagtgtgacaatcattcag

SEQ ID NO: 752451 - DNA, 20 bp, mouse
gcgaacgccgaggcccgagg

SEQ ID NO: 752452 - DNA, 20 bp, mouse
gtccgccccagacggtcccg

SEQ ID NO: 752453 - DNA, 20 bp, mouse
gtgtctgcctggcccaccaa

SEQ ID NO: 752454 - DNA, 20 bp, mouse
gggaaaccacaagcatactc

SEQ ID NO: 752455 - DNA, 20 bp, mouse
gtaaatccggagtatgcttg

SEQ ID NO: 752456 - DNA, 20 bp, mouse
gctggaccagcactgatcct

SEQ ID NO: 752457 - DNA, 20 bp, mouse
gcacgccaaagtcacgtggg

SEQ ID NO: 752458 - DNA, 20 bp, mouse
ggtagctgatggtctgtgat

SEQ ID NO: 752459 - DNA, 20 bp, mouse
gggcgccctctgccgtcagc

SEQ ID NO: 752460 - DNA, 20 bp, mouse
gggcgccccgacgcaaagcg

SEQ ID NO: 752461 - DNA, 20 bp, mouse
gaggcggccgaggtagctga

SEQ ID NO: 752462 - DNA, 20 bp, mouse
gcacagaccatcagctacct

SEQ ID NO: 752463 - DNA, 20 bp, mouse
gagtacctgctgacggcaga

SEQ ID NO: 752464 - DNA, 20 bp, mouse
ggacccacatgataagatgg

SEQ ID NO: 752465 - DNA, 20 bp, mouse
gcacgccccccacgtgactt

SEQ ID NO: 752466 - DNA, 20 bp, mouse
gcccccttccccagcaggtt

SEQ ID NO: 752467 - DNA, 20 bp, mouse
gtggccgctcgaggtggagg

SEQ ID NO: 752468 - DNA, 20 bp, mouse
gcctgcttgcgggtgctcgt

SEQ ID NO: 752469 - DNA, 20 bp, mouse
ggggccacacggatctagtg

SEQ ID NO: 752470 - DNA, 20 bp, mouse
gggctggccgctcgaggtgg

SEQ ID NO: 752471 - DNA, 20 bp, mouse
gcgccgaacctgctggggaa

SEQ ID NO: 752472 - DNA, 20 bp, mouse
gccgcggtcgccatggcgcc

SEQ ID NO: 752473 - DNA, 20 bp, mouse
gccaggctccgcggtcgcca

SEQ ID NO: 752474 - DNA, 20 bp, mouse
gagcgggcagttgggagtcc

SEQ ID NO: 752475 - DNA, 20 bp, mouse
gaacccctttccaaaccgaa

SEQ ID NO: 752476 - DNA, 20 bp, mouse
gtaccctgaggggacctctc

SEQ ID NO: 752477 - DNA, 20 bp, mouse
ggtcccgggggagcgcgcga

SEQ ID NO: 752478 - DNA, 20 bp, mouse
gctcgcgcgcggactgcccc

SEQ ID NO: 752479 - DNA, 20 bp, mouse
gccgctcggcgggacgggag

SEQ ID NO: 752480 - DNA, 20 bp, mouse
ggtccggagaggtcccctca

SEQ ID NO: 752481 - DNA, 20 bp, mouse
ggcgccccgctcggcgggac

SEQ ID NO: 752482 - DNA, 20 bp, mouse
ggcgcgctcccccgggacgg

SEQ ID NO: 752483 - DNA, 20 bp, mouse
ggcccctcgcgcgctccccc

SEQ ID NO: 752484 - DNA, 20 bp, mouse
gtgcaaagtgagtaccctga

SEQ ID NO: 752485 - DNA, 20 bp, mouse
gagcgggcgcgcgcggagca

SEQ ID NO: 752486 - DNA, 20 bp, mouse
gcacacaggaatcagctgat

SEQ ID NO: 752487 - DNA, 20 bp, mouse
ggccgcaggaggcgcgtagt

SEQ ID NO: 752488 - DNA, 20 bp, mouse
gcatggcggaggtgagtgag

SEQ ID NO: 752489 - DNA, 20 bp, mouse
gccgcccggtaatagtgggg

SEQ ID NO: 752490 - DNA, 20 bp, mouse
ggctccgcccggtaatagtg

SEQ ID NO: 752491 - DNA, 20 bp, mouse
gtcgacccagggcagtgtgt

SEQ ID NO: 752492 - DNA, 20 bp, mouse
gacaggtgagggatggtcta

SEQ ID NO: 752493 - DNA, 20 bp, mouse
gaggcgcgtagtaggtgtgc

SEQ ID NO: 752494 - DNA, 20 bp, mouse
ggccggaccaggtcgaccca

SEQ ID NO: 752495 - DNA, 20 bp, mouse
ggggacaatctagcagtgag

SEQ ID NO: 752496 - DNA, 20 bp, mouse
gcgggcgcgtgcaggagcgg

SEQ ID NO: 752497 - DNA, 20 bp, mouse
gcgggagcgccggacggcgt

SEQ ID NO: 752498 - DNA, 20 bp, mouse
gcgcccacggcgctctgccc

SEQ ID NO: 752499 - DNA, 20 bp, mouse
gggccggcctgccctataag

SEQ ID NO: 752500 - DNA, 20 bp, mouse
gagcgggccgggggcgtcgc

SEQ ID NO: 752501 - DNA, 20 bp, mouse
gacggcgtgggtgtgcgagc

SEQ ID NO: 752502 - DNA, 20 bp, mouse
gagggtggcgggagactcgg

SEQ ID NO: 752503 - DNA, 20 bp, mouse
gcggccgcgggagcgccgga

SEQ ID NO: 752504 - DNA, 20 bp, mouse
gccgccaggcacccgcccgg

SEQ ID NO: 752505 - DNA, 20 bp, mouse
gaggcggctcggccccttat

SEQ ID NO: 752506 - DNA, 20 bp, mouse
ggggccaggcaggggatcga

SEQ ID NO: 752507 - DNA, 20 bp, mouse
ggctgtaggaagtattacat

SEQ ID NO: 752508 - DNA, 20 bp, mouse
gggacgtagtctgacgtcag

SEQ ID NO: 752509 - DNA, 20 bp, mouse
gcggaggatgctagatagtg

SEQ ID NO: 752510 - DNA, 20 bp, mouse
gagactacgtcccaaagggg

SEQ ID NO: 752511 - DNA, 20 bp, mouse
ggcagaagcagcgcgctgaa

SEQ ID NO: 752512 - DNA, 20 bp, mouse
gcccactagcatgagaaata

SEQ ID NO: 752513 - DNA, 20 bp, mouse
gagcggcagccggcttgggg

SEQ ID NO: 752514 - DNA, 20 bp, mouse
gtttcctaagatggaaacgg

SEQ ID NO: 752515 - DNA, 20 bp, mouse
gagaaataaggccaacctac

SEQ ID NO: 752516 - DNA, 20 bp, mouse
gtccccctaggaaagaccca

SEQ ID NO: 752517 - DNA, 20 bp, mouse
gggaggggcgtagtcttctg

SEQ ID NO: 752518 - DNA, 20 bp, mouse
gcggttaaagcggagtgcaa

SEQ ID NO: 752519 - DNA, 20 bp, mouse
gaacctggaagattcagggt

SEQ ID NO: 752520 - DNA, 20 bp, mouse
gaagcggagtgcaagggctg

SEQ ID NO: 752521 - DNA, 20 bp, mouse
gcgtgggaggagcttcggga

SEQ ID NO: 752522 - DNA, 20 bp, mouse
ggacccagggccctttatct

SEQ ID NO: 752523 - DNA, 20 bp, mouse
gttaaagcagctgagagctt

SEQ ID NO: 752524 - DNA, 20 bp, mouse
gaaggcgtggcctattcggg

SEQ ID NO: 752525 - DNA, 20 bp, mouse
gggccctgggtctttcctag

SEQ ID NO: 752526 - DNA, 20 bp, mouse
gcctccgccgctgtcctgct

SEQ ID NO: 752527 - DNA, 20 bp, mouse
gaatccgcctccagcagggg

SEQ ID NO: 752528 - DNA, 20 bp, mouse
gaattggccgagcaggacag

SEQ ID NO: 752529 - DNA, 20 bp, mouse
gcggcagtttcaatatggaa

SEQ ID NO: 752530 - DNA, 20 bp, mouse
ggcgtcctggcactgtcaat

SEQ ID NO: 752531 - DNA, 20 bp, mouse
gtaatggcagtggataggtg

SEQ ID NO: 752532 - DNA, 20 bp, mouse
gccccagagtgcttttgcca

SEQ ID NO: 752533 - DNA, 20 bp, mouse
gtcggccaattgacagtgcc

SEQ ID NO: 752534 - DNA, 20 bp, mouse
gatggaaaggaggggctaat

SEQ ID NO: 752535 - DNA, 20 bp, mouse
ggtgaaaaggtcaaagttgc

SEQ ID NO: 752536 - DNA, 20 bp, mouse
ggggaggagcatttgaatca

SEQ ID NO: 752537 - DNA, 20 bp, mouse
gggagcaggtaataaaaccc

SEQ ID NO: 752538 - DNA, 20 bp, mouse
gaagctggaatcttgatgtg

SEQ ID NO: 752539 - DNA, 20 bp, mouse
gctgggagtgagtaaagctg

SEQ ID NO: 752540 - DNA, 20 bp, mouse
gcatgcacagatacctgagt

SEQ ID NO: 752541 - DNA, 20 bp, mouse
ggcagtagggatagctgtaa

SEQ ID NO: 752542 - DNA, 20 bp, mouse
gtgcatgctcacacaggact

SEQ ID NO: 752543 - DNA, 20 bp, mouse
ggtggtaagtttagttccca

SEQ ID NO: 752544 - DNA, 20 bp, mouse
gcaggcaggtatctcaaccg

SEQ ID NO: 752545 - DNA, 20 bp, mouse
gcttaagaccaggctgggca

SEQ ID NO: 752546 - DNA, 20 bp, mouse
gacagctgaagggatgttga

SEQ ID NO: 752547 - DNA, 20 bp, mouse
gctgttggtgtaagagatat

SEQ ID NO: 752548 - DNA, 20 bp, mouse
gtgatgggtggagctctgaa

SEQ ID NO: 752549 - DNA, 20 bp, mouse
ggactggtgaacacagctga

SEQ ID NO: 752550 - DNA, 20 bp, mouse
gttctcgtcacttagctgat

SEQ ID NO: 752551 - DNA, 20 bp, mouse
gatgttgaaggatgtccgaa

SEQ ID NO: 752552 - DNA, 20 bp, mouse
gctacaaggtatggaccctt

SEQ ID NO: 752553 - DNA, 20 bp, mouse
gtcgtcacttagctgatggg

SEQ ID NO: 752554 - DNA, 20 bp, mouse
gaaaagtagtttgaacagac

SEQ ID NO: 752555 - DNA, 20 bp, mouse
gaatatcaggaggaatctgt

SEQ ID NO: 752556 - DNA, 20 bp, mouse
gcagcagctctaagtgagat

SEQ ID NO: 752557 - DNA, 20 bp, mouse
gcctatgggccggagtgaaa

SEQ ID NO: 752558 - DNA, 20 bp, mouse
gagtgagataggagaccttg

SEQ ID NO: 752559 - DNA, 20 bp, mouse
gagctgttccagtaatatga

SEQ ID NO: 752560 - DNA, 20 bp, mouse
gcactcaccagccccgataa

SEQ ID NO: 752561 - DNA, 20 bp, mouse
gctcacttagagctgctgct

SEQ ID NO: 752562 - DNA, 20 bp, mouse
gagttaaaccaacgagtcat

SEQ ID NO: 752563 - DNA, 20 bp, mouse
gctctgtgctctggagagta

SEQ ID NO: 752564 - DNA, 20 bp, mouse
gaacaggacctatgactcgt

SEQ ID NO: 752565 - DNA, 20 bp, mouse
gtcctctcatttcctgtgtg

SEQ ID NO: 752566 - DNA, 20 bp, mouse
ggggcggagccagaagtccg

SEQ ID NO: 752567 - DNA, 20 bp, mouse
gaaggcctgtagctgtaggc

SEQ ID NO: 752568 - DNA, 20 bp, mouse
gcggccccgccccggacttc

SEQ ID NO: 752569 - DNA, 20 bp, mouse
gtgcgcgcgcagacggggag

SEQ ID NO: 752570 - DNA, 20 bp, mouse
gcccacgcgctgcaccggca

SEQ ID NO: 752571 - DNA, 20 bp, mouse
gggagcagggatgtggtccg

SEQ ID NO: 752572 - DNA, 20 bp, mouse
gctctggcctatgaacctaa

SEQ ID NO: 752573 - DNA, 20 bp, mouse
gcgaccccgcccacgagacg

SEQ ID NO: 752574 - DNA, 20 bp, mouse
gtggtgagccgggtggctga

SEQ ID NO: 752575 - DNA, 20 bp, mouse
gccgcaagttgacccagcta

SEQ ID NO: 752576 - DNA, 20 bp, mouse
gacccagtctcgctagagcc

SEQ ID NO: 752577 - DNA, 20 bp, mouse
gcgcctgcaacccgagtcgc

SEQ ID NO: 752578 - DNA, 20 bp, mouse
gaacgaaggaactagaggag

SEQ ID NO: 752579 - DNA, 20 bp, mouse
gcagctgggcacacgaaaga

SEQ ID NO: 752580 - DNA, 20 bp, mouse
gccgggcgccccctcctgcg

SEQ ID NO: 752581 - DNA, 20 bp, mouse
gaaggagcgcgaccacccgc

SEQ ID NO: 752582 - DNA, 20 bp, mouse
gcgcccctcgagtcccccga

SEQ ID NO: 752583 - DNA, 20 bp, mouse
gtgccccgaaggccggggag

SEQ ID NO: 752584 - DNA, 20 bp, mouse
ggtcgcgctccttccactcc

SEQ ID NO: 752585 - DNA, 20 bp, mouse
gcgcctgtcagccgctgggt

SEQ ID NO: 752586 - DNA, 20 bp, mouse
gccggcgcgccaaatatcgc

SEQ ID NO: 752587 - DNA, 20 bp, mouse
ggggttcagtaggtataaaa

SEQ ID NO: 752588 - DNA, 20 bp, mouse
gaccctgaccttggagatag

SEQ ID NO: 752589 - DNA, 20 bp, mouse
ggctcggtcgtcaaggtgac

SEQ ID NO: 752590 - DNA, 20 bp, mouse
gggatcacatacgtcgtccc

SEQ ID NO: 752591 - DNA, 20 bp, mouse
gagggtcacctccggctccc

SEQ ID NO: 752592 - DNA, 20 bp, mouse
gtgaccttggagatagcgga

SEQ ID NO: 752593 - DNA, 20 bp, mouse
gagggcaacagtagaacggg

SEQ ID NO: 752594 - DNA, 20 bp, mouse
gcgaccgagcgaagaaaagc

SEQ ID NO: 752595 - DNA, 20 bp, mouse
gcaacagtagaacgggagga

SEQ ID NO: 752596 - DNA, 20 bp, mouse
gagaaggcaagcgtggtctc

SEQ ID NO: 752597 - DNA, 20 bp, mouse
gactcgctcggtgacagcac

SEQ ID NO: 752598 - DNA, 20 bp, mouse
gccggcccgggaacctcaga

SEQ ID NO: 752599 - DNA, 20 bp, mouse
gacgatcggccacactcgct

SEQ ID NO: 752600 - DNA, 20 bp, mouse
gcgggagcagagcgcacttc

SEQ ID NO: 752601 - DNA, 20 bp, mouse
gcgagtgtggccgatcgtct

SEQ ID NO: 752602 - DNA, 20 bp, mouse
gcccggtgtcacacgctcgt

SEQ ID NO: 752603 - DNA, 20 bp, mouse
ggccgatcgtctcggagctt

SEQ ID NO: 752604 - DNA, 20 bp, mouse
gtcgtctcggagcttcggtg

SEQ ID NO: 752605 - DNA, 20 bp, mouse
ggagcttcggtgtggacaag

SEQ ID NO: 752606 - DNA, 20 bp, mouse
ggggcagggcccacactggg

SEQ ID NO: 752607 - DNA, 20 bp, mouse
gagagggaggcggggactct

SEQ ID NO: 752608 - DNA, 20 bp, mouse
gcacaagagggcgacggaag

SEQ ID NO: 752609 - DNA, 20 bp, mouse
gggcggagcgctcgagaggg

SEQ ID NO: 752610 - DNA, 20 bp, mouse
gttgctggagaggggtcccg

SEQ ID NO: 752611 - DNA, 20 bp, mouse
gactgggcggagcgctcgag

SEQ ID NO: 752612 - DNA, 20 bp, mouse
gggagcgctcgagagggagg

SEQ ID NO: 752613 - DNA, 20 bp, mouse
gaggcggggactctaggttg

SEQ ID NO: 752614 - DNA, 20 bp, mouse
gtgtggccctgcccacaaga

SEQ ID NO: 752615 - DNA, 20 bp, mouse
gccgtcgccctcttgtgggc

SEQ ID NO: 752616 - DNA, 20 bp, mouse
gacagaggaggcagctatta

SEQ ID NO: 752617 - DNA, 20 bp, mouse
ggaggcagctattaaggcaa

SEQ ID NO: 752618 - DNA, 20 bp, mouse
gtgagggagcagtcacccga

SEQ ID NO: 752619 - DNA, 20 bp, mouse
ggactgctccctcaggatga

SEQ ID NO: 752620 - DNA, 20 bp, mouse
ggccatgggctcaacagaag

SEQ ID NO: 752621 - DNA, 20 bp, mouse
ggcagggctagcaggtgaaa

SEQ ID NO: 752622 - DNA, 20 bp, mouse
gtgcaggaaagcgaaatcgt

SEQ ID NO: 752623 - DNA, 20 bp, mouse
gtctgttgagcccatggcaa

SEQ ID NO: 752624 - DNA, 20 bp, mouse
gttgtggtccagtccccgta

SEQ ID NO: 752625 - DNA, 20 bp, mouse
gcgaccttcgacatgcgcaa

SEQ ID NO: 752626 - DNA, 20 bp, mouse
gaaccccttcacagctgtgg

SEQ ID NO: 752627 - DNA, 20 bp, mouse
ggggatgagcgcagaagcca

SEQ ID NO: 752628 - DNA, 20 bp, mouse
ggccaaggagccagaagtat

SEQ ID NO: 752629 - DNA, 20 bp, mouse
gaggggcaggttgaggtaat

SEQ ID NO: 752630 - DNA, 20 bp, mouse
gtctgtgtgtgtcaaagctg

SEQ ID NO: 752631 - DNA, 20 bp, mouse
gtccatggaccccatacttc

SEQ ID NO: 752632 - DNA, 20 bp, mouse
ggaggtctgaatcgaacttc

SEQ ID NO: 752633 - DNA, 20 bp, mouse
gcgagcccaccctatcttag

SEQ ID NO: 752634 - DNA, 20 bp, mouse
gatagggtgggctcgctcat

SEQ ID NO: 752635 - DNA, 20 bp, mouse
gctctcctcagcagggggag

SEQ ID NO: 752636 - DNA, 20 bp, mouse
gtctgcatgcccaccagcta

SEQ ID NO: 752637 - DNA, 20 bp, mouse
ggggagaaggaagtcgggtc

SEQ ID NO: 752638 - DNA, 20 bp, mouse
gtcttcctccagacacacga

SEQ ID NO: 752639 - DNA, 20 bp, mouse
gcacgagggcgctacgaaac

SEQ ID NO: 752640 - DNA, 20 bp, mouse
gaggaagtcgggtcaggcat

SEQ ID NO: 752641 - DNA, 20 bp, mouse
gccacgccgcggaactcgca

SEQ ID NO: 752642 - DNA, 20 bp, mouse
gtggagctgctcagaaggcg

SEQ ID NO: 752643 - DNA, 20 bp, mouse
gacagtggtactagggcaca

SEQ ID NO: 752644 - DNA, 20 bp, mouse
ggagcacgctaacaatcgtt

SEQ ID NO: 752645 - DNA, 20 bp, mouse
ggagtttgacagtggtacta

SEQ ID NO: 752646 - DNA, 20 bp, mouse
gggaaaggaaggcgacctcg

SEQ ID NO: 752647 - DNA, 20 bp, mouse
gggggaaatgtgtggttctc

SEQ ID NO: 752648 - DNA, 20 bp, mouse
ggagggctcaaggatggttc

SEQ ID NO: 752649 - DNA, 20 bp, mouse
gcgctaactggggaaatgtg

SEQ ID NO: 752650 - DNA, 20 bp, mouse
gacctcgaggtcgcgttctg

SEQ ID NO: 752651 - DNA, 20 bp, mouse
gcgaggtcgcgttctgtggg

SEQ ID NO: 752652 - DNA, 20 bp, mouse
gtccgggctgctggaaagga

SEQ ID NO: 752653 - DNA, 20 bp, mouse
ggggcttccggcgagctgga

SEQ ID NO: 752654 - DNA, 20 bp, mouse
gaaccagtgcgcgctaactg

SEQ ID NO: 752655 - DNA, 20 bp, mouse
gtcccatggagtatcttcac

SEQ ID NO: 752656 - DNA, 20 bp, mouse
gccgccgcctggcatactgg

SEQ ID NO: 752657 - DNA, 20 bp, mouse
gaggcgcaactcttgattgg

SEQ ID NO: 752658 - DNA, 20 bp, mouse
gaagagttgcgcctctgcgt

SEQ ID NO: 752659 - DNA, 20 bp, mouse
gaaggagggaaagctagctg

SEQ ID NO: 752660 - DNA, 20 bp, mouse
ggcgggaagccggtgtgggg

SEQ ID NO: 752661 - DNA, 20 bp, mouse
gaaaaggaaggcgacaagga

SEQ ID NO: 752662 - DNA, 20 bp, mouse
gtggaagaaggcggtaacac

SEQ ID NO: 752663 - DNA, 20 bp, mouse
gcagaggcgcaactcttgat

SEQ ID NO: 752664 - DNA, 20 bp, mouse
gagggattggcggacggaac

SEQ ID NO: 752665 - DNA, 20 bp, mouse
ggccccaaggcgccagcgat

SEQ ID NO: 752666 - DNA, 20 bp, mouse
ggacgcaagcgcagtgagcg

SEQ ID NO: 752667 - DNA, 20 bp, mouse
gaggcggggcaccgcccgaa

SEQ ID NO: 752668 - DNA, 20 bp, mouse
ggggcaccgcccgaaggggt

SEQ ID NO: 752669 - DNA, 20 bp, mouse
gtgagcgaaagctggtgaac

SEQ ID NO: 752670 - DNA, 20 bp, mouse
gggctcgcgcgccggtcaga

SEQ ID NO: 752671 - DNA, 20 bp, mouse
gctggtgaactggggtgctg

SEQ ID NO: 752672 - DNA, 20 bp, mouse
gccgctgctgagaaagttga

SEQ ID NO: 752673 - DNA, 20 bp, mouse
gctgctggagaagcgtctgt

SEQ ID NO: 752674 - DNA, 20 bp, mouse
ggtaagcagacccatcttca

SEQ ID NO: 752675 - DNA, 20 bp, mouse
gtacctgcggctgcagaagt

SEQ ID NO: 752676 - DNA, 20 bp, mouse
gtctccccgcggagcatcac

SEQ ID NO: 752677 - DNA, 20 bp, mouse
ggcaaccgaggggcttcggt

SEQ ID NO: 752678 - DNA, 20 bp, mouse
gcggggagaaaaccccacga

SEQ ID NO: 752679 - DNA, 20 bp, mouse
ggctgggcgtcaaccgtcgt

SEQ ID NO: 752680 - DNA, 20 bp, mouse
gctcccgggggcccgccttg

SEQ ID NO: 752681 - DNA, 20 bp, mouse
gaactccacgagcaaccgag

SEQ ID NO: 752682 - DNA, 20 bp, mouse
gtcacagcctcgggccgctc

SEQ ID NO: 752683 - DNA, 20 bp, mouse
gccccgcggagcatcacggg

SEQ ID NO: 752684 - DNA, 20 bp, mouse
ggcgtccgaccgaagcccct

SEQ ID NO: 752685 - DNA, 20 bp, mouse
gcggagcatcacgggaggag

SEQ ID NO: 752686 - DNA, 20 bp, mouse
gaaggggtgcggcctcctag

SEQ ID NO: 752687 - DNA, 20 bp, mouse
gcaaaggaggaggaagacgg

SEQ ID NO: 752688 - DNA, 20 bp, mouse
gttcctcaagccctgagcct

SEQ ID NO: 752689 - DNA, 20 bp, mouse
gtctcctccaggccacggga

SEQ ID NO: 752690 - DNA, 20 bp, mouse
gtagtggtggagccataaaa

SEQ ID NO: 752691 - DNA, 20 bp, mouse
gcacacgtcaaaagcagaag

SEQ ID NO: 752692 - DNA, 20 bp, mouse
gtgggaaagtcaagaacatg

SEQ ID NO: 752693 - DNA, 20 bp, mouse
gagcaagggcacttcagccg

SEQ ID NO: 752694 - DNA, 20 bp, mouse
ggagaggcgcactttcctga

SEQ ID NO: 752695 - DNA, 20 bp, mouse
gaacatgggggtgaagggcg

SEQ ID NO: 752696 - DNA, 20 bp, mouse
gatactcaggctgacgaggg

SEQ ID NO: 752697 - DNA, 20 bp, mouse
gagacagaaaaacgatactc

SEQ ID NO: 752698 - DNA, 20 bp, mouse
ggggtcccacaagctagccc

SEQ ID NO: 752699 - DNA, 20 bp, mouse
gacgatactcaggctgacga

SEQ ID NO: 752700 - DNA, 20 bp, mouse
gtcagtccccacccggacct

SEQ ID NO: 752701 - DNA, 20 bp, mouse
gcccggccacatgttgctaa

SEQ ID NO: 752702 - DNA, 20 bp, mouse
gggccttggccctacaaagc

SEQ ID NO: 752703 - DNA, 20 bp, mouse
gttccggctttgtagggcca

SEQ ID NO: 752704 - DNA, 20 bp, mouse
ggctcagttccggctttgta

SEQ ID NO: 752705 - DNA, 20 bp, mouse
gcagtcagcaggacttggga

SEQ ID NO: 752706 - DNA, 20 bp, mouse
ggtacggtctgtgacggcaa

SEQ ID NO: 752707 - DNA, 20 bp, mouse
ggcgcctgcgctgtcttcta

SEQ ID NO: 752708 - DNA, 20 bp, mouse
gagaaccgtacggtctgtga

SEQ ID NO: 752709 - DNA, 20 bp, mouse
gtcgccggtgagtgcggtcg

SEQ ID NO: 752710 - DNA, 20 bp, mouse
gccggaaccaaagaaccgta

SEQ ID NO: 752711 - DNA, 20 bp, mouse
gtctatggcgcgttgtgaat

SEQ ID NO: 752712 - DNA, 20 bp, mouse
ggtctgtgacggcaacggcg

SEQ ID NO: 752713 - DNA, 20 bp, mouse
gctcccacgaccgcactcac

SEQ ID NO: 752714 - DNA, 20 bp, mouse
ggttcctctccttccggctg

SEQ ID NO: 752715 - DNA, 20 bp, mouse
gagatcaagaaataggtctg

SEQ ID NO: 752716 - DNA, 20 bp, mouse
ggctcctctccgtgtctctc

SEQ ID NO: 752717 - DNA, 20 bp, mouse
gaaaccggggagagacaacg

SEQ ID NO: 752718 - DNA, 20 bp, mouse
gactcccagaaggtcaaacc

SEQ ID NO: 752719 - DNA, 20 bp, mouse
gagagacaacgtggtgtaca

SEQ ID NO: 752720 - DNA, 20 bp, mouse
gaaaccggagagacacggag

SEQ ID NO: 752721 - DNA, 20 bp, mouse
gggagctgctgacattgaca

SEQ ID NO: 752722 - DNA, 20 bp, mouse
gaataagaacaactcagcct

SEQ ID NO: 752723 - DNA, 20 bp, mouse
gacaccacgttgtctctccc

SEQ ID NO: 752724 - DNA, 20 bp, mouse
ggcagtccagaagagctcgg

SEQ ID NO: 752725 - DNA, 20 bp, mouse
gctccccggtttgaccttct

SEQ ID NO: 752726 - DNA, 20 bp, mouse
gtggacagaaccccctcttc

SEQ ID NO: 752727 - DNA, 20 bp, mouse
gagattcaggcgctcttgag

SEQ ID NO: 752728 - DNA, 20 bp, mouse
ggcgctcttgagaggtcttc

SEQ ID NO: 752729 - DNA, 20 bp, mouse
gcaaagcggttcgaggtatg

SEQ ID NO: 752730 - DNA, 20 bp, mouse
gcgggccaggcacagcgcgg

SEQ ID NO: 752731 - DNA, 20 bp, mouse
gagggggttctgtccaagtc

SEQ ID NO: 752732 - DNA, 20 bp, mouse
gtcttgggggcttggttcgt

SEQ ID NO: 752733 - DNA, 20 bp, mouse
gcgaccccaccggggcaaag

SEQ ID NO: 752734 - DNA, 20 bp, mouse
ggtaaggtctagcacatagc

SEQ ID NO: 752735 - DNA, 20 bp, mouse
ggtccgcctgtcaccatcaa

SEQ ID NO: 752736 - DNA, 20 bp, mouse
gggcgagggcgacagaggat

SEQ ID NO: 752737 - DNA, 20 bp, mouse
gagccagagaccaatggcga

SEQ ID NO: 752738 - DNA, 20 bp, mouse
gcgccctcgccattggtctc

SEQ ID NO: 752739 - DNA, 20 bp, mouse
ggaagtccagaggtggggcc

SEQ ID NO: 752740 - DNA, 20 bp, mouse
gccaatggcgagggcgacag

SEQ ID NO: 752741 - DNA, 20 bp, mouse
ggattggggaagtccagagg

SEQ ID NO: 752742 - DNA, 20 bp, mouse
gtgggaggggccaggccggt

SEQ ID NO: 752743 - DNA, 20 bp, mouse
gccttggcgcggaaccgcct

SEQ ID NO: 752744 - DNA, 20 bp, mouse
gtggagaagcggaacccgag

SEQ ID NO: 752745 - DNA, 20 bp, mouse
gtccggaaggcgggcagggt

SEQ ID NO: 752746 - DNA, 20 bp, mouse
ggtagcaaaagagcaggccc

SEQ ID NO: 752747 - DNA, 20 bp, mouse
gaaggaaacgtcacttccga

SEQ ID NO: 752748 - DNA, 20 bp, mouse
gtcggaagcggaagtagagg

SEQ ID NO: 752749 - DNA, 20 bp, mouse
ggtctcggaagcggaagtag

SEQ ID NO: 752750 - DNA, 20 bp, mouse
ggcctcaattctagacaccg

SEQ ID NO: 752751 - DNA, 20 bp, mouse
ggactggggaggttggccac

SEQ ID NO: 752752 - DNA, 20 bp, mouse
gaatcggattaaggctccgt

SEQ ID NO: 752753 - DNA, 20 bp, mouse
ggggacgttggaaaacatgc

SEQ ID NO: 752754 - DNA, 20 bp, mouse
gcatgaacaggcaacgggca

SEQ ID NO: 752755 - DNA, 20 bp, mouse
gttccttcgcgtctcggaag

SEQ ID NO: 752756 - DNA, 20 bp, mouse
gagggcgtcctgagagaggt

SEQ ID NO: 752757 - DNA, 20 bp, mouse
gccgtcaccggaaatcttac

SEQ ID NO: 752758 - DNA, 20 bp, mouse
gttcccccgcccctcttccg

SEQ ID NO: 752759 - DNA, 20 bp, mouse
gaacagaggaaacgccacct

SEQ ID NO: 752760 - DNA, 20 bp, mouse
gaaaccccggaagaggggcg

SEQ ID NO: 752761 - DNA, 20 bp, mouse
gggaaagctgcggccgtcac

SEQ ID NO: 752762 - DNA, 20 bp, mouse
gcgccctaagctgtagaaac

SEQ ID NO: 752763 - DNA, 20 bp, mouse
gcgtctgcccgtaagatttc

SEQ ID NO: 752764 - DNA, 20 bp, mouse
ggggcaaggcgccttgtgat

SEQ ID NO: 752765 - DNA, 20 bp, mouse
gaggaaacgccacctaggac

SEQ ID NO: 752766 - DNA, 20 bp, mouse
gtctactagaaggaactctg

SEQ ID NO: 752767 - DNA, 20 bp, mouse
ggatgcgtgtctgatctccg

SEQ ID NO: 752768 - DNA, 20 bp, mouse
gtctggggctaacgcagttt

SEQ ID NO: 752769 - DNA, 20 bp, mouse
gtccccccatgagcagtgag

SEQ ID NO: 752770 - DNA, 20 bp, mouse
gagagcccctcactgctcat

SEQ ID NO: 752771 - DNA, 20 bp, mouse
gaggggctctttaggatgac

SEQ ID NO: 752772 - DNA, 20 bp, mouse
ggcttccctctcttaaaaat

SEQ ID NO: 752773 - DNA, 20 bp, mouse
gattcggcgtaactttgctg

SEQ ID NO: 752774 - DNA, 20 bp, mouse
gggaaaggccgagggttatc

SEQ ID NO: 752775 - DNA, 20 bp, mouse
gtattcaaaactctactaga

SEQ ID NO: 752776 - DNA, 20 bp, mouse
ggcgagggcggatgccgggt

SEQ ID NO: 752777 - DNA, 20 bp, mouse
gcggatgccgggtgggagaa

SEQ ID NO: 752778 - DNA, 20 bp, mouse
ggcgccgagccgactcccgg

SEQ ID NO: 752779 - DNA, 20 bp, mouse
gcaggggcgagggcggatgc

SEQ ID NO: 752780 - DNA, 20 bp, mouse
ggggaggagggtaagcacgg

SEQ ID NO: 752781 - DNA, 20 bp, mouse
gctctcacctggctgccccg

SEQ ID NO: 752782 - DNA, 20 bp, mouse
ggggcagccaggtgagagcg

SEQ ID NO: 752783 - DNA, 20 bp, mouse
ggtagcgccgagccgactcc

SEQ ID NO: 752784 - DNA, 20 bp, mouse
gcagccaggtgagagcgcgg

SEQ ID NO: 752785 - DNA, 20 bp, mouse
gggtgtaaacctccgggagt

SEQ ID NO: 752786 - DNA, 20 bp, mouse
gaacttcatgagtaatgcat

SEQ ID NO: 752787 - DNA, 20 bp, mouse
gcccacagaggaacgtggga

SEQ ID NO: 752788 - DNA, 20 bp, mouse
gggctggaatggcaaaggga

SEQ ID NO: 752789 - DNA, 20 bp, mouse
gggctcccacagaggaacgt

SEQ ID NO: 752790 - DNA, 20 bp, mouse
gtcagtgctcgtcagatgat

SEQ ID NO: 752791 - DNA, 20 bp, mouse
gctctctgtaagcaaagccc

SEQ ID NO: 752792 - DNA, 20 bp, mouse
ggattgaagcagccagcgcg

SEQ ID NO: 752793 - DNA, 20 bp, mouse
gagaaacctttgctgataac

SEQ ID NO: 752794 - DNA, 20 bp, mouse
gtaacaggaagatgaacggc

SEQ ID NO: 752795 - DNA, 20 bp, mouse
ggatagccctatgtagcaag

SEQ ID NO: 752796 - DNA, 20 bp, mouse
gaaggaaagcctccctggga

SEQ ID NO: 752797 - DNA, 20 bp, mouse
gagctaggaaaggacagcgt

SEQ ID NO: 752798 - DNA, 20 bp, mouse
gcaggaaaggaaagcctccc

SEQ ID NO: 752799 - DNA, 20 bp, mouse
gccgggaacccgaccgcgca

SEQ ID NO: 752800 - DNA, 20 bp, mouse
gacggggcctgctcttaaag

SEQ ID NO: 752801 - DNA, 20 bp, mouse
gctagctgaccctcccaggg

SEQ ID NO: 752802 - DNA, 20 bp, mouse
gtgcttggaggccgcttcct

SEQ ID NO: 752803 - DNA, 20 bp, mouse
ggggaaaattcgatgagctt

SEQ ID NO: 752804 - DNA, 20 bp, mouse
gagtgccggccctgcgcggt

SEQ ID NO: 752805 - DNA, 20 bp, mouse
gacgtctcctagaataggaa

SEQ ID NO: 752806 - DNA, 20 bp, mouse
gggagggcccgagcagaagg

SEQ ID NO: 752807 - DNA, 20 bp, mouse
gagcagaaggaggcgtgagg

SEQ ID NO: 752808 - DNA, 20 bp, mouse
gagtcacgcctgcgccccga

SEQ ID NO: 752809 - DNA, 20 bp, mouse
gtcgccacgtgtggccctcg

SEQ ID NO: 752810 - DNA, 20 bp, mouse
gcaaggccagttcactgcgc

SEQ ID NO: 752811 - DNA, 20 bp, mouse
gccacgcctgcgcagtgaac

SEQ ID NO: 752812 - DNA, 20 bp, mouse
gcaagtctggagtatacaaa

SEQ ID NO: 752813 - DNA, 20 bp, mouse
gagaaggaggcgtgaggggg

SEQ ID NO: 752814 - DNA, 20 bp, mouse
gccacacgtggcgagaagca

SEQ ID NO: 752815 - DNA, 20 bp, mouse
ggcgccccgagggccacacg

SEQ ID NO: 752816 - DNA, 20 bp, mouse
gccggcgcggccacctttat

SEQ ID NO: 752817 - DNA, 20 bp, mouse
gcgccggggaatgcagaata

SEQ ID NO: 752818 - DNA, 20 bp, mouse
ggagcttccaggagcgtcga

SEQ ID NO: 752819 - DNA, 20 bp, mouse
gcggcagcggcccagtggag

SEQ ID NO: 752820 - DNA, 20 bp, mouse
ggggagattccgagggaagt

SEQ ID NO: 752821 - DNA, 20 bp, mouse
gcgcgctcccgtttaagggg

SEQ ID NO: 752822 - DNA, 20 bp, mouse
gccagtggaggggtccgtgg

SEQ ID NO: 752823 - DNA, 20 bp, mouse
ggctgcgcgctcccgtttaa

SEQ ID NO: 752824 - DNA, 20 bp, mouse
gcggctcctctcggcggcag

SEQ ID NO: 752825 - DNA, 20 bp, mouse
gcaggcgcaggcgactccgg

SEQ ID NO: 752826 - DNA, 20 bp, mouse
gtacgtgcgccaccagccat

SEQ ID NO: 752827 - DNA, 20 bp, mouse
gttagccaggtgtgctagga

SEQ ID NO: 752828 - DNA, 20 bp, mouse
gagaaggagaagacagcgaa

SEQ ID NO: 752829 - DNA, 20 bp, mouse
gtggtggcgcacgtacaagg

SEQ ID NO: 752830 - DNA, 20 bp, mouse
gggctggtggcgcacgtaca

SEQ ID NO: 752831 - DNA, 20 bp, mouse
gaaacagatcccaacacaat

SEQ ID NO: 752832 - DNA, 20 bp, mouse
gaatcagcgtcgccggagga

SEQ ID NO: 752833 - DNA, 20 bp, mouse
gcggcgacgctgattggtga

SEQ ID NO: 752834 - DNA, 20 bp, mouse
gggactggcgcagagctctc

SEQ ID NO: 752835 - DNA, 20 bp, mouse
gggtcctttgatggctagga

SEQ ID NO: 752836 - DNA, 20 bp, mouse
gagaagtagcgcacgaacga

SEQ ID NO: 752837 - DNA, 20 bp, mouse
gatcacaatgggttccgcca

SEQ ID NO: 752838 - DNA, 20 bp, mouse
gtgcgaggcccttacttcta

SEQ ID NO: 752839 - DNA, 20 bp, mouse
gtaagggcctcgcagatgat

SEQ ID NO: 752840 - DNA, 20 bp, mouse
gctaaggagtagggaccttc

SEQ ID NO: 752841 - DNA, 20 bp, mouse
gaacctaaccaccatcacaa

SEQ ID NO: 752842 - DNA, 20 bp, mouse
gttccggctccaggccctgg

SEQ ID NO: 752843 - DNA, 20 bp, mouse
ggcctcagaaagttgggatc

SEQ ID NO: 752844 - DNA, 20 bp, mouse
ggagtgacgcgactccgcgg

SEQ ID NO: 752845 - DNA, 20 bp, mouse
gagtagcgcacgaacgaggg

SEQ ID NO: 752846 - DNA, 20 bp, mouse
ggggaaacactgtggaaacg

SEQ ID NO: 752847 - DNA, 20 bp, mouse
gactgtggaaacggggattg

SEQ ID NO: 752848 - DNA, 20 bp, mouse
gctgcttgagacactgggat

SEQ ID NO: 752849 - DNA, 20 bp, mouse
gctaggaatggtgttacaac

SEQ ID NO: 752850 - DNA, 20 bp, mouse
gaacaggcacgcgaaaaaca

SEQ ID NO: 752851 - DNA, 20 bp, mouse
gaggcacgcgaaaaacatgg

SEQ ID NO: 752852 - DNA, 20 bp, mouse
gcagtgtctcaagcagaaac

SEQ ID NO: 752853 - DNA, 20 bp, mouse
gagagtcgcacttagaaagc

SEQ ID NO: 752854 - DNA, 20 bp, mouse
gtccacagtgtttcccctca

SEQ ID NO: 752855 - DNA, 20 bp, mouse
gcaacttccggtgaagccct

SEQ ID NO: 752856 - DNA, 20 bp, mouse
ggggtcccgctgccaggcta

SEQ ID NO: 752857 - DNA, 20 bp, mouse
gctccacccaaggtgaaagt

SEQ ID NO: 752858 - DNA, 20 bp, mouse
gacgctggcttcttaggcaa

SEQ ID NO: 752859 - DNA, 20 bp, mouse
ggcgcagctctccacgtctg

SEQ ID NO: 752860 - DNA, 20 bp, mouse
gggactggctcccgcagacg

SEQ ID NO: 752861 - DNA, 20 bp, mouse
gactcacacaggacagctga

SEQ ID NO: 752862 - DNA, 20 bp, mouse
ggactcaggtcacctggttc

SEQ ID NO: 752863 - DNA, 20 bp, mouse
ggtgcaccaactttcacctt

SEQ ID NO: 752864 - DNA, 20 bp, mouse
gcaccaactttcaccttggg

SEQ ID NO: 752865 - DNA, 20 bp, mouse
gaggtgagctttactcacac

SEQ ID NO: 752866 - DNA, 20 bp, mouse
gacgcggtatccatgttccc

SEQ ID NO: 752867 - DNA, 20 bp, mouse
ggcgtccgcgggatgttcgt

SEQ ID NO: 752868 - DNA, 20 bp, mouse
ggggccgcgcgcatcagtct

SEQ ID NO: 752869 - DNA, 20 bp, mouse
gagagaggaagcgatcgcgc

SEQ ID NO: 752870 - DNA, 20 bp, mouse
ggagctgctgttaacccctc

SEQ ID NO: 752871 - DNA, 20 bp, mouse
gaacatggataccgcgtccg

SEQ ID NO: 752872 - DNA, 20 bp, mouse
ggggctcccgtcttggccgg

SEQ ID NO: 752873 - DNA, 20 bp, mouse
gccagcctacgaacatcccg

SEQ ID NO: 752874 - DNA, 20 bp, mouse
gtgttcccgggcggcgagag

SEQ ID NO: 752875 - DNA, 20 bp, mouse
gggaagcgatcgcgccggtc

SEQ ID NO: 752876 - DNA, 20 bp, mouse
gggaaagcacaagccatcaa

SEQ ID NO: 752877 - DNA, 20 bp, mouse
ggggcaaagtgttggttttg

SEQ ID NO: 752878 - DNA, 20 bp, mouse
gaaaagaacagagcccttga

SEQ ID NO: 752879 - DNA, 20 bp, mouse
gcttgcctggggcaaagtgt

SEQ ID NO: 752880 - DNA, 20 bp, mouse
gggaggttgtagtagtcaaa

SEQ ID NO: 752881 - DNA, 20 bp, mouse
gccctgctgtgtctccttga

SEQ ID NO: 752882 - DNA, 20 bp, mouse
gatgagttttggattcctaa

SEQ ID NO: 752883 - DNA, 20 bp, mouse
gcctgaaagagcccagagcc

SEQ ID NO: 752884 - DNA, 20 bp, mouse
gaaagaggaatggcttgcct

SEQ ID NO: 752885 - DNA, 20 bp, mouse
gcattcctctttaagttgcc

SEQ ID NO: 752886 - DNA, 20 bp, mouse
gggagctttcccaataggaa

SEQ ID NO: 752887 - DNA, 20 bp, mouse
ggagcagtgagggggaccaa

SEQ ID NO: 752888 - DNA, 20 bp, mouse
gtggctagtgagcagtgagg

SEQ ID NO: 752889 - DNA, 20 bp, mouse
gtccttgattgcataaccag

SEQ ID NO: 752890 - DNA, 20 bp, mouse
gccaaactgcacttcagcca

SEQ ID NO: 752891 - DNA, 20 bp, mouse
gacctggctagtgagcagtg

SEQ ID NO: 752892 - DNA, 20 bp, mouse
gtctgttcggggcccaatac

SEQ ID NO: 752893 - DNA, 20 bp, mouse
gggaaagagaagtattacta

SEQ ID NO: 752894 - DNA, 20 bp, mouse
gcgaacagaaaactactcaa

SEQ ID NO: 752895 - DNA, 20 bp, mouse
gttggatcctgaccagtatt

SEQ ID NO: 752896 - DNA, 20 bp, mouse
gccattggctggtgcgtccg

SEQ ID NO: 752897 - DNA, 20 bp, mouse
gggctggtgcgtccggggag

SEQ ID NO: 752898 - DNA, 20 bp, mouse
gtaggctccggcccaaccac

SEQ ID NO: 752899 - DNA, 20 bp, mouse
gcgcgcccagggagggagtt

SEQ ID NO: 752900 - DNA, 20 bp, mouse
ggggtggtgggtaattcatg

SEQ ID NO: 752901 - DNA, 20 bp, mouse
gccaaccacggggcacgaga

SEQ ID NO: 752902 - DNA, 20 bp, mouse
gcgggctgagggctgggcgt

SEQ ID NO: 752903 - DNA, 20 bp, mouse
gcgactgtgggattccgggg

SEQ ID NO: 752904 - DNA, 20 bp, mouse
gatggcgcggccgctctcgg

SEQ ID NO: 752905 - DNA, 20 bp, mouse
ggacgcaccagccaatggcg

SEQ ID NO: 752906 - DNA, 20 bp, mouse
gaagggggaaggacatcgct

SEQ ID NO: 752907 - DNA, 20 bp, mouse
gtggcggcgtgaagtttgtc

SEQ ID NO: 752908 - DNA, 20 bp, mouse
ggccgccagtgtgtttacag

SEQ ID NO: 752909 - DNA, 20 bp, mouse
ggccgcgcccgcgactaggg

SEQ ID NO: 752910 - DNA, 20 bp, mouse
gtcaccttagtgacgtcata

SEQ ID NO: 752911 - DNA, 20 bp, mouse
gagagaccaagttgtctctc

SEQ ID NO: 752912 - DNA, 20 bp, mouse
gctcaggagcctcgcggatg

SEQ ID NO: 752913 - DNA, 20 bp, mouse
gtgacgtcactaaggtgagg

SEQ ID NO: 752914 - DNA, 20 bp, mouse
gcactaaggtgaggcggaga

SEQ ID NO: 752915 - DNA, 20 bp, mouse
gatcgccgcgcccgcgacta

SEQ ID NO: 752916 - DNA, 20 bp, mouse
gtagaactccccggcctcgt

SEQ ID NO: 752917 - DNA, 20 bp, mouse
gttacggaacggagcgagag

SEQ ID NO: 752918 - DNA, 20 bp, mouse
gccgctgttgggtgttttcc

SEQ ID NO: 752919 - DNA, 20 bp, mouse
ggagcggagtccaaagcaac

SEQ ID NO: 752920 - DNA, 20 bp, mouse
ggcggggccagagagcgtcc

SEQ ID NO: 752921 - DNA, 20 bp, mouse
gaaaacacccaacagcggag

SEQ ID NO: 752922 - DNA, 20 bp, mouse
gcgagagcacgatgaaatcc

SEQ ID NO: 752923 - DNA, 20 bp, mouse
gcgggcgggctgttagttga

SEQ ID NO: 752924 - DNA, 20 bp, mouse
ggcggagcatagcgaggact

SEQ ID NO: 752925 - DNA, 20 bp, mouse
gaactccccggcctcgtggg

SEQ ID NO: 752926 - DNA, 20 bp, mouse
ggggcggagcggaatcggga

SEQ ID NO: 752927 - DNA, 20 bp, mouse
gagggcgggtcctctggggc

SEQ ID NO: 752928 - DNA, 20 bp, mouse
gccagaggacccgccctccg

SEQ ID NO: 752929 - DNA, 20 bp, mouse
gggctcggggatctggggac

SEQ ID NO: 752930 - DNA, 20 bp, mouse
gtaagctggctcggggatct

SEQ ID NO: 752931 - DNA, 20 bp, mouse
gaggctcctgcaaaggtggg

SEQ ID NO: 752932 - DNA, 20 bp, mouse
gtgtctgggggcgatcggtg

SEQ ID NO: 752933 - DNA, 20 bp, mouse
ggtgggaggtgtcattaagc

SEQ ID NO: 752934 - DNA, 20 bp, mouse
gggcccgagaagccgatctt

SEQ ID NO: 752935 - DNA, 20 bp, mouse
gggagctccgcccacctgct

SEQ ID NO: 752936 - DNA, 20 bp, mouse
gagagcgggacagagatccc

SEQ ID NO: 752937 - DNA, 20 bp, mouse
gcgtgaggagctcgagtgat

SEQ ID NO: 752938 - DNA, 20 bp, mouse
gagggcacctccgttcctat

SEQ ID NO: 752939 - DNA, 20 bp, mouse
gaacggaggtgccctggcgg

SEQ ID NO: 752940 - DNA, 20 bp, mouse
gggcccgacaccaggctaga

SEQ ID NO: 752941 - DNA, 20 bp, mouse
gtaaacagcggcccgacacc

SEQ ID NO: 752942 - DNA, 20 bp, mouse
gccagcggcaagtgctgatt

SEQ ID NO: 752943 - DNA, 20 bp, mouse
ggtcgggccgctgtttagag

SEQ ID NO: 752944 - DNA, 20 bp, mouse
gtgatctggcgcagaaccca

SEQ ID NO: 752945 - DNA, 20 bp, mouse
gctccagccaataggaacgg

SEQ ID NO: 752946 - DNA, 20 bp, mouse
gtctttcggaatggggtgaa

SEQ ID NO: 752947 - DNA, 20 bp, mouse
gcatgcaaaggagacgagaa

SEQ ID NO: 752948 - DNA, 20 bp, mouse
ggaaacaagaaagatatatg

SEQ ID NO: 752949 - DNA, 20 bp, mouse
gtgcgcgtcccttcacctgg

SEQ ID NO: 752950 - DNA, 20 bp, mouse
gtcgtgcagacgccgtctgg

SEQ ID NO: 752951 - DNA, 20 bp, mouse
gatctagcgaacaaagacta

SEQ ID NO: 752952 - DNA, 20 bp, mouse
gcagtgcgcaggcgctaagg

SEQ ID NO: 752953 - DNA, 20 bp, mouse
gggtggcaagtagatattca

SEQ ID NO: 752954 - DNA, 20 bp, mouse
ggaactaattggaacccgcc

SEQ ID NO: 752955 - DNA, 20 bp, mouse
gacgtcgtgcagacgccgtc

SEQ ID NO: 752956 - DNA, 20 bp, mouse
gtaaccagaaattatcgcca

SEQ ID NO: 752957 - DNA, 20 bp, mouse
ggtcctaggctcttacaacg

SEQ ID NO: 752958 - DNA, 20 bp, mouse
gaagccctggcgataatttc

SEQ ID NO: 752959 - DNA, 20 bp, mouse
gttgtcacgtgcatctttct

SEQ ID NO: 752960 - DNA, 20 bp, mouse
gcagctattgatgaaatctg

SEQ ID NO: 752961 - DNA, 20 bp, mouse
ggggtttgaacatctataaa

SEQ ID NO: 752962 - DNA, 20 bp, mouse
gtcttccgtgctctgtttat

SEQ ID NO: 752963 - DNA, 20 bp, mouse
ggggcttctgatatcgtcct

SEQ ID NO: 752964 - DNA, 20 bp, mouse
gttcagagaaccaaacttgt

SEQ ID NO: 752965 - DNA, 20 bp, mouse
gttccacgttgtaagagcct

SEQ ID NO: 752966 - DNA, 20 bp, mouse
gccaactaggggcttcaact

SEQ ID NO: 752967 - DNA, 20 bp, mouse
gagccctgatagccagtgta

SEQ ID NO: 752968 - DNA, 20 bp, mouse
gctgtccagagagcgggtgt

SEQ ID NO: 752969 - DNA, 20 bp, mouse
gaagctggcatatctccagt

SEQ ID NO: 752970 - DNA, 20 bp, mouse
gaggaactccgcaccagccg

SEQ ID NO: 752971 - DNA, 20 bp, mouse
ggggaaagaatcagccaact

SEQ ID NO: 752972 - DNA, 20 bp, mouse
ggtaacccgtagaagtgctg

SEQ ID NO: 752973 - DNA, 20 bp, mouse
ggacctcaaacagagaacct

SEQ ID NO: 752974 - DNA, 20 bp, mouse
gaggcagaagaccgcggtcc

SEQ ID NO: 752975 - DNA, 20 bp, mouse
ggcaccaagggaggggactc

SEQ ID NO: 752976 - DNA, 20 bp, mouse
gggtgtgcgccgcacgtgga

SEQ ID NO: 752977 - DNA, 20 bp, mouse
ggggcgggcggagggagtga

SEQ ID NO: 752978 - DNA, 20 bp, mouse
gccccgggagcggctctaga

SEQ ID NO: 752979 - DNA, 20 bp, mouse
ggaaagccggcgccgcaggg

SEQ ID NO: 752980 - DNA, 20 bp, mouse
gaggccagagacccgcgcgt

SEQ ID NO: 752981 - DNA, 20 bp, mouse
gcgaggcgagctctgctgag

SEQ ID NO: 752982 - DNA, 20 bp, mouse
gtgcggcgccggctttctat

SEQ ID NO: 752983 - DNA, 20 bp, mouse
ggaggggttgggccaggccg

SEQ ID NO: 752984 - DNA, 20 bp, mouse
gttcgagccctgcggaggga

SEQ ID NO: 752985 - DNA, 20 bp, mouse
gggcgaggccgggcccgagt

SEQ ID NO: 752986 - DNA, 20 bp, mouse
gccctccggtagactcactc

SEQ ID NO: 752987 - DNA, 20 bp, mouse
ggcgccgccgagcggtgcgg

SEQ ID NO: 752988 - DNA, 20 bp, mouse
ggcgccgaggtgtgcggagg

SEQ ID NO: 752989 - DNA, 20 bp, mouse
gccgaggtgtgcggaggtgg

SEQ ID NO: 752990 - DNA, 20 bp, mouse
ggcggcgccgaggtgtgcgg

SEQ ID NO: 752991 - DNA, 20 bp, mouse
gaggcaggggccaggggacg

SEQ ID NO: 752992 - DNA, 20 bp, mouse
gagggctctggggcgcacga

SEQ ID NO: 752993 - DNA, 20 bp, mouse
gggtgggggacgagcggagt

SEQ ID NO: 752994 - DNA, 20 bp, mouse
gtacgccgggtgacgctcgg

SEQ ID NO: 752995 - DNA, 20 bp, mouse
gtgagggaggcggcccagag

SEQ ID NO: 752996 - DNA, 20 bp, mouse
gcaccgtagagcctctccgt

SEQ ID NO: 752997 - DNA, 20 bp, mouse
gcctgactcggctaattcga

SEQ ID NO: 752998 - DNA, 20 bp, mouse
gagggtacttggagaggtgg

SEQ ID NO: 752999 - DNA, 20 bp, mouse
gacgcgattacgaaacccag

SEQ ID NO: 753000 - DNA, 20 bp, mouse
ggagccgcaggtaagagcgc

SEQ ID NO: 753001 - DNA, 20 bp, mouse
gcggcacggcggggagttga

SEQ ID NO: 753002 - DNA, 20 bp, mouse
gcagaggtggggctggcgga

SEQ ID NO: 753003 - DNA, 20 bp, mouse
gacggcggggagttgagggc

SEQ ID NO: 753004 - DNA, 20 bp, mouse
gggaaggtgcgaagcgacag

SEQ ID NO: 753005 - DNA, 20 bp, mouse
gcagcccctcctagcaaggg

SEQ ID NO: 753006 - DNA, 20 bp, mouse
gtaagcgaggcgttccagtg

SEQ ID NO: 753007 - DNA, 20 bp, mouse
gcgcctccccgaaaccccgg

SEQ ID NO: 753008 - DNA, 20 bp, mouse
gaggccgagcgaccgagcca

SEQ ID NO: 753009 - DNA, 20 bp, mouse
gaaagtaacaggttcctgat

SEQ ID NO: 753010 - DNA, 20 bp, mouse
ggagggagggggcccggcac

SEQ ID NO: 753011 - DNA, 20 bp, mouse
gcggggaggcggccgctgat

SEQ ID NO: 753012 - DNA, 20 bp, mouse
ggcgggccgccggggtttcg

SEQ ID NO: 753013 - DNA, 20 bp, mouse
gccccccagccgcaggagaa

SEQ ID NO: 753014 - DNA, 20 bp, mouse
ggccgtggcgcctgacaccc

SEQ ID NO: 753015 - DNA, 20 bp, mouse
gggccgcctccccgaaaccc

SEQ ID NO: 753016 - DNA, 20 bp, mouse
gctccggcacagagcgagtg

SEQ ID NO: 753017 - DNA, 20 bp, mouse
gggggcgcgtcgggtgtcag

SEQ ID NO: 753018 - DNA, 20 bp, mouse
gaccacgcggcagcacctag

SEQ ID NO: 753019 - DNA, 20 bp, mouse
gccgccctgggcaggctcag

SEQ ID NO: 753020 - DNA, 20 bp, mouse
gcgtgcgtgcaggggcgcgt

SEQ ID NO: 753021 - DNA, 20 bp, mouse
gggccgcactcgctctgtgc

SEQ ID NO: 753022 - DNA, 20 bp, mouse
ggggatggacaggtgggcgt

SEQ ID NO: 753023 - DNA, 20 bp, mouse
ggccgcgctcggtccgccct

SEQ ID NO: 753024 - DNA, 20 bp, mouse
gccacccctgagcctgccca

SEQ ID NO: 753025 - DNA, 20 bp, mouse
gccggagccgctcggtcctg

SEQ ID NO: 753026 - DNA, 20 bp, mouse
gcgccgccgggtaaagtctt

SEQ ID NO: 753027 - DNA, 20 bp, mouse
gtcaaccctagggaaatcta

SEQ ID NO: 753028 - DNA, 20 bp, mouse
gacccaaagtgtgacacgga

SEQ ID NO: 753029 - DNA, 20 bp, mouse
ggggtaaagtcttaggttca

SEQ ID NO: 753030 - DNA, 20 bp, mouse
ggcgccgagtggcacatcgc

SEQ ID NO: 753031 - DNA, 20 bp, mouse
gtgacacggaggggaggact

SEQ ID NO: 753032 - DNA, 20 bp, mouse
gtgcccggccgcggcagcca

SEQ ID NO: 753033 - DNA, 20 bp, mouse
gacacccagagaagggggat

SEQ ID NO: 753034 - DNA, 20 bp, mouse
gaacctaagactttacccgg

SEQ ID NO: 753035 - DNA, 20 bp, mouse
gaaaagctccctaccaagcc

SEQ ID NO: 753036 - DNA, 20 bp, mouse
gggaggcgctgaagtgggta

SEQ ID NO: 753037 - DNA, 20 bp, mouse
gcaccccagggtgcctggac

SEQ ID NO: 753038 - DNA, 20 bp, mouse
gggactccagtggccctcct

SEQ ID NO: 753039 - DNA, 20 bp, mouse
gctcctgggaggcgctgaag

SEQ ID NO: 753040 - DNA, 20 bp, mouse
gggcgctgaagtgggtatgg

SEQ ID NO: 753041 - DNA, 20 bp, mouse
gagagcagagcggactccag

SEQ ID NO: 753042 - DNA, 20 bp, mouse
ggccggtcctgcccaacttg

SEQ ID NO: 753043 - DNA, 20 bp, mouse
gcgggatcgacgtgcacccc

SEQ ID NO: 753044 - DNA, 20 bp, mouse
gtggcctgtccaggcaccct

SEQ ID NO: 753045 - DNA, 20 bp, mouse
gcgcgtgttctgctctcaac

SEQ ID NO: 753046 - DNA, 20 bp, mouse
gagaccatgggtccggggag

SEQ ID NO: 753047 - DNA, 20 bp, mouse
ggagttgaagggtggcgtcg

SEQ ID NO: 753048 - DNA, 20 bp, mouse
gacgccacccttcaactcac

SEQ ID NO: 753049 - DNA, 20 bp, mouse
ggcctcgccgtcctggacta

SEQ ID NO: 753050 - DNA, 20 bp, mouse
gagagtgcggtcggggtaat

SEQ ID NO: 753051 - DNA, 20 bp, mouse
gtacgggggacacgggatga

SEQ ID NO: 753052 - DNA, 20 bp, mouse
gcgggcgagaccatgggtcc

SEQ ID NO: 753053 - DNA, 20 bp, mouse
gagggctgctaccgaccact

SEQ ID NO: 753054 - DNA, 20 bp, mouse
gggagccaagtctggaaaat

SEQ ID NO: 753055 - DNA, 20 bp, mouse
gttcccagtgagttgaaggg

SEQ ID NO: 753056 - DNA, 20 bp, mouse
gggccagtggggacccttag

SEQ ID NO: 753057 - DNA, 20 bp, mouse
gagcccctaagggtccccac

SEQ ID NO: 753058 - DNA, 20 bp, mouse
gtgttggaggaggctaaatc

SEQ ID NO: 753059 - DNA, 20 bp, mouse
gtaggcaatgtcagccccta

SEQ ID NO: 753060 - DNA, 20 bp, mouse
gtccgaatgagaatcttcaa

SEQ ID NO: 753061 - DNA, 20 bp, mouse
ggcccccaacctccaggaag

SEQ ID NO: 753062 - DNA, 20 bp, mouse
gggactggcccccaacctcc

SEQ ID NO: 753063 - DNA, 20 bp, mouse
gcacgactacaattgcggat

SEQ ID NO: 753064 - DNA, 20 bp, mouse
gactacaattgcggattggt

SEQ ID NO: 753065 - DNA, 20 bp, mouse
gccgctcacgactacaattg

SEQ ID NO: 753066 - DNA, 20 bp, mouse
gtactccagggccagccgga

SEQ ID NO: 753067 - DNA, 20 bp, mouse
gcgcgcctctcggggagcct

SEQ ID NO: 753068 - DNA, 20 bp, mouse
gaggggaaagaggacagcca

SEQ ID NO: 753069 - DNA, 20 bp, mouse
gaagccaggccgcgcctctc

SEQ ID NO: 753070 - DNA, 20 bp, mouse
gccaatgccgccctgagccc

SEQ ID NO: 753071 - DNA, 20 bp, mouse
gtgagcccaggctccccgag

SEQ ID NO: 753072 - DNA, 20 bp, mouse
ggcagaggcgagcatccgat

SEQ ID NO: 753073 - DNA, 20 bp, mouse
gctccccgagaggcgcggcc

SEQ ID NO: 753074 - DNA, 20 bp, mouse
ggctgtctgttcaactagtc

SEQ ID NO: 753075 - DNA, 20 bp, mouse
ggcaaggagggcactccacg

SEQ ID NO: 753076 - DNA, 20 bp, mouse
gtccgggctagggacgaccc

SEQ ID NO: 753077 - DNA, 20 bp, mouse
gcccaccacaaggacctatc

SEQ ID NO: 753078 - DNA, 20 bp, mouse
gtgtaagtgtaacactcggg

SEQ ID NO: 753079 - DNA, 20 bp, mouse
ggactcggatacggacttgg

SEQ ID NO: 753080 - DNA, 20 bp, mouse
ggggcgtggccatggtaatt

SEQ ID NO: 753081 - DNA, 20 bp, mouse
gaggacctatcaggagaaca

SEQ ID NO: 753082 - DNA, 20 bp, mouse
gcgagtccgagtccgggcta

SEQ ID NO: 753083 - DNA, 20 bp, mouse
gggtgggcgtggcccttagt

SEQ ID NO: 753084 - DNA, 20 bp, mouse
gcgagagttggcgacaatag

SEQ ID NO: 753085 - DNA, 20 bp, mouse
gggtgtgaaaccactgatcc

SEQ ID NO: 753086 - DNA, 20 bp, mouse
gggacggcggacggagacat

SEQ ID NO: 753087 - DNA, 20 bp, mouse
gcgcgtgcgtagtggggaaa

SEQ ID NO: 753088 - DNA, 20 bp, mouse
gcaatcggggggtagaacgg

SEQ ID NO: 753089 - DNA, 20 bp, mouse
gcaagccaagagggcgagtc

SEQ ID NO: 753090 - DNA, 20 bp, mouse
gggagacattggccaatcgg

SEQ ID NO: 753091 - DNA, 20 bp, mouse
gggggtagaacggcggggga

SEQ ID NO: 753092 - DNA, 20 bp, mouse
gggcacctgactcgccctct

SEQ ID NO: 753093 - DNA, 20 bp, mouse
ggtggggaaagggactgagg

SEQ ID NO: 753094 - DNA, 20 bp, mouse
gtcggggggtagaacggcgg

SEQ ID NO: 753095 - DNA, 20 bp, mouse
gaccgggttccggggacctt

SEQ ID NO: 753096 - DNA, 20 bp, mouse
gcgggtggcggggtgtgctt

SEQ ID NO: 753097 - DNA, 20 bp, mouse
gggcgggaagtgggtggtga

SEQ ID NO: 753098 - DNA, 20 bp, mouse
ggggtcactgaggacgacgt

SEQ ID NO: 753099 - DNA, 20 bp, mouse
ggtggcggggtgtgcttggg

SEQ ID NO: 753100 - DNA, 20 bp, mouse
gccaggacgcattccaggtg

SEQ ID NO: 753101 - DNA, 20 bp, mouse
gtgcttgggcgggaagtggg

SEQ ID NO: 753102 - DNA, 20 bp, mouse
gggcccggcccaaccctcag

SEQ ID NO: 753103 - DNA, 20 bp, mouse
ggtgtgcttgggcgggaagt

SEQ ID NO: 753104 - DNA, 20 bp, mouse
ggtaacgcgacgccccgcgc

SEQ ID NO: 753105 - DNA, 20 bp, mouse
gtacgcctgcgtgccgccgg

SEQ ID NO: 753106 - DNA, 20 bp, mouse
ggcggggcggagtcatcccc

SEQ ID NO: 753107 - DNA, 20 bp, mouse
gcaatgggaatcaagagctg

SEQ ID NO: 753108 - DNA, 20 bp, mouse
gggaactctcccatctgata

SEQ ID NO: 753109 - DNA, 20 bp, mouse
ggaaagaggcgaggcaattt

SEQ ID NO: 753110 - DNA, 20 bp, mouse
ggggcactcgcaccagggcg

SEQ ID NO: 753111 - DNA, 20 bp, mouse
gaatcagagagctggagcta

SEQ ID NO: 753112 - DNA, 20 bp, mouse
ggggagagttccaaggaggc

SEQ ID NO: 753113 - DNA, 20 bp, mouse
gggaaacagcgattgagagg

SEQ ID NO: 753114 - DNA, 20 bp, mouse
gggcctggggcactcgcacc

SEQ ID NO: 753115 - DNA, 20 bp, mouse
ggggtcaaacattaaccaat

SEQ ID NO: 753116 - DNA, 20 bp, mouse
ggtgtcccgacgagcttcac

SEQ ID NO: 753117 - DNA, 20 bp, mouse
gtcccgacgagcttcacggg

SEQ ID NO: 753118 - DNA, 20 bp, mouse
ggactctgcacggtgcatct

SEQ ID NO: 753119 - DNA, 20 bp, mouse
gacctcccgtgaagctcgtc

SEQ ID NO: 753120 - DNA, 20 bp, mouse
gtccagactcggttatgttt

SEQ ID NO: 753121 - DNA, 20 bp, mouse
gggactcaactgactctgca

SEQ ID NO: 753122 - DNA, 20 bp, mouse
gaaactgagtccgcttcttg

SEQ ID NO: 753123 - DNA, 20 bp, mouse
gacacggagtcttccagact

SEQ ID NO: 753124 - DNA, 20 bp, mouse
gcaagagttcaaactctggt

SEQ ID NO: 753125 - DNA, 20 bp, mouse
gggagaccacaggcaataga

SEQ ID NO: 753126 - DNA, 20 bp, mouse
gtgggtaaactggtggatcg

SEQ ID NO: 753127 - DNA, 20 bp, mouse
gggctcggaggcaactactc

SEQ ID NO: 753128 - DNA, 20 bp, mouse
gggcggagcgggaccaagtt

SEQ ID NO: 753129 - DNA, 20 bp, mouse
ggtaaactggtggatcgggg

SEQ ID NO: 753130 - DNA, 20 bp, mouse
gtcgagtagaggatgatctt

SEQ ID NO: 753131 - DNA, 20 bp, mouse
gaggcgatctagtgtttcat

SEQ ID NO: 753132 - DNA, 20 bp, mouse
gtggtggatcggggcggagc

SEQ ID NO: 753133 - DNA, 20 bp, mouse
gtcggtcgatcttcgagtag

SEQ ID NO: 753134 - DNA, 20 bp, mouse
gatcgaccgacggcatcgat

SEQ ID NO: 753135 - DNA, 20 bp, mouse
gacggcatcgatgggctcgg

SEQ ID NO: 753136 - DNA, 20 bp, mouse
gcccacctaccgagcttcaa

SEQ ID NO: 753137 - DNA, 20 bp, mouse
gcgccgctccggacactgat

SEQ ID NO: 753138 - DNA, 20 bp, mouse
gggccaatcagtgtccggag

SEQ ID NO: 753139 - DNA, 20 bp, mouse
gtgggccccgccccggagcc

SEQ ID NO: 753140 - DNA, 20 bp, mouse
gaacaacggtgtgtaggaga

SEQ ID NO: 753141 - DNA, 20 bp, mouse
ggggtgtggctagccgaaag

SEQ ID NO: 753142 - DNA, 20 bp, mouse
gcggacactgattggccact

SEQ ID NO: 753143 - DNA, 20 bp, mouse
gttcggctagccacacccct

SEQ ID NO: 753144 - DNA, 20 bp, mouse
gcctccgcccccgggtgcct

SEQ ID NO: 753145 - DNA, 20 bp, mouse
gtgtggctagccgaaagggg

SEQ ID NO: 753146 - DNA, 20 bp, mouse
gggctagaacagcaatgggg

SEQ ID NO: 753147 - DNA, 20 bp, mouse
ggacgcctggggaccgaact

SEQ ID NO: 753148 - DNA, 20 bp, mouse
gcggggagaagctagcagga

SEQ ID NO: 753149 - DNA, 20 bp, mouse
ggctggctagaacagcaatg

SEQ ID NO: 753150 - DNA, 20 bp, mouse
gaagccacaggggacgcctg

SEQ ID NO: 753151 - DNA, 20 bp, mouse
gggatggtagggtggattca

SEQ ID NO: 753152 - DNA, 20 bp, mouse
ggcgcacgctgccaatcgcc

SEQ ID NO: 753153 - DNA, 20 bp, mouse
gaatcccgagcagatggtgg

SEQ ID NO: 753154 - DNA, 20 bp, mouse
ggcctggggaccgaactagg

SEQ ID NO: 753155 - DNA, 20 bp, mouse
gggcctcccagccgggcgat

SEQ ID NO: 753156 - DNA, 20 bp, mouse
ggataagggtatctatgaat

SEQ ID NO: 753157 - DNA, 20 bp, mouse
gcactgaatgggcaaaaaag

SEQ ID NO: 753158 - DNA, 20 bp, mouse
gttgaagatggtcactgaat

SEQ ID NO: 753159 - DNA, 20 bp, mouse
gaacttgtaaaagataccat

SEQ ID NO: 753160 - DNA, 20 bp, mouse
gcatagatacccttatctgc

SEQ ID NO: 753161 - DNA, 20 bp, mouse
gttacttcccctgcagataa

SEQ ID NO: 753162 - DNA, 20 bp, mouse
gactcatgtgaactttagac

SEQ ID NO: 753163 - DNA, 20 bp, mouse
gatactctgacctacaaagg

SEQ ID NO: 753164 - DNA, 20 bp, mouse
gcttaaagttttaactaagc

SEQ ID NO: 753165 - DNA, 20 bp, mouse
gagtacttctaactctaagt

SEQ ID NO: 753166 - DNA, 20 bp, mouse
ggacacgcctcctcctcccg

SEQ ID NO: 753167 - DNA, 20 bp, mouse
gtaagcaagggcagaggccg

SEQ ID NO: 753168 - DNA, 20 bp, mouse
gcgacctggaggaggaccct

SEQ ID NO: 753169 - DNA, 20 bp, mouse
gagcggggcaccagtgtccc

SEQ ID NO: 753170 - DNA, 20 bp, mouse
gactgggacctgagaatgtg

SEQ ID NO: 753171 - DNA, 20 bp, mouse
gagtcggtgggacgggcaac

SEQ ID NO: 753172 - DNA, 20 bp, mouse
gggccgagaaggcgacctgg

SEQ ID NO: 753173 - DNA, 20 bp, mouse
gtgacctgacatcactccca

SEQ ID NO: 753174 - DNA, 20 bp, mouse
gggaccctgggagtgatgtc

SEQ ID NO: 753175 - DNA, 20 bp, mouse
ggcgccgggagtcggtggga

SEQ ID NO: 753176 - DNA, 20 bp, mouse
ggaccctggtaggtttctat

SEQ ID NO: 753177 - DNA, 20 bp, mouse
gcgggtgtgctttctagtat

SEQ ID NO: 753178 - DNA, 20 bp, mouse
gcaaggaagaacacccaggg

SEQ ID NO: 753179 - DNA, 20 bp, mouse
gtctagcccaaagcgaccca

SEQ ID NO: 753180 - DNA, 20 bp, mouse
gcagttggaagggtcctcac

SEQ ID NO: 753181 - DNA, 20 bp, mouse
gcagtcactgggtggggtaa

SEQ ID NO: 753182 - DNA, 20 bp, mouse
gcattccgtgggctttcatg

SEQ ID NO: 753183 - DNA, 20 bp, mouse
ggaaagcccacggaatgcac

SEQ ID NO: 753184 - DNA, 20 bp, mouse
gacgggcacagcagttggaa

SEQ ID NO: 753185 - DNA, 20 bp, mouse
ggctccctccctggctctag

SEQ ID NO: 753186 - DNA, 20 bp, mouse
ggggtcctgggccacagaag

SEQ ID NO: 753187 - DNA, 20 bp, mouse
ggagccgcctcaagccctga

SEQ ID NO: 753188 - DNA, 20 bp, mouse
gcctctgtggaccccttctg

SEQ ID NO: 753189 - DNA, 20 bp, mouse
gtggaggtgtcgatgaaggg

SEQ ID NO: 753190 - DNA, 20 bp, mouse
gagaatttgaaggggatccc

SEQ ID NO: 753191 - DNA, 20 bp, mouse
gtatggatgtgctaaccaca

SEQ ID NO: 753192 - DNA, 20 bp, mouse
gcaggcagccctgaggaggt

SEQ ID NO: 753193 - DNA, 20 bp, mouse
gagaggcagagaatttgaag

SEQ ID NO: 753194 - DNA, 20 bp, mouse
gtgggtaccacccgtggggt

SEQ ID NO: 753195 - DNA, 20 bp, mouse
gtcttggaggtgtcgatgaa

SEQ ID NO: 753196 - DNA, 20 bp, mouse
ggggacagcgacacggaaaa

SEQ ID NO: 753197 - DNA, 20 bp, mouse
gaggccgagcgagaccaatg

SEQ ID NO: 753198 - DNA, 20 bp, mouse
gcctgggaggagaagaaggt

SEQ ID NO: 753199 - DNA, 20 bp, mouse
ggagaggcagggctgagttg

SEQ ID NO: 753200 - DNA, 20 bp, mouse
gctgcactgcgcagtcgcag

SEQ ID NO: 753201 - DNA, 20 bp, mouse
gcgagaccaatggggagacg

SEQ ID NO: 753202 - DNA, 20 bp, mouse
gaggggcgggacttacggaa

SEQ ID NO: 753203 - DNA, 20 bp, mouse
gacgcgccggatttggagaa

SEQ ID NO: 753204 - DNA, 20 bp, mouse
gaacgcggaaaaaggaatgc

SEQ ID NO: 753205 - DNA, 20 bp, mouse
ggccgagagaacgcggaaaa

SEQ ID NO: 753206 - DNA, 20 bp, mouse
ggagggagggagacacgcgg

SEQ ID NO: 753207 - DNA, 20 bp, mouse
gaaggagcgggcgccggaga

SEQ ID NO: 753208 - DNA, 20 bp, mouse
gcggggcggggccgacgggc

SEQ ID NO: 753209 - DNA, 20 bp, mouse
gccgacgcgccggtgatagg

SEQ ID NO: 753210 - DNA, 20 bp, mouse
gccgcgcggcgggaaggagc

SEQ ID NO: 753211 - DNA, 20 bp, mouse
gggcgagcgccgggacgggc

SEQ ID NO: 753212 - DNA, 20 bp, mouse
gctagcccagagccgcgcgg

SEQ ID NO: 753213 - DNA, 20 bp, mouse
gtccccggccgcaactttgg

SEQ ID NO: 753214 - DNA, 20 bp, mouse
ggagcgggcgccggagaggg

SEQ ID NO: 753215 - DNA, 20 bp, mouse
gtggcggcgagcgccgggac

SEQ ID NO: 753216 - DNA, 20 bp, mouse
gtacagaggtaagaagcttg

SEQ ID NO: 753217 - DNA, 20 bp, mouse
gaagaggaaaagggactgtc

SEQ ID NO: 753218 - DNA, 20 bp, mouse
gcttaggcttacatacattc

SEQ ID NO: 753219 - DNA, 20 bp, mouse
gggcttctgtgtttacaaag

SEQ ID NO: 753220 - DNA, 20 bp, mouse
ggaaagaatgcttaatctca

SEQ ID NO: 753221 - DNA, 20 bp, mouse
gaaagcagtcaatacggagg

SEQ ID NO: 753222 - DNA, 20 bp, mouse
gagattgcaaagtgaatgta

SEQ ID NO: 753223 - DNA, 20 bp, mouse
gttcaagtttactaggttga

SEQ ID NO: 753224 - DNA, 20 bp, mouse
gaatgtaaggactgctgtct

SEQ ID NO: 753225 - DNA, 20 bp, mouse
gtcagagtactcttacccca

SEQ ID NO: 753226 - DNA, 20 bp, mouse
ggcagcagcggtctgagtta

SEQ ID NO: 753227 - DNA, 20 bp, mouse
gtagggaggagtgcccggag

SEQ ID NO: 753228 - DNA, 20 bp, mouse
ggcggggcgaatgctataag

SEQ ID NO: 753229 - DNA, 20 bp, mouse
ggcagcggtctgagttaggg

SEQ ID NO: 753230 - DNA, 20 bp, mouse
gaaggatgagacttctgaag

SEQ ID NO: 753231 - DNA, 20 bp, mouse
gaggagtgcccggaggggct

SEQ ID NO: 753232 - DNA, 20 bp, mouse
gccggctctcactagttcta

SEQ ID NO: 753233 - DNA, 20 bp, mouse
ggggcgaatgctataagggg

SEQ ID NO: 753234 - DNA, 20 bp, mouse
gtaagggacccagcccctcc

SEQ ID NO: 753235 - DNA, 20 bp, mouse
gctaaacagccctagctaac

SEQ ID NO: 753236 - DNA, 20 bp, mouse
gaccttcaggtagaagtagg

SEQ ID NO: 753237 - DNA, 20 bp, mouse
gcttaccttcaggtagaagt

SEQ ID NO: 753238 - DNA, 20 bp, mouse
gtgattctgaagtaaatcaa

SEQ ID NO: 753239 - DNA, 20 bp, mouse
gtgagtgatgaattagacaa

SEQ ID NO: 753240 - DNA, 20 bp, mouse
gtcaacagtgagtcagatag

SEQ ID NO: 753241 - DNA, 20 bp, mouse
ggtcacagatcctggtacta

SEQ ID NO: 753242 - DNA, 20 bp, mouse
gaactccattagcagagttt

SEQ ID NO: 753243 - DNA, 20 bp, mouse
gaatcctgacaggttgtctg

SEQ ID NO: 753244 - DNA, 20 bp, mouse
gaatcatgtgaagtaacagc

SEQ ID NO: 753245 - DNA, 20 bp, mouse
gagtcagatagaggatttca

SEQ ID NO: 753246 - DNA, 20 bp, mouse
gtctgccacaaaccacactt

SEQ ID NO: 753247 - DNA, 20 bp, mouse
gtggtttgtggcagaatctg

SEQ ID NO: 753248 - DNA, 20 bp, mouse
gtaacttcctagtgaggcga

SEQ ID NO: 753249 - DNA, 20 bp, mouse
ggtgatgagtcaccactttg

SEQ ID NO: 753250 - DNA, 20 bp, mouse
gtcttcctaagtgtggtttg

SEQ ID NO: 753251 - DNA, 20 bp, mouse
ggggaatatcaaaactcatc

SEQ ID NO: 753252 - DNA, 20 bp, mouse
ggcatctctactttcagtgg

SEQ ID NO: 753253 - DNA, 20 bp, mouse
ggaaggtaaacatgcttaca

SEQ ID NO: 753254 - DNA, 20 bp, mouse
gctgtccacaaaatggttat

SEQ ID NO: 753255 - DNA, 20 bp, mouse
ggtgtgttaacttcctagtg

SEQ ID NO: 753256 - DNA, 20 bp, mouse
gaggagcctgggtgtcccag

SEQ ID NO: 753257 - DNA, 20 bp, mouse
gccgcagccggcaactaact

SEQ ID NO: 753258 - DNA, 20 bp, mouse
gctgccatctgcaggggttg

SEQ ID NO: 753259 - DNA, 20 bp, mouse
gcggcctcaacccctgcaga

SEQ ID NO: 753260 - DNA, 20 bp, mouse
gtgcaggctgccatctgcag

SEQ ID NO: 753261 - DNA, 20 bp, mouse
gaaaaaggagggcattgggg

SEQ ID NO: 753262 - DNA, 20 bp, mouse
gaaggagggcattggggcgg

SEQ ID NO: 753263 - DNA, 20 bp, mouse
gaccacgtccccaccgaaaa

SEQ ID NO: 753264 - DNA, 20 bp, mouse
gggccacccaaaaaatgctt

SEQ ID NO: 753265 - DNA, 20 bp, mouse
gcccgtcccctgggacaccc

SEQ ID NO: 753266 - DNA, 20 bp, mouse
ggggagccgcggttcttaaa

SEQ ID NO: 753267 - DNA, 20 bp, mouse
gccgcctgcggtgacccggc

SEQ ID NO: 753268 - DNA, 20 bp, mouse
gccgccgcgcactgggagta

SEQ ID NO: 753269 - DNA, 20 bp, mouse
gctgagggagggcgcaagga

SEQ ID NO: 753270 - DNA, 20 bp, mouse
gccacctgccgggtcaccgc

SEQ ID NO: 753271 - DNA, 20 bp, mouse
gaggcgagatctcccttgga

SEQ ID NO: 753272 - DNA, 20 bp, mouse
ggggggcgggacctaacccg

SEQ ID NO: 753273 - DNA, 20 bp, mouse
gcctgctactgagaagcctc

SEQ ID NO: 753274 - DNA, 20 bp, mouse
gcagcatagggtcgagtcat

SEQ ID NO: 753275 - DNA, 20 bp, mouse
gaggacattcagatcaaagt

SEQ ID NO: 753276 - DNA, 20 bp, mouse
gaccgatgaacattctggag

SEQ ID NO: 753277 - DNA, 20 bp, mouse
ggggtctgcggggatcttgg

SEQ ID NO: 753278 - DNA, 20 bp, mouse
gacgcaggcgcgcttcttaa

SEQ ID NO: 753279 - DNA, 20 bp, mouse
ggtaccagacatctagatga

SEQ ID NO: 753280 - DNA, 20 bp, mouse
gatccccgcagaccccggga

SEQ ID NO: 753281 - DNA, 20 bp, mouse
gccccacccaagttctggtt

SEQ ID NO: 753282 - DNA, 20 bp, mouse
gagcgcgcctgcgtgtgttt

SEQ ID NO: 753283 - DNA, 20 bp, mouse
gtcttaaaggagaagactca

SEQ ID NO: 753284 - DNA, 20 bp, mouse
ggaactagggcctttcgcaa

SEQ ID NO: 753285 - DNA, 20 bp, mouse
gccaagttctggttggggag

SEQ ID NO: 753286 - DNA, 20 bp, mouse
gcgcgggcgggacccggtaa

SEQ ID NO: 753287 - DNA, 20 bp, mouse
ggacagggagccggcggatc

SEQ ID NO: 753288 - DNA, 20 bp, mouse
gagggggcgcgtccagagga

SEQ ID NO: 753289 - DNA, 20 bp, mouse
ggtgctccagccttcggggt

SEQ ID NO: 753290 - DNA, 20 bp, mouse
gggcgcgcggctcagtcccg

SEQ ID NO: 753291 - DNA, 20 bp, mouse
gcgcgcgggggcccctttaa

SEQ ID NO: 753292 - DNA, 20 bp, mouse
gcactcgcagcccgatccgc

SEQ ID NO: 753293 - DNA, 20 bp, mouse
ggccccgcccactcccttaa

SEQ ID NO: 753294 - DNA, 20 bp, mouse
gtgggcgggagtaggggctt

SEQ ID NO: 753295 - DNA, 20 bp, mouse
ggaagctttgcccaccccga

SEQ ID NO: 753296 - DNA, 20 bp, mouse
ggtgagttgcaacatctctc

SEQ ID NO: 753297 - DNA, 20 bp, mouse
gagcagagaactctgggggt

SEQ ID NO: 753298 - DNA, 20 bp, mouse
gtggctctcacgatgccagg

SEQ ID NO: 753299 - DNA, 20 bp, mouse
gccccattctccacagttga

SEQ ID NO: 753300 - DNA, 20 bp, mouse
gctaatctctttagatactc

SEQ ID NO: 753301 - DNA, 20 bp, mouse
gtatctaaagagattagcat

SEQ ID NO: 753302 - DNA, 20 bp, mouse
gttggcttctgctctttggt

SEQ ID NO: 753303 - DNA, 20 bp, mouse
gtggacattcctgcttctca

SEQ ID NO: 753304 - DNA, 20 bp, mouse
gctctggctctcacgatgcc

SEQ ID NO: 753305 - DNA, 20 bp, mouse
gatgtctctctgtactgctc

SEQ ID NO: 753306 - DNA, 20 bp, mouse
gtgaccttagcagttgagtt

SEQ ID NO: 753307 - DNA, 20 bp, mouse
gcaacctaactcaactgcta

SEQ ID NO: 753308 - DNA, 20 bp, mouse
gccagaggctatgtgactca

SEQ ID NO: 753309 - DNA, 20 bp, mouse
gatgtgctgctggatagtcc

SEQ ID NO: 753310 - DNA, 20 bp, mouse
gctaaaatggatggtcactg

SEQ ID NO: 753311 - DNA, 20 bp, mouse
gcagttgagttaggttggtt

SEQ ID NO: 753312 - DNA, 20 bp, mouse
gatccattttagttttagaa

SEQ ID NO: 753313 - DNA, 20 bp, mouse
gatcctttctaaaactaaaa

SEQ ID NO: 753314 - DNA, 20 bp, mouse
ggctgtctctatggattaat

SEQ ID NO: 753315 - DNA, 20 bp, mouse
gtgggtgagctcagaacatg

SEQ ID NO: 753316 - DNA, 20 bp, mouse
gtcagatactgtgacctcca

SEQ ID NO: 753317 - DNA, 20 bp, mouse
gccaaggagatgatttaggc

SEQ ID NO: 753318 - DNA, 20 bp, mouse
gccaggaccacatgtgtgaa

SEQ ID NO: 753319 - DNA, 20 bp, mouse
gcaataccaggattaaatcc

SEQ ID NO: 753320 - DNA, 20 bp, mouse
ggccatccctttcacacatg

SEQ ID NO: 753321 - DNA, 20 bp, mouse
ggagatgatttaggctggtt

SEQ ID NO: 753322 - DNA, 20 bp, mouse
ggccagaggctatatgactc

SEQ ID NO: 753323 - DNA, 20 bp, mouse
ggggtgagctcagaacatgc

SEQ ID NO: 753324 - DNA, 20 bp, mouse
gtcagcagtgtaaatgctga

SEQ ID NO: 753325 - DNA, 20 bp, mouse
gtgaccacccattttaattt

SEQ ID NO: 753326 - DNA, 20 bp, mouse
ggtgggaagaagctgagaaa

SEQ ID NO: 753327 - DNA, 20 bp, mouse
gtagggagcaagaagggcca

SEQ ID NO: 753328 - DNA, 20 bp, mouse
gcccagttagggagcaagaa

SEQ ID NO: 753329 - DNA, 20 bp, mouse
gtggcagcaccgggtggaga

SEQ ID NO: 753330 - DNA, 20 bp, mouse
gagcaccgggtggagagggg

SEQ ID NO: 753331 - DNA, 20 bp, mouse
ggaggacctaggtgcagatg

SEQ ID NO: 753332 - DNA, 20 bp, mouse
ggagtggtagcccccagtta

SEQ ID NO: 753333 - DNA, 20 bp, mouse
gtaaacgtgtagtttggaga

SEQ ID NO: 753334 - DNA, 20 bp, mouse
ggggtcccaacctttcatga

SEQ ID NO: 753335 - DNA, 20 bp, mouse
gggaagagtgctggcagcac

SEQ ID NO: 753336 - DNA, 20 bp, mouse
gcagtggtgcccagggatca

SEQ ID NO: 753337 - DNA, 20 bp, mouse
gtgtttctccccctgatgaa

SEQ ID NO: 753338 - DNA, 20 bp, mouse
gagggctttcaaatccctaa

SEQ ID NO: 753339 - DNA, 20 bp, mouse
gccactgttaccccttcatc

SEQ ID NO: 753340 - DNA, 20 bp, mouse
gggggtaacagtggtgccca

SEQ ID NO: 753341 - DNA, 20 bp, mouse
gaaagggagtcttaaaagta

SEQ ID NO: 753342 - DNA, 20 bp, mouse
gtgattgaccaaatcataaa

SEQ ID NO: 753343 - DNA, 20 bp, mouse
ggttagctatgtacagaaat

SEQ ID NO: 753344 - DNA, 20 bp, mouse
gtttcaaatccctaatggat

SEQ ID NO: 753345 - DNA, 20 bp, mouse
gacatgcagagagaattcag

SEQ ID NO: 753346 - DNA, 20 bp, mouse
ggtggccctggggtcttcaa

SEQ ID NO: 753347 - DNA, 20 bp, mouse
gtctcccctcctaaggagca

SEQ ID NO: 753348 - DNA, 20 bp, mouse
gtactgtgatccaggactga

SEQ ID NO: 753349 - DNA, 20 bp, mouse
gcccagggccacttttctca

SEQ ID NO: 753350 - DNA, 20 bp, mouse
ggtcacacccatgagaaaag

SEQ ID NO: 753351 - DNA, 20 bp, mouse
gcatgccctgctccttagga

SEQ ID NO: 753352 - DNA, 20 bp, mouse
ggctgcctttgaagacccca

SEQ ID NO: 753353 - DNA, 20 bp, mouse
gcttctgagtggtgaacttg

SEQ ID NO: 753354 - DNA, 20 bp, mouse
gtgaactgagggagaagtgc

SEQ ID NO: 753355 - DNA, 20 bp, mouse
gctcagaagtactgtgatcc

SEQ ID NO: 753356 - DNA, 20 bp, mouse
gaaccaggccgaagggtcgg

SEQ ID NO: 753357 - DNA, 20 bp, mouse
gacacaccctacagtgtcgg

SEQ ID NO: 753358 - DNA, 20 bp, mouse
gagctggggcggagtgggaa

SEQ ID NO: 753359 - DNA, 20 bp, mouse
ggacctggatcgcagagctg

SEQ ID NO: 753360 - DNA, 20 bp, mouse
ggcgccggggctcagatttg

SEQ ID NO: 753361 - DNA, 20 bp, mouse
gctatggtgaagagaggacc

SEQ ID NO: 753362 - DNA, 20 bp, mouse
gagaccagcgggagtcctta

SEQ ID NO: 753363 - DNA, 20 bp, mouse
gacgggacggagctgactgt

SEQ ID NO: 753364 - DNA, 20 bp, mouse
ggacccttcggcctggttcc

SEQ ID NO: 753365 - DNA, 20 bp, mouse
gaccgcagtgactgagtgta

SEQ ID NO: 753366 - DNA, 20 bp, mouse
gcaggccccgggtgcaaaga

SEQ ID NO: 753367 - DNA, 20 bp, mouse
ggcctcccgcaggtcccgtt

SEQ ID NO: 753368 - DNA, 20 bp, mouse
gagcgcccgaacgggacctg

SEQ ID NO: 753369 - DNA, 20 bp, mouse
gcccgaacgggacctgcggg

SEQ ID NO: 753370 - DNA, 20 bp, mouse
gaggcgctcgctccaggccc

SEQ ID NO: 753371 - DNA, 20 bp, mouse
gtaaccccaggctagccctg

SEQ ID NO: 753372 - DNA, 20 bp, mouse
ggcctcttcaccctccctca

SEQ ID NO: 753373 - DNA, 20 bp, mouse
gaccctgagggagggtgaag

SEQ ID NO: 753374 - DNA, 20 bp, mouse
gctcccccagggctagcctg

SEQ ID NO: 753375 - DNA, 20 bp, mouse
ggggcccggccagccgccct

SEQ ID NO: 753376 - DNA, 20 bp, mouse
gccgcggcgaaaggaagcta

SEQ ID NO: 753377 - DNA, 20 bp, mouse
ggcagggcggcaggatgcgt

SEQ ID NO: 753378 - DNA, 20 bp, mouse
gcatcctgccgccctgccgg

SEQ ID NO: 753379 - DNA, 20 bp, mouse
gcggcaggatgcgtgggggg

SEQ ID NO: 753380 - DNA, 20 bp, mouse
ggggactttgagatgggaac

SEQ ID NO: 753381 - DNA, 20 bp, mouse
gcagcctggggtcccccggc

SEQ ID NO: 753382 - DNA, 20 bp, mouse
ggactctcctatgagcttaa

SEQ ID NO: 753383 - DNA, 20 bp, mouse
ggagtccctgcgtgccggtg

SEQ ID NO: 753384 - DNA, 20 bp, mouse
ggggttggaacaatggttcg

SEQ ID NO: 753385 - DNA, 20 bp, mouse
gggaagctacggagctcaga

SEQ ID NO: 753386 - DNA, 20 bp, mouse
ggataagcaatcaccaactg

SEQ ID NO: 753387 - DNA, 20 bp, mouse
gagaccagaagactaacttg

SEQ ID NO: 753388 - DNA, 20 bp, mouse
gcaaaattcaagtttatcta

SEQ ID NO: 753389 - DNA, 20 bp, mouse
gttgagcgctgacaatagca

SEQ ID NO: 753390 - DNA, 20 bp, mouse
gcatatcttggtagtgtgat

SEQ ID NO: 753391 - DNA, 20 bp, mouse
ggaagtcatgagacacttca

SEQ ID NO: 753392 - DNA, 20 bp, mouse
gggcccccaagttagtcttc

SEQ ID NO: 753393 - DNA, 20 bp, mouse
ggaaagttgacagtgagacg

SEQ ID NO: 753394 - DNA, 20 bp, mouse
ggtgtgattggaagagacaa

SEQ ID NO: 753395 - DNA, 20 bp, mouse
ggtagttttactggtagttt

SEQ ID NO: 753396 - DNA, 20 bp, mouse
gccgctggcggaagaggcta

SEQ ID NO: 753397 - DNA, 20 bp, mouse
ggggcaagacacttgactgc

SEQ ID NO: 753398 - DNA, 20 bp, mouse
gaaaaagggcgcgggaggat

SEQ ID NO: 753399 - DNA, 20 bp, mouse
ggctacaccgctggcggaag

SEQ ID NO: 753400 - DNA, 20 bp, mouse
ggaagccaggactggggtca

SEQ ID NO: 753401 - DNA, 20 bp, mouse
gtggggcttgagtttgagaa

SEQ ID NO: 753402 - DNA, 20 bp, mouse
gggagcggctacaccgctgg

SEQ ID NO: 753403 - DNA, 20 bp, mouse
ggactgaaataggcctcaat

SEQ ID NO: 753404 - DNA, 20 bp, mouse
gttgcggcaggagccgggag

SEQ ID NO: 753405 - DNA, 20 bp, mouse
gccgggagcggctacaccgc

SEQ ID NO: 753406 - DNA, 20 bp, mouse
gaatactgtgagaagaggta

SEQ ID NO: 753407 - DNA, 20 bp, mouse
gcaaatggtgattaatctcc

SEQ ID NO: 753408 - DNA, 20 bp, mouse
gttctcacagtattcagctt

SEQ ID NO: 753409 - DNA, 20 bp, mouse
gtatgtggtcactgatagtg

SEQ ID NO: 753410 - DNA, 20 bp, mouse
gccagttttctcttttgcca

SEQ ID NO: 753411 - DNA, 20 bp, mouse
gtaattgcttccatccaaat

SEQ ID NO: 753412 - DNA, 20 bp, mouse
gcaaacattacagctctgga

SEQ ID NO: 753413 - DNA, 20 bp, mouse
gtttgtgacttggatagaag

SEQ ID NO: 753414 - DNA, 20 bp, mouse
gaaaccttcttaattttgca

SEQ ID NO: 753415 - DNA, 20 bp, mouse
gagctgtaatgtttgtgact

SEQ ID NO: 753416 - DNA, 20 bp, mouse
ggtggattcagcatggtggg

SEQ ID NO: 753417 - DNA, 20 bp, mouse
gtggctacatagccagatca

SEQ ID NO: 753418 - DNA, 20 bp, mouse
gcttgtggattcagcatggt

SEQ ID NO: 753419 - DNA, 20 bp, mouse
gaagtattgtgtttttatat

SEQ ID NO: 753420 - DNA, 20 bp, mouse
gagatcatgggctgcatagg

SEQ ID NO: 753421 - DNA, 20 bp, mouse
gtggctatgtagccactatg

SEQ ID NO: 753422 - DNA, 20 bp, mouse
gtgcctggggtccagaattc

SEQ ID NO: 753423 - DNA, 20 bp, mouse
gacagccagcatcactgagc

SEQ ID NO: 753424 - DNA, 20 bp, mouse
ggtgtttttatattggcagg

SEQ ID NO: 753425 - DNA, 20 bp, mouse
gcatggcatttatcttttag

SEQ ID NO: 753426 - DNA, 20 bp, mouse
ggtaaactgtcagggtgagg

SEQ ID NO: 753427 - DNA, 20 bp, mouse
ggctacttttgtaaactgtc

SEQ ID NO: 753428 - DNA, 20 bp, mouse
gcgctatcaggcagcagtgg

SEQ ID NO: 753429 - DNA, 20 bp, mouse
gatgttgcctcatactgctt

SEQ ID NO: 753430 - DNA, 20 bp, mouse
gaatgttcagcgatcatctt

SEQ ID NO: 753431 - DNA, 20 bp, mouse
gtcaagatgtagctttataa

SEQ ID NO: 753432 - DNA, 20 bp, mouse
gcagggtgaggtggctggca

SEQ ID NO: 753433 - DNA, 20 bp, mouse
gtgatttggaacctagaagt

SEQ ID NO: 753434 - DNA, 20 bp, mouse
gcgatcatcttgggaagcgg

SEQ ID NO: 753435 - DNA, 20 bp, mouse
gaagcagcatctagagatga

SEQ ID NO: 753436 - DNA, 20 bp, mouse
ggggcagggcataagggagg

SEQ ID NO: 753437 - DNA, 20 bp, mouse
ggactgtgggcagggcataa

SEQ ID NO: 753438 - DNA, 20 bp, mouse
gctgcctgacttggcaatgg

SEQ ID NO: 753439 - DNA, 20 bp, mouse
ggcaggacccccagacccac

SEQ ID NO: 753440 - DNA, 20 bp, mouse
gagtcagcataagcctggag

SEQ ID NO: 753441 - DNA, 20 bp, mouse
ggtcagggccgtcagaccta

SEQ ID NO: 753442 - DNA, 20 bp, mouse
gttactgggctgatcagtca

SEQ ID NO: 753443 - DNA, 20 bp, mouse
gaaggagggtgtgcaggatg

SEQ ID NO: 753444 - DNA, 20 bp, mouse
gcagcataagcctggagggg

SEQ ID NO: 753445 - DNA, 20 bp, mouse
ggatcagcccagtaaaagac

SEQ ID NO: 753446 - DNA, 20 bp, mouse
gtggatcaatggagtggtga

SEQ ID NO: 753447 - DNA, 20 bp, mouse
gccctcctaggatggatcaa

SEQ ID NO: 753448 - DNA, 20 bp, mouse
gcactccattgatccatcct

SEQ ID NO: 753449 - DNA, 20 bp, mouse
gaacatggacaattatcagc

SEQ ID NO: 753450 - DNA, 20 bp, mouse
ggaaaaggaaaattgctttc

SEQ ID NO: 753451 - DNA, 20 bp, mouse
gtgcgatctgtgaccctcct

SEQ ID NO: 753452 - DNA, 20 bp, mouse
ggagacacatgagcatacct

SEQ ID NO: 753453 - DNA, 20 bp, mouse
gttagaaggaaacttcccat

SEQ ID NO: 753454 - DNA, 20 bp, mouse
gtccattgatccatcctagg

SEQ ID NO: 753455 - DNA, 20 bp, mouse
gggaaacttcccattggcag

SEQ ID NO: 753456 - DNA, 20 bp, mouse
gttctccaggactctgtcgt

SEQ ID NO: 753457 - DNA, 20 bp, mouse
gaggaattgacctgagtggt

SEQ ID NO: 753458 - DNA, 20 bp, mouse
gtccagcctggcccccttgg

SEQ ID NO: 753459 - DNA, 20 bp, mouse
gtggttggaggcctccaagg

SEQ ID NO: 753460 - DNA, 20 bp, mouse
gtcctgagggcacttgaatc

SEQ ID NO: 753461 - DNA, 20 bp, mouse
gaattgacctgagtggttgg

SEQ ID NO: 753462 - DNA, 20 bp, mouse
ggccaggctggaaggggcgg

SEQ ID NO: 753463 - DNA, 20 bp, mouse
gacttcctggccaacagtat

SEQ ID NO: 753464 - DNA, 20 bp, mouse
gaaaacacgaggacaacaaa

SEQ ID NO: 753465 - DNA, 20 bp, mouse
gtggcctggtccggcccacc

SEQ ID NO: 753466 - DNA, 20 bp, mouse
ggggccgttaggtccctgaa

SEQ ID NO: 753467 - DNA, 20 bp, mouse
gtatgcgccctcaaccgccc

SEQ ID NO: 753468 - DNA, 20 bp, mouse
ggggccaggcagtcccttca

SEQ ID NO: 753469 - DNA, 20 bp, mouse
gagccggcaggcacgtgacc

SEQ ID NO: 753470 - DNA, 20 bp, mouse
gacgcagccggggcggttga

SEQ ID NO: 753471 - DNA, 20 bp, mouse
gagtcccttcagggacctaa

SEQ ID NO: 753472 - DNA, 20 bp, mouse
ggccgggcacgcagccgggg

SEQ ID NO: 753473 - DNA, 20 bp, mouse
gtgggcgcagacttcagggg

SEQ ID NO: 753474 - DNA, 20 bp, mouse
gcctctggggaggggccgtt

SEQ ID NO: 753475 - DNA, 20 bp, mouse
gcgggaggggaagtgactgc

SEQ ID NO: 753476 - DNA, 20 bp, mouse
gccacctcgcaaactctcaa

SEQ ID NO: 753477 - DNA, 20 bp, mouse
gtggaagtagggtctgcgaa

SEQ ID NO: 753478 - DNA, 20 bp, mouse
gccagtgaggactcgcgaga

SEQ ID NO: 753479 - DNA, 20 bp, mouse
gaacggcggggatcagcttc

SEQ ID NO: 753480 - DNA, 20 bp, mouse
gccgctgaagcctggaagta

SEQ ID NO: 753481 - DNA, 20 bp, mouse
gccccagggcaggaagaggg

SEQ ID NO: 753482 - DNA, 20 bp, mouse
gtcgcgagagcccgtcggcc

SEQ ID NO: 753483 - DNA, 20 bp, mouse
gcgaatccctggacttgtcc

SEQ ID NO: 753484 - DNA, 20 bp, mouse
gagatctcgcgagagcccgt

SEQ ID NO: 753485 - DNA, 20 bp, mouse
ggtcggcccggacaagtcca

SEQ ID NO: 753486 - DNA, 20 bp, mouse
gtggctcccgccgtcgtcct

SEQ ID NO: 753487 - DNA, 20 bp, mouse
gcgcgagcctaggacgacgg

SEQ ID NO: 753488 - DNA, 20 bp, mouse
gccaccaacccgcgctactc

SEQ ID NO: 753489 - DNA, 20 bp, mouse
ggccggacccggagtagcgc

SEQ ID NO: 753490 - DNA, 20 bp, mouse
gcgacctgcggggtgggcag

SEQ ID NO: 753491 - DNA, 20 bp, mouse
ggggtccggcgctacggcgt

SEQ ID NO: 753492 - DNA, 20 bp, mouse
gccccaggtgcccccggctg

SEQ ID NO: 753493 - DNA, 20 bp, mouse
ggcggggcgcacagacaatg

SEQ ID NO: 753494 - DNA, 20 bp, mouse
gggtcccggctgcgcaggcc

SEQ ID NO: 753495 - DNA, 20 bp, mouse
gacccccaacgccgtagcgc

SEQ ID NO: 753496 - DNA, 20 bp, mouse
gtgaatcagttcagtatctt

SEQ ID NO: 753497 - DNA, 20 bp, mouse
gggaactgtagcggctggaa

SEQ ID NO: 753498 - DNA, 20 bp, mouse
gggttaggttggaactgtag

SEQ ID NO: 753499 - DNA, 20 bp, mouse
gaactgattcacctaaggtt

SEQ ID NO: 753500 - DNA, 20 bp, mouse
gggaacggagaactcgctcc

SEQ ID NO: 753501 - DNA, 20 bp, mouse
gaggttggaactgtagcggc

SEQ ID NO: 753502 - DNA, 20 bp, mouse
gcgctgcaaaacaaacgttc

SEQ ID NO: 753503 - DNA, 20 bp, mouse
gacagttccaacctaacctt

SEQ ID NO: 753504 - DNA, 20 bp, mouse
ggattcacctaaggttaggt

SEQ ID NO: 753505 - DNA, 20 bp, mouse
ggtccttcgcgaaagagcac

SEQ ID NO: 753506 - DNA, 20 bp, mouse
gaaaagttggggcctggcgt

SEQ ID NO: 753507 - DNA, 20 bp, mouse
gaaccccagaggcacgggaa

SEQ ID NO: 753508 - DNA, 20 bp, mouse
ggggtcccgcagtcctacca

SEQ ID NO: 753509 - DNA, 20 bp, mouse
ggggcgcggcctgaaataat

SEQ ID NO: 753510 - DNA, 20 bp, mouse
gagaccagatggaccagtct

SEQ ID NO: 753511 - DNA, 20 bp, mouse
ggtaggactgcgggacccga

SEQ ID NO: 753512 - DNA, 20 bp, mouse
gcaacccagactggtccatc

SEQ ID NO: 753513 - DNA, 20 bp, mouse
ggggccggactgagaccaga

SEQ ID NO: 753514 - DNA, 20 bp, mouse
ggaaaggaaaagttggggcc

SEQ ID NO: 753515 - DNA, 20 bp, mouse
gtggcgtgggagctggagca

SEQ ID NO: 753516 - DNA, 20 bp, mouse
ggctgaggtctgaactccaa

SEQ ID NO: 753517 - DNA, 20 bp, mouse
gctgtggggggaggtaactt

SEQ ID NO: 753518 - DNA, 20 bp, mouse
gaggcattcccttatgctgc

SEQ ID NO: 753519 - DNA, 20 bp, mouse
gttcagctacatgacacagt

SEQ ID NO: 753520 - DNA, 20 bp, mouse
gtatgaacgaaactgggagt

SEQ ID NO: 753521 - DNA, 20 bp, mouse
ggaagagtctaatacactca

SEQ ID NO: 753522 - DNA, 20 bp, mouse
gtaacttcctgtaaatactg

SEQ ID NO: 753523 - DNA, 20 bp, mouse
gacgaaactgggagtaggcc

SEQ ID NO: 753524 - DNA, 20 bp, mouse
gcaattctctggcttccaaa

SEQ ID NO: 753525 - DNA, 20 bp, mouse
gtagtgaccacagtatttac

SEQ ID NO: 753526 - DNA, 20 bp, mouse
gtgtaggcacagccagtaat

SEQ ID NO: 753527 - DNA, 20 bp, mouse
gccaggaagccagtgtgggt

SEQ ID NO: 753528 - DNA, 20 bp, mouse
gagggccaggaagccagtgt

SEQ ID NO: 753529 - DNA, 20 bp, mouse
gtggttgatgagcagatgga

SEQ ID NO: 753530 - DNA, 20 bp, mouse
gggagacttaagatgaaatt

SEQ ID NO: 753531 - DNA, 20 bp, mouse
gggatagggagtcttcagtg

SEQ ID NO: 753532 - DNA, 20 bp, mouse
gttgatgagcagatggaggg

SEQ ID NO: 753533 - DNA, 20 bp, mouse
gccctggcattccccattac

SEQ ID NO: 753534 - DNA, 20 bp, mouse
gtgagcagatggagggagga

SEQ ID NO: 753535 - DNA, 20 bp, mouse
gctcatcaaccaacccacac

SEQ ID NO: 753536 - DNA, 20 bp, mouse
gagctcccttcggatgtaaa

SEQ ID NO: 753537 - DNA, 20 bp, mouse
gaccgactgaggatggtaga

SEQ ID NO: 753538 - DNA, 20 bp, mouse
gaggccgcgtccctcttggg

SEQ ID NO: 753539 - DNA, 20 bp, mouse
gtgtcactgcagtggactga

SEQ ID NO: 753540 - DNA, 20 bp, mouse
gtggaaggagcgctcctgcc

SEQ ID NO: 753541 - DNA, 20 bp, mouse
ggagggacgcggcctcccat

SEQ ID NO: 753542 - DNA, 20 bp, mouse
gggagccgtttacatccgaa

SEQ ID NO: 753543 - DNA, 20 bp, mouse
gcgtccgaacttcgcgcttt

SEQ ID NO: 753544 - DNA, 20 bp, mouse
gcgcagagattagctccctt

SEQ ID NO: 753545 - DNA, 20 bp, mouse
ggacaagtccgagcttattg

SEQ ID NO: 753546 - DNA, 20 bp, mouse
gcgcacacgtggcttgggtg

SEQ ID NO: 753547 - DNA, 20 bp, mouse
gggccgcggcgtctcactga

SEQ ID NO: 753548 - DNA, 20 bp, mouse
gcgcgcgcgcacacgtggct

SEQ ID NO: 753549 - DNA, 20 bp, mouse
gcccaccgcgcgcgcacacg

SEQ ID NO: 753550 - DNA, 20 bp, mouse
gggggtgagaagatggaacc

SEQ ID NO: 753551 - DNA, 20 bp, mouse
gcggagaggaggggcaagta

SEQ ID NO: 753552 - DNA, 20 bp, mouse
ggcggcgtctcactgagggc

SEQ ID NO: 753553 - DNA, 20 bp, mouse
gccgcccaggggcggatccc

SEQ ID NO: 753554 - DNA, 20 bp, mouse
ggccagccacaagttaaacg

SEQ ID NO: 753555 - DNA, 20 bp, mouse
gacgccgcggccctgcgggc

SEQ ID NO: 753556 - DNA, 20 bp, mouse
gcacctacgctgttcaccac

SEQ ID NO: 753557 - DNA, 20 bp, mouse
gcccccaggtcctaagcagc

SEQ ID NO: 753558 - DNA, 20 bp, mouse
gagccggtggtgaacagcgt

SEQ ID NO: 753559 - DNA, 20 bp, mouse
gggtgaacagcgtaggtggc

SEQ ID NO: 753560 - DNA, 20 bp, mouse
gggactcggggggcactcac

SEQ ID NO: 753561 - DNA, 20 bp, mouse
gggcggggcgtcaggctaat

SEQ ID NO: 753562 - DNA, 20 bp, mouse
gagggagcgcgagtagctgg

SEQ ID NO: 753563 - DNA, 20 bp, mouse
gaggctaattggaccgtgac

SEQ ID NO: 753564 - DNA, 20 bp, mouse
gcactgggacccagggttac

SEQ ID NO: 753565 - DNA, 20 bp, mouse
ggaacagcgtaggtggccgg

SEQ ID NO: 753566 - DNA, 20 bp, mouse
gcaggggcgtcgcgagaagg

SEQ ID NO: 753567 - DNA, 20 bp, mouse
gcggagcccggtgacagttg

SEQ ID NO: 753568 - DNA, 20 bp, mouse
ggagaaggcggggccccgtg

SEQ ID NO: 753569 - DNA, 20 bp, mouse
ggaaaagtggccgccgccag

SEQ ID NO: 753570 - DNA, 20 bp, mouse
gcgccaggggcgtcgcgaga

SEQ ID NO: 753571 - DNA, 20 bp, mouse
gtggcactcggtggggctct

SEQ ID NO: 753572 - DNA, 20 bp, mouse
gtcaccgggctccgctgcgt

SEQ ID NO: 753573 - DNA, 20 bp, mouse
gagacagccaatcctaagga

SEQ ID NO: 753574 - DNA, 20 bp, mouse
gtccgctgcgtgggcccagg

SEQ ID NO: 753575 - DNA, 20 bp, mouse
gctggagcccgtggtgtcgc

SEQ ID NO: 753576 - DNA, 20 bp, mouse
ggacaggaaggtgagacccg

SEQ ID NO: 753577 - DNA, 20 bp, mouse
gcgggcgggccactcaggac

SEQ ID NO: 753578 - DNA, 20 bp, mouse
ggctgctcggcttggctgtc

SEQ ID NO: 753579 - DNA, 20 bp, mouse
gacggaagctctgaatgcgg

SEQ ID NO: 753580 - DNA, 20 bp, mouse
gcctccggagccccaggcgg

SEQ ID NO: 753581 - DNA, 20 bp, mouse
gactacggctggtcacgcgg

SEQ ID NO: 753582 - DNA, 20 bp, mouse
gtcggctcccggccggacgc

SEQ ID NO: 753583 - DNA, 20 bp, mouse
gctcggcggcgggtgcagtg

SEQ ID NO: 753584 - DNA, 20 bp, mouse
gcccgagctcggctcccggc

SEQ ID NO: 753585 - DNA, 20 bp, mouse
gtgggtcgcgcagctgaaga

SEQ ID NO: 753586 - DNA, 20 bp, mouse
gtcaactgttccgtggccga

SEQ ID NO: 753587 - DNA, 20 bp, mouse
ggccgctgtcaactgttccg

SEQ ID NO: 753588 - DNA, 20 bp, mouse
gggcagacgtccctcggcca

SEQ ID NO: 753589 - DNA, 20 bp, mouse
ggccacggaacagttgacag

SEQ ID NO: 753590 - DNA, 20 bp, mouse
gtggccacctcgcctgttga

SEQ ID NO: 753591 - DNA, 20 bp, mouse
gttgacaccaggtgacacta

SEQ ID NO: 753592 - DNA, 20 bp, mouse
gctcccaggtgtccatcaac

SEQ ID NO: 753593 - DNA, 20 bp, mouse
ggtgggcacgggagggaaat

SEQ ID NO: 753594 - DNA, 20 bp, mouse
gtgtccatcaacaggcgagg

SEQ ID NO: 753595 - DNA, 20 bp, mouse
gaatcagtattctgtgggca

SEQ ID NO: 753596 - DNA, 20 bp, mouse
gctggcgccccgcccacatt

SEQ ID NO: 753597 - DNA, 20 bp, mouse
gcggggctgcgaggaggacg

SEQ ID NO: 753598 - DNA, 20 bp, mouse
gacgcctgggtctcatggat

SEQ ID NO: 753599 - DNA, 20 bp, mouse
gtgcccgagcacgtgacctg

SEQ ID NO: 753600 - DNA, 20 bp, mouse
ggctcgggcaagctctcagc

SEQ ID NO: 753601 - DNA, 20 bp, mouse
gccacattaggattaccttc

SEQ ID NO: 753602 - DNA, 20 bp, mouse
ggatgtggctctcagttcgt

SEQ ID NO: 753603 - DNA, 20 bp, mouse
ggcggcgggcggtgcttcct

SEQ ID NO: 753604 - DNA, 20 bp, mouse
gcaggactcggcaggctcac

SEQ ID NO: 753605 - DNA, 20 bp, mouse
gtcggagcccagcggggaag

SEQ ID NO: 753606 - DNA, 20 bp, mouse
ggaagccccgaggttggcga

SEQ ID NO: 753607 - DNA, 20 bp, mouse
gggtctcgaagccccgaggt

SEQ ID NO: 753608 - DNA, 20 bp, mouse
gcctgggtctcgaagccccg

SEQ ID NO: 753609 - DNA, 20 bp, mouse
gttccccatcgccaacctcg

SEQ ID NO: 753610 - DNA, 20 bp, mouse
gacactccagaacaggtact

SEQ ID NO: 753611 - DNA, 20 bp, mouse
gtctggtgatccagaaactc

SEQ ID NO: 753612 - DNA, 20 bp, mouse
gatgtcccgagtacctgttc

SEQ ID NO: 753613 - DNA, 20 bp, mouse
gcgcgcgtcacgtccggcag

SEQ ID NO: 753614 - DNA, 20 bp, mouse
gagagtgagaataacttcag

SEQ ID NO: 753615 - DNA, 20 bp, mouse
gggtcctgacactccagaac

SEQ ID NO: 753616 - DNA, 20 bp, mouse
ggggacgagccctccctcgc

SEQ ID NO: 753617 - DNA, 20 bp, mouse
ggaggtgtggcgcccgagtt

SEQ ID NO: 753618 - DNA, 20 bp, mouse
gcgcccgtcctggtctccag

SEQ ID NO: 753619 - DNA, 20 bp, mouse
gcggaggatcacggtgtgaa

SEQ ID NO: 753620 - DNA, 20 bp, mouse
gttcccgagccagcgaggga

SEQ ID NO: 753621 - DNA, 20 bp, mouse
gctaattggctgtagtggag

SEQ ID NO: 753622 - DNA, 20 bp, mouse
ggcccgagttcggaggatca

SEQ ID NO: 753623 - DNA, 20 bp, mouse
gtgcgtaaggcgctgtggat

SEQ ID NO: 753624 - DNA, 20 bp, mouse
ggtgtggcgcccgagttcgg

SEQ ID NO: 753625 - DNA, 20 bp, mouse
gcaggacgggcgctgctaat

SEQ ID NO: 753626 - DNA, 20 bp, mouse
gtggaaaggcagctacgcgg

SEQ ID NO: 753627 - DNA, 20 bp, mouse
ggggcgccactgcaactcac

SEQ ID NO: 753628 - DNA, 20 bp, mouse
gaggctcttgtggagattag

SEQ ID NO: 753629 - DNA, 20 bp, mouse
gggagattagaggatcctaa

SEQ ID NO: 753630 - DNA, 20 bp, mouse
gtcagagcggagtcccctgg

SEQ ID NO: 753631 - DNA, 20 bp, mouse
gggcgcgctgggtgcatgtg

SEQ ID NO: 753632 - DNA, 20 bp, mouse
gaggggactccgctctgagc

SEQ ID NO: 753633 - DNA, 20 bp, mouse
ggaggagtcctgttgccctt

SEQ ID NO: 753634 - DNA, 20 bp, mouse
gcagcagggccctaggtgga

SEQ ID NO: 753635 - DNA, 20 bp, mouse
gctctggaaaggcagctacg

SEQ ID NO: 753636 - DNA, 20 bp, mouse
gcgggctcgctgtctccccg

SEQ ID NO: 753637 - DNA, 20 bp, mouse
ggggagacagcgagcccgat

SEQ ID NO: 753638 - DNA, 20 bp, mouse
gaatctgaggctatctcctt

SEQ ID NO: 753639 - DNA, 20 bp, mouse
gggaagtgggaagtccgatc

SEQ ID NO: 753640 - DNA, 20 bp, mouse
gagctcagataactgcagga

SEQ ID NO: 753641 - DNA, 20 bp, mouse
gaactgaggagccgccccaa

SEQ ID NO: 753642 - DNA, 20 bp, mouse
gagtaagtatcctgggacgg

SEQ ID NO: 753643 - DNA, 20 bp, mouse
gtctcctcgagcactggcgg

SEQ ID NO: 753644 - DNA, 20 bp, mouse
ggagatagcctcagattcat

SEQ ID NO: 753645 - DNA, 20 bp, mouse
ggagggcaaaggactaactg

SEQ ID NO: 753646 - DNA, 20 bp, mouse
gcgcccgcgcggagcaccat

SEQ ID NO: 753647 - DNA, 20 bp, mouse
gaagatgcgaccggaagctg

SEQ ID NO: 753648 - DNA, 20 bp, mouse
ggggaagagtgccgagcccg

SEQ ID NO: 753649 - DNA, 20 bp, mouse
gagctccgccgaggccgaaa

SEQ ID NO: 753650 - DNA, 20 bp, mouse
gagtgccgagcccgcggctc

SEQ ID NO: 753651 - DNA, 20 bp, mouse
gagcccgcggctccggcgga

SEQ ID NO: 753652 - DNA, 20 bp, mouse
gccgcggctccggcggaggg

SEQ ID NO: 753653 - DNA, 20 bp, mouse
ggggtagagagccgcttcca

SEQ ID NO: 753654 - DNA, 20 bp, mouse
ggcaccacagaccttggaag

SEQ ID NO: 753655 - DNA, 20 bp, mouse
gcgggcggcggctgttccgc

SEQ ID NO: 753656 - DNA, 20 bp, mouse
gcatccacaccacaacctac

SEQ ID NO: 753657 - DNA, 20 bp, mouse
gtacacaaaggcccgcacaa

SEQ ID NO: 753658 - DNA, 20 bp, mouse
gcgatcggctatggatagag

SEQ ID NO: 753659 - DNA, 20 bp, mouse
gtggcacaggcgatcggcta

SEQ ID NO: 753660 - DNA, 20 bp, mouse
gaacaaaggccaacaaagat

SEQ ID NO: 753661 - DNA, 20 bp, mouse
gagagtggcgggaatggctt

SEQ ID NO: 753662 - DNA, 20 bp, mouse
ggcgggaatggctttggaga

SEQ ID NO: 753663 - DNA, 20 bp, mouse
ggtgttgattatgtggtggt

SEQ ID NO: 753664 - DNA, 20 bp, mouse
ggtaaagtacatcttggctg

SEQ ID NO: 753665 - DNA, 20 bp, mouse
gaggggtgatgctttgcgtg

SEQ ID NO: 753666 - DNA, 20 bp, mouse
gacagcccagcgctgatcaa

SEQ ID NO: 753667 - DNA, 20 bp, mouse
ggacccggtcgcgcactctg

SEQ ID NO: 753668 - DNA, 20 bp, mouse
gtcctgtcccaggtgggcaa

SEQ ID NO: 753669 - DNA, 20 bp, mouse
ggaccgcagagtgcgcgacc

SEQ ID NO: 753670 - DNA, 20 bp, mouse
gtgactcgggtccccaccca

SEQ ID NO: 753671 - DNA, 20 bp, mouse
gtcctactggcccagaatct

SEQ ID NO: 753672 - DNA, 20 bp, mouse
ggaggcgccgcccctgggtg

SEQ ID NO: 753673 - DNA, 20 bp, mouse
gtcgcgcactctgcggtcat

SEQ ID NO: 753674 - DNA, 20 bp, mouse
gctcgaagctcgctgactca

SEQ ID NO: 753675 - DNA, 20 bp, mouse
gtggggacccgagtcacccg

SEQ ID NO: 753676 - DNA, 20 bp, mouse
gccaagtagccaatcagcga

SEQ ID NO: 753677 - DNA, 20 bp, mouse
gtccagagggcaatgcggag

SEQ ID NO: 753678 - DNA, 20 bp, mouse
gaacacgcttccgtcctgga

SEQ ID NO: 753679 - DNA, 20 bp, mouse
gcaagaacacgcttccgtcc

SEQ ID NO: 753680 - DNA, 20 bp, mouse
gtggaacagagtcatttcgg

SEQ ID NO: 753681 - DNA, 20 bp, mouse
gacctggaacagagtcattt

SEQ ID NO: 753682 - DNA, 20 bp, mouse
ggcctctccgcattgccctc

SEQ ID NO: 753683 - DNA, 20 bp, mouse
gtgtgcagaaatgccaagtc

SEQ ID NO: 753684 - DNA, 20 bp, mouse
ggtggactacaacttccaga

SEQ ID NO: 753685 - DNA, 20 bp, mouse
gtgtctcaaaggtgtaaccc

SEQ ID NO: 753686 - DNA, 20 bp, mouse
gcggcccctccatccagtgt

SEQ ID NO: 753687 - DNA, 20 bp, mouse
ggggccgcataggttagcct

SEQ ID NO: 753688 - DNA, 20 bp, mouse
gggcggagcgaagtgtacgc

SEQ ID NO: 753689 - DNA, 20 bp, mouse
gcggactgagcgcccagcga

SEQ ID NO: 753690 - DNA, 20 bp, mouse
gacctcttgtgtgacccggc

SEQ ID NO: 753691 - DNA, 20 bp, mouse
gtggggaaggccaccctgcc

SEQ ID NO: 753692 - DNA, 20 bp, mouse
gcgcatgcgctctgagtcac

SEQ ID NO: 753693 - DNA, 20 bp, mouse
ggtacctaggaagtctggat

SEQ ID NO: 753694 - DNA, 20 bp, mouse
gcgtacccacgcgacaacta

SEQ ID NO: 753695 - DNA, 20 bp, mouse
gctggatggaggggccgcat

SEQ ID NO: 753696 - DNA, 20 bp, mouse
ggcctctcgcagagccgtca

SEQ ID NO: 753697 - DNA, 20 bp, mouse
gacggctctgcgagaggcgc

SEQ ID NO: 753698 - DNA, 20 bp, mouse
ggacgtcccagtgtggtccc

SEQ ID NO: 753699 - DNA, 20 bp, mouse
ggtaccaaatctcggagcat

SEQ ID NO: 753700 - DNA, 20 bp, mouse
gccggggaagccgtcacgat

SEQ ID NO: 753701 - DNA, 20 bp, mouse
ggacttacgtcatccgacac

SEQ ID NO: 753702 - DNA, 20 bp, mouse
gaaatctcggagcatggggg

SEQ ID NO: 753703 - DNA, 20 bp, mouse
gtcggagcatgggggaggct

SEQ ID NO: 753704 - DNA, 20 bp, mouse
gagccgtcatggcttccacg

SEQ ID NO: 753705 - DNA, 20 bp, mouse
gagactgcgactcgcccccg

SEQ ID NO: 753706 - DNA, 20 bp, mouse
gcctcacagcactggagcag

SEQ ID NO: 753707 - DNA, 20 bp, mouse
ggacgtggggccattcctca

SEQ ID NO: 753708 - DNA, 20 bp, mouse
gtatctggcaagggtgacgt

SEQ ID NO: 753709 - DNA, 20 bp, mouse
gcttcccaagactggatcca

SEQ ID NO: 753710 - DNA, 20 bp, mouse
gccaagactggatccatgga

SEQ ID NO: 753711 - DNA, 20 bp, mouse
gagcaaaccctggtcatcaa

SEQ ID NO: 753712 - DNA, 20 bp, mouse
gccgaagggagaatctggga

SEQ ID NO: 753713 - DNA, 20 bp, mouse
gtcttgggaagggcatgtag

SEQ ID NO: 753714 - DNA, 20 bp, mouse
gctcccttcgggcttcttgg

SEQ ID NO: 753715 - DNA, 20 bp, mouse
gtccagtgctgtgaggggtt

SEQ ID NO: 753716 - DNA, 20 bp, mouse
gagggtgcgcggcgttgagg

SEQ ID NO: 753717 - DNA, 20 bp, mouse
ggcgttgaggcggggtgctg

SEQ ID NO: 753718 - DNA, 20 bp, mouse
gtgcccaatcgctagggcct

SEQ ID NO: 753719 - DNA, 20 bp, mouse
gcggtctatcagatgaacaa

SEQ ID NO: 753720 - DNA, 20 bp, mouse
gggcccaggccctagcgatt

SEQ ID NO: 753721 - DNA, 20 bp, mouse
gcaaatacgggtggaggccc

SEQ ID NO: 753722 - DNA, 20 bp, mouse
ggcagaaccctggtcactcg

SEQ ID NO: 753723 - DNA, 20 bp, mouse
gatgaacaatggtcaaatac

SEQ ID NO: 753724 - DNA, 20 bp, mouse
gccctggtcactcgtgggag

SEQ ID NO: 753725 - DNA, 20 bp, mouse
ggatgaggtgggtttatggg

SEQ ID NO: 753726 - DNA, 20 bp, mouse
ggtacggggaaaaaaggatg

SEQ ID NO: 753727 - DNA, 20 bp, mouse
gtggcgtgggcggagcagga

SEQ ID NO: 753728 - DNA, 20 bp, mouse
gtctaggcagagggattaca

SEQ ID NO: 753729 - DNA, 20 bp, mouse
gtacaaggtacggggaaaaa

SEQ ID NO: 753730 - DNA, 20 bp, mouse
ggcctagaccaggctaaagg

SEQ ID NO: 753731 - DNA, 20 bp, mouse
gtgagcagattctagagggt

SEQ ID NO: 753732 - DNA, 20 bp, mouse
gagagggattacaaggtacg

SEQ ID NO: 753733 - DNA, 20 bp, mouse
gttgcctaagagaactgata

SEQ ID NO: 753734 - DNA, 20 bp, mouse
ggaactgataaggatgaaag

SEQ ID NO: 753735 - DNA, 20 bp, mouse
gttagcctggtctaggcaga

SEQ ID NO: 753736 - DNA, 20 bp, mouse
gtacggagaccaggactcga

SEQ ID NO: 753737 - DNA, 20 bp, mouse
gccgaagcccggaagcgctg

SEQ ID NO: 753738 - DNA, 20 bp, mouse
ggatgggtgagaagcgtcag

SEQ ID NO: 753739 - DNA, 20 bp, mouse
gtcagtggtttggagttcaa

SEQ ID NO: 753740 - DNA, 20 bp, mouse
gagcccggaagcgctgtggc

SEQ ID NO: 753741 - DNA, 20 bp, mouse
ggtggctggttgactcggta

SEQ ID NO: 753742 - DNA, 20 bp, mouse
ggtaacggcgctggctcgcg

SEQ ID NO: 753743 - DNA, 20 bp, mouse
gagagatggctcgacggtaa

SEQ ID NO: 753744 - DNA, 20 bp, mouse
ggcgctgtggctggttgact

SEQ ID NO: 753745 - DNA, 20 bp, mouse
gtgaaagcgggatttccggt

SEQ ID NO: 753746 - DNA, 20 bp, mouse
gaggacccgcctctaagaca

SEQ ID NO: 753747 - DNA, 20 bp, mouse
ggtgccaggtgaggcaaccc

SEQ ID NO: 753748 - DNA, 20 bp, mouse
ggtgaggcaacccgggtcct

SEQ ID NO: 753749 - DNA, 20 bp, mouse
gtctaagacacggaagaagg

SEQ ID NO: 753750 - DNA, 20 bp, mouse
gaagctgcgggagcggttcc

SEQ ID NO: 753751 - DNA, 20 bp, mouse
gaaccgctcccgcagcttta

SEQ ID NO: 753752 - DNA, 20 bp, mouse
gttaaggctgcggagagtta

SEQ ID NO: 753753 - DNA, 20 bp, mouse
gctctggcatcgccaggctc

SEQ ID NO: 753754 - DNA, 20 bp, mouse
gcccgcccctgtgtgcattg

SEQ ID NO: 753755 - DNA, 20 bp, mouse
gcggggtctgacctaggacc

SEQ ID NO: 753756 - DNA, 20 bp, mouse
gagaatggggcgggacataa

SEQ ID NO: 753757 - DNA, 20 bp, mouse
gcaccggacgcagccaggat

SEQ ID NO: 753758 - DNA, 20 bp, mouse
gccaggatcggctgtgaagt

SEQ ID NO: 753759 - DNA, 20 bp, mouse
ggcactccggggagtcaata

SEQ ID NO: 753760 - DNA, 20 bp, mouse
gtggaaatctactaggtcga

SEQ ID NO: 753761 - DNA, 20 bp, mouse
gtcagtcaagggatgagcag

SEQ ID NO: 753762 - DNA, 20 bp, mouse
gagcccttggtacgcgaagt

SEQ ID NO: 753763 - DNA, 20 bp, mouse
gtgcggaggctccaccagaa

SEQ ID NO: 753764 - DNA, 20 bp, mouse
gggcccacttcgcgtaccaa

SEQ ID NO: 753765 - DNA, 20 bp, mouse
gcctggctgcgtccggtgga

SEQ ID NO: 753766 - DNA, 20 bp, mouse
ggtaacctggggatgatcgg

SEQ ID NO: 753767 - DNA, 20 bp, mouse
gcggaggcgagtctctggag

SEQ ID NO: 753768 - DNA, 20 bp, mouse
gtgccggccacctgcgtcga

SEQ ID NO: 753769 - DNA, 20 bp, mouse
gccacctgcgtcgacggcgg

SEQ ID NO: 753770 - DNA, 20 bp, mouse
gcgcgcctgcgcagctgtgc

SEQ ID NO: 753771 - DNA, 20 bp, mouse
gcccagctggagctcgttct

SEQ ID NO: 753772 - DNA, 20 bp, mouse
gcccgcccgggccaatccgg

SEQ ID NO: 753773 - DNA, 20 bp, mouse
ggtggccggcacagctgcgc

SEQ ID NO: 753774 - DNA, 20 bp, mouse
gccgcccccgccgtcgacgc

SEQ ID NO: 753775 - DNA, 20 bp, mouse
gggcccggagtccggaagtg

SEQ ID NO: 753776 - DNA, 20 bp, mouse
gtggacgtaggcgtgggcgt

SEQ ID NO: 753777 - DNA, 20 bp, mouse
gaggccgtacgcgtggacgt

SEQ ID NO: 753778 - DNA, 20 bp, mouse
gtacgcgtggacgtaggcgt

SEQ ID NO: 753779 - DNA, 20 bp, mouse
gtcagcgctgagaacaccag

SEQ ID NO: 753780 - DNA, 20 bp, mouse
gatgagaagagccacatagc

SEQ ID NO: 753781 - DNA, 20 bp, mouse
gagtgagtgccaggatactc

SEQ ID NO: 753782 - DNA, 20 bp, mouse
gccagcaagagggaagtctg

SEQ ID NO: 753783 - DNA, 20 bp, mouse
gtgagaacaccagggggcga

SEQ ID NO: 753784 - DNA, 20 bp, mouse
ggcctggctcacttgcagag

SEQ ID NO: 753785 - DNA, 20 bp, mouse
gtcaccgtgctaggcccttc

SEQ ID NO: 753786 - DNA, 20 bp, mouse
ggcgcgcgccctcacgtgat

SEQ ID NO: 753787 - DNA, 20 bp, mouse
gggaccggccaaacaagatc

SEQ ID NO: 753788 - DNA, 20 bp, mouse
gcacccggacgacccctcgt

SEQ ID NO: 753789 - DNA, 20 bp, mouse
gaatcagaaggtggagtctc

SEQ ID NO: 753790 - DNA, 20 bp, mouse
ggtcaggaaagcaggaagag

SEQ ID NO: 753791 - DNA, 20 bp, mouse
gtaaatggccgagaggggtc

SEQ ID NO: 753792 - DNA, 20 bp, mouse
gcacgtgaccggatcttgtt

SEQ ID NO: 753793 - DNA, 20 bp, mouse
gaaggtggagtctcagggcg

SEQ ID NO: 753794 - DNA, 20 bp, mouse
gggtccgcccccatcacgtg

SEQ ID NO: 753795 - DNA, 20 bp, mouse
ggaggcctccagcgcacctt

SEQ ID NO: 753796 - DNA, 20 bp, mouse
gctaaagagcagagctcgac

SEQ ID NO: 753797 - DNA, 20 bp, mouse
gtcccagcacccaggtccgg

SEQ ID NO: 753798 - DNA, 20 bp, mouse
ggcagcgcgcttggaaccac

SEQ ID NO: 753799 - DNA, 20 bp, mouse
ggtcaggtgacgctccatgg

SEQ ID NO: 753800 - DNA, 20 bp, mouse
gtcgactggattgtaataat

SEQ ID NO: 753801 - DNA, 20 bp, mouse
gtgacgctccatggaggcgg

SEQ ID NO: 753802 - DNA, 20 bp, mouse
gaatgggatagctttagcga

SEQ ID NO: 753803 - DNA, 20 bp, mouse
gaggtgacgctccatggagg

SEQ ID NO: 753804 - DNA, 20 bp, mouse
gtgggtgctggaccaaagga

SEQ ID NO: 753805 - DNA, 20 bp, mouse
gggttccaagcgcgctgcgg

SEQ ID NO: 753806 - DNA, 20 bp, mouse
gcagcaggtcaggcccgctc

SEQ ID NO: 753807 - DNA, 20 bp, mouse
ggcccgaggcggaaatgagt

SEQ ID NO: 753808 - DNA, 20 bp, mouse
gcctgcgcgcgcagcaggtc

SEQ ID NO: 753809 - DNA, 20 bp, mouse
gggaccttgagattgaagat

SEQ ID NO: 753810 - DNA, 20 bp, mouse
ggggcgcatgcgtaggtgag

SEQ ID NO: 753811 - DNA, 20 bp, mouse
gcgcgcaggacccaggcgtt

SEQ ID NO: 753812 - DNA, 20 bp, mouse
gcggccgcagcccgactggg

SEQ ID NO: 753813 - DNA, 20 bp, mouse
ggccccgcccacttccgggg

SEQ ID NO: 753814 - DNA, 20 bp, mouse
gacgcatgcgcccaacgcct

SEQ ID NO: 753815 - DNA, 20 bp, mouse
gcagcagaggcttgcccgag

SEQ ID NO: 753816 - DNA, 20 bp, mouse
gcgggaatgtggcaagagga

SEQ ID NO: 753817 - DNA, 20 bp, mouse
ggggaaagcgcgaggggagg

SEQ ID NO: 753818 - DNA, 20 bp, mouse
gaggggggatggcggtgcgt

SEQ ID NO: 753819 - DNA, 20 bp, mouse
ggaggagggagagcgtgcat

SEQ ID NO: 753820 - DNA, 20 bp, mouse
gagagcgtgcatgggatttc

SEQ ID NO: 753821 - DNA, 20 bp, mouse
gagcgggaaagcgcgagggg

SEQ ID NO: 753822 - DNA, 20 bp, mouse
gttagtcatgaagcctaagt

SEQ ID NO: 753823 - DNA, 20 bp, mouse
ggatttctggagtcccactt

SEQ ID NO: 753824 - DNA, 20 bp, mouse
gaattcttggcgtttgccat

SEQ ID NO: 753825 - DNA, 20 bp, mouse
gcccgcccctaattaattct

SEQ ID NO: 753826 - DNA, 20 bp, mouse
gaggggcggtggtggatcgc

SEQ ID NO: 753827 - DNA, 20 bp, mouse
gtggggtctggatacttaga

SEQ ID NO: 753828 - DNA, 20 bp, mouse
gaccctgctggcgtcatccg

SEQ ID NO: 753829 - DNA, 20 bp, mouse
ggggattggtagttcgacct

SEQ ID NO: 753830 - DNA, 20 bp, mouse
gcagccgccgcctcagccaa

SEQ ID NO: 753831 - DNA, 20 bp, mouse
gcccagaggcatgccgggat

SEQ ID NO: 753832 - DNA, 20 bp, mouse
gacttggcctaggagagcgc

SEQ ID NO: 753833 - DNA, 20 bp, mouse
ggtggtggatcgcgggcgtg

SEQ ID NO: 753834 - DNA, 20 bp, mouse
gacctcggatgacgccagca

SEQ ID NO: 753835 - DNA, 20 bp, mouse
gctgcgcccgtgccgcccag

SEQ ID NO: 753836 - DNA, 20 bp, mouse
gctagcacccgcctttactg

SEQ ID NO: 753837 - DNA, 20 bp, mouse
gggcggctgtccaatcatct

SEQ ID NO: 753838 - DNA, 20 bp, mouse
gcgggagccctcactgaaga

SEQ ID NO: 753839 - DNA, 20 bp, mouse
gcggctggagcgcacttgga

SEQ ID NO: 753840 - DNA, 20 bp, mouse
gaactctgggtcgtgaagac

SEQ ID NO: 753841 - DNA, 20 bp, mouse
gtggagcgcacttggagggc

SEQ ID NO: 753842 - DNA, 20 bp, mouse
gggcagacacgtcaccctgg

SEQ ID NO: 753843 - DNA, 20 bp, mouse
ggagtgtcactgctgacgtg

SEQ ID NO: 753844 - DNA, 20 bp, mouse
gcagacaagacggctaggat

SEQ ID NO: 753845 - DNA, 20 bp, mouse
ggggaaaggaagtgccgacg

SEQ ID NO: 753846 - DNA, 20 bp, mouse
gggactgtgagtatataagg

SEQ ID NO: 753847 - DNA, 20 bp, mouse
gaggaactccactaccccca

SEQ ID NO: 753848 - DNA, 20 bp, mouse
gttagcgactgatgtcattg

SEQ ID NO: 753849 - DNA, 20 bp, mouse
gacagtccagcgggcgtcat

SEQ ID NO: 753850 - DNA, 20 bp, mouse
gcgctaagataaccagacac

SEQ ID NO: 753851 - DNA, 20 bp, mouse
gtcattgggggctggttatc

SEQ ID NO: 753852 - DNA, 20 bp, mouse
gaattgtaacgagaatagta

SEQ ID NO: 753853 - DNA, 20 bp, mouse
gcgaaatgcacaggtcacac

SEQ ID NO: 753854 - DNA, 20 bp, mouse
gcataatgatgtcgccttga

SEQ ID NO: 753855 - DNA, 20 bp, mouse
ggctggactgtgagtatata

SEQ ID NO: 753856 - DNA, 20 bp, mouse
ggaaacgtgccgtggtgcac

SEQ ID NO: 753857 - DNA, 20 bp, mouse
ggcttcccggcggaaggacg

SEQ ID NO: 753858 - DNA, 20 bp, mouse
gcccggcggaaggacggggt

SEQ ID NO: 753859 - DNA, 20 bp, mouse
ggcaaccggaggccaatgga

SEQ ID NO: 753860 - DNA, 20 bp, mouse
ggcgccggatccggagcctg

SEQ ID NO: 753861 - DNA, 20 bp, mouse
ggcgcctccagccgccaaga

SEQ ID NO: 753862 - DNA, 20 bp, mouse
gtcaatgcgcctgtgcacca

SEQ ID NO: 753863 - DNA, 20 bp, mouse
gacatccgaagcagcggcgc

SEQ ID NO: 753864 - DNA, 20 bp, mouse
gtggcgggagcgcttcccgg

SEQ ID NO: 753865 - DNA, 20 bp, mouse
ggcagctggcgatccctacc

SEQ ID NO: 753866 - DNA, 20 bp, mouse
ggcacccagggtcggggtcc

SEQ ID NO: 753867 - DNA, 20 bp, mouse
gctgcgggtgaggtccaaga

SEQ ID NO: 753868 - DNA, 20 bp, mouse
gtggtcctgcctgtcagccc

SEQ ID NO: 753869 - DNA, 20 bp, mouse
gagcccaggggcagtgaacc

SEQ ID NO: 753870 - DNA, 20 bp, mouse
gcgcccaggtgtcttctgat

SEQ ID NO: 753871 - DNA, 20 bp, mouse
ggtccaggttcactgcccct

SEQ ID NO: 753872 - DNA, 20 bp, mouse
gagccaggtacggcctgacg

SEQ ID NO: 753873 - DNA, 20 bp, mouse
ggctgacaggcaggaccata

SEQ ID NO: 753874 - DNA, 20 bp, mouse
gcaacgctacgagccaggta

SEQ ID NO: 753875 - DNA, 20 bp, mouse
gggatgtgatcactagagag

SEQ ID NO: 753876 - DNA, 20 bp, mouse
gtaccaggtacgtagggcaa

SEQ ID NO: 753877 - DNA, 20 bp, mouse
ggccctacgtacctggtaga

SEQ ID NO: 753878 - DNA, 20 bp, mouse
ggggcaagggctaacagggc

SEQ ID NO: 753879 - DNA, 20 bp, mouse
gaccactccaggtgtatcag

SEQ ID NO: 753880 - DNA, 20 bp, mouse
gaggtcggggctcccagaca

SEQ ID NO: 753881 - DNA, 20 bp, mouse
gaggtgtatcagagggtatc

SEQ ID NO: 753882 - DNA, 20 bp, mouse
gagcccttgccctacgtacc

SEQ ID NO: 753883 - DNA, 20 bp, mouse
gaccaatcaggaaccgactt

SEQ ID NO: 753884 - DNA, 20 bp, mouse
gccctctgatacacctggag

SEQ ID NO: 753885 - DNA, 20 bp, mouse
gctaccagataagagtcgta

SEQ ID NO: 753886 - DNA, 20 bp, mouse
gcctggaggtctctggagag

SEQ ID NO: 753887 - DNA, 20 bp, mouse
gacaaagatggcacgaaaga

SEQ ID NO: 753888 - DNA, 20 bp, mouse
ggtgaggggcccagtgtttt

SEQ ID NO: 753889 - DNA, 20 bp, mouse
gaagatctgaaagagaggtg

SEQ ID NO: 753890 - DNA, 20 bp, mouse
ggggctggaccaatggggag

SEQ ID NO: 753891 - DNA, 20 bp, mouse
gggccaaagatctgaaagag

SEQ ID NO: 753892 - DNA, 20 bp, mouse
gaagtggctaccctctctaa

SEQ ID NO: 753893 - DNA, 20 bp, mouse
gactgggcccctcacaaaga

SEQ ID NO: 753894 - DNA, 20 bp, mouse
ggtgggcagcaagttcttca

SEQ ID NO: 753895 - DNA, 20 bp, mouse
gcgaaagagggctggaccaa

SEQ ID NO: 753896 - DNA, 20 bp, mouse
gccagccaaaggggacttga

SEQ ID NO: 753897 - DNA, 20 bp, mouse
gcagtcttggccagccaaag

SEQ ID NO: 753898 - DNA, 20 bp, mouse
ggcgcaagcgcactgctcta

SEQ ID NO: 753899 - DNA, 20 bp, mouse
gcggccgagggcacctggtc

SEQ ID NO: 753900 - DNA, 20 bp, mouse
ggagacgggcgacacggccg

SEQ ID NO: 753901 - DNA, 20 bp, mouse
gttggcagctccactatccc

SEQ ID NO: 753902 - DNA, 20 bp, mouse
gacgcatgcgcagatggtac

SEQ ID NO: 753903 - DNA, 20 bp, mouse
gatagtggagctgccaactc

SEQ ID NO: 753904 - DNA, 20 bp, mouse
gtcaccgggagggagagcaa

SEQ ID NO: 753905 - DNA, 20 bp, mouse
gggtagccgcgaccctgacc

SEQ ID NO: 753906 - DNA, 20 bp, mouse
gggccagtactgtttaacgg

SEQ ID NO: 753907 - DNA, 20 bp, mouse
ggtgacgtgaacttttgggc

SEQ ID NO: 753908 - DNA, 20 bp, mouse
ggattgaagaattagttgga

SEQ ID NO: 753909 - DNA, 20 bp, mouse
gagtagtgatagcacagatg

SEQ ID NO: 753910 - DNA, 20 bp, mouse
gttcccccgttaaacagtac

SEQ ID NO: 753911 - DNA, 20 bp, mouse
gggaaggtgacgtgaacttt

SEQ ID NO: 753912 - DNA, 20 bp, mouse
gtttgagaatcaaggaagaa

SEQ ID NO: 753913 - DNA, 20 bp, mouse
ggcaggccagtactgtttaa

SEQ ID NO: 753914 - DNA, 20 bp, mouse
ggggagtgatttaatgcagc

SEQ ID NO: 753915 - DNA, 20 bp, mouse
ggtgctatcactactccaca

SEQ ID NO: 753916 - DNA, 20 bp, mouse
gaggatgagtcgcaactggg

SEQ ID NO: 753917 - DNA, 20 bp, mouse
gcggggcggggtctagccgg

SEQ ID NO: 753918 - DNA, 20 bp, mouse
gtgaatgaggcagacgtcaa

SEQ ID NO: 753919 - DNA, 20 bp, mouse
gttggggagaggagtgaatg

SEQ ID NO: 753920 - DNA, 20 bp, mouse
gcaggaggatgagtcgcaac

SEQ ID NO: 753921 - DNA, 20 bp, mouse
gaggaagagtcacaagcctt

SEQ ID NO: 753922 - DNA, 20 bp, mouse
ggaaagcctctaatcctctg

SEQ ID NO: 753923 - DNA, 20 bp, mouse
gctgcctgctgggatatggg

SEQ ID NO: 753924 - DNA, 20 bp, mouse
gcccagcaggcagtgcagtc

SEQ ID NO: 753925 - DNA, 20 bp, mouse
gaggaaggaaaggcgggccc

SEQ ID NO: 753926 - DNA, 20 bp, mouse
gctaccccggacaacactat

SEQ ID NO: 753927 - DNA, 20 bp, mouse
ggctacttggggcgggacac

SEQ ID NO: 753928 - DNA, 20 bp, mouse
ggtgccaggaggtcgtcgga

SEQ ID NO: 753929 - DNA, 20 bp, mouse
gaccggtgccaggaggtcgt

SEQ ID NO: 753930 - DNA, 20 bp, mouse
ggggaggggcggagcctccg

SEQ ID NO: 753931 - DNA, 20 bp, mouse
gaaaagcatcagagtgctcc

SEQ ID NO: 753932 - DNA, 20 bp, mouse
gtgctccaggctacttgggg

SEQ ID NO: 753933 - DNA, 20 bp, mouse
gccaggaggtcgtcggaagg

SEQ ID NO: 753934 - DNA, 20 bp, mouse
gcgggaataagtgctctgct

SEQ ID NO: 753935 - DNA, 20 bp, mouse
gctcccacttgcttctctaa

SEQ ID NO: 753936 - DNA, 20 bp, mouse
gaaaaggcgtggtcagaaac

SEQ ID NO: 753937 - DNA, 20 bp, mouse
gaaaccggaagacccggatt

SEQ ID NO: 753938 - DNA, 20 bp, mouse
ggcgtggtcagaaacagggc

SEQ ID NO: 753939 - DNA, 20 bp, mouse
ggggaagcgacgaggcggga

SEQ ID NO: 753940 - DNA, 20 bp, mouse
ggtacggcggaagtgcataa

SEQ ID NO: 753941 - DNA, 20 bp, mouse
gcttcccaatccgggtcttc

SEQ ID NO: 753942 - DNA, 20 bp, mouse
gtcaaagagcagagtccgtc

SEQ ID NO: 753943 - DNA, 20 bp, mouse
ggtacggcctctcttattgg

SEQ ID NO: 753944 - DNA, 20 bp, mouse
ggcagagtccgtcaggagat

SEQ ID NO: 753945 - DNA, 20 bp, mouse
gagtacaagcggctgttcac

SEQ ID NO: 753946 - DNA, 20 bp, mouse
ggaccttggagcctcagcta

SEQ ID NO: 753947 - DNA, 20 bp, mouse
gggctctggagagtgggcgt

SEQ ID NO: 753948 - DNA, 20 bp, mouse
gtgcagccgacccatgtccg

SEQ ID NO: 753949 - DNA, 20 bp, mouse
gcgaacgtggatatcgcctg

SEQ ID NO: 753950 - DNA, 20 bp, mouse
gtggggccccctaaacagcc

SEQ ID NO: 753951 - DNA, 20 bp, mouse
gcagagccccggacatgggt

SEQ ID NO: 753952 - DNA, 20 bp, mouse
ggggtcggctgcagctggac

SEQ ID NO: 753953 - DNA, 20 bp, mouse
gagggcagagccccggacat

SEQ ID NO: 753954 - DNA, 20 bp, mouse
gggagggagctcggggtaag

SEQ ID NO: 753955 - DNA, 20 bp, mouse
gctgaggctccaaggtcctc

SEQ ID NO: 753956 - DNA, 20 bp, mouse
ggctaaccgccaacctctcg

SEQ ID NO: 753957 - DNA, 20 bp, mouse
ggagcctcgtggaatataca

SEQ ID NO: 753958 - DNA, 20 bp, mouse
gagagggtggcgctttgtgc

SEQ ID NO: 753959 - DNA, 20 bp, mouse
gagcacgtgaaggagcatgg

SEQ ID NO: 753960 - DNA, 20 bp, mouse
gggtccctgtatattccacg

SEQ ID NO: 753961 - DNA, 20 bp, mouse
ggcctggcatgcgcagtgtg

SEQ ID NO: 753962 - DNA, 20 bp, mouse
ggaatatacagggaccccat

SEQ ID NO: 753963 - DNA, 20 bp, mouse
gtcctcgtgcaagagatgag

SEQ ID NO: 753964 - DNA, 20 bp, mouse
ggcagatgcaagaaccccat

SEQ ID NO: 753965 - DNA, 20 bp, mouse
ggttagccacgagaggttgg

SEQ ID NO: 753966 - DNA, 20 bp, mouse
gacccagccgggtagaagaa

SEQ ID NO: 753967 - DNA, 20 bp, mouse
gccctcccatggtcccgaga

SEQ ID NO: 753968 - DNA, 20 bp, mouse
gtggcagcaggtggatgcct

SEQ ID NO: 753969 - DNA, 20 bp, mouse
gagggacctaggaaaggaat

SEQ ID NO: 753970 - DNA, 20 bp, mouse
gtaggacccagaaccagcgg

SEQ ID NO: 753971 - DNA, 20 bp, mouse
gaatcgatgtgcagactggg

SEQ ID NO: 753972 - DNA, 20 bp, mouse
gcagccgggtagaagaaagg

SEQ ID NO: 753973 - DNA, 20 bp, mouse
ggggaaaatctggggtgcgg

SEQ ID NO: 753974 - DNA, 20 bp, mouse
gcccggggcggtcccaagtt

SEQ ID NO: 753975 - DNA, 20 bp, mouse
ggatacacggtggcagcagg

SEQ ID NO: 753976 - DNA, 20 bp, mouse
gtccagggaggacacagagt

SEQ ID NO: 753977 - DNA, 20 bp, mouse
gagaacctccttgactttac

SEQ ID NO: 753978 - DNA, 20 bp, mouse
ggtagggtagatatggagga

SEQ ID NO: 753979 - DNA, 20 bp, mouse
gtgtcctccctggacacttg

SEQ ID NO: 753980 - DNA, 20 bp, mouse
gtggaggagggaggtgttaa

SEQ ID NO: 753981 - DNA, 20 bp, mouse
gcttgagccacaagtgtcca

SEQ ID NO: 753982 - DNA, 20 bp, mouse
gaacagaggtagggtagata

SEQ ID NO: 753983 - DNA, 20 bp, mouse
ggggaaagggtgtattccag

SEQ ID NO: 753984 - DNA, 20 bp, mouse
ggccaggcacagtgccatgt

SEQ ID NO: 753985 - DNA, 20 bp, mouse
gggcaccactctgtacacag

SEQ ID NO: 753986 - DNA, 20 bp, mouse
gccgccgggcccttttacga

SEQ ID NO: 753987 - DNA, 20 bp, mouse
gcggcggcccggacgactgg

SEQ ID NO: 753988 - DNA, 20 bp, mouse
gcggggctgccgtcgtaaaa

SEQ ID NO: 753989 - DNA, 20 bp, mouse
ggacgactggcggttgctag

SEQ ID NO: 753990 - DNA, 20 bp, mouse
gggggcaaagggacaggcga

SEQ ID NO: 753991 - DNA, 20 bp, mouse
gccgccccgagggcaggcgg

SEQ ID NO: 753992 - DNA, 20 bp, mouse
gcaccccccgcctgccctcg

SEQ ID NO: 753993 - DNA, 20 bp, mouse
ggaagcctgcccaggacccc

SEQ ID NO: 753994 - DNA, 20 bp, mouse
gcgcagagcgcgtccgggat

SEQ ID NO: 753995 - DNA, 20 bp, mouse
gcggttgctaggggctgcga

SEQ ID NO: 753996 - DNA, 20 bp, mouse
gagcgggttggggagaccga

SEQ ID NO: 753997 - DNA, 20 bp, mouse
gaggcgttgcgcaagcttaa

SEQ ID NO: 753998 - DNA, 20 bp, mouse
gtggcctcacagagcggaag

SEQ ID NO: 753999 - DNA, 20 bp, mouse
gccggcccgcctcctgcgag

SEQ ID NO: 754000 - DNA, 20 bp, mouse
ggccggaaggagatgatttc

SEQ ID NO: 754001 - DNA, 20 bp, mouse
gctcgcccgcctagctctag

SEQ ID NO: 754002 - DNA, 20 bp, mouse
gggggccgctagagctaggc

SEQ ID NO: 754003 - DNA, 20 bp, mouse
gagctctagcggccccagca

SEQ ID NO: 754004 - DNA, 20 bp, mouse
ggaggccagccaattagagc

SEQ ID NO: 754005 - DNA, 20 bp, mouse
gcgcctcctgcgagcgggtt

SEQ ID NO: 754006 - DNA, 20 bp, mouse
gcgggcgagcatcacggaga

SEQ ID NO: 754007 - DNA, 20 bp, mouse
gaggaggcgggcgagcatca

SEQ ID NO: 754008 - DNA, 20 bp, mouse
gcgcgcacaaaagcctgcct

SEQ ID NO: 754009 - DNA, 20 bp, mouse
gcatgcgcggcgcggataaa

SEQ ID NO: 754010 - DNA, 20 bp, mouse
ggctcgcccgcctcctctag

SEQ ID NO: 754011 - DNA, 20 bp, mouse
gacaagatggcgtacatgca

SEQ ID NO: 754012 - DNA, 20 bp, mouse
ggacctgtgtcccctagagg

SEQ ID NO: 754013 - DNA, 20 bp, mouse
gcaggggggacagggcgagg

SEQ ID NO: 754014 - DNA, 20 bp, mouse
gcgtacatgcaggggggaca

SEQ ID NO: 754015 - DNA, 20 bp, mouse
gaagagcagccctggcctcg

SEQ ID NO: 754016 - DNA, 20 bp, mouse
ggggtgacggacaagcgcga

SEQ ID NO: 754017 - DNA, 20 bp, mouse
ggccgccgagatggaacgac

SEQ ID NO: 754018 - DNA, 20 bp, mouse
gcgcgaaggcggcggggcgt

SEQ ID NO: 754019 - DNA, 20 bp, mouse
gcccgggcccgcgtgggtga

SEQ ID NO: 754020 - DNA, 20 bp, mouse
gtgacggacaagcgcgaagg

SEQ ID NO: 754021 - DNA, 20 bp, mouse
ggctgggccgcgcccctgat

SEQ ID NO: 754022 - DNA, 20 bp, mouse
gggggcgcgctggccaatca

SEQ ID NO: 754023 - DNA, 20 bp, mouse
ggacaagcgcgaaggcggcg

SEQ ID NO: 754024 - DNA, 20 bp, mouse
gcgggcccgggcccgtgcgc

SEQ ID NO: 754025 - DNA, 20 bp, mouse
gcagccccgcggcctccggg

SEQ ID NO: 754026 - DNA, 20 bp, mouse
gttggagatagacttatcta

SEQ ID NO: 754027 - DNA, 20 bp, mouse
gacacagagtagcctggagg

SEQ ID NO: 754028 - DNA, 20 bp, mouse
gctcacaaagcatgcatctg

SEQ ID NO: 754029 - DNA, 20 bp, mouse
ggttctgggcatcctgggtg

SEQ ID NO: 754030 - DNA, 20 bp, mouse
gggtgagggttcccagcaaa

SEQ ID NO: 754031 - DNA, 20 bp, mouse
gttacacttttgttctcagg

SEQ ID NO: 754032 - DNA, 20 bp, mouse
gcattggtacactgaagttg

SEQ ID NO: 754033 - DNA, 20 bp, mouse
gcacaagcacggatgctcct

SEQ ID NO: 754034 - DNA, 20 bp, mouse
gtccaggctactctgtgtca

SEQ ID NO: 754035 - DNA, 20 bp, mouse
gatctagggctgaactgctc

SEQ ID NO: 754036 - DNA, 20 bp, mouse
gaggcggagcgaggactcta

SEQ ID NO: 754037 - DNA, 20 bp, mouse
gaggactctaggggcgggac

SEQ ID NO: 754038 - DNA, 20 bp, mouse
gcagaaggcatgtagcgcgg

SEQ ID NO: 754039 - DNA, 20 bp, mouse
ggccaccggaagcgcggaga

SEQ ID NO: 754040 - DNA, 20 bp, mouse
gtggaaggaatctgcagaag

SEQ ID NO: 754041 - DNA, 20 bp, mouse
ggagcgaggactctaggggc

SEQ ID NO: 754042 - DNA, 20 bp, mouse
gacccttgaaaattcagtcc

SEQ ID NO: 754043 - DNA, 20 bp, mouse
gaacccaggttctctagatc

SEQ ID NO: 754044 - DNA, 20 bp, mouse
gttcagagaggatgtcttga

SEQ ID NO: 754045 - DNA, 20 bp, mouse
ggaaccagatctagagaacc

SEQ ID NO: 754046 - DNA, 20 bp, mouse
gggcgtgtcaaagctgaagt

SEQ ID NO: 754047 - DNA, 20 bp, mouse
ggggcggggcgtgagacctg

SEQ ID NO: 754048 - DNA, 20 bp, mouse
ggaccaatggctcttttcgg

SEQ ID NO: 754049 - DNA, 20 bp, mouse
ggggacggggcgcgagtccg

SEQ ID NO: 754050 - DNA, 20 bp, mouse
gagccgcaaacacttctatt

SEQ ID NO: 754051 - DNA, 20 bp, mouse
gtgactgacggcgggacgag

SEQ ID NO: 754052 - DNA, 20 bp, mouse
gcaatcacgcgacaccactg

SEQ ID NO: 754053 - DNA, 20 bp, mouse
gacttctattgggcatgcgt

SEQ ID NO: 754054 - DNA, 20 bp, mouse
gttgggcatgcgtaggggtg

SEQ ID NO: 754055 - DNA, 20 bp, mouse
gataggccggaacctgtgtg

SEQ ID NO: 754056 - DNA, 20 bp, mouse
gtagggcggggcagcgcgat

SEQ ID NO: 754057 - DNA, 20 bp, mouse
ggatgggtgtgcctaatcgg

SEQ ID NO: 754058 - DNA, 20 bp, mouse
ggcagctccgagcactaggg

SEQ ID NO: 754059 - DNA, 20 bp, mouse
ggcggggcgactgcgattca

SEQ ID NO: 754060 - DNA, 20 bp, mouse
gcgcgatgggtgtgcctaat

SEQ ID NO: 754061 - DNA, 20 bp, mouse
ggggcgtggcaacggcgcgg

SEQ ID NO: 754062 - DNA, 20 bp, mouse
gaagagctgtggtaagagct

SEQ ID NO: 754063 - DNA, 20 bp, mouse
gaggacgctggagctgtagg

SEQ ID NO: 754064 - DNA, 20 bp, mouse
gactgcgattcagggtccca

SEQ ID NO: 754065 - DNA, 20 bp, mouse
gccagggctaaactcaggaa

SEQ ID NO: 754066 - DNA, 20 bp, mouse
gaggcaagccagccaattgt

SEQ ID NO: 754067 - DNA, 20 bp, mouse
gcacgcaaaggcgcgctccc

SEQ ID NO: 754068 - DNA, 20 bp, mouse
gtcccctggggagactgcga

SEQ ID NO: 754069 - DNA, 20 bp, mouse
gggcgggtcgacggactctg

SEQ ID NO: 754070 - DNA, 20 bp, mouse
gcgcgctccccggctccctg

SEQ ID NO: 754071 - DNA, 20 bp, mouse
ggcctcagggaagagcggaa

SEQ ID NO: 754072 - DNA, 20 bp, mouse
gagaacggccaatcacgcaa

SEQ ID NO: 754073 - DNA, 20 bp, mouse
ggagttcacgggaagtggat

SEQ ID NO: 754074 - DNA, 20 bp, mouse
gaagtggatgggcgggtcga

SEQ ID NO: 754075 - DNA, 20 bp, mouse
gagagcggaagggctcccct

SEQ ID NO: 754076 - DNA, 20 bp, mouse
gttgctccccacagctgaat

SEQ ID NO: 754077 - DNA, 20 bp, mouse
ggactctctaaggataacca

SEQ ID NO: 754078 - DNA, 20 bp, mouse
gtcaaacccattcagctgtg

SEQ ID NO: 754079 - DNA, 20 bp, mouse
ggggaaagcagggtagaagt

SEQ ID NO: 754080 - DNA, 20 bp, mouse
gtggaactaactcagtgacc

SEQ ID NO: 754081 - DNA, 20 bp, mouse
gaaaaattgtcaggcacctg

SEQ ID NO: 754082 - DNA, 20 bp, mouse
gcgaaaaactggcaaggcac

SEQ ID NO: 754083 - DNA, 20 bp, mouse
gcagcacttgaagggaaagc

SEQ ID NO: 754084 - DNA, 20 bp, mouse
gatgaaaattaacatcaaac

SEQ ID NO: 754085 - DNA, 20 bp, mouse
gtagcaacgaaaaactggca

SEQ ID NO: 754086 - DNA, 20 bp, mouse
gcgcgcgtcaggggaaacta

SEQ ID NO: 754087 - DNA, 20 bp, mouse
gcgtcaggggaaactagggg

SEQ ID NO: 754088 - DNA, 20 bp, mouse
ggtaggctgggagaagccgt

SEQ ID NO: 754089 - DNA, 20 bp, mouse
ggagggcagggcgacgccgg

SEQ ID NO: 754090 - DNA, 20 bp, mouse
gagagagggcagggcgacgc

SEQ ID NO: 754091 - DNA, 20 bp, mouse
gggccaagacctctgctgat

SEQ ID NO: 754092 - DNA, 20 bp, mouse
ggtgcgcagttgatgagaat

SEQ ID NO: 754093 - DNA, 20 bp, mouse
gaccgaggatgggaaatcta

SEQ ID NO: 754094 - DNA, 20 bp, mouse
gctgcacgcacgcgcgtcag

SEQ ID NO: 754095 - DNA, 20 bp, mouse
gcgtgcagctcgctccagag

SEQ ID NO: 754096 - DNA, 20 bp, mouse
ggggcctttagtctagagaa

SEQ ID NO: 754097 - DNA, 20 bp, mouse
gccgcgcgcagaaaaagcgg

SEQ ID NO: 754098 - DNA, 20 bp, mouse
gtgctcagggaagaggcggt

SEQ ID NO: 754099 - DNA, 20 bp, mouse
gctgttgaaatcaagagtta

SEQ ID NO: 754100 - DNA, 20 bp, mouse
ggctccgcgcgcagaaaaag

SEQ ID NO: 754101 - DNA, 20 bp, mouse
gtttacatacgggtaaaaga

SEQ ID NO: 754102 - DNA, 20 bp, mouse
gtcctgactgctcagggaag

SEQ ID NO: 754103 - DNA, 20 bp, mouse
gagaaaaagcggaggctgct

SEQ ID NO: 754104 - DNA, 20 bp, mouse
ggagaccagccctgttacaa

SEQ ID NO: 754105 - DNA, 20 bp, mouse
gagttctcagtatttacata

SEQ ID NO: 754106 - DNA, 20 bp, mouse
ggggcccatccagaccacac

SEQ ID NO: 754107 - DNA, 20 bp, mouse
gctggcccctggccccagtg

SEQ ID NO: 754108 - DNA, 20 bp, mouse
gccctggccccagtgtggtc

SEQ ID NO: 754109 - DNA, 20 bp, mouse
gtggggccaggggccagagg

SEQ ID NO: 754110 - DNA, 20 bp, mouse
ggtctggatgggccccagag

SEQ ID NO: 754111 - DNA, 20 bp, mouse
gtggggcccagcttcctgaa

SEQ ID NO: 754112 - DNA, 20 bp, mouse
ggaacctgaggggctggccc

SEQ ID NO: 754113 - DNA, 20 bp, mouse
ggccccagtgtggtctggat

SEQ ID NO: 754114 - DNA, 20 bp, mouse
gacgtggggctgtatctgac

SEQ ID NO: 754115 - DNA, 20 bp, mouse
ggaagccatgagccttctgt

SEQ ID NO: 754116 - DNA, 20 bp, mouse
gaggaggaaagactgtaaag

SEQ ID NO: 754117 - DNA, 20 bp, mouse
gcactcaatggaagaatggt

SEQ ID NO: 754118 - DNA, 20 bp, mouse
gcggaagcggagggcgtggt

SEQ ID NO: 754119 - DNA, 20 bp, mouse
ggggccgagtgagactgagg

SEQ ID NO: 754120 - DNA, 20 bp, mouse
ggacgactgtgctcgtgctg

SEQ ID NO: 754121 - DNA, 20 bp, mouse
gtgcaagagggcaggtaaac

SEQ ID NO: 754122 - DNA, 20 bp, mouse
gtgggcggggaagagtgcga

SEQ ID NO: 754123 - DNA, 20 bp, mouse
ggcacgagcacagtcgtcaa

SEQ ID NO: 754124 - DNA, 20 bp, mouse
gggcgtgcgggttccgaaga

SEQ ID NO: 754125 - DNA, 20 bp, mouse
ggacccccagtacacgaaga

SEQ ID NO: 754126 - DNA, 20 bp, mouse
ggggcggaggggatacggag

SEQ ID NO: 754127 - DNA, 20 bp, mouse
gtgggcaggcccaagaccta

SEQ ID NO: 754128 - DNA, 20 bp, mouse
gcggggacacagcagtctat

SEQ ID NO: 754129 - DNA, 20 bp, mouse
gcgaaactaaagctggaggt

SEQ ID NO: 754130 - DNA, 20 bp, mouse
ggaggggatacggagcggtt

SEQ ID NO: 754131 - DNA, 20 bp, mouse
gaactaaagctggaggttgg

SEQ ID NO: 754132 - DNA, 20 bp, mouse
gtgccgggacacagcgtcca

SEQ ID NO: 754133 - DNA, 20 bp, mouse
gcactggagttggagcgatc

SEQ ID NO: 754134 - DNA, 20 bp, mouse
gcactcggaggaggctgtgc

SEQ ID NO: 754135 - DNA, 20 bp, mouse
gtagctggtggcctcgagta

SEQ ID NO: 754136 - DNA, 20 bp, mouse
ggctgaggagacaggaaatc

SEQ ID NO: 754137 - DNA, 20 bp, mouse
gcctcactaaggttggagtg

SEQ ID NO: 754138 - DNA, 20 bp, mouse
gtgcctgaagataagaggaa

SEQ ID NO: 754139 - DNA, 20 bp, mouse
gggctccaggctcgggacaa

SEQ ID NO: 754140 - DNA, 20 bp, mouse
gggggggtcctcactaaggt

SEQ ID NO: 754141 - DNA, 20 bp, mouse
gttaggcttctcaggaagaa

SEQ ID NO: 754142 - DNA, 20 bp, mouse
gcagagctggttgtggttaa

SEQ ID NO: 754143 - DNA, 20 bp, mouse
gtcagccccactgagagctg

SEQ ID NO: 754144 - DNA, 20 bp, mouse
gcctacctccggagaccctg

SEQ ID NO: 754145 - DNA, 20 bp, mouse
gaaggacccagagctgattt

SEQ ID NO: 754146 - DNA, 20 bp, mouse
gacaaggaaggccaaggcgt

SEQ ID NO: 754147 - DNA, 20 bp, mouse
gtgggcttaggggcgggcca

SEQ ID NO: 754148 - DNA, 20 bp, mouse
gctggctgcgcatctcgaca

SEQ ID NO: 754149 - DNA, 20 bp, mouse
gcgcagaggcgtggttagag

SEQ ID NO: 754150 - DNA, 20 bp, mouse
gggaaggccaaggcgtgggt

SEQ ID NO: 754151 - DNA, 20 bp, mouse
gccaaggcgtgggtgggctt

SEQ ID NO: 754152 - DNA, 20 bp, mouse
gtagactaaggcggcggagg

SEQ ID NO: 754153 - DNA, 20 bp, mouse
gcgtgggtgggcttaggggc

SEQ ID NO: 754154 - DNA, 20 bp, mouse
gtggagagtaggcggagcgt

SEQ ID NO: 754155 - DNA, 20 bp, mouse
gtaaggcggcggaggaggca

SEQ ID NO: 754156 - DNA, 20 bp, mouse
gctcccaggagcaggcgggt

SEQ ID NO: 754157 - DNA, 20 bp, mouse
gcggggaagtggtggttaac

SEQ ID NO: 754158 - DNA, 20 bp, mouse
gagagggctgggacacggaa

SEQ ID NO: 754159 - DNA, 20 bp, mouse
gaaaggagagggctgggaca

SEQ ID NO: 754160 - DNA, 20 bp, mouse
gaggtctcctaggagcgaag

SEQ ID NO: 754161 - DNA, 20 bp, mouse
gctgggacacggaagggacg

SEQ ID NO: 754162 - DNA, 20 bp, mouse
gcactgtaaagtaatctccc

SEQ ID NO: 754163 - DNA, 20 bp, mouse
ggctagccgcgctcttaaag

SEQ ID NO: 754164 - DNA, 20 bp, mouse
ggactaagcggtcccgttaa

SEQ ID NO: 754165 - DNA, 20 bp, mouse
gaggaccaacgtgtgttact

SEQ ID NO: 754166 - DNA, 20 bp, mouse
gcagcgcccccggctcccgg

SEQ ID NO: 754167 - DNA, 20 bp, mouse
gaggccccgcccagcgcccc

SEQ ID NO: 754168 - DNA, 20 bp, mouse
gtgggcggggcctgcgaggg

SEQ ID NO: 754169 - DNA, 20 bp, mouse
gtgcaaaatcggattctcgg

SEQ ID NO: 754170 - DNA, 20 bp, mouse
gcggcggagcaggtgtccac

SEQ ID NO: 754171 - DNA, 20 bp, mouse
gccccgcaggcccccctcgc

SEQ ID NO: 754172 - DNA, 20 bp, mouse
ggcccagcgcccccggctcc

SEQ ID NO: 754173 - DNA, 20 bp, mouse
ggggtcggggcagcgcgcac

SEQ ID NO: 754174 - DNA, 20 bp, mouse
gggagcttcaaagccaaacg

SEQ ID NO: 754175 - DNA, 20 bp, mouse
gtgagagccccgcaagtgcc

SEQ ID NO: 754176 - DNA, 20 bp, mouse
gacagctagggctgctgcgg

SEQ ID NO: 754177 - DNA, 20 bp, mouse
gtgtgagagaaagctcactg

SEQ ID NO: 754178 - DNA, 20 bp, mouse
ggaaatattaagggcttgta

SEQ ID NO: 754179 - DNA, 20 bp, mouse
gagccctagctgtccctgca

SEQ ID NO: 754180 - DNA, 20 bp, mouse
gtgcccttgcaggctaaccc

SEQ ID NO: 754181 - DNA, 20 bp, mouse
gtggttatacacacagtttg

SEQ ID NO: 754182 - DNA, 20 bp, mouse
gaagctctgtgcatcctctt

SEQ ID NO: 754183 - DNA, 20 bp, mouse
gggaaagggagcccccagac

SEQ ID NO: 754184 - DNA, 20 bp, mouse
ggaacacatctgcggggcat

SEQ ID NO: 754185 - DNA, 20 bp, mouse
ggtaggaaagatttgaaggg

SEQ ID NO: 754186 - DNA, 20 bp, mouse
gccacggcccggagagaggc

SEQ ID NO: 754187 - DNA, 20 bp, mouse
gcctgagcgcgcgtggggag

SEQ ID NO: 754188 - DNA, 20 bp, mouse
gcggccgagcccccgggagg

SEQ ID NO: 754189 - DNA, 20 bp, mouse
gccccacgcgcgctcaggat

SEQ ID NO: 754190 - DNA, 20 bp, mouse
gaacgcttcgcagttcgagg

SEQ ID NO: 754191 - DNA, 20 bp, mouse
gaggcagcgaagcgactcag

SEQ ID NO: 754192 - DNA, 20 bp, mouse
gccgcccacggcccggagag

SEQ ID NO: 754193 - DNA, 20 bp, mouse
gcccgctgcgccagcgtccc

SEQ ID NO: 754194 - DNA, 20 bp, mouse
gtcctggcgcggcccgccca

SEQ ID NO: 754195 - DNA, 20 bp, mouse
gtgcgcgcggccgagccccc

SEQ ID NO: 754196 - DNA, 20 bp, mouse
gtgggccagggcgaccctaa

SEQ ID NO: 754197 - DNA, 20 bp, mouse
gcggccccgcccctcggttg

SEQ ID NO: 754198 - DNA, 20 bp, mouse
ggcggccaggccacaaccga

SEQ ID NO: 754199 - DNA, 20 bp, mouse
gcctgcgggcgggtccctta

SEQ ID NO: 754200 - DNA, 20 bp, mouse
gagcccctgagtcggtagat

SEQ ID NO: 754201 - DNA, 20 bp, mouse
gactcggaggtggacttgaa

SEQ ID NO: 754202 - DNA, 20 bp, mouse
gggagcggagcggctgagag

SEQ ID NO: 754203 - DNA, 20 bp, mouse
gaggccacaaccgaggggcg

SEQ ID NO: 754204 - DNA, 20 bp, mouse
gggcgcccgcgactgatgag

SEQ ID NO: 754205 - DNA, 20 bp, mouse
gctaccaccagagggccctg

SEQ ID NO: 754206 - DNA, 20 bp, mouse
gagagtgtcagtcaaggagt

SEQ ID NO: 754207 - DNA, 20 bp, mouse
gcgtctcagcgctctctcat

SEQ ID NO: 754208 - DNA, 20 bp, mouse
gccccggggcggagactctg

SEQ ID NO: 754209 - DNA, 20 bp, mouse
gctctctcattggttggcaa

SEQ ID NO: 754210 - DNA, 20 bp, mouse
ggggaggtgcattggcgggg

SEQ ID NO: 754211 - DNA, 20 bp, mouse
gagcaacagagtgtcagtca

SEQ ID NO: 754212 - DNA, 20 bp, mouse
ggaggcggggtctcgctggg

SEQ ID NO: 754213 - DNA, 20 bp, mouse
gcccaggcccaggtgactat

SEQ ID NO: 754214 - DNA, 20 bp, mouse
gcccaggtgactataggaag

SEQ ID NO: 754215 - DNA, 20 bp, mouse
ggcggggtttcgaagttcgg

SEQ ID NO: 754216 - DNA, 20 bp, mouse
ggtgtcaatgagccggtcag

SEQ ID NO: 754217 - DNA, 20 bp, mouse
gccggccggaaggactctcg

SEQ ID NO: 754218 - DNA, 20 bp, mouse
gggtcagaggcttattgtgg

SEQ ID NO: 754219 - DNA, 20 bp, mouse
gacctggcaaggtgtcgttt

SEQ ID NO: 754220 - DNA, 20 bp, mouse
gtcccgagaagctgccacgg

SEQ ID NO: 754221 - DNA, 20 bp, mouse
gggaaggagccgccaggagt

SEQ ID NO: 754222 - DNA, 20 bp, mouse
gggtccccaggcgcgcggtt

SEQ ID NO: 754223 - DNA, 20 bp, mouse
gacaccgagcggtggcagga

SEQ ID NO: 754224 - DNA, 20 bp, mouse
gaaaacgcagcagtggcccg

SEQ ID NO: 754225 - DNA, 20 bp, mouse
gacgacaccttgccaggttc

SEQ ID NO: 754226 - DNA, 20 bp, mouse
gggagccccccgccccgcga

SEQ ID NO: 754227 - DNA, 20 bp, mouse
gcggggcggcccctgagcgg

SEQ ID NO: 754228 - DNA, 20 bp, mouse
gccccgcaggagcgcgatcg

SEQ ID NO: 754229 - DNA, 20 bp, mouse
ggctaggggctgcgtggaga

SEQ ID NO: 754230 - DNA, 20 bp, mouse
gccggccgcgcctggggcct

SEQ ID NO: 754231 - DNA, 20 bp, mouse
gtcctccttcgcggggcggg

SEQ ID NO: 754232 - DNA, 20 bp, mouse
gagcccgcatcccgccgctc

SEQ ID NO: 754233 - DNA, 20 bp, mouse
gggggcggccgggacccggg

SEQ ID NO: 754234 - DNA, 20 bp, mouse
gcccctgagcggcgggatgc

SEQ ID NO: 754235 - DNA, 20 bp, mouse
ggccgcgatcgcgctcctgc

SEQ ID NO: 754236 - DNA, 20 bp, mouse
gtgggccggaactacggcag

SEQ ID NO: 754237 - DNA, 20 bp, mouse
ggccgcggggtttccaggag

SEQ ID NO: 754238 - DNA, 20 bp, mouse
gcacgcccctgccgtagttc

SEQ ID NO: 754239 - DNA, 20 bp, mouse
gctgccgcctgcttgaccca

SEQ ID NO: 754240 - DNA, 20 bp, mouse
gccgaggccgcggggtttcc

SEQ ID NO: 754241 - DNA, 20 bp, mouse
gataggggtcggggagatgg

SEQ ID NO: 754242 - DNA, 20 bp, mouse
gtgcctctggctctatgaga

SEQ ID NO: 754243 - DNA, 20 bp, mouse
gcgtgggtggggggttcgag

SEQ ID NO: 754244 - DNA, 20 bp, mouse
gaactcgctgcaggggcagg

SEQ ID NO: 754245 - DNA, 20 bp, mouse
gagggcgcggggtcccagcg

SEQ ID NO: 754246 - DNA, 20 bp, mouse
gggcgcaaggtaacttgtcc

SEQ ID NO: 754247 - DNA, 20 bp, mouse
ggccgcgcgcactcggggag

SEQ ID NO: 754248 - DNA, 20 bp, mouse
gcccgtcatccattggtcga

SEQ ID NO: 754249 - DNA, 20 bp, mouse
ggggagaccgcggagatctc

SEQ ID NO: 754250 - DNA, 20 bp, mouse
ggctgggaaggtggaggcgc

SEQ ID NO: 754251 - DNA, 20 bp, mouse
ggcccagctcggttcgttcg

SEQ ID NO: 754252 - DNA, 20 bp, mouse
ggcccgcggcctgacagctg

SEQ ID NO: 754253 - DNA, 20 bp, mouse
gagaaagacaggggcccgca

SEQ ID NO: 754254 - DNA, 20 bp, mouse
gaggacgccggagatctccg

SEQ ID NO: 754255 - DNA, 20 bp, mouse
ggatctccgcggtctccctg

SEQ ID NO: 754256 - DNA, 20 bp, mouse
gggggctccctgggtgttaa

SEQ ID NO: 754257 - DNA, 20 bp, mouse
ggacacgcaccaccctctcc

SEQ ID NO: 754258 - DNA, 20 bp, mouse
ggaccgcgggcgccaggaga

SEQ ID NO: 754259 - DNA, 20 bp, mouse
ggcagagcctggctcaccca

SEQ ID NO: 754260 - DNA, 20 bp, mouse
gccaggctcaattagcccat

SEQ ID NO: 754261 - DNA, 20 bp, mouse
gacccagggagccccctgcc

SEQ ID NO: 754262 - DNA, 20 bp, mouse
gactagggatatgtgctaat

SEQ ID NO: 754263 - DNA, 20 bp, mouse
ggcaaagtagggtagagccc

SEQ ID NO: 754264 - DNA, 20 bp, mouse
ggggtgttaaaggcagagcc

SEQ ID NO: 754265 - DNA, 20 bp, mouse
ggatatgtgctaatcggtgt

SEQ ID NO: 754266 - DNA, 20 bp, mouse
gggaggcggtacaatggtgc

SEQ ID NO: 754267 - DNA, 20 bp, mouse
ggaagctcgaggtgacactg

SEQ ID NO: 754268 - DNA, 20 bp, mouse
gagaagtattatacgaggag

SEQ ID NO: 754269 - DNA, 20 bp, mouse
gagccgggagggttctcaag

SEQ ID NO: 754270 - DNA, 20 bp, mouse
gcgaagacgcagaagctgtt

SEQ ID NO: 754271 - DNA, 20 bp, mouse
ggcgctccgaagaagctgga

SEQ ID NO: 754272 - DNA, 20 bp, mouse
ggacgcaggcgccatgaagc

SEQ ID NO: 754273 - DNA, 20 bp, mouse
gagcttctgcgtcttcgcac

SEQ ID NO: 754274 - DNA, 20 bp, mouse
gaagctggagggttcaaacc

SEQ ID NO: 754275 - DNA, 20 bp, mouse
gtcccccgcagtacgggaaa

SEQ ID NO: 754276 - DNA, 20 bp, mouse
gtaaactctaaccacacaga

SEQ ID NO: 754277 - DNA, 20 bp, mouse
gactaacctaccagtccatg

SEQ ID NO: 754278 - DNA, 20 bp, mouse
gatcttctgtcctcatggac

SEQ ID NO: 754279 - DNA, 20 bp, mouse
gtctatagactgattttgat

SEQ ID NO: 754280 - DNA, 20 bp, mouse
gctctctataatttgagact

SEQ ID NO: 754281 - DNA, 20 bp, mouse
gtacttctgtataataccgc

SEQ ID NO: 754282 - DNA, 20 bp, mouse
gaaaggacacatgttgatca

SEQ ID NO: 754283 - DNA, 20 bp, mouse
gttctgtataataccgctgg

SEQ ID NO: 754284 - DNA, 20 bp, mouse
gtctgtcctcatggactggt

SEQ ID NO: 754285 - DNA, 20 bp, mouse
gcatggttttaaaactaatg

SEQ ID NO: 754286 - DNA, 20 bp, mouse
gaagaagacaaagtaataaa

SEQ ID NO: 754287 - DNA, 20 bp, mouse
gctcttatataggactcact

SEQ ID NO: 754288 - DNA, 20 bp, mouse
ggctctctacaatttgagat

SEQ ID NO: 754289 - DNA, 20 bp, mouse
gatcttccgtgttcatgaac

SEQ ID NO: 754290 - DNA, 20 bp, mouse
gaaaggacacatgttggtca

SEQ ID NO: 754291 - DNA, 20 bp, mouse
gtagtatggtgttgggacaa

SEQ ID NO: 754292 - DNA, 20 bp, mouse
gataaaaatagtatggtgtt

SEQ ID NO: 754293 - DNA, 20 bp, mouse
gttgaaagcactgaaagaaa

SEQ ID NO: 754294 - DNA, 20 bp, mouse
gaaataatgtaaaaattctt

SEQ ID NO: 754295 - DNA, 20 bp, mouse
gtataagagctacacagcag

SEQ ID NO: 754296 - DNA, 20 bp, mouse
gcccactccccttaagtggt

SEQ ID NO: 754297 - DNA, 20 bp, mouse
gtggtgcagtccacgagaag

SEQ ID NO: 754298 - DNA, 20 bp, mouse
ggcctcgcaaggggtatcaa

SEQ ID NO: 754299 - DNA, 20 bp, mouse
ggctgcccactccccttaag

SEQ ID NO: 754300 - DNA, 20 bp, mouse
ggatagtctggggagaacga

SEQ ID NO: 754301 - DNA, 20 bp, mouse
ggtgggcagcccccttctcg

SEQ ID NO: 754302 - DNA, 20 bp, mouse
ggtccaggaggaatgcaggt

SEQ ID NO: 754303 - DNA, 20 bp, mouse
gactgtcctacaccgatgtt

SEQ ID NO: 754304 - DNA, 20 bp, mouse
gctgcaccaaacatcggtgt

SEQ ID NO: 754305 - DNA, 20 bp, mouse
gcagactgtcagtctcccgg

SEQ ID NO: 754306 - DNA, 20 bp, mouse
gcctgccccgggtgccctca

SEQ ID NO: 754307 - DNA, 20 bp, mouse
gtgacagctggccaccgaga

SEQ ID NO: 754308 - DNA, 20 bp, mouse
gcgagagggcggagcttctg

SEQ ID NO: 754309 - DNA, 20 bp, mouse
gggtccaatccagtgacagc

SEQ ID NO: 754310 - DNA, 20 bp, mouse
ggagcttctgtggtgatgta

SEQ ID NO: 754311 - DNA, 20 bp, mouse
ggagggaggtccaatcgctc

SEQ ID NO: 754312 - DNA, 20 bp, mouse
gtggattggaccagcgggtt

SEQ ID NO: 754313 - DNA, 20 bp, mouse
gcccctggaactgacaccat

SEQ ID NO: 754314 - DNA, 20 bp, mouse
ggtgatgtacggcgtccacc

SEQ ID NO: 754315 - DNA, 20 bp, mouse
ggtgtcagttccaggggcaa

SEQ ID NO: 754316 - DNA, 20 bp, mouse
gcggcctgccgcaacgcttg

SEQ ID NO: 754317 - DNA, 20 bp, mouse
gccaaagctccgcctctcaa

SEQ ID NO: 754318 - DNA, 20 bp, mouse
gcgagctgaccaatggtagg

SEQ ID NO: 754319 - DNA, 20 bp, mouse
gggtcagctcggctcagggg

SEQ ID NO: 754320 - DNA, 20 bp, mouse
gagccgagctgaccaatggt

SEQ ID NO: 754321 - DNA, 20 bp, mouse
gaggccgctcacgccgaaca

SEQ ID NO: 754322 - DNA, 20 bp, mouse
gcctgagccgagctgaccaa

SEQ ID NO: 754323 - DNA, 20 bp, mouse
gttcccgtgttcggcgtgag

SEQ ID NO: 754324 - DNA, 20 bp, mouse
gcgcaacgcttgaggacgat

SEQ ID NO: 754325 - DNA, 20 bp, mouse
ggaatagggcggttcttcgg

SEQ ID NO: 754326 - DNA, 20 bp, mouse
ggggcattgtatacgctggg

SEQ ID NO: 754327 - DNA, 20 bp, mouse
gaaggggcattgtatacgct

SEQ ID NO: 754328 - DNA, 20 bp, mouse
gagggggcatggagcagaag

SEQ ID NO: 754329 - DNA, 20 bp, mouse
gccaggctgcaattggtcac

SEQ ID NO: 754330 - DNA, 20 bp, mouse
gggcatgtgcaatggagagg

SEQ ID NO: 754331 - DNA, 20 bp, mouse
gcacaaagccctctgtgtaa

SEQ ID NO: 754332 - DNA, 20 bp, mouse
gaccctaggttggaatgttg

SEQ ID NO: 754333 - DNA, 20 bp, mouse
gataccaccccttacacaga

SEQ ID NO: 754334 - DNA, 20 bp, mouse
gtgtgcaatggagaggtggt

SEQ ID NO: 754335 - DNA, 20 bp, mouse
gtccaacctagggtaggggg

SEQ ID NO: 754336 - DNA, 20 bp, mouse
gagggcggggccttgcccga

SEQ ID NO: 754337 - DNA, 20 bp, mouse
gagggagtcgagttgtccaa

SEQ ID NO: 754338 - DNA, 20 bp, mouse
gtgcctgcgtggctggtcgt

SEQ ID NO: 754339 - DNA, 20 bp, mouse
gactccctgtcagccccctc

SEQ ID NO: 754340 - DNA, 20 bp, mouse
gttgcccgagggggctgaca

SEQ ID NO: 754341 - DNA, 20 bp, mouse
gaccaagggcggggcccgga

SEQ ID NO: 754342 - DNA, 20 bp, mouse
gaggaccaatgagcgagcag

SEQ ID NO: 754343 - DNA, 20 bp, mouse
gctgcagaggcacagtacgc

SEQ ID NO: 754344 - DNA, 20 bp, mouse
ggctgcacagatcacaccaa

SEQ ID NO: 754345 - DNA, 20 bp, mouse
gtgggactggcccctcagag

SEQ ID NO: 754346 - DNA, 20 bp, mouse
gcagggctcggtcagatgaa

SEQ ID NO: 754347 - DNA, 20 bp, mouse
gtgaacggaaaagtaaagag

SEQ ID NO: 754348 - DNA, 20 bp, mouse
gtgaggccatccggaggcca

SEQ ID NO: 754349 - DNA, 20 bp, mouse
gtgcttgtgaggccatccgg

SEQ ID NO: 754350 - DNA, 20 bp, mouse
ggggcgggatgagtcacgac

SEQ ID NO: 754351 - DNA, 20 bp, mouse
gagacctttgcgcagagggc

SEQ ID NO: 754352 - DNA, 20 bp, mouse
gggcgggagggagaatcagg

SEQ ID NO: 754353 - DNA, 20 bp, mouse
gacagctctggaatgaaagg

SEQ ID NO: 754354 - DNA, 20 bp, mouse
gactccagccctctgcgcaa

SEQ ID NO: 754355 - DNA, 20 bp, mouse
gggtacagctctggaatgaa

SEQ ID NO: 754356 - DNA, 20 bp, mouse
gaaccgctgatgagggtaac

SEQ ID NO: 754357 - DNA, 20 bp, mouse
gtccccgggaggcgtaaaga

SEQ ID NO: 754358 - DNA, 20 bp, mouse
gccggacccaacctcaatca

SEQ ID NO: 754359 - DNA, 20 bp, mouse
gacccggttaccctcatcag

SEQ ID NO: 754360 - DNA, 20 bp, mouse
gcagcggttctttgactctc

SEQ ID NO: 754361 - DNA, 20 bp, mouse
gccaacctcaatcagggaca

SEQ ID NO: 754362 - DNA, 20 bp, mouse
gacagtcggaggatcgagcc

SEQ ID NO: 754363 - DNA, 20 bp, mouse
gcgcctcccggggaccatgc

SEQ ID NO: 754364 - DNA, 20 bp, mouse
gcggttctttgactctcagg

SEQ ID NO: 754365 - DNA, 20 bp, mouse
gagtcaaagaaccgctgatg

SEQ ID NO: 754366 - DNA, 20 bp, mouse
ggtaactgagcactgtgggg

SEQ ID NO: 754367 - DNA, 20 bp, mouse
gtgagtctgaaacccacaag

SEQ ID NO: 754368 - DNA, 20 bp, mouse
gttgagctacagttgggaac

SEQ ID NO: 754369 - DNA, 20 bp, mouse
ggcactgtggggtgggacag

SEQ ID NO: 754370 - DNA, 20 bp, mouse
gtgtagctcaattacatgaa

SEQ ID NO: 754371 - DNA, 20 bp, mouse
gttaccaagtgtaagtaagt

SEQ ID NO: 754372 - DNA, 20 bp, mouse
gcaccctgggttctaagatt

SEQ ID NO: 754373 - DNA, 20 bp, mouse
ggaagcaaaaattaatgaca

SEQ ID NO: 754374 - DNA, 20 bp, mouse
gcaattacatgaaaggtata

SEQ ID NO: 754375 - DNA, 20 bp, mouse
gacaaaggaaattgcaccct

SEQ ID NO: 754376 - DNA, 20 bp, mouse
gtgggcaagaactcagatga

SEQ ID NO: 754377 - DNA, 20 bp, mouse
gtaagcaaccagtagacctc

SEQ ID NO: 754378 - DNA, 20 bp, mouse
gaggcaagctagagccgaat

SEQ ID NO: 754379 - DNA, 20 bp, mouse
gcagctaagaggtgcgattg

SEQ ID NO: 754380 - DNA, 20 bp, mouse
ggcctctccgtggaaggatg

SEQ ID NO: 754381 - DNA, 20 bp, mouse
gtacatacggggcctgcctt

SEQ ID NO: 754382 - DNA, 20 bp, mouse
gctcctggacaaacctccaa

SEQ ID NO: 754383 - DNA, 20 bp, mouse
gtcctcatccttccacggag

SEQ ID NO: 754384 - DNA, 20 bp, mouse
gtagcttgcctctccgtgga

SEQ ID NO: 754385 - DNA, 20 bp, mouse
ggctctagcttgcctctccg

SEQ ID NO: 754386 - DNA, 20 bp, mouse
gtgggtggtggtggttcatg

SEQ ID NO: 754387 - DNA, 20 bp, mouse
gtgtacctatagtatggagg

SEQ ID NO: 754388 - DNA, 20 bp, mouse
ggagctgatcaagatgaaat

SEQ ID NO: 754389 - DNA, 20 bp, mouse
gctcgctgaacttgaacgca

SEQ ID NO: 754390 - DNA, 20 bp, mouse
gcgcgctcgcgacctagcgg

SEQ ID NO: 754391 - DNA, 20 bp, mouse
gtcctctccggctctgtagt

SEQ ID NO: 754392 - DNA, 20 bp, mouse
gtggatccctaaggttggga

SEQ ID NO: 754393 - DNA, 20 bp, mouse
gacccactacagagccggag

SEQ ID NO: 754394 - DNA, 20 bp, mouse
gggttcttacacacactggg

SEQ ID NO: 754395 - DNA, 20 bp, mouse
gagggacactttatcctctc

SEQ ID NO: 754396 - DNA, 20 bp, mouse
ggatccgtgtggtgagtgag

SEQ ID NO: 754397 - DNA, 20 bp, mouse
ggccccgcgccgccgactga

SEQ ID NO: 754398 - DNA, 20 bp, mouse
ggcctcgggagccttccgag

SEQ ID NO: 754399 - DNA, 20 bp, mouse
gggtgtcctaggcttatcgg

SEQ ID NO: 754400 - DNA, 20 bp, mouse
gagccgcccggcaaccctga

SEQ ID NO: 754401 - DNA, 20 bp, mouse
ggacagctggcaccgggcaa

SEQ ID NO: 754402 - DNA, 20 bp, mouse
ggcgcggagccgtcagtcgg

SEQ ID NO: 754403 - DNA, 20 bp, mouse
ggataagcctaggacaccta

SEQ ID NO: 754404 - DNA, 20 bp, mouse
gccgtgtggtgagtgagtgg

SEQ ID NO: 754405 - DNA, 20 bp, mouse
gaagcgacgggactcttcta

SEQ ID NO: 754406 - DNA, 20 bp, mouse
gtgacaggatatctctcaat

SEQ ID NO: 754407 - DNA, 20 bp, mouse
ggacccaggccatgagcagc

SEQ ID NO: 754408 - DNA, 20 bp, mouse
ggtgctgggcagtaaccaaa

SEQ ID NO: 754409 - DNA, 20 bp, mouse
gtgggtgggaaaaagtctcc

SEQ ID NO: 754410 - DNA, 20 bp, mouse
ggagagatatcctgtcacat

SEQ ID NO: 754411 - DNA, 20 bp, mouse
ggcttcgtaagctaaggcac

SEQ ID NO: 754412 - DNA, 20 bp, mouse
gagaaagggaggacactcgc

SEQ ID NO: 754413 - DNA, 20 bp, mouse
gactccttggaaaggatcaa

SEQ ID NO: 754414 - DNA, 20 bp, mouse
gccagataatggcctccgtt

SEQ ID NO: 754415 - DNA, 20 bp, mouse
gtcgtaagctaaggcacagg

SEQ ID NO: 754416 - DNA, 20 bp, mouse
ggaggagcgcagaaccctgg

SEQ ID NO: 754417 - DNA, 20 bp, mouse
gagtgcgtgtcgggagggag

SEQ ID NO: 754418 - DNA, 20 bp, mouse
gaagggagtgcgtgtcggga

SEQ ID NO: 754419 - DNA, 20 bp, mouse
ggctggggacccggccgcaa

SEQ ID NO: 754420 - DNA, 20 bp, mouse
gccgcaagggagtgcgtgtc

SEQ ID NO: 754421 - DNA, 20 bp, mouse
gcccgcagagggagggcgga

SEQ ID NO: 754422 - DNA, 20 bp, mouse
ggagcgcagaaccctggagg

SEQ ID NO: 754423 - DNA, 20 bp, mouse
gagggaggagcgcagaaccc

SEQ ID NO: 754424 - DNA, 20 bp, mouse
gcccctcaaaccctcctcca

SEQ ID NO: 754425 - DNA, 20 bp, mouse
gaggatcagcgaggtccaca

SEQ ID NO: 754426 - DNA, 20 bp, mouse
ggccgcccgccccaccgctc

SEQ ID NO: 754427 - DNA, 20 bp, mouse
gcgaaggggcgaacccggaa

SEQ ID NO: 754428 - DNA, 20 bp, mouse
gagcagcgaaggggcgaacc

SEQ ID NO: 754429 - DNA, 20 bp, mouse
ggtgaggcgcgtgtccggag

SEQ ID NO: 754430 - DNA, 20 bp, mouse
ggcttctggggcgatcgtca

SEQ ID NO: 754431 - DNA, 20 bp, mouse
gcacctcgcaggtagcatcg

SEQ ID NO: 754432 - DNA, 20 bp, mouse
ggaaaggtgaggcgcgtgtc

SEQ ID NO: 754433 - DNA, 20 bp, mouse
gcgtgtccggagcggtgggg

SEQ ID NO: 754434 - DNA, 20 bp, mouse
gggaaaggaagttctcggtg

SEQ ID NO: 754435 - DNA, 20 bp, mouse
gaatggctccgtcacctcac

SEQ ID NO: 754436 - DNA, 20 bp, mouse
ggcgccccgcagaaccccgg

SEQ ID NO: 754437 - DNA, 20 bp, mouse
gcaggcgccccgcagaaccc

SEQ ID NO: 754438 - DNA, 20 bp, mouse
gagcgcgctcgctccctaga

SEQ ID NO: 754439 - DNA, 20 bp, mouse
ggcagacccctgctgctcag

SEQ ID NO: 754440 - DNA, 20 bp, mouse
gacgcccacggctgccctct

SEQ ID NO: 754441 - DNA, 20 bp, mouse
gagcccttgaacactcttag

SEQ ID NO: 754442 - DNA, 20 bp, mouse
gggtcacctccggggttctg

SEQ ID NO: 754443 - DNA, 20 bp, mouse
gcggggaattaaaagagaga

SEQ ID NO: 754444 - DNA, 20 bp, mouse
gttcccctaagagtgttcaa

SEQ ID NO: 754445 - DNA, 20 bp, mouse
gtgcagagaagccaattaaa

SEQ ID NO: 754446 - DNA, 20 bp, mouse
gcgcgctcgcgtccacgaag

SEQ ID NO: 754447 - DNA, 20 bp, mouse
gggcggggcgagcgcctctg

SEQ ID NO: 754448 - DNA, 20 bp, mouse
gtcagcgcggccgtaaagag

SEQ ID NO: 754449 - DNA, 20 bp, mouse
gctcgcgtccacgaaggggc

SEQ ID NO: 754450 - DNA, 20 bp, mouse
gagcgccgagcgctggttga

SEQ ID NO: 754451 - DNA, 20 bp, mouse
ggcggccgcgcgctgacatt

SEQ ID NO: 754452 - DNA, 20 bp, mouse
gtgcaaaagctgcgaaaggg

SEQ ID NO: 754453 - DNA, 20 bp, mouse
gagctgcaaaagctgcgaaa

SEQ ID NO: 754454 - DNA, 20 bp, mouse
ggcgcggaggtgtcgtgaaa

SEQ ID NO: 754455 - DNA, 20 bp, mouse
ggtcgcaaagcgccgagcgc

SEQ ID NO: 754456 - DNA, 20 bp, mouse
gcaggcgcacttggtgtgga

SEQ ID NO: 754457 - DNA, 20 bp, mouse
gcagagccgtaggcagtaaa

SEQ ID NO: 754458 - DNA, 20 bp, mouse
gctctgtccggagaaggcga

SEQ ID NO: 754459 - DNA, 20 bp, mouse
gccggtgcagcagcgactcc

SEQ ID NO: 754460 - DNA, 20 bp, mouse
gcttctccggacagagccgt

SEQ ID NO: 754461 - DNA, 20 bp, mouse
ggcgcaggcgcagcgaagac

SEQ ID NO: 754462 - DNA, 20 bp, mouse
ggtggagggcgcgcactcgc

SEQ ID NO: 754463 - DNA, 20 bp, mouse
gtactgcctacggctctgtc

SEQ ID NO: 754464 - DNA, 20 bp, mouse
gcgcgcaggcgcacttggtg

SEQ ID NO: 754465 - DNA, 20 bp, mouse
gacacacggcccaaaaatct

SEQ ID NO: 754466 - DNA, 20 bp, mouse
gttgtaagtgggagtatgta

SEQ ID NO: 754467 - DNA, 20 bp, mouse
gtacaaataggactctgaga

SEQ ID NO: 754468 - DNA, 20 bp, mouse
gaacaggaaagccaggtcat

SEQ ID NO: 754469 - DNA, 20 bp, mouse
gtgagacatttctcattctc

SEQ ID NO: 754470 - DNA, 20 bp, mouse
gacaggaggaaacacacagt

SEQ ID NO: 754471 - DNA, 20 bp, mouse
gactctgagaaggaaaccac

SEQ ID NO: 754472 - DNA, 20 bp, mouse
ggaaaccacagggctgtctg

SEQ ID NO: 754473 - DNA, 20 bp, mouse
gcatactcccacttacaaat

SEQ ID NO: 754474 - DNA, 20 bp, mouse
gttgcttggcattattgtct

SEQ ID NO: 754475 - DNA, 20 bp, mouse
gtctgctaaagcagagaagt

SEQ ID NO: 754476 - DNA, 20 bp, mouse
ggaaaccataaggctgtctg

SEQ ID NO: 754477 - DNA, 20 bp, mouse
gctctgagcaggaaaccata

SEQ ID NO: 754478 - DNA, 20 bp, mouse
gaataccccagacagcctta

SEQ ID NO: 754479 - DNA, 20 bp, mouse
gaattgagaaatacctcaga

SEQ ID NO: 754480 - DNA, 20 bp, mouse
gtgccaataggactctgagc

SEQ ID NO: 754481 - DNA, 20 bp, mouse
gttgtgcttcatactcccgt

SEQ ID NO: 754482 - DNA, 20 bp, mouse
gtacactctctgttgccaat

SEQ ID NO: 754483 - DNA, 20 bp, mouse
gtctgtaagtgactgctgct

SEQ ID NO: 754484 - DNA, 20 bp, mouse
gttggaagaaactagagaaa

SEQ ID NO: 754485 - DNA, 20 bp, mouse
ggtattattgtccaggtgac

SEQ ID NO: 754486 - DNA, 20 bp, mouse
gaacaattgtacacctcatg

SEQ ID NO: 754487 - DNA, 20 bp, mouse
gattgtacacctcatggggt

SEQ ID NO: 754488 - DNA, 20 bp, mouse
ggaaaccataaggctgtctg

SEQ ID NO: 754489 - DNA, 20 bp, mouse
gctctgagcaggaaaccata

SEQ ID NO: 754490 - DNA, 20 bp, mouse
gaataccccagacagcctta

SEQ ID NO: 754491 - DNA, 20 bp, mouse
gttgtgcttcatactcccgt

SEQ ID NO: 754492 - DNA, 20 bp, mouse
gtctgtaagtgactgctgct

SEQ ID NO: 754493 - DNA, 20 bp, mouse
gtgccaataggactctgagc

SEQ ID NO: 754494 - DNA, 20 bp, mouse
ggtattattgtccaggtgac

SEQ ID NO: 754495 - DNA, 20 bp, mouse
gaattgagaaatacctcaga

SEQ ID NO: 754496 - DNA, 20 bp, mouse
gaaaaggaaaggaaggtcat

SEQ ID NO: 754497 - DNA, 20 bp, mouse
gagaaaaccaccaagctgtc

SEQ ID NO: 754498 - DNA, 20 bp, mouse
gcctgtaattgattgtttct

SEQ ID NO: 754499 - DNA, 20 bp, mouse
gtacaggaggaaagacacaa

SEQ ID NO: 754500 - DNA, 20 bp, mouse
gtgctgctttagcagagaaa

SEQ ID NO: 754501 - DNA, 20 bp, mouse
gtctgctaaagcagcaatgt

SEQ ID NO: 754502 - DNA, 20 bp, mouse
gaattccccagacagcttgg

SEQ ID NO: 754503 - DNA, 20 bp, mouse
gtcagagtcctattggcaag

SEQ ID NO: 754504 - DNA, 20 bp, mouse
gatcaattccccagacagct

SEQ ID NO: 754505 - DNA, 20 bp, mouse
gctttagcagagaaaaggaa

SEQ ID NO: 754506 - DNA, 20 bp, mouse
gacgaggaaagctaggtcgt

SEQ ID NO: 754507 - DNA, 20 bp, mouse
gtgccaataggattctgaga

SEQ ID NO: 754508 - DNA, 20 bp, mouse
gaataatgccaagtaaagtg

SEQ ID NO: 754509 - DNA, 20 bp, mouse
gagggtttctgggtatgctc

SEQ ID NO: 754510 - DNA, 20 bp, mouse
gggacactcctcactttact

SEQ ID NO: 754511 - DNA, 20 bp, mouse
gtgatgctttaacagatacg

SEQ ID NO: 754512 - DNA, 20 bp, mouse
gaacagatacgaggaaagct

SEQ ID NO: 754513 - DNA, 20 bp, mouse
ggaaatcgcaggtctgtctg

SEQ ID NO: 754514 - DNA, 20 bp, mouse
gttccttctcagaatcctat

SEQ ID NO: 754515 - DNA, 20 bp, mouse
ggggtatgctctggctgtcc

SEQ ID NO: 754516 - DNA, 20 bp, mouse
gtggagataaagtgtagaac

SEQ ID NO: 754517 - DNA, 20 bp, mouse
gagtgtagaacaggcactaa

SEQ ID NO: 754518 - DNA, 20 bp, mouse
gtaatggttggttgctaact

SEQ ID NO: 754519 - DNA, 20 bp, mouse
gctctgtatttgtaagtgtc

SEQ ID NO: 754520 - DNA, 20 bp, mouse
gtcctgagtgagaaaagaac

SEQ ID NO: 754521 - DNA, 20 bp, mouse
ggaccaaagtatgggcgttt

SEQ ID NO: 754522 - DNA, 20 bp, mouse
gttttctacttctaatcatt

SEQ ID NO: 754523 - DNA, 20 bp, mouse
gccccaggtggaacattctc

SEQ ID NO: 754524 - DNA, 20 bp, mouse
gagcacagggttcctaatag

SEQ ID NO: 754525 - DNA, 20 bp, mouse
gtatgtcagcattcactcct

SEQ ID NO: 754526 - DNA, 20 bp, mouse
ggaggggatagaggggttct

SEQ ID NO: 754527 - DNA, 20 bp, mouse
ggggatagaggggttctggg

SEQ ID NO: 754528 - DNA, 20 bp, mouse
gtagaggggttctgggagga

SEQ ID NO: 754529 - DNA, 20 bp, mouse
gcccagtgtaggggaatcaa

SEQ ID NO: 754530 - DNA, 20 bp, mouse
gctgggaggagggcaaagtg

SEQ ID NO: 754531 - DNA, 20 bp, mouse
gtgggagtggttgggtgtgt

SEQ ID NO: 754532 - DNA, 20 bp, mouse
ggaggagggcaaagtgagga

SEQ ID NO: 754533 - DNA, 20 bp, mouse
gtggtcatgtcattcatcag

SEQ ID NO: 754534 - DNA, 20 bp, mouse
gccatagacgccccagtgta

SEQ ID NO: 754535 - DNA, 20 bp, mouse
gcgcccttgcagaactccca

SEQ ID NO: 754536 - DNA, 20 bp, mouse
gtcagcactagacagatctg

SEQ ID NO: 754537 - DNA, 20 bp, mouse
gaaggagaagccagaccaag

SEQ ID NO: 754538 - DNA, 20 bp, mouse
gcttcatactccccttggtc

SEQ ID NO: 754539 - DNA, 20 bp, mouse
gtttggaagaaacggggaat

SEQ ID NO: 754540 - DNA, 20 bp, mouse
ggtgttatttggaagaaacg

SEQ ID NO: 754541 - DNA, 20 bp, mouse
gtacaggaaggaggacagag

SEQ ID NO: 754542 - DNA, 20 bp, mouse
gtcaacaatcacttacagga

SEQ ID NO: 754543 - DNA, 20 bp, mouse
gagagattgagaactgtctc

SEQ ID NO: 754544 - DNA, 20 bp, mouse
gttgcttggcattactgtcc

SEQ ID NO: 754545 - DNA, 20 bp, mouse
gttcctgctcagagttttat

SEQ ID NO: 754546 - DNA, 20 bp, mouse
gaatgggatggaagctagat

SEQ ID NO: 754547 - DNA, 20 bp, mouse
gggactgggggattactctg

SEQ ID NO: 754548 - DNA, 20 bp, mouse
ggcggggagagctcctagat

SEQ ID NO: 754549 - DNA, 20 bp, mouse
gtcagtacttggatgttcct

SEQ ID NO: 754550 - DNA, 20 bp, mouse
gctaagtacaggaaactaca

SEQ ID NO: 754551 - DNA, 20 bp, mouse
gagagctcctagataggact

SEQ ID NO: 754552 - DNA, 20 bp, mouse
gggatgttccttgggaaaga

SEQ ID NO: 754553 - DNA, 20 bp, mouse
gaagtactgagattgtagac

SEQ ID NO: 754554 - DNA, 20 bp, mouse
gtaatcccccagtcctatct

SEQ ID NO: 754555 - DNA, 20 bp, mouse
gtcaactttaactaatggga

SEQ ID NO: 754556 - DNA, 20 bp, mouse
gtctgaaaaagctatagcac

SEQ ID NO: 754557 - DNA, 20 bp, mouse
gctcttctgaacatttagac

SEQ ID NO: 754558 - DNA, 20 bp, mouse
gacaaacactaagtgggaag

SEQ ID NO: 754559 - DNA, 20 bp, mouse
gacacaaacaaacactaagt

SEQ ID NO: 754560 - DNA, 20 bp, mouse
gagcactggctcacattatt

SEQ ID NO: 754561 - DNA, 20 bp, mouse
gtgatcaaaggacagggtat

SEQ ID NO: 754562 - DNA, 20 bp, mouse
gttcttatgatcaaaggaca

SEQ ID NO: 754563 - DNA, 20 bp, mouse
ggaaactagaagcatcccat

SEQ ID NO: 754564 - DNA, 20 bp, mouse
gctcaaaggagtccaagtac

SEQ ID NO: 754565 - DNA, 20 bp, mouse
gatagagttcttatgatcaa

SEQ ID NO: 754566 - DNA, 20 bp, mouse
gaatgggattgcagacatta

SEQ ID NO: 754567 - DNA, 20 bp, mouse
gagggtgttgccgagcatca

SEQ ID NO: 754568 - DNA, 20 bp, mouse
gggggggcaggatatcctgt

SEQ ID NO: 754569 - DNA, 20 bp, mouse
gcagtcactagtgcataaaa

SEQ ID NO: 754570 - DNA, 20 bp, mouse
gatatcctgccccccaatac

SEQ ID NO: 754571 - DNA, 20 bp, mouse
gctactgtgatgagagtagc

SEQ ID NO: 754572 - DNA, 20 bp, mouse
gggacatgacttgtagatag

SEQ ID NO: 754573 - DNA, 20 bp, mouse
gcaggactgtaagcagctat

SEQ ID NO: 754574 - DNA, 20 bp, mouse
ggcttacagtcctgtattgg

SEQ ID NO: 754575 - DNA, 20 bp, mouse
gttaagagtgtttaaactga

SEQ ID NO: 754576 - DNA, 20 bp, mouse
gtgcagacctatatgatatg

SEQ ID NO: 754577 - DNA, 20 bp, mouse
gcaactaccccatatcatat

SEQ ID NO: 754578 - DNA, 20 bp, mouse
gacacaagatagtctcagtc

SEQ ID NO: 754579 - DNA, 20 bp, mouse
gtagacgaaatagtataaac

SEQ ID NO: 754580 - DNA, 20 bp, mouse
gatggaatgagagtcacgaa

SEQ ID NO: 754581 - DNA, 20 bp, mouse
gtgagacttttctcaggtgt

SEQ ID NO: 754582 - DNA, 20 bp, mouse
gcagccatgcttcttatcct

SEQ ID NO: 754583 - DNA, 20 bp, mouse
gcatgcttcttatcctagga

SEQ ID NO: 754584 - DNA, 20 bp, mouse
gtggaagaacattatccaat

SEQ ID NO: 754585 - DNA, 20 bp, mouse
ggataatgttcttccagtga

SEQ ID NO: 754586 - DNA, 20 bp, mouse
ggataccttccagtgactat

SEQ ID NO: 754587 - DNA, 20 bp, mouse
gtatagatccatatgatatg

SEQ ID NO: 754588 - DNA, 20 bp, mouse
gtcttcccatagtcactgga

SEQ ID NO: 754589 - DNA, 20 bp, mouse
gatattgtagcacatctgga

SEQ ID NO: 754590 - DNA, 20 bp, mouse
gtgtagcacatctggaaggt

SEQ ID NO: 754591 - DNA, 20 bp, mouse
gtccataaagaggggtaagc

SEQ ID NO: 754592 - DNA, 20 bp, mouse
gcatatcttcccatagtcac

SEQ ID NO: 754593 - DNA, 20 bp, mouse
ggaatgttatttctgttcta

SEQ ID NO: 754594 - DNA, 20 bp, mouse
gacctgaaatgcttagtact

SEQ ID NO: 754595 - DNA, 20 bp, mouse
gctggcaccggtccataaag

SEQ ID NO: 754596 - DNA, 20 bp, mouse
ggttgtgtggcagaatgaaa

SEQ ID NO: 754597 - DNA, 20 bp, mouse
gacacaacatgagacacttg

SEQ ID NO: 754598 - DNA, 20 bp, mouse
ggacacttggggtgtatact

SEQ ID NO: 754599 - DNA, 20 bp, mouse
gtggagaagggttatatgta

SEQ ID NO: 754600 - DNA, 20 bp, mouse
gctcccccctgaccagcaga

SEQ ID NO: 754601 - DNA, 20 bp, mouse
gtggaacactgaacctgtag

SEQ ID NO: 754602 - DNA, 20 bp, mouse
gagggcaaagggtgatttac

SEQ ID NO: 754603 - DNA, 20 bp, mouse
gaaagacattggccctctgc

SEQ ID NO: 754604 - DNA, 20 bp, mouse
gtgaatatacagtcactgtt

SEQ ID NO: 754605 - DNA, 20 bp, mouse
ggggtgatttacaggacttt

SEQ ID NO: 754606 - DNA, 20 bp, mouse
gaagagatgcaaacactggc

SEQ ID NO: 754607 - DNA, 20 bp, mouse
gcctgagcccagaagttctt

SEQ ID NO: 754608 - DNA, 20 bp, mouse
gtcccaagtgcagagtaaga

SEQ ID NO: 754609 - DNA, 20 bp, mouse
gtggagtgactacagagttc

SEQ ID NO: 754610 - DNA, 20 bp, mouse
ggtggagcctcaagagagtg

SEQ ID NO: 754611 - DNA, 20 bp, mouse
ggactaggaaaggtcattac

SEQ ID NO: 754612 - DNA, 20 bp, mouse
ggagcacgaaggcaggacgg

SEQ ID NO: 754613 - DNA, 20 bp, mouse
ggcctcagggtcttcaccat

SEQ ID NO: 754614 - DNA, 20 bp, mouse
ggcaacctcactgagcctca

SEQ ID NO: 754615 - DNA, 20 bp, mouse
gagcgaagagatgcaaacac

SEQ ID NO: 754616 - DNA, 20 bp, mouse
gagcccgcgaggtcattgct

SEQ ID NO: 754617 - DNA, 20 bp, mouse
gctcaggtgtggatagcagg

SEQ ID NO: 754618 - DNA, 20 bp, mouse
gcgcccagcaatgacctcgc

SEQ ID NO: 754619 - DNA, 20 bp, mouse
gtgccaggaagactgcagga

SEQ ID NO: 754620 - DNA, 20 bp, mouse
gctcgcgggctctcctgtct

SEQ ID NO: 754621 - DNA, 20 bp, mouse
ggacaaaagtggtctctaaa

SEQ ID NO: 754622 - DNA, 20 bp, mouse
gcctcagtgtcacatggtgt

SEQ ID NO: 754623 - DNA, 20 bp, mouse
gggcttgccaggaagactgc

SEQ ID NO: 754624 - DNA, 20 bp, mouse
gtccaagtaccaggcttgcc

SEQ ID NO: 754625 - DNA, 20 bp, mouse
ggtgtcacatggtgtcggag

SEQ ID NO: 754626 - DNA, 20 bp, mouse
ggaggagctgaacagtgatg

SEQ ID NO: 754627 - DNA, 20 bp, mouse
ggggaggggagagttagagg

SEQ ID NO: 754628 - DNA, 20 bp, mouse
gctgaacagtgatgaggctt

SEQ ID NO: 754629 - DNA, 20 bp, mouse
gttccaggccaggcagaagg

SEQ ID NO: 754630 - DNA, 20 bp, mouse
gttggcctgagcactggggc

SEQ ID NO: 754631 - DNA, 20 bp, mouse
gccaaacccaattccaggcc

SEQ ID NO: 754632 - DNA, 20 bp, mouse
ggggaaggaatgcccagttc

SEQ ID NO: 754633 - DNA, 20 bp, mouse
ggatgagttcccagtgggga

SEQ ID NO: 754634 - DNA, 20 bp, mouse
gcaacaggcaaggcgggtga

SEQ ID NO: 754635 - DNA, 20 bp, mouse
gaggccaacgtgacgtcatc

SEQ ID NO: 754636 - DNA, 20 bp, mouse
gccagaatgggcggcgtgca

SEQ ID NO: 754637 - DNA, 20 bp, mouse
gcacgccgcccattctggaa

SEQ ID NO: 754638 - DNA, 20 bp, mouse
gccagggaccattccagaat

SEQ ID NO: 754639 - DNA, 20 bp, mouse
gaggctcctccttttcatct

SEQ ID NO: 754640 - DNA, 20 bp, mouse
gtcccgagcacctaaggcca

SEQ ID NO: 754641 - DNA, 20 bp, mouse
gcttaggtgctcgggaccaa

SEQ ID NO: 754642 - DNA, 20 bp, mouse
gcagttccctagaagtgggg

SEQ ID NO: 754643 - DNA, 20 bp, mouse
gcatctcccagatgaaaagg

SEQ ID NO: 754644 - DNA, 20 bp, mouse
gctgccagttccctagaagt

SEQ ID NO: 754645 - DNA, 20 bp, mouse
ggtccctggccttaggtgct

SEQ ID NO: 754646 - DNA, 20 bp, mouse
gtgtacttggggtttaacag

SEQ ID NO: 754647 - DNA, 20 bp, mouse
ggcaggctaggttcatcaac

SEQ ID NO: 754648 - DNA, 20 bp, mouse
gaacagaggagggagaacgc

SEQ ID NO: 754649 - DNA, 20 bp, mouse
gaccccaagtacaggtcaca

SEQ ID NO: 754650 - DNA, 20 bp, mouse
gacaggttgcctgggatgca

SEQ ID NO: 754651 - DNA, 20 bp, mouse
ggacaaagtcacaggttgcc

SEQ ID NO: 754652 - DNA, 20 bp, mouse
gggtgggccattccagggta

SEQ ID NO: 754653 - DNA, 20 bp, mouse
gttccctgtgacctgtactt

SEQ ID NO: 754654 - DNA, 20 bp, mouse
gttgagacactccctccctg

SEQ ID NO: 754655 - DNA, 20 bp, mouse
gcttggggtttaacagagga

SEQ ID NO: 754656 - DNA, 20 bp, mouse
gcggagataccagataagga

SEQ ID NO: 754657 - DNA, 20 bp, mouse
gggtgcggagataccagata

SEQ ID NO: 754658 - DNA, 20 bp, mouse
gacagcccaagaaatcgcat

SEQ ID NO: 754659 - DNA, 20 bp, mouse
gtactgcctaggctcacagt

SEQ ID NO: 754660 - DNA, 20 bp, mouse
gcacctacaaattagttatc

SEQ ID NO: 754661 - DNA, 20 bp, mouse
gctacaaattagttatcagg

SEQ ID NO: 754662 - DNA, 20 bp, mouse
gagcatgacatgtggagaat

SEQ ID NO: 754663 - DNA, 20 bp, mouse
ggttgaactctggtttataa

SEQ ID NO: 754664 - DNA, 20 bp, mouse
gtttagttattcatgttgaa

SEQ ID NO: 754665 - DNA, 20 bp, mouse
gggaaaggctcacatatgag

SEQ ID NO: 754666 - DNA, 20 bp, mouse
gtactgccactaatagggaa

SEQ ID NO: 754667 - DNA, 20 bp, mouse
gcttaggagtcatggaggtt

SEQ ID NO: 754668 - DNA, 20 bp, mouse
gcagcacttaggagtcatgg

SEQ ID NO: 754669 - DNA, 20 bp, mouse
gagaatgtcaggaagccttg

SEQ ID NO: 754670 - DNA, 20 bp, mouse
ggacccagatcctcacaatt

SEQ ID NO: 754671 - DNA, 20 bp, mouse
gatgaggagcatgactcaag

SEQ ID NO: 754672 - DNA, 20 bp, mouse
gcatacagccagtatcaatg

SEQ ID NO: 754673 - DNA, 20 bp, mouse
ggtttctactgccactaata

SEQ ID NO: 754674 - DNA, 20 bp, mouse
gcatggaggtttgggaaaga

SEQ ID NO: 754675 - DNA, 20 bp, mouse
gtccccaattgtgaggatct

SEQ ID NO: 754676 - DNA, 20 bp, mouse
ggatgaggcagaggtgttta

SEQ ID NO: 754677 - DNA, 20 bp, mouse
gaacacctctgcctcatcaa

SEQ ID NO: 754678 - DNA, 20 bp, mouse
gccgtcgacaacaaatctaa

SEQ ID NO: 754679 - DNA, 20 bp, mouse
gagatggggatttcctggag

SEQ ID NO: 754680 - DNA, 20 bp, mouse
ggtcgacggtgccattgatg

SEQ ID NO: 754681 - DNA, 20 bp, mouse
gttgatggcttattccatgg

SEQ ID NO: 754682 - DNA, 20 bp, mouse
gaaggtcctaggacctttga

SEQ ID NO: 754683 - DNA, 20 bp, mouse
gcatgcatcaatggaaaaaa

SEQ ID NO: 754684 - DNA, 20 bp, mouse
gcaacaaatcagacaccccc

SEQ ID NO: 754685 - DNA, 20 bp, mouse
gttgagccttcaaaggtcct

SEQ ID NO: 754686 - DNA, 20 bp, mouse
gtcatcgcttcagtaacgga

SEQ ID NO: 754687 - DNA, 20 bp, mouse
ggtaacggatggacgatttc

SEQ ID NO: 754688 - DNA, 20 bp, mouse
ggccccatcaccaagcatct

SEQ ID NO: 754689 - DNA, 20 bp, mouse
gggagaagttacagccactc

SEQ ID NO: 754690 - DNA, 20 bp, mouse
gtgacacgctgattaagcgc

SEQ ID NO: 754691 - DNA, 20 bp, mouse
gcgttactgaagcgatgact

SEQ ID NO: 754692 - DNA, 20 bp, mouse
gggagctagaactcggcctt

SEQ ID NO: 754693 - DNA, 20 bp, mouse
ggtgtctgtgagccgtggat

SEQ ID NO: 754694 - DNA, 20 bp, mouse
gggagacaaaagtagtccca

SEQ ID NO: 754695 - DNA, 20 bp, mouse
ggatggggctatttttttgc

SEQ ID NO: 754696 - DNA, 20 bp, mouse
gagtgcgactcactcctgta

SEQ ID NO: 754697 - DNA, 20 bp, mouse
ggacgcacatgtgcgcttgg

SEQ ID NO: 754698 - DNA, 20 bp, mouse
gcatgtgcgtcatcggacag

SEQ ID NO: 754699 - DNA, 20 bp, mouse
gactcctgtagggggtgcag

SEQ ID NO: 754700 - DNA, 20 bp, mouse
gggctcgcctgcgtcagcgg

SEQ ID NO: 754701 - DNA, 20 bp, mouse
gaagcgcacatgtgcgtcat

SEQ ID NO: 754702 - DNA, 20 bp, mouse
gctgacgcaggcgagcctag

SEQ ID NO: 754703 - DNA, 20 bp, mouse
gctaaccttggactgctccc

SEQ ID NO: 754704 - DNA, 20 bp, mouse
gtctccactgcaccccctac

SEQ ID NO: 754705 - DNA, 20 bp, mouse
gtgaggggacgaagtgtggg

SEQ ID NO: 754706 - DNA, 20 bp, mouse
gctctcgtggtgcgtgtctc

SEQ ID NO: 754707 - DNA, 20 bp, mouse
gtatctccagcaactagcag

SEQ ID NO: 754708 - DNA, 20 bp, mouse
gacagctctgcaaactctga

SEQ ID NO: 754709 - DNA, 20 bp, mouse
gttgaccagctgttcactaa

SEQ ID NO: 754710 - DNA, 20 bp, mouse
gggaaggtcaaaatcaccta

SEQ ID NO: 754711 - DNA, 20 bp, mouse
gtctgcctgtatgacatgaa

SEQ ID NO: 754712 - DNA, 20 bp, mouse
gttggagaggtacacaatag

SEQ ID NO: 754713 - DNA, 20 bp, mouse
gacctcccttcatgtcatac

SEQ ID NO: 754714 - DNA, 20 bp, mouse
gagagcccctcaaagctgga

SEQ ID NO: 754715 - DNA, 20 bp, mouse
gcacagctctatccccatgc

SEQ ID NO: 754716 - DNA, 20 bp, mouse
gatcccagttaaggcttcca

SEQ ID NO: 754717 - DNA, 20 bp, mouse
gaagagaagcatttaatcta

SEQ ID NO: 754718 - DNA, 20 bp, mouse
gggcgctatcatcccagtta

SEQ ID NO: 754719 - DNA, 20 bp, mouse
gacaggattatgttggggag

SEQ ID NO: 754720 - DNA, 20 bp, mouse
ggcacacggcggcagagttc

SEQ ID NO: 754721 - DNA, 20 bp, mouse
ggaaggagaaacgacgcgga

SEQ ID NO: 754722 - DNA, 20 bp, mouse
gaacgaatctgcttggcata

SEQ ID NO: 754723 - DNA, 20 bp, mouse
gtcccagcgatgccagtaga

SEQ ID NO: 754724 - DNA, 20 bp, mouse
ggttctaacaggattatgtt

SEQ ID NO: 754725 - DNA, 20 bp, mouse
gatcgctgggaaatgacgcc

SEQ ID NO: 754726 - DNA, 20 bp, mouse
gagtgggcggagttaacgtg

SEQ ID NO: 754727 - DNA, 20 bp, mouse
gtctctgctgggtaccccag

SEQ ID NO: 754728 - DNA, 20 bp, mouse
ggggctgcggggatgggctt

SEQ ID NO: 754729 - DNA, 20 bp, mouse
gggaagaagtaggtgtacct

SEQ ID NO: 754730 - DNA, 20 bp, mouse
gccgcccactctccgctcca

SEQ ID NO: 754731 - DNA, 20 bp, mouse
gtgtggagatcgcacggagg

SEQ ID NO: 754732 - DNA, 20 bp, mouse
ggtgcgatctccacactcat

SEQ ID NO: 754733 - DNA, 20 bp, mouse
gcaggccgcagttggccaga

SEQ ID NO: 754734 - DNA, 20 bp, mouse
ggagtgtggagatcgcacgg

SEQ ID NO: 754735 - DNA, 20 bp, mouse
gggtgtacctaggcgctcca

SEQ ID NO: 754736 - DNA, 20 bp, mouse
gaaaaggaaatcactagtgg

SEQ ID NO: 754737 - DNA, 20 bp, mouse
gggtagagcccagtatagaa

SEQ ID NO: 754738 - DNA, 20 bp, mouse
gggttacaaccaaggatcaa

SEQ ID NO: 754739 - DNA, 20 bp, mouse
gccaaggatcaaaggggtgg

SEQ ID NO: 754740 - DNA, 20 bp, mouse
ggggaaaaggaaatcactag

SEQ ID NO: 754741 - DNA, 20 bp, mouse
gagtcaaggcagctgaaggg

SEQ ID NO: 754742 - DNA, 20 bp, mouse
ggtctgggagataactgtga

SEQ ID NO: 754743 - DNA, 20 bp, mouse
ggatgtatggtggcctgttt

SEQ ID NO: 754744 - DNA, 20 bp, mouse
ggagacctccttcgtcacta

SEQ ID NO: 754745 - DNA, 20 bp, mouse
ggaccagaagccaggtgagg

SEQ ID NO: 754746 - DNA, 20 bp, mouse
gtaagtcagcaaggagtggt

SEQ ID NO: 754747 - DNA, 20 bp, mouse
gacttctggcacaatatatg

SEQ ID NO: 754748 - DNA, 20 bp, mouse
gagaaaaagcctgagcctat

SEQ ID NO: 754749 - DNA, 20 bp, mouse
gacagcacatgatggcagaa

SEQ ID NO: 754750 - DNA, 20 bp, mouse
ggagttctgataagtcagca

SEQ ID NO: 754751 - DNA, 20 bp, mouse
gtgtgtgtgacagcacatga

SEQ ID NO: 754752 - DNA, 20 bp, mouse
gtgaggtcagtcacacaaca

SEQ ID NO: 754753 - DNA, 20 bp, mouse
gcagggcatgctcagtggac

SEQ ID NO: 754754 - DNA, 20 bp, mouse
gcagggaagacgatgacttc

SEQ ID NO: 754755 - DNA, 20 bp, mouse
ggagaagcaaccatcaaaat

SEQ ID NO: 754756 - DNA, 20 bp, mouse
gggacaggacacagctcacc

SEQ ID NO: 754757 - DNA, 20 bp, mouse
gtgagctgtgtcctgtccct

SEQ ID NO: 754758 - DNA, 20 bp, mouse
gacagagtgctcagataaga

SEQ ID NO: 754759 - DNA, 20 bp, mouse
ggagtgctcagataagatgg

SEQ ID NO: 754760 - DNA, 20 bp, mouse
gaagagggccaaagcacaga

SEQ ID NO: 754761 - DNA, 20 bp, mouse
gaccttcataatggctttca

SEQ ID NO: 754762 - DNA, 20 bp, mouse
gtggagacccttctgtgctt

SEQ ID NO: 754763 - DNA, 20 bp, mouse
gagggtctccacccagggac

SEQ ID NO: 754764 - DNA, 20 bp, mouse
gggtgggagtcatgtgggtt

SEQ ID NO: 754765 - DNA, 20 bp, mouse
gcagagtgacaccttcataa

SEQ ID NO: 754766 - DNA, 20 bp, mouse
gactcgagggaggtgagggg

SEQ ID NO: 754767 - DNA, 20 bp, mouse
gagcactcgagggaggtgag

SEQ ID NO: 754768 - DNA, 20 bp, mouse
gggacttccctagcactcga

SEQ ID NO: 754769 - DNA, 20 bp, mouse
gggggtggggggcacacatt

SEQ ID NO: 754770 - DNA, 20 bp, mouse
ggcttcttatgattcagtgg

SEQ ID NO: 754771 - DNA, 20 bp, mouse
ggaagtccctctgttctttt

SEQ ID NO: 754772 - DNA, 20 bp, mouse
gtgaaacagaagggttagat

SEQ ID NO: 754773 - DNA, 20 bp, mouse
gtgtgggttgggagtcaaac

SEQ ID NO: 754774 - DNA, 20 bp, mouse
gcttccctagcactcgaggg

SEQ ID NO: 754775 - DNA, 20 bp, mouse
ggggcacacatttggaacag

SEQ ID NO: 754776 - DNA, 20 bp, mouse
gctgggaaccgatggctctt

SEQ ID NO: 754777 - DNA, 20 bp, mouse
gagtaagctgaatggaggac

SEQ ID NO: 754778 - DNA, 20 bp, mouse
gggactgccaaattttccca

SEQ ID NO: 754779 - DNA, 20 bp, mouse
gatggaggacagggagactt

SEQ ID NO: 754780 - DNA, 20 bp, mouse
ggggagacttgggctcctga

SEQ ID NO: 754781 - DNA, 20 bp, mouse
gtgtcattctgggcttccca

SEQ ID NO: 754782 - DNA, 20 bp, mouse
gtgacagacagtaagctgaa

SEQ ID NO: 754783 - DNA, 20 bp, mouse
gttgaaaatgggtttgagaa

SEQ ID NO: 754784 - DNA, 20 bp, mouse
gatagggaataattgtcgaa

SEQ ID NO: 754785 - DNA, 20 bp, mouse
ggactatctaagattataga

SEQ ID NO: 754786 - DNA, 20 bp, mouse
gcccagaggagctctaaggg

SEQ ID NO: 754787 - DNA, 20 bp, mouse
gctactgggaatagtcccag

SEQ ID NO: 754788 - DNA, 20 bp, mouse
gagtcccagaggagctctaa

SEQ ID NO: 754789 - DNA, 20 bp, mouse
gggggcagaggttttacaaa

SEQ ID NO: 754790 - DNA, 20 bp, mouse
ggagcaatggaaatcagaca

SEQ ID NO: 754791 - DNA, 20 bp, mouse
gaaaaacagtaagggctact

SEQ ID NO: 754792 - DNA, 20 bp, mouse
gggttaggatggaatcctca

SEQ ID NO: 754793 - DNA, 20 bp, mouse
gccatcctaaccgacactga

SEQ ID NO: 754794 - DNA, 20 bp, mouse
ggccccccttagagctcctc

SEQ ID NO: 754795 - DNA, 20 bp, mouse
ggtacatgttcaagcctcct

SEQ ID NO: 754796 - DNA, 20 bp, mouse
gaggacggccagcttcggga

SEQ ID NO: 754797 - DNA, 20 bp, mouse
gggcgccagcagcaccaagc

SEQ ID NO: 754798 - DNA, 20 bp, mouse
gaagggcgcgccaagcagga

SEQ ID NO: 754799 - DNA, 20 bp, mouse
gccagcttcgggagggaagg

SEQ ID NO: 754800 - DNA, 20 bp, mouse
gcaagcaggacggccagctt

SEQ ID NO: 754801 - DNA, 20 bp, mouse
gccagcagcaccaagccggg

SEQ ID NO: 754802 - DNA, 20 bp, mouse
gaaccagggaagccggggag

SEQ ID NO: 754803 - DNA, 20 bp, mouse
gccccggcttccctggttca

SEQ ID NO: 754804 - DNA, 20 bp, mouse
ggcgaggccagacgcgggaa

SEQ ID NO: 754805 - DNA, 20 bp, mouse
ggcaggggtcgcagcagcgc

SEQ ID NO: 754806 - DNA, 20 bp, mouse
ggaagaggtgggttgatcta

SEQ ID NO: 754807 - DNA, 20 bp, mouse
gaaagactcaagaggaggac

SEQ ID NO: 754808 - DNA, 20 bp, mouse
gcctggcctaaagactcaag

SEQ ID NO: 754809 - DNA, 20 bp, mouse
gactatggagaggataggaa

SEQ ID NO: 754810 - DNA, 20 bp, mouse
gtgatctagggaggggagta

SEQ ID NO: 754811 - DNA, 20 bp, mouse
gggtcctcagggaactgctg

SEQ ID NO: 754812 - DNA, 20 bp, mouse
gctctgggttagcacatggc

SEQ ID NO: 754813 - DNA, 20 bp, mouse
ggaggggagtagggaagtgt

SEQ ID NO: 754814 - DNA, 20 bp, mouse
gggcctaaagactcaagagg

SEQ ID NO: 754815 - DNA, 20 bp, mouse
gacaggcttgttggtcctca

SEQ ID NO: 754816 - DNA, 20 bp, mouse
ggaagccccagtagggtcag

SEQ ID NO: 754817 - DNA, 20 bp, mouse
ggtggcgtgggcatagacgt

SEQ ID NO: 754818 - DNA, 20 bp, mouse
gttgtgaagggtgtctgccc

SEQ ID NO: 754819 - DNA, 20 bp, mouse
gcctagcatggacttgtgaa

SEQ ID NO: 754820 - DNA, 20 bp, mouse
ggcagggccagactatgcag

SEQ ID NO: 754821 - DNA, 20 bp, mouse
ggcagtggccatgtcccact

SEQ ID NO: 754822 - DNA, 20 bp, mouse
gtggagatcatggactatcg

SEQ ID NO: 754823 - DNA, 20 bp, mouse
gccccaggcaagagggggat

SEQ ID NO: 754824 - DNA, 20 bp, mouse
gccctcccccaggcaagagg

SEQ ID NO: 754825 - DNA, 20 bp, mouse
ggcgggcctacagacaggcg

SEQ ID NO: 754826 - DNA, 20 bp, mouse
gcacgacctgactcaaatga

SEQ ID NO: 754827 - DNA, 20 bp, mouse
ggcaggagcaggagtcttat

SEQ ID NO: 754828 - DNA, 20 bp, mouse
gcgggcttatagtctttgtg

SEQ ID NO: 754829 - DNA, 20 bp, mouse
gaggtcgtgccttagtgtag

SEQ ID NO: 754830 - DNA, 20 bp, mouse
gggagcccaggtaagcggaa

SEQ ID NO: 754831 - DNA, 20 bp, mouse
gggcggggagcccaggtaag

SEQ ID NO: 754832 - DNA, 20 bp, mouse
gtggaggatgacaagtgctt

SEQ ID NO: 754833 - DNA, 20 bp, mouse
gaacagaggtataaggtcac

SEQ ID NO: 754834 - DNA, 20 bp, mouse
gatgttctggggttctttga

SEQ ID NO: 754835 - DNA, 20 bp, mouse
gaggtcacaggagatgttct

SEQ ID NO: 754836 - DNA, 20 bp, mouse
ggagactcacaggtctgtct

SEQ ID NO: 754837 - DNA, 20 bp, mouse
ggtactactcgaatgaatgg

SEQ ID NO: 754838 - DNA, 20 bp, mouse
gggctctctgtgacaggcgt

SEQ ID NO: 754839 - DNA, 20 bp, mouse
ggtggcggggcgtgcgacgt

SEQ ID NO: 754840 - DNA, 20 bp, mouse
gtgtcacagagagccacccc

SEQ ID NO: 754841 - DNA, 20 bp, mouse
gcaaggccgagcgcgagccc

SEQ ID NO: 754842 - DNA, 20 bp, mouse
gtgtctcagggcaagggagt

SEQ ID NO: 754843 - DNA, 20 bp, mouse
gtgtgacaggcgtaggccgc

SEQ ID NO: 754844 - DNA, 20 bp, mouse
gacgggtgcagacttgtaac

SEQ ID NO: 754845 - DNA, 20 bp, mouse
gggcgtgcgacgtgggacta

SEQ ID NO: 754846 - DNA, 20 bp, mouse
gactcgcactgtctctactg

SEQ ID NO: 754847 - DNA, 20 bp, mouse
gcgcactgtctctactgagg

SEQ ID NO: 754848 - DNA, 20 bp, mouse
gtgaatgacaaacaagtata

SEQ ID NO: 754849 - DNA, 20 bp, mouse
gaggcagtttatggcaaaat

SEQ ID NO: 754850 - DNA, 20 bp, mouse
gctagaatggatgtggcacc

SEQ ID NO: 754851 - DNA, 20 bp, mouse
gaatacagttcaatacaagt

SEQ ID NO: 754852 - DNA, 20 bp, mouse
gattgtgctaacatatgcac

SEQ ID NO: 754853 - DNA, 20 bp, mouse
ggtatttcctttcagtcgta

SEQ ID NO: 754854 - DNA, 20 bp, mouse
ggagcttccctacgactgaa

SEQ ID NO: 754855 - DNA, 20 bp, mouse
gtaaaccatgaggcagttta

SEQ ID NO: 754856 - DNA, 20 bp, mouse
ggggcgtagctgatctgtga

SEQ ID NO: 754857 - DNA, 20 bp, mouse
ggggactggaggtcagcagt

SEQ ID NO: 754858 - DNA, 20 bp, mouse
ggggcgcgggcgggagagtg

SEQ ID NO: 754859 - DNA, 20 bp, mouse
ggggagagtgcggttctcag

SEQ ID NO: 754860 - DNA, 20 bp, mouse
gtacagtggaaactctggat

SEQ ID NO: 754861 - DNA, 20 bp, mouse
gggcgaggacagcggtgagt

SEQ ID NO: 754862 - DNA, 20 bp, mouse
gaggtcagcagtcggctcgg

SEQ ID NO: 754863 - DNA, 20 bp, mouse
gcagaccccgcagcttacag

SEQ ID NO: 754864 - DNA, 20 bp, mouse
gtggaggtcagcagtcggct

SEQ ID NO: 754865 - DNA, 20 bp, mouse
gtggatggggttcatgctga

SEQ ID NO: 754866 - DNA, 20 bp, mouse
ggacaggaacctcgccacga

SEQ ID NO: 754867 - DNA, 20 bp, mouse
gacgaaaggcagtctcagac

SEQ ID NO: 754868 - DNA, 20 bp, mouse
gcctggcttcagtgccctcg

SEQ ID NO: 754869 - DNA, 20 bp, mouse
gtctcagacagggaaccgac

SEQ ID NO: 754870 - DNA, 20 bp, mouse
gtccgcgcggaagctggcaa

SEQ ID NO: 754871 - DNA, 20 bp, mouse
ggagcagggcggggacgacc

SEQ ID NO: 754872 - DNA, 20 bp, mouse
gtgcacggaaatgcgaaaaa

SEQ ID NO: 754873 - DNA, 20 bp, mouse
gtttcgtggctcgggttcaa

SEQ ID NO: 754874 - DNA, 20 bp, mouse
gaaggccaagagtatagcga

SEQ ID NO: 754875 - DNA, 20 bp, mouse
ggcgcggaagctggcaaagg

SEQ ID NO: 754876 - DNA, 20 bp, mouse
ggacgccaggtctgacggaa

SEQ ID NO: 754877 - DNA, 20 bp, mouse
gtggttgaacccaggttgga

SEQ ID NO: 754878 - DNA, 20 bp, mouse
gtctgacggaacggggggag

SEQ ID NO: 754879 - DNA, 20 bp, mouse
ggggttctgagaattattgg

SEQ ID NO: 754880 - DNA, 20 bp, mouse
gacccgggcccggaaatagt

SEQ ID NO: 754881 - DNA, 20 bp, mouse
gcagagaagcttagacggtt

SEQ ID NO: 754882 - DNA, 20 bp, mouse
gacgaaggatctggagttag

SEQ ID NO: 754883 - DNA, 20 bp, mouse
ggccaggtctgacggaacgg

SEQ ID NO: 754884 - DNA, 20 bp, mouse
ggcgccacgcccactatttc

SEQ ID NO: 754885 - DNA, 20 bp, mouse
gagtgggcgtggcgcctgat

SEQ ID NO: 754886 - DNA, 20 bp, mouse
ggggccctcgtgttcggcta

SEQ ID NO: 754887 - DNA, 20 bp, mouse
gagtctccgcacagcattgt

SEQ ID NO: 754888 - DNA, 20 bp, mouse
gtgcctgtgcgcaccgctga

SEQ ID NO: 754889 - DNA, 20 bp, mouse
gaaagtcccgaactcctgtt

SEQ ID NO: 754890 - DNA, 20 bp, mouse
gcaacagcaggcgcaggata

SEQ ID NO: 754891 - DNA, 20 bp, mouse
gagtacacacaatccctcag

SEQ ID NO: 754892 - DNA, 20 bp, mouse
gggcaggacgagaacctata

SEQ ID NO: 754893 - DNA, 20 bp, mouse
gggtgaagggccctcgtgtt

SEQ ID NO: 754894 - DNA, 20 bp, mouse
gtccgtaattggtctttagt

SEQ ID NO: 754895 - DNA, 20 bp, mouse
gactcctgtttggctgtcta

SEQ ID NO: 754896 - DNA, 20 bp, mouse
gcaggcgcggagacaatact

SEQ ID NO: 754897 - DNA, 20 bp, mouse
ggcgtgcggaacacgactga

SEQ ID NO: 754898 - DNA, 20 bp, mouse
gtattcccctggcgagacaa

SEQ ID NO: 754899 - DNA, 20 bp, mouse
gcgcggagacaatactgggt

SEQ ID NO: 754900 - DNA, 20 bp, mouse
gtctcgccaggggaataagt

SEQ ID NO: 754901 - DNA, 20 bp, mouse
gcggaagcgacgctctatcc

SEQ ID NO: 754902 - DNA, 20 bp, mouse
gaccactgagttgaattcaa

SEQ ID NO: 754903 - DNA, 20 bp, mouse
gactaggcggtgcgacgcgc

SEQ ID NO: 754904 - DNA, 20 bp, mouse
gtgtccgggccgctctagcc

SEQ ID NO: 754905 - DNA, 20 bp, mouse
ggcggtgcgacgcgcaggcg

SEQ ID NO: 754906 - DNA, 20 bp, mouse
gaccggcggggacccgagtg

SEQ ID NO: 754907 - DNA, 20 bp, mouse
gagtccgggcgcgaagagga

SEQ ID NO: 754908 - DNA, 20 bp, mouse
gcgcgcgcaacgtgcacttc

SEQ ID NO: 754909 - DNA, 20 bp, mouse
gctcgggtccccgccggtag

SEQ ID NO: 754910 - DNA, 20 bp, mouse
ggtagcggtttcgttatgag

SEQ ID NO: 754911 - DNA, 20 bp, mouse
ggcggggacccgagtgtggc

SEQ ID NO: 754912 - DNA, 20 bp, mouse
gaacctgagcggcaggaaac

SEQ ID NO: 754913 - DNA, 20 bp, mouse
gggaaccagcaccacgggtc

SEQ ID NO: 754914 - DNA, 20 bp, mouse
gaaacagcccggtaagctct

SEQ ID NO: 754915 - DNA, 20 bp, mouse
gaagaggcgggaacgaccgg

SEQ ID NO: 754916 - DNA, 20 bp, mouse
gcggcagcgcgtgggggagg

SEQ ID NO: 754917 - DNA, 20 bp, mouse
gggtccgcgtactcacccct

SEQ ID NO: 754918 - DNA, 20 bp, mouse
gagccaagtaaggggtgctg

SEQ ID NO: 754919 - DNA, 20 bp, mouse
ggccgggcggctagagctct

SEQ ID NO: 754920 - DNA, 20 bp, mouse
gcggccgcggcagcgcgtgg

SEQ ID NO: 754921 - DNA, 20 bp, mouse
ggggagggggagtcgccggg

SEQ ID NO: 754922 - DNA, 20 bp, mouse
ggggacgcgcagctgagtcc

SEQ ID NO: 754923 - DNA, 20 bp, mouse
gtcacccctaggcgcagact

SEQ ID NO: 754924 - DNA, 20 bp, mouse
ggaactagagtggcactcga

SEQ ID NO: 754925 - DNA, 20 bp, mouse
ggccccacgggacccaacgg

SEQ ID NO: 754926 - DNA, 20 bp, mouse
gtggccctctcgggaagttg

SEQ ID NO: 754927 - DNA, 20 bp, mouse
gaaggcgccggggtcaagaa

SEQ ID NO: 754928 - DNA, 20 bp, mouse
gttagccacaacttcccgag

SEQ ID NO: 754929 - DNA, 20 bp, mouse
gcggtgggcgttctctatgc

SEQ ID NO: 754930 - DNA, 20 bp, mouse
gtgctgcctggggaaggtga

SEQ ID NO: 754931 - DNA, 20 bp, mouse
gtggggaaggtgagggcggt

SEQ ID NO: 754932 - DNA, 20 bp, mouse
gcccaggcagcagaaaacac

SEQ ID NO: 754933 - DNA, 20 bp, mouse
ggctaacttggttatgctga

SEQ ID NO: 754934 - DNA, 20 bp, mouse
gcgggaagttgtggctaact

SEQ ID NO: 754935 - DNA, 20 bp, mouse
ggaactggtacactttcaga

SEQ ID NO: 754936 - DNA, 20 bp, mouse
gagagcgaccgcatccgcgt

SEQ ID NO: 754937 - DNA, 20 bp, mouse
gcgaccgcatccgcgtcggt

SEQ ID NO: 754938 - DNA, 20 bp, mouse
gctctgcagcacgacagggg

SEQ ID NO: 754939 - DNA, 20 bp, mouse
gtcgctctgcagcacgacag

SEQ ID NO: 754940 - DNA, 20 bp, mouse
gggcccctgtcgcgctgcag

SEQ ID NO: 754941 - DNA, 20 bp, mouse
gcgacaggggcggggcagta

SEQ ID NO: 754942 - DNA, 20 bp, mouse
gggccgctgcagcgcgacag

SEQ ID NO: 754943 - DNA, 20 bp, mouse
gaagacatagcctaccgacg

SEQ ID NO: 754944 - DNA, 20 bp, mouse
gcacgctgtacggtaaaagt

SEQ ID NO: 754945 - DNA, 20 bp, mouse
gaatgactgaacacgctgta

SEQ ID NO: 754946 - DNA, 20 bp, mouse
gcggaaacttgaaacacctc

SEQ ID NO: 754947 - DNA, 20 bp, mouse
gaaaactgagaagaccctcg

SEQ ID NO: 754948 - DNA, 20 bp, mouse
gggccggcaaagctctgaac

SEQ ID NO: 754949 - DNA, 20 bp, mouse
gtgcgggttaaaggtcccac

SEQ ID NO: 754950 - DNA, 20 bp, mouse
gcggcccgcggacacaagac

SEQ ID NO: 754951 - DNA, 20 bp, mouse
ggtgtttcaagtttccgcga

SEQ ID NO: 754952 - DNA, 20 bp, mouse
ggagaagagacataaatgta

SEQ ID NO: 754953 - DNA, 20 bp, mouse
gactctataaaaggtgggac

SEQ ID NO: 754954 - DNA, 20 bp, mouse
gacaggtgatcgaacccagc

SEQ ID NO: 754955 - DNA, 20 bp, mouse
gtctggagcaggttatctgc

SEQ ID NO: 754956 - DNA, 20 bp, mouse
ggggcgggcctcaaggtctg

SEQ ID NO: 754957 - DNA, 20 bp, mouse
gctagctggcagtctgaggg

SEQ ID NO: 754958 - DNA, 20 bp, mouse
gagaactgcgtcagaggggt

SEQ ID NO: 754959 - DNA, 20 bp, mouse
ggggcggaggcacgtctcag

SEQ ID NO: 754960 - DNA, 20 bp, mouse
gtgcctagctggcagtctga

SEQ ID NO: 754961 - DNA, 20 bp, mouse
gccgggaaagtgagtacctg

SEQ ID NO: 754962 - DNA, 20 bp, mouse
gcggtgctctgtggcgaact

SEQ ID NO: 754963 - DNA, 20 bp, mouse
ggcactgcgtcggctggctg

SEQ ID NO: 754964 - DNA, 20 bp, mouse
gcggctggctggggcgttct

SEQ ID NO: 754965 - DNA, 20 bp, mouse
gctggctggggcgttcttgg

SEQ ID NO: 754966 - DNA, 20 bp, mouse
gtgaaaacgccggaagtagg

SEQ ID NO: 754967 - DNA, 20 bp, mouse
gaccgcagacgttgaggcgg

SEQ ID NO: 754968 - DNA, 20 bp, mouse
gaaagtggaaaacggaagtc

SEQ ID NO: 754969 - DNA, 20 bp, mouse
gggtagggattgacagacga

SEQ ID NO: 754970 - DNA, 20 bp, mouse
gtagaagaaaggcgcgaaag

SEQ ID NO: 754971 - DNA, 20 bp, mouse
ggcaaggtctgccgggaaag

SEQ ID NO: 754972 - DNA, 20 bp, mouse
gaggccccgcggcatcgctc

SEQ ID NO: 754973 - DNA, 20 bp, mouse
ggggcgggacacgctagccg

SEQ ID NO: 754974 - DNA, 20 bp, mouse
ggagtggccgagtgagcgat

SEQ ID NO: 754975 - DNA, 20 bp, mouse
gagtgagcgatcggtatccc

SEQ ID NO: 754976 - DNA, 20 bp, mouse
gcgtccgaatggccaggcca

SEQ ID NO: 754977 - DNA, 20 bp, mouse
gatggggtgtggccggacgg

SEQ ID NO: 754978 - DNA, 20 bp, mouse
gaggcccggtgctctgaaat

SEQ ID NO: 754979 - DNA, 20 bp, mouse
gaagtcagtgcgatggggtg

SEQ ID NO: 754980 - DNA, 20 bp, mouse
gcccagaagtcagtgcgatg

SEQ ID NO: 754981 - DNA, 20 bp, mouse
gacgctccgggccaggtaca

SEQ ID NO: 754982 - DNA, 20 bp, mouse
gtgtaccgccgcttgtttga

SEQ ID NO: 754983 - DNA, 20 bp, mouse
gaagacgagagaaggtgagg

SEQ ID NO: 754984 - DNA, 20 bp, mouse
gtgaacccaccgggctctga

SEQ ID NO: 754985 - DNA, 20 bp, mouse
ggaaacctgtcatcgtggac

SEQ ID NO: 754986 - DNA, 20 bp, mouse
ggggcggggaagaatcgcgg

SEQ ID NO: 754987 - DNA, 20 bp, mouse
gtctcagccaatcatcgggg

SEQ ID NO: 754988 - DNA, 20 bp, mouse
gggttgctcgggtcacgtga

SEQ ID NO: 754989 - DNA, 20 bp, mouse
gggtccggctaccgcctccg

SEQ ID NO: 754990 - DNA, 20 bp, mouse
gcacctgcagtctgccggtc

SEQ ID NO: 754991 - DNA, 20 bp, mouse
gagcgccaggctctggatga

SEQ ID NO: 754992 - DNA, 20 bp, mouse
gtcgggggggggggttgctc

SEQ ID NO: 754993 - DNA, 20 bp, mouse
gcaagaaagcgtgtatcctg

SEQ ID NO: 754994 - DNA, 20 bp, mouse
gtccaatgacgcgagagagg

SEQ ID NO: 754995 - DNA, 20 bp, mouse
gaaaggggcagcacccacgg

SEQ ID NO: 754996 - DNA, 20 bp, mouse
gctcccgcgtgcggacggtc

SEQ ID NO: 754997 - DNA, 20 bp, mouse
ggaagccccgcgggcgggga

SEQ ID NO: 754998 - DNA, 20 bp, mouse
gaaactggaggaagccccgc

SEQ ID NO: 754999 - DNA, 20 bp, mouse
gtgcggacggtctggcacaa

SEQ ID NO: 755000 - DNA, 20 bp, mouse
ggatggcgagcagtcccgga

SEQ ID NO: 755001 - DNA, 20 bp, mouse
gaccaccgagtgttccttgg

SEQ ID NO: 755002 - DNA, 20 bp, mouse
gcggggatggcgagcagtcc

SEQ ID NO: 755003 - DNA, 20 bp, mouse
gagcgagtctagaggcgccc

SEQ ID NO: 755004 - DNA, 20 bp, mouse
gtggaggaagccccgcgggc

SEQ ID NO: 755005 - DNA, 20 bp, mouse
gtgctcgcacacatccggca

SEQ ID NO: 755006 - DNA, 20 bp, mouse
gcggccgggaatccgcgccc

SEQ ID NO: 755007 - DNA, 20 bp, mouse
ggggaacgcaggaaacggac

SEQ ID NO: 755008 - DNA, 20 bp, mouse
ggggtcccacaggactaaac

SEQ ID NO: 755009 - DNA, 20 bp, mouse
gtcagtcaggggctgcatcg

SEQ ID NO: 755010 - DNA, 20 bp, mouse
ggggaatccgcgccctggct

SEQ ID NO: 755011 - DNA, 20 bp, mouse
gctggagcgggacgccgagg

SEQ ID NO: 755012 - DNA, 20 bp, mouse
gcacccagccaacactagac

SEQ ID NO: 755013 - DNA, 20 bp, mouse
gtggctccaggcggtaacta

SEQ ID NO: 755014 - DNA, 20 bp, mouse
gacacggtccgactggaact

SEQ ID NO: 755015 - DNA, 20 bp, mouse
ggagctggagcgggacgccg

SEQ ID NO: 755016 - DNA, 20 bp, mouse
gtatacgcatgcgcagtccg

SEQ ID NO: 755017 - DNA, 20 bp, mouse
gcgcatgcgcagtccgaggc

SEQ ID NO: 755018 - DNA, 20 bp, mouse
gcagtccgaggccggcttcc

SEQ ID NO: 755019 - DNA, 20 bp, mouse
gcacaaggacgacgcattcc

SEQ ID NO: 755020 - DNA, 20 bp, mouse
gcccttttcaggctgttatg

SEQ ID NO: 755021 - DNA, 20 bp, mouse
ggtgcgttgtcatggagacc

SEQ ID NO: 755022 - DNA, 20 bp, mouse
gaagtcagagtgcgttgtca

SEQ ID NO: 755023 - DNA, 20 bp, mouse
ggaaggcagcatcggatatg

SEQ ID NO: 755024 - DNA, 20 bp, mouse
gacaggagcagaactagaac

SEQ ID NO: 755025 - DNA, 20 bp, mouse
gtctgaccagacttttcaca

SEQ ID NO: 755026 - DNA, 20 bp, mouse
ggggctgttcactgttttta

SEQ ID NO: 755027 - DNA, 20 bp, mouse
ggcggtgcgcaagcagctta

SEQ ID NO: 755028 - DNA, 20 bp, mouse
ggcaaagtgtggtgcccttg

SEQ ID NO: 755029 - DNA, 20 bp, mouse
ggcagcttacggtgcacggg

SEQ ID NO: 755030 - DNA, 20 bp, mouse
gtgcggggccgggtgagggg

SEQ ID NO: 755031 - DNA, 20 bp, mouse
ggcggggtgcgctgtgccgg

SEQ ID NO: 755032 - DNA, 20 bp, mouse
gaggtatgcaggattctgtg

SEQ ID NO: 755033 - DNA, 20 bp, mouse
ggtgctgggatggggcaaat

SEQ ID NO: 755034 - DNA, 20 bp, mouse
gacggtgcacgggtggggga

SEQ ID NO: 755035 - DNA, 20 bp, mouse
ggcttacggtgcacgggtgg

SEQ ID NO: 755036 - DNA, 20 bp, mouse
ggggagatgtagtcaaattg

SEQ ID NO: 755037 - DNA, 20 bp, mouse
gcagactgggaaaggcatgt

SEQ ID NO: 755038 - DNA, 20 bp, mouse
ggagaagagccaggacataa

SEQ ID NO: 755039 - DNA, 20 bp, mouse
gccacggatggtgagaggac

SEQ ID NO: 755040 - DNA, 20 bp, mouse
gccagtccacggatggtgag

SEQ ID NO: 755041 - DNA, 20 bp, mouse
gagcgagcctcccagcgtct

SEQ ID NO: 755042 - DNA, 20 bp, mouse
gtccccacccaccggatttt

SEQ ID NO: 755043 - DNA, 20 bp, mouse
gcccaaaaatccggtgggtg

SEQ ID NO: 755044 - DNA, 20 bp, mouse
gcatctcccaaaaatccggt

SEQ ID NO: 755045 - DNA, 20 bp, mouse
gctagtccgttgctacaaaa

SEQ ID NO: 755046 - DNA, 20 bp, mouse
ggaggctgggagatggaaac

SEQ ID NO: 755047 - DNA, 20 bp, mouse
ggatacggggaagaagtgag

SEQ ID NO: 755048 - DNA, 20 bp, mouse
gggagacagtcgccctccaa

SEQ ID NO: 755049 - DNA, 20 bp, mouse
gaggggctccggacctttgg

SEQ ID NO: 755050 - DNA, 20 bp, mouse
gcccatggtgaacctagata

SEQ ID NO: 755051 - DNA, 20 bp, mouse
gcggtcacgtgacacgttgt

SEQ ID NO: 755052 - DNA, 20 bp, mouse
gcagtcgccctccaaaggtc

SEQ ID NO: 755053 - DNA, 20 bp, mouse
gattgcgaggcgagacagca

SEQ ID NO: 755054 - DNA, 20 bp, mouse
gcccggaagtagatctatcc

SEQ ID NO: 755055 - DNA, 20 bp, mouse
gcagcactgtggctattgcg

SEQ ID NO: 755056 - DNA, 20 bp, mouse
gttggcaagcctgttgggaa

SEQ ID NO: 755057 - DNA, 20 bp, mouse
gaagctgctggggaactcct

SEQ ID NO: 755058 - DNA, 20 bp, mouse
gggaaagggaggttgagctc

SEQ ID NO: 755059 - DNA, 20 bp, mouse
gcgtctgccaagtgcagccc

SEQ ID NO: 755060 - DNA, 20 bp, mouse
gggtccctaaaggaggcgga

SEQ ID NO: 755061 - DNA, 20 bp, mouse
gaggcttgccaaagctgctg

SEQ ID NO: 755062 - DNA, 20 bp, mouse
ggacgggcgttgctgccaat

SEQ ID NO: 755063 - DNA, 20 bp, mouse
gcagggtagcctttcccaac

SEQ ID NO: 755064 - DNA, 20 bp, mouse
gtctactgcgaatgggttca

SEQ ID NO: 755065 - DNA, 20 bp, mouse
gaaaaattatctactgcgaa

SEQ ID NO: 755066 - DNA, 20 bp, mouse
gtggtggcaaagaacgtttg

SEQ ID NO: 755067 - DNA, 20 bp, mouse
ggatacggaaccatagttac

SEQ ID NO: 755068 - DNA, 20 bp, mouse
gagatggttgactctagtgg

SEQ ID NO: 755069 - DNA, 20 bp, mouse
gttcccacagtgagtattat

SEQ ID NO: 755070 - DNA, 20 bp, mouse
gaatggctctactttgccaa

SEQ ID NO: 755071 - DNA, 20 bp, mouse
ggactccatacctgtaacta

SEQ ID NO: 755072 - DNA, 20 bp, mouse
gttgagaaacggaccggaag

SEQ ID NO: 755073 - DNA, 20 bp, mouse
gggaaccatagttacaggta

SEQ ID NO: 755074 - DNA, 20 bp, mouse
gcccggaccgctttgagaaa

SEQ ID NO: 755075 - DNA, 20 bp, mouse
gggaccacatgcaactttcg

SEQ ID NO: 755076 - DNA, 20 bp, mouse
ggcgcctgcgctgtcttcta

SEQ ID NO: 755077 - DNA, 20 bp, mouse
ggctatcggaatcctgtccc

SEQ ID NO: 755078 - DNA, 20 bp, mouse
gtgatggctaagtccagcct

SEQ ID NO: 755079 - DNA, 20 bp, mouse
ggtacggtctgtgacggcaa

SEQ ID NO: 755080 - DNA, 20 bp, mouse
gtctatggcgcgttgtgaat

SEQ ID NO: 755081 - DNA, 20 bp, mouse
ggccaccgccgcagtgctat

SEQ ID NO: 755082 - DNA, 20 bp, mouse
gtcccggtaccagcaggctc

SEQ ID NO: 755083 - DNA, 20 bp, mouse
ggcggtggcggtactaaagc

SEQ ID NO: 755084 - DNA, 20 bp, mouse
ggattccgatagcactgcgg

SEQ ID NO: 755085 - DNA, 20 bp, mouse
ggcgccatagaagacagcgc

SEQ ID NO: 755086 - DNA, 20 bp, mouse
gagcgaggaggcggggaagt

SEQ ID NO: 755087 - DNA, 20 bp, mouse
gccctcttgcgcatgcgcaa

SEQ ID NO: 755088 - DNA, 20 bp, mouse
gcatgctctgagcgaggagg

SEQ ID NO: 755089 - DNA, 20 bp, mouse
gattggaggagagtcaccta

SEQ ID NO: 755090 - DNA, 20 bp, mouse
gacacacgggaccatgtctg

SEQ ID NO: 755091 - DNA, 20 bp, mouse
gacctggctggtgtttgcgt

SEQ ID NO: 755092 - DNA, 20 bp, mouse
gtccatgcgtcgcagatcac

SEQ ID NO: 755093 - DNA, 20 bp, mouse
gcacaggagcgccccagaca

SEQ ID NO: 755094 - DNA, 20 bp, mouse
gactacattcaggtattcgg

SEQ ID NO: 755095 - DNA, 20 bp, mouse
gctgcgacgcatggaacctg

SEQ ID NO: 755096 - DNA, 20 bp, mouse
gactgcccgaacttcagggg

SEQ ID NO: 755097 - DNA, 20 bp, mouse
ggatcagtgtctcttgggaa

SEQ ID NO: 755098 - DNA, 20 bp, mouse
gagctcaacgactacttccg

SEQ ID NO: 755099 - DNA, 20 bp, mouse
gcgaacttcaggggagggcg

SEQ ID NO: 755100 - DNA, 20 bp, mouse
ggagactgcccgaacttcag

SEQ ID NO: 755101 - DNA, 20 bp, mouse
gctctgactcagtgatttat

SEQ ID NO: 755102 - DNA, 20 bp, mouse
gactacttccggggcatgcg

SEQ ID NO: 755103 - DNA, 20 bp, mouse
ggggttccggtagaaggctc

SEQ ID NO: 755104 - DNA, 20 bp, mouse
gtgggaaaggctacatgttt

SEQ ID NO: 755105 - DNA, 20 bp, mouse
gcggtagaaggctcaggaag

SEQ ID NO: 755106 - DNA, 20 bp, mouse
gctggggcgccctctaccag

SEQ ID NO: 755107 - DNA, 20 bp, mouse
gggtgacgatagtggggtgg

SEQ ID NO: 755108 - DNA, 20 bp, mouse
gagagggcgccccagagtgg

SEQ ID NO: 755109 - DNA, 20 bp, mouse
gggtagagggcgccccagag

SEQ ID NO: 755110 - DNA, 20 bp, mouse
gcgccctctaccagtggccg

SEQ ID NO: 755111 - DNA, 20 bp, mouse
ggagcccagagtgtaggaac

SEQ ID NO: 755112 - DNA, 20 bp, mouse
gcacccgccctcattgaaga

SEQ ID NO: 755113 - DNA, 20 bp, mouse
gtgcccgtcttcaatgaggg

SEQ ID NO: 755114 - DNA, 20 bp, mouse
gtggaactacagctcccgga

SEQ ID NO: 755115 - DNA, 20 bp, mouse
gctccaaaatgaccaggaga

SEQ ID NO: 755116 - DNA, 20 bp, mouse
gacgaccctgcgtgcttatg

SEQ ID NO: 755117 - DNA, 20 bp, mouse
gtggaggaggcggaactaaa

SEQ ID NO: 755118 - DNA, 20 bp, mouse
gtgcgcgaacccaaacataa

SEQ ID NO: 755119 - DNA, 20 bp, mouse
ggaactaaagggaacaggcg

SEQ ID NO: 755120 - DNA, 20 bp, mouse
gaagttgagttggggtatag

SEQ ID NO: 755121 - DNA, 20 bp, mouse
gaagggaacaggcgtggcca

SEQ ID NO: 755122 - DNA, 20 bp, mouse
gctaacccccataagcacgc

SEQ ID NO: 755123 - DNA, 20 bp, mouse
gtaagtaattaagaagacgg

SEQ ID NO: 755124 - DNA, 20 bp, mouse
gttaagaagacggtggttta

SEQ ID NO: 755125 - DNA, 20 bp, mouse
gttgagttggggtatagggg

SEQ ID NO: 755126 - DNA, 20 bp, mouse
ggctgtgcagaggacgacta

SEQ ID NO: 755127 - DNA, 20 bp, mouse
gcagatgctgggaccaagac

SEQ ID NO: 755128 - DNA, 20 bp, mouse
ggaggcagagcttagagtgc

SEQ ID NO: 755129 - DNA, 20 bp, mouse
gagatggcgtaaggtcacgt

SEQ ID NO: 755130 - DNA, 20 bp, mouse
gcaggaagaaagatggcgta

SEQ ID NO: 755131 - DNA, 20 bp, mouse
gggaccaagaccggtgccca

SEQ ID NO: 755132 - DNA, 20 bp, mouse
gcgcgtctgcgcagtggagt

SEQ ID NO: 755133 - DNA, 20 bp, mouse
gaagaatactgagacaagga

SEQ ID NO: 755134 - DNA, 20 bp, mouse
gctcccatgggcaccggtct

SEQ ID NO: 755135 - DNA, 20 bp, mouse
ggttctggcagacatgggaa

SEQ ID NO: 755136 - DNA, 20 bp, mouse
gaggatgggaactgcctgag

SEQ ID NO: 755137 - DNA, 20 bp, mouse
gcctgcacgggcaaagatgg

SEQ ID NO: 755138 - DNA, 20 bp, mouse
gaggcagttcccatccttat

SEQ ID NO: 755139 - DNA, 20 bp, mouse
gagtgcccgcagagcgggcc

SEQ ID NO: 755140 - DNA, 20 bp, mouse
ggtccctgcacgggcaaaga

SEQ ID NO: 755141 - DNA, 20 bp, mouse
ggccggcgcggaggagcgta

SEQ ID NO: 755142 - DNA, 20 bp, mouse
gaacgtggggcgtatgagtg

SEQ ID NO: 755143 - DNA, 20 bp, mouse
gccgctctgcgggcactcgc

SEQ ID NO: 755144 - DNA, 20 bp, mouse
ggcgtccgggcccgctctgc

SEQ ID NO: 755145 - DNA, 20 bp, mouse
gacagggtgtacgagatccc

SEQ ID NO: 755146 - DNA, 20 bp, mouse
gaggtctgatagtgcgggcc

SEQ ID NO: 755147 - DNA, 20 bp, mouse
gaaggtgagtgagatccctg

SEQ ID NO: 755148 - DNA, 20 bp, mouse
gggacgcgcaggcttctctc

SEQ ID NO: 755149 - DNA, 20 bp, mouse
gcagccccgcgcgatccaac

SEQ ID NO: 755150 - DNA, 20 bp, mouse
gaagagaggtctgatagtgc

SEQ ID NO: 755151 - DNA, 20 bp, mouse
gatgcctgttggatcgcgcg

SEQ ID NO: 755152 - DNA, 20 bp, mouse
gctgacacagggattgatag

SEQ ID NO: 755153 - DNA, 20 bp, mouse
gagtcctgggaccttcccat

SEQ ID NO: 755154 - DNA, 20 bp, mouse
gacgtaatgctgaaagtcct

SEQ ID NO: 755155 - DNA, 20 bp, mouse
ggatccaacaggcatcttcc

SEQ ID NO: 755156 - DNA, 20 bp, mouse
gagcgcgccgagccacgcgg

SEQ ID NO: 755157 - DNA, 20 bp, mouse
ggccaagggtgagccatcca

SEQ ID NO: 755158 - DNA, 20 bp, mouse
gggactgatcagctcgggac

SEQ ID NO: 755159 - DNA, 20 bp, mouse
gaagactcgcagcgcggcca

SEQ ID NO: 755160 - DNA, 20 bp, mouse
ggcgctgcgagtcttgtcct

SEQ ID NO: 755161 - DNA, 20 bp, mouse
gtggaaccctcgtgagacaa

SEQ ID NO: 755162 - DNA, 20 bp, mouse
ggagtcgcagaagtgtctat

SEQ ID NO: 755163 - DNA, 20 bp, mouse
gacgccgggtacaactctag

SEQ ID NO: 755164 - DNA, 20 bp, mouse
gcagtcgtgcctagatcatt

SEQ ID NO: 755165 - DNA, 20 bp, mouse
gaacgcggaacccgcggcgg

SEQ ID NO: 755166 - DNA, 20 bp, mouse
ggggtccgcccatacctggg

SEQ ID NO: 755167 - DNA, 20 bp, mouse
ggaccctccatcaatacttg

SEQ ID NO: 755168 - DNA, 20 bp, mouse
gtattagccaggtaccgccc

SEQ ID NO: 755169 - DNA, 20 bp, mouse
gggagctgatccacagcctc

SEQ ID NO: 755170 - DNA, 20 bp, mouse
ggcacccggctctggctctc

SEQ ID NO: 755171 - DNA, 20 bp, mouse
gaaagagaaccgcgtctctg

SEQ ID NO: 755172 - DNA, 20 bp, mouse
ggaacctcaagtattgatgg

SEQ ID NO: 755173 - DNA, 20 bp, mouse
gcagccggaagccccgacac

SEQ ID NO: 755174 - DNA, 20 bp, mouse
gggggcttccggctgtcaag

SEQ ID NO: 755175 - DNA, 20 bp, mouse
gtctccggtgtcggggcttc

SEQ ID NO: 755176 - DNA, 20 bp, mouse
gcggggcggggctgcgtcgg

SEQ ID NO: 755177 - DNA, 20 bp, mouse
gcgccccgggcaagcaacgg

SEQ ID NO: 755178 - DNA, 20 bp, mouse
ggcccggggcggggctgcgt

SEQ ID NO: 755179 - DNA, 20 bp, mouse
gcggcgatgcagaaccaggg

SEQ ID NO: 755180 - DNA, 20 bp, mouse
ggcctcggcccggaactcgc

SEQ ID NO: 755181 - DNA, 20 bp, mouse
gccgcagcatccacagaagg

SEQ ID NO: 755182 - DNA, 20 bp, mouse
gaggcgggacgcccgcaaaa

SEQ ID NO: 755183 - DNA, 20 bp, mouse
ggaggcctgccagacccgac

SEQ ID NO: 755184 - DNA, 20 bp, mouse
gaagccaccgttgcttgccc

SEQ ID NO: 755185 - DNA, 20 bp, mouse
gggcgccagcatgcatctag

SEQ ID NO: 755186 - DNA, 20 bp, mouse
gcgcgcgcccgatccacatc

SEQ ID NO: 755187 - DNA, 20 bp, mouse
ggggccgcaccccctccgct

SEQ ID NO: 755188 - DNA, 20 bp, mouse
ggcagagccggatgtggatc

SEQ ID NO: 755189 - DNA, 20 bp, mouse
gagcctcagccgagcggagg

SEQ ID NO: 755190 - DNA, 20 bp, mouse
gcaccccctccgctcggctg

SEQ ID NO: 755191 - DNA, 20 bp, mouse
gctgctctgtcgccttgagg

SEQ ID NO: 755192 - DNA, 20 bp, mouse
gcctcgccgactggtcacca

SEQ ID NO: 755193 - DNA, 20 bp, mouse
gtctgcgcgactgcgcggat

SEQ ID NO: 755194 - DNA, 20 bp, mouse
gctaagagcgaccgctccat

SEQ ID NO: 755195 - DNA, 20 bp, mouse
gcagtcccacggccggacta

SEQ ID NO: 755196 - DNA, 20 bp, mouse
gcctgctactaaaatcggga

SEQ ID NO: 755197 - DNA, 20 bp, mouse
gttgttgtctgggcaccttt

SEQ ID NO: 755198 - DNA, 20 bp, mouse
gggccaggctgcatttgttg

SEQ ID NO: 755199 - DNA, 20 bp, mouse
gttgcagaaagaaggcgggg

SEQ ID NO: 755200 - DNA, 20 bp, mouse
gagccctagttgcagaaaga

SEQ ID NO: 755201 - DNA, 20 bp, mouse
gttgggaatcctgagtccaa

SEQ ID NO: 755202 - DNA, 20 bp, mouse
ggggtagcgattttgttgtc

SEQ ID NO: 755203 - DNA, 20 bp, mouse
gagttcctgctactaaaatc

SEQ ID NO: 755204 - DNA, 20 bp, mouse
gcctagttgcagaaagaagg

SEQ ID NO: 755205 - DNA, 20 bp, mouse
gtacgcgcgcgaggcactct

SEQ ID NO: 755206 - DNA, 20 bp, mouse
gtgcggacagaacactagaa

SEQ ID NO: 755207 - DNA, 20 bp, mouse
gtcagacgggatgcagaaag

SEQ ID NO: 755208 - DNA, 20 bp, mouse
ggagtggtgacgcgaagctg

SEQ ID NO: 755209 - DNA, 20 bp, mouse
gagccaggagagtccgtaga

SEQ ID NO: 755210 - DNA, 20 bp, mouse
gcgctcgcacgcgctactcg

SEQ ID NO: 755211 - DNA, 20 bp, mouse
gctggagttggggttcagac

SEQ ID NO: 755212 - DNA, 20 bp, mouse
gacccctctacggactctcc

SEQ ID NO: 755213 - DNA, 20 bp, mouse
gccccggaaccggaagtcac

SEQ ID NO: 755214 - DNA, 20 bp, mouse
gtgctggaggtcacgcgctc

SEQ ID NO: 755215 - DNA, 20 bp, mouse
gctcggagcgcctggagttg

SEQ ID NO: 755216 - DNA, 20 bp, mouse
gcgctggaggacaccgaaga

SEQ ID NO: 755217 - DNA, 20 bp, mouse
gcagagagaggcctgaacgc

SEQ ID NO: 755218 - DNA, 20 bp, mouse
gaacacaagcgagactgata

SEQ ID NO: 755219 - DNA, 20 bp, mouse
ggcacccatacttacagaat

SEQ ID NO: 755220 - DNA, 20 bp, mouse
gagagaggcctgaacgctgg

SEQ ID NO: 755221 - DNA, 20 bp, mouse
gctgcccattctgtaagtat

SEQ ID NO: 755222 - DNA, 20 bp, mouse
gtagcccgaacgcggttccc

SEQ ID NO: 755223 - DNA, 20 bp, mouse
ggagcggtgtagcccgaacg

SEQ ID NO: 755224 - DNA, 20 bp, mouse
gtcagtagtggctggaatga

SEQ ID NO: 755225 - DNA, 20 bp, mouse
gctcccacaggggaagactc

SEQ ID NO: 755226 - DNA, 20 bp, mouse
gcgcacgcgcacgctctcca

SEQ ID NO: 755227 - DNA, 20 bp, mouse
gcgcacgctctccaggggag

SEQ ID NO: 755228 - DNA, 20 bp, mouse
ggtcacgcgccagtcggaga

SEQ ID NO: 755229 - DNA, 20 bp, mouse
gggctctccccgtctccgac

SEQ ID NO: 755230 - DNA, 20 bp, mouse
ggcgcgcgccccaggccgaa

SEQ ID NO: 755231 - DNA, 20 bp, mouse
gggaagtagggtaaaccgca

SEQ ID NO: 755232 - DNA, 20 bp, mouse
ggccctctgcgccttttctc

SEQ ID NO: 755233 - DNA, 20 bp, mouse
gccagctgcgcctgcgcagg

SEQ ID NO: 755234 - DNA, 20 bp, mouse
gctggcgcgtgacagccgtg

SEQ ID NO: 755235 - DNA, 20 bp, mouse
gctggggagtggaattttcc

SEQ ID NO: 755236 - DNA, 20 bp, mouse
gaggcaacgcgggccggcga

SEQ ID NO: 755237 - DNA, 20 bp, mouse
gtggaatgaaccattccctt

SEQ ID NO: 755238 - DNA, 20 bp, mouse
gccggcccgcgttgcctcat

SEQ ID NO: 755239 - DNA, 20 bp, mouse
ggaggggcgggtttaccgag

SEQ ID NO: 755240 - DNA, 20 bp, mouse
gccaaccccaggttcccatg

SEQ ID NO: 755241 - DNA, 20 bp, mouse
gccagcaccatgagcctctg

SEQ ID NO: 755242 - DNA, 20 bp, mouse
ggggaaagttcctacataaa

SEQ ID NO: 755243 - DNA, 20 bp, mouse
gtctgtgagcacccccacag

SEQ ID NO: 755244 - DNA, 20 bp, mouse
ggagagagagagtacgatga

SEQ ID NO: 755245 - DNA, 20 bp, mouse
ggaaccattccctttggggg

SEQ ID NO: 755246 - DNA, 20 bp, mouse
gagggctaagggagccggga

SEQ ID NO: 755247 - DNA, 20 bp, mouse
ggagagccctgtaaactcta

SEQ ID NO: 755248 - DNA, 20 bp, mouse
gagggacaatccaccagtga

SEQ ID NO: 755249 - DNA, 20 bp, mouse
gccgctgccctcactcaata

SEQ ID NO: 755250 - DNA, 20 bp, mouse
gaggaggccatattgagtga

SEQ ID NO: 755251 - DNA, 20 bp, mouse
gacaaaagtgacgacattgt

SEQ ID NO: 755252 - DNA, 20 bp, mouse
gccggccacggaaggaagtg

SEQ ID NO: 755253 - DNA, 20 bp, mouse
ggagcttcacaggcaggcgc

SEQ ID NO: 755254 - DNA, 20 bp, mouse
gcagtgagggcgaacgctag

SEQ ID NO: 755255 - DNA, 20 bp, mouse
ggaagcgagagccgtgggag

SEQ ID NO: 755256 - DNA, 20 bp, mouse
gaaagcgtctcggtaggatt

SEQ ID NO: 755257 - DNA, 20 bp, mouse
gaaatcacagggaaggtgac

SEQ ID NO: 755258 - DNA, 20 bp, mouse
gtactgcccagagaaatcac

SEQ ID NO: 755259 - DNA, 20 bp, mouse
ggagcagaaagcgtctcggt

SEQ ID NO: 755260 - DNA, 20 bp, mouse
gctggggtgagggtggaatc

SEQ ID NO: 755261 - DNA, 20 bp, mouse
gaccttccctgtgatttctc

SEQ ID NO: 755262 - DNA, 20 bp, mouse
gaaataatatgtagtctcat

SEQ ID NO: 755263 - DNA, 20 bp, mouse
ggcgtgagcagaaagcgtct

SEQ ID NO: 755264 - DNA, 20 bp, mouse
gtggaataaattaaccagac

SEQ ID NO: 755265 - DNA, 20 bp, mouse
gaagcactcggtaacaaaga

SEQ ID NO: 755266 - DNA, 20 bp, mouse
gacagggacaagaggagtcg

SEQ ID NO: 755267 - DNA, 20 bp, mouse
ggggacccggggaaaaggct

SEQ ID NO: 755268 - DNA, 20 bp, mouse
ggccagaagggctgcactgg

SEQ ID NO: 755269 - DNA, 20 bp, mouse
ggcagcccttctggccgctg

SEQ ID NO: 755270 - DNA, 20 bp, mouse
gggccgctgaggctccccgc

SEQ ID NO: 755271 - DNA, 20 bp, mouse
ggctgcaggcggcggagtcc

SEQ ID NO: 755272 - DNA, 20 bp, mouse
ggtcgggggacccggggaaa

SEQ ID NO: 755273 - DNA, 20 bp, mouse
gctcctcgctaggatctatc

SEQ ID NO: 755274 - DNA, 20 bp, mouse
gggcggggtgaggactgagg

SEQ ID NO: 755275 - DNA, 20 bp, mouse
gaggcggcggagtccgggcg

SEQ ID NO: 755276 - DNA, 20 bp, mouse
gcgaccgcgcggatcgctgg

SEQ ID NO: 755277 - DNA, 20 bp, mouse
gcgcctgcgtacagcgtaag

SEQ ID NO: 755278 - DNA, 20 bp, mouse
gcgggctaggtgagacacgg

SEQ ID NO: 755279 - DNA, 20 bp, mouse
gaaggggcgggctgggacgg

SEQ ID NO: 755280 - DNA, 20 bp, mouse
gccgcgggctaggtgagaca

SEQ ID NO: 755281 - DNA, 20 bp, mouse
gtgacgtcacacgcagcagg

SEQ ID NO: 755282 - DNA, 20 bp, mouse
gtcactgcagcgcgaccgcg

SEQ ID NO: 755283 - DNA, 20 bp, mouse
gctgcgtacagcgtaagggg

SEQ ID NO: 755284 - DNA, 20 bp, mouse
gggtacggtaatcaaggcgg

SEQ ID NO: 755285 - DNA, 20 bp, mouse
ggcgcgaccgcgcggatcgc

SEQ ID NO: 755286 - DNA, 20 bp, mouse
gtaggtctgggcaacgtcag

SEQ ID NO: 755287 - DNA, 20 bp, mouse
gtcccggaatgcataggtct

SEQ ID NO: 755288 - DNA, 20 bp, mouse
gaggcggtggctcgctccct

SEQ ID NO: 755289 - DNA, 20 bp, mouse
ggagaaggggctcaccggat

SEQ ID NO: 755290 - DNA, 20 bp, mouse
gagttggagcggttccgcga

SEQ ID NO: 755291 - DNA, 20 bp, mouse
ggcaagcgaactacatttcc

SEQ ID NO: 755292 - DNA, 20 bp, mouse
ggtaacgccttctggtccgg

SEQ ID NO: 755293 - DNA, 20 bp, mouse
ggtcccgctgcctagcctta

SEQ ID NO: 755294 - DNA, 20 bp, mouse
gcatttacggaagaaggcgg

SEQ ID NO: 755295 - DNA, 20 bp, mouse
ggcgttacccggagccttcg

SEQ ID NO: 755296 - DNA, 20 bp, mouse
ggcggcccgcggagagacaa

SEQ ID NO: 755297 - DNA, 20 bp, mouse
gctgcggtgtttgttgtcgc

SEQ ID NO: 755298 - DNA, 20 bp, mouse
gtgcgcgtcctcaactgtga

SEQ ID NO: 755299 - DNA, 20 bp, mouse
gtcaactgtgagggaagtgg

SEQ ID NO: 755300 - DNA, 20 bp, mouse
gtcacaggccggaacttgga

SEQ ID NO: 755301 - DNA, 20 bp, mouse
gttgaggacgcgcaagggac

SEQ ID NO: 755302 - DNA, 20 bp, mouse
ggtcacccgttgtctctccg

SEQ ID NO: 755303 - DNA, 20 bp, mouse
ggcgccacatggttaaaagc

SEQ ID NO: 755304 - DNA, 20 bp, mouse
gtggaagaatggaaccgctg

SEQ ID NO: 755305 - DNA, 20 bp, mouse
gccgcccccggggctgtgat

SEQ ID NO: 755306 - DNA, 20 bp, mouse
gagggtgcaagatgcacgcg

SEQ ID NO: 755307 - DNA, 20 bp, mouse
ggtatctcaaccacctcgga

SEQ ID NO: 755308 - DNA, 20 bp, mouse
gtgggctgagtgttctgaac

SEQ ID NO: 755309 - DNA, 20 bp, mouse
gcatcttgcaccctccgagg

SEQ ID NO: 755310 - DNA, 20 bp, mouse
ggacttggaaacagctgcga

SEQ ID NO: 755311 - DNA, 20 bp, mouse
gttgcgttatcgtacggaag

SEQ ID NO: 755312 - DNA, 20 bp, mouse
gagtcgaagaagtggtgaat

SEQ ID NO: 755313 - DNA, 20 bp, mouse
gctgtccagtgagtgattgt

SEQ ID NO: 755314 - DNA, 20 bp, mouse
ggcgtcccgcgtggctgccg

SEQ ID NO: 755315 - DNA, 20 bp, mouse
gcatgccggagcaagggaac

SEQ ID NO: 755316 - DNA, 20 bp, mouse
gggcaggaccccgagggaga

SEQ ID NO: 755317 - DNA, 20 bp, mouse
ggggctagcgctcaggagac

SEQ ID NO: 755318 - DNA, 20 bp, mouse
gaaactagaaggggtctaca

SEQ ID NO: 755319 - DNA, 20 bp, mouse
ggcccctgtagcaacagcca

SEQ ID NO: 755320 - DNA, 20 bp, mouse
ggcagggcttgccttctgct

SEQ ID NO: 755321 - DNA, 20 bp, mouse
gggctccgcggtacttcgcg

SEQ ID NO: 755322 - DNA, 20 bp, mouse
gttcgcgcggctgacctccg

SEQ ID NO: 755323 - DNA, 20 bp, mouse
gccccgagggagagggctga

SEQ ID NO: 755324 - DNA, 20 bp, mouse
gctaatggctgaagtattcg

SEQ ID NO: 755325 - DNA, 20 bp, mouse
gtccttcagccctctccctc

SEQ ID NO: 755326 - DNA, 20 bp, mouse
gcagccctccagatcggctt

SEQ ID NO: 755327 - DNA, 20 bp, mouse
gcctccaaagccgatctgga

SEQ ID NO: 755328 - DNA, 20 bp, mouse
ggtgccatcaccatttgaac

SEQ ID NO: 755329 - DNA, 20 bp, mouse
gttgtcgtcatcatcgtctg

SEQ ID NO: 755330 - DNA, 20 bp, mouse
gaggacagtcagttgtgatg

SEQ ID NO: 755331 - DNA, 20 bp, mouse
gaacacctccaaagccgatc

SEQ ID NO: 755332 - DNA, 20 bp, mouse
gtcggctttggaggtgttgg

SEQ ID NO: 755333 - DNA, 20 bp, mouse
gtatgggtagctgagaatga

SEQ ID NO: 755334 - DNA, 20 bp, mouse
gttcttgcccccagttcaaa

SEQ ID NO: 755335 - DNA, 20 bp, mouse
gccatcaccatttgaactgg

SEQ ID NO: 755336 - DNA, 20 bp, mouse
gcgggtggcgaaactgaagt

SEQ ID NO: 755337 - DNA, 20 bp, mouse
gtacccaaggccagagagtg

SEQ ID NO: 755338 - DNA, 20 bp, mouse
ggcctcccgcccacactctc

SEQ ID NO: 755339 - DNA, 20 bp, mouse
gtacctgcggaaaggggtca

SEQ ID NO: 755340 - DNA, 20 bp, mouse
gtggttggagccagctctcg

SEQ ID NO: 755341 - DNA, 20 bp, mouse
gagtgtgggcgggaggccgt

SEQ ID NO: 755342 - DNA, 20 bp, mouse
gctgaagtaggctaggtcga

SEQ ID NO: 755343 - DNA, 20 bp, mouse
ggggcggccgtccccattaa

SEQ ID NO: 755344 - DNA, 20 bp, mouse
gtggagccagctctcgtggt

SEQ ID NO: 755345 - DNA, 20 bp, mouse
gcggccgtccccattaaggg

SEQ ID NO: 755346 - DNA, 20 bp, mouse
gctctccgctgtcctatcgt

SEQ ID NO: 755347 - DNA, 20 bp, mouse
gggcgtgcaaggcggggttg

SEQ ID NO: 755348 - DNA, 20 bp, mouse
ggcctgagtggtatagatat

SEQ ID NO: 755349 - DNA, 20 bp, mouse
gttaaaaaaagaggcggagg

SEQ ID NO: 755350 - DNA, 20 bp, mouse
gtgcccgcggcgcgcctgag

SEQ ID NO: 755351 - DNA, 20 bp, mouse
gcatgcgcagctgcgcctct

SEQ ID NO: 755352 - DNA, 20 bp, mouse
gcggtccacgcaaagctctg

SEQ ID NO: 755353 - DNA, 20 bp, mouse
ggtcctatcgtcggcgtgca

SEQ ID NO: 755354 - DNA, 20 bp, mouse
gtatcgtcggcgtgcaaggc

SEQ ID NO: 755355 - DNA, 20 bp, mouse
gataggctgcgctgagacct

SEQ ID NO: 755356 - DNA, 20 bp, mouse
ggcggcgcgcgcagcgtgtg

SEQ ID NO: 755357 - DNA, 20 bp, mouse
gggcgcctgcagcaggtaaa

SEQ ID NO: 755358 - DNA, 20 bp, mouse
gtgggagtttatccagacgg

SEQ ID NO: 755359 - DNA, 20 bp, mouse
gtcaaggagcaccgtctcta

SEQ ID NO: 755360 - DNA, 20 bp, mouse
gtgaccccggaagcggtcct

SEQ ID NO: 755361 - DNA, 20 bp, mouse
gagcgtgtgtggctctgtgc

SEQ ID NO: 755362 - DNA, 20 bp, mouse
gaagcggtcctgggcgatca

SEQ ID NO: 755363 - DNA, 20 bp, mouse
gaacaagcctggcattccga

SEQ ID NO: 755364 - DNA, 20 bp, mouse
gtcgcccaggaccgcttccg

SEQ ID NO: 755365 - DNA, 20 bp, mouse
gagaaccacccaagacaaat

SEQ ID NO: 755366 - DNA, 20 bp, mouse
ggggcgccgcggtaccttgt

SEQ ID NO: 755367 - DNA, 20 bp, mouse
gaggcaacgcgggccggcga

SEQ ID NO: 755368 - DNA, 20 bp, mouse
gccggcccgcgttgcctcat

SEQ ID NO: 755369 - DNA, 20 bp, mouse
gtggaatgaaccattccctt

SEQ ID NO: 755370 - DNA, 20 bp, mouse
gccaaccccaggttcccatg

SEQ ID NO: 755371 - DNA, 20 bp, mouse
ggaggggcgggtttaccgag

SEQ ID NO: 755372 - DNA, 20 bp, mouse
ggaaccattccctttggggg

SEQ ID NO: 755373 - DNA, 20 bp, mouse
ggggaaagttcctacataaa

SEQ ID NO: 755374 - DNA, 20 bp, mouse
gccagcaccatgagcctctg

SEQ ID NO: 755375 - DNA, 20 bp, mouse
gaaagatggcggcgcccgta

SEQ ID NO: 755376 - DNA, 20 bp, mouse
gacgggacaaggatgacgat

SEQ ID NO: 755377 - DNA, 20 bp, mouse
ggctccctggagctccgcaa

SEQ ID NO: 755378 - DNA, 20 bp, mouse
ggcccctggcgagccaggaa

SEQ ID NO: 755379 - DNA, 20 bp, mouse
gtcactgaagggacgggaca

SEQ ID NO: 755380 - DNA, 20 bp, mouse
gcgtgtgcagccagaaccca

SEQ ID NO: 755381 - DNA, 20 bp, mouse
gcctggctcgccaggggctc

SEQ ID NO: 755382 - DNA, 20 bp, mouse
ggccatggacgcagccatct

SEQ ID NO: 755383 - DNA, 20 bp, mouse
gccggaaggggctggaggta

SEQ ID NO: 755384 - DNA, 20 bp, mouse
gggagcgcgcggctttttct

SEQ ID NO: 755385 - DNA, 20 bp, mouse
gccaaggaggagtttcgcta

SEQ ID NO: 755386 - DNA, 20 bp, mouse
gcctaagtgggcggtccgca

SEQ ID NO: 755387 - DNA, 20 bp, mouse
gtagcctatagagagggaga

SEQ ID NO: 755388 - DNA, 20 bp, mouse
gagagggagagggtaggtgc

SEQ ID NO: 755389 - DNA, 20 bp, mouse
ggggccaggagagatcgcgc

SEQ ID NO: 755390 - DNA, 20 bp, mouse
gtgaccagtgccagttctgc

SEQ ID NO: 755391 - DNA, 20 bp, mouse
gctaccctctccctctctat

SEQ ID NO: 755392 - DNA, 20 bp, mouse
gctcctactgcctaagtggg

SEQ ID NO: 755393 - DNA, 20 bp, mouse
ggaccgcccacttaggcagt

SEQ ID NO: 755394 - DNA, 20 bp, mouse
gtattctcctactgcctaag

SEQ ID NO: 755395 - DNA, 20 bp, mouse
gctgccctggacccgccctt

SEQ ID NO: 755396 - DNA, 20 bp, mouse
gcccaccaggccaaattcct

SEQ ID NO: 755397 - DNA, 20 bp, mouse
gggggcggagcccaggaatt

SEQ ID NO: 755398 - DNA, 20 bp, mouse
gggtcgagcccgaaccgtca

SEQ ID NO: 755399 - DNA, 20 bp, mouse
gtgagcgaatggatcggttc

SEQ ID NO: 755400 - DNA, 20 bp, mouse
gggcctgtaagcgtagaaac

SEQ ID NO: 755401 - DNA, 20 bp, mouse
gaggttgagaactgaggacc

SEQ ID NO: 755402 - DNA, 20 bp, mouse
ggggcgcagccatgacggtt

SEQ ID NO: 755403 - DNA, 20 bp, mouse
ggatcggttccggattgtca

SEQ ID NO: 755404 - DNA, 20 bp, mouse
ggcgcgacaagagctgccga

SEQ ID NO: 755405 - DNA, 20 bp, mouse
gccccagctccctgacaatc

SEQ ID NO: 755406 - DNA, 20 bp, mouse
ggaaccgtcgcaggatggaa

SEQ ID NO: 755407 - DNA, 20 bp, mouse
gacggaagaggcgtgtctgt

SEQ ID NO: 755408 - DNA, 20 bp, mouse
gggccggaggcttccgcaga

SEQ ID NO: 755409 - DNA, 20 bp, mouse
ggcagtcaaggatcagtcac

SEQ ID NO: 755410 - DNA, 20 bp, mouse
ggggcgggccgatcggccgg

SEQ ID NO: 755411 - DNA, 20 bp, mouse
gagagccggaaagccctctg

SEQ ID NO: 755412 - DNA, 20 bp, mouse
ggaggcgtgtctgtaggcgt

SEQ ID NO: 755413 - DNA, 20 bp, mouse
gaagagaaagcggaaggggc

SEQ ID NO: 755414 - DNA, 20 bp, mouse
gcggcgccctgtggcactcc

SEQ ID NO: 755415 - DNA, 20 bp, mouse
gagccctctgcggaagcctc

SEQ ID NO: 755416 - DNA, 20 bp, mouse
gcctcccggcggaagtcctg

SEQ ID NO: 755417 - DNA, 20 bp, mouse
ggactggcgccctgtgaaat

SEQ ID NO: 755418 - DNA, 20 bp, mouse
ggcgccctgtgaaatgggag

SEQ ID NO: 755419 - DNA, 20 bp, mouse
gttgaacaagcacctcccgg

SEQ ID NO: 755420 - DNA, 20 bp, mouse
gcgccagtcctgtcagtctt

SEQ ID NO: 755421 - DNA, 20 bp, mouse
gcgcccaagactgacaggac

SEQ ID NO: 755422 - DNA, 20 bp, mouse
gggcactgcaatagatgcgc

SEQ ID NO: 755423 - DNA, 20 bp, mouse
gtagccccaggacttccgcc

SEQ ID NO: 755424 - DNA, 20 bp, mouse
gggtgcttgttcaaatagat

SEQ ID NO: 755425 - DNA, 20 bp, mouse
gcctataaaaaaagaataag

SEQ ID NO: 755426 - DNA, 20 bp, mouse
gtagacctgtcaggacagat

SEQ ID NO: 755427 - DNA, 20 bp, mouse
gaaaaactaaggaaaccggg

SEQ ID NO: 755428 - DNA, 20 bp, mouse
gaggacagattgggatggta

SEQ ID NO: 755429 - DNA, 20 bp, mouse
gcatcccaatctgtcctgac

SEQ ID NO: 755430 - DNA, 20 bp, mouse
gacaaagatcggcaggtggg

SEQ ID NO: 755431 - DNA, 20 bp, mouse
gcagccgctgtgcggcggga

SEQ ID NO: 755432 - DNA, 20 bp, mouse
gaaaccctcccgccgcacag

SEQ ID NO: 755433 - DNA, 20 bp, mouse
gtgggcagcttttgtgactg

SEQ ID NO: 755434 - DNA, 20 bp, mouse
gggtgtgcgcagccgctgtg

SEQ ID NO: 755435 - DNA, 20 bp, mouse
ggtcacaaaagctgcccagc

SEQ ID NO: 755436 - DNA, 20 bp, mouse
gccagtcaggcttacttctg

SEQ ID NO: 755437 - DNA, 20 bp, mouse
gctcatggcagcaacgaaca

SEQ ID NO: 755438 - DNA, 20 bp, mouse
gacgaacagggctgcttgca

SEQ ID NO: 755439 - DNA, 20 bp, mouse
gcctgactggcattcatgca

SEQ ID NO: 755440 - DNA, 20 bp, mouse
gaacagggctgcttgcacgg

SEQ ID NO: 755441 - DNA, 20 bp, mouse
gggtcagacatcagatgtgc

SEQ ID NO: 755442 - DNA, 20 bp, mouse
gcttacttctgggggtctca

SEQ ID NO: 755443 - DNA, 20 bp, mouse
ggtaactaggagagtagtct

SEQ ID NO: 755444 - DNA, 20 bp, mouse
gtccctgcttcttagattga

SEQ ID NO: 755445 - DNA, 20 bp, mouse
ggcctgggctacacggtatt

SEQ ID NO: 755446 - DNA, 20 bp, mouse
gcggctgctcacatgtctaa

SEQ ID NO: 755447 - DNA, 20 bp, mouse
gctaagggcggaagcgtcaa

SEQ ID NO: 755448 - DNA, 20 bp, mouse
gggcggaagcgtcaaggggc

SEQ ID NO: 755449 - DNA, 20 bp, mouse
gcgccccgcaatgcggaagg

SEQ ID NO: 755450 - DNA, 20 bp, mouse
gacacgccccgcaatgcgga

SEQ ID NO: 755451 - DNA, 20 bp, mouse
gacccggggtcgccctcggt

SEQ ID NO: 755452 - DNA, 20 bp, mouse
ggctcccagtgcgcatgcgt

SEQ ID NO: 755453 - DNA, 20 bp, mouse
gtcgggacacgcactagggt

SEQ ID NO: 755454 - DNA, 20 bp, mouse
gcggcccgacgcatgcgcac

SEQ ID NO: 755455 - DNA, 20 bp, mouse
gcgaccccgggtcgccggag

SEQ ID NO: 755456 - DNA, 20 bp, mouse
ggggaagcgcgggaagataa

SEQ ID NO: 755457 - DNA, 20 bp, mouse
ggggctgcgctgctgaggga

SEQ ID NO: 755458 - DNA, 20 bp, mouse
ggggccgttgtcatggagga

SEQ ID NO: 755459 - DNA, 20 bp, mouse
gccccgggtcacgtgacttc

SEQ ID NO: 755460 - DNA, 20 bp, mouse
gcacccagggcggctgtcgc

SEQ ID NO: 755461 - DNA, 20 bp, mouse
gctccgggctgcacccaggg

SEQ ID NO: 755462 - DNA, 20 bp, mouse
ggggatggaaagctgatgct

SEQ ID NO: 755463 - DNA, 20 bp, mouse
gcagccgtcctccatgacaa

SEQ ID NO: 755464 - DNA, 20 bp, mouse
gcggctccgggctgcaccca

SEQ ID NO: 755465 - DNA, 20 bp, mouse
gagaacggcgccaccggctc

SEQ ID NO: 755466 - DNA, 20 bp, mouse
gcgcccgcatccttgtaaat

SEQ ID NO: 755467 - DNA, 20 bp, mouse
gtatcgagaggaacgagctg

SEQ ID NO: 755468 - DNA, 20 bp, mouse
gcccgcgcgctcagaggagg

SEQ ID NO: 755469 - DNA, 20 bp, mouse
ggagttggcactgtgaccag

SEQ ID NO: 755470 - DNA, 20 bp, mouse
ggggtcgcagcgccgcttgc

SEQ ID NO: 755471 - DNA, 20 bp, mouse
gcagtggtctgcactcagct

SEQ ID NO: 755472 - DNA, 20 bp, mouse
gacagcggagagggtcctcc

SEQ ID NO: 755473 - DNA, 20 bp, mouse
gtccttgtaaatgggcgagt

SEQ ID NO: 755474 - DNA, 20 bp, mouse
ggcgccgcttgctggcccgg

SEQ ID NO: 755475 - DNA, 20 bp, mouse
ggaccccgcgcgctcagagg

SEQ ID NO: 755476 - DNA, 20 bp, mouse
gccgcgactcctccatagga

SEQ ID NO: 755477 - DNA, 20 bp, mouse
gacgaccgcgactcctccat

SEQ ID NO: 755478 - DNA, 20 bp, mouse
gaggattagagctacggatc

SEQ ID NO: 755479 - DNA, 20 bp, mouse
gtggggataacatacacata

SEQ ID NO: 755480 - DNA, 20 bp, mouse
gggtcgtcgggtctgcgaga

SEQ ID NO: 755481 - DNA, 20 bp, mouse
ggggaggaagctacgctgca

SEQ ID NO: 755482 - DNA, 20 bp, mouse
gaagctacggagtcccgcga

SEQ ID NO: 755483 - DNA, 20 bp, mouse
gttaccgtctgaccttgcga

SEQ ID NO: 755484 - DNA, 20 bp, mouse
gcgtcctcaccttcctatgg

SEQ ID NO: 755485 - DNA, 20 bp, mouse
gttaaatagaaaatattctc

SEQ ID NO: 755486 - DNA, 20 bp, mouse
ggggtggaggcaaggcgccg

SEQ ID NO: 755487 - DNA, 20 bp, mouse
gtgtctctaagagggaagcg

SEQ ID NO: 755488 - DNA, 20 bp, mouse
gctaagagggaagcggggcg

SEQ ID NO: 755489 - DNA, 20 bp, mouse
gtgcagagactgtctctaag

SEQ ID NO: 755490 - DNA, 20 bp, mouse
gctgggaaatgtagtctggg

SEQ ID NO: 755491 - DNA, 20 bp, mouse
gggaaatgtagtctgggtgg

SEQ ID NO: 755492 - DNA, 20 bp, mouse
gaagcaaggcaagcactgta

SEQ ID NO: 755493 - DNA, 20 bp, mouse
gtcagaaagcggattgcagc

SEQ ID NO: 755494 - DNA, 20 bp, mouse
ggcggattgcagcgggtttg

SEQ ID NO: 755495 - DNA, 20 bp, mouse
gttcccacatctgtaatcag

SEQ ID NO: 755496 - DNA, 20 bp, mouse
gagccctcaggtcctgcgtc

SEQ ID NO: 755497 - DNA, 20 bp, mouse
ggtcctgcgtccgggtgggt

SEQ ID NO: 755498 - DNA, 20 bp, mouse
gaacgaccggtcctggggaa

SEQ ID NO: 755499 - DNA, 20 bp, mouse
gccaggcagaagcaaacgat

SEQ ID NO: 755500 - DNA, 20 bp, mouse
gacccggacgcaggacctga

SEQ ID NO: 755501 - DNA, 20 bp, mouse
gctcgacgtcatccggacgg

SEQ ID NO: 755502 - DNA, 20 bp, mouse
gtctgcctggttccgccgtc

SEQ ID NO: 755503 - DNA, 20 bp, mouse
ggtcccgcctcgacgtcatc

SEQ ID NO: 755504 - DNA, 20 bp, mouse
gcaagcggctggccgagccg

SEQ ID NO: 755505 - DNA, 20 bp, mouse
gccagccgcttgttccccct

SEQ ID NO: 755506 - DNA, 20 bp, mouse
gcggggcgtggcgagggaga

SEQ ID NO: 755507 - DNA, 20 bp, mouse
ggggtcgcgccggcccaaga

SEQ ID NO: 755508 - DNA, 20 bp, mouse
gccaacaccaggtccgacca

SEQ ID NO: 755509 - DNA, 20 bp, mouse
gaggactagctgacagtatc

SEQ ID NO: 755510 - DNA, 20 bp, mouse
gctaacgggaacacgggcgg

SEQ ID NO: 755511 - DNA, 20 bp, mouse
ggtggcgtgggtcggagtgt

SEQ ID NO: 755512 - DNA, 20 bp, mouse
ggagagggcgtggcgtgggt

SEQ ID NO: 755513 - DNA, 20 bp, mouse
gtcagtgcgcagccgcagga

SEQ ID NO: 755514 - DNA, 20 bp, mouse
ggagggagagggcgtggcgt

SEQ ID NO: 755515 - DNA, 20 bp, mouse
gcccgcctctccgcaggtgc

SEQ ID NO: 755516 - DNA, 20 bp, mouse
gctcgcagccgcctcagcgt

SEQ ID NO: 755517 - DNA, 20 bp, mouse
gcttcagaactggagatctt

SEQ ID NO: 755518 - DNA, 20 bp, mouse
gtctgaagtgaagagcttga

SEQ ID NO: 755519 - DNA, 20 bp, mouse
gaaggactctgcttagagga

SEQ ID NO: 755520 - DNA, 20 bp, mouse
gcggctccgggaatcttggg

SEQ ID NO: 755521 - DNA, 20 bp, mouse
gctgaggcggctgcgagccc

SEQ ID NO: 755522 - DNA, 20 bp, mouse
gccggagccgcgctggtccg

SEQ ID NO: 755523 - DNA, 20 bp, mouse
gttgattcccaacgctgagg

SEQ ID NO: 755524 - DNA, 20 bp, mouse
gaggaaagagtggcttgctc

SEQ ID NO: 755525 - DNA, 20 bp, mouse
gaggttgattcccaacgctg

SEQ ID NO: 755526 - DNA, 20 bp, mouse
gacgcagcccagcaagctgt

SEQ ID NO: 755527 - DNA, 20 bp, mouse
gagggtagacaggccatcgg

SEQ ID NO: 755528 - DNA, 20 bp, mouse
ggactctcgggtagagtggg

SEQ ID NO: 755529 - DNA, 20 bp, mouse
gtagagtgggaggggtcgag

SEQ ID NO: 755530 - DNA, 20 bp, mouse
gaatgcacgtccggactctc

SEQ ID NO: 755531 - DNA, 20 bp, mouse
gtggagacccacagcttgct

SEQ ID NO: 755532 - DNA, 20 bp, mouse
gcaacagggacgaggacagg

SEQ ID NO: 755533 - DNA, 20 bp, mouse
ggggctctctggcccgccga

SEQ ID NO: 755534 - DNA, 20 bp, mouse
gtcttgcatcaggtctggga

SEQ ID NO: 755535 - DNA, 20 bp, mouse
ggctccgcccaacagggacg

SEQ ID NO: 755536 - DNA, 20 bp, mouse
gcggccgcacgcctggaagg

SEQ ID NO: 755537 - DNA, 20 bp, mouse
ggcacccgcaggcgttccag

SEQ ID NO: 755538 - DNA, 20 bp, mouse
ggagcctgagcccgtcaccc

SEQ ID NO: 755539 - DNA, 20 bp, mouse
gtcaccccgggatgcagcga

SEQ ID NO: 755540 - DNA, 20 bp, mouse
ggcgtccttcgctgcatccc

SEQ ID NO: 755541 - DNA, 20 bp, mouse
ggctgccgctgcactctcgg

SEQ ID NO: 755542 - DNA, 20 bp, mouse
ggcactctcggaggtacgag

SEQ ID NO: 755543 - DNA, 20 bp, mouse
gtcggcccctggaacgcctg

SEQ ID NO: 755544 - DNA, 20 bp, mouse
gcgtacctccgagagtgcag

SEQ ID NO: 755545 - DNA, 20 bp, mouse
gcctgcccgggtcccgcaga

SEQ ID NO: 755546 - DNA, 20 bp, mouse
gaactctaacaggataacga

SEQ ID NO: 755547 - DNA, 20 bp, mouse
gtgtactacacggtcttcag

SEQ ID NO: 755548 - DNA, 20 bp, mouse
gctacagctgctgtactaca

SEQ ID NO: 755549 - DNA, 20 bp, mouse
ggctctctggcgtccgcggg

SEQ ID NO: 755550 - DNA, 20 bp, mouse
gcgaaagtgctgagtaacga

SEQ ID NO: 755551 - DNA, 20 bp, mouse
gcgtcaccccgtccctcagg

SEQ ID NO: 755552 - DNA, 20 bp, mouse
gtagcgtcaccccgtccctc

SEQ ID NO: 755553 - DNA, 20 bp, mouse
gccaggcgagcctactagtc

SEQ ID NO: 755554 - DNA, 20 bp, mouse
gtgctgagtaacgaaggcac

SEQ ID NO: 755555 - DNA, 20 bp, mouse
ggagagcgcatgcctcctga

SEQ ID NO: 755556 - DNA, 20 bp, mouse
gaccggtgggaaaatatctg

SEQ ID NO: 755557 - DNA, 20 bp, mouse
gatactgattggttgcaaac

SEQ ID NO: 755558 - DNA, 20 bp, mouse
ggggaccaatcgcttcttgg

SEQ ID NO: 755559 - DNA, 20 bp, mouse
gtcttcagagcataaccggt

SEQ ID NO: 755560 - DNA, 20 bp, mouse
gaccaatcgcttcttggagg

SEQ ID NO: 755561 - DNA, 20 bp, mouse
ggagggtaacagactatatg

SEQ ID NO: 755562 - DNA, 20 bp, mouse
gcccgcctccaagaagcgat

SEQ ID NO: 755563 - DNA, 20 bp, mouse
ggtccctacggcaagcgaag

SEQ ID NO: 755564 - DNA, 20 bp, mouse
gaagaatacaacaaacttca

SEQ ID NO: 755565 - DNA, 20 bp, mouse
gcttgctcgtaggatgtttt

SEQ ID NO: 755566 - DNA, 20 bp, mouse
gctgctgcttcctttttgga

SEQ ID NO: 755567 - DNA, 20 bp, mouse
gtcgccccgtcactcacgga

SEQ ID NO: 755568 - DNA, 20 bp, mouse
ggacccaggaacataatgat

SEQ ID NO: 755569 - DNA, 20 bp, mouse
gtcgagccagccaaagaccc

SEQ ID NO: 755570 - DNA, 20 bp, mouse
gaaaaggagcggaacagtgc

SEQ ID NO: 755571 - DNA, 20 bp, mouse
ggtcacagagacaaccgctg

SEQ ID NO: 755572 - DNA, 20 bp, mouse
gtgacggggcgagtccgcag

SEQ ID NO: 755573 - DNA, 20 bp, mouse
gcattatgttcctgggtctt

SEQ ID NO: 755574 - DNA, 20 bp, mouse
ggctccttttggattccggt

SEQ ID NO: 755575 - DNA, 20 bp, mouse
gactcacggaagggcaggac

SEQ ID NO: 755576 - DNA, 20 bp, mouse
ggaggaaagccgggttgtgt

SEQ ID NO: 755577 - DNA, 20 bp, mouse
gacaacccggctttcctcgc

SEQ ID NO: 755578 - DNA, 20 bp, mouse
gtccgcccgcgaggaaagcc

SEQ ID NO: 755579 - DNA, 20 bp, mouse
ggaactactctcactccctg

SEQ ID NO: 755580 - DNA, 20 bp, mouse
gcgcgctcgctctgagccca

SEQ ID NO: 755581 - DNA, 20 bp, mouse
ggagctgggaagcaagtaaa

SEQ ID NO: 755582 - DNA, 20 bp, mouse
gttgatggctagagcggagt

SEQ ID NO: 755583 - DNA, 20 bp, mouse
gcctcgcgggcggaggccct

SEQ ID NO: 755584 - DNA, 20 bp, mouse
gatggctagagcggagtcgg

SEQ ID NO: 755585 - DNA, 20 bp, mouse
ggagccttggctatccagga

SEQ ID NO: 755586 - DNA, 20 bp, mouse
ggacccaggtgaggggacgg

SEQ ID NO: 755587 - DNA, 20 bp, mouse
gggtgaaggtgtccccgcta

SEQ ID NO: 755588 - DNA, 20 bp, mouse
gtctgagtcggaaatctccc

SEQ ID NO: 755589 - DNA, 20 bp, mouse
gccatcggcgacctcaaacc

SEQ ID NO: 755590 - DNA, 20 bp, mouse
gcgctctcctgctggactcg

SEQ ID NO: 755591 - DNA, 20 bp, mouse
gacaacgctaccctgtctgg

SEQ ID NO: 755592 - DNA, 20 bp, mouse
ggtgtccccgctagggaggt

SEQ ID NO: 755593 - DNA, 20 bp, mouse
gtcgccgatggccgagacgc

SEQ ID NO: 755594 - DNA, 20 bp, mouse
gcggtctcgcgtctcggtcg

SEQ ID NO: 755595 - DNA, 20 bp, mouse
gtggggccagccaccagaca

SEQ ID NO: 755596 - DNA, 20 bp, mouse
gcagcagcggacatggagtt

SEQ ID NO: 755597 - DNA, 20 bp, mouse
gggaccggaagtgtgtaacc

SEQ ID NO: 755598 - DNA, 20 bp, mouse
gctggcgcagtgagcaatac

SEQ ID NO: 755599 - DNA, 20 bp, mouse
gatagtggagctgtggctct

SEQ ID NO: 755600 - DNA, 20 bp, mouse
gtctcacagtctacgtctac

SEQ ID NO: 755601 - DNA, 20 bp, mouse
gtgactgttgtggaatgatg

SEQ ID NO: 755602 - DNA, 20 bp, mouse
ggaagtgtgtaacctgggaa

SEQ ID NO: 755603 - DNA, 20 bp, mouse
gacggaagagcactgggcaa

SEQ ID NO: 755604 - DNA, 20 bp, mouse
gggacaagcaccgccgggag

SEQ ID NO: 755605 - DNA, 20 bp, mouse
gacatggtgtgctgatatgc

SEQ ID NO: 755606 - DNA, 20 bp, mouse
ggggcggggcggacgcagag

SEQ ID NO: 755607 - DNA, 20 bp, mouse
gagaaactagctatctagga

SEQ ID NO: 755608 - DNA, 20 bp, mouse
gccagaggtgagtgtctagg

SEQ ID NO: 755609 - DNA, 20 bp, mouse
ggcagcgccgggaggaaagg

SEQ ID NO: 755610 - DNA, 20 bp, mouse
gagggatggtgcagacgcag

SEQ ID NO: 755611 - DNA, 20 bp, mouse
gcgagcaggggcagcttccg

SEQ ID NO: 755612 - DNA, 20 bp, mouse
gagtgtctaggcgggaagag

SEQ ID NO: 755613 - DNA, 20 bp, mouse
gcgtgctcgtcggaggtcgg

SEQ ID NO: 755614 - DNA, 20 bp, mouse
ggacgagctgcagaagtatc

SEQ ID NO: 755615 - DNA, 20 bp, mouse
gacgaaccaaatagttcaac

SEQ ID NO: 755616 - DNA, 20 bp, mouse
gaggagctggagaataaaaa

SEQ ID NO: 755617 - DNA, 20 bp, mouse
ggaaacatacatatgagagt

SEQ ID NO: 755618 - DNA, 20 bp, mouse
gagacccttttatgcttcat

SEQ ID NO: 755619 - DNA, 20 bp, mouse
gagtctatgaactcaataat

SEQ ID NO: 755620 - DNA, 20 bp, mouse
gcataaaagggtcttgtttt

SEQ ID NO: 755621 - DNA, 20 bp, mouse
ggtgcctatgaagcataaaa

SEQ ID NO: 755622 - DNA, 20 bp, mouse
gtatgagagttggaaagcaa

SEQ ID NO: 755623 - DNA, 20 bp, mouse
gtacaagaaggaaaattggg

SEQ ID NO: 755624 - DNA, 20 bp, mouse
gaaggaaaattgggaggagc

SEQ ID NO: 755625 - DNA, 20 bp, mouse
gagttacaagaaggaaaatt

SEQ ID NO: 755626 - DNA, 20 bp, mouse
gacccctgagcagctgtccg

SEQ ID NO: 755627 - DNA, 20 bp, mouse
ggaggtgtgctgaggctcga

SEQ ID NO: 755628 - DNA, 20 bp, mouse
gggaaagagtctgggaacat

SEQ ID NO: 755629 - DNA, 20 bp, mouse
gaacatcgggaaggagcccg

SEQ ID NO: 755630 - DNA, 20 bp, mouse
gctgccctcgtggaccacag

SEQ ID NO: 755631 - DNA, 20 bp, mouse
gccacagaggaaactgagtc

SEQ ID NO: 755632 - DNA, 20 bp, mouse
gtggtgagatgtgatccatt

SEQ ID NO: 755633 - DNA, 20 bp, mouse
gctaggaccccgggcagggg

SEQ ID NO: 755634 - DNA, 20 bp, mouse
gggtgaatgagacaaagtgt

SEQ ID NO: 755635 - DNA, 20 bp, mouse
gggccaccattcagcgcaca

SEQ ID NO: 755636 - DNA, 20 bp, mouse
gcgaggagacggcctccgac

SEQ ID NO: 755637 - DNA, 20 bp, mouse
gagcctgcggagcgtggaca

SEQ ID NO: 755638 - DNA, 20 bp, mouse
ggtctcgagcagcccgtcgg

SEQ ID NO: 755639 - DNA, 20 bp, mouse
gggctcgggggacacagaca

SEQ ID NO: 755640 - DNA, 20 bp, mouse
ggcaaggcgccctccgggag

SEQ ID NO: 755641 - DNA, 20 bp, mouse
gtccacgctccgcaggctcg

SEQ ID NO: 755642 - DNA, 20 bp, mouse
gacacagacacggcccggga

SEQ ID NO: 755643 - DNA, 20 bp, mouse
gggaggaaggcggggtgcta

SEQ ID NO: 755644 - DNA, 20 bp, mouse
ggaggcctggaaagttccac

SEQ ID NO: 755645 - DNA, 20 bp, mouse
ggctcgcctagcacccggga

SEQ ID NO: 755646 - DNA, 20 bp, mouse
gaccgcgtcggaggccgcga

SEQ ID NO: 755647 - DNA, 20 bp, mouse
gggaccgggcggctgcaata

SEQ ID NO: 755648 - DNA, 20 bp, mouse
ggcgcgccggaccgcgtcgg

SEQ ID NO: 755649 - DNA, 20 bp, mouse
gggcggctgcaatatggcgg

SEQ ID NO: 755650 - DNA, 20 bp, mouse
gcgggcgcgccggaccgcgt

SEQ ID NO: 755651 - DNA, 20 bp, mouse
ggaagggccgctgctcgcaa

SEQ ID NO: 755652 - DNA, 20 bp, mouse
gcgccgagggctgcggtcca

SEQ ID NO: 755653 - DNA, 20 bp, mouse
gccgggcggctgcaatatgg

SEQ ID NO: 755654 - DNA, 20 bp, mouse
gggctgcaatatggcggagg

SEQ ID NO: 755655 - DNA, 20 bp, mouse
gagaacctcgcgaggcttga

SEQ ID NO: 755656 - DNA, 20 bp, mouse
gctgccgcgcacccaatcag

SEQ ID NO: 755657 - DNA, 20 bp, mouse
gcgcacccaatcagcggcga

SEQ ID NO: 755658 - DNA, 20 bp, mouse
gggaaggcttgtctgagcgt

SEQ ID NO: 755659 - DNA, 20 bp, mouse
ggtgagaataagactgtgga

SEQ ID NO: 755660 - DNA, 20 bp, mouse
gccaatcagcggcgaggggc

SEQ ID NO: 755661 - DNA, 20 bp, mouse
gaaaacgggcaagttcaagg

SEQ ID NO: 755662 - DNA, 20 bp, mouse
gttgccttgcacatggcttt

SEQ ID NO: 755663 - DNA, 20 bp, mouse
gaagccgaaagccatgtgca

SEQ ID NO: 755664 - DNA, 20 bp, mouse
ggcgcaggcgcagacctccc

SEQ ID NO: 755665 - DNA, 20 bp, mouse
gtggagtgagaataagactg

SEQ ID NO: 755666 - DNA, 20 bp, mouse
gagctgagggcacagctctg

SEQ ID NO: 755667 - DNA, 20 bp, mouse
gcgcaggcgtagtgcgtcac

SEQ ID NO: 755668 - DNA, 20 bp, mouse
gtggcagcgaagtcactaat

SEQ ID NO: 755669 - DNA, 20 bp, mouse
ggcggggcctagaagcctgc

SEQ ID NO: 755670 - DNA, 20 bp, mouse
ggacgctggggtccgagcga

SEQ ID NO: 755671 - DNA, 20 bp, mouse
ggacaggacaatccggggcg

SEQ ID NO: 755672 - DNA, 20 bp, mouse
gccccggattgtcctgtctc

SEQ ID NO: 755673 - DNA, 20 bp, mouse
gccaggatggcactgagctt

SEQ ID NO: 755674 - DNA, 20 bp, mouse
ggaaaaccatcctcacccgc

SEQ ID NO: 755675 - DNA, 20 bp, mouse
ggctttcggggcatgagctg

SEQ ID NO: 755676 - DNA, 20 bp, mouse
gccaggacgtgcaagtgtga

SEQ ID NO: 755677 - DNA, 20 bp, mouse
gctgccgtccacgcatgctc

SEQ ID NO: 755678 - DNA, 20 bp, mouse
gcatgctccggcgtggtgtc

SEQ ID NO: 755679 - DNA, 20 bp, mouse
gttacggacgcagaccgggt

SEQ ID NO: 755680 - DNA, 20 bp, mouse
gacgccggagcatgcgtgga

SEQ ID NO: 755681 - DNA, 20 bp, mouse
ggcacgtcctggctctgtta

SEQ ID NO: 755682 - DNA, 20 bp, mouse
gtgtctggtgactgccgacc

SEQ ID NO: 755683 - DNA, 20 bp, mouse
gccgcagctcctcgaaacaa

SEQ ID NO: 755684 - DNA, 20 bp, mouse
gtcgaaacaatggacacttt

SEQ ID NO: 755685 - DNA, 20 bp, mouse
gggcgcgggacggctcgcgc

SEQ ID NO: 755686 - DNA, 20 bp, mouse
gagcgcaggcggggaagaga

SEQ ID NO: 755687 - DNA, 20 bp, mouse
gcggtctacgaagaccaagt

SEQ ID NO: 755688 - DNA, 20 bp, mouse
ggcgaaccggttcctctcta

SEQ ID NO: 755689 - DNA, 20 bp, mouse
ggcgtctgggttctggatct

SEQ ID NO: 755690 - DNA, 20 bp, mouse
ggagaggaaccggttcgcga

SEQ ID NO: 755691 - DNA, 20 bp, mouse
gcctccgcagagccatagag

SEQ ID NO: 755692 - DNA, 20 bp, mouse
gtatggctctgcggagggag

SEQ ID NO: 755693 - DNA, 20 bp, mouse
ggctgtgctgctcgtccctg

SEQ ID NO: 755694 - DNA, 20 bp, mouse
ggctccgcccagtgtcctga

SEQ ID NO: 755695 - DNA, 20 bp, mouse
gggaagccgccgggactgga

SEQ ID NO: 755696 - DNA, 20 bp, mouse
gcagagaggggctggatgag

SEQ ID NO: 755697 - DNA, 20 bp, mouse
gtgtgccagaggggtatgaa

SEQ ID NO: 755698 - DNA, 20 bp, mouse
ggggggccctggtggaacac

SEQ ID NO: 755699 - DNA, 20 bp, mouse
gtgcaaaagcctggggatag

SEQ ID NO: 755700 - DNA, 20 bp, mouse
ggctccaagctgaaaagctc

SEQ ID NO: 755701 - DNA, 20 bp, mouse
gaatcccgagggtttaagat

SEQ ID NO: 755702 - DNA, 20 bp, mouse
gctacaggatggttaagtgg

SEQ ID NO: 755703 - DNA, 20 bp, mouse
gcccccatgtggctgtgtta

SEQ ID NO: 755704 - DNA, 20 bp, mouse
gatccagcccctctctgagg

SEQ ID NO: 755705 - DNA, 20 bp, mouse
gggattgctagagagaacag

SEQ ID NO: 755706 - DNA, 20 bp, mouse
ggtggatggtgggtccctaa

SEQ ID NO: 755707 - DNA, 20 bp, mouse
gtgtaagcaggtgtggatgg

SEQ ID NO: 755708 - DNA, 20 bp, mouse
gtccctgagaaggtacactt

SEQ ID NO: 755709 - DNA, 20 bp, mouse
gcccaccctgtaagcaggtg

SEQ ID NO: 755710 - DNA, 20 bp, mouse
gggtccctaagggctggaaa

SEQ ID NO: 755711 - DNA, 20 bp, mouse
gccctgtaagcaggtgtgga

SEQ ID NO: 755712 - DNA, 20 bp, mouse
gagctctaacagcccatctc

SEQ ID NO: 755713 - DNA, 20 bp, mouse
ggggcacccatgcaaaaagt

SEQ ID NO: 755714 - DNA, 20 bp, mouse
gagaggtaccactccaggtc

SEQ ID NO: 755715 - DNA, 20 bp, mouse
gctcccaagtgtaccttctc

SEQ ID NO: 755716 - DNA, 20 bp, mouse
gtagctgggagtgtgagcaa

SEQ ID NO: 755717 - DNA, 20 bp, mouse
gctaatcagagatgcatgtc

SEQ ID NO: 755718 - DNA, 20 bp, mouse
gctcagatcttcacctgccc

SEQ ID NO: 755719 - DNA, 20 bp, mouse
gaactgtctcagctgttaaa

SEQ ID NO: 755720 - DNA, 20 bp, mouse
gtctgcttccaaacctgggc

SEQ ID NO: 755721 - DNA, 20 bp, mouse
gcatgcatctctgattagct

SEQ ID NO: 755722 - DNA, 20 bp, mouse
gatcttcacctgcccaggtt

SEQ ID NO: 755723 - DNA, 20 bp, mouse
ggctgttaaagggagacata

SEQ ID NO: 755724 - DNA, 20 bp, mouse
gggtctgaacggatattgtc

SEQ ID NO: 755725 - DNA, 20 bp, mouse
gatgttctgatttccacctc

SEQ ID NO: 755726 - DNA, 20 bp, mouse
gcaagccgccgggttgtcaa

SEQ ID NO: 755727 - DNA, 20 bp, mouse
gaaccagtgcgcagactcac

SEQ ID NO: 755728 - DNA, 20 bp, mouse
ggggcctgcgggccacgccc

SEQ ID NO: 755729 - DNA, 20 bp, mouse
ggctggaacactgcctcttc

SEQ ID NO: 755730 - DNA, 20 bp, mouse
gcatccctctgccctaagag

SEQ ID NO: 755731 - DNA, 20 bp, mouse
ggaagtgagggaccagggcg

SEQ ID NO: 755732 - DNA, 20 bp, mouse
ggtaaacgatcaggtctctg

SEQ ID NO: 755733 - DNA, 20 bp, mouse
ggttgcccttgacaacccgg

SEQ ID NO: 755734 - DNA, 20 bp, mouse
gccagaagaggatcgaagtg

SEQ ID NO: 755735 - DNA, 20 bp, mouse
gagccctctcttagggcaga

SEQ ID NO: 755736 - DNA, 20 bp, mouse
gccagaggaagctacttgtg

SEQ ID NO: 755737 - DNA, 20 bp, mouse
gtcagtggggtgaaagggag

SEQ ID NO: 755738 - DNA, 20 bp, mouse
gcctctgagggcatctcagt

SEQ ID NO: 755739 - DNA, 20 bp, mouse
gtctttggaagggaacgcca

SEQ ID NO: 755740 - DNA, 20 bp, mouse
gtagctcggacactagtagt

SEQ ID NO: 755741 - DNA, 20 bp, mouse
gtccgcctgtctcccagagg

SEQ ID NO: 755742 - DNA, 20 bp, mouse
ggcctgtctcccagaggtgg

SEQ ID NO: 755743 - DNA, 20 bp, mouse
gagtggggtgaaagccatat

SEQ ID NO: 755744 - DNA, 20 bp, mouse
ggcatctcagtggggtgaaa

SEQ ID NO: 755745 - DNA, 20 bp, mouse
gggtactttgggctctttgg

SEQ ID NO: 755746 - DNA, 20 bp, mouse
ggtgcagataaattcaaggt

SEQ ID NO: 755747 - DNA, 20 bp, mouse
ggcagaatgtcagagtgtac

SEQ ID NO: 755748 - DNA, 20 bp, mouse
gagccaatgaatataatgtc

SEQ ID NO: 755749 - DNA, 20 bp, mouse
gggctctcggtgaaacttca

SEQ ID NO: 755750 - DNA, 20 bp, mouse
gcacggtcataaatactccg

SEQ ID NO: 755751 - DNA, 20 bp, mouse
gttatgaccgtgtctagaat

SEQ ID NO: 755752 - DNA, 20 bp, mouse
gcgaggtgcagataaattca

SEQ ID NO: 755753 - DNA, 20 bp, mouse
gagcctgacattatattcat

SEQ ID NO: 755754 - DNA, 20 bp, mouse
gcagaatcctattctagaca

SEQ ID NO: 755755 - DNA, 20 bp, mouse
gtctcggtgaaacttcaagg

SEQ ID NO: 755756 - DNA, 20 bp, mouse
gaaaaagcaagggtgctctt

SEQ ID NO: 755757 - DNA, 20 bp, mouse
gcctagatgcttcagtatta

SEQ ID NO: 755758 - DNA, 20 bp, mouse
gtccataaatcccacatctc

SEQ ID NO: 755759 - DNA, 20 bp, mouse
gtccgcatgaagataatcat

SEQ ID NO: 755760 - DNA, 20 bp, mouse
gacttgtcagataagtctcc

SEQ ID NO: 755761 - DNA, 20 bp, mouse
gaatgaagagctcatgacat

SEQ ID NO: 755762 - DNA, 20 bp, mouse
gcataattctgccagagatg

SEQ ID NO: 755763 - DNA, 20 bp, mouse
gtcactgatatcaatcagcc

SEQ ID NO: 755764 - DNA, 20 bp, mouse
ggatacacatagtatagttt

SEQ ID NO: 755765 - DNA, 20 bp, mouse
gtaaatactatgcagaagac

SEQ ID NO: 755766 - DNA, 20 bp, mouse
ggaacaaggggctaagtcag

SEQ ID NO: 755767 - DNA, 20 bp, mouse
gccagtggaagtggttttgc

SEQ ID NO: 755768 - DNA, 20 bp, mouse
gtaagaaggaagctggtata

SEQ ID NO: 755769 - DNA, 20 bp, mouse
gaggcagaatgaatagtgtt

SEQ ID NO: 755770 - DNA, 20 bp, mouse
gataccattaagaaggaagc

SEQ ID NO: 755771 - DNA, 20 bp, mouse
gtccttcttaatggtatact

SEQ ID NO: 755772 - DNA, 20 bp, mouse
gtcttagagccagatgctga

SEQ ID NO: 755773 - DNA, 20 bp, mouse
ggtcagtgggaaggtagagt

SEQ ID NO: 755774 - DNA, 20 bp, mouse
ggtgggaaggtagagtggga

SEQ ID NO: 755775 - DNA, 20 bp, mouse
ggccattagtgccctcaaat

SEQ ID NO: 755776 - DNA, 20 bp, mouse
gcatctcagccatcatatat

SEQ ID NO: 755777 - DNA, 20 bp, mouse
ggaggaaatgtcagaggcaa

SEQ ID NO: 755778 - DNA, 20 bp, mouse
gggttgcaatgtgcacttaa

SEQ ID NO: 755779 - DNA, 20 bp, mouse
gactgggctatataagatgt

SEQ ID NO: 755780 - DNA, 20 bp, mouse
gcagactgtttgattgtgtc

SEQ ID NO: 755781 - DNA, 20 bp, mouse
gcttaaatacaaatgaatat

SEQ ID NO: 755782 - DNA, 20 bp, mouse
gttgatcaagtgagagtatt

SEQ ID NO: 755783 - DNA, 20 bp, mouse
gccctataaaaattacaata

SEQ ID NO: 755784 - DNA, 20 bp, mouse
gttgtttactgtatgaaaaa

SEQ ID NO: 755785 - DNA, 20 bp, mouse
gcacatccacccatatatga

SEQ ID NO: 755786 - DNA, 20 bp, mouse
gccaaaccataatgactgat

SEQ ID NO: 755787 - DNA, 20 bp, mouse
gctaggaagagcccaaaaga

SEQ ID NO: 755788 - DNA, 20 bp, mouse
gaggtcagaaggtatgtcgt

SEQ ID NO: 755789 - DNA, 20 bp, mouse
ggggggaggagaaggcaata

SEQ ID NO: 755790 - DNA, 20 bp, mouse
gagtctgctatctacaaagg

SEQ ID NO: 755791 - DNA, 20 bp, mouse
gcttctcccatcagtcatta

SEQ ID NO: 755792 - DNA, 20 bp, mouse
gtcactgtatctttacacac

SEQ ID NO: 755793 - DNA, 20 bp, mouse
gtcatttagacaaatggata

SEQ ID NO: 755794 - DNA, 20 bp, mouse
gtgcctcttagtcagtggag

SEQ ID NO: 755795 - DNA, 20 bp, mouse
gaggcagaaccttttgcttc

SEQ ID NO: 755796 - DNA, 20 bp, mouse
gcggggtctcgggaagagag

SEQ ID NO: 755797 - DNA, 20 bp, mouse
gatcccacagggaatgtcct

SEQ ID NO: 755798 - DNA, 20 bp, mouse
gaagccaaggacattccctg

SEQ ID NO: 755799 - DNA, 20 bp, mouse
ggagctcaggctgatcccac

SEQ ID NO: 755800 - DNA, 20 bp, mouse
gtgagaaaggaatctgggcg

SEQ ID NO: 755801 - DNA, 20 bp, mouse
ggctgcgcctggacttccaa

SEQ ID NO: 755802 - DNA, 20 bp, mouse
gtcctgaactacaaaacttc

SEQ ID NO: 755803 - DNA, 20 bp, mouse
gcccctacatgtttaattat

SEQ ID NO: 755804 - DNA, 20 bp, mouse
gaagagctgagaaaggaatc

SEQ ID NO: 755805 - DNA, 20 bp, mouse
gcccaataattaaacatgta

SEQ ID NO: 755806 - DNA, 20 bp, mouse
gagtgccattgcttgtgtat

SEQ ID NO: 755807 - DNA, 20 bp, mouse
gagaatatgactagtagtct

SEQ ID NO: 755808 - DNA, 20 bp, mouse
gcagaaaatacggtgtcctt

SEQ ID NO: 755809 - DNA, 20 bp, mouse
gcattgcttgtgtattggtt

SEQ ID NO: 755810 - DNA, 20 bp, mouse
gtctctctctacacttgaaa

SEQ ID NO: 755811 - DNA, 20 bp, mouse
ggtagtatatgacttgccca

SEQ ID NO: 755812 - DNA, 20 bp, mouse
gcacagagtcatagaatttc

SEQ ID NO: 755813 - DNA, 20 bp, mouse
gaaaaaattagcaatgtaac

SEQ ID NO: 755814 - DNA, 20 bp, mouse
gaagccactctgctttaggg

SEQ ID NO: 755815 - DNA, 20 bp, mouse
ggtgttgcctgtcacttaaa

SEQ ID NO: 755816 - DNA, 20 bp, mouse
gaaccagttttgatagagtg

SEQ ID NO: 755817 - DNA, 20 bp, mouse
gatgagagaaagtttttgga

SEQ ID NO: 755818 - DNA, 20 bp, mouse
gtttgatagagtgaggggtg

SEQ ID NO: 755819 - DNA, 20 bp, mouse
gcccctcactctatcaaaac

SEQ ID NO: 755820 - DNA, 20 bp, mouse
gtcattaaatagtagttaga

SEQ ID NO: 755821 - DNA, 20 bp, mouse
gggcattgcatgcagctagt

SEQ ID NO: 755822 - DNA, 20 bp, mouse
gtagtagttagaaggaagac

SEQ ID NO: 755823 - DNA, 20 bp, mouse
gtaagatgagagaaagtttt

SEQ ID NO: 755824 - DNA, 20 bp, mouse
gacaaagaacagcaacatgc

SEQ ID NO: 755825 - DNA, 20 bp, mouse
gaactttctctcatcttaat

SEQ ID NO: 755826 - DNA, 20 bp, mouse
ggaagggaagtggtgcttac

SEQ ID NO: 755827 - DNA, 20 bp, mouse
gtgtgctcgctgcacgggaa

SEQ ID NO: 755828 - DNA, 20 bp, mouse
gagtggagctggtgcgtgtt

SEQ ID NO: 755829 - DNA, 20 bp, mouse
gtaagagatttgagagagtg

SEQ ID NO: 755830 - DNA, 20 bp, mouse
gcgctgcacgggaagggaag

SEQ ID NO: 755831 - DNA, 20 bp, mouse
gtaagaagaaagttttctga

SEQ ID NO: 755832 - DNA, 20 bp, mouse
gagtgaacttgggcttcaag

SEQ ID NO: 755833 - DNA, 20 bp, mouse
gactgaaaacagcaacaagc

SEQ ID NO: 755834 - DNA, 20 bp, mouse
gtcttctaagtagaatttaa

SEQ ID NO: 755835 - DNA, 20 bp, mouse
gttcttctgtgctcgctgca

SEQ ID NO: 755836 - DNA, 20 bp, mouse
gaaccaggaaaatgactaat

SEQ ID NO: 755837 - DNA, 20 bp, mouse
gggaagtggcgcttacagtc

SEQ ID NO: 755838 - DNA, 20 bp, mouse
ggtaagcataatgcacactg

SEQ ID NO: 755839 - DNA, 20 bp, mouse
gccagttctgggagacttgt

SEQ ID NO: 755840 - DNA, 20 bp, mouse
gtgactaattggaccagttc

SEQ ID NO: 755841 - DNA, 20 bp, mouse
gactccactgacactaagtc

SEQ ID NO: 755842 - DNA, 20 bp, mouse
gatctagaatacacattcag

SEQ ID NO: 755843 - DNA, 20 bp, mouse
gaggatcagatcagaaatta

SEQ ID NO: 755844 - DNA, 20 bp, mouse
ggcactgacatttttatcac

SEQ ID NO: 755845 - DNA, 20 bp, mouse
gtctatgaaaaaggaagtaa

SEQ ID NO: 755846 - DNA, 20 bp, mouse
gcaaaatgactgagtgtcaa

SEQ ID NO: 755847 - DNA, 20 bp, mouse
gggaggaaacagctggtaag

SEQ ID NO: 755848 - DNA, 20 bp, mouse
ggtaatcacgagtacttccg

SEQ ID NO: 755849 - DNA, 20 bp, mouse
ggaaacaaatttggtcaagt

SEQ ID NO: 755850 - DNA, 20 bp, mouse
gctgacttacagaattaatg

SEQ ID NO: 755851 - DNA, 20 bp, mouse
ggaagtactcgtgattacac

SEQ ID NO: 755852 - DNA, 20 bp, mouse
gttacagaattaatgaggaa

SEQ ID NO: 755853 - DNA, 20 bp, mouse
gaggcagacagtgcaacttc

SEQ ID NO: 755854 - DNA, 20 bp, mouse
gctttctgaagtttgaggtt

SEQ ID NO: 755855 - DNA, 20 bp, mouse
gtgcagtaattacaagtagt

SEQ ID NO: 755856 - DNA, 20 bp, mouse
gcaaagaaatacatgatccc

SEQ ID NO: 755857 - DNA, 20 bp, mouse
ggtgcctgaatggagagttg

SEQ ID NO: 755858 - DNA, 20 bp, mouse
ggggcttcaaggtgcctgaa

SEQ ID NO: 755859 - DNA, 20 bp, mouse
gctgtgctgaaatagaggac

SEQ ID NO: 755860 - DNA, 20 bp, mouse
gagaatgacctggacattca

SEQ ID NO: 755861 - DNA, 20 bp, mouse
gacagagagagctgtggagc

SEQ ID NO: 755862 - DNA, 20 bp, mouse
gtggagagttgaggttgtgc

SEQ ID NO: 755863 - DNA, 20 bp, mouse
gtgacctggacattcagggc

SEQ ID NO: 755864 - DNA, 20 bp, mouse
gaatacagctcattttgtca

SEQ ID NO: 755865 - DNA, 20 bp, mouse
gtctttcctgggtgaggcct

SEQ ID NO: 755866 - DNA, 20 bp, mouse
gacaagacaagcacaacctg

SEQ ID NO: 755867 - DNA, 20 bp, mouse
gaggctggaatccattgcta

SEQ ID NO: 755868 - DNA, 20 bp, mouse
gagatggcggatgaggacct

SEQ ID NO: 755869 - DNA, 20 bp, mouse
ggctgtctgtggaggcagta

SEQ ID NO: 755870 - DNA, 20 bp, mouse
gctctgtgtgaccttagcaa

SEQ ID NO: 755871 - DNA, 20 bp, mouse
gacagcatctccagctaaca

SEQ ID NO: 755872 - DNA, 20 bp, mouse
gcagaccagtggctatctgt

SEQ ID NO: 755873 - DNA, 20 bp, mouse
gaactcagtatgtatatact

SEQ ID NO: 755874 - DNA, 20 bp, mouse
gggatctccccatatccctt

SEQ ID NO: 755875 - DNA, 20 bp, mouse
gttagcaaaatgttggccta

SEQ ID NO: 755876 - DNA, 20 bp, mouse
gagggcccggaggatgtgtc

SEQ ID NO: 755877 - DNA, 20 bp, mouse
gggcctcacccctgttgtga

SEQ ID NO: 755878 - DNA, 20 bp, mouse
gcatgagggcgcgggagtga

SEQ ID NO: 755879 - DNA, 20 bp, mouse
ggggaaaggcgaagatttgc

SEQ ID NO: 755880 - DNA, 20 bp, mouse
gcggccgctcctctcccggg

SEQ ID NO: 755881 - DNA, 20 bp, mouse
ggggcgcgggagtgaaggac

SEQ ID NO: 755882 - DNA, 20 bp, mouse
gtcgccgcggtcagagggcc

SEQ ID NO: 755883 - DNA, 20 bp, mouse
gaggagcggccggcaccagc

SEQ ID NO: 755884 - DNA, 20 bp, mouse
gcctccgggccctctgaccg

SEQ ID NO: 755885 - DNA, 20 bp, mouse
gccagccagacacatcctcc

SEQ ID NO: 755886 - DNA, 20 bp, mouse
ggggcagcgcggcggaaccg

SEQ ID NO: 755887 - DNA, 20 bp, mouse
gtggcccgggagctgcggaa

SEQ ID NO: 755888 - DNA, 20 bp, mouse
ggcggaaccggggctcggga

SEQ ID NO: 755889 - DNA, 20 bp, mouse
ggcagctcccgggccaaggt

SEQ ID NO: 755890 - DNA, 20 bp, mouse
gaggctcgcgctaactcgtg

SEQ ID NO: 755891 - DNA, 20 bp, mouse
gaccctgtgtgcctacccag

SEQ ID NO: 755892 - DNA, 20 bp, mouse
gggaaggtgggggactgcac

SEQ ID NO: 755893 - DNA, 20 bp, mouse
ggcgctgcccaccttggccc

SEQ ID NO: 755894 - DNA, 20 bp, mouse
gagggcccacgtcagtcagg

SEQ ID NO: 755895 - DNA, 20 bp, mouse
ggggcggcttaaacaactgg

SEQ ID NO: 755896 - DNA, 20 bp, mouse
gtgaacacagttcacaattt

SEQ ID NO: 755897 - DNA, 20 bp, mouse
ggaagattgggctcaaacag

SEQ ID NO: 755898 - DNA, 20 bp, mouse
gttacaagttatttgagcta

SEQ ID NO: 755899 - DNA, 20 bp, mouse
gaaacacagcttaaaatcac

SEQ ID NO: 755900 - DNA, 20 bp, mouse
gtatagggctaaattaaatc

SEQ ID NO: 755901 - DNA, 20 bp, mouse
gagtatgttttgtgagttat

SEQ ID NO: 755902 - DNA, 20 bp, mouse
gagtaatacaggttactggt

SEQ ID NO: 755903 - DNA, 20 bp, mouse
gcaagttatttgagctatgg

SEQ ID NO: 755904 - DNA, 20 bp, mouse
ggcatcaattcacaacacaa

SEQ ID NO: 755905 - DNA, 20 bp, mouse
gcttgtaacactagaagatt

SEQ ID NO: 755906 - DNA, 20 bp, mouse
gctaaccgcagggttcaggg

SEQ ID NO: 755907 - DNA, 20 bp, mouse
gccgctaaccgcagggttca

SEQ ID NO: 755908 - DNA, 20 bp, mouse
gtactctgagggtcagtcgt

SEQ ID NO: 755909 - DNA, 20 bp, mouse
ggtggggcaggggcgtggaa

SEQ ID NO: 755910 - DNA, 20 bp, mouse
gacctcgcacagatactctg

SEQ ID NO: 755911 - DNA, 20 bp, mouse
gcccctcggcaaagtagagg

SEQ ID NO: 755912 - DNA, 20 bp, mouse
gcctgcggttagcggggcgg

SEQ ID NO: 755913 - DNA, 20 bp, mouse
gaaccctgcggttagcgggg

SEQ ID NO: 755914 - DNA, 20 bp, mouse
gtgcgaggtaagtgagattt

SEQ ID NO: 755915 - DNA, 20 bp, mouse
gtgaaagggggacaagaggt

SEQ ID NO: 755916 - DNA, 20 bp, mouse
gaaagggggcccctggtgga

SEQ ID NO: 755917 - DNA, 20 bp, mouse
ggaagaaccaaggaccgaga

SEQ ID NO: 755918 - DNA, 20 bp, mouse
ggaggggaaagtgacacccg

SEQ ID NO: 755919 - DNA, 20 bp, mouse
gataccgggaggtgtaggtg

SEQ ID NO: 755920 - DNA, 20 bp, mouse
gtgggaaagggggcccctgg

SEQ ID NO: 755921 - DNA, 20 bp, mouse
ggtaggtgagggagtcctca

SEQ ID NO: 755922 - DNA, 20 bp, mouse
gcctgtggaactcattaata

SEQ ID NO: 755923 - DNA, 20 bp, mouse
gagatgctaattatcaaaga

SEQ ID NO: 755924 - DNA, 20 bp, mouse
gtgtttaaagacattttagc

SEQ ID NO: 755925 - DNA, 20 bp, mouse
gtatgcccaccctgggaaat

SEQ ID NO: 755926 - DNA, 20 bp, mouse
ggcgctgcgccccggtgggt

SEQ ID NO: 755927 - DNA, 20 bp, mouse
gaggccggacgaggtttagg

SEQ ID NO: 755928 - DNA, 20 bp, mouse
gcctgcaaggctgcagaagt

SEQ ID NO: 755929 - DNA, 20 bp, mouse
gaaacctcgtccggcctctg

SEQ ID NO: 755930 - DNA, 20 bp, mouse
gatgcagcgctgcgccccgg

SEQ ID NO: 755931 - DNA, 20 bp, mouse
ggcggtagactcccacccac

SEQ ID NO: 755932 - DNA, 20 bp, mouse
gccaactgcagcgtctcctt

SEQ ID NO: 755933 - DNA, 20 bp, mouse
ggcttcgtgcgcttctttga

SEQ ID NO: 755934 - DNA, 20 bp, mouse
gtggagcggctcggaaatgg

SEQ ID NO: 755935 - DNA, 20 bp, mouse
ggggtcgctctgtgctctag

SEQ ID NO: 755936 - DNA, 20 bp, mouse
gcccaaggccggtcccgcac

SEQ ID NO: 755937 - DNA, 20 bp, mouse
ggcaagtggtacacagctca

SEQ ID NO: 755938 - DNA, 20 bp, mouse
gccagggagcctgtgagcaa

SEQ ID NO: 755939 - DNA, 20 bp, mouse
gtgtcccaaaatatggggat

SEQ ID NO: 755940 - DNA, 20 bp, mouse
gtaaggctccgcccctacca

SEQ ID NO: 755941 - DNA, 20 bp, mouse
gccggccaatacctgagcgg

SEQ ID NO: 755942 - DNA, 20 bp, mouse
gccccgcgggaaatccgcgt

SEQ ID NO: 755943 - DNA, 20 bp, mouse
ggccggtcccgcacaggttg

SEQ ID NO: 755944 - DNA, 20 bp, mouse
ggacggcaatcctagcgtga

SEQ ID NO: 755945 - DNA, 20 bp, mouse
ggaaccggtagcttggtctc

SEQ ID NO: 755946 - DNA, 20 bp, mouse
gtacgggacagagcacaaca

SEQ ID NO: 755947 - DNA, 20 bp, mouse
ggggcacatgctgtgtactg

SEQ ID NO: 755948 - DNA, 20 bp, mouse
gtgcagtactcgaaatagga

SEQ ID NO: 755949 - DNA, 20 bp, mouse
gtgtacacatagcatagtac

SEQ ID NO: 755950 - DNA, 20 bp, mouse
gaaactgcagtactcgaaat

SEQ ID NO: 755951 - DNA, 20 bp, mouse
gtgtgtactgggggtgtaac

SEQ ID NO: 755952 - DNA, 20 bp, mouse
gagtcttgctcgaaaccctt

SEQ ID NO: 755953 - DNA, 20 bp, mouse
gcttcaaggaacatgtctgc

SEQ ID NO: 755954 - DNA, 20 bp, mouse
ggtactgcagttttgcacat

SEQ ID NO: 755955 - DNA, 20 bp, mouse
gtccctcaagttttctacag

SEQ ID NO: 755956 - DNA, 20 bp, mouse
ggaggacgctagatgtcgat

SEQ ID NO: 755957 - DNA, 20 bp, mouse
gtagccatccaacgggaagg

SEQ ID NO: 755958 - DNA, 20 bp, mouse
gaggtccccgcctggaaaaa

SEQ ID NO: 755959 - DNA, 20 bp, mouse
gtcagggaggtggatcgtcg

SEQ ID NO: 755960 - DNA, 20 bp, mouse
gcccggaggccgaccttaaa

SEQ ID NO: 755961 - DNA, 20 bp, mouse
gcggagcccgccctaaacta

SEQ ID NO: 755962 - DNA, 20 bp, mouse
gggcttgcggcggttggtca

SEQ ID NO: 755963 - DNA, 20 bp, mouse
gaggcggggaccttagttta

SEQ ID NO: 755964 - DNA, 20 bp, mouse
gttgcggcggttggtcaggg

SEQ ID NO: 755965 - DNA, 20 bp, mouse
gggaaagtgctgcgaattgg

SEQ ID NO: 755966 - DNA, 20 bp, mouse
gcccgccaacccgagcttgg

SEQ ID NO: 755967 - DNA, 20 bp, mouse
gccagcccccaagctcgggt

SEQ ID NO: 755968 - DNA, 20 bp, mouse
ggtgccctggcgtagatggg

SEQ ID NO: 755969 - DNA, 20 bp, mouse
gcgggcccagcccccaagct

SEQ ID NO: 755970 - DNA, 20 bp, mouse
ggccccgcccatctacgcca

SEQ ID NO: 755971 - DNA, 20 bp, mouse
ggacgtgccctggcgtagat

SEQ ID NO: 755972 - DNA, 20 bp, mouse
ggggctacggatgctcgggt

SEQ ID NO: 755973 - DNA, 20 bp, mouse
gagcccagcggccaatccga

SEQ ID NO: 755974 - DNA, 20 bp, mouse
gtgcaccaagaagacggaag

SEQ ID NO: 755975 - DNA, 20 bp, mouse
gtgcgcggttgctggaacgg

SEQ ID NO: 755976 - DNA, 20 bp, mouse
ggccctgcgcgcataaagcc

SEQ ID NO: 755977 - DNA, 20 bp, mouse
gccgtggggaacgccctccc

SEQ ID NO: 755978 - DNA, 20 bp, mouse
gaggaaccccgagggaagtg

SEQ ID NO: 755979 - DNA, 20 bp, mouse
gcgagcccgcaccaggaatc

SEQ ID NO: 755980 - DNA, 20 bp, mouse
gcaaggggagggcccgccgg

SEQ ID NO: 755981 - DNA, 20 bp, mouse
gcccgcgccgctgtgggtga

SEQ ID NO: 755982 - DNA, 20 bp, mouse
gctgggcccccgcgccgctg

SEQ ID NO: 755983 - DNA, 20 bp, mouse
ggaccagggaggaaggacta

SEQ ID NO: 755984 - DNA, 20 bp, mouse
gccgggaagcgcttcatccc

SEQ ID NO: 755985 - DNA, 20 bp, mouse
gcggggttcctgtgtgtccg

SEQ ID NO: 755986 - DNA, 20 bp, mouse
gcccacgtgcgcggggagga

SEQ ID NO: 755987 - DNA, 20 bp, mouse
gcggcagcgggacccatcag

SEQ ID NO: 755988 - DNA, 20 bp, mouse
ggacaggcgggggaccgaac

SEQ ID NO: 755989 - DNA, 20 bp, mouse
gtgcgcgcgcggacaggcgg

SEQ ID NO: 755990 - DNA, 20 bp, mouse
gcagcgggacccatcagggg

SEQ ID NO: 755991 - DNA, 20 bp, mouse
ggcgagagcccgtcacacgt

SEQ ID NO: 755992 - DNA, 20 bp, mouse
gctcgcgcgccgcccctgat

SEQ ID NO: 755993 - DNA, 20 bp, mouse
gcgagccccgcgactcgagt

SEQ ID NO: 755994 - DNA, 20 bp, mouse
gaactccgccccacgtgcgc

SEQ ID NO: 755995 - DNA, 20 bp, mouse
ggagccgagcccacgtgtga

SEQ ID NO: 755996 - DNA, 20 bp, mouse
gcccccctcccggagtagga

SEQ ID NO: 755997 - DNA, 20 bp, mouse
gagccctcctactccgggag

SEQ ID NO: 755998 - DNA, 20 bp, mouse
gcccttgctcctcctcggga

SEQ ID NO: 755999 - DNA, 20 bp, mouse
ggcggcgcggagaacccccg

SEQ ID NO: 756000 - DNA, 20 bp, mouse
gggtctgccgcctcccccgg

SEQ ID NO: 756001 - DNA, 20 bp, mouse
gaggagtcgggggtgactgt

SEQ ID NO: 756002 - DNA, 20 bp, mouse
ggggcggctgaggcgagctc

SEQ ID NO: 756003 - DNA, 20 bp, mouse
ggaggggaggtcggggacga

SEQ ID NO: 756004 - DNA, 20 bp, mouse
gctcccaccccctcccgagg

SEQ ID NO: 756005 - DNA, 20 bp, mouse
gagaccccccctcccggagt

SEQ ID NO: 756006 - DNA, 20 bp, mouse
gcccgcgcgcacttcctccc

SEQ ID NO: 756007 - DNA, 20 bp, mouse
gagggaggcccccgcccgaa

SEQ ID NO: 756008 - DNA, 20 bp, mouse
ggcgtccggcatggcgagaa

SEQ ID NO: 756009 - DNA, 20 bp, mouse
gaggcccccgcccgaaaggg

SEQ ID NO: 756010 - DNA, 20 bp, mouse
ggccgcgccaggcgcagcgt

SEQ ID NO: 756011 - DNA, 20 bp, mouse
gctagtgccagcagccgcgg

SEQ ID NO: 756012 - DNA, 20 bp, mouse
ggctggtgaccccaagtgtg

SEQ ID NO: 756013 - DNA, 20 bp, mouse
gtgtgcggctgagaagcgga

SEQ ID NO: 756014 - DNA, 20 bp, mouse
gcctcccgggcctccctttc

SEQ ID NO: 756015 - DNA, 20 bp, mouse
gcaagtgtgcggctgagaag

SEQ ID NO: 756016 - DNA, 20 bp, mouse
ggaagcgcgcggccccgcca

SEQ ID NO: 756017 - DNA, 20 bp, mouse
gtccccgcccgtcccctctg

SEQ ID NO: 756018 - DNA, 20 bp, mouse
gtctgagccccagaggggac

SEQ ID NO: 756019 - DNA, 20 bp, mouse
ggctcagagaggggtgcgga

SEQ ID NO: 756020 - DNA, 20 bp, mouse
gcccctctctgagccccaga

SEQ ID NO: 756021 - DNA, 20 bp, mouse
gactgccaaggtcctcgcag

SEQ ID NO: 756022 - DNA, 20 bp, mouse
ggcgcggggtggccggagga

SEQ ID NO: 756023 - DNA, 20 bp, mouse
gaaggtcctcgcagtggcgc

SEQ ID NO: 756024 - DNA, 20 bp, mouse
ggctggaagacctcggtcga

SEQ ID NO: 756025 - DNA, 20 bp, mouse
ggggcggggacaagccctgg

SEQ ID NO: 756026 - DNA, 20 bp, mouse
ggaagggttgtggaagtctc

SEQ ID NO: 756027 - DNA, 20 bp, mouse
gtacaactcccagaggtctc

SEQ ID NO: 756028 - DNA, 20 bp, mouse
gactggacaaggcaaggccc

SEQ ID NO: 756029 - DNA, 20 bp, mouse
gtgtaccagctatcacctta

SEQ ID NO: 756030 - DNA, 20 bp, mouse
gggctagctaggcaagacac

SEQ ID NO: 756031 - DNA, 20 bp, mouse
gagggctgttctctctagtc

SEQ ID NO: 756032 - DNA, 20 bp, mouse
gcattccctaaggtgatagc

SEQ ID NO: 756033 - DNA, 20 bp, mouse
gcgagtggttgcctcaaaat

SEQ ID NO: 756034 - DNA, 20 bp, mouse
ggggaatgcatggctattaa

SEQ ID NO: 756035 - DNA, 20 bp, mouse
gttgctctatcgctaggaga

SEQ ID NO: 756036 - DNA, 20 bp, mouse
ggtgggagggccctagtctc

SEQ ID NO: 756037 - DNA, 20 bp, mouse
gggaggcagtgccacccgtt

SEQ ID NO: 756038 - DNA, 20 bp, mouse
gggagggccctagtctctgg

SEQ ID NO: 756039 - DNA, 20 bp, mouse
gaatcaagagaatgcttgac

SEQ ID NO: 756040 - DNA, 20 bp, mouse
ggaaatggctacagcccaac

SEQ ID NO: 756041 - DNA, 20 bp, mouse
gggagggggcgctagagagt

SEQ ID NO: 756042 - DNA, 20 bp, mouse
gggcactgcctccagagact

SEQ ID NO: 756043 - DNA, 20 bp, mouse
ggaaggacagtggtcttcgt

SEQ ID NO: 756044 - DNA, 20 bp, mouse
gtcttcagcggattagccaa

SEQ ID NO: 756045 - DNA, 20 bp, mouse
ggaagtaaaccagacaaatc

SEQ ID NO: 756046 - DNA, 20 bp, mouse
gctgccctgccctgtgaggc

SEQ ID NO: 756047 - DNA, 20 bp, mouse
gaacccgtaacaaccggagc

SEQ ID NO: 756048 - DNA, 20 bp, mouse
gacccaaagggactgatcta

SEQ ID NO: 756049 - DNA, 20 bp, mouse
gagtgcccctccctatagga

SEQ ID NO: 756050 - DNA, 20 bp, mouse
gaggctgaccacgctgtaga

SEQ ID NO: 756051 - DNA, 20 bp, mouse
gacagggctatctcctgctc

SEQ ID NO: 756052 - DNA, 20 bp, mouse
ggcctggcaagcggtcagtg

SEQ ID NO: 756053 - DNA, 20 bp, mouse
gcaggagcactgagtggttc

SEQ ID NO: 756054 - DNA, 20 bp, mouse
gcagtgtcccctctggggtg

SEQ ID NO: 756055 - DNA, 20 bp, mouse
gctcctgctccggttgttac

SEQ ID NO: 756056 - DNA, 20 bp, mouse
gaagctgggcctccagggga

SEQ ID NO: 756057 - DNA, 20 bp, mouse
gtgtgcctaatgtccagtgt

SEQ ID NO: 756058 - DNA, 20 bp, mouse
gaggcacacacagacaagta

SEQ ID NO: 756059 - DNA, 20 bp, mouse
gtcagccccaggagaaactc

SEQ ID NO: 756060 - DNA, 20 bp, mouse
gggaggcccagcttcattca

SEQ ID NO: 756061 - DNA, 20 bp, mouse
gtcagcctgagtttctcctg

SEQ ID NO: 756062 - DNA, 20 bp, mouse
gcagtgctacgccgaaatgt

SEQ ID NO: 756063 - DNA, 20 bp, mouse
gacacacagacaagtatggt

SEQ ID NO: 756064 - DNA, 20 bp, mouse
ggctacgccgaaatgtgggc

SEQ ID NO: 756065 - DNA, 20 bp, mouse
gtgctatgcctgggcccaag

SEQ ID NO: 756066 - DNA, 20 bp, mouse
gaagggcaacagcgtgtcaa

SEQ ID NO: 756067 - DNA, 20 bp, mouse
ggggccacttgaccagttcg

SEQ ID NO: 756068 - DNA, 20 bp, mouse
gctagtgataagcacagaat

SEQ ID NO: 756069 - DNA, 20 bp, mouse
gggtgaggataaccactcgt

SEQ ID NO: 756070 - DNA, 20 bp, mouse
ggacacgctgttgcccttca

SEQ ID NO: 756071 - DNA, 20 bp, mouse
ggtctgccagtgcaggatga

SEQ ID NO: 756072 - DNA, 20 bp, mouse
gacaccccgaactggtcaag

SEQ ID NO: 756073 - DNA, 20 bp, mouse
gtagggttttctaggcactg

SEQ ID NO: 756074 - DNA, 20 bp, mouse
gtgaggaatacaccccgaac

SEQ ID NO: 756075 - DNA, 20 bp, mouse
gtccatggagccattttcca

SEQ ID NO: 756076 - DNA, 20 bp, mouse
gcctccctccggtccaggca

SEQ ID NO: 756077 - DNA, 20 bp, mouse
gcagtccagcgccccttcca

SEQ ID NO: 756078 - DNA, 20 bp, mouse
ggagggaggtggccgtggaa

SEQ ID NO: 756079 - DNA, 20 bp, mouse
ggtggccgtggaaggggcgc

SEQ ID NO: 756080 - DNA, 20 bp, mouse
gcacccctgctggtggtgga

SEQ ID NO: 756081 - DNA, 20 bp, mouse
ggatccctgcctggaccgga

SEQ ID NO: 756082 - DNA, 20 bp, mouse
gcccaggaaatgcctccctc

SEQ ID NO: 756083 - DNA, 20 bp, mouse
gctgctgaggagagctggac

SEQ ID NO: 756084 - DNA, 20 bp, mouse
gcctccctccaccaccagca

SEQ ID NO: 756085 - DNA, 20 bp, mouse
ggagggttgaaggccccagg

SEQ ID NO: 756086 - DNA, 20 bp, mouse
gcagcccagagaggctactc

SEQ ID NO: 756087 - DNA, 20 bp, mouse
ggggcgatgcccgaagccgc

SEQ ID NO: 756088 - DNA, 20 bp, mouse
gtggccccccagtcaagctc

SEQ ID NO: 756089 - DNA, 20 bp, mouse
gtggccagagtagcctctct

SEQ ID NO: 756090 - DNA, 20 bp, mouse
ggggcagagtgggcactagt

SEQ ID NO: 756091 - DNA, 20 bp, mouse
ggctactctggccacgtggg

SEQ ID NO: 756092 - DNA, 20 bp, mouse
gcggaagcccggccacataa

SEQ ID NO: 756093 - DNA, 20 bp, mouse
gggtcgaaacttggagggag

SEQ ID NO: 756094 - DNA, 20 bp, mouse
gtgagccagagcttgactgg

SEQ ID NO: 756095 - DNA, 20 bp, mouse
ggatgcccgaagccgcgggc

SEQ ID NO: 756096 - DNA, 20 bp, mouse
gctggctaatacgttgtgag

SEQ ID NO: 756097 - DNA, 20 bp, mouse
gggagcaagaattttggagc

SEQ ID NO: 756098 - DNA, 20 bp, mouse
gggaccatgtggactaaagg

SEQ ID NO: 756099 - DNA, 20 bp, mouse
ggcatctagcccacaaggaa

SEQ ID NO: 756100 - DNA, 20 bp, mouse
gccttctgacacgtggtcag

SEQ ID NO: 756101 - DNA, 20 bp, mouse
gacaatgtcctttaaggaaa

SEQ ID NO: 756102 - DNA, 20 bp, mouse
gtcactgtgtcttcttgcag

SEQ ID NO: 756103 - DNA, 20 bp, mouse
gaccacgtgtcagaaggtac

SEQ ID NO: 756104 - DNA, 20 bp, mouse
gtgaagtacaattcagagaa

SEQ ID NO: 756105 - DNA, 20 bp, mouse
gactcattccctttccttaa

SEQ ID NO: 756106 - DNA, 20 bp, mouse
gcccggaaccctggctgcgg

SEQ ID NO: 756107 - DNA, 20 bp, mouse
gcaactctgacctcccgcgg

SEQ ID NO: 756108 - DNA, 20 bp, mouse
gtacatcgcacccggaaccc

SEQ ID NO: 756109 - DNA, 20 bp, mouse
gcatctagccatcctcttat

SEQ ID NO: 756110 - DNA, 20 bp, mouse
gtcaaccacaaagtagaaaa

SEQ ID NO: 756111 - DNA, 20 bp, mouse
gagaaaggcagacctataag

SEQ ID NO: 756112 - DNA, 20 bp, mouse
gtgagtgagtacatcgcacc

SEQ ID NO: 756113 - DNA, 20 bp, mouse
ggcccagccagcatcaattt

SEQ ID NO: 756114 - DNA, 20 bp, mouse
gcgcgggccaaaattgatgc

SEQ ID NO: 756115 - DNA, 20 bp, mouse
gcagcaactctgacctcccg

SEQ ID NO: 756116 - DNA, 20 bp, mouse
gtgagggcggggctgctagg

SEQ ID NO: 756117 - DNA, 20 bp, mouse
gcctgggcggggccttctag

SEQ ID NO: 756118 - DNA, 20 bp, mouse
ggaagtaaggacgtgatctc

SEQ ID NO: 756119 - DNA, 20 bp, mouse
gggtggggtttagggcctat

SEQ ID NO: 756120 - DNA, 20 bp, mouse
gggagagactccttgagggc

SEQ ID NO: 756121 - DNA, 20 bp, mouse
gtggggaatccaagagtgac

SEQ ID NO: 756122 - DNA, 20 bp, mouse
gccttctagaggcggaagta

SEQ ID NO: 756123 - DNA, 20 bp, mouse
gctgctaggaggcggccgtg

SEQ ID NO: 756124 - DNA, 20 bp, mouse
gagaggggaccagtcactct

SEQ ID NO: 756125 - DNA, 20 bp, mouse
gttaagcctgggtcggaggt

SEQ ID NO: 756126 - DNA, 20 bp, mouse
gggagtgtgtggaatatccc

SEQ ID NO: 756127 - DNA, 20 bp, mouse
gggaggaggcagtggagtcc

SEQ ID NO: 756128 - DNA, 20 bp, mouse
gaggaatagccaggtctcaa

SEQ ID NO: 756129 - DNA, 20 bp, mouse
gcggagtaaggtactgcggg

SEQ ID NO: 756130 - DNA, 20 bp, mouse
gaggataagttaagtggtgg

SEQ ID NO: 756131 - DNA, 20 bp, mouse
gagcaagaggataagttaag

SEQ ID NO: 756132 - DNA, 20 bp, mouse
ggcagaggggagggatccgg

SEQ ID NO: 756133 - DNA, 20 bp, mouse
gagtaaggtactgcgggagg

SEQ ID NO: 756134 - DNA, 20 bp, mouse
gaatcggagtaaggtactgc

SEQ ID NO: 756135 - DNA, 20 bp, mouse
gcgcgaagatcaaggtcaag

SEQ ID NO: 756136 - DNA, 20 bp, mouse
gcggaggcgggagttggcgg

SEQ ID NO: 756137 - DNA, 20 bp, mouse
gcggaagccctgttcccgca

SEQ ID NO: 756138 - DNA, 20 bp, mouse
ggcagacaagcgagggagga

SEQ ID NO: 756139 - DNA, 20 bp, mouse
ggagcatagcagacaagcga

SEQ ID NO: 756140 - DNA, 20 bp, mouse
gggccagccctgcgggaaca

SEQ ID NO: 756141 - DNA, 20 bp, mouse
gttcccgcagggctggcccg

SEQ ID NO: 756142 - DNA, 20 bp, mouse
ggacaagcgagggaggacgg

SEQ ID NO: 756143 - DNA, 20 bp, mouse
gctgtcgcccggagccggga

SEQ ID NO: 756144 - DNA, 20 bp, mouse
ggcggccgcgtcccgggcag

SEQ ID NO: 756145 - DNA, 20 bp, mouse
gcgccggaggcgggagttgg

SEQ ID NO: 756146 - DNA, 20 bp, mouse
gctccctaacgagacaagtc

SEQ ID NO: 756147 - DNA, 20 bp, mouse
gacagagtcttgagccctct

SEQ ID NO: 756148 - DNA, 20 bp, mouse
ggtcctgacttgtctcgtta

SEQ ID NO: 756149 - DNA, 20 bp, mouse
gtaggagggggaaatctctt

SEQ ID NO: 756150 - DNA, 20 bp, mouse
gtgcaagtgagacacagcct

SEQ ID NO: 756151 - DNA, 20 bp, mouse
gtcaggacctggacacctgc

SEQ ID NO: 756152 - DNA, 20 bp, mouse
gttgcctgactttggtgagt

SEQ ID NO: 756153 - DNA, 20 bp, mouse
ggagacatccaggaaatagt

SEQ ID NO: 756154 - DNA, 20 bp, mouse
ggaattcatccttgtctgtc

SEQ ID NO: 756155 - DNA, 20 bp, mouse
gaagataggcatcaaaccaa

SEQ ID NO: 756156 - DNA, 20 bp, mouse
ggcaatgagacagcactcga

SEQ ID NO: 756157 - DNA, 20 bp, mouse
gcctgagaggcctctctgtg

SEQ ID NO: 756158 - DNA, 20 bp, mouse
gcgacctcagggatagatgg

SEQ ID NO: 756159 - DNA, 20 bp, mouse
gtggacttgactgacacata

SEQ ID NO: 756160 - DNA, 20 bp, mouse
ggacttaggagggttctgtg

SEQ ID NO: 756161 - DNA, 20 bp, mouse
gtgtgtggtaggcaggactt

SEQ ID NO: 756162 - DNA, 20 bp, mouse
gtccgggatggggctgtggt

SEQ ID NO: 756163 - DNA, 20 bp, mouse
ggaagacagtggagtgatct

SEQ ID NO: 756164 - DNA, 20 bp, mouse
gagtgctgtctcattgcagc

SEQ ID NO: 756165 - DNA, 20 bp, mouse
gcagagtcacccaatcctga

SEQ ID NO: 756166 - DNA, 20 bp, mouse
gaggtgggccccagtgggtg

SEQ ID NO: 756167 - DNA, 20 bp, mouse
gaccatgtggggaacggaga

SEQ ID NO: 756168 - DNA, 20 bp, mouse
gacgggcggagccctgtcga

SEQ ID NO: 756169 - DNA, 20 bp, mouse
gacagtgttcctatgaaaga

SEQ ID NO: 756170 - DNA, 20 bp, mouse
gagccctgccgcacccactg

SEQ ID NO: 756171 - DNA, 20 bp, mouse
gtggggatataggatggttc

SEQ ID NO: 756172 - DNA, 20 bp, mouse
ggaaagcagggccttcgaca

SEQ ID NO: 756173 - DNA, 20 bp, mouse
gcctcatggccctctttcat

SEQ ID NO: 756174 - DNA, 20 bp, mouse
gctgggggcggggctacggg

SEQ ID NO: 756175 - DNA, 20 bp, mouse
gactctttccagctgtgaga

SEQ ID NO: 756176 - DNA, 20 bp, mouse
gagaggagacaagtgtcgtc

SEQ ID NO: 756177 - DNA, 20 bp, mouse
gctgacagcgagattcattg

SEQ ID NO: 756178 - DNA, 20 bp, mouse
gagtattttgttacagtcga

SEQ ID NO: 756179 - DNA, 20 bp, mouse
gacacttgtctcctctaagt

SEQ ID NO: 756180 - DNA, 20 bp, mouse
gactgtaacaaaatactgct

SEQ ID NO: 756181 - DNA, 20 bp, mouse
gtgtcgtcaggatctatgat

SEQ ID NO: 756182 - DNA, 20 bp, mouse
gactgatgcaactttttagc

SEQ ID NO: 756183 - DNA, 20 bp, mouse
gttggtgacttgtgacagac

SEQ ID NO: 756184 - DNA, 20 bp, mouse
gaattagagaagtaaaaact

SEQ ID NO: 756185 - DNA, 20 bp, mouse
gacagcactccaagtcttaa

SEQ ID NO: 756186 - DNA, 20 bp, mouse
gccagacccgccacagtctg

SEQ ID NO: 756187 - DNA, 20 bp, mouse
ggggctgggacattagagat

SEQ ID NO: 756188 - DNA, 20 bp, mouse
gccacagtctgaggcgcaga

SEQ ID NO: 756189 - DNA, 20 bp, mouse
ggtctgaggcgcagaaggaa

SEQ ID NO: 756190 - DNA, 20 bp, mouse
gactgtggcgggtctggcca

SEQ ID NO: 756191 - DNA, 20 bp, mouse
gcctcggagaccaacgaatc

SEQ ID NO: 756192 - DNA, 20 bp, mouse
ggagagacaacagccgatcg

SEQ ID NO: 756193 - DNA, 20 bp, mouse
gggaaagcacgtgctcgcgc

SEQ ID NO: 756194 - DNA, 20 bp, mouse
gcgagcacgtgctttcccgt

SEQ ID NO: 756195 - DNA, 20 bp, mouse
gaaaggccgtgccactgata

SEQ ID NO: 756196 - DNA, 20 bp, mouse
gaaagctccccaggtacctc

SEQ ID NO: 756197 - DNA, 20 bp, mouse
gcccacctgacttagctagg

SEQ ID NO: 756198 - DNA, 20 bp, mouse
gggaagggcctgacccgcac

SEQ ID NO: 756199 - DNA, 20 bp, mouse
gacagagccggaggtacctg

SEQ ID NO: 756200 - DNA, 20 bp, mouse
gcggctctgtcccgcctgtg

SEQ ID NO: 756201 - DNA, 20 bp, mouse
gagggcctgacccgcacagg

SEQ ID NO: 756202 - DNA, 20 bp, mouse
ggggtccggagagaaccatt

SEQ ID NO: 756203 - DNA, 20 bp, mouse
ggggcacgagcacagcccaa

SEQ ID NO: 756204 - DNA, 20 bp, mouse
gcctgggggcgctcggggaa

SEQ ID NO: 756205 - DNA, 20 bp, mouse
gcggccaatcagagcgcgag

SEQ ID NO: 756206 - DNA, 20 bp, mouse
gtccagggagagccaatcgg

SEQ ID NO: 756207 - DNA, 20 bp, mouse
gggccctgctcctgacgcca

SEQ ID NO: 756208 - DNA, 20 bp, mouse
gaagggccccaagcctctcc

SEQ ID NO: 756209 - DNA, 20 bp, mouse
ggccaccgattggctctccc

SEQ ID NO: 756210 - DNA, 20 bp, mouse
gctgtcctccgaggggaagt

SEQ ID NO: 756211 - DNA, 20 bp, mouse
gaatcggtggcgagcgtccg

SEQ ID NO: 756212 - DNA, 20 bp, mouse
gctctccagggagagccaat

SEQ ID NO: 756213 - DNA, 20 bp, mouse
ggcccagcctgtcctccgag

SEQ ID NO: 756214 - DNA, 20 bp, mouse
gcgtccgtggcgtcaggagc

SEQ ID NO: 756215 - DNA, 20 bp, mouse
ggctctccctggagaggctt

SEQ ID NO: 756216 - DNA, 20 bp, mouse
gccagcgggaaaagctgagg

SEQ ID NO: 756217 - DNA, 20 bp, mouse
gaatgctaccccaggtctcg

SEQ ID NO: 756218 - DNA, 20 bp, mouse
gtgagggggctgtcagtctt

SEQ ID NO: 756219 - DNA, 20 bp, mouse
ggggtagcggcgcatgaaag

SEQ ID NO: 756220 - DNA, 20 bp, mouse
gagtcccgaaatcctgacgt

SEQ ID NO: 756221 - DNA, 20 bp, mouse
ggatgtgcgggtctcagtgc

SEQ ID NO: 756222 - DNA, 20 bp, mouse
ggggccactagcaacttcga

SEQ ID NO: 756223 - DNA, 20 bp, mouse
ggcgctctgcctaagcgcgg

SEQ ID NO: 756224 - DNA, 20 bp, mouse
gttcatgcgccgctacccaa

SEQ ID NO: 756225 - DNA, 20 bp, mouse
gcttaggcagagcgcagcta

SEQ ID NO: 756226 - DNA, 20 bp, mouse
gcgagccagtcgtgccaaag

SEQ ID NO: 756227 - DNA, 20 bp, mouse
gtgtgcacactggcgctcca

SEQ ID NO: 756228 - DNA, 20 bp, mouse
gggggcgcgtgactatgcgt

SEQ ID NO: 756229 - DNA, 20 bp, mouse
ggtcacgcgccccgcgtcct

SEQ ID NO: 756230 - DNA, 20 bp, mouse
gtggcacgactggctcggat

SEQ ID NO: 756231 - DNA, 20 bp, mouse
gggacgacccatgtgacgtg

SEQ ID NO: 756232 - DNA, 20 bp, mouse
ggccgagcgcacttttcggg

SEQ ID NO: 756233 - DNA, 20 bp, mouse
gagagccgagcgcacttttc

SEQ ID NO: 756234 - DNA, 20 bp, mouse
gaccgcccctttggcacgac

SEQ ID NO: 756235 - DNA, 20 bp, mouse
gcggctctgccaaggacgcg

SEQ ID NO: 756236 - DNA, 20 bp, mouse
ggggccccggggcaccgcaa

SEQ ID NO: 756237 - DNA, 20 bp, mouse
ggggtcgtgcgcaggcccag

SEQ ID NO: 756238 - DNA, 20 bp, mouse
gtgtcccacgagcaaaaaga

SEQ ID NO: 756239 - DNA, 20 bp, mouse
gatggccagcacacgcccct

SEQ ID NO: 756240 - DNA, 20 bp, mouse
gggcgcgcgcgggagcaagc

SEQ ID NO: 756241 - DNA, 20 bp, mouse
gatcccttgagccagaaaaa

SEQ ID NO: 756242 - DNA, 20 bp, mouse
gcggccctctttttgctcgt

SEQ ID NO: 756243 - DNA, 20 bp, mouse
gcagaattcgggtcgtgcgc

SEQ ID NO: 756244 - DNA, 20 bp, mouse
gggggtgtgactcagcgcgg

SEQ ID NO: 756245 - DNA, 20 bp, mouse
gaaagctccgcccgggtgga

SEQ ID NO: 756246 - DNA, 20 bp, mouse
gggagacggctgcagtggca

SEQ ID NO: 756247 - DNA, 20 bp, mouse
gcggctgcagtggcaaggag

SEQ ID NO: 756248 - DNA, 20 bp, mouse
gtgcaaagatggtactgcgc

SEQ ID NO: 756249 - DNA, 20 bp, mouse
gttcagggagacggctgcag

SEQ ID NO: 756250 - DNA, 20 bp, mouse
gggagaagaacctacgggaa

SEQ ID NO: 756251 - DNA, 20 bp, mouse
gtactgcgcaggcaccttca

SEQ ID NO: 756252 - DNA, 20 bp, mouse
ggctgtgcgtgcataggggc

SEQ ID NO: 756253 - DNA, 20 bp, mouse
gcaaggagtggacagcggac

SEQ ID NO: 756254 - DNA, 20 bp, mouse
gaggcgctgtgcgtgcatag

SEQ ID NO: 756255 - DNA, 20 bp, mouse
ggggcgcgcaagcagcgact

SEQ ID NO: 756256 - DNA, 20 bp, mouse
gttcccgtggcactcatgga

SEQ ID NO: 756257 - DNA, 20 bp, mouse
gaagccaggtgaggttcccg

SEQ ID NO: 756258 - DNA, 20 bp, mouse
gcggcccagtgagacgctca

SEQ ID NO: 756259 - DNA, 20 bp, mouse
ggagacgctcagggctaggg

SEQ ID NO: 756260 - DNA, 20 bp, mouse
gctggccccagggagaggtg

SEQ ID NO: 756261 - DNA, 20 bp, mouse
gagtgagacgctcagggcta

SEQ ID NO: 756262 - DNA, 20 bp, mouse
gagccctccatgagtgccac

SEQ ID NO: 756263 - DNA, 20 bp, mouse
gggaatgtgcccacctggac

SEQ ID NO: 756264 - DNA, 20 bp, mouse
gcttccctgccatagtgtta

SEQ ID NO: 756265 - DNA, 20 bp, mouse
gtctcactgggccgtgtgca

SEQ ID NO: 756266 - DNA, 20 bp, mouse
gaggcaggaggggtcgtggg

SEQ ID NO: 756267 - DNA, 20 bp, mouse
ggcgagctaagggctcagaa

SEQ ID NO: 756268 - DNA, 20 bp, mouse
ggcggcgcggggtcgggtaa

SEQ ID NO: 756269 - DNA, 20 bp, mouse
ggggctccggatggccaccc

SEQ ID NO: 756270 - DNA, 20 bp, mouse
gcgaggaccaggcgagctaa

SEQ ID NO: 756271 - DNA, 20 bp, mouse
gccagggccacgaaagcgtg

SEQ ID NO: 756272 - DNA, 20 bp, mouse
ggggtcgtgggagggcgatc

SEQ ID NO: 756273 - DNA, 20 bp, mouse
gccaagggccactccagcag

SEQ ID NO: 756274 - DNA, 20 bp, mouse
gcagaagggccactcggcca

SEQ ID NO: 756275 - DNA, 20 bp, mouse
gtgccgaggaggaccacctg

SEQ ID NO: 756276 - DNA, 20 bp, mouse
ggggcggggtcgagctgcaa

SEQ ID NO: 756277 - DNA, 20 bp, mouse
gccggctcctcaccgccctc

SEQ ID NO: 756278 - DNA, 20 bp, mouse
gcctccttccggaacacctt

SEQ ID NO: 756279 - DNA, 20 bp, mouse
ggccacttccggaaggaact

SEQ ID NO: 756280 - DNA, 20 bp, mouse
gtcgaccccgcccctgaggg

SEQ ID NO: 756281 - DNA, 20 bp, mouse
ggggcagtgatgagccgcgg

SEQ ID NO: 756282 - DNA, 20 bp, mouse
gaaggcccagcgctcggctc

SEQ ID NO: 756283 - DNA, 20 bp, mouse
gaaaggagccgagttccttc

SEQ ID NO: 756284 - DNA, 20 bp, mouse
gcccagcgctcggctcaggt

SEQ ID NO: 756285 - DNA, 20 bp, mouse
gccccggcagtggcgtcgaa

SEQ ID NO: 756286 - DNA, 20 bp, mouse
ggagcacggcgggaacgggg

SEQ ID NO: 756287 - DNA, 20 bp, mouse
gaggggctgtggaagaacca

SEQ ID NO: 756288 - DNA, 20 bp, mouse
gggaggggacaccgagggag

SEQ ID NO: 756289 - DNA, 20 bp, mouse
gaccctggtgtgctaccccg

SEQ ID NO: 756290 - DNA, 20 bp, mouse
ggggtagcacaccagggtca

SEQ ID NO: 756291 - DNA, 20 bp, mouse
gccaaggtggacaggtgacg

SEQ ID NO: 756292 - DNA, 20 bp, mouse
ggggccacccgcactagcct

SEQ ID NO: 756293 - DNA, 20 bp, mouse
ggacgccgagcgggcccggg

SEQ ID NO: 756294 - DNA, 20 bp, mouse
ggccgcctcgccacggggga

SEQ ID NO: 756295 - DNA, 20 bp, mouse
gcgggaggccggagcacggc

SEQ ID NO: 756296 - DNA, 20 bp, mouse
ggtccctcttgcagagtttt

SEQ ID NO: 756297 - DNA, 20 bp, mouse
gagccgaaaactctgcaaga

SEQ ID NO: 756298 - DNA, 20 bp, mouse
ggagcagtgcggggacccac

SEQ ID NO: 756299 - DNA, 20 bp, mouse
gtggccagggctgtaaaatc

SEQ ID NO: 756300 - DNA, 20 bp, mouse
gactctgcaagagggacggg

SEQ ID NO: 756301 - DNA, 20 bp, mouse
gtcttcctcccggggagcgc

SEQ ID NO: 756302 - DNA, 20 bp, mouse
ggtgacaagcacatcctaag

SEQ ID NO: 756303 - DNA, 20 bp, mouse
ggaacctgatttgaggagga

SEQ ID NO: 756304 - DNA, 20 bp, mouse
gctcccggggagcgcgggat

SEQ ID NO: 756305 - DNA, 20 bp, mouse
gcattcctgggctttgggga

SEQ ID NO: 756306 - DNA, 20 bp, mouse
gaaaggaaaagaacggtcaa

SEQ ID NO: 756307 - DNA, 20 bp, mouse
gctaatgctacctatattga

SEQ ID NO: 756308 - DNA, 20 bp, mouse
ggccggggctgggaccccgg

SEQ ID NO: 756309 - DNA, 20 bp, mouse
gtcccatgaaccttcaatat

SEQ ID NO: 756310 - DNA, 20 bp, mouse
gggccaagtgggcagctgat

SEQ ID NO: 756311 - DNA, 20 bp, mouse
gaagtgggcagctgattggc

SEQ ID NO: 756312 - DNA, 20 bp, mouse
ggggtgttaacttatggatg

SEQ ID NO: 756313 - DNA, 20 bp, mouse
gaaggttcatgggaagtgcg

SEQ ID NO: 756314 - DNA, 20 bp, mouse
gagaaccgccaatataagaa

SEQ ID NO: 756315 - DNA, 20 bp, mouse
gttaacacatggttatgggc

SEQ ID NO: 756316 - DNA, 20 bp, mouse
gaccggcggggacccgagtg

SEQ ID NO: 756317 - DNA, 20 bp, mouse
gggaaccagcaccacgggtc

SEQ ID NO: 756318 - DNA, 20 bp, mouse
ggcggggacccgagtgtggc

SEQ ID NO: 756319 - DNA, 20 bp, mouse
gctcgggtccccgccggtag

SEQ ID NO: 756320 - DNA, 20 bp, mouse
gcggggcgggtgcaaagtaa

SEQ ID NO: 756321 - DNA, 20 bp, mouse
ggtagcggtttcgttatgag

SEQ ID NO: 756322 - DNA, 20 bp, mouse
gaacgaaaccgctaccggcg

SEQ ID NO: 756323 - DNA, 20 bp, mouse
ggccggggaaccagcaccac

SEQ ID NO: 756324 - DNA, 20 bp, mouse
gagcagatgagcgcacgcga

SEQ ID NO: 756325 - DNA, 20 bp, mouse
gtggggcgccctagagaagc

SEQ ID NO: 756326 - DNA, 20 bp, mouse
ggccacgccccgaacgtcaa

SEQ ID NO: 756327 - DNA, 20 bp, mouse
ggcctggtccgcaaaggggc

SEQ ID NO: 756328 - DNA, 20 bp, mouse
ggccccgaacgtcaagggga

SEQ ID NO: 756329 - DNA, 20 bp, mouse
gcactcacgccgcggggcga

SEQ ID NO: 756330 - DNA, 20 bp, mouse
gcacacagactgagactcgt

SEQ ID NO: 756331 - DNA, 20 bp, mouse
gagactcgtaggcacgattg

SEQ ID NO: 756332 - DNA, 20 bp, mouse
gagctgcaaagaacccgccc

SEQ ID NO: 756333 - DNA, 20 bp, mouse
gaacgtcaaggggagggtcc

SEQ ID NO: 756334 - DNA, 20 bp, mouse
gggtcccgggatcgtgctga

SEQ ID NO: 756335 - DNA, 20 bp, mouse
gcaaagaacccgccccgggc

SEQ ID NO: 756336 - DNA, 20 bp, mouse
gcaagccggaagtgtccgga

SEQ ID NO: 756337 - DNA, 20 bp, mouse
gaaacggcaggcgctcgcga

SEQ ID NO: 756338 - DNA, 20 bp, mouse
gggaagtgtccggaaggagt

SEQ ID NO: 756339 - DNA, 20 bp, mouse
gcgctcgcgaggggccgcct

SEQ ID NO: 756340 - DNA, 20 bp, mouse
gtgcgcaagccggaagtgtc

SEQ ID NO: 756341 - DNA, 20 bp, mouse
gcgcgcatgcgtctgggcgt

SEQ ID NO: 756342 - DNA, 20 bp, mouse
ggggaatggtaatgatgggg

SEQ ID NO: 756343 - DNA, 20 bp, mouse
gggagggaatggtaatgatg

SEQ ID NO: 756344 - DNA, 20 bp, mouse
gccggtgggcggagcctaag

SEQ ID NO: 756345 - DNA, 20 bp, mouse
gggggtgaccctgacggcaa

SEQ ID NO: 756346 - DNA, 20 bp, mouse
ggggcggagcctcaagctaa

SEQ ID NO: 756347 - DNA, 20 bp, mouse
gcgcccttggcggacgtgag

SEQ ID NO: 756348 - DNA, 20 bp, mouse
gggtcgctgcgtctgagcgc

SEQ ID NO: 756349 - DNA, 20 bp, mouse
gtgcccgcctagcagcacct

SEQ ID NO: 756350 - DNA, 20 bp, mouse
gcacagcggctcgtccaacc

SEQ ID NO: 756351 - DNA, 20 bp, mouse
ggctctgagcacagaaaagg

SEQ ID NO: 756352 - DNA, 20 bp, mouse
gagccgctgtgcgcccttgg

SEQ ID NO: 756353 - DNA, 20 bp, mouse
gcagccctggaagaacagcg

SEQ ID NO: 756354 - DNA, 20 bp, mouse
gaacagcgcgggttccacag

SEQ ID NO: 756355 - DNA, 20 bp, mouse
gcccccgccggggcggacgt

SEQ ID NO: 756356 - DNA, 20 bp, mouse
ggggtctccttgagctgtgt

SEQ ID NO: 756357 - DNA, 20 bp, mouse
gggagctagaaatctgacgg

SEQ ID NO: 756358 - DNA, 20 bp, mouse
gcggactctagtcttggagt

SEQ ID NO: 756359 - DNA, 20 bp, mouse
gtcccccggcggaacaatgg

SEQ ID NO: 756360 - DNA, 20 bp, mouse
ggggagctcggtggactctg

SEQ ID NO: 756361 - DNA, 20 bp, mouse
ggccgggcggactctagtct

SEQ ID NO: 756362 - DNA, 20 bp, mouse
gggcggggcatgcgtcacat

SEQ ID NO: 756363 - DNA, 20 bp, mouse
gcgtcacatggggcgatggg

SEQ ID NO: 756364 - DNA, 20 bp, mouse
ggcaaggcggccaaacccat

SEQ ID NO: 756365 - DNA, 20 bp, mouse
gcgactcggagcttgcgaag

SEQ ID NO: 756366 - DNA, 20 bp, mouse
gtgaacctgttctttggtac

SEQ ID NO: 756367 - DNA, 20 bp, mouse
gcaagacaacctctgccttc

SEQ ID NO: 756368 - DNA, 20 bp, mouse
gcttaccttcaccagtattg

SEQ ID NO: 756369 - DNA, 20 bp, mouse
gctttccgcaatactggtga

SEQ ID NO: 756370 - DNA, 20 bp, mouse
ggtcttgctttccgcaatac

SEQ ID NO: 756371 - DNA, 20 bp, mouse
ggatcagtagtttcactttc

SEQ ID NO: 756372 - DNA, 20 bp, mouse
gaagccttggcgccgccctg

SEQ ID NO: 756373 - DNA, 20 bp, mouse
gcggcgccaaggcttccctc

SEQ ID NO: 756374 - DNA, 20 bp, mouse
gtgaccgcgggagcccagca

SEQ ID NO: 756375 - DNA, 20 bp, mouse
gcaaggcttccctctggctg

SEQ ID NO: 756376 - DNA, 20 bp, mouse
gaacgcggcgaccagctcca

SEQ ID NO: 756377 - DNA, 20 bp, mouse
ggggtctggcaccctgagaa

SEQ ID NO: 756378 - DNA, 20 bp, mouse
gtgggcgagaccatctgcgg

SEQ ID NO: 756379 - DNA, 20 bp, mouse
gccggcaccgccccccacgt

SEQ ID NO: 756380 - DNA, 20 bp, mouse
gcggcggagtgactgatcct

SEQ ID NO: 756381 - DNA, 20 bp, mouse
gcaccaccgcgtcccggagc

SEQ ID NO: 756382 - DNA, 20 bp, mouse
gagaccatctgcggcggcgc

SEQ ID NO: 756383 - DNA, 20 bp, mouse
gtcgcagcgcagcccacgtg

SEQ ID NO: 756384 - DNA, 20 bp, mouse
gactccgccgtaatgtgggg

SEQ ID NO: 756385 - DNA, 20 bp, mouse
gcgcgcgcgggtccttccct

SEQ ID NO: 756386 - DNA, 20 bp, mouse
gcacgagcatctgggatcaa

SEQ ID NO: 756387 - DNA, 20 bp, mouse
gtgtgtccgccgaactcccg

SEQ ID NO: 756388 - DNA, 20 bp, mouse
gggtgcagctccctttagtt

SEQ ID NO: 756389 - DNA, 20 bp, mouse
gccacaccccgggagttcgg

SEQ ID NO: 756390 - DNA, 20 bp, mouse
ggagttcggcggacacagat

SEQ ID NO: 756391 - DNA, 20 bp, mouse
gaggtagtgttgcttgttcc

SEQ ID NO: 756392 - DNA, 20 bp, mouse
ggtgctgggcacgagcatct

SEQ ID NO: 756393 - DNA, 20 bp, mouse
gaccgagtatgcccaactaa

SEQ ID NO: 756394 - DNA, 20 bp, mouse
gcccagcacctgcagcttgc

SEQ ID NO: 756395 - DNA, 20 bp, mouse
gtagacaggtggacgatgaa

SEQ ID NO: 756396 - DNA, 20 bp, mouse
gggcaatagaccctgtagtg

SEQ ID NO: 756397 - DNA, 20 bp, mouse
gactgtgtacaggctcccgt

SEQ ID NO: 756398 - DNA, 20 bp, mouse
gaactggcagggcttcgcct

SEQ ID NO: 756399 - DNA, 20 bp, mouse
gctgtctcagcaaactctgg

SEQ ID NO: 756400 - DNA, 20 bp, mouse
gctgtacacagtgttctaat

SEQ ID NO: 756401 - DNA, 20 bp, mouse
ggctcgagaaactgatgtgc

SEQ ID NO: 756402 - DNA, 20 bp, mouse
gaataagtgagccacactac

SEQ ID NO: 756403 - DNA, 20 bp, mouse
ggagttgtaacgttctctaa

SEQ ID NO: 756404 - DNA, 20 bp, mouse
gtaattggctacgctcggga

SEQ ID NO: 756405 - DNA, 20 bp, mouse
gtgtggctcacttattccca

SEQ ID NO: 756406 - DNA, 20 bp, mouse
gatgctgcgtgggtacagtg

SEQ ID NO: 756407 - DNA, 20 bp, mouse
gggaggatacgcgacatcag

SEQ ID NO: 756408 - DNA, 20 bp, mouse
gggaagctgaccatagagag

SEQ ID NO: 756409 - DNA, 20 bp, mouse
gctacgcatctggaaggcgg

SEQ ID NO: 756410 - DNA, 20 bp, mouse
ggggcggagcgagtggagtc

SEQ ID NO: 756411 - DNA, 20 bp, mouse
ggctccgcccacagcccgct

SEQ ID NO: 756412 - DNA, 20 bp, mouse
gggcctacgcatctggaagg

SEQ ID NO: 756413 - DNA, 20 bp, mouse
ggcgaggagagggatgccgt

SEQ ID NO: 756414 - DNA, 20 bp, mouse
gtggcgctccggtgccgcac

SEQ ID NO: 756415 - DNA, 20 bp, mouse
ggagaggcccggggagccct

SEQ ID NO: 756416 - DNA, 20 bp, mouse
gtgggagcgcggagctactc

SEQ ID NO: 756417 - DNA, 20 bp, mouse
gctccagagccgcagagggg

SEQ ID NO: 756418 - DNA, 20 bp, mouse
ggtaaggcaagcatcagcgt

SEQ ID NO: 756419 - DNA, 20 bp, mouse
gggaccagcgctgaacaaag

SEQ ID NO: 756420 - DNA, 20 bp, mouse
gagtccgcgggaaaccaaaa

SEQ ID NO: 756421 - DNA, 20 bp, mouse
ggagctactccggggccgaa

SEQ ID NO: 756422 - DNA, 20 bp, mouse
gttgctcagtacatcttgat

SEQ ID NO: 756423 - DNA, 20 bp, mouse
gggactctttaacgtcgcgg

SEQ ID NO: 756424 - DNA, 20 bp, mouse
ggagagctgccattcggccc

SEQ ID NO: 756425 - DNA, 20 bp, mouse
ggctctggagagctgccatt

SEQ ID NO: 756426 - DNA, 20 bp, mouse
gcgcatgcgtgcccatggtg

SEQ ID NO: 756427 - DNA, 20 bp, mouse
gcacgcgcagacgacaaggc

SEQ ID NO: 756428 - DNA, 20 bp, mouse
gaaggcggggcctgccgctt

SEQ ID NO: 756429 - DNA, 20 bp, mouse
gcaagcacgcgcagacgaca

SEQ ID NO: 756430 - DNA, 20 bp, mouse
gctcaactgaagaaccacta

SEQ ID NO: 756431 - DNA, 20 bp, mouse
ggcggggcctgccgctttgg

SEQ ID NO: 756432 - DNA, 20 bp, mouse
ggggcacgcatgcgcatggt

SEQ ID NO: 756433 - DNA, 20 bp, mouse
ggaactgtctcgagttgtag

SEQ ID NO: 756434 - DNA, 20 bp, mouse
gttgagccacgcctccaaag

SEQ ID NO: 756435 - DNA, 20 bp, mouse
gttgctccgccccccaccat

SEQ ID NO: 756436 - DNA, 20 bp, mouse
gaaacccaagcctaggagag

SEQ ID NO: 756437 - DNA, 20 bp, mouse
gccgcggttcgtgtgtaaat

SEQ ID NO: 756438 - DNA, 20 bp, mouse
gcggagaatggaatcttctt

SEQ ID NO: 756439 - DNA, 20 bp, mouse
gtagtccttgcgactgtcta

SEQ ID NO: 756440 - DNA, 20 bp, mouse
gtgtctaaggcagtgaatgt

SEQ ID NO: 756441 - DNA, 20 bp, mouse
gtatcgctaacgccactgca

SEQ ID NO: 756442 - DNA, 20 bp, mouse
gggtgtgcggcttctaggaa

SEQ ID NO: 756443 - DNA, 20 bp, mouse
gaataggtcagagttccaat

SEQ ID NO: 756444 - DNA, 20 bp, mouse
ggaagcaaacttgagtctac

SEQ ID NO: 756445 - DNA, 20 bp, mouse
gcaagtaggatttgtctcta

SEQ ID NO: 756446 - DNA, 20 bp, mouse
gcacgccggctacctgtccc

SEQ ID NO: 756447 - DNA, 20 bp, mouse
gcacgcgcggtgcccagtaa

SEQ ID NO: 756448 - DNA, 20 bp, mouse
gtgcgcacagagcccgggac

SEQ ID NO: 756449 - DNA, 20 bp, mouse
gggaaggcgtgtctgctcgc

SEQ ID NO: 756450 - DNA, 20 bp, mouse
ggcctaggctgaccagtgaa

SEQ ID NO: 756451 - DNA, 20 bp, mouse
ggacaggtagccggcgtggc

SEQ ID NO: 756452 - DNA, 20 bp, mouse
ggtctgctcgccggccacgc

SEQ ID NO: 756453 - DNA, 20 bp, mouse
gcaagcacacgccccttact

SEQ ID NO: 756454 - DNA, 20 bp, mouse
gcgcgcgtgcgcacagagcc

SEQ ID NO: 756455 - DNA, 20 bp, mouse
ggcctcagcgagccgttcac

SEQ ID NO: 756456 - DNA, 20 bp, mouse
ggacgcgggctctgagtgga

SEQ ID NO: 756457 - DNA, 20 bp, mouse
gaggggcccggaatggacgc

SEQ ID NO: 756458 - DNA, 20 bp, mouse
gaatggacgcgggctctgag

SEQ ID NO: 756459 - DNA, 20 bp, mouse
gccctcccccggaggggtga

SEQ ID NO: 756460 - DNA, 20 bp, mouse
gccgcccgctggggtaggag

SEQ ID NO: 756461 - DNA, 20 bp, mouse
gcacgccctcacccctccgg

SEQ ID NO: 756462 - DNA, 20 bp, mouse
gcctagagaggggcccggaa

SEQ ID NO: 756463 - DNA, 20 bp, mouse
gaggaggccacacccctccc

SEQ ID NO: 756464 - DNA, 20 bp, mouse
gacttcgtgccctcccccgg

SEQ ID NO: 756465 - DNA, 20 bp, mouse
gagtggacggcagaccggcc

SEQ ID NO: 756466 - DNA, 20 bp, mouse
gacgccgccggtgattggaa

SEQ ID NO: 756467 - DNA, 20 bp, mouse
gccgggaagaagctactctg

SEQ ID NO: 756468 - DNA, 20 bp, mouse
gggaggacgccgccggtgat

SEQ ID NO: 756469 - DNA, 20 bp, mouse
gcaccggcggcgtcctccgg

SEQ ID NO: 756470 - DNA, 20 bp, mouse
gtcctccggcggcgtccaat

SEQ ID NO: 756471 - DNA, 20 bp, mouse
gtggaagggtaagagccaat

SEQ ID NO: 756472 - DNA, 20 bp, mouse
gggcggccggggaaactctc

SEQ ID NO: 756473 - DNA, 20 bp, mouse
gcggaagcggcgagcgattc

SEQ ID NO: 756474 - DNA, 20 bp, mouse
ggcaccgtgcccccagcatt

SEQ ID NO: 756475 - DNA, 20 bp, mouse
ggccaataggcgcattcgaa

SEQ ID NO: 756476 - DNA, 20 bp, mouse
gccggtagtgctccattctc

SEQ ID NO: 756477 - DNA, 20 bp, mouse
gagcactctgggataagcag

SEQ ID NO: 756478 - DNA, 20 bp, mouse
gcgcctgactcgagcactct

SEQ ID NO: 756479 - DNA, 20 bp, mouse
gaagaacctcacataagctc

SEQ ID NO: 756480 - DNA, 20 bp, mouse
gcaggggcacggggttggcc

SEQ ID NO: 756481 - DNA, 20 bp, mouse
gtctgggataagcaggggca

SEQ ID NO: 756482 - DNA, 20 bp, mouse
ggcacggaacccaggcgcgc

SEQ ID NO: 756483 - DNA, 20 bp, mouse
gcacactgagagccacttac

SEQ ID NO: 756484 - DNA, 20 bp, mouse
gatcccagagtgctcgagtc

SEQ ID NO: 756485 - DNA, 20 bp, mouse
gagtcggaccgcctccgcca

SEQ ID NO: 756486 - DNA, 20 bp, mouse
gccctggcctgagtgcacat

SEQ ID NO: 756487 - DNA, 20 bp, mouse
gaccggaggaagtgatctgt

SEQ ID NO: 756488 - DNA, 20 bp, mouse
gaatccatccccatgcattg

SEQ ID NO: 756489 - DNA, 20 bp, mouse
ggttggaccccacaatgcat

SEQ ID NO: 756490 - DNA, 20 bp, mouse
gtccaacagatcacttcctc

SEQ ID NO: 756491 - DNA, 20 bp, mouse
gttactgaagagtgtctctc

SEQ ID NO: 756492 - DNA, 20 bp, mouse
gcgccacggtgcacccgtgt

SEQ ID NO: 756493 - DNA, 20 bp, mouse
ggtcagagaaaacaagtgac

SEQ ID NO: 756494 - DNA, 20 bp, mouse
gacaggagaacactgactga

SEQ ID NO: 756495 - DNA, 20 bp, mouse
gaatctccaaggagaatatg

SEQ ID NO: 756496 - DNA, 20 bp, mouse
gtccggtagcaaagtgaaaa

SEQ ID NO: 756497 - DNA, 20 bp, mouse
ggaaacagtaatgcccgcgt

SEQ ID NO: 756498 - DNA, 20 bp, mouse
gtggcacccagatgcctgtc

SEQ ID NO: 756499 - DNA, 20 bp, mouse
gtgcggtggcagatgcactc

SEQ ID NO: 756500 - DNA, 20 bp, mouse
gccgcgtgggatttaatatc

SEQ ID NO: 756501 - DNA, 20 bp, mouse
gccacaaggccccatagggc

SEQ ID NO: 756502 - DNA, 20 bp, mouse
gtctgggtgcctgccctatg

SEQ ID NO: 756503 - DNA, 20 bp, mouse
gcggaagccagacaggcatc

SEQ ID NO: 756504 - DNA, 20 bp, mouse
gttcaacaacgctgctgtct

SEQ ID NO: 756505 - DNA, 20 bp, mouse
gctgtcccacaaggccccat

SEQ ID NO: 756506 - DNA, 20 bp, mouse
ggaagctcccggctcatcag

SEQ ID NO: 756507 - DNA, 20 bp, mouse
gactggttggcggcaatgac

SEQ ID NO: 756508 - DNA, 20 bp, mouse
gggctcccgcagacgctcct

SEQ ID NO: 756509 - DNA, 20 bp, mouse
ggctcccggctcatcagagg

SEQ ID NO: 756510 - DNA, 20 bp, mouse
gggtgggcccaggcagcaag

SEQ ID NO: 756511 - DNA, 20 bp, mouse
ggaggcccaggagcgtctgc

SEQ ID NO: 756512 - DNA, 20 bp, mouse
gtggcggcaatgactggctg

SEQ ID NO: 756513 - DNA, 20 bp, mouse
gcgtgacccgctgacagagg

SEQ ID NO: 756514 - DNA, 20 bp, mouse
gtgcgggagccggtgggccc

SEQ ID NO: 756515 - DNA, 20 bp, mouse
gcctgggcctcctctgtcag

SEQ ID NO: 756516 - DNA, 20 bp, mouse
gaggaggtggggcatcagcg

SEQ ID NO: 756517 - DNA, 20 bp, mouse
gaggaactgaggcccctagg

SEQ ID NO: 756518 - DNA, 20 bp, mouse
gaaagtcaaggcataggagg

SEQ ID NO: 756519 - DNA, 20 bp, mouse
ggggctggccatacaatctc

SEQ ID NO: 756520 - DNA, 20 bp, mouse
gcggctgcaagttcttcccc

SEQ ID NO: 756521 - DNA, 20 bp, mouse
gcggacgtgaagcttttggt

SEQ ID NO: 756522 - DNA, 20 bp, mouse
gcgtgacgttaacagggcgg

SEQ ID NO: 756523 - DNA, 20 bp, mouse
gtgccagaaagtcaaggcat

SEQ ID NO: 756524 - DNA, 20 bp, mouse
gggccgtgacgttaacaggg

SEQ ID NO: 756525 - DNA, 20 bp, mouse
gccagcggacgtgaagcttt

SEQ ID NO: 756526 - DNA, 20 bp, mouse
ggctgcctctcctcagtcag

SEQ ID NO: 756527 - DNA, 20 bp, mouse
ggctaggccaactgaatctg

SEQ ID NO: 756528 - DNA, 20 bp, mouse
gagccggcgtaggagccaat

SEQ ID NO: 756529 - DNA, 20 bp, mouse
gcgggaggcggggctttcgt

SEQ ID NO: 756530 - DNA, 20 bp, mouse
gcagcagtggtccctcagct

SEQ ID NO: 756531 - DNA, 20 bp, mouse
gggctcctacgccggctcag

SEQ ID NO: 756532 - DNA, 20 bp, mouse
gcgtaagctggtccaggagc

SEQ ID NO: 756533 - DNA, 20 bp, mouse
gggccacgaagctatacccc

SEQ ID NO: 756534 - DNA, 20 bp, mouse
gttgactccttcagccaatc

SEQ ID NO: 756535 - DNA, 20 bp, mouse
gattcagttggcctagctga

SEQ ID NO: 756536 - DNA, 20 bp, mouse
gcccgtggcgacagcgtgca

SEQ ID NO: 756537 - DNA, 20 bp, mouse
gtaaccatggaaacgagacc

SEQ ID NO: 756538 - DNA, 20 bp, mouse
ggcggggccgagccccgaga

SEQ ID NO: 756539 - DNA, 20 bp, mouse
ggctgggcctggggcacaag

SEQ ID NO: 756540 - DNA, 20 bp, mouse
ggccttgctgcctgcaagaa

SEQ ID NO: 756541 - DNA, 20 bp, mouse
gctgcctgcaagaacggccg

SEQ ID NO: 756542 - DNA, 20 bp, mouse
ggctgccctccctgtaacca

SEQ ID NO: 756543 - DNA, 20 bp, mouse
gctggtggccgcggggtggc

SEQ ID NO: 756544 - DNA, 20 bp, mouse
gacgcccggggccctcagca

SEQ ID NO: 756545 - DNA, 20 bp, mouse
gagggactagagctgggcct

SEQ ID NO: 756546 - DNA, 20 bp, mouse
gcggaagtcccgccccaaca

SEQ ID NO: 756547 - DNA, 20 bp, mouse
gggagtggctgcagacgggt

SEQ ID NO: 756548 - DNA, 20 bp, mouse
gctaagggaaacaggacgag

SEQ ID NO: 756549 - DNA, 20 bp, mouse
gcggagctgtcggttgctaa

SEQ ID NO: 756550 - DNA, 20 bp, mouse
gtccctagggctggcgaaga

SEQ ID NO: 756551 - DNA, 20 bp, mouse
ggctggcgaagaaggcgggg

SEQ ID NO: 756552 - DNA, 20 bp, mouse
ggatccgcgcctcacgtgac

SEQ ID NO: 756553 - DNA, 20 bp, mouse
gcacgtgactggccccggga

SEQ ID NO: 756554 - DNA, 20 bp, mouse
gtacgagacgagacgacggc

SEQ ID NO: 756555 - DNA, 20 bp, mouse
gggccgcgcccagaggtctc

SEQ ID NO: 756556 - DNA, 20 bp, mouse
gaggctcaggcgcaagtcaa

SEQ ID NO: 756557 - DNA, 20 bp, mouse
gaggaagatgagtgggggag

SEQ ID NO: 756558 - DNA, 20 bp, mouse
ggaagctggggccacgcaaa

SEQ ID NO: 756559 - DNA, 20 bp, mouse
gaaaggaggaagatgagtgg

SEQ ID NO: 756560 - DNA, 20 bp, mouse
ggaaatctagtgatcctgaa

SEQ ID NO: 756561 - DNA, 20 bp, mouse
ggggcgggagtaaggtttcc

SEQ ID NO: 756562 - DNA, 20 bp, mouse
gacgcaaaggggcgggagta

SEQ ID NO: 756563 - DNA, 20 bp, mouse
gcgcctggaacgtgttatat

SEQ ID NO: 756564 - DNA, 20 bp, mouse
ggccctgtgccctgttggaa

SEQ ID NO: 756565 - DNA, 20 bp, mouse
gtgggcacaccctccaggaa

SEQ ID NO: 756566 - DNA, 20 bp, mouse
gagaatgttttacattgacc

SEQ ID NO: 756567 - DNA, 20 bp, mouse
gatgttttacattgaccagg

SEQ ID NO: 756568 - DNA, 20 bp, mouse
gggaacatccatctccagaa

SEQ ID NO: 756569 - DNA, 20 bp, mouse
ggagatggatgttccctctc

SEQ ID NO: 756570 - DNA, 20 bp, mouse
gtctgcagagggtctaacaa

SEQ ID NO: 756571 - DNA, 20 bp, mouse
gcagtccccagctatcaagc

SEQ ID NO: 756572 - DNA, 20 bp, mouse
gtatcaagcaggaagggtca

SEQ ID NO: 756573 - DNA, 20 bp, mouse
gccttcctgcttgatagctg

SEQ ID NO: 756574 - DNA, 20 bp, mouse
ggcagactcccgtcctgtgt

SEQ ID NO: 756575 - DNA, 20 bp, mouse
gaccctcggagcttaagggg

SEQ ID NO: 756576 - DNA, 20 bp, mouse
gattcgtttacttttttctt

SEQ ID NO: 756577 - DNA, 20 bp, mouse
gaaagttcagactgtgaagg

SEQ ID NO: 756578 - DNA, 20 bp, mouse
ggccaaagttcagactgtga

SEQ ID NO: 756579 - DNA, 20 bp, mouse
gaaacaagatccctctaagt

SEQ ID NO: 756580 - DNA, 20 bp, mouse
gtagttcccacctacttaga

SEQ ID NO: 756581 - DNA, 20 bp, mouse
gcccttagaacatgagtaag

SEQ ID NO: 756582 - DNA, 20 bp, mouse
gaacccacagaaccgagaag

SEQ ID NO: 756583 - DNA, 20 bp, mouse
gcaagatccctctaagtagg

SEQ ID NO: 756584 - DNA, 20 bp, mouse
ggcctcttactcatgttcta

SEQ ID NO: 756585 - DNA, 20 bp, mouse
gcttgagaagtagatagacc

SEQ ID NO: 756586 - DNA, 20 bp, mouse
gcacgcgcggttggtgcagt

SEQ ID NO: 756587 - DNA, 20 bp, mouse
ggactcccgttctgggtttg

SEQ ID NO: 756588 - DNA, 20 bp, mouse
gagcgcgcggggacatgcta

SEQ ID NO: 756589 - DNA, 20 bp, mouse
gcgacgcattagaggaccag

SEQ ID NO: 756590 - DNA, 20 bp, mouse
gaacatataacactctaggg

SEQ ID NO: 756591 - DNA, 20 bp, mouse
gcgtcggtgctactactgca

SEQ ID NO: 756592 - DNA, 20 bp, mouse
gcagttccagcggtgacctc

SEQ ID NO: 756593 - DNA, 20 bp, mouse
ggtgggcggactcccgttct

SEQ ID NO: 756594 - DNA, 20 bp, mouse
ggcgcggttggtgcagtggg

SEQ ID NO: 756595 - DNA, 20 bp, mouse
gcgttgcaaggcagttccag

SEQ ID NO: 756596 - DNA, 20 bp, mouse
gctggcctgcagtggggacc

SEQ ID NO: 756597 - DNA, 20 bp, mouse
gtggaattctgggttgtctg

SEQ ID NO: 756598 - DNA, 20 bp, mouse
gagggtaggtagtggagcta

SEQ ID NO: 756599 - DNA, 20 bp, mouse
gtggccctagaaagctctaa

SEQ ID NO: 756600 - DNA, 20 bp, mouse
gaagcacgacggggacctca

SEQ ID NO: 756601 - DNA, 20 bp, mouse
gtagaaagctctaacggggt

SEQ ID NO: 756602 - DNA, 20 bp, mouse
gacgacggggacctcacgga

SEQ ID NO: 756603 - DNA, 20 bp, mouse
ggggtgggcagggtaggtag

SEQ ID NO: 756604 - DNA, 20 bp, mouse
ggtcctgtaacctgcagctt

SEQ ID NO: 756605 - DNA, 20 bp, mouse
gtagtggagctagggttctc

SEQ ID NO: 756606 - DNA, 20 bp, mouse
gaaatctctcagtttcactc

SEQ ID NO: 756607 - DNA, 20 bp, mouse
gctccgccggagcaccgcgt

SEQ ID NO: 756608 - DNA, 20 bp, mouse
gacagtgctagacaactgca

SEQ ID NO: 756609 - DNA, 20 bp, mouse
gagggtgcagctgcggcctg

SEQ ID NO: 756610 - DNA, 20 bp, mouse
gacttcctgagtcccttaaa

SEQ ID NO: 756611 - DNA, 20 bp, mouse
gtactaacctgctgctccaa

SEQ ID NO: 756612 - DNA, 20 bp, mouse
gcgatgcagtgactgttcca

SEQ ID NO: 756613 - DNA, 20 bp, mouse
gcctgagtcccttaaaggga

SEQ ID NO: 756614 - DNA, 20 bp, mouse
gggaagccgacgcggtgctc

SEQ ID NO: 756615 - DNA, 20 bp, mouse
gttagcgttcacttggcctt

SEQ ID NO: 756616 - DNA, 20 bp, mouse
ggggcctgagcatgatggat

SEQ ID NO: 756617 - DNA, 20 bp, mouse
ggggccttgccatggaggtt

SEQ ID NO: 756618 - DNA, 20 bp, mouse
ggggcctctgccaagatgac

SEQ ID NO: 756619 - DNA, 20 bp, mouse
ggggcggggccttgccatgg

SEQ ID NO: 756620 - DNA, 20 bp, mouse
ggggcggggcctgagcatga

SEQ ID NO: 756621 - DNA, 20 bp, mouse
gatgacaggagcctgggttg

SEQ ID NO: 756622 - DNA, 20 bp, mouse
gtgtggtaggtgggtgtcta

SEQ ID NO: 756623 - DNA, 20 bp, mouse
gcacccacctaccacaaccc

SEQ ID NO: 756624 - DNA, 20 bp, mouse
gcaggagcctgggttgtggt

SEQ ID NO: 756625 - DNA, 20 bp, mouse
gggcccgtctctgactgaac

SEQ ID NO: 756626 - DNA, 20 bp, mouse
ggacatggacacgtgatctg

SEQ ID NO: 756627 - DNA, 20 bp, mouse
gggggtgggcggaaagtgct

SEQ ID NO: 756628 - DNA, 20 bp, mouse
gtgtagcctggagtcttcca

SEQ ID NO: 756629 - DNA, 20 bp, mouse
gttgccccgcctttgagccc

SEQ ID NO: 756630 - DNA, 20 bp, mouse
gccggagcgtagagacatct

SEQ ID NO: 756631 - DNA, 20 bp, mouse
gaagggtgaagagctgcaag

SEQ ID NO: 756632 - DNA, 20 bp, mouse
gaaggcggggcaagcgtgga

SEQ ID NO: 756633 - DNA, 20 bp, mouse
gaaaccctgtttgccaggtc

SEQ ID NO: 756634 - DNA, 20 bp, mouse
gtgtcctgccaatcggaact

SEQ ID NO: 756635 - DNA, 20 bp, mouse
gagggagggcatctgtagcc

SEQ ID NO: 756636 - DNA, 20 bp, mouse
gtgggcggggaatccgtggt

SEQ ID NO: 756637 - DNA, 20 bp, mouse
gcaggacagtacaacctctg

SEQ ID NO: 756638 - DNA, 20 bp, mouse
gctcaggctgggctggttga

SEQ ID NO: 756639 - DNA, 20 bp, mouse
gaggcggggtcggtgcggga

SEQ ID NO: 756640 - DNA, 20 bp, mouse
gaatccgtggtgggaccgtg

SEQ ID NO: 756641 - DNA, 20 bp, mouse
gaggtgacagctaatggcgg

SEQ ID NO: 756642 - DNA, 20 bp, mouse
gtggcgacccgcaggttcct

SEQ ID NO: 756643 - DNA, 20 bp, mouse
gcaggtgggcggggaatccg

SEQ ID NO: 756644 - DNA, 20 bp, mouse
gcagcccagcctgagcaatc

SEQ ID NO: 756645 - DNA, 20 bp, mouse
ggttcctgggcacagcaggt

SEQ ID NO: 756646 - DNA, 20 bp, mouse
ggggtcacggaggatttcac

SEQ ID NO: 756647 - DNA, 20 bp, mouse
gtgagagcgcgcttctacgg

SEQ ID NO: 756648 - DNA, 20 bp, mouse
gggagcgcgacgctggagtg

SEQ ID NO: 756649 - DNA, 20 bp, mouse
gtccgcgcgagtcgcttccg

SEQ ID NO: 756650 - DNA, 20 bp, mouse
gaggcccgcaggggtcacgg

SEQ ID NO: 756651 - DNA, 20 bp, mouse
gtctctaggcggtactgtca

SEQ ID NO: 756652 - DNA, 20 bp, mouse
gtagaagcgcgctctcaaga

SEQ ID NO: 756653 - DNA, 20 bp, mouse
gcggaggcccgcaggggtca

SEQ ID NO: 756654 - DNA, 20 bp, mouse
gccgagcgcccgcccgaaat

SEQ ID NO: 756655 - DNA, 20 bp, mouse
gagcgcccgcccgaaatagg

SEQ ID NO: 756656 - DNA, 20 bp, mouse
gccagacaggggaggctctt

SEQ ID NO: 756657 - DNA, 20 bp, mouse
ggagactaaaatgtggatgt

SEQ ID NO: 756658 - DNA, 20 bp, mouse
gaaaatgtggatgtgggtta

SEQ ID NO: 756659 - DNA, 20 bp, mouse
gcaacccgttaggttgtcag

SEQ ID NO: 756660 - DNA, 20 bp, mouse
gtccgggagtagagcagcta

SEQ ID NO: 756661 - DNA, 20 bp, mouse
gacaaggaggggctggttaa

SEQ ID NO: 756662 - DNA, 20 bp, mouse
gggaggagcttaagaaagat

SEQ ID NO: 756663 - DNA, 20 bp, mouse
gaagatgcccagccccttaa

SEQ ID NO: 756664 - DNA, 20 bp, mouse
gtctgttcgtgaatattagt

SEQ ID NO: 756665 - DNA, 20 bp, mouse
ggggagaggctaaatcctag

SEQ ID NO: 756666 - DNA, 20 bp, mouse
ggaggtcccgcccacagcat

SEQ ID NO: 756667 - DNA, 20 bp, mouse
ggctcgctctgctccggctg

SEQ ID NO: 756668 - DNA, 20 bp, mouse
ggcggagcgaacggtgtcag

SEQ ID NO: 756669 - DNA, 20 bp, mouse
gccgccgcggccctagggat

SEQ ID NO: 756670 - DNA, 20 bp, mouse
gttggctagagcaaatacct

SEQ ID NO: 756671 - DNA, 20 bp, mouse
gcgccccgcctagcgaccgt

SEQ ID NO: 756672 - DNA, 20 bp, mouse
ggacaccgttcgctccgccc

SEQ ID NO: 756673 - DNA, 20 bp, mouse
ggtggccagtcccatgctgt

SEQ ID NO: 756674 - DNA, 20 bp, mouse
gctgtgggcgggacctcagc

SEQ ID NO: 756675 - DNA, 20 bp, mouse
gtaggcggggcgcgtggcct

SEQ ID NO: 756676 - DNA, 20 bp, mouse
gtcccccggggaaacccctt

SEQ ID NO: 756677 - DNA, 20 bp, mouse
gcgcccaaggggtttccccg

SEQ ID NO: 756678 - DNA, 20 bp, mouse
ggggccgcgctccgcccaag

SEQ ID NO: 756679 - DNA, 20 bp, mouse
gagagcccggggttcgtgcc

SEQ ID NO: 756680 - DNA, 20 bp, mouse
gccaagtggcctcacggcgg

SEQ ID NO: 756681 - DNA, 20 bp, mouse
ggatccaagtggcctcacgg

SEQ ID NO: 756682 - DNA, 20 bp, mouse
gtgggccgggcacgaacccc

SEQ ID NO: 756683 - DNA, 20 bp, mouse
gaagccgggctaaaccaccg

SEQ ID NO: 756684 - DNA, 20 bp, mouse
gagggatccaagtggcctca

SEQ ID NO: 756685 - DNA, 20 bp, mouse
ggaaccattggcaacaagag

SEQ ID NO: 756686 - DNA, 20 bp, mouse
gtgggcggcctgtgggatga

SEQ ID NO: 756687 - DNA, 20 bp, mouse
gcttgggagaggtggactcg

SEQ ID NO: 756688 - DNA, 20 bp, mouse
gacacaagatgtgacggctt

SEQ ID NO: 756689 - DNA, 20 bp, mouse
gaggaatgtgggcggcctgt

SEQ ID NO: 756690 - DNA, 20 bp, mouse
gtgtgacggcttgggagagg

SEQ ID NO: 756691 - DNA, 20 bp, mouse
ggccccgtggcgctacaaag

SEQ ID NO: 756692 - DNA, 20 bp, mouse
gcagcccccgcgcgcagtgc

SEQ ID NO: 756693 - DNA, 20 bp, mouse
ggagggggtgaggtatttaa

SEQ ID NO: 756694 - DNA, 20 bp, mouse
gagatgtgacggcttgggag

SEQ ID NO: 756695 - DNA, 20 bp, mouse
ggccaggcaggctccgagac

SEQ ID NO: 756696 - DNA, 20 bp, mouse
gtggtcacgccccaggatgt

SEQ ID NO: 756697 - DNA, 20 bp, mouse
ggctgcaagtcaccagactg

SEQ ID NO: 756698 - DNA, 20 bp, mouse
gaagactggccgtcacggga

SEQ ID NO: 756699 - DNA, 20 bp, mouse
gccggcgcgctgtccgctgt

SEQ ID NO: 756700 - DNA, 20 bp, mouse
gggggaagactggccgtcac

SEQ ID NO: 756701 - DNA, 20 bp, mouse
ggccgtcacgggatgggcga

SEQ ID NO: 756702 - DNA, 20 bp, mouse
gacgccccaggatgtgggcg

SEQ ID NO: 756703 - DNA, 20 bp, mouse
ggccctcgcccatcccgtga

SEQ ID NO: 756704 - DNA, 20 bp, mouse
gggctcgttggtcacgcccc

SEQ ID NO: 756705 - DNA, 20 bp, mouse
gcgcgctgtccgctgtggga

SEQ ID NO: 756706 - DNA, 20 bp, mouse
gtgagcagcgtggagagtga

SEQ ID NO: 756707 - DNA, 20 bp, mouse
gtgagagggcgtctgcccac

SEQ ID NO: 756708 - DNA, 20 bp, mouse
gtggtctccgggtgccggat

SEQ ID NO: 756709 - DNA, 20 bp, mouse
ggcggctgcgtggtgaggca

SEQ ID NO: 756710 - DNA, 20 bp, mouse
gtaagaggggtcgcagccta

SEQ ID NO: 756711 - DNA, 20 bp, mouse
gtacccggagggaggaggct

SEQ ID NO: 756712 - DNA, 20 bp, mouse
gtctcgggcggggtcgtcac

SEQ ID NO: 756713 - DNA, 20 bp, mouse
ggataggttacaagctgaga

SEQ ID NO: 756714 - DNA, 20 bp, mouse
gtagaggctagagatacgat

SEQ ID NO: 756715 - DNA, 20 bp, mouse
gcctccctccgggtactgtc

SEQ ID NO: 756716 - DNA, 20 bp, mouse
gctccccgcaacctgggcag

SEQ ID NO: 756717 - DNA, 20 bp, mouse
gcaggactccgccgaggagg

SEQ ID NO: 756718 - DNA, 20 bp, mouse
ggccgaggaggtggaggcga

SEQ ID NO: 756719 - DNA, 20 bp, mouse
gagagcccaggactccgccg

SEQ ID NO: 756720 - DNA, 20 bp, mouse
ggccctctggcaagagcgaa

SEQ ID NO: 756721 - DNA, 20 bp, mouse
gacctctccagggaactcta

SEQ ID NO: 756722 - DNA, 20 bp, mouse
ggcccaggactccgccgagg

SEQ ID NO: 756723 - DNA, 20 bp, mouse
gcccgcaacctgggcagcgg

SEQ ID NO: 756724 - DNA, 20 bp, mouse
gtcccccgctgcccaggttg

SEQ ID NO: 756725 - DNA, 20 bp, mouse
ggtagcacacctggaaagat

SEQ ID NO: 756726 - DNA, 20 bp, mouse
gcagaggggatcctgacagc

SEQ ID NO: 756727 - DNA, 20 bp, mouse
gagctagcatacgctctcta

SEQ ID NO: 756728 - DNA, 20 bp, mouse
gtgtacagcgccctctctga

SEQ ID NO: 756729 - DNA, 20 bp, mouse
gtctatgggcgacactcagc

SEQ ID NO: 756730 - DNA, 20 bp, mouse
gagagagggcgctgtacaac

SEQ ID NO: 756731 - DNA, 20 bp, mouse
ggacgcctgcgcagtgccac

SEQ ID NO: 756732 - DNA, 20 bp, mouse
ggcaaatcttagcttcagag

SEQ ID NO: 756733 - DNA, 20 bp, mouse
ggtacaacaggccatgcatg

SEQ ID NO: 756734 - DNA, 20 bp, mouse
gcttgtctagctgaacatgt

SEQ ID NO: 756735 - DNA, 20 bp, mouse
ggctagctgggccacatgca

SEQ ID NO: 756736 - DNA, 20 bp, mouse
ggaaaggagagcaaagtcca

SEQ ID NO: 756737 - DNA, 20 bp, mouse
ggagacccgcaggtgcgagc

SEQ ID NO: 756738 - DNA, 20 bp, mouse
ggcaatgggaagggcgggga

SEQ ID NO: 756739 - DNA, 20 bp, mouse
gggcgcagagccgcgatctc

SEQ ID NO: 756740 - DNA, 20 bp, mouse
ggcgtgcggcgcaatgggaa

SEQ ID NO: 756741 - DNA, 20 bp, mouse
gcacctgcgggtctcaccct

SEQ ID NO: 756742 - DNA, 20 bp, mouse
gctgcgcgggcctgagatcg

SEQ ID NO: 756743 - DNA, 20 bp, mouse
gctgcgcctgctcgcacctg

SEQ ID NO: 756744 - DNA, 20 bp, mouse
gtgcggcgcaatgggaaggg

SEQ ID NO: 756745 - DNA, 20 bp, mouse
ggctcctcctccaggtgcgc

SEQ ID NO: 756746 - DNA, 20 bp, mouse
gtgaagggcaaggattgcgg

SEQ ID NO: 756747 - DNA, 20 bp, mouse
ggccaccggcgtctgacggg

SEQ ID NO: 756748 - DNA, 20 bp, mouse
gactcggaagacatagaaac

SEQ ID NO: 756749 - DNA, 20 bp, mouse
ggcgtctgacgggcgggctg

SEQ ID NO: 756750 - DNA, 20 bp, mouse
gtacttccgccagaagtccc

SEQ ID NO: 756751 - DNA, 20 bp, mouse
gcccgcccgtcagacgccgg

SEQ ID NO: 756752 - DNA, 20 bp, mouse
ggaactcctgcacaattaga

SEQ ID NO: 756753 - DNA, 20 bp, mouse
gcgggactcggtcgcagaga

SEQ ID NO: 756754 - DNA, 20 bp, mouse
gcatgagtgctgtccctcaa

SEQ ID NO: 756755 - DNA, 20 bp, mouse
gcgagtcccggccagtggtg

SEQ ID NO: 756756 - DNA, 20 bp, mouse
ggcgcaacgtgcacgcactg

SEQ ID NO: 756757 - DNA, 20 bp, mouse
ggggtgtcctaccaccggga

SEQ ID NO: 756758 - DNA, 20 bp, mouse
gcgtggaggcatcaagtgga

SEQ ID NO: 756759 - DNA, 20 bp, mouse
ggcgggagggccataaaaag

SEQ ID NO: 756760 - DNA, 20 bp, mouse
gaccgagtctcgccacacgg

SEQ ID NO: 756761 - DNA, 20 bp, mouse
gtgcacgttgcgcccccgtg

SEQ ID NO: 756762 - DNA, 20 bp, mouse
gacctccgagtccaagttgc

SEQ ID NO: 756763 - DNA, 20 bp, mouse
gaggtgtcagcaggcggcag

SEQ ID NO: 756764 - DNA, 20 bp, mouse
ggactcggtgagacacgtgg

SEQ ID NO: 756765 - DNA, 20 bp, mouse
ggggaaacttgcaccctgga

SEQ ID NO: 756766 - DNA, 20 bp, mouse
ggagacaattaattgaacgt

SEQ ID NO: 756767 - DNA, 20 bp, mouse
gaaaaggtccagacagggac

SEQ ID NO: 756768 - DNA, 20 bp, mouse
gttaagaagaggctgcgggg

SEQ ID NO: 756769 - DNA, 20 bp, mouse
ggctgcggggagggacctag

SEQ ID NO: 756770 - DNA, 20 bp, mouse
gagaagaacgcgtccctcag

SEQ ID NO: 756771 - DNA, 20 bp, mouse
gagaaataaaaggtccagac

SEQ ID NO: 756772 - DNA, 20 bp, mouse
gtaattgaacgtgggcagag

SEQ ID NO: 756773 - DNA, 20 bp, mouse
gcccagtgagtgttaagaag

SEQ ID NO: 756774 - DNA, 20 bp, mouse
gtcaactaggccacctaaag

SEQ ID NO: 756775 - DNA, 20 bp, mouse
gttcttgagcgtgccactga

SEQ ID NO: 756776 - DNA, 20 bp, mouse
gtacctgcggggggaggaag

SEQ ID NO: 756777 - DNA, 20 bp, mouse
gagcgctgaaagtacctgcg

SEQ ID NO: 756778 - DNA, 20 bp, mouse
gagacgcccggaactgtcac

SEQ ID NO: 756779 - DNA, 20 bp, mouse
gcggagaaggaacatgttga

SEQ ID NO: 756780 - DNA, 20 bp, mouse
gctggcgggagattctatct

SEQ ID NO: 756781 - DNA, 20 bp, mouse
gtatcttggaggttgaggtt

SEQ ID NO: 756782 - DNA, 20 bp, mouse
gcaaaagcgtcgctggacgc

SEQ ID NO: 756783 - DNA, 20 bp, mouse
ggcccagctggcttctactc

SEQ ID NO: 756784 - DNA, 20 bp, mouse
ggggggggggagaacgcaca

SEQ ID NO: 756785 - DNA, 20 bp, mouse
ggggcgccgcgctgtcgctg

SEQ ID NO: 756786 - DNA, 20 bp, mouse
gggcaagcaaaaggaggcga

SEQ ID NO: 756787 - DNA, 20 bp, mouse
gagcgggccgagctcgaaga

SEQ ID NO: 756788 - DNA, 20 bp, mouse
ggcaaccagtggcaagcaaa

SEQ ID NO: 756789 - DNA, 20 bp, mouse
gttcgggaccggcttctcga

SEQ ID NO: 756790 - DNA, 20 bp, mouse
gcacacggtcacagcgtgtg

SEQ ID NO: 756791 - DNA, 20 bp, mouse
ggccgagctcgaagatgggg

SEQ ID NO: 756792 - DNA, 20 bp, mouse
gcggtcacagcgtgtgtgga

SEQ ID NO: 756793 - DNA, 20 bp, mouse
gagaactggggcagaggtta

SEQ ID NO: 756794 - DNA, 20 bp, mouse
ggaccggcttctcgagggcg

SEQ ID NO: 756795 - DNA, 20 bp, mouse
gaagtcaactcacgactgat

SEQ ID NO: 756796 - DNA, 20 bp, mouse
ggagtagcaacacttcacca

SEQ ID NO: 756797 - DNA, 20 bp, mouse
gaagcccattaggtcaaact

SEQ ID NO: 756798 - DNA, 20 bp, mouse
gcaacaacgggaagcccatt

SEQ ID NO: 756799 - DNA, 20 bp, mouse
gcgccgagagaccgcaacaa

SEQ ID NO: 756800 - DNA, 20 bp, mouse
gagtagaaagcaaaatacga

SEQ ID NO: 756801 - DNA, 20 bp, mouse
gaaaactctcctctgttgtg

SEQ ID NO: 756802 - DNA, 20 bp, mouse
gtcccgttgttgcggtctct

SEQ ID NO: 756803 - DNA, 20 bp, mouse
gaggtttgcatatacttacg

SEQ ID NO: 756804 - DNA, 20 bp, mouse
gttaaaaagatatctaacta

SEQ ID NO: 756805 - DNA, 20 bp, mouse
gactacctagtttgacctaa

SEQ ID NO: 756806 - DNA, 20 bp, mouse
ggccggccaaggcagagtag

SEQ ID NO: 756807 - DNA, 20 bp, mouse
gcgcaaaagtggctctcctg

SEQ ID NO: 756808 - DNA, 20 bp, mouse
ggaggtaagcagtcggggcg

SEQ ID NO: 756809 - DNA, 20 bp, mouse
gtggaggtcaggaaaatcag

SEQ ID NO: 756810 - DNA, 20 bp, mouse
gagtagaggcgtggttccaa

SEQ ID NO: 756811 - DNA, 20 bp, mouse
gtctccagaaagctctgctc

SEQ ID NO: 756812 - DNA, 20 bp, mouse
gggcgtggttccaatgggcg

SEQ ID NO: 756813 - DNA, 20 bp, mouse
ggccctagcggggcgtgaac

SEQ ID NO: 756814 - DNA, 20 bp, mouse
gacctggggaggtgttggat

SEQ ID NO: 756815 - DNA, 20 bp, mouse
gaggggaacgttagtttcca

SEQ ID NO: 756816 - DNA, 20 bp, mouse
gactcagggaagagacgctc

SEQ ID NO: 756817 - DNA, 20 bp, mouse
gatcagtggtggagtatcaa

SEQ ID NO: 756818 - DNA, 20 bp, mouse
ggctcctcgccgccgtgtat

SEQ ID NO: 756819 - DNA, 20 bp, mouse
gagacgctctggtctccata

SEQ ID NO: 756820 - DNA, 20 bp, mouse
gcctgagtactgggtcccta

SEQ ID NO: 756821 - DNA, 20 bp, mouse
gagcaaagcctccggcgatt

SEQ ID NO: 756822 - DNA, 20 bp, mouse
ggctttgctccgtggcccta

SEQ ID NO: 756823 - DNA, 20 bp, mouse
gtgccggaggctagattgag

SEQ ID NO: 756824 - DNA, 20 bp, mouse
gagagctaacggcgcagtgg

SEQ ID NO: 756825 - DNA, 20 bp, mouse
gaccaacagcctatacacgg

SEQ ID NO: 756826 - DNA, 20 bp, mouse
gaccacgcgtggaacggatt

SEQ ID NO: 756827 - DNA, 20 bp, mouse
ggagtaaagggtcttagggt

SEQ ID NO: 756828 - DNA, 20 bp, mouse
gaggagagggcgatccactt

SEQ ID NO: 756829 - DNA, 20 bp, mouse
ggctctggaaggaccacgcg

SEQ ID NO: 756830 - DNA, 20 bp, mouse
gggtaggatactgctctgga

SEQ ID NO: 756831 - DNA, 20 bp, mouse
gagggaaaaggttcgcttct

SEQ ID NO: 756832 - DNA, 20 bp, mouse
gttggttagggcactaggag

SEQ ID NO: 756833 - DNA, 20 bp, mouse
gtcccaggattccttggtta

SEQ ID NO: 756834 - DNA, 20 bp, mouse
gagatggagtaaagggtctt

SEQ ID NO: 756835 - DNA, 20 bp, mouse
gtgccctaaccaaggaatcc

SEQ ID NO: 756836 - DNA, 20 bp, mouse
ggagcccctcccctggggta

SEQ ID NO: 756837 - DNA, 20 bp, mouse
ggccccagacctgtcccatt

SEQ ID NO: 756838 - DNA, 20 bp, mouse
ggacctgtcccatttggagg

SEQ ID NO: 756839 - DNA, 20 bp, mouse
gtccaaatgggacaggtctg

SEQ ID NO: 756840 - DNA, 20 bp, mouse
gccacgcccccgtggaggcg

SEQ ID NO: 756841 - DNA, 20 bp, mouse
gtccgccctaccccagggga

SEQ ID NO: 756842 - DNA, 20 bp, mouse
gcgtctcagccccgcctcca

SEQ ID NO: 756843 - DNA, 20 bp, mouse
gagtctccgccctaccccag

SEQ ID NO: 756844 - DNA, 20 bp, mouse
ggtggagctccgccctgagg

SEQ ID NO: 756845 - DNA, 20 bp, mouse
gagagctcgcccactagaag

SEQ ID NO: 756846 - DNA, 20 bp, mouse
gaaggggcagcgtccgtgta

SEQ ID NO: 756847 - DNA, 20 bp, mouse
gagcccacggagcacgagtg

SEQ ID NO: 756848 - DNA, 20 bp, mouse
ggctgatcgccggatgtggg

SEQ ID NO: 756849 - DNA, 20 bp, mouse
gcgcgcctggaggtattcgg

SEQ ID NO: 756850 - DNA, 20 bp, mouse
gccctgggagcgtccgtaca

SEQ ID NO: 756851 - DNA, 20 bp, mouse
gcacgagtggggaagcccgg

SEQ ID NO: 756852 - DNA, 20 bp, mouse
gtccgtgtacggacgctccc

SEQ ID NO: 756853 - DNA, 20 bp, mouse
gcgaccgccaacagacatgc

SEQ ID NO: 756854 - DNA, 20 bp, mouse
gggaatgttctccaggtaag

SEQ ID NO: 756855 - DNA, 20 bp, mouse
ggtctgtcctgtcccgggtg

SEQ ID NO: 756856 - DNA, 20 bp, mouse
gggagcgcgcgctggctgag

SEQ ID NO: 756857 - DNA, 20 bp, mouse
gcgtgagccgcccgagggcg

SEQ ID NO: 756858 - DNA, 20 bp, mouse
ggcaaggaggagctggcggg

SEQ ID NO: 756859 - DNA, 20 bp, mouse
gtgcggcgagggtctctgag

SEQ ID NO: 756860 - DNA, 20 bp, mouse
gtcgtgcgtgagccgcccga

SEQ ID NO: 756861 - DNA, 20 bp, mouse
gcgggcgcacaggagtaaaa

SEQ ID NO: 756862 - DNA, 20 bp, mouse
gtgctcccggggatgttgcg

SEQ ID NO: 756863 - DNA, 20 bp, mouse
gcgctctggcggtgctcccg

SEQ ID NO: 756864 - DNA, 20 bp, mouse
gagagcgcctcgtgcggcga

SEQ ID NO: 756865 - DNA, 20 bp, mouse
gacgaggcgctctgaacgtc

SEQ ID NO: 756866 - DNA, 20 bp, mouse
gccctcttgccggaccagtc

SEQ ID NO: 756867 - DNA, 20 bp, mouse
gtccgctcccgctggagggt

SEQ ID NO: 756868 - DNA, 20 bp, mouse
gcctgcgccgccccgacccg

SEQ ID NO: 756869 - DNA, 20 bp, mouse
gtggcgctgccagactggtc

SEQ ID NO: 756870 - DNA, 20 bp, mouse
gccccaccctccagcgggag

SEQ ID NO: 756871 - DNA, 20 bp, mouse
gcaagaggggccggcgggag

SEQ ID NO: 756872 - DNA, 20 bp, mouse
gcattcacggccagaaacca

SEQ ID NO: 756873 - DNA, 20 bp, mouse
ggctgtgggaaaggccgggc

SEQ ID NO: 756874 - DNA, 20 bp, mouse
gagcgggcgccgccgcgggt

SEQ ID NO: 756875 - DNA, 20 bp, mouse
ggatgcacgcgtgtacacat

SEQ ID NO: 756876 - DNA, 20 bp, mouse
gtgagcccttccatgaactt

SEQ ID NO: 756877 - DNA, 20 bp, mouse
gttgtcgccggttctgaaga

SEQ ID NO: 756878 - DNA, 20 bp, mouse
gcaggacctaagttcatgga

SEQ ID NO: 756879 - DNA, 20 bp, mouse
gaagtgaccctcttcagaac

SEQ ID NO: 756880 - DNA, 20 bp, mouse
gagataaacactgttgtcgc

SEQ ID NO: 756881 - DNA, 20 bp, mouse
gttaatgattaaacgcaggt

SEQ ID NO: 756882 - DNA, 20 bp, mouse
gactcccttgattttccttc

SEQ ID NO: 756883 - DNA, 20 bp, mouse
gaggtcctgattttggagtt

SEQ ID NO: 756884 - DNA, 20 bp, mouse
gcaacagtgtttatctatag

SEQ ID NO: 756885 - DNA, 20 bp, mouse
gactattaatgattaaacgc

SEQ ID NO: 756886 - DNA, 20 bp, mouse
gggttgttgtggttcccgac

SEQ ID NO: 756887 - DNA, 20 bp, mouse
gacaggacctgcgacatcat

SEQ ID NO: 756888 - DNA, 20 bp, mouse
gtcccgactgggatggaaag

SEQ ID NO: 756889 - DNA, 20 bp, mouse
gtaacagccaatgatgtcgc

SEQ ID NO: 756890 - DNA, 20 bp, mouse
gggagaaagtgggtggtctc

SEQ ID NO: 756891 - DNA, 20 bp, mouse
gaatagacattaggcatgtg

SEQ ID NO: 756892 - DNA, 20 bp, mouse
gcctgtcactatttggaacg

SEQ ID NO: 756893 - DNA, 20 bp, mouse
gtagctaataaatagacatt

SEQ ID NO: 756894 - DNA, 20 bp, mouse
gtatccctgggcactttccc

SEQ ID NO: 756895 - DNA, 20 bp, mouse
gcgggaaccacaacaacccg

SEQ ID NO: 756896 - DNA, 20 bp, mouse
gcaaaggccaggttgcgggg

SEQ ID NO: 756897 - DNA, 20 bp, mouse
ggctcctagagcccagacaa

SEQ ID NO: 756898 - DNA, 20 bp, mouse
gtaacctgagagacgagcag

SEQ ID NO: 756899 - DNA, 20 bp, mouse
ggacgagcaggggttccttg

SEQ ID NO: 756900 - DNA, 20 bp, mouse
gccgccagggggaggagcga

SEQ ID NO: 756901 - DNA, 20 bp, mouse
gctcccgcggagctccacta

SEQ ID NO: 756902 - DNA, 20 bp, mouse
ggaacccctgctcgtctctc

SEQ ID NO: 756903 - DNA, 20 bp, mouse
gtggcctcgcccctcgcccg

SEQ ID NO: 756904 - DNA, 20 bp, mouse
gtctcaggttagtttttttg

SEQ ID NO: 756905 - DNA, 20 bp, mouse
gtacggtcgccagccgggtc

SEQ ID NO: 756906 - DNA, 20 bp, mouse
gagggagatgccactgtcaa

SEQ ID NO: 756907 - DNA, 20 bp, mouse
ggcagagaggaggactcggg

SEQ ID NO: 756908 - DNA, 20 bp, mouse
gccagggccacctagtttcc

SEQ ID NO: 756909 - DNA, 20 bp, mouse
gaggattcccggaaactagg

SEQ ID NO: 756910 - DNA, 20 bp, mouse
gggtgacagttcatctgcag

SEQ ID NO: 756911 - DNA, 20 bp, mouse
gaacttcagcgattgcagag

SEQ ID NO: 756912 - DNA, 20 bp, mouse
gctggtaaatcctcctgcga

SEQ ID NO: 756913 - DNA, 20 bp, mouse
gggagaccctgagggaccca

SEQ ID NO: 756914 - DNA, 20 bp, mouse
gccaccccctgggtccctca

SEQ ID NO: 756915 - DNA, 20 bp, mouse
gaggagggctcttggctcgt

SEQ ID NO: 756916 - DNA, 20 bp, mouse
gcccccgcggcgtccgctca

SEQ ID NO: 756917 - DNA, 20 bp, mouse
gcggccctgctcccttacgg

SEQ ID NO: 756918 - DNA, 20 bp, mouse
ggaaccgccggcgacacgga

SEQ ID NO: 756919 - DNA, 20 bp, mouse
ggtggggcatcggccttctg

SEQ ID NO: 756920 - DNA, 20 bp, mouse
ggtgaacccgaggggagctg

SEQ ID NO: 756921 - DNA, 20 bp, mouse
gcctgaggcggcccccgtaa

SEQ ID NO: 756922 - DNA, 20 bp, mouse
gcccaagcgcgtctggacgg

SEQ ID NO: 756923 - DNA, 20 bp, mouse
ggcccgcggcgctccccaga

SEQ ID NO: 756924 - DNA, 20 bp, mouse
gccggctggggcctgagtgg

SEQ ID NO: 756925 - DNA, 20 bp, mouse
gctgtccggggtgaacccga

SEQ ID NO: 756926 - DNA, 20 bp, mouse
gcagagagcctgctctctta

SEQ ID NO: 756927 - DNA, 20 bp, mouse
gccactaactgtaggattcg

SEQ ID NO: 756928 - DNA, 20 bp, mouse
ggcgagagccctaagagagc

SEQ ID NO: 756929 - DNA, 20 bp, mouse
ggacgccggaagtgcttggt

SEQ ID NO: 756930 - DNA, 20 bp, mouse
ggagagaattcctgagtttc

SEQ ID NO: 756931 - DNA, 20 bp, mouse
gtactggagcccagaaactc

SEQ ID NO: 756932 - DNA, 20 bp, mouse
ggtgcctggtctggttctac

SEQ ID NO: 756933 - DNA, 20 bp, mouse
ggcggagcagccggaagtgc

SEQ ID NO: 756934 - DNA, 20 bp, mouse
gcggcctggcggtaaccttg

SEQ ID NO: 756935 - DNA, 20 bp, mouse
gctctctggctagagtcttt

SEQ ID NO: 756936 - DNA, 20 bp, mouse
gactaggagctgtgccggaa

SEQ ID NO: 756937 - DNA, 20 bp, mouse
ggcagcaggcctttgagaga

SEQ ID NO: 756938 - DNA, 20 bp, mouse
gaccagactaggagctgtgc

SEQ ID NO: 756939 - DNA, 20 bp, mouse
ggctttggacagagtcagaa

SEQ ID NO: 756940 - DNA, 20 bp, mouse
gctccagcacgtggaatgga

SEQ ID NO: 756941 - DNA, 20 bp, mouse
gccacgtgctggagagtggg

SEQ ID NO: 756942 - DNA, 20 bp, mouse
gtgggcggtacgagtacttc

SEQ ID NO: 756943 - DNA, 20 bp, mouse
gcactctccagcacgtggaa

SEQ ID NO: 756944 - DNA, 20 bp, mouse
gagctgggactgactccttg

SEQ ID NO: 756945 - DNA, 20 bp, mouse
gttgctaaaccttctctcaa

SEQ ID NO: 756946 - DNA, 20 bp, mouse
gtacacaggaatgactgggg

SEQ ID NO: 756947 - DNA, 20 bp, mouse
gctactggaaagtctggcag

SEQ ID NO: 756948 - DNA, 20 bp, mouse
gacctggggtagtcaaggag

SEQ ID NO: 756949 - DNA, 20 bp, mouse
ggggctggataatagtggac

SEQ ID NO: 756950 - DNA, 20 bp, mouse
gagcggttggtaaaagtggg

SEQ ID NO: 756951 - DNA, 20 bp, mouse
ggagcccaagtaccctacac

SEQ ID NO: 756952 - DNA, 20 bp, mouse
gtaccctacacaggaatgac

SEQ ID NO: 756953 - DNA, 20 bp, mouse
gactaccccaggtgtgtatg

SEQ ID NO: 756954 - DNA, 20 bp, mouse
gtgaccgccaagaagaggaa

SEQ ID NO: 756955 - DNA, 20 bp, mouse
gtgtcataaggttgagtgat

SEQ ID NO: 756956 - DNA, 20 bp, mouse
ggtctctggtcgtacagcat

SEQ ID NO: 756957 - DNA, 20 bp, mouse
ggtcacttgagcccagcttc

SEQ ID NO: 756958 - DNA, 20 bp, mouse
gctcaagtgacctgactctg

SEQ ID NO: 756959 - DNA, 20 bp, mouse
ggagacagtagtaggctctg

SEQ ID NO: 756960 - DNA, 20 bp, mouse
ggtaaggcaatcatcgttct

SEQ ID NO: 756961 - DNA, 20 bp, mouse
ggtagctgccagaggatggt

SEQ ID NO: 756962 - DNA, 20 bp, mouse
gtgtttagagagacagtagt

SEQ ID NO: 756963 - DNA, 20 bp, mouse
ggcaattcgtggtcaggatc

SEQ ID NO: 756964 - DNA, 20 bp, mouse
ggcaaaggcaattcgtggtc

SEQ ID NO: 756965 - DNA, 20 bp, mouse
ggaaatccttgcaaggtcaa

SEQ ID NO: 756966 - DNA, 20 bp, mouse
gataggatatcacctcactc

SEQ ID NO: 756967 - DNA, 20 bp, mouse
gccggaggggtcagtagtca

SEQ ID NO: 756968 - DNA, 20 bp, mouse
gcctctcagctgtaagcaat

SEQ ID NO: 756969 - DNA, 20 bp, mouse
gggcaggtcagtcaggttct

SEQ ID NO: 756970 - DNA, 20 bp, mouse
ggtaacctatgaaaactaga

SEQ ID NO: 756971 - DNA, 20 bp, mouse
gtgtggcacatgactcactg

SEQ ID NO: 756972 - DNA, 20 bp, mouse
gcatagagaagaagtaggtg

SEQ ID NO: 756973 - DNA, 20 bp, mouse
ggaggggtgatagcatcctc

SEQ ID NO: 756974 - DNA, 20 bp, mouse
gctagagaaacaaaattggg

SEQ ID NO: 756975 - DNA, 20 bp, mouse
gaagcgaagaatttgtttat

SEQ ID NO: 756976 - DNA, 20 bp, mouse
ggcaacattactcaaaagta

SEQ ID NO: 756977 - DNA, 20 bp, mouse
gttgagcagcagtgtgttat

SEQ ID NO: 756978 - DNA, 20 bp, mouse
ggacccttagttctttgtac

SEQ ID NO: 756979 - DNA, 20 bp, mouse
gaacaaaaaggagctccata

SEQ ID NO: 756980 - DNA, 20 bp, mouse
gcctcaaagagaatctgata

SEQ ID NO: 756981 - DNA, 20 bp, mouse
gattccacaaaatagatcct

SEQ ID NO: 756982 - DNA, 20 bp, mouse
gtcatcaagatcaactgtgt

SEQ ID NO: 756983 - DNA, 20 bp, mouse
ggggttcctgaagcataaat

SEQ ID NO: 756984 - DNA, 20 bp, mouse
ggtgtgttataggcacttag

SEQ ID NO: 756985 - DNA, 20 bp, mouse
gtagcatgcatgcctacttt

SEQ ID NO: 756986 - DNA, 20 bp, mouse
gctaagagctggtttatctt

SEQ ID NO: 756987 - DNA, 20 bp, mouse
gcaggttccactgaacgtga

SEQ ID NO: 756988 - DNA, 20 bp, mouse
ggattcttgcccataggaat

SEQ ID NO: 756989 - DNA, 20 bp, mouse
gccataggcccaattcctat

SEQ ID NO: 756990 - DNA, 20 bp, mouse
ggatctgccttcacgttcag

SEQ ID NO: 756991 - DNA, 20 bp, mouse
gtgtccacttctcttggccc

SEQ ID NO: 756992 - DNA, 20 bp, mouse
gacctgtttccactaagagc

SEQ ID NO: 756993 - DNA, 20 bp, mouse
gtcattttagaatttgttaa

SEQ ID NO: 756994 - DNA, 20 bp, mouse
gtgtcaagacatctgggacc

SEQ ID NO: 756995 - DNA, 20 bp, mouse
gctattgtgtcaagacatct

SEQ ID NO: 756996 - DNA, 20 bp, mouse
gagccagtgcagtagcctgt

SEQ ID NO: 756997 - DNA, 20 bp, mouse
gcatcgaaggtgacaaagtg

SEQ ID NO: 756998 - DNA, 20 bp, mouse
gcacataggtacagttaccc

SEQ ID NO: 756999 - DNA, 20 bp, mouse
ggggcaggacaccttgtcat

SEQ ID NO: 757000 - DNA, 20 bp, mouse
gccaaagttgtccactgtgg

SEQ ID NO: 757001 - DNA, 20 bp, mouse
ggaggagattacccccacag

SEQ ID NO: 757002 - DNA, 20 bp, mouse
gctgtagtagagcccatcga

SEQ ID NO: 757003 - DNA, 20 bp, mouse
gatctcctccaccagcacat

SEQ ID NO: 757004 - DNA, 20 bp, mouse
gcactgtgatgccaatgaca

SEQ ID NO: 757005 - DNA, 20 bp, mouse
gagtcattgtcaggattcaa

SEQ ID NO: 757006 - DNA, 20 bp, mouse
gaagccgggaccccaggtat

SEQ ID NO: 757007 - DNA, 20 bp, mouse
gccaggggagggtttcagaa

SEQ ID NO: 757008 - DNA, 20 bp, mouse
gcctggggtcccggcttcat

SEQ ID NO: 757009 - DNA, 20 bp, mouse
gaccccaggtatgggtgagt

SEQ ID NO: 757010 - DNA, 20 bp, mouse
gcgggtgaccacaaatgtgc

SEQ ID NO: 757011 - DNA, 20 bp, mouse
gaatcagagaggcaaggcat

SEQ ID NO: 757012 - DNA, 20 bp, mouse
gcaggctgacagcaggttca

SEQ ID NO: 757013 - DNA, 20 bp, mouse
gtcacccatacctggggtcc

SEQ ID NO: 757014 - DNA, 20 bp, mouse
gtgactgggtaggttccagg

SEQ ID NO: 757015 - DNA, 20 bp, mouse
gacgactgcccaggtgtgac

SEQ ID NO: 757016 - DNA, 20 bp, mouse
gcactagtggttgtgacttc

SEQ ID NO: 757017 - DNA, 20 bp, mouse
gcaacagtggttgtaatttc

SEQ ID NO: 757018 - DNA, 20 bp, mouse
ggttgtaatttcaggagtgg

SEQ ID NO: 757019 - DNA, 20 bp, mouse
gctgctgacttcaccaccac

SEQ ID NO: 757020 - DNA, 20 bp, mouse
gcttctgatgttaccaccac

SEQ ID NO: 757021 - DNA, 20 bp, mouse
gcaacggtggttgtgatttc

SEQ ID NO: 757022 - DNA, 20 bp, mouse
ggtggtgaggtcagcagtgg

SEQ ID NO: 757023 - DNA, 20 bp, mouse
ggtggttgtgatttcaggtg

SEQ ID NO: 757024 - DNA, 20 bp, mouse
ggtggtgttgacaacaccag

SEQ ID NO: 757025 - DNA, 20 bp, mouse
ggttgtgatttcaggtgtgg

SEQ ID NO: 757026 - DNA, 20 bp, mouse
ggcagggggaatggggggta

SEQ ID NO: 757027 - DNA, 20 bp, mouse
gggctggccaaccagtcccg

SEQ ID NO: 757028 - DNA, 20 bp, mouse
gtgaggaaggcgtggcaaca

SEQ ID NO: 757029 - DNA, 20 bp, mouse
gggagcttgaaaagtaatcc

SEQ ID NO: 757030 - DNA, 20 bp, mouse
ggggtaggggtggtttcata

SEQ ID NO: 757031 - DNA, 20 bp, mouse
gccccccattccccctgcga

SEQ ID NO: 757032 - DNA, 20 bp, mouse
gttccagcactggagacacg

SEQ ID NO: 757033 - DNA, 20 bp, mouse
ggctgtggttccatcgcagg

SEQ ID NO: 757034 - DNA, 20 bp, mouse
gtggtttcataaggtgagga

SEQ ID NO: 757035 - DNA, 20 bp, mouse
gacccgtagcaacacgaaaa

SEQ ID NO: 757036 - DNA, 20 bp, mouse
gtgacaaggagcagagctat

SEQ ID NO: 757037 - DNA, 20 bp, mouse
gtcaacttgagccaagtggg

SEQ ID NO: 757038 - DNA, 20 bp, mouse
gagagggaggaaagatctca

SEQ ID NO: 757039 - DNA, 20 bp, mouse
gcacttggctcaagttgaca

SEQ ID NO: 757040 - DNA, 20 bp, mouse
gagcagagctatgggtgtac

SEQ ID NO: 757041 - DNA, 20 bp, mouse
gggtgagaatgagtaccagg

SEQ ID NO: 757042 - DNA, 20 bp, mouse
gaggaagggcagagataata

SEQ ID NO: 757043 - DNA, 20 bp, mouse
gaagactgggcaaggatgat

SEQ ID NO: 757044 - DNA, 20 bp, mouse
ggcagctgggtcacttcaga

SEQ ID NO: 757045 - DNA, 20 bp, mouse
gggcaaggatgattggcatg

SEQ ID NO: 757046 - DNA, 20 bp, mouse
gtagtcaatggcagtagtca

SEQ ID NO: 757047 - DNA, 20 bp, mouse
ggagacctgggggagcctca

SEQ ID NO: 757048 - DNA, 20 bp, mouse
gagtacacaggtgagacctg

SEQ ID NO: 757049 - DNA, 20 bp, mouse
ggaaaccaggctccacctgc

SEQ ID NO: 757050 - DNA, 20 bp, mouse
gtgtgccggcaggtggagcc

SEQ ID NO: 757051 - DNA, 20 bp, mouse
gagccccagtgacttcacgt

SEQ ID NO: 757052 - DNA, 20 bp, mouse
ggaacttatggcttagaaag

SEQ ID NO: 757053 - DNA, 20 bp, mouse
gcaggggtgagtgtgccggc

SEQ ID NO: 757054 - DNA, 20 bp, mouse
gccacccacgtgaagtcact

SEQ ID NO: 757055 - DNA, 20 bp, mouse
gaccccctggatggtacctc

SEQ ID NO: 757056 - DNA, 20 bp, mouse
gaggggtgggagcactctgg

SEQ ID NO: 757057 - DNA, 20 bp, mouse
gtggcttctgagaactggga

SEQ ID NO: 757058 - DNA, 20 bp, mouse
gggtagggagatgactactc

SEQ ID NO: 757059 - DNA, 20 bp, mouse
gtacccaccccataggccca

SEQ ID NO: 757060 - DNA, 20 bp, mouse
gagagtgctcccaccccttg

SEQ ID NO: 757061 - DNA, 20 bp, mouse
gcacctggggtcagcttccc

SEQ ID NO: 757062 - DNA, 20 bp, mouse
gggagggagtggacagggta

SEQ ID NO: 757063 - DNA, 20 bp, mouse
gggtccccaaagtatcaaca

SEQ ID NO: 757064 - DNA, 20 bp, mouse
gaagccctgggcctatgggg

SEQ ID NO: 757065 - DNA, 20 bp, mouse
gggcctatggggtgggtatt

SEQ ID NO: 757066 - DNA, 20 bp, mouse
gtcagtcccccactgggagt

SEQ ID NO: 757067 - DNA, 20 bp, mouse
gacgttggaaaattctgcaa

SEQ ID NO: 757068 - DNA, 20 bp, mouse
gctagagtatggggcacaag

SEQ ID NO: 757069 - DNA, 20 bp, mouse
gggcaggcggtggtgatcac

SEQ ID NO: 757070 - DNA, 20 bp, mouse
gctgggagtgggaagataat

SEQ ID NO: 757071 - DNA, 20 bp, mouse
gtatggggcacaagtgggtg

SEQ ID NO: 757072 - DNA, 20 bp, mouse
gcgtgtgtcagtcccccact

SEQ ID NO: 757073 - DNA, 20 bp, mouse
ggcacaagtgggtgcggcaa

SEQ ID NO: 757074 - DNA, 20 bp, mouse
gtggcagttaggacagactg

SEQ ID NO: 757075 - DNA, 20 bp, mouse
gagatgcaggaggtatttgt

SEQ ID NO: 757076 - DNA, 20 bp, mouse
gttctcttgtgtgaagaacg

SEQ ID NO: 757077 - DNA, 20 bp, mouse
ggacagagtgtgcagacatt

SEQ ID NO: 757078 - DNA, 20 bp, mouse
gaacctggtatttgtgtaac

SEQ ID NO: 757079 - DNA, 20 bp, mouse
gtctgggacaacagcttgac

SEQ ID NO: 757080 - DNA, 20 bp, mouse
gagagtgtgcagacattggg

SEQ ID NO: 757081 - DNA, 20 bp, mouse
gcattgtatattcctatcac

SEQ ID NO: 757082 - DNA, 20 bp, mouse
gatttacattatcataatca

SEQ ID NO: 757083 - DNA, 20 bp, mouse
gtccaagaagctgaagatgt

SEQ ID NO: 757084 - DNA, 20 bp, mouse
gaaagatagaagttatttct

SEQ ID NO: 757085 - DNA, 20 bp, mouse
gtggtctttccatcagtgtt

SEQ ID NO: 757086 - DNA, 20 bp, mouse
gactgtggtgccactagctc

SEQ ID NO: 757087 - DNA, 20 bp, mouse
gaaactgcccacgaggaaaa

SEQ ID NO: 757088 - DNA, 20 bp, mouse
ggtggtgccactagctctgg

SEQ ID NO: 757089 - DNA, 20 bp, mouse
ggtgagtaaaagcagttagg

SEQ ID NO: 757090 - DNA, 20 bp, mouse
gctgactccaccagagctag

SEQ ID NO: 757091 - DNA, 20 bp, mouse
gagcttggaaactgcccacg

SEQ ID NO: 757092 - DNA, 20 bp, mouse
gctggctttcgtcagactcc

SEQ ID NO: 757093 - DNA, 20 bp, mouse
gcttgtcaagctgacccaac

SEQ ID NO: 757094 - DNA, 20 bp, mouse
gactagtaaatctttgcagt

SEQ ID NO: 757095 - DNA, 20 bp, mouse
gcacgaggaaaagggttcca

SEQ ID NO: 757096 - DNA, 20 bp, mouse
gtgtggatggcattggtaaa

SEQ ID NO: 757097 - DNA, 20 bp, mouse
gggcattggtaaagggtcaa

SEQ ID NO: 757098 - DNA, 20 bp, mouse
gaaaaggggactgtggatac

SEQ ID NO: 757099 - DNA, 20 bp, mouse
gtattctagtagcactatct

SEQ ID NO: 757100 - DNA, 20 bp, mouse
gaccagtaaatctttgcagc

SEQ ID NO: 757101 - DNA, 20 bp, mouse
gaaaggtgccagaggagctg

SEQ ID NO: 757102 - DNA, 20 bp, mouse
ggtgccagaggagctgtgga

SEQ ID NO: 757103 - DNA, 20 bp, mouse
ggaggagctgtggatggcat

SEQ ID NO: 757104 - DNA, 20 bp, mouse
gattacaacagtctcaggaa

SEQ ID NO: 757105 - DNA, 20 bp, mouse
ggggtcttgtgtataaaaag

SEQ ID NO: 757106 - DNA, 20 bp, mouse
ggggctggctgtggtcacgt

SEQ ID NO: 757107 - DNA, 20 bp, mouse
gagaacgtctagaaacccgg

SEQ ID NO: 757108 - DNA, 20 bp, mouse
gaaaaccggaagtggaggac

SEQ ID NO: 757109 - DNA, 20 bp, mouse
gcggcctcctgggaaaccgg

SEQ ID NO: 757110 - DNA, 20 bp, mouse
gcacgtgggagctctccctc

SEQ ID NO: 757111 - DNA, 20 bp, mouse
ggggcgacgggttccgggaa

SEQ ID NO: 757112 - DNA, 20 bp, mouse
ggaaacagaccagtgagtaa

SEQ ID NO: 757113 - DNA, 20 bp, mouse
gcctgggaaaccggtggggc

SEQ ID NO: 757114 - DNA, 20 bp, mouse
gtgccttggtgcacctatag

SEQ ID NO: 757115 - DNA, 20 bp, mouse
gcggaagtggaggacggggg

SEQ ID NO: 757116 - DNA, 20 bp, mouse
gggtggagggcgtgaccgat

SEQ ID NO: 757117 - DNA, 20 bp, mouse
gcaggtacgcagttcccatt

SEQ ID NO: 757118 - DNA, 20 bp, mouse
ggggccacgcctcagcccat

SEQ ID NO: 757119 - DNA, 20 bp, mouse
ggggcgtgaccgatgggctg

SEQ ID NO: 757120 - DNA, 20 bp, mouse
ggtggcgcgctcttgggggg

SEQ ID NO: 757121 - DNA, 20 bp, mouse
gaggaggtggcgcgctcttg

SEQ ID NO: 757122 - DNA, 20 bp, mouse
gccgccgcgcagatccccgc

SEQ ID NO: 757123 - DNA, 20 bp, mouse
gaggcgtggcccgcaggagg

SEQ ID NO: 757124 - DNA, 20 bp, mouse
gggcccgaggcagggtagac

SEQ ID NO: 757125 - DNA, 20 bp, mouse
gggcggggcctgcctcacag

SEQ ID NO: 757126 - DNA, 20 bp, mouse
gggaacgcacgaggtgggcg

SEQ ID NO: 757127 - DNA, 20 bp, mouse
gagggctcctgatgctcagg

SEQ ID NO: 757128 - DNA, 20 bp, mouse
gaggggcggagcatccgggg

SEQ ID NO: 757129 - DNA, 20 bp, mouse
gaggagggctcctgatgctc

SEQ ID NO: 757130 - DNA, 20 bp, mouse
gaaaaggggcggagcatccg

SEQ ID NO: 757131 - DNA, 20 bp, mouse
gaggcgggaacgcacgaggt

SEQ ID NO: 757132 - DNA, 20 bp, mouse
ggggaaggcgggaacgcacg

SEQ ID NO: 757133 - DNA, 20 bp, mouse
ggctccgcccctttttgggt

SEQ ID NO: 757134 - DNA, 20 bp, mouse
gcggagcatccggggcggag

SEQ ID NO: 757135 - DNA, 20 bp, mouse
ggaaattgaaggtatgtttg

SEQ ID NO: 757136 - DNA, 20 bp, mouse
gcagaaagtcagtttggagg

SEQ ID NO: 757137 - DNA, 20 bp, mouse
gtgcacaggaggaggccaca

SEQ ID NO: 757138 - DNA, 20 bp, mouse
gaagtcagtttggagggggt

SEQ ID NO: 757139 - DNA, 20 bp, mouse
ggctaaaggagacccatatg

SEQ ID NO: 757140 - DNA, 20 bp, mouse
ggattacgaaatcaatcttt

SEQ ID NO: 757141 - DNA, 20 bp, mouse
gcaaagcctgactgagctaa

SEQ ID NO: 757142 - DNA, 20 bp, mouse
gctgaatttagagtcagttg

SEQ ID NO: 757143 - DNA, 20 bp, mouse
gcagttgtgggatgccacat

SEQ ID NO: 757144 - DNA, 20 bp, mouse
gggtctcctttagctcagtc

SEQ ID NO: 757145 - DNA, 20 bp, mouse
ggcctcctcctgtgcacatg

SEQ ID NO: 757146 - DNA, 20 bp, mouse
gttgctttaagacttgactg

SEQ ID NO: 757147 - DNA, 20 bp, mouse
gtttaagacttgactgtgga

SEQ ID NO: 757148 - DNA, 20 bp, mouse
gtttttcatggtatgagcat

SEQ ID NO: 757149 - DNA, 20 bp, mouse
gaagattcatttatttttca

SEQ ID NO: 757150 - DNA, 20 bp, mouse
gaaacattcactgttctcat

SEQ ID NO: 757151 - DNA, 20 bp, mouse
gagaacacgtttcaaagaat

SEQ ID NO: 757152 - DNA, 20 bp, mouse
ggaggtaatgcagacccata

SEQ ID NO: 757153 - DNA, 20 bp, mouse
ggtaatcagaaagtcagttt

SEQ ID NO: 757154 - DNA, 20 bp, mouse
gtttttcacttattgatgat

SEQ ID NO: 757155 - DNA, 20 bp, mouse
gacttattgatgataggcca

SEQ ID NO: 757156 - DNA, 20 bp, mouse
gcaaacatgtagagaatctt

SEQ ID NO: 757157 - DNA, 20 bp, mouse
gagggcccaggttcaaatac

SEQ ID NO: 757158 - DNA, 20 bp, mouse
gtttggttaagacttgagtg

SEQ ID NO: 757159 - DNA, 20 bp, mouse
gaagccagttttggagggtg

SEQ ID NO: 757160 - DNA, 20 bp, mouse
gtaccaagtttgaaaaggtc

SEQ ID NO: 757161 - DNA, 20 bp, mouse
gggtgtgggaactgaactgg

SEQ ID NO: 757162 - DNA, 20 bp, mouse
gtaaaacttgtttttgctga

SEQ ID NO: 757163 - DNA, 20 bp, mouse
gttgtttttgctgagggccc

SEQ ID NO: 757164 - DNA, 20 bp, mouse
gttcccacaccctccaaaac

SEQ ID NO: 757165 - DNA, 20 bp, mouse
ggagggtgtgggaactgaac

SEQ ID NO: 757166 - DNA, 20 bp, mouse
gctagatgcacatctggatt

SEQ ID NO: 757167 - DNA, 20 bp, mouse
gagaaaacactgggtattca

SEQ ID NO: 757168 - DNA, 20 bp, mouse
gattcaagggaacttcaatc

SEQ ID NO: 757169 - DNA, 20 bp, mouse
gtgcacatctggatttggct

SEQ ID NO: 757170 - DNA, 20 bp, mouse
gctggaactagatgcacatc

SEQ ID NO: 757171 - DNA, 20 bp, mouse
ggccagttttggagggggta

SEQ ID NO: 757172 - DNA, 20 bp, mouse
gctttacttttagacgagta

SEQ ID NO: 757173 - DNA, 20 bp, mouse
gactcagattctttgaaact

SEQ ID NO: 757174 - DNA, 20 bp, mouse
gactgcaccaggcctgtgta

SEQ ID NO: 757175 - DNA, 20 bp, mouse
ggtacctgagtaccatacac

SEQ ID NO: 757176 - DNA, 20 bp, mouse
gcggccccggtgctttgcaa

SEQ ID NO: 757177 - DNA, 20 bp, mouse
gcatgcttgccgactgacta

SEQ ID NO: 757178 - DNA, 20 bp, mouse
gttgcagggcagtcacgtat

SEQ ID NO: 757179 - DNA, 20 bp, mouse
ggtcagtcggcaagcatgtt

SEQ ID NO: 757180 - DNA, 20 bp, mouse
ggagcccttgcaaagcaccg

SEQ ID NO: 757181 - DNA, 20 bp, mouse
gcggcaagcatgtttggaac

SEQ ID NO: 757182 - DNA, 20 bp, mouse
gctcagtatgagtaacatag

SEQ ID NO: 757183 - DNA, 20 bp, mouse
gaatacttgaccactctcca

SEQ ID NO: 757184 - DNA, 20 bp, mouse
gacccacacagacttatttg

SEQ ID NO: 757185 - DNA, 20 bp, mouse
gttgcaagggctcatgttgc

SEQ ID NO: 757186 - DNA, 20 bp, mouse
gcggccctcccagtcacagg

SEQ ID NO: 757187 - DNA, 20 bp, mouse
gtgactgggagggccggtgt

SEQ ID NO: 757188 - DNA, 20 bp, mouse
gtgggtggggcctgtccaaa

SEQ ID NO: 757189 - DNA, 20 bp, mouse
gggacagcgccccctgtgac

SEQ ID NO: 757190 - DNA, 20 bp, mouse
gaggctcactatcgtagaag

SEQ ID NO: 757191 - DNA, 20 bp, mouse
ggtgggagggacatcttaaa

SEQ ID NO: 757192 - DNA, 20 bp, mouse
gggtgccggcgggcgaatgg

SEQ ID NO: 757193 - DNA, 20 bp, mouse
gaaagagggcttaagaaaag

SEQ ID NO: 757194 - DNA, 20 bp, mouse
gagctggtgccctgctaggt

SEQ ID NO: 757195 - DNA, 20 bp, mouse
gagtctgctctcgaattttt

SEQ ID NO: 757196 - DNA, 20 bp, mouse
gagctcagggaaagcaatga

SEQ ID NO: 757197 - DNA, 20 bp, mouse
gagctggggagaactcactc

SEQ ID NO: 757198 - DNA, 20 bp, mouse
gaggccagtaatgcaagtgg

SEQ ID NO: 757199 - DNA, 20 bp, mouse
gttaggaacgctggagctca

SEQ ID NO: 757200 - DNA, 20 bp, mouse
gacgtgtaggggttgaaatc

SEQ ID NO: 757201 - DNA, 20 bp, mouse
gctggctgtaatgatggacg

SEQ ID NO: 757202 - DNA, 20 bp, mouse
gatagcctctcctgtcccaa

SEQ ID NO: 757203 - DNA, 20 bp, mouse
ggggggatggacctcgcatt

SEQ ID NO: 757204 - DNA, 20 bp, mouse
ggacctcgcattaggaacgc

SEQ ID NO: 757205 - DNA, 20 bp, mouse
gctcaggccagtaatgcaag

SEQ ID NO: 757206 - DNA, 20 bp, mouse
ggggacagctgcttactcga

SEQ ID NO: 757207 - DNA, 20 bp, mouse
ggagggagggccctgaacaa

SEQ ID NO: 757208 - DNA, 20 bp, mouse
gccacccctgccactgggat

SEQ ID NO: 757209 - DNA, 20 bp, mouse
gaggggaagtctctgaggag

SEQ ID NO: 757210 - DNA, 20 bp, mouse
gcagctgtccccagagatgc

SEQ ID NO: 757211 - DNA, 20 bp, mouse
gcgcggggaccccgcatctc

SEQ ID NO: 757212 - DNA, 20 bp, mouse
gcagctgcttactcgacggt

SEQ ID NO: 757213 - DNA, 20 bp, mouse
gggctgtctcacacattcca

SEQ ID NO: 757214 - DNA, 20 bp, mouse
gtggtgagaggagatggccg

SEQ ID NO: 757215 - DNA, 20 bp, mouse
gggagggccctgaacaaggg

SEQ ID NO: 757216 - DNA, 20 bp, mouse
gggaaccggaagcgtcagtg

SEQ ID NO: 757217 - DNA, 20 bp, mouse
ggacgcgcgcccgcaatgtc

SEQ ID NO: 757218 - DNA, 20 bp, mouse
gagtcgaggaagcgataaag

SEQ ID NO: 757219 - DNA, 20 bp, mouse
ggcgcccgcaatgtccggat

SEQ ID NO: 757220 - DNA, 20 bp, mouse
gaagcaactgtgaagagtcg

SEQ ID NO: 757221 - DNA, 20 bp, mouse
gtgtagagaaggccggcctg

SEQ ID NO: 757222 - DNA, 20 bp, mouse
gagggtcagggggactagag

SEQ ID NO: 757223 - DNA, 20 bp, mouse
gaaagcggctgacagatcca

SEQ ID NO: 757224 - DNA, 20 bp, mouse
gcgttcctcactgacgcttc

SEQ ID NO: 757225 - DNA, 20 bp, mouse
gtgaggctcaaattatcccc

SEQ ID NO: 757226 - DNA, 20 bp, mouse
gtcggcgtctgggtcccgta

SEQ ID NO: 757227 - DNA, 20 bp, mouse
gggaacggaagttgacccta

SEQ ID NO: 757228 - DNA, 20 bp, mouse
ggggagccgctcaccgtcag

SEQ ID NO: 757229 - DNA, 20 bp, mouse
gcccgcccgaccactcggaa

SEQ ID NO: 757230 - DNA, 20 bp, mouse
ggcgacacggatctaggatg

SEQ ID NO: 757231 - DNA, 20 bp, mouse
gacgcccctcgccagccttc

SEQ ID NO: 757232 - DNA, 20 bp, mouse
gctaggatggggcggggtct

SEQ ID NO: 757233 - DNA, 20 bp, mouse
ggcgaggggcgtcatggccg

SEQ ID NO: 757234 - DNA, 20 bp, mouse
gccagaagcgacacggatct

SEQ ID NO: 757235 - DNA, 20 bp, mouse
gcgcaccccgcccgaccact

SEQ ID NO: 757236 - DNA, 20 bp, mouse
gtgcagaaggcaggagtcac

SEQ ID NO: 757237 - DNA, 20 bp, mouse
gactacccagtgtgcggagg

SEQ ID NO: 757238 - DNA, 20 bp, mouse
ggaccagtccaaagtaaccg

SEQ ID NO: 757239 - DNA, 20 bp, mouse
gcacactgggtagtgattta

SEQ ID NO: 757240 - DNA, 20 bp, mouse
ggacgcttaagatacgtttg

SEQ ID NO: 757241 - DNA, 20 bp, mouse
gaacgccccctccgcacact

SEQ ID NO: 757242 - DNA, 20 bp, mouse
gcgggtctccacggttactt

SEQ ID NO: 757243 - DNA, 20 bp, mouse
gaccgtggagacccgccctc

SEQ ID NO: 757244 - DNA, 20 bp, mouse
ggggcgttcactttccggac

SEQ ID NO: 757245 - DNA, 20 bp, mouse
gttctgcaaggaaacttaac

SEQ ID NO: 757246 - DNA, 20 bp, mouse
ggcctagcagagccgagcgg

SEQ ID NO: 757247 - DNA, 20 bp, mouse
gccgagcggaggccgactgg

SEQ ID NO: 757248 - DNA, 20 bp, mouse
ggggaggggcgtgcagcctg

SEQ ID NO: 757249 - DNA, 20 bp, mouse
gggcaccgggggccacaggg

SEQ ID NO: 757250 - DNA, 20 bp, mouse
ggggaaggcgtctctgcaaa

SEQ ID NO: 757251 - DNA, 20 bp, mouse
gggtgcagtcaagcctacaa

SEQ ID NO: 757252 - DNA, 20 bp, mouse
gaggggcgtgcagcctgcgg

SEQ ID NO: 757253 - DNA, 20 bp, mouse
gagagcagaggggatcgccc

SEQ ID NO: 757254 - DNA, 20 bp, mouse
gcaggtggttcagggatcaa

SEQ ID NO: 757255 - DNA, 20 bp, mouse
ggagacctgctctgagagtg

SEQ ID NO: 757256 - DNA, 20 bp, mouse
ggacaggatcgaatgatgtg

SEQ ID NO: 757257 - DNA, 20 bp, mouse
gcccggtgcctgcaagctcg

SEQ ID NO: 757258 - DNA, 20 bp, mouse
gcgagaggcggggtccgctc

SEQ ID NO: 757259 - DNA, 20 bp, mouse
gctgtccataggctaaaaag

SEQ ID NO: 757260 - DNA, 20 bp, mouse
gagcttgcaggcaccggggg

SEQ ID NO: 757261 - DNA, 20 bp, mouse
gcaggaggtggtatctgcgc

SEQ ID NO: 757262 - DNA, 20 bp, mouse
gaaaaagtggatcatgggct

SEQ ID NO: 757263 - DNA, 20 bp, mouse
ggtggtatctgcgcaggcgt

SEQ ID NO: 757264 - DNA, 20 bp, mouse
gggccagcgggccaatcata

SEQ ID NO: 757265 - DNA, 20 bp, mouse
gaggaacctttgtaagaagg

SEQ ID NO: 757266 - DNA, 20 bp, mouse
ggcggggcggagtcatcccc

SEQ ID NO: 757267 - DNA, 20 bp, mouse
gcaatgggaatcaagagctg

SEQ ID NO: 757268 - DNA, 20 bp, mouse
gggaaacagcgattgagagg

SEQ ID NO: 757269 - DNA, 20 bp, mouse
ggggcactcgcaccagggcg

SEQ ID NO: 757270 - DNA, 20 bp, mouse
gggcctggggcactcgcacc

SEQ ID NO: 757271 - DNA, 20 bp, mouse
gggaactctcccatctgata

SEQ ID NO: 757272 - DNA, 20 bp, mouse
ggaaagaggcgaggcaattt

SEQ ID NO: 757273 - DNA, 20 bp, mouse
ggggagagttccaaggaggc

SEQ ID NO: 757274 - DNA, 20 bp, mouse
ggggctcgtcatggcgtcag

SEQ ID NO: 757275 - DNA, 20 bp, mouse
gaatcagagagctggagcta

SEQ ID NO: 757276 - DNA, 20 bp, mouse
gaggatgcagcagtaagggt

SEQ ID NO: 757277 - DNA, 20 bp, mouse
gtgaatcagtgctaactggc

SEQ ID NO: 757278 - DNA, 20 bp, mouse
gtcagaggatgcagcagtaa

SEQ ID NO: 757279 - DNA, 20 bp, mouse
gcagaaactgcccccagctg

SEQ ID NO: 757280 - DNA, 20 bp, mouse
gcaagtgagaatgcgtgctt

SEQ ID NO: 757281 - DNA, 20 bp, mouse
gccaccacgcccaactcatc

SEQ ID NO: 757282 - DNA, 20 bp, mouse
gctgaagtcaccacagctgg

SEQ ID NO: 757283 - DNA, 20 bp, mouse
gaaaagatgcccgatgagtt

SEQ ID NO: 757284 - DNA, 20 bp, mouse
gctgcctgcccagcccatta

SEQ ID NO: 757285 - DNA, 20 bp, mouse
ggggaagtcatcccaagtgt

SEQ ID NO: 757286 - DNA, 20 bp, mouse
ggggccttggcttggtactg

SEQ ID NO: 757287 - DNA, 20 bp, mouse
gtaccaagccaaggcccctc

SEQ ID NO: 757288 - DNA, 20 bp, mouse
gaccctgaggggccttggct

SEQ ID NO: 757289 - DNA, 20 bp, mouse
gagaaacgaaactcaccctg

SEQ ID NO: 757290 - DNA, 20 bp, mouse
gaactcaccctgaggggcct

SEQ ID NO: 757291 - DNA, 20 bp, mouse
gagcaggcagccatctgaac

SEQ ID NO: 757292 - DNA, 20 bp, mouse
gcacagagctggaagggtcc

SEQ ID NO: 757293 - DNA, 20 bp, mouse
gctcctcagtgattctggta

SEQ ID NO: 757294 - DNA, 20 bp, mouse
gagctcctttcatatgtggt

SEQ ID NO: 757295 - DNA, 20 bp, mouse
gcttggcttggtactgaggt

SEQ ID NO: 757296 - DNA, 20 bp, mouse
gacccagccaaggccccctt

SEQ ID NO: 757297 - DNA, 20 bp, mouse
gagcaggcagccctctaaac

SEQ ID NO: 757298 - DNA, 20 bp, mouse
gaaaggaaactcaccctaag

SEQ ID NO: 757299 - DNA, 20 bp, mouse
gagctccattcatgtgtggt

SEQ ID NO: 757300 - DNA, 20 bp, mouse
gaccctaagggggccttggc

SEQ ID NO: 757301 - DNA, 20 bp, mouse
gcttggctgggtcctgaggt

SEQ ID NO: 757302 - DNA, 20 bp, mouse
gactcaccctaagggggcct

SEQ ID NO: 757303 - DNA, 20 bp, mouse
gagtatggacaccagtttag

SEQ ID NO: 757304 - DNA, 20 bp, mouse
gaccataccaggaatcactg

SEQ ID NO: 757305 - DNA, 20 bp, mouse
ggttcaattgagaggaagtc

SEQ ID NO: 757306 - DNA, 20 bp, mouse
gggcacttccccaatcgcgg

SEQ ID NO: 757307 - DNA, 20 bp, mouse
gaagcccggccaaccggcgg

SEQ ID NO: 757308 - DNA, 20 bp, mouse
gggaggcaggctgaagcacg

SEQ ID NO: 757309 - DNA, 20 bp, mouse
gcgggggaagcgggcttctg

SEQ ID NO: 757310 - DNA, 20 bp, mouse
ggtcaagcccggccaaccgg

SEQ ID NO: 757311 - DNA, 20 bp, mouse
gccccggccctccgcgattg

SEQ ID NO: 757312 - DNA, 20 bp, mouse
gcctgcagccaatggggcgt

SEQ ID NO: 757313 - DNA, 20 bp, mouse
ggccgccgcgggcctgtcaa

SEQ ID NO: 757314 - DNA, 20 bp, mouse
ggcgagtcctgcagccaatg

SEQ ID NO: 757315 - DNA, 20 bp, mouse
gtcccttgacaggcccgcgg

SEQ ID NO: 757316 - DNA, 20 bp, mouse
gcagcagcccagttcagcct

SEQ ID NO: 757317 - DNA, 20 bp, mouse
gcccccgcggcgggagaagg

SEQ ID NO: 757318 - DNA, 20 bp, mouse
gttcccgcccaggctgaact

SEQ ID NO: 757319 - DNA, 20 bp, mouse
gtcaaccaacccagtctccg

SEQ ID NO: 757320 - DNA, 20 bp, mouse
ggggcggacggggttcccat

SEQ ID NO: 757321 - DNA, 20 bp, mouse
gcagcctgggcgggaagagg

SEQ ID NO: 757322 - DNA, 20 bp, mouse
ggggctgcctgacccggcgg

SEQ ID NO: 757323 - DNA, 20 bp, mouse
gcttgcagcgcccggtgtcc

SEQ ID NO: 757324 - DNA, 20 bp, mouse
ggggacgcggccacatcctc

SEQ ID NO: 757325 - DNA, 20 bp, mouse
gattgcctgtcgcaggagtg

SEQ ID NO: 757326 - DNA, 20 bp, mouse
ggggactggccgaacgcctc

SEQ ID NO: 757327 - DNA, 20 bp, mouse
gccggagcgcccacacctat

SEQ ID NO: 757328 - DNA, 20 bp, mouse
gtcgacgcagccaataggtg

SEQ ID NO: 757329 - DNA, 20 bp, mouse
ggcgttcggccagtccctat

SEQ ID NO: 757330 - DNA, 20 bp, mouse
gggtgtgggcgctccggctt

SEQ ID NO: 757331 - DNA, 20 bp, mouse
gtgcgaagcttggctaggat

SEQ ID NO: 757332 - DNA, 20 bp, mouse
gacagggcgtggggccaatg

SEQ ID NO: 757333 - DNA, 20 bp, mouse
gcgccagtcagcgagcactg

SEQ ID NO: 757334 - DNA, 20 bp, mouse
gtgtctagccttgcccaata

SEQ ID NO: 757335 - DNA, 20 bp, mouse
gaggacgtggaccgtgtctc

SEQ ID NO: 757336 - DNA, 20 bp, mouse
ggaccggtcaaaataaatgg

SEQ ID NO: 757337 - DNA, 20 bp, mouse
ggcagctaggatttgcggag

SEQ ID NO: 757338 - DNA, 20 bp, mouse
gtctacgcagctaggatttg

SEQ ID NO: 757339 - DNA, 20 bp, mouse
gtaaatggtggcggctaggg

SEQ ID NO: 757340 - DNA, 20 bp, mouse
gggaagggtgctggataggc

SEQ ID NO: 757341 - DNA, 20 bp, mouse
gcggtcaaaataaatggtgg

SEQ ID NO: 757342 - DNA, 20 bp, mouse
ggagcccgatgccatctgac

SEQ ID NO: 757343 - DNA, 20 bp, mouse
gaaaaccctcggatgtctct

SEQ ID NO: 757344 - DNA, 20 bp, mouse
gtccacctagagacatccga

SEQ ID NO: 757345 - DNA, 20 bp, mouse
gaggacggacggaggcgctg

SEQ ID NO: 757346 - DNA, 20 bp, mouse
gatgcgcaggcgtactgagg

SEQ ID NO: 757347 - DNA, 20 bp, mouse
gggcacccgacgtgcactgg

SEQ ID NO: 757348 - DNA, 20 bp, mouse
gccccccgccagtgcacgtc

SEQ ID NO: 757349 - DNA, 20 bp, mouse
gagtgcacgtcgggtgccga

SEQ ID NO: 757350 - DNA, 20 bp, mouse
ggtcgggtgccgagggacat

SEQ ID NO: 757351 - DNA, 20 bp, mouse
gtcccagggggcagcggaag

SEQ ID NO: 757352 - DNA, 20 bp, mouse
gacccgacgtgcactggcgg

SEQ ID NO: 757353 - DNA, 20 bp, mouse
gtggactccgcgatggcctc

SEQ ID NO: 757354 - DNA, 20 bp, mouse
ggggagatgtagtctttcct

SEQ ID NO: 757355 - DNA, 20 bp, mouse
gcgcatggtggactccgcga

SEQ ID NO: 757356 - DNA, 20 bp, mouse
ggcgctgaaaagctcgctct

SEQ ID NO: 757357 - DNA, 20 bp, mouse
gtccagggcgcgaggggcgt

SEQ ID NO: 757358 - DNA, 20 bp, mouse
gaggcagtctagacagcctg

SEQ ID NO: 757359 - DNA, 20 bp, mouse
gcggttaagagcgcttccat

SEQ ID NO: 757360 - DNA, 20 bp, mouse
gcgaactccgaatcactcca

SEQ ID NO: 757361 - DNA, 20 bp, mouse
gaatcactccagggcgcgag

SEQ ID NO: 757362 - DNA, 20 bp, mouse
ggcgggttccctcggggtcc

SEQ ID NO: 757363 - DNA, 20 bp, mouse
gactgaagcctgagctgaga

SEQ ID NO: 757364 - DNA, 20 bp, mouse
gggcgcggcgggttccctcg

SEQ ID NO: 757365 - DNA, 20 bp, mouse
gtccagaggcagagacggat

SEQ ID NO: 757366 - DNA, 20 bp, mouse
gtccgggcccagttggtggg

SEQ ID NO: 757367 - DNA, 20 bp, mouse
gtggcctcccccatcttgac

SEQ ID NO: 757368 - DNA, 20 bp, mouse
gtagaggctcggccagtcac

SEQ ID NO: 757369 - DNA, 20 bp, mouse
gagtcctgggacagaagacg

SEQ ID NO: 757370 - DNA, 20 bp, mouse
gctgtccgggcccagttggt

SEQ ID NO: 757371 - DNA, 20 bp, mouse
ggggagcagcccaggttctc

SEQ ID NO: 757372 - DNA, 20 bp, mouse
gccagtcactggtcagtctt

SEQ ID NO: 757373 - DNA, 20 bp, mouse
gtcactggtcagtcttgggg

SEQ ID NO: 757374 - DNA, 20 bp, mouse
gtataggccagtcaagatgg

SEQ ID NO: 757375 - DNA, 20 bp, mouse
gtcagaccctcccaccaact

SEQ ID NO: 757376 - DNA, 20 bp, mouse
gctgcaccccctcactggta

SEQ ID NO: 757377 - DNA, 20 bp, mouse
gcaccccctcactggtaggg

SEQ ID NO: 757378 - DNA, 20 bp, mouse
gtcccgccctaccagtgagg

SEQ ID NO: 757379 - DNA, 20 bp, mouse
gtatccctggtaggccccga

SEQ ID NO: 757380 - DNA, 20 bp, mouse
ggtagccgtggagacaaaac

SEQ ID NO: 757381 - DNA, 20 bp, mouse
gctggtaggccccgaaggcg

SEQ ID NO: 757382 - DNA, 20 bp, mouse
gcgcgcgagggaggggttgt

SEQ ID NO: 757383 - DNA, 20 bp, mouse
gcagctctgcaccccctcac

SEQ ID NO: 757384 - DNA, 20 bp, mouse
ggaggggtggggtctcctgg

SEQ ID NO: 757385 - DNA, 20 bp, mouse
ggccacaccacgcccccaga

SEQ ID NO: 757386 - DNA, 20 bp, mouse
gacagatgcaggtgcgtcag

SEQ ID NO: 757387 - DNA, 20 bp, mouse
gtgggcgagaacagagagta

SEQ ID NO: 757388 - DNA, 20 bp, mouse
ggaggcgttgagcaacctct

SEQ ID NO: 757389 - DNA, 20 bp, mouse
gcctctagggatcaccgctg

SEQ ID NO: 757390 - DNA, 20 bp, mouse
gagtaggggctcgccctcta

SEQ ID NO: 757391 - DNA, 20 bp, mouse
gcaagctagttcccattcta

SEQ ID NO: 757392 - DNA, 20 bp, mouse
gctaacttgtagtcccgaaa

SEQ ID NO: 757393 - DNA, 20 bp, mouse
gcccgaaaggggctttttgt

SEQ ID NO: 757394 - DNA, 20 bp, mouse
gatgcaggtgcgtcagaggc

SEQ ID NO: 757395 - DNA, 20 bp, mouse
gcttgcaggttgctattccg

SEQ ID NO: 757396 - DNA, 20 bp, mouse
gcgcgagaggcgaatgggag

SEQ ID NO: 757397 - DNA, 20 bp, mouse
gagggcgcgtgcgcactgca

SEQ ID NO: 757398 - DNA, 20 bp, mouse
gaccgcggaggcggcgggca

SEQ ID NO: 757399 - DNA, 20 bp, mouse
ggcaggggcgccagatttgg

SEQ ID NO: 757400 - DNA, 20 bp, mouse
gagcagctccgcggcgcgag

SEQ ID NO: 757401 - DNA, 20 bp, mouse
gcgcggcgcgagaggcgaat

SEQ ID NO: 757402 - DNA, 20 bp, mouse
gaatgggagcggcggccagg

SEQ ID NO: 757403 - DNA, 20 bp, mouse
ggggcgccagatttggcggg

SEQ ID NO: 757404 - DNA, 20 bp, mouse
gagccccggagcctacggag

SEQ ID NO: 757405 - DNA, 20 bp, mouse
gcagatgccatcaaacaaag

SEQ ID NO: 757406 - DNA, 20 bp, mouse
ggggcctagcaggttggaag

SEQ ID NO: 757407 - DNA, 20 bp, mouse
gcgcgagcagacccgggtct

SEQ ID NO: 757408 - DNA, 20 bp, mouse
gcactgggacgtccgagtga

SEQ ID NO: 757409 - DNA, 20 bp, mouse
gaggagttcctgacgaccgg

SEQ ID NO: 757410 - DNA, 20 bp, mouse
gagggaaaggcaaggccgta

SEQ ID NO: 757411 - DNA, 20 bp, mouse
gagtgagggcggggcctagc

SEQ ID NO: 757412 - DNA, 20 bp, mouse
gacccacagccacaagggaa

SEQ ID NO: 757413 - DNA, 20 bp, mouse
ggggacgtccgagtgagggc

SEQ ID NO: 757414 - DNA, 20 bp, mouse
gaataaaagcggaataatag

SEQ ID NO: 757415 - DNA, 20 bp, mouse
gactagatcgcgagcagacc

SEQ ID NO: 757416 - DNA, 20 bp, mouse
ggccggcggggctagaagcc

SEQ ID NO: 757417 - DNA, 20 bp, mouse
gcggggctagaagccaggat

SEQ ID NO: 757418 - DNA, 20 bp, mouse
gacgcggccccgaacctcat

SEQ ID NO: 757419 - DNA, 20 bp, mouse
gctcccgcgagttccaatcc

SEQ ID NO: 757420 - DNA, 20 bp, mouse
gcagccgccgccacctccgg

SEQ ID NO: 757421 - DNA, 20 bp, mouse
gcgccccagccaatgaggtt

SEQ ID NO: 757422 - DNA, 20 bp, mouse
ggtgacaggacacggaacgc

SEQ ID NO: 757423 - DNA, 20 bp, mouse
gccccgaacctcattggctg

SEQ ID NO: 757424 - DNA, 20 bp, mouse
gagccaggattggaactcgc

SEQ ID NO: 757425 - DNA, 20 bp, mouse
ggcggccgccccagccaatg

SEQ ID NO: 757426 - DNA, 20 bp, mouse
gtaggaggggcctactgtag

SEQ ID NO: 757427 - DNA, 20 bp, mouse
ggaggggcctactgtagggg

SEQ ID NO: 757428 - DNA, 20 bp, mouse
gcgcgcgccagaaccctagg

SEQ ID NO: 757429 - DNA, 20 bp, mouse
gcaggggcggagcatacgga

SEQ ID NO: 757430 - DNA, 20 bp, mouse
gtaggggcggagcccaagca

SEQ ID NO: 757431 - DNA, 20 bp, mouse
ggcgaagcgtacaagacacg

SEQ ID NO: 757432 - DNA, 20 bp, mouse
ggcccaagcatggggaagag

SEQ ID NO: 757433 - DNA, 20 bp, mouse
gaggggagtggtttaccgga

SEQ ID NO: 757434 - DNA, 20 bp, mouse
gtgggctccgcccctacagt

SEQ ID NO: 757435 - DNA, 20 bp, mouse
ggaagaggggagtggtttac

SEQ ID NO: 757436 - DNA, 20 bp, mouse
gctctcctgtccgtctcgtg

SEQ ID NO: 757437 - DNA, 20 bp, mouse
gtctgccacacgagacggac

SEQ ID NO: 757438 - DNA, 20 bp, mouse
gcttccagcaggcgggagag

SEQ ID NO: 757439 - DNA, 20 bp, mouse
gtcgcatctgccacacgaga

SEQ ID NO: 757440 - DNA, 20 bp, mouse
gcagacaacagatgtgagaa

SEQ ID NO: 757441 - DNA, 20 bp, mouse
ggaggcgccaacatgattga

SEQ ID NO: 757442 - DNA, 20 bp, mouse
ggcacacgcttctgtggaac

SEQ ID NO: 757443 - DNA, 20 bp, mouse
ggagaacaggaaagagcacg

SEQ ID NO: 757444 - DNA, 20 bp, mouse
gcgccaacatgattgatggt

SEQ ID NO: 757445 - DNA, 20 bp, mouse
ggagagtccttccagcaggc

SEQ ID NO: 757446 - DNA, 20 bp, mouse
gccaaggccctagtggggat

SEQ ID NO: 757447 - DNA, 20 bp, mouse
ggggatgccaaggccctagt

SEQ ID NO: 757448 - DNA, 20 bp, mouse
gcacaggggtccagattctt

SEQ ID NO: 757449 - DNA, 20 bp, mouse
gactgcgtgaccgcagaaag

SEQ ID NO: 757450 - DNA, 20 bp, mouse
gaggtcctggatgaagtggg

SEQ ID NO: 757451 - DNA, 20 bp, mouse
gaccgcagaaagaggggaac

SEQ ID NO: 757452 - DNA, 20 bp, mouse
gagtctcgagactccataaa

SEQ ID NO: 757453 - DNA, 20 bp, mouse
ggactcccaggaggcagcgc

SEQ ID NO: 757454 - DNA, 20 bp, mouse
gtgtgtgggggcaaagaacg

SEQ ID NO: 757455 - DNA, 20 bp, mouse
gtcctcttgcatgctctaaa

SEQ ID NO: 757456 - DNA, 20 bp, mouse
ggggctacccctgagatcca

SEQ ID NO: 757457 - DNA, 20 bp, mouse
ggtgggagagagggtatcca

SEQ ID NO: 757458 - DNA, 20 bp, mouse
gagcaggaggctgataagca

SEQ ID NO: 757459 - DNA, 20 bp, mouse
gcctgagatccatggaggag

SEQ ID NO: 757460 - DNA, 20 bp, mouse
ggaagctatccagtcctgct

SEQ ID NO: 757461 - DNA, 20 bp, mouse
gagatccatggaggagtgga

SEQ ID NO: 757462 - DNA, 20 bp, mouse
gggaccacggaatcctgagt

SEQ ID NO: 757463 - DNA, 20 bp, mouse
gacccacagctaaagatcga

SEQ ID NO: 757464 - DNA, 20 bp, mouse
gatccagtcctgctgggggt

SEQ ID NO: 757465 - DNA, 20 bp, mouse
gcgacagtgtaattttctgg

SEQ ID NO: 757466 - DNA, 20 bp, mouse
gccagtgcccagatcaggga

SEQ ID NO: 757467 - DNA, 20 bp, mouse
gtctgggggaggaaccacaa

SEQ ID NO: 757468 - DNA, 20 bp, mouse
gcccaggccaggaatagctc

SEQ ID NO: 757469 - DNA, 20 bp, mouse
ggcttctcaaggggcccttg

SEQ ID NO: 757470 - DNA, 20 bp, mouse
gaaggtagtatgcttctcaa

SEQ ID NO: 757471 - DNA, 20 bp, mouse
gctggctgtgaggtctagct

SEQ ID NO: 757472 - DNA, 20 bp, mouse
gcaaaccattcccagctgtg

SEQ ID NO: 757473 - DNA, 20 bp, mouse
gtggaaaggaagatcaagtc

SEQ ID NO: 757474 - DNA, 20 bp, mouse
gatgagctggcacatcgctg

SEQ ID NO: 757475 - DNA, 20 bp, mouse
gccaggaatagctctggggg

SEQ ID NO: 757476 - DNA, 20 bp, mouse
gacaccctacagcattagga

SEQ ID NO: 757477 - DNA, 20 bp, mouse
gcagaatagccgcgggagga

SEQ ID NO: 757478 - DNA, 20 bp, mouse
gccactgaagggagaagtag

SEQ ID NO: 757479 - DNA, 20 bp, mouse
ggaagggagaagtaggggcc

SEQ ID NO: 757480 - DNA, 20 bp, mouse
ggagctgcccagaatagccg

SEQ ID NO: 757481 - DNA, 20 bp, mouse
gtgtgagcagagtatatgag

SEQ ID NO: 757482 - DNA, 20 bp, mouse
gtgcccagaatagccgcggg

SEQ ID NO: 757483 - DNA, 20 bp, mouse
gccctccctcctaatgctgt

SEQ ID NO: 757484 - DNA, 20 bp, mouse
ggggctgggacagcaaacag

SEQ ID NO: 757485 - DNA, 20 bp, mouse
gcacctcagccctcctcccg

SEQ ID NO: 757486 - DNA, 20 bp, mouse
gcagacccccggaatataaa

SEQ ID NO: 757487 - DNA, 20 bp, mouse
ggcggccaggcgtctctcta

SEQ ID NO: 757488 - DNA, 20 bp, mouse
gtgcgcggccgaggacccct

SEQ ID NO: 757489 - DNA, 20 bp, mouse
gagtggggagccggggaaag

SEQ ID NO: 757490 - DNA, 20 bp, mouse
gcacccgccctttatattcc

SEQ ID NO: 757491 - DNA, 20 bp, mouse
gtgagagcagcgcagcccag

SEQ ID NO: 757492 - DNA, 20 bp, mouse
gggagctgagtgaggcgagt

SEQ ID NO: 757493 - DNA, 20 bp, mouse
ggagtgaggcgagtcggacc

SEQ ID NO: 757494 - DNA, 20 bp, mouse
gcagcccagtactccggctc

SEQ ID NO: 757495 - DNA, 20 bp, mouse
ggttcccaaagcagagggcg

SEQ ID NO: 757496 - DNA, 20 bp, mouse
ggacctgtggggccctggat

SEQ ID NO: 757497 - DNA, 20 bp, mouse
gtgcgcgcccactaacacgt

SEQ ID NO: 757498 - DNA, 20 bp, mouse
gaaaacaggccacaccccgg

SEQ ID NO: 757499 - DNA, 20 bp, mouse
gtcgccgcggcaaccggaac

SEQ ID NO: 757500 - DNA, 20 bp, mouse
ggttccgcgcatgagcagtg

SEQ ID NO: 757501 - DNA, 20 bp, mouse
gtgcgtgagcccgccctccg

SEQ ID NO: 757502 - DNA, 20 bp, mouse
gagcccgccctccgcggttc

SEQ ID NO: 757503 - DNA, 20 bp, mouse
gtcccggtcgccatgaaaac

SEQ ID NO: 757504 - DNA, 20 bp, mouse
ggactgcccggaaccgcgga

SEQ ID NO: 757505 - DNA, 20 bp, mouse
gtgcccggaaccgcggaggg

SEQ ID NO: 757506 - DNA, 20 bp, mouse
gccgagctgtggatgtccag

SEQ ID NO: 757507 - DNA, 20 bp, mouse
gtccctccgcctccgagctg

SEQ ID NO: 757508 - DNA, 20 bp, mouse
ggacatccacagctcggagg

SEQ ID NO: 757509 - DNA, 20 bp, mouse
gctggggaagctgtcagtgg

SEQ ID NO: 757510 - DNA, 20 bp, mouse
gtggatgtccaggggctgag

SEQ ID NO: 757511 - DNA, 20 bp, mouse
ggctctgaggaggaagttcg

SEQ ID NO: 757512 - DNA, 20 bp, mouse
gcgagggcggcgcagggagg

SEQ ID NO: 757513 - DNA, 20 bp, mouse
ggaagagcctggaccgggct

SEQ ID NO: 757514 - DNA, 20 bp, mouse
gacgaggaagagcctggacc

SEQ ID NO: 757515 - DNA, 20 bp, mouse
gccacccgcggagtgtgagg

SEQ ID NO: 757516 - DNA, 20 bp, mouse
gaacatctggggagtctagg

SEQ ID NO: 757517 - DNA, 20 bp, mouse
gctggccgaagctgagtgac

SEQ ID NO: 757518 - DNA, 20 bp, mouse
gccggtggaggcggagtctg

SEQ ID NO: 757519 - DNA, 20 bp, mouse
ggacccagagcagaaacatc

SEQ ID NO: 757520 - DNA, 20 bp, mouse
gtgactggcctaggaagtga

SEQ ID NO: 757521 - DNA, 20 bp, mouse
gggagcatgtgtccagtcac

SEQ ID NO: 757522 - DNA, 20 bp, mouse
ggaagtgatggctgattagt

SEQ ID NO: 757523 - DNA, 20 bp, mouse
gtggtgtgagatgagcgtgc

SEQ ID NO: 757524 - DNA, 20 bp, mouse
gggagatcctatggcggccg

SEQ ID NO: 757525 - DNA, 20 bp, mouse
ggcagatgacaggccggtgg

SEQ ID NO: 757526 - DNA, 20 bp, mouse
gtctccgctggcgacaggtg

SEQ ID NO: 757527 - DNA, 20 bp, mouse
ggggaggggcttgtctccta

SEQ ID NO: 757528 - DNA, 20 bp, mouse
gacgctcccgggatcgacgc

SEQ ID NO: 757529 - DNA, 20 bp, mouse
gtgcccggggcttggggacc

SEQ ID NO: 757530 - DNA, 20 bp, mouse
gcctgtcgccagcggagaga

SEQ ID NO: 757531 - DNA, 20 bp, mouse
gcggccccacctgtcgccag

SEQ ID NO: 757532 - DNA, 20 bp, mouse
gcgacgagatataaagcagt

SEQ ID NO: 757533 - DNA, 20 bp, mouse
ggcgctcccgcgtcgatccc

SEQ ID NO: 757534 - DNA, 20 bp, mouse
gacgcgggagcgcgatctgc

SEQ ID NO: 757535 - DNA, 20 bp, mouse
gccccagcgtacaatttatt

SEQ ID NO: 757536 - DNA, 20 bp, mouse
ggggctgtggcgcagacgag

SEQ ID NO: 757537 - DNA, 20 bp, mouse
ggtggcgcagacgaggggga

SEQ ID NO: 757538 - DNA, 20 bp, mouse
ggcgcctcccctgattttta

SEQ ID NO: 757539 - DNA, 20 bp, mouse
gcaagccagggggtccaaaa

SEQ ID NO: 757540 - DNA, 20 bp, mouse
ggcagtctgaaaaacgagag

SEQ ID NO: 757541 - DNA, 20 bp, mouse
gaaaatctgacacacccggg

SEQ ID NO: 757542 - DNA, 20 bp, mouse
gtatggaaatcaagagggcg

SEQ ID NO: 757543 - DNA, 20 bp, mouse
ggtgcagcgggtgcaagcca

SEQ ID NO: 757544 - DNA, 20 bp, mouse
gccagggggtccaaaaggga

SEQ ID NO: 757545 - DNA, 20 bp, mouse
gagcaaagctgggaaacccg

SEQ ID NO: 757546 - DNA, 20 bp, mouse
gttgctgtgtacactaatct

SEQ ID NO: 757547 - DNA, 20 bp, mouse
gacctggtgggtggattcaa

SEQ ID NO: 757548 - DNA, 20 bp, mouse
gtggaaagttgctttcgttg

SEQ ID NO: 757549 - DNA, 20 bp, mouse
ggaagtgacaatcaactgtc

SEQ ID NO: 757550 - DNA, 20 bp, mouse
ggggtggattcaaaggaggg

SEQ ID NO: 757551 - DNA, 20 bp, mouse
gggtgggtggattcaaagga

SEQ ID NO: 757552 - DNA, 20 bp, mouse
gtggattcaaaggagggtgg

SEQ ID NO: 757553 - DNA, 20 bp, mouse
gcacaggacatgatgctcct

SEQ ID NO: 757554 - DNA, 20 bp, mouse
gacaatcaactgtctggacc

SEQ ID NO: 757555 - DNA, 20 bp, mouse
gagcattaagaaggtgctta

SEQ ID NO: 757556 - DNA, 20 bp, mouse
ggggcacttagcaacgaggg

SEQ ID NO: 757557 - DNA, 20 bp, mouse
gagagggcacttagcaacga

SEQ ID NO: 757558 - DNA, 20 bp, mouse
gcaaagctgtctggggacaa

SEQ ID NO: 757559 - DNA, 20 bp, mouse
ggaggcagaaagcaagaccc

SEQ ID NO: 757560 - DNA, 20 bp, mouse
ggagggaggaaatgacggga

SEQ ID NO: 757561 - DNA, 20 bp, mouse
ggtaaacacaagtatacgtg

SEQ ID NO: 757562 - DNA, 20 bp, mouse
ggcagaacagcattgcactc

SEQ ID NO: 757563 - DNA, 20 bp, mouse
gaaagagtgaaactgaatat

SEQ ID NO: 757564 - DNA, 20 bp, mouse
gcttatcttggaattccaca

SEQ ID NO: 757565 - DNA, 20 bp, mouse
gttctcttgctcaaccacaa

SEQ ID NO: 757566 - DNA, 20 bp, mouse
gccaaggcagatgccagagg

SEQ ID NO: 757567 - DNA, 20 bp, mouse
gcaccttgatcggtgggcca

SEQ ID NO: 757568 - DNA, 20 bp, mouse
gtgccttggcccaccgatca

SEQ ID NO: 757569 - DNA, 20 bp, mouse
gcacaagtgggttgactttt

SEQ ID NO: 757570 - DNA, 20 bp, mouse
gcggaaagcgaaagaaggag

SEQ ID NO: 757571 - DNA, 20 bp, mouse
gggactaggcgatctggtag

SEQ ID NO: 757572 - DNA, 20 bp, mouse
gtaaattctcacaccttcga

SEQ ID NO: 757573 - DNA, 20 bp, mouse
gttcggaagtagtaacccga

SEQ ID NO: 757574 - DNA, 20 bp, mouse
gtatattctggtagtaggga

SEQ ID NO: 757575 - DNA, 20 bp, mouse
ggcccaccgatcaaggtgga

SEQ ID NO: 757576 - DNA, 20 bp, mouse
gccacctgcggagggagcgc

SEQ ID NO: 757577 - DNA, 20 bp, mouse
ggcctgggggggcagagatg

SEQ ID NO: 757578 - DNA, 20 bp, mouse
gcggcgcggccacctgcgga

SEQ ID NO: 757579 - DNA, 20 bp, mouse
ggctccggcgcggccacctg

SEQ ID NO: 757580 - DNA, 20 bp, mouse
gtcctcggggacggggcctt

SEQ ID NO: 757581 - DNA, 20 bp, mouse
ggacggggcctttggatgag

SEQ ID NO: 757582 - DNA, 20 bp, mouse
gatggcagctccatctctgc

SEQ ID NO: 757583 - DNA, 20 bp, mouse
ggctaccggtgctcgctggc

SEQ ID NO: 757584 - DNA, 20 bp, mouse
ggcagctccatctctgcggg

SEQ ID NO: 757585 - DNA, 20 bp, mouse
gcctttggatgagaggacta

SEQ ID NO: 757586 - DNA, 20 bp, mouse
ggcacagcacgagttgtcag

SEQ ID NO: 757587 - DNA, 20 bp, mouse
ggcggcgcggagcgatgcgt

SEQ ID NO: 757588 - DNA, 20 bp, mouse
ggaagaacgccggaagtaga

SEQ ID NO: 757589 - DNA, 20 bp, mouse
ggcgcctcggtggcactcgc

SEQ ID NO: 757590 - DNA, 20 bp, mouse
gaggccagcgagtgccaccg

SEQ ID NO: 757591 - DNA, 20 bp, mouse
gggatccccgggtgctgttg

SEQ ID NO: 757592 - DNA, 20 bp, mouse
gcacgcctgcaaacctgcgc

SEQ ID NO: 757593 - DNA, 20 bp, mouse
gcggagcgatgcgtgggggt

SEQ ID NO: 757594 - DNA, 20 bp, mouse
gtgtggacctggatgaggtg

SEQ ID NO: 757595 - DNA, 20 bp, mouse
gcaggcctttggggattcag

SEQ ID NO: 757596 - DNA, 20 bp, mouse
gtctctagaagaaagacaag

SEQ ID NO: 757597 - DNA, 20 bp, mouse
gaacctagggatcacttaaa

SEQ ID NO: 757598 - DNA, 20 bp, mouse
gggatcacttaaaggggttg

SEQ ID NO: 757599 - DNA, 20 bp, mouse
gccccccacaggggctgtct

SEQ ID NO: 757600 - DNA, 20 bp, mouse
ggaaggccaccgagcaggtt

SEQ ID NO: 757601 - DNA, 20 bp, mouse
gcttgcccagacagcccctg

SEQ ID NO: 757602 - DNA, 20 bp, mouse
ggtaaaatcattagcgtcaa

SEQ ID NO: 757603 - DNA, 20 bp, mouse
ggctctttatatattcctgg

SEQ ID NO: 757604 - DNA, 20 bp, mouse
gatccagaaggccaccgagc

SEQ ID NO: 757605 - DNA, 20 bp, mouse
gctaataacgcccagctaca

SEQ ID NO: 757606 - DNA, 20 bp, mouse
ggcgctcgctgtaatcactt

SEQ ID NO: 757607 - DNA, 20 bp, mouse
gcggtcacattcactctcag

SEQ ID NO: 757608 - DNA, 20 bp, mouse
gcagttgaactctggaggga

SEQ ID NO: 757609 - DNA, 20 bp, mouse
gtgacaggcagaacagagta

SEQ ID NO: 757610 - DNA, 20 bp, mouse
gtaattaaatgccatctggg

SEQ ID NO: 757611 - DNA, 20 bp, mouse
gtggaagcaccgaatgcttt

SEQ ID NO: 757612 - DNA, 20 bp, mouse
ggtgtcggaactgtccaaaa

SEQ ID NO: 757613 - DNA, 20 bp, mouse
gcgacactaacctgctaacc

SEQ ID NO: 757614 - DNA, 20 bp, mouse
ggaccgtccataagacaaac

SEQ ID NO: 757615 - DNA, 20 bp, mouse
gcccagaggagccacccaga

SEQ ID NO: 757616 - DNA, 20 bp, mouse
gcccttggagggaactatat

SEQ ID NO: 757617 - DNA, 20 bp, mouse
gtgtgcgtcccgattcgggg

SEQ ID NO: 757618 - DNA, 20 bp, mouse
gtctggttggaacctctata

SEQ ID NO: 757619 - DNA, 20 bp, mouse
ggagccaagcatgcggtgct

SEQ ID NO: 757620 - DNA, 20 bp, mouse
gaggttccaaccagaggttt

SEQ ID NO: 757621 - DNA, 20 bp, mouse
gtataaggccgtgtggctag

SEQ ID NO: 757622 - DNA, 20 bp, mouse
gggtttggggacctgtaaaa

SEQ ID NO: 757623 - DNA, 20 bp, mouse
gttacaggtccccaaacctc

SEQ ID NO: 757624 - DNA, 20 bp, mouse
ggaccgctgcgcaaatgggg

SEQ ID NO: 757625 - DNA, 20 bp, mouse
gacagcctagtgagaaccca

SEQ ID NO: 757626 - DNA, 20 bp, mouse
gccttaatatgaggggaatt

SEQ ID NO: 757627 - DNA, 20 bp, mouse
gccgtccttggaataatgta

SEQ ID NO: 757628 - DNA, 20 bp, mouse
gtccaaacatccttaatatg

SEQ ID NO: 757629 - DNA, 20 bp, mouse
ggctgatgagccttcacaga

SEQ ID NO: 757630 - DNA, 20 bp, mouse
gcaagtcactctcattccaa

SEQ ID NO: 757631 - DNA, 20 bp, mouse
gccctcatattaaggatgtt

SEQ ID NO: 757632 - DNA, 20 bp, mouse
gatacttaacccaatgtgag

SEQ ID NO: 757633 - DNA, 20 bp, mouse
gagttgttgcagctacactg

SEQ ID NO: 757634 - DNA, 20 bp, mouse
ggcaaaatgtgtttttggca

SEQ ID NO: 757635 - DNA, 20 bp, mouse
gttccaaggggtacttttat

SEQ ID NO: 757636 - DNA, 20 bp, mouse
gtgggaaggtagcttcgttc

SEQ ID NO: 757637 - DNA, 20 bp, mouse
gaatgagcatcattccaggt

SEQ ID NO: 757638 - DNA, 20 bp, mouse
gactccgggaggtgcggccg

SEQ ID NO: 757639 - DNA, 20 bp, mouse
gggcgcgcaaaccgaccagt

SEQ ID NO: 757640 - DNA, 20 bp, mouse
gcacagactcccaatctcat

SEQ ID NO: 757641 - DNA, 20 bp, mouse
gacctcccggagtctctgac

SEQ ID NO: 757642 - DNA, 20 bp, mouse
gtgtgggtctaggtcgggag

SEQ ID NO: 757643 - DNA, 20 bp, mouse
gggtgcggccggggcagtgg

SEQ ID NO: 757644 - DNA, 20 bp, mouse
ggagatggcccaatgagggt

SEQ ID NO: 757645 - DNA, 20 bp, mouse
ggggccgcagaacgctcgag

SEQ ID NO: 757646 - DNA, 20 bp, mouse
gtaaggacccaggatctggg

SEQ ID NO: 757647 - DNA, 20 bp, mouse
gcgcactgacccacagcctc

SEQ ID NO: 757648 - DNA, 20 bp, mouse
gccggtatacagagtctgta

SEQ ID NO: 757649 - DNA, 20 bp, mouse
gtcggacgtccgagagtggg

SEQ ID NO: 757650 - DNA, 20 bp, mouse
gctacagggagcgaagcctg

SEQ ID NO: 757651 - DNA, 20 bp, mouse
ggtggcaggtgaatgaagag

SEQ ID NO: 757652 - DNA, 20 bp, mouse
gcagctggaatggacctagg

SEQ ID NO: 757653 - DNA, 20 bp, mouse
gcaggatctgggtggctaca

SEQ ID NO: 757654 - DNA, 20 bp, mouse
gctgtcggacgtccgagagt

SEQ ID NO: 757655 - DNA, 20 bp, mouse
ggcctccagtatgtatgaac

SEQ ID NO: 757656 - DNA, 20 bp, mouse
ggagacttagagagttgtag

SEQ ID NO: 757657 - DNA, 20 bp, mouse
gtaggggctgagtggaactg

SEQ ID NO: 757658 - DNA, 20 bp, mouse
ggacttggataaatgaccag

SEQ ID NO: 757659 - DNA, 20 bp, mouse
gtcaacaagagtaagagatc

SEQ ID NO: 757660 - DNA, 20 bp, mouse
gccaagtgagagtgctgggc

SEQ ID NO: 757661 - DNA, 20 bp, mouse
gggggcagagtgtgctaaga

SEQ ID NO: 757662 - DNA, 20 bp, mouse
gaatgccaagtcagctgcat

SEQ ID NO: 757663 - DNA, 20 bp, mouse
gtgcatagggattttgacgt

SEQ ID NO: 757664 - DNA, 20 bp, mouse
ggattgatgatcaatcgcat

SEQ ID NO: 757665 - DNA, 20 bp, mouse
ggagtgtgctaagaaggtca

SEQ ID NO: 757666 - DNA, 20 bp, mouse
gcggctgtgggcaaaggtga

SEQ ID NO: 757667 - DNA, 20 bp, mouse
gaaccctagcatacttagtc

SEQ ID NO: 757668 - DNA, 20 bp, mouse
ggaacctgttgccaagtggg

SEQ ID NO: 757669 - DNA, 20 bp, mouse
gagccggactaagtatgcta

SEQ ID NO: 757670 - DNA, 20 bp, mouse
gagtgggcggctgtgggcaa

SEQ ID NO: 757671 - DNA, 20 bp, mouse
gttggggcatcccacttcca

SEQ ID NO: 757672 - DNA, 20 bp, mouse
gttgccaagtgggcggctgt

SEQ ID NO: 757673 - DNA, 20 bp, mouse
gttcctagcgaagaaagtga

SEQ ID NO: 757674 - DNA, 20 bp, mouse
gcctgccttcctgacgggag

SEQ ID NO: 757675 - DNA, 20 bp, mouse
gacacctgccgggctgggcg

SEQ ID NO: 757676 - DNA, 20 bp, mouse
gtcaaggggacagggtgaat

SEQ ID NO: 757677 - DNA, 20 bp, mouse
gcaggcgtgggaaaagaacc

SEQ ID NO: 757678 - DNA, 20 bp, mouse
gggcaaagcgtgccaggcgt

SEQ ID NO: 757679 - DNA, 20 bp, mouse
gcgctcagacctcgcccctg

SEQ ID NO: 757680 - DNA, 20 bp, mouse
ggctgcccaatcaaaaagag

SEQ ID NO: 757681 - DNA, 20 bp, mouse
gggccgcagcaagtgctgat

SEQ ID NO: 757682 - DNA, 20 bp, mouse
gcgccaggccaatcagaagt

SEQ ID NO: 757683 - DNA, 20 bp, mouse
ggctgctggttcaaggggac

SEQ ID NO: 757684 - DNA, 20 bp, mouse
gtgcggcagtaggcgggacc

SEQ ID NO: 757685 - DNA, 20 bp, mouse
ggaacctggccgagaatgtg

SEQ ID NO: 757686 - DNA, 20 bp, mouse
ggagtcaaaaacattctttc

SEQ ID NO: 757687 - DNA, 20 bp, mouse
ggtcattcattaagcattga

SEQ ID NO: 757688 - DNA, 20 bp, mouse
gaatgaatgacctgccttga

SEQ ID NO: 757689 - DNA, 20 bp, mouse
gataaagataaagaaaagct

SEQ ID NO: 757690 - DNA, 20 bp, mouse
ggacctcttgatatgaatgg

SEQ ID NO: 757691 - DNA, 20 bp, mouse
gctagacctcttgatatgaa

SEQ ID NO: 757692 - DNA, 20 bp, mouse
gtgccgaagtcagaattctg

SEQ ID NO: 757693 - DNA, 20 bp, mouse
gcatctaagtccatcaaggc

SEQ ID NO: 757694 - DNA, 20 bp, mouse
gtattgacatataataatca

SEQ ID NO: 757695 - DNA, 20 bp, mouse
ggaagtcaaattataacctt

SEQ ID NO: 757696 - DNA, 20 bp, mouse
gagacgctcgattgccaaga

SEQ ID NO: 757697 - DNA, 20 bp, mouse
gtcaggctggtggataaaga

SEQ ID NO: 757698 - DNA, 20 bp, mouse
gctgaaaggaagattcaggc

SEQ ID NO: 757699 - DNA, 20 bp, mouse
gtgtctggcaaaaaccctct

SEQ ID NO: 757700 - DNA, 20 bp, mouse
gcggcagccaggtatcctgc

SEQ ID NO: 757701 - DNA, 20 bp, mouse
gaagacggtggccagccagc

SEQ ID NO: 757702 - DNA, 20 bp, mouse
gtaagtcaaaaggaattgtc

SEQ ID NO: 757703 - DNA, 20 bp, mouse
gggctggtggataaagacgg

SEQ ID NO: 757704 - DNA, 20 bp, mouse
gtgccgtcggaacgtctttt

SEQ ID NO: 757705 - DNA, 20 bp, mouse
gtataaaagagtcccgaacg

SEQ ID NO: 757706 - DNA, 20 bp, mouse
ggcgaaaaatacgtgtggag

SEQ ID NO: 757707 - DNA, 20 bp, mouse
gcaacggcgaaaaatacgtg

SEQ ID NO: 757708 - DNA, 20 bp, mouse
ggagcccagggggttagtgg

SEQ ID NO: 757709 - DNA, 20 bp, mouse
gaatgagcccagggggttag

SEQ ID NO: 757710 - DNA, 20 bp, mouse
gtatacttttcccttggcaa

SEQ ID NO: 757711 - DNA, 20 bp, mouse
ggccctgagttcacagagca

SEQ ID NO: 757712 - DNA, 20 bp, mouse
gaggccaccactaaccccct

SEQ ID NO: 757713 - DNA, 20 bp, mouse
gagaggaagaatgagcccag

SEQ ID NO: 757714 - DNA, 20 bp, mouse
gagtggcttcagctgatttc

SEQ ID NO: 757715 - DNA, 20 bp, mouse
gtcagggtgggatggcctgc

SEQ ID NO: 757716 - DNA, 20 bp, mouse
ggcagctaggacagctgagg

SEQ ID NO: 757717 - DNA, 20 bp, mouse
gacacaatattcactgactg

SEQ ID NO: 757718 - DNA, 20 bp, mouse
gtccgcagctaggacagctg

SEQ ID NO: 757719 - DNA, 20 bp, mouse
gtataggcacgagagtgagt

SEQ ID NO: 757720 - DNA, 20 bp, mouse
gaatggagatccagggtttt

SEQ ID NO: 757721 - DNA, 20 bp, mouse
gacaggaacgagcccggtgt

SEQ ID NO: 757722 - DNA, 20 bp, mouse
gaaacagcctccaaaaaccc

SEQ ID NO: 757723 - DNA, 20 bp, mouse
gtttgacaggggatgatcta

SEQ ID NO: 757724 - DNA, 20 bp, mouse
gcccagcttcacttttatag

SEQ ID NO: 757725 - DNA, 20 bp, mouse
gacgagagtgagtagggacc

SEQ ID NO: 757726 - DNA, 20 bp, mouse
gcatggagccagaggggcga

SEQ ID NO: 757727 - DNA, 20 bp, mouse
gagagccaagggatcaaagg

SEQ ID NO: 757728 - DNA, 20 bp, mouse
gagggcaacagacctttcat

SEQ ID NO: 757729 - DNA, 20 bp, mouse
gtcctccccaaagggccgat

SEQ ID NO: 757730 - DNA, 20 bp, mouse
gaggaggagccaggacagga

SEQ ID NO: 757731 - DNA, 20 bp, mouse
gaggcagcaggcatatggga

SEQ ID NO: 757732 - DNA, 20 bp, mouse
ggcccatcggccctttgggg

SEQ ID NO: 757733 - DNA, 20 bp, mouse
gaaaaggccatggagccaga

SEQ ID NO: 757734 - DNA, 20 bp, mouse
gcccaaggtttgcccatgaa

SEQ ID NO: 757735 - DNA, 20 bp, mouse
ggatagccagggttgaaagg

SEQ ID NO: 757736 - DNA, 20 bp, mouse
ggtactgtttggacaaggga

SEQ ID NO: 757737 - DNA, 20 bp, mouse
gaggaggggggagtactgtt

SEQ ID NO: 757738 - DNA, 20 bp, mouse
ggaagtggtcgtcattgttg

SEQ ID NO: 757739 - DNA, 20 bp, mouse
gccctagccagatttagaaa

SEQ ID NO: 757740 - DNA, 20 bp, mouse
gtgggggcaaggcttctaag

SEQ ID NO: 757741 - DNA, 20 bp, mouse
gccctggctggcctgcaaga

SEQ ID NO: 757742 - DNA, 20 bp, mouse
ggctaggaaacaattggaag

SEQ ID NO: 757743 - DNA, 20 bp, mouse
ggggaagggggggagagtcg

SEQ ID NO: 757744 - DNA, 20 bp, mouse
gagggccaggctagcactgg

SEQ ID NO: 757745 - DNA, 20 bp, mouse
gggtcgtcattgttgtggca

SEQ ID NO: 757746 - DNA, 20 bp, mouse
ggcccatgggctaagagtgt

SEQ ID NO: 757747 - DNA, 20 bp, mouse
gggcatcatgtccatccttg

SEQ ID NO: 757748 - DNA, 20 bp, mouse
gcatgggctaagagtgtagg

SEQ ID NO: 757749 - DNA, 20 bp, mouse
gctgtggactacaatatcct

SEQ ID NO: 757750 - DNA, 20 bp, mouse
gtggtctcttcataacctaa

SEQ ID NO: 757751 - DNA, 20 bp, mouse
gcaggaagcccacttctctt

SEQ ID NO: 757752 - DNA, 20 bp, mouse
gacttggtcgagatattctt

SEQ ID NO: 757753 - DNA, 20 bp, mouse
gatgcactcctcctcaagga

SEQ ID NO: 757754 - DNA, 20 bp, mouse
ggcttccccttgacatttcg

SEQ ID NO: 757755 - DNA, 20 bp, mouse
gagcagcacagggatctggg

SEQ ID NO: 757756 - DNA, 20 bp, mouse
gtgtcaggggatcacaaagg

SEQ ID NO: 757757 - DNA, 20 bp, mouse
gacaaggcagtgaggcactc

SEQ ID NO: 757758 - DNA, 20 bp, mouse
gcattgtcaggggatcacaa

SEQ ID NO: 757759 - DNA, 20 bp, mouse
gggaggtaaaaatagcccag

SEQ ID NO: 757760 - DNA, 20 bp, mouse
gggatcacaaaggcggagag

SEQ ID NO: 757761 - DNA, 20 bp, mouse
ggagaggcagtcactcagtc

SEQ ID NO: 757762 - DNA, 20 bp, mouse
ggcagtgaggcactcaggag

SEQ ID NO: 757763 - DNA, 20 bp, mouse
gattcagagtgacagggaca

SEQ ID NO: 757764 - DNA, 20 bp, mouse
gtgagctagaggagataaaa

SEQ ID NO: 757765 - DNA, 20 bp, mouse
gaggctgaggggtagtgtcc

SEQ ID NO: 757766 - DNA, 20 bp, mouse
gagccctggcgacggcccaa

SEQ ID NO: 757767 - DNA, 20 bp, mouse
gtgggctcttggcggagata

SEQ ID NO: 757768 - DNA, 20 bp, mouse
gccagaggtaagtgatggat

SEQ ID NO: 757769 - DNA, 20 bp, mouse
gtcgctacaaacttcgccga

SEQ ID NO: 757770 - DNA, 20 bp, mouse
gggcggagatagggtgtgag

SEQ ID NO: 757771 - DNA, 20 bp, mouse
ggcccaagggaatgcagtgt

SEQ ID NO: 757772 - DNA, 20 bp, mouse
gagggtgggcactggtccaa

SEQ ID NO: 757773 - DNA, 20 bp, mouse
gtggctctgctgccctagtc

SEQ ID NO: 757774 - DNA, 20 bp, mouse
gacttggcaacaggaaccct

SEQ ID NO: 757775 - DNA, 20 bp, mouse
gttcccttgggccgtcgcca

SEQ ID NO: 757776 - DNA, 20 bp, mouse
gctcgccgccggctcgtggg

SEQ ID NO: 757777 - DNA, 20 bp, mouse
gggacccgcccaacaaggcg

SEQ ID NO: 757778 - DNA, 20 bp, mouse
gccccgcccttccaagagga

SEQ ID NO: 757779 - DNA, 20 bp, mouse
ggggagagggcggggactct

SEQ ID NO: 757780 - DNA, 20 bp, mouse
gagcgtactggggaggtctg

SEQ ID NO: 757781 - DNA, 20 bp, mouse
gcagctcgccgccggctcgt

SEQ ID NO: 757782 - DNA, 20 bp, mouse
gtccacccgcgcttcctagg

SEQ ID NO: 757783 - DNA, 20 bp, mouse
gctgttggattgggcagtgt

SEQ ID NO: 757784 - DNA, 20 bp, mouse
ggggctcctggtcccggctc

SEQ ID NO: 757785 - DNA, 20 bp, mouse
gattgggcagtgtggggaga

SEQ ID NO: 757786 - DNA, 20 bp, mouse
ggaggcggtcaaaaaacttg

SEQ ID NO: 757787 - DNA, 20 bp, mouse
ggaagaagctgggtgaaagt

SEQ ID NO: 757788 - DNA, 20 bp, mouse
ggacagacgtacctttttct

SEQ ID NO: 757789 - DNA, 20 bp, mouse
gagccggaatgccacccccc

SEQ ID NO: 757790 - DNA, 20 bp, mouse
gttccggctcagactataaa

SEQ ID NO: 757791 - DNA, 20 bp, mouse
ggaaccttgacacacgcggc

SEQ ID NO: 757792 - DNA, 20 bp, mouse
ggaatccggtaaagcttctt

SEQ ID NO: 757793 - DNA, 20 bp, mouse
gcgtgtgtcaaggttctatt

SEQ ID NO: 757794 - DNA, 20 bp, mouse
gctgggtgaaagttgggtga

SEQ ID NO: 757795 - DNA, 20 bp, mouse
gaaatggaatctaaagggtc

SEQ ID NO: 757796 - DNA, 20 bp, mouse
gtggtggccctggtgaccct

SEQ ID NO: 757797 - DNA, 20 bp, mouse
gctaactaatatagactccc

SEQ ID NO: 757798 - DNA, 20 bp, mouse
gctacagtctgtgagggttg

SEQ ID NO: 757799 - DNA, 20 bp, mouse
gaggaaggagtccctaattc

SEQ ID NO: 757800 - DNA, 20 bp, mouse
gccctgaacaccgtggtcca

SEQ ID NO: 757801 - DNA, 20 bp, mouse
ggtgccttctactctcttgc

SEQ ID NO: 757802 - DNA, 20 bp, mouse
gcagccggctgctatttgta

SEQ ID NO: 757803 - DNA, 20 bp, mouse
gcacggtgttcagggacccg

SEQ ID NO: 757804 - DNA, 20 bp, mouse
gggagtttaaagaggttggt

SEQ ID NO: 757805 - DNA, 20 bp, mouse
gactctcttgcgggctcttc

SEQ ID NO: 757806 - DNA, 20 bp, mouse
gggccactcagagacaggtg

SEQ ID NO: 757807 - DNA, 20 bp, mouse
gtcaaaataaatttggtctg

SEQ ID NO: 757808 - DNA, 20 bp, mouse
gggcgtggttcgggaggcgt

SEQ ID NO: 757809 - DNA, 20 bp, mouse
ggaggattctaggcggggga

SEQ ID NO: 757810 - DNA, 20 bp, mouse
gtggagatgtcttcaagatt

SEQ ID NO: 757811 - DNA, 20 bp, mouse
ggaagcgatcaaaataaatt

SEQ ID NO: 757812 - DNA, 20 bp, mouse
gtccgattgtgttacttttg

SEQ ID NO: 757813 - DNA, 20 bp, mouse
ggcaaggagtctatgtgtcg

SEQ ID NO: 757814 - DNA, 20 bp, mouse
ggagtgaagaaaaagatctc

SEQ ID NO: 757815 - DNA, 20 bp, mouse
gaaaaagatctctggacttg

SEQ ID NO: 757816 - DNA, 20 bp, mouse
gagagcggatggcaggcgtg

SEQ ID NO: 757817 - DNA, 20 bp, mouse
ggggaaggtgacagagcgga

SEQ ID NO: 757818 - DNA, 20 bp, mouse
gagaccgagagaccctccac

SEQ ID NO: 757819 - DNA, 20 bp, mouse
gcatctgctgacagggggga

SEQ ID NO: 757820 - DNA, 20 bp, mouse
ggagtccgggacgcggagta

SEQ ID NO: 757821 - DNA, 20 bp, mouse
gcgccagcccggacgggagg

SEQ ID NO: 757822 - DNA, 20 bp, mouse
gtcggtgcgccagcccggac

SEQ ID NO: 757823 - DNA, 20 bp, mouse
gtcgccgcgctctggaatgc

SEQ ID NO: 757824 - DNA, 20 bp, mouse
gggcaggcgtggggcgccga

SEQ ID NO: 757825 - DNA, 20 bp, mouse
gggtctctcggtctaatcac

SEQ ID NO: 757826 - DNA, 20 bp, mouse
gtgctctaaaaataaggctg

SEQ ID NO: 757827 - DNA, 20 bp, mouse
gtaggggtcacttcgggtgc

SEQ ID NO: 757828 - DNA, 20 bp, mouse
gaacattctaggggtcactt

SEQ ID NO: 757829 - DNA, 20 bp, mouse
gtgcctggagaatataactg

SEQ ID NO: 757830 - DNA, 20 bp, mouse
gacttcgggtgctggaatct

SEQ ID NO: 757831 - DNA, 20 bp, mouse
gactcgtaggaaacattcta

SEQ ID NO: 757832 - DNA, 20 bp, mouse
gtggtagataactggagttg

SEQ ID NO: 757833 - DNA, 20 bp, mouse
ggcagcctccagaggacgtt

SEQ ID NO: 757834 - DNA, 20 bp, mouse
gctccaggcagggctaaaac

SEQ ID NO: 757835 - DNA, 20 bp, mouse
ggctggtgtgttgtaatcaa

SEQ ID NO: 757836 - DNA, 20 bp, mouse
gggacccaggcagccagcgg

SEQ ID NO: 757837 - DNA, 20 bp, mouse
gctacaggggctgagttcgt

SEQ ID NO: 757838 - DNA, 20 bp, mouse
gccagcggcggaaactagcc

SEQ ID NO: 757839 - DNA, 20 bp, mouse
gagcccggcgcgaccaaccg

SEQ ID NO: 757840 - DNA, 20 bp, mouse
gtcggctcgggaatgcggaa

SEQ ID NO: 757841 - DNA, 20 bp, mouse
ggcgcgaccaaccgtggcag

SEQ ID NO: 757842 - DNA, 20 bp, mouse
gccaggggacccccaaacca

SEQ ID NO: 757843 - DNA, 20 bp, mouse
gtatgtactcgcggctacag

SEQ ID NO: 757844 - DNA, 20 bp, mouse
ggggagccgccctggtttgg

SEQ ID NO: 757845 - DNA, 20 bp, mouse
gttgcagcaaccccctgcca

SEQ ID NO: 757846 - DNA, 20 bp, mouse
gcaaaggcggccacccgcct

SEQ ID NO: 757847 - DNA, 20 bp, mouse
ggggcctggcctggggatga

SEQ ID NO: 757848 - DNA, 20 bp, mouse
gtgaagtaagagctgctcaa

SEQ ID NO: 757849 - DNA, 20 bp, mouse
ggggtctcacgtgtccaccc

SEQ ID NO: 757850 - DNA, 20 bp, mouse
gttcaaggttaaagagtcag

SEQ ID NO: 757851 - DNA, 20 bp, mouse
gcagaagaacggcatggagt

SEQ ID NO: 757852 - DNA, 20 bp, mouse
ggttaaagagtcagtggctg

SEQ ID NO: 757853 - DNA, 20 bp, mouse
gaactgccaaaagtggtcat

SEQ ID NO: 757854 - DNA, 20 bp, mouse
gcttccctgccattgtctaa

SEQ ID NO: 757855 - DNA, 20 bp, mouse
gctcacgtgtccacccaggc

SEQ ID NO: 757856 - DNA, 20 bp, mouse
gcctctccccaacaggtgac

SEQ ID NO: 757857 - DNA, 20 bp, mouse
ggggcattggctctgctcaa

SEQ ID NO: 757858 - DNA, 20 bp, mouse
gtcaagcccaggaatgggtg

SEQ ID NO: 757859 - DNA, 20 bp, mouse
gcaacaggtgactgggggaa

SEQ ID NO: 757860 - DNA, 20 bp, mouse
ggagggcattgttcaagccc

SEQ ID NO: 757861 - DNA, 20 bp, mouse
gagcaggataaagcccaggg

SEQ ID NO: 757862 - DNA, 20 bp, mouse
gctgctcaaggggctatttt

SEQ ID NO: 757863 - DNA, 20 bp, mouse
gtccctattgtgcatggtag

SEQ ID NO: 757864 - DNA, 20 bp, mouse
gaggggctggaatgaccaaa

SEQ ID NO: 757865 - DNA, 20 bp, mouse
ggtcccctgattaagagcga

SEQ ID NO: 757866 - DNA, 20 bp, mouse
gaagtcggctcatccctctc

SEQ ID NO: 757867 - DNA, 20 bp, mouse
gccctgatgctcaacagttc

SEQ ID NO: 757868 - DNA, 20 bp, mouse
gcaaagccctgtgttgtcca

SEQ ID NO: 757869 - DNA, 20 bp, mouse
ggggcctagggctagcttaa

SEQ ID NO: 757870 - DNA, 20 bp, mouse
gtgctctggccccttggaga

SEQ ID NO: 757871 - DNA, 20 bp, mouse
gaacaactgcgggtagaggg

SEQ ID NO: 757872 - DNA, 20 bp, mouse
gtccaccagctgttgcttca

SEQ ID NO: 757873 - DNA, 20 bp, mouse
gctcacacaaagcccagggg

SEQ ID NO: 757874 - DNA, 20 bp, mouse
gatgagtgaggtgtgtgcat

SEQ ID NO: 757875 - DNA, 20 bp, mouse
gagcatcagggcagggccta

SEQ ID NO: 757876 - DNA, 20 bp, mouse
ggggcgccctacctcggctc

SEQ ID NO: 757877 - DNA, 20 bp, mouse
ggggcctgggttgggactct

SEQ ID NO: 757878 - DNA, 20 bp, mouse
gtcggctcaggaatctagca

SEQ ID NO: 757879 - DNA, 20 bp, mouse
ggaatctagcaggggggcct

SEQ ID NO: 757880 - DNA, 20 bp, mouse
gttggtgcagctcggaagaa

SEQ ID NO: 757881 - DNA, 20 bp, mouse
gtctggccgcacaggaggtg

SEQ ID NO: 757882 - DNA, 20 bp, mouse
gagattcctgagccgaggta

SEQ ID NO: 757883 - DNA, 20 bp, mouse
ggggggggggcgccctacct

SEQ ID NO: 757884 - DNA, 20 bp, mouse
gcaccaagagcagaggattt

SEQ ID NO: 757885 - DNA, 20 bp, mouse
gccaataggcacgctagtct

SEQ ID NO: 757886 - DNA, 20 bp, mouse
gaagtcaccaccaactctca

SEQ ID NO: 757887 - DNA, 20 bp, mouse
gtctgcagccgcagggtcat

SEQ ID NO: 757888 - DNA, 20 bp, mouse
gcagccgcagggtcatgggt

SEQ ID NO: 757889 - DNA, 20 bp, mouse
gtagccttgcgggcgtctgt

SEQ ID NO: 757890 - DNA, 20 bp, mouse
gaactctcacggctgggaaa

SEQ ID NO: 757891 - DNA, 20 bp, mouse
gtcccagccgtgagagttgg

SEQ ID NO: 757892 - DNA, 20 bp, mouse
gcggaaccggcgcacgcctc

SEQ ID NO: 757893 - DNA, 20 bp, mouse
gcgagcacccgcaggctcac

SEQ ID NO: 757894 - DNA, 20 bp, mouse
ggccggttccggaattgaaa

SEQ ID NO: 757895 - DNA, 20 bp, mouse
ggtagtccgcgagcacccgc

SEQ ID NO: 757896 - DNA, 20 bp, mouse
gagtgtgaataggatctatg

SEQ ID NO: 757897 - DNA, 20 bp, mouse
gcccccaagtgtaacatcct

SEQ ID NO: 757898 - DNA, 20 bp, mouse
gggagcctggtcacaagaga

SEQ ID NO: 757899 - DNA, 20 bp, mouse
gcacactcctggtaaccttc

SEQ ID NO: 757900 - DNA, 20 bp, mouse
gcccgctggtggagaaagac

SEQ ID NO: 757901 - DNA, 20 bp, mouse
ggcccaaataaggagaggaa

SEQ ID NO: 757902 - DNA, 20 bp, mouse
gcagaggcccaaataaggag

SEQ ID NO: 757903 - DNA, 20 bp, mouse
gtcacccagaggcccaaata

SEQ ID NO: 757904 - DNA, 20 bp, mouse
gacctggactagcacacgtt

SEQ ID NO: 757905 - DNA, 20 bp, mouse
gtctctgaccagggaagaca

SEQ ID NO: 757906 - DNA, 20 bp, mouse
gcctgggccgacccagagaa

SEQ ID NO: 757907 - DNA, 20 bp, mouse
gcagagaaaggctgcgtcga

SEQ ID NO: 757908 - DNA, 20 bp, mouse
gagaaaggctgcgtcgaggg

SEQ ID NO: 757909 - DNA, 20 bp, mouse
gtgcaagcagaggcctaata

SEQ ID NO: 757910 - DNA, 20 bp, mouse
gaaggcagaagaatgcgcgg

SEQ ID NO: 757911 - DNA, 20 bp, mouse
gaggcctaataaggccgggc

SEQ ID NO: 757912 - DNA, 20 bp, mouse
gtcgaggggggctattccag

SEQ ID NO: 757913 - DNA, 20 bp, mouse
gtgcttccatgccccagcct

SEQ ID NO: 757914 - DNA, 20 bp, mouse
gcagccagcccggccttatt

SEQ ID NO: 757915 - DNA, 20 bp, mouse
gagcagaggcctaataaggc

SEQ ID NO: 757916 - DNA, 20 bp, mouse
ggcgaccgtgctggggattg

SEQ ID NO: 757917 - DNA, 20 bp, mouse
gtgggaggagcgtcgcccag

SEQ ID NO: 757918 - DNA, 20 bp, mouse
gagaggccgcgaccgtgctg

SEQ ID NO: 757919 - DNA, 20 bp, mouse
gaaccaattcccagtctcgg

SEQ ID NO: 757920 - DNA, 20 bp, mouse
ggagactgggaattggttgc

SEQ ID NO: 757921 - DNA, 20 bp, mouse
gctgtggagctgcgggaggt

SEQ ID NO: 757922 - DNA, 20 bp, mouse
gtggagctgcgggcgacagc

SEQ ID NO: 757923 - DNA, 20 bp, mouse
gcgcctcccggcaccgcctg

SEQ ID NO: 757924 - DNA, 20 bp, mouse
gctccacaggcggtgccggg

SEQ ID NO: 757925 - DNA, 20 bp, mouse
ggcaccgcctgtggagctgc

SEQ ID NO: 757926 - DNA, 20 bp, mouse
gactgcccatcagtcttcca

SEQ ID NO: 757927 - DNA, 20 bp, mouse
gtccggccctgcacgtacca

SEQ ID NO: 757928 - DNA, 20 bp, mouse
ggtaactggtaggagggcca

SEQ ID NO: 757929 - DNA, 20 bp, mouse
ggtaaggggtgctacaaact

SEQ ID NO: 757930 - DNA, 20 bp, mouse
ggctgtggtaactggtagga

SEQ ID NO: 757931 - DNA, 20 bp, mouse
ggggccggaagcagttctcc

SEQ ID NO: 757932 - DNA, 20 bp, mouse
ggtcggctgtggtaactggt

SEQ ID NO: 757933 - DNA, 20 bp, mouse
gagacactgccacggataaa

SEQ ID NO: 757934 - DNA, 20 bp, mouse
gtctcacaggtgatagtaag

SEQ ID NO: 757935 - DNA, 20 bp, mouse
gaagttgcctgggtaagctg

SEQ ID NO: 757936 - DNA, 20 bp, mouse
gctaccccatgtcaggccgt

SEQ ID NO: 757937 - DNA, 20 bp, mouse
ggcaggggcgtgggcagtgg

SEQ ID NO: 757938 - DNA, 20 bp, mouse
gcttcccacggcctgacatg

SEQ ID NO: 757939 - DNA, 20 bp, mouse
gacatggggtagaatggcgt

SEQ ID NO: 757940 - DNA, 20 bp, mouse
gggcccccgttcagaggaca

SEQ ID NO: 757941 - DNA, 20 bp, mouse
gaccaggggccaagcagtgc

SEQ ID NO: 757942 - DNA, 20 bp, mouse
gagaggtgtggcatagaggt

SEQ ID NO: 757943 - DNA, 20 bp, mouse
ggtggccaggatacgggaag

SEQ ID NO: 757944 - DNA, 20 bp, mouse
gagtggaggcggagactaag

SEQ ID NO: 757945 - DNA, 20 bp, mouse
gactcttggcccccgttcag

SEQ ID NO: 757946 - DNA, 20 bp, mouse
gtggcccaggcccttctcct

SEQ ID NO: 757947 - DNA, 20 bp, mouse
gcagcctgtcactctctcag

SEQ ID NO: 757948 - DNA, 20 bp, mouse
ggctgagtgcgagatagaca

SEQ ID NO: 757949 - DNA, 20 bp, mouse
gaatttgagaggaactgaga

SEQ ID NO: 757950 - DNA, 20 bp, mouse
gagtcagcagcctcttaaag

SEQ ID NO: 757951 - DNA, 20 bp, mouse
gggccccaggagaagggcct

SEQ ID NO: 757952 - DNA, 20 bp, mouse
gtaacatgcaaacagggaag

SEQ ID NO: 757953 - DNA, 20 bp, mouse
ggagtctgcccagagaaggc

SEQ ID NO: 757954 - DNA, 20 bp, mouse
gcaacccttaaacaaagaac

SEQ ID NO: 757955 - DNA, 20 bp, mouse
gactaattctcagctttcct

SEQ ID NO: 757956 - DNA, 20 bp, mouse
gtcaaaggtcaggtaaggag

SEQ ID NO: 757957 - DNA, 20 bp, mouse
gccagcccggtaattacaag

SEQ ID NO: 757958 - DNA, 20 bp, mouse
gaattacaaggggcggagag

SEQ ID NO: 757959 - DNA, 20 bp, mouse
gctcggcgtggcatttgaga

SEQ ID NO: 757960 - DNA, 20 bp, mouse
gagcacattggtttaaacag

SEQ ID NO: 757961 - DNA, 20 bp, mouse
gccaggcctttcaaagctga

SEQ ID NO: 757962 - DNA, 20 bp, mouse
ggcccggtaattacaagggg

SEQ ID NO: 757963 - DNA, 20 bp, mouse
gctccgccccttgtaattac

SEQ ID NO: 757964 - DNA, 20 bp, mouse
gaccgggctggatttgtgct

SEQ ID NO: 757965 - DNA, 20 bp, mouse
gagagggaagacacttcctc

SEQ ID NO: 757966 - DNA, 20 bp, mouse
ggcagtgtgccaggattcag

SEQ ID NO: 757967 - DNA, 20 bp, mouse
gtgctgcaggcctccaagaa

SEQ ID NO: 757968 - DNA, 20 bp, mouse
gtcagggaagcccacagttc

SEQ ID NO: 757969 - DNA, 20 bp, mouse
gcacagggctaaggttacca

SEQ ID NO: 757970 - DNA, 20 bp, mouse
gcaggcctccaagaaaggag

SEQ ID NO: 757971 - DNA, 20 bp, mouse
gttgggatgcaagtctcgtt

SEQ ID NO: 757972 - DNA, 20 bp, mouse
gtgggctattttagtatctg

SEQ ID NO: 757973 - DNA, 20 bp, mouse
gtgccctgcggtctgctcac

SEQ ID NO: 757974 - DNA, 20 bp, mouse
ggcacactgcagtccccctt

SEQ ID NO: 757975 - DNA, 20 bp, mouse
gctaaaatagcccagctcag

SEQ ID NO: 757976 - DNA, 20 bp, mouse
gaaagtgcacctgttgaggg

SEQ ID NO: 757977 - DNA, 20 bp, mouse
gaggtgagagtgggaggcta

SEQ ID NO: 757978 - DNA, 20 bp, mouse
gtccccctccaccctttgaa

SEQ ID NO: 757979 - DNA, 20 bp, mouse
gtttctgggaaggaggggta

SEQ ID NO: 757980 - DNA, 20 bp, mouse
gctcaacaggtgcactttct

SEQ ID NO: 757981 - DNA, 20 bp, mouse
gcctccaccctttgaaggga

SEQ ID NO: 757982 - DNA, 20 bp, mouse
gcggtcaaggttagagacgg

SEQ ID NO: 757983 - DNA, 20 bp, mouse
ggaaaccaggaattggccca

SEQ ID NO: 757984 - DNA, 20 bp, mouse
gtgagggtaaaggttgaaca

SEQ ID NO: 757985 - DNA, 20 bp, mouse
gggtgaggacagatgaaacc

SEQ ID NO: 757986 - DNA, 20 bp, mouse
gatgacgtccgcaggttcta

SEQ ID NO: 757987 - DNA, 20 bp, mouse
gcatgcgcaacgtgggagga

SEQ ID NO: 757988 - DNA, 20 bp, mouse
gcgcaacgtgggaggaaggt

SEQ ID NO: 757989 - DNA, 20 bp, mouse
gtcagagttagtgcagtaaa

SEQ ID NO: 757990 - DNA, 20 bp, mouse
ggggggaaatggaatctcga

SEQ ID NO: 757991 - DNA, 20 bp, mouse
gaggaaggtgggctttctac

SEQ ID NO: 757992 - DNA, 20 bp, mouse
gcactgggcatgcgcaacgt

SEQ ID NO: 757993 - DNA, 20 bp, mouse
gtgcactaactctgatttcg

SEQ ID NO: 757994 - DNA, 20 bp, mouse
ggatataagcaaaaagattc

SEQ ID NO: 757995 - DNA, 20 bp, mouse
gaagcaaaaagattccggta

SEQ ID NO: 757996 - DNA, 20 bp, mouse
gctgtgggcggggctataat

SEQ ID NO: 757997 - DNA, 20 bp, mouse
gaccaggagtcgagtaggcg

SEQ ID NO: 757998 - DNA, 20 bp, mouse
gtcagggaaagcacagggca

SEQ ID NO: 757999 - DNA, 20 bp, mouse
ggggagagggcgcggcatgt

SEQ ID NO: 758000 - DNA, 20 bp, mouse
gggggcggggccaggtccgt

SEQ ID NO: 758001 - DNA, 20 bp, mouse
ggcggggccgcgcatccggt

SEQ ID NO: 758002 - DNA, 20 bp, mouse
ggcatgtaggaagcccgagc

SEQ ID NO: 758003 - DNA, 20 bp, mouse
gagtcgagtaggcggggttt

SEQ ID NO: 758004 - DNA, 20 bp, mouse
ggcggggccaggtccgtagg

SEQ ID NO: 758005 - DNA, 20 bp, mouse
ggcgtgaccaggagtcgagt

SEQ ID NO: 758006 - DNA, 20 bp, mouse
gagcctggaaagcaagtagt

SEQ ID NO: 758007 - DNA, 20 bp, mouse
ggggccccaggcggtcaatg

SEQ ID NO: 758008 - DNA, 20 bp, mouse
ggcccaaagccctacttctc

SEQ ID NO: 758009 - DNA, 20 bp, mouse
gtctctataatcaccaggaa

SEQ ID NO: 758010 - DNA, 20 bp, mouse
gaagcacaagcagctgacat

SEQ ID NO: 758011 - DNA, 20 bp, mouse
gagggagagagctctaaggc

SEQ ID NO: 758012 - DNA, 20 bp, mouse
ggacctagccagcaccatcg

SEQ ID NO: 758013 - DNA, 20 bp, mouse
gggccccgatggtgctggct

SEQ ID NO: 758014 - DNA, 20 bp, mouse
gtgcagggcagctgatgctc

SEQ ID NO: 758015 - DNA, 20 bp, mouse
gaggcagccggaggccccga

SEQ ID NO: 758016 - DNA, 20 bp, mouse
ggggccctgtggctgttgtc

SEQ ID NO: 758017 - DNA, 20 bp, mouse
gaaggaactggggctaaaag

SEQ ID NO: 758018 - DNA, 20 bp, mouse
ggaggcctcaggggcctgga

SEQ ID NO: 758019 - DNA, 20 bp, mouse
gggggctaaaagggggagtc

SEQ ID NO: 758020 - DNA, 20 bp, mouse
gtaggagtcatcaggcaaga

SEQ ID NO: 758021 - DNA, 20 bp, mouse
ggagatagtcagtaagcagt

SEQ ID NO: 758022 - DNA, 20 bp, mouse
gggagagtagaagaggcctc

SEQ ID NO: 758023 - DNA, 20 bp, mouse
gaggggacaaagtccagcca

SEQ ID NO: 758024 - DNA, 20 bp, mouse
gctaacagcctcaacttgct

SEQ ID NO: 758025 - DNA, 20 bp, mouse
gaggggacaaatggtctcag

SEQ ID NO: 758026 - DNA, 20 bp, mouse
gtgcaggatcaggaacgcag

SEQ ID NO: 758027 - DNA, 20 bp, mouse
ggccatggacattattgtgt

SEQ ID NO: 758028 - DNA, 20 bp, mouse
gcagtgggcaatgcagattc

SEQ ID NO: 758029 - DNA, 20 bp, mouse
gatgtagtagtcataggatc

SEQ ID NO: 758030 - DNA, 20 bp, mouse
gaccaacacaataatgtcca

SEQ ID NO: 758031 - DNA, 20 bp, mouse
gggaatacagtagacactgc

SEQ ID NO: 758032 - DNA, 20 bp, mouse
gtcaggaatgtagtagtcat

SEQ ID NO: 758033 - DNA, 20 bp, mouse
gtgtggacattgacgatctg

SEQ ID NO: 758034 - DNA, 20 bp, mouse
gcagtaagatttatagaatc

SEQ ID NO: 758035 - DNA, 20 bp, mouse
gtatagaatcaggagagcgg

SEQ ID NO: 758036 - DNA, 20 bp, mouse
gagggcgcgccgccagcctt

SEQ ID NO: 758037 - DNA, 20 bp, mouse
ggcaggcactggacattcat

SEQ ID NO: 758038 - DNA, 20 bp, mouse
gctagccgctggagactgcg

SEQ ID NO: 758039 - DNA, 20 bp, mouse
gtgctgagttgcactgacca

SEQ ID NO: 758040 - DNA, 20 bp, mouse
gcggctggcggcatagacgc

SEQ ID NO: 758041 - DNA, 20 bp, mouse
ggcgcgccctggcatcagac

SEQ ID NO: 758042 - DNA, 20 bp, mouse
ggccggccggtctgatgcca

SEQ ID NO: 758043 - DNA, 20 bp, mouse
ggcccaaacactgtccgcga

SEQ ID NO: 758044 - DNA, 20 bp, mouse
gtgggctccagcttggccca

SEQ ID NO: 758045 - DNA, 20 bp, mouse
gcgcgagccgagcgaaccga

SEQ ID NO: 758046 - DNA, 20 bp, mouse
gaggactgcgggcaccaggt

SEQ ID NO: 758047 - DNA, 20 bp, mouse
gccagggagcaatggggtct

SEQ ID NO: 758048 - DNA, 20 bp, mouse
gccacagccagggagcaatg

SEQ ID NO: 758049 - DNA, 20 bp, mouse
gagagagtgtcctggggtta

SEQ ID NO: 758050 - DNA, 20 bp, mouse
ggcaatggggtctgggtaga

SEQ ID NO: 758051 - DNA, 20 bp, mouse
gccaggtaggtccacagcca

SEQ ID NO: 758052 - DNA, 20 bp, mouse
gcaaataaggacataggttg

SEQ ID NO: 758053 - DNA, 20 bp, mouse
gagcagaggctagaggactg

SEQ ID NO: 758054 - DNA, 20 bp, mouse
gtagcagctcagaatagcac

SEQ ID NO: 758055 - DNA, 20 bp, mouse
gtgcacagctctggcagggt

SEQ ID NO: 758056 - DNA, 20 bp, mouse
gccgccctaggacaagatga

SEQ ID NO: 758057 - DNA, 20 bp, mouse
gctgtccccagctggttcaa

SEQ ID NO: 758058 - DNA, 20 bp, mouse
gagcccgtgagccccaggtc

SEQ ID NO: 758059 - DNA, 20 bp, mouse
gacagcatgcacatatatgg

SEQ ID NO: 758060 - DNA, 20 bp, mouse
ggggacagcatgcacatata

SEQ ID NO: 758061 - DNA, 20 bp, mouse
gcacatatatggtggcggga

SEQ ID NO: 758062 - DNA, 20 bp, mouse
gaggactccctacaccagcc

SEQ ID NO: 758063 - DNA, 20 bp, mouse
gtggcgggaggggacagctc

SEQ ID NO: 758064 - DNA, 20 bp, mouse
ggtggccgttgaaccagctg

SEQ ID NO: 758065 - DNA, 20 bp, mouse
gcatgcacatatatggtggc

SEQ ID NO: 758066 - DNA, 20 bp, mouse
gaggtgaggtctattgagtc

SEQ ID NO: 758067 - DNA, 20 bp, mouse
gaacccgcctcgccctgggg

SEQ ID NO: 758068 - DNA, 20 bp, mouse
gacgccctgcccacgactga

SEQ ID NO: 758069 - DNA, 20 bp, mouse
gcgtcccaggccgccggctc

SEQ ID NO: 758070 - DNA, 20 bp, mouse
ggcgcggcgggtccgtggga

SEQ ID NO: 758071 - DNA, 20 bp, mouse
ggacgcacgtggcccgtccc

SEQ ID NO: 758072 - DNA, 20 bp, mouse
ggcgaggcgggttaggtaga

SEQ ID NO: 758073 - DNA, 20 bp, mouse
gtctccggcgtggacagaac

SEQ ID NO: 758074 - DNA, 20 bp, mouse
ggccgccggctccggctagc

SEQ ID NO: 758075 - DNA, 20 bp, mouse
ggagcagcgcaagggctctc

SEQ ID NO: 758076 - DNA, 20 bp, mouse
ggctccagggaggactctga

SEQ ID NO: 758077 - DNA, 20 bp, mouse
gccaccagctactaaaaaat

SEQ ID NO: 758078 - DNA, 20 bp, mouse
gagggaggactctgagggtt

SEQ ID NO: 758079 - DNA, 20 bp, mouse
ggtccatgccagaagatgat

SEQ ID NO: 758080 - DNA, 20 bp, mouse
gtggggaaggagagtgctcc

SEQ ID NO: 758081 - DNA, 20 bp, mouse
gagagctgcccgtggaaaat

SEQ ID NO: 758082 - DNA, 20 bp, mouse
gtttagtagctggtgggagt

SEQ ID NO: 758083 - DNA, 20 bp, mouse
gaaatggggtgtgtctcttt

SEQ ID NO: 758084 - DNA, 20 bp, mouse
gagaacgagaacagcataca

SEQ ID NO: 758085 - DNA, 20 bp, mouse
gctcctcaagcagactgagt

SEQ ID NO: 758086 - DNA, 20 bp, mouse
gcccgccgggtgctcaccgg

SEQ ID NO: 758087 - DNA, 20 bp, mouse
gccccccggtgagcacccgg

SEQ ID NO: 758088 - DNA, 20 bp, mouse
gaaccgcggccagggagcga

SEQ ID NO: 758089 - DNA, 20 bp, mouse
gagcgaggggcgcgtccggg

SEQ ID NO: 758090 - DNA, 20 bp, mouse
gtgcgcgcctgggtgaaccg

SEQ ID NO: 758091 - DNA, 20 bp, mouse
gcatgcagtggccaaggtga

SEQ ID NO: 758092 - DNA, 20 bp, mouse
gccgcccgccgggtgctcac

SEQ ID NO: 758093 - DNA, 20 bp, mouse
gcctgggtgaaccgcggcca

SEQ ID NO: 758094 - DNA, 20 bp, mouse
ggcccctcgctccctggccg

SEQ ID NO: 758095 - DNA, 20 bp, mouse
gagggagcgaggggcgcgtc

SEQ ID NO: 758096 - DNA, 20 bp, mouse
gccctcgcgcgccccctctt

SEQ ID NO: 758097 - DNA, 20 bp, mouse
gccggctgcagtgggtccta

SEQ ID NO: 758098 - DNA, 20 bp, mouse
ggggttcgggacctaagagg

SEQ ID NO: 758099 - DNA, 20 bp, mouse
ggacaccccgcgcgagacga

SEQ ID NO: 758100 - DNA, 20 bp, mouse
ggcaggccccttggctcagg

SEQ ID NO: 758101 - DNA, 20 bp, mouse
gccggccaggccggctgcag

SEQ ID NO: 758102 - DNA, 20 bp, mouse
gagggggttcgggacctaag

SEQ ID NO: 758103 - DNA, 20 bp, mouse
gaggaacgtcgttagttcca

SEQ ID NO: 758104 - DNA, 20 bp, mouse
gtgagccaaggggcctgcaa

SEQ ID NO: 758105 - DNA, 20 bp, mouse
ggacaggcggagcctctgta

SEQ ID NO: 758106 - DNA, 20 bp, mouse
gagcacggggcggggcccaa

SEQ ID NO: 758107 - DNA, 20 bp, mouse
ggggccccgccccgtgctgg

SEQ ID NO: 758108 - DNA, 20 bp, mouse
gcacttctctattaactcgt

SEQ ID NO: 758109 - DNA, 20 bp, mouse
ggtgctggtggccctcccca

SEQ ID NO: 758110 - DNA, 20 bp, mouse
gcgcgcgcgcgcctgagcct

SEQ ID NO: 758111 - DNA, 20 bp, mouse
gacgcaaggcagtatagtga

SEQ ID NO: 758112 - DNA, 20 bp, mouse
gtcacgctgtagtacttggt

SEQ ID NO: 758113 - DNA, 20 bp, mouse
gagggccaccagcacggggc

SEQ ID NO: 758114 - DNA, 20 bp, mouse
gcgtgagttgggtcttctac

SEQ ID NO: 758115 - DNA, 20 bp, mouse
gccttgcgggggatgacgat

SEQ ID NO: 758116 - DNA, 20 bp, mouse
gaggcggctgggccggggtt

SEQ ID NO: 758117 - DNA, 20 bp, mouse
gtggggcggggacgcgctct

SEQ ID NO: 758118 - DNA, 20 bp, mouse
gacgcgctctgggccagccg

SEQ ID NO: 758119 - DNA, 20 bp, mouse
gggcgcgcacgcgtggggcg

SEQ ID NO: 758120 - DNA, 20 bp, mouse
gggttgggcgggctcatcgg

SEQ ID NO: 758121 - DNA, 20 bp, mouse
gactaggcaggggttgaaga

SEQ ID NO: 758122 - DNA, 20 bp, mouse
gcggcggggcggagcccgag

SEQ ID NO: 758123 - DNA, 20 bp, mouse
ggccccctaaagacaggcac

SEQ ID NO: 758124 - DNA, 20 bp, mouse
gctgggcggcgcgcacgcgt

SEQ ID NO: 758125 - DNA, 20 bp, mouse
gcgggacccaggctagaggc

SEQ ID NO: 758126 - DNA, 20 bp, mouse
ggagccacccccaaaccgaa

SEQ ID NO: 758127 - DNA, 20 bp, mouse
gaggacagcggcgcgctctg

SEQ ID NO: 758128 - DNA, 20 bp, mouse
gcatcccttcggtttggggg

SEQ ID NO: 758129 - DNA, 20 bp, mouse
gagcgaggccgcaggactac

SEQ ID NO: 758130 - DNA, 20 bp, mouse
ggctgtcctagccgtcccca

SEQ ID NO: 758131 - DNA, 20 bp, mouse
gtggctccctggggacggct

SEQ ID NO: 758132 - DNA, 20 bp, mouse
gtcactcctcagggaagccg

SEQ ID NO: 758133 - DNA, 20 bp, mouse
gcgggcaatctgtccataaa

SEQ ID NO: 758134 - DNA, 20 bp, mouse
gaagagaagcgacaggagcg

SEQ ID NO: 758135 - DNA, 20 bp, mouse
ggcaggactacaggatccag

SEQ ID NO: 758136 - DNA, 20 bp, mouse
gagctctagcagcaatgaca

SEQ ID NO: 758137 - DNA, 20 bp, mouse
gcgggagggctcatgaccac

SEQ ID NO: 758138 - DNA, 20 bp, mouse
ggggctcatgaccacagggg

SEQ ID NO: 758139 - DNA, 20 bp, mouse
gtgaagggataggtcaaagt

SEQ ID NO: 758140 - DNA, 20 bp, mouse
ggggataggtcaaagttggc

SEQ ID NO: 758141 - DNA, 20 bp, mouse
gtagttctcttcagaatcag

SEQ ID NO: 758142 - DNA, 20 bp, mouse
ggtttggagcttaccctgaa

SEQ ID NO: 758143 - DNA, 20 bp, mouse
ggagcttaccctgaagggat

SEQ ID NO: 758144 - DNA, 20 bp, mouse
gcagggctgagggaaccgtt

SEQ ID NO: 758145 - DNA, 20 bp, mouse
gacccaaatcagctgactgc

SEQ ID NO: 758146 - DNA, 20 bp, mouse
gccagcctgcccgtaatctt

SEQ ID NO: 758147 - DNA, 20 bp, mouse
gcctaactgtctgtcctgat

SEQ ID NO: 758148 - DNA, 20 bp, mouse
gagtgcttgggattacagac

SEQ ID NO: 758149 - DNA, 20 bp, mouse
gtcctgctccctggcccaca

SEQ ID NO: 758150 - DNA, 20 bp, mouse
ggtatggccaaacctagctt

SEQ ID NO: 758151 - DNA, 20 bp, mouse
ggggcagggccaaactcccc

SEQ ID NO: 758152 - DNA, 20 bp, mouse
ggtcctgatggggtctttac

SEQ ID NO: 758153 - DNA, 20 bp, mouse
gtagcttgggaagagcttta

SEQ ID NO: 758154 - DNA, 20 bp, mouse
gcaggggagtagcaatgggc

SEQ ID NO: 758155 - DNA, 20 bp, mouse
gaaggcaggggagtagcaat

SEQ ID NO: 758156 - DNA, 20 bp, mouse
ggcgccagatccacaatcga

SEQ ID NO: 758157 - DNA, 20 bp, mouse
gaaaccctgagaataagctg

SEQ ID NO: 758158 - DNA, 20 bp, mouse
gtcacctcagcttattctca

SEQ ID NO: 758159 - DNA, 20 bp, mouse
gtatccagaaccgtcgattg

SEQ ID NO: 758160 - DNA, 20 bp, mouse
gaccggcagaagtatgtgct

SEQ ID NO: 758161 - DNA, 20 bp, mouse
ggtggtcagtcttgacacaa

SEQ ID NO: 758162 - DNA, 20 bp, mouse
gtatgcaggcctggactcca

SEQ ID NO: 758163 - DNA, 20 bp, mouse
gtgtggatctggcgcccgcc

SEQ ID NO: 758164 - DNA, 20 bp, mouse
gataacaagccatggagtcc

SEQ ID NO: 758165 - DNA, 20 bp, mouse
gcaagcatggtaaaaaacac

SEQ ID NO: 758166 - DNA, 20 bp, mouse
gggccccgtggcacctccca

SEQ ID NO: 758167 - DNA, 20 bp, mouse
ggccctgcccagaaaccaca

SEQ ID NO: 758168 - DNA, 20 bp, mouse
ggactcaggagcgtctgggt

SEQ ID NO: 758169 - DNA, 20 bp, mouse
gaaccactggacagcaactc

SEQ ID NO: 758170 - DNA, 20 bp, mouse
gccgccgggtcccctacaga

SEQ ID NO: 758171 - DNA, 20 bp, mouse
gcccgtggcacctcccaggg

SEQ ID NO: 758172 - DNA, 20 bp, mouse
gtcgccccgcccctctgtag

SEQ ID NO: 758173 - DNA, 20 bp, mouse
ggccaggactcaggagcgtc

SEQ ID NO: 758174 - DNA, 20 bp, mouse
gggcgacctgggtccgccct

SEQ ID NO: 758175 - DNA, 20 bp, mouse
gtggaatgcgagcttgtttt

SEQ ID NO: 758176 - DNA, 20 bp, mouse
gctctgggccgcttgaacaa

SEQ ID NO: 758177 - DNA, 20 bp, mouse
gtgtcccgggagaccccagt

SEQ ID NO: 758178 - DNA, 20 bp, mouse
ggttcaagcggcccagagat

SEQ ID NO: 758179 - DNA, 20 bp, mouse
ggcacagggaggggcattga

SEQ ID NO: 758180 - DNA, 20 bp, mouse
gtcccagcggcctcaagttc

SEQ ID NO: 758181 - DNA, 20 bp, mouse
gctacaacaagcaccaactc

SEQ ID NO: 758182 - DNA, 20 bp, mouse
gagcaggaggcctggtaaag

SEQ ID NO: 758183 - DNA, 20 bp, mouse
gcaacccactggggtctccc

SEQ ID NO: 758184 - DNA, 20 bp, mouse
gtgggactaaacccagggca

SEQ ID NO: 758185 - DNA, 20 bp, mouse
gagccctgctcccaagcacg

SEQ ID NO: 758186 - DNA, 20 bp, mouse
ggcgactgaagagaccgcaa

SEQ ID NO: 758187 - DNA, 20 bp, mouse
gtcccccgagcacgcgcctc

SEQ ID NO: 758188 - DNA, 20 bp, mouse
gcacgcgcctcgggctcacg

SEQ ID NO: 758189 - DNA, 20 bp, mouse
ggagcccgaaagagccggga

SEQ ID NO: 758190 - DNA, 20 bp, mouse
ggctgtgtgtgtggaccagg

SEQ ID NO: 758191 - DNA, 20 bp, mouse
gtgtgtggaccaggcggctt

SEQ ID NO: 758192 - DNA, 20 bp, mouse
gcggcttggggagactgagg

SEQ ID NO: 758193 - DNA, 20 bp, mouse
ggagcccgaggcgcgtgctc

SEQ ID NO: 758194 - DNA, 20 bp, mouse
ggaggaaactgagggagcga

SEQ ID NO: 758195 - DNA, 20 bp, mouse
gagggagcgcgtcccgctcg

SEQ ID NO: 758196 - DNA, 20 bp, mouse
gggcgcggagggcttaaagg

SEQ ID NO: 758197 - DNA, 20 bp, mouse
gtgctctcccggctcaggta

SEQ ID NO: 758198 - DNA, 20 bp, mouse
gcgcgctgctctcccggctc

SEQ ID NO: 758199 - DNA, 20 bp, mouse
gagaaggcgcgctgctctcc

SEQ ID NO: 758200 - DNA, 20 bp, mouse
gtcccggctcaggtacggag

SEQ ID NO: 758201 - DNA, 20 bp, mouse
gccgccaccgggtcctgggg

SEQ ID NO: 758202 - DNA, 20 bp, mouse
gcaggtacggagaggtgacg

SEQ ID NO: 758203 - DNA, 20 bp, mouse
gcccgccgccaccgggtcct

SEQ ID NO: 758204 - DNA, 20 bp, mouse
gccggggcgccgctcctcgc

SEQ ID NO: 758205 - DNA, 20 bp, mouse
gctggtgcggcgaccaggag

SEQ ID NO: 758206 - DNA, 20 bp, mouse
ggctggctgctgtaagggag

SEQ ID NO: 758207 - DNA, 20 bp, mouse
gagggagcgggaacttgggc

SEQ ID NO: 758208 - DNA, 20 bp, mouse
gaccgggccaatggcaacgc

SEQ ID NO: 758209 - DNA, 20 bp, mouse
gtgtaagggagcgggaactt

SEQ ID NO: 758210 - DNA, 20 bp, mouse
gggctctggcgcccggactg

SEQ ID NO: 758211 - DNA, 20 bp, mouse
ggaacttctaaattgaggaa

SEQ ID NO: 758212 - DNA, 20 bp, mouse
gtgagggttagcagcgggat

SEQ ID NO: 758213 - DNA, 20 bp, mouse
gcgccagagccctcggggga

SEQ ID NO: 758214 - DNA, 20 bp, mouse
gtccgggcgccagagccctc

SEQ ID NO: 758215 - DNA, 20 bp, mouse
ggcggggtgagggttagcag

SEQ ID NO: 758216 - DNA, 20 bp, mouse
ggtagtgagcacaattgggg

SEQ ID NO: 758217 - DNA, 20 bp, mouse
gaggtggctagaggagcaag

SEQ ID NO: 758218 - DNA, 20 bp, mouse
gcctctagccaccttagaga

SEQ ID NO: 758219 - DNA, 20 bp, mouse
ggaggtagtgagcacaattg

SEQ ID NO: 758220 - DNA, 20 bp, mouse
ggaacaggtggaagccgtga

SEQ ID NO: 758221 - DNA, 20 bp, mouse
gctgccttccttctctaagg

SEQ ID NO: 758222 - DNA, 20 bp, mouse
gagtccatgcctgccgtctc

SEQ ID NO: 758223 - DNA, 20 bp, mouse
gtccccaagcctgagacggc

SEQ ID NO: 758224 - DNA, 20 bp, mouse
ggtgggaatggaaaccctca

SEQ ID NO: 758225 - DNA, 20 bp, mouse
gttacaaaaacacctcctgc

SEQ ID NO: 758226 - DNA, 20 bp, mouse
ggcaaggcatagaagctcca

SEQ ID NO: 758227 - DNA, 20 bp, mouse
gtgaggggcgggctgtgctg

SEQ ID NO: 758228 - DNA, 20 bp, mouse
ggtgacatcagcatgagggg

SEQ ID NO: 758229 - DNA, 20 bp, mouse
gaggaagatgggacgtgatc

SEQ ID NO: 758230 - DNA, 20 bp, mouse
ggggcctggggccaaccatc

SEQ ID NO: 758231 - DNA, 20 bp, mouse
gaacgtctagaggttgccca

SEQ ID NO: 758232 - DNA, 20 bp, mouse
gccaggcccgaggttcccac

SEQ ID NO: 758233 - DNA, 20 bp, mouse
gggagccctgggggcctcga

SEQ ID NO: 758234 - DNA, 20 bp, mouse
gcagaccttcgaggccccca

SEQ ID NO: 758235 - DNA, 20 bp, mouse
ggctggccagtgggaacctc

SEQ ID NO: 758236 - DNA, 20 bp, mouse
ggggctgcaggaggacctgt

SEQ ID NO: 758237 - DNA, 20 bp, mouse
gacagaccctgaggcctcta

SEQ ID NO: 758238 - DNA, 20 bp, mouse
gtcagccgagcagtggttaa

SEQ ID NO: 758239 - DNA, 20 bp, mouse
gggcaccattaaccactgct

SEQ ID NO: 758240 - DNA, 20 bp, mouse
gggctgaagagtgagctagc

SEQ ID NO: 758241 - DNA, 20 bp, mouse
gacagttcagtgtcttcgaa

SEQ ID NO: 758242 - DNA, 20 bp, mouse
gtggtgccctagaggcctca

SEQ ID NO: 758243 - DNA, 20 bp, mouse
gctctcagacatctgagtac

SEQ ID NO: 758244 - DNA, 20 bp, mouse
ggactccaagaacgccagtc

SEQ ID NO: 758245 - DNA, 20 bp, mouse
gcaggagtattcactcccac

SEQ ID NO: 758246 - DNA, 20 bp, mouse
gagtcctggcaggacgggga

SEQ ID NO: 758247 - DNA, 20 bp, mouse
ggggaggcggggccattcgg

SEQ ID NO: 758248 - DNA, 20 bp, mouse
gggaaagtcctggcaggacg

SEQ ID NO: 758249 - DNA, 20 bp, mouse
gacgcagaggcagttggcgg

SEQ ID NO: 758250 - DNA, 20 bp, mouse
gggacggggagggactgcgg

SEQ ID NO: 758251 - DNA, 20 bp, mouse
gggccgggcggggctgtccg

SEQ ID NO: 758252 - DNA, 20 bp, mouse
ggggccgcgtgagcggggtc

SEQ ID NO: 758253 - DNA, 20 bp, mouse
gccctgccgtaaagtgaaga

SEQ ID NO: 758254 - DNA, 20 bp, mouse
ggggactgcggcggagatac

SEQ ID NO: 758255 - DNA, 20 bp, mouse
gccagcagcgtcacgtgcgg

SEQ ID NO: 758256 - DNA, 20 bp, mouse
gtgggcgggcgccaactcgt

SEQ ID NO: 758257 - DNA, 20 bp, mouse
ggcgcagcgaacgccctctg

SEQ ID NO: 758258 - DNA, 20 bp, mouse
gctaaaatactgctggggag

SEQ ID NO: 758259 - DNA, 20 bp, mouse
gcttccggcaccaacctgag

SEQ ID NO: 758260 - DNA, 20 bp, mouse
gcggaagcccacacgtctga

SEQ ID NO: 758261 - DNA, 20 bp, mouse
ggcgggctaaaatactgctg

SEQ ID NO: 758262 - DNA, 20 bp, mouse
ggaggtcccgccccatctaa

SEQ ID NO: 758263 - DNA, 20 bp, mouse
gctgtggaacacttagcatc

SEQ ID NO: 758264 - DNA, 20 bp, mouse
gccaactcgtcggagaggcg

SEQ ID NO: 758265 - DNA, 20 bp, mouse
ggaaaaagggcgtggctcca

SEQ ID NO: 758266 - DNA, 20 bp, mouse
gggacccagccctgtgtgga

SEQ ID NO: 758267 - DNA, 20 bp, mouse
gctacaggacgtgtctactc

SEQ ID NO: 758268 - DNA, 20 bp, mouse
gagaggtgatcacatgaagc

SEQ ID NO: 758269 - DNA, 20 bp, mouse
gtggaccagcataaggaact

SEQ ID NO: 758270 - DNA, 20 bp, mouse
gggatgtggggtacatgcac

SEQ ID NO: 758271 - DNA, 20 bp, mouse
gaggggttattattgggatg

SEQ ID NO: 758272 - DNA, 20 bp, mouse
gtaatcctcctatcccccca

SEQ ID NO: 758273 - DNA, 20 bp, mouse
gtgggttggaccagccatgg

SEQ ID NO: 758274 - DNA, 20 bp, mouse
gtatgcgcaccttgtctgac

SEQ ID NO: 758275 - DNA, 20 bp, mouse
gaaacagactagaaacttag

SEQ ID NO: 758276 - DNA, 20 bp, mouse
gtgcactggcacccctaaat

SEQ ID NO: 758277 - DNA, 20 bp, mouse
gcaggcgggagtctctgcac

SEQ ID NO: 758278 - DNA, 20 bp, mouse
gccttcgggcatccgattta

SEQ ID NO: 758279 - DNA, 20 bp, mouse
ggcctggagcagctactgag

SEQ ID NO: 758280 - DNA, 20 bp, mouse
gcgttcctggctgatgtcat

SEQ ID NO: 758281 - DNA, 20 bp, mouse
gtctgcaaagagttaagagc

SEQ ID NO: 758282 - DNA, 20 bp, mouse
gccgcctgggcaagcagcct

SEQ ID NO: 758283 - DNA, 20 bp, mouse
gggggcctggggaccagacg

SEQ ID NO: 758284 - DNA, 20 bp, mouse
gaggagcggtgagcggggcc

SEQ ID NO: 758285 - DNA, 20 bp, mouse
ggccaggaacgcctaggatg

SEQ ID NO: 758286 - DNA, 20 bp, mouse
gtgccccagcacagagtcgc

SEQ ID NO: 758287 - DNA, 20 bp, mouse
ggctgcctagctaggaagga

SEQ ID NO: 758288 - DNA, 20 bp, mouse
gggccccagtggctaccctg

SEQ ID NO: 758289 - DNA, 20 bp, mouse
ggtccccagggtagccactg

SEQ ID NO: 758290 - DNA, 20 bp, mouse
gccagcacagagtcgcggga

SEQ ID NO: 758291 - DNA, 20 bp, mouse
ggggcactccctggccccag

SEQ ID NO: 758292 - DNA, 20 bp, mouse
gggaggagtagacactggag

SEQ ID NO: 758293 - DNA, 20 bp, mouse
gcgccctactacactcctat

SEQ ID NO: 758294 - DNA, 20 bp, mouse
gagccaataggagtgtagta

SEQ ID NO: 758295 - DNA, 20 bp, mouse
gtgagcactgaggtcagtac

SEQ ID NO: 758296 - DNA, 20 bp, mouse
gggcctgcgtggactccggg

SEQ ID NO: 758297 - DNA, 20 bp, mouse
gagggcttctcccaccgcgg

SEQ ID NO: 758298 - DNA, 20 bp, mouse
gtgtgggcctgcgtggactc

SEQ ID NO: 758299 - DNA, 20 bp, mouse
ggggagacatcctcctccca

SEQ ID NO: 758300 - DNA, 20 bp, mouse
ggggcaggggggtgggcctc

SEQ ID NO: 758301 - DNA, 20 bp, mouse
gtccctcccggagtccacgc

SEQ ID NO: 758302 - DNA, 20 bp, mouse
gccacgcaggcccacaggcg

SEQ ID NO: 758303 - DNA, 20 bp, mouse
gaccacccccccaccgcggt

SEQ ID NO: 758304 - DNA, 20 bp, mouse
ggaggaggatgtctcccagc

SEQ ID NO: 758305 - DNA, 20 bp, mouse
gagctgggggagggcttcct

SEQ ID NO: 758306 - DNA, 20 bp, mouse
gaaaggagcagatgagacgg

SEQ ID NO: 758307 - DNA, 20 bp, mouse
gggccaggggcaggcctgca

SEQ ID NO: 758308 - DNA, 20 bp, mouse
gggcctgcccctggcccagg

SEQ ID NO: 758309 - DNA, 20 bp, mouse
gcggctcctgtgcacgggtc

SEQ ID NO: 758310 - DNA, 20 bp, mouse
gggcctcccgacccgtgcac

SEQ ID NO: 758311 - DNA, 20 bp, mouse
gccgggtaggagtaattgaa

SEQ ID NO: 758312 - DNA, 20 bp, mouse
gcaggagccgcctgggccag

SEQ ID NO: 758313 - DNA, 20 bp, mouse
gccgtgcacaggagccgcct

SEQ ID NO: 758314 - DNA, 20 bp, mouse
gtgtgcagcaacagcttaga

SEQ ID NO: 758315 - DNA, 20 bp, mouse
ggcacgggtcgggaggccgt

SEQ ID NO: 758316 - DNA, 20 bp, mouse
gccccacagccagcctttta

SEQ ID NO: 758317 - DNA, 20 bp, mouse
gctgcaggagcagtaggatt

SEQ ID NO: 758318 - DNA, 20 bp, mouse
gggaggaccgacttaaatag

SEQ ID NO: 758319 - DNA, 20 bp, mouse
gagggctagaggctggattc

SEQ ID NO: 758320 - DNA, 20 bp, mouse
gctgccttcctggccataaa

SEQ ID NO: 758321 - DNA, 20 bp, mouse
gacggcctgattaaaccaaa

SEQ ID NO: 758322 - DNA, 20 bp, mouse
ggttaatggctcaatgagta

SEQ ID NO: 758323 - DNA, 20 bp, mouse
gggccataaaaggctggctg

SEQ ID NO: 758324 - DNA, 20 bp, mouse
ggaatcttaacgccaagacg

SEQ ID NO: 758325 - DNA, 20 bp, mouse
gatatagcagcacatgggga

SEQ ID NO: 758326 - DNA, 20 bp, mouse
gagctcccgtgcactagtca

SEQ ID NO: 758327 - DNA, 20 bp, mouse
gaggaagagcagagtaccct

SEQ ID NO: 758328 - DNA, 20 bp, mouse
gaggagaagcaccagatgca

SEQ ID NO: 758329 - DNA, 20 bp, mouse
gagcagagtaccctgggacg

SEQ ID NO: 758330 - DNA, 20 bp, mouse
gactgttggtaccacgtccc

SEQ ID NO: 758331 - DNA, 20 bp, mouse
gctcctctggccataaatgg

SEQ ID NO: 758332 - DNA, 20 bp, mouse
gaggtgctatatttaggcaa

SEQ ID NO: 758333 - DNA, 20 bp, mouse
gagagccactgcatatgtca

SEQ ID NO: 758334 - DNA, 20 bp, mouse
gtgagtggggacagcttgct

SEQ ID NO: 758335 - DNA, 20 bp, mouse
gctcctccctgactagtgca

SEQ ID NO: 758336 - DNA, 20 bp, mouse
gctgggcagcagcaacaggt

SEQ ID NO: 758337 - DNA, 20 bp, mouse
gcagtctggcttggggaaag

SEQ ID NO: 758338 - DNA, 20 bp, mouse
gcagtgcggtgacaatggat

SEQ ID NO: 758339 - DNA, 20 bp, mouse
gtgagacagtgcggtgacaa

SEQ ID NO: 758340 - DNA, 20 bp, mouse
gtgggtgccccacaacggga

SEQ ID NO: 758341 - DNA, 20 bp, mouse
ggaggcatggctcttactcc

SEQ ID NO: 758342 - DNA, 20 bp, mouse
gtagcagcgctgagacagtg

SEQ ID NO: 758343 - DNA, 20 bp, mouse
gtcgggctccagtctggctt

SEQ ID NO: 758344 - DNA, 20 bp, mouse
gacccaccgcacacaaccat

SEQ ID NO: 758345 - DNA, 20 bp, mouse
gtgttctctgctatagaagt

SEQ ID NO: 758346 - DNA, 20 bp, mouse
gtagagtgagagtgaaaaag

SEQ ID NO: 758347 - DNA, 20 bp, mouse
ggaaatgggagagacgattg

SEQ ID NO: 758348 - DNA, 20 bp, mouse
gctagtgaggaagattagta

SEQ ID NO: 758349 - DNA, 20 bp, mouse
gaaactcatgtctaaaatag

SEQ ID NO: 758350 - DNA, 20 bp, mouse
gagggcatgtggagacatag

SEQ ID NO: 758351 - DNA, 20 bp, mouse
gttggtgatatttcaggagt

SEQ ID NO: 758352 - DNA, 20 bp, mouse
gcatgccagcataggtagat

SEQ ID NO: 758353 - DNA, 20 bp, mouse
gtactttgacatgccagcat

SEQ ID NO: 758354 - DNA, 20 bp, mouse
gcctgcctatctacctatgc

SEQ ID NO: 758355 - DNA, 20 bp, mouse
gaacaatatctcagatgtct

SEQ ID NO: 758356 - DNA, 20 bp, mouse
gagcctgccctctttgcctg

SEQ ID NO: 758357 - DNA, 20 bp, mouse
gctggctcagacagtctggt

SEQ ID NO: 758358 - DNA, 20 bp, mouse
gccagggatcagtcagccga

SEQ ID NO: 758359 - DNA, 20 bp, mouse
gatccctggctcagacagtc

SEQ ID NO: 758360 - DNA, 20 bp, mouse
gagagggagcagatagtggt

SEQ ID NO: 758361 - DNA, 20 bp, mouse
ggccgagagggagcagatag

SEQ ID NO: 758362 - DNA, 20 bp, mouse
gccctctttgcctgaggttc

SEQ ID NO: 758363 - DNA, 20 bp, mouse
gacagggggtactgagaccc

SEQ ID NO: 758364 - DNA, 20 bp, mouse
gaaagccctaagttgaagat

SEQ ID NO: 758365 - DNA, 20 bp, mouse
gcacccacaaatacactcat

SEQ ID NO: 758366 - DNA, 20 bp, mouse
gggagggacggggacacatt

SEQ ID NO: 758367 - DNA, 20 bp, mouse
gatcccctcgactaaggtat

SEQ ID NO: 758368 - DNA, 20 bp, mouse
gagtaggggccctggaaaga

SEQ ID NO: 758369 - DNA, 20 bp, mouse
gtggctgtggtactttccaa

SEQ ID NO: 758370 - DNA, 20 bp, mouse
gtatcccataccttagtcga

SEQ ID NO: 758371 - DNA, 20 bp, mouse
gctggcgaaagggagggacg

SEQ ID NO: 758372 - DNA, 20 bp, mouse
ggatgccagtcttctcagaa

SEQ ID NO: 758373 - DNA, 20 bp, mouse
gtttactgaacactttccgt

SEQ ID NO: 758374 - DNA, 20 bp, mouse
ggaaagtaccacagccaaaa

SEQ ID NO: 758375 - DNA, 20 bp, mouse
gttcagtaaaaacattcttc

SEQ ID NO: 758376 - DNA, 20 bp, mouse
gctggggaagacaggtgccc

SEQ ID NO: 758377 - DNA, 20 bp, mouse
gactgggctctggggaagac

SEQ ID NO: 758378 - DNA, 20 bp, mouse
gcaagcccttctgtttgcaa

SEQ ID NO: 758379 - DNA, 20 bp, mouse
gacctgagaatgctggggat

SEQ ID NO: 758380 - DNA, 20 bp, mouse
gcgggctgcaacaggagccg

SEQ ID NO: 758381 - DNA, 20 bp, mouse
gggctgaatgaagcatggac

SEQ ID NO: 758382 - DNA, 20 bp, mouse
ggccagatgcttaaagcact

SEQ ID NO: 758383 - DNA, 20 bp, mouse
gcctgttgcagcccgaaata

SEQ ID NO: 758384 - DNA, 20 bp, mouse
ggccaatccccagcattctc

SEQ ID NO: 758385 - DNA, 20 bp, mouse
ggctgcgttcgctgaagctt

SEQ ID NO: 758386 - DNA, 20 bp, mouse
gacagcacctacgggagctg

SEQ ID NO: 758387 - DNA, 20 bp, mouse
ggcggtaaatgaaattccgt

SEQ ID NO: 758388 - DNA, 20 bp, mouse
gcactgaccccagctcccgt

SEQ ID NO: 758389 - DNA, 20 bp, mouse
gcaggagaacactgagcaaa

SEQ ID NO: 758390 - DNA, 20 bp, mouse
ggagcaaagggattccattg

SEQ ID NO: 758391 - DNA, 20 bp, mouse
gcgtaggtgctgtcccgcaa

SEQ ID NO: 758392 - DNA, 20 bp, mouse
gaaacaccttgtccttctgg

SEQ ID NO: 758393 - DNA, 20 bp, mouse
ggatctccacacgcacacta

SEQ ID NO: 758394 - DNA, 20 bp, mouse
ggcgaaacattccacctgat

SEQ ID NO: 758395 - DNA, 20 bp, mouse
gggaatgtttcgcaggcaca

SEQ ID NO: 758396 - DNA, 20 bp, mouse
gtgcgcagtgctgggagaca

SEQ ID NO: 758397 - DNA, 20 bp, mouse
gcatgcgcgccgggcgaacg

SEQ ID NO: 758398 - DNA, 20 bp, mouse
gtagtcctgggtaccatcgc

SEQ ID NO: 758399 - DNA, 20 bp, mouse
gagagaacgcagctctgtca

SEQ ID NO: 758400 - DNA, 20 bp, mouse
ggcccggcgcgcatgcgtct

SEQ ID NO: 758401 - DNA, 20 bp, mouse
gcagaggagggattgggcgt

SEQ ID NO: 758402 - DNA, 20 bp, mouse
gcctgcgcagaggagggatt

SEQ ID NO: 758403 - DNA, 20 bp, mouse
gtacttcagcgctaaatgtg

SEQ ID NO: 758404 - DNA, 20 bp, mouse
gagcgctgaagtaggttccc

SEQ ID NO: 758405 - DNA, 20 bp, mouse
gcccacccacgcagttgtca

SEQ ID NO: 758406 - DNA, 20 bp, mouse
ggggtgccgcgtcgtctgca

SEQ ID NO: 758407 - DNA, 20 bp, mouse
ggcgccccctgcagacgacg

SEQ ID NO: 758408 - DNA, 20 bp, mouse
gacgcccagagccgcaacct

SEQ ID NO: 758409 - DNA, 20 bp, mouse
gttaaggcaaggcagtaccc

SEQ ID NO: 758410 - DNA, 20 bp, mouse
gtaccgccagagggcgctga

SEQ ID NO: 758411 - DNA, 20 bp, mouse
gcgacgcggcggtggtgtcc

SEQ ID NO: 758412 - DNA, 20 bp, mouse
gaggagctatctctgagatc

SEQ ID NO: 758413 - DNA, 20 bp, mouse
gaccctgctacccgaggttg

SEQ ID NO: 758414 - DNA, 20 bp, mouse
ggcaggcggaggccgggcta

SEQ ID NO: 758415 - DNA, 20 bp, mouse
ggctctgggcgtaccgccag

SEQ ID NO: 758416 - DNA, 20 bp, mouse
ggactagatctgcttaatga

SEQ ID NO: 758417 - DNA, 20 bp, mouse
gtagatctgcttaatgaagg

SEQ ID NO: 758418 - DNA, 20 bp, mouse
ggaagagccttatctcttat

SEQ ID NO: 758419 - DNA, 20 bp, mouse
ggtcgtctaagtgtgtactg

SEQ ID NO: 758420 - DNA, 20 bp, mouse
gtggtggtggccaaaaagac

SEQ ID NO: 758421 - DNA, 20 bp, mouse
gcatgtatcaccaaggacaa

SEQ ID NO: 758422 - DNA, 20 bp, mouse
gaaagactgggttattttaa

SEQ ID NO: 758423 - DNA, 20 bp, mouse
gaaagaacctataagagata

SEQ ID NO: 758424 - DNA, 20 bp, mouse
gtccttaaaacaaagcccac

SEQ ID NO: 758425 - DNA, 20 bp, mouse
gtcaatataatcggttttgg

SEQ ID NO: 758426 - DNA, 20 bp, mouse
gagctcgcgaggaacccgcg

SEQ ID NO: 758427 - DNA, 20 bp, mouse
gaacccgcggggtaggcggc

SEQ ID NO: 758428 - DNA, 20 bp, mouse
gcgccccgggcgcctgtgat

SEQ ID NO: 758429 - DNA, 20 bp, mouse
gcgcgcacccgggtcgttgc

SEQ ID NO: 758430 - DNA, 20 bp, mouse
gccgcagcccgcaacgaccc

SEQ ID NO: 758431 - DNA, 20 bp, mouse
gcaccggccgcctaccccgc

SEQ ID NO: 758432 - DNA, 20 bp, mouse
ggggtaggcggccggtgtcc

SEQ ID NO: 758433 - DNA, 20 bp, mouse
gcccgctgaccgccaatcac

SEQ ID NO: 758434 - DNA, 20 bp, mouse
gggttcctcgcgagctcccc

SEQ ID NO: 758435 - DNA, 20 bp, mouse
ggggtggcacgcgccgggag

SEQ ID NO: 758436 - DNA, 20 bp, mouse
ggcttccccaaggaccgcat

SEQ ID NO: 758437 - DNA, 20 bp, mouse
gttgtggcatccattgtctc

SEQ ID NO: 758438 - DNA, 20 bp, mouse
gttggcgtggcgcacttccg

SEQ ID NO: 758439 - DNA, 20 bp, mouse
gagaagtgagataacccatg

SEQ ID NO: 758440 - DNA, 20 bp, mouse
gaactccggcgagtaagacc

SEQ ID NO: 758441 - DNA, 20 bp, mouse
gataacccatgcggtccttg

SEQ ID NO: 758442 - DNA, 20 bp, mouse
gagatcccgcgagatgcggc

SEQ ID NO: 758443 - DNA, 20 bp, mouse
ggcgcacttccggggaactc

SEQ ID NO: 758444 - DNA, 20 bp, mouse
gccgccccgccgcatctcgc

SEQ ID NO: 758445 - DNA, 20 bp, mouse
gcttctctcacgtcttacgt

SEQ ID NO: 758446 - DNA, 20 bp, mouse
gttgggcacatttgttggtg

SEQ ID NO: 758447 - DNA, 20 bp, mouse
ggaggctcagaacagtaaac

SEQ ID NO: 758448 - DNA, 20 bp, mouse
gagaggggagtgagcatggt

SEQ ID NO: 758449 - DNA, 20 bp, mouse
gaccggaatgacagatgccc

SEQ ID NO: 758450 - DNA, 20 bp, mouse
gccagagccatgctaaccca

SEQ ID NO: 758451 - DNA, 20 bp, mouse
ggatatatttaggcagattt

SEQ ID NO: 758452 - DNA, 20 bp, mouse
ggcacctctcaccttcaact

SEQ ID NO: 758453 - DNA, 20 bp, mouse
gattgattatagatatattt

SEQ ID NO: 758454 - DNA, 20 bp, mouse
gcgctgctattaggaattat

SEQ ID NO: 758455 - DNA, 20 bp, mouse
ggatggatctgccaagttga

SEQ ID NO: 758456 - DNA, 20 bp, mouse
gcccacccctggacattaag

SEQ ID NO: 758457 - DNA, 20 bp, mouse
gagtggagctgcgtgcatta

SEQ ID NO: 758458 - DNA, 20 bp, mouse
gaacagaaggtcatatgccg

SEQ ID NO: 758459 - DNA, 20 bp, mouse
gtctatgaggccatctgttg

SEQ ID NO: 758460 - DNA, 20 bp, mouse
gaggtcatatgccggggatt

SEQ ID NO: 758461 - DNA, 20 bp, mouse
ggaggtaaagcagatctctt

SEQ ID NO: 758462 - DNA, 20 bp, mouse
gcatacctggtaactagctg

SEQ ID NO: 758463 - DNA, 20 bp, mouse
gaccaccccagctagttacc

SEQ ID NO: 758464 - DNA, 20 bp, mouse
gataagctcactgcataata

SEQ ID NO: 758465 - DNA, 20 bp, mouse
gaatgtccaggggtggggtt

SEQ ID NO: 758466 - DNA, 20 bp, mouse
gtggacagggagatacagag

SEQ ID NO: 758467 - DNA, 20 bp, mouse
ggtgtgcaggaagactggac

SEQ ID NO: 758468 - DNA, 20 bp, mouse
gagaggagacgctcaacttt

SEQ ID NO: 758469 - DNA, 20 bp, mouse
gacagtgtgtgcaggaagac

SEQ ID NO: 758470 - DNA, 20 bp, mouse
gtcgtgaggccaaaaggaca

SEQ ID NO: 758471 - DNA, 20 bp, mouse
gcctgcacacactgtgggtc

SEQ ID NO: 758472 - DNA, 20 bp, mouse
gagggtcccagtagtccttg

SEQ ID NO: 758473 - DNA, 20 bp, mouse
gggtgcaaatctgtgaggac

SEQ ID NO: 758474 - DNA, 20 bp, mouse
gctcctgggctccagccctg

SEQ ID NO: 758475 - DNA, 20 bp, mouse
gctggggtcgtgaggccaaa

SEQ ID NO: 758476 - DNA, 20 bp, mouse
ggcctcgcggaaagggaaga

SEQ ID NO: 758477 - DNA, 20 bp, mouse
ggccacgcatgcaggggacc

SEQ ID NO: 758478 - DNA, 20 bp, mouse
gctccagggcctcgcggaaa

SEQ ID NO: 758479 - DNA, 20 bp, mouse
gtgcatgcgtggcgtctcca

SEQ ID NO: 758480 - DNA, 20 bp, mouse
gcctgaccgaacatcctgtg

SEQ ID NO: 758481 - DNA, 20 bp, mouse
gcccacaggtcacagtctcc

SEQ ID NO: 758482 - DNA, 20 bp, mouse
gtgtgacctgagccagcggt

SEQ ID NO: 758483 - DNA, 20 bp, mouse
gaccggccacctcaccccac

SEQ ID NO: 758484 - DNA, 20 bp, mouse
gactatgtgctcttcatcag

SEQ ID NO: 758485 - DNA, 20 bp, mouse
gggaaagggcaccctaggat

SEQ ID NO: 758486 - DNA, 20 bp, mouse
gtagccccatacagagtcgg

SEQ ID NO: 758487 - DNA, 20 bp, mouse
gtcctagtgagagcggtgat

SEQ ID NO: 758488 - DNA, 20 bp, mouse
ggtaactaagggaccaaacc

SEQ ID NO: 758489 - DNA, 20 bp, mouse
gtgcgcaaacgcagcaccac

SEQ ID NO: 758490 - DNA, 20 bp, mouse
ggtggcgaagccaaggggaa

SEQ ID NO: 758491 - DNA, 20 bp, mouse
gaggagtgagcgggactcca

SEQ ID NO: 758492 - DNA, 20 bp, mouse
gtcgaaaaagagcgtccgct

SEQ ID NO: 758493 - DNA, 20 bp, mouse
ggcgtccgctgggctacctg

SEQ ID NO: 758494 - DNA, 20 bp, mouse
gccaaacctggtggtatcct

SEQ ID NO: 758495 - DNA, 20 bp, mouse
gcgggactccatggtaacta

SEQ ID NO: 758496 - DNA, 20 bp, mouse
gagaacgtacctacactcgt

SEQ ID NO: 758497 - DNA, 20 bp, mouse
gagctcgcctaggtgtgaag

SEQ ID NO: 758498 - DNA, 20 bp, mouse
gccagccaatggcgtcgagg

SEQ ID NO: 758499 - DNA, 20 bp, mouse
gagggcgcctggacactgaa

SEQ ID NO: 758500 - DNA, 20 bp, mouse
gctcggcgctcggcgcgagg

SEQ ID NO: 758501 - DNA, 20 bp, mouse
ggagctcacaggtacgtctg

SEQ ID NO: 758502 - DNA, 20 bp, mouse
gaatcaacgcggtccggcgt

SEQ ID NO: 758503 - DNA, 20 bp, mouse
ggacggcggtgggacgcgat

SEQ ID NO: 758504 - DNA, 20 bp, mouse
gcgtgctctccggccaacca

SEQ ID NO: 758505 - DNA, 20 bp, mouse
gccgtccgcgaaccagccaa

SEQ ID NO: 758506 - DNA, 20 bp, mouse
ggggttgtgtgtctggatag

SEQ ID NO: 758507 - DNA, 20 bp, mouse
gagtgcctacacagtgaaag

SEQ ID NO: 758508 - DNA, 20 bp, mouse
gtgcaggcgcttttcccggg

SEQ ID NO: 758509 - DNA, 20 bp, mouse
gaggccacacccctgcctac

SEQ ID NO: 758510 - DNA, 20 bp, mouse
gccctgcctactgggaaaag

SEQ ID NO: 758511 - DNA, 20 bp, mouse
gtcgggaaagagtggaccgg

SEQ ID NO: 758512 - DNA, 20 bp, mouse
gccgatggcagtgacaatca

SEQ ID NO: 758513 - DNA, 20 bp, mouse
gcgtcatcaagctgcgcgtc

SEQ ID NO: 758514 - DNA, 20 bp, mouse
gttgagccgcttttcccagt

SEQ ID NO: 758515 - DNA, 20 bp, mouse
gagaactgcaaatgtttggc

SEQ ID NO: 758516 - DNA, 20 bp, mouse
gcggaccgcgcctgaggctc

SEQ ID NO: 758517 - DNA, 20 bp, mouse
gaccgcgcctgaggctccgg

SEQ ID NO: 758518 - DNA, 20 bp, mouse
ggcggcgcgcgcccacgggc

SEQ ID NO: 758519 - DNA, 20 bp, mouse
gtggggcgcggtgggagcgc

SEQ ID NO: 758520 - DNA, 20 bp, mouse
gcgcgcgccgccccaccctc

SEQ ID NO: 758521 - DNA, 20 bp, mouse
ggcgccctcggccggcccgt

SEQ ID NO: 758522 - DNA, 20 bp, mouse
gcgccccgggagctggcccc

SEQ ID NO: 758523 - DNA, 20 bp, mouse
ggctgcgcggaccgcgcctg

SEQ ID NO: 758524 - DNA, 20 bp, mouse
gccgacccggggccagctcc

SEQ ID NO: 758525 - DNA, 20 bp, mouse
gcccctgcagcgccgacccg

SEQ ID NO: 758526 - DNA, 20 bp, mouse
ggggcggccatatttgataa

SEQ ID NO: 758527 - DNA, 20 bp, mouse
gtcgcgaagggtgcgttggt

SEQ ID NO: 758528 - DNA, 20 bp, mouse
gactgtcatcccactggggt

SEQ ID NO: 758529 - DNA, 20 bp, mouse
gagggtgcgttggtaggctg

SEQ ID NO: 758530 - DNA, 20 bp, mouse
gtcggcaggcgaggcctggg

SEQ ID NO: 758531 - DNA, 20 bp, mouse
gccttctactagatgcccaa

SEQ ID NO: 758532 - DNA, 20 bp, mouse
gctgtcaccatgttgaccgt

SEQ ID NO: 758533 - DNA, 20 bp, mouse
ggggcaagcgtcggcaggcg

SEQ ID NO: 758534 - DNA, 20 bp, mouse
gtcaacatggtgacagcgtg

SEQ ID NO: 758535 - DNA, 20 bp, mouse
ggggcggcgagtttccacaa

SEQ ID NO: 758536 - DNA, 20 bp, mouse
gcggggaagagcagccgcgc

SEQ ID NO: 758537 - DNA, 20 bp, mouse
gggtctcgcggccgccgcaa

SEQ ID NO: 758538 - DNA, 20 bp, mouse
gcccacccgccctctcgcgg

SEQ ID NO: 758539 - DNA, 20 bp, mouse
gggtgggcggccgcgtgggg

SEQ ID NO: 758540 - DNA, 20 bp, mouse
gtacgtggcagccattgcgg

SEQ ID NO: 758541 - DNA, 20 bp, mouse
ggcaggagcccgccgcgaga

SEQ ID NO: 758542 - DNA, 20 bp, mouse
gggcgggtgggcggccgcgt

SEQ ID NO: 758543 - DNA, 20 bp, mouse
ggacccgagcccaccggtgc

SEQ ID NO: 758544 - DNA, 20 bp, mouse
gcccgcgcccgccacggcgc

SEQ ID NO: 758545 - DNA, 20 bp, mouse
gccgcccacccgccctctcg

SEQ ID NO: 758546 - DNA, 20 bp, mouse
gtgacagcccggggaagcgt

SEQ ID NO: 758547 - DNA, 20 bp, mouse
ggaagggctgcggaaggcgg

SEQ ID NO: 758548 - DNA, 20 bp, mouse
gccggggagtctgacagccc

SEQ ID NO: 758549 - DNA, 20 bp, mouse
gcctggccccggggacacag

SEQ ID NO: 758550 - DNA, 20 bp, mouse
ggcgtcacccacgcttcccc

SEQ ID NO: 758551 - DNA, 20 bp, mouse
gcagcccttcccaagggaag

SEQ ID NO: 758552 - DNA, 20 bp, mouse
gcggccatgtgatagatgga

SEQ ID NO: 758553 - DNA, 20 bp, mouse
gcaggccccttcccttggga

SEQ ID NO: 758554 - DNA, 20 bp, mouse
gtgaggccccggcgctgccg

SEQ ID NO: 758555 - DNA, 20 bp, mouse
gttcgcggggccggggagga

SEQ ID NO: 758556 - DNA, 20 bp, mouse
gaacaagactgagtctacgt

SEQ ID NO: 758557 - DNA, 20 bp, mouse
gggctcacgcccggcattat

SEQ ID NO: 758558 - DNA, 20 bp, mouse
gaaggcagcgacgtcctctg

SEQ ID NO: 758559 - DNA, 20 bp, mouse
gtgagcccgcggtgctgcat

SEQ ID NO: 758560 - DNA, 20 bp, mouse
ggctgcatgggtaatcctag

SEQ ID NO: 758561 - DNA, 20 bp, mouse
ggaaacttccccccactaca

SEQ ID NO: 758562 - DNA, 20 bp, mouse
gtaagtcttgcaatggactc

SEQ ID NO: 758563 - DNA, 20 bp, mouse
gacagagcgatgggtcccgg

SEQ ID NO: 758564 - DNA, 20 bp, mouse
ggttccccgccctgtagtgg

SEQ ID NO: 758565 - DNA, 20 bp, mouse
gattacccatgcagcaccgc

SEQ ID NO: 758566 - DNA, 20 bp, mouse
gcggggctcaggtcgctcgg

SEQ ID NO: 758567 - DNA, 20 bp, mouse
gagcgaacgagcacgcatcg

SEQ ID NO: 758568 - DNA, 20 bp, mouse
ggtggccgctgcaccatgcg

SEQ ID NO: 758569 - DNA, 20 bp, mouse
ggcgaggcccgagttggagg

SEQ ID NO: 758570 - DNA, 20 bp, mouse
gcagcccggcccccggatgt

SEQ ID NO: 758571 - DNA, 20 bp, mouse
gcgggcgaggcccgagttgg

SEQ ID NO: 758572 - DNA, 20 bp, mouse
ggaacgagcacgcatcgcgg

SEQ ID NO: 758573 - DNA, 20 bp, mouse
ggcgctctagagcctcgtcc

SEQ ID NO: 758574 - DNA, 20 bp, mouse
gctagccgcgcatggtgcag

SEQ ID NO: 758575 - DNA, 20 bp, mouse
gtagagcctcgtccgggctg

SEQ ID NO: 758576 - DNA, 20 bp, mouse
gactgacgatgctcaatatt

SEQ ID NO: 758577 - DNA, 20 bp, mouse
gttggggtgaaagagcttgt

SEQ ID NO: 758578 - DNA, 20 bp, mouse
gaacttgtgcttacttttat

SEQ ID NO: 758579 - DNA, 20 bp, mouse
gagttgaaaacggatgttag

SEQ ID NO: 758580 - DNA, 20 bp, mouse
gttacactgggtggcgtttg

SEQ ID NO: 758581 - DNA, 20 bp, mouse
gcgtcagttattttgtacta

SEQ ID NO: 758582 - DNA, 20 bp, mouse
gtgcgcttttgtcttacact

SEQ ID NO: 758583 - DNA, 20 bp, mouse
ggctgggactataaaagctg

SEQ ID NO: 758584 - DNA, 20 bp, mouse
gaagagcttgttgggctctc

SEQ ID NO: 758585 - DNA, 20 bp, mouse
gtgaaattatagtttgggct

SEQ ID NO: 758586 - DNA, 20 bp, mouse
ggtcccgcccagtcagcttc

SEQ ID NO: 758587 - DNA, 20 bp, mouse
ggggacctccgcgtttgcgc

SEQ ID NO: 758588 - DNA, 20 bp, mouse
gggcgggactagacgctcat

SEQ ID NO: 758589 - DNA, 20 bp, mouse
gctggtgcagaccagacggt

SEQ ID NO: 758590 - DNA, 20 bp, mouse
gtgcaccagcgcaaacgcgg

SEQ ID NO: 758591 - DNA, 20 bp, mouse
gccaggttttaattaggttg

SEQ ID NO: 758592 - DNA, 20 bp, mouse
gtagaagccggaagctgact

SEQ ID NO: 758593 - DNA, 20 bp, mouse
gcttccggcttctacaaccc

SEQ ID NO: 758594 - DNA, 20 bp, mouse
gggagcattagttttgatta

SEQ ID NO: 758595 - DNA, 20 bp, mouse
gctcattggctcccaccgtc

SEQ ID NO: 758596 - DNA, 20 bp, mouse
gggctcaaggcgttggagta

SEQ ID NO: 758597 - DNA, 20 bp, mouse
ggcttcaaacgcaccacctt

SEQ ID NO: 758598 - DNA, 20 bp, mouse
gacagcgggcgaggagtcga

SEQ ID NO: 758599 - DNA, 20 bp, mouse
ggtggcacttagagataatt

SEQ ID NO: 758600 - DNA, 20 bp, mouse
ggaacggggcgagactgtag

SEQ ID NO: 758601 - DNA, 20 bp, mouse
ggagaatgaaccccggggta

SEQ ID NO: 758602 - DNA, 20 bp, mouse
gcacacaagcatgtggaaca

SEQ ID NO: 758603 - DNA, 20 bp, mouse
gtggttgtgcagttcggagg

SEQ ID NO: 758604 - DNA, 20 bp, mouse
gggactggggccaggatcct

SEQ ID NO: 758605 - DNA, 20 bp, mouse
gccgctgtctctacccatga

SEQ ID NO: 758606 - DNA, 20 bp, mouse
gagaggagctgagtccttct

SEQ ID NO: 758607 - DNA, 20 bp, mouse
gcctacgggcggaaggggcg

SEQ ID NO: 758608 - DNA, 20 bp, mouse
gcccaaatgtgaacatactg

SEQ ID NO: 758609 - DNA, 20 bp, mouse
ggagtccttctcggtttaaa

SEQ ID NO: 758610 - DNA, 20 bp, mouse
ggaaggcctacgggcggaag

SEQ ID NO: 758611 - DNA, 20 bp, mouse
gtgtgcagtggtacatgtgc

SEQ ID NO: 758612 - DNA, 20 bp, mouse
gacaggaagcctcacgggct

SEQ ID NO: 758613 - DNA, 20 bp, mouse
gcatactgaggcctgagaac

SEQ ID NO: 758614 - DNA, 20 bp, mouse
gaaaactgagtccaaataga

SEQ ID NO: 758615 - DNA, 20 bp, mouse
gctgagaacaggaagcctca

SEQ ID NO: 758616 - DNA, 20 bp, mouse
ggagccgcggatttcagagt

SEQ ID NO: 758617 - DNA, 20 bp, mouse
gcctcccaggcacacggcac

SEQ ID NO: 758618 - DNA, 20 bp, mouse
ggcggcggcggaagcgtcat

SEQ ID NO: 758619 - DNA, 20 bp, mouse
ggcaggctccggtgcatcga

SEQ ID NO: 758620 - DNA, 20 bp, mouse
gcggcctccgcgttcccggc

SEQ ID NO: 758621 - DNA, 20 bp, mouse
gcacacggcactggcaggac

SEQ ID NO: 758622 - DNA, 20 bp, mouse
ggcggcggaagcgtcattgg

SEQ ID NO: 758623 - DNA, 20 bp, mouse
gggctccggtgcatcgaggg

SEQ ID NO: 758624 - DNA, 20 bp, mouse
ggagcctgccgggaacgcgg

SEQ ID NO: 758625 - DNA, 20 bp, mouse
gcgtcattggcggccctccc

SEQ ID NO: 758626 - DNA, 20 bp, mouse
gcaccgacccggagacctcc

SEQ ID NO: 758627 - DNA, 20 bp, mouse
gaggtctccgggtcggtgca

SEQ ID NO: 758628 - DNA, 20 bp, mouse
gacgaacagtccagagatta

SEQ ID NO: 758629 - DNA, 20 bp, mouse
gaagcccgcgcgcgccaaga

SEQ ID NO: 758630 - DNA, 20 bp, mouse
gttctcacccgggaggtctc

SEQ ID NO: 758631 - DNA, 20 bp, mouse
gtaggcgcttaagacgtgac

SEQ ID NO: 758632 - DNA, 20 bp, mouse
ggtgcgcatgcgcagtctcg

SEQ ID NO: 758633 - DNA, 20 bp, mouse
gtagactcttctcacccggg

SEQ ID NO: 758634 - DNA, 20 bp, mouse
gttagggcgagtaaatgact

SEQ ID NO: 758635 - DNA, 20 bp, mouse
gacccgggaggtctccgggt

SEQ ID NO: 758636 - DNA, 20 bp, mouse
gcccgcggccgccatggggt

SEQ ID NO: 758637 - DNA, 20 bp, mouse
ggcgtcgtagctctctctgg

SEQ ID NO: 758638 - DNA, 20 bp, mouse
gtgcggggcgcggatcatta

SEQ ID NO: 758639 - DNA, 20 bp, mouse
gggaaagggtctgcggggcg

SEQ ID NO: 758640 - DNA, 20 bp, mouse
ggccctgagccatcctttta

SEQ ID NO: 758641 - DNA, 20 bp, mouse
gagtaggcagagtagtaaca

SEQ ID NO: 758642 - DNA, 20 bp, mouse
ggtagcgtcgtagctctctc

SEQ ID NO: 758643 - DNA, 20 bp, mouse
gcatccctggttcatgacag

SEQ ID NO: 758644 - DNA, 20 bp, mouse
gttaggaagtgatccctaaa

SEQ ID NO: 758645 - DNA, 20 bp, mouse
gatgcttcacagggtgagtt

SEQ ID NO: 758646 - DNA, 20 bp, mouse
gaccccaggggcggttgttg

SEQ ID NO: 758647 - DNA, 20 bp, mouse
gtgcgcctgcgtagaaaggg

SEQ ID NO: 758648 - DNA, 20 bp, mouse
ggacctatcgcgatagtgga

SEQ ID NO: 758649 - DNA, 20 bp, mouse
gggagtgcgcctgcgtagaa

SEQ ID NO: 758650 - DNA, 20 bp, mouse
gtatcgcgatagtggagggg

SEQ ID NO: 758651 - DNA, 20 bp, mouse
ggggcggttgttgtggttga

SEQ ID NO: 758652 - DNA, 20 bp, mouse
gtagtggaggggaggtacgg

SEQ ID NO: 758653 - DNA, 20 bp, mouse
gaaaccacagcgccaattaa

SEQ ID NO: 758654 - DNA, 20 bp, mouse
gtcagggaacgggtggagga

SEQ ID NO: 758655 - DNA, 20 bp, mouse
gcggagtcatcgggacccca

SEQ ID NO: 758656 - DNA, 20 bp, mouse
gggcccgaggtgtctccgga

SEQ ID NO: 758657 - DNA, 20 bp, mouse
ggctgccgggccagaaaagg

SEQ ID NO: 758658 - DNA, 20 bp, mouse
ggcggggcccgaggtgtctc

SEQ ID NO: 758659 - DNA, 20 bp, mouse
gccagaaaagggggcgtgga

SEQ ID NO: 758660 - DNA, 20 bp, mouse
gcgggtgagaggctcggcag

SEQ ID NO: 758661 - DNA, 20 bp, mouse
gcagcctccccgggtgggca

SEQ ID NO: 758662 - DNA, 20 bp, mouse
gtctccggagggcttccggg

SEQ ID NO: 758663 - DNA, 20 bp, mouse
gagccctccggagacacctc

SEQ ID NO: 758664 - DNA, 20 bp, mouse
gccggctgccgggccagaaa

SEQ ID NO: 758665 - DNA, 20 bp, mouse
gagggaggtgacctgtgcag

SEQ ID NO: 758666 - DNA, 20 bp, mouse
gcggcggcctaggtgaggga

SEQ ID NO: 758667 - DNA, 20 bp, mouse
gtaggccgccgcatccgggt

SEQ ID NO: 758668 - DNA, 20 bp, mouse
gcgcgcctacccggatgcgg

SEQ ID NO: 758669 - DNA, 20 bp, mouse
gggagcctggagtgcttcct

SEQ ID NO: 758670 - DNA, 20 bp, mouse
gcggccggaggggaggaaaa

SEQ ID NO: 758671 - DNA, 20 bp, mouse
gaggggaggaaaatggtgca

SEQ ID NO: 758672 - DNA, 20 bp, mouse
ggggaggggtagggcttccg

SEQ ID NO: 758673 - DNA, 20 bp, mouse
gcccacggccgggtctcggc

SEQ ID NO: 758674 - DNA, 20 bp, mouse
gtgcgcggagtcccgaaagt

SEQ ID NO: 758675 - DNA, 20 bp, mouse
ggcgcatcctctcttctcgc

SEQ ID NO: 758676 - DNA, 20 bp, mouse
gccgggcggggctgactagt

SEQ ID NO: 758677 - DNA, 20 bp, mouse
gcgagcgccgcccagaagcc

SEQ ID NO: 758678 - DNA, 20 bp, mouse
ggaaggaggctctagcggac

SEQ ID NO: 758679 - DNA, 20 bp, mouse
gcgctcgcacgccgagacca

SEQ ID NO: 758680 - DNA, 20 bp, mouse
gggacaggcagtttatggag

SEQ ID NO: 758681 - DNA, 20 bp, mouse
gacactgtggtagttactaa

SEQ ID NO: 758682 - DNA, 20 bp, mouse
gcctgtccccgccttggtct

SEQ ID NO: 758683 - DNA, 20 bp, mouse
ggcctcagcggcgacgaatc

SEQ ID NO: 758684 - DNA, 20 bp, mouse
gcgcacgccgagaccaaggc

SEQ ID NO: 758685 - DNA, 20 bp, mouse
gggaaaggagccggccaaac

SEQ ID NO: 758686 - DNA, 20 bp, mouse
gcgaaggcgcgcaggtggaa

SEQ ID NO: 758687 - DNA, 20 bp, mouse
gcgcccaccaagtggctccg

SEQ ID NO: 758688 - DNA, 20 bp, mouse
gcgcaccaccgcccaccaag

SEQ ID NO: 758689 - DNA, 20 bp, mouse
gtgcctgcgcgcctcagcga

SEQ ID NO: 758690 - DNA, 20 bp, mouse
gtacagacgcggaccgtcga

SEQ ID NO: 758691 - DNA, 20 bp, mouse
gagaaccggaccagagtggg

SEQ ID NO: 758692 - DNA, 20 bp, mouse
gcggtccgcgtctgtaacta

SEQ ID NO: 758693 - DNA, 20 bp, mouse
gcgcagaaccggaccagagt

SEQ ID NO: 758694 - DNA, 20 bp, mouse
gcgccggcgcggggccctct

SEQ ID NO: 758695 - DNA, 20 bp, mouse
gagcctcggagccacttggt

SEQ ID NO: 758696 - DNA, 20 bp, mouse
gcccctagagagtgtcgcaa

SEQ ID NO: 758697 - DNA, 20 bp, mouse
gggggggcggggaatcctgg

SEQ ID NO: 758698 - DNA, 20 bp, mouse
gaggcccggcccctggagag

SEQ ID NO: 758699 - DNA, 20 bp, mouse
gccggcccctggagagcggg

SEQ ID NO: 758700 - DNA, 20 bp, mouse
ggcgccggcgcgttgagggg

SEQ ID NO: 758701 - DNA, 20 bp, mouse
ggccgcgccggcgcgttgag

SEQ ID NO: 758702 - DNA, 20 bp, mouse
gagagagtgtcgcaaagggt

SEQ ID NO: 758703 - DNA, 20 bp, mouse
gcgacactctctaggggatc

SEQ ID NO: 758704 - DNA, 20 bp, mouse
gtgcacgtgtggaggagcgg

SEQ ID NO: 758705 - DNA, 20 bp, mouse
gtggagggctagaaaggaat

SEQ ID NO: 758706 - DNA, 20 bp, mouse
ggccctcactgcagatggag

SEQ ID NO: 758707 - DNA, 20 bp, mouse
gctaacgactgtgcggggaa

SEQ ID NO: 758708 - DNA, 20 bp, mouse
gaagagctgtggtcactcct

SEQ ID NO: 758709 - DNA, 20 bp, mouse
gagtgaccacagctcttgcc

SEQ ID NO: 758710 - DNA, 20 bp, mouse
ggggggaaagctaaagagtg

SEQ ID NO: 758711 - DNA, 20 bp, mouse
gtgttcctctacaccaaccc

SEQ ID NO: 758712 - DNA, 20 bp, mouse
gggagctgagtgacgagaga

SEQ ID NO: 758713 - DNA, 20 bp, mouse
gagtgacgagagacggctag

SEQ ID NO: 758714 - DNA, 20 bp, mouse
gcgtcactcagctcctgggt

SEQ ID NO: 758715 - DNA, 20 bp, mouse
gtactcgtggcaaatagcac

SEQ ID NO: 758716 - DNA, 20 bp, mouse
gacaccgcctcctgccccag

SEQ ID NO: 758717 - DNA, 20 bp, mouse
gagtctagggggttcgggtg

SEQ ID NO: 758718 - DNA, 20 bp, mouse
ggatagaagtatagtctagg

SEQ ID NO: 758719 - DNA, 20 bp, mouse
gctgtgtaaaaggccgggag

SEQ ID NO: 758720 - DNA, 20 bp, mouse
gtatcacatctctgtgtaaa

SEQ ID NO: 758721 - DNA, 20 bp, mouse
gcaggatcgggtgtggtctt

SEQ ID NO: 758722 - DNA, 20 bp, mouse
gggaggcggtgtcagtgctt

SEQ ID NO: 758723 - DNA, 20 bp, mouse
gttaatcccgctggggcagg

SEQ ID NO: 758724 - DNA, 20 bp, mouse
gaagcaggcttaatcccgct

SEQ ID NO: 758725 - DNA, 20 bp, mouse
gaaacaatgcttacgagtct

SEQ ID NO: 758726 - DNA, 20 bp, mouse
ggatgtgagcgggtatctat

SEQ ID NO: 758727 - DNA, 20 bp, mouse
ggaagcagcctgctcccccg

SEQ ID NO: 758728 - DNA, 20 bp, mouse
gtctgcctgcagtggaaggc

SEQ ID NO: 758729 - DNA, 20 bp, mouse
gcgggatgggagtaggattg

SEQ ID NO: 758730 - DNA, 20 bp, mouse
ggtggtgttgggatgagatg

SEQ ID NO: 758731 - DNA, 20 bp, mouse
gtgggatttggggtcgggat

SEQ ID NO: 758732 - DNA, 20 bp, mouse
ggtcaactgcatctcaagaa

SEQ ID NO: 758733 - DNA, 20 bp, mouse
gtctattggaacagagaatc

SEQ ID NO: 758734 - DNA, 20 bp, mouse
gactatcccctgatgtgagc

SEQ ID NO: 758735 - DNA, 20 bp, mouse
gagatacccgctcacatcag

SEQ ID NO: 758736 - DNA, 20 bp, mouse
ggggacacactgccggcaaa

SEQ ID NO: 758737 - DNA, 20 bp, mouse
gtcagcagggagtggacacc

SEQ ID NO: 758738 - DNA, 20 bp, mouse
gaagggggtggtccattcca

SEQ ID NO: 758739 - DNA, 20 bp, mouse
gacactgccggcaaaggggg

SEQ ID NO: 758740 - DNA, 20 bp, mouse
gaatggaccaccccctttgc

SEQ ID NO: 758741 - DNA, 20 bp, mouse
gacctgctgggtcctcactg

SEQ ID NO: 758742 - DNA, 20 bp, mouse
ggccagcaagataacagtca

SEQ ID NO: 758743 - DNA, 20 bp, mouse
gttggttaaccattactcat

SEQ ID NO: 758744 - DNA, 20 bp, mouse
gcaggtaacggtgctcacag

SEQ ID NO: 758745 - DNA, 20 bp, mouse
gaaaagccaggacatcctgc

SEQ ID NO: 758746 - DNA, 20 bp, mouse
ggccccgcgcgctgtcacat

SEQ ID NO: 758747 - DNA, 20 bp, mouse
ggcggcgaatggagcaagag

SEQ ID NO: 758748 - DNA, 20 bp, mouse
gcgcgcgcgcgggtcggagg

SEQ ID NO: 758749 - DNA, 20 bp, mouse
gcccccgcgcccatcgaggg

SEQ ID NO: 758750 - DNA, 20 bp, mouse
gacgcccccgcgcccatcga

SEQ ID NO: 758751 - DNA, 20 bp, mouse
gcgggcccgcccaggaggga

SEQ ID NO: 758752 - DNA, 20 bp, mouse
gtcactcggccgcgcgtggg

SEQ ID NO: 758753 - DNA, 20 bp, mouse
gggcgctcgctcggtcgcgc

SEQ ID NO: 758754 - DNA, 20 bp, mouse
ggtgacgcagatcccggcgt

SEQ ID NO: 758755 - DNA, 20 bp, mouse
gcgggagccggagcggcgaa

SEQ ID NO: 758756 - DNA, 20 bp, mouse
gagggcgtgggcagaaccgg

SEQ ID NO: 758757 - DNA, 20 bp, mouse
ggagcggggactcaggaatc

SEQ ID NO: 758758 - DNA, 20 bp, mouse
gggcgctcacgtgggtacgt

SEQ ID NO: 758759 - DNA, 20 bp, mouse
ggggtacgtgggcgcagaga

SEQ ID NO: 758760 - DNA, 20 bp, mouse
gaggaatcgggcgctgagtt

SEQ ID NO: 758761 - DNA, 20 bp, mouse
ggggctgggaccggaggcgg

SEQ ID NO: 758762 - DNA, 20 bp, mouse
gctccctgtgcgtcctgcgg

SEQ ID NO: 758763 - DNA, 20 bp, mouse
gccgaggccgagctgtggaa

SEQ ID NO: 758764 - DNA, 20 bp, mouse
gctcccccgcaggacgcaca

SEQ ID NO: 758765 - DNA, 20 bp, mouse
gaggcggtgggtgggagccc

SEQ ID NO: 758766 - DNA, 20 bp, mouse
ggacagtaggggaggatcca

SEQ ID NO: 758767 - DNA, 20 bp, mouse
gaagacgtggagcgaccagc

SEQ ID NO: 758768 - DNA, 20 bp, mouse
gtggccgagagaccattggt

SEQ ID NO: 758769 - DNA, 20 bp, mouse
gccgcctcccggccgaccaa

SEQ ID NO: 758770 - DNA, 20 bp, mouse
ggccccagaggcgtgctagt

SEQ ID NO: 758771 - DNA, 20 bp, mouse
gcgcgcgccccctccgtccc

SEQ ID NO: 758772 - DNA, 20 bp, mouse
ggtgcttgtgctgacagtag

SEQ ID NO: 758773 - DNA, 20 bp, mouse
gggtgtggccgagagaccat

SEQ ID NO: 758774 - DNA, 20 bp, mouse
ggggcgcggcttaataaagc

SEQ ID NO: 758775 - DNA, 20 bp, mouse
ggcgctgtgttccgccccag

SEQ ID NO: 758776 - DNA, 20 bp, mouse
gggccaccacccatccaatc

SEQ ID NO: 758777 - DNA, 20 bp, mouse
gtcccaaagcgccccacctt

SEQ ID NO: 758778 - DNA, 20 bp, mouse
ggggcagttttaggttttaa

SEQ ID NO: 758779 - DNA, 20 bp, mouse
ggaggcagatcggaccttat

SEQ ID NO: 758780 - DNA, 20 bp, mouse
gcctcccaaagaatgcactt

SEQ ID NO: 758781 - DNA, 20 bp, mouse
gcagtgtattagttccgtag

SEQ ID NO: 758782 - DNA, 20 bp, mouse
gcttcgcggcaagtgaatct

SEQ ID NO: 758783 - DNA, 20 bp, mouse
gcggagcctgattggatggg

SEQ ID NO: 758784 - DNA, 20 bp, mouse
ggatgggtggtggccgaagg

SEQ ID NO: 758785 - DNA, 20 bp, mouse
ggaaagatggatggaccacc

SEQ ID NO: 758786 - DNA, 20 bp, mouse
gcggtggcgcggtctaaata

SEQ ID NO: 758787 - DNA, 20 bp, mouse
gcaggcccgcgcgtcctctt

SEQ ID NO: 758788 - DNA, 20 bp, mouse
gaattccgaagaggacgcgc

SEQ ID NO: 758789 - DNA, 20 bp, mouse
gggcctggctggggcggtag

SEQ ID NO: 758790 - DNA, 20 bp, mouse
gaggacgcgcgggcctggct

SEQ ID NO: 758791 - DNA, 20 bp, mouse
gggtaggggccgccccgtca

SEQ ID NO: 758792 - DNA, 20 bp, mouse
gcggtcttggcgcgtccctc

SEQ ID NO: 758793 - DNA, 20 bp, mouse
ggttctcacgggcacggcgg

SEQ ID NO: 758794 - DNA, 20 bp, mouse
gaaggctatgaattccgaag

SEQ ID NO: 758795 - DNA, 20 bp, mouse
gtcggggtcaaggccatgac

SEQ ID NO: 758796 - DNA, 20 bp, mouse
gtggttccagacaatctctt

SEQ ID NO: 758797 - DNA, 20 bp, mouse
gctggcgggaatagtgagtg

SEQ ID NO: 758798 - DNA, 20 bp, mouse
gctaaagagctgaacggtga

SEQ ID NO: 758799 - DNA, 20 bp, mouse
gtctctgtggcaacgggaga

SEQ ID NO: 758800 - DNA, 20 bp, mouse
gagacaggaggtagttgcta

SEQ ID NO: 758801 - DNA, 20 bp, mouse
gcaggggtgcgggttaatat

SEQ ID NO: 758802 - DNA, 20 bp, mouse
ggaaaacagcagctcaggat

SEQ ID NO: 758803 - DNA, 20 bp, mouse
gaactgagtgcgccagagag

SEQ ID NO: 758804 - DNA, 20 bp, mouse
gctgaagtcggggaaattag

SEQ ID NO: 758805 - DNA, 20 bp, mouse
ggctcaggattggctggtcc

SEQ ID NO: 758806 - DNA, 20 bp, mouse
ggggctaagttgagtgactg

SEQ ID NO: 758807 - DNA, 20 bp, mouse
ggggtctcggttctgtagac

SEQ ID NO: 758808 - DNA, 20 bp, mouse
gtacagaaccgagacccggg

SEQ ID NO: 758809 - DNA, 20 bp, mouse
gagtcaagaacagaagagtg

SEQ ID NO: 758810 - DNA, 20 bp, mouse
gccgagacccgggaggaaag

SEQ ID NO: 758811 - DNA, 20 bp, mouse
gtaagcttgcctaaggggcg

SEQ ID NO: 758812 - DNA, 20 bp, mouse
gagttgagtgactgcgggac

SEQ ID NO: 758813 - DNA, 20 bp, mouse
gaaccgaagcgctcgaagcg

SEQ ID NO: 758814 - DNA, 20 bp, mouse
gaggaagcgcacggcgctgc

SEQ ID NO: 758815 - DNA, 20 bp, mouse
gtgcctcggccccgcccctt

SEQ ID NO: 758816 - DNA, 20 bp, mouse
ggcaccacgcagcaactctc

SEQ ID NO: 758817 - DNA, 20 bp, mouse
gcctgcaccgggcaccgaag

SEQ ID NO: 758818 - DNA, 20 bp, mouse
gtgaacgctaagtgctcgga

SEQ ID NO: 758819 - DNA, 20 bp, mouse
gcgcgcactcgtcgccaggt

SEQ ID NO: 758820 - DNA, 20 bp, mouse
gtcagcgcccaaacaggggt

SEQ ID NO: 758821 - DNA, 20 bp, mouse
gcgcgcgcgcactcgtcgcc

SEQ ID NO: 758822 - DNA, 20 bp, mouse
gaagaaagcatagaggggtc

SEQ ID NO: 758823 - DNA, 20 bp, mouse
ggggatcagcgcccaaacag

SEQ ID NO: 758824 - DNA, 20 bp, mouse
gctcgtcgccaggtgggcgc

SEQ ID NO: 758825 - DNA, 20 bp, mouse
ggcgcccgcgggctgtttaa

SEQ ID NO: 758826 - DNA, 20 bp, mouse
gccagaggaatgcacggctc

SEQ ID NO: 758827 - DNA, 20 bp, mouse
gtacgtggagaaatgcttcg

SEQ ID NO: 758828 - DNA, 20 bp, mouse
gacactgggtctgtacagga

SEQ ID NO: 758829 - DNA, 20 bp, mouse
gaatgcacggctccgggtgt

SEQ ID NO: 758830 - DNA, 20 bp, mouse
ggaggcagggcacggggcta

SEQ ID NO: 758831 - DNA, 20 bp, mouse
gtgccaaaggggtcctaaag

SEQ ID NO: 758832 - DNA, 20 bp, mouse
gtgggtctgtacaggatggc

SEQ ID NO: 758833 - DNA, 20 bp, mouse
gggcacggggctaggggatg

SEQ ID NO: 758834 - DNA, 20 bp, mouse
ggaacatccaggcagctctc

SEQ ID NO: 758835 - DNA, 20 bp, mouse
ggggcaggaggcagggcacg

SEQ ID NO: 758836 - DNA, 20 bp, mouse
ggcgaggcaaaggggaggcg

SEQ ID NO: 758837 - DNA, 20 bp, mouse
gtgggagacgtgaagaggga

SEQ ID NO: 758838 - DNA, 20 bp, mouse
gagggaggggcgaggcaaag

SEQ ID NO: 758839 - DNA, 20 bp, mouse
gaaacagggcatagcggaat

SEQ ID NO: 758840 - DNA, 20 bp, mouse
gggggtgggagacgtgaaga

SEQ ID NO: 758841 - DNA, 20 bp, mouse
gagactaagccggagggaag

SEQ ID NO: 758842 - DNA, 20 bp, mouse
ggcagggcacgtggggagag

SEQ ID NO: 758843 - DNA, 20 bp, mouse
gtggggccaaggttggagaa

SEQ ID NO: 758844 - DNA, 20 bp, mouse
gtaggccaaggatcagaggc

SEQ ID NO: 758845 - DNA, 20 bp, mouse
ggggcatagcggaatgggat

SEQ ID NO: 758846 - DNA, 20 bp, mouse
gtagagcggcctccctgaaa

SEQ ID NO: 758847 - DNA, 20 bp, mouse
gccaatccccgcagcccctc

SEQ ID NO: 758848 - DNA, 20 bp, mouse
gcctccctgaaagggtgaag

SEQ ID NO: 758849 - DNA, 20 bp, mouse
gggccgagaggccactgcgc

SEQ ID NO: 758850 - DNA, 20 bp, mouse
ggcgcaggcgcccaagaaaa

SEQ ID NO: 758851 - DNA, 20 bp, mouse
gcgcctgcgcagtggcctct

SEQ ID NO: 758852 - DNA, 20 bp, mouse
gagggcggagaggccccggg

SEQ ID NO: 758853 - DNA, 20 bp, mouse
gcctgaaagggtgaagaggg

SEQ ID NO: 758854 - DNA, 20 bp, mouse
gctgtcagctaatcagaggt

SEQ ID NO: 758855 - DNA, 20 bp, mouse
gagatctgtcagctaatcag

SEQ ID NO: 758856 - DNA, 20 bp, mouse
gggggcggggtctcacggaa

SEQ ID NO: 758857 - DNA, 20 bp, mouse
gtgtggagggcgaaaggacg

SEQ ID NO: 758858 - DNA, 20 bp, mouse
gcgcactgcgaaagtgagaa

SEQ ID NO: 758859 - DNA, 20 bp, mouse
gttgtgcaggatctccgcgg

SEQ ID NO: 758860 - DNA, 20 bp, mouse
gtgtggctgtggagggcgaa

SEQ ID NO: 758861 - DNA, 20 bp, mouse
gtgcagaagctgggctatga

SEQ ID NO: 758862 - DNA, 20 bp, mouse
gggggcttccgggtaagaca

SEQ ID NO: 758863 - DNA, 20 bp, mouse
gtgcgccggcgcagttctgg

SEQ ID NO: 758864 - DNA, 20 bp, mouse
gggcgaaaggacggggcttc

SEQ ID NO: 758865 - DNA, 20 bp, mouse
gaccgcctccagaactgcgc

SEQ ID NO: 758866 - DNA, 20 bp, mouse
gggaagccgggggaaacctg

SEQ ID NO: 758867 - DNA, 20 bp, mouse
gccagcgcgcagccagtagg

SEQ ID NO: 758868 - DNA, 20 bp, mouse
ggcactgcgcacgcgtcact

SEQ ID NO: 758869 - DNA, 20 bp, mouse
gagttctccacaattactgc

SEQ ID NO: 758870 - DNA, 20 bp, mouse
gataaaccttagtcctcttc

SEQ ID NO: 758871 - DNA, 20 bp, mouse
gacagaggggccccacccca

SEQ ID NO: 758872 - DNA, 20 bp, mouse
gcagcgtcggcgccccctac

SEQ ID NO: 758873 - DNA, 20 bp, mouse
gcacgcgtcactgggaagcc

SEQ ID NO: 758874 - DNA, 20 bp, mouse
gctggctgcgcgctggagga

SEQ ID NO: 758875 - DNA, 20 bp, mouse
gtaccctgatgggtagacag

SEQ ID NO: 758876 - DNA, 20 bp, mouse
ggtgctgctcactaaagcga

SEQ ID NO: 758877 - DNA, 20 bp, mouse
gtcaccagaagcagtgaact

SEQ ID NO: 758878 - DNA, 20 bp, mouse
gacgagacgccggttcccag

SEQ ID NO: 758879 - DNA, 20 bp, mouse
gccgccaagttcactgcttc

SEQ ID NO: 758880 - DNA, 20 bp, mouse
gtgaaggattccaactatgg

SEQ ID NO: 758881 - DNA, 20 bp, mouse
gggctgaaggattccaacta

SEQ ID NO: 758882 - DNA, 20 bp, mouse
ggacgtcatgaacgagacgc

SEQ ID NO: 758883 - DNA, 20 bp, mouse
gatgccgggggcgtgtcctc

SEQ ID NO: 758884 - DNA, 20 bp, mouse
ggagggcttccaggcgtggt

SEQ ID NO: 758885 - DNA, 20 bp, mouse
gtccaactatggaggaaact

SEQ ID NO: 758886 - DNA, 20 bp, mouse
ggcgcgctcccgtgggaagt

SEQ ID NO: 758887 - DNA, 20 bp, mouse
ggcacagcggcgcgcgcaca

SEQ ID NO: 758888 - DNA, 20 bp, mouse
gtcccgtgggaagtcggctt

SEQ ID NO: 758889 - DNA, 20 bp, mouse
ggcagaacgcgagcttagat

SEQ ID NO: 758890 - DNA, 20 bp, mouse
gcgccgctgtgcctcgggtc

SEQ ID NO: 758891 - DNA, 20 bp, mouse
gcgcccaagccgacttccca

SEQ ID NO: 758892 - DNA, 20 bp, mouse
gtgcgcgcgccgctgtgcct

SEQ ID NO: 758893 - DNA, 20 bp, mouse
gggagctggggcatagaggg

SEQ ID NO: 758894 - DNA, 20 bp, mouse
gtcccgaggcgcgctcccgt

SEQ ID NO: 758895 - DNA, 20 bp, mouse
gggagggcacggcgttgcta

SEQ ID NO: 758896 - DNA, 20 bp, mouse
gctcctgggagggtgtgtga

SEQ ID NO: 758897 - DNA, 20 bp, mouse
ggggctagaaaaaaccggag

SEQ ID NO: 758898 - DNA, 20 bp, mouse
ggggagcgaagtcacggcta

SEQ ID NO: 758899 - DNA, 20 bp, mouse
gcccagctgaggctcctggg

SEQ ID NO: 758900 - DNA, 20 bp, mouse
gggaggcggcaccccagctg

SEQ ID NO: 758901 - DNA, 20 bp, mouse
ggaagcagtcacttgaacgg

SEQ ID NO: 758902 - DNA, 20 bp, mouse
gcagacgcgcgctaactgtg

SEQ ID NO: 758903 - DNA, 20 bp, mouse
gacaaggggcggtgcccgtg

SEQ ID NO: 758904 - DNA, 20 bp, mouse
gaaaccggaggggaaagctg

SEQ ID NO: 758905 - DNA, 20 bp, mouse
ggcgacagcaggggcgagag

SEQ ID NO: 758906 - DNA, 20 bp, mouse
gcgggccgaggatgtttcat

SEQ ID NO: 758907 - DNA, 20 bp, mouse
gcaccctccagccacgagcg

SEQ ID NO: 758908 - DNA, 20 bp, mouse
ggaccgcgctcgtggctgga

SEQ ID NO: 758909 - DNA, 20 bp, mouse
gtgaccctatgaaacatcct

SEQ ID NO: 758910 - DNA, 20 bp, mouse
gggccacgtgacctgaaggt

SEQ ID NO: 758911 - DNA, 20 bp, mouse
gcgggcccggagcttggtat

SEQ ID NO: 758912 - DNA, 20 bp, mouse
gggcatgcgcagcgtctcat

SEQ ID NO: 758913 - DNA, 20 bp, mouse
ggctacccgcccggagaacc

SEQ ID NO: 758914 - DNA, 20 bp, mouse
ggtgacttgcggaagaaaga

SEQ ID NO: 758915 - DNA, 20 bp, mouse
gagggctgccagcatccaat

SEQ ID NO: 758916 - DNA, 20 bp, mouse
gaatgctggggttgtggcgt

SEQ ID NO: 758917 - DNA, 20 bp, mouse
gaattccatcagagagggta

SEQ ID NO: 758918 - DNA, 20 bp, mouse
gtgcaacacagaaggaacta

SEQ ID NO: 758919 - DNA, 20 bp, mouse
ggcctggcctggaatcacgt

SEQ ID NO: 758920 - DNA, 20 bp, mouse
ggagcctagggggtaagagg

SEQ ID NO: 758921 - DNA, 20 bp, mouse
gaggagaatcggaagttaag

SEQ ID NO: 758922 - DNA, 20 bp, mouse
gccagccttaccctctctga

SEQ ID NO: 758923 - DNA, 20 bp, mouse
gtggggcgagcccacgtgac

SEQ ID NO: 758924 - DNA, 20 bp, mouse
gaagaggaaaaggagcctag

SEQ ID NO: 758925 - DNA, 20 bp, mouse
gctggtttgtgcaacacaga

SEQ ID NO: 758926 - DNA, 20 bp, mouse
gggtacggaaccgttagtga

SEQ ID NO: 758927 - DNA, 20 bp, mouse
gactcggggcgggatgggat

SEQ ID NO: 758928 - DNA, 20 bp, mouse
gaaggggcggagaagtctag

SEQ ID NO: 758929 - DNA, 20 bp, mouse
gatcagactcggggcgggat

SEQ ID NO: 758930 - DNA, 20 bp, mouse
gccgtacccccatacacaag

SEQ ID NO: 758931 - DNA, 20 bp, mouse
gctccgccccttgtgtatgg

SEQ ID NO: 758932 - DNA, 20 bp, mouse
gggctggatcagactcgggg

SEQ ID NO: 758933 - DNA, 20 bp, mouse
gccgttagtgagggtcacga

SEQ ID NO: 758934 - DNA, 20 bp, mouse
ggaaagcgctcagatgtcct

SEQ ID NO: 758935 - DNA, 20 bp, mouse
gaaggtcagatttagagtgg

SEQ ID NO: 758936 - DNA, 20 bp, mouse
ggttctgaaacagcagtggg

SEQ ID NO: 758937 - DNA, 20 bp, mouse
gcgcactccaattcgacaaa

SEQ ID NO: 758938 - DNA, 20 bp, mouse
gtggagaaatggccatttct

SEQ ID NO: 758939 - DNA, 20 bp, mouse
gcagtgttctgaaacagcag

SEQ ID NO: 758940 - DNA, 20 bp, mouse
gaaagggatgggccaagact

SEQ ID NO: 758941 - DNA, 20 bp, mouse
gaattgagcgatggtggcaa

SEQ ID NO: 758942 - DNA, 20 bp, mouse
gagttccaattgagcgatgg

SEQ ID NO: 758943 - DNA, 20 bp, mouse
gcatgatccctttgtcgaat

SEQ ID NO: 758944 - DNA, 20 bp, mouse
gtgaaacagcagtggggggc

SEQ ID NO: 758945 - DNA, 20 bp, mouse
gaaaagttccaattgagcga

SEQ ID NO: 758946 - DNA, 20 bp, mouse
ggtacagtagctcttgtgtt

SEQ ID NO: 758947 - DNA, 20 bp, mouse
gaaagatgagcataacgatg

SEQ ID NO: 758948 - DNA, 20 bp, mouse
gccaactgactgttttgcat

SEQ ID NO: 758949 - DNA, 20 bp, mouse
gtacacatggtagaatcatg

SEQ ID NO: 758950 - DNA, 20 bp, mouse
gttcaaacagcactagtagc

SEQ ID NO: 758951 - DNA, 20 bp, mouse
gttgaggaagctactagtta

SEQ ID NO: 758952 - DNA, 20 bp, mouse
ggccaggctataaacgcata

SEQ ID NO: 758953 - DNA, 20 bp, mouse
gtcagaactcccctccaact

SEQ ID NO: 758954 - DNA, 20 bp, mouse
gctccaactaggtaaatcct

SEQ ID NO: 758955 - DNA, 20 bp, mouse
gtaggacttattatcttctt

SEQ ID NO: 758956 - DNA, 20 bp, mouse
gagtagaagacactgtgtct

SEQ ID NO: 758957 - DNA, 20 bp, mouse
gtgaagatcccattggatcc

SEQ ID NO: 758958 - DNA, 20 bp, mouse
gattgaggtgaagatcccat

SEQ ID NO: 758959 - DNA, 20 bp, mouse
ggaactcaccaggatccaat

SEQ ID NO: 758960 - DNA, 20 bp, mouse
gaaaggatcaggtgttgaaa

SEQ ID NO: 758961 - DNA, 20 bp, mouse
gctctcaaatcatcgtgaga

SEQ ID NO: 758962 - DNA, 20 bp, mouse
gttaccatgtgtctatgaac

SEQ ID NO: 758963 - DNA, 20 bp, mouse
gatacccattgtactattct

SEQ ID NO: 758964 - DNA, 20 bp, mouse
gaacttgattgttttcgagg

SEQ ID NO: 758965 - DNA, 20 bp, mouse
gggaaacttgattgttttcg

SEQ ID NO: 758966 - DNA, 20 bp, mouse
gggtgaagggagtggaccac

SEQ ID NO: 758967 - DNA, 20 bp, mouse
gtcctggcatatggctgtct

SEQ ID NO: 758968 - DNA, 20 bp, mouse
gggggaactccagggacaag

SEQ ID NO: 758969 - DNA, 20 bp, mouse
gtatggctgtctgggtttgg

SEQ ID NO: 758970 - DNA, 20 bp, mouse
gactggagatagctattaca

SEQ ID NO: 758971 - DNA, 20 bp, mouse
gacccagacagccatatgcc

SEQ ID NO: 758972 - DNA, 20 bp, mouse
ggcaaaatcttcctggcata

SEQ ID NO: 758973 - DNA, 20 bp, mouse
gcggggcatggtgaagggag

SEQ ID NO: 758974 - DNA, 20 bp, mouse
gagaggcggggcatggtgaa

SEQ ID NO: 758975 - DNA, 20 bp, mouse
gaataataataaaaagagtt

SEQ ID NO: 758976 - DNA, 20 bp, mouse
gtgggtgtatgcaatagcag

SEQ ID NO: 758977 - DNA, 20 bp, mouse
ggtgtatgcaatagcagggg

SEQ ID NO: 758978 - DNA, 20 bp, mouse
gcaatagcaggggtggtggt

SEQ ID NO: 758979 - DNA, 20 bp, mouse
gtgaaagtctcattttagtt

SEQ ID NO: 758980 - DNA, 20 bp, mouse
ggtctcattttagttaggta

SEQ ID NO: 758981 - DNA, 20 bp, mouse
gtatgcaatagcaggggtgg

SEQ ID NO: 758982 - DNA, 20 bp, mouse
gttgcagatgaaccatgctt

SEQ ID NO: 758983 - DNA, 20 bp, mouse
gggttggaaattgatgcgag

SEQ ID NO: 758984 - DNA, 20 bp, mouse
gctagtgcagagattgtgga

SEQ ID NO: 758985 - DNA, 20 bp, mouse
gagagctagtgcagagattg

SEQ ID NO: 758986 - DNA, 20 bp, mouse
gctgaagctgaggtcttgta

SEQ ID NO: 758987 - DNA, 20 bp, mouse
gtcttctcaggctgttctag

SEQ ID NO: 758988 - DNA, 20 bp, mouse
ggctaaagggtgttcgtaca

SEQ ID NO: 758989 - DNA, 20 bp, mouse
gcacacaggcctagagaagc

SEQ ID NO: 758990 - DNA, 20 bp, mouse
ggcagtggacggtgtctcct

SEQ ID NO: 758991 - DNA, 20 bp, mouse
gcacctgcaagtacggaccc

SEQ ID NO: 758992 - DNA, 20 bp, mouse
ggggaagccacctgcaagta

SEQ ID NO: 758993 - DNA, 20 bp, mouse
ggcccagctgttgctgagac

SEQ ID NO: 758994 - DNA, 20 bp, mouse
gaatccagtagaataagtgt

SEQ ID NO: 758995 - DNA, 20 bp, mouse
gcaagtacggaccctggcac

SEQ ID NO: 758996 - DNA, 20 bp, mouse
gcatcccggggacaaggggc

SEQ ID NO: 758997 - DNA, 20 bp, mouse
gccgcccatcccggggacaa

SEQ ID NO: 758998 - DNA, 20 bp, mouse
gggggcgggggggactgagg

SEQ ID NO: 758999 - DNA, 20 bp, mouse
ggctccggcggctttcccgg

SEQ ID NO: 759000 - DNA, 20 bp, mouse
ggagccgccgggaaagccgc

SEQ ID NO: 759001 - DNA, 20 bp, mouse
gactcccggcaggaggggcg

SEQ ID NO: 759002 - DNA, 20 bp, mouse
gcacgcgctggggtgacggt

SEQ ID NO: 759003 - DNA, 20 bp, mouse
ggggcaggtccgtgacgcgg

SEQ ID NO: 759004 - DNA, 20 bp, mouse
gaaagccgccggagcgcgct

SEQ ID NO: 759005 - DNA, 20 bp, mouse
gcaggtccgtgacgcggcgg

SEQ ID NO: 759006 - DNA, 20 bp, mouse
gtaaggtgacccagactggg

SEQ ID NO: 759007 - DNA, 20 bp, mouse
gctgggtgcctgggagaata

SEQ ID NO: 759008 - DNA, 20 bp, mouse
ggagccgttggccttcagat

SEQ ID NO: 759009 - DNA, 20 bp, mouse
gggattaactgtgaattcac

SEQ ID NO: 759010 - DNA, 20 bp, mouse
gtgcctgggagaataggggg

SEQ ID NO: 759011 - DNA, 20 bp, mouse
ggggtgccgcctgggtgcct

SEQ ID NO: 759012 - DNA, 20 bp, mouse
ggctgtaaggtgacccagac

SEQ ID NO: 759013 - DNA, 20 bp, mouse
ggggaagtttcaggtcaagt

SEQ ID NO: 759014 - DNA, 20 bp, mouse
gggtagggtaggaggcttga

SEQ ID NO: 759015 - DNA, 20 bp, mouse
gtggggcgtgggtgccgcct

SEQ ID NO: 759016 - DNA, 20 bp, mouse
gcgggcggcgcttgctggga

SEQ ID NO: 759017 - DNA, 20 bp, mouse
gaaaacccaagctgggttac

SEQ ID NO: 759018 - DNA, 20 bp, mouse
gccctggcgctcaatggctg

SEQ ID NO: 759019 - DNA, 20 bp, mouse
gtgcagaaagcgactgaatg

SEQ ID NO: 759020 - DNA, 20 bp, mouse
ggattggtggcgatcgggga

SEQ ID NO: 759021 - DNA, 20 bp, mouse
gtggcgatcggggaaggggc

SEQ ID NO: 759022 - DNA, 20 bp, mouse
ggctgcggacctgactccgc

SEQ ID NO: 759023 - DNA, 20 bp, mouse
gacgctgattggtggcgatc

SEQ ID NO: 759024 - DNA, 20 bp, mouse
gcgccggtcgggacgctgat

SEQ ID NO: 759025 - DNA, 20 bp, mouse
ggacctgactccgcgggcgc

SEQ ID NO: 759026 - DNA, 20 bp, mouse
gtggctggctccaatctccc

SEQ ID NO: 759027 - DNA, 20 bp, mouse
gttggaggaggggcaacctg

SEQ ID NO: 759028 - DNA, 20 bp, mouse
gacacagtgctttggaggag

SEQ ID NO: 759029 - DNA, 20 bp, mouse
gtggaagcaggttattcccc

SEQ ID NO: 759030 - DNA, 20 bp, mouse
gcagaaaatacacagtgctt

SEQ ID NO: 759031 - DNA, 20 bp, mouse
ggcactgtgtattttctggg

SEQ ID NO: 759032 - DNA, 20 bp, mouse
gtccactaaagatccttggc

SEQ ID NO: 759033 - DNA, 20 bp, mouse
ggagggaccttcaagtccat

SEQ ID NO: 759034 - DNA, 20 bp, mouse
gcacttccactaaagatcct

SEQ ID NO: 759035 - DNA, 20 bp, mouse
ggccagccaaggatctttag

SEQ ID NO: 759036 - DNA, 20 bp, mouse
ggagacccgggggaagccta

SEQ ID NO: 759037 - DNA, 20 bp, mouse
gaccccctgcgcaggtgtat

SEQ ID NO: 759038 - DNA, 20 bp, mouse
ggtctcctcccccttcctgt

SEQ ID NO: 759039 - DNA, 20 bp, mouse
gaagccccccagtgacaatg

SEQ ID NO: 759040 - DNA, 20 bp, mouse
gacaggggttaacctcccac

SEQ ID NO: 759041 - DNA, 20 bp, mouse
gcacctgcgcagggggtata

SEQ ID NO: 759042 - DNA, 20 bp, mouse
gtgaagctactgaccgccct

SEQ ID NO: 759043 - DNA, 20 bp, mouse
ggaccgccctaggcttcccc

SEQ ID NO: 759044 - DNA, 20 bp, mouse
gcctcccaccccctgcctta

SEQ ID NO: 759045 - DNA, 20 bp, mouse
ggggtgtaaaagggtggagc

SEQ ID NO: 759046 - DNA, 20 bp, mouse
gggtgcgcgtgcacgagagg

SEQ ID NO: 759047 - DNA, 20 bp, mouse
gaaggcttactgctgtgtgt

SEQ ID NO: 759048 - DNA, 20 bp, mouse
gaagcccaccaagccattaa

SEQ ID NO: 759049 - DNA, 20 bp, mouse
gcaccaagccattaacggag

SEQ ID NO: 759050 - DNA, 20 bp, mouse
gggatggtcctctccgttaa

SEQ ID NO: 759051 - DNA, 20 bp, mouse
gtagggtgcgcgtgcacgag

SEQ ID NO: 759052 - DNA, 20 bp, mouse
ggagaccccggagctttgga

SEQ ID NO: 759053 - DNA, 20 bp, mouse
gaaggacatccgagccgtac

SEQ ID NO: 759054 - DNA, 20 bp, mouse
gggcaagatcgcgcgagatt

SEQ ID NO: 759055 - DNA, 20 bp, mouse
ggtcctctccgttaatggct

SEQ ID NO: 759056 - DNA, 20 bp, mouse
gggcgtaggcagcgctggag

SEQ ID NO: 759057 - DNA, 20 bp, mouse
ggcagaggtaaggctccgat

SEQ ID NO: 759058 - DNA, 20 bp, mouse
ggtaggcagcgctggagggg

SEQ ID NO: 759059 - DNA, 20 bp, mouse
gaaattgtgtctagaggcgt

SEQ ID NO: 759060 - DNA, 20 bp, mouse
gcgagacggggcccgcggat

SEQ ID NO: 759061 - DNA, 20 bp, mouse
gctgtcgcgcagccaatccg

SEQ ID NO: 759062 - DNA, 20 bp, mouse
gcagccgccggctgacgtgg

SEQ ID NO: 759063 - DNA, 20 bp, mouse
gaacgcccggggcagcaagc

SEQ ID NO: 759064 - DNA, 20 bp, mouse
ggccccgccacgtcagccgg

SEQ ID NO: 759065 - DNA, 20 bp, mouse
gttctccccgctctctgcag

SEQ ID NO: 759066 - DNA, 20 bp, mouse
ggccacaggcgggaagccta

SEQ ID NO: 759067 - DNA, 20 bp, mouse
gcctaaggtgccggggaaga

SEQ ID NO: 759068 - DNA, 20 bp, mouse
gggcgggaagcctaaggtgc

SEQ ID NO: 759069 - DNA, 20 bp, mouse
gagcacaagaccgccacagg

SEQ ID NO: 759070 - DNA, 20 bp, mouse
ggcgagcacaagaccgccac

SEQ ID NO: 759071 - DNA, 20 bp, mouse
gcaggcgggcaaggagaacc

SEQ ID NO: 759072 - DNA, 20 bp, mouse
gcgttgcgtagcaacgggag

SEQ ID NO: 759073 - DNA, 20 bp, mouse
gaccttaggcttcccgcctg

SEQ ID NO: 759074 - DNA, 20 bp, mouse
gcagagccgtccttcttccc

SEQ ID NO: 759075 - DNA, 20 bp, mouse
ggggtcgtcgctgtgggatt

SEQ ID NO: 759076 - DNA, 20 bp, mouse
gtggctgattcctccaccta

SEQ ID NO: 759077 - DNA, 20 bp, mouse
ggtggaagatgagccatagg

SEQ ID NO: 759078 - DNA, 20 bp, mouse
gagctgctccagccactcgg

SEQ ID NO: 759079 - DNA, 20 bp, mouse
gcttcccagattctctaata

SEQ ID NO: 759080 - DNA, 20 bp, mouse
gccactcgggggcggaggga

SEQ ID NO: 759081 - DNA, 20 bp, mouse
gagcctcaggttataaccaa

SEQ ID NO: 759082 - DNA, 20 bp, mouse
gcagccatattagagaatct

SEQ ID NO: 759083 - DNA, 20 bp, mouse
gccagccactcgggggcgga

SEQ ID NO: 759084 - DNA, 20 bp, mouse
gcaactgcgtaatcatactg

SEQ ID NO: 759085 - DNA, 20 bp, mouse
gattagagaagagtcctggg

SEQ ID NO: 759086 - DNA, 20 bp, mouse
gaacccaggtgcatatggga

SEQ ID NO: 759087 - DNA, 20 bp, mouse
ggaggaatggcgttagtctt

SEQ ID NO: 759088 - DNA, 20 bp, mouse
ggggctgcccatcctaaccc

SEQ ID NO: 759089 - DNA, 20 bp, mouse
gagggctgtcaacaagggag

SEQ ID NO: 759090 - DNA, 20 bp, mouse
gggactcagaaccgtctcct

SEQ ID NO: 759091 - DNA, 20 bp, mouse
ggagtccggtactgcgtcac

SEQ ID NO: 759092 - DNA, 20 bp, mouse
gtggcaacccaggtgcatat

SEQ ID NO: 759093 - DNA, 20 bp, mouse
ggaggggaagttgaccatag

SEQ ID NO: 759094 - DNA, 20 bp, mouse
gaccagagggctgtcaacaa

SEQ ID NO: 759095 - DNA, 20 bp, mouse
ggggaacgaatttaaccaga

SEQ ID NO: 759096 - DNA, 20 bp, mouse
gggctggcgagggactgggg

SEQ ID NO: 759097 - DNA, 20 bp, mouse
gggcggctggcgagggactg

SEQ ID NO: 759098 - DNA, 20 bp, mouse
gggcgcgcgtgtaggacttt

SEQ ID NO: 759099 - DNA, 20 bp, mouse
ggaggcgcgaggtgcggtgc

SEQ ID NO: 759100 - DNA, 20 bp, mouse
gcaccaggcactaggaaagg

SEQ ID NO: 759101 - DNA, 20 bp, mouse
gagggtggagcccggcgata

SEQ ID NO: 759102 - DNA, 20 bp, mouse
ggggcttgttacaacctcta

SEQ ID NO: 759103 - DNA, 20 bp, mouse
gccgcaggaggcgcgaggtg

SEQ ID NO: 759104 - DNA, 20 bp, mouse
gggcggagacggggaggagt

SEQ ID NO: 759105 - DNA, 20 bp, mouse
gctccggggctgcaccgccg

SEQ ID NO: 759106 - DNA, 20 bp, mouse
ggggtgggggcggatgctga

SEQ ID NO: 759107 - DNA, 20 bp, mouse
ggcggctcgcggcaagtgaa

SEQ ID NO: 759108 - DNA, 20 bp, mouse
ggctgctcactatcagctga

SEQ ID NO: 759109 - DNA, 20 bp, mouse
gcggcaaacgctgacggctg

SEQ ID NO: 759110 - DNA, 20 bp, mouse
gaagatgcggcaaacgctga

SEQ ID NO: 759111 - DNA, 20 bp, mouse
gggggcggatgctgagggct

SEQ ID NO: 759112 - DNA, 20 bp, mouse
gtatctgcgcagaccatctt

SEQ ID NO: 759113 - DNA, 20 bp, mouse
gactggctggaaccagctcg

SEQ ID NO: 759114 - DNA, 20 bp, mouse
gcagccagttctgcaggggt

SEQ ID NO: 759115 - DNA, 20 bp, mouse
gtggttccagccagttctgc

SEQ ID NO: 759116 - DNA, 20 bp, mouse
gggcgtgtgctcacgtgttg

SEQ ID NO: 759117 - DNA, 20 bp, mouse
gcctcccggcacgccccctc

SEQ ID NO: 759118 - DNA, 20 bp, mouse
gctgcgaggcactctcctcc

SEQ ID NO: 759119 - DNA, 20 bp, mouse
gtgctgagtgcggtagccgg

SEQ ID NO: 759120 - DNA, 20 bp, mouse
gcgcttgtgggggttccagg

SEQ ID NO: 759121 - DNA, 20 bp, mouse
gtggttcgcagggttcacgt

SEQ ID NO: 759122 - DNA, 20 bp, mouse
gaccctgcgaaccaaccagt

SEQ ID NO: 759123 - DNA, 20 bp, mouse
gtagccggagggggcgtgcc

SEQ ID NO: 759124 - DNA, 20 bp, mouse
gtgtgctcacgtgttggggg

SEQ ID NO: 759125 - DNA, 20 bp, mouse
gtgagtgcggtagccggagg

SEQ ID NO: 759126 - DNA, 20 bp, mouse
gcccctcctccagggagtcc

SEQ ID NO: 759127 - DNA, 20 bp, mouse
gtaggactacagatcccgaa

SEQ ID NO: 759128 - DNA, 20 bp, mouse
gtggcattaaggtggaatgt

SEQ ID NO: 759129 - DNA, 20 bp, mouse
gctgctgggaactgtagttg

SEQ ID NO: 759130 - DNA, 20 bp, mouse
gggcccaagacccctccaga

SEQ ID NO: 759131 - DNA, 20 bp, mouse
ggttctcccggactccctgg

SEQ ID NO: 759132 - DNA, 20 bp, mouse
ggcagggccgggcgttctcc

SEQ ID NO: 759133 - DNA, 20 bp, mouse
ggggagggctaagtcgtccc

SEQ ID NO: 759134 - DNA, 20 bp, mouse
gttgggccttggacccttgg

SEQ ID NO: 759135 - DNA, 20 bp, mouse
gtgggaggtggggcaccaca

SEQ ID NO: 759136 - DNA, 20 bp, mouse
ggggcggagccatcttgcga

SEQ ID NO: 759137 - DNA, 20 bp, mouse
gggacggagcggaagctcga

SEQ ID NO: 759138 - DNA, 20 bp, mouse
gatgaagcgaggctgctgga

SEQ ID NO: 759139 - DNA, 20 bp, mouse
gtgggcggggccatgccggt

SEQ ID NO: 759140 - DNA, 20 bp, mouse
gggggggcggagttggttag

SEQ ID NO: 759141 - DNA, 20 bp, mouse
ggagccgaggccctcaggcg

SEQ ID NO: 759142 - DNA, 20 bp, mouse
gccgcagagccgaggccctc

SEQ ID NO: 759143 - DNA, 20 bp, mouse
gaaggcggcgcgctgtatgt

SEQ ID NO: 759144 - DNA, 20 bp, mouse
ggccgagggaggagagacgc

SEQ ID NO: 759145 - DNA, 20 bp, mouse
gttgcgagggtggagcgaag

SEQ ID NO: 759146 - DNA, 20 bp, mouse
ggcaaagctgtcccggaaat

SEQ ID NO: 759147 - DNA, 20 bp, mouse
gtggaatgaatgcgcggaga

SEQ ID NO: 759148 - DNA, 20 bp, mouse
gtcgcgcaagcgcggtgata

SEQ ID NO: 759149 - DNA, 20 bp, mouse
gagccgggaaaggggactac

SEQ ID NO: 759150 - DNA, 20 bp, mouse
gtcagcttaaagtgccttca

SEQ ID NO: 759151 - DNA, 20 bp, mouse
gggaacgcctcggaggaagc

SEQ ID NO: 759152 - DNA, 20 bp, mouse
ggctaggcctcgcgcaagcg

SEQ ID NO: 759153 - DNA, 20 bp, mouse
gcgtcggcgtgggaacgcct

SEQ ID NO: 759154 - DNA, 20 bp, mouse
gaatgaatgcgcggagaggg

SEQ ID NO: 759155 - DNA, 20 bp, mouse
gacacccggagcgtcggcgt

SEQ ID NO: 759156 - DNA, 20 bp, mouse
gcaactactagcagattagg

SEQ ID NO: 759157 - DNA, 20 bp, mouse
ggaccagggaggagcaatca

SEQ ID NO: 759158 - DNA, 20 bp, mouse
gcagctgcaagcagcgtcat

SEQ ID NO: 759159 - DNA, 20 bp, mouse
gagttggagtccaggagact

SEQ ID NO: 759160 - DNA, 20 bp, mouse
gggaacccaagcaccagcat

SEQ ID NO: 759161 - DNA, 20 bp, mouse
gggactcaaaccagcaagat

SEQ ID NO: 759162 - DNA, 20 bp, mouse
ggaagctgagagccccctag

SEQ ID NO: 759163 - DNA, 20 bp, mouse
gtgaggggcaagcggctagt

SEQ ID NO: 759164 - DNA, 20 bp, mouse
gattgctcctccctggtcag

SEQ ID NO: 759165 - DNA, 20 bp, mouse
gactaccataaactgtccta

SEQ ID NO: 759166 - DNA, 20 bp, mouse
gaggtggtggggcgtgaaca

SEQ ID NO: 759167 - DNA, 20 bp, mouse
gcagtagcagggccagaacc

SEQ ID NO: 759168 - DNA, 20 bp, mouse
gtgaacagggtggagtctca

SEQ ID NO: 759169 - DNA, 20 bp, mouse
gagaggggcaggaaaggggt

SEQ ID NO: 759170 - DNA, 20 bp, mouse
gtggtggggcgtgaacaggg

SEQ ID NO: 759171 - DNA, 20 bp, mouse
gaccttaaacagcccggttc

SEQ ID NO: 759172 - DNA, 20 bp, mouse
gaggcaagggcagaaagagt

SEQ ID NO: 759173 - DNA, 20 bp, mouse
gctgtgttccagtaggtggt

SEQ ID NO: 759174 - DNA, 20 bp, mouse
ggccagaaccgggctgttta

SEQ ID NO: 759175 - DNA, 20 bp, mouse
ggagtctcaaggggaagaaa

SEQ ID NO: 759176 - DNA, 20 bp, mouse
gccgggcaactactagtcga

SEQ ID NO: 759177 - DNA, 20 bp, mouse
ggaagtggcaggtccctccc

SEQ ID NO: 759178 - DNA, 20 bp, mouse
gaggccgcggccactgagca

SEQ ID NO: 759179 - DNA, 20 bp, mouse
gagccaatgaaaagagtgca

SEQ ID NO: 759180 - DNA, 20 bp, mouse
gaaagagtgcaaggatggta

SEQ ID NO: 759181 - DNA, 20 bp, mouse
gtctctgattggctcctggg

SEQ ID NO: 759182 - DNA, 20 bp, mouse
ggaagagtgcgctgaccgag

SEQ ID NO: 759183 - DNA, 20 bp, mouse
gggagccaatcagagaacgg

SEQ ID NO: 759184 - DNA, 20 bp, mouse
gtccacccccgttctctgat

SEQ ID NO: 759185 - DNA, 20 bp, mouse
gtcattggcttaagcggcgg

SEQ ID NO: 759186 - DNA, 20 bp, mouse
ggagaccgaacgctgtgctg

SEQ ID NO: 759187 - DNA, 20 bp, mouse
gcgtgcgcgccctctgccgg

SEQ ID NO: 759188 - DNA, 20 bp, mouse
ggctcaaggccgccggcaga

SEQ ID NO: 759189 - DNA, 20 bp, mouse
gccacaaccaagggacgcaa

SEQ ID NO: 759190 - DNA, 20 bp, mouse
gtcccgtaggggtcggaatc

SEQ ID NO: 759191 - DNA, 20 bp, mouse
ggccgagcgctcaaggccgc

SEQ ID NO: 759192 - DNA, 20 bp, mouse
gccgctgggccgagcgctca

SEQ ID NO: 759193 - DNA, 20 bp, mouse
gagtctctcccgcttcccgt

SEQ ID NO: 759194 - DNA, 20 bp, mouse
gcaaggtgatgaatgaaatc

SEQ ID NO: 759195 - DNA, 20 bp, mouse
gcctgctacaccacaaccaa

SEQ ID NO: 759196 - DNA, 20 bp, mouse
gggcctgcgcgcgaatgcaa

SEQ ID NO: 759197 - DNA, 20 bp, mouse
gtaaaaactactgacgagtc

SEQ ID NO: 759198 - DNA, 20 bp, mouse
gtgcgcgcgaatgcaaaggg

SEQ ID NO: 759199 - DNA, 20 bp, mouse
gtcaggatgtgggggtcata

SEQ ID NO: 759200 - DNA, 20 bp, mouse
gcgcgcgcaggcccgtcccg

SEQ ID NO: 759201 - DNA, 20 bp, mouse
gaggggctgaatatgtaact

SEQ ID NO: 759202 - DNA, 20 bp, mouse
gaagcctgaagttacagcct

SEQ ID NO: 759203 - DNA, 20 bp, mouse
gaaagggaacctaatctttc

SEQ ID NO: 759204 - DNA, 20 bp, mouse
gcatgtatacggtgttggaa

SEQ ID NO: 759205 - DNA, 20 bp, mouse
gagagtggagtggagatttt

SEQ ID NO: 759206 - DNA, 20 bp, mouse
gccgcccagggtcttcgaac

SEQ ID NO: 759207 - DNA, 20 bp, mouse
ggcgcaggggctgggaacta

SEQ ID NO: 759208 - DNA, 20 bp, mouse
gcggccgccatttttagtca

SEQ ID NO: 759209 - DNA, 20 bp, mouse
gagacggaactgcaggtccc

SEQ ID NO: 759210 - DNA, 20 bp, mouse
ggaactgcaggtcccgggtt

SEQ ID NO: 759211 - DNA, 20 bp, mouse
gagatgggcgagtgactcag

SEQ ID NO: 759212 - DNA, 20 bp, mouse
gtgggcggggtgcggtctct

SEQ ID NO: 759213 - DNA, 20 bp, mouse
gcttccggttcgaagaccct

SEQ ID NO: 759214 - DNA, 20 bp, mouse
gagaagacatcggatcttta

SEQ ID NO: 759215 - DNA, 20 bp, mouse
gtcagctgcgcaacccaacc

SEQ ID NO: 759216 - DNA, 20 bp, mouse
gaaggcgcaagggctgtctc

SEQ ID NO: 759217 - DNA, 20 bp, mouse
ggggcggggctaaggcgcaa

SEQ ID NO: 759218 - DNA, 20 bp, mouse
gagctcgtgaggcgccgcac

SEQ ID NO: 759219 - DNA, 20 bp, mouse
ggtgaggcgccgcaccggta

SEQ ID NO: 759220 - DNA, 20 bp, mouse
ggagactgaggaatacttgt

SEQ ID NO: 759221 - DNA, 20 bp, mouse
gtgtctgtgcagagtcttag

SEQ ID NO: 759222 - DNA, 20 bp, mouse
gtactgttgggtcatctcta

SEQ ID NO: 759223 - DNA, 20 bp, mouse
gtgcaccgcccctaccggtg

SEQ ID NO: 759224 - DNA, 20 bp, mouse
gactccacccagcgtgatga

SEQ ID NO: 759225 - DNA, 20 bp, mouse
gatgacggaagagcgagcac

SEQ ID NO: 759226 - DNA, 20 bp, mouse
ggggcgggaagatacccaaa

SEQ ID NO: 759227 - DNA, 20 bp, mouse
gggaagatacccaaacggga

SEQ ID NO: 759228 - DNA, 20 bp, mouse
gtgcctgcctgtgattgcga

SEQ ID NO: 759229 - DNA, 20 bp, mouse
gccaaacgggaagggataca

SEQ ID NO: 759230 - DNA, 20 bp, mouse
gagcacgagtacagcagcaa

SEQ ID NO: 759231 - DNA, 20 bp, mouse
ggggaggatccggaagtgga

SEQ ID NO: 759232 - DNA, 20 bp, mouse
gggattggatcagtcaaagg

SEQ ID NO: 759233 - DNA, 20 bp, mouse
gctgacggggatacccgaga

SEQ ID NO: 759234 - DNA, 20 bp, mouse
gaggaaaaacgggctagggc

SEQ ID NO: 759235 - DNA, 20 bp, mouse
gaggggggaggatccggaag

SEQ ID NO: 759236 - DNA, 20 bp, mouse
gactcagttaagtggggtga

SEQ ID NO: 759237 - DNA, 20 bp, mouse
gtaggcaatagagaacatag

SEQ ID NO: 759238 - DNA, 20 bp, mouse
gtcaaaagacagattagatg

SEQ ID NO: 759239 - DNA, 20 bp, mouse
gtggaatctgtcactcgaca

SEQ ID NO: 759240 - DNA, 20 bp, mouse
gctataacactcagttaagt

SEQ ID NO: 759241 - DNA, 20 bp, mouse
gtcagtgtaaatcttcaagt

SEQ ID NO: 759242 - DNA, 20 bp, mouse
gaaacatagaaagtgtctca

SEQ ID NO: 759243 - DNA, 20 bp, mouse
gtgaaatgtaaaattttgga

SEQ ID NO: 759244 - DNA, 20 bp, mouse
gtacagggaaagttttgatg

SEQ ID NO: 759245 - DNA, 20 bp, mouse
gaagcttcactcacacttga

SEQ ID NO: 759246 - DNA, 20 bp, mouse
ggtaacctggctatgacagg

SEQ ID NO: 759247 - DNA, 20 bp, mouse
gcaagcgtagcggagatccg

SEQ ID NO: 759248 - DNA, 20 bp, mouse
ggcagcaaatggcgaaatgg

SEQ ID NO: 759249 - DNA, 20 bp, mouse
gacgcttgcgcactaactcc

SEQ ID NO: 759250 - DNA, 20 bp, mouse
gcgtgggcaagtgctcagaa

SEQ ID NO: 759251 - DNA, 20 bp, mouse
gagttagtgcgcaagcgtag

SEQ ID NO: 759252 - DNA, 20 bp, mouse
ggaaggtcccatagctgtag

SEQ ID NO: 759253 - DNA, 20 bp, mouse
ggggcaagtgctcagaaggg

SEQ ID NO: 759254 - DNA, 20 bp, mouse
ggtaccgcggccacgatcgt

SEQ ID NO: 759255 - DNA, 20 bp, mouse
gccaggttacccgcagcaaa

SEQ ID NO: 759256 - DNA, 20 bp, mouse
ggaggaaactgcgaggacga

SEQ ID NO: 759257 - DNA, 20 bp, mouse
ggggcaggggttgggagtaa

SEQ ID NO: 759258 - DNA, 20 bp, mouse
gaacccctgccccatagtgg

SEQ ID NO: 759259 - DNA, 20 bp, mouse
gttcccccactatggggcag

SEQ ID NO: 759260 - DNA, 20 bp, mouse
ggaggccagtgggagaacct

SEQ ID NO: 759261 - DNA, 20 bp, mouse
ggggagaaccttggagaagg

SEQ ID NO: 759262 - DNA, 20 bp, mouse
gagtaatggaggaaactgcg

SEQ ID NO: 759263 - DNA, 20 bp, mouse
gagtgggagaaccttggaga

SEQ ID NO: 759264 - DNA, 20 bp, mouse
gggcaggagagggtcaccac

SEQ ID NO: 759265 - DNA, 20 bp, mouse
gacagagagggtttcttacc

SEQ ID NO: 759266 - DNA, 20 bp, mouse
gtcaagctctgacctctcac

SEQ ID NO: 759267 - DNA, 20 bp, mouse
ggtagggcttcacttaaccc

SEQ ID NO: 759268 - DNA, 20 bp, mouse
gtcacagagtttatgatctc

SEQ ID NO: 759269 - DNA, 20 bp, mouse
gggaaggaaaggcatacatt

SEQ ID NO: 759270 - DNA, 20 bp, mouse
gactagagaaagagttcacc

SEQ ID NO: 759271 - DNA, 20 bp, mouse
gcagatcaaggacgtagagg

SEQ ID NO: 759272 - DNA, 20 bp, mouse
gttcccagagatccttgaga

SEQ ID NO: 759273 - DNA, 20 bp, mouse
gaaaccatctcaaggatctc

SEQ ID NO: 759274 - DNA, 20 bp, mouse
gaagcagatcaaggacgtag

SEQ ID NO: 759275 - DNA, 20 bp, mouse
gaaggcatacattaggaatg

SEQ ID NO: 759276 - DNA, 20 bp, mouse
gtggctctgggtttgtagat

SEQ ID NO: 759277 - DNA, 20 bp, mouse
gtctagcatcatcacggtaa

SEQ ID NO: 759278 - DNA, 20 bp, mouse
gagacagccctgccccggaa

SEQ ID NO: 759279 - DNA, 20 bp, mouse
gcatcatcacggtaaaggca

SEQ ID NO: 759280 - DNA, 20 bp, mouse
ggcaaatgatggtgggtgga

SEQ ID NO: 759281 - DNA, 20 bp, mouse
gagaggattcaatgaagcct

SEQ ID NO: 759282 - DNA, 20 bp, mouse
gccaatatctagcatcatca

SEQ ID NO: 759283 - DNA, 20 bp, mouse
gcaggccaccttataggata

SEQ ID NO: 759284 - DNA, 20 bp, mouse
gccagccatatcctataagg

SEQ ID NO: 759285 - DNA, 20 bp, mouse
gctgggtttgtagataggac

SEQ ID NO: 759286 - DNA, 20 bp, mouse
gcttgctgggcaaccctcag

SEQ ID NO: 759287 - DNA, 20 bp, mouse
gtggctgggtagcttgtgtg

SEQ ID NO: 759288 - DNA, 20 bp, mouse
gctgacaattaggtccttct

SEQ ID NO: 759289 - DNA, 20 bp, mouse
gaataagcaagcactagaag

SEQ ID NO: 759290 - DNA, 20 bp, mouse
gttggcacagagctgacata

SEQ ID NO: 759291 - DNA, 20 bp, mouse
gtctgctgactcatagattc

SEQ ID NO: 759292 - DNA, 20 bp, mouse
ggtgcctgtggccatgtcag

SEQ ID NO: 759293 - DNA, 20 bp, mouse
gtgggcaaccctcagtggct

SEQ ID NO: 759294 - DNA, 20 bp, mouse
ggtgcttgcttattagcata

SEQ ID NO: 759295 - DNA, 20 bp, mouse
gtgcttattagcatagggct

SEQ ID NO: 759296 - DNA, 20 bp, mouse
gacgtgggctggtgcctcat

SEQ ID NO: 759297 - DNA, 20 bp, mouse
gaaaggctggaatgtgacag

SEQ ID NO: 759298 - DNA, 20 bp, mouse
gcacgtgttaggtgaacctt

SEQ ID NO: 759299 - DNA, 20 bp, mouse
gaaggagtgagcttgtgatg

SEQ ID NO: 759300 - DNA, 20 bp, mouse
gcacctaacacgtgcatctt

SEQ ID NO: 759301 - DNA, 20 bp, mouse
gggacagtgcaacttaccct

SEQ ID NO: 759302 - DNA, 20 bp, mouse
gacaggagtaagagctatcg

SEQ ID NO: 759303 - DNA, 20 bp, mouse
ggatccccacaagactaacg

SEQ ID NO: 759304 - DNA, 20 bp, mouse
gccaaggagacctctaccca

SEQ ID NO: 759305 - DNA, 20 bp, mouse
gagcccaagatgcacgtgtt

SEQ ID NO: 759306 - DNA, 20 bp, mouse
ggggaagcaggacactaact

SEQ ID NO: 759307 - DNA, 20 bp, mouse
gtgtgcacacttacacacta

SEQ ID NO: 759308 - DNA, 20 bp, mouse
ggatgaagagggatgtagtc

SEQ ID NO: 759309 - DNA, 20 bp, mouse
ggaaagcttctaggatgaag

SEQ ID NO: 759310 - DNA, 20 bp, mouse
gctgtcaccagaggggaagc

SEQ ID NO: 759311 - DNA, 20 bp, mouse
gggatgtagtcaggtgttac

SEQ ID NO: 759312 - DNA, 20 bp, mouse
gtctgtggactatatattgc

SEQ ID NO: 759313 - DNA, 20 bp, mouse
gccacggcccggcagtttgt

SEQ ID NO: 759314 - DNA, 20 bp, mouse
gagcttttgtttattgtctg

SEQ ID NO: 759315 - DNA, 20 bp, mouse
gtaaaaaaccaacaaactgc

SEQ ID NO: 759316 - DNA, 20 bp, mouse
gacagggcgcgcatggagtg

SEQ ID NO: 759317 - DNA, 20 bp, mouse
gcgtgcagacgcagcagaca

SEQ ID NO: 759318 - DNA, 20 bp, mouse
ggcgtctgcacgtcttgctc

SEQ ID NO: 759319 - DNA, 20 bp, mouse
gtgctcgcggagaccctctc

SEQ ID NO: 759320 - DNA, 20 bp, mouse
gtggagtggggaatgcgtag

SEQ ID NO: 759321 - DNA, 20 bp, mouse
gcgcgagcacgaggatgatt

SEQ ID NO: 759322 - DNA, 20 bp, mouse
gtctgcacgtcttgctccgg

SEQ ID NO: 759323 - DNA, 20 bp, mouse
ggcagcagacagggcgcgca

SEQ ID NO: 759324 - DNA, 20 bp, mouse
gcacgaggatgattcggctt

SEQ ID NO: 759325 - DNA, 20 bp, mouse
gcgccccgtggccttggtgc

SEQ ID NO: 759326 - DNA, 20 bp, mouse
gcacgcgctcgcttggacgg

SEQ ID NO: 759327 - DNA, 20 bp, mouse
gccaagcgagcgcgtgggga

SEQ ID NO: 759328 - DNA, 20 bp, mouse
ggagaagcagacagctgtgt

SEQ ID NO: 759329 - DNA, 20 bp, mouse
gacgggcaggagggcaggac

SEQ ID NO: 759330 - DNA, 20 bp, mouse
gcgtagcgggcgctggtgcg

SEQ ID NO: 759331 - DNA, 20 bp, mouse
gggtgcggggccgctggtgc

SEQ ID NO: 759332 - DNA, 20 bp, mouse
gaggggcgcagtgcgttgat

SEQ ID NO: 759333 - DNA, 20 bp, mouse
gctcgcttggacgggggact

SEQ ID NO: 759334 - DNA, 20 bp, mouse
ggagactgagggaccggctc

SEQ ID NO: 759335 - DNA, 20 bp, mouse
gagaggggaggcttaagggt

SEQ ID NO: 759336 - DNA, 20 bp, mouse
gttaacccgcagaggggcgg

SEQ ID NO: 759337 - DNA, 20 bp, mouse
gagtgcagggaggaaagcga

SEQ ID NO: 759338 - DNA, 20 bp, mouse
gcggctgggggtgggcggga

SEQ ID NO: 759339 - DNA, 20 bp, mouse
gccggccggccgcagaaagg

SEQ ID NO: 759340 - DNA, 20 bp, mouse
gccccagccgcgggcgctcc

SEQ ID NO: 759341 - DNA, 20 bp, mouse
gccggctcggccctcagccg

SEQ ID NO: 759342 - DNA, 20 bp, mouse
gaagctggcacagtgcaggg

SEQ ID NO: 759343 - DNA, 20 bp, mouse
gcgctgccctaggcacacgc

SEQ ID NO: 759344 - DNA, 20 bp, mouse
gggaaggctaacgcaggaaa

SEQ ID NO: 759345 - DNA, 20 bp, mouse
gcgcagaggggcggaggcat

SEQ ID NO: 759346 - DNA, 20 bp, mouse
ggggccgccgccgaaactct

SEQ ID NO: 759347 - DNA, 20 bp, mouse
ggtcgcgactcgcactgcaa

SEQ ID NO: 759348 - DNA, 20 bp, mouse
gcgcggccccagagtttcgg

SEQ ID NO: 759349 - DNA, 20 bp, mouse
ggcagtgcgagtcgcgaccg

SEQ ID NO: 759350 - DNA, 20 bp, mouse
ggggcgtggcctcaactccg

SEQ ID NO: 759351 - DNA, 20 bp, mouse
gcggcggccccgcggagttg

SEQ ID NO: 759352 - DNA, 20 bp, mouse
gccggggccgtgccgcagag

SEQ ID NO: 759353 - DNA, 20 bp, mouse
ggctggacgcaggggaggac

SEQ ID NO: 759354 - DNA, 20 bp, mouse
gcgagctggtggccgctctg

SEQ ID NO: 759355 - DNA, 20 bp, mouse
ggggctgcagggctggacgc

SEQ ID NO: 759356 - DNA, 20 bp, mouse
gagcaaaactagcagtcatc

SEQ ID NO: 759357 - DNA, 20 bp, mouse
gaatgctcttaacctcagtc

SEQ ID NO: 759358 - DNA, 20 bp, mouse
ggctggagtctaccagactg

SEQ ID NO: 759359 - DNA, 20 bp, mouse
gaacttgctgaacaggagag

SEQ ID NO: 759360 - DNA, 20 bp, mouse
gtctacaaagccatttctga

SEQ ID NO: 759361 - DNA, 20 bp, mouse
gaactttcaaactaagtttc

SEQ ID NO: 759362 - DNA, 20 bp, mouse
gcttctgaaaatactaaagc

SEQ ID NO: 759363 - DNA, 20 bp, mouse
gctctataatccttcagaaa

SEQ ID NO: 759364 - DNA, 20 bp, mouse
gaaaactagcagtcatctgg

SEQ ID NO: 759365 - DNA, 20 bp, mouse
ggggagaagaaaacaaagtg

SEQ ID NO: 759366 - DNA, 20 bp, mouse
gctaaacttgacagatctgt

SEQ ID NO: 759367 - DNA, 20 bp, mouse
gggacgcggccgctggtgat

SEQ ID NO: 759368 - DNA, 20 bp, mouse
gggcacaaatgaacaaaaag

SEQ ID NO: 759369 - DNA, 20 bp, mouse
gcagcttcgtagacgctgac

SEQ ID NO: 759370 - DNA, 20 bp, mouse
gatgaacaaaaagtggacca

SEQ ID NO: 759371 - DNA, 20 bp, mouse
ggcactacggcgactcgcgc

SEQ ID NO: 759372 - DNA, 20 bp, mouse
gtcttgtatgagatatgtct

SEQ ID NO: 759373 - DNA, 20 bp, mouse
gcgcgcgggtcatactttcc

SEQ ID NO: 759374 - DNA, 20 bp, mouse
gaatgaattaagtgcggaaa

SEQ ID NO: 759375 - DNA, 20 bp, mouse
gcaagaacctcccagagtgc

SEQ ID NO: 759376 - DNA, 20 bp, mouse
gagtcgcgaggggaaggaca

SEQ ID NO: 759377 - DNA, 20 bp, mouse
ggcgcggggaggagtcgcga

SEQ ID NO: 759378 - DNA, 20 bp, mouse
gggcccggtcccagcgcgtg

SEQ ID NO: 759379 - DNA, 20 bp, mouse
gaggagcgccgggagaaaga

SEQ ID NO: 759380 - DNA, 20 bp, mouse
gcgcctgcgcgcagcttggg

SEQ ID NO: 759381 - DNA, 20 bp, mouse
ggacaggtgagcaggtgcgc

SEQ ID NO: 759382 - DNA, 20 bp, mouse
gggggagggacgaggggtga

SEQ ID NO: 759383 - DNA, 20 bp, mouse
gcggccccacctcgctgcgg

SEQ ID NO: 759384 - DNA, 20 bp, mouse
gcggtcccagcgcgtggggg

SEQ ID NO: 759385 - DNA, 20 bp, mouse
gtcgccgtgcgggccacgtg

SEQ ID NO: 759386 - DNA, 20 bp, mouse
gggtagctggtctcgtaaat

SEQ ID NO: 759387 - DNA, 20 bp, mouse
gacccctgatgaagaagtgt

SEQ ID NO: 759388 - DNA, 20 bp, mouse
gaaaactgcggtagatggga

SEQ ID NO: 759389 - DNA, 20 bp, mouse
gtgtgccaaacaggagtttc

SEQ ID NO: 759390 - DNA, 20 bp, mouse
gttaaaggaaggcgtgagta

SEQ ID NO: 759391 - DNA, 20 bp, mouse
gccttgatcaccccattcaa

SEQ ID NO: 759392 - DNA, 20 bp, mouse
gagactgtctcaggtcaata

SEQ ID NO: 759393 - DNA, 20 bp, mouse
gggagggcccgaggaattcc

SEQ ID NO: 759394 - DNA, 20 bp, mouse
gtagtcgtggtgtgccaaac

SEQ ID NO: 759395 - DNA, 20 bp, mouse
gtccaacacttcttcatcag

SEQ ID NO: 759396 - DNA, 20 bp, mouse
ggggccgggtaaatccccag

SEQ ID NO: 759397 - DNA, 20 bp, mouse
gtccggcagccgctcctcga

SEQ ID NO: 759398 - DNA, 20 bp, mouse
ggggagcgacgtcagcacgt

SEQ ID NO: 759399 - DNA, 20 bp, mouse
gcgcaggcatgccgggggag

SEQ ID NO: 759400 - DNA, 20 bp, mouse
ggaggggcttcggggctgag

SEQ ID NO: 759401 - DNA, 20 bp, mouse
gcggctgcgcaggcatgccg

SEQ ID NO: 759402 - DNA, 20 bp, mouse
gactactgaccggaatgccc

SEQ ID NO: 759403 - DNA, 20 bp, mouse
gagccgcagtgccctcgctc

SEQ ID NO: 759404 - DNA, 20 bp, mouse
ggtcacccagctggacgtga

SEQ ID NO: 759405 - DNA, 20 bp, mouse
ggcccctgggctaatcattc

SEQ ID NO: 759406 - DNA, 20 bp, mouse
gaggaggggcgtgtagactt

SEQ ID NO: 759407 - DNA, 20 bp, mouse
gtggacagtcctaggagagg

SEQ ID NO: 759408 - DNA, 20 bp, mouse
gttggtggctaagtgcgaca

SEQ ID NO: 759409 - DNA, 20 bp, mouse
gaggggcgtgtagactttgg

SEQ ID NO: 759410 - DNA, 20 bp, mouse
gcactgctgggggaagtccg

SEQ ID NO: 759411 - DNA, 20 bp, mouse
gtccaaagggcggggaagtc

SEQ ID NO: 759412 - DNA, 20 bp, mouse
ggagctccatgcgacctccc

SEQ ID NO: 759413 - DNA, 20 bp, mouse
ggagcggcgctacactgctg

SEQ ID NO: 759414 - DNA, 20 bp, mouse
gcccgggccgccctgacccc

SEQ ID NO: 759415 - DNA, 20 bp, mouse
ggagctccgcctctcgcagg

SEQ ID NO: 759416 - DNA, 20 bp, mouse
gggagcggggcccatggctc

SEQ ID NO: 759417 - DNA, 20 bp, mouse
gcgcccctgctcacgagtgg

SEQ ID NO: 759418 - DNA, 20 bp, mouse
gcatgggccccgctccccga

SEQ ID NO: 759419 - DNA, 20 bp, mouse
gggcagcggcgacgagggga

SEQ ID NO: 759420 - DNA, 20 bp, mouse
gcggccgggacagggatgaa

SEQ ID NO: 759421 - DNA, 20 bp, mouse
gctccccgacggccgggaca

SEQ ID NO: 759422 - DNA, 20 bp, mouse
ggacgaggggagggacgcgc

SEQ ID NO: 759423 - DNA, 20 bp, mouse
gtccctccactcgtgagcag

SEQ ID NO: 759424 - DNA, 20 bp, mouse
gagcaggggcgcccgagcca

SEQ ID NO: 759425 - DNA, 20 bp, mouse
gggccccgctccccgacggc

SEQ ID NO: 759426 - DNA, 20 bp, mouse
ggcccagcctgcgcggtcac

SEQ ID NO: 759427 - DNA, 20 bp, mouse
gagcccgcgccggtgcagcc

SEQ ID NO: 759428 - DNA, 20 bp, mouse
gccagagcgcgccgctgacg

SEQ ID NO: 759429 - DNA, 20 bp, mouse
gggaatgtgatggaccgaac

SEQ ID NO: 759430 - DNA, 20 bp, mouse
ggcgcggaaagcgtcctggc

SEQ ID NO: 759431 - DNA, 20 bp, mouse
gtaggtggcgcccccgtcag

SEQ ID NO: 759432 - DNA, 20 bp, mouse
gtgcagcgcggaaagcgtcc

SEQ ID NO: 759433 - DNA, 20 bp, mouse
gtcttcggaaaggcgggaac

SEQ ID NO: 759434 - DNA, 20 bp, mouse
gtgcagcccggtgaccgcgc

SEQ ID NO: 759435 - DNA, 20 bp, mouse
gaaaaagctcggaagtaatg

SEQ ID NO: 759436 - DNA, 20 bp, mouse
gtggccaatcggcttgggaa

SEQ ID NO: 759437 - DNA, 20 bp, mouse
gtacccgagaatcgcggggc

SEQ ID NO: 759438 - DNA, 20 bp, mouse
gaaagcagagggtggccaat

SEQ ID NO: 759439 - DNA, 20 bp, mouse
gaaacacccaggccgagggg

SEQ ID NO: 759440 - DNA, 20 bp, mouse
gacacgtcagcggaagggaa

SEQ ID NO: 759441 - DNA, 20 bp, mouse
gggtcagtgctgcgttggca

SEQ ID NO: 759442 - DNA, 20 bp, mouse
gctagcgcgcagaagtcagc

SEQ ID NO: 759443 - DNA, 20 bp, mouse
ggagggtggccaatcggctt

SEQ ID NO: 759444 - DNA, 20 bp, mouse
gtacctggggcggaaccaaa

SEQ ID NO: 759445 - DNA, 20 bp, mouse
ggtagagaggttattttgag

SEQ ID NO: 759446 - DNA, 20 bp, mouse
ggctgagtccgcacagtcaa

SEQ ID NO: 759447 - DNA, 20 bp, mouse
gtgtcgtagcaaccacagac

SEQ ID NO: 759448 - DNA, 20 bp, mouse
gtcgtgagtcacaactttga

SEQ ID NO: 759449 - DNA, 20 bp, mouse
gtgccgggcactgttcacaa

SEQ ID NO: 759450 - DNA, 20 bp, mouse
gggtcacagcatgcattttc

SEQ ID NO: 759451 - DNA, 20 bp, mouse
ggctgtgatagtaagactaa

SEQ ID NO: 759452 - DNA, 20 bp, mouse
ggctctgaaattatttcaat

SEQ ID NO: 759453 - DNA, 20 bp, mouse
gagagcatgccgatgaaaga

SEQ ID NO: 759454 - DNA, 20 bp, mouse
gatgccgatgaaagatggtg

SEQ ID NO: 759455 - DNA, 20 bp, mouse
gggactttgacgtcagccag

SEQ ID NO: 759456 - DNA, 20 bp, mouse
gcacctgtgcatcccagctt

SEQ ID NO: 759457 - DNA, 20 bp, mouse
gtggctcggctgcttctgtc

SEQ ID NO: 759458 - DNA, 20 bp, mouse
gggctgcagcagtacaaggc

SEQ ID NO: 759459 - DNA, 20 bp, mouse
gtgaggggaccagccgaagc

SEQ ID NO: 759460 - DNA, 20 bp, mouse
gcacggagaggccacgtcca

SEQ ID NO: 759461 - DNA, 20 bp, mouse
gctgggatgcacaggtgcag

SEQ ID NO: 759462 - DNA, 20 bp, mouse
gggctgcttctgtcggggtg

SEQ ID NO: 759463 - DNA, 20 bp, mouse
gggcctcagccgggttccct

SEQ ID NO: 759464 - DNA, 20 bp, mouse
ggtggcctctccgtgcgatg

SEQ ID NO: 759465 - DNA, 20 bp, mouse
gcagcggctgcagcagtaca

SEQ ID NO: 759466 - DNA, 20 bp, mouse
gcgtgaacgcagctcggcag

SEQ ID NO: 759467 - DNA, 20 bp, mouse
ggaactggggatgcgagcga

SEQ ID NO: 759468 - DNA, 20 bp, mouse
ggggatgcgagcgacgggcg

SEQ ID NO: 759469 - DNA, 20 bp, mouse
gaatcccagctctgcctgga

SEQ ID NO: 759470 - DNA, 20 bp, mouse
gcggctcccttggtaactcc

SEQ ID NO: 759471 - DNA, 20 bp, mouse
gggagccgggctctttcaca

SEQ ID NO: 759472 - DNA, 20 bp, mouse
gtccctgcgctggcccgggt

SEQ ID NO: 759473 - DNA, 20 bp, mouse
gcatccaggaggtaagagac

SEQ ID NO: 759474 - DNA, 20 bp, mouse
gccgagttgcgagtgtgctg

SEQ ID NO: 759475 - DNA, 20 bp, mouse
ggttaggaactatttgtggt

SEQ ID NO: 759476 - DNA, 20 bp, mouse
gactcctgggctcgaacccg

SEQ ID NO: 759477 - DNA, 20 bp, mouse
ggggctcgaacccgtggctg

SEQ ID NO: 759478 - DNA, 20 bp, mouse
gccactgcggacgaatcccg

SEQ ID NO: 759479 - DNA, 20 bp, mouse
ggggtcgcaaaagagccaga

SEQ ID NO: 759480 - DNA, 20 bp, mouse
gtcccggggccgcgcgtgcc

SEQ ID NO: 759481 - DNA, 20 bp, mouse
gccgcgcgtgcctggctcgc

SEQ ID NO: 759482 - DNA, 20 bp, mouse
gcggatggtgcatgctcacg

SEQ ID NO: 759483 - DNA, 20 bp, mouse
gtagaaaagcccgggactcc

SEQ ID NO: 759484 - DNA, 20 bp, mouse
gcgcgcggagggatccgccg

SEQ ID NO: 759485 - DNA, 20 bp, mouse
gcaacccggccacacctgcg

SEQ ID NO: 759486 - DNA, 20 bp, mouse
gcggagcaggtggcctcatg

SEQ ID NO: 759487 - DNA, 20 bp, mouse
gcagacgtgaaaggaatctc

SEQ ID NO: 759488 - DNA, 20 bp, mouse
gcagaaggaaagggcagagt

SEQ ID NO: 759489 - DNA, 20 bp, mouse
ggtgtccggacagacgtgaa

SEQ ID NO: 759490 - DNA, 20 bp, mouse
gcatactggagtcatttaat

SEQ ID NO: 759491 - DNA, 20 bp, mouse
ggactccagtatgcctcatg

SEQ ID NO: 759492 - DNA, 20 bp, mouse
gcccacctgtaaatcggagc

SEQ ID NO: 759493 - DNA, 20 bp, mouse
ggtggcctcatgaggcatac

SEQ ID NO: 759494 - DNA, 20 bp, mouse
gcatccaccctgtaggtcac

SEQ ID NO: 759495 - DNA, 20 bp, mouse
gcccttctctttgagctctt

SEQ ID NO: 759496 - DNA, 20 bp, mouse
gaggaggccaatcgcgacag

SEQ ID NO: 759497 - DNA, 20 bp, mouse
gccgcccccggggctgtgat

SEQ ID NO: 759498 - DNA, 20 bp, mouse
gggcctcctggcagccgttg

SEQ ID NO: 759499 - DNA, 20 bp, mouse
ggcggcccgcggagagacaa

SEQ ID NO: 759500 - DNA, 20 bp, mouse
gccgggaaagcgcagactcg

SEQ ID NO: 759501 - DNA, 20 bp, mouse
gttccctgttcaaacctcaa

SEQ ID NO: 759502 - DNA, 20 bp, mouse
ggaaccggccaatccgcggc

SEQ ID NO: 759503 - DNA, 20 bp, mouse
gagcgcgacgcctggcgctg

SEQ ID NO: 759504 - DNA, 20 bp, mouse
ggtcacccgttgtctctccg

SEQ ID NO: 759505 - DNA, 20 bp, mouse
gagccgttgaggtttgaaca

SEQ ID NO: 759506 - DNA, 20 bp, mouse
ggtaacgcaccgaagtgcta

SEQ ID NO: 759507 - DNA, 20 bp, mouse
gtctcgtcgcccaccgggtg

SEQ ID NO: 759508 - DNA, 20 bp, mouse
gcggcgccgccgtagcactt

SEQ ID NO: 759509 - DNA, 20 bp, mouse
ggggcaggagaactccggcc

SEQ ID NO: 759510 - DNA, 20 bp, mouse
gactagggccctgggaggaa

SEQ ID NO: 759511 - DNA, 20 bp, mouse
gacgcaccgaagtgctacgg

SEQ ID NO: 759512 - DNA, 20 bp, mouse
ggcaccgccaggatctgcgt

SEQ ID NO: 759513 - DNA, 20 bp, mouse
gggcctgcgcccctggggtg

SEQ ID NO: 759514 - DNA, 20 bp, mouse
gcctggcggtgcagcgacta

SEQ ID NO: 759515 - DNA, 20 bp, mouse
gagaactgcctggactcccg

SEQ ID NO: 759516 - DNA, 20 bp, mouse
gcccgctgctgggacgcctg

SEQ ID NO: 759517 - DNA, 20 bp, mouse
gtgctgggacgcctggggtg

SEQ ID NO: 759518 - DNA, 20 bp, mouse
gtcggagagcggagacctga

SEQ ID NO: 759519 - DNA, 20 bp, mouse
gggggccggaagtagtgctg

SEQ ID NO: 759520 - DNA, 20 bp, mouse
gggcctgccgctctcccaat

SEQ ID NO: 759521 - DNA, 20 bp, mouse
gggtgccttgcgggatcttg

SEQ ID NO: 759522 - DNA, 20 bp, mouse
gagatcccgcaaggcaccga

SEQ ID NO: 759523 - DNA, 20 bp, mouse
gccaaccacaagatcccgca

SEQ ID NO: 759524 - DNA, 20 bp, mouse
gcgagacttccgccggaggg

SEQ ID NO: 759525 - DNA, 20 bp, mouse
gcccgagcgaaggagtcgtt

SEQ ID NO: 759526 - DNA, 20 bp, mouse
gggcccaagcaccgcctcct

SEQ ID NO: 759527 - DNA, 20 bp, mouse
gctaaagagactcccgccag

SEQ ID NO: 759528 - DNA, 20 bp, mouse
ggctctgagtcacgcccagg

SEQ ID NO: 759529 - DNA, 20 bp, mouse
gtgagagcggcgactggtga

SEQ ID NO: 759530 - DNA, 20 bp, mouse
gcctggctgcagagctgtgg

SEQ ID NO: 759531 - DNA, 20 bp, mouse
ggcagagctgtgggggatat

SEQ ID NO: 759532 - DNA, 20 bp, mouse
ggcgtcagatctcgtgagag

SEQ ID NO: 759533 - DNA, 20 bp, mouse
ggaggcggtgcttgggcctt

SEQ ID NO: 759534 - DNA, 20 bp, mouse
gctgagtcacgcccaggagg

SEQ ID NO: 759535 - DNA, 20 bp, mouse
gggagcgtccggggtatacg

SEQ ID NO: 759536 - DNA, 20 bp, mouse
gcgagcgctgggcgcggagt

SEQ ID NO: 759537 - DNA, 20 bp, mouse
gaatctggattgtaacgggg

SEQ ID NO: 759538 - DNA, 20 bp, mouse
gcctgcgcaggccgcctagg

SEQ ID NO: 759539 - DNA, 20 bp, mouse
gtgacccagctgaagacgtt

SEQ ID NO: 759540 - DNA, 20 bp, mouse
gccccagtgacgtcacgcgg

SEQ ID NO: 759541 - DNA, 20 bp, mouse
gtggctgatcagagtggccc

SEQ ID NO: 759542 - DNA, 20 bp, mouse
ggctgtgctttcctagaatc

SEQ ID NO: 759543 - DNA, 20 bp, mouse
ggcgagtgaactaggtgcag

SEQ ID NO: 759544 - DNA, 20 bp, mouse
gggagtaggatgtgtggatc

SEQ ID NO: 759545 - DNA, 20 bp, mouse
ggtcactggggcgtggtctt

SEQ ID NO: 759546 - DNA, 20 bp, mouse
gggggcggggcctacaccgg

SEQ ID NO: 759547 - DNA, 20 bp, mouse
ggggcagctaggagactaga

SEQ ID NO: 759548 - DNA, 20 bp, mouse
gcggggctccgtgtctaggg

SEQ ID NO: 759549 - DNA, 20 bp, mouse
ggggcggggctccgtgtcta

SEQ ID NO: 759550 - DNA, 20 bp, mouse
gaggagactaagtttctagg

SEQ ID NO: 759551 - DNA, 20 bp, mouse
gggctccgtgtctagggggg

SEQ ID NO: 759552 - DNA, 20 bp, mouse
gtggagctcagtgacccgac

SEQ ID NO: 759553 - DNA, 20 bp, mouse
gggagccccgcccccggtgt

SEQ ID NO: 759554 - DNA, 20 bp, mouse
gcaggccccccccctagaca

SEQ ID NO: 759555 - DNA, 20 bp, mouse
gagactagagggcactactt

SEQ ID NO: 759556 - DNA, 20 bp, mouse
gccggggggcgtgggctcga

SEQ ID NO: 759557 - DNA, 20 bp, mouse
ggcccctgcgccgacgactt

SEQ ID NO: 759558 - DNA, 20 bp, mouse
ggcagcgccaagttggtgaa

SEQ ID NO: 759559 - DNA, 20 bp, mouse
gtgtccagaagggcccgggg

SEQ ID NO: 759560 - DNA, 20 bp, mouse
ggggctccgcagtggaaggc

SEQ ID NO: 759561 - DNA, 20 bp, mouse
ggcccggggtggaaagccgg

SEQ ID NO: 759562 - DNA, 20 bp, mouse
gccgccgggaaaatcccgcc

SEQ ID NO: 759563 - DNA, 20 bp, mouse
ggacttccggagaaaggtga

SEQ ID NO: 759564 - DNA, 20 bp, mouse
gcggaagtctcctaagtcgt

SEQ ID NO: 759565 - DNA, 20 bp, mouse
gtctcccgaggcgtctacag

SEQ ID NO: 759566 - DNA, 20 bp, mouse
gagcagccgccggaagacca

SEQ ID NO: 759567 - DNA, 20 bp, mouse
gaggcgaaggcagcgagcgt

SEQ ID NO: 759568 - DNA, 20 bp, mouse
ggtggccgtccggaaggcga

SEQ ID NO: 759569 - DNA, 20 bp, mouse
gtgtagctgtagcagcgcga

SEQ ID NO: 759570 - DNA, 20 bp, mouse
gtcgcggcccatccggcggg

SEQ ID NO: 759571 - DNA, 20 bp, mouse
ggagagccatggtcttccgg

SEQ ID NO: 759572 - DNA, 20 bp, mouse
ggctgcgccgcccgccggat

SEQ ID NO: 759573 - DNA, 20 bp, mouse
gagaaccaagcggcgggcgg

SEQ ID NO: 759574 - DNA, 20 bp, mouse
gggacggccacgcccgacga

SEQ ID NO: 759575 - DNA, 20 bp, mouse
gcgccggctagtccgtcgtc

SEQ ID NO: 759576 - DNA, 20 bp, mouse
gaatcccgggagagagcctg

SEQ ID NO: 759577 - DNA, 20 bp, mouse
gaggacctcgcctgacccct

SEQ ID NO: 759578 - DNA, 20 bp, mouse
ggggactggaccttttctga

SEQ ID NO: 759579 - DNA, 20 bp, mouse
gagactagaagcatagatgg

SEQ ID NO: 759580 - DNA, 20 bp, mouse
ggaggtcctcagctggccct

SEQ ID NO: 759581 - DNA, 20 bp, mouse
gcagccaaaactccttaagg

SEQ ID NO: 759582 - DNA, 20 bp, mouse
gagctggccctggggaaact

SEQ ID NO: 759583 - DNA, 20 bp, mouse
ggggaaggacacagtaattg

SEQ ID NO: 759584 - DNA, 20 bp, mouse
ggctctctcccgggattcac

SEQ ID NO: 759585 - DNA, 20 bp, mouse
gtgccagccaaaactcctta

SEQ ID NO: 759586 - DNA, 20 bp, mouse
gggctcgcggccaaaggctg

SEQ ID NO: 759587 - DNA, 20 bp, mouse
gggaggaggggcggcgctga

SEQ ID NO: 759588 - DNA, 20 bp, mouse
gcagccgcgagcccaaaagt

SEQ ID NO: 759589 - DNA, 20 bp, mouse
gggtgcgggccgccccgcaa

SEQ ID NO: 759590 - DNA, 20 bp, mouse
gagcactcaggccccagact

SEQ ID NO: 759591 - DNA, 20 bp, mouse
gggtgcggccatcttgcttg

SEQ ID NO: 759592 - DNA, 20 bp, mouse
gggcctgagtgctcgagcta

SEQ ID NO: 759593 - DNA, 20 bp, mouse
gctgagtgctcgagctaagg

SEQ ID NO: 759594 - DNA, 20 bp, mouse
gcgtccgggccctcagcctt

SEQ ID NO: 759595 - DNA, 20 bp, mouse
gagcaagatggccgcaccgg

SEQ ID NO: 759596 - DNA, 20 bp, mouse
gagaggcagcttggcatcgc

SEQ ID NO: 759597 - DNA, 20 bp, mouse
gaggctgcgtcgggaggaag

SEQ ID NO: 759598 - DNA, 20 bp, mouse
gcgcggatgtgccccctccg

SEQ ID NO: 759599 - DNA, 20 bp, mouse
gatactcacagtgtccgcca

SEQ ID NO: 759600 - DNA, 20 bp, mouse
ggtgtccttgcgaatagctg

SEQ ID NO: 759601 - DNA, 20 bp, mouse
gcgcaaggacaccgcggagg

SEQ ID NO: 759602 - DNA, 20 bp, mouse
gtcccgacgcagcctgtgat

SEQ ID NO: 759603 - DNA, 20 bp, mouse
gcgccaggttgcaggaagca

SEQ ID NO: 759604 - DNA, 20 bp, mouse
gagcaaccagcaacccctgg

SEQ ID NO: 759605 - DNA, 20 bp, mouse
gcaggctgcgagccaatcac

SEQ ID NO: 759606 - DNA, 20 bp, mouse
gtgagcttcaacagagtggt

SEQ ID NO: 759607 - DNA, 20 bp, mouse
gaaccacccccaacaaacat

SEQ ID NO: 759608 - DNA, 20 bp, mouse
gtctgctgcttgtggggtaa

SEQ ID NO: 759609 - DNA, 20 bp, mouse
ggtagagaggccccagtgcc

SEQ ID NO: 759610 - DNA, 20 bp, mouse
gcgacaccatggcccaaccc

SEQ ID NO: 759611 - DNA, 20 bp, mouse
gtgtggggtaagggcgggga

SEQ ID NO: 759612 - DNA, 20 bp, mouse
ggccatggtgtcggtagaac

SEQ ID NO: 759613 - DNA, 20 bp, mouse
gcatggcccaacccaggcac

SEQ ID NO: 759614 - DNA, 20 bp, mouse
ggctgcttgtggggtaaggg

SEQ ID NO: 759615 - DNA, 20 bp, mouse
gactaagtctaagagcctcc

SEQ ID NO: 759616 - DNA, 20 bp, mouse
gaggctcccacagagggtgt

SEQ ID NO: 759617 - DNA, 20 bp, mouse
gacatagaagaagctcttag

SEQ ID NO: 759618 - DNA, 20 bp, mouse
gagagctagcaagtcttcca

SEQ ID NO: 759619 - DNA, 20 bp, mouse
gcctagacccagagcctgag

SEQ ID NO: 759620 - DNA, 20 bp, mouse
gagagcttcttctatgtcct

SEQ ID NO: 759621 - DNA, 20 bp, mouse
ggaactgaccagcccacggc

SEQ ID NO: 759622 - DNA, 20 bp, mouse
gcatcagagcagcctgccgt

SEQ ID NO: 759623 - DNA, 20 bp, mouse
gctgcttcccacaccctctg

SEQ ID NO: 759624 - DNA, 20 bp, mouse
gctgtgggagcctcaggtca

SEQ ID NO: 759625 - DNA, 20 bp, mouse
ggtgaaaaagagtcaagtac

SEQ ID NO: 759626 - DNA, 20 bp, mouse
gaaaactgctctatggtggg

SEQ ID NO: 759627 - DNA, 20 bp, mouse
gtggctgagaagacgtgtga

SEQ ID NO: 759628 - DNA, 20 bp, mouse
ggctaaaactgctctatggt

SEQ ID NO: 759629 - DNA, 20 bp, mouse
gcagggcgggacctcctcaa

SEQ ID NO: 759630 - DNA, 20 bp, mouse
ggtccttgatggactaccca

SEQ ID NO: 759631 - DNA, 20 bp, mouse
gcagggctaaaactgctcta

SEQ ID NO: 759632 - DNA, 20 bp, mouse
gtgtaaggagagcctctgtg

SEQ ID NO: 759633 - DNA, 20 bp, mouse
gtgcacagcagttgaggaag

SEQ ID NO: 759634 - DNA, 20 bp, mouse
gagtccatcaaggacacttg

SEQ ID NO: 759635 - DNA, 20 bp, mouse
ggaggtggaggcagattgta

SEQ ID NO: 759636 - DNA, 20 bp, mouse
gaggaggctaggggagaaca

SEQ ID NO: 759637 - DNA, 20 bp, mouse
gcccgcccctgacgcttcag

SEQ ID NO: 759638 - DNA, 20 bp, mouse
gaggctaggggagaacaggg

SEQ ID NO: 759639 - DNA, 20 bp, mouse
ggccgcgcagtctcagctca

SEQ ID NO: 759640 - DNA, 20 bp, mouse
gcagccaccgaggaggctag

SEQ ID NO: 759641 - DNA, 20 bp, mouse
ggctccacgcccaatctaat

SEQ ID NO: 759642 - DNA, 20 bp, mouse
gtctcccctagcctcctcgg

SEQ ID NO: 759643 - DNA, 20 bp, mouse
gcgctcgcccaatcccggag

SEQ ID NO: 759644 - DNA, 20 bp, mouse
gaagcccgctcgcccaatcc

SEQ ID NO: 759645 - DNA, 20 bp, mouse
gggcgcgcgcaaccggtggg

SEQ ID NO: 759646 - DNA, 20 bp, mouse
gcacccgggaggggctgcta

SEQ ID NO: 759647 - DNA, 20 bp, mouse
gcccaggcggcgctttcccg

SEQ ID NO: 759648 - DNA, 20 bp, mouse
gcgcaccggcctgcgatccg

SEQ ID NO: 759649 - DNA, 20 bp, mouse
gctggctgggactcccaggt

SEQ ID NO: 759650 - DNA, 20 bp, mouse
ggggtagggaggtcgctgta

SEQ ID NO: 759651 - DNA, 20 bp, mouse
gggggctgctagggataagg

SEQ ID NO: 759652 - DNA, 20 bp, mouse
ggcccagcccggcgcacgcg

SEQ ID NO: 759653 - DNA, 20 bp, mouse
gggaggggctgctagggata

SEQ ID NO: 759654 - DNA, 20 bp, mouse
gtccgcacccggctgtgcgt

SEQ ID NO: 759655 - DNA, 20 bp, mouse
gccgggctgggccggcccct

SEQ ID NO: 759656 - DNA, 20 bp, mouse
gaagacaaggcaactccaac

SEQ ID NO: 759657 - DNA, 20 bp, mouse
gaaggaccctagcaatgtgg

SEQ ID NO: 759658 - DNA, 20 bp, mouse
gcagacagtcatcatatcct

SEQ ID NO: 759659 - DNA, 20 bp, mouse
gagcctcctccacattgcta

SEQ ID NO: 759660 - DNA, 20 bp, mouse
gcactgatgtggggtaatag

SEQ ID NO: 759661 - DNA, 20 bp, mouse
gcccagcatctacacaacta

SEQ ID NO: 759662 - DNA, 20 bp, mouse
gtgctcacgcaactgataaa

SEQ ID NO: 759663 - DNA, 20 bp, mouse
gcagaaaagcccactgatgt

SEQ ID NO: 759664 - DNA, 20 bp, mouse
gctctttcttgatcaagcag

SEQ ID NO: 759665 - DNA, 20 bp, mouse
gagaaagagcctatttacaa

SEQ ID NO: 759666 - DNA, 20 bp, mouse
ggcggcggctgagaacgagt

SEQ ID NO: 759667 - DNA, 20 bp, mouse
gggagcggggacaacttcgg

SEQ ID NO: 759668 - DNA, 20 bp, mouse
gtggggagcggggacaactt

SEQ ID NO: 759669 - DNA, 20 bp, mouse
gccgccgccgccacacctag

SEQ ID NO: 759670 - DNA, 20 bp, mouse
ggaggccgccgggagaactg

SEQ ID NO: 759671 - DNA, 20 bp, mouse
gcctccgctaggtgtggcgg

SEQ ID NO: 759672 - DNA, 20 bp, mouse
ggaactgcggccggagcccg

SEQ ID NO: 759673 - DNA, 20 bp, mouse
gaccgcggcttgggggtccc

SEQ ID NO: 759674 - DNA, 20 bp, mouse
gcgagcgccggtcccggctg

SEQ ID NO: 759675 - DNA, 20 bp, mouse
gcggcgctcggtcacctgat

SEQ ID NO: 759676 - DNA, 20 bp, mouse
gtggaggatagcagtcacta

SEQ ID NO: 759677 - DNA, 20 bp, mouse
gaagcacaagagggctctga

SEQ ID NO: 759678 - DNA, 20 bp, mouse
gaagaagtgggcggaagctg

SEQ ID NO: 759679 - DNA, 20 bp, mouse
gggtaagtgtagaggtgaat

SEQ ID NO: 759680 - DNA, 20 bp, mouse
ggtactgcacaaccagaaag

SEQ ID NO: 759681 - DNA, 20 bp, mouse
gcctcttgcaccctcagcag

SEQ ID NO: 759682 - DNA, 20 bp, mouse
gcagtacttcagtaagaagt

SEQ ID NO: 759683 - DNA, 20 bp, mouse
gagcagtcactatggctcac

SEQ ID NO: 759684 - DNA, 20 bp, mouse
ggccccaaatattctcagcc

SEQ ID NO: 759685 - DNA, 20 bp, mouse
gtaaaaggacccgccctggt

SEQ ID NO: 759686 - DNA, 20 bp, mouse
gatacagtctggttcctctg

SEQ ID NO: 759687 - DNA, 20 bp, mouse
gtatctcagcagtcacctgg

SEQ ID NO: 759688 - DNA, 20 bp, mouse
gcaccaaaatctacagaagt

SEQ ID NO: 759689 - DNA, 20 bp, mouse
gtagagactctgatacagtc

SEQ ID NO: 759690 - DNA, 20 bp, mouse
gctcactctactaaacaagg

SEQ ID NO: 759691 - DNA, 20 bp, mouse
gtctgtggcagtcttcagta

SEQ ID NO: 759692 - DNA, 20 bp, mouse
gataaaggctagaatgtcag

SEQ ID NO: 759693 - DNA, 20 bp, mouse
gagcctgtgacatgaccacc

SEQ ID NO: 759694 - DNA, 20 bp, mouse
gcttaacaggtagcattctc

SEQ ID NO: 759695 - DNA, 20 bp, mouse
gggctctgttagatccatcc

SEQ ID NO: 759696 - DNA, 20 bp, mouse
gtaggggagtactttctgaa

SEQ ID NO: 759697 - DNA, 20 bp, mouse
ggcccagggcagctgaaaag

SEQ ID NO: 759698 - DNA, 20 bp, mouse
gtggggctcccacgaggcag

SEQ ID NO: 759699 - DNA, 20 bp, mouse
ggcagcggagaagtcagaaa

SEQ ID NO: 759700 - DNA, 20 bp, mouse
gccgatcacgaggagaactt

SEQ ID NO: 759701 - DNA, 20 bp, mouse
gcctactgaactacaaggaa

SEQ ID NO: 759702 - DNA, 20 bp, mouse
gccgggcgatcccgatcacg

SEQ ID NO: 759703 - DNA, 20 bp, mouse
gtgaaaggggtgacttatta

SEQ ID NO: 759704 - DNA, 20 bp, mouse
gtgactcctactgaactaca

SEQ ID NO: 759705 - DNA, 20 bp, mouse
gtacatgggacgcacgccca

SEQ ID NO: 759706 - DNA, 20 bp, mouse
ggccgcgcctgccttaccac

SEQ ID NO: 759707 - DNA, 20 bp, mouse
gtggagttggggaccctcct

SEQ ID NO: 759708 - DNA, 20 bp, mouse
gagcaggcgcgcactcctat

SEQ ID NO: 759709 - DNA, 20 bp, mouse
gagactctgaatacccagag

SEQ ID NO: 759710 - DNA, 20 bp, mouse
gttggggaccctccttggga

SEQ ID NO: 759711 - DNA, 20 bp, mouse
gaagtggcactgctgtcccc

SEQ ID NO: 759712 - DNA, 20 bp, mouse
gagggccagagcggacccat

SEQ ID NO: 759713 - DNA, 20 bp, mouse
gcactcctatgggtccgctc

SEQ ID NO: 759714 - DNA, 20 bp, mouse
gagagattggcggaaccatt

SEQ ID NO: 759715 - DNA, 20 bp, mouse
gctgctgtccccaggcggag

SEQ ID NO: 759716 - DNA, 20 bp, mouse
gcagacttagctctcgtcct

SEQ ID NO: 759717 - DNA, 20 bp, mouse
gagcaccgggagcaccgcga

SEQ ID NO: 759718 - DNA, 20 bp, mouse
ggcgccgcttccgcccgagt

SEQ ID NO: 759719 - DNA, 20 bp, mouse
ggctcctggtgctggggatc

SEQ ID NO: 759720 - DNA, 20 bp, mouse
gatgccaggcccggccgagt

SEQ ID NO: 759721 - DNA, 20 bp, mouse
gctgggaggggcaggcaccc

SEQ ID NO: 759722 - DNA, 20 bp, mouse
gctgcccactcgggcggaag

SEQ ID NO: 759723 - DNA, 20 bp, mouse
gagagctaagtctgcccggc

SEQ ID NO: 759724 - DNA, 20 bp, mouse
gctgacctgcaaagccttcg

SEQ ID NO: 759725 - DNA, 20 bp, mouse
gggaacatctggatagagct

SEQ ID NO: 759726 - DNA, 20 bp, mouse
gaaacctctctcggccgcga

SEQ ID NO: 759727 - DNA, 20 bp, mouse
ggggcgcggcgctccaatac

SEQ ID NO: 759728 - DNA, 20 bp, mouse
ggcggccgagagaggtttgg

SEQ ID NO: 759729 - DNA, 20 bp, mouse
gcgccccgccaaacctctct

SEQ ID NO: 759730 - DNA, 20 bp, mouse
gcgcacgcgcggcgtgtcac

SEQ ID NO: 759731 - DNA, 20 bp, mouse
ggcacctgagctgggaaagg

SEQ ID NO: 759732 - DNA, 20 bp, mouse
gactccagtcagctgactta

SEQ ID NO: 759733 - DNA, 20 bp, mouse
gagcgagtcggctccagtat

SEQ ID NO: 759734 - DNA, 20 bp, mouse
gccgactcgctcctggggcg

SEQ ID NO: 759735 - DNA, 20 bp, mouse
ggtcagctgactggagtctg

SEQ ID NO: 759736 - DNA, 20 bp, mouse
gagggcggggctcttagggg

SEQ ID NO: 759737 - DNA, 20 bp, mouse
ggacgagggcggggctctta

SEQ ID NO: 759738 - DNA, 20 bp, mouse
gctaaggcttgacgagggcg

SEQ ID NO: 759739 - DNA, 20 bp, mouse
gcacgcctgcgcagtgggac

SEQ ID NO: 759740 - DNA, 20 bp, mouse
ggcagcgtgaggcgggccta

SEQ ID NO: 759741 - DNA, 20 bp, mouse
gccaaacgagtcccgccctc

SEQ ID NO: 759742 - DNA, 20 bp, mouse
ggggacgggcgagtttggcg

SEQ ID NO: 759743 - DNA, 20 bp, mouse
ggacggacgcgagctctggt

SEQ ID NO: 759744 - DNA, 20 bp, mouse
gggcccaggcggacgttgac

SEQ ID NO: 759745 - DNA, 20 bp, mouse
gccaaccgcgagccttaacg

SEQ ID NO: 759746 - DNA, 20 bp, mouse
gccgcgcgctgtggaaccct

SEQ ID NO: 759747 - DNA, 20 bp, mouse
gagtgtgcctacaactccca

SEQ ID NO: 759748 - DNA, 20 bp, mouse
ggtgccgctcctagaagcta

SEQ ID NO: 759749 - DNA, 20 bp, mouse
gcgcggagccgtttaaaacg

SEQ ID NO: 759750 - DNA, 20 bp, mouse
gacagcccgcgcctgcccta

SEQ ID NO: 759751 - DNA, 20 bp, mouse
gcacacttagactcgcacta

SEQ ID NO: 759752 - DNA, 20 bp, mouse
ggtgctgcccgaaggaccct

SEQ ID NO: 759753 - DNA, 20 bp, mouse
gaggaccctagggcaggcgc

SEQ ID NO: 759754 - DNA, 20 bp, mouse
gtaaacggctccgcgcgctg

SEQ ID NO: 759755 - DNA, 20 bp, mouse
gagtgggactacaacttcca

SEQ ID NO: 759756 - DNA, 20 bp, mouse
gcaggaggagagagcgacgt

SEQ ID NO: 759757 - DNA, 20 bp, mouse
gagacctgaagtcccctgag

SEQ ID NO: 759758 - DNA, 20 bp, mouse
gctggaagaagtgggtgcgg

SEQ ID NO: 759759 - DNA, 20 bp, mouse
gggagcgctgggcaggtgat

SEQ ID NO: 759760 - DNA, 20 bp, mouse
gcgttgacggagagctgaat

SEQ ID NO: 759761 - DNA, 20 bp, mouse
gacgtggggacactgcgggc

SEQ ID NO: 759762 - DNA, 20 bp, mouse
gctgccgctcaggggacttc

SEQ ID NO: 759763 - DNA, 20 bp, mouse
gggggagggtggtcactagt

SEQ ID NO: 759764 - DNA, 20 bp, mouse
ggggacactgcgggcggggc

SEQ ID NO: 759765 - DNA, 20 bp, mouse
gggaagggacctcgcgttga

SEQ ID NO: 759766 - DNA, 20 bp, mouse
ggcgggcagcttcagaagtt

SEQ ID NO: 759767 - DNA, 20 bp, mouse
gccctgccaggtcctgactt

SEQ ID NO: 759768 - DNA, 20 bp, mouse
gcagcttcagaagttgggat

SEQ ID NO: 759769 - DNA, 20 bp, mouse
gacagaggggcatttgtccg

SEQ ID NO: 759770 - DNA, 20 bp, mouse
ggcccgcggtgagcgctgga

SEQ ID NO: 759771 - DNA, 20 bp, mouse
gaggcaagccagcgtgggga

SEQ ID NO: 759772 - DNA, 20 bp, mouse
ggtgctaggcaagccagcgt

SEQ ID NO: 759773 - DNA, 20 bp, mouse
gtacatgaggctccggtccc

SEQ ID NO: 759774 - DNA, 20 bp, mouse
gtcctgcccaagtcaggacc

SEQ ID NO: 759775 - DNA, 20 bp, mouse
gacagggggtgtactctctc

SEQ ID NO: 759776 - DNA, 20 bp, mouse
gtgggtggggcggggctcga

SEQ ID NO: 759777 - DNA, 20 bp, mouse
ggcgcgccgtcggagccaga

SEQ ID NO: 759778 - DNA, 20 bp, mouse
ggctctgggcctgtccgcgg

SEQ ID NO: 759779 - DNA, 20 bp, mouse
ggccccgccccacccactcg

SEQ ID NO: 759780 - DNA, 20 bp, mouse
ggggcggcttcacgctgcgc

SEQ ID NO: 759781 - DNA, 20 bp, mouse
gtgagggcggagccgcgagt

SEQ ID NO: 759782 - DNA, 20 bp, mouse
ggctgcccggggcgcgccgt

SEQ ID NO: 759783 - DNA, 20 bp, mouse
gcgtgcctgcggccggcaga

SEQ ID NO: 759784 - DNA, 20 bp, mouse
gccctgccccctccgcggac

SEQ ID NO: 759785 - DNA, 20 bp, mouse
gcacgctgcgcggggctgga

SEQ ID NO: 759786 - DNA, 20 bp, mouse
gcgagctcgcgagcagggga

SEQ ID NO: 759787 - DNA, 20 bp, mouse
gcgaacgctgtcaccgctca

SEQ ID NO: 759788 - DNA, 20 bp, mouse
gcgtgggcccgggaacaccg

SEQ ID NO: 759789 - DNA, 20 bp, mouse
ggacagcgttcgctcggagg

SEQ ID NO: 759790 - DNA, 20 bp, mouse
ggtcccgcgcccccgagcgt

SEQ ID NO: 759791 - DNA, 20 bp, mouse
gttcccgggcccacgctcgg

SEQ ID NO: 759792 - DNA, 20 bp, mouse
gaccgcgcgagctcgcgagc

SEQ ID NO: 759793 - DNA, 20 bp, mouse
gcgcaagtgcagagccgcgg

SEQ ID NO: 759794 - DNA, 20 bp, mouse
gcaccgctcaggggaccggg

SEQ ID NO: 759795 - DNA, 20 bp, mouse
ggggtagccccggtgttccc

SEQ ID NO: 759796 - DNA, 20 bp, mouse
gacagccagattcgggtcgg

SEQ ID NO: 759797 - DNA, 20 bp, mouse
gtgatggggcagtgagccaa

SEQ ID NO: 759798 - DNA, 20 bp, mouse
ggaggagggtgctcgagctc

SEQ ID NO: 759799 - DNA, 20 bp, mouse
gcctcccaccgacccgaatc

SEQ ID NO: 759800 - DNA, 20 bp, mouse
ggtcactcccggagagtaag

SEQ ID NO: 759801 - DNA, 20 bp, mouse
gggccggggaccctcctctc

SEQ ID NO: 759802 - DNA, 20 bp, mouse
gtctggctgtgcctgactga

SEQ ID NO: 759803 - DNA, 20 bp, mouse
gacccgagccccttactctc

SEQ ID NO: 759804 - DNA, 20 bp, mouse
gggggcagtgagccaatgga

SEQ ID NO: 759805 - DNA, 20 bp, mouse
ggctcccggggaggcgtcca

SEQ ID NO: 759806 - DNA, 20 bp, mouse
gacgtcctcttcacctccag

SEQ ID NO: 759807 - DNA, 20 bp, mouse
ggggccgtgcgcgaggcagg

SEQ ID NO: 759808 - DNA, 20 bp, mouse
gccagccgctggaggtgaag

SEQ ID NO: 759809 - DNA, 20 bp, mouse
ggaagtcaggaattccagga

SEQ ID NO: 759810 - DNA, 20 bp, mouse
ggaggggaacccaggcctcg

SEQ ID NO: 759811 - DNA, 20 bp, mouse
gggaggtgaagaggacgttc

SEQ ID NO: 759812 - DNA, 20 bp, mouse
gggtgagctgaggggaaccc

SEQ ID NO: 759813 - DNA, 20 bp, mouse
gcctcagctcacccagccgc

SEQ ID NO: 759814 - DNA, 20 bp, mouse
gcccagcactacgggtccca

SEQ ID NO: 759815 - DNA, 20 bp, mouse
gacaacgccccctcagctac

SEQ ID NO: 759816 - DNA, 20 bp, mouse
gttcttagagctcaacgtgg

SEQ ID NO: 759817 - DNA, 20 bp, mouse
gaagacagagttctcgcgat

SEQ ID NO: 759818 - DNA, 20 bp, mouse
ggcactggaaccaggaggta

SEQ ID NO: 759819 - DNA, 20 bp, mouse
gacgaaaatgatccagacta

SEQ ID NO: 759820 - DNA, 20 bp, mouse
gcgcgagaactctgtcttca

SEQ ID NO: 759821 - DNA, 20 bp, mouse
ggcctccctaccacgcttct

SEQ ID NO: 759822 - DNA, 20 bp, mouse
gggattagagacttactgat

SEQ ID NO: 759823 - DNA, 20 bp, mouse
gactaccgagaagcgtggta

SEQ ID NO: 759824 - DNA, 20 bp, mouse
gttcccagccacctacagga

SEQ ID NO: 759825 - DNA, 20 bp, mouse
gctctaagaagactttgcgc

SEQ ID NO: 759826 - DNA, 20 bp, mouse
gcccacggaggccctgtggt

SEQ ID NO: 759827 - DNA, 20 bp, mouse
ggggcccagcggcggtcaag

SEQ ID NO: 759828 - DNA, 20 bp, mouse
gagcccctccccgggcccag

SEQ ID NO: 759829 - DNA, 20 bp, mouse
gcccggggaggggctgccga

SEQ ID NO: 759830 - DNA, 20 bp, mouse
gtaactacagagaacaagcg

SEQ ID NO: 759831 - DNA, 20 bp, mouse
gaggcggggcgtgacctggc

SEQ ID NO: 759832 - DNA, 20 bp, mouse
ggggcgtgacctggccggta

SEQ ID NO: 759833 - DNA, 20 bp, mouse
ggagacctcttgaccgccgc

SEQ ID NO: 759834 - DNA, 20 bp, mouse
gcccagcctcgcgcccacgg

SEQ ID NO: 759835 - DNA, 20 bp, mouse
gaacggtccagcagccgact

SEQ ID NO: 759836 - DNA, 20 bp, mouse
ggggcgaggcggtggttctg

SEQ ID NO: 759837 - DNA, 20 bp, mouse
gagcctgcgggtttacggca

SEQ ID NO: 759838 - DNA, 20 bp, mouse
gcgaggcggtggttctgggg

SEQ ID NO: 759839 - DNA, 20 bp, mouse
ggcccccgtcgccaaggaga

SEQ ID NO: 759840 - DNA, 20 bp, mouse
gcctagtaacggggtctcag

SEQ ID NO: 759841 - DNA, 20 bp, mouse
gccagcggttgcctagtaac

SEQ ID NO: 759842 - DNA, 20 bp, mouse
gagtaacggggtctcagtgg

SEQ ID NO: 759843 - DNA, 20 bp, mouse
gggggcggagtgtggaggta

SEQ ID NO: 759844 - DNA, 20 bp, mouse
gcacgaggcaatggcggccg

SEQ ID NO: 759845 - DNA, 20 bp, mouse
gccacgcctgcgccccgcgc

SEQ ID NO: 759846 - DNA, 20 bp, mouse
gaggggacgcccgatcacgt

SEQ ID NO: 759847 - DNA, 20 bp, mouse
gggcccctgcccacgtgatc

SEQ ID NO: 759848 - DNA, 20 bp, mouse
gcgagcgagcgtgcgagctc

SEQ ID NO: 759849 - DNA, 20 bp, mouse
gagcgtgcgagctccggtgc

SEQ ID NO: 759850 - DNA, 20 bp, mouse
gcgtcccctggcgcgcaagg

SEQ ID NO: 759851 - DNA, 20 bp, mouse
gctcagggagccggtgggga

SEQ ID NO: 759852 - DNA, 20 bp, mouse
ggggcgtcccctggcgcgca

SEQ ID NO: 759853 - DNA, 20 bp, mouse
gacgcccgatcacgtgggca

SEQ ID NO: 759854 - DNA, 20 bp, mouse
gtcccggcgcagaagaaatg

SEQ ID NO: 759855 - DNA, 20 bp, mouse
gagtctgctaaggtggtggt

SEQ ID NO: 759856 - DNA, 20 bp, mouse
ggcgctgcactcgtctgctg

SEQ ID NO: 759857 - DNA, 20 bp, mouse
ggcagcccgcatcgctaagg

SEQ ID NO: 759858 - DNA, 20 bp, mouse
ggcagcgcgcgccccgggtc

SEQ ID NO: 759859 - DNA, 20 bp, mouse
ggcctcgagcaccccggcgg

SEQ ID NO: 759860 - DNA, 20 bp, mouse
gccgctgggcccagggttcg

SEQ ID NO: 759861 - DNA, 20 bp, mouse
gcccgcatcgctaaggcggt

SEQ ID NO: 759862 - DNA, 20 bp, mouse
gcgcccggcgccctgaccgt

SEQ ID NO: 759863 - DNA, 20 bp, mouse
gtctagctccgcccgacccg

SEQ ID NO: 759864 - DNA, 20 bp, mouse
gtgcggggtgcgctcctgaa

SEQ ID NO: 759865 - DNA, 20 bp, mouse
gaggctggacagcctcgagg

SEQ ID NO: 759866 - DNA, 20 bp, mouse
gggggcgggcatgagtgcga

SEQ ID NO: 759867 - DNA, 20 bp, mouse
gcgcccggggccttcccctc

SEQ ID NO: 759868 - DNA, 20 bp, mouse
ggtccgcgacccaggaagcg

SEQ ID NO: 759869 - DNA, 20 bp, mouse
ggtggcagccatcgcgtcct

SEQ ID NO: 759870 - DNA, 20 bp, mouse
gctccaggccgaggacgcga

SEQ ID NO: 759871 - DNA, 20 bp, mouse
gtccccgggagaacggagtg

SEQ ID NO: 759872 - DNA, 20 bp, mouse
ggacgcgatggctgccacgg

SEQ ID NO: 759873 - DNA, 20 bp, mouse
ggccggaggcagcgctgccg

SEQ ID NO: 759874 - DNA, 20 bp, mouse
gggaggcagcgctgccgggg

SEQ ID NO: 759875 - DNA, 20 bp, mouse
gggcgcggcgtccgcgaccc

SEQ ID NO: 759876 - DNA, 20 bp, mouse
gtaggagggtcgctgggtta

SEQ ID NO: 759877 - DNA, 20 bp, mouse
gcaggtaggagactgtagga

SEQ ID NO: 759878 - DNA, 20 bp, mouse
ggtgccaagcctagcatggt

SEQ ID NO: 759879 - DNA, 20 bp, mouse
gtctctgtgctggtcagtct

SEQ ID NO: 759880 - DNA, 20 bp, mouse
gatggtgggagcaaagaaca

SEQ ID NO: 759881 - DNA, 20 bp, mouse
gtcctcaggtaggagactgt

SEQ ID NO: 759882 - DNA, 20 bp, mouse
gagactgtaggagggtcgct

SEQ ID NO: 759883 - DNA, 20 bp, mouse
ggggtgcgcgatcactacaa

SEQ ID NO: 759884 - DNA, 20 bp, mouse
gccgacttcccagataggtt

SEQ ID NO: 759885 - DNA, 20 bp, mouse
gcggggttccctaacctatc

SEQ ID NO: 759886 - DNA, 20 bp, mouse
gcatctgcgtgcgactctga

SEQ ID NO: 759887 - DNA, 20 bp, mouse
ggattcccgtgaagtctctg

SEQ ID NO: 759888 - DNA, 20 bp, mouse
ggctcggggtgcgcgcacgg

SEQ ID NO: 759889 - DNA, 20 bp, mouse
gcggagacgacgccccggga

SEQ ID NO: 759890 - DNA, 20 bp, mouse
ggggccctttaaggcggcag

SEQ ID NO: 759891 - DNA, 20 bp, mouse
gactctgagggctccgtggg

SEQ ID NO: 759892 - DNA, 20 bp, mouse
ggctccgtgggtggccctcc

SEQ ID NO: 759893 - DNA, 20 bp, mouse
gcggggtgcgtaggcctgga

SEQ ID NO: 759894 - DNA, 20 bp, mouse
ggcagctcggggtgcgcgca

SEQ ID NO: 759895 - DNA, 20 bp, mouse
gctggggttcgcggaggagg

SEQ ID NO: 759896 - DNA, 20 bp, mouse
ggtcctaggtcaatggtaaa

SEQ ID NO: 759897 - DNA, 20 bp, mouse
gcacacacatagttcagcac

SEQ ID NO: 759898 - DNA, 20 bp, mouse
gtcacagagcaaaaggtctg

SEQ ID NO: 759899 - DNA, 20 bp, mouse
ggcctgaagtcctaggtcaa

SEQ ID NO: 759900 - DNA, 20 bp, mouse
gaggacttcaggcaaaaact

SEQ ID NO: 759901 - DNA, 20 bp, mouse
ggagggagatgcacaggatg

SEQ ID NO: 759902 - DNA, 20 bp, mouse
gctccctttaccattgacct

SEQ ID NO: 759903 - DNA, 20 bp, mouse
gtcccatggtgactagtgtc

SEQ ID NO: 759904 - DNA, 20 bp, mouse
gtgtgtggattgagtccagt

SEQ ID NO: 759905 - DNA, 20 bp, mouse
gttgcagactgagcagttga

SEQ ID NO: 759906 - DNA, 20 bp, mouse
gggcgccgggcgatgagtgg

SEQ ID NO: 759907 - DNA, 20 bp, mouse
gcacgccgctgcggagaggg

SEQ ID NO: 759908 - DNA, 20 bp, mouse
gagctcgcgcctgtcggagc

SEQ ID NO: 759909 - DNA, 20 bp, mouse
gcgggaggcggggagcgtag

SEQ ID NO: 759910 - DNA, 20 bp, mouse
gcacccctggcgcgccggtg

SEQ ID NO: 759911 - DNA, 20 bp, mouse
ggaggcaccccctctcctgt

SEQ ID NO: 759912 - DNA, 20 bp, mouse
gctacgcagcccagtaacca

SEQ ID NO: 759913 - DNA, 20 bp, mouse
gggcgcgccaggggtggact

SEQ ID NO: 759914 - DNA, 20 bp, mouse
gcagggagggcccggaaaat

SEQ ID NO: 759915 - DNA, 20 bp, mouse
gaaccgagccccggcggctg

SEQ ID NO: 759916 - DNA, 20 bp, mouse
ggctcccggtggcactccca

SEQ ID NO: 759917 - DNA, 20 bp, mouse
gggacccgctaacctgacct

SEQ ID NO: 759918 - DNA, 20 bp, mouse
ggacccgggagtagctgacg

SEQ ID NO: 759919 - DNA, 20 bp, mouse
gaacccggaggaataaccga

SEQ ID NO: 759920 - DNA, 20 bp, mouse
gggctcctaggtcaggttag

SEQ ID NO: 759921 - DNA, 20 bp, mouse
gggagtgccaccgggagcgg

SEQ ID NO: 759922 - DNA, 20 bp, mouse
gctaggagcccgaggcctga

SEQ ID NO: 759923 - DNA, 20 bp, mouse
ggcgctcttcgtctcgaatt

SEQ ID NO: 759924 - DNA, 20 bp, mouse
ggcgcgcgggtcaaaggtag

SEQ ID NO: 759925 - DNA, 20 bp, mouse
gactcccgggtcgcggctcc

SEQ ID NO: 759926 - DNA, 20 bp, mouse
ggctacggggaagttctggc

SEQ ID NO: 759927 - DNA, 20 bp, mouse
gtgtggctacggggaagttc

SEQ ID NO: 759928 - DNA, 20 bp, mouse
gtggccggttgagtctgttc

SEQ ID NO: 759929 - DNA, 20 bp, mouse
gacctggaggcatgtggcta

SEQ ID NO: 759930 - DNA, 20 bp, mouse
gcgagtcacagcccacctgg

SEQ ID NO: 759931 - DNA, 20 bp, mouse
ggggaggtgagtcccgtaaa

SEQ ID NO: 759932 - DNA, 20 bp, mouse
ggactcgaggaagcgtcctc

SEQ ID NO: 759933 - DNA, 20 bp, mouse
gcctcgagtcacagcccacc

SEQ ID NO: 759934 - DNA, 20 bp, mouse
gaggcgaagctgcggagaga

SEQ ID NO: 759935 - DNA, 20 bp, mouse
gtcgcctgaacagactcaac

SEQ ID NO: 759936 - DNA, 20 bp, mouse
gttagcgtcggtgacccgaa

SEQ ID NO: 759937 - DNA, 20 bp, mouse
gacagggcgggactcccttc

SEQ ID NO: 759938 - DNA, 20 bp, mouse
gaggacgagtagggctgtcc

SEQ ID NO: 759939 - DNA, 20 bp, mouse
gccgacgctaacgacgacct

SEQ ID NO: 759940 - DNA, 20 bp, mouse
ggaacctcacgccgcctcat

SEQ ID NO: 759941 - DNA, 20 bp, mouse
ggctcgcttggcccccgatg

SEQ ID NO: 759942 - DNA, 20 bp, mouse
gtcgggggccaagcgagctc

SEQ ID NO: 759943 - DNA, 20 bp, mouse
ggaagagcccagagctcgct

SEQ ID NO: 759944 - DNA, 20 bp, mouse
gaggacccaagcctatgagg

SEQ ID NO: 759945 - DNA, 20 bp, mouse
ggatgccagcttcccggaca

SEQ ID NO: 759946 - DNA, 20 bp, mouse
ggctgggccaagcctcggtg

SEQ ID NO: 759947 - DNA, 20 bp, mouse
gcggaaggcgggcgtggaga

SEQ ID NO: 759948 - DNA, 20 bp, mouse
ggcccctcccgcccccaccg

SEQ ID NO: 759949 - DNA, 20 bp, mouse
gggccactggcccggaaggc

SEQ ID NO: 759950 - DNA, 20 bp, mouse
gagcgcaaagaagcgaggtt

SEQ ID NO: 759951 - DNA, 20 bp, mouse
ggcgcggctgggccaagcct

SEQ ID NO: 759952 - DNA, 20 bp, mouse
ggcaccgcgcagtaccggcg

SEQ ID NO: 759953 - DNA, 20 bp, mouse
ggaggcgcaggccactggcc

SEQ ID NO: 759954 - DNA, 20 bp, mouse
gcagtggcctgcgcctcctg

SEQ ID NO: 759955 - DNA, 20 bp, mouse
gcagtaccggcgaggctgga

SEQ ID NO: 759956 - DNA, 20 bp, mouse
gctcctccccgacacgtcag

SEQ ID NO: 759957 - DNA, 20 bp, mouse
ggatacgcggagtggagctc

SEQ ID NO: 759958 - DNA, 20 bp, mouse
gagcccggtgcggggatacg

SEQ ID NO: 759959 - DNA, 20 bp, mouse
gcagcgcgcaaagcctaggt

SEQ ID NO: 759960 - DNA, 20 bp, mouse
gcaagagcatgcgcagaagc

SEQ ID NO: 759961 - DNA, 20 bp, mouse
gagcaggctggcgtgcgggg

SEQ ID NO: 759962 - DNA, 20 bp, mouse
gccggacccccgaaggaggt

SEQ ID NO: 759963 - DNA, 20 bp, mouse
gctaaaaaacccacctcctt

SEQ ID NO: 759964 - DNA, 20 bp, mouse
gcagaagcaggctggcgtgc

SEQ ID NO: 759965 - DNA, 20 bp, mouse
gtcctgcgcaggcgccgccc

SEQ ID NO: 759966 - DNA, 20 bp, mouse
ggcccccgccgcagctactc

SEQ ID NO: 759967 - DNA, 20 bp, mouse
gcacgtacatcctcagggtc

SEQ ID NO: 759968 - DNA, 20 bp, mouse
gtcctccccaggggccgcgg

SEQ ID NO: 759969 - DNA, 20 bp, mouse
gtgaggatggcagttatgaa

SEQ ID NO: 759970 - DNA, 20 bp, mouse
gaaggcgacttcagcgactc

SEQ ID NO: 759971 - DNA, 20 bp, mouse
gcccgccagtccagaccctg

SEQ ID NO: 759972 - DNA, 20 bp, mouse
gaaacctcaaccctgcaaga

SEQ ID NO: 759973 - DNA, 20 bp, mouse
ggggcggggtatagtgcgga

SEQ ID NO: 759974 - DNA, 20 bp, mouse
gtagctgcggcgggggcgag

SEQ ID NO: 759975 - DNA, 20 bp, mouse
gagcgactccggagtagctg

SEQ ID NO: 759976 - DNA, 20 bp, mouse
gtgggcggtggcaaccgaag

SEQ ID NO: 759977 - DNA, 20 bp, mouse
gtccggaggtgtccctaggt

SEQ ID NO: 759978 - DNA, 20 bp, mouse
gaagtccccgggagccctct

SEQ ID NO: 759979 - DNA, 20 bp, mouse
gacaacctagagggctcccg

SEQ ID NO: 759980 - DNA, 20 bp, mouse
gcggctccggaggtgtccct

SEQ ID NO: 759981 - DNA, 20 bp, mouse
ggactagatgacaacctaga

SEQ ID NO: 759982 - DNA, 20 bp, mouse
gcgcggacgcgcatgctctc

SEQ ID NO: 759983 - DNA, 20 bp, mouse
gtgagggcaggtttcactgt

SEQ ID NO: 759984 - DNA, 20 bp, mouse
gccccgccaggcgacctcgg

SEQ ID NO: 759985 - DNA, 20 bp, mouse
gaggctggggactaataaaa

SEQ ID NO: 759986 - DNA, 20 bp, mouse
gcccaaccactggggtctaa

SEQ ID NO: 759987 - DNA, 20 bp, mouse
gtctaagggagggtaccact

SEQ ID NO: 759988 - DNA, 20 bp, mouse
gaccactggggtctaaggga

SEQ ID NO: 759989 - DNA, 20 bp, mouse
gcagcaaagcccaaccactg

SEQ ID NO: 759990 - DNA, 20 bp, mouse
gcacagaactagatgatggt

SEQ ID NO: 759991 - DNA, 20 bp, mouse
gatggcacagaactagatga

SEQ ID NO: 759992 - DNA, 20 bp, mouse
gaagggtggtagggctggaa

SEQ ID NO: 759993 - DNA, 20 bp, mouse
gagggaaagaaacaagttga

SEQ ID NO: 759994 - DNA, 20 bp, mouse
gtgttgggaagccagaaggg

SEQ ID NO: 759995 - DNA, 20 bp, mouse
gatctagttctgtgccatac

SEQ ID NO: 759996 - DNA, 20 bp, mouse
gagggcgcgaggcacgaagg

SEQ ID NO: 759997 - DNA, 20 bp, mouse
ggtgaggagtacttggtcgt

SEQ ID NO: 759998 - DNA, 20 bp, mouse
gccctcgtggggttgcagtc

SEQ ID NO: 759999 - DNA, 20 bp, mouse
gccgggcaaggagtgtgcgc

SEQ ID NO: 760000 - DNA, 20 bp, mouse
gagaggcggcggctcatacg

SEQ ID NO: 760001 - DNA, 20 bp, mouse
gcctcacacaagaccctcgt

SEQ ID NO: 760002 - DNA, 20 bp, mouse
gtgcgcgagagaggcagcaa

SEQ ID NO: 760003 - DNA, 20 bp, mouse
gcctctgtggctggtgcacg

SEQ ID NO: 760004 - DNA, 20 bp, mouse
ggtggggttgcagtctggtg

SEQ ID NO: 760005 - DNA, 20 bp, mouse
ggagagggcgcgaggcacga

SEQ ID NO: 760006 - DNA, 20 bp, mouse
gaaaactggggataaagccc

SEQ ID NO: 760007 - DNA, 20 bp, mouse
gagtgtgcggttgagttcta

SEQ ID NO: 760008 - DNA, 20 bp, mouse
gtagctactgcgcatgcgga

SEQ ID NO: 760009 - DNA, 20 bp, mouse
gtcgccggcgcgctgcgtcc

SEQ ID NO: 760010 - DNA, 20 bp, mouse
gcctcccggacgcagcgcgc

SEQ ID NO: 760011 - DNA, 20 bp, mouse
ggaggcggagcgatacgact

SEQ ID NO: 760012 - DNA, 20 bp, mouse
gtgtgcgggtgggaaaataa

SEQ ID NO: 760013 - DNA, 20 bp, mouse
ggcgcgtgacgtcacgtcgc

SEQ ID NO: 760014 - DNA, 20 bp, mouse
gatgcggagggcctcggcgc

SEQ ID NO: 760015 - DNA, 20 bp, mouse
gggagctgctgccagcgccg

SEQ ID NO: 760016 - DNA, 20 bp, mouse
gagccccagggccggcgtcc

SEQ ID NO: 760017 - DNA, 20 bp, mouse
gctggggctctgcgaccctg

SEQ ID NO: 760018 - DNA, 20 bp, mouse
gaccctgaggaccccaaccc

SEQ ID NO: 760019 - DNA, 20 bp, mouse
gccggcgtccaggccaggtt

SEQ ID NO: 760020 - DNA, 20 bp, mouse
gaccccggacccggaaccgg

SEQ ID NO: 760021 - DNA, 20 bp, mouse
gccaaccccggacccggaac

SEQ ID NO: 760022 - DNA, 20 bp, mouse
gaggaccccaaccccggacc

SEQ ID NO: 760023 - DNA, 20 bp, mouse
gcggtcgccaggtctgcggt

SEQ ID NO: 760024 - DNA, 20 bp, mouse
gtgctgccgccgctgcacac

SEQ ID NO: 760025 - DNA, 20 bp, mouse
gctggcctggacgccggccc

SEQ ID NO: 760026 - DNA, 20 bp, mouse
gggaataccacggaaatgtt

SEQ ID NO: 760027 - DNA, 20 bp, mouse
gagagcgcctaacatttccg

SEQ ID NO: 760028 - DNA, 20 bp, mouse
gactgctcggatcttttcca

SEQ ID NO: 760029 - DNA, 20 bp, mouse
gttaggcgctctcgttatcg

SEQ ID NO: 760030 - DNA, 20 bp, mouse
ggcagcagcgctctagcaaa

SEQ ID NO: 760031 - DNA, 20 bp, mouse
gctcatcttaagatgctcca

SEQ ID NO: 760032 - DNA, 20 bp, mouse
ggattgatatatgcctgcaa

SEQ ID NO: 760033 - DNA, 20 bp, mouse
gcatatatcaatcaggcgtg

SEQ ID NO: 760034 - DNA, 20 bp, mouse
gctgttgtttaagcgaccca

SEQ ID NO: 760035 - DNA, 20 bp, mouse
ggaagttgaaatgctaaggg

SEQ ID NO: 760036 - DNA, 20 bp, mouse
gctcgtgctgcaccctgcct

SEQ ID NO: 760037 - DNA, 20 bp, mouse
gtccagtcgcgcccctgcaa

SEQ ID NO: 760038 - DNA, 20 bp, mouse
gggtcccgagagcggatcac

SEQ ID NO: 760039 - DNA, 20 bp, mouse
gcacgccgcggtcccgagag

SEQ ID NO: 760040 - DNA, 20 bp, mouse
gacgaggcgggccggagaaa

SEQ ID NO: 760041 - DNA, 20 bp, mouse
gcaaaggcttgcgcaacagg

SEQ ID NO: 760042 - DNA, 20 bp, mouse
ggcagggtgcagcacgaggc

SEQ ID NO: 760043 - DNA, 20 bp, mouse
gtcccagcgcagcaggagac

SEQ ID NO: 760044 - DNA, 20 bp, mouse
gcgaacgtgtgcccaccgag

SEQ ID NO: 760045 - DNA, 20 bp, mouse
ggagacccggaggaagtggg

SEQ ID NO: 760046 - DNA, 20 bp, mouse
ggggcgagagggtgcggctt

SEQ ID NO: 760047 - DNA, 20 bp, mouse
gtaccaggggaggggcgaga

SEQ ID NO: 760048 - DNA, 20 bp, mouse
gcgcctgggctaccagggga

SEQ ID NO: 760049 - DNA, 20 bp, mouse
gcgggcggagctgaaatcgt

SEQ ID NO: 760050 - DNA, 20 bp, mouse
ggtccccacgcccacatcaa

SEQ ID NO: 760051 - DNA, 20 bp, mouse
gtctggagacggggcgtcga

SEQ ID NO: 760052 - DNA, 20 bp, mouse
gtgggcgtggggaccatttg

SEQ ID NO: 760053 - DNA, 20 bp, mouse
gtgaagtggggtgagcgtgg

SEQ ID NO: 760054 - DNA, 20 bp, mouse
gtctgcaagggtggagtaaa

SEQ ID NO: 760055 - DNA, 20 bp, mouse
gcgctgccactcaatctggg

SEQ ID NO: 760056 - DNA, 20 bp, mouse
ggcgctgctagagactctgt

SEQ ID NO: 760057 - DNA, 20 bp, mouse
gtacagacaaaatggtggtc

SEQ ID NO: 760058 - DNA, 20 bp, mouse
gaggccgggctgaacgcgat

SEQ ID NO: 760059 - DNA, 20 bp, mouse
gttgctcagaactgccagga

SEQ ID NO: 760060 - DNA, 20 bp, mouse
gcctccgcccgctgtggtag

SEQ ID NO: 760061 - DNA, 20 bp, mouse
gtgaacgcgataggctcggg

SEQ ID NO: 760062 - DNA, 20 bp, mouse
gtcttcttgcggtgtcccgg

SEQ ID NO: 760063 - DNA, 20 bp, mouse
gcacacctacctctccctca

SEQ ID NO: 760064 - DNA, 20 bp, mouse
gggcgcgctgaggatgccgg

SEQ ID NO: 760065 - DNA, 20 bp, mouse
ggaccgcgaggacccggggc

SEQ ID NO: 760066 - DNA, 20 bp, mouse
ggcagaagctggggaccctc

SEQ ID NO: 760067 - DNA, 20 bp, mouse
gggaccctcaggatgctgtg

SEQ ID NO: 760068 - DNA, 20 bp, mouse
gtgtgtggctcgggagggag

SEQ ID NO: 760069 - DNA, 20 bp, mouse
gagggctccgggtgagcaag

SEQ ID NO: 760070 - DNA, 20 bp, mouse
gacagccaatgcgggagcga

SEQ ID NO: 760071 - DNA, 20 bp, mouse
gaatgcgggagcgagggctc

SEQ ID NO: 760072 - DNA, 20 bp, mouse
gcaccctggcaccatccatt

SEQ ID NO: 760073 - DNA, 20 bp, mouse
ggctgcgcagaaaccttgca

SEQ ID NO: 760074 - DNA, 20 bp, mouse
gagacaaacctggctccaat

SEQ ID NO: 760075 - DNA, 20 bp, mouse
gcccagcttctgccgctcaa

SEQ ID NO: 760076 - DNA, 20 bp, mouse
gtgagaagacccacaggccg

SEQ ID NO: 760077 - DNA, 20 bp, mouse
gggggcgtgcccacgtgggt

SEQ ID NO: 760078 - DNA, 20 bp, mouse
ggcccggtgagaagacccac

SEQ ID NO: 760079 - DNA, 20 bp, mouse
gggactgtctcgggctgtct

SEQ ID NO: 760080 - DNA, 20 bp, mouse
gagaaacgctggacagagac

SEQ ID NO: 760081 - DNA, 20 bp, mouse
gcgtctgaggggacaccctg

SEQ ID NO: 760082 - DNA, 20 bp, mouse
gagactcccacggggaacct

SEQ ID NO: 760083 - DNA, 20 bp, mouse
gagcgccagagactcccacg

SEQ ID NO: 760084 - DNA, 20 bp, mouse
gggctggagctggactgtct

SEQ ID NO: 760085 - DNA, 20 bp, mouse
ggcgcctgacctcccaaaga

SEQ ID NO: 760086 - DNA, 20 bp, mouse
gcggcgccccctggctggtt

SEQ ID NO: 760087 - DNA, 20 bp, mouse
gaccctgtgggcccaacgtg

SEQ ID NO: 760088 - DNA, 20 bp, mouse
ggggcccacagggtaaaggc

SEQ ID NO: 760089 - DNA, 20 bp, mouse
ggtgacataaaggggtgtag

SEQ ID NO: 760090 - DNA, 20 bp, mouse
gggtaaaggctgggatgctg

SEQ ID NO: 760091 - DNA, 20 bp, mouse
gtcctcacgttgggcccaca

SEQ ID NO: 760092 - DNA, 20 bp, mouse
gagcggcatgcggcgccccc

SEQ ID NO: 760093 - DNA, 20 bp, mouse
ggggcacttttgctctgcac

SEQ ID NO: 760094 - DNA, 20 bp, mouse
gaacctcagtctcgccatgt

SEQ ID NO: 760095 - DNA, 20 bp, mouse
gctgctgttgactgctccca

SEQ ID NO: 760096 - DNA, 20 bp, mouse
gggacggggtccaccctggt

SEQ ID NO: 760097 - DNA, 20 bp, mouse
gccacccggcgtggaggacg

SEQ ID NO: 760098 - DNA, 20 bp, mouse
gtcacgcagcggccacgctc

SEQ ID NO: 760099 - DNA, 20 bp, mouse
gagcccgcgtaccaagggcg

SEQ ID NO: 760100 - DNA, 20 bp, mouse
ggggacctgggataagccga

SEQ ID NO: 760101 - DNA, 20 bp, mouse
gtggaccccgtcctccacgc

SEQ ID NO: 760102 - DNA, 20 bp, mouse
gagggccgtcggcttatccc

SEQ ID NO: 760103 - DNA, 20 bp, mouse
ggagggagcccgcgtaccaa

SEQ ID NO: 760104 - DNA, 20 bp, mouse
gactcggcccaccgcctaag

SEQ ID NO: 760105 - DNA, 20 bp, mouse
gtggccccgcccttggtacg

SEQ ID NO: 760106 - DNA, 20 bp, mouse
gcacccaggagactgcgcgc

SEQ ID NO: 760107 - DNA, 20 bp, mouse
gcccgcgcgcgctcttggac

SEQ ID NO: 760108 - DNA, 20 bp, mouse
gcgcccgggaagctgcggga

SEQ ID NO: 760109 - DNA, 20 bp, mouse
gaccggcgctcgtcccacgc

SEQ ID NO: 760110 - DNA, 20 bp, mouse
ggaggggctggcaggacgag

SEQ ID NO: 760111 - DNA, 20 bp, mouse
gggagactgcgcgccggcgt

SEQ ID NO: 760112 - DNA, 20 bp, mouse
gccaaccgcccgggaagctg

SEQ ID NO: 760113 - DNA, 20 bp, mouse
gcagccgcctcccccagcat

SEQ ID NO: 760114 - DNA, 20 bp, mouse
ggaagctgcgggagggagtc

SEQ ID NO: 760115 - DNA, 20 bp, mouse
gccgccccgccctgagctcc

SEQ ID NO: 760116 - DNA, 20 bp, mouse
gactatgaaggcagctctgc

SEQ ID NO: 760117 - DNA, 20 bp, mouse
gtgtgtaacatcccactgcc

SEQ ID NO: 760118 - DNA, 20 bp, mouse
gagctctgccgggttatgat

SEQ ID NO: 760119 - DNA, 20 bp, mouse
gctgctgaattagcttctgc

SEQ ID NO: 760120 - DNA, 20 bp, mouse
gcttgaggatgattagctga

SEQ ID NO: 760121 - DNA, 20 bp, mouse
gcacatctccagaactatga

SEQ ID NO: 760122 - DNA, 20 bp, mouse
ggtgatgtcatccaggcagt

SEQ ID NO: 760123 - DNA, 20 bp, mouse
ggatttggataatcgttcac

SEQ ID NO: 760124 - DNA, 20 bp, mouse
gagctgttgtgatgtcatcc

SEQ ID NO: 760125 - DNA, 20 bp, mouse
gatgacatcacaacagcttc

SEQ ID NO: 760126 - DNA, 20 bp, mouse
gatgcagcggatcagatagg

SEQ ID NO: 760127 - DNA, 20 bp, mouse
gaggaagcgacggtggctgt

SEQ ID NO: 760128 - DNA, 20 bp, mouse
ggcggtgccccgtacggctc

SEQ ID NO: 760129 - DNA, 20 bp, mouse
gccagcaagcgttcccggac

SEQ ID NO: 760130 - DNA, 20 bp, mouse
gccggaggaggaagcgacgg

SEQ ID NO: 760131 - DNA, 20 bp, mouse
gctgatgcagcggatcagat

SEQ ID NO: 760132 - DNA, 20 bp, mouse
ggctccggaggaggaagcga

SEQ ID NO: 760133 - DNA, 20 bp, mouse
ggtgccccgtacggctccgg

SEQ ID NO: 760134 - DNA, 20 bp, mouse
ggtggtggtctctgatgcag

SEQ ID NO: 760135 - DNA, 20 bp, mouse
ggcggtccagcaagcgttcc

SEQ ID NO: 760136 - DNA, 20 bp, mouse
gagaaagtgggtctacgttt

SEQ ID NO: 760137 - DNA, 20 bp, mouse
gaggcgccgcgaacactcag

SEQ ID NO: 760138 - DNA, 20 bp, mouse
gcccactcccaggtgttctg

SEQ ID NO: 760139 - DNA, 20 bp, mouse
gccggaactgggacggggcg

SEQ ID NO: 760140 - DNA, 20 bp, mouse
gtgcttgagcttagattgtt

SEQ ID NO: 760141 - DNA, 20 bp, mouse
gcagagggacatgaacgcga

SEQ ID NO: 760142 - DNA, 20 bp, mouse
gcggggtcctagctcgtccg

SEQ ID NO: 760143 - DNA, 20 bp, mouse
gacactcagtggtgacgtca

SEQ ID NO: 760144 - DNA, 20 bp, mouse
gctctcctcagcgaccagaa

SEQ ID NO: 760145 - DNA, 20 bp, mouse
gcgaccagaagggcggggag

SEQ ID NO: 760146 - DNA, 20 bp, mouse
gacgcccgtgacgtcaggaa

SEQ ID NO: 760147 - DNA, 20 bp, mouse
ggacctgtcaatcccatcct

SEQ ID NO: 760148 - DNA, 20 bp, mouse
gagaaacctcgtcttcgcta

SEQ ID NO: 760149 - DNA, 20 bp, mouse
gaatgttgatagtgcatcca

SEQ ID NO: 760150 - DNA, 20 bp, mouse
gagaaggtaggacaatcgca

SEQ ID NO: 760151 - DNA, 20 bp, mouse
ggaagacgaggtttctagta

SEQ ID NO: 760152 - DNA, 20 bp, mouse
gttacctttcctgacgtcac

SEQ ID NO: 760153 - DNA, 20 bp, mouse
ggcaagatctgtgtcgtgct

SEQ ID NO: 760154 - DNA, 20 bp, mouse
gcacgccttgtctgcgtcca

SEQ ID NO: 760155 - DNA, 20 bp, mouse
gtccagccctagcgaagacg

SEQ ID NO: 760156 - DNA, 20 bp, mouse
gcgcggaggtcgttctacgc

SEQ ID NO: 760157 - DNA, 20 bp, mouse
ggcgcagggaggattatctg

SEQ ID NO: 760158 - DNA, 20 bp, mouse
gtacccagaaagcgaccctg

SEQ ID NO: 760159 - DNA, 20 bp, mouse
ggcagagctggaggtcgcgc

SEQ ID NO: 760160 - DNA, 20 bp, mouse
gccccgcagggtcgctttct

SEQ ID NO: 760161 - DNA, 20 bp, mouse
gcctgctcgtcaaccggccg

SEQ ID NO: 760162 - DNA, 20 bp, mouse
gagcaggaacctccaaacgg

SEQ ID NO: 760163 - DNA, 20 bp, mouse
gacaggagaaactcccatct

SEQ ID NO: 760164 - DNA, 20 bp, mouse
ggtgaaattaatgttttcgg

SEQ ID NO: 760165 - DNA, 20 bp, mouse
gatctggggttttacagtac

SEQ ID NO: 760166 - DNA, 20 bp, mouse
gtaccccggcgccagaagcg

SEQ ID NO: 760167 - DNA, 20 bp, mouse
gcgtctgcccggccctcggc

SEQ ID NO: 760168 - DNA, 20 bp, mouse
ggggctgaactgtagcagct

SEQ ID NO: 760169 - DNA, 20 bp, mouse
gtcgtcgaagggcatgcacc

SEQ ID NO: 760170 - DNA, 20 bp, mouse
gacctgagcaccacctactg

SEQ ID NO: 760171 - DNA, 20 bp, mouse
gcgggccaggtggcgcgcaa

SEQ ID NO: 760172 - DNA, 20 bp, mouse
gcctgacggcctcgaactgt

SEQ ID NO: 760173 - DNA, 20 bp, mouse
gcaatgtccgagtcgtcgaa

SEQ ID NO: 760174 - DNA, 20 bp, mouse
gccacggcggcggccctctg

SEQ ID NO: 760175 - DNA, 20 bp, mouse
gtggcgcgcggcgacttcgc

SEQ ID NO: 760176 - DNA, 20 bp, mouse
gtggtgacgcgaaggaagac

SEQ ID NO: 760177 - DNA, 20 bp, mouse
gacacgatgcctcctgtcat

SEQ ID NO: 760178 - DNA, 20 bp, mouse
ggcatcgtgtggtgacgcga

SEQ ID NO: 760179 - DNA, 20 bp, mouse
ggaaggaagacaggttttcg

SEQ ID NO: 760180 - DNA, 20 bp, mouse
gccgtcgattggatgacgca

SEQ ID NO: 760181 - DNA, 20 bp, mouse
gtgtccccctaacaagacag

SEQ ID NO: 760182 - DNA, 20 bp, mouse
gcgcgattgcggacgttgag

SEQ ID NO: 760183 - DNA, 20 bp, mouse
gttgtcgccgctgtcttgtt

SEQ ID NO: 760184 - DNA, 20 bp, mouse
gaatcttagccaatgacagg

SEQ ID NO: 760185 - DNA, 20 bp, mouse
gtggtccgattgagggtgaa

SEQ ID NO: 760186 - DNA, 20 bp, mouse
gacaaggagcggagctctct

SEQ ID NO: 760187 - DNA, 20 bp, mouse
ggaaactgtgggctgatccg

SEQ ID NO: 760188 - DNA, 20 bp, mouse
gaggggcgcggcagtcacga

SEQ ID NO: 760189 - DNA, 20 bp, mouse
gggtccacgtcctcgcccaa

SEQ ID NO: 760190 - DNA, 20 bp, mouse
ggatggccgggagtaagtac

SEQ ID NO: 760191 - DNA, 20 bp, mouse
ggcactaaggggcagatgga

SEQ ID NO: 760192 - DNA, 20 bp, mouse
gccaaagctgactttattac

SEQ ID NO: 760193 - DNA, 20 bp, mouse
ggactgccgcgcccctattc

SEQ ID NO: 760194 - DNA, 20 bp, mouse
gccgggagtaagtacaggtt

SEQ ID NO: 760195 - DNA, 20 bp, mouse
gtcttggcggcgacaaggag

SEQ ID NO: 760196 - DNA, 20 bp, mouse
gcagcaggaaagcccggatg

SEQ ID NO: 760197 - DNA, 20 bp, mouse
gtcctctaaggtgcctgaat

SEQ ID NO: 760198 - DNA, 20 bp, mouse
gcggatgcggctgtcctcta

SEQ ID NO: 760199 - DNA, 20 bp, mouse
ggaagtggtcgggacattta

SEQ ID NO: 760200 - DNA, 20 bp, mouse
gctccagccgccggggtcaa

SEQ ID NO: 760201 - DNA, 20 bp, mouse
gcgcactgccagcggaccgc

SEQ ID NO: 760202 - DNA, 20 bp, mouse
gaaaaatgcgaagaagtggt

SEQ ID NO: 760203 - DNA, 20 bp, mouse
gtccacgcgcggccctggcc

SEQ ID NO: 760204 - DNA, 20 bp, mouse
gaacctatcaaaaagatgca

SEQ ID NO: 760205 - DNA, 20 bp, mouse
gacggcatgcgtatagacca

SEQ ID NO: 760206 - DNA, 20 bp, mouse
gaacaggctggaagttgttg

SEQ ID NO: 760207 - DNA, 20 bp, mouse
gcccgccccccatcagggag

SEQ ID NO: 760208 - DNA, 20 bp, mouse
gtgaaaggggatccagatgt

SEQ ID NO: 760209 - DNA, 20 bp, mouse
gcagtaagagagagttggga

SEQ ID NO: 760210 - DNA, 20 bp, mouse
gaaaccgcccagaccaagag

SEQ ID NO: 760211 - DNA, 20 bp, mouse
gaggctgacccctccctgat

SEQ ID NO: 760212 - DNA, 20 bp, mouse
gaagctgggtggagctggcg

SEQ ID NO: 760213 - DNA, 20 bp, mouse
gctgacccctccctgatggg

SEQ ID NO: 760214 - DNA, 20 bp, mouse
gtctgagggaggaacctctt

SEQ ID NO: 760215 - DNA, 20 bp, mouse
gcccaaagacccaagtataa

SEQ ID NO: 760216 - DNA, 20 bp, mouse
ggctcccgcccacctaggag

SEQ ID NO: 760217 - DNA, 20 bp, mouse
gcctgcgcagctcacacaag

SEQ ID NO: 760218 - DNA, 20 bp, mouse
gctcttggctccaaccgctc

SEQ ID NO: 760219 - DNA, 20 bp, mouse
gcaaccgctcgggctgggta

SEQ ID NO: 760220 - DNA, 20 bp, mouse
gcgggtaaaatagcagtcga

SEQ ID NO: 760221 - DNA, 20 bp, mouse
gtgcccctacccagcccgag

SEQ ID NO: 760222 - DNA, 20 bp, mouse
gcacacaagcggctccacgc

SEQ ID NO: 760223 - DNA, 20 bp, mouse
gcaaatctacctctcctagg

SEQ ID NO: 760224 - DNA, 20 bp, mouse
gagtactcagagacgtcagt

SEQ ID NO: 760225 - DNA, 20 bp, mouse
gggctccaaccgctcgggct

SEQ ID NO: 760226 - DNA, 20 bp, mouse
ggggttggctcgttcaacgg

SEQ ID NO: 760227 - DNA, 20 bp, mouse
gggaaggactgactggacta

SEQ ID NO: 760228 - DNA, 20 bp, mouse
gccggggttggctcgttcaa

SEQ ID NO: 760229 - DNA, 20 bp, mouse
ggcgctgaggaaccaccagg

SEQ ID NO: 760230 - DNA, 20 bp, mouse
gggaaacaccgatccggggt

SEQ ID NO: 760231 - DNA, 20 bp, mouse
gtcgacgctgcgcctcctgg

SEQ ID NO: 760232 - DNA, 20 bp, mouse
ggaacgagccaaccccggat

SEQ ID NO: 760233 - DNA, 20 bp, mouse
gccgcggaaacaccgatccg

SEQ ID NO: 760234 - DNA, 20 bp, mouse
ggcggcgctgaggaaccacc

SEQ ID NO: 760235 - DNA, 20 bp, mouse
ggctcggaggagaagacctc

SEQ ID NO: 760236 - DNA, 20 bp, mouse
gagaggagtcacgtgagcag

SEQ ID NO: 760237 - DNA, 20 bp, mouse
gcatcaagctggctagggtg

SEQ ID NO: 760238 - DNA, 20 bp, mouse
gaggggatgccttttatagt

SEQ ID NO: 760239 - DNA, 20 bp, mouse
gtctcgcgagagcgaaagtg

SEQ ID NO: 760240 - DNA, 20 bp, mouse
ggtgcacgcaggtgagtgat

SEQ ID NO: 760241 - DNA, 20 bp, mouse
gggtcagagccgactataaa

SEQ ID NO: 760242 - DNA, 20 bp, mouse
gtggttacctacaggaaata

SEQ ID NO: 760243 - DNA, 20 bp, mouse
gcgagagcgaaagtgaggcg

SEQ ID NO: 760244 - DNA, 20 bp, mouse
gcggagtcctcccgagtacc

SEQ ID NO: 760245 - DNA, 20 bp, mouse
ggagaccgcacgcggtaccc

SEQ ID NO: 760246 - DNA, 20 bp, mouse
gggtctccgcccacatctcc

SEQ ID NO: 760247 - DNA, 20 bp, mouse
gtggagacatggacgaatgg

SEQ ID NO: 760248 - DNA, 20 bp, mouse
gtatgacaaccaggagatgt

SEQ ID NO: 760249 - DNA, 20 bp, mouse
ggaagtctagcggtcccgag

SEQ ID NO: 760250 - DNA, 20 bp, mouse
gacgccaagacagctgaagt

SEQ ID NO: 760251 - DNA, 20 bp, mouse
ggcgcaagcgcactgctcta

SEQ ID NO: 760252 - DNA, 20 bp, mouse
gctagcggtcccgaggggcg

SEQ ID NO: 760253 - DNA, 20 bp, mouse
gcagtcttggccagccaaag

SEQ ID NO: 760254 - DNA, 20 bp, mouse
gaccgctagacttcctggaa

SEQ ID NO: 760255 - DNA, 20 bp, mouse
gcgtccatgtctccactttc

SEQ ID NO: 760256 - DNA, 20 bp, mouse
gacagtcccggttttggaat

SEQ ID NO: 760257 - DNA, 20 bp, mouse
gcgcaaacgccaactgggaa

SEQ ID NO: 760258 - DNA, 20 bp, mouse
ggactcaagggcatgcaaaa

SEQ ID NO: 760259 - DNA, 20 bp, mouse
gcactcaaggagttgcacgg

SEQ ID NO: 760260 - DNA, 20 bp, mouse
gcagctctgcaggggtaaga

SEQ ID NO: 760261 - DNA, 20 bp, mouse
gcgccaactgggaacggaag

SEQ ID NO: 760262 - DNA, 20 bp, mouse
gggaggaaaaaggtgtaata

SEQ ID NO: 760263 - DNA, 20 bp, mouse
ggaaaatacagtcccggttt

SEQ ID NO: 760264 - DNA, 20 bp, mouse
ggcaacaacgcggggtcaaa

SEQ ID NO: 760265 - DNA, 20 bp, mouse
gttggcgtgcgaggggctta

SEQ ID NO: 760266 - DNA, 20 bp, mouse
ggggtcagtgacagtgttta

SEQ ID NO: 760267 - DNA, 20 bp, mouse
ggggcgcgggcggaccctag

SEQ ID NO: 760268 - DNA, 20 bp, mouse
gaaaggaggtgggtgcagcg

SEQ ID NO: 760269 - DNA, 20 bp, mouse
ggcagcccttgtccttctaa

SEQ ID NO: 760270 - DNA, 20 bp, mouse
gacctcctttagaaggacaa

SEQ ID NO: 760271 - DNA, 20 bp, mouse
gtgcacccacctcctttaga

SEQ ID NO: 760272 - DNA, 20 bp, mouse
ggaagtagcgaggtacccag

SEQ ID NO: 760273 - DNA, 20 bp, mouse
gcgtacagagcggcgcttga

SEQ ID NO: 760274 - DNA, 20 bp, mouse
gacgccggcgacgtacagag

SEQ ID NO: 760275 - DNA, 20 bp, mouse
gccatctcagagacggagaa

SEQ ID NO: 760276 - DNA, 20 bp, mouse
gtcagaaagcgaccccgctg

SEQ ID NO: 760277 - DNA, 20 bp, mouse
gtaaagcgtaagacaaccgg

SEQ ID NO: 760278 - DNA, 20 bp, mouse
gtcagatagttcaagagtaa

SEQ ID NO: 760279 - DNA, 20 bp, mouse
gaccgggcgagaaaagtaga

SEQ ID NO: 760280 - DNA, 20 bp, mouse
gaaccggaagcgtggcgaac

SEQ ID NO: 760281 - DNA, 20 bp, mouse
gggtcctcaaaattccccag

SEQ ID NO: 760282 - DNA, 20 bp, mouse
gtaagacaaccggaggcttc

SEQ ID NO: 760283 - DNA, 20 bp, mouse
gtactgaggatgggtgattg

SEQ ID NO: 760284 - DNA, 20 bp, mouse
gtcctgtccgacatcaaact

SEQ ID NO: 760285 - DNA, 20 bp, mouse
gtggggctgacttgggacac

SEQ ID NO: 760286 - DNA, 20 bp, mouse
gggagagcggcgttactggg

SEQ ID NO: 760287 - DNA, 20 bp, mouse
gatgacagaccggggaactg

SEQ ID NO: 760288 - DNA, 20 bp, mouse
gcaggcctccagccggtgtg

SEQ ID NO: 760289 - DNA, 20 bp, mouse
gtggcctgaccaacggagag

SEQ ID NO: 760290 - DNA, 20 bp, mouse
gccaagggagagtctggagc

SEQ ID NO: 760291 - DNA, 20 bp, mouse
ggggtccacacaccggctgg

SEQ ID NO: 760292 - DNA, 20 bp, mouse
gtctcccttggcaccggaag

SEQ ID NO: 760293 - DNA, 20 bp, mouse
gctgggggatgcaacaacac

SEQ ID NO: 760294 - DNA, 20 bp, mouse
gggcgctgccatgacagacc

SEQ ID NO: 760295 - DNA, 20 bp, mouse
gcaacaacacgggctctcat

SEQ ID NO: 760296 - DNA, 20 bp, mouse
gcctccagcgacagtcccta

SEQ ID NO: 760297 - DNA, 20 bp, mouse
gtccctgggagcccgaataa

SEQ ID NO: 760298 - DNA, 20 bp, mouse
gcacccgcatggggagacag

SEQ ID NO: 760299 - DNA, 20 bp, mouse
gggagacagaggctctgcat

SEQ ID NO: 760300 - DNA, 20 bp, mouse
gcgccctaagggtattgttt

SEQ ID NO: 760301 - DNA, 20 bp, mouse
ggtgccctccgggacgcaag

SEQ ID NO: 760302 - DNA, 20 bp, mouse
ggggcaccgcgcaccttgaa

SEQ ID NO: 760303 - DNA, 20 bp, mouse
gggactgtcgctggaggcat

SEQ ID NO: 760304 - DNA, 20 bp, mouse
gatggggcggggtgggcgac

SEQ ID NO: 760305 - DNA, 20 bp, mouse
ggcgacagtccctaaggagg

SEQ ID NO: 760306 - DNA, 20 bp, mouse
gtggccgggaggacgcaccc

SEQ ID NO: 760307 - DNA, 20 bp, mouse
gtgcgcctgtgcggaagggt

SEQ ID NO: 760308 - DNA, 20 bp, mouse
gggtgggcggggcggagtcc

SEQ ID NO: 760309 - DNA, 20 bp, mouse
gcgtcctcccggccaccagg

SEQ ID NO: 760310 - DNA, 20 bp, mouse
gcccgcccacccttccgcac

SEQ ID NO: 760311 - DNA, 20 bp, mouse
gggcgactccggagtcttta

SEQ ID NO: 760312 - DNA, 20 bp, mouse
gggcgcatgcgcagacatct

SEQ ID NO: 760313 - DNA, 20 bp, mouse
gcgcatgcgcctgtgcggaa

SEQ ID NO: 760314 - DNA, 20 bp, mouse
gtcgccccctggtggccggg

SEQ ID NO: 760315 - DNA, 20 bp, mouse
gtgggcgttgtcagggacgc

SEQ ID NO: 760316 - DNA, 20 bp, mouse
gaagacggagcgtctcgcgg

SEQ ID NO: 760317 - DNA, 20 bp, mouse
ggggatctgagaagagtggt

SEQ ID NO: 760318 - DNA, 20 bp, mouse
ggcgtctcgcggaggattgt

SEQ ID NO: 760319 - DNA, 20 bp, mouse
ggaaagggaccggactatag

SEQ ID NO: 760320 - DNA, 20 bp, mouse
gcgaggtgctgcccgaagga

SEQ ID NO: 760321 - DNA, 20 bp, mouse
ggggctactcacaaatccca

SEQ ID NO: 760322 - DNA, 20 bp, mouse
gctccatgtgaactcagact

SEQ ID NO: 760323 - DNA, 20 bp, mouse
gcagcccgggcgccacagca

SEQ ID NO: 760324 - DNA, 20 bp, mouse
gaaactgtgcggtcgcccgt

SEQ ID NO: 760325 - DNA, 20 bp, mouse
gaatcccaaggagagcccga

SEQ ID NO: 760326 - DNA, 20 bp, mouse
gtggcgttctggggttctgt

SEQ ID NO: 760327 - DNA, 20 bp, mouse
ggaaccccagaacgccaaaa

SEQ ID NO: 760328 - DNA, 20 bp, mouse
ggttctgtgggagtggacgc

SEQ ID NO: 760329 - DNA, 20 bp, mouse
gaagaggatcaagagaggat

SEQ ID NO: 760330 - DNA, 20 bp, mouse
gctctcttgatcctcttcaa

SEQ ID NO: 760331 - DNA, 20 bp, mouse
gcatcccttttggcgttctg

SEQ ID NO: 760332 - DNA, 20 bp, mouse
ggatctctgcaactccgcaa

SEQ ID NO: 760333 - DNA, 20 bp, mouse
gggcgtggccactttccggg

SEQ ID NO: 760334 - DNA, 20 bp, mouse
gcgggtgccctccgaccctg

SEQ ID NO: 760335 - DNA, 20 bp, mouse
ggcacccgaagcgggtgtca

SEQ ID NO: 760336 - DNA, 20 bp, mouse
gaacgccacaggttcctggt

SEQ ID NO: 760337 - DNA, 20 bp, mouse
gcagccctggcgtcccaaac

SEQ ID NO: 760338 - DNA, 20 bp, mouse
gacgaggaggatggcgatga

SEQ ID NO: 760339 - DNA, 20 bp, mouse
gtcctggtcggccgacatgg

SEQ ID NO: 760340 - DNA, 20 bp, mouse
gtaaagcggaagtaagctcc

SEQ ID NO: 760341 - DNA, 20 bp, mouse
ggtgacagaagatccggatg

SEQ ID NO: 760342 - DNA, 20 bp, mouse
gatggcgatgagggcaagaa

SEQ ID NO: 760343 - DNA, 20 bp, mouse
ggcttggcaaggaacgccac

SEQ ID NO: 760344 - DNA, 20 bp, mouse
gggcaagaatggcttctccc

SEQ ID NO: 760345 - DNA, 20 bp, mouse
gtcacctgtttgggacgcca

SEQ ID NO: 760346 - DNA, 20 bp, mouse
gagagcgctggggaccacaa

SEQ ID NO: 760347 - DNA, 20 bp, mouse
ggcagggaatatggtgaaca

SEQ ID NO: 760348 - DNA, 20 bp, mouse
gactctgcctaggttccctg

SEQ ID NO: 760349 - DNA, 20 bp, mouse
gcggacgtggagcgagtaga

SEQ ID NO: 760350 - DNA, 20 bp, mouse
gaggatgcctcagagcgctg

SEQ ID NO: 760351 - DNA, 20 bp, mouse
gcctctcgagcacccccttg

SEQ ID NO: 760352 - DNA, 20 bp, mouse
ggcgaggcaccatgggatag

SEQ ID NO: 760353 - DNA, 20 bp, mouse
ggggcgaagcactgtgccta

SEQ ID NO: 760354 - DNA, 20 bp, mouse
ggggcagccgcgaggcacca

SEQ ID NO: 760355 - DNA, 20 bp, mouse
gccctgctatcttagctggt

SEQ ID NO: 760356 - DNA, 20 bp, mouse
gcgaactcgtaaacaaactt

SEQ ID NO: 760357 - DNA, 20 bp, mouse
gtaaagagcgggcctcttag

SEQ ID NO: 760358 - DNA, 20 bp, mouse
gcatagaagaggcgcgggga

SEQ ID NO: 760359 - DNA, 20 bp, mouse
gccgttgcgggtcgtgggat

SEQ ID NO: 760360 - DNA, 20 bp, mouse
gaatacaatgtgcgcagctg

SEQ ID NO: 760361 - DNA, 20 bp, mouse
gttcggtagcgacacggcgt

SEQ ID NO: 760362 - DNA, 20 bp, mouse
ggggccggtgtgcatagaag

SEQ ID NO: 760363 - DNA, 20 bp, mouse
gcgtaaacaaacttaggccg

SEQ ID NO: 760364 - DNA, 20 bp, mouse
gaccttgctaaatagatccc

SEQ ID NO: 760365 - DNA, 20 bp, mouse
ggcgctcaccttctcggccc

SEQ ID NO: 760366 - DNA, 20 bp, mouse
gtcgcactgcgtctctaccc

SEQ ID NO: 760367 - DNA, 20 bp, mouse
gcagccaagagcaccttgcc

SEQ ID NO: 760368 - DNA, 20 bp, mouse
gagcctctaaggtccgccaa

SEQ ID NO: 760369 - DNA, 20 bp, mouse
gctgtgccacgaggcagcca

SEQ ID NO: 760370 - DNA, 20 bp, mouse
gtgcgacgcagtgacgtcac

SEQ ID NO: 760371 - DNA, 20 bp, mouse
gttagaggctccaggttaac

SEQ ID NO: 760372 - DNA, 20 bp, mouse
gggcagataggtcgtccttc

SEQ ID NO: 760373 - DNA, 20 bp, mouse
gcgggctgatggtaggccac

SEQ ID NO: 760374 - DNA, 20 bp, mouse
gcagcctggcaaggtgctct

SEQ ID NO: 760375 - DNA, 20 bp, mouse
gaaagcagggagcagcagta

SEQ ID NO: 760376 - DNA, 20 bp, mouse
gtgcagctggagtctgcttg

SEQ ID NO: 760377 - DNA, 20 bp, mouse
gcggggtgacaggtaggcgg

SEQ ID NO: 760378 - DNA, 20 bp, mouse
ggagctgacgaaggtgaagt

SEQ ID NO: 760379 - DNA, 20 bp, mouse
gcagacctgggagcaagctc

SEQ ID NO: 760380 - DNA, 20 bp, mouse
gcgggagggtcgtgaggaga

SEQ ID NO: 760381 - DNA, 20 bp, mouse
gcgtagtcgggagctgacga

SEQ ID NO: 760382 - DNA, 20 bp, mouse
gccgcctaaagattccgtcc

SEQ ID NO: 760383 - DNA, 20 bp, mouse
gcctgggagcaagctcggga

SEQ ID NO: 760384 - DNA, 20 bp, mouse
gctgcggggtgacaggtagg

SEQ ID NO: 760385 - DNA, 20 bp, mouse
gggtggcggtaggaagcctg

SEQ ID NO: 760386 - DNA, 20 bp, mouse
gtgcgcacgcgcagaatacg

SEQ ID NO: 760387 - DNA, 20 bp, mouse
gcgcagaatacgcgggacga

SEQ ID NO: 760388 - DNA, 20 bp, mouse
ggggagaggggtggggttcg

SEQ ID NO: 760389 - DNA, 20 bp, mouse
gcgggacgagggcgtgaagg

SEQ ID NO: 760390 - DNA, 20 bp, mouse
gacgcgggacgagggcgtga

SEQ ID NO: 760391 - DNA, 20 bp, mouse
gcgagggcgtgaaggaggat

SEQ ID NO: 760392 - DNA, 20 bp, mouse
gaggttggaagaacccaccc

SEQ ID NO: 760393 - DNA, 20 bp, mouse
gagaacccaccctggactgt

SEQ ID NO: 760394 - DNA, 20 bp, mouse
gaggggtggggttcgaggct

SEQ ID NO: 760395 - DNA, 20 bp, mouse
gctagaggagactgggaaac

SEQ ID NO: 760396 - DNA, 20 bp, mouse
ggagagccctgtaaactcta

SEQ ID NO: 760397 - DNA, 20 bp, mouse
gagggctaagggagccggga

SEQ ID NO: 760398 - DNA, 20 bp, mouse
gagggacaatccaccagtga

SEQ ID NO: 760399 - DNA, 20 bp, mouse
gacaaaagtgacgacattgt

SEQ ID NO: 760400 - DNA, 20 bp, mouse
gtccacgaggtcacttccgc

SEQ ID NO: 760401 - DNA, 20 bp, mouse
ggaagcgagagccgtgggag

SEQ ID NO: 760402 - DNA, 20 bp, mouse
gccgctgccctcactcaata

SEQ ID NO: 760403 - DNA, 20 bp, mouse
gaggaggccatattgagtga

SEQ ID NO: 760404 - DNA, 20 bp, mouse
ggagcttcacaggcaggcgc

SEQ ID NO: 760405 - DNA, 20 bp, mouse
ggtaaactctatggcagact

SEQ ID NO: 760406 - DNA, 20 bp, mouse
gcatgcgcaaagccctctct

SEQ ID NO: 760407 - DNA, 20 bp, mouse
gggaggggaccggaagaaca

SEQ ID NO: 760408 - DNA, 20 bp, mouse
gtcggcccgcccccagaggc

SEQ ID NO: 760409 - DNA, 20 bp, mouse
gaccttgaggcgcctggaag

SEQ ID NO: 760410 - DNA, 20 bp, mouse
ggggcgggccgactccttcg

SEQ ID NO: 760411 - DNA, 20 bp, mouse
gaacttgtaggggaggggac

SEQ ID NO: 760412 - DNA, 20 bp, mouse
ggaaagtgtgagaagtcctg

SEQ ID NO: 760413 - DNA, 20 bp, mouse
gcctgagttaagaactaagt

SEQ ID NO: 760414 - DNA, 20 bp, mouse
gagaaagaacttgtagggga

SEQ ID NO: 760415 - DNA, 20 bp, mouse
gaaaacccagggtccaagag

SEQ ID NO: 760416 - DNA, 20 bp, mouse
gacaccccctggcggtgtgg

SEQ ID NO: 760417 - DNA, 20 bp, mouse
gtggccagggagttgcaggg

SEQ ID NO: 760418 - DNA, 20 bp, mouse
gcgaacgccagttggctaga

SEQ ID NO: 760419 - DNA, 20 bp, mouse
ggctcgctgacaccccctgg

SEQ ID NO: 760420 - DNA, 20 bp, mouse
gaggagtgcgggtgtggaag

SEQ ID NO: 760421 - DNA, 20 bp, mouse
gctggctcgctgacaccccc

SEQ ID NO: 760422 - DNA, 20 bp, mouse
gggaggagacagagcgggtg

SEQ ID NO: 760423 - DNA, 20 bp, mouse
gctagcactgggcagagcac

SEQ ID NO: 760424 - DNA, 20 bp, mouse
gctgacccggcgctatctgt

SEQ ID NO: 760425 - DNA, 20 bp, mouse
gactcctccctgcaactccc

SEQ ID NO: 760426 - DNA, 20 bp, mouse
ggtagagcctggacggtgag

SEQ ID NO: 760427 - DNA, 20 bp, mouse
gggctggcgcagccccgaaa

SEQ ID NO: 760428 - DNA, 20 bp, mouse
ggcgcaaaagcgggtcacgg

SEQ ID NO: 760429 - DNA, 20 bp, mouse
gaagggcctcagtcggttga

SEQ ID NO: 760430 - DNA, 20 bp, mouse
ggcgagccgcctccagtaat

SEQ ID NO: 760431 - DNA, 20 bp, mouse
ggccccgaaagggcctcagt

SEQ ID NO: 760432 - DNA, 20 bp, mouse
gggacggtgagcggctgatg

SEQ ID NO: 760433 - DNA, 20 bp, mouse
gcacagcggtctgagatatt

SEQ ID NO: 760434 - DNA, 20 bp, mouse
ggaagccagcgcagaagtcc

SEQ ID NO: 760435 - DNA, 20 bp, mouse
ggaagtcccggcatcaagct

SEQ ID NO: 760436 - DNA, 20 bp, mouse
gggacccgggactgtcagcg

SEQ ID NO: 760437 - DNA, 20 bp, mouse
gcaagttcgtgggtaagggc

SEQ ID NO: 760438 - DNA, 20 bp, mouse
gtcgcggcatggcctttcca

SEQ ID NO: 760439 - DNA, 20 bp, mouse
gggtaagggcaggtttgtct

SEQ ID NO: 760440 - DNA, 20 bp, mouse
ggagcctcgctgacagtccc

SEQ ID NO: 760441 - DNA, 20 bp, mouse
gaaaggccatgccgcgaaaa

SEQ ID NO: 760442 - DNA, 20 bp, mouse
gtgccgcgaaaaggggaccc

SEQ ID NO: 760443 - DNA, 20 bp, mouse
gccagggcacggaagatgcc

SEQ ID NO: 760444 - DNA, 20 bp, mouse
gtgagtctcttcaagttcgt

SEQ ID NO: 760445 - DNA, 20 bp, mouse
gtcccagggaaaagcggaag

SEQ ID NO: 760446 - DNA, 20 bp, mouse
gaaaacaaagggtacgaaga

SEQ ID NO: 760447 - DNA, 20 bp, mouse
gccaagaacccggacttagt

SEQ ID NO: 760448 - DNA, 20 bp, mouse
gtgggctgtgaataaaacaa

SEQ ID NO: 760449 - DNA, 20 bp, mouse
gcgcgcgcatctccggttgg

SEQ ID NO: 760450 - DNA, 20 bp, mouse
ggccccctggcagcagaact

SEQ ID NO: 760451 - DNA, 20 bp, mouse
gagaactgggactcgcaggt

SEQ ID NO: 760452 - DNA, 20 bp, mouse
gcagcagaactgggactcgc

SEQ ID NO: 760453 - DNA, 20 bp, mouse
gtgcgcgcgcagggagaagg

SEQ ID NO: 760454 - DNA, 20 bp, mouse
gaaagggtacgaagagggtt

SEQ ID NO: 760455 - DNA, 20 bp, mouse
gctccctgcgcgcgcatctc

SEQ ID NO: 760456 - DNA, 20 bp, mouse
gaataacccacagtgggcaa

SEQ ID NO: 760457 - DNA, 20 bp, mouse
gggcaaaggctaggaaacat

SEQ ID NO: 760458 - DNA, 20 bp, mouse
gtcgcgtgcagaggttgcta

SEQ ID NO: 760459 - DNA, 20 bp, mouse
gagtggcccacaacgcgtga

SEQ ID NO: 760460 - DNA, 20 bp, mouse
ggaggttccgggcttctaag

SEQ ID NO: 760461 - DNA, 20 bp, mouse
gtcagcaccagggtattcgg

SEQ ID NO: 760462 - DNA, 20 bp, mouse
gcctctgcacgcgaggttcc

SEQ ID NO: 760463 - DNA, 20 bp, mouse
ggcaagccttcacgcgttgt

SEQ ID NO: 760464 - DNA, 20 bp, mouse
gggctgaagggcattgcgta

SEQ ID NO: 760465 - DNA, 20 bp, mouse
gaggtcagcaccagggtatt

SEQ ID NO: 760466 - DNA, 20 bp, mouse
gaggccgcggccagcgctga

SEQ ID NO: 760467 - DNA, 20 bp, mouse
ggggagctgtgcaaaagcgg

SEQ ID NO: 760468 - DNA, 20 bp, mouse
gacggggagctgtgcaaaag

SEQ ID NO: 760469 - DNA, 20 bp, mouse
ggagcgggacctcccgggag

SEQ ID NO: 760470 - DNA, 20 bp, mouse
gagggcgtttcccttcgttt

SEQ ID NO: 760471 - DNA, 20 bp, mouse
ggcaaggcctcggctacttc

SEQ ID NO: 760472 - DNA, 20 bp, mouse
gcggacaagagctacattga

SEQ ID NO: 760473 - DNA, 20 bp, mouse
gaaggccggcggacgacctg

SEQ ID NO: 760474 - DNA, 20 bp, mouse
gtgggtggcagatagttctt

SEQ ID NO: 760475 - DNA, 20 bp, mouse
gaggcctcggctacttccgg

SEQ ID NO: 760476 - DNA, 20 bp, mouse
gagtgcgtaggggacctaga

SEQ ID NO: 760477 - DNA, 20 bp, mouse
gagagggagcgcagtttcta

SEQ ID NO: 760478 - DNA, 20 bp, mouse
gagtaagggcgtccctccca

SEQ ID NO: 760479 - DNA, 20 bp, mouse
ggaagctgagaagcggaatc

SEQ ID NO: 760480 - DNA, 20 bp, mouse
gtcacgcccagagaagccgt

SEQ ID NO: 760481 - DNA, 20 bp, mouse
gactgccgtcatctttagta

SEQ ID NO: 760482 - DNA, 20 bp, mouse
gcgcaagtgaagctgagaag

SEQ ID NO: 760483 - DNA, 20 bp, mouse
gtggacctagcgggaagtgc

SEQ ID NO: 760484 - DNA, 20 bp, mouse
gcgcccagagaagccgtggg

SEQ ID NO: 760485 - DNA, 20 bp, mouse
gtgcagagcgtggacctagc

SEQ ID NO: 760486 - DNA, 20 bp, mouse
gaaggctgaagcataagcta

SEQ ID NO: 760487 - DNA, 20 bp, mouse
gagcatggaggcacacgggg

SEQ ID NO: 760488 - DNA, 20 bp, mouse
gagaaactggcggtctgatt

SEQ ID NO: 760489 - DNA, 20 bp, mouse
gtggtggtgaggggcacact

SEQ ID NO: 760490 - DNA, 20 bp, mouse
gtggtatatgtggtggtgag

SEQ ID NO: 760491 - DNA, 20 bp, mouse
gccgtggaatgtgttagact

SEQ ID NO: 760492 - DNA, 20 bp, mouse
gtagttctaagatagcatgg

SEQ ID NO: 760493 - DNA, 20 bp, mouse
ggcccattatgccctatagt

SEQ ID NO: 760494 - DNA, 20 bp, mouse
ggttcctatcggttctcgag

SEQ ID NO: 760495 - DNA, 20 bp, mouse
ggggtgatgctccgaggctc

SEQ ID NO: 760496 - DNA, 20 bp, mouse
gtgagccctggcatgaaagg

SEQ ID NO: 760497 - DNA, 20 bp, mouse
gcctccgctgtaccgagata

SEQ ID NO: 760498 - DNA, 20 bp, mouse
gccccccaatactgaggctt

SEQ ID NO: 760499 - DNA, 20 bp, mouse
gcgcaggtggggaaaccgtg

SEQ ID NO: 760500 - DNA, 20 bp, mouse
gaaccgcaccggtgagagaa

SEQ ID NO: 760501 - DNA, 20 bp, mouse
ggggggggggagacgatgga

SEQ ID NO: 760502 - DNA, 20 bp, mouse
gtagccctatctcggtacag

SEQ ID NO: 760503 - DNA, 20 bp, mouse
gaagacgcaacgaaccgcac

SEQ ID NO: 760504 - DNA, 20 bp, mouse
ggcaggtaagaaagacccgc

SEQ ID NO: 760505 - DNA, 20 bp, mouse
ggtaagaaagacccgcaggt

SEQ ID NO: 760506 - DNA, 20 bp, mouse
gctagctgaaagaactaaag

SEQ ID NO: 760507 - DNA, 20 bp, mouse
gaggttggtcatttacattg

SEQ ID NO: 760508 - DNA, 20 bp, mouse
ggcccactggaagagccgga

SEQ ID NO: 760509 - DNA, 20 bp, mouse
gaaagaactcggaatatctg

SEQ ID NO: 760510 - DNA, 20 bp, mouse
gaggaagtgagtccctagcg

SEQ ID NO: 760511 - DNA, 20 bp, mouse
gaaagactcaagaagccctc

SEQ ID NO: 760512 - DNA, 20 bp, mouse
gctaggtcctcaatcgcaaa

SEQ ID NO: 760513 - DNA, 20 bp, mouse
gactcggaatatctgaggct

SEQ ID NO: 760514 - DNA, 20 bp, mouse
gagccctccggctcttccag

SEQ ID NO: 760515 - DNA, 20 bp, mouse
gaaggcttgcaaacggaatc

SEQ ID NO: 760516 - DNA, 20 bp, mouse
gggtcacgacagtgctgaaa

SEQ ID NO: 760517 - DNA, 20 bp, mouse
gctaccgggcgcagtagtat

SEQ ID NO: 760518 - DNA, 20 bp, mouse
gcaagtagcacaacaatcaa

SEQ ID NO: 760519 - DNA, 20 bp, mouse
ggaaagggagaactcactac

SEQ ID NO: 760520 - DNA, 20 bp, mouse
ggcagtagtatggggaaagt

SEQ ID NO: 760521 - DNA, 20 bp, mouse
gctgtcagcgtctggaggct

SEQ ID NO: 760522 - DNA, 20 bp, mouse
ggctgggctgcttgctgcgc

SEQ ID NO: 760523 - DNA, 20 bp, mouse
ggaaactgccaccgtgaaac

SEQ ID NO: 760524 - DNA, 20 bp, mouse
gtcggccggtggttgattta

SEQ ID NO: 760525 - DNA, 20 bp, mouse
gaaacagtcacacaagtttt

SEQ ID NO: 760526 - DNA, 20 bp, mouse
ggctggtggtggaactggat

SEQ ID NO: 760527 - DNA, 20 bp, mouse
gaactgtgcgcagtgttcaa

SEQ ID NO: 760528 - DNA, 20 bp, mouse
ggcaggcgcacagcagtcgg

SEQ ID NO: 760529 - DNA, 20 bp, mouse
gtgtgacaaaggcagggggt

SEQ ID NO: 760530 - DNA, 20 bp, mouse
gccagccccgccagccgctc

SEQ ID NO: 760531 - DNA, 20 bp, mouse
gtactagtgtgacaaaggca

SEQ ID NO: 760532 - DNA, 20 bp, mouse
gtggataggatgcggagctg

SEQ ID NO: 760533 - DNA, 20 bp, mouse
gtatgcctgagcggctggcg

SEQ ID NO: 760534 - DNA, 20 bp, mouse
gagtcggcggggagtacttg

SEQ ID NO: 760535 - DNA, 20 bp, mouse
gagaaaatgcagattttccg

SEQ ID NO: 760536 - DNA, 20 bp, mouse
ggaacgtaaaagttcaacat

SEQ ID NO: 760537 - DNA, 20 bp, mouse
ggctgtggtcgtccctgggt

SEQ ID NO: 760538 - DNA, 20 bp, mouse
ggggaatgaaaaagtcgctg

SEQ ID NO: 760539 - DNA, 20 bp, mouse
gcgcgaccacaggtataaag

SEQ ID NO: 760540 - DNA, 20 bp, mouse
ggaccgtggcgcactctgcg

SEQ ID NO: 760541 - DNA, 20 bp, mouse
gctgactaatgtcgtctctg

SEQ ID NO: 760542 - DNA, 20 bp, mouse
gcgcgctaaagcaatggcac

SEQ ID NO: 760543 - DNA, 20 bp, mouse
gctaaagcaatggcacgggg

SEQ ID NO: 760544 - DNA, 20 bp, mouse
gaagcaggaggatgtgtacg

SEQ ID NO: 760545 - DNA, 20 bp, mouse
gagtcgctgtggtcgtccct

SEQ ID NO: 760546 - DNA, 20 bp, mouse
gccgcctcctacaggaccct

SEQ ID NO: 760547 - DNA, 20 bp, mouse
ggggacgctgctacagtccg

SEQ ID NO: 760548 - DNA, 20 bp, mouse
gagtcccgccttcaggatct

SEQ ID NO: 760549 - DNA, 20 bp, mouse
gtcctgggcccgcctcctac

SEQ ID NO: 760550 - DNA, 20 bp, mouse
gacgctgctacagtccgggg

SEQ ID NO: 760551 - DNA, 20 bp, mouse
gtcctgtaggaggcgggccc

SEQ ID NO: 760552 - DNA, 20 bp, mouse
gtagagaaaaatatagtcct

SEQ ID NO: 760553 - DNA, 20 bp, mouse
gcttcaggatctcggaagtc

SEQ ID NO: 760554 - DNA, 20 bp, mouse
gtggcggtgtagaatctgga

SEQ ID NO: 760555 - DNA, 20 bp, mouse
gagcgtcccaaaccgaggtc

SEQ ID NO: 760556 - DNA, 20 bp, mouse
gtcgcccactaaaggtgcgc

SEQ ID NO: 760557 - DNA, 20 bp, mouse
gcctcggcctcgcccactaa

SEQ ID NO: 760558 - DNA, 20 bp, mouse
gctccgagaaaggagagtct

SEQ ID NO: 760559 - DNA, 20 bp, mouse
gtgtgcccgcgcacctttag

SEQ ID NO: 760560 - DNA, 20 bp, mouse
gtgcccagactctcctttct

SEQ ID NO: 760561 - DNA, 20 bp, mouse
ggcagccagtggcgtgtcca

SEQ ID NO: 760562 - DNA, 20 bp, mouse
gaatacttgggatccagcag

SEQ ID NO: 760563 - DNA, 20 bp, mouse
gtagcacgagagtaaatttc

SEQ ID NO: 760564 - DNA, 20 bp, mouse
gaggtccctggacacgccac

SEQ ID NO: 760565 - DNA, 20 bp, mouse
gacagagctcaaaggaacgg

SEQ ID NO: 760566 - DNA, 20 bp, mouse
gaaggcgagcctcgtcctca

SEQ ID NO: 760567 - DNA, 20 bp, mouse
gctgacgcagcggcgcgcga

SEQ ID NO: 760568 - DNA, 20 bp, mouse
gcgcgcgcgccgtgcgtcct

SEQ ID NO: 760569 - DNA, 20 bp, mouse
gcgcgcgcgctcacgagccc

SEQ ID NO: 760570 - DNA, 20 bp, mouse
gcaaccgggccggcctttta

SEQ ID NO: 760571 - DNA, 20 bp, mouse
gggctgctgggaccggtggg

SEQ ID NO: 760572 - DNA, 20 bp, mouse
gctggcctgggcgtcccgaa

SEQ ID NO: 760573 - DNA, 20 bp, mouse
ggggccggccttttagggac

SEQ ID NO: 760574 - DNA, 20 bp, mouse
gagtccccgccctgaggacg

SEQ ID NO: 760575 - DNA, 20 bp, mouse
gcgcgccgctgcgtcaggaa

SEQ ID NO: 760576 - DNA, 20 bp, mouse
gtgggcaggcccaaatcgga

SEQ ID NO: 760577 - DNA, 20 bp, mouse
gaatgcgcgcgcaaacgctt

SEQ ID NO: 760578 - DNA, 20 bp, mouse
gttgcgcgcgcattctggga

SEQ ID NO: 760579 - DNA, 20 bp, mouse
gaaagcgtggggtcctcccc

SEQ ID NO: 760580 - DNA, 20 bp, mouse
gcaaacgcttgggtccacca

SEQ ID NO: 760581 - DNA, 20 bp, mouse
gaattggtggactcagttag

SEQ ID NO: 760582 - DNA, 20 bp, mouse
gtccgggttcgggaaagcgt

SEQ ID NO: 760583 - DNA, 20 bp, mouse
gcaggcccaaatcggagggg

SEQ ID NO: 760584 - DNA, 20 bp, mouse
gtaagggcgagatcagggca

SEQ ID NO: 760585 - DNA, 20 bp, mouse
ggtggtgcgtgtgcacaagt

SEQ ID NO: 760586 - DNA, 20 bp, mouse
gacgcccaggcaaaagccac

SEQ ID NO: 760587 - DNA, 20 bp, mouse
gcgtctcaggaggggagagc

SEQ ID NO: 760588 - DNA, 20 bp, mouse
gaccgtggagccttcatcgt

SEQ ID NO: 760589 - DNA, 20 bp, mouse
gaatcatggaacatcctctc

SEQ ID NO: 760590 - DNA, 20 bp, mouse
ggggaaacagcggtgagccg

SEQ ID NO: 760591 - DNA, 20 bp, mouse
gacccctgagaggcaagtcc

SEQ ID NO: 760592 - DNA, 20 bp, mouse
gctaactgccaacccctgag

SEQ ID NO: 760593 - DNA, 20 bp, mouse
gcgctcccaacttatcatgt

SEQ ID NO: 760594 - DNA, 20 bp, mouse
gctcccctcctgagacgccc

SEQ ID NO: 760595 - DNA, 20 bp, mouse
gagtggaattgacgaacagg

SEQ ID NO: 760596 - DNA, 20 bp, mouse
ggcggaggaggtcagaactg

SEQ ID NO: 760597 - DNA, 20 bp, mouse
gtcaccctggagtgagagga

SEQ ID NO: 760598 - DNA, 20 bp, mouse
gtgggagccccggactgctg

SEQ ID NO: 760599 - DNA, 20 bp, mouse
gccacggccacagcagtccg

SEQ ID NO: 760600 - DNA, 20 bp, mouse
ggctccccaggcctcatggg

SEQ ID NO: 760601 - DNA, 20 bp, mouse
gaggtgggcgtcagcgacaa

SEQ ID NO: 760602 - DNA, 20 bp, mouse
gagtgagcgagcgcaagggg

SEQ ID NO: 760603 - DNA, 20 bp, mouse
gtcggctccccaggcctcat

SEQ ID NO: 760604 - DNA, 20 bp, mouse
gggcccaaaggggtgtatgg

SEQ ID NO: 760605 - DNA, 20 bp, mouse
gcctggggagccgacaccca

SEQ ID NO: 760606 - DNA, 20 bp, mouse
ggcagtcagccacgggaagg

SEQ ID NO: 760607 - DNA, 20 bp, mouse
gagggaatgctcactggcaa

SEQ ID NO: 760608 - DNA, 20 bp, mouse
ggggtccagaaggttacctc

SEQ ID NO: 760609 - DNA, 20 bp, mouse
gtacctctggcaagtgacta

SEQ ID NO: 760610 - DNA, 20 bp, mouse
gctaagtcggatccccagtg

SEQ ID NO: 760611 - DNA, 20 bp, mouse
gtgctctgtcatgtaaagtg

SEQ ID NO: 760612 - DNA, 20 bp, mouse
gcgtgctgaagcctagaggc

SEQ ID NO: 760613 - DNA, 20 bp, mouse
gaaagtgcggtgtggtgggc

SEQ ID NO: 760614 - DNA, 20 bp, mouse
ggagagtccgcgcagagcag

SEQ ID NO: 760615 - DNA, 20 bp, mouse
gcagaaaccaggttgggcgt

SEQ ID NO: 760616 - DNA, 20 bp, mouse
ggggcccagcgaccggaccc

SEQ ID NO: 760617 - DNA, 20 bp, mouse
gcggggaccgccagtgccgg

SEQ ID NO: 760618 - DNA, 20 bp, mouse
gagcacgtggctcggggtcc

SEQ ID NO: 760619 - DNA, 20 bp, mouse
gggcgcggagcacgtggctc

SEQ ID NO: 760620 - DNA, 20 bp, mouse
gccctggcacggcccccgag

SEQ ID NO: 760621 - DNA, 20 bp, mouse
gtgaacgaagccatccccct

SEQ ID NO: 760622 - DNA, 20 bp, mouse
gttcacgcagaacttagggc

SEQ ID NO: 760623 - DNA, 20 bp, mouse
ggtggcgggcgcggagcacg

SEQ ID NO: 760624 - DNA, 20 bp, mouse
gccccgccggccaagagcgg

SEQ ID NO: 760625 - DNA, 20 bp, mouse
gcggcgggagcggcgtgcgc

SEQ ID NO: 760626 - DNA, 20 bp, mouse
gtgcctgcccacacccgact

SEQ ID NO: 760627 - DNA, 20 bp, mouse
gaaccggcgctccacccagt

SEQ ID NO: 760628 - DNA, 20 bp, mouse
ggtggagcgccggttcctgt

SEQ ID NO: 760629 - DNA, 20 bp, mouse
gacccgactgggtggagcgc

SEQ ID NO: 760630 - DNA, 20 bp, mouse
ggggaaaccgaggccaggtg

SEQ ID NO: 760631 - DNA, 20 bp, mouse
gttgtgggtctgatctatta

SEQ ID NO: 760632 - DNA, 20 bp, mouse
gcgcccccagccagcctggg

SEQ ID NO: 760633 - DNA, 20 bp, mouse
gcacccagtcgggtgtgggc

SEQ ID NO: 760634 - DNA, 20 bp, mouse
gcaggcaaagctctaagtgc

SEQ ID NO: 760635 - DNA, 20 bp, mouse
ggggccatgcttgggccaat

SEQ ID NO: 760636 - DNA, 20 bp, mouse
gcacttgcctgccaaggcct

SEQ ID NO: 760637 - DNA, 20 bp, mouse
gcccaacccgaggccttggc

SEQ ID NO: 760638 - DNA, 20 bp, mouse
gcttgagtaacggcaaagac

SEQ ID NO: 760639 - DNA, 20 bp, mouse
ggggcgggctgagacgccga

SEQ ID NO: 760640 - DNA, 20 bp, mouse
gagagcccaacccgaggcct

SEQ ID NO: 760641 - DNA, 20 bp, mouse
gccgctcgggtacagcttcg

SEQ ID NO: 760642 - DNA, 20 bp, mouse
gggggaaagagcccaacccg

SEQ ID NO: 760643 - DNA, 20 bp, mouse
ggcctgccaaggcctcgggt

SEQ ID NO: 760644 - DNA, 20 bp, mouse
gcgcaaaacctgttacaatc

SEQ ID NO: 760645 - DNA, 20 bp, mouse
ggtgacgcgaaggaagccgt

SEQ ID NO: 760646 - DNA, 20 bp, mouse
gaatcccagaaggttctcag

SEQ ID NO: 760647 - DNA, 20 bp, mouse
gggcactcgggagcgatcgg

SEQ ID NO: 760648 - DNA, 20 bp, mouse
gtatcagccaccctggtcta

SEQ ID NO: 760649 - DNA, 20 bp, mouse
gtctataccctagaccaggg

SEQ ID NO: 760650 - DNA, 20 bp, mouse
ggatctgaggcgcccggcag

SEQ ID NO: 760651 - DNA, 20 bp, mouse
gcgcttcacggtctgatctg

SEQ ID NO: 760652 - DNA, 20 bp, mouse
ggcagagagcaatcgcttca

SEQ ID NO: 760653 - DNA, 20 bp, mouse
gtacaaccaggttcgggatt

SEQ ID NO: 760654 - DNA, 20 bp, mouse
gtatgtgcgcaaggccccag

SEQ ID NO: 760655 - DNA, 20 bp, mouse
gaagcctctgagaaccttct

SEQ ID NO: 760656 - DNA, 20 bp, mouse
gccaccctggggcggtgcag

SEQ ID NO: 760657 - DNA, 20 bp, mouse
gataaaggagcagtagctac

SEQ ID NO: 760658 - DNA, 20 bp, mouse
gaggcgctgagttaggctgt

SEQ ID NO: 760659 - DNA, 20 bp, mouse
gccgcctcgcatgacgtcac

SEQ ID NO: 760660 - DNA, 20 bp, mouse
gtcgcatgacgtcacgggaa

SEQ ID NO: 760661 - DNA, 20 bp, mouse
ggtgtgccaggcgctgagtt

SEQ ID NO: 760662 - DNA, 20 bp, mouse
gggccacccagcacccccgc

SEQ ID NO: 760663 - DNA, 20 bp, mouse
gagcccgcgggggtgctggg

SEQ ID NO: 760664 - DNA, 20 bp, mouse
ggcaaacaaatgagtgataa

SEQ ID NO: 760665 - DNA, 20 bp, mouse
gcatgacgtcacgggaaagg

SEQ ID NO: 760666 - DNA, 20 bp, mouse
ggctgcgcgcgaggcttggg

SEQ ID NO: 760667 - DNA, 20 bp, mouse
gggccccgcgacgcgcgctc

SEQ ID NO: 760668 - DNA, 20 bp, mouse
gcaggggcgcgcggcgagaa

SEQ ID NO: 760669 - DNA, 20 bp, mouse
ggaagggcgggcgaggttgg

SEQ ID NO: 760670 - DNA, 20 bp, mouse
gggcgcgcggcgagaagggg

SEQ ID NO: 760671 - DNA, 20 bp, mouse
ggggttggagcaagcgtggc

SEQ ID NO: 760672 - DNA, 20 bp, mouse
gaggggcgggacccgctctg

SEQ ID NO: 760673 - DNA, 20 bp, mouse
gcggcggaggaggcccactc

SEQ ID NO: 760674 - DNA, 20 bp, mouse
gctcgcgtggcgggctccca

SEQ ID NO: 760675 - DNA, 20 bp, mouse
ggcgcgcgtcgcggggcccg

SEQ ID NO: 760676 - DNA, 20 bp, mouse
gccccagcccggcctgtgat

SEQ ID NO: 760677 - DNA, 20 bp, mouse
gcgagcgggagggtccccgt

SEQ ID NO: 760678 - DNA, 20 bp, mouse
ggtcccggggatcgccgagc

SEQ ID NO: 760679 - DNA, 20 bp, mouse
gcggcaggcccagcccgcca

SEQ ID NO: 760680 - DNA, 20 bp, mouse
ggggaccctcccgctcgccg

SEQ ID NO: 760681 - DNA, 20 bp, mouse
ggagctggggcgcgccctgg

SEQ ID NO: 760682 - DNA, 20 bp, mouse
ggggctcccgcccccgccga

SEQ ID NO: 760683 - DNA, 20 bp, mouse
gccagctcagtgctctgtgc

SEQ ID NO: 760684 - DNA, 20 bp, mouse
gtccagttcaccgggtccca

SEQ ID NO: 760685 - DNA, 20 bp, mouse
ggggaggccgggagagccat

SEQ ID NO: 760686 - DNA, 20 bp, mouse
gtggccacgcgcggggtctc

SEQ ID NO: 760687 - DNA, 20 bp, mouse
gctcgccgctaacaccagtt

SEQ ID NO: 760688 - DNA, 20 bp, mouse
gtgtaaagagaaaggcaagt

SEQ ID NO: 760689 - DNA, 20 bp, mouse
gtcggctaggaacagccaga

SEQ ID NO: 760690 - DNA, 20 bp, mouse
ggccgctaacaccagttcgg

SEQ ID NO: 760691 - DNA, 20 bp, mouse
gagtggggttgtaaagagaa

SEQ ID NO: 760692 - DNA, 20 bp, mouse
gcagttcggtggccacgcgc

SEQ ID NO: 760693 - DNA, 20 bp, mouse
gccactgacacagaacacga

SEQ ID NO: 760694 - DNA, 20 bp, mouse
gtggccctgaaggctcatcg

SEQ ID NO: 760695 - DNA, 20 bp, mouse
ggagctgcctccaggcatga

SEQ ID NO: 760696 - DNA, 20 bp, mouse
gggtttcagaagttagaggt

SEQ ID NO: 760697 - DNA, 20 bp, mouse
ggcggcgcggtatgcaaacg

SEQ ID NO: 760698 - DNA, 20 bp, mouse
gaacgaggcccgcgccgtgc

SEQ ID NO: 760699 - DNA, 20 bp, mouse
gggcccgcgccgtgctggtc

SEQ ID NO: 760700 - DNA, 20 bp, mouse
gaagttagaggtgggcgggg

SEQ ID NO: 760701 - DNA, 20 bp, mouse
gcacgttatcaaaagggcgg

SEQ ID NO: 760702 - DNA, 20 bp, mouse
gttacacgctctttgtcgga

SEQ ID NO: 760703 - DNA, 20 bp, mouse
gggagggtttcagaagttag

SEQ ID NO: 760704 - DNA, 20 bp, mouse
gtttcacgttatcaaaaggg

SEQ ID NO: 760705 - DNA, 20 bp, mouse
gtcttttcacgttatcaaaa

SEQ ID NO: 760706 - DNA, 20 bp, mouse
gaaaaaccccacacatgcac

SEQ ID NO: 760707 - DNA, 20 bp, mouse
gcaggccacgaacatccgac

SEQ ID NO: 760708 - DNA, 20 bp, mouse
gtcgtggcctgtgcatgtgt

SEQ ID NO: 760709 - DNA, 20 bp, mouse
gatagtaggcaatgacttag

SEQ ID NO: 760710 - DNA, 20 bp, mouse
gcttttctgtggtttgaaac

SEQ ID NO: 760711 - DNA, 20 bp, mouse
gcctgcaatgcaactccaaa

SEQ ID NO: 760712 - DNA, 20 bp, mouse
gtggactacatttgttctga

SEQ ID NO: 760713 - DNA, 20 bp, mouse
gtttccttccggttgctgag

SEQ ID NO: 760714 - DNA, 20 bp, mouse
gaacatcgcctctcagcaac

SEQ ID NO: 760715 - DNA, 20 bp, mouse
gggtatttgtggcatatagt

SEQ ID NO: 760716 - DNA, 20 bp, mouse
gtcactgcggagaagccggt

SEQ ID NO: 760717 - DNA, 20 bp, mouse
gtctccgcagtgagaggggc

SEQ ID NO: 760718 - DNA, 20 bp, mouse
gcggagaagccggtcggccc

SEQ ID NO: 760719 - DNA, 20 bp, mouse
ggcctcccgaggtcagacca

SEQ ID NO: 760720 - DNA, 20 bp, mouse
gcggtccggcccctcggcag

SEQ ID NO: 760721 - DNA, 20 bp, mouse
gtactccttggtctgacctc

SEQ ID NO: 760722 - DNA, 20 bp, mouse
gggcttctccgcagtgagag

SEQ ID NO: 760723 - DNA, 20 bp, mouse
ggagtaaaggacttccggag

SEQ ID NO: 760724 - DNA, 20 bp, mouse
gagccccgcccctctcactg

SEQ ID NO: 760725 - DNA, 20 bp, mouse
gccaaggagtaaaggacttc

SEQ ID NO: 760726 - DNA, 20 bp, mouse
gcgttgctgcagccaagggg

SEQ ID NO: 760727 - DNA, 20 bp, mouse
gaataagcagggaagttatg

SEQ ID NO: 760728 - DNA, 20 bp, mouse
gacagaaggctagcgagctg

SEQ ID NO: 760729 - DNA, 20 bp, mouse
gtgcgcaaaagcaaaggcgg

SEQ ID NO: 760730 - DNA, 20 bp, mouse
gaggggtcctcatagaaaag

SEQ ID NO: 760731 - DNA, 20 bp, mouse
gggcgggggcgaacgacaga

SEQ ID NO: 760732 - DNA, 20 bp, mouse
gtgggggtctcagagaaagt

SEQ ID NO: 760733 - DNA, 20 bp, mouse
gagtcccggcgtataaatag

SEQ ID NO: 760734 - DNA, 20 bp, mouse
gagggtccctgaggcaaaaa

SEQ ID NO: 760735 - DNA, 20 bp, mouse
gggattctgcgcaaaagcaa

SEQ ID NO: 760736 - DNA, 20 bp, mouse
gtaccgggtgacaagaggtc

SEQ ID NO: 760737 - DNA, 20 bp, mouse
gaagccttgcggtgattcag

SEQ ID NO: 760738 - DNA, 20 bp, mouse
gcggccgctgaatcaccgca

SEQ ID NO: 760739 - DNA, 20 bp, mouse
gtcaaggggacgctaggaaa

SEQ ID NO: 760740 - DNA, 20 bp, mouse
ggggactgcgggtaccgggc

SEQ ID NO: 760741 - DNA, 20 bp, mouse
gcacactggaccccacactt

SEQ ID NO: 760742 - DNA, 20 bp, mouse
ggtggggtccagtgtggtgc

SEQ ID NO: 760743 - DNA, 20 bp, mouse
ggagtggcgagacaaagaaa

SEQ ID NO: 760744 - DNA, 20 bp, mouse
ggcccggcgacacccaagtg

SEQ ID NO: 760745 - DNA, 20 bp, mouse
ggaccctacggccaaaagta

SEQ ID NO: 760746 - DNA, 20 bp, mouse
gaagagggactgggaagcta

SEQ ID NO: 760747 - DNA, 20 bp, mouse
gtgggaagctagggcgactg

SEQ ID NO: 760748 - DNA, 20 bp, mouse
gcaaccccgcccagggatgg

SEQ ID NO: 760749 - DNA, 20 bp, mouse
ggatacgccgaggtctagtc

SEQ ID NO: 760750 - DNA, 20 bp, mouse
gcgcccagggatggaggacc

SEQ ID NO: 760751 - DNA, 20 bp, mouse
gggcggggttgctacggaaa

SEQ ID NO: 760752 - DNA, 20 bp, mouse
gtccgtagcaaccccgccca

SEQ ID NO: 760753 - DNA, 20 bp, mouse
ggccaagccggactagacct

SEQ ID NO: 760754 - DNA, 20 bp, mouse
gggcgactgaggatacgccg

SEQ ID NO: 760755 - DNA, 20 bp, mouse
gctgggaagtcagggcataa

SEQ ID NO: 760756 - DNA, 20 bp, mouse
ggagcagtcgcgtaacccgg

SEQ ID NO: 760757 - DNA, 20 bp, mouse
gaatccctggggacccaaga

SEQ ID NO: 760758 - DNA, 20 bp, mouse
gtatgagaatcccgggtgtt

SEQ ID NO: 760759 - DNA, 20 bp, mouse
gcgggcaccagttcggaaca

SEQ ID NO: 760760 - DNA, 20 bp, mouse
gccacaggggcttatatctg

SEQ ID NO: 760761 - DNA, 20 bp, mouse
gcaggcggcgcagtatggaa

SEQ ID NO: 760762 - DNA, 20 bp, mouse
ggcgactccgggcaccagtt

SEQ ID NO: 760763 - DNA, 20 bp, mouse
gacggcctgcgggagctagg

SEQ ID NO: 760764 - DNA, 20 bp, mouse
gccgggtgttgggcaagctt

SEQ ID NO: 760765 - DNA, 20 bp, mouse
ggggagctagggggccgaga

SEQ ID NO: 760766 - DNA, 20 bp, mouse
gcccacctgcagcgcctcca

SEQ ID NO: 760767 - DNA, 20 bp, mouse
gcggaccccgtgcgctccaa

SEQ ID NO: 760768 - DNA, 20 bp, mouse
ggcaggtgggggttcacttc

SEQ ID NO: 760769 - DNA, 20 bp, mouse
ggtggggtacatccctgatg

SEQ ID NO: 760770 - DNA, 20 bp, mouse
gaaacctgaagctcctcatc

SEQ ID NO: 760771 - DNA, 20 bp, mouse
gtccaagaccagctcggccc

SEQ ID NO: 760772 - DNA, 20 bp, mouse
gttcccggggtgaccactgg

SEQ ID NO: 760773 - DNA, 20 bp, mouse
ggaaacggggagacttgaga

SEQ ID NO: 760774 - DNA, 20 bp, mouse
ggctccccctgcaagtagga

SEQ ID NO: 760775 - DNA, 20 bp, mouse
ggtgggggttcacttcggga

SEQ ID NO: 760776 - DNA, 20 bp, mouse
gaggcagcccacagaactca

SEQ ID NO: 760777 - DNA, 20 bp, mouse
gcggccaggccacgcctagg

SEQ ID NO: 760778 - DNA, 20 bp, mouse
gagcaaaccccgcccatctg

SEQ ID NO: 760779 - DNA, 20 bp, mouse
gagtccgcaccacctaggcg

SEQ ID NO: 760780 - DNA, 20 bp, mouse
ggtggtgcggactctgctct

SEQ ID NO: 760781 - DNA, 20 bp, mouse
gcggctcagtgtaaaaactc

SEQ ID NO: 760782 - DNA, 20 bp, mouse
gtgaacttcccgcccagtgt

SEQ ID NO: 760783 - DNA, 20 bp, mouse
ggatgggcggggtttgctgg

SEQ ID NO: 760784 - DNA, 20 bp, mouse
ggcctggccgcagatgggcg

SEQ ID NO: 760785 - DNA, 20 bp, mouse
gggtctcacacttgtgtcat

SEQ ID NO: 760786 - DNA, 20 bp, mouse
ggggctggactaagagtgat

SEQ ID NO: 760787 - DNA, 20 bp, mouse
gtggactaagagtgatgggg

SEQ ID NO: 760788 - DNA, 20 bp, mouse
gcgaacggactgtacgtgcg

SEQ ID NO: 760789 - DNA, 20 bp, mouse
gaagggcggggttacggaat

SEQ ID NO: 760790 - DNA, 20 bp, mouse
ggagctagcggggagcgtga

SEQ ID NO: 760791 - DNA, 20 bp, mouse
gccggggaagggcggggtta

SEQ ID NO: 760792 - DNA, 20 bp, mouse
ggaggagccgggatctgcgg

SEQ ID NO: 760793 - DNA, 20 bp, mouse
gcggggccaggcgaagcgaa

SEQ ID NO: 760794 - DNA, 20 bp, mouse
ggccagcgacagtgacgcga

SEQ ID NO: 760795 - DNA, 20 bp, mouse
gagcaagccggggatgggta

SEQ ID NO: 760796 - DNA, 20 bp, mouse
gaatgccccgaatatatccc

SEQ ID NO: 760797 - DNA, 20 bp, mouse
gggtcttcctgggatatatt

SEQ ID NO: 760798 - DNA, 20 bp, mouse
gaaacttggtcagaagatac

SEQ ID NO: 760799 - DNA, 20 bp, mouse
gccacaacccatcgtgtgat

SEQ ID NO: 760800 - DNA, 20 bp, mouse
gtaagaatagttacggagga

SEQ ID NO: 760801 - DNA, 20 bp, mouse
gcccacaagtctcagagaaa

SEQ ID NO: 760802 - DNA, 20 bp, mouse
gcaattaagaatagttacgg

SEQ ID NO: 760803 - DNA, 20 bp, mouse
ggtgcaattaagaatagtta

SEQ ID NO: 760804 - DNA, 20 bp, mouse
gcatcgtgtgataggaatct

SEQ ID NO: 760805 - DNA, 20 bp, mouse
gttattagattgagtggtac

SEQ ID NO: 760806 - DNA, 20 bp, mouse
gaggcggccgcaagtgtgag

SEQ ID NO: 760807 - DNA, 20 bp, mouse
ggccgcaagtgtgagaggaa

SEQ ID NO: 760808 - DNA, 20 bp, mouse
gagaagctgagggctctccc

SEQ ID NO: 760809 - DNA, 20 bp, mouse
gaggcgtggcgaagcgagca

SEQ ID NO: 760810 - DNA, 20 bp, mouse
gggcaggagcaggttgaggt

SEQ ID NO: 760811 - DNA, 20 bp, mouse
ggtaggatcccggggagaaa

SEQ ID NO: 760812 - DNA, 20 bp, mouse
ggggccgggtggtgggaact

SEQ ID NO: 760813 - DNA, 20 bp, mouse
gcagcagcaggtaggatccc

SEQ ID NO: 760814 - DNA, 20 bp, mouse
ggggagaaacggcagacccg

SEQ ID NO: 760815 - DNA, 20 bp, mouse
gcggaagcagccggcggatc

SEQ ID NO: 760816 - DNA, 20 bp, mouse
gtagcgacacgcattttccc

SEQ ID NO: 760817 - DNA, 20 bp, mouse
gtctgcgtctagctgctcta

SEQ ID NO: 760818 - DNA, 20 bp, mouse
gtaggcaaccgcgtcggcgt

SEQ ID NO: 760819 - DNA, 20 bp, mouse
gtgtcgctaggcaaccgcgt

SEQ ID NO: 760820 - DNA, 20 bp, mouse
gggtgcatctcaactctgat

SEQ ID NO: 760821 - DNA, 20 bp, mouse
gcaacactgctaggcatcct

SEQ ID NO: 760822 - DNA, 20 bp, mouse
gccgaaaacccctgggattt

SEQ ID NO: 760823 - DNA, 20 bp, mouse
gagtgcagaggagtcggaaa

SEQ ID NO: 760824 - DNA, 20 bp, mouse
ggcagacaccaacgccgacg

SEQ ID NO: 760825 - DNA, 20 bp, mouse
gccaccgggtcaaccgtcgc

SEQ ID NO: 760826 - DNA, 20 bp, mouse
gactcagagaacagcgccta

SEQ ID NO: 760827 - DNA, 20 bp, mouse
gtgagttattgctccagatt

SEQ ID NO: 760828 - DNA, 20 bp, mouse
gggggcgtgcccctagctgt

SEQ ID NO: 760829 - DNA, 20 bp, mouse
gtgcccctagctgtgggcag

SEQ ID NO: 760830 - DNA, 20 bp, mouse
gaatgctagcagtgtccctg

SEQ ID NO: 760831 - DNA, 20 bp, mouse
ggaggcaggagatccagaat

SEQ ID NO: 760832 - DNA, 20 bp, mouse
ggctttaaaacagctctttg

SEQ ID NO: 760833 - DNA, 20 bp, mouse
gtattgctaacgttttgaac

SEQ ID NO: 760834 - DNA, 20 bp, mouse
gagcaataactcaaattact

SEQ ID NO: 760835 - DNA, 20 bp, mouse
gagttgtaccaggacgtggt

SEQ ID NO: 760836 - DNA, 20 bp, mouse
gcggggctgccgaaccgctc

SEQ ID NO: 760837 - DNA, 20 bp, mouse
gctctatggcaggtcctccg

SEQ ID NO: 760838 - DNA, 20 bp, mouse
gttccaggagcgaagctcta

SEQ ID NO: 760839 - DNA, 20 bp, mouse
gaacgcaggaagtgcggctc

SEQ ID NO: 760840 - DNA, 20 bp, mouse
gaaccaaaacgcaggaagtg

SEQ ID NO: 760841 - DNA, 20 bp, mouse
ggctctggccgcttccgcga

SEQ ID NO: 760842 - DNA, 20 bp, mouse
gcatcgagccgtcgcggaag

SEQ ID NO: 760843 - DNA, 20 bp, mouse
gtccgcgacggctcgatggt

SEQ ID NO: 760844 - DNA, 20 bp, mouse
gggaagcggccagagcggtt

SEQ ID NO: 760845 - DNA, 20 bp, mouse
gtaccccgccagtatcgcta

SEQ ID NO: 760846 - DNA, 20 bp, mouse
gcggaggagcgggaagaccc

SEQ ID NO: 760847 - DNA, 20 bp, mouse
ggggacaagcacacttttat

SEQ ID NO: 760848 - DNA, 20 bp, mouse
gtggccctgcccctgcgtct

SEQ ID NO: 760849 - DNA, 20 bp, mouse
gtcctcagacaccaagctac

SEQ ID NO: 760850 - DNA, 20 bp, mouse
gcacactccctggaacccga

SEQ ID NO: 760851 - DNA, 20 bp, mouse
ggcagggccaccctcgcccg

SEQ ID NO: 760852 - DNA, 20 bp, mouse
ggtagtggagagtagggaat

SEQ ID NO: 760853 - DNA, 20 bp, mouse
ggtacctggaaatgagccct

SEQ ID NO: 760854 - DNA, 20 bp, mouse
ggggaagtgggcggagtgct

SEQ ID NO: 760855 - DNA, 20 bp, mouse
ggccaccccagcacactccc

SEQ ID NO: 760856 - DNA, 20 bp, mouse
gcagaggggttcagtgccca

SEQ ID NO: 760857 - DNA, 20 bp, mouse
gcgggcgcgcgcagaagcgg

SEQ ID NO: 760858 - DNA, 20 bp, mouse
gcggccgccacgcaggctag

SEQ ID NO: 760859 - DNA, 20 bp, mouse
ggggttcagtgcccagggtt

SEQ ID NO: 760860 - DNA, 20 bp, mouse
gcgccccctagcctgcgtgg

SEQ ID NO: 760861 - DNA, 20 bp, mouse
ggatgaggaatccatgggtg

SEQ ID NO: 760862 - DNA, 20 bp, mouse
ggtgcctgatcgtccaactc

SEQ ID NO: 760863 - DNA, 20 bp, mouse
ggcgctggcggctctctcgg

SEQ ID NO: 760864 - DNA, 20 bp, mouse
gcaacctgagttggacgatc

SEQ ID NO: 760865 - DNA, 20 bp, mouse
ggaaccaagcggactagctg

SEQ ID NO: 760866 - DNA, 20 bp, mouse
gctcgggaaagtggtagcgt

SEQ ID NO: 760867 - DNA, 20 bp, mouse
gaaagtggtagcgtgggctc

SEQ ID NO: 760868 - DNA, 20 bp, mouse
ggggtgtgcctcgcttacgg

SEQ ID NO: 760869 - DNA, 20 bp, mouse
gctaccactttcccgagaac

SEQ ID NO: 760870 - DNA, 20 bp, mouse
ggggtcgaccgccgtaagcg

SEQ ID NO: 760871 - DNA, 20 bp, mouse
gccggagcagggtgcgggcg

SEQ ID NO: 760872 - DNA, 20 bp, mouse
gggtaggtatgcagaatctt

SEQ ID NO: 760873 - DNA, 20 bp, mouse
gctggggtgtgcctcgctta

SEQ ID NO: 760874 - DNA, 20 bp, mouse
gagaggcagcttaaactact

SEQ ID NO: 760875 - DNA, 20 bp, mouse
gaccccagttctcgggaaag

SEQ ID NO: 760876 - DNA, 20 bp, mouse
ggtacggttctgagcactga

SEQ ID NO: 760877 - DNA, 20 bp, mouse
ggatcagagaatagtcgttc

SEQ ID NO: 760878 - DNA, 20 bp, mouse
gaagtcacgcgtgtgcgatg

SEQ ID NO: 760879 - DNA, 20 bp, mouse
ggaggagctcccagatggga

SEQ ID NO: 760880 - DNA, 20 bp, mouse
gccaactcgtcccggacagt

SEQ ID NO: 760881 - DNA, 20 bp, mouse
gcgggggcgtctgtcgagtc

SEQ ID NO: 760882 - DNA, 20 bp, mouse
gtgcgcggaccctcccatct

SEQ ID NO: 760883 - DNA, 20 bp, mouse
ggaaacacgacttagcctct

SEQ ID NO: 760884 - DNA, 20 bp, mouse
gtattctctgatccctcgtt

SEQ ID NO: 760885 - DNA, 20 bp, mouse
gagtcgtgtttccccaacga

SEQ ID NO: 760886 - DNA, 20 bp, mouse
gcccgcgagtgtcgtggaag

SEQ ID NO: 760887 - DNA, 20 bp, mouse
gcggaagagtgaccacacgg

SEQ ID NO: 760888 - DNA, 20 bp, mouse
gctggcgacacgtttgtccc

SEQ ID NO: 760889 - DNA, 20 bp, mouse
gaagcggaagagtgaccaca

SEQ ID NO: 760890 - DNA, 20 bp, mouse
ggcagtctggaaagctggta

SEQ ID NO: 760891 - DNA, 20 bp, mouse
gggtctgcaaacccgccgtg

SEQ ID NO: 760892 - DNA, 20 bp, mouse
gtgaaggccagcgacgccca

SEQ ID NO: 760893 - DNA, 20 bp, mouse
ggatgcgtcccgcacacctt

SEQ ID NO: 760894 - DNA, 20 bp, mouse
gcagcgacgcccaaggtgtg

SEQ ID NO: 760895 - DNA, 20 bp, mouse
gggacgcatctgcaacaagt

SEQ ID NO: 760896 - DNA, 20 bp, mouse
ggagccgaggcgcaagaaca

SEQ ID NO: 760897 - DNA, 20 bp, mouse
gcacacggatgcgactcaaa

SEQ ID NO: 760898 - DNA, 20 bp, mouse
gtcggctcgaagcctccaga

SEQ ID NO: 760899 - DNA, 20 bp, mouse
gctcactgcggtactctgag

SEQ ID NO: 760900 - DNA, 20 bp, mouse
gtctccgcgaaaagaactct

SEQ ID NO: 760901 - DNA, 20 bp, mouse
gaaacccagagttcttttcg

SEQ ID NO: 760902 - DNA, 20 bp, mouse
gggaacatctcgacgacaca

SEQ ID NO: 760903 - DNA, 20 bp, mouse
ggcggcacctactagggcgc

SEQ ID NO: 760904 - DNA, 20 bp, mouse
gatgatggcggcacctacta

SEQ ID NO: 760905 - DNA, 20 bp, mouse
ggcagtgaggcgcaacagtt

SEQ ID NO: 760906 - DNA, 20 bp, mouse
gagaacgtgctcaaggggcg

SEQ ID NO: 760907 - DNA, 20 bp, mouse
gtggctaaggcctccggaga

SEQ ID NO: 760908 - DNA, 20 bp, mouse
gacaagagcgcgggctagag

SEQ ID NO: 760909 - DNA, 20 bp, mouse
ggtcgtgagaacgtgctcaa

SEQ ID NO: 760910 - DNA, 20 bp, mouse
gggacctaggcagtcaaggg

SEQ ID NO: 760911 - DNA, 20 bp, mouse
gtgtgaagttaccccatctc

SEQ ID NO: 760912 - DNA, 20 bp, mouse
ggatcccctgaaactgtcgt

SEQ ID NO: 760913 - DNA, 20 bp, mouse
gctagagtggctaaggcctc

SEQ ID NO: 760914 - DNA, 20 bp, mouse
gcgacttgctacccagtgag

SEQ ID NO: 760915 - DNA, 20 bp, mouse
gcggcggaggcgttttcccg

SEQ ID NO: 760916 - DNA, 20 bp, mouse
gaaggctagagaggcggagt

SEQ ID NO: 760917 - DNA, 20 bp, mouse
gggaggcgtggcctagtctt

SEQ ID NO: 760918 - DNA, 20 bp, mouse
ggcctcaggcaaggctagag

SEQ ID NO: 760919 - DNA, 20 bp, mouse
gagagaggcggagttggaaa

SEQ ID NO: 760920 - DNA, 20 bp, mouse
gcggttctgggcctcaggca

SEQ ID NO: 760921 - DNA, 20 bp, mouse
ggctcatgagagatcctaca

SEQ ID NO: 760922 - DNA, 20 bp, mouse
gcgtggttacagaggaggcg

SEQ ID NO: 760923 - DNA, 20 bp, mouse
gtagtctttggcctgctggg

SEQ ID NO: 760924 - DNA, 20 bp, mouse
gagagcgcgtgcgcggttct

SEQ ID NO: 760925 - DNA, 20 bp, mouse
gactatgggcaaaaagtact

SEQ ID NO: 760926 - DNA, 20 bp, mouse
gctcgcccacgctcccggcg

SEQ ID NO: 760927 - DNA, 20 bp, mouse
gccgctctcgcccacgctcc

SEQ ID NO: 760928 - DNA, 20 bp, mouse
ggagacggagcgactcggtg

SEQ ID NO: 760929 - DNA, 20 bp, mouse
gtcaacttccgcccttctcg

SEQ ID NO: 760930 - DNA, 20 bp, mouse
gctcgcggcgatgacgtaaa

SEQ ID NO: 760931 - DNA, 20 bp, mouse
gacggagcgactcggtgagg

SEQ ID NO: 760932 - DNA, 20 bp, mouse
gaggggaggcagaactacaa

SEQ ID NO: 760933 - DNA, 20 bp, mouse
gagccggccccgccccgaga

SEQ ID NO: 760934 - DNA, 20 bp, mouse
gccttgcccggctccgagtc

SEQ ID NO: 760935 - DNA, 20 bp, mouse
gggaggagagtggacgggag

SEQ ID NO: 760936 - DNA, 20 bp, mouse
ggccacccgcggtggagggt

SEQ ID NO: 760937 - DNA, 20 bp, mouse
gctgcgctccccctgagcta

SEQ ID NO: 760938 - DNA, 20 bp, mouse
gcggcgcagtggcagaggcg

SEQ ID NO: 760939 - DNA, 20 bp, mouse
ggctcccgccctagctcagg

SEQ ID NO: 760940 - DNA, 20 bp, mouse
gccagggcaacctgcgggag

SEQ ID NO: 760941 - DNA, 20 bp, mouse
gggaatccgcacagactccc

SEQ ID NO: 760942 - DNA, 20 bp, mouse
ggcgtgaagccgtgaggcgc

SEQ ID NO: 760943 - DNA, 20 bp, mouse
ggactcccagggcaacctgc

SEQ ID NO: 760944 - DNA, 20 bp, mouse
gtccggagatgcaaggatcc

SEQ ID NO: 760945 - DNA, 20 bp, mouse
gggggctccgccactcccgc

SEQ ID NO: 760946 - DNA, 20 bp, mouse
gctggccagcccagactgag

SEQ ID NO: 760947 - DNA, 20 bp, mouse
gcctcccggagcggtctcgg

SEQ ID NO: 760948 - DNA, 20 bp, mouse
gcacagcagcaagggtcaaa

SEQ ID NO: 760949 - DNA, 20 bp, mouse
ggcgggagaccgaaggagat

SEQ ID NO: 760950 - DNA, 20 bp, mouse
ggacaggcgcgggagaccga

SEQ ID NO: 760951 - DNA, 20 bp, mouse
gagcgtgagtgtctaagtga

SEQ ID NO: 760952 - DNA, 20 bp, mouse
gggcagaaagcctctcagtc

SEQ ID NO: 760953 - DNA, 20 bp, mouse
gggagatgggtagtgagcag

SEQ ID NO: 760954 - DNA, 20 bp, mouse
gcggccgcctcgggcaaaag

SEQ ID NO: 760955 - DNA, 20 bp, mouse
gcaaagcacgcaagactcct

SEQ ID NO: 760956 - DNA, 20 bp, mouse
gttaacccggtcattgttca

SEQ ID NO: 760957 - DNA, 20 bp, mouse
gaaaggacgcagtttcgaga

SEQ ID NO: 760958 - DNA, 20 bp, mouse
gagcgcttggcttgtgtcta

SEQ ID NO: 760959 - DNA, 20 bp, mouse
ggctcaggatggaagagcaa

SEQ ID NO: 760960 - DNA, 20 bp, mouse
gtcctggggcaactgattaa

SEQ ID NO: 760961 - DNA, 20 bp, mouse
gaagcatagtggtcctgcgt

SEQ ID NO: 760962 - DNA, 20 bp, mouse
gaatccccaaacaaggggac

SEQ ID NO: 760963 - DNA, 20 bp, mouse
gcaaggggacgggattaacc

SEQ ID NO: 760964 - DNA, 20 bp, mouse
gcaggaaggcgctatcgctc

SEQ ID NO: 760965 - DNA, 20 bp, mouse
gaaggcgctatcgctcagga

SEQ ID NO: 760966 - DNA, 20 bp, mouse
ggggcggggcggagcacagt

SEQ ID NO: 760967 - DNA, 20 bp, mouse
ggacttagcgtcagagagaa

SEQ ID NO: 760968 - DNA, 20 bp, mouse
gaacgagggaaagacagatg

SEQ ID NO: 760969 - DNA, 20 bp, mouse
ggggaggggccctgtaagac

SEQ ID NO: 760970 - DNA, 20 bp, mouse
gaggagaggacaaattgata

SEQ ID NO: 760971 - DNA, 20 bp, mouse
ggaagggggggcaagttact

SEQ ID NO: 760972 - DNA, 20 bp, mouse
gaccagttcaagaacattac

SEQ ID NO: 760973 - DNA, 20 bp, mouse
gaattgggattatacactag

SEQ ID NO: 760974 - DNA, 20 bp, mouse
ggcacagtcggctcctaggg

SEQ ID NO: 760975 - DNA, 20 bp, mouse
ggcctgtaatgttcttgaac

SEQ ID NO: 760976 - DNA, 20 bp, mouse
ggcgcgaagagggtgctcgt

SEQ ID NO: 760977 - DNA, 20 bp, mouse
gtgcccgcgaagcgaccgcc

SEQ ID NO: 760978 - DNA, 20 bp, mouse
gaagagggtgctcgtgggga

SEQ ID NO: 760979 - DNA, 20 bp, mouse
gtctcccgagagccagaggg

SEQ ID NO: 760980 - DNA, 20 bp, mouse
ggcctgccgggctccaatcc

SEQ ID NO: 760981 - DNA, 20 bp, mouse
gtgccgggctccaatcccgg

SEQ ID NO: 760982 - DNA, 20 bp, mouse
gagggtgctcgtggggaggg

SEQ ID NO: 760983 - DNA, 20 bp, mouse
gccaccccccggctctcggc

SEQ ID NO: 760984 - DNA, 20 bp, mouse
ggcttcgcgggcagccgcgg

SEQ ID NO: 760985 - DNA, 20 bp, mouse
gcctcacggtagagcgaggg

SEQ ID NO: 760986 - DNA, 20 bp, mouse
ggcaagccataaataacaca

SEQ ID NO: 760987 - DNA, 20 bp, mouse
ggtgagaagacagggggttg

SEQ ID NO: 760988 - DNA, 20 bp, mouse
gcaatcattacaaagaggaa

SEQ ID NO: 760989 - DNA, 20 bp, mouse
gtgttcacctagagatatta

SEQ ID NO: 760990 - DNA, 20 bp, mouse
ggttagcaatcattacaaag

SEQ ID NO: 760991 - DNA, 20 bp, mouse
gaaactaagctccttatctg

SEQ ID NO: 760992 - DNA, 20 bp, mouse
ggattgctaacccagacaaa

SEQ ID NO: 760993 - DNA, 20 bp, mouse
gccatttgttccatttgtct

SEQ ID NO: 760994 - DNA, 20 bp, mouse
gagggtcacagaaaatgcaa

SEQ ID NO: 760995 - DNA, 20 bp, mouse
gagaaaatgcaaaggtttta

SEQ ID NO: 760996 - DNA, 20 bp, mouse
ggcagtaggaatggctccag

SEQ ID NO: 760997 - DNA, 20 bp, mouse
ggacgagatgagcctgacat

SEQ ID NO: 760998 - DNA, 20 bp, mouse
ggaatgaagctaccagcagt

SEQ ID NO: 760999 - DNA, 20 bp, mouse
gtaggaatggctccagtggc

SEQ ID NO: 761000 - DNA, 20 bp, mouse
gtcaggctcatctcgtctct

SEQ ID NO: 761001 - DNA, 20 bp, mouse
gctggaaagttgcttgaata

SEQ ID NO: 761002 - DNA, 20 bp, mouse
gggttctcatgaaactatag

SEQ ID NO: 761003 - DNA, 20 bp, mouse
gcagatatctgaataggacc

SEQ ID NO: 761004 - DNA, 20 bp, mouse
gtgctggtagcttcattcct

SEQ ID NO: 761005 - DNA, 20 bp, mouse
gtgagaactctaccaatgtc

SEQ ID NO: 761006 - DNA, 20 bp, mouse
gccctggcggggatcccgtc

SEQ ID NO: 761007 - DNA, 20 bp, mouse
ggcggggatcccgtccggtg

SEQ ID NO: 761008 - DNA, 20 bp, mouse
ggacagtgacccagcggaag

SEQ ID NO: 761009 - DNA, 20 bp, mouse
ggcgggtgattttccgaaag

SEQ ID NO: 761010 - DNA, 20 bp, mouse
gcggaaaaggggcggtccct

SEQ ID NO: 761011 - DNA, 20 bp, mouse
gtgagtaagagtgtagagaa

SEQ ID NO: 761012 - DNA, 20 bp, mouse
gaaaatcacccgcaccggac

SEQ ID NO: 761013 - DNA, 20 bp, mouse
gtcagtgcaacacacagccc

SEQ ID NO: 761014 - DNA, 20 bp, mouse
gagcggcgacagtgacccag

SEQ ID NO: 761015 - DNA, 20 bp, mouse
gcatactcccgccggccggg

SEQ ID NO: 761016 - DNA, 20 bp, mouse
gtaggagctccagtgacaaa

SEQ ID NO: 761017 - DNA, 20 bp, mouse
gagagtgggaagcggttgct

SEQ ID NO: 761018 - DNA, 20 bp, mouse
ggatcggccaatcagagagt

SEQ ID NO: 761019 - DNA, 20 bp, mouse
gagactgcctttcaggagta

SEQ ID NO: 761020 - DNA, 20 bp, mouse
gaagtggtaaggtgaaagtt

SEQ ID NO: 761021 - DNA, 20 bp, mouse
gaagcggttgctaggctacg

SEQ ID NO: 761022 - DNA, 20 bp, mouse
gtctctgattggccgatctc

SEQ ID NO: 761023 - DNA, 20 bp, mouse
gggtatgaagtcttctgatt

SEQ ID NO: 761024 - DNA, 20 bp, mouse
gtcaaatccccggatgacgg

SEQ ID NO: 761025 - DNA, 20 bp, mouse
gccaactgcctcttgctttg

SEQ ID NO: 761026 - DNA, 20 bp, mouse
gcggtccctcgcaataaaaa

SEQ ID NO: 761027 - DNA, 20 bp, mouse
ggaggccgagtgaacgccag

SEQ ID NO: 761028 - DNA, 20 bp, mouse
gactcccgataactgcggag

SEQ ID NO: 761029 - DNA, 20 bp, mouse
gaagagccgaagcccacagg

SEQ ID NO: 761030 - DNA, 20 bp, mouse
gagctcaggagtccggggcg

SEQ ID NO: 761031 - DNA, 20 bp, mouse
gcgcgcccctccgcagttat

SEQ ID NO: 761032 - DNA, 20 bp, mouse
gcgcagagctcaggagtccg

SEQ ID NO: 761033 - DNA, 20 bp, mouse
gaggcagctccgggctctcg

SEQ ID NO: 761034 - DNA, 20 bp, mouse
gggttcctctggcgttcact

SEQ ID NO: 761035 - DNA, 20 bp, mouse
gggggccaaaggattcatgg

SEQ ID NO: 761036 - DNA, 20 bp, mouse
ggggactcgaaagctccagt

SEQ ID NO: 761037 - DNA, 20 bp, mouse
gactcgaaagctccagttgg

SEQ ID NO: 761038 - DNA, 20 bp, mouse
ggagtcccctctcttctaaa

SEQ ID NO: 761039 - DNA, 20 bp, mouse
gtagccccttctgctggagc

SEQ ID NO: 761040 - DNA, 20 bp, mouse
gggtctaagagcgaaagccc

SEQ ID NO: 761041 - DNA, 20 bp, mouse
gcgagcgtttggatgtatta

SEQ ID NO: 761042 - DNA, 20 bp, mouse
gagagcgaaagcccgggcgc

SEQ ID NO: 761043 - DNA, 20 bp, mouse
gacagcggcttggttcgtgg

SEQ ID NO: 761044 - DNA, 20 bp, mouse
gcgtttggatgtattagggt

SEQ ID NO: 761045 - DNA, 20 bp, mouse
gctgggcgggtgaaactcac

SEQ ID NO: 761046 - DNA, 20 bp, mouse
gaggcccgggaagcgagtgg

SEQ ID NO: 761047 - DNA, 20 bp, mouse
gagcttgaggtcctccgaga

SEQ ID NO: 761048 - DNA, 20 bp, mouse
gccggcgcgcgccacttcaa

SEQ ID NO: 761049 - DNA, 20 bp, mouse
ggggatggaaaaatcggacc

SEQ ID NO: 761050 - DNA, 20 bp, mouse
gcgagaggggatggaaaaat

SEQ ID NO: 761051 - DNA, 20 bp, mouse
gagaagacaccggcagggag

SEQ ID NO: 761052 - DNA, 20 bp, mouse
gcttcgagaagacaccggca

SEQ ID NO: 761053 - DNA, 20 bp, mouse
gttcccccggccagcagtaa

SEQ ID NO: 761054 - DNA, 20 bp, mouse
gtgggccgcgcgcgaggccc

SEQ ID NO: 761055 - DNA, 20 bp, mouse
gcgcgtgcgcagtggccccg

SEQ ID NO: 761056 - DNA, 20 bp, mouse
gaaaaggctcacacagactg

SEQ ID NO: 761057 - DNA, 20 bp, mouse
gagaacgtgacgaaaggggc

SEQ ID NO: 761058 - DNA, 20 bp, mouse
ggctgcggcccccaagggga

SEQ ID NO: 761059 - DNA, 20 bp, mouse
gtctgtgtgagccttttgac

SEQ ID NO: 761060 - DNA, 20 bp, mouse
gacgccagaacgtgacgaaa

SEQ ID NO: 761061 - DNA, 20 bp, mouse
ggaaaggcactgaccccttg

SEQ ID NO: 761062 - DNA, 20 bp, mouse
gggcgttagagccagtcaaa

SEQ ID NO: 761063 - DNA, 20 bp, mouse
ggggtcatccactgggacgt

SEQ ID NO: 761064 - DNA, 20 bp, mouse
gacagactggggccgcctct

SEQ ID NO: 761065 - DNA, 20 bp, mouse
gggactcatacaaactagga

SEQ ID NO: 761066 - DNA, 20 bp, mouse
gtatagggaggcaggtctga

SEQ ID NO: 761067 - DNA, 20 bp, mouse
gggaggcaggtctgaaggtc

SEQ ID NO: 761068 - DNA, 20 bp, mouse
ggggccagctatagggaggc

SEQ ID NO: 761069 - DNA, 20 bp, mouse
gaggtgcccggacaggaccg

SEQ ID NO: 761070 - DNA, 20 bp, mouse
gagtgcctgtcccaggaatg

SEQ ID NO: 761071 - DNA, 20 bp, mouse
gcccggacaggaccgtggat

SEQ ID NO: 761072 - DNA, 20 bp, mouse
ggctcctagggaggtgtgtc

SEQ ID NO: 761073 - DNA, 20 bp, mouse
gaggaatggggccagctata

SEQ ID NO: 761074 - DNA, 20 bp, mouse
gtagcctggaaaagcctccc

SEQ ID NO: 761075 - DNA, 20 bp, mouse
gaggtcaggaatgtttccca

SEQ ID NO: 761076 - DNA, 20 bp, mouse
gggtggcacccacacagcga

SEQ ID NO: 761077 - DNA, 20 bp, mouse
gctgtgtgggtgccaccctg

SEQ ID NO: 761078 - DNA, 20 bp, mouse
gtgccaccctgaggcaggta

SEQ ID NO: 761079 - DNA, 20 bp, mouse
gataggatctgcctactaat

SEQ ID NO: 761080 - DNA, 20 bp, mouse
gctaatggggttgtggagtg

SEQ ID NO: 761081 - DNA, 20 bp, mouse
ggctgtgcaattggagagat

SEQ ID NO: 761082 - DNA, 20 bp, mouse
ggggaaggcaggggataact

SEQ ID NO: 761083 - DNA, 20 bp, mouse
ggcacagagagaagagtgat

SEQ ID NO: 761084 - DNA, 20 bp, mouse
gcggccaagggtggttattc

SEQ ID NO: 761085 - DNA, 20 bp, mouse
gagctgagggagtggagctt

SEQ ID NO: 761086 - DNA, 20 bp, mouse
gtccacagaccaatcgttaa

SEQ ID NO: 761087 - DNA, 20 bp, mouse
gtctccacgcccttaacgat

SEQ ID NO: 761088 - DNA, 20 bp, mouse
gcagtctaattgtcgaacaa

SEQ ID NO: 761089 - DNA, 20 bp, mouse
ggagcagaaggaatgcgctg

SEQ ID NO: 761090 - DNA, 20 bp, mouse
gtcgacaattagactgtcta

SEQ ID NO: 761091 - DNA, 20 bp, mouse
ggcccttaacgattggtctg

SEQ ID NO: 761092 - DNA, 20 bp, mouse
gaaaggttccgaggctcaga

SEQ ID NO: 761093 - DNA, 20 bp, mouse
gaggactgagagcagcgtct

SEQ ID NO: 761094 - DNA, 20 bp, mouse
gcgggcactgcgcggtgaag

SEQ ID NO: 761095 - DNA, 20 bp, mouse
gcgagaagggcaattgttca

SEQ ID NO: 761096 - DNA, 20 bp, mouse
gcaggctggggagtgggatc

SEQ ID NO: 761097 - DNA, 20 bp, mouse
ggcgtccgctcagaccgaac

SEQ ID NO: 761098 - DNA, 20 bp, mouse
gtaaactgagagctatgaag

SEQ ID NO: 761099 - DNA, 20 bp, mouse
ggagacattctctgtctatt

SEQ ID NO: 761100 - DNA, 20 bp, mouse
ggtgggatcaggctcccagc

SEQ ID NO: 761101 - DNA, 20 bp, mouse
gtgcagagctggggtcttct

SEQ ID NO: 761102 - DNA, 20 bp, mouse
gtatgtacaatgggtatctg

SEQ ID NO: 761103 - DNA, 20 bp, mouse
gtgagagctatgaaggggac

SEQ ID NO: 761104 - DNA, 20 bp, mouse
gtgtgcctgttcggtctgag

SEQ ID NO: 761105 - DNA, 20 bp, mouse
gtcttgtggtcctagacttt

SEQ ID NO: 761106 - DNA, 20 bp, mouse
gtcgccgcggccgtccccgc

SEQ ID NO: 761107 - DNA, 20 bp, mouse
gcggctgctcggaggctcgt

SEQ ID NO: 761108 - DNA, 20 bp, mouse
gggcgctgcaagctcacccg

SEQ ID NO: 761109 - DNA, 20 bp, mouse
gcgcccgctctgccagatgt

SEQ ID NO: 761110 - DNA, 20 bp, mouse
gctagcgtcgccaggactcc

SEQ ID NO: 761111 - DNA, 20 bp, mouse
gacggccgcggcgacgtgcg

SEQ ID NO: 761112 - DNA, 20 bp, mouse
gtgctcggaggctcgtcggc

SEQ ID NO: 761113 - DNA, 20 bp, mouse
ggcgccccgagacccacatc

SEQ ID NO: 761114 - DNA, 20 bp, mouse
gcccgcgggccatagagtcg

SEQ ID NO: 761115 - DNA, 20 bp, mouse
gagtcctggcgacgctaggg

SEQ ID NO: 761116 - DNA, 20 bp, mouse
gggtgcgcgcgggaacgacg

SEQ ID NO: 761117 - DNA, 20 bp, mouse
gcgggaacgacgagggcagg

SEQ ID NO: 761118 - DNA, 20 bp, mouse
ggctccatgacagtccatcc

SEQ ID NO: 761119 - DNA, 20 bp, mouse
gcccggcgacccatcccgat

SEQ ID NO: 761120 - DNA, 20 bp, mouse
gcccgccaccaaccgtgctt

SEQ ID NO: 761121 - DNA, 20 bp, mouse
gtcacgccagacagtgtcaa

SEQ ID NO: 761122 - DNA, 20 bp, mouse
gtgggtggtgcctcgactca

SEQ ID NO: 761123 - DNA, 20 bp, mouse
gggacgacgcgcacacatgc

SEQ ID NO: 761124 - DNA, 20 bp, mouse
gcccgcccaagcacggttgg

SEQ ID NO: 761125 - DNA, 20 bp, mouse
ggcgcgggaacgacgagggc

SEQ ID NO: 761126 - DNA, 20 bp, mouse
gccgaagcgcaagggatctg

SEQ ID NO: 761127 - DNA, 20 bp, mouse
gaaggggtccccaggagcct

SEQ ID NO: 761128 - DNA, 20 bp, mouse
ggctcctggggaccccttac

SEQ ID NO: 761129 - DNA, 20 bp, mouse
ggccctgaaggttattagtc

SEQ ID NO: 761130 - DNA, 20 bp, mouse
gtggctctgtggcccggagt

SEQ ID NO: 761131 - DNA, 20 bp, mouse
gcggagatgcccaaactggt

SEQ ID NO: 761132 - DNA, 20 bp, mouse
gaccaagatcacctgatctc

SEQ ID NO: 761133 - DNA, 20 bp, mouse
gcgggagtggtcaaagtgcg

SEQ ID NO: 761134 - DNA, 20 bp, mouse
gagtcagggtgccagagatc

SEQ ID NO: 761135 - DNA, 20 bp, mouse
gctgcaggaggaagcatcgg

SEQ ID NO: 761136 - DNA, 20 bp, mouse
gggctggtctgagataagaa

SEQ ID NO: 761137 - DNA, 20 bp, mouse
ggtgagccacgagaggtcat

SEQ ID NO: 761138 - DNA, 20 bp, mouse
ggacctctcgtggctcacag

SEQ ID NO: 761139 - DNA, 20 bp, mouse
ggaccaccaaagtctttgtt

SEQ ID NO: 761140 - DNA, 20 bp, mouse
gagtggactgctgctgcagc

SEQ ID NO: 761141 - DNA, 20 bp, mouse
gtgagctccagcctataaaa

SEQ ID NO: 761142 - DNA, 20 bp, mouse
gactttggtggtcctggtct

SEQ ID NO: 761143 - DNA, 20 bp, mouse
gtgaaggtgaggccgcccag

SEQ ID NO: 761144 - DNA, 20 bp, mouse
ggtggggttggacaccatgc

SEQ ID NO: 761145 - DNA, 20 bp, mouse
ggtccactgtgagccacgag

SEQ ID NO: 761146 - DNA, 20 bp, mouse
gcggcccagcgggacgacag

SEQ ID NO: 761147 - DNA, 20 bp, mouse
gaacggaaggacgacggggt

SEQ ID NO: 761148 - DNA, 20 bp, mouse
gggaaggacgacggggtcgg

SEQ ID NO: 761149 - DNA, 20 bp, mouse
gaaccgaggtctctcacgag

SEQ ID NO: 761150 - DNA, 20 bp, mouse
ggaggggaacggaaggacga

SEQ ID NO: 761151 - DNA, 20 bp, mouse
gctctcacgaggggaacgga

SEQ ID NO: 761152 - DNA, 20 bp, mouse
gccggcctcggcactgtgaa

SEQ ID NO: 761153 - DNA, 20 bp, mouse
gacgagagccgggaagattt

SEQ ID NO: 761154 - DNA, 20 bp, mouse
gttaaagcgtgcggtgttag

SEQ ID NO: 761155 - DNA, 20 bp, mouse
ggtagcctctgtcgtcccgc

SEQ ID NO: 761156 - DNA, 20 bp, mouse
ggggcgggaggaaagttctg

SEQ ID NO: 761157 - DNA, 20 bp, mouse
gcaggggcggaggtactgtg

SEQ ID NO: 761158 - DNA, 20 bp, mouse
gtggcgcatgccggggagga

SEQ ID NO: 761159 - DNA, 20 bp, mouse
ggggcgggagtcgttcagtc

SEQ ID NO: 761160 - DNA, 20 bp, mouse
gggtccgcggagtctctaac

SEQ ID NO: 761161 - DNA, 20 bp, mouse
gtgcgggaggcgagctggaa

SEQ ID NO: 761162 - DNA, 20 bp, mouse
gctggaccgggaagaccata

SEQ ID NO: 761163 - DNA, 20 bp, mouse
gcatatggcgcatgccgggg

SEQ ID NO: 761164 - DNA, 20 bp, mouse
gcgctccgcggcatacaaat

SEQ ID NO: 761165 - DNA, 20 bp, mouse
gccgcggcatacaaataggc

SEQ ID NO: 761166 - DNA, 20 bp, mouse
ggggtcaggaccagaccctg

SEQ ID NO: 761167 - DNA, 20 bp, mouse
gagatggcggcgggtcccgg

SEQ ID NO: 761168 - DNA, 20 bp, mouse
gtggggggttctatatctga

SEQ ID NO: 761169 - DNA, 20 bp, mouse
gagagagtgacagatggcgg

SEQ ID NO: 761170 - DNA, 20 bp, mouse
ggattggcatgcgtctgcat

SEQ ID NO: 761171 - DNA, 20 bp, mouse
gtggttgccaggccaattca

SEQ ID NO: 761172 - DNA, 20 bp, mouse
gtggcatgcgtctgcattgg

SEQ ID NO: 761173 - DNA, 20 bp, mouse
gagaccctggggtgtggaga

SEQ ID NO: 761174 - DNA, 20 bp, mouse
ggtgccaagcccatatggcc

SEQ ID NO: 761175 - DNA, 20 bp, mouse
gcccccacatgggaacaatg

SEQ ID NO: 761176 - DNA, 20 bp, mouse
gaaggggaggggctaccctg

SEQ ID NO: 761177 - DNA, 20 bp, mouse
gtagagcaggcaaaacagga

SEQ ID NO: 761178 - DNA, 20 bp, mouse
gggtcagagaagccttgtga

SEQ ID NO: 761179 - DNA, 20 bp, mouse
gtgtgggctgctgaagttga

SEQ ID NO: 761180 - DNA, 20 bp, mouse
gggaaggaactagagggtgt

SEQ ID NO: 761181 - DNA, 20 bp, mouse
ggcgggagatgttgcccaca

SEQ ID NO: 761182 - DNA, 20 bp, mouse
gcagagaagccttgtgaagg

SEQ ID NO: 761183 - DNA, 20 bp, mouse
gaaacacgcagtggcaaagc

SEQ ID NO: 761184 - DNA, 20 bp, mouse
ggtgtctttaggctaggaag

SEQ ID NO: 761185 - DNA, 20 bp, mouse
ggttgatgggtgaaaactaa

SEQ ID NO: 761186 - DNA, 20 bp, mouse
gctagctgctcgggtctcac

SEQ ID NO: 761187 - DNA, 20 bp, mouse
gatctggcatccctgtaagt

SEQ ID NO: 761188 - DNA, 20 bp, mouse
gaatgctggtacccacttac

SEQ ID NO: 761189 - DNA, 20 bp, mouse
gcacaggaggttagactgat

SEQ ID NO: 761190 - DNA, 20 bp, mouse
gcgacaaaggggtcagcaaa

SEQ ID NO: 761191 - DNA, 20 bp, mouse
gtaacagttgcaccattggc

SEQ ID NO: 761192 - DNA, 20 bp, mouse
gctgaaggaaaccaagatta

SEQ ID NO: 761193 - DNA, 20 bp, mouse
gagccatgtgatcctctctt

SEQ ID NO: 761194 - DNA, 20 bp, mouse
gagctggggttggatactga

SEQ ID NO: 761195 - DNA, 20 bp, mouse
gtgtgtgggaactagaagct

SEQ ID NO: 761196 - DNA, 20 bp, mouse
gagggaggccggggcgtctc

SEQ ID NO: 761197 - DNA, 20 bp, mouse
gcgggcacgctccaggaggg

SEQ ID NO: 761198 - DNA, 20 bp, mouse
gcgggagccggatcaagcga

SEQ ID NO: 761199 - DNA, 20 bp, mouse
gcggtggcccggcctgctcc

SEQ ID NO: 761200 - DNA, 20 bp, mouse
ggattggccggcggtaatta

SEQ ID NO: 761201 - DNA, 20 bp, mouse
ggagccggatcaagcgaggg

SEQ ID NO: 761202 - DNA, 20 bp, mouse
gcgggtgtccctcgctgggg

SEQ ID NO: 761203 - DNA, 20 bp, mouse
gacacccgcgcgcccctggg

SEQ ID NO: 761204 - DNA, 20 bp, mouse
gtgtccctcgctggggtgga

SEQ ID NO: 761205 - DNA, 20 bp, mouse
gccgaggcacactcctccca

SEQ ID NO: 761206 - DNA, 20 bp, mouse
ggaaaagaataagctgggga

SEQ ID NO: 761207 - DNA, 20 bp, mouse
gggaccaggacaggcggagg

SEQ ID NO: 761208 - DNA, 20 bp, mouse
gcgatgaaaagaataagctg

SEQ ID NO: 761209 - DNA, 20 bp, mouse
ggccgcggcttcggtagctt

SEQ ID NO: 761210 - DNA, 20 bp, mouse
ggcggcagtggctcaagctg

SEQ ID NO: 761211 - DNA, 20 bp, mouse
gagataaaggggggacggag

SEQ ID NO: 761212 - DNA, 20 bp, mouse
gaaaacaatcagatctgccc

SEQ ID NO: 761213 - DNA, 20 bp, mouse
gaggtgaggagggggccccg

SEQ ID NO: 761214 - DNA, 20 bp, mouse
gctggccaatcagtgttccc

SEQ ID NO: 761215 - DNA, 20 bp, mouse
ggcaggcctcccggagtccc

SEQ ID NO: 761216 - DNA, 20 bp, mouse
ggacaaagggcaggggtcgg

SEQ ID NO: 761217 - DNA, 20 bp, mouse
ggggactgagcccgcgacgg

SEQ ID NO: 761218 - DNA, 20 bp, mouse
gacgggggaggcgtggagtg

SEQ ID NO: 761219 - DNA, 20 bp, mouse
gactgagcccgcgacggggg

SEQ ID NO: 761220 - DNA, 20 bp, mouse
gcggccggacgggactcttc

SEQ ID NO: 761221 - DNA, 20 bp, mouse
gtccacgcctcccccgtcgc

SEQ ID NO: 761222 - DNA, 20 bp, mouse
ggggctgctgcctgcaccac

SEQ ID NO: 761223 - DNA, 20 bp, mouse
ggcagagcacagctggattc

SEQ ID NO: 761224 - DNA, 20 bp, mouse
gaatcagcggagggggccca

SEQ ID NO: 761225 - DNA, 20 bp, mouse
gctcgcgtggcgcagcccct

SEQ ID NO: 761226 - DNA, 20 bp, mouse
gggtacttcacctccataag

SEQ ID NO: 761227 - DNA, 20 bp, mouse
gtccttgaaactgccatcag

SEQ ID NO: 761228 - DNA, 20 bp, mouse
gtccactgatggcagtttca

SEQ ID NO: 761229 - DNA, 20 bp, mouse
gcacttgggtgaatattcaa

SEQ ID NO: 761230 - DNA, 20 bp, mouse
ggtgaattacattgctgtca

SEQ ID NO: 761231 - DNA, 20 bp, mouse
gattgctgtcaaggctataa

SEQ ID NO: 761232 - DNA, 20 bp, mouse
gagtaacgagtttaagaata

SEQ ID NO: 761233 - DNA, 20 bp, mouse
gtgtaattcaccacttatgg

SEQ ID NO: 761234 - DNA, 20 bp, mouse
gaaactatccaccatcaaat

SEQ ID NO: 761235 - DNA, 20 bp, mouse
gaagtactgaaaagcttgga

SEQ ID NO: 761236 - DNA, 20 bp, mouse
ggctgtgatgatccaaataa

SEQ ID NO: 761237 - DNA, 20 bp, mouse
gctttggcacataggactta

SEQ ID NO: 761238 - DNA, 20 bp, mouse
gttagggacaggtttacatg

SEQ ID NO: 761239 - DNA, 20 bp, mouse
gtatgtgccaaagcttggca

SEQ ID NO: 761240 - DNA, 20 bp, mouse
gttttagagaatatctaatc

SEQ ID NO: 761241 - DNA, 20 bp, mouse
gactgtcgttgtcatagcat

SEQ ID NO: 761242 - DNA, 20 bp, mouse
gatctcttgtggggttgaac

SEQ ID NO: 761243 - DNA, 20 bp, mouse
gagacacgacttatctcttg

SEQ ID NO: 761244 - DNA, 20 bp, mouse
gttaatctttaataatagga

SEQ ID NO: 761245 - DNA, 20 bp, mouse
gaattttgattgggtttttg

SEQ ID NO: 761246 - DNA, 20 bp, mouse
gacagcctacgcaccggagt

SEQ ID NO: 761247 - DNA, 20 bp, mouse
ggccccgcgccagtttaggt

SEQ ID NO: 761248 - DNA, 20 bp, mouse
gaaaaagcgagtcctcctgg

SEQ ID NO: 761249 - DNA, 20 bp, mouse
gtgagccgactccggtgcgt

SEQ ID NO: 761250 - DNA, 20 bp, mouse
ggggagacccgcggcagcga

SEQ ID NO: 761251 - DNA, 20 bp, mouse
ggctcccggggttagaagtt

SEQ ID NO: 761252 - DNA, 20 bp, mouse
gcaagcccggaggccagcgg

SEQ ID NO: 761253 - DNA, 20 bp, mouse
gtgagagcgcggctgggaaa

SEQ ID NO: 761254 - DNA, 20 bp, mouse
gctccgggcccggaggagtt

SEQ ID NO: 761255 - DNA, 20 bp, mouse
gtgacgtcacctaactcctc

SEQ ID NO: 761256 - DNA, 20 bp, mouse
gtccaggaggcgggacgaag

SEQ ID NO: 761257 - DNA, 20 bp, mouse
gagcgtagtgggagtccgga

SEQ ID NO: 761258 - DNA, 20 bp, mouse
gagtcgctgagtagcgtagt

SEQ ID NO: 761259 - DNA, 20 bp, mouse
gagggccgccggtctgttct

SEQ ID NO: 761260 - DNA, 20 bp, mouse
gcggcaggtcgctgaggtgg

SEQ ID NO: 761261 - DNA, 20 bp, mouse
gtgaaagttgcactgaacga

SEQ ID NO: 761262 - DNA, 20 bp, mouse
gaacgccgagaacagaccgg

SEQ ID NO: 761263 - DNA, 20 bp, mouse
gggtggagtaggcctccagg

SEQ ID NO: 761264 - DNA, 20 bp, mouse
ggtagtgggagtccggaggg

SEQ ID NO: 761265 - DNA, 20 bp, mouse
ggagtagcgtagtgggagtc

SEQ ID NO: 761266 - DNA, 20 bp, mouse
gcggaagcaaccttggtgag

SEQ ID NO: 761267 - DNA, 20 bp, mouse
gtgggaaaagagcatgcggt

SEQ ID NO: 761268 - DNA, 20 bp, mouse
gctgctgcgagggactaagg

SEQ ID NO: 761269 - DNA, 20 bp, mouse
ggaagcagaagggtgtccag

SEQ ID NO: 761270 - DNA, 20 bp, mouse
ggcagcagaggaccctgtcc

SEQ ID NO: 761271 - DNA, 20 bp, mouse
gacagggtcctctgctgcga

SEQ ID NO: 761272 - DNA, 20 bp, mouse
gcttcaggacaccttctcaa

SEQ ID NO: 761273 - DNA, 20 bp, mouse
gagaaggtgtcctgaagggg

SEQ ID NO: 761274 - DNA, 20 bp, mouse
ggtccagaggaggaacttat

SEQ ID NO: 761275 - DNA, 20 bp, mouse
gtaaggaggccccagaagcc

SEQ ID NO: 761276 - DNA, 20 bp, mouse
gtacgcagggaggggttcgg

SEQ ID NO: 761277 - DNA, 20 bp, mouse
gcaggacccagcagctccga

SEQ ID NO: 761278 - DNA, 20 bp, mouse
gtggcactccgtgttgtcgt

SEQ ID NO: 761279 - DNA, 20 bp, mouse
gcgggcggccagcgcgtccc

SEQ ID NO: 761280 - DNA, 20 bp, mouse
gcctggagccagaactgttg

SEQ ID NO: 761281 - DNA, 20 bp, mouse
gtgatccttagcgcgtgggg

SEQ ID NO: 761282 - DNA, 20 bp, mouse
gtagcgcgtggggcggactg

SEQ ID NO: 761283 - DNA, 20 bp, mouse
gcaagatcaagggagaaaac

SEQ ID NO: 761284 - DNA, 20 bp, mouse
ggtggcacctgagcatccgt

SEQ ID NO: 761285 - DNA, 20 bp, mouse
gcaggccgccggggacgcgc

SEQ ID NO: 761286 - DNA, 20 bp, mouse
gactagacgtgttttcacct

SEQ ID NO: 761287 - DNA, 20 bp, mouse
gtcaacagaacgttcagctg

SEQ ID NO: 761288 - DNA, 20 bp, mouse
ggacgtgttttcacctaggc

SEQ ID NO: 761289 - DNA, 20 bp, mouse
gtcacaaatcacattttcat

SEQ ID NO: 761290 - DNA, 20 bp, mouse
gcgtctagtgtacttactct

SEQ ID NO: 761291 - DNA, 20 bp, mouse
gtgggactgctagccagcct

SEQ ID NO: 761292 - DNA, 20 bp, mouse
gctatgaagcagagaactac

SEQ ID NO: 761293 - DNA, 20 bp, mouse
gaaagtaaaataacgctatt

SEQ ID NO: 761294 - DNA, 20 bp, mouse
gcaaattccaattattcttt

SEQ ID NO: 761295 - DNA, 20 bp, mouse
gagcatatatgtttcatatt

SEQ ID NO: 761296 - DNA, 20 bp, mouse
ggggcccgggggacaagtcg

SEQ ID NO: 761297 - DNA, 20 bp, mouse
ggggcgccctggtttggaca

SEQ ID NO: 761298 - DNA, 20 bp, mouse
gagccgctgcgcacagaggg

SEQ ID NO: 761299 - DNA, 20 bp, mouse
ggactggagggagctcccag

SEQ ID NO: 761300 - DNA, 20 bp, mouse
gcaagcggggcgccctggtt

SEQ ID NO: 761301 - DNA, 20 bp, mouse
gggtacccctgtccaaacca

SEQ ID NO: 761302 - DNA, 20 bp, mouse
gcgtccggctggtccacccc

SEQ ID NO: 761303 - DNA, 20 bp, mouse
gcgccgccctctgtgcgcag

SEQ ID NO: 761304 - DNA, 20 bp, mouse
gggcacctggaggtgggcaa

SEQ ID NO: 761305 - DNA, 20 bp, mouse
ggctccgcgacttgtccccc

SEQ ID NO: 761306 - DNA, 20 bp, mouse
gtaaacccggaaacacccgg

SEQ ID NO: 761307 - DNA, 20 bp, mouse
gggagcgggcatgcgacaga

SEQ ID NO: 761308 - DNA, 20 bp, mouse
gtggagcctgggctacgctt

SEQ ID NO: 761309 - DNA, 20 bp, mouse
gaggcccgagggagctgtgc

SEQ ID NO: 761310 - DNA, 20 bp, mouse
gggagctgtgcggggtcgtg

SEQ ID NO: 761311 - DNA, 20 bp, mouse
gcgggcctccgcctcctgtg

SEQ ID NO: 761312 - DNA, 20 bp, mouse
gagacccagggcacctcctt

SEQ ID NO: 761313 - DNA, 20 bp, mouse
gggagcggggggtatcctaa

SEQ ID NO: 761314 - DNA, 20 bp, mouse
ggcgagcccaagcgtagccc

SEQ ID NO: 761315 - DNA, 20 bp, mouse
gagcgaagccccacaggagg

SEQ ID NO: 761316 - DNA, 20 bp, mouse
gcgcccctctcctaggaatc

SEQ ID NO: 761317 - DNA, 20 bp, mouse
gggcgccgcccggacgggga

SEQ ID NO: 761318 - DNA, 20 bp, mouse
gggtgaagcagaagttgtct

SEQ ID NO: 761319 - DNA, 20 bp, mouse
ggcctgcgagctctacctta

SEQ ID NO: 761320 - DNA, 20 bp, mouse
gcctgctgctgtctgaccca

SEQ ID NO: 761321 - DNA, 20 bp, mouse
gtgtcccaaccggcccacag

SEQ ID NO: 761322 - DNA, 20 bp, mouse
gacagcttctgaccggaccc

SEQ ID NO: 761323 - DNA, 20 bp, mouse
gtcgctcaggccagaccggg

SEQ ID NO: 761324 - DNA, 20 bp, mouse
gctctcctaggaatcgggaa

SEQ ID NO: 761325 - DNA, 20 bp, mouse
gcctgtcgctcaggccagac

SEQ ID NO: 761326 - DNA, 20 bp, mouse
gcgcggaggaggcgacgtca

SEQ ID NO: 761327 - DNA, 20 bp, mouse
gagctggctggccgcggagg

SEQ ID NO: 761328 - DNA, 20 bp, mouse
gacaagtccctgattgttcg

SEQ ID NO: 761329 - DNA, 20 bp, mouse
gtctctgccccgaacaatca

SEQ ID NO: 761330 - DNA, 20 bp, mouse
ggccgaaggagccacggagc

SEQ ID NO: 761331 - DNA, 20 bp, mouse
gtcggggcagagaaaaagtc

SEQ ID NO: 761332 - DNA, 20 bp, mouse
gcccctgggcaagtgtccaa

SEQ ID NO: 761333 - DNA, 20 bp, mouse
gcgtccatctccaaaactaa

SEQ ID NO: 761334 - DNA, 20 bp, mouse
gaagcccttagttttggaga

SEQ ID NO: 761335 - DNA, 20 bp, mouse
gcgggatccaggggtttcca

SEQ ID NO: 761336 - DNA, 20 bp, mouse
gccctggggaaggctgggtc

SEQ ID NO: 761337 - DNA, 20 bp, mouse
gcgcctatccacgttctcat

SEQ ID NO: 761338 - DNA, 20 bp, mouse
ggaccaatgagaacgtggat

SEQ ID NO: 761339 - DNA, 20 bp, mouse
gggaagagatgatgaccggc

SEQ ID NO: 761340 - DNA, 20 bp, mouse
gtaggcggatccagagcgtg

SEQ ID NO: 761341 - DNA, 20 bp, mouse
ggggacagacgctaatacgg

SEQ ID NO: 761342 - DNA, 20 bp, mouse
gtgggccggtgactgtgtag

SEQ ID NO: 761343 - DNA, 20 bp, mouse
ggcgcctttgttttagtgga

SEQ ID NO: 761344 - DNA, 20 bp, mouse
gaggctgttcgtccaatgaa

SEQ ID NO: 761345 - DNA, 20 bp, mouse
gggatccagagcgtgtgggc

SEQ ID NO: 761346 - DNA, 20 bp, mouse
ggggcccgtggctgtcagcg

SEQ ID NO: 761347 - DNA, 20 bp, mouse
ggaggactcacgcgataggt

SEQ ID NO: 761348 - DNA, 20 bp, mouse
gtggccccgctgacagccac

SEQ ID NO: 761349 - DNA, 20 bp, mouse
ggcgtgagtcctctgcgagg

SEQ ID NO: 761350 - DNA, 20 bp, mouse
gctaaaccaagaccagggta

SEQ ID NO: 761351 - DNA, 20 bp, mouse
gagcggggccagcggcctat

SEQ ID NO: 761352 - DNA, 20 bp, mouse
gggaacccacgtaggccaat

SEQ ID NO: 761353 - DNA, 20 bp, mouse
gttaactacaacttccgaga

SEQ ID NO: 761354 - DNA, 20 bp, mouse
ggcccgacggggcagcccat

SEQ ID NO: 761355 - DNA, 20 bp, mouse
gcggcagtggcggcgactgt

SEQ ID NO: 761356 - DNA, 20 bp, mouse
gggaggggccggtgcatccc

SEQ ID NO: 761357 - DNA, 20 bp, mouse
ggggccgctttgaagaagtt

SEQ ID NO: 761358 - DNA, 20 bp, mouse
gggactggagagatgaccgg

SEQ ID NO: 761359 - DNA, 20 bp, mouse
gcgggtaaccaatcagagac

SEQ ID NO: 761360 - DNA, 20 bp, mouse
ggggccaataggtaccatta

SEQ ID NO: 761361 - DNA, 20 bp, mouse
gcctcctccatggatgagat

SEQ ID NO: 761362 - DNA, 20 bp, mouse
gagggggcgtctcagagaaa

SEQ ID NO: 761363 - DNA, 20 bp, mouse
ggtcccaccccctccaaaga

SEQ ID NO: 761364 - DNA, 20 bp, mouse
ggaggcggcagcgacagaag

SEQ ID NO: 761365 - DNA, 20 bp, mouse
gaccaatcagagacaggctg

SEQ ID NO: 761366 - DNA, 20 bp, mouse
gggtgcgcccgcttctaccg

SEQ ID NO: 761367 - DNA, 20 bp, mouse
gcactggtaactccgaccga

SEQ ID NO: 761368 - DNA, 20 bp, mouse
gtgcccccgctgccacagag

SEQ ID NO: 761369 - DNA, 20 bp, mouse
gcgctgccacagagaggcgg

SEQ ID NO: 761370 - DNA, 20 bp, mouse
gtctctccgaagccctcggt

SEQ ID NO: 761371 - DNA, 20 bp, mouse
gtgccccttctggccaagag

SEQ ID NO: 761372 - DNA, 20 bp, mouse
ggaagggttggaggaagcac

SEQ ID NO: 761373 - DNA, 20 bp, mouse
ggtagaagcgggcgcaccgg

SEQ ID NO: 761374 - DNA, 20 bp, mouse
ggcgcccagccatggcccgg

SEQ ID NO: 761375 - DNA, 20 bp, mouse
gggaggagaagagggccacg

SEQ ID NO: 761376 - DNA, 20 bp, mouse
ggccgagaggggtcttgatc

SEQ ID NO: 761377 - DNA, 20 bp, mouse
ggtggggcctggggaacgga

SEQ ID NO: 761378 - DNA, 20 bp, mouse
ggaccagaaagcgtgttcct

SEQ ID NO: 761379 - DNA, 20 bp, mouse
gaggggtcttgatcgggctc

SEQ ID NO: 761380 - DNA, 20 bp, mouse
gaggccgggacttgggctga

SEQ ID NO: 761381 - DNA, 20 bp, mouse
gacacggccggaaagaaacg

SEQ ID NO: 761382 - DNA, 20 bp, mouse
gcgagtgcagtggaaggagg

SEQ ID NO: 761383 - DNA, 20 bp, mouse
ggggcggcgagatgtggttg

SEQ ID NO: 761384 - DNA, 20 bp, mouse
gcggctatctcgttggggaa

SEQ ID NO: 761385 - DNA, 20 bp, mouse
gcgaaagcttgtgggataag

SEQ ID NO: 761386 - DNA, 20 bp, mouse
gggacgggacaagaacttag

SEQ ID NO: 761387 - DNA, 20 bp, mouse
gggggcggaacaaggaccta

SEQ ID NO: 761388 - DNA, 20 bp, mouse
gagaggcggagaaaaggcta

SEQ ID NO: 761389 - DNA, 20 bp, mouse
gaaggcctagggcggggcaa

SEQ ID NO: 761390 - DNA, 20 bp, mouse
gggaacaaggacctagggac

SEQ ID NO: 761391 - DNA, 20 bp, mouse
gggaacgcgggaactccggc

SEQ ID NO: 761392 - DNA, 20 bp, mouse
gggcatggaggcggggtaag

SEQ ID NO: 761393 - DNA, 20 bp, mouse
ggagaaaaggctagggcaag

SEQ ID NO: 761394 - DNA, 20 bp, mouse
gggaaggagcaagagcccga

SEQ ID NO: 761395 - DNA, 20 bp, mouse
gtggaatcgcgtacaggggc

SEQ ID NO: 761396 - DNA, 20 bp, mouse
ggcggggcgaagtttgaagg

SEQ ID NO: 761397 - DNA, 20 bp, mouse
ggccgcgccaggcactgtgt

SEQ ID NO: 761398 - DNA, 20 bp, mouse
ggggctccaggcctctttat

SEQ ID NO: 761399 - DNA, 20 bp, mouse
gtgtgcctgcggctcggggc

SEQ ID NO: 761400 - DNA, 20 bp, mouse
gggtccaggtcactaccaca

SEQ ID NO: 761401 - DNA, 20 bp, mouse
gtgaaactcctcctataaag

SEQ ID NO: 761402 - DNA, 20 bp, mouse
gcggggacccagagaggcgg

SEQ ID NO: 761403 - DNA, 20 bp, mouse
ggcactgtgtgggcagccga

SEQ ID NO: 761404 - DNA, 20 bp, mouse
gggccagcacggagggtaag

SEQ ID NO: 761405 - DNA, 20 bp, mouse
ggctgaaaaaacctatgggt

SEQ ID NO: 761406 - DNA, 20 bp, mouse
gccggcgcgggagcgggaaa

SEQ ID NO: 761407 - DNA, 20 bp, mouse
gcagctcgcgggcacccggc

SEQ ID NO: 761408 - DNA, 20 bp, mouse
gtaacgcgcgcccttctctg

SEQ ID NO: 761409 - DNA, 20 bp, mouse
gcgggcgcgcgggcagctcg

SEQ ID NO: 761410 - DNA, 20 bp, mouse
gctctcccgacgtccgcgga

SEQ ID NO: 761411 - DNA, 20 bp, mouse
gccgccgccgcgggggtgtg

SEQ ID NO: 761412 - DNA, 20 bp, mouse
ggcggctgcggcgctgacac

SEQ ID NO: 761413 - DNA, 20 bp, mouse
gcgggcagctcgcgggcacc

SEQ ID NO: 761414 - DNA, 20 bp, mouse
ggctccgcgccgcgttcccg

SEQ ID NO: 761415 - DNA, 20 bp, mouse
gcgtggagcggcaagagcgc

SEQ ID NO: 761416 - DNA, 20 bp, mouse
ggcggggcgcgcgcaggaga

SEQ ID NO: 761417 - DNA, 20 bp, mouse
gagctcgagcggggtccaga

SEQ ID NO: 761418 - DNA, 20 bp, mouse
gcggggcaggagcgcagcaa

SEQ ID NO: 761419 - DNA, 20 bp, mouse
gcgcaggagagggccgggtg

SEQ ID NO: 761420 - DNA, 20 bp, mouse
gtggccagcggcaccggcag

SEQ ID NO: 761421 - DNA, 20 bp, mouse
ggcgcaggcgcggagctccc

SEQ ID NO: 761422 - DNA, 20 bp, mouse
gctggccacagcccacggaa

SEQ ID NO: 761423 - DNA, 20 bp, mouse
gcagcggagtccacgcgcgg

SEQ ID NO: 761424 - DNA, 20 bp, mouse
gcgagtgcgcgcgggtggcg

SEQ ID NO: 761425 - DNA, 20 bp, mouse
gccctagccccggctcgggg

SEQ ID NO: 761426 - DNA, 20 bp, mouse
gctagagggaggggactagg

SEQ ID NO: 761427 - DNA, 20 bp, mouse
gcgatcaggtccacgagatg

SEQ ID NO: 761428 - DNA, 20 bp, mouse
gacaaatggatagctctaga

SEQ ID NO: 761429 - DNA, 20 bp, mouse
ggactcaggtgggatgtggg

SEQ ID NO: 761430 - DNA, 20 bp, mouse
gtagagctatccatttgtag

SEQ ID NO: 761431 - DNA, 20 bp, mouse
ggggatgtggggggcagcta

SEQ ID NO: 761432 - DNA, 20 bp, mouse
gactgccagtagggtagagg

SEQ ID NO: 761433 - DNA, 20 bp, mouse
ggtgtgataaagagcagagt

SEQ ID NO: 761434 - DNA, 20 bp, mouse
ggagtttggggtacagttgg

SEQ ID NO: 761435 - DNA, 20 bp, mouse
gctaaacttggggacctggt

SEQ ID NO: 761436 - DNA, 20 bp, mouse
ggggatgcaagcgcggacac

SEQ ID NO: 761437 - DNA, 20 bp, mouse
gcgcgcgcgcccgcagacgg

SEQ ID NO: 761438 - DNA, 20 bp, mouse
gtccgcgcttgcatccccag

SEQ ID NO: 761439 - DNA, 20 bp, mouse
gggtcctcggctgcagaccg

SEQ ID NO: 761440 - DNA, 20 bp, mouse
gccgcgctccggccggtcct

SEQ ID NO: 761441 - DNA, 20 bp, mouse
ggacggcggactcgccgctg

SEQ ID NO: 761442 - DNA, 20 bp, mouse
gcggcctagaggctcttgtc

SEQ ID NO: 761443 - DNA, 20 bp, mouse
ggccgctggggatgcaagcg

SEQ ID NO: 761444 - DNA, 20 bp, mouse
gaccggagcagcggcagcct

SEQ ID NO: 761445 - DNA, 20 bp, mouse
ggacgcccggggaggtgcgg

SEQ ID NO: 761446 - DNA, 20 bp, mouse
gactgccagtggcgccgcgg

SEQ ID NO: 761447 - DNA, 20 bp, mouse
ggcgccgcggcggagaggac

SEQ ID NO: 761448 - DNA, 20 bp, mouse
gcggactgccagtggcgccg

SEQ ID NO: 761449 - DNA, 20 bp, mouse
ggctgctacccgctgtccgt

SEQ ID NO: 761450 - DNA, 20 bp, mouse
ggccactggccgcgccgaca

SEQ ID NO: 761451 - DNA, 20 bp, mouse
ggaaggacgcggactgccag

SEQ ID NO: 761452 - DNA, 20 bp, mouse
gagcgagcgcagcgacccgg

SEQ ID NO: 761453 - DNA, 20 bp, mouse
gaacccgaggcacgcctaag

SEQ ID NO: 761454 - DNA, 20 bp, mouse
ggtggggagcccgcccctgt

SEQ ID NO: 761455 - DNA, 20 bp, mouse
gccgctgtccgtggggaccc

SEQ ID NO: 761456 - DNA, 20 bp, mouse
gtgtgtcggcgcccgaacgc

SEQ ID NO: 761457 - DNA, 20 bp, mouse
gcggccagcacgtgtcgggg

SEQ ID NO: 761458 - DNA, 20 bp, mouse
gcggccgccccgacacgtgc

SEQ ID NO: 761459 - DNA, 20 bp, mouse
gcgtgtcggggcggccgcgt

SEQ ID NO: 761460 - DNA, 20 bp, mouse
gcacacgctgacacgcagca

SEQ ID NO: 761461 - DNA, 20 bp, mouse
gacgccggccagcacgtgtc

SEQ ID NO: 761462 - DNA, 20 bp, mouse
ggcggggacgcacaccgacg

SEQ ID NO: 761463 - DNA, 20 bp, mouse
gtgggacgacatgtgacagt

SEQ ID NO: 761464 - DNA, 20 bp, mouse
gcacgtgctggccggcgttc

SEQ ID NO: 761465 - DNA, 20 bp, mouse
gacgggcacaaatgtcacga

SEQ ID NO: 761466 - DNA, 20 bp, mouse
ggggaataggggccgggctt

SEQ ID NO: 761467 - DNA, 20 bp, mouse
gctgtgcaatggagcgtggg

SEQ ID NO: 761468 - DNA, 20 bp, mouse
gaataggggccgggcttggg

SEQ ID NO: 761469 - DNA, 20 bp, mouse
gtgcgtggggcggtggtagg

SEQ ID NO: 761470 - DNA, 20 bp, mouse
gcctctgtgcaatggagcgt

SEQ ID NO: 761471 - DNA, 20 bp, mouse
ggttctggggaataggggcc

SEQ ID NO: 761472 - DNA, 20 bp, mouse
ggggtagggtacgctgttgt

SEQ ID NO: 761473 - DNA, 20 bp, mouse
gagttagggcggtgggactt

SEQ ID NO: 761474 - DNA, 20 bp, mouse
gggggaaattaattttttta

SEQ ID NO: 761475 - DNA, 20 bp, mouse
gggcgagcagagagagcgcg

SEQ ID NO: 761476 - DNA, 20 bp, mouse
gaagcccgcgcgccccgacc

SEQ ID NO: 761477 - DNA, 20 bp, mouse
ggggcttcccccacccccgg

SEQ ID NO: 761478 - DNA, 20 bp, mouse
gggaggtggggtcgcctccg

SEQ ID NO: 761479 - DNA, 20 bp, mouse
gcgcgggcttcccccacccc

SEQ ID NO: 761480 - DNA, 20 bp, mouse
gggctgcgggcgcctcccgg

SEQ ID NO: 761481 - DNA, 20 bp, mouse
gggcaggcccggacagctgg

SEQ ID NO: 761482 - DNA, 20 bp, mouse
ggggtcgcctccgggggtgg

SEQ ID NO: 761483 - DNA, 20 bp, mouse
gccgcggggcttggggttcg

SEQ ID NO: 761484 - DNA, 20 bp, mouse
gcacgcgcgcgcgcacagcg

SEQ ID NO: 761485 - DNA, 20 bp, mouse
gggaggcgcccgcagcccaa

SEQ ID NO: 761486 - DNA, 20 bp, mouse
gacaccccgcggccagtcct

SEQ ID NO: 761487 - DNA, 20 bp, mouse
gcgcctgcgttgctccgggt

SEQ ID NO: 761488 - DNA, 20 bp, mouse
ggaagggctcggaaagaagt

SEQ ID NO: 761489 - DNA, 20 bp, mouse
gcaacgaccggtccggggaa

SEQ ID NO: 761490 - DNA, 20 bp, mouse
gggcgcgcctgcgttgctcc

SEQ ID NO: 761491 - DNA, 20 bp, mouse
gggacctcctagctgggaag

SEQ ID NO: 761492 - DNA, 20 bp, mouse
gtcttccagtggggcctccg

SEQ ID NO: 761493 - DNA, 20 bp, mouse
gtcagatccctgagtgtcta

SEQ ID NO: 761494 - DNA, 20 bp, mouse
gtcagccagcgtggaggaca

SEQ ID NO: 761495 - DNA, 20 bp, mouse
gggcccactggactccgtaa

SEQ ID NO: 761496 - DNA, 20 bp, mouse
gtccctgtgcatgaccccag

SEQ ID NO: 761497 - DNA, 20 bp, mouse
gaagcctaaacccagggccg

SEQ ID NO: 761498 - DNA, 20 bp, mouse
gagccactggggtcatgcac

SEQ ID NO: 761499 - DNA, 20 bp, mouse
gctgcagggaagtacctaga

SEQ ID NO: 761500 - DNA, 20 bp, mouse
gacccagggccggggttcat

SEQ ID NO: 761501 - DNA, 20 bp, mouse
ggaccccagtggctcatcgc

SEQ ID NO: 761502 - DNA, 20 bp, mouse
ggaaccccggccctgggttt

SEQ ID NO: 761503 - DNA, 20 bp, mouse
gaggactttccagccactca

SEQ ID NO: 761504 - DNA, 20 bp, mouse
gactgagaagcctaaaccca

SEQ ID NO: 761505 - DNA, 20 bp, mouse
ggaaagaagggttcttgcag

SEQ ID NO: 761506 - DNA, 20 bp, mouse
gtggctgtggtgcagtacag

SEQ ID NO: 761507 - DNA, 20 bp, mouse
gtcggccatgggaacggggt

SEQ ID NO: 761508 - DNA, 20 bp, mouse
gcggcggccatattgataaa

SEQ ID NO: 761509 - DNA, 20 bp, mouse
gacagccaatcagaaaaatg

SEQ ID NO: 761510 - DNA, 20 bp, mouse
gcagtcggtgacagtcccga

SEQ ID NO: 761511 - DNA, 20 bp, mouse
gctgtggtgcagtacagggg

SEQ ID NO: 761512 - DNA, 20 bp, mouse
gtgttggggaattcccgata

SEQ ID NO: 761513 - DNA, 20 bp, mouse
gaaagggcgtctggaaaatg

SEQ ID NO: 761514 - DNA, 20 bp, mouse
ggagccggaccgtgagttag

SEQ ID NO: 761515 - DNA, 20 bp, mouse
gccaaaaagcctggcgccgg

SEQ ID NO: 761516 - DNA, 20 bp, mouse
gtgcccctctaggaaaaagc

SEQ ID NO: 761517 - DNA, 20 bp, mouse
gcctggaagtaggtgcttaa

SEQ ID NO: 761518 - DNA, 20 bp, mouse
gactccggggactgtgggcg

SEQ ID NO: 761519 - DNA, 20 bp, mouse
gacttggtcttcctggaagt

SEQ ID NO: 761520 - DNA, 20 bp, mouse
gcggggctccgccttgaacc

SEQ ID NO: 761521 - DNA, 20 bp, mouse
gtagctctgcggcttcaccc

SEQ ID NO: 761522 - DNA, 20 bp, mouse
gtggagaagtctctaggcaa

SEQ ID NO: 761523 - DNA, 20 bp, mouse
ggcctcttggagaagtctct

SEQ ID NO: 761524 - DNA, 20 bp, mouse
ggctaacttagactctgaat

SEQ ID NO: 761525 - DNA, 20 bp, mouse
gggccacgcccggttcaagg

SEQ ID NO: 761526 - DNA, 20 bp, mouse
gaaaaggaaggaaatggcgg

SEQ ID NO: 761527 - DNA, 20 bp, mouse
gaagacagaaggaagtcatc

SEQ ID NO: 761528 - DNA, 20 bp, mouse
gggtggctgggagtgcatgt

SEQ ID NO: 761529 - DNA, 20 bp, mouse
gcacccgaatgcagcctcgg

SEQ ID NO: 761530 - DNA, 20 bp, mouse
ggctcgctcgaaggaaagga

SEQ ID NO: 761531 - DNA, 20 bp, mouse
gaggaaaagcgtggaggaaa

SEQ ID NO: 761532 - DNA, 20 bp, mouse
gccgaggagcccggtgtctc

SEQ ID NO: 761533 - DNA, 20 bp, mouse
gcactacggtggtggaaagt

SEQ ID NO: 761534 - DNA, 20 bp, mouse
gtgccaccgaggctgcattc

SEQ ID NO: 761535 - DNA, 20 bp, mouse
gagtcactgcccaacacaga

SEQ ID NO: 761536 - DNA, 20 bp, mouse
gtacgcaagcagcaaacagg

SEQ ID NO: 761537 - DNA, 20 bp, mouse
gcgcaggagtgagtcaagac

SEQ ID NO: 761538 - DNA, 20 bp, mouse
gtacccggaagctcctttga

SEQ ID NO: 761539 - DNA, 20 bp, mouse
gcaaacagggggattccgga

SEQ ID NO: 761540 - DNA, 20 bp, mouse
gtgggcgaaacaatccacgc

SEQ ID NO: 761541 - DNA, 20 bp, mouse
gcgcccccggacccaagaag

SEQ ID NO: 761542 - DNA, 20 bp, mouse
gccgccctcaaaggagcttc

SEQ ID NO: 761543 - DNA, 20 bp, mouse
gcgacagagaagacctaact

SEQ ID NO: 761544 - DNA, 20 bp, mouse
gtttgctgcttgcgtaggca

SEQ ID NO: 761545 - DNA, 20 bp, mouse
gggaggggcggggctctacc

SEQ ID NO: 761546 - DNA, 20 bp, mouse
gcctgcaagcggaagatgag

SEQ ID NO: 761547 - DNA, 20 bp, mouse
gcgtaccgaacgctcggact

SEQ ID NO: 761548 - DNA, 20 bp, mouse
gtaagacgctcggagaaggg

SEQ ID NO: 761549 - DNA, 20 bp, mouse
gacgctcggagaagggaggt

SEQ ID NO: 761550 - DNA, 20 bp, mouse
gtgacttgtgattaggtctc

SEQ ID NO: 761551 - DNA, 20 bp, mouse
ggaggcgtggagacacagtt

SEQ ID NO: 761552 - DNA, 20 bp, mouse
gatgagaggcgagctttcga

SEQ ID NO: 761553 - DNA, 20 bp, mouse
ggactgggtgacttgtgatt

SEQ ID NO: 761554 - DNA, 20 bp, mouse
ggaccctcagagacggaggc

SEQ ID NO: 761555 - DNA, 20 bp, mouse
gttgtgattaggtctccgga

SEQ ID NO: 761556 - DNA, 20 bp, mouse
gccgaccggttgttttccgg

SEQ ID NO: 761557 - DNA, 20 bp, mouse
ggaaaacaaccggtcggccc

SEQ ID NO: 761558 - DNA, 20 bp, mouse
gtgagccgccggaaaacaac

SEQ ID NO: 761559 - DNA, 20 bp, mouse
gcaggcgccgcctcaccggg

SEQ ID NO: 761560 - DNA, 20 bp, mouse
gggtgctagccggggtttcc

SEQ ID NO: 761561 - DNA, 20 bp, mouse
gccgccccgcccgggccgac

SEQ ID NO: 761562 - DNA, 20 bp, mouse
gaacaaccggtcggcccggg

SEQ ID NO: 761563 - DNA, 20 bp, mouse
gcaggggctgcgatgcccgg

SEQ ID NO: 761564 - DNA, 20 bp, mouse
gcccaggggcccggggtccg

SEQ ID NO: 761565 - DNA, 20 bp, mouse
gggggcgcgggtgctagccg

SEQ ID NO: 761566 - DNA, 20 bp, mouse
gcatcctcgggttcgatcgg

SEQ ID NO: 761567 - DNA, 20 bp, mouse
gcgaacccgaggatgagcat

SEQ ID NO: 761568 - DNA, 20 bp, mouse
ggggcaccgagaagggccgg

SEQ ID NO: 761569 - DNA, 20 bp, mouse
gactcgggtcggtgtctttt

SEQ ID NO: 761570 - DNA, 20 bp, mouse
gcaccgagaagggccggagg

SEQ ID NO: 761571 - DNA, 20 bp, mouse
gcgtgggcaccgagaagggc

SEQ ID NO: 761572 - DNA, 20 bp, mouse
gggttcgatcgggggtgcgt

SEQ ID NO: 761573 - DNA, 20 bp, mouse
ggccctggcggggaatgtcc

SEQ ID NO: 761574 - DNA, 20 bp, mouse
gcggctccagtccgggtctt

SEQ ID NO: 761575 - DNA, 20 bp, mouse
gacaccctatgctcatcctc

SEQ ID NO: 761576 - DNA, 20 bp, mouse
gctggtgccacaagctacgt

SEQ ID NO: 761577 - DNA, 20 bp, mouse
gcggcggggcggagcgtatt

SEQ ID NO: 761578 - DNA, 20 bp, mouse
ggtggggcgaaacctaacgg

SEQ ID NO: 761579 - DNA, 20 bp, mouse
ggccacaagctacgtcggtg

SEQ ID NO: 761580 - DNA, 20 bp, mouse
gcctgtggggcgaaacctaa

SEQ ID NO: 761581 - DNA, 20 bp, mouse
gggcaccagacgcgtcgggg

SEQ ID NO: 761582 - DNA, 20 bp, mouse
gtattgggcaggacgggcag

SEQ ID NO: 761583 - DNA, 20 bp, mouse
gggagcgtattgggcaggac

SEQ ID NO: 761584 - DNA, 20 bp, mouse
gcggaaggggcgggacctgt

SEQ ID NO: 761585 - DNA, 20 bp, mouse
gagcaagagcacagtctgac

SEQ ID NO: 761586 - DNA, 20 bp, mouse
ggggtcctccatcgcgaggg

SEQ ID NO: 761587 - DNA, 20 bp, mouse
ggtgaggtggggcccgacag

SEQ ID NO: 761588 - DNA, 20 bp, mouse
ggcggagaacgaggtgaggt

SEQ ID NO: 761589 - DNA, 20 bp, mouse
ggcggggtcctccatcgcga

SEQ ID NO: 761590 - DNA, 20 bp, mouse
ggcctccaccaccctcgcga

SEQ ID NO: 761591 - DNA, 20 bp, mouse
gcggccaggggacgcacagc

SEQ ID NO: 761592 - DNA, 20 bp, mouse
gcgcagcggagaacgaggtg

SEQ ID NO: 761593 - DNA, 20 bp, mouse
gtcctccatcgcgagggtgg

SEQ ID NO: 761594 - DNA, 20 bp, mouse
gagggcctggtcaccagccg

SEQ ID NO: 761595 - DNA, 20 bp, mouse
gtggtcaccagccgtggcgt

SEQ ID NO: 761596 - DNA, 20 bp, mouse
gagaaagggggtgaattcgg

SEQ ID NO: 761597 - DNA, 20 bp, mouse
gaattcggaggggaagtgtg

SEQ ID NO: 761598 - DNA, 20 bp, mouse
gttggaggaaatagagggaa

SEQ ID NO: 761599 - DNA, 20 bp, mouse
gtgtaaggaaccggcgtccc

SEQ ID NO: 761600 - DNA, 20 bp, mouse
gcagtaaaaggagggcggaa

SEQ ID NO: 761601 - DNA, 20 bp, mouse
gctgcagagagggcggtccg

SEQ ID NO: 761602 - DNA, 20 bp, mouse
ggcagggcctgagtctgcgt

SEQ ID NO: 761603 - DNA, 20 bp, mouse
gaagttgagggcggtgctgc

SEQ ID NO: 761604 - DNA, 20 bp, mouse
gggacttggagacaagaagg

SEQ ID NO: 761605 - DNA, 20 bp, mouse
ggttccttacaagttgaggg

SEQ ID NO: 761606 - DNA, 20 bp, mouse
gcgcccggggacagccaagg

SEQ ID NO: 761607 - DNA, 20 bp, mouse
gcgggtgcaagcggggtttg

SEQ ID NO: 761608 - DNA, 20 bp, mouse
gtcccaggtcctgaagtcgt

SEQ ID NO: 761609 - DNA, 20 bp, mouse
gtgcaagcggggtttgcggg

SEQ ID NO: 761610 - DNA, 20 bp, mouse
ggggcgctgtagtaatcaaa

SEQ ID NO: 761611 - DNA, 20 bp, mouse
gcggctcacgcaggcgacga

SEQ ID NO: 761612 - DNA, 20 bp, mouse
ggacctgggaggctggatcg

SEQ ID NO: 761613 - DNA, 20 bp, mouse
gctcacgcaggcgacgaggg

SEQ ID NO: 761614 - DNA, 20 bp, mouse
gaccccgcttgcacccgggc

SEQ ID NO: 761615 - DNA, 20 bp, mouse
gtttgcgggggggacacgag

SEQ ID NO: 761616 - DNA, 20 bp, mouse
ggggaaatgtagttccccaa

SEQ ID NO: 761617 - DNA, 20 bp, mouse
gctcccggcacgcccaccaa

SEQ ID NO: 761618 - DNA, 20 bp, mouse
gccggcacgcccaccaacgg

SEQ ID NO: 761619 - DNA, 20 bp, mouse
gccgacggcgcccaccgcca

SEQ ID NO: 761620 - DNA, 20 bp, mouse
ggcggtgggcgccgtcggta

SEQ ID NO: 761621 - DNA, 20 bp, mouse
ggcgcatgcgcggtcgttcg

SEQ ID NO: 761622 - DNA, 20 bp, mouse
ggaaaagtagacgcctccgt

SEQ ID NO: 761623 - DNA, 20 bp, mouse
ggctactggcggctgctccc

SEQ ID NO: 761624 - DNA, 20 bp, mouse
gccgcggaccgcagaatgcg

SEQ ID NO: 761625 - DNA, 20 bp, mouse
gcggtcgttcgcggcctttg

SEQ ID NO: 761626 - DNA, 20 bp, mouse
gtggacgcttagaaataggt

SEQ ID NO: 761627 - DNA, 20 bp, mouse
gcactgggacccaccctctg

SEQ ID NO: 761628 - DNA, 20 bp, mouse
gtcccgccaaaggcctacgc

SEQ ID NO: 761629 - DNA, 20 bp, mouse
gccagtggacgcttagaaat

SEQ ID NO: 761630 - DNA, 20 bp, mouse
gtgacaccgcctcccgccaa

SEQ ID NO: 761631 - DNA, 20 bp, mouse
gcctgcgcggtgctcttcct

SEQ ID NO: 761632 - DNA, 20 bp, mouse
gtggccggggttatggggcg

SEQ ID NO: 761633 - DNA, 20 bp, mouse
gagcgtacggagcgtgtgaa

SEQ ID NO: 761634 - DNA, 20 bp, mouse
gcgcctgcgtaggcctttgg

SEQ ID NO: 761635 - DNA, 20 bp, mouse
gcctgcgtggtatataattc

SEQ ID NO: 761636 - DNA, 20 bp, mouse
gagggagggtgtcacgtaga

SEQ ID NO: 761637 - DNA, 20 bp, mouse
gcgcgggcgtcgcggaggga

SEQ ID NO: 761638 - DNA, 20 bp, mouse
gcgggcgcgggcgtcgcgga

SEQ ID NO: 761639 - DNA, 20 bp, mouse
ggggcgagacgctggttagt

SEQ ID NO: 761640 - DNA, 20 bp, mouse
gtggagacgggagccaacca

SEQ ID NO: 761641 - DNA, 20 bp, mouse
ggaccgcgcgccttgctcag

SEQ ID NO: 761642 - DNA, 20 bp, mouse
gagacgctggttagtgggga

SEQ ID NO: 761643 - DNA, 20 bp, mouse
gcaaacagccgattggagac

SEQ ID NO: 761644 - DNA, 20 bp, mouse
gcaggtgtagatcccctccg

SEQ ID NO: 761645 - DNA, 20 bp, mouse
gccacgccccggtccgcccc

SEQ ID NO: 761646 - DNA, 20 bp, mouse
ggcctccgaagcagtcccat

SEQ ID NO: 761647 - DNA, 20 bp, mouse
gacccctgttctgcttctca

SEQ ID NO: 761648 - DNA, 20 bp, mouse
gaacaggaagtgtacaaagg

SEQ ID NO: 761649 - DNA, 20 bp, mouse
gtaccttgagaagcagaaca

SEQ ID NO: 761650 - DNA, 20 bp, mouse
gtcagccaatgggactgctt

SEQ ID NO: 761651 - DNA, 20 bp, mouse
ggccaatgggactgcttcgg

SEQ ID NO: 761652 - DNA, 20 bp, mouse
gtgcgcttctaaaacagggg

SEQ ID NO: 761653 - DNA, 20 bp, mouse
gttccgatccttaagttctt

SEQ ID NO: 761654 - DNA, 20 bp, mouse
gctcaaggtaactttaaaac

SEQ ID NO: 761655 - DNA, 20 bp, mouse
gaagaatacaaagccatgat

SEQ ID NO: 761656 - DNA, 20 bp, mouse
gctcccgcgcccctgggaag

SEQ ID NO: 761657 - DNA, 20 bp, mouse
ggggccccgccccttcccag

SEQ ID NO: 761658 - DNA, 20 bp, mouse
ggggcgcgggaggcgtttct

SEQ ID NO: 761659 - DNA, 20 bp, mouse
gccaagcgggatagtgagag

SEQ ID NO: 761660 - DNA, 20 bp, mouse
gcaaggatatagaacgtcct

SEQ ID NO: 761661 - DNA, 20 bp, mouse
gctaggatgcgctcgcttct

SEQ ID NO: 761662 - DNA, 20 bp, mouse
gagtgagagcggagactttt

SEQ ID NO: 761663 - DNA, 20 bp, mouse
gggatatagaacgtcctcgg

SEQ ID NO: 761664 - DNA, 20 bp, mouse
gtagggagagaagaacttcg

SEQ ID NO: 761665 - DNA, 20 bp, mouse
gatccttgaagctctcagct

SEQ ID NO: 761666 - DNA, 20 bp, mouse
gctcactgggccagagtggg

SEQ ID NO: 761667 - DNA, 20 bp, mouse
ggggagcgcgcaagcctcac

SEQ ID NO: 761668 - DNA, 20 bp, mouse
ggcttccggggaccccgctt

SEQ ID NO: 761669 - DNA, 20 bp, mouse
gccaccgtagctttaatggg

SEQ ID NO: 761670 - DNA, 20 bp, mouse
gctggccgtgcgcatcctct

SEQ ID NO: 761671 - DNA, 20 bp, mouse
ggaaccgcccattaaagcta

SEQ ID NO: 761672 - DNA, 20 bp, mouse
gagcctcactgggccagagt

SEQ ID NO: 761673 - DNA, 20 bp, mouse
ggaagcgcccgaggccaagc

SEQ ID NO: 761674 - DNA, 20 bp, mouse
ggggtccccggaagcgcccg

SEQ ID NO: 761675 - DNA, 20 bp, mouse
gctgggagcttcggggtgta

SEQ ID NO: 761676 - DNA, 20 bp, mouse
gttaaggcgtaaaggtgggc

SEQ ID NO: 761677 - DNA, 20 bp, mouse
ggtcccgcctctccgattag

SEQ ID NO: 761678 - DNA, 20 bp, mouse
ggacggaagccgccaccctg

SEQ ID NO: 761679 - DNA, 20 bp, mouse
gtctgcgtttgacacattca

SEQ ID NO: 761680 - DNA, 20 bp, mouse
gaggcgttcttaaggcgtaa

SEQ ID NO: 761681 - DNA, 20 bp, mouse
gcgttcttaaggcgtaaagg

SEQ ID NO: 761682 - DNA, 20 bp, mouse
gaaaacagaccgcagggtgg

SEQ ID NO: 761683 - DNA, 20 bp, mouse
gaccctgccgcatcagagaa

SEQ ID NO: 761684 - DNA, 20 bp, mouse
gaaagatctcttacttccat

SEQ ID NO: 761685 - DNA, 20 bp, mouse
gctgggagccaatgagctct

SEQ ID NO: 761686 - DNA, 20 bp, mouse
gaggccggcggcggcgaggt

SEQ ID NO: 761687 - DNA, 20 bp, mouse
ggccgggtgcacccggacca

SEQ ID NO: 761688 - DNA, 20 bp, mouse
ggcgcggctccggtccatgt

SEQ ID NO: 761689 - DNA, 20 bp, mouse
gcggcgaggtgggggcgcta

SEQ ID NO: 761690 - DNA, 20 bp, mouse
gccgccccgggtttcttgaa

SEQ ID NO: 761691 - DNA, 20 bp, mouse
gcgggagacgcggggacaga

SEQ ID NO: 761692 - DNA, 20 bp, mouse
gaggtgggggcgctagggcc

SEQ ID NO: 761693 - DNA, 20 bp, mouse
ggagtcaccgccccctggtc

SEQ ID NO: 761694 - DNA, 20 bp, mouse
ggtgcacccggaccaggggg

SEQ ID NO: 761695 - DNA, 20 bp, mouse
gggtgactccccacatggac

SEQ ID NO: 761696 - DNA, 20 bp, mouse
ggtgactagacccaggggtc

SEQ ID NO: 761697 - DNA, 20 bp, mouse
gtgtaagggtcctggggaca

SEQ ID NO: 761698 - DNA, 20 bp, mouse
gggtctagtcacagcaggtg

SEQ ID NO: 761699 - DNA, 20 bp, mouse
ggggtcctggggacaaggga

SEQ ID NO: 761700 - DNA, 20 bp, mouse
gggaggggtcgggtgagtgg

SEQ ID NO: 761701 - DNA, 20 bp, mouse
gcacccgacccctccctctc

SEQ ID NO: 761702 - DNA, 20 bp, mouse
gcctgctgtgactagaccca

SEQ ID NO: 761703 - DNA, 20 bp, mouse
gccccaggacccttacaacc

SEQ ID NO: 761704 - DNA, 20 bp, mouse
gcccaggggtccgggttgta

SEQ ID NO: 761705 - DNA, 20 bp, mouse
gagccaggaaaagccagtca

SEQ ID NO: 761706 - DNA, 20 bp, mouse
gacagcggggcacacgggtg

SEQ ID NO: 761707 - DNA, 20 bp, mouse
gcgcccggctgcctagggtg

SEQ ID NO: 761708 - DNA, 20 bp, mouse
gcagtcaagtgaggcgtgag

SEQ ID NO: 761709 - DNA, 20 bp, mouse
ggggcgggcgcggttccgga

SEQ ID NO: 761710 - DNA, 20 bp, mouse
ggggctgccccacgtaccca

SEQ ID NO: 761711 - DNA, 20 bp, mouse
gaagccacagcggggcacac

SEQ ID NO: 761712 - DNA, 20 bp, mouse
ggcgcccgcccggctgccta

SEQ ID NO: 761713 - DNA, 20 bp, mouse
gcggaggtgccctgggtacg

SEQ ID NO: 761714 - DNA, 20 bp, mouse
gcccgctgtggcttctcagt

SEQ ID NO: 761715 - DNA, 20 bp, mouse
gcggttccggaggggttggg

SEQ ID NO: 761716 - DNA, 20 bp, mouse
gaagacctggctatagtggg

SEQ ID NO: 761717 - DNA, 20 bp, mouse
gtacccgcgcgcttgtgtgt

SEQ ID NO: 761718 - DNA, 20 bp, mouse
gcaccaagagatagagagtg

SEQ ID NO: 761719 - DNA, 20 bp, mouse
gtagtgggagggagacatag

SEQ ID NO: 761720 - DNA, 20 bp, mouse
gtatctcttggtgtgttatg

SEQ ID NO: 761721 - DNA, 20 bp, mouse
gtggagaaaacatttggata

SEQ ID NO: 761722 - DNA, 20 bp, mouse
gtatagccaggtcttggctt

SEQ ID NO: 761723 - DNA, 20 bp, mouse
gtctccctcccactatagcc

SEQ ID NO: 761724 - DNA, 20 bp, mouse
ggccaagacctggctatagt

SEQ ID NO: 761725 - DNA, 20 bp, mouse
ggtgttatggggagaagttc

SEQ ID NO: 761726 - DNA, 20 bp, mouse
gttggggtacggggtacaag

SEQ ID NO: 761727 - DNA, 20 bp, mouse
gaggccggttgcgaacgttg

SEQ ID NO: 761728 - DNA, 20 bp, mouse
ggtacaaggggccgagccag

SEQ ID NO: 761729 - DNA, 20 bp, mouse
gttcgcaaccggcctctccg

SEQ ID NO: 761730 - DNA, 20 bp, mouse
gtggctgcttgtgtcgggta

SEQ ID NO: 761731 - DNA, 20 bp, mouse
gggttgcgaacgttggggta

SEQ ID NO: 761732 - DNA, 20 bp, mouse
gaggctgtgcaattatctct

SEQ ID NO: 761733 - DNA, 20 bp, mouse
gagtagatctcgagctgtgg

SEQ ID NO: 761734 - DNA, 20 bp, mouse
gagctcgagatctactccac

SEQ ID NO: 761735 - DNA, 20 bp, mouse
gggaaagtgatcatggtctg

SEQ ID NO: 761736 - DNA, 20 bp, mouse
gagggtcgacagggacactg

SEQ ID NO: 761737 - DNA, 20 bp, mouse
gggtctggagagggtcgaca

SEQ ID NO: 761738 - DNA, 20 bp, mouse
gctaggagcaagagacttgt

SEQ ID NO: 761739 - DNA, 20 bp, mouse
gagaccgaagagctgtgaac

SEQ ID NO: 761740 - DNA, 20 bp, mouse
ggaacgggcaggtctggaga

SEQ ID NO: 761741 - DNA, 20 bp, mouse
gcaagaaaggcaaggaggtt

SEQ ID NO: 761742 - DNA, 20 bp, mouse
gaggcccagagtgaacaggc

SEQ ID NO: 761743 - DNA, 20 bp, mouse
gcgaagagctgtgaacgggc

SEQ ID NO: 761744 - DNA, 20 bp, mouse
gaaacactgttggccaagaa

SEQ ID NO: 761745 - DNA, 20 bp, mouse
gaggactcacgttgatgtcc

SEQ ID NO: 761746 - DNA, 20 bp, mouse
ggacacgaccgcccaaaaag

SEQ ID NO: 761747 - DNA, 20 bp, mouse
gaacccacagcgagcgagag

SEQ ID NO: 761748 - DNA, 20 bp, mouse
gaccggaaagcaccggaagt

SEQ ID NO: 761749 - DNA, 20 bp, mouse
ggcagcctgtgccagagggg

SEQ ID NO: 761750 - DNA, 20 bp, mouse
gagaagagcttgcctcagac

SEQ ID NO: 761751 - DNA, 20 bp, mouse
ggcaggaaagggtgggtaac

SEQ ID NO: 761752 - DNA, 20 bp, mouse
gcccagtcggaatcggggtc

SEQ ID NO: 761753 - DNA, 20 bp, mouse
gcacctctctcgctcgctgt

SEQ ID NO: 761754 - DNA, 20 bp, mouse
gggcgaacccggaagcagaa

SEQ ID NO: 761755 - DNA, 20 bp, mouse
gtgtgccagaggggcggctc

SEQ ID NO: 761756 - DNA, 20 bp, mouse
gggccaagagattttctttg

SEQ ID NO: 761757 - DNA, 20 bp, mouse
ggaccacaaagaaaatctct

SEQ ID NO: 761758 - DNA, 20 bp, mouse
gccaccaacaggtactcata

SEQ ID NO: 761759 - DNA, 20 bp, mouse
gtgtggtccagatatggaat

SEQ ID NO: 761760 - DNA, 20 bp, mouse
ggtccagatatggaatggga

SEQ ID NO: 761761 - DNA, 20 bp, mouse
gggttgcagccttagaaaag

SEQ ID NO: 761762 - DNA, 20 bp, mouse
gagagccctaggctctcaag

SEQ ID NO: 761763 - DNA, 20 bp, mouse
ggtaccttatgagtacctgt

SEQ ID NO: 761764 - DNA, 20 bp, mouse
gaccctcctcttgagagcct

SEQ ID NO: 761765 - DNA, 20 bp, mouse
ggtatttctccacttttcta

SEQ ID NO: 761766 - DNA, 20 bp, mouse
gctgctacctctagtgtggg

SEQ ID NO: 761767 - DNA, 20 bp, mouse
gtgccctgctacctctagtg

SEQ ID NO: 761768 - DNA, 20 bp, mouse
ggccaggcagccattggcag

SEQ ID NO: 761769 - DNA, 20 bp, mouse
gagggatctgggaacccctt

SEQ ID NO: 761770 - DNA, 20 bp, mouse
gtcccagatccctctgccaa

SEQ ID NO: 761771 - DNA, 20 bp, mouse
gccagccaatagagagctgg

SEQ ID NO: 761772 - DNA, 20 bp, mouse
ggggccagccaatagagagc

SEQ ID NO: 761773 - DNA, 20 bp, mouse
gctggccctgagggggggcg

SEQ ID NO: 761774 - DNA, 20 bp, mouse
gggcgggggctggccctgag

SEQ ID NO: 761775 - DNA, 20 bp, mouse
ggccattggcagagggatct

SEQ ID NO: 761776 - DNA, 20 bp, mouse
gtggacacgagtcacttaat

SEQ ID NO: 761777 - DNA, 20 bp, mouse
gctgatctgctaaaatattt

SEQ ID NO: 761778 - DNA, 20 bp, mouse
gccagacgctgtagatgcta

SEQ ID NO: 761779 - DNA, 20 bp, mouse
ggagatggtggaagagataa

SEQ ID NO: 761780 - DNA, 20 bp, mouse
gttgacatctgtcacagtgt

SEQ ID NO: 761781 - DNA, 20 bp, mouse
gtttatggcacagattcagt

SEQ ID NO: 761782 - DNA, 20 bp, mouse
gcagcgtctggccacacagg

SEQ ID NO: 761783 - DNA, 20 bp, mouse
gctggctcacaaaatgccag

SEQ ID NO: 761784 - DNA, 20 bp, mouse
gaaacaaggaaccgcctgtg

SEQ ID NO: 761785 - DNA, 20 bp, mouse
gtttcaactgctatatttta

SEQ ID NO: 761786 - DNA, 20 bp, mouse
gacagctagtctctcaggga

SEQ ID NO: 761787 - DNA, 20 bp, mouse
gaaagattgagacatgtcag

SEQ ID NO: 761788 - DNA, 20 bp, mouse
gggggcggggtgtgatgagt

SEQ ID NO: 761789 - DNA, 20 bp, mouse
gtcgctgggaggtgggtacc

SEQ ID NO: 761790 - DNA, 20 bp, mouse
gtgagacatgtcagcgggtg

SEQ ID NO: 761791 - DNA, 20 bp, mouse
ggggataatcacgtcacggg

SEQ ID NO: 761792 - DNA, 20 bp, mouse
ggtcacgggtggaagattcc

SEQ ID NO: 761793 - DNA, 20 bp, mouse
gcctgggataatcacgtcac

SEQ ID NO: 761794 - DNA, 20 bp, mouse
ggggcatgcgctctgacgca

SEQ ID NO: 761795 - DNA, 20 bp, mouse
ggacatgtcagcgggtgtgg

SEQ ID NO: 761796 - DNA, 20 bp, mouse
gtgtcactgccgtgccgaat

SEQ ID NO: 761797 - DNA, 20 bp, mouse
ggacacggggaaggctgcta

SEQ ID NO: 761798 - DNA, 20 bp, mouse
ggcggcccggaacctggaag

SEQ ID NO: 761799 - DNA, 20 bp, mouse
gcctcccggtagtccctcgt

SEQ ID NO: 761800 - DNA, 20 bp, mouse
gtcggcacggcagtgacagt

SEQ ID NO: 761801 - DNA, 20 bp, mouse
gaacggggcgagctgcacaa

SEQ ID NO: 761802 - DNA, 20 bp, mouse
ggcccggaacctggaagggg

SEQ ID NO: 761803 - DNA, 20 bp, mouse
gccaaagggccgtgcttccc

SEQ ID NO: 761804 - DNA, 20 bp, mouse
gaaggtaaagcaaccctcgg

SEQ ID NO: 761805 - DNA, 20 bp, mouse
ggccagattcgacacgggga

SEQ ID NO: 761806 - DNA, 20 bp, mouse
gagcgaagagtaagtaggtc

SEQ ID NO: 761807 - DNA, 20 bp, mouse
ggggggcggggtcctagtgt

SEQ ID NO: 761808 - DNA, 20 bp, mouse
gcgagaaactgaagagttag

SEQ ID NO: 761809 - DNA, 20 bp, mouse
ggacacccggaattagtctt

SEQ ID NO: 761810 - DNA, 20 bp, mouse
gctagtggccaggagcacct

SEQ ID NO: 761811 - DNA, 20 bp, mouse
gtcggggcggagcaaggagc

SEQ ID NO: 761812 - DNA, 20 bp, mouse
ggggaccagggtcactcgct

SEQ ID NO: 761813 - DNA, 20 bp, mouse
gcacctcggcgtggggacca

SEQ ID NO: 761814 - DNA, 20 bp, mouse
gaaaggagcgaagagtaagt

SEQ ID NO: 761815 - DNA, 20 bp, mouse
ggtgctcctggccactagga

SEQ ID NO: 761816 - DNA, 20 bp, mouse
ggggtggcctatagttgtag

SEQ ID NO: 761817 - DNA, 20 bp, mouse
ggggtgcaggcctggagact

SEQ ID NO: 761818 - DNA, 20 bp, mouse
gctccatcgggcaagacagg

SEQ ID NO: 761819 - DNA, 20 bp, mouse
gggctgagtccccagtctcc

SEQ ID NO: 761820 - DNA, 20 bp, mouse
gacagcctgggtgtttgggg

SEQ ID NO: 761821 - DNA, 20 bp, mouse
ggaatggggaggacggctag

SEQ ID NO: 761822 - DNA, 20 bp, mouse
gtgcctcctgtcttgcccga

SEQ ID NO: 761823 - DNA, 20 bp, mouse
gaagccagagggtgcaggcc

SEQ ID NO: 761824 - DNA, 20 bp, mouse
gcgcccctccccaaacaccc

SEQ ID NO: 761825 - DNA, 20 bp, mouse
gataggccacccctccaagt

SEQ ID NO: 761826 - DNA, 20 bp, mouse
gccgagaggtggggcccaaa

SEQ ID NO: 761827 - DNA, 20 bp, mouse
gcaccgcgggaatcccaggg

SEQ ID NO: 761828 - DNA, 20 bp, mouse
ggggcctggggccgagaggt

SEQ ID NO: 761829 - DNA, 20 bp, mouse
gggaaagaggcggagcccaa

SEQ ID NO: 761830 - DNA, 20 bp, mouse
gttagaaccgggtttccaga

SEQ ID NO: 761831 - DNA, 20 bp, mouse
gggaggccgaatttagaacc

SEQ ID NO: 761832 - DNA, 20 bp, mouse
gcaggtcacaaggagctcag

SEQ ID NO: 761833 - DNA, 20 bp, mouse
gggaaacccggttctaaatt

SEQ ID NO: 761834 - DNA, 20 bp, mouse
gtaaaggtcaatctaagcac

SEQ ID NO: 761835 - DNA, 20 bp, mouse
ggatctacttagagattggt

SEQ ID NO: 761836 - DNA, 20 bp, mouse
gaagtggcacactagtacaa

SEQ ID NO: 761837 - DNA, 20 bp, mouse
gctagtacaacgggttgtga

SEQ ID NO: 761838 - DNA, 20 bp, mouse
gagagtgctgaagtcatctt

SEQ ID NO: 761839 - DNA, 20 bp, mouse
gtagtgtgccacttcccgag

SEQ ID NO: 761840 - DNA, 20 bp, mouse
gcagtggttgtgagtctctt

SEQ ID NO: 761841 - DNA, 20 bp, mouse
gcacagagcgcgcgcaatga

SEQ ID NO: 761842 - DNA, 20 bp, mouse
ggattgtgaataaaccactc

SEQ ID NO: 761843 - DNA, 20 bp, mouse
gtcttcttccgggaaggggg

SEQ ID NO: 761844 - DNA, 20 bp, mouse
gttagcgttctagttaggat

SEQ ID NO: 761845 - DNA, 20 bp, mouse
ggcactctcttcttccggga

SEQ ID NO: 761846 - DNA, 20 bp, mouse
gcggggaggagatttcggaa

SEQ ID NO: 761847 - DNA, 20 bp, mouse
gaggggcgcagcgccctgtg

SEQ ID NO: 761848 - DNA, 20 bp, mouse
ggagactatgagcgtggtgg

SEQ ID NO: 761849 - DNA, 20 bp, mouse
ggctccccggagcggccgag

SEQ ID NO: 761850 - DNA, 20 bp, mouse
ggggggaggccagggcgaga

SEQ ID NO: 761851 - DNA, 20 bp, mouse
ggactcccagcggccgcaca

SEQ ID NO: 761852 - DNA, 20 bp, mouse
ggggaagggtgacgcagcat

SEQ ID NO: 761853 - DNA, 20 bp, mouse
gccggggagcgattgcgcct

SEQ ID NO: 761854 - DNA, 20 bp, mouse
gaggcggcgcgggggcggca

SEQ ID NO: 761855 - DNA, 20 bp, mouse
gtccgcgtgtgtgtctaggt

SEQ ID NO: 761856 - DNA, 20 bp, mouse
gtgggagcagcctgcgacaa

SEQ ID NO: 761857 - DNA, 20 bp, mouse
ggagcagcctgcgacaacgg

SEQ ID NO: 761858 - DNA, 20 bp, mouse
gtgcacccagcgctctgcct

SEQ ID NO: 761859 - DNA, 20 bp, mouse
ggctcccagcctttcagatt

SEQ ID NO: 761860 - DNA, 20 bp, mouse
gtgcagcgctcatgcaaatg

SEQ ID NO: 761861 - DNA, 20 bp, mouse
gcactgaaacctaatctgaa

SEQ ID NO: 761862 - DNA, 20 bp, mouse
ggagaaacttcaaatgtgtg

SEQ ID NO: 761863 - DNA, 20 bp, mouse
gggctcccaggcagagcgct

SEQ ID NO: 761864 - DNA, 20 bp, mouse
gaaacctaatctgaaaggct

SEQ ID NO: 761865 - DNA, 20 bp, mouse
ggctctgcctcctacaccaa

SEQ ID NO: 761866 - DNA, 20 bp, mouse
gcactcctgcgaaagatgat

SEQ ID NO: 761867 - DNA, 20 bp, mouse
gctgaagtacggtctgtgga

SEQ ID NO: 761868 - DNA, 20 bp, mouse
gaccactgaagtacggtctg

SEQ ID NO: 761869 - DNA, 20 bp, mouse
gagacgtctacgttctgcac

SEQ ID NO: 761870 - DNA, 20 bp, mouse
ggggctctctgtctccaatg

SEQ ID NO: 761871 - DNA, 20 bp, mouse
gttgagctaccactgaagta

SEQ ID NO: 761872 - DNA, 20 bp, mouse
ggacactgaaggcacctcat

SEQ ID NO: 761873 - DNA, 20 bp, mouse
ggtacggtctgtggaggggc

SEQ ID NO: 761874 - DNA, 20 bp, mouse
gactccacaaacaataaaac

SEQ ID NO: 761875 - DNA, 20 bp, mouse
gggggtggggacacgggtta

SEQ ID NO: 761876 - DNA, 20 bp, mouse
ggaagctgagagttaaccga

SEQ ID NO: 761877 - DNA, 20 bp, mouse
gcgcagattaacgcttgatc

SEQ ID NO: 761878 - DNA, 20 bp, mouse
gttaacccgggttaaggtac

SEQ ID NO: 761879 - DNA, 20 bp, mouse
gactgggcctgaagctcctc

SEQ ID NO: 761880 - DNA, 20 bp, mouse
gaggcccagtaccttaaccc

SEQ ID NO: 761881 - DNA, 20 bp, mouse
gtcggtgcgcaaaatgtgcc

SEQ ID NO: 761882 - DNA, 20 bp, mouse
gacagcagagacacgaagtc

SEQ ID NO: 761883 - DNA, 20 bp, mouse
gtcagctcactcagctactt

SEQ ID NO: 761884 - DNA, 20 bp, mouse
gtggccgctagcttgctcaa

SEQ ID NO: 761885 - DNA, 20 bp, mouse
gcattcacacagacttccct

SEQ ID NO: 761886 - DNA, 20 bp, mouse
ggtggacgagtcagatctga

SEQ ID NO: 761887 - DNA, 20 bp, mouse
gtaggcaagccgactgtcag

SEQ ID NO: 761888 - DNA, 20 bp, mouse
ggcaagccgactgtcagagg

SEQ ID NO: 761889 - DNA, 20 bp, mouse
gtgtgggttcccgtctgccc

SEQ ID NO: 761890 - DNA, 20 bp, mouse
gtgtctgtgtggtgaacgtg

SEQ ID NO: 761891 - DNA, 20 bp, mouse
gtgacatgacataaagccga

SEQ ID NO: 761892 - DNA, 20 bp, mouse
gctcgtccacctctgacagt

SEQ ID NO: 761893 - DNA, 20 bp, mouse
gctggctaggtgattggcct

SEQ ID NO: 761894 - DNA, 20 bp, mouse
gtgcatgctggctaggtgat

SEQ ID NO: 761895 - DNA, 20 bp, mouse
ggttgaaagagatgactgaa

SEQ ID NO: 761896 - DNA, 20 bp, mouse
ggcgtctgtaagtccctccc

SEQ ID NO: 761897 - DNA, 20 bp, mouse
gcaagagtcggaaatgtcaa

SEQ ID NO: 761898 - DNA, 20 bp, mouse
gatcagggcgggtcaagagt

SEQ ID NO: 761899 - DNA, 20 bp, mouse
gttacagacgcgaggatgat

SEQ ID NO: 761900 - DNA, 20 bp, mouse
gcgccctgatcatcggtgat

SEQ ID NO: 761901 - DNA, 20 bp, mouse
gttgcccggagcagcccggg

SEQ ID NO: 761902 - DNA, 20 bp, mouse
gcaaaggatccagaatgctt

SEQ ID NO: 761903 - DNA, 20 bp, mouse
gtggataaagaacggctcga

SEQ ID NO: 761904 - DNA, 20 bp, mouse
gggatcctttggataaagaa

SEQ ID NO: 761905 - DNA, 20 bp, mouse
gaagacagcccaaagcattc

SEQ ID NO: 761906 - DNA, 20 bp, mouse
gcgcgggggaacctcggtgt

SEQ ID NO: 761907 - DNA, 20 bp, mouse
gggaacccagaatcaggaac

SEQ ID NO: 761908 - DNA, 20 bp, mouse
gcaaggaataaaaacagttt

SEQ ID NO: 761909 - DNA, 20 bp, mouse
gccagacaaagtctcaagtg

SEQ ID NO: 761910 - DNA, 20 bp, mouse
gaataaaaacagtttgggaa

SEQ ID NO: 761911 - DNA, 20 bp, mouse
gtctgggttccttaagttat

SEQ ID NO: 761912 - DNA, 20 bp, mouse
gtgcggaatcctataactta

SEQ ID NO: 761913 - DNA, 20 bp, mouse
gacttaaggaacccagaatc

SEQ ID NO: 761914 - DNA, 20 bp, mouse
gagactttgtctggcaggtg

SEQ ID NO: 761915 - DNA, 20 bp, mouse
gaaaaacagtttgggaatgg

SEQ ID NO: 761916 - DNA, 20 bp, mouse
gctgcaggaggtgacctcaa

SEQ ID NO: 761917 - DNA, 20 bp, mouse
gcgccagcggccactacatg

SEQ ID NO: 761918 - DNA, 20 bp, mouse
gcactgggttggcagagcga

SEQ ID NO: 761919 - DNA, 20 bp, mouse
gacccccaactctccagtgt

SEQ ID NO: 761920 - DNA, 20 bp, mouse
gggacagcctagaccagacc

SEQ ID NO: 761921 - DNA, 20 bp, mouse
gcgttggcccggtctggtct

SEQ ID NO: 761922 - DNA, 20 bp, mouse
gactacatgtggttctcatt

SEQ ID NO: 761923 - DNA, 20 bp, mouse
gagagtcgctgattggtcag

SEQ ID NO: 761924 - DNA, 20 bp, mouse
ggtggccgggctggaaggtg

SEQ ID NO: 761925 - DNA, 20 bp, mouse
gggctggaaggtgaggccgt

SEQ ID NO: 761926 - DNA, 20 bp, mouse
ggctccgggcttcacttctg

SEQ ID NO: 761927 - DNA, 20 bp, mouse
gagagactgacgggagagta

SEQ ID NO: 761928 - DNA, 20 bp, mouse
gtggtcctccgagtcctagt

SEQ ID NO: 761929 - DNA, 20 bp, mouse
ggtgtgaagttgggcggaat

SEQ ID NO: 761930 - DNA, 20 bp, mouse
gtagagctctcaggggccga

SEQ ID NO: 761931 - DNA, 20 bp, mouse
ggtcccctgcggagggctcc

SEQ ID NO: 761932 - DNA, 20 bp, mouse
gtctcctcatcacaccgact

SEQ ID NO: 761933 - DNA, 20 bp, mouse
gagtcctagtcggtgtgatg

SEQ ID NO: 761934 - DNA, 20 bp, mouse
gagcccggagccctccgcag

SEQ ID NO: 761935 - DNA, 20 bp, mouse
ggaccacgcacctcacccct

SEQ ID NO: 761936 - DNA, 20 bp, mouse
gcctcccggaaagtctgcag

SEQ ID NO: 761937 - DNA, 20 bp, mouse
gccaaccccccgctcaggat

SEQ ID NO: 761938 - DNA, 20 bp, mouse
gcctggcaggctggtttcta

SEQ ID NO: 761939 - DNA, 20 bp, mouse
gctaggcccaaaccccctcc

SEQ ID NO: 761940 - DNA, 20 bp, mouse
gaagccggcctggacctggc

SEQ ID NO: 761941 - DNA, 20 bp, mouse
gaaaccagcctgccaggtcc

SEQ ID NO: 761942 - DNA, 20 bp, mouse
ggactggatggtcactgcga

SEQ ID NO: 761943 - DNA, 20 bp, mouse
gaggcctgatgtgtatacaa

SEQ ID NO: 761944 - DNA, 20 bp, mouse
ggtgtgtagttgtgtggcaa

SEQ ID NO: 761945 - DNA, 20 bp, mouse
gtttgggcctagagtgacga

SEQ ID NO: 761946 - DNA, 20 bp, mouse
gccgagggaggagcgggtag

SEQ ID NO: 761947 - DNA, 20 bp, mouse
gcgggtgcgagcccccgcca

SEQ ID NO: 761948 - DNA, 20 bp, mouse
gtgggtgcaggactgacacg

SEQ ID NO: 761949 - DNA, 20 bp, mouse
gggtacgctgaggcgacctc

SEQ ID NO: 761950 - DNA, 20 bp, mouse
ggcgggtagcggctgagagt

SEQ ID NO: 761951 - DNA, 20 bp, mouse
gctcccgccgcagccgaggg

SEQ ID NO: 761952 - DNA, 20 bp, mouse
gagtgccagctggtacgctg

SEQ ID NO: 761953 - DNA, 20 bp, mouse
ggtggtgggcaagggaccgc

SEQ ID NO: 761954 - DNA, 20 bp, mouse
gggactgacacgcggagcca

SEQ ID NO: 761955 - DNA, 20 bp, mouse
gcgccagggagatttgaatt

SEQ ID NO: 761956 - DNA, 20 bp, mouse
gactccgcctccacccgggg

SEQ ID NO: 761957 - DNA, 20 bp, mouse
ggtgaaggagcctgagaatt

SEQ ID NO: 761958 - DNA, 20 bp, mouse
gtcatcgcgaggacaggcgc

SEQ ID NO: 761959 - DNA, 20 bp, mouse
gcaggatagcacttctccag

SEQ ID NO: 761960 - DNA, 20 bp, mouse
ggagaagtgctatcctgctc

SEQ ID NO: 761961 - DNA, 20 bp, mouse
gctccacccggggcgggccg

SEQ ID NO: 761962 - DNA, 20 bp, mouse
ggctggaatcgcgcctgagc

SEQ ID NO: 761963 - DNA, 20 bp, mouse
ggggcctagacgccagctgc

SEQ ID NO: 761964 - DNA, 20 bp, mouse
gcccggactccgcctccacc

SEQ ID NO: 761965 - DNA, 20 bp, mouse
ggtcctcgcgatgacatcgg

SEQ ID NO: 761966 - DNA, 20 bp, mouse
gtggcctggctgggattcga

SEQ ID NO: 761967 - DNA, 20 bp, mouse
gccgcatgtggcatattgag

SEQ ID NO: 761968 - DNA, 20 bp, mouse
gaggcgccagtcacctcaga

SEQ ID NO: 761969 - DNA, 20 bp, mouse
gattcgagggacaactcaaa

SEQ ID NO: 761970 - DNA, 20 bp, mouse
ggtgtcaggtcaccaatcgt

SEQ ID NO: 761971 - DNA, 20 bp, mouse
gtgggcttatggctcttctg

SEQ ID NO: 761972 - DNA, 20 bp, mouse
gaacctcatgtcttgggatt

SEQ ID NO: 761973 - DNA, 20 bp, mouse
gccaggccatctgaggtgac

SEQ ID NO: 761974 - DNA, 20 bp, mouse
gcgtgtgcacctccccccag

SEQ ID NO: 761975 - DNA, 20 bp, mouse
gcgagtgtctgccccgcatg

SEQ ID NO: 761976 - DNA, 20 bp, mouse
gggtgcgcgtgcacgagagg

SEQ ID NO: 761977 - DNA, 20 bp, mouse
gaaggcttactgctgtgtgt

SEQ ID NO: 761978 - DNA, 20 bp, mouse
gaagcccaccaagccattaa

SEQ ID NO: 761979 - DNA, 20 bp, mouse
gcaccaagccattaacggag

SEQ ID NO: 761980 - DNA, 20 bp, mouse
gggatggtcctctccgttaa

SEQ ID NO: 761981 - DNA, 20 bp, mouse
gtagggtgcgcgtgcacgag

SEQ ID NO: 761982 - DNA, 20 bp, mouse
ggagaccccggagctttgga

SEQ ID NO: 761983 - DNA, 20 bp, mouse
gaaggacatccgagccgtac

SEQ ID NO: 761984 - DNA, 20 bp, mouse
gggcaagatcgcgcgagatt

SEQ ID NO: 761985 - DNA, 20 bp, mouse
ggtcctctccgttaatggct

SEQ ID NO: 761986 - DNA, 20 bp, mouse
gggcctagctggtatggaag

SEQ ID NO: 761987 - DNA, 20 bp, mouse
gctagctggtatggaagagg

SEQ ID NO: 761988 - DNA, 20 bp, mouse
gttctcgcggggcctcccca

SEQ ID NO: 761989 - DNA, 20 bp, mouse
gaggccccgcgagaacgagg

SEQ ID NO: 761990 - DNA, 20 bp, mouse
ggccaggggcctagctggta

SEQ ID NO: 761991 - DNA, 20 bp, mouse
gcaggatgacttcaaggctc

SEQ ID NO: 761992 - DNA, 20 bp, mouse
ggcggggcctccccagggaa

SEQ ID NO: 761993 - DNA, 20 bp, mouse
gggcggggcttggacgggcg

SEQ ID NO: 761994 - DNA, 20 bp, mouse
ggggaggccccgcgagaacg

SEQ ID NO: 761995 - DNA, 20 bp, mouse
ggggcggcgcccagaggcct

SEQ ID NO: 761996 - DNA, 20 bp, mouse
gtggccgaagcggtcgtgga

SEQ ID NO: 761997 - DNA, 20 bp, mouse
gggcggctgcgcaaagatca

SEQ ID NO: 761998 - DNA, 20 bp, mouse
gacttccggggaccgaaagc

SEQ ID NO: 761999 - DNA, 20 bp, mouse
gctaccgtggcggacttccg

SEQ ID NO: 762000 - DNA, 20 bp, mouse
ggggaaacggaaacgattgg

SEQ ID NO: 762001 - DNA, 20 bp, mouse
gcagccctccacgaccgctt

SEQ ID NO: 762002 - DNA, 20 bp, mouse
gggtccccggaagtccgcca

SEQ ID NO: 762003 - DNA, 20 bp, mouse
gggctctgaagaggaagtga

SEQ ID NO: 762004 - DNA, 20 bp, mouse
gagtccgccacggtaggcgg

SEQ ID NO: 762005 - DNA, 20 bp, mouse
gtcccccagcgcgacggccg

SEQ ID NO: 762006 - DNA, 20 bp, mouse
ggggtgggagcgagcttagg

SEQ ID NO: 762007 - DNA, 20 bp, mouse
gggactgcgaagtaagacag

SEQ ID NO: 762008 - DNA, 20 bp, mouse
gtgcgcgcgccgcgccccac

SEQ ID NO: 762009 - DNA, 20 bp, mouse
gcatgcagtgggatcagagg

SEQ ID NO: 762010 - DNA, 20 bp, mouse
gagccctagggcgtctggtg

SEQ ID NO: 762011 - DNA, 20 bp, mouse
gtgggagcgagcttaggggg

SEQ ID NO: 762012 - DNA, 20 bp, mouse
gctgcgaagtaagacagggg

SEQ ID NO: 762013 - DNA, 20 bp, mouse
gaggagccgaaaggcttctg

SEQ ID NO: 762014 - DNA, 20 bp, mouse
ggggagccggagttcggggt

SEQ ID NO: 762015 - DNA, 20 bp, mouse
ggatcagaggaggagccgaa

SEQ ID NO: 762016 - DNA, 20 bp, mouse
ggtcccacgtgaagactccc

SEQ ID NO: 762017 - DNA, 20 bp, mouse
ggtgaagactcccaggaaat

SEQ ID NO: 762018 - DNA, 20 bp, mouse
gggaggagccgtaccttcta

SEQ ID NO: 762019 - DNA, 20 bp, mouse
gctcctccggctcgctgtca

SEQ ID NO: 762020 - DNA, 20 bp, mouse
gcgccctgacagcgagccgg

SEQ ID NO: 762021 - DNA, 20 bp, mouse
gttcctgggagtcttcacgt

SEQ ID NO: 762022 - DNA, 20 bp, mouse
gctcaggccccgcctccgca

SEQ ID NO: 762023 - DNA, 20 bp, mouse
gaagatgaccttagaaggta

SEQ ID NO: 762024 - DNA, 20 bp, mouse
gccccgccctgacagcgagc

SEQ ID NO: 762025 - DNA, 20 bp, mouse
gagtcttcacgtgggacctt

SEQ ID NO: 762026 - DNA, 20 bp, mouse
ggtgactgaaggaacttctg

SEQ ID NO: 762027 - DNA, 20 bp, mouse
gcccacccagtcactctcat

SEQ ID NO: 762028 - DNA, 20 bp, mouse
ggatcggtggagtcagcgaa

SEQ ID NO: 762029 - DNA, 20 bp, mouse
gctgcctccgcccccgtggc

SEQ ID NO: 762030 - DNA, 20 bp, mouse
ggtggacccgggagctgcac

SEQ ID NO: 762031 - DNA, 20 bp, mouse
gctgtcccgaggcccccttc

SEQ ID NO: 762032 - DNA, 20 bp, mouse
gggcccccttctggttgtcc

SEQ ID NO: 762033 - DNA, 20 bp, mouse
gaggagatgaggttacagcg

SEQ ID NO: 762034 - DNA, 20 bp, mouse
gggtgtctgcagggtggacc

SEQ ID NO: 762035 - DNA, 20 bp, mouse
ggcggcgatgagcgagcggt

SEQ ID NO: 762036 - DNA, 20 bp, mouse
gctgacaggtgtaggcaccg

SEQ ID NO: 762037 - DNA, 20 bp, mouse
gtaggcaccggggcccagaa

SEQ ID NO: 762038 - DNA, 20 bp, mouse
ggcggcacgcaggtgaggtc

SEQ ID NO: 762039 - DNA, 20 bp, mouse
gcgccggcacctggctcctg

SEQ ID NO: 762040 - DNA, 20 bp, mouse
gaccggggcccagaagggag

SEQ ID NO: 762041 - DNA, 20 bp, mouse
gtgcctacacctgtcagcgc

SEQ ID NO: 762042 - DNA, 20 bp, mouse
ggccgctcccttctgggccc

SEQ ID NO: 762043 - DNA, 20 bp, mouse
gttcctgcgctgacaggtgt

SEQ ID NO: 762044 - DNA, 20 bp, mouse
gtgcgggaggacggacggga

SEQ ID NO: 762045 - DNA, 20 bp, mouse
ggaagggagcggcggcaact

SEQ ID NO: 762046 - DNA, 20 bp, mouse
gcaggcgagtggttgtcggg

SEQ ID NO: 762047 - DNA, 20 bp, mouse
gcgggacatcctgaaataat

SEQ ID NO: 762048 - DNA, 20 bp, mouse
ggcgcaggcgagtggttgtc

SEQ ID NO: 762049 - DNA, 20 bp, mouse
ggggcgacctgacactcacc

SEQ ID NO: 762050 - DNA, 20 bp, mouse
gactcctccaggtgagtgtc

SEQ ID NO: 762051 - DNA, 20 bp, mouse
gcgacctgacactcacctgg

SEQ ID NO: 762052 - DNA, 20 bp, mouse
gaagcctctgcgcaggcgag

SEQ ID NO: 762053 - DNA, 20 bp, mouse
gcagagccctgacacgtctc

SEQ ID NO: 762054 - DNA, 20 bp, mouse
gcaaccactcgcctgcgcag

SEQ ID NO: 762055 - DNA, 20 bp, mouse
gaagctcgcttgaagcgtag

SEQ ID NO: 762056 - DNA, 20 bp, mouse
ggcacgggcggatgactcgg

SEQ ID NO: 762057 - DNA, 20 bp, mouse
gcgatggggaatcaactctg

SEQ ID NO: 762058 - DNA, 20 bp, mouse
gccgaaggggagggtcctcg

SEQ ID NO: 762059 - DNA, 20 bp, mouse
gctgcggtcgcaccccagaa

SEQ ID NO: 762060 - DNA, 20 bp, mouse
ggggaatcaactctggggca

SEQ ID NO: 762061 - DNA, 20 bp, mouse
ggagtcatccgcccgtgcca

SEQ ID NO: 762062 - DNA, 20 bp, mouse
gtagcagagttgatacactc

SEQ ID NO: 762063 - DNA, 20 bp, mouse
gaaggggagggtcctcgggg

SEQ ID NO: 762064 - DNA, 20 bp, mouse
ggcaggggctcatgcccttc

SEQ ID NO: 762065 - DNA, 20 bp, mouse
gcctgtgccttgggcaacac

SEQ ID NO: 762066 - DNA, 20 bp, mouse
gtcagcgcgccggctcccgc

SEQ ID NO: 762067 - DNA, 20 bp, mouse
gcggcggcggaagtggagta

SEQ ID NO: 762068 - DNA, 20 bp, mouse
gaccccacgggcagcatcca

SEQ ID NO: 762069 - DNA, 20 bp, mouse
ggcagagctgcgagcccgag

SEQ ID NO: 762070 - DNA, 20 bp, mouse
ggagctgcgagcccgagtgg

SEQ ID NO: 762071 - DNA, 20 bp, mouse
gcgtccgttgcacaggacaa

SEQ ID NO: 762072 - DNA, 20 bp, mouse
gaagccggtcacccgagcaa

SEQ ID NO: 762073 - DNA, 20 bp, mouse
ggcccggagcgcctgagaag

SEQ ID NO: 762074 - DNA, 20 bp, mouse
gcagctctgcctcagcgcgc

SEQ ID NO: 762075 - DNA, 20 bp, mouse
ggcccggggccggccagtca

SEQ ID NO: 762076 - DNA, 20 bp, mouse
gttcaagagctcggaggtgt

SEQ ID NO: 762077 - DNA, 20 bp, mouse
ggagctcggaggtgtgggta

SEQ ID NO: 762078 - DNA, 20 bp, mouse
ggactgtgcaactgtagagt

SEQ ID NO: 762079 - DNA, 20 bp, mouse
gaattcatctcgataatcgc

SEQ ID NO: 762080 - DNA, 20 bp, mouse
gcagagtttcaagagctcgg

SEQ ID NO: 762081 - DNA, 20 bp, mouse
gattatcgagatgaattccc

SEQ ID NO: 762082 - DNA, 20 bp, mouse
gatgaattcccaggtacaga

SEQ ID NO: 762083 - DNA, 20 bp, mouse
gcacgcctcagcccagtggc

SEQ ID NO: 762084 - DNA, 20 bp, mouse
gctgcagagtttcaagagct

SEQ ID NO: 762085 - DNA, 20 bp, mouse
gccacctgcttgtgtttgaa

SEQ ID NO: 762086 - DNA, 20 bp, mouse
gaaaaccagcccctcaagtg

SEQ ID NO: 762087 - DNA, 20 bp, mouse
gcctcaagtggggcaccgaa

SEQ ID NO: 762088 - DNA, 20 bp, mouse
gtggacacggctgctgtccc

SEQ ID NO: 762089 - DNA, 20 bp, mouse
gcaggcagggtttgaatggt

SEQ ID NO: 762090 - DNA, 20 bp, mouse
ggtagtaacatgcagaaaag

SEQ ID NO: 762091 - DNA, 20 bp, mouse
gtaggacttcaatgctggag

SEQ ID NO: 762092 - DNA, 20 bp, mouse
gggccaagataaatatccag

SEQ ID NO: 762093 - DNA, 20 bp, mouse
gagctctggagcaaaggtct

SEQ ID NO: 762094 - DNA, 20 bp, mouse
gacacggctgctgtcccagg

SEQ ID NO: 762095 - DNA, 20 bp, mouse
ggagcctaggacttcaatgc

SEQ ID NO: 762096 - DNA, 20 bp, mouse
gtgctctgtgatgaaggcga

SEQ ID NO: 762097 - DNA, 20 bp, mouse
gtcccccgtcccgccctgtc

SEQ ID NO: 762098 - DNA, 20 bp, mouse
gcacgcctcgcccagcattt

SEQ ID NO: 762099 - DNA, 20 bp, mouse
gaggaagggggagcgtaaag

SEQ ID NO: 762100 - DNA, 20 bp, mouse
gtgtcctgacagggcgggac

SEQ ID NO: 762101 - DNA, 20 bp, mouse
gtagaactgcaccaagctca

SEQ ID NO: 762102 - DNA, 20 bp, mouse
gtggtgcagttctacattct

SEQ ID NO: 762103 - DNA, 20 bp, mouse
gggatcttgtgatactgctc

SEQ ID NO: 762104 - DNA, 20 bp, mouse
gggaatgttattgtcctgac

SEQ ID NO: 762105 - DNA, 20 bp, mouse
gctaacagggacataaccat

SEQ ID NO: 762106 - DNA, 20 bp, mouse
gtggactgggcgtggctcgg

SEQ ID NO: 762107 - DNA, 20 bp, mouse
ggaggtaatgccccgggatg

SEQ ID NO: 762108 - DNA, 20 bp, mouse
ggagccacgcccagtccagc

SEQ ID NO: 762109 - DNA, 20 bp, mouse
ggtggcgtggatgcttcttg

SEQ ID NO: 762110 - DNA, 20 bp, mouse
gcacgccacgccctacattc

SEQ ID NO: 762111 - DNA, 20 bp, mouse
ggggatggggaacagaaccg

SEQ ID NO: 762112 - DNA, 20 bp, mouse
gccttccccgcaggcgcaag

SEQ ID NO: 762113 - DNA, 20 bp, mouse
gtacagaagaggtaatgccc

SEQ ID NO: 762114 - DNA, 20 bp, mouse
gtctaacactccagaatgta

SEQ ID NO: 762115 - DNA, 20 bp, mouse
gcgtggatgcttcttggggt

SEQ ID NO: 762116 - DNA, 20 bp, mouse
gaggggacagaacgccgcac

SEQ ID NO: 762117 - DNA, 20 bp, mouse
gaatgaccacaactgcccga

SEQ ID NO: 762118 - DNA, 20 bp, mouse
gcgcgcccgcgacgccatct

SEQ ID NO: 762119 - DNA, 20 bp, mouse
ggcggggcgaggacgcaagc

SEQ ID NO: 762120 - DNA, 20 bp, mouse
gtccagaggggacattaata

SEQ ID NO: 762121 - DNA, 20 bp, mouse
gaagcgaagcagagtgactt

SEQ ID NO: 762122 - DNA, 20 bp, mouse
gcaattacgggcaaggggcg

SEQ ID NO: 762123 - DNA, 20 bp, mouse
gtgacttcggagagttccga

SEQ ID NO: 762124 - DNA, 20 bp, mouse
gacgcatgcgcagctcctgc

SEQ ID NO: 762125 - DNA, 20 bp, mouse
ggcaaattgggcaagcccgc

SEQ ID NO: 762126 - DNA, 20 bp, mouse
ggcgcacaaggcacccgggg

SEQ ID NO: 762127 - DNA, 20 bp, mouse
ggtcgtgtgggcaagagcgg

SEQ ID NO: 762128 - DNA, 20 bp, mouse
gggcacgcacgggggagagg

SEQ ID NO: 762129 - DNA, 20 bp, mouse
gggtgtcggcggaacaggtg

SEQ ID NO: 762130 - DNA, 20 bp, mouse
ggcgggagcggcgcggggaa

SEQ ID NO: 762131 - DNA, 20 bp, mouse
gggggcggtgtcggcggaac

SEQ ID NO: 762132 - DNA, 20 bp, mouse
gcgcgagcgcacaaggcacc

SEQ ID NO: 762133 - DNA, 20 bp, mouse
gggtgtgggtgggtagtcaa

SEQ ID NO: 762134 - DNA, 20 bp, mouse
ggcggacagcagcggtcgtg

SEQ ID NO: 762135 - DNA, 20 bp, mouse
ggggcctttagtcctttcca

SEQ ID NO: 762136 - DNA, 20 bp, mouse
gtgaatgtgcacaaagtcgg

SEQ ID NO: 762137 - DNA, 20 bp, mouse
ggcagaaggggcgtggtcaa

SEQ ID NO: 762138 - DNA, 20 bp, mouse
gcccaggcaagaatgtagac

SEQ ID NO: 762139 - DNA, 20 bp, mouse
gtggtcaagggctgggtcga

SEQ ID NO: 762140 - DNA, 20 bp, mouse
ggggtgagccatttttagta

SEQ ID NO: 762141 - DNA, 20 bp, mouse
gttggtgtatgcaaccgcaa

SEQ ID NO: 762142 - DNA, 20 bp, mouse
gttgtgctgtgctgtaatgt

SEQ ID NO: 762143 - DNA, 20 bp, mouse
gctccgcagcgtgcagaagg

SEQ ID NO: 762144 - DNA, 20 bp, mouse
gccgagccgcgcgcgcagaa

SEQ ID NO: 762145 - DNA, 20 bp, mouse
ggtgtgccataaatggtctg

SEQ ID NO: 762146 - DNA, 20 bp, mouse
ggggaggggcggaagagcga

SEQ ID NO: 762147 - DNA, 20 bp, mouse
gggaggggcgtggagcgaag

SEQ ID NO: 762148 - DNA, 20 bp, mouse
gcggctaaggaacagcagtc

SEQ ID NO: 762149 - DNA, 20 bp, mouse
ggcccaaggtgacacggcta

SEQ ID NO: 762150 - DNA, 20 bp, mouse
ggctcggccgccaccccgga

SEQ ID NO: 762151 - DNA, 20 bp, mouse
gcctgcgcgctggcagctct

SEQ ID NO: 762152 - DNA, 20 bp, mouse
ggagcgaagtggaagagtgc

SEQ ID NO: 762153 - DNA, 20 bp, mouse
gccctcagctggccaagcta

SEQ ID NO: 762154 - DNA, 20 bp, mouse
gggcggccgagccacgtggt

SEQ ID NO: 762155 - DNA, 20 bp, mouse
gcccggagggaggcgaggga

SEQ ID NO: 762156 - DNA, 20 bp, mouse
gaccacgcccgcaacggcca

SEQ ID NO: 762157 - DNA, 20 bp, mouse
gacaacgcgagggatcgggt

SEQ ID NO: 762158 - DNA, 20 bp, mouse
gagcccgcgcacccgtgcgt

SEQ ID NO: 762159 - DNA, 20 bp, mouse
gggtgcgcgggctcccgggg

SEQ ID NO: 762160 - DNA, 20 bp, mouse
ggactgcgggaacaacgcga

SEQ ID NO: 762161 - DNA, 20 bp, mouse
ggatccgctcatctaggcaa

SEQ ID NO: 762162 - DNA, 20 bp, mouse
gaacaacttctcagaggtcg

SEQ ID NO: 762163 - DNA, 20 bp, mouse
ggggcccgggcgcgtctcct

SEQ ID NO: 762164 - DNA, 20 bp, mouse
gcgggaacaacgcgagggat

SEQ ID NO: 762165 - DNA, 20 bp, mouse
gcagcagccctggccgttgc

SEQ ID NO: 762166 - DNA, 20 bp, mouse
gggtgtctggaaagtgcggt

SEQ ID NO: 762167 - DNA, 20 bp, mouse
gaaagagagcgcctctgggg

SEQ ID NO: 762168 - DNA, 20 bp, mouse
gtacctctccagggcagcgt

SEQ ID NO: 762169 - DNA, 20 bp, mouse
gaaagtgcggtgggctgtct

SEQ ID NO: 762170 - DNA, 20 bp, mouse
gggtgggtgtctggaaagtg

SEQ ID NO: 762171 - DNA, 20 bp, mouse
gtacccacgctgccctggag

SEQ ID NO: 762172 - DNA, 20 bp, mouse
gagtgggtgaatgtctttta

SEQ ID NO: 762173 - DNA, 20 bp, mouse
ggggtcggcttcttgaggag

SEQ ID NO: 762174 - DNA, 20 bp, mouse
gagcctaggcttcaaatccc

SEQ ID NO: 762175 - DNA, 20 bp, mouse
gttaggggaggggagtatgc

SEQ ID NO: 762176 - DNA, 20 bp, mouse
gctaaagagcctgtgggcag

SEQ ID NO: 762177 - DNA, 20 bp, mouse
gggatctgcaagctggaagg

SEQ ID NO: 762178 - DNA, 20 bp, mouse
gggggcaggatctaagagga

SEQ ID NO: 762179 - DNA, 20 bp, mouse
ggcagcgcagggctgaatag

SEQ ID NO: 762180 - DNA, 20 bp, mouse
ggggtcccgcgcctcctctc

SEQ ID NO: 762181 - DNA, 20 bp, mouse
gggaaggaggcggtgttttc

SEQ ID NO: 762182 - DNA, 20 bp, mouse
gcccgaggcaagatcccgtt

SEQ ID NO: 762183 - DNA, 20 bp, mouse
gaatgcggggcggaggaatg

SEQ ID NO: 762184 - DNA, 20 bp, mouse
gggtctgctaggtttacccg

SEQ ID NO: 762185 - DNA, 20 bp, mouse
gaggcaagatcccgttgggg

SEQ ID NO: 762186 - DNA, 20 bp, mouse
gtccttgccgccaacaggaa

SEQ ID NO: 762187 - DNA, 20 bp, mouse
gtcgtcccacactaaataaa

SEQ ID NO: 762188 - DNA, 20 bp, mouse
gcaggcatccagtgcggttt

SEQ ID NO: 762189 - DNA, 20 bp, mouse
gtcatacgcgcacactatac

SEQ ID NO: 762190 - DNA, 20 bp, mouse
gtgttggcggcaaggactct

SEQ ID NO: 762191 - DNA, 20 bp, mouse
gctggccggcttctatatag

SEQ ID NO: 762192 - DNA, 20 bp, mouse
gtctgaaacctaaaccgcac

SEQ ID NO: 762193 - DNA, 20 bp, mouse
ggtagcctcagtttcctggc

SEQ ID NO: 762194 - DNA, 20 bp, mouse
gtatgatggactagttgaag

SEQ ID NO: 762195 - DNA, 20 bp, mouse
gttcatcgcaatgttctttc

SEQ ID NO: 762196 - DNA, 20 bp, mouse
ggcagccctagtccgaaccg

SEQ ID NO: 762197 - DNA, 20 bp, mouse
gcaggcgcactagagacggg

SEQ ID NO: 762198 - DNA, 20 bp, mouse
gtcccctggggctcaaggtg

SEQ ID NO: 762199 - DNA, 20 bp, mouse
gcacgccccagaggttgaag

SEQ ID NO: 762200 - DNA, 20 bp, mouse
gtgtaggcgggtcaattccg

SEQ ID NO: 762201 - DNA, 20 bp, mouse
gagggctcttgcgcaggctc

SEQ ID NO: 762202 - DNA, 20 bp, mouse
ggctgcaccgggctacgccc

SEQ ID NO: 762203 - DNA, 20 bp, mouse
gttgaagagggctcttgcgc

SEQ ID NO: 762204 - DNA, 20 bp, mouse
gcagcgccacggttcggact

SEQ ID NO: 762205 - DNA, 20 bp, mouse
gtgcttcccgcttccatcgg

SEQ ID NO: 762206 - DNA, 20 bp, mouse
ggaggggtggagcctcgatg

SEQ ID NO: 762207 - DNA, 20 bp, mouse
ggaggcggggcctgcgggta

SEQ ID NO: 762208 - DNA, 20 bp, mouse
ggtggagcctcgatggggag

SEQ ID NO: 762209 - DNA, 20 bp, mouse
gcgaacctcggggcctgagt

SEQ ID NO: 762210 - DNA, 20 bp, mouse
ggccccgaggttcgcacggg

SEQ ID NO: 762211 - DNA, 20 bp, mouse
gcgatgggcgggaccacaga

SEQ ID NO: 762212 - DNA, 20 bp, mouse
gcgggtaggggctggccgat

SEQ ID NO: 762213 - DNA, 20 bp, mouse
ggccggcagcggcccatcaa

SEQ ID NO: 762214 - DNA, 20 bp, mouse
gcaggccccgaggttcgcac

SEQ ID NO: 762215 - DNA, 20 bp, mouse
gaaaggcgaggcggacgcgg

SEQ ID NO: 762216 - DNA, 20 bp, mouse
gtaagctctgtctgccctca

SEQ ID NO: 762217 - DNA, 20 bp, mouse
gcgcgacggggctttaacag

SEQ ID NO: 762218 - DNA, 20 bp, mouse
ggccgcggaccgtagcgcag

SEQ ID NO: 762219 - DNA, 20 bp, mouse
gagcgcgcgcgcccgcgacg

SEQ ID NO: 762220 - DNA, 20 bp, mouse
gtcaagaaaaagattggtga

SEQ ID NO: 762221 - DNA, 20 bp, mouse
gctcgcacagggcatccctg

SEQ ID NO: 762222 - DNA, 20 bp, mouse
gtccactgcgctacggtccg

SEQ ID NO: 762223 - DNA, 20 bp, mouse
gtaagactttactagacagg

SEQ ID NO: 762224 - DNA, 20 bp, mouse
gacagccaaaggtatcaaga

SEQ ID NO: 762225 - DNA, 20 bp, mouse
gtagggtaaaggagacgcta

SEQ ID NO: 762226 - DNA, 20 bp, mouse
ggggcccacccctaccacat

SEQ ID NO: 762227 - DNA, 20 bp, mouse
gaggtgggctaatcatacta

SEQ ID NO: 762228 - DNA, 20 bp, mouse
gcccacccctaccacatagg

SEQ ID NO: 762229 - DNA, 20 bp, mouse
gaggggaggccaaaccactc

SEQ ID NO: 762230 - DNA, 20 bp, mouse
ggggtgtgaattaactgaaa

SEQ ID NO: 762231 - DNA, 20 bp, mouse
gtatctgcgtgatgaggatg

SEQ ID NO: 762232 - DNA, 20 bp, mouse
gggagaggagccaatcgaag

SEQ ID NO: 762233 - DNA, 20 bp, mouse
gaggccaaaccactcaggaa

SEQ ID NO: 762234 - DNA, 20 bp, mouse
gtgagggggtgcccagaggt

SEQ ID NO: 762235 - DNA, 20 bp, mouse
gaagaaggacttgagtcggt

SEQ ID NO: 762236 - DNA, 20 bp, mouse
gtcccgacatccaacctggt

SEQ ID NO: 762237 - DNA, 20 bp, mouse
gccaccggaaggagggtcgc

SEQ ID NO: 762238 - DNA, 20 bp, mouse
gggagagcatccggaagcgg

SEQ ID NO: 762239 - DNA, 20 bp, mouse
gcagccatcaggtagggcgg

SEQ ID NO: 762240 - DNA, 20 bp, mouse
gtgggacagcccgccgcttc

SEQ ID NO: 762241 - DNA, 20 bp, mouse
ggctacaatgccccaccgga

SEQ ID NO: 762242 - DNA, 20 bp, mouse
gtagccgcactgtgcctctt

SEQ ID NO: 762243 - DNA, 20 bp, mouse
ggtagtcccgacatccaacc

SEQ ID NO: 762244 - DNA, 20 bp, mouse
gagccccaagaggcacagtg

SEQ ID NO: 762245 - DNA, 20 bp, mouse
gtggcggcagccatcaggta

SEQ ID NO: 762246 - DNA, 20 bp, mouse
ggcacagcgcccccagaggc

SEQ ID NO: 762247 - DNA, 20 bp, mouse
gaggaagagggccgtcttta

SEQ ID NO: 762248 - DNA, 20 bp, mouse
gcggcggcgtaaagtgagcg

SEQ ID NO: 762249 - DNA, 20 bp, mouse
gacccaccagaacttgtgtc

SEQ ID NO: 762250 - DNA, 20 bp, mouse
ggatcgcacagcgcccccag

SEQ ID NO: 762251 - DNA, 20 bp, mouse
gaagacggccctcttcctct

SEQ ID NO: 762252 - DNA, 20 bp, mouse
ggttattaagccgatgttcc

SEQ ID NO: 762253 - DNA, 20 bp, mouse
gccgccggaagttgtcttga

SEQ ID NO: 762254 - DNA, 20 bp, mouse
gaccagacacaagttctggt

SEQ ID NO: 762255 - DNA, 20 bp, mouse
gagcgcccccagaggccggc

SEQ ID NO: 762256 - DNA, 20 bp, mouse
gtggtggtggggtgttcctt

SEQ ID NO: 762257 - DNA, 20 bp, mouse
gcggggagtgcagaggttgt

SEQ ID NO: 762258 - DNA, 20 bp, mouse
gggggggcagcgtgtgttac

SEQ ID NO: 762259 - DNA, 20 bp, mouse
gagatggctgggagatactg

SEQ ID NO: 762260 - DNA, 20 bp, mouse
gagatactgtggggctaggc

SEQ ID NO: 762261 - DNA, 20 bp, mouse
gggcccccgtaaccttggac

SEQ ID NO: 762262 - DNA, 20 bp, mouse
gaagacaatggccagatggc

SEQ ID NO: 762263 - DNA, 20 bp, mouse
gacagaagtgagaagtggca

SEQ ID NO: 762264 - DNA, 20 bp, mouse
gagctaggctgaagtctaag

SEQ ID NO: 762265 - DNA, 20 bp, mouse
gtggctccctagttctaaga

SEQ ID NO: 762266 - DNA, 20 bp, mouse
gtgtgtgtgagggacgctca

SEQ ID NO: 762267 - DNA, 20 bp, mouse
gtggccgggggcaagcgagg

SEQ ID NO: 762268 - DNA, 20 bp, mouse
gaagagtgacgtcagaggaa

SEQ ID NO: 762269 - DNA, 20 bp, mouse
gtcagagtggggacggcccc

SEQ ID NO: 762270 - DNA, 20 bp, mouse
gacgctcagggctgagactg

SEQ ID NO: 762271 - DNA, 20 bp, mouse
ggggtggcacgcggggaggt

SEQ ID NO: 762272 - DNA, 20 bp, mouse
gggtccgcagaggtgctgtg

SEQ ID NO: 762273 - DNA, 20 bp, mouse
gttgcccccggccagttggt

SEQ ID NO: 762274 - DNA, 20 bp, mouse
gcactctgaagcagagaaga

SEQ ID NO: 762275 - DNA, 20 bp, mouse
gcgcacggctccaactaatg

SEQ ID NO: 762276 - DNA, 20 bp, mouse
gcggggtgtggggtcggagt

SEQ ID NO: 762277 - DNA, 20 bp, mouse
gcgcactcgggattggacag

SEQ ID NO: 762278 - DNA, 20 bp, mouse
gacaggggatcctgaggggc

SEQ ID NO: 762279 - DNA, 20 bp, mouse
ggtgctgcatgagtgagccg

SEQ ID NO: 762280 - DNA, 20 bp, mouse
gcgcacacgtctgcgcactc

SEQ ID NO: 762281 - DNA, 20 bp, mouse
gattggacaggggatcctga

SEQ ID NO: 762282 - DNA, 20 bp, mouse
ggggcccggcccgcctgaca

SEQ ID NO: 762283 - DNA, 20 bp, mouse
gtggccagtggatgaacgca

SEQ ID NO: 762284 - DNA, 20 bp, mouse
gtcgccggctggccctcacg

SEQ ID NO: 762285 - DNA, 20 bp, mouse
ggggtggggcggcctctcgt

SEQ ID NO: 762286 - DNA, 20 bp, mouse
gggctgcgaacggtcccaag

SEQ ID NO: 762287 - DNA, 20 bp, mouse
gtaggcgtgagcgctaacga

SEQ ID NO: 762288 - DNA, 20 bp, mouse
ggggcccggtacgggactca

SEQ ID NO: 762289 - DNA, 20 bp, mouse
gtgcccgcctccttggcgaa

SEQ ID NO: 762290 - DNA, 20 bp, mouse
gggagtaggcgggcccggta

SEQ ID NO: 762291 - DNA, 20 bp, mouse
gggtcccaagcggagtaggc

SEQ ID NO: 762292 - DNA, 20 bp, mouse
gggaccgttcgcagccaatt

SEQ ID NO: 762293 - DNA, 20 bp, mouse
gagtccgtgagtcccgtacc

SEQ ID NO: 762294 - DNA, 20 bp, mouse
ggaacggtcccaagcggagt

SEQ ID NO: 762295 - DNA, 20 bp, mouse
gtgagcgctaacgagggaag

SEQ ID NO: 762296 - DNA, 20 bp, mouse
ggcccaggatagtctcgtgg

SEQ ID NO: 762297 - DNA, 20 bp, mouse
ggggagggagcgctgactag

SEQ ID NO: 762298 - DNA, 20 bp, mouse
gagactcgtgaagggcgtga

SEQ ID NO: 762299 - DNA, 20 bp, mouse
gtatcctgggcagccggagg

SEQ ID NO: 762300 - DNA, 20 bp, mouse
ggcctccacgagactatcct

SEQ ID NO: 762301 - DNA, 20 bp, mouse
gactgcacgtggaaggggtc

SEQ ID NO: 762302 - DNA, 20 bp, mouse
gagcgcgcattggcgcgcga

SEQ ID NO: 762303 - DNA, 20 bp, mouse
gagcgctcactgcacgtgga

SEQ ID NO: 762304 - DNA, 20 bp, mouse
gccacggtgacccggcgaac

SEQ ID NO: 762305 - DNA, 20 bp, mouse
gtgctgcggagactcgtgaa

SEQ ID NO: 762306 - DNA, 20 bp, mouse
gttgttggatgtacacgtaa

SEQ ID NO: 762307 - DNA, 20 bp, mouse
gcctccactcaagccaatta

SEQ ID NO: 762308 - DNA, 20 bp, mouse
gggaccgagtccgccttaat

SEQ ID NO: 762309 - DNA, 20 bp, mouse
gaagccaattaaggcggact

SEQ ID NO: 762310 - DNA, 20 bp, mouse
gccactcaagccaattaagg

SEQ ID NO: 762311 - DNA, 20 bp, mouse
gtagcccggcgccaggtttt

SEQ ID NO: 762312 - DNA, 20 bp, mouse
gtttaggcagccaccagagg

SEQ ID NO: 762313 - DNA, 20 bp, mouse
gagcttacatgctgatgaca

SEQ ID NO: 762314 - DNA, 20 bp, mouse
gccgggctaaaacaaacgcg

SEQ ID NO: 762315 - DNA, 20 bp, mouse
gtggcttgagtggaggctcg

SEQ ID NO: 762316 - DNA, 20 bp, mouse
gcacacgtggccaacctttg

SEQ ID NO: 762317 - DNA, 20 bp, mouse
gccctccccaggttcgtgag

SEQ ID NO: 762318 - DNA, 20 bp, mouse
gaaggttggccacgtgtggg

SEQ ID NO: 762319 - DNA, 20 bp, mouse
gggctccactcacgaacctg

SEQ ID NO: 762320 - DNA, 20 bp, mouse
gccacgtgtgggcgggtctt

SEQ ID NO: 762321 - DNA, 20 bp, mouse
ggcgggtcttgggagtcaag

SEQ ID NO: 762322 - DNA, 20 bp, mouse
gacattaaaaccgcaaaggt

SEQ ID NO: 762323 - DNA, 20 bp, mouse
gagagacattaaaaccgcaa

SEQ ID NO: 762324 - DNA, 20 bp, mouse
gtccactcacgaacctgggg

SEQ ID NO: 762325 - DNA, 20 bp, mouse
gtcttgctctagagggctgt

SEQ ID NO: 762326 - DNA, 20 bp, mouse
gggtcagcagggctcgacgt

SEQ ID NO: 762327 - DNA, 20 bp, mouse
gcggggctcgagggtcagca

SEQ ID NO: 762328 - DNA, 20 bp, mouse
gcgggaacacctggagtctg

SEQ ID NO: 762329 - DNA, 20 bp, mouse
gaggcctgcggcagggggaa

SEQ ID NO: 762330 - DNA, 20 bp, mouse
gccacacctgacagcacgtg

SEQ ID NO: 762331 - DNA, 20 bp, mouse
gcagcagggctcgacgtggg

SEQ ID NO: 762332 - DNA, 20 bp, mouse
ggggaaggaggcctcgagaa

SEQ ID NO: 762333 - DNA, 20 bp, mouse
gccgctcctgcccacggagc

SEQ ID NO: 762334 - DNA, 20 bp, mouse
ggggtcgccgagctgttcag

SEQ ID NO: 762335 - DNA, 20 bp, mouse
ggggggggggaactccagca

SEQ ID NO: 762336 - DNA, 20 bp, mouse
ggggccctgcgtcacgtcaa

SEQ ID NO: 762337 - DNA, 20 bp, mouse
gactgcaaggactggggccg

SEQ ID NO: 762338 - DNA, 20 bp, mouse
gcccactgggtggacgcaga

SEQ ID NO: 762339 - DNA, 20 bp, mouse
gagcgcagcaacatcccact

SEQ ID NO: 762340 - DNA, 20 bp, mouse
gtgggtggacgcagagggcg

SEQ ID NO: 762341 - DNA, 20 bp, mouse
gccaccgcgacttggatctc

SEQ ID NO: 762342 - DNA, 20 bp, mouse
ggcgctaccagaaatagaca

SEQ ID NO: 762343 - DNA, 20 bp, mouse
gatagacagggactagaata

SEQ ID NO: 762344 - DNA, 20 bp, mouse
ggggaaaagctgcaaaaaac

SEQ ID NO: 762345 - DNA, 20 bp, mouse
gacccccaggtcccggccaa

SEQ ID NO: 762346 - DNA, 20 bp, mouse
ggcgaaggatggagctagaa

SEQ ID NO: 762347 - DNA, 20 bp, mouse
gaacccggatagaagcgcga

SEQ ID NO: 762348 - DNA, 20 bp, mouse
gaagttcagtagaacgtcga

SEQ ID NO: 762349 - DNA, 20 bp, mouse
gcggatagaagcgcgaagga

SEQ ID NO: 762350 - DNA, 20 bp, mouse
gccccgagctgcgggatctc

SEQ ID NO: 762351 - DNA, 20 bp, mouse
ggaggggctgatagctagaa

SEQ ID NO: 762352 - DNA, 20 bp, mouse
gccccccttccagataacgg

SEQ ID NO: 762353 - DNA, 20 bp, mouse
gttgcctccgttatctggaa

SEQ ID NO: 762354 - DNA, 20 bp, mouse
gtcaccccccttccagataa

SEQ ID NO: 762355 - DNA, 20 bp, mouse
gtcagtagaacgtcgagggg

SEQ ID NO: 762356 - DNA, 20 bp, mouse
gagtctaaacgcagggttgg

SEQ ID NO: 762357 - DNA, 20 bp, mouse
gaggcccctggcccaatggc

SEQ ID NO: 762358 - DNA, 20 bp, mouse
ggcctggatgacaggagcga

SEQ ID NO: 762359 - DNA, 20 bp, mouse
ggcgggagcaggctggagta

SEQ ID NO: 762360 - DNA, 20 bp, mouse
gaacccagaggggccccaag

SEQ ID NO: 762361 - DNA, 20 bp, mouse
gcagcctgccattgggccag

SEQ ID NO: 762362 - DNA, 20 bp, mouse
gaggtagcgcggagcaccag

SEQ ID NO: 762363 - DNA, 20 bp, mouse
ggtgtcctgtatcactaaat

SEQ ID NO: 762364 - DNA, 20 bp, mouse
gaaggggccgcgacacattt

SEQ ID NO: 762365 - DNA, 20 bp, mouse
ggtgtctggctgggattttc

SEQ ID NO: 762366 - DNA, 20 bp, mouse
gtcagctaccgagaaagggg

SEQ ID NO: 762367 - DNA, 20 bp, mouse
ggggcggagctggcaagttc

SEQ ID NO: 762368 - DNA, 20 bp, mouse
gagaaaggggtggaggccac

SEQ ID NO: 762369 - DNA, 20 bp, mouse
ggcatctcgtagccgagggg

SEQ ID NO: 762370 - DNA, 20 bp, mouse
gaggactgccactacagaag

SEQ ID NO: 762371 - DNA, 20 bp, mouse
gggggtgcgacacctggctg

SEQ ID NO: 762372 - DNA, 20 bp, mouse
gacagcatctcgtagccgag

SEQ ID NO: 762373 - DNA, 20 bp, mouse
gaatgtcagctaccgagaaa

SEQ ID NO: 762374 - DNA, 20 bp, mouse
gaccgcgccttcccttgact

SEQ ID NO: 762375 - DNA, 20 bp, mouse
gtcaagggaaggcgcggtcc

SEQ ID NO: 762376 - DNA, 20 bp, mouse
gaaagtggggacagataatg

SEQ ID NO: 762377 - DNA, 20 bp, mouse
gtgtctgattagaccaaagt

SEQ ID NO: 762378 - DNA, 20 bp, mouse
gactacctcccagaggtcgc

SEQ ID NO: 762379 - DNA, 20 bp, mouse
gaagctggggctcagttggg

SEQ ID NO: 762380 - DNA, 20 bp, mouse
gtaccagtgaataacatctt

SEQ ID NO: 762381 - DNA, 20 bp, mouse
gaggtcgcaggaagctggcc

SEQ ID NO: 762382 - DNA, 20 bp, mouse
gcacccaagatgttattcac

SEQ ID NO: 762383 - DNA, 20 bp, mouse
ggcaccttccggacttgccc

SEQ ID NO: 762384 - DNA, 20 bp, mouse
gtcaggctgacgtggggcct

SEQ ID NO: 762385 - DNA, 20 bp, mouse
gtggtctttccagatgtcta

SEQ ID NO: 762386 - DNA, 20 bp, mouse
gggctccaggtgaccctcaa

SEQ ID NO: 762387 - DNA, 20 bp, mouse
gccctcaaggggcgagtcct

SEQ ID NO: 762388 - DNA, 20 bp, mouse
ggttaagggctcatcaggga

SEQ ID NO: 762389 - DNA, 20 bp, mouse
ggacacggctgctccccgat

SEQ ID NO: 762390 - DNA, 20 bp, mouse
gtcaaggggcgagtcctggg

SEQ ID NO: 762391 - DNA, 20 bp, mouse
gtctggcaaagggcttgaga

SEQ ID NO: 762392 - DNA, 20 bp, mouse
gggcgagtcctgggcggatt

SEQ ID NO: 762393 - DNA, 20 bp, mouse
gggcccggtgatagcaaaag

SEQ ID NO: 762394 - DNA, 20 bp, mouse
ggaaaggttaagggctcatc

SEQ ID NO: 762395 - DNA, 20 bp, mouse
gttgtggcttctctggcaaa

SEQ ID NO: 762396 - DNA, 20 bp, mouse
gtcctgggctctcccggcag

SEQ ID NO: 762397 - DNA, 20 bp, mouse
gcagttgagtagcaaaagac

SEQ ID NO: 762398 - DNA, 20 bp, mouse
gaaagtcaacggcctccagt

SEQ ID NO: 762399 - DNA, 20 bp, mouse
ggccctctggggaccggccc

SEQ ID NO: 762400 - DNA, 20 bp, mouse
ggcccaggacagctagtgaa

SEQ ID NO: 762401 - DNA, 20 bp, mouse
ggaccctcaccccacctcac

SEQ ID NO: 762402 - DNA, 20 bp, mouse
gaaccaggtttaggagggaa

SEQ ID NO: 762403 - DNA, 20 bp, mouse
gggccggcgagaattgtcaa

SEQ ID NO: 762404 - DNA, 20 bp, mouse
ggctactgagaaccaggttt

SEQ ID NO: 762405 - DNA, 20 bp, mouse
ggagcgaagccctacaggcc

SEQ ID NO: 762406 - DNA, 20 bp, mouse
gccccgccccagcttcactt

SEQ ID NO: 762407 - DNA, 20 bp, mouse
ggggcggagccaagagggga

SEQ ID NO: 762408 - DNA, 20 bp, mouse
gcgaggacgtcattccgggg

SEQ ID NO: 762409 - DNA, 20 bp, mouse
gtcccaggtgggcgtgttct

SEQ ID NO: 762410 - DNA, 20 bp, mouse
gaggtgtggcgctcccaggt

SEQ ID NO: 762411 - DNA, 20 bp, mouse
gggagcggggcccgggtcct

SEQ ID NO: 762412 - DNA, 20 bp, mouse
gggaggcggtgtttacgccc

SEQ ID NO: 762413 - DNA, 20 bp, mouse
ggcgtcccccagctaaagag

SEQ ID NO: 762414 - DNA, 20 bp, mouse
gcacttgggcggagccaaga

SEQ ID NO: 762415 - DNA, 20 bp, mouse
gtagctgggggacgcaaggg

SEQ ID NO: 762416 - DNA, 20 bp, mouse
gcggccatgcactccatgaa

SEQ ID NO: 762417 - DNA, 20 bp, mouse
gaagggcccattagcgaggc

SEQ ID NO: 762418 - DNA, 20 bp, mouse
ggggcccttcatggagtgca

SEQ ID NO: 762419 - DNA, 20 bp, mouse
gctcgctaatgggcccttca

SEQ ID NO: 762420 - DNA, 20 bp, mouse
gtctagggagataaatcagg

SEQ ID NO: 762421 - DNA, 20 bp, mouse
gaggcacctgcctcgctaat

SEQ ID NO: 762422 - DNA, 20 bp, mouse
ggcgccgctccgacctgccc

SEQ ID NO: 762423 - DNA, 20 bp, mouse
gcgggccggacgctggccaa

SEQ ID NO: 762424 - DNA, 20 bp, mouse
ggagatgaaataaatcccgt

SEQ ID NO: 762425 - DNA, 20 bp, mouse
gatactaagggcggcgggag

SEQ ID NO: 762426 - DNA, 20 bp, mouse
ggcgccctgagcctggtcac

SEQ ID NO: 762427 - DNA, 20 bp, mouse
gtagaatacagacctgagac

SEQ ID NO: 762428 - DNA, 20 bp, mouse
gggcgcctggaggtagggac

SEQ ID NO: 762429 - DNA, 20 bp, mouse
ggcgctgtgtcgccattggt

SEQ ID NO: 762430 - DNA, 20 bp, mouse
gagccaatgtgaggcccatg

SEQ ID NO: 762431 - DNA, 20 bp, mouse
gaggtgggcgcctggaggta

SEQ ID NO: 762432 - DNA, 20 bp, mouse
ggcaagcgctgtgtcgccat

SEQ ID NO: 762433 - DNA, 20 bp, mouse
ggagcctgtgaccaggctca

SEQ ID NO: 762434 - DNA, 20 bp, mouse
gcattggttggagaccacat

SEQ ID NO: 762435 - DNA, 20 bp, mouse
gagaaaaggtgggcgcctgg

SEQ ID NO: 762436 - DNA, 20 bp, mouse
gcccacgtggaggagaaccg

SEQ ID NO: 762437 - DNA, 20 bp, mouse
ggtaccgaggcccgagggga

SEQ ID NO: 762438 - DNA, 20 bp, mouse
ggactcctccgaacacgaga

SEQ ID NO: 762439 - DNA, 20 bp, mouse
gggagtcaagccgctctcgg

SEQ ID NO: 762440 - DNA, 20 bp, mouse
ggtggaggatgacacttcca

SEQ ID NO: 762441 - DNA, 20 bp, mouse
gaggccgggattgccaatgg

SEQ ID NO: 762442 - DNA, 20 bp, mouse
gcggaggccgggattgccaa

SEQ ID NO: 762443 - DNA, 20 bp, mouse
gtccacgtggggacgcagga

SEQ ID NO: 762444 - DNA, 20 bp, mouse
gcaatcccggcctccgagag

SEQ ID NO: 762445 - DNA, 20 bp, mouse
gaatcgctactgtgaaaaga

SEQ ID NO: 762446 - DNA, 20 bp, mouse
gctgtctgtgtgaaatcaat

SEQ ID NO: 762447 - DNA, 20 bp, mouse
ggggaaacagaatggtcaat

SEQ ID NO: 762448 - DNA, 20 bp, mouse
gagtagcaatgtggtaagag

SEQ ID NO: 762449 - DNA, 20 bp, mouse
gcttaccacattgctactat

SEQ ID NO: 762450 - DNA, 20 bp, mouse
gatagtgatgattgaagatg

SEQ ID NO: 762451 - DNA, 20 bp, mouse
gattaagagtggcgagagtc

SEQ ID NO: 762452 - DNA, 20 bp, mouse
gaagttactgagcaactccc

SEQ ID NO: 762453 - DNA, 20 bp, mouse
ggtttcccatagtagcaatg

SEQ ID NO: 762454 - DNA, 20 bp, mouse
gaatcaaatccaggtagcag

SEQ ID NO: 762455 - DNA, 20 bp, mouse
gtcaatcatcactattcatc

SEQ ID NO: 762456 - DNA, 20 bp, mouse
gcacccgccctctggagtgt

SEQ ID NO: 762457 - DNA, 20 bp, mouse
ggtgacgcgcggggctgctg

SEQ ID NO: 762458 - DNA, 20 bp, mouse
ggacgtagcgaactagagca

SEQ ID NO: 762459 - DNA, 20 bp, mouse
gccagagggtgggagatccg

SEQ ID NO: 762460 - DNA, 20 bp, mouse
gggcaggcgggtgcaagcga

SEQ ID NO: 762461 - DNA, 20 bp, mouse
ggggctctccgggtctagca

SEQ ID NO: 762462 - DNA, 20 bp, mouse
ggggcctctaggcacagagg

SEQ ID NO: 762463 - DNA, 20 bp, mouse
gtagacccggagagcccaga

SEQ ID NO: 762464 - DNA, 20 bp, mouse
gggggattgaagacagtgaa

SEQ ID NO: 762465 - DNA, 20 bp, mouse
gacccggagagcccagaggg

SEQ ID NO: 762466 - DNA, 20 bp, mouse
gatagcttggaatgtgaggg

SEQ ID NO: 762467 - DNA, 20 bp, mouse
gagagcttgcctgacgtggt

SEQ ID NO: 762468 - DNA, 20 bp, mouse
gcgcgtgcccggacacgggg

SEQ ID NO: 762469 - DNA, 20 bp, mouse
gagtgatggctcaagtcctg

SEQ ID NO: 762470 - DNA, 20 bp, mouse
ggctgcgcgtgcccggacac

SEQ ID NO: 762471 - DNA, 20 bp, mouse
ggagcagagcttgcctgacg

SEQ ID NO: 762472 - DNA, 20 bp, mouse
gcacacacacccaccacgtc

SEQ ID NO: 762473 - DNA, 20 bp, mouse
gacaaaaggagttaatgcca

SEQ ID NO: 762474 - DNA, 20 bp, mouse
ggctgtgcccgcgcaccaag

SEQ ID NO: 762475 - DNA, 20 bp, mouse
gctgatagcttggaatgtga

SEQ ID NO: 762476 - DNA, 20 bp, mouse
gtgtctgaagcttccggcca

SEQ ID NO: 762477 - DNA, 20 bp, mouse
ggaggcggacgcggacaggt

SEQ ID NO: 762478 - DNA, 20 bp, mouse
gcccgcccccggttcaggat

SEQ ID NO: 762479 - DNA, 20 bp, mouse
gcggacaggtgggcgtggat

SEQ ID NO: 762480 - DNA, 20 bp, mouse
gggtgggcgtggattggcta

SEQ ID NO: 762481 - DNA, 20 bp, mouse
ggcttccggccagggattgg

SEQ ID NO: 762482 - DNA, 20 bp, mouse
gtccccaggagacccacacc

SEQ ID NO: 762483 - DNA, 20 bp, mouse
ggaagcttccggccagggat

SEQ ID NO: 762484 - DNA, 20 bp, mouse
gaggcgcactggtcgaccag

SEQ ID NO: 762485 - DNA, 20 bp, mouse
ggaagagaaagcggtcacgg

SEQ ID NO: 762486 - DNA, 20 bp, mouse
ggggcggggcgatggactcg

SEQ ID NO: 762487 - DNA, 20 bp, mouse
gggcggagcagggcacggag

SEQ ID NO: 762488 - DNA, 20 bp, mouse
gcggctgctcgcaaggctct

SEQ ID NO: 762489 - DNA, 20 bp, mouse
gcggggcgatggactcgggg

SEQ ID NO: 762490 - DNA, 20 bp, mouse
gaggggcggggccacggcgt

SEQ ID NO: 762491 - DNA, 20 bp, mouse
gccgccccaggggcggagca

SEQ ID NO: 762492 - DNA, 20 bp, mouse
gtgggcctgcagcacgtggg

SEQ ID NO: 762493 - DNA, 20 bp, mouse
gggggccacggcgtaggcgt

SEQ ID NO: 762494 - DNA, 20 bp, mouse
gcggtgcaggcctccatctg

SEQ ID NO: 762495 - DNA, 20 bp, mouse
ggacggagccggatgcgggg

SEQ ID NO: 762496 - DNA, 20 bp, mouse
gggccccaggctcacctctt

SEQ ID NO: 762497 - DNA, 20 bp, mouse
gcaacataacttccctactc

SEQ ID NO: 762498 - DNA, 20 bp, mouse
gcataacttccctactctgg

SEQ ID NO: 762499 - DNA, 20 bp, mouse
gcacagcatgtgctcgggat

SEQ ID NO: 762500 - DNA, 20 bp, mouse
gtagacaggaaggaaggttg

SEQ ID NO: 762501 - DNA, 20 bp, mouse
gcagtgagctgcttggcccc

SEQ ID NO: 762502 - DNA, 20 bp, mouse
gtgctgagagatagtcagtg

SEQ ID NO: 762503 - DNA, 20 bp, mouse
ggaaccaaagaggtgagcct

SEQ ID NO: 762504 - DNA, 20 bp, mouse
gaggatgctcagtcccagaa

SEQ ID NO: 762505 - DNA, 20 bp, mouse
gggaatgcctgcatgcctcc

SEQ ID NO: 762506 - DNA, 20 bp, mouse
gactgagtagccaggaagta

SEQ ID NO: 762507 - DNA, 20 bp, mouse
gtggtaaagagttaacaact

SEQ ID NO: 762508 - DNA, 20 bp, mouse
gagcagcaactgttccatga

SEQ ID NO: 762509 - DNA, 20 bp, mouse
ggttcaaagtccctacttcc

SEQ ID NO: 762510 - DNA, 20 bp, mouse
gtaattacgtagcaagaaaa

SEQ ID NO: 762511 - DNA, 20 bp, mouse
ggtaaataccccgattatta

SEQ ID NO: 762512 - DNA, 20 bp, mouse
ggagaaagctttgaatgaca

SEQ ID NO: 762513 - DNA, 20 bp, mouse
ggactctttttacgtaccct

SEQ ID NO: 762514 - DNA, 20 bp, mouse
gcttaagaaccataataatc

SEQ ID NO: 762515 - DNA, 20 bp, mouse
gtgtttatttctccaagcaa

SEQ ID NO: 762516 - DNA, 20 bp, mouse
gaaggaaaacaggtgaactg

SEQ ID NO: 762517 - DNA, 20 bp, mouse
gagaagctggccgtgcagag

SEQ ID NO: 762518 - DNA, 20 bp, mouse
gggctggggtaagtggcctt

SEQ ID NO: 762519 - DNA, 20 bp, mouse
ggaactgggggtaggtgagt

SEQ ID NO: 762520 - DNA, 20 bp, mouse
ggggtaagtggccttggggt

SEQ ID NO: 762521 - DNA, 20 bp, mouse
gggaagatccatcttggcag

SEQ ID NO: 762522 - DNA, 20 bp, mouse
gtcggttggcattcggctaa

SEQ ID NO: 762523 - DNA, 20 bp, mouse
gcctctggctgaacttgtag

SEQ ID NO: 762524 - DNA, 20 bp, mouse
gaggtgagtagggggcaggc

SEQ ID NO: 762525 - DNA, 20 bp, mouse
gtctagattcggttggcatt

SEQ ID NO: 762526 - DNA, 20 bp, mouse
gatggggaaaacagggacca

SEQ ID NO: 762527 - DNA, 20 bp, mouse
gtggctagagacggaaaaga

SEQ ID NO: 762528 - DNA, 20 bp, mouse
gtccgtctctagccagggca

SEQ ID NO: 762529 - DNA, 20 bp, mouse
gaaagtgagttaagagatat

SEQ ID NO: 762530 - DNA, 20 bp, mouse
ggaactgagtttaattggag

SEQ ID NO: 762531 - DNA, 20 bp, mouse
gttaacaacggagatgatcc

SEQ ID NO: 762532 - DNA, 20 bp, mouse
gcggtgacaactagagaaac

SEQ ID NO: 762533 - DNA, 20 bp, mouse
ggttaacctagcccatctta

SEQ ID NO: 762534 - DNA, 20 bp, mouse
gaacaggaactgagtttaat

SEQ ID NO: 762535 - DNA, 20 bp, mouse
ggatgatgttaaccctgccc

SEQ ID NO: 762536 - DNA, 20 bp, mouse
gtagcagagaagcaatgggt

SEQ ID NO: 762537 - DNA, 20 bp, mouse
gagcgtggttgttttgtcaa

SEQ ID NO: 762538 - DNA, 20 bp, mouse
gagaaggacgtgtgaagatg

SEQ ID NO: 762539 - DNA, 20 bp, mouse
gagtggtggagcagaaccca

SEQ ID NO: 762540 - DNA, 20 bp, mouse
gcagcagccttgcatattcc

SEQ ID NO: 762541 - DNA, 20 bp, mouse
gagggaggaccagcagttcc

SEQ ID NO: 762542 - DNA, 20 bp, mouse
ggtgggcagaatgaagccct

SEQ ID NO: 762543 - DNA, 20 bp, mouse
ggaccagcagttccaggttc

SEQ ID NO: 762544 - DNA, 20 bp, mouse
gtcaatgtgggtcatgctta

SEQ ID NO: 762545 - DNA, 20 bp, mouse
gtcaggaatgctggctttat

SEQ ID NO: 762546 - DNA, 20 bp, mouse
gggagtgagtagtcttcctg

SEQ ID NO: 762547 - DNA, 20 bp, mouse
gtctgagccacagttgaaga

SEQ ID NO: 762548 - DNA, 20 bp, mouse
gtccctgccatcttcaactg

SEQ ID NO: 762549 - DNA, 20 bp, mouse
gttaacacttttcttagttc

SEQ ID NO: 762550 - DNA, 20 bp, mouse
gtgttcccagggctgtatag

SEQ ID NO: 762551 - DNA, 20 bp, mouse
gctagttcatccccaacccc

SEQ ID NO: 762552 - DNA, 20 bp, mouse
gagccacagttgaagatggc

SEQ ID NO: 762553 - DNA, 20 bp, mouse
ggtgaagccttgaaatgcaa

SEQ ID NO: 762554 - DNA, 20 bp, mouse
ggtgtttcatggggaatgag

SEQ ID NO: 762555 - DNA, 20 bp, mouse
gacttccactatacagccct

SEQ ID NO: 762556 - DNA, 20 bp, mouse
ggctgggcaggctataggga

SEQ ID NO: 762557 - DNA, 20 bp, mouse
gatcaagagcccaaaactgg

SEQ ID NO: 762558 - DNA, 20 bp, mouse
gtactgaaatgagcagactg

SEQ ID NO: 762559 - DNA, 20 bp, mouse
gtgtggctgggcaggctata

SEQ ID NO: 762560 - DNA, 20 bp, mouse
gtctggttccccccagtttt

SEQ ID NO: 762561 - DNA, 20 bp, mouse
ggaaatgagcagactgtggc

SEQ ID NO: 762562 - DNA, 20 bp, mouse
gacttgaaagcttatgggtg

SEQ ID NO: 762563 - DNA, 20 bp, mouse
gctccattcccagtgttcag

SEQ ID NO: 762564 - DNA, 20 bp, mouse
ggcaggctatagggaaggcg

SEQ ID NO: 762565 - DNA, 20 bp, mouse
gacagtgtttgtggtctaag

SEQ ID NO: 762566 - DNA, 20 bp, mouse
gtaagtctcagcagatgtct

SEQ ID NO: 762567 - DNA, 20 bp, mouse
gctgtggctgggcagacgac

SEQ ID NO: 762568 - DNA, 20 bp, mouse
gtctcagcagatgtctaggc

SEQ ID NO: 762569 - DNA, 20 bp, mouse
gtccctccaagtttgtgctc

SEQ ID NO: 762570 - DNA, 20 bp, mouse
gatccagagcacaaacttgg

SEQ ID NO: 762571 - DNA, 20 bp, mouse
gacctgaaagcttaggggta

SEQ ID NO: 762572 - DNA, 20 bp, mouse
ggaaatgaacaccctgtggc

SEQ ID NO: 762573 - DNA, 20 bp, mouse
gcagcagatgtctaggctgg

SEQ ID NO: 762574 - DNA, 20 bp, mouse
gacagggttccttgtataag

SEQ ID NO: 762575 - DNA, 20 bp, mouse
gcagagaaagaatacagtgt

SEQ ID NO: 762576 - DNA, 20 bp, mouse
gctgttcctactcacaccag

SEQ ID NO: 762577 - DNA, 20 bp, mouse
gggtgtgagtaggaacagca

SEQ ID NO: 762578 - DNA, 20 bp, mouse
gttgtctctaggaatgggat

SEQ ID NO: 762579 - DNA, 20 bp, mouse
ggccaatcacagagctgggt

SEQ ID NO: 762580 - DNA, 20 bp, mouse
gcctactcacaccagtggtt

SEQ ID NO: 762581 - DNA, 20 bp, mouse
gccctgagaaatttgtctct

SEQ ID NO: 762582 - DNA, 20 bp, mouse
gttatctactccggggaagg

SEQ ID NO: 762583 - DNA, 20 bp, mouse
ggacttatctactccgggga

SEQ ID NO: 762584 - DNA, 20 bp, mouse
ggtgtgtgcatcaggggaat

SEQ ID NO: 762585 - DNA, 20 bp, mouse
gctgttagacttatctactc

SEQ ID NO: 762586 - DNA, 20 bp, mouse
gactcagaactctattgctt

SEQ ID NO: 762587 - DNA, 20 bp, mouse
gtgcagaccagaattcccgg

SEQ ID NO: 762588 - DNA, 20 bp, mouse
gggcaagcagaaccagtgtg

SEQ ID NO: 762589 - DNA, 20 bp, mouse
ggcttctgcagggaaccccc

SEQ ID NO: 762590 - DNA, 20 bp, mouse
gagggaacccccgggaattc

SEQ ID NO: 762591 - DNA, 20 bp, mouse
gtggcagttactcatctgga

SEQ ID NO: 762592 - DNA, 20 bp, mouse
ggagagggggacataagcag

SEQ ID NO: 762593 - DNA, 20 bp, mouse
ggaactctattgcttgggtt

SEQ ID NO: 762594 - DNA, 20 bp, mouse
gacttttggtctcacctgtc

SEQ ID NO: 762595 - DNA, 20 bp, mouse
gcagaagcctttagaaacaa

SEQ ID NO: 762596 - DNA, 20 bp, mouse
gggaaatagaggaacactga

SEQ ID NO: 762597 - DNA, 20 bp, mouse
ggttagctgtcagcccgtct

SEQ ID NO: 762598 - DNA, 20 bp, mouse
gcacacaattccacctgatc

SEQ ID NO: 762599 - DNA, 20 bp, mouse
gtgacagacagaacccgatc

SEQ ID NO: 762600 - DNA, 20 bp, mouse
ggtagaggaaagtgcctgaa

SEQ ID NO: 762601 - DNA, 20 bp, mouse
ggagtggtagagacactaag

SEQ ID NO: 762602 - DNA, 20 bp, mouse
ggaattgtgtgcatataaag

SEQ ID NO: 762603 - DNA, 20 bp, mouse
gaacagtgaaggctgtgccc

SEQ ID NO: 762604 - DNA, 20 bp, mouse
gagaagagtaaaaagaatca

SEQ ID NO: 762605 - DNA, 20 bp, mouse
gcagacagaacccgatcagg

SEQ ID NO: 762606 - DNA, 20 bp, mouse
gtgaactaactggatcaaga

SEQ ID NO: 762607 - DNA, 20 bp, mouse
ggccttggcgatacattatc

SEQ ID NO: 762608 - DNA, 20 bp, mouse
gtcaggctgggatggaaatc

SEQ ID NO: 762609 - DNA, 20 bp, mouse
gtactccctctccttggtgg

SEQ ID NO: 762610 - DNA, 20 bp, mouse
gaggagagggagtaaagcgc

SEQ ID NO: 762611 - DNA, 20 bp, mouse
gcatgtgaaatgataacaag

SEQ ID NO: 762612 - DNA, 20 bp, mouse
gggtgtagctctaaatcctc

SEQ ID NO: 762613 - DNA, 20 bp, mouse
gcttggtggtggttgcggga

SEQ ID NO: 762614 - DNA, 20 bp, mouse
gcatcccagcctgaactaac

SEQ ID NO: 762615 - DNA, 20 bp, mouse
gaaagcgctggccaatcaca

SEQ ID NO: 762616 - DNA, 20 bp, mouse
ggtaaaataccaggccctgt

SEQ ID NO: 762617 - DNA, 20 bp, mouse
gaagatggatatgatgttga

SEQ ID NO: 762618 - DNA, 20 bp, mouse
ggtatggctctaaacccaca

SEQ ID NO: 762619 - DNA, 20 bp, mouse
ggggattatgcagggaaagt

SEQ ID NO: 762620 - DNA, 20 bp, mouse
gcactccttctcattggtgg

SEQ ID NO: 762621 - DNA, 20 bp, mouse
gccctccaccaccaatgaga

SEQ ID NO: 762622 - DNA, 20 bp, mouse
gaaaataacaagtcataagg

SEQ ID NO: 762623 - DNA, 20 bp, mouse
ggctctaaacccacagggcc

SEQ ID NO: 762624 - DNA, 20 bp, mouse
ggaagcagataaatgaaggt

SEQ ID NO: 762625 - DNA, 20 bp, mouse
gtgatgttgaaggtttggta

SEQ ID NO: 762626 - DNA, 20 bp, mouse
gaacacgcgaagagggtgaa

SEQ ID NO: 762627 - DNA, 20 bp, mouse
gacctcggagatgccgtatc

SEQ ID NO: 762628 - DNA, 20 bp, mouse
gcgccccctggaccaatgag

SEQ ID NO: 762629 - DNA, 20 bp, mouse
gtccggatacggcatctccg

SEQ ID NO: 762630 - DNA, 20 bp, mouse
ggccgtatccggagtgcatc

SEQ ID NO: 762631 - DNA, 20 bp, mouse
ggatggatgggaagctgaga

SEQ ID NO: 762632 - DNA, 20 bp, mouse
gtaggattccggatgcactc

SEQ ID NO: 762633 - DNA, 20 bp, mouse
gaagaggagtgtataaatga

SEQ ID NO: 762634 - DNA, 20 bp, mouse
gtccgaggtttctgactgta

SEQ ID NO: 762635 - DNA, 20 bp, mouse
gtgtcgccgctataaagtcc

SEQ ID NO: 762636 - DNA, 20 bp, mouse
gccaggagtaagaaacatat

SEQ ID NO: 762637 - DNA, 20 bp, mouse
ggtgtttgctgcacaagttt

SEQ ID NO: 762638 - DNA, 20 bp, mouse
gagaaacatatgggttctgt

SEQ ID NO: 762639 - DNA, 20 bp, mouse
gaatggggaagtgatggagc

SEQ ID NO: 762640 - DNA, 20 bp, mouse
ggtggggaatggggaagtga

SEQ ID NO: 762641 - DNA, 20 bp, mouse
gaagacatatagtactttga

SEQ ID NO: 762642 - DNA, 20 bp, mouse
gtgaggcccacaccataaga

SEQ ID NO: 762643 - DNA, 20 bp, mouse
gcacaaagcaaaaaaaatgg

SEQ ID NO: 762644 - DNA, 20 bp, mouse
ggggctccctcttatggtgt

SEQ ID NO: 762645 - DNA, 20 bp, mouse
gaacagagaggagcagatgc

SEQ ID NO: 762646 - DNA, 20 bp, mouse
ggtagaataccaggacttga

SEQ ID NO: 762647 - DNA, 20 bp, mouse
ggggttggtgaaagatagga

SEQ ID NO: 762648 - DNA, 20 bp, mouse
ggggggggttggtgaaagat

SEQ ID NO: 762649 - DNA, 20 bp, mouse
gcagcgatgtgtagaatacc

SEQ ID NO: 762650 - DNA, 20 bp, mouse
gtgtctcagccctcaagtcc

SEQ ID NO: 762651 - DNA, 20 bp, mouse
gccgctgctcgaccaatgag

SEQ ID NO: 762652 - DNA, 20 bp, mouse
gtggacttcatgggggttag

SEQ ID NO: 762653 - DNA, 20 bp, mouse
gggcagcctaagcctgggaa

SEQ ID NO: 762654 - DNA, 20 bp, mouse
gaggatatgattgatgttag

SEQ ID NO: 762655 - DNA, 20 bp, mouse
gcacatacaagaataaccac

SEQ ID NO: 762656 - DNA, 20 bp, mouse
ggaagagcaagagcagaacg

SEQ ID NO: 762657 - DNA, 20 bp, mouse
gacgtggaataaagagccta

SEQ ID NO: 762658 - DNA, 20 bp, mouse
ggtactggacctacagacgg

SEQ ID NO: 762659 - DNA, 20 bp, mouse
gacatgatagagggtgccta

SEQ ID NO: 762660 - DNA, 20 bp, mouse
ggaaaagcacccagaagacc

SEQ ID NO: 762661 - DNA, 20 bp, mouse
gggtagcatccaccgtctgt

SEQ ID NO: 762662 - DNA, 20 bp, mouse
gtaaagagcctaaggataat

SEQ ID NO: 762663 - DNA, 20 bp, mouse
gatgtgctccatgcccttgt

SEQ ID NO: 762664 - DNA, 20 bp, mouse
gcacatgcacacacatgctc

SEQ ID NO: 762665 - DNA, 20 bp, mouse
gaaagtcaaaagaagtcaac

SEQ ID NO: 762666 - DNA, 20 bp, mouse
gcagctgcaggtcgagtggc

SEQ ID NO: 762667 - DNA, 20 bp, mouse
gtgtgcagctgcaggtcgag

SEQ ID NO: 762668 - DNA, 20 bp, mouse
ggaacagctgcgcccagtac

SEQ ID NO: 762669 - DNA, 20 bp, mouse
gagcccttcccgggtagact

SEQ ID NO: 762670 - DNA, 20 bp, mouse
gcagctgttcccagtctacc

SEQ ID NO: 762671 - DNA, 20 bp, mouse
gaggactaagcacccgtatt

SEQ ID NO: 762672 - DNA, 20 bp, mouse
gttcccagtctacccgggaa

SEQ ID NO: 762673 - DNA, 20 bp, mouse
gcagctcaggaacaccaggt

SEQ ID NO: 762674 - DNA, 20 bp, mouse
gaagaatacaatctaattaa

SEQ ID NO: 762675 - DNA, 20 bp, mouse
ggggtctttagctagaaaga

SEQ ID NO: 762676 - DNA, 20 bp, mouse
gctgccctagagctgggtgt

SEQ ID NO: 762677 - DNA, 20 bp, mouse
gaaccacctcacagctgcat

SEQ ID NO: 762678 - DNA, 20 bp, mouse
ggtgaaaatcaagagggcag

SEQ ID NO: 762679 - DNA, 20 bp, mouse
gcacccttatccctgcccac

SEQ ID NO: 762680 - DNA, 20 bp, mouse
gacaaggcgtgaaaatcaag

SEQ ID NO: 762681 - DNA, 20 bp, mouse
gataggatgccacacccagg

SEQ ID NO: 762682 - DNA, 20 bp, mouse
gccgatctctgccctagagc

SEQ ID NO: 762683 - DNA, 20 bp, mouse
gaaatagctgactcacaacc

SEQ ID NO: 762684 - DNA, 20 bp, mouse
gctggcacggacgtgtgtaa

SEQ ID NO: 762685 - DNA, 20 bp, mouse
ggatatggagtttcactgtg

SEQ ID NO: 762686 - DNA, 20 bp, mouse
gggcaaaaagctgttcagat

SEQ ID NO: 762687 - DNA, 20 bp, mouse
gataacctgtctctctcatt

SEQ ID NO: 762688 - DNA, 20 bp, mouse
gtcaccattgagttgtatcc

SEQ ID NO: 762689 - DNA, 20 bp, mouse
gagctgttcagataggtact

SEQ ID NO: 762690 - DNA, 20 bp, mouse
gtgcccccaatgagagagac

SEQ ID NO: 762691 - DNA, 20 bp, mouse
gtttccaggatacaactcaa

SEQ ID NO: 762692 - DNA, 20 bp, mouse
gcggtatagattttaacagc

SEQ ID NO: 762693 - DNA, 20 bp, mouse
gtagagatgcaggaggaact

SEQ ID NO: 762694 - DNA, 20 bp, mouse
ggtgagagctgatgtgtgta

SEQ ID NO: 762695 - DNA, 20 bp, mouse
gctcctgcatctctaacatc

SEQ ID NO: 762696 - DNA, 20 bp, mouse
gattaatggccagacattag

SEQ ID NO: 762697 - DNA, 20 bp, mouse
gctgcctctgtctatttcca

SEQ ID NO: 762698 - DNA, 20 bp, mouse
gaaataagtgacatacaaag

SEQ ID NO: 762699 - DNA, 20 bp, mouse
gtggccattaattttaacaa

SEQ ID NO: 762700 - DNA, 20 bp, mouse
gcgtgtagcactggcagtct

SEQ ID NO: 762701 - DNA, 20 bp, mouse
gacaaaaaaccttaatacta

SEQ ID NO: 762702 - DNA, 20 bp, mouse
gagtgaatgataaaaagatt

SEQ ID NO: 762703 - DNA, 20 bp, mouse
ggactgtggccttagtatta

SEQ ID NO: 762704 - DNA, 20 bp, mouse
gtggctttttgagacactct

SEQ ID NO: 762705 - DNA, 20 bp, mouse
gtatatgaaatatagtgaaa

SEQ ID NO: 762706 - DNA, 20 bp, mouse
gcaaggatgcaagttcctgc

SEQ ID NO: 762707 - DNA, 20 bp, mouse
gccagtcagctttgaatttc

SEQ ID NO: 762708 - DNA, 20 bp, mouse
gtacagctaagaactggtcg

SEQ ID NO: 762709 - DNA, 20 bp, mouse
gcacatttaggactccctct

SEQ ID NO: 762710 - DNA, 20 bp, mouse
gtgtagtctctagcacattt

SEQ ID NO: 762711 - DNA, 20 bp, mouse
ggtggctagatccccatcgc

SEQ ID NO: 762712 - DNA, 20 bp, mouse
gaatttctggcctatttaac

SEQ ID NO: 762713 - DNA, 20 bp, mouse
gattaagtgtcccgttaaat

SEQ ID NO: 762714 - DNA, 20 bp, mouse
gggcatggacagacctataa

SEQ ID NO: 762715 - DNA, 20 bp, mouse
ggctcattacagctaagaac

SEQ ID NO: 762716 - DNA, 20 bp, mouse
gagcacttggaagcagacag

SEQ ID NO: 762717 - DNA, 20 bp, mouse
gaagaaataagtgacactcg

SEQ ID NO: 762718 - DNA, 20 bp, mouse
gcacgtgatatcaataactt

SEQ ID NO: 762719 - DNA, 20 bp, mouse
gaaattatagtaaaagagta

SEQ ID NO: 762720 - DNA, 20 bp, mouse
gattaatggctagaaactgg

SEQ ID NO: 762721 - DNA, 20 bp, mouse
gactgtagccttagtataaa

SEQ ID NO: 762722 - DNA, 20 bp, mouse
ggcgcaagaattatacagct

SEQ ID NO: 762723 - DNA, 20 bp, mouse
gatcaaaagagtcaaagaag

SEQ ID NO: 762724 - DNA, 20 bp, mouse
gcttggaagcagacagaggc

SEQ ID NO: 762725 - DNA, 20 bp, mouse
gggaactcactgtttagaac

SEQ ID NO: 762726 - DNA, 20 bp, mouse
gggccctgggaagaccgggt

SEQ ID NO: 762727 - DNA, 20 bp, mouse
gtggaggtggatgaggtcat

SEQ ID NO: 762728 - DNA, 20 bp, mouse
ggccccacccggtcttccca

SEQ ID NO: 762729 - DNA, 20 bp, mouse
gagcaaagacccgcagaagg

SEQ ID NO: 762730 - DNA, 20 bp, mouse
gggaatggggtgctggcgcg

SEQ ID NO: 762731 - DNA, 20 bp, mouse
ggacccgcagaagggggaat

SEQ ID NO: 762732 - DNA, 20 bp, mouse
gttcccgtactgccccctgc

SEQ ID NO: 762733 - DNA, 20 bp, mouse
ggtacgggaacctgggccct

SEQ ID NO: 762734 - DNA, 20 bp, mouse
gtgacgcttgggaacctgca

SEQ ID NO: 762735 - DNA, 20 bp, mouse
gacctgggccctgggaagac

SEQ ID NO: 762736 - DNA, 20 bp, mouse
gataagcacgcgagtgtggt

SEQ ID NO: 762737 - DNA, 20 bp, mouse
gtaggagaaaccgggatgca

SEQ ID NO: 762738 - DNA, 20 bp, mouse
ggggacagaattatggggaa

SEQ ID NO: 762739 - DNA, 20 bp, mouse
gccagcaaaggtggttccca

SEQ ID NO: 762740 - DNA, 20 bp, mouse
gggctcagatggtttgagac

SEQ ID NO: 762741 - DNA, 20 bp, mouse
gcgagctccgctcctcaggc

SEQ ID NO: 762742 - DNA, 20 bp, mouse
gcccacacagccttgcatcc

SEQ ID NO: 762743 - DNA, 20 bp, mouse
gggctgaagtaacaacttga

SEQ ID NO: 762744 - DNA, 20 bp, mouse
gatggcatcgtccccagcaa

SEQ ID NO: 762745 - DNA, 20 bp, mouse
ggaacggggacagaattatg

SEQ ID NO: 762746 - DNA, 20 bp, mouse
ggcgctccagagcttcccct

SEQ ID NO: 762747 - DNA, 20 bp, mouse
ggcaaaccagcggcagtgaa

SEQ ID NO: 762748 - DNA, 20 bp, mouse
gtgaagggaacctctcctag

SEQ ID NO: 762749 - DNA, 20 bp, mouse
gccagagcttcccctaggag

SEQ ID NO: 762750 - DNA, 20 bp, mouse
gaacaaaggtcagtccctgt

SEQ ID NO: 762751 - DNA, 20 bp, mouse
gaggttcccttcactgccgc

SEQ ID NO: 762752 - DNA, 20 bp, mouse
gtggaccagataggcaggta

SEQ ID NO: 762753 - DNA, 20 bp, mouse
gttagagagcgggagaacaa

SEQ ID NO: 762754 - DNA, 20 bp, mouse
gctctgcaggacgagcgcgg

SEQ ID NO: 762755 - DNA, 20 bp, mouse
gttctcccgctctctaatag

SEQ ID NO: 762756 - DNA, 20 bp, mouse
gggtggggatacgggagacc

SEQ ID NO: 762757 - DNA, 20 bp, mouse
gagtgagtgggtggggatac

SEQ ID NO: 762758 - DNA, 20 bp, mouse
gcctatggagtgagtgggtg

SEQ ID NO: 762759 - DNA, 20 bp, mouse
gctgaagggtgcgggagaag

SEQ ID NO: 762760 - DNA, 20 bp, mouse
gtacacgtgtagcaaggggc

SEQ ID NO: 762761 - DNA, 20 bp, mouse
gcccgcgtgctgaagggtgc

SEQ ID NO: 762762 - DNA, 20 bp, mouse
gggaaatcccgcgtgctgaa

SEQ ID NO: 762763 - DNA, 20 bp, mouse
ggacagtgattacaacagtt

SEQ ID NO: 762764 - DNA, 20 bp, mouse
gtgccgccctcttaactctg

SEQ ID NO: 762765 - DNA, 20 bp, mouse
gcctatcgcgagatcttcgt

SEQ ID NO: 762766 - DNA, 20 bp, mouse
ggtaggggagaaacagaaga

SEQ ID NO: 762767 - DNA, 20 bp, mouse
gccggtccccgcttcttctg

SEQ ID NO: 762768 - DNA, 20 bp, mouse
gcccgcttcttctggggagt

SEQ ID NO: 762769 - DNA, 20 bp, mouse
gcggcggtgtaccgctaaaa

SEQ ID NO: 762770 - DNA, 20 bp, mouse
gaagatggccgccagacagg

SEQ ID NO: 762771 - DNA, 20 bp, mouse
gggagtcggatgtcattcta

SEQ ID NO: 762772 - DNA, 20 bp, mouse
gaagggaaggtggaatgaca

SEQ ID NO: 762773 - DNA, 20 bp, mouse
gtaaaagggctcccctgaat

SEQ ID NO: 762774 - DNA, 20 bp, mouse
ggagtcacaggcagccgtag

SEQ ID NO: 762775 - DNA, 20 bp, mouse
gtgctcgcacggaacctttt

SEQ ID NO: 762776 - DNA, 20 bp, mouse
gccagtagacgctcaatagg

SEQ ID NO: 762777 - DNA, 20 bp, mouse
ggcagggattgggattttac

SEQ ID NO: 762778 - DNA, 20 bp, mouse
gcactggtgtggttttccta

SEQ ID NO: 762779 - DNA, 20 bp, mouse
gaatttgtgggtgaatgagc

SEQ ID NO: 762780 - DNA, 20 bp, mouse
gaggggatgttgcactggtg

SEQ ID NO: 762781 - DNA, 20 bp, mouse
gtattgagcgtctactggga

SEQ ID NO: 762782 - DNA, 20 bp, mouse
gcttcaggatattaatttgt

SEQ ID NO: 762783 - DNA, 20 bp, mouse
ggggggtaatccgcttgaaa

SEQ ID NO: 762784 - DNA, 20 bp, mouse
ggtctactgggatggagcta

SEQ ID NO: 762785 - DNA, 20 bp, mouse
gaattaatatcctgaagtgg

SEQ ID NO: 762786 - DNA, 20 bp, mouse
gaagaacaggcggacttggg

SEQ ID NO: 762787 - DNA, 20 bp, mouse
gccgcagccctgcaaggaga

SEQ ID NO: 762788 - DNA, 20 bp, mouse
ggcaaagaacaggcggactt

SEQ ID NO: 762789 - DNA, 20 bp, mouse
gtgcacgccctctccttgca

SEQ ID NO: 762790 - DNA, 20 bp, mouse
gtgggcagcggggtcctccg

SEQ ID NO: 762791 - DNA, 20 bp, mouse
gtgcccaacccgggacgctc

SEQ ID NO: 762792 - DNA, 20 bp, mouse
ggctgggcgcggatgtctca

SEQ ID NO: 762793 - DNA, 20 bp, mouse
gaggaccccgctgcccaacc

SEQ ID NO: 762794 - DNA, 20 bp, mouse
gtgcaccgcgagcctttggg

SEQ ID NO: 762795 - DNA, 20 bp, mouse
gcgtctctgtccccgcccaa

SEQ ID NO: 762796 - DNA, 20 bp, mouse
ggggcccctctctgattcct

SEQ ID NO: 762797 - DNA, 20 bp, mouse
ggggaggaaaggtggcggta

SEQ ID NO: 762798 - DNA, 20 bp, mouse
gcaggtgctcccgcacactc

SEQ ID NO: 762799 - DNA, 20 bp, mouse
gtgagcccaaagcgcagtct

SEQ ID NO: 762800 - DNA, 20 bp, mouse
ggtgtaccgcaggacaaggg

SEQ ID NO: 762801 - DNA, 20 bp, mouse
gcatgtgtaccgcaggacaa

SEQ ID NO: 762802 - DNA, 20 bp, mouse
gccaagaggtcctttaaggg

SEQ ID NO: 762803 - DNA, 20 bp, mouse
gagtcctggcagttagactg

SEQ ID NO: 762804 - DNA, 20 bp, mouse
gggggcgggccaagcggcaa

SEQ ID NO: 762805 - DNA, 20 bp, mouse
gcatcaggcaatgaataatg

SEQ ID NO: 762806 - DNA, 20 bp, mouse
gctggggttggtcgagccca

SEQ ID NO: 762807 - DNA, 20 bp, mouse
gggccccagcgggcccctta

SEQ ID NO: 762808 - DNA, 20 bp, mouse
ggccccgcctccaccctaag

SEQ ID NO: 762809 - DNA, 20 bp, mouse
gcaccctaaggggcccgctg

SEQ ID NO: 762810 - DNA, 20 bp, mouse
gactatcatgctcagagcct

SEQ ID NO: 762811 - DNA, 20 bp, mouse
gggccccttagggtggaggc

SEQ ID NO: 762812 - DNA, 20 bp, mouse
gccaaccccagtactgcagg

SEQ ID NO: 762813 - DNA, 20 bp, mouse
ggaagacaagaatgtgatgt

SEQ ID NO: 762814 - DNA, 20 bp, mouse
gttcttgagggctaaattca

SEQ ID NO: 762815 - DNA, 20 bp, mouse
gggcggggcggggcaatgcg

SEQ ID NO: 762816 - DNA, 20 bp, mouse
gtagagaaggtctggcgcta

SEQ ID NO: 762817 - DNA, 20 bp, mouse
gtctggcgctaaggctaaaa

SEQ ID NO: 762818 - DNA, 20 bp, mouse
ggccctctgcagccaccgtt

SEQ ID NO: 762819 - DNA, 20 bp, mouse
gccgtgtttctgtggtttcc

SEQ ID NO: 762820 - DNA, 20 bp, mouse
ggcccagaaggtgtttgatg

SEQ ID NO: 762821 - DNA, 20 bp, mouse
gaaagctggtttcctaacgg

SEQ ID NO: 762822 - DNA, 20 bp, mouse
gagtccttcccgtgtttctg

SEQ ID NO: 762823 - DNA, 20 bp, mouse
gttgctaagagacccaaagc

SEQ ID NO: 762824 - DNA, 20 bp, mouse
gtcctaacggtggctgcaga

SEQ ID NO: 762825 - DNA, 20 bp, mouse
gtagaggggatggcatcacg

SEQ ID NO: 762826 - DNA, 20 bp, mouse
ggggctagagagatctgttg

SEQ ID NO: 762827 - DNA, 20 bp, mouse
gccagactgcaggatccgga

SEQ ID NO: 762828 - DNA, 20 bp, mouse
gcgtgcctgaaggaccccaa

SEQ ID NO: 762829 - DNA, 20 bp, mouse
gtctggcgctgcacgcctgg

SEQ ID NO: 762830 - DNA, 20 bp, mouse
gtagagaagcccaggttgtt

SEQ ID NO: 762831 - DNA, 20 bp, mouse
gacgcggcagggcagccctc

SEQ ID NO: 762832 - DNA, 20 bp, mouse
ggtactcccgccaatcctcc

SEQ ID NO: 762833 - DNA, 20 bp, mouse
gaggaccccaaaggacccgt

SEQ ID NO: 762834 - DNA, 20 bp, mouse
gtgccctgccgcgtgcctga

SEQ ID NO: 762835 - DNA, 20 bp, mouse
gcgccctctcctggtttcat

SEQ ID NO: 762836 - DNA, 20 bp, mouse
gcagacggaagtgaacgcgt

SEQ ID NO: 762837 - DNA, 20 bp, mouse
ggccccaggcgatgaggcaa

SEQ ID NO: 762838 - DNA, 20 bp, mouse
ggaacgcgttggaacggaga

SEQ ID NO: 762839 - DNA, 20 bp, mouse
gggaagtgaacgcgttggaa

SEQ ID NO: 762840 - DNA, 20 bp, mouse
ggaagctgcttcgtctccat

SEQ ID NO: 762841 - DNA, 20 bp, mouse
gcaggcgatgaggcaaaggg

SEQ ID NO: 762842 - DNA, 20 bp, mouse
gagacgaagcagcttcgagg

SEQ ID NO: 762843 - DNA, 20 bp, mouse
ggacagggtctactatgtat

SEQ ID NO: 762844 - DNA, 20 bp, mouse
gcctaattactcccagccaa

SEQ ID NO: 762845 - DNA, 20 bp, mouse
ggaggcgctgcgtgtcaggg

SEQ ID NO: 762846 - DNA, 20 bp, mouse
gtggacttgggtatgttgat

SEQ ID NO: 762847 - DNA, 20 bp, mouse
gagggccggccgggcctcga

SEQ ID NO: 762848 - DNA, 20 bp, mouse
gacttggtaggaggcagcag

SEQ ID NO: 762849 - DNA, 20 bp, mouse
ggaaatgctgaggtggactt

SEQ ID NO: 762850 - DNA, 20 bp, mouse
gaagcccaagcaagagcagt

SEQ ID NO: 762851 - DNA, 20 bp, mouse
ggcgcctactgctcttgctt

SEQ ID NO: 762852 - DNA, 20 bp, mouse
ggagactgcaacttggtagg

SEQ ID NO: 762853 - DNA, 20 bp, mouse
gcagtctctaagactgtaca

SEQ ID NO: 762854 - DNA, 20 bp, mouse
gtctctgggagagaatccct

SEQ ID NO: 762855 - DNA, 20 bp, mouse
gggaacttgaaatgctgagg

SEQ ID NO: 762856 - DNA, 20 bp, mouse
ggccctggacgaagtcctca

SEQ ID NO: 762857 - DNA, 20 bp, mouse
ggccctgaggacttcgtcca

SEQ ID NO: 762858 - DNA, 20 bp, mouse
ggacagcagcaatggcgccc

SEQ ID NO: 762859 - DNA, 20 bp, mouse
gacgagcagcgctcagtccc

SEQ ID NO: 762860 - DNA, 20 bp, mouse
ggaaagtgaaagtaaggcct

SEQ ID NO: 762861 - DNA, 20 bp, mouse
gtaataagagacagcagcaa

SEQ ID NO: 762862 - DNA, 20 bp, mouse
gagagcgccaccatgtagaa

SEQ ID NO: 762863 - DNA, 20 bp, mouse
ggaacacgctgttgaaaagc

SEQ ID NO: 762864 - DNA, 20 bp, mouse
ggggcctcccttctacatgg

SEQ ID NO: 762865 - DNA, 20 bp, mouse
gagacagcaaagagctatca

SEQ ID NO: 762866 - DNA, 20 bp, mouse
gcggcaggcggggatcggga

SEQ ID NO: 762867 - DNA, 20 bp, mouse
gcgcccgctagcggatccca

SEQ ID NO: 762868 - DNA, 20 bp, mouse
gcccgcctgccgcccgctag

SEQ ID NO: 762869 - DNA, 20 bp, mouse
ggcccggtggtcacctgagg

SEQ ID NO: 762870 - DNA, 20 bp, mouse
gcgggcggcaggcggggatc

SEQ ID NO: 762871 - DNA, 20 bp, mouse
gcaggcccggtggtcacctg

SEQ ID NO: 762872 - DNA, 20 bp, mouse
ggcggggatcgggagggcga

SEQ ID NO: 762873 - DNA, 20 bp, mouse
ggaactccaagctcccgccg

SEQ ID NO: 762874 - DNA, 20 bp, mouse
gtccgccaggccggggagtc

SEQ ID NO: 762875 - DNA, 20 bp, mouse
gtaggactccccgcctcctc

SEQ ID NO: 762876 - DNA, 20 bp, mouse
ggccactccggctcgatcca

SEQ ID NO: 762877 - DNA, 20 bp, mouse
gtctgcagacggagaaagga

SEQ ID NO: 762878 - DNA, 20 bp, mouse
gagtggcaagcgttaaaggg

SEQ ID NO: 762879 - DNA, 20 bp, mouse
ggggtagaaacaatagggtc

SEQ ID NO: 762880 - DNA, 20 bp, mouse
ggggagagaaaaagtgagtc

SEQ ID NO: 762881 - DNA, 20 bp, mouse
gccggagtggcaagcgttaa

SEQ ID NO: 762882 - DNA, 20 bp, mouse
gtatgtctgcagacggagaa

SEQ ID NO: 762883 - DNA, 20 bp, mouse
gagaaaggaaggcgaggctc

SEQ ID NO: 762884 - DNA, 20 bp, mouse
ggctccggcggtggatgctg

SEQ ID NO: 762885 - DNA, 20 bp, mouse
gacgcggtttgcgtctagag

SEQ ID NO: 762886 - DNA, 20 bp, mouse
ggggcacggggcgtggtctt

SEQ ID NO: 762887 - DNA, 20 bp, mouse
gaggacctgaagagcggggg

SEQ ID NO: 762888 - DNA, 20 bp, mouse
gcacagatgacaatctactg

SEQ ID NO: 762889 - DNA, 20 bp, mouse
gtgccccgcccccgctcttc

SEQ ID NO: 762890 - DNA, 20 bp, mouse
gctgaggacctgaagagcgg

SEQ ID NO: 762891 - DNA, 20 bp, mouse
gaagagggaagcaggggccc

SEQ ID NO: 762892 - DNA, 20 bp, mouse
gtggtcttaggtcgctgagg

SEQ ID NO: 762893 - DNA, 20 bp, mouse
gggaagggactgatgaaaaa

SEQ ID NO: 762894 - DNA, 20 bp, mouse
gctgctgtgggcggaactcc

SEQ ID NO: 762895 - DNA, 20 bp, mouse
ggcaaggtcaagttcactcg

SEQ ID NO: 762896 - DNA, 20 bp, mouse
gacactggcgcggtctgaac

SEQ ID NO: 762897 - DNA, 20 bp, mouse
gaggacctcaggcgcccccc

SEQ ID NO: 762898 - DNA, 20 bp, mouse
gaggccatggagcacggggg

SEQ ID NO: 762899 - DNA, 20 bp, mouse
gggcaggtcacacactggcg

SEQ ID NO: 762900 - DNA, 20 bp, mouse
gtggaagcgtggcaactggc

SEQ ID NO: 762901 - DNA, 20 bp, mouse
gcccctggaagcgtggcaac

SEQ ID NO: 762902 - DNA, 20 bp, mouse
gagggtagaagggttccagt

SEQ ID NO: 762903 - DNA, 20 bp, mouse
ggtctgaacgggctctgtta

SEQ ID NO: 762904 - DNA, 20 bp, mouse
ggggctctgttagggtagaa

SEQ ID NO: 762905 - DNA, 20 bp, mouse
gtgccctcccccgtgctcca

SEQ ID NO: 762906 - DNA, 20 bp, mouse
ggagcccggccgaacctcag

SEQ ID NO: 762907 - DNA, 20 bp, mouse
gcgcctcgccggctgctgat

SEQ ID NO: 762908 - DNA, 20 bp, mouse
gtccgcgcgcaacccgatgc

SEQ ID NO: 762909 - DNA, 20 bp, mouse
gggagccccgcctttctctt

SEQ ID NO: 762910 - DNA, 20 bp, mouse
gtgtgcgtgtggggctcccg

SEQ ID NO: 762911 - DNA, 20 bp, mouse
gaggctggacctctgaggtt

SEQ ID NO: 762912 - DNA, 20 bp, mouse
gggacctctgaggttcggcc

SEQ ID NO: 762913 - DNA, 20 bp, mouse
gacgccctcaggccctgcgt

SEQ ID NO: 762914 - DNA, 20 bp, mouse
ggttgcgcgcggatccggag

SEQ ID NO: 762915 - DNA, 20 bp, mouse
gtcccctacgcagggcctga

SEQ ID NO: 762916 - DNA, 20 bp, mouse
ggggcgagcacctgtttcat

SEQ ID NO: 762917 - DNA, 20 bp, mouse
gaggggacacagatattttt

SEQ ID NO: 762918 - DNA, 20 bp, mouse
gtaaaaaagtcacgagccag

SEQ ID NO: 762919 - DNA, 20 bp, mouse
gagcctggaggccgccccgg

SEQ ID NO: 762920 - DNA, 20 bp, mouse
ggcacttgtgagagtaaggg

SEQ ID NO: 762921 - DNA, 20 bp, mouse
gagaaccagtctcaatgtca

SEQ ID NO: 762922 - DNA, 20 bp, mouse
ggtatagaaaggtgtgacta

SEQ ID NO: 762923 - DNA, 20 bp, mouse
gtagaaaggtgtgactaggg

SEQ ID NO: 762924 - DNA, 20 bp, mouse
gcaagcacttgtgagagtaa

SEQ ID NO: 762925 - DNA, 20 bp, mouse
ggaggccgccccgggggaag

SEQ ID NO: 762926 - DNA, 20 bp, mouse
gactctacaatgcttacact

SEQ ID NO: 762927 - DNA, 20 bp, mouse
gctacaatgcttacactcgg

SEQ ID NO: 762928 - DNA, 20 bp, mouse
gaaaacttctgactcaggga

SEQ ID NO: 762929 - DNA, 20 bp, mouse
gaatggcatcttgtggtctt

SEQ ID NO: 762930 - DNA, 20 bp, mouse
ggcgttgcgcaggaggaccc

SEQ ID NO: 762931 - DNA, 20 bp, mouse
gcctcctgcgcaacgctgat

SEQ ID NO: 762932 - DNA, 20 bp, mouse
gcctaaggatgagcggaaca

SEQ ID NO: 762933 - DNA, 20 bp, mouse
gcataattgttattctataa

SEQ ID NO: 762934 - DNA, 20 bp, mouse
ggcaccaatcagcgttgcgc

SEQ ID NO: 762935 - DNA, 20 bp, mouse
ggcagaatcctagagcccat

SEQ ID NO: 762936 - DNA, 20 bp, mouse
ggccccgcgaccaccctata

SEQ ID NO: 762937 - DNA, 20 bp, mouse
ggaggagcgggcagcaattc

SEQ ID NO: 762938 - DNA, 20 bp, mouse
gagagggcggccgaacctag

SEQ ID NO: 762939 - DNA, 20 bp, mouse
gacagcgcccttcgtctcag

SEQ ID NO: 762940 - DNA, 20 bp, mouse
gaggagccctccatgtagcg

SEQ ID NO: 762941 - DNA, 20 bp, mouse
gcggccgccctctgagacga

SEQ ID NO: 762942 - DNA, 20 bp, mouse
gaaagggcttgcaaagtcca

SEQ ID NO: 762943 - DNA, 20 bp, mouse
gcgcccttcgtctcagaggg

SEQ ID NO: 762944 - DNA, 20 bp, mouse
gaaaacccagaaatcatgaa

SEQ ID NO: 762945 - DNA, 20 bp, mouse
gacgctgccttgggaggagc

SEQ ID NO: 762946 - DNA, 20 bp, mouse
ggggcccgccctgactgagg

SEQ ID NO: 762947 - DNA, 20 bp, mouse
ggggccgggccggctgtgat

SEQ ID NO: 762948 - DNA, 20 bp, mouse
gagacaggcgggagcctcaa

SEQ ID NO: 762949 - DNA, 20 bp, mouse
gtgtaggcacgcaatgtggg

SEQ ID NO: 762950 - DNA, 20 bp, mouse
ggggtgtaggcacgcaatgt

SEQ ID NO: 762951 - DNA, 20 bp, mouse
ggggccgcagactcgagact

SEQ ID NO: 762952 - DNA, 20 bp, mouse
ggtcccgcccgcctcagtca

SEQ ID NO: 762953 - DNA, 20 bp, mouse
gcggtcacgcccatcacagc

SEQ ID NO: 762954 - DNA, 20 bp, mouse
ggcggggcccgccctgactg

SEQ ID NO: 762955 - DNA, 20 bp, mouse
ggcgggactgcatagacagg

SEQ ID NO: 762956 - DNA, 20 bp, mouse
gactcaggacaccacgcagt

SEQ ID NO: 762957 - DNA, 20 bp, mouse
gagggagcgcgtgtcctgcg

SEQ ID NO: 762958 - DNA, 20 bp, mouse
gctggccgagtgtctgactc

SEQ ID NO: 762959 - DNA, 20 bp, mouse
ggggaggctgctaccccctc

SEQ ID NO: 762960 - DNA, 20 bp, mouse
gagggtggtcaagttggaag

SEQ ID NO: 762961 - DNA, 20 bp, mouse
ggggccggctgggtatactg

SEQ ID NO: 762962 - DNA, 20 bp, mouse
ggtgtcctgagtcagacact

SEQ ID NO: 762963 - DNA, 20 bp, mouse
ggcgggggcggcagcaggtc

SEQ ID NO: 762964 - DNA, 20 bp, mouse
gctcccagagcctgagatca

SEQ ID NO: 762965 - DNA, 20 bp, mouse
ggggtgacgccagggagcca

SEQ ID NO: 762966 - DNA, 20 bp, mouse
gggagtctgtaggatagaag

SEQ ID NO: 762967 - DNA, 20 bp, mouse
gtgaaatgcactttagtggg

SEQ ID NO: 762968 - DNA, 20 bp, mouse
gctaagttatcacactgtag

SEQ ID NO: 762969 - DNA, 20 bp, mouse
gcccaacgcgaaggaagctg

SEQ ID NO: 762970 - DNA, 20 bp, mouse
gtagttgaaatgcactttag

SEQ ID NO: 762971 - DNA, 20 bp, mouse
gcagatgctttctttcccag

SEQ ID NO: 762972 - DNA, 20 bp, mouse
gtgattagtcacatgccact

SEQ ID NO: 762973 - DNA, 20 bp, mouse
ggcctcagcttccttcgcgt

SEQ ID NO: 762974 - DNA, 20 bp, mouse
ggataacttaggacagagct

SEQ ID NO: 762975 - DNA, 20 bp, mouse
gattttcaaggtttgcactc

SEQ ID NO: 762976 - DNA, 20 bp, mouse
gagggtgttaagctgcactg

SEQ ID NO: 762977 - DNA, 20 bp, mouse
gtggctgcgtccaagtcaca

SEQ ID NO: 762978 - DNA, 20 bp, mouse
gcccgcccccggcacgctgt

SEQ ID NO: 762979 - DNA, 20 bp, mouse
gcgtgagaggagagccctag

SEQ ID NO: 762980 - DNA, 20 bp, mouse
ggagctgcctgcaccacctg

SEQ ID NO: 762981 - DNA, 20 bp, mouse
gaccaggcaggttggtgtga

SEQ ID NO: 762982 - DNA, 20 bp, mouse
gcactgtgggagaaccaggc

SEQ ID NO: 762983 - DNA, 20 bp, mouse
gtgcagcttaacaccctcat

SEQ ID NO: 762984 - DNA, 20 bp, mouse
gggtgtgagggctttgtgtt

SEQ ID NO: 762985 - DNA, 20 bp, mouse
gtggccagcctcagagttgt

SEQ ID NO: 762986 - DNA, 20 bp, mouse
gcgggcagagcagaatcttc

SEQ ID NO: 762987 - DNA, 20 bp, mouse
gtgggggatgttgagaagga

SEQ ID NO: 762988 - DNA, 20 bp, mouse
gttctggaacggtgttagag

SEQ ID NO: 762989 - DNA, 20 bp, mouse
gtacagtgtagaatgagggt

SEQ ID NO: 762990 - DNA, 20 bp, mouse
gtagagcgggctcaggaggt

SEQ ID NO: 762991 - DNA, 20 bp, mouse
ggtgttagagcgggctcagg

SEQ ID NO: 762992 - DNA, 20 bp, mouse
ggcgcacttaggtggcaaga

SEQ ID NO: 762993 - DNA, 20 bp, mouse
gtcggtgtggaaagaacaga

SEQ ID NO: 762994 - DNA, 20 bp, mouse
gacggtgttagagcgggctc

SEQ ID NO: 762995 - DNA, 20 bp, mouse
gtggcgcggcactggttacg

SEQ ID NO: 762996 - DNA, 20 bp, mouse
ggaccagtggtgcaggtcag

SEQ ID NO: 762997 - DNA, 20 bp, mouse
gcagacgttcaggctattcc

SEQ ID NO: 762998 - DNA, 20 bp, mouse
gttcctggagaagggagctt

SEQ ID NO: 762999 - DNA, 20 bp, mouse
ggaagggagcttaggagaag

SEQ ID NO: 763000 - DNA, 20 bp, mouse
ggcaagaacaagcagactac

SEQ ID NO: 763001 - DNA, 20 bp, mouse
gtgatgaaattcctggagaa

SEQ ID NO: 763002 - DNA, 20 bp, mouse
gcatgcagccctctgaccag

SEQ ID NO: 763003 - DNA, 20 bp, mouse
ggactgcagtgtgctcaaga

SEQ ID NO: 763004 - DNA, 20 bp, mouse
gcaggaagtgatgaaattcc

SEQ ID NO: 763005 - DNA, 20 bp, mouse
gaaatagactgcagacgttc

SEQ ID NO: 763006 - DNA, 20 bp, mouse
gggccctggcagagacaaag

SEQ ID NO: 763007 - DNA, 20 bp, mouse
gaagccgagggcgggaatgg

SEQ ID NO: 763008 - DNA, 20 bp, mouse
gaggaagccgagggcgggaa

SEQ ID NO: 763009 - DNA, 20 bp, mouse
ggtagcgcagggtttcctct

SEQ ID NO: 763010 - DNA, 20 bp, mouse
gtaactggagaagacttagg

SEQ ID NO: 763011 - DNA, 20 bp, mouse
gtgtaacttagtctcctggg

SEQ ID NO: 763012 - DNA, 20 bp, mouse
ggaaaagtccggcccaagag

SEQ ID NO: 763013 - DNA, 20 bp, mouse
gttaggcgggaggaagccga

SEQ ID NO: 763014 - DNA, 20 bp, mouse
gctctgctgggagaccggtg

SEQ ID NO: 763015 - DNA, 20 bp, mouse
gcactgcaactcaagttttt

SEQ ID NO: 763016 - DNA, 20 bp, mouse
gagttcaggcagacgtgcaa

SEQ ID NO: 763017 - DNA, 20 bp, mouse
ggcacggactcgatagagct

SEQ ID NO: 763018 - DNA, 20 bp, mouse
gccccagcgactagacgaga

SEQ ID NO: 763019 - DNA, 20 bp, mouse
gtgcgcagacgactggcaaa

SEQ ID NO: 763020 - DNA, 20 bp, mouse
gcgccacggacgggatgcgg

SEQ ID NO: 763021 - DNA, 20 bp, mouse
gccccctcgctgagacgccg

SEQ ID NO: 763022 - DNA, 20 bp, mouse
gggctccttagccagaagtt

SEQ ID NO: 763023 - DNA, 20 bp, mouse
gccgaggattctgggaacgt

SEQ ID NO: 763024 - DNA, 20 bp, mouse
ggcgtgaagcgtgcctcaag

SEQ ID NO: 763025 - DNA, 20 bp, mouse
gctggagacgggaagcgcgg

SEQ ID NO: 763026 - DNA, 20 bp, mouse
gtatgcgcgcagtcctgaag

SEQ ID NO: 763027 - DNA, 20 bp, mouse
ggcgccgcttgccctgcctg

SEQ ID NO: 763028 - DNA, 20 bp, mouse
ggtcctgaaggggtggccgg

SEQ ID NO: 763029 - DNA, 20 bp, mouse
ggggtggccggtggccgcta

SEQ ID NO: 763030 - DNA, 20 bp, mouse
ggcgcgcagtcctgaagggg

SEQ ID NO: 763031 - DNA, 20 bp, mouse
gatttcgcggcgccccctag

SEQ ID NO: 763032 - DNA, 20 bp, mouse
gcagctgttcctccggtctg

SEQ ID NO: 763033 - DNA, 20 bp, mouse
ggcaaacccaagaacggcgc

SEQ ID NO: 763034 - DNA, 20 bp, mouse
gttccgaggacgattactta

SEQ ID NO: 763035 - DNA, 20 bp, mouse
gtggagcctgcgccgttctt

SEQ ID NO: 763036 - DNA, 20 bp, mouse
gaggcaccgcacacctgggg

SEQ ID NO: 763037 - DNA, 20 bp, mouse
gaggacaggctcatattcaa

SEQ ID NO: 763038 - DNA, 20 bp, mouse
ggcgaggcaccgcacacctg

SEQ ID NO: 763039 - DNA, 20 bp, mouse
ggtgcggtgcctcgccctgg

SEQ ID NO: 763040 - DNA, 20 bp, mouse
gacctccccaaagtcggggc

SEQ ID NO: 763041 - DNA, 20 bp, mouse
gttggctcacagggaactgc

SEQ ID NO: 763042 - DNA, 20 bp, mouse
gagccaagggtaccagatac

SEQ ID NO: 763043 - DNA, 20 bp, mouse
gtcactgcgtgctaggatgt

SEQ ID NO: 763044 - DNA, 20 bp, mouse
gtcgccctgggggtggagtt

SEQ ID NO: 763045 - DNA, 20 bp, mouse
gtcatgcagcgcagccgcag

SEQ ID NO: 763046 - DNA, 20 bp, mouse
gtggaacgaccgctcgcacc

SEQ ID NO: 763047 - DNA, 20 bp, mouse
gccctcccgcccggggaccg

SEQ ID NO: 763048 - DNA, 20 bp, mouse
gcacgcccggagggtggagg

SEQ ID NO: 763049 - DNA, 20 bp, mouse
gcctgcctaccacgcccgga

SEQ ID NO: 763050 - DNA, 20 bp, mouse
gcgctcgcacccgggaaaca

SEQ ID NO: 763051 - DNA, 20 bp, mouse
gtgcgagcggtcgttccagg

SEQ ID NO: 763052 - DNA, 20 bp, mouse
ggcggccgcggtccccgggc

SEQ ID NO: 763053 - DNA, 20 bp, mouse
gcgcggagataaaaggcgtg

SEQ ID NO: 763054 - DNA, 20 bp, mouse
gtaccacgcccggagggtgg

SEQ ID NO: 763055 - DNA, 20 bp, mouse
gaacccgaaagccagcagca

SEQ ID NO: 763056 - DNA, 20 bp, mouse
gaatcgctgaggctgaagag

SEQ ID NO: 763057 - DNA, 20 bp, mouse
gtccgtgagagactgagccc

SEQ ID NO: 763058 - DNA, 20 bp, mouse
gaggctgaagagtgggcgag

SEQ ID NO: 763059 - DNA, 20 bp, mouse
gacccttgtgagaatcgctg

SEQ ID NO: 763060 - DNA, 20 bp, mouse
ggactgaaaaggaatccggg

SEQ ID NO: 763061 - DNA, 20 bp, mouse
gcatccctccacaggcactg

SEQ ID NO: 763062 - DNA, 20 bp, mouse
gtggagaagacaaaagacga

SEQ ID NO: 763063 - DNA, 20 bp, mouse
gacaaaagacgagggcttgg

SEQ ID NO: 763064 - DNA, 20 bp, mouse
gactcaagcaggttcccgcc

SEQ ID NO: 763065 - DNA, 20 bp, mouse
gaggcggagccacaagacgc

SEQ ID NO: 763066 - DNA, 20 bp, mouse
gccacgccgcggttcctctc

SEQ ID NO: 763067 - DNA, 20 bp, mouse
gtcccgctgctgtcgctcac

SEQ ID NO: 763068 - DNA, 20 bp, mouse
gcagggggatacggacgcag

SEQ ID NO: 763069 - DNA, 20 bp, mouse
gcccagaggccgcggggcag

SEQ ID NO: 763070 - DNA, 20 bp, mouse
gcacccgagcctctaggtcg

SEQ ID NO: 763071 - DNA, 20 bp, mouse
gcgacacagcacaacgtagg

SEQ ID NO: 763072 - DNA, 20 bp, mouse
ggggatacggacgcagaggc

SEQ ID NO: 763073 - DNA, 20 bp, mouse
gagccggagctcgagaccac

SEQ ID NO: 763074 - DNA, 20 bp, mouse
ggccccgcgacctagaggct

SEQ ID NO: 763075 - DNA, 20 bp, mouse
gccgcggcgtggggcagcta

SEQ ID NO: 763076 - DNA, 20 bp, mouse
gaggcctcgcagttcgccca

SEQ ID NO: 763077 - DNA, 20 bp, mouse
ggagccgccgcacactgcat

SEQ ID NO: 763078 - DNA, 20 bp, mouse
ggccactgcgcagtgggagt

SEQ ID NO: 763079 - DNA, 20 bp, mouse
ggcacactgcatcggacgag

SEQ ID NO: 763080 - DNA, 20 bp, mouse
ggcgctgggtggcactctca

SEQ ID NO: 763081 - DNA, 20 bp, mouse
gctggcacgacgagttccca

SEQ ID NO: 763082 - DNA, 20 bp, mouse
gtctgcccgggtcccggcat

SEQ ID NO: 763083 - DNA, 20 bp, mouse
gccacggccgcggagagcca

SEQ ID NO: 763084 - DNA, 20 bp, mouse
gcacccctgggcgaactgcg

SEQ ID NO: 763085 - DNA, 20 bp, mouse
gggcgggccttggctctccg

SEQ ID NO: 763086 - DNA, 20 bp, mouse
gagaccccgcccactctggc

SEQ ID NO: 763087 - DNA, 20 bp, mouse
gacaagggaaccagagtcct

SEQ ID NO: 763088 - DNA, 20 bp, mouse
gcagtccctagagggaaatc

SEQ ID NO: 763089 - DNA, 20 bp, mouse
ggagacaggtatccgggaac

SEQ ID NO: 763090 - DNA, 20 bp, mouse
gggagccgatgcaccctctc

SEQ ID NO: 763091 - DNA, 20 bp, mouse
ggactggtgagacaggtatc

SEQ ID NO: 763092 - DNA, 20 bp, mouse
gaatccctgagagggtgcat

SEQ ID NO: 763093 - DNA, 20 bp, mouse
gccctagagggaaatcagga

SEQ ID NO: 763094 - DNA, 20 bp, mouse
ggtgttctgcccttggggac

SEQ ID NO: 763095 - DNA, 20 bp, mouse
ggggaccggtttcaatcaca

SEQ ID NO: 763096 - DNA, 20 bp, mouse
gcaggggagcccctgctgag

SEQ ID NO: 763097 - DNA, 20 bp, mouse
gaccgcgaggggtccagaag

SEQ ID NO: 763098 - DNA, 20 bp, mouse
gcggcggcggctcagatata

SEQ ID NO: 763099 - DNA, 20 bp, mouse
gagaggggcaaggtgcgggg

SEQ ID NO: 763100 - DNA, 20 bp, mouse
ggagacttcccgaggtagag

SEQ ID NO: 763101 - DNA, 20 bp, mouse
gtcagcagggagacttcccg

SEQ ID NO: 763102 - DNA, 20 bp, mouse
gtccctccctccctccggag

SEQ ID NO: 763103 - DNA, 20 bp, mouse
gtacagagaaattgtggcgg

SEQ ID NO: 763104 - DNA, 20 bp, mouse
gaccctggaggggcagggca

SEQ ID NO: 763105 - DNA, 20 bp, mouse
gctgctgagacagcgggcta

SEQ ID NO: 763106 - DNA, 20 bp, mouse
gtccggcggggcacagtcct

SEQ ID NO: 763107 - DNA, 20 bp, mouse
ggggcggtgcattttgtagg

SEQ ID NO: 763108 - DNA, 20 bp, mouse
gcggagacgcacgggctcgg

SEQ ID NO: 763109 - DNA, 20 bp, mouse
gccccgggaagccgacagtc

SEQ ID NO: 763110 - DNA, 20 bp, mouse
gcgccggagctcacaggcgg

SEQ ID NO: 763111 - DNA, 20 bp, mouse
gcgccgccgcctgtgagctc

SEQ ID NO: 763112 - DNA, 20 bp, mouse
gaacgcggagagagagtcag

SEQ ID NO: 763113 - DNA, 20 bp, mouse
gggtgtggggttgtcgaggt

SEQ ID NO: 763114 - DNA, 20 bp, mouse
gccgccggacccagatgccc

SEQ ID NO: 763115 - DNA, 20 bp, mouse
gtcccggggaaagctcgtgg

SEQ ID NO: 763116 - DNA, 20 bp, mouse
gggtccggggagatgtgctc

SEQ ID NO: 763117 - DNA, 20 bp, mouse
ggcactagaggcggcaagag

SEQ ID NO: 763118 - DNA, 20 bp, mouse
gcgctcactaggctgcccca

SEQ ID NO: 763119 - DNA, 20 bp, mouse
ggaggcggcaagagcgggtc

SEQ ID NO: 763120 - DNA, 20 bp, mouse
gagggcggaggcactagagg

SEQ ID NO: 763121 - DNA, 20 bp, mouse
ggtacgagaaagcatgagat

SEQ ID NO: 763122 - DNA, 20 bp, mouse
gcatcccaaggcctctgatg

SEQ ID NO: 763123 - DNA, 20 bp, mouse
gtcactaggctgccccaggg

SEQ ID NO: 763124 - DNA, 20 bp, mouse
gcaagccctctcggcaacta

SEQ ID NO: 763125 - DNA, 20 bp, mouse
gtctagtctcaaacgatatc

SEQ ID NO: 763126 - DNA, 20 bp, mouse
gaggtgaaacaagagggcaa

SEQ ID NO: 763127 - DNA, 20 bp, mouse
ggcgaacaccgcccagtggg

SEQ ID NO: 763128 - DNA, 20 bp, mouse
gccgggaggcgtggcctcga

SEQ ID NO: 763129 - DNA, 20 bp, mouse
gcgaacgctcaagaccctcg

SEQ ID NO: 763130 - DNA, 20 bp, mouse
gggtctagactccacccact

SEQ ID NO: 763131 - DNA, 20 bp, mouse
ggagacagaaatcgctgagt

SEQ ID NO: 763132 - DNA, 20 bp, mouse
ggacccctggcgggcggaag

SEQ ID NO: 763133 - DNA, 20 bp, mouse
gcagaactgcgacccctggc

SEQ ID NO: 763134 - DNA, 20 bp, mouse
gggtcttgagcgttcgcacg

SEQ ID NO: 763135 - DNA, 20 bp, mouse
gctcgcgagaggaagcacaa

SEQ ID NO: 763136 - DNA, 20 bp, mouse
gaaagctgaggcaggacggg

SEQ ID NO: 763137 - DNA, 20 bp, mouse
gaatggcttcggtgagaact

SEQ ID NO: 763138 - DNA, 20 bp, mouse
gtcaccgaagccattctggg

SEQ ID NO: 763139 - DNA, 20 bp, mouse
gaggtcagatgatggaatcg

SEQ ID NO: 763140 - DNA, 20 bp, mouse
gcctgcctcagctttggttc

SEQ ID NO: 763141 - DNA, 20 bp, mouse
ggacgggaggctcctttaaa

SEQ ID NO: 763142 - DNA, 20 bp, mouse
gtctgcggaactgtggaaca

SEQ ID NO: 763143 - DNA, 20 bp, mouse
gttcgaggcaggtcagatga

SEQ ID NO: 763144 - DNA, 20 bp, mouse
gccggaagaaccctccgcgt

SEQ ID NO: 763145 - DNA, 20 bp, mouse
gttctcaccgaagccattct

SEQ ID NO: 763146 - DNA, 20 bp, mouse
gtcactggctctgcgaactc

SEQ ID NO: 763147 - DNA, 20 bp, mouse
gggggaagggcatgcttcac

SEQ ID NO: 763148 - DNA, 20 bp, mouse
gcgaactctggtggcgacgc

SEQ ID NO: 763149 - DNA, 20 bp, mouse
gagcacccggatttgagtca

SEQ ID NO: 763150 - DNA, 20 bp, mouse
gctggtggaggcgtgctggc

SEQ ID NO: 763151 - DNA, 20 bp, mouse
gctggtggcgacgctggtgg

SEQ ID NO: 763152 - DNA, 20 bp, mouse
gccaccccctgactcaaatc

SEQ ID NO: 763153 - DNA, 20 bp, mouse
gggaggcgtgctggcagggg

SEQ ID NO: 763154 - DNA, 20 bp, mouse
gagcagctgcaacaggggcg

SEQ ID NO: 763155 - DNA, 20 bp, mouse
ggctgctgggaatggcgtgg

SEQ ID NO: 763156 - DNA, 20 bp, mouse
ggcccccgggatccctaaat

SEQ ID NO: 763157 - DNA, 20 bp, mouse
gcaggctgcaggttagaggc

SEQ ID NO: 763158 - DNA, 20 bp, mouse
gcggcagccaggtggcggaa

SEQ ID NO: 763159 - DNA, 20 bp, mouse
ggagctggaggcatccaggt

SEQ ID NO: 763160 - DNA, 20 bp, mouse
ggactcaagagcaatggaga

SEQ ID NO: 763161 - DNA, 20 bp, mouse
ggacccagaggaaatctcca

SEQ ID NO: 763162 - DNA, 20 bp, mouse
gtcccatttagggatcccgg

SEQ ID NO: 763163 - DNA, 20 bp, mouse
gctggactcgtccccccacc

SEQ ID NO: 763164 - DNA, 20 bp, mouse
gaaaggagctggaggcatcc

SEQ ID NO: 763165 - DNA, 20 bp, mouse
ggcagcatgcgcactgcccc

SEQ ID NO: 763166 - DNA, 20 bp, mouse
gggtactcacctagagtgag

SEQ ID NO: 763167 - DNA, 20 bp, mouse
ggggatacaagtaagctctc

SEQ ID NO: 763168 - DNA, 20 bp, mouse
ggcacctagctgcctcataa

SEQ ID NO: 763169 - DNA, 20 bp, mouse
gtaggtgagtaccccttatg

SEQ ID NO: 763170 - DNA, 20 bp, mouse
ggcaaaggaagcggatgctg

SEQ ID NO: 763171 - DNA, 20 bp, mouse
gtcacctagagtgagcggtg

SEQ ID NO: 763172 - DNA, 20 bp, mouse
gctagctgaggaagcttcag

SEQ ID NO: 763173 - DNA, 20 bp, mouse
gctaaaacgcagatgcctgt

SEQ ID NO: 763174 - DNA, 20 bp, mouse
gtcgcggctaggatctcagg

SEQ ID NO: 763175 - DNA, 20 bp, mouse
gaggcatctgcgttttagaa

SEQ ID NO: 763176 - DNA, 20 bp, mouse
gcggcgtcgaggctgtaaat

SEQ ID NO: 763177 - DNA, 20 bp, mouse
gggaagctacggggtagatc

SEQ ID NO: 763178 - DNA, 20 bp, mouse
gcgtcgaggctgtaaatcgg

SEQ ID NO: 763179 - DNA, 20 bp, mouse
gccacccactgcagttccat

SEQ ID NO: 763180 - DNA, 20 bp, mouse
gcctcgacgccgcactaaac

SEQ ID NO: 763181 - DNA, 20 bp, mouse
gctgcagtcccaaacgcttc

SEQ ID NO: 763182 - DNA, 20 bp, mouse
gtagcccaatggaactgcag

SEQ ID NO: 763183 - DNA, 20 bp, mouse
gagctcctcccttcccgaaa

SEQ ID NO: 763184 - DNA, 20 bp, mouse
gtaaatcggcggaccttgtt

SEQ ID NO: 763185 - DNA, 20 bp, mouse
gtgaccaatagtgagcgaga

SEQ ID NO: 763186 - DNA, 20 bp, mouse
ggggagggcggggcttttca

SEQ ID NO: 763187 - DNA, 20 bp, mouse
gtatgggcagaggattgcaa

SEQ ID NO: 763188 - DNA, 20 bp, mouse
gacgccctctgctggttcgg

SEQ ID NO: 763189 - DNA, 20 bp, mouse
gcaagtgcacggatagatta

SEQ ID NO: 763190 - DNA, 20 bp, mouse
ggaggccgcgaaacgtgctg

SEQ ID NO: 763191 - DNA, 20 bp, mouse
gcggcctccgaaccagcaga

SEQ ID NO: 763192 - DNA, 20 bp, mouse
gctgaggcgcgtgcgcggga

SEQ ID NO: 763193 - DNA, 20 bp, mouse
gtttcatggctgagacgggg

SEQ ID NO: 763194 - DNA, 20 bp, mouse
gccaaaaaatatatgggcag

SEQ ID NO: 763195 - DNA, 20 bp, mouse
gcgctctctacgccctctgc

SEQ ID NO: 763196 - DNA, 20 bp, mouse
ggggatgggcggccgttgga

SEQ ID NO: 763197 - DNA, 20 bp, mouse
gtggcccagtggccgttaga

SEQ ID NO: 763198 - DNA, 20 bp, mouse
gagaacgtcagtaaaagcga

SEQ ID NO: 763199 - DNA, 20 bp, mouse
ggagctcttacgtcaccgaa

SEQ ID NO: 763200 - DNA, 20 bp, mouse
ggggcagccaggagacttca

SEQ ID NO: 763201 - DNA, 20 bp, mouse
ggaacgtcgtccgaggccgt

SEQ ID NO: 763202 - DNA, 20 bp, mouse
gtcagtaaaagcgaaggcgg

SEQ ID NO: 763203 - DNA, 20 bp, mouse
gtccgagaatccgccccctt

SEQ ID NO: 763204 - DNA, 20 bp, mouse
ggaactgcgcgccctggagg

SEQ ID NO: 763205 - DNA, 20 bp, mouse
gggaccactctcgagctcac

SEQ ID NO: 763206 - DNA, 20 bp, mouse
gggcgtctgcagcgcatcat

SEQ ID NO: 763207 - DNA, 20 bp, mouse
gcttctctccgggcaactga

SEQ ID NO: 763208 - DNA, 20 bp, mouse
gtgcccggagagaagcttgg

SEQ ID NO: 763209 - DNA, 20 bp, mouse
gggctctcctgtctccaacc

SEQ ID NO: 763210 - DNA, 20 bp, mouse
gatgcaaaagcccaccctgc

SEQ ID NO: 763211 - DNA, 20 bp, mouse
gtggttaaatccaggaggtt

SEQ ID NO: 763212 - DNA, 20 bp, mouse
ggtctccaacccggcagggt

SEQ ID NO: 763213 - DNA, 20 bp, mouse
gcataatgtaaatagggctc

SEQ ID NO: 763214 - DNA, 20 bp, mouse
gaaagcccaccctgccgggt

SEQ ID NO: 763215 - DNA, 20 bp, mouse
gctcctgtctccaacccggc

SEQ ID NO: 763216 - DNA, 20 bp, mouse
gcacgagccgcccactaagg

SEQ ID NO: 763217 - DNA, 20 bp, mouse
gggcgcgcagcggaaaagag

SEQ ID NO: 763218 - DNA, 20 bp, mouse
ggaaaagagtggcgcacacg

SEQ ID NO: 763219 - DNA, 20 bp, mouse
gggtcgcgtaccctccaccc

SEQ ID NO: 763220 - DNA, 20 bp, mouse
ggctccgcctccttagtggg

SEQ ID NO: 763221 - DNA, 20 bp, mouse
ggccacgctcctgtccgagg

SEQ ID NO: 763222 - DNA, 20 bp, mouse
ggcaggatgatgacgcgtgt

SEQ ID NO: 763223 - DNA, 20 bp, mouse
ggcccacgagccgcccacta

SEQ ID NO: 763224 - DNA, 20 bp, mouse
gaaagcacagcccgggtcga

SEQ ID NO: 763225 - DNA, 20 bp, mouse
gggtctctcctcccgggtgg

SEQ ID NO: 763226 - DNA, 20 bp, mouse
ggactaaaaaggacggtggg

SEQ ID NO: 763227 - DNA, 20 bp, mouse
gtgcgtgtgtacccatgaga

SEQ ID NO: 763228 - DNA, 20 bp, mouse
gctgctggtaggagggtacc

SEQ ID NO: 763229 - DNA, 20 bp, mouse
gtctactagtgtctgtgacc

SEQ ID NO: 763230 - DNA, 20 bp, mouse
gggaggtttcctctgctggt

SEQ ID NO: 763231 - DNA, 20 bp, mouse
ggcatcacttccggaagggg

SEQ ID NO: 763232 - DNA, 20 bp, mouse
gacgcacgcaagaaaatgca

SEQ ID NO: 763233 - DNA, 20 bp, mouse
gttccggaagcgcgcttcaa

SEQ ID NO: 763234 - DNA, 20 bp, mouse
gccttccggaagtgatgccg

SEQ ID NO: 763235 - DNA, 20 bp, mouse
gggaagcactgagaaaacct

SEQ ID NO: 763236 - DNA, 20 bp, mouse
gcgcaagcggccatcattcc

SEQ ID NO: 763237 - DNA, 20 bp, mouse
gaggctgcgcagagtcctcc

SEQ ID NO: 763238 - DNA, 20 bp, mouse
gaggacgccagaggcgcaag

SEQ ID NO: 763239 - DNA, 20 bp, mouse
gcctgcgcagagcagctccg

SEQ ID NO: 763240 - DNA, 20 bp, mouse
gtggaaggaacagcccagac

SEQ ID NO: 763241 - DNA, 20 bp, mouse
gcagctccggggcgggtcct

SEQ ID NO: 763242 - DNA, 20 bp, mouse
gtgtcgcgtcggtctttctt

SEQ ID NO: 763243 - DNA, 20 bp, mouse
gacgcgacacgcgatccgcc

SEQ ID NO: 763244 - DNA, 20 bp, mouse
gcgcgatccgcccggaatga

SEQ ID NO: 763245 - DNA, 20 bp, mouse
gaagcggccatcattccggg

SEQ ID NO: 763246 - DNA, 20 bp, mouse
gaggaagatcggagcgaaaa

SEQ ID NO: 763247 - DNA, 20 bp, mouse
gagccagcagtggaaggtag

SEQ ID NO: 763248 - DNA, 20 bp, mouse
ggctcacccggccctacgga

SEQ ID NO: 763249 - DNA, 20 bp, mouse
gagcacaagacggaaaagga

SEQ ID NO: 763250 - DNA, 20 bp, mouse
gttcgtgtgaacgacagatg

SEQ ID NO: 763251 - DNA, 20 bp, mouse
gcagatggggacaaagagcg

SEQ ID NO: 763252 - DNA, 20 bp, mouse
ggggaggtaccgagctccgt

SEQ ID NO: 763253 - DNA, 20 bp, mouse
ggccgagcacaagacggaaa

SEQ ID NO: 763254 - DNA, 20 bp, mouse
gcggactaatgagactttct

SEQ ID NO: 763255 - DNA, 20 bp, mouse
gagaggctcacccggcccta

SEQ ID NO: 763256 - DNA, 20 bp, mouse
gcatatccatgtgaccagaa

SEQ ID NO: 763257 - DNA, 20 bp, mouse
ggtgtgccagccacttgcca

SEQ ID NO: 763258 - DNA, 20 bp, mouse
gctaatccctggcaagtggc

SEQ ID NO: 763259 - DNA, 20 bp, mouse
gcttcctaatccctggcaag

SEQ ID NO: 763260 - DNA, 20 bp, mouse
gaaaccggatgtaaaaagta

SEQ ID NO: 763261 - DNA, 20 bp, mouse
gtgctgctagctggaaccca

SEQ ID NO: 763262 - DNA, 20 bp, mouse
gttggacggaagtctctcca

SEQ ID NO: 763263 - DNA, 20 bp, mouse
gttgcaaggttgctgctagc

SEQ ID NO: 763264 - DNA, 20 bp, mouse
ggctctactatgcccccttc

SEQ ID NO: 763265 - DNA, 20 bp, mouse
gctcaacctcctatatccta

SEQ ID NO: 763266 - DNA, 20 bp, mouse
gccaggaagtcgaggaagtg

SEQ ID NO: 763267 - DNA, 20 bp, mouse
ggcccagcgccaggaagtcg

SEQ ID NO: 763268 - DNA, 20 bp, mouse
gcccctcggggcggcgtctg

SEQ ID NO: 763269 - DNA, 20 bp, mouse
ggcgtctgaggatactgtgg

SEQ ID NO: 763270 - DNA, 20 bp, mouse
gcgccccgaggggagctctc

SEQ ID NO: 763271 - DNA, 20 bp, mouse
gtcgccgcggagatgggaca

SEQ ID NO: 763272 - DNA, 20 bp, mouse
ggtagggtagggcgcggcga

SEQ ID NO: 763273 - DNA, 20 bp, mouse
gagcccgagagctcccctcg

SEQ ID NO: 763274 - DNA, 20 bp, mouse
ggcggcgtctgaggatactg

SEQ ID NO: 763275 - DNA, 20 bp, mouse
gtacccgtgtcccatctccg

SEQ ID NO: 763276 - DNA, 20 bp, mouse
gtgaagccctcgataactgg

SEQ ID NO: 763277 - DNA, 20 bp, mouse
gcggaccccgccttctgatg

SEQ ID NO: 763278 - DNA, 20 bp, mouse
gtctgtgctggtgggtatgg

SEQ ID NO: 763279 - DNA, 20 bp, mouse
gttctgatgaggtcactacg

SEQ ID NO: 763280 - DNA, 20 bp, mouse
gcgtgcgcgcaaggattctt

SEQ ID NO: 763281 - DNA, 20 bp, mouse
ggatgaggtcactacggggc

SEQ ID NO: 763282 - DNA, 20 bp, mouse
gccaagcccccagttatcga

SEQ ID NO: 763283 - DNA, 20 bp, mouse
ggaaggcggggtccggtgtc

SEQ ID NO: 763284 - DNA, 20 bp, mouse
gaggacacaaatccggacac

SEQ ID NO: 763285 - DNA, 20 bp, mouse
ggtgacctcatcagaaggcg

SEQ ID NO: 763286 - DNA, 20 bp, mouse
gctcacccgcggttcagaga

SEQ ID NO: 763287 - DNA, 20 bp, mouse
gtgaaagggtccggagggga

SEQ ID NO: 763288 - DNA, 20 bp, mouse
ggggacacgcccctcacccg

SEQ ID NO: 763289 - DNA, 20 bp, mouse
ggaggggagggttacctcta

SEQ ID NO: 763290 - DNA, 20 bp, mouse
gcggcctcgggagtagcggg

SEQ ID NO: 763291 - DNA, 20 bp, mouse
gttgcgggctaaggcaatta

SEQ ID NO: 763292 - DNA, 20 bp, mouse
gtgggaccccgcgatcttgc

SEQ ID NO: 763293 - DNA, 20 bp, mouse
ggtgcccgatgccactagat

SEQ ID NO: 763294 - DNA, 20 bp, mouse
gccggaacacacgtgatcca

SEQ ID NO: 763295 - DNA, 20 bp, mouse
gcctccggaccctttcacat

SEQ ID NO: 763296 - DNA, 20 bp, mouse
ggggcgggttggactaccac

SEQ ID NO: 763297 - DNA, 20 bp, mouse
gaactcggtgaggggacatg

SEQ ID NO: 763298 - DNA, 20 bp, mouse
ggtactgcgtctgtagtgaa

SEQ ID NO: 763299 - DNA, 20 bp, mouse
gctgccggcaggccgcagag

SEQ ID NO: 763300 - DNA, 20 bp, mouse
gggtagtccaacccgcccga

SEQ ID NO: 763301 - DNA, 20 bp, mouse
gtcgcgcagccgcagaggct

SEQ ID NO: 763302 - DNA, 20 bp, mouse
ggggtgtggtatcgtccgtc

SEQ ID NO: 763303 - DNA, 20 bp, mouse
gccctccgaagacctgacaa

SEQ ID NO: 763304 - DNA, 20 bp, mouse
gcctctgcggctgcgcgagc

SEQ ID NO: 763305 - DNA, 20 bp, mouse
ggaaaccattgtcaggtctt

SEQ ID NO: 763306 - DNA, 20 bp, mouse
gtcccgcccacagtagaatc

SEQ ID NO: 763307 - DNA, 20 bp, mouse
gtggaagctgtcagtttatt

SEQ ID NO: 763308 - DNA, 20 bp, mouse
gactgtgggcgggaaaaacc

SEQ ID NO: 763309 - DNA, 20 bp, mouse
gagtagaatccggaaagaga

SEQ ID NO: 763310 - DNA, 20 bp, mouse
gtctttccggattctactgt

SEQ ID NO: 763311 - DNA, 20 bp, mouse
gatcccgtggaactcactga

SEQ ID NO: 763312 - DNA, 20 bp, mouse
ggaaatgatctcacgctctg

SEQ ID NO: 763313 - DNA, 20 bp, mouse
gtccggattctactgtgggc

SEQ ID NO: 763314 - DNA, 20 bp, mouse
gtcccatcagtgagttccac

SEQ ID NO: 763315 - DNA, 20 bp, mouse
gttttaaggccgtctctttc

SEQ ID NO: 763316 - DNA, 20 bp, mouse
gggagtccgcaaatggggaa

SEQ ID NO: 763317 - DNA, 20 bp, mouse
ggctgcgtctgctgctggta

SEQ ID NO: 763318 - DNA, 20 bp, mouse
gcgcacccggacttccatcc

SEQ ID NO: 763319 - DNA, 20 bp, mouse
gtggggtggagtccgcaaat

SEQ ID NO: 763320 - DNA, 20 bp, mouse
gggtctgaccctggaactcc

SEQ ID NO: 763321 - DNA, 20 bp, mouse
gggtgcggataacgatgata

SEQ ID NO: 763322 - DNA, 20 bp, mouse
ggttccagggtcagacccag

SEQ ID NO: 763323 - DNA, 20 bp, mouse
gagggtcagacccagtgggg

SEQ ID NO: 763324 - DNA, 20 bp, mouse
gtatggccacgaagagtcct

SEQ ID NO: 763325 - DNA, 20 bp, mouse
gggcgcgctccggacgcacg

SEQ ID NO: 763326 - DNA, 20 bp, mouse
gaagaaattggggaccctaa

SEQ ID NO: 763327 - DNA, 20 bp, mouse
gagagcggcccttttaatga

SEQ ID NO: 763328 - DNA, 20 bp, mouse
ggtcgcaaccctcattaaaa

SEQ ID NO: 763329 - DNA, 20 bp, mouse
gaaaagggccgctctgggct

SEQ ID NO: 763330 - DNA, 20 bp, mouse
ggagaggctcttttgggcag

SEQ ID NO: 763331 - DNA, 20 bp, mouse
gcccacgcccataaaccagc

SEQ ID NO: 763332 - DNA, 20 bp, mouse
ggtgggcagacgttctggaa

SEQ ID NO: 763333 - DNA, 20 bp, mouse
ggtgaccacagcggggagag

SEQ ID NO: 763334 - DNA, 20 bp, mouse
gtggatgtagtgaccacagc

SEQ ID NO: 763335 - DNA, 20 bp, mouse
gtggggaccctaaaggggac

SEQ ID NO: 763336 - DNA, 20 bp, mouse
gtggccagggcgaagttccc

SEQ ID NO: 763337 - DNA, 20 bp, mouse
gcgctcctgcggtctggcca

SEQ ID NO: 763338 - DNA, 20 bp, mouse
gagacccgggaacttcgccc

SEQ ID NO: 763339 - DNA, 20 bp, mouse
gtcgccacgctcctgcggtc

SEQ ID NO: 763340 - DNA, 20 bp, mouse
gcgcaggagcgtggcgatcc

SEQ ID NO: 763341 - DNA, 20 bp, mouse
gtgtcacggagacgccggat

SEQ ID NO: 763342 - DNA, 20 bp, mouse
gttcgccctggccagaccgc

SEQ ID NO: 763343 - DNA, 20 bp, mouse
gcggagcagggtgcctgtca

SEQ ID NO: 763344 - DNA, 20 bp, mouse
gcggggctctagcgcgcggg

SEQ ID NO: 763345 - DNA, 20 bp, mouse
gtctagcgcgcgggaggagt

SEQ ID NO: 763346 - DNA, 20 bp, mouse
gctaacttgcacacccaact

SEQ ID NO: 763347 - DNA, 20 bp, mouse
gcctcagcagctgcaagcca

SEQ ID NO: 763348 - DNA, 20 bp, mouse
gcttcctggtcgcccgtcca

SEQ ID NO: 763349 - DNA, 20 bp, mouse
gacgggcgaccaggaagaga

SEQ ID NO: 763350 - DNA, 20 bp, mouse
gcaagttagctcattcatga

SEQ ID NO: 763351 - DNA, 20 bp, mouse
gagctgcaagccagggtatg

SEQ ID NO: 763352 - DNA, 20 bp, mouse
gctgccttggacgggcgacc

SEQ ID NO: 763353 - DNA, 20 bp, mouse
gtgggactcactagggaggg

SEQ ID NO: 763354 - DNA, 20 bp, mouse
gaaagggagagtccccagtt

SEQ ID NO: 763355 - DNA, 20 bp, mouse
ggaagagatggccttgcatg

SEQ ID NO: 763356 - DNA, 20 bp, mouse
gagggctagagctgataagt

SEQ ID NO: 763357 - DNA, 20 bp, mouse
ggacccagagggtgggaggc

SEQ ID NO: 763358 - DNA, 20 bp, mouse
gctcccaccctctgggtcag

SEQ ID NO: 763359 - DNA, 20 bp, mouse
gcccctgtcccacacacaat

SEQ ID NO: 763360 - DNA, 20 bp, mouse
gcgcctgggttccgccatga

SEQ ID NO: 763361 - DNA, 20 bp, mouse
ggtccggcctcccaccctct

SEQ ID NO: 763362 - DNA, 20 bp, mouse
gtgcccgctgacccagaggg

SEQ ID NO: 763363 - DNA, 20 bp, mouse
gagccctcatggcggaaccc

SEQ ID NO: 763364 - DNA, 20 bp, mouse
gtcatgcccgctgacccaga

SEQ ID NO: 763365 - DNA, 20 bp, mouse
gcagggaggctctaaaacct

SEQ ID NO: 763366 - DNA, 20 bp, mouse
gaacgtgagtgactactcga

SEQ ID NO: 763367 - DNA, 20 bp, mouse
gagcgaaagtggtttgactc

SEQ ID NO: 763368 - DNA, 20 bp, mouse
gtaatgcctagaacaggcta

SEQ ID NO: 763369 - DNA, 20 bp, mouse
gagacaccctagcctgttct

SEQ ID NO: 763370 - DNA, 20 bp, mouse
gaggttccggtgagcgaaag

SEQ ID NO: 763371 - DNA, 20 bp, mouse
gcctgtcgggcggaagtagg

SEQ ID NO: 763372 - DNA, 20 bp, mouse
gtagtcactcacgtttccgg

SEQ ID NO: 763373 - DNA, 20 bp, mouse
ggaagcgcctccgcgactag

SEQ ID NO: 763374 - DNA, 20 bp, mouse
gagtgactactcgaaggttc

SEQ ID NO: 763375 - DNA, 20 bp, mouse
gtggtgggaagggaattctt

SEQ ID NO: 763376 - DNA, 20 bp, mouse
gtggacttccgggattcaaa

SEQ ID NO: 763377 - DNA, 20 bp, mouse
gctggacgctgcaatcaatc

SEQ ID NO: 763378 - DNA, 20 bp, mouse
gtctctcaaggctacacctc

SEQ ID NO: 763379 - DNA, 20 bp, mouse
gtggatgaaagtccaggggc

SEQ ID NO: 763380 - DNA, 20 bp, mouse
gctgggtcaaaagagccagt

SEQ ID NO: 763381 - DNA, 20 bp, mouse
gtgcttctcaccattcccac

SEQ ID NO: 763382 - DNA, 20 bp, mouse
ggccccacctagatccaggt

SEQ ID NO: 763383 - DNA, 20 bp, mouse
gtccaggcatccagatcatg

SEQ ID NO: 763384 - DNA, 20 bp, mouse
gtctaggtggggctgtctga

SEQ ID NO: 763385 - DNA, 20 bp, mouse
gggtagagttccccatgatc

SEQ ID NO: 763386 - DNA, 20 bp, mouse
gtctgcgcctgtccgggcta

SEQ ID NO: 763387 - DNA, 20 bp, mouse
gcaggggcgggcccccatag

SEQ ID NO: 763388 - DNA, 20 bp, mouse
gagggagcgcgtcccgagcc

SEQ ID NO: 763389 - DNA, 20 bp, mouse
gccaggatctaaggatctta

SEQ ID NO: 763390 - DNA, 20 bp, mouse
gctggcgctgcggaaggatc

SEQ ID NO: 763391 - DNA, 20 bp, mouse
ggggagggacagggtccaca

SEQ ID NO: 763392 - DNA, 20 bp, mouse
gcaagacaaggaggaatgga

SEQ ID NO: 763393 - DNA, 20 bp, mouse
gcgcgctccctagcccggac

SEQ ID NO: 763394 - DNA, 20 bp, mouse
gatggaggggtgtatggaat

SEQ ID NO: 763395 - DNA, 20 bp, mouse
gcgggacgcgctccctagcc

SEQ ID NO: 763396 - DNA, 20 bp, mouse
gcggtcgagcgggcggagta

SEQ ID NO: 763397 - DNA, 20 bp, mouse
gccggtcctctgcgcgcgga

SEQ ID NO: 763398 - DNA, 20 bp, mouse
gccgcccatgagctcggaaa

SEQ ID NO: 763399 - DNA, 20 bp, mouse
gggcgggctcggcggtcgag

SEQ ID NO: 763400 - DNA, 20 bp, mouse
gcccatgagctcggaaaggg

SEQ ID NO: 763401 - DNA, 20 bp, mouse
ggaaacccctgggcgcgcgg

SEQ ID NO: 763402 - DNA, 20 bp, mouse
gagctcatgggcgggctcgg

SEQ ID NO: 763403 - DNA, 20 bp, mouse
gggagcctcgcggtgggagg

SEQ ID NO: 763404 - DNA, 20 bp, mouse
gcgcccaacatcaaacacta

SEQ ID NO: 763405 - DNA, 20 bp, mouse
gcccgcgtgtccttccgcct

SEQ ID NO: 763406 - DNA, 20 bp, mouse
gttaacctgcgtgacgtgac

SEQ ID NO: 763407 - DNA, 20 bp, mouse
gggcagacctgagtgtaccg

SEQ ID NO: 763408 - DNA, 20 bp, mouse
ggcttggcgggtagaagggt

SEQ ID NO: 763409 - DNA, 20 bp, mouse
gcagcccgacagcctcactt

SEQ ID NO: 763410 - DNA, 20 bp, mouse
gaccccaggaggccgggcag

SEQ ID NO: 763411 - DNA, 20 bp, mouse
gcccaggcttggcgggtaga

SEQ ID NO: 763412 - DNA, 20 bp, mouse
ggatggatgtgctcacgagc

SEQ ID NO: 763413 - DNA, 20 bp, mouse
gtcgccgaagtgaggctgtc

SEQ ID NO: 763414 - DNA, 20 bp, mouse
ggctcgccccgccccggggc

SEQ ID NO: 763415 - DNA, 20 bp, mouse
ggatacctgtcacgtcacgc

SEQ ID NO: 763416 - DNA, 20 bp, mouse
gagtaagagaggggcgtggc

SEQ ID NO: 763417 - DNA, 20 bp, mouse
gaggggcgtggctggccggg

SEQ ID NO: 763418 - DNA, 20 bp, mouse
gacagaggtgttgggacaag

SEQ ID NO: 763419 - DNA, 20 bp, mouse
gtcctggacaccctactgat

SEQ ID NO: 763420 - DNA, 20 bp, mouse
ggtggggggtcagccaaatg

SEQ ID NO: 763421 - DNA, 20 bp, mouse
gtgacaggaactcccccatt

SEQ ID NO: 763422 - DNA, 20 bp, mouse
gaggtcttagacagaggtgt

SEQ ID NO: 763423 - DNA, 20 bp, mouse
gtgaggcgtgcagcaggctc

SEQ ID NO: 763424 - DNA, 20 bp, mouse
gcaggaaacagctcagactg

SEQ ID NO: 763425 - DNA, 20 bp, mouse
gggtttgctcttagggccca

SEQ ID NO: 763426 - DNA, 20 bp, mouse
gcatcccaccaggacagggg

SEQ ID NO: 763427 - DNA, 20 bp, mouse
gctcccacccctgtcctggt

SEQ ID NO: 763428 - DNA, 20 bp, mouse
gaggcaggttgcatcccacc

SEQ ID NO: 763429 - DNA, 20 bp, mouse
gggttgcatcccaccaggac

SEQ ID NO: 763430 - DNA, 20 bp, mouse
gccgcctcccacccctgtcc

SEQ ID NO: 763431 - DNA, 20 bp, mouse
gtcctccactccagtgcttt

SEQ ID NO: 763432 - DNA, 20 bp, mouse
gactgtgcttggcttcgaag

SEQ ID NO: 763433 - DNA, 20 bp, mouse
gagtactttccccaaagcac

SEQ ID NO: 763434 - DNA, 20 bp, mouse
gggaccttgtagaccagcct

SEQ ID NO: 763435 - DNA, 20 bp, mouse
gaatcagcgatgattaagtc

SEQ ID NO: 763436 - DNA, 20 bp, mouse
ggcccccgggatcaaagcgg

SEQ ID NO: 763437 - DNA, 20 bp, mouse
gaacaactgcggcaccagat

SEQ ID NO: 763438 - DNA, 20 bp, mouse
gtcccggcccggctccgtgg

SEQ ID NO: 763439 - DNA, 20 bp, mouse
gcccgggcgcggcaggggga

SEQ ID NO: 763440 - DNA, 20 bp, mouse
gggcccctccgtcagacttg

SEQ ID NO: 763441 - DNA, 20 bp, mouse
gcgcctccggcggttgcaac

SEQ ID NO: 763442 - DNA, 20 bp, mouse
gggcccgcgccaatgagcgg

SEQ ID NO: 763443 - DNA, 20 bp, mouse
gcccctgccccgtgcattcg

SEQ ID NO: 763444 - DNA, 20 bp, mouse
gtccctgccccagacgccac

SEQ ID NO: 763445 - DNA, 20 bp, mouse
gccgcagggcgcccccgatg

SEQ ID NO: 763446 - DNA, 20 bp, mouse
gcccaaggcagctctcctta

SEQ ID NO: 763447 - DNA, 20 bp, mouse
ggccttggggcccatcacca

SEQ ID NO: 763448 - DNA, 20 bp, mouse
gtggggggaatcagctgggt

SEQ ID NO: 763449 - DNA, 20 bp, mouse
gggaaatagaaggagctccg

SEQ ID NO: 763450 - DNA, 20 bp, mouse
gggctcggggtcttggcctc

SEQ ID NO: 763451 - DNA, 20 bp, mouse
gtccgcggttgccttggtga

SEQ ID NO: 763452 - DNA, 20 bp, mouse
gggccgggcgccacgcccta

SEQ ID NO: 763453 - DNA, 20 bp, mouse
gaggaagtagcggtgtcagg

SEQ ID NO: 763454 - DNA, 20 bp, mouse
gcgctccagggacgcaaaac

SEQ ID NO: 763455 - DNA, 20 bp, mouse
gcagtccctccctgtgctca

SEQ ID NO: 763456 - DNA, 20 bp, mouse
gccgctcaggcaaacgtcag

SEQ ID NO: 763457 - DNA, 20 bp, mouse
gggcccaggcaacgccgctc

SEQ ID NO: 763458 - DNA, 20 bp, mouse
gggagtctccgcctgcgggg

SEQ ID NO: 763459 - DNA, 20 bp, mouse
ggcttgccgcggaaacccag

SEQ ID NO: 763460 - DNA, 20 bp, mouse
ggaggcggggtgaaaggtcg

SEQ ID NO: 763461 - DNA, 20 bp, mouse
ggcggcgcgtgtgggagtcg

SEQ ID NO: 763462 - DNA, 20 bp, mouse
gccggggcgctcccgcgggg

SEQ ID NO: 763463 - DNA, 20 bp, mouse
gactcccacacgcgccgcgc

SEQ ID NO: 763464 - DNA, 20 bp, mouse
ggcggggccggcctccgcgc

SEQ ID NO: 763465 - DNA, 20 bp, mouse
gcgggccggggcgctcccgc

SEQ ID NO: 763466 - DNA, 20 bp, mouse
ggggccacgcccatcacgct

SEQ ID NO: 763467 - DNA, 20 bp, mouse
gaaggcgtggaggagcctcg

SEQ ID NO: 763468 - DNA, 20 bp, mouse
gaataaaagggtgaagggta

SEQ ID NO: 763469 - DNA, 20 bp, mouse
ggtggcccaggcttcaagga

SEQ ID NO: 763470 - DNA, 20 bp, mouse
gttcaaggatggaccaatgg

SEQ ID NO: 763471 - DNA, 20 bp, mouse
ggtggggagccctcaagaaa

SEQ ID NO: 763472 - DNA, 20 bp, mouse
gccgcaaataaaagggtgaa

SEQ ID NO: 763473 - DNA, 20 bp, mouse
ggggtataataaggaccgcg

SEQ ID NO: 763474 - DNA, 20 bp, mouse
ggaccaatgggggcgcagaa

SEQ ID NO: 763475 - DNA, 20 bp, mouse
gcgcccctccgcaaataaaa

SEQ ID NO: 763476 - DNA, 20 bp, mouse
gtcagcagggaaaacccctg

SEQ ID NO: 763477 - DNA, 20 bp, mouse
gaaacccctgtggttgtcag

SEQ ID NO: 763478 - DNA, 20 bp, mouse
gtacactgagaaacataatt

SEQ ID NO: 763479 - DNA, 20 bp, mouse
gggggtgaaaaccctcagca

SEQ ID NO: 763480 - DNA, 20 bp, mouse
gaaacagttccgtttagacg

SEQ ID NO: 763481 - DNA, 20 bp, mouse
gagccaagctggccatagtc

SEQ ID NO: 763482 - DNA, 20 bp, mouse
gtgagggttttcaccccttc

SEQ ID NO: 763483 - DNA, 20 bp, mouse
gtctgccttcctcgtctaaa

SEQ ID NO: 763484 - DNA, 20 bp, mouse
gtctgagtaggtgtgcatat

SEQ ID NO: 763485 - DNA, 20 bp, mouse
gccctgcctctgacaaccac

SEQ ID NO: 763486 - DNA, 20 bp, mouse
gctgaccgaaattatgtaga

SEQ ID NO: 763487 - DNA, 20 bp, mouse
gaattatgtagaaggggagt

SEQ ID NO: 763488 - DNA, 20 bp, mouse
gcagagactcatatttacct

SEQ ID NO: 763489 - DNA, 20 bp, mouse
gatcgagagctaagtacata

SEQ ID NO: 763490 - DNA, 20 bp, mouse
gtccaggatccttcagaaat

SEQ ID NO: 763491 - DNA, 20 bp, mouse
gcagcttggtgatacgctct

SEQ ID NO: 763492 - DNA, 20 bp, mouse
ggccatgaagcatgtcagct

SEQ ID NO: 763493 - DNA, 20 bp, mouse
gcttgagagctgctcccaac

SEQ ID NO: 763494 - DNA, 20 bp, mouse
gaagtactgttgggaaaatt

SEQ ID NO: 763495 - DNA, 20 bp, mouse
ggatctcagcctcttgggaa

SEQ ID NO: 763496 - DNA, 20 bp, mouse
gtcgcgcgagacaaaggggc

SEQ ID NO: 763497 - DNA, 20 bp, mouse
gaggctcgcgcgagacaaag

SEQ ID NO: 763498 - DNA, 20 bp, mouse
ggagcagcgcggtgggagcc

SEQ ID NO: 763499 - DNA, 20 bp, mouse
gagacaaaggggctggcgca

SEQ ID NO: 763500 - DNA, 20 bp, mouse
gctggctggaggtctccacc

SEQ ID NO: 763501 - DNA, 20 bp, mouse
ggacgtcccgggtgggaagg

SEQ ID NO: 763502 - DNA, 20 bp, mouse
gggcaagggagcagcgcggt

SEQ ID NO: 763503 - DNA, 20 bp, mouse
ggcgtgggggcgagggtcaa

SEQ ID NO: 763504 - DNA, 20 bp, mouse
ggaaccgccgccacaacaac

SEQ ID NO: 763505 - DNA, 20 bp, mouse
gcggttcaggacgtcccggg

SEQ ID NO: 763506 - DNA, 20 bp, mouse
gtgggcttggcttgagtaag

SEQ ID NO: 763507 - DNA, 20 bp, mouse
ggacgtcgggggcccatcta

SEQ ID NO: 763508 - DNA, 20 bp, mouse
gcttcctggcaagaactagg

SEQ ID NO: 763509 - DNA, 20 bp, mouse
ggttccggggtcagtatgga

SEQ ID NO: 763510 - DNA, 20 bp, mouse
gtcttcagaagtgaccgggt

SEQ ID NO: 763511 - DNA, 20 bp, mouse
gcaaaactgcagagtgtttg

SEQ ID NO: 763512 - DNA, 20 bp, mouse
gcctggcaagaactaggagg

SEQ ID NO: 763513 - DNA, 20 bp, mouse
ggaccctctcctcagtgcta

SEQ ID NO: 763514 - DNA, 20 bp, mouse
gtcagcgtggtcaggcaagt

SEQ ID NO: 763515 - DNA, 20 bp, mouse
gcgaccgggccaaggttccg

SEQ ID NO: 763516 - DNA, 20 bp, mouse
gcctctccttccttagtcag

SEQ ID NO: 763517 - DNA, 20 bp, mouse
gaagcacaaaaaaacgagag

SEQ ID NO: 763518 - DNA, 20 bp, mouse
gcctgctgtgacctcctcca

SEQ ID NO: 763519 - DNA, 20 bp, mouse
ggaggcggcaggtgctttgg

SEQ ID NO: 763520 - DNA, 20 bp, mouse
gggacccagtagttgactca

SEQ ID NO: 763521 - DNA, 20 bp, mouse
gcaggaagactgccaggggg

SEQ ID NO: 763522 - DNA, 20 bp, mouse
ggttaggcacaccctggagg

SEQ ID NO: 763523 - DNA, 20 bp, mouse
ggagggggcaggtgaagttg

SEQ ID NO: 763524 - DNA, 20 bp, mouse
gccttttcttccatctgccc

SEQ ID NO: 763525 - DNA, 20 bp, mouse
gtgagaacagtcttgtacaa

SEQ ID NO: 763526 - DNA, 20 bp, mouse
gcgtgccggcgacagttcgg

SEQ ID NO: 763527 - DNA, 20 bp, mouse
ggcgggcagcggggccaaga

SEQ ID NO: 763528 - DNA, 20 bp, mouse
gagccggcgggcttccctcg

SEQ ID NO: 763529 - DNA, 20 bp, mouse
ggggcgtgccggcgacagtt

SEQ ID NO: 763530 - DNA, 20 bp, mouse
ggagcgggaaccgcagcccg

SEQ ID NO: 763531 - DNA, 20 bp, mouse
gtgagcccagccccgggctg

SEQ ID NO: 763532 - DNA, 20 bp, mouse
gggagcgtgcacgccaccgc

SEQ ID NO: 763533 - DNA, 20 bp, mouse
gtgcccgcacgccagcaaga

SEQ ID NO: 763534 - DNA, 20 bp, mouse
gctcaggccggggcaggagg

SEQ ID NO: 763535 - DNA, 20 bp, mouse
ggcccgggtcgcggaggcgt

SEQ ID NO: 763536 - DNA, 20 bp, mouse
gcccaagttcagaatctgga

SEQ ID NO: 763537 - DNA, 20 bp, mouse
gtgttggaatggggccacag

SEQ ID NO: 763538 - DNA, 20 bp, mouse
gaggcagaaggggttgagta

SEQ ID NO: 763539 - DNA, 20 bp, mouse
gacacaggatctcacttcaa

SEQ ID NO: 763540 - DNA, 20 bp, mouse
gagtgcccatgctgagataa

SEQ ID NO: 763541 - DNA, 20 bp, mouse
gagtcagtacaggtcaatac

SEQ ID NO: 763542 - DNA, 20 bp, mouse
gaactcccaagttcagaatc

SEQ ID NO: 763543 - DNA, 20 bp, mouse
gacgctccattcaggcagaa

SEQ ID NO: 763544 - DNA, 20 bp, mouse
gcagaaggggttgagtatgg

SEQ ID NO: 763545 - DNA, 20 bp, mouse
gtacttcctaatcactctcc

SEQ ID NO: 763546 - DNA, 20 bp, mouse
gtgaagatggcgatcgtggt

SEQ ID NO: 763547 - DNA, 20 bp, mouse
gccaccccttggaactcttg

SEQ ID NO: 763548 - DNA, 20 bp, mouse
gcgatcgtggtgggactcca

SEQ ID NO: 763549 - DNA, 20 bp, mouse
ggaactatctgggatagtgt

SEQ ID NO: 763550 - DNA, 20 bp, mouse
gtaactgaagatggcgatcg

SEQ ID NO: 763551 - DNA, 20 bp, mouse
gctgatgtggtcaaacggtg

SEQ ID NO: 763552 - DNA, 20 bp, mouse
gggaactatccagcaggcag

SEQ ID NO: 763553 - DNA, 20 bp, mouse
gattgccccaagagttccaa

SEQ ID NO: 763554 - DNA, 20 bp, mouse
ggcaggggccgctgtaggcg

SEQ ID NO: 763555 - DNA, 20 bp, mouse
gtacagcggcccctgcctgc

SEQ ID NO: 763556 - DNA, 20 bp, mouse
gaccccccggcgactctcgg

SEQ ID NO: 763557 - DNA, 20 bp, mouse
gtgagtgcgcggctcacact

SEQ ID NO: 763558 - DNA, 20 bp, mouse
gggcctctgcgagtcctgcg

SEQ ID NO: 763559 - DNA, 20 bp, mouse
gccccgccgagagtcgccgg

SEQ ID NO: 763560 - DNA, 20 bp, mouse
gggtagccgccggagcctgg

SEQ ID NO: 763561 - DNA, 20 bp, mouse
ggcggcacgcgctgagtgcg

SEQ ID NO: 763562 - DNA, 20 bp, mouse
gagcgcgtgccgcagggacg

SEQ ID NO: 763563 - DNA, 20 bp, mouse
gactgggtttggaccgtagg

SEQ ID NO: 763564 - DNA, 20 bp, mouse
gcggagcctggaggcttaag

SEQ ID NO: 763565 - DNA, 20 bp, mouse
ggggtccggccagtctggtc

SEQ ID NO: 763566 - DNA, 20 bp, mouse
gcgcgagcccagctgagagg

SEQ ID NO: 763567 - DNA, 20 bp, mouse
ggcaaacagcaaaacgtgtc

SEQ ID NO: 763568 - DNA, 20 bp, mouse
gaggtgcggggggtgtgcga

SEQ ID NO: 763569 - DNA, 20 bp, mouse
ggggccttttctcccttttg

SEQ ID NO: 763570 - DNA, 20 bp, mouse
ggcccagctgagaggaggag

SEQ ID NO: 763571 - DNA, 20 bp, mouse
gccgccgcgcacagtggccg

SEQ ID NO: 763572 - DNA, 20 bp, mouse
gagcccgcgggtgtaggaat

SEQ ID NO: 763573 - DNA, 20 bp, mouse
ggggtccaggctgaaacggg

SEQ ID NO: 763574 - DNA, 20 bp, mouse
gggaggaaggatgcaccggg

SEQ ID NO: 763575 - DNA, 20 bp, mouse
gaaagcaacatcctggaaag

SEQ ID NO: 763576 - DNA, 20 bp, mouse
gcgacgtcacgggatgacgt

SEQ ID NO: 763577 - DNA, 20 bp, mouse
gacgtcgaacgggagaggga

SEQ ID NO: 763578 - DNA, 20 bp, mouse
gccgtgacgtcgaacgggag

SEQ ID NO: 763579 - DNA, 20 bp, mouse
gaggaacagtacatggatta

SEQ ID NO: 763580 - DNA, 20 bp, mouse
ggggctaaagcaagctgcag

SEQ ID NO: 763581 - DNA, 20 bp, mouse
gaagctgcagagggagccac

SEQ ID NO: 763582 - DNA, 20 bp, mouse
gcgggatgacgtcggaagtc

SEQ ID NO: 763583 - DNA, 20 bp, mouse
gtcatcccgtgacgtcgaac

SEQ ID NO: 763584 - DNA, 20 bp, mouse
gatgacgtcggaagtctggg

SEQ ID NO: 763585 - DNA, 20 bp, mouse
gaccccccctccccagccag

SEQ ID NO: 763586 - DNA, 20 bp, mouse
gccggccaccaggtcctctc

SEQ ID NO: 763587 - DNA, 20 bp, mouse
gcgcaagcgcagtcgtgcgg

SEQ ID NO: 763588 - DNA, 20 bp, mouse
gtggccggctgtgggagcgt

SEQ ID NO: 763589 - DNA, 20 bp, mouse
gctcccgcaactccgcccag

SEQ ID NO: 763590 - DNA, 20 bp, mouse
ggggccgacgctcccacagc

SEQ ID NO: 763591 - DNA, 20 bp, mouse
ggcttccgcgggagacagaa

SEQ ID NO: 763592 - DNA, 20 bp, mouse
gtgtgggagcgtcggcccct

SEQ ID NO: 763593 - DNA, 20 bp, mouse
gacgacggttccgaggagaa

SEQ ID NO: 763594 - DNA, 20 bp, mouse
ggtggccagagaggacctgg

SEQ ID NO: 763595 - DNA, 20 bp, mouse
ggtgccccaaaggaagaagt

SEQ ID NO: 763596 - DNA, 20 bp, mouse
ggccctctgccccatctcgc

SEQ ID NO: 763597 - DNA, 20 bp, mouse
gaaaggacagttccacttga

SEQ ID NO: 763598 - DNA, 20 bp, mouse
gggacagttccacttgaggg

SEQ ID NO: 763599 - DNA, 20 bp, mouse
gatctcacaccctgcgagat

SEQ ID NO: 763600 - DNA, 20 bp, mouse
gctgcaagtggtaaatcagt

SEQ ID NO: 763601 - DNA, 20 bp, mouse
ggtggcgcacagactgcaag

SEQ ID NO: 763602 - DNA, 20 bp, mouse
gcagatgtatcaacttccaa

SEQ ID NO: 763603 - DNA, 20 bp, mouse
gaactccaatgggaccgagg

SEQ ID NO: 763604 - DNA, 20 bp, mouse
ggggcccagcagattttgag

SEQ ID NO: 763605 - DNA, 20 bp, mouse
gggaggagcgggcgacagaa

SEQ ID NO: 763606 - DNA, 20 bp, mouse
gacactgtagctactttcta

SEQ ID NO: 763607 - DNA, 20 bp, mouse
gcagaagccacttgactcct

SEQ ID NO: 763608 - DNA, 20 bp, mouse
gagcactttgatgtattcag

SEQ ID NO: 763609 - DNA, 20 bp, mouse
gcgctgacgccgggactcca

SEQ ID NO: 763610 - DNA, 20 bp, mouse
ggacgccgggactccaaggc

SEQ ID NO: 763611 - DNA, 20 bp, mouse
gactggaatctgatttccac

SEQ ID NO: 763612 - DNA, 20 bp, mouse
gacaccggcgaattcagcag

SEQ ID NO: 763613 - DNA, 20 bp, mouse
gagctctaaaacaggggatt

SEQ ID NO: 763614 - DNA, 20 bp, mouse
gaagctcttctctccacctg

SEQ ID NO: 763615 - DNA, 20 bp, mouse
ggagtccagcagtagtctct

SEQ ID NO: 763616 - DNA, 20 bp, mouse
gctgcccggggtgaggatta

SEQ ID NO: 763617 - DNA, 20 bp, mouse
ggaggcggggctaaactctc

SEQ ID NO: 763618 - DNA, 20 bp, mouse
gaaagggcgggttagccggt

SEQ ID NO: 763619 - DNA, 20 bp, mouse
gaaggcacgcccacaagggg

SEQ ID NO: 763620 - DNA, 20 bp, mouse
gtgcagacgtggctcggcaa

SEQ ID NO: 763621 - DNA, 20 bp, mouse
gtacgcagacgccggagaaa

SEQ ID NO: 763622 - DNA, 20 bp, mouse
ggcaagcgccctctaccgac

SEQ ID NO: 763623 - DNA, 20 bp, mouse
ggggttagccggtcggtaga

SEQ ID NO: 763624 - DNA, 20 bp, mouse
gggcggggctacgcagacgc

SEQ ID NO: 763625 - DNA, 20 bp, mouse
ggcgtagccccgccccttgt

SEQ ID NO: 763626 - DNA, 20 bp, mouse
gccagtgtctggtctcgcag

SEQ ID NO: 763627 - DNA, 20 bp, mouse
gggaccccagcgccttcact

SEQ ID NO: 763628 - DNA, 20 bp, mouse
gctaggaagttgacctcaga

SEQ ID NO: 763629 - DNA, 20 bp, mouse
ggagacagccggggaagctg

SEQ ID NO: 763630 - DNA, 20 bp, mouse
gcagttgcgtcaaaaaacga

SEQ ID NO: 763631 - DNA, 20 bp, mouse
gataaccctcgtctgtcatg

SEQ ID NO: 763632 - DNA, 20 bp, mouse
ggtggtagttagagccaacc

SEQ ID NO: 763633 - DNA, 20 bp, mouse
gatggcaccatctgatgtaa

SEQ ID NO: 763634 - DNA, 20 bp, mouse
gtcatggggccaataggact

SEQ ID NO: 763635 - DNA, 20 bp, mouse
gcagtacggcccagtcctat

SEQ ID NO: 763636 - DNA, 20 bp, mouse
ggcctggaagcggaagagat

SEQ ID NO: 763637 - DNA, 20 bp, mouse
gtgggtatagcgagataaga

SEQ ID NO: 763638 - DNA, 20 bp, mouse
gcgtaggccctgcctggaag

SEQ ID NO: 763639 - DNA, 20 bp, mouse
gagagatgggcggagataaa

SEQ ID NO: 763640 - DNA, 20 bp, mouse
gcaaagagcgagttctccgt

SEQ ID NO: 763641 - DNA, 20 bp, mouse
gtgggtcggtaccaatagag

SEQ ID NO: 763642 - DNA, 20 bp, mouse
ggcgctcgggaaggtatcga

SEQ ID NO: 763643 - DNA, 20 bp, mouse
gtaaacttgtcccggaccga

SEQ ID NO: 763644 - DNA, 20 bp, mouse
gcttccggaggaggggagaa

SEQ ID NO: 763645 - DNA, 20 bp, mouse
ggcccccaagcgtgcctatt

SEQ ID NO: 763646 - DNA, 20 bp, mouse
gtcccccggggcggttgcta

SEQ ID NO: 763647 - DNA, 20 bp, mouse
gtctcccgccaggactgcgg

SEQ ID NO: 763648 - DNA, 20 bp, mouse
gggcgcgcgaaggctcttaa

SEQ ID NO: 763649 - DNA, 20 bp, mouse
gagtcctggcgggagaccga

SEQ ID NO: 763650 - DNA, 20 bp, mouse
ggggccgtcacgtgatgctc

SEQ ID NO: 763651 - DNA, 20 bp, mouse
gtccctagcaaccgccccgg

SEQ ID NO: 763652 - DNA, 20 bp, mouse
ggagggggaggccctggcaa

SEQ ID NO: 763653 - DNA, 20 bp, mouse
gggcctgagcgccgttgcca

SEQ ID NO: 763654 - DNA, 20 bp, mouse
gggcccggagcatcacgtga

SEQ ID NO: 763655 - DNA, 20 bp, mouse
gctctcccccgcagtcctgg

SEQ ID NO: 763656 - DNA, 20 bp, mouse
gctaacagggtgagtggtga

SEQ ID NO: 763657 - DNA, 20 bp, mouse
gcgcctgcgcgctccacctg

SEQ ID NO: 763658 - DNA, 20 bp, mouse
gcaaaaggggaccccccaac

SEQ ID NO: 763659 - DNA, 20 bp, mouse
gaggaggcattctgctgtag

SEQ ID NO: 763660 - DNA, 20 bp, mouse
gtgcggcaatggatccggga

SEQ ID NO: 763661 - DNA, 20 bp, mouse
gccccccaacaggatgcaga

SEQ ID NO: 763662 - DNA, 20 bp, mouse
gacgttgcggcaatggatcc

SEQ ID NO: 763663 - DNA, 20 bp, mouse
gcactcccgacacttttctc

SEQ ID NO: 763664 - DNA, 20 bp, mouse
gctgcgcgctccacctgcgg

SEQ ID NO: 763665 - DNA, 20 bp, mouse
gcactcagacgcctgacaaa

SEQ ID NO: 763666 - DNA, 20 bp, mouse
ggccacttgccccccaacgg

SEQ ID NO: 763667 - DNA, 20 bp, mouse
gaggcccggaaggcgcagta

SEQ ID NO: 763668 - DNA, 20 bp, mouse
gcccggccggggtcgtgggg

SEQ ID NO: 763669 - DNA, 20 bp, mouse
ggcgaggcgcagtcccacga

SEQ ID NO: 763670 - DNA, 20 bp, mouse
gcctggaagcgctccagctc

SEQ ID NO: 763671 - DNA, 20 bp, mouse
gaggcgcagtcccacgaggg

SEQ ID NO: 763672 - DNA, 20 bp, mouse
ggcggcctacgcggaataaa

SEQ ID NO: 763673 - DNA, 20 bp, mouse
gtgccctggagccacgtccg

SEQ ID NO: 763674 - DNA, 20 bp, mouse
ggggccgtactgcgccttcc

SEQ ID NO: 763675 - DNA, 20 bp, mouse
gcggctgtccctggcaagtg

SEQ ID NO: 763676 - DNA, 20 bp, mouse
gcctcggcgcgcgccctcag

SEQ ID NO: 763677 - DNA, 20 bp, mouse
gaggccgcggtcggcgaacg

SEQ ID NO: 763678 - DNA, 20 bp, mouse
gggcaggaaagagccacgaa

SEQ ID NO: 763679 - DNA, 20 bp, mouse
ggggctgcctacggggaagg

SEQ ID NO: 763680 - DNA, 20 bp, mouse
gaggagcaggcggcgagcga

SEQ ID NO: 763681 - DNA, 20 bp, mouse
gcgcccgcgcccggtgaatg

SEQ ID NO: 763682 - DNA, 20 bp, mouse
gggcgggctgcctacgggga

SEQ ID NO: 763683 - DNA, 20 bp, mouse
gcctccgcccccttccccgt

SEQ ID NO: 763684 - DNA, 20 bp, mouse
gctgcgtgcgcgaccccgcg

SEQ ID NO: 763685 - DNA, 20 bp, mouse
ggcgggcgcgaccccgctga

SEQ ID NO: 763686 - DNA, 20 bp, mouse
gtccccaggggagtacggga

SEQ ID NO: 763687 - DNA, 20 bp, mouse
gtaactccaggcttaggctg

SEQ ID NO: 763688 - DNA, 20 bp, mouse
gagagtccccaggggagtac

SEQ ID NO: 763689 - DNA, 20 bp, mouse
gtaagagcagagagtcccca

SEQ ID NO: 763690 - DNA, 20 bp, mouse
gcccccctcccgtactcccc

SEQ ID NO: 763691 - DNA, 20 bp, mouse
gtccccccaggctgccggtg

SEQ ID NO: 763692 - DNA, 20 bp, mouse
gtctatataactccaggctt

SEQ ID NO: 763693 - DNA, 20 bp, mouse
ggatgcataaatcttgtctc

SEQ ID NO: 763694 - DNA, 20 bp, mouse
ggggaaatctagacaagcaa

SEQ ID NO: 763695 - DNA, 20 bp, mouse
gaggattggaggttcttcta

SEQ ID NO: 763696 - DNA, 20 bp, mouse
ggcaccgcccgcactttgga

SEQ ID NO: 763697 - DNA, 20 bp, mouse
ggtgcccgccgcagccctgg

SEQ ID NO: 763698 - DNA, 20 bp, mouse
gcacctgtgcggccgagcga

SEQ ID NO: 763699 - DNA, 20 bp, mouse
gggctggtgtgtgtccacca

SEQ ID NO: 763700 - DNA, 20 bp, mouse
ggggacccctacagagaagc

SEQ ID NO: 763701 - DNA, 20 bp, mouse
gctcccccgcaaactctccc

SEQ ID NO: 763702 - DNA, 20 bp, mouse
gctcgtgccatgtaaagagt

SEQ ID NO: 763703 - DNA, 20 bp, mouse
gttggagggtgcggggtcct

SEQ ID NO: 763704 - DNA, 20 bp, mouse
ggtcctgggagagtttgcgg

SEQ ID NO: 763705 - DNA, 20 bp, mouse
ggtgccgggtgccatggaga

SEQ ID NO: 763706 - DNA, 20 bp, mouse
gacacctagaggattaaaca

SEQ ID NO: 763707 - DNA, 20 bp, mouse
ggaccattctggcatactta

SEQ ID NO: 763708 - DNA, 20 bp, mouse
ggctctgattactgcctcct

SEQ ID NO: 763709 - DNA, 20 bp, mouse
gaaacaaggcaagccttccc

SEQ ID NO: 763710 - DNA, 20 bp, mouse
gcaaggcaagccttcccagg

SEQ ID NO: 763711 - DNA, 20 bp, mouse
ggctactctcagcctgctta

SEQ ID NO: 763712 - DNA, 20 bp, mouse
ggggctctccttgtccctat

SEQ ID NO: 763713 - DNA, 20 bp, mouse
gagcctgcttaggggcggct

SEQ ID NO: 763714 - DNA, 20 bp, mouse
gctctccttgtccctattgg

SEQ ID NO: 763715 - DNA, 20 bp, mouse
gacccttaagtatgccagaa

SEQ ID NO: 763716 - DNA, 20 bp, mouse
ggacctctactactatccct

SEQ ID NO: 763717 - DNA, 20 bp, mouse
gcctgcagtcagggactccc

SEQ ID NO: 763718 - DNA, 20 bp, mouse
ggatagtagtagaggtcccc

SEQ ID NO: 763719 - DNA, 20 bp, mouse
gttcctagggatagtagtag

SEQ ID NO: 763720 - DNA, 20 bp, mouse
ggtcagggaaaccaaagcta

SEQ ID NO: 763721 - DNA, 20 bp, mouse
gcagagcaccgcacggtgtg

SEQ ID NO: 763722 - DNA, 20 bp, mouse
gcgccacaaccccgtgccac

SEQ ID NO: 763723 - DNA, 20 bp, mouse
gtgcactaaacggtcggttt

SEQ ID NO: 763724 - DNA, 20 bp, mouse
gacaggttgcactaaacggt

SEQ ID NO: 763725 - DNA, 20 bp, mouse
gatcacgacctcacaccgtg

SEQ ID NO: 763726 - DNA, 20 bp, mouse
ggtggggcgaggtgctgtag

SEQ ID NO: 763727 - DNA, 20 bp, mouse
gcgaggtgctgtagaggaga

SEQ ID NO: 763728 - DNA, 20 bp, mouse
gagggcggggcctagatggt

SEQ ID NO: 763729 - DNA, 20 bp, mouse
gtggccaggccttaagggcg

SEQ ID NO: 763730 - DNA, 20 bp, mouse
ggggcgtggccaggccttaa

SEQ ID NO: 763731 - DNA, 20 bp, mouse
ggagcaagctggggatgtta

SEQ ID NO: 763732 - DNA, 20 bp, mouse
gcatctaggccccgccctta

SEQ ID NO: 763733 - DNA, 20 bp, mouse
gcgtaacgtggcaactagag

SEQ ID NO: 763734 - DNA, 20 bp, mouse
gtggggagaagggcgtaacg

SEQ ID NO: 763735 - DNA, 20 bp, mouse
ggggcggagccatactttcg

SEQ ID NO: 763736 - DNA, 20 bp, mouse
ggtgaagcatagccaataat

SEQ ID NO: 763737 - DNA, 20 bp, mouse
gcgcccgccaatccacgcat

SEQ ID NO: 763738 - DNA, 20 bp, mouse
ggcccctagcagcctattat

SEQ ID NO: 763739 - DNA, 20 bp, mouse
ggggagctgcatgatttgca

SEQ ID NO: 763740 - DNA, 20 bp, mouse
gcggaacggggcgtgggatc

SEQ ID NO: 763741 - DNA, 20 bp, mouse
gctcccgccgatgcgtggat

SEQ ID NO: 763742 - DNA, 20 bp, mouse
ggaggtaaagatgctgcggg

SEQ ID NO: 763743 - DNA, 20 bp, mouse
gcagcctcgcaggtgcccgc

SEQ ID NO: 763744 - DNA, 20 bp, mouse
gcggagcgagcgggattcgg

SEQ ID NO: 763745 - DNA, 20 bp, mouse
gacgccagtcacagtctcat

SEQ ID NO: 763746 - DNA, 20 bp, mouse
ggagctaggcctgtgtgcgt

SEQ ID NO: 763747 - DNA, 20 bp, mouse
gtaggcctgtgtgcgtggga

SEQ ID NO: 763748 - DNA, 20 bp, mouse
gtggggccttggggtcaccc

SEQ ID NO: 763749 - DNA, 20 bp, mouse
ggtagccttcccacgcacac

SEQ ID NO: 763750 - DNA, 20 bp, mouse
ggcaaagagcaaggatgtcc

SEQ ID NO: 763751 - DNA, 20 bp, mouse
ggcggtacatgccacagtct

SEQ ID NO: 763752 - DNA, 20 bp, mouse
gaaacccatacccacagaag

SEQ ID NO: 763753 - DNA, 20 bp, mouse
gcaggatggaacgcagagct

SEQ ID NO: 763754 - DNA, 20 bp, mouse
gcccctgctggtgaatatgc

SEQ ID NO: 763755 - DNA, 20 bp, mouse
ggtctgggctgcaaagagca

SEQ ID NO: 763756 - DNA, 20 bp, mouse
ggacctgaatgggagattct

SEQ ID NO: 763757 - DNA, 20 bp, mouse
gaccacagcaggctctgctt

SEQ ID NO: 763758 - DNA, 20 bp, mouse
gcaaccgggtgcgggtgcac

SEQ ID NO: 763759 - DNA, 20 bp, mouse
gcaggatgcaatgctctcag

SEQ ID NO: 763760 - DNA, 20 bp, mouse
gacagcaggctctgcttagg

SEQ ID NO: 763761 - DNA, 20 bp, mouse
gtgctctcagaggacctgaa

SEQ ID NO: 763762 - DNA, 20 bp, mouse
gcaccaagaatctcccattc

SEQ ID NO: 763763 - DNA, 20 bp, mouse
gccaagaaggaacagcaatt

SEQ ID NO: 763764 - DNA, 20 bp, mouse
ggcaccatccagacccaaga

SEQ ID NO: 763765 - DNA, 20 bp, mouse
gtctcaaagcaaccgggtgc

SEQ ID NO: 763766 - DNA, 20 bp, mouse
gaggacagtgggtatccaag

SEQ ID NO: 763767 - DNA, 20 bp, mouse
ggcactagttgctccttctt

SEQ ID NO: 763768 - DNA, 20 bp, mouse
gggaccacgtggggccgcgc

SEQ ID NO: 763769 - DNA, 20 bp, mouse
ggagcaactagtgcagtctc

SEQ ID NO: 763770 - DNA, 20 bp, mouse
gtcccggactcagaataata

SEQ ID NO: 763771 - DNA, 20 bp, mouse
gaggggctgcgggaccacgt

SEQ ID NO: 763772 - DNA, 20 bp, mouse
ggcacttgcaggacttgaac

SEQ ID NO: 763773 - DNA, 20 bp, mouse
gagatgttgtgatacagtgg

SEQ ID NO: 763774 - DNA, 20 bp, mouse
gagccggtgaagcagctccc

SEQ ID NO: 763775 - DNA, 20 bp, mouse
gcggttgcgcttttaactca

SEQ ID NO: 763776 - DNA, 20 bp, mouse
gaggctgggcccaggaccct

SEQ ID NO: 763777 - DNA, 20 bp, mouse
ggggcccagcctaggggaag

SEQ ID NO: 763778 - DNA, 20 bp, mouse
gggtcctgggcccagcctag

SEQ ID NO: 763779 - DNA, 20 bp, mouse
gcggagagagaggcgaaaca

SEQ ID NO: 763780 - DNA, 20 bp, mouse
gtcacagtcttctgaaccca

SEQ ID NO: 763781 - DNA, 20 bp, mouse
gggcacggacgagggacgcg

SEQ ID NO: 763782 - DNA, 20 bp, mouse
gcttctgaacccagggtcct

SEQ ID NO: 763783 - DNA, 20 bp, mouse
gaagcaccggacatcggcac

SEQ ID NO: 763784 - DNA, 20 bp, mouse
gtcgctcaacacactccgcc

SEQ ID NO: 763785 - DNA, 20 bp, mouse
gcatgcgcgcggccgttggc

SEQ ID NO: 763786 - DNA, 20 bp, mouse
gcttgggcgacagtagtgga

SEQ ID NO: 763787 - DNA, 20 bp, mouse
gagcacgagcggagaagacg

SEQ ID NO: 763788 - DNA, 20 bp, mouse
gtgcgcttgggcgacagtag

SEQ ID NO: 763789 - DNA, 20 bp, mouse
gctgggcccgcgagcacgag

SEQ ID NO: 763790 - DNA, 20 bp, mouse
ggcgcacgcgcgttcgtctc

SEQ ID NO: 763791 - DNA, 20 bp, mouse
gcaggcctacggggaacgga

SEQ ID NO: 763792 - DNA, 20 bp, mouse
gggagaaaagagacgctctg

SEQ ID NO: 763793 - DNA, 20 bp, mouse
gagaaaacgcgcctgcgctt

SEQ ID NO: 763794 - DNA, 20 bp, mouse
ggcaaaagcgcgactgtgcg

SEQ ID NO: 763795 - DNA, 20 bp, mouse
ggactgtgcggggagtggga

SEQ ID NO: 763796 - DNA, 20 bp, mouse
ggtgtcagctgcggtgggtc

SEQ ID NO: 763797 - DNA, 20 bp, mouse
gccgcgcaggatcacttccg

SEQ ID NO: 763798 - DNA, 20 bp, mouse
gaaaggcgggatctggtctg

SEQ ID NO: 763799 - DNA, 20 bp, mouse
gtccggggccgcgcagacgc

SEQ ID NO: 763800 - DNA, 20 bp, mouse
gtccgacgcaagggccgcgc

SEQ ID NO: 763801 - DNA, 20 bp, mouse
gggatcaggtcacgtccgga

SEQ ID NO: 763802 - DNA, 20 bp, mouse
ggcgtctccttccgacgcaa

SEQ ID NO: 763803 - DNA, 20 bp, mouse
gcccagatgcaacctaggtg

SEQ ID NO: 763804 - DNA, 20 bp, mouse
gcgcagcccagatgcaacct

SEQ ID NO: 763805 - DNA, 20 bp, mouse
gctgcgcgtgcgtggaacaa

SEQ ID NO: 763806 - DNA, 20 bp, mouse
gccagaagaaatctccacga

SEQ ID NO: 763807 - DNA, 20 bp, mouse
gtcgcctcttccacgaggac

SEQ ID NO: 763808 - DNA, 20 bp, mouse
ggcgctcgccacacgaagca

SEQ ID NO: 763809 - DNA, 20 bp, mouse
ggccggccgccatgctgaaa

SEQ ID NO: 763810 - DNA, 20 bp, mouse
gaccggaactggctgaggcg

SEQ ID NO: 763811 - DNA, 20 bp, mouse
gtatgtatatatccccgggt

SEQ ID NO: 763812 - DNA, 20 bp, mouse
ggggagtggcagagtggtac

SEQ ID NO: 763813 - DNA, 20 bp, mouse
gctcgccacacgaagcaggg

SEQ ID NO: 763814 - DNA, 20 bp, mouse
gctccagcatgatcaggaag

SEQ ID NO: 763815 - DNA, 20 bp, mouse
gttccggtcccgcccattaa

SEQ ID NO: 763816 - DNA, 20 bp, mouse
ggcttctgagcctctctcga

SEQ ID NO: 763817 - DNA, 20 bp, mouse
gaggcaccgaaggtgttccg

SEQ ID NO: 763818 - DNA, 20 bp, mouse
ggaccctccaccctcgagag

SEQ ID NO: 763819 - DNA, 20 bp, mouse
gactcctgatgatggatgta

SEQ ID NO: 763820 - DNA, 20 bp, mouse
gtggaaatcacatggtgccg

SEQ ID NO: 763821 - DNA, 20 bp, mouse
ggatgcccaaaagcatgaaa

SEQ ID NO: 763822 - DNA, 20 bp, mouse
gtatagaagcaggaaggcag

SEQ ID NO: 763823 - DNA, 20 bp, mouse
gagcctctctcgagggtgga

SEQ ID NO: 763824 - DNA, 20 bp, mouse
gcatggtgccggggtgaggt

SEQ ID NO: 763825 - DNA, 20 bp, mouse
ggggtcaggggtaaggtgtc

SEQ ID NO: 763826 - DNA, 20 bp, mouse
gcgcgcccagggcaccaggg

SEQ ID NO: 763827 - DNA, 20 bp, mouse
gcaagcgccacccgtggccg

SEQ ID NO: 763828 - DNA, 20 bp, mouse
gggcaggggcggctcagggg

SEQ ID NO: 763829 - DNA, 20 bp, mouse
gagaggctggggcgacagtg

SEQ ID NO: 763830 - DNA, 20 bp, mouse
ggagccccggcgcgcgccca

SEQ ID NO: 763831 - DNA, 20 bp, mouse
gccccgccgccctggtgccc

SEQ ID NO: 763832 - DNA, 20 bp, mouse
gccaggggcaggggcggctc

SEQ ID NO: 763833 - DNA, 20 bp, mouse
gacgggtggcgcttgccccc

SEQ ID NO: 763834 - DNA, 20 bp, mouse
ggcaccagggcggcggggca

SEQ ID NO: 763835 - DNA, 20 bp, mouse
gctggcgaggggaggcgctg

SEQ ID NO: 763836 - DNA, 20 bp, mouse
gtggagctgctcaaggcaaa

SEQ ID NO: 763837 - DNA, 20 bp, mouse
gaatcctgaggcgagcgccc

SEQ ID NO: 763838 - DNA, 20 bp, mouse
ggacccatgcagggaagcag

SEQ ID NO: 763839 - DNA, 20 bp, mouse
gtcgctgcaagtgacagaat

SEQ ID NO: 763840 - DNA, 20 bp, mouse
gtcttgcagctgagggtctg

SEQ ID NO: 763841 - DNA, 20 bp, mouse
gggaagcagagggtgacggc

SEQ ID NO: 763842 - DNA, 20 bp, mouse
ggggtgagtggagctgctca

SEQ ID NO: 763843 - DNA, 20 bp, mouse
ggcgcccaggaagataacca

SEQ ID NO: 763844 - DNA, 20 bp, mouse
gaacagggacatctagggtg

SEQ ID NO: 763845 - DNA, 20 bp, mouse
gagctggggggctataaaaa

SEQ ID NO: 763846 - DNA, 20 bp, mouse
ggcaagccttgtatagaaat

SEQ ID NO: 763847 - DNA, 20 bp, mouse
gtgtgtggagtattcattgt

SEQ ID NO: 763848 - DNA, 20 bp, mouse
gtcacccctctgtgcctgtg

SEQ ID NO: 763849 - DNA, 20 bp, mouse
gccagcctgtggcgagtgtg

SEQ ID NO: 763850 - DNA, 20 bp, mouse
gatagaaatgggctgggcta

SEQ ID NO: 763851 - DNA, 20 bp, mouse
gcactcagccccagtataaa

SEQ ID NO: 763852 - DNA, 20 bp, mouse
gccacccctactccgtgaaa

SEQ ID NO: 763853 - DNA, 20 bp, mouse
gtaagccccacactcgccac

SEQ ID NO: 763854 - DNA, 20 bp, mouse
gcagaccttttcacggagta

SEQ ID NO: 763855 - DNA, 20 bp, mouse
gcccagcccatttctataca

SEQ ID NO: 763856 - DNA, 20 bp, mouse
gcgaatcgacggcccggagg

SEQ ID NO: 763857 - DNA, 20 bp, mouse
ggagccgccggctccttcgg

SEQ ID NO: 763858 - DNA, 20 bp, mouse
gccgccggctccttcggagg

SEQ ID NO: 763859 - DNA, 20 bp, mouse
gtgggtgcgctctgagtccg

SEQ ID NO: 763860 - DNA, 20 bp, mouse
gctccttcggaggtgggatg

SEQ ID NO: 763861 - DNA, 20 bp, mouse
gagcccccgtggccccctcc

SEQ ID NO: 763862 - DNA, 20 bp, mouse
ggcgcacgcggccgaatcga

SEQ ID NO: 763863 - DNA, 20 bp, mouse
gtgtgggttggagcagaaga

SEQ ID NO: 763864 - DNA, 20 bp, mouse
gtgcgctgtgccattggccc

SEQ ID NO: 763865 - DNA, 20 bp, mouse
ggccaatggcacagcgcacg

SEQ ID NO: 763866 - DNA, 20 bp, mouse
gaactggcgcacgcgagggt

SEQ ID NO: 763867 - DNA, 20 bp, mouse
gttgtcgccgaatctgggag

SEQ ID NO: 763868 - DNA, 20 bp, mouse
gaatcctcccctcccagatt

SEQ ID NO: 763869 - DNA, 20 bp, mouse
ggctgggaggaaggagttaa

SEQ ID NO: 763870 - DNA, 20 bp, mouse
gtcggcgacaagagagccgg

SEQ ID NO: 763871 - DNA, 20 bp, mouse
ggtgggaaccagccatagtc

SEQ ID NO: 763872 - DNA, 20 bp, mouse
gtccggctggcccaagtctc

SEQ ID NO: 763873 - DNA, 20 bp, mouse
gctctcttgtcgccgaatct

SEQ ID NO: 763874 - DNA, 20 bp, mouse
ggaccacaaggtcccgagcc

SEQ ID NO: 763875 - DNA, 20 bp, mouse
ggaagagggtcagcaataac

SEQ ID NO: 763876 - DNA, 20 bp, mouse
ggggcccgggagaagcggag

SEQ ID NO: 763877 - DNA, 20 bp, mouse
gcgcggaaggactgggacat

SEQ ID NO: 763878 - DNA, 20 bp, mouse
gcgcccgccgcggaaggact

SEQ ID NO: 763879 - DNA, 20 bp, mouse
gaagccagagccccgggctg

SEQ ID NO: 763880 - DNA, 20 bp, mouse
gggacacctcacagctgatc

SEQ ID NO: 763881 - DNA, 20 bp, mouse
ggggccgaggcgacctgacc

SEQ ID NO: 763882 - DNA, 20 bp, mouse
gaagggaggaatctgagcct

SEQ ID NO: 763883 - DNA, 20 bp, mouse
ggggccgccgcagctccgga

SEQ ID NO: 763884 - DNA, 20 bp, mouse
gccacctcagcccggggctc

SEQ ID NO: 763885 - DNA, 20 bp, mouse
gagggagcgaagcgaggcct

SEQ ID NO: 763886 - DNA, 20 bp, mouse
gtgagcaccggcaactagtg

SEQ ID NO: 763887 - DNA, 20 bp, mouse
gggacccggcaaccgcgagt

SEQ ID NO: 763888 - DNA, 20 bp, mouse
ggtgccgcgaggtctcccgc

SEQ ID NO: 763889 - DNA, 20 bp, mouse
ggtaggccaggggtgcgggg

SEQ ID NO: 763890 - DNA, 20 bp, mouse
gtctctgcaacgggtggggt

SEQ ID NO: 763891 - DNA, 20 bp, mouse
gcgcgagtaggccaggggtg

SEQ ID NO: 763892 - DNA, 20 bp, mouse
gggcaaccgcgagtaggcca

SEQ ID NO: 763893 - DNA, 20 bp, mouse
gcttgtctctgcaacgggtg

SEQ ID NO: 763894 - DNA, 20 bp, mouse
gccggcaactagtggggctt

SEQ ID NO: 763895 - DNA, 20 bp, mouse
ggccgggcttgtctctgcaa

SEQ ID NO: 763896 - DNA, 20 bp, mouse
ggtcccaggaagtctcgggt

SEQ ID NO: 763897 - DNA, 20 bp, mouse
gtgaggagggcaaaattcta

SEQ ID NO: 763898 - DNA, 20 bp, mouse
gaagtgaagctactccgtaa

SEQ ID NO: 763899 - DNA, 20 bp, mouse
gaagctactccgtaacggag

SEQ ID NO: 763900 - DNA, 20 bp, mouse
gagcggtggcgcggctggcg

SEQ ID NO: 763901 - DNA, 20 bp, mouse
gggtgggtagacatcgcacc

SEQ ID NO: 763902 - DNA, 20 bp, mouse
gcctgcgcagggcgactcag

SEQ ID NO: 763903 - DNA, 20 bp, mouse
gctactccgtaacggagcgg

SEQ ID NO: 763904 - DNA, 20 bp, mouse
gggcgtggttgccgctggat

SEQ ID NO: 763905 - DNA, 20 bp, mouse
gggaaggcgtggagcactac

SEQ ID NO: 763906 - DNA, 20 bp, mouse
gcccccgcgcatgcccggac

SEQ ID NO: 763907 - DNA, 20 bp, mouse
gccggcgcagtcgcctgtcc

SEQ ID NO: 763908 - DNA, 20 bp, mouse
ggcactctagtagctcgcta

SEQ ID NO: 763909 - DNA, 20 bp, mouse
gaaaggcaggagcggtggtc

SEQ ID NO: 763910 - DNA, 20 bp, mouse
gtgcagccaaggcgtcgcgc

SEQ ID NO: 763911 - DNA, 20 bp, mouse
gagctactagagtgcagcca

SEQ ID NO: 763912 - DNA, 20 bp, mouse
gctgcgccggcgcgacgcct

SEQ ID NO: 763913 - DNA, 20 bp, mouse
gcgcctgtccgggcatgcgc

SEQ ID NO: 763914 - DNA, 20 bp, mouse
gggaaccagcgggagtgcat

SEQ ID NO: 763915 - DNA, 20 bp, mouse
ggaagccggcacctcggcct

SEQ ID NO: 763916 - DNA, 20 bp, mouse
gtctgagtgaagtcaacccc

SEQ ID NO: 763917 - DNA, 20 bp, mouse
gcactcagagcttgccatta

SEQ ID NO: 763918 - DNA, 20 bp, mouse
ggctgtcaccgagtgtccag

SEQ ID NO: 763919 - DNA, 20 bp, mouse
gagcttccctgtgacatggg

SEQ ID NO: 763920 - DNA, 20 bp, mouse
gctttgaagggcatccttaa

SEQ ID NO: 763921 - DNA, 20 bp, mouse
gtgagtgtagaggcctgatc

SEQ ID NO: 763922 - DNA, 20 bp, mouse
gaagtcaacccctggacact

SEQ ID NO: 763923 - DNA, 20 bp, mouse
gaatacaagtgaaatcactg

SEQ ID NO: 763924 - DNA, 20 bp, mouse
gtgactggttggcctggctg

SEQ ID NO: 763925 - DNA, 20 bp, mouse
ggaaatcactgagggatcca

SEQ ID NO: 763926 - DNA, 20 bp, mouse
gcaggtctgtgggatggtga

SEQ ID NO: 763927 - DNA, 20 bp, mouse
gcggacaggcaagcccatcc

SEQ ID NO: 763928 - DNA, 20 bp, mouse
gtggacaggcaagcccggac

SEQ ID NO: 763929 - DNA, 20 bp, mouse
gaaggtctatcacacaagtt

SEQ ID NO: 763930 - DNA, 20 bp, mouse
gccacactgggcaggtctgt

SEQ ID NO: 763931 - DNA, 20 bp, mouse
gtatcccaattgctccttag

SEQ ID NO: 763932 - DNA, 20 bp, mouse
gaggccgtgctcacgtttcc

SEQ ID NO: 763933 - DNA, 20 bp, mouse
gagtgtggccgcatcctaag

SEQ ID NO: 763934 - DNA, 20 bp, mouse
gagcaattgggatatttagc

SEQ ID NO: 763935 - DNA, 20 bp, mouse
gttagctggtccactaattc

SEQ ID NO: 763936 - DNA, 20 bp, mouse
gacgctgcggcggtaggagg

SEQ ID NO: 763937 - DNA, 20 bp, mouse
gcgcgcgagggagtgaacga

SEQ ID NO: 763938 - DNA, 20 bp, mouse
gggcgggccaggagcaccgg

SEQ ID NO: 763939 - DNA, 20 bp, mouse
gcgccagcggaggtctcgcg

SEQ ID NO: 763940 - DNA, 20 bp, mouse
gtggacgctgcggcggtagg

SEQ ID NO: 763941 - DNA, 20 bp, mouse
gggtgctcctggcccgccca

SEQ ID NO: 763942 - DNA, 20 bp, mouse
gcggcaaggctcgcgagaag

SEQ ID NO: 763943 - DNA, 20 bp, mouse
gcccccgtgggagaaggagc

SEQ ID NO: 763944 - DNA, 20 bp, mouse
gtgaacgagggaggcagccg

SEQ ID NO: 763945 - DNA, 20 bp, mouse
ggattggccaagcacaaggg

SEQ ID NO: 763946 - DNA, 20 bp, mouse
gggcggtggcggatccggga

SEQ ID NO: 763947 - DNA, 20 bp, mouse
ggatccgggagggacgagat

SEQ ID NO: 763948 - DNA, 20 bp, mouse
gcctcccccgctgacgtcgg

SEQ ID NO: 763949 - DNA, 20 bp, mouse
gcgtgcggaggcggtgggag

SEQ ID NO: 763950 - DNA, 20 bp, mouse
gcgggagggacgagatgggg

SEQ ID NO: 763951 - DNA, 20 bp, mouse
gcctcccgcggctgcataaa

SEQ ID NO: 763952 - DNA, 20 bp, mouse
gtcggcgccgccgacgtcag

SEQ ID NO: 763953 - DNA, 20 bp, mouse
gggcgccgcgggggtcgcac

SEQ ID NO: 763954 - DNA, 20 bp, mouse
gaagcggcgcgggcccaggc

SEQ ID NO: 763955 - DNA, 20 bp, mouse
gcgctcccgtgcgacccccg

SEQ ID NO: 763956 - DNA, 20 bp, mouse
gggcgttcgcgtcacgcgga

SEQ ID NO: 763957 - DNA, 20 bp, mouse
gaaacggtcagagaaagcgt

SEQ ID NO: 763958 - DNA, 20 bp, mouse
gttgcgcggcgttctggccc

SEQ ID NO: 763959 - DNA, 20 bp, mouse
gtcgcgccgcgctctctgat

SEQ ID NO: 763960 - DNA, 20 bp, mouse
gcgcgagtgcaggatcccca

SEQ ID NO: 763961 - DNA, 20 bp, mouse
gtaggcaagtggagtcatct

SEQ ID NO: 763962 - DNA, 20 bp, mouse
ggtggggccacaggcgcgtg

SEQ ID NO: 763963 - DNA, 20 bp, mouse
ggggcggcaagttgtccccg

SEQ ID NO: 763964 - DNA, 20 bp, mouse
gaggcggctgggttctgtcg

SEQ ID NO: 763965 - DNA, 20 bp, mouse
gggagagcgggtttttgcga

SEQ ID NO: 763966 - DNA, 20 bp, mouse
gtgactggatggctacgtgg

SEQ ID NO: 763967 - DNA, 20 bp, mouse
gtcccggcacggaacgggtg

SEQ ID NO: 763968 - DNA, 20 bp, mouse
gactgcgtgcgccacgccca

SEQ ID NO: 763969 - DNA, 20 bp, mouse
gacgtggcggctgggttcta

SEQ ID NO: 763970 - DNA, 20 bp, mouse
gcgggctcccggcacggaac

SEQ ID NO: 763971 - DNA, 20 bp, mouse
gacagctccggctcccactc

SEQ ID NO: 763972 - DNA, 20 bp, mouse
gccgccgcgcgggctcagag

SEQ ID NO: 763973 - DNA, 20 bp, mouse
gggccccgggggagcgagtg

SEQ ID NO: 763974 - DNA, 20 bp, mouse
gcccactccggctcccgttc

SEQ ID NO: 763975 - DNA, 20 bp, mouse
gctcagagcggcggcagtag

SEQ ID NO: 763976 - DNA, 20 bp, mouse
gaatgtgcttaattcattct

SEQ ID NO: 763977 - DNA, 20 bp, mouse
gcccctaattagataagatt

SEQ ID NO: 763978 - DNA, 20 bp, mouse
gtcccaatcttatctaatta

SEQ ID NO: 763979 - DNA, 20 bp, mouse
gtcaaacgaaattagggacg

SEQ ID NO: 763980 - DNA, 20 bp, mouse
gcaaaatgtcaaacgaaatt

SEQ ID NO: 763981 - DNA, 20 bp, mouse
gattaagattctaaacaaac

SEQ ID NO: 763982 - DNA, 20 bp, mouse
gacgagaaatcctttgtttt

SEQ ID NO: 763983 - DNA, 20 bp, mouse
gatattctatacacgctagc

SEQ ID NO: 763984 - DNA, 20 bp, mouse
gattcatggcatttcattga

SEQ ID NO: 763985 - DNA, 20 bp, mouse
gaaattcagatacaagggtt

SEQ ID NO: 763986 - DNA, 20 bp, mouse
gcccagaaagggaactgtca

SEQ ID NO: 763987 - DNA, 20 bp, mouse
gccggggcggggccactgaa

SEQ ID NO: 763988 - DNA, 20 bp, mouse
ggagacagcagagttctggt

SEQ ID NO: 763989 - DNA, 20 bp, mouse
gtcgcactcacccaagggag

SEQ ID NO: 763990 - DNA, 20 bp, mouse
gagaaagggaactgtcaagg

SEQ ID NO: 763991 - DNA, 20 bp, mouse
gagaagaggtacagccctca

SEQ ID NO: 763992 - DNA, 20 bp, mouse
gggaggtgaagagggaaccc

SEQ ID NO: 763993 - DNA, 20 bp, mouse
gttgcgaactactcattgag

SEQ ID NO: 763994 - DNA, 20 bp, mouse
ggaagcaactcctaccaagg

SEQ ID NO: 763995 - DNA, 20 bp, mouse
ggtgcggcgggggcgatccg

SEQ ID NO: 763996 - DNA, 20 bp, mouse
ggagcgggccgcttagaatt

SEQ ID NO: 763997 - DNA, 20 bp, mouse
ggatagagagagggctccga

SEQ ID NO: 763998 - DNA, 20 bp, mouse
ggccgcttagaattggggtg

SEQ ID NO: 763999 - DNA, 20 bp, mouse
ggcccgctctgcggggagaa

SEQ ID NO: 764000 - DNA, 20 bp, mouse
gcccgctagggagatgaagc

SEQ ID NO: 764001 - DNA, 20 bp, mouse
gagatgaagcgggaccgctt

SEQ ID NO: 764002 - DNA, 20 bp, mouse
gggagccactgccgctcgag

SEQ ID NO: 764003 - DNA, 20 bp, mouse
ggacggtcggggatagagag

SEQ ID NO: 764004 - DNA, 20 bp, mouse
ggccactgccgctcgagtgg

SEQ ID NO: 764005 - DNA, 20 bp, mouse
gtctaagcggcccgctctgc

SEQ ID NO: 764006 - DNA, 20 bp, mouse
gcctcggatgcacaactcgg

SEQ ID NO: 764007 - DNA, 20 bp, mouse
gcatccgaggtgttgggagg

SEQ ID NO: 764008 - DNA, 20 bp, mouse
gaaaccttgggtgatcctcg

SEQ ID NO: 764009 - DNA, 20 bp, mouse
ggcttgagtcaaggactagt

SEQ ID NO: 764010 - DNA, 20 bp, mouse
gcgggtctgaaacatagctt

SEQ ID NO: 764011 - DNA, 20 bp, mouse
ggggtgccatcacatgatcc

SEQ ID NO: 764012 - DNA, 20 bp, mouse
gggtgagagctccgtgcgta

SEQ ID NO: 764013 - DNA, 20 bp, mouse
ggtgcgttgcctaggaattc

SEQ ID NO: 764014 - DNA, 20 bp, mouse
gaccccacgaggatcaccca

SEQ ID NO: 764015 - DNA, 20 bp, mouse
gcatgtgatggcaccccacg

SEQ ID NO: 764016 - DNA, 20 bp, mouse
gtaggggaactgcggagcga

SEQ ID NO: 764017 - DNA, 20 bp, mouse
gaaggaaaggacacaggtag

SEQ ID NO: 764018 - DNA, 20 bp, mouse
gagcgtgcaactaaggttgg

SEQ ID NO: 764019 - DNA, 20 bp, mouse
ggcgaaccccgatgcaggga

SEQ ID NO: 764020 - DNA, 20 bp, mouse
gggagtgaatagcagctgca

SEQ ID NO: 764021 - DNA, 20 bp, mouse
ggctgcatagcgtgcaacta

SEQ ID NO: 764022 - DNA, 20 bp, mouse
gcagagccccgggtaggagt

SEQ ID NO: 764023 - DNA, 20 bp, mouse
gaatctccagtctctgacta

SEQ ID NO: 764024 - DNA, 20 bp, mouse
gaacgccgccctggaaggaa

SEQ ID NO: 764025 - DNA, 20 bp, mouse
ggctctgagctgtgcagtgc

SEQ ID NO: 764026 - DNA, 20 bp, mouse
gtgggtgcggctcccaaagt

SEQ ID NO: 764027 - DNA, 20 bp, mouse
gaggcagaagctagagtctc

SEQ ID NO: 764028 - DNA, 20 bp, mouse
gcccccaggaggcgaggtgc

SEQ ID NO: 764029 - DNA, 20 bp, mouse
gcctcctgggggctggctgt

SEQ ID NO: 764030 - DNA, 20 bp, mouse
gaagtcagcctgccacttgc

SEQ ID NO: 764031 - DNA, 20 bp, mouse
ggggtgtggactcccggcac

SEQ ID NO: 764032 - DNA, 20 bp, mouse
ggggagaaatccagggatga

SEQ ID NO: 764033 - DNA, 20 bp, mouse
ggccagcacctcgcctcctg

SEQ ID NO: 764034 - DNA, 20 bp, mouse
ggggcggtgctagagttttg

SEQ ID NO: 764035 - DNA, 20 bp, mouse
gattccgtggttgaggaaac

SEQ ID NO: 764036 - DNA, 20 bp, mouse
ggccccgggcagccgctcta

SEQ ID NO: 764037 - DNA, 20 bp, mouse
gggactgtcacgtgttcccg

SEQ ID NO: 764038 - DNA, 20 bp, mouse
gaactagagaacagggtagt

SEQ ID NO: 764039 - DNA, 20 bp, mouse
gcaccgggatgtacctaaat

SEQ ID NO: 764040 - DNA, 20 bp, mouse
ggcatcctgtagccctagag

SEQ ID NO: 764041 - DNA, 20 bp, mouse
gcggtgcccgtgtgtctgtt

SEQ ID NO: 764042 - DNA, 20 bp, mouse
ggaggcggcggtgggaagga

SEQ ID NO: 764043 - DNA, 20 bp, mouse
gaggggccccggagccgcca

SEQ ID NO: 764044 - DNA, 20 bp, mouse
gccactatggggttgaggat

SEQ ID NO: 764045 - DNA, 20 bp, mouse
gctaaggggtagtagtgtgt

SEQ ID NO: 764046 - DNA, 20 bp, mouse
gggccactgcggagcatgaa

SEQ ID NO: 764047 - DNA, 20 bp, mouse
gcactgcggagcatgaaggg

SEQ ID NO: 764048 - DNA, 20 bp, mouse
ggagatgataaaaatgcgtc

SEQ ID NO: 764049 - DNA, 20 bp, mouse
gctgggaaactagcattttc

SEQ ID NO: 764050 - DNA, 20 bp, mouse
gtgctaaagaccgagattac

SEQ ID NO: 764051 - DNA, 20 bp, mouse
gccttgaagttgtgtaatcg

SEQ ID NO: 764052 - DNA, 20 bp, mouse
ggtctttagcaggtggaagc

SEQ ID NO: 764053 - DNA, 20 bp, mouse
gtaaaaattgcatttctatc

SEQ ID NO: 764054 - DNA, 20 bp, mouse
gaatctcggtctttagcagg

SEQ ID NO: 764055 - DNA, 20 bp, mouse
gaagttaatttataagtccc

SEQ ID NO: 764056 - DNA, 20 bp, mouse
gggcagggagaagcagtttg

SEQ ID NO: 764057 - DNA, 20 bp, mouse
gtgtgcagagcagccagcga

SEQ ID NO: 764058 - DNA, 20 bp, mouse
gtgggaagataccaagtttt

SEQ ID NO: 764059 - DNA, 20 bp, mouse
gggactaggactcctgtata

SEQ ID NO: 764060 - DNA, 20 bp, mouse
ggctggactccagaacccag

SEQ ID NO: 764061 - DNA, 20 bp, mouse
gaagggttccccgggagcaa

SEQ ID NO: 764062 - DNA, 20 bp, mouse
gctcttcggagagatcctta

SEQ ID NO: 764063 - DNA, 20 bp, mouse
gagtgaggactaatctacac

SEQ ID NO: 764064 - DNA, 20 bp, mouse
ggtggggcagcaaaacggat

SEQ ID NO: 764065 - DNA, 20 bp, mouse
ggtgcaaaggtgacttccca

SEQ ID NO: 764066 - DNA, 20 bp, mouse
gaactactggagcccagcgt

SEQ ID NO: 764067 - DNA, 20 bp, mouse
gaaagcctgtgctgggagat

SEQ ID NO: 764068 - DNA, 20 bp, mouse
gaacaggtcaaggagacagt

SEQ ID NO: 764069 - DNA, 20 bp, mouse
ggctgggctccagtagttgt

SEQ ID NO: 764070 - DNA, 20 bp, mouse
gccgctagaggtcagtgtga

SEQ ID NO: 764071 - DNA, 20 bp, mouse
gccactgattgggagttgtg

SEQ ID NO: 764072 - DNA, 20 bp, mouse
gtggttttgcccacaactac

SEQ ID NO: 764073 - DNA, 20 bp, mouse
gctggagcccagcgtggggc

SEQ ID NO: 764074 - DNA, 20 bp, mouse
gagaggatgaggtacaaagc

SEQ ID NO: 764075 - DNA, 20 bp, mouse
gaaaacggccctgggcgcag

SEQ ID NO: 764076 - DNA, 20 bp, mouse
gaaccccaggcagctagtta

SEQ ID NO: 764077 - DNA, 20 bp, mouse
gaggaggggtggagtgaaga

SEQ ID NO: 764078 - DNA, 20 bp, mouse
gaagaaggaaaggtggtatg

SEQ ID NO: 764079 - DNA, 20 bp, mouse
gctagaagctggaaatccaa

SEQ ID NO: 764080 - DNA, 20 bp, mouse
gcacccctcctgcctctacc

SEQ ID NO: 764081 - DNA, 20 bp, mouse
ggcctcctcctcttggacaa

SEQ ID NO: 764082 - DNA, 20 bp, mouse
gagccctaactagctgcctg

SEQ ID NO: 764083 - DNA, 20 bp, mouse
gtcttggacaagggcgcaga

SEQ ID NO: 764084 - DNA, 20 bp, mouse
gaggtcagagtctaagttaa

SEQ ID NO: 764085 - DNA, 20 bp, mouse
gtgcgcccttgtccaagagg

SEQ ID NO: 764086 - DNA, 20 bp, mouse
ggaccctggcaggactgatg

SEQ ID NO: 764087 - DNA, 20 bp, mouse
gcatacacgctgaccctggc

SEQ ID NO: 764088 - DNA, 20 bp, mouse
ggggcactggaagctccacg

SEQ ID NO: 764089 - DNA, 20 bp, mouse
gggcaggactgatggggaag

SEQ ID NO: 764090 - DNA, 20 bp, mouse
gtaaacagggtcattaaccc

SEQ ID NO: 764091 - DNA, 20 bp, mouse
ggtggccctgtgccctgcaa

SEQ ID NO: 764092 - DNA, 20 bp, mouse
gtggtgccctggtacagcct

SEQ ID NO: 764093 - DNA, 20 bp, mouse
gaatgcatacacgctgaccc

SEQ ID NO: 764094 - DNA, 20 bp, mouse
gaaacagcagtcccaggcac

SEQ ID NO: 764095 - DNA, 20 bp, mouse
gagagagagggccagatagc

SEQ ID NO: 764096 - DNA, 20 bp, mouse
gcgcacagatctcaacgtgc

SEQ ID NO: 764097 - DNA, 20 bp, mouse
ggaaaggctcgggcaaaagg

SEQ ID NO: 764098 - DNA, 20 bp, mouse
gcgtgcggcccgggaaccct

SEQ ID NO: 764099 - DNA, 20 bp, mouse
gccgcacgcggcactggagc

SEQ ID NO: 764100 - DNA, 20 bp, mouse
gtgtagtctactgacaatgt

SEQ ID NO: 764101 - DNA, 20 bp, mouse
gagccctctgtcccagggaa

SEQ ID NO: 764102 - DNA, 20 bp, mouse
gtgcgcaccgccaggattgt

SEQ ID NO: 764103 - DNA, 20 bp, mouse
gcaaatcccaacaatcctgg

SEQ ID NO: 764104 - DNA, 20 bp, mouse
gcgcaggcgccagcagccca

SEQ ID NO: 764105 - DNA, 20 bp, mouse
gtggggcacgaggcgctccc

SEQ ID NO: 764106 - DNA, 20 bp, mouse
gggtaggagcgggagagtcg

SEQ ID NO: 764107 - DNA, 20 bp, mouse
gcgggagagtcgaggagagg

SEQ ID NO: 764108 - DNA, 20 bp, mouse
ggagagggcgtgtctgggga

SEQ ID NO: 764109 - DNA, 20 bp, mouse
ggcggagccaagggtaggag

SEQ ID NO: 764110 - DNA, 20 bp, mouse
ggagcctgtatagaggaagt

SEQ ID NO: 764111 - DNA, 20 bp, mouse
gccagagtgtaaggaatgga

SEQ ID NO: 764112 - DNA, 20 bp, mouse
gtgaacaggagcaacgggag

SEQ ID NO: 764113 - DNA, 20 bp, mouse
gggccgacgggccaagtcca

SEQ ID NO: 764114 - DNA, 20 bp, mouse
gaggagcgggcggcctgagg

SEQ ID NO: 764115 - DNA, 20 bp, mouse
gggtcaggaccgctcgttgg

SEQ ID NO: 764116 - DNA, 20 bp, mouse
gtcttctggtagttcccctc

SEQ ID NO: 764117 - DNA, 20 bp, mouse
ggctgtggaggcacaatcac

SEQ ID NO: 764118 - DNA, 20 bp, mouse
ggggactcagaaaaaagttc

SEQ ID NO: 764119 - DNA, 20 bp, mouse
ggccgaggcctcacagtcgg

SEQ ID NO: 764120 - DNA, 20 bp, mouse
gccggccgaggcctcacagt

SEQ ID NO: 764121 - DNA, 20 bp, mouse
gttcccggtccgcctacttc

SEQ ID NO: 764122 - DNA, 20 bp, mouse
ggacacagaggcaagtgcgc

SEQ ID NO: 764123 - DNA, 20 bp, mouse
gcggtggcgccctggcagac

SEQ ID NO: 764124 - DNA, 20 bp, mouse
gcgtcacttccggaagtagg

SEQ ID NO: 764125 - DNA, 20 bp, mouse
ggttgcttcgagctactccc

SEQ ID NO: 764126 - DNA, 20 bp, mouse
gcaagccagtagaactccaa

SEQ ID NO: 764127 - DNA, 20 bp, mouse
gggcgccttcccagaggcag

SEQ ID NO: 764128 - DNA, 20 bp, mouse
ggagcttggcgccttcccag

SEQ ID NO: 764129 - DNA, 20 bp, mouse
ggcaaagagcctccagggtg

SEQ ID NO: 764130 - DNA, 20 bp, mouse
gcggggaaacgcgacagttt

SEQ ID NO: 764131 - DNA, 20 bp, mouse
gggccggggaggagttagtc

SEQ ID NO: 764132 - DNA, 20 bp, mouse
ggagggaacgctgactctgg

SEQ ID NO: 764133 - DNA, 20 bp, mouse
gctcagtcctggggctagtg

SEQ ID NO: 764134 - DNA, 20 bp, mouse
gttcacccttggagttctac

SEQ ID NO: 764135 - DNA, 20 bp, mouse
ggaggctgctgggattaggg

SEQ ID NO: 764136 - DNA, 20 bp, mouse
gttaccctcaaaaaattctt

SEQ ID NO: 764137 - DNA, 20 bp, mouse
ggacctccagccagtcttag

SEQ ID NO: 764138 - DNA, 20 bp, mouse
gtgcctagtaagctggaaac

SEQ ID NO: 764139 - DNA, 20 bp, mouse
gccagccagtcttagaggca

SEQ ID NO: 764140 - DNA, 20 bp, mouse
gcagcctaagaattttttga

SEQ ID NO: 764141 - DNA, 20 bp, mouse
gcgttccctgcctctaagac

SEQ ID NO: 764142 - DNA, 20 bp, mouse
gaggtcaaatgccacacgga

SEQ ID NO: 764143 - DNA, 20 bp, mouse
ggtcttagataaacattttg

SEQ ID NO: 764144 - DNA, 20 bp, mouse
gtgtaacagcagaagcatta

SEQ ID NO: 764145 - DNA, 20 bp, mouse
gggtctatagtaggcttctc

SEQ ID NO: 764146 - DNA, 20 bp, mouse
gggctgtcttgtagggtctc

SEQ ID NO: 764147 - DNA, 20 bp, mouse
gacagctcacctagcaccac

SEQ ID NO: 764148 - DNA, 20 bp, mouse
ggccagcgcaatccagagac

SEQ ID NO: 764149 - DNA, 20 bp, mouse
gccagcagacctgtggtgct

SEQ ID NO: 764150 - DNA, 20 bp, mouse
ggattgcgctggcaattcca

SEQ ID NO: 764151 - DNA, 20 bp, mouse
gcagaagatcagggtggctc

SEQ ID NO: 764152 - DNA, 20 bp, mouse
gtgaaagaaactgcagagtg

SEQ ID NO: 764153 - DNA, 20 bp, mouse
gccaagctagcagaagatca

SEQ ID NO: 764154 - DNA, 20 bp, mouse
gctggcaattccaaggctct

SEQ ID NO: 764155 - DNA, 20 bp, mouse
gctgctaaatgatgtaaaca

SEQ ID NO: 764156 - DNA, 20 bp, mouse
gtgtctgtgagatagagctg

SEQ ID NO: 764157 - DNA, 20 bp, mouse
gtcctctcttgggttaaaac

SEQ ID NO: 764158 - DNA, 20 bp, mouse
gccctgttttaacccaagag

SEQ ID NO: 764159 - DNA, 20 bp, mouse
gtgcccagctgggaagtcaa

SEQ ID NO: 764160 - DNA, 20 bp, mouse
ggcctcagtccctgatggac

SEQ ID NO: 764161 - DNA, 20 bp, mouse
gggggacgttgcatccactt

SEQ ID NO: 764162 - DNA, 20 bp, mouse
gtctggagagtgggacctgc

SEQ ID NO: 764163 - DNA, 20 bp, mouse
gaaaatataaccggtccatc

SEQ ID NO: 764164 - DNA, 20 bp, mouse
ggcacttccctgcttatcag

SEQ ID NO: 764165 - DNA, 20 bp, mouse
gagctgtacagaaagaacag

SEQ ID NO: 764166 - DNA, 20 bp, mouse
gtggacctggggtgtactgt

SEQ ID NO: 764167 - DNA, 20 bp, mouse
gtggggtagcaggacatcat

SEQ ID NO: 764168 - DNA, 20 bp, mouse
gccctcagagaggcaaacat

SEQ ID NO: 764169 - DNA, 20 bp, mouse
gactgtaaaacatgtaaggg

SEQ ID NO: 764170 - DNA, 20 bp, mouse
gagggtgattttgcctctag

SEQ ID NO: 764171 - DNA, 20 bp, mouse
ggggacttgggagtgccaac

SEQ ID NO: 764172 - DNA, 20 bp, mouse
gctggggccccttactacat

SEQ ID NO: 764173 - DNA, 20 bp, mouse
gcccaggtccaatgtagtaa

SEQ ID NO: 764174 - DNA, 20 bp, mouse
gttaggagctatagattcaa

SEQ ID NO: 764175 - DNA, 20 bp, mouse
gtagaagcttcctgtctagt

SEQ ID NO: 764176 - DNA, 20 bp, mouse
gcccgagaagtgttggttgg

SEQ ID NO: 764177 - DNA, 20 bp, mouse
gtagcctaaagctcacccac

SEQ ID NO: 764178 - DNA, 20 bp, mouse
gggacccagggcaaagacct

SEQ ID NO: 764179 - DNA, 20 bp, mouse
gctgctgcttactagactcc

SEQ ID NO: 764180 - DNA, 20 bp, mouse
gtcctggaggatttccctgt

SEQ ID NO: 764181 - DNA, 20 bp, mouse
gggttggtggcagatgggga

SEQ ID NO: 764182 - DNA, 20 bp, mouse
gtagcatgcccgagaagtgt

SEQ ID NO: 764183 - DNA, 20 bp, mouse
ggacccagactctggaccca

SEQ ID NO: 764184 - DNA, 20 bp, mouse
gtggcaccgaggatacctag

SEQ ID NO: 764185 - DNA, 20 bp, mouse
gtcaggatccatgcaaaaag

SEQ ID NO: 764186 - DNA, 20 bp, mouse
gggaaatcaaggacgaccga

SEQ ID NO: 764187 - DNA, 20 bp, mouse
gtctccctccacacctacag

SEQ ID NO: 764188 - DNA, 20 bp, mouse
ggaagtcgattgccccctgt

SEQ ID NO: 764189 - DNA, 20 bp, mouse
gcattagcgcggtggagaag

SEQ ID NO: 764190 - DNA, 20 bp, mouse
ggcaccgccaagccgagggt

SEQ ID NO: 764191 - DNA, 20 bp, mouse
gcgagggccccggagtccag

SEQ ID NO: 764192 - DNA, 20 bp, mouse
gacaccagagttgcaggtat

SEQ ID NO: 764193 - DNA, 20 bp, mouse
gcagaaccgccgctggactc

SEQ ID NO: 764194 - DNA, 20 bp, mouse
gttgccccctgtaggtgtgg

SEQ ID NO: 764195 - DNA, 20 bp, mouse
ggggccctcggcttcgccca

SEQ ID NO: 764196 - DNA, 20 bp, mouse
gcaggtgcggccgatcccgt

SEQ ID NO: 764197 - DNA, 20 bp, mouse
gtcggcgcggcgccaggcaa

SEQ ID NO: 764198 - DNA, 20 bp, mouse
ggggcgggcgagcacgcgat

SEQ ID NO: 764199 - DNA, 20 bp, mouse
ggagctcccggtaccttcct

SEQ ID NO: 764200 - DNA, 20 bp, mouse
gcaagcggtgcctacgggat

SEQ ID NO: 764201 - DNA, 20 bp, mouse
gccgagatgttgcaagcgag

SEQ ID NO: 764202 - DNA, 20 bp, mouse
gctgcgggcctcagctccgg

SEQ ID NO: 764203 - DNA, 20 bp, mouse
gtgcaagcgagcggtgtcct

SEQ ID NO: 764204 - DNA, 20 bp, mouse
ggggagctcagtgcactccc

SEQ ID NO: 764205 - DNA, 20 bp, mouse
ggagctgaggcccgcaggcc

SEQ ID NO: 764206 - DNA, 20 bp, mouse
gtggaaggcaatggggtgca

SEQ ID NO: 764207 - DNA, 20 bp, mouse
ggggtcggagcaggacgcaa

SEQ ID NO: 764208 - DNA, 20 bp, mouse
gtgcaggtagacatgatcac

SEQ ID NO: 764209 - DNA, 20 bp, mouse
ggagcaggacgcaagggctg

SEQ ID NO: 764210 - DNA, 20 bp, mouse
gctcgccgtggatgcagctt

SEQ ID NO: 764211 - DNA, 20 bp, mouse
gggaacattttgtagccact

SEQ ID NO: 764212 - DNA, 20 bp, mouse
gttaaagggccctcacactg

SEQ ID NO: 764213 - DNA, 20 bp, mouse
gcccgccccggccccgcgaa

SEQ ID NO: 764214 - DNA, 20 bp, mouse
gctccccttcgcctcttaaa

SEQ ID NO: 764215 - DNA, 20 bp, mouse
gggccctttaagaggcgaag

SEQ ID NO: 764216 - DNA, 20 bp, mouse
gagaccccgccaggagttgg

SEQ ID NO: 764217 - DNA, 20 bp, mouse
gcggctccgtgcgtgcgtga

SEQ ID NO: 764218 - DNA, 20 bp, mouse
gctgacgtcagccatgtgcg

SEQ ID NO: 764219 - DNA, 20 bp, mouse
ggaggggaatagggcgtccc

SEQ ID NO: 764220 - DNA, 20 bp, mouse
gccatgtgcggggaggagat

SEQ ID NO: 764221 - DNA, 20 bp, mouse
gacgtcagccatgtgcgggg

SEQ ID NO: 764222 - DNA, 20 bp, mouse
gctgacaggcagccgcgggg

SEQ ID NO: 764223 - DNA, 20 bp, mouse
gggaaaagctaagtgggcca

SEQ ID NO: 764224 - DNA, 20 bp, mouse
gatattaatgaacctccaag

SEQ ID NO: 764225 - DNA, 20 bp, mouse
ggcgtgcgtgatggtgagga

SEQ ID NO: 764226 - DNA, 20 bp, mouse
gctcccatacagtgtcagta

SEQ ID NO: 764227 - DNA, 20 bp, mouse
gccagtcagccctgattcct

SEQ ID NO: 764228 - DNA, 20 bp, mouse
gaggctgcctaacatgcctg

SEQ ID NO: 764229 - DNA, 20 bp, mouse
gagggctgactggctcccag

SEQ ID NO: 764230 - DNA, 20 bp, mouse
gaggtccagcagagggtatt

SEQ ID NO: 764231 - DNA, 20 bp, mouse
gcacacctgcagcattaccc

SEQ ID NO: 764232 - DNA, 20 bp, mouse
gggcacctgggtaatgctgc

SEQ ID NO: 764233 - DNA, 20 bp, mouse
ggtgtcagtaaggacagcaa

SEQ ID NO: 764234 - DNA, 20 bp, mouse
gaccgacccccaggcatgtt

SEQ ID NO: 764235 - DNA, 20 bp, mouse
gttgaagtccctgggtaggt

SEQ ID NO: 764236 - DNA, 20 bp, mouse
gtggtcagagccctgaatgg

SEQ ID NO: 764237 - DNA, 20 bp, mouse
gccaaccaatggcgtgaagg

SEQ ID NO: 764238 - DNA, 20 bp, mouse
gttgacacgagctccatata

SEQ ID NO: 764239 - DNA, 20 bp, mouse
gtcagagcaatgtttccgaa

SEQ ID NO: 764240 - DNA, 20 bp, mouse
gcagactgtaggtagctggg

SEQ ID NO: 764241 - DNA, 20 bp, mouse
gttcgcgcagatcccccttt

SEQ ID NO: 764242 - DNA, 20 bp, mouse
ggctggcaactgataatcaa

SEQ ID NO: 764243 - DNA, 20 bp, mouse
gctacagtctgggatgtcga

SEQ ID NO: 764244 - DNA, 20 bp, mouse
gttgccagcagcccttctct

SEQ ID NO: 764245 - DNA, 20 bp, mouse
gagtctgggatgtcgagggg

SEQ ID NO: 764246 - DNA, 20 bp, mouse
gttcctgaatggctgactgt

SEQ ID NO: 764247 - DNA, 20 bp, mouse
gtgtgcagcggaggagttgg

SEQ ID NO: 764248 - DNA, 20 bp, mouse
gcaggaaagccatcgaaatc

SEQ ID NO: 764249 - DNA, 20 bp, mouse
gaaggagaggcgactgtccg

SEQ ID NO: 764250 - DNA, 20 bp, mouse
gaggaggactgggagagcgg

SEQ ID NO: 764251 - DNA, 20 bp, mouse
gctgccctggacttggcccc

SEQ ID NO: 764252 - DNA, 20 bp, mouse
gtagtgtgcagcggaggagt

SEQ ID NO: 764253 - DNA, 20 bp, mouse
gcccgacccggaggcttcgg

SEQ ID NO: 764254 - DNA, 20 bp, mouse
ggaaagccatcgaaatcagg

SEQ ID NO: 764255 - DNA, 20 bp, mouse
ggccgccgaagcctccgggt

SEQ ID NO: 764256 - DNA, 20 bp, mouse
gacaggactcgcaggggtta

SEQ ID NO: 764257 - DNA, 20 bp, mouse
ggccccgacaggactcgcag

SEQ ID NO: 764258 - DNA, 20 bp, mouse
ggcgacggccgcccttataa

SEQ ID NO: 764259 - DNA, 20 bp, mouse
ggcgcgccgcccggagccgt

SEQ ID NO: 764260 - DNA, 20 bp, mouse
gctaccccatgcccttataa

SEQ ID NO: 764261 - DNA, 20 bp, mouse
gtaaggctgcgcggccgcgt

SEQ ID NO: 764262 - DNA, 20 bp, mouse
gtgcgcggccgcgtggggga

SEQ ID NO: 764263 - DNA, 20 bp, mouse
ggccccccggggacatctgc

SEQ ID NO: 764264 - DNA, 20 bp, mouse
gccgtgggccggcgagaggg

SEQ ID NO: 764265 - DNA, 20 bp, mouse
ggccgcccggagccgtgggc

SEQ ID NO: 764266 - DNA, 20 bp, mouse
gccagcgcgctcacattcgg

SEQ ID NO: 764267 - DNA, 20 bp, mouse
gctgggcgagaagagggcga

SEQ ID NO: 764268 - DNA, 20 bp, mouse
ggggccgcccagacgatgcg

SEQ ID NO: 764269 - DNA, 20 bp, mouse
gcgcgcgctgggcgagaaga

SEQ ID NO: 764270 - DNA, 20 bp, mouse
ggactcggggaagagggtgg

SEQ ID NO: 764271 - DNA, 20 bp, mouse
gcgactgtcggcaactgcaa

SEQ ID NO: 764272 - DNA, 20 bp, mouse
gggggggggaggtttgaact

SEQ ID NO: 764273 - DNA, 20 bp, mouse
gtagcagaggggctacggga

SEQ ID NO: 764274 - DNA, 20 bp, mouse
gcggcccctcgggcggggag

SEQ ID NO: 764275 - DNA, 20 bp, mouse
gggagcgcggacacgcgaaa

SEQ ID NO: 764276 - DNA, 20 bp, mouse
gccggggcgggccaagagga

SEQ ID NO: 764277 - DNA, 20 bp, mouse
ggggcgggcgaaagccccga

SEQ ID NO: 764278 - DNA, 20 bp, mouse
gccgctggagccatttccat

SEQ ID NO: 764279 - DNA, 20 bp, mouse
gggccaggcgcgcttctcat

SEQ ID NO: 764280 - DNA, 20 bp, mouse
gcgggtgcgcaggagctgag

SEQ ID NO: 764281 - DNA, 20 bp, mouse
ggtgcgcaggagctgagggg

SEQ ID NO: 764282 - DNA, 20 bp, mouse
gctaaagggtagcgtgtgca

SEQ ID NO: 764283 - DNA, 20 bp, mouse
gaaagccggcccttttaaac

SEQ ID NO: 764284 - DNA, 20 bp, mouse
gcccccttggccaatggaaa

SEQ ID NO: 764285 - DNA, 20 bp, mouse
gtaaggaagctgcggagtcc

SEQ ID NO: 764286 - DNA, 20 bp, mouse
gccacccgctggtgggagac

SEQ ID NO: 764287 - DNA, 20 bp, mouse
gccaccggatagggagtgga

SEQ ID NO: 764288 - DNA, 20 bp, mouse
gggtcctgccacccgctggt

SEQ ID NO: 764289 - DNA, 20 bp, mouse
ggaggccagacgccaggtca

SEQ ID NO: 764290 - DNA, 20 bp, mouse
gggggccggcgaagagaaga

SEQ ID NO: 764291 - DNA, 20 bp, mouse
ggggtgctggtggctgtcgt

SEQ ID NO: 764292 - DNA, 20 bp, mouse
gtggtgggagacaggggtgc

SEQ ID NO: 764293 - DNA, 20 bp, mouse
ggtgcaggtgccaccggata

SEQ ID NO: 764294 - DNA, 20 bp, mouse
ggcagtatgaggctgtccag

SEQ ID NO: 764295 - DNA, 20 bp, mouse
gcagcctcatactgcaagtg

SEQ ID NO: 764296 - DNA, 20 bp, mouse
gcggggacggggagcccgag

SEQ ID NO: 764297 - DNA, 20 bp, mouse
gccggcttggtgagcctagt

SEQ ID NO: 764298 - DNA, 20 bp, mouse
gtccgcgctccctgcgtcaa

SEQ ID NO: 764299 - DNA, 20 bp, mouse
gccaggaggaggcgcgggga

SEQ ID NO: 764300 - DNA, 20 bp, mouse
gcgccccccgcgcccttgta

SEQ ID NO: 764301 - DNA, 20 bp, mouse
gtggccatacaagggcgcgg

SEQ ID NO: 764302 - DNA, 20 bp, mouse
gtcacgcgcgcagacattcc

SEQ ID NO: 764303 - DNA, 20 bp, mouse
gggggcggcgcggttccggc

SEQ ID NO: 764304 - DNA, 20 bp, mouse
ggggaggagatcctgttctg

SEQ ID NO: 764305 - DNA, 20 bp, mouse
ggccgggccgtgtgcgtcag

SEQ ID NO: 764306 - DNA, 20 bp, mouse
gcgacctgacgtcacgactg

SEQ ID NO: 764307 - DNA, 20 bp, mouse
gtgtgaggacgcaaggtctg

SEQ ID NO: 764308 - DNA, 20 bp, mouse
gagcgcgggccaggagtccg

SEQ ID NO: 764309 - DNA, 20 bp, mouse
gctggggctgattttaaggt

SEQ ID NO: 764310 - DNA, 20 bp, mouse
gaccttgcgtcctcacacgt

SEQ ID NO: 764311 - DNA, 20 bp, mouse
gggaccgcgggccgctgacg

SEQ ID NO: 764312 - DNA, 20 bp, mouse
gtcctggcccgcgctcgctt

SEQ ID NO: 764313 - DNA, 20 bp, mouse
gaccacggacttcacggacc

SEQ ID NO: 764314 - DNA, 20 bp, mouse
ggaggacgcaaggtctgggg

SEQ ID NO: 764315 - DNA, 20 bp, mouse
gcagccccagtcgtgacgtc

SEQ ID NO: 764316 - DNA, 20 bp, mouse
ggcgctccccgcccgatgga

SEQ ID NO: 764317 - DNA, 20 bp, mouse
ggcagcccctccatcgggcg

SEQ ID NO: 764318 - DNA, 20 bp, mouse
ggctctgcggctagagggtg

SEQ ID NO: 764319 - DNA, 20 bp, mouse
ggtggggcagcccctccatc

SEQ ID NO: 764320 - DNA, 20 bp, mouse
ggagccaggggtgtcccggt

SEQ ID NO: 764321 - DNA, 20 bp, mouse
gtagccgcagagcgccaacc

SEQ ID NO: 764322 - DNA, 20 bp, mouse
gttggcgctctgcggctaga

SEQ ID NO: 764323 - DNA, 20 bp, mouse
gtgtcccggttggcgctctg

SEQ ID NO: 764324 - DNA, 20 bp, mouse
gggcgccctgccagtgacgc

SEQ ID NO: 764325 - DNA, 20 bp, mouse
gcccgccaggccggcgtcac

SEQ ID NO: 764326 - DNA, 20 bp, mouse
ggtgcggccgtgagaatggc

SEQ ID NO: 764327 - DNA, 20 bp, mouse
gaccctcgcacacgcggaac

SEQ ID NO: 764328 - DNA, 20 bp, mouse
ggacgtcaatgtgacgacat

SEQ ID NO: 764329 - DNA, 20 bp, mouse
gggctcccgtgcagaggggt

SEQ ID NO: 764330 - DNA, 20 bp, mouse
gagggcgccggtctaccaga

SEQ ID NO: 764331 - DNA, 20 bp, mouse
gcgcgcgtgcgcgcgtcctc

SEQ ID NO: 764332 - DNA, 20 bp, mouse
ggccggttccgcgtgtgcga

SEQ ID NO: 764333 - DNA, 20 bp, mouse
gcaagcggctcccgtgcaga

SEQ ID NO: 764334 - DNA, 20 bp, mouse
gtgtgtatggggagcggagg

SEQ ID NO: 764335 - DNA, 20 bp, mouse
gcggccgtgagaatggccgg

SEQ ID NO: 764336 - DNA, 20 bp, mouse
gaaggcctgcagagtcacgt

SEQ ID NO: 764337 - DNA, 20 bp, mouse
gtgaggcagggaccccatgt

SEQ ID NO: 764338 - DNA, 20 bp, mouse
gcatgtaggcagataggcag

SEQ ID NO: 764339 - DNA, 20 bp, mouse
gtggctgtccaggctgatga

SEQ ID NO: 764340 - DNA, 20 bp, mouse
gcctcctcccctcgtgggtg

SEQ ID NO: 764341 - DNA, 20 bp, mouse
gtggcccccccacccacgag

SEQ ID NO: 764342 - DNA, 20 bp, mouse
ggggaggaggaaaggacgat

SEQ ID NO: 764343 - DNA, 20 bp, mouse
gcccaggcaaggacccaggg

SEQ ID NO: 764344 - DNA, 20 bp, mouse
gcagggcccccataaagata

SEQ ID NO: 764345 - DNA, 20 bp, mouse
gggaccccatgtaggcagat

SEQ ID NO: 764346 - DNA, 20 bp, mouse
gtggtcacatgaccctgtgc

SEQ ID NO: 764347 - DNA, 20 bp, mouse
gaagaactcttggcagataa

SEQ ID NO: 764348 - DNA, 20 bp, mouse
gtcctcttatcaaccggcac

SEQ ID NO: 764349 - DNA, 20 bp, mouse
gccctgtgccggttgataag

SEQ ID NO: 764350 - DNA, 20 bp, mouse
ggttgtaaagccaaggggtc

SEQ ID NO: 764351 - DNA, 20 bp, mouse
gaagaaaggaagctttcaat

SEQ ID NO: 764352 - DNA, 20 bp, mouse
gagcttgcaagtgctcctgt

SEQ ID NO: 764353 - DNA, 20 bp, mouse
ggtcaggagatcatacttag

SEQ ID NO: 764354 - DNA, 20 bp, mouse
gttacaactttccacactct

SEQ ID NO: 764355 - DNA, 20 bp, mouse
ggaaatgattaactcagaaa

SEQ ID NO: 764356 - DNA, 20 bp, mouse
gcgggactctaccaaataaa

SEQ ID NO: 764357 - DNA, 20 bp, mouse
gtggatacgcctccttggaa

SEQ ID NO: 764358 - DNA, 20 bp, mouse
gctaccaaataaaggggtga

SEQ ID NO: 764359 - DNA, 20 bp, mouse
gcagcggcgcgtgacgtcag

SEQ ID NO: 764360 - DNA, 20 bp, mouse
gggggtgatggaaaaaaaac

SEQ ID NO: 764361 - DNA, 20 bp, mouse
gcacgtgctcacccggttcc

SEQ ID NO: 764362 - DNA, 20 bp, mouse
gtgccacgcacatgcccgtg

SEQ ID NO: 764363 - DNA, 20 bp, mouse
gccgtgtgggcagcctcgtt

SEQ ID NO: 764364 - DNA, 20 bp, mouse
ggggagctggccagtgctga

SEQ ID NO: 764365 - DNA, 20 bp, mouse
gaggcgtatccaccgggaac

SEQ ID NO: 764366 - DNA, 20 bp, mouse
ggaggcggggccgagctcga

SEQ ID NO: 764367 - DNA, 20 bp, mouse
gaggccagacagggtaacag

SEQ ID NO: 764368 - DNA, 20 bp, mouse
ggggaccgcgccctcgagct

SEQ ID NO: 764369 - DNA, 20 bp, mouse
ggcaaggggcgggccagtgg

SEQ ID NO: 764370 - DNA, 20 bp, mouse
gcaagagtgagccaaggcaa

SEQ ID NO: 764371 - DNA, 20 bp, mouse
gcttctgcgtgctccggcgt

SEQ ID NO: 764372 - DNA, 20 bp, mouse
gccagcgtgcctggcagagc

SEQ ID NO: 764373 - DNA, 20 bp, mouse
gcggagcacgcagaagcact

SEQ ID NO: 764374 - DNA, 20 bp, mouse
gtaacagaggctaagactgg

SEQ ID NO: 764375 - DNA, 20 bp, mouse
gtctgcccaagagtgagcca

SEQ ID NO: 764376 - DNA, 20 bp, mouse
gggggggcggtcagatgctt

SEQ ID NO: 764377 - DNA, 20 bp, mouse
gaggcggatccccagactat

SEQ ID NO: 764378 - DNA, 20 bp, mouse
ggtggagaaccaactcttgg

SEQ ID NO: 764379 - DNA, 20 bp, mouse
ggcggtcagatgcttgggct

SEQ ID NO: 764380 - DNA, 20 bp, mouse
gtatgtggagaaccaactct

SEQ ID NO: 764381 - DNA, 20 bp, mouse
gactgttatgcctctgacaa

SEQ ID NO: 764382 - DNA, 20 bp, mouse
gtagaaaagttaactcacga

SEQ ID NO: 764383 - DNA, 20 bp, mouse
gtgatgtctacacgggggta

SEQ ID NO: 764384 - DNA, 20 bp, mouse
gttttctggagtatgaccac

SEQ ID NO: 764385 - DNA, 20 bp, mouse
ggaaccaactcttggggggt

SEQ ID NO: 764386 - DNA, 20 bp, mouse
gggtctgaccagcactagtc

SEQ ID NO: 764387 - DNA, 20 bp, mouse
gcagctccctccaggataga

SEQ ID NO: 764388 - DNA, 20 bp, mouse
gtcgtgctgcagctccctcc

SEQ ID NO: 764389 - DNA, 20 bp, mouse
gcagcgccctctatcctgga

SEQ ID NO: 764390 - DNA, 20 bp, mouse
gtggtgctggaaaacccccg

SEQ ID NO: 764391 - DNA, 20 bp, mouse
gcagacccaggatcccgcag

SEQ ID NO: 764392 - DNA, 20 bp, mouse
gtccttgcgcagccactccc

SEQ ID NO: 764393 - DNA, 20 bp, mouse
gagaccagcgccctctatcc

SEQ ID NO: 764394 - DNA, 20 bp, mouse
gcaactcccgacatctatga

SEQ ID NO: 764395 - DNA, 20 bp, mouse
gagcaccactgcgggatcct

SEQ ID NO: 764396 - DNA, 20 bp, mouse
ggggctggactgggtgcggc

SEQ ID NO: 764397 - DNA, 20 bp, mouse
ggtccccgccccagccacgt

SEQ ID NO: 764398 - DNA, 20 bp, mouse
ggctgcaagactctagtcgt

SEQ ID NO: 764399 - DNA, 20 bp, mouse
ggtcagctcaggggttgtcg

SEQ ID NO: 764400 - DNA, 20 bp, mouse
gcacccgctacgtaatcact

SEQ ID NO: 764401 - DNA, 20 bp, mouse
gagctcaggggttgtcgggg

SEQ ID NO: 764402 - DNA, 20 bp, mouse
gaaaacctcaaatgacaacg

SEQ ID NO: 764403 - DNA, 20 bp, mouse
gtggggccaattcaagatga

SEQ ID NO: 764404 - DNA, 20 bp, mouse
ggcgcctagtgattacgtag

SEQ ID NO: 764405 - DNA, 20 bp, mouse
gtatgttaatggcgaaagaa

SEQ ID NO: 764406 - DNA, 20 bp, mouse
ggcggctggggtgagagcat

SEQ ID NO: 764407 - DNA, 20 bp, mouse
gtgagagcatggggtgggcg

SEQ ID NO: 764408 - DNA, 20 bp, mouse
gcgcccctctcctcgcgaga

SEQ ID NO: 764409 - DNA, 20 bp, mouse
gctctgctagacttcggcgg

SEQ ID NO: 764410 - DNA, 20 bp, mouse
gccccgcgacgcgacgtcgg

SEQ ID NO: 764411 - DNA, 20 bp, mouse
ggagctctgctagacttcgg

SEQ ID NO: 764412 - DNA, 20 bp, mouse
gagggagctctgctagactt

SEQ ID NO: 764413 - DNA, 20 bp, mouse
ggaacagaaacggagaagga

SEQ ID NO: 764414 - DNA, 20 bp, mouse
ggccccccgcgacgcgacgt

SEQ ID NO: 764415 - DNA, 20 bp, mouse
gtcacgtgatgagccgggtc

SEQ ID NO: 764416 - DNA, 20 bp, mouse
gtctgccggaaccccgcaag

SEQ ID NO: 764417 - DNA, 20 bp, mouse
gcccgcaaggggaggagacc

SEQ ID NO: 764418 - DNA, 20 bp, mouse
gtctcaaggcagtctactgc

SEQ ID NO: 764419 - DNA, 20 bp, mouse
ggcggcgtccggaccaacag

SEQ ID NO: 764420 - DNA, 20 bp, mouse
gctgcggagcgcagctgtga

SEQ ID NO: 764421 - DNA, 20 bp, mouse
gcgtccggaccaacagtggg

SEQ ID NO: 764422 - DNA, 20 bp, mouse
gtcgtccggcagaattactt

SEQ ID NO: 764423 - DNA, 20 bp, mouse
gacaagaagacaacgctggc

SEQ ID NO: 764424 - DNA, 20 bp, mouse
gtgcccccaagtaattctgc

SEQ ID NO: 764425 - DNA, 20 bp, mouse
gtcctccccttgcggggttc

SEQ ID NO: 764426 - DNA, 20 bp, mouse
ggagaggcctccgcaggaat

SEQ ID NO: 764427 - DNA, 20 bp, mouse
gaggcctccgcaggaatggg

SEQ ID NO: 764428 - DNA, 20 bp, mouse
ggcaccacccattcctgcgg

SEQ ID NO: 764429 - DNA, 20 bp, mouse
ggggctcgcagcggacccga

SEQ ID NO: 764430 - DNA, 20 bp, mouse
gggggaagcaggagtggtct

SEQ ID NO: 764431 - DNA, 20 bp, mouse
gaatgggtggtgcctttgag

SEQ ID NO: 764432 - DNA, 20 bp, mouse
gggagtggtctgggaggacg

SEQ ID NO: 764433 - DNA, 20 bp, mouse
gaggccaggcacagtctgct

SEQ ID NO: 764434 - DNA, 20 bp, mouse
gtgaggggcgcgtctctttg

SEQ ID NO: 764435 - DNA, 20 bp, mouse
gctggactgtagctcgatcc

SEQ ID NO: 764436 - DNA, 20 bp, mouse
ggacgctaagagagtcggga

SEQ ID NO: 764437 - DNA, 20 bp, mouse
gcggggacgctaagagagtc

SEQ ID NO: 764438 - DNA, 20 bp, mouse
ggggttaggccggaggggag

SEQ ID NO: 764439 - DNA, 20 bp, mouse
ggggcgacgcccggtgagtg

SEQ ID NO: 764440 - DNA, 20 bp, mouse
gtcgctgcagcctaagctgt

SEQ ID NO: 764441 - DNA, 20 bp, mouse
gtcctcaaggcgctcaaggc

SEQ ID NO: 764442 - DNA, 20 bp, mouse
ggatacccagcgtcgcgctc

SEQ ID NO: 764443 - DNA, 20 bp, mouse
gagcttaggctgcagcgaat

SEQ ID NO: 764444 - DNA, 20 bp, mouse
gtgcagcctaagctgtgggt

SEQ ID NO: 764445 - DNA, 20 bp, mouse
gagaggccacccagtcctca

SEQ ID NO: 764446 - DNA, 20 bp, mouse
gaaacagccaatgggagtag

SEQ ID NO: 764447 - DNA, 20 bp, mouse
gaaaagaggcggaggatgat

SEQ ID NO: 764448 - DNA, 20 bp, mouse
ggctggggcagcaacaacgc

SEQ ID NO: 764449 - DNA, 20 bp, mouse
gggcgaaggaaaagaggcgg

SEQ ID NO: 764450 - DNA, 20 bp, mouse
ggaacccggcctatttctat

SEQ ID NO: 764451 - DNA, 20 bp, mouse
ggcgagagaccaatagaaat

SEQ ID NO: 764452 - DNA, 20 bp, mouse
gctagagtccatagcgtcat

SEQ ID NO: 764453 - DNA, 20 bp, mouse
gtctgggtgcgccaggaacc

SEQ ID NO: 764454 - DNA, 20 bp, mouse
gcatcggctgtcaggagggt

SEQ ID NO: 764455 - DNA, 20 bp, mouse
gtcgaaacctgacgtgggcg

SEQ ID NO: 764456 - DNA, 20 bp, mouse
gggcggtgcggagacccaaa

SEQ ID NO: 764457 - DNA, 20 bp, mouse
gccggagggcactaactaca

SEQ ID NO: 764458 - DNA, 20 bp, mouse
gggagacccaaagggtagag

SEQ ID NO: 764459 - DNA, 20 bp, mouse
gtctccgcaccgccttgccc

SEQ ID NO: 764460 - DNA, 20 bp, mouse
gctccggcttcactgaacaa

SEQ ID NO: 764461 - DNA, 20 bp, mouse
gaactggaattcagctcctc

SEQ ID NO: 764462 - DNA, 20 bp, mouse
gactcctgggcaaggcggtg

SEQ ID NO: 764463 - DNA, 20 bp, mouse
gtggaggacggtgactcgcg

SEQ ID NO: 764464 - DNA, 20 bp, mouse
gaaggcttaactcctgggca

SEQ ID NO: 764465 - DNA, 20 bp, mouse
gccagacggcgccatttctg

SEQ ID NO: 764466 - DNA, 20 bp, mouse
gcctcggaaaaggaggggaa

SEQ ID NO: 764467 - DNA, 20 bp, mouse
ggccctgtgccctacggcgg

SEQ ID NO: 764468 - DNA, 20 bp, mouse
ggtagggcacagggccccgg

SEQ ID NO: 764469 - DNA, 20 bp, mouse
ggtgcagcctcggaaaagga

SEQ ID NO: 764470 - DNA, 20 bp, mouse
gggagagagcgcgcaaggca

SEQ ID NO: 764471 - DNA, 20 bp, mouse
gccgcagcgcgcactctggc

SEQ ID NO: 764472 - DNA, 20 bp, mouse
gctgcggtcccggggctgtt

SEQ ID NO: 764473 - DNA, 20 bp, mouse
gtggctccgcggtggcagca

SEQ ID NO: 764474 - DNA, 20 bp, mouse
gagaagtgcagcctcggaaa

SEQ ID NO: 764475 - DNA, 20 bp, mouse
gcttactcggcaggaatcgg

SEQ ID NO: 764476 - DNA, 20 bp, mouse
gagacccccggccgcctcgt

SEQ ID NO: 764477 - DNA, 20 bp, mouse
gcggcgctctctgagacccc

SEQ ID NO: 764478 - DNA, 20 bp, mouse
ggctctgcggctccggggag

SEQ ID NO: 764479 - DNA, 20 bp, mouse
gccggggagggggctctcgg

SEQ ID NO: 764480 - DNA, 20 bp, mouse
gcgctgccgagccgcaccag

SEQ ID NO: 764481 - DNA, 20 bp, mouse
ggcaccagaggccgacgagg

SEQ ID NO: 764482 - DNA, 20 bp, mouse
ggctggccggggcccggacc

SEQ ID NO: 764483 - DNA, 20 bp, mouse
gcagcacggctctgcggctc

SEQ ID NO: 764484 - DNA, 20 bp, mouse
ggaggcacgcacgcgacgca

SEQ ID NO: 764485 - DNA, 20 bp, mouse
gcgaggccagcacggctctg

SEQ ID NO: 764486 - DNA, 20 bp, mouse
gcaaagtaagagagcttaag

SEQ ID NO: 764487 - DNA, 20 bp, mouse
ggataaggcacccaagtcca

SEQ ID NO: 764488 - DNA, 20 bp, mouse
gttgaagggggaaatcgata

SEQ ID NO: 764489 - DNA, 20 bp, mouse
gccggttggttcaagaaggc

SEQ ID NO: 764490 - DNA, 20 bp, mouse
gcttcttgaaccaaccggga

SEQ ID NO: 764491 - DNA, 20 bp, mouse
gtgaaccaaccgggatggtt

SEQ ID NO: 764492 - DNA, 20 bp, mouse
gtggtaatgcactgtgagag

SEQ ID NO: 764493 - DNA, 20 bp, mouse
gatgctgtatcatttggttg

SEQ ID NO: 764494 - DNA, 20 bp, mouse
gttctccaaaccatcccggt

SEQ ID NO: 764495 - DNA, 20 bp, mouse
ggaagctggtgtctgcttag

SEQ ID NO: 764496 - DNA, 20 bp, mouse
ggcccctgcgggctgaaggc

SEQ ID NO: 764497 - DNA, 20 bp, mouse
gaagtcctggcgcacaggga

SEQ ID NO: 764498 - DNA, 20 bp, mouse
gactaggtccgggatagagg

SEQ ID NO: 764499 - DNA, 20 bp, mouse
gcctgtgcgccaggacttgg

SEQ ID NO: 764500 - DNA, 20 bp, mouse
gactcatagcctagggctta

SEQ ID NO: 764501 - DNA, 20 bp, mouse
gtgcccgccttcagcccgca

SEQ ID NO: 764502 - DNA, 20 bp, mouse
gccacgctcctgactaggtc

SEQ ID NO: 764503 - DNA, 20 bp, mouse
gcaggagcgtggcttctgca

SEQ ID NO: 764504 - DNA, 20 bp, mouse
gcttcagcccgcaggggcgc

SEQ ID NO: 764505 - DNA, 20 bp, mouse
gctataaatcccaagagcaa

SEQ ID NO: 764506 - DNA, 20 bp, mouse
gcggcgaggcgctcggtaga

SEQ ID NO: 764507 - DNA, 20 bp, mouse
gaggctggagcgcacacagg

SEQ ID NO: 764508 - DNA, 20 bp, mouse
gccgccggccggtcagggag

SEQ ID NO: 764509 - DNA, 20 bp, mouse
gcgcgcaggaggcacctagg

SEQ ID NO: 764510 - DNA, 20 bp, mouse
gctggagcgcacacaggcgg

SEQ ID NO: 764511 - DNA, 20 bp, mouse
ggggcgccgccggccggtca

SEQ ID NO: 764512 - DNA, 20 bp, mouse
gctcggtagaggggcgagac

SEQ ID NO: 764513 - DNA, 20 bp, mouse
gcctgcgcgacggggtccct

SEQ ID NO: 764514 - DNA, 20 bp, mouse
gagaggggcgagaccggccc

SEQ ID NO: 764515 - DNA, 20 bp, mouse
gccggccggtcagggagcgg

SEQ ID NO: 764516 - DNA, 20 bp, mouse
gcagaggtcgcaagcagcca

SEQ ID NO: 764517 - DNA, 20 bp, mouse
gtgtgtgggcgtggttcccc

SEQ ID NO: 764518 - DNA, 20 bp, mouse
gtgtgtgggcgtgactccct

SEQ ID NO: 764519 - DNA, 20 bp, mouse
gctgctcctgacctctgtgt

SEQ ID NO: 764520 - DNA, 20 bp, mouse
ggacatgcagagataagtaa

SEQ ID NO: 764521 - DNA, 20 bp, mouse
gttccaaaccgcaaacgggt

SEQ ID NO: 764522 - DNA, 20 bp, mouse
ggtaagggctctaaagaacg

SEQ ID NO: 764523 - DNA, 20 bp, mouse
gaggtggcacccctaaagcg

SEQ ID NO: 764524 - DNA, 20 bp, mouse
ggtgaaatcctacccgtttg

SEQ ID NO: 764525 - DNA, 20 bp, mouse
ggaaaaggagctgcggtagg

SEQ ID NO: 764526 - DNA, 20 bp, mouse
gggcggagagagtcgagaga

SEQ ID NO: 764527 - DNA, 20 bp, mouse
gacaaggcctccaacatcca

SEQ ID NO: 764528 - DNA, 20 bp, mouse
gaagacactttctgcagggt

SEQ ID NO: 764529 - DNA, 20 bp, mouse
gagagagtcgagagaaggag

SEQ ID NO: 764530 - DNA, 20 bp, mouse
gggggtgaatttgggagatg

SEQ ID NO: 764531 - DNA, 20 bp, mouse
gtggagcaccaaagcgagcg

SEQ ID NO: 764532 - DNA, 20 bp, mouse
gctgccaggcagatgtacgt

SEQ ID NO: 764533 - DNA, 20 bp, mouse
gctgcgacttagaaagcggg

SEQ ID NO: 764534 - DNA, 20 bp, mouse
gcagtctgcgacttagaaag

SEQ ID NO: 764535 - DNA, 20 bp, mouse
gggcggggagaactggagcg

SEQ ID NO: 764536 - DNA, 20 bp, mouse
ggggccgagcgcgcacccgg

SEQ ID NO: 764537 - DNA, 20 bp, mouse
gcgctcggcccgggtgacaa

SEQ ID NO: 764538 - DNA, 20 bp, mouse
gaggcctgcagacgcccggt

SEQ ID NO: 764539 - DNA, 20 bp, mouse
gcggcccgggtgacaatggg

SEQ ID NO: 764540 - DNA, 20 bp, mouse
ggcgtggagcagcgagggga

SEQ ID NO: 764541 - DNA, 20 bp, mouse
gtggcaatgcagggaaactt

SEQ ID NO: 764542 - DNA, 20 bp, mouse
gcggagccggggagcccacc

SEQ ID NO: 764543 - DNA, 20 bp, mouse
gcgtctgcaggcctcctcgc

SEQ ID NO: 764544 - DNA, 20 bp, mouse
gccggccgccgcgaagtcgg

SEQ ID NO: 764545 - DNA, 20 bp, mouse
gcggctggctggacggggct

SEQ ID NO: 764546 - DNA, 20 bp, mouse
ggggtcctgctcagagtggg

SEQ ID NO: 764547 - DNA, 20 bp, mouse
gactgttcagagactggaag

SEQ ID NO: 764548 - DNA, 20 bp, mouse
gggtgttgtaaactgtcagg

SEQ ID NO: 764549 - DNA, 20 bp, mouse
ggggacttcagcgtctaaca

SEQ ID NO: 764550 - DNA, 20 bp, mouse
gctaacagggaagatctcag

SEQ ID NO: 764551 - DNA, 20 bp, mouse
gtggaaaaacccagccctaa

SEQ ID NO: 764552 - DNA, 20 bp, mouse
gggtgagtgccattgtgtgg

SEQ ID NO: 764553 - DNA, 20 bp, mouse
gtcgccctccctctccttta

SEQ ID NO: 764554 - DNA, 20 bp, mouse
gaggagagggagggcgagca

SEQ ID NO: 764555 - DNA, 20 bp, mouse
gaacatgcgcccccacacaa

SEQ ID NO: 764556 - DNA, 20 bp, mouse
gggcgcaggttcaggaacga

SEQ ID NO: 764557 - DNA, 20 bp, mouse
gcgccccggggtcagtctgt

SEQ ID NO: 764558 - DNA, 20 bp, mouse
gcggagggggccaggaggat

SEQ ID NO: 764559 - DNA, 20 bp, mouse
ggggaccgacctgaagttgg

SEQ ID NO: 764560 - DNA, 20 bp, mouse
ggggtcagtctgtcggccgt

SEQ ID NO: 764561 - DNA, 20 bp, mouse
gccacgccgcggccgatccc

SEQ ID NO: 764562 - DNA, 20 bp, mouse
gcgtcccgcccctctggcgc

SEQ ID NO: 764563 - DNA, 20 bp, mouse
gactgaccccggggcgctga

SEQ ID NO: 764564 - DNA, 20 bp, mouse
gtgaacctgcgccagagggg

SEQ ID NO: 764565 - DNA, 20 bp, mouse
gtgtctgagcccagcaccag

SEQ ID NO: 764566 - DNA, 20 bp, mouse
ggggcagagggagtctctaa

SEQ ID NO: 764567 - DNA, 20 bp, mouse
gggcccggaggagctcgaag

SEQ ID NO: 764568 - DNA, 20 bp, mouse
ggcggggtgcgggcggctag

SEQ ID NO: 764569 - DNA, 20 bp, mouse
gggagctcgaaggggattgg

SEQ ID NO: 764570 - DNA, 20 bp, mouse
gtcagcccaggacccggggg

SEQ ID NO: 764571 - DNA, 20 bp, mouse
gggaggagctcgaaggggat

SEQ ID NO: 764572 - DNA, 20 bp, mouse
ggaggagagccagggggccc

SEQ ID NO: 764573 - DNA, 20 bp, mouse
ggggcagggtgcgcctttca

SEQ ID NO: 764574 - DNA, 20 bp, mouse
gggtgggcagccgcgcagca

SEQ ID NO: 764575 - DNA, 20 bp, mouse
gggagtctctaacggtcttc

SEQ ID NO: 764576 - DNA, 20 bp, mouse
gcctagtaggggccgaagca

SEQ ID NO: 764577 - DNA, 20 bp, mouse
gcataagcaaggtctgatat

SEQ ID NO: 764578 - DNA, 20 bp, mouse
ggaggaccacagatgatctc

SEQ ID NO: 764579 - DNA, 20 bp, mouse
gcctcatccaataagatgaa

SEQ ID NO: 764580 - DNA, 20 bp, mouse
ggggccgaagcagggatagt

SEQ ID NO: 764581 - DNA, 20 bp, mouse
gacgagtcagggtgaaggta

SEQ ID NO: 764582 - DNA, 20 bp, mouse
gtggaagccattgttccaac

SEQ ID NO: 764583 - DNA, 20 bp, mouse
gtcaacatggctctctatat

SEQ ID NO: 764584 - DNA, 20 bp, mouse
gggaagctgagggctcatga

SEQ ID NO: 764585 - DNA, 20 bp, mouse
gcatcctcagccagcttgtt

SEQ ID NO: 764586 - DNA, 20 bp, mouse
gcgtcagggcagctggtctg

SEQ ID NO: 764587 - DNA, 20 bp, mouse
gggtctgcggctacccttgt

SEQ ID NO: 764588 - DNA, 20 bp, mouse
ggcaaggcggggaccgcgag

SEQ ID NO: 764589 - DNA, 20 bp, mouse
gagcgcggagttggaatccc

SEQ ID NO: 764590 - DNA, 20 bp, mouse
gggaatcccaggcgtcgtca

SEQ ID NO: 764591 - DNA, 20 bp, mouse
ggctgagattcgacccacaa

SEQ ID NO: 764592 - DNA, 20 bp, mouse
gagcgctgtcagtgttctcg

SEQ ID NO: 764593 - DNA, 20 bp, mouse
gcccaggtcccgcctccttg

SEQ ID NO: 764594 - DNA, 20 bp, mouse
gggattgaggctggagaata

SEQ ID NO: 764595 - DNA, 20 bp, mouse
gtgggcagggccagcagtcg

SEQ ID NO: 764596 - DNA, 20 bp, mouse
gacgagcaggcctgacgtgg

SEQ ID NO: 764597 - DNA, 20 bp, mouse
gcccacgagcaggcctgacg

SEQ ID NO: 764598 - DNA, 20 bp, mouse
gggcccctggaacgaggagg

SEQ ID NO: 764599 - DNA, 20 bp, mouse
gcaccaggactccccgtctc

SEQ ID NO: 764600 - DNA, 20 bp, mouse
gccctccctgcgcagaatcg

SEQ ID NO: 764601 - DNA, 20 bp, mouse
gccccactgagggcgagaga

SEQ ID NO: 764602 - DNA, 20 bp, mouse
gccctggaacgaggaggcgg

SEQ ID NO: 764603 - DNA, 20 bp, mouse
ggctgggggcccctggaacg

SEQ ID NO: 764604 - DNA, 20 bp, mouse
gactccccgtctccggggcg

SEQ ID NO: 764605 - DNA, 20 bp, mouse
gaggcctgctcgtgggcgtg

SEQ ID NO: 764606 - DNA, 20 bp, mouse
gccgcctccagcatccagct

SEQ ID NO: 764607 - DNA, 20 bp, mouse
ggtgttgcctgaattggaca

SEQ ID NO: 764608 - DNA, 20 bp, mouse
gagggcaaaactgcccagag

SEQ ID NO: 764609 - DNA, 20 bp, mouse
ggcaaaactgcccagagagg

SEQ ID NO: 764610 - DNA, 20 bp, mouse
gttgcctgaattggacaggg

SEQ ID NO: 764611 - DNA, 20 bp, mouse
ggaagggattctgattggat

SEQ ID NO: 764612 - DNA, 20 bp, mouse
gacacctccctgtccaattc

SEQ ID NO: 764613 - DNA, 20 bp, mouse
gtccaaaccaatctactctg

SEQ ID NO: 764614 - DNA, 20 bp, mouse
gcagaggaagggattctgat

SEQ ID NO: 764615 - DNA, 20 bp, mouse
gtgggcagttttgccctctg

SEQ ID NO: 764616 - DNA, 20 bp, mouse
gagcacagcagggtacccgg

SEQ ID NO: 764617 - DNA, 20 bp, mouse
gggagcccagaggaccaacc

SEQ ID NO: 764618 - DNA, 20 bp, mouse
gaggaggtccgggttgtctg

SEQ ID NO: 764619 - DNA, 20 bp, mouse
gacagcagggtacccggagg

SEQ ID NO: 764620 - DNA, 20 bp, mouse
gtggcagagctgtgcgggga

SEQ ID NO: 764621 - DNA, 20 bp, mouse
gtaccctgctgtgctctccg

SEQ ID NO: 764622 - DNA, 20 bp, mouse
gaagaaggtcactagggagc

SEQ ID NO: 764623 - DNA, 20 bp, mouse
ggggtgcagagatctcgtca

SEQ ID NO: 764624 - DNA, 20 bp, mouse
gactgcccgggccatgtctc

SEQ ID NO: 764625 - DNA, 20 bp, mouse
ggacaacccggacctcctct

SEQ ID NO: 764626 - DNA, 20 bp, mouse
ggcagcgcgccctgaaggga

SEQ ID NO: 764627 - DNA, 20 bp, mouse
ggcacccagctcgggcgggg

SEQ ID NO: 764628 - DNA, 20 bp, mouse
ggctccgcggagtttccctc

SEQ ID NO: 764629 - DNA, 20 bp, mouse
ggccccgcacgaaggtgcgt

SEQ ID NO: 764630 - DNA, 20 bp, mouse
gccgcccgagctgggtgccg

SEQ ID NO: 764631 - DNA, 20 bp, mouse
gggcgcagagccgaggaccg

SEQ ID NO: 764632 - DNA, 20 bp, mouse
gagaggcagcgcgccctgaa

SEQ ID NO: 764633 - DNA, 20 bp, mouse
gggaggtgcggactgggaga

SEQ ID NO: 764634 - DNA, 20 bp, mouse
gtaatcggatcgctctgccg

SEQ ID NO: 764635 - DNA, 20 bp, mouse
gaggaccgcggcacccagct

SEQ ID NO: 764636 - DNA, 20 bp, mouse
gaaggaactgccaccgcggg

SEQ ID NO: 764637 - DNA, 20 bp, mouse
gaactgccaccgcggggggt

SEQ ID NO: 764638 - DNA, 20 bp, mouse
gttggggcagaattcagtga

SEQ ID NO: 764639 - DNA, 20 bp, mouse
gactcagcccgcgtcttaga

SEQ ID NO: 764640 - DNA, 20 bp, mouse
gagcagggctgtcactctac

SEQ ID NO: 764641 - DNA, 20 bp, mouse
gtggggttggacgaggatgc

SEQ ID NO: 764642 - DNA, 20 bp, mouse
gtgagtgctgagtcgctgag

SEQ ID NO: 764643 - DNA, 20 bp, mouse
gcagcctgccaagctctgtt

SEQ ID NO: 764644 - DNA, 20 bp, mouse
ggcagttccttctaagacgc

SEQ ID NO: 764645 - DNA, 20 bp, mouse
ggttccaggaactcttctac

SEQ ID NO: 764646 - DNA, 20 bp, mouse
gcgcgcgcggccgcgagtaa

SEQ ID NO: 764647 - DNA, 20 bp, mouse
gcctgtgggaagggccgacc

SEQ ID NO: 764648 - DNA, 20 bp, mouse
ggtgcccaacggtgccaggg

SEQ ID NO: 764649 - DNA, 20 bp, mouse
ggggaacaagacgctatcac

SEQ ID NO: 764650 - DNA, 20 bp, mouse
gcccactcccccaaaagatt

SEQ ID NO: 764651 - DNA, 20 bp, mouse
gcgcctgcgctgcgcggact

SEQ ID NO: 764652 - DNA, 20 bp, mouse
gaaggggcggtgctccaggt

SEQ ID NO: 764653 - DNA, 20 bp, mouse
gctggtgcccaacggtgcca

SEQ ID NO: 764654 - DNA, 20 bp, mouse
gggcccagtccgcgcagcgc

SEQ ID NO: 764655 - DNA, 20 bp, mouse
gacaagacgctatcacagga

SEQ ID NO: 764656 - DNA, 20 bp, mouse
gcaacggtggggagctgcac

SEQ ID NO: 764657 - DNA, 20 bp, mouse
gactgagtaagggacaacgg

SEQ ID NO: 764658 - DNA, 20 bp, mouse
gggtgtctctccgaccccgg

SEQ ID NO: 764659 - DNA, 20 bp, mouse
gcgagcgtcagatctgagtg

SEQ ID NO: 764660 - DNA, 20 bp, mouse
gtctctccgaccccggaggc

SEQ ID NO: 764661 - DNA, 20 bp, mouse
gaggaggtgatactgtggag

SEQ ID NO: 764662 - DNA, 20 bp, mouse
gatgggaggaggtgatactg

SEQ ID NO: 764663 - DNA, 20 bp, mouse
ggggggtgtctctccgaccc

SEQ ID NO: 764664 - DNA, 20 bp, mouse
gagtctgcagagccagcctc

SEQ ID NO: 764665 - DNA, 20 bp, mouse
ggcgctacaatcccgggcgg

SEQ ID NO: 764666 - DNA, 20 bp, mouse
gataaaggagagtccccggg

SEQ ID NO: 764667 - DNA, 20 bp, mouse
gagagcaggtggcaggaacg

SEQ ID NO: 764668 - DNA, 20 bp, mouse
gcaggtggcaggaacgtggg

SEQ ID NO: 764669 - DNA, 20 bp, mouse
ggtcctgcccacagctgtag

SEQ ID NO: 764670 - DNA, 20 bp, mouse
gggatcaaccaactgatcga

SEQ ID NO: 764671 - DNA, 20 bp, mouse
gtggacgtgggcgtggcgta

SEQ ID NO: 764672 - DNA, 20 bp, mouse
gcacagctgtaggggcgctc

SEQ ID NO: 764673 - DNA, 20 bp, mouse
gcgcccctacagctgtgggc

SEQ ID NO: 764674 - DNA, 20 bp, mouse
gttcccggaggcgtggacgt

SEQ ID NO: 764675 - DNA, 20 bp, mouse
gctccgggagagcaggtggc

SEQ ID NO: 764676 - DNA, 20 bp, mouse
ggagcggccggcccgtgctc

SEQ ID NO: 764677 - DNA, 20 bp, mouse
gtctctctctcggaatgggg

SEQ ID NO: 764678 - DNA, 20 bp, mouse
gctaagattccccctgcaag

SEQ ID NO: 764679 - DNA, 20 bp, mouse
gacgggccggccgctctcca

SEQ ID NO: 764680 - DNA, 20 bp, mouse
gtccgcagtaccatggagag

SEQ ID NO: 764681 - DNA, 20 bp, mouse
gggccggcccgtgctctggc

SEQ ID NO: 764682 - DNA, 20 bp, mouse
gtgagctctccgcagtacca

SEQ ID NO: 764683 - DNA, 20 bp, mouse
gaggctgggttacgtgacgc

SEQ ID NO: 764684 - DNA, 20 bp, mouse
ggaccccgcagctaaaggga

SEQ ID NO: 764685 - DNA, 20 bp, mouse
gcacgtaacccagccttctc

SEQ ID NO: 764686 - DNA, 20 bp, mouse
gcgggctcgtatggaaggtg

SEQ ID NO: 764687 - DNA, 20 bp, mouse
gccgctacataaggagtgtg

SEQ ID NO: 764688 - DNA, 20 bp, mouse
gcccccgcggcgggctcgta

SEQ ID NO: 764689 - DNA, 20 bp, mouse
gagaggaaaggtttaatcga

SEQ ID NO: 764690 - DNA, 20 bp, mouse
gaaggggtgtcgtcggtgtc

SEQ ID NO: 764691 - DNA, 20 bp, mouse
gaaggcaacgacggcggctg

SEQ ID NO: 764692 - DNA, 20 bp, mouse
gcagattcaaggggtgtcgt

SEQ ID NO: 764693 - DNA, 20 bp, mouse
ggtgggtgtgggtgtagcct

SEQ ID NO: 764694 - DNA, 20 bp, mouse
gaccaaggccagttcctcaa

SEQ ID NO: 764695 - DNA, 20 bp, mouse
ggccgccgtcgttgccttcc

SEQ ID NO: 764696 - DNA, 20 bp, mouse
ggaaaagacctgttgaagaa

SEQ ID NO: 764697 - DNA, 20 bp, mouse
ggtcctgggagctctgttat

SEQ ID NO: 764698 - DNA, 20 bp, mouse
gactctggtacaaagactgg

SEQ ID NO: 764699 - DNA, 20 bp, mouse
ggaagcagattcagacttca

SEQ ID NO: 764700 - DNA, 20 bp, mouse
gcttcaacaggtcttttctc

SEQ ID NO: 764701 - DNA, 20 bp, mouse
gaagcaccaactattaactc

SEQ ID NO: 764702 - DNA, 20 bp, mouse
gggtggagtactgatacccc

SEQ ID NO: 764703 - DNA, 20 bp, mouse
gttaactctggtacaaagac

SEQ ID NO: 764704 - DNA, 20 bp, mouse
ggaggtacttcatacagggc

SEQ ID NO: 764705 - DNA, 20 bp, mouse
ggaagcatctagaacagcct

SEQ ID NO: 764706 - DNA, 20 bp, mouse
gaggccggggagtgctcgtc

SEQ ID NO: 764707 - DNA, 20 bp, mouse
ggatccgcgggttccttctg

SEQ ID NO: 764708 - DNA, 20 bp, mouse
ggaactgcttagagggcgga

SEQ ID NO: 764709 - DNA, 20 bp, mouse
ggtccgccggggagtaagag

SEQ ID NO: 764710 - DNA, 20 bp, mouse
gtacccgcagaaggaacccg

SEQ ID NO: 764711 - DNA, 20 bp, mouse
ggccaccggaactgcttaga

SEQ ID NO: 764712 - DNA, 20 bp, mouse
gggttccttctgcgggtatg

SEQ ID NO: 764713 - DNA, 20 bp, mouse
gtgagggtgtctgaggtggt

SEQ ID NO: 764714 - DNA, 20 bp, mouse
ggcagctacgaggtcagcag

SEQ ID NO: 764715 - DNA, 20 bp, mouse
gtgtaagctgggagatccgc

SEQ ID NO: 764716 - DNA, 20 bp, mouse
gcgcccggggagagagacga

SEQ ID NO: 764717 - DNA, 20 bp, mouse
gaaggggtgcgcgcgcaggg

SEQ ID NO: 764718 - DNA, 20 bp, mouse
gagctagcgcccagggggaa

SEQ ID NO: 764719 - DNA, 20 bp, mouse
ggggtgcgcgcgcagggagg

SEQ ID NO: 764720 - DNA, 20 bp, mouse
gtgcgagcgaccgaggcccc

SEQ ID NO: 764721 - DNA, 20 bp, mouse
gcggggagagagacgagggg

SEQ ID NO: 764722 - DNA, 20 bp, mouse
gaggaaggggtgcgcgcgca

SEQ ID NO: 764723 - DNA, 20 bp, mouse
gggcctcggtcgctcgcacg

SEQ ID NO: 764724 - DNA, 20 bp, mouse
gagtgcgcaggggtgggcga

SEQ ID NO: 764725 - DNA, 20 bp, mouse
ggtaactagtgcgcaggggt

SEQ ID NO: 764726 - DNA, 20 bp, mouse
gtcgcccaagagcaagaggg

SEQ ID NO: 764727 - DNA, 20 bp, mouse
ggagcaagagggcggtgcgt

SEQ ID NO: 764728 - DNA, 20 bp, mouse
gcgcacagcccgcttcccat

SEQ ID NO: 764729 - DNA, 20 bp, mouse
ggtaagtgctagggattcgg

SEQ ID NO: 764730 - DNA, 20 bp, mouse
gaactcgcccaagagcaaga

SEQ ID NO: 764731 - DNA, 20 bp, mouse
gtgtgcgcgcgtggagcagt

SEQ ID NO: 764732 - DNA, 20 bp, mouse
gagcagtgggaacgccgctg

SEQ ID NO: 764733 - DNA, 20 bp, mouse
gtgggtgatggtaagtgcta

SEQ ID NO: 764734 - DNA, 20 bp, mouse
ggtttgggaacgaagaggtg

SEQ ID NO: 764735 - DNA, 20 bp, mouse
gaaccggtggcagagtccgt

SEQ ID NO: 764736 - DNA, 20 bp, mouse
gtggccgcctcactgctacc

SEQ ID NO: 764737 - DNA, 20 bp, mouse
ggctcgcacgggatggggaa

SEQ ID NO: 764738 - DNA, 20 bp, mouse
ggggaagggcgtcggggacg

SEQ ID NO: 764739 - DNA, 20 bp, mouse
gactgcgcgctcgcacggga

SEQ ID NO: 764740 - DNA, 20 bp, mouse
gagtccgagcaccgccattt

SEQ ID NO: 764741 - DNA, 20 bp, mouse
gcccccaaaggggactgtgg

SEQ ID NO: 764742 - DNA, 20 bp, mouse
gtgaaaaccgggtagcagtg

SEQ ID NO: 764743 - DNA, 20 bp, mouse
gtggccagctttgtgaaaac

SEQ ID NO: 764744 - DNA, 20 bp, mouse
gcggcagccggccctcgcgc

SEQ ID NO: 764745 - DNA, 20 bp, mouse
ggggatggggaagggcgtcg

SEQ ID NO: 764746 - DNA, 20 bp, mouse
gccgctgggcgcctgctcgt

SEQ ID NO: 764747 - DNA, 20 bp, mouse
ggctggacgcggtagaacgg

SEQ ID NO: 764748 - DNA, 20 bp, mouse
ggctaggtttcccacacgga

SEQ ID NO: 764749 - DNA, 20 bp, mouse
gcaggaaaagccctccgtgt

SEQ ID NO: 764750 - DNA, 20 bp, mouse
ggacgcggtagaacggcggg

SEQ ID NO: 764751 - DNA, 20 bp, mouse
gattaaggtgaggctcacat

SEQ ID NO: 764752 - DNA, 20 bp, mouse
gttgggcggagcctacgagc

SEQ ID NO: 764753 - DNA, 20 bp, mouse
gtgctagatgctgtggaaag

SEQ ID NO: 764754 - DNA, 20 bp, mouse
gggcggctaggtttcccaca

SEQ ID NO: 764755 - DNA, 20 bp, mouse
gtctaccgcgtccagccgct

SEQ ID NO: 764756 - DNA, 20 bp, mouse
gcggcgctgcgtcaaggcgg

SEQ ID NO: 764757 - DNA, 20 bp, mouse
gaccccgcgcgctccccgac

SEQ ID NO: 764758 - DNA, 20 bp, mouse
gcgagcgcggggagattggg

SEQ ID NO: 764759 - DNA, 20 bp, mouse
ggggcggcgctgcgtcaagg

SEQ ID NO: 764760 - DNA, 20 bp, mouse
gactcccaatgcccgactaa

SEQ ID NO: 764761 - DNA, 20 bp, mouse
gcgcgggcggcgctgcgtca

SEQ ID NO: 764762 - DNA, 20 bp, mouse
ggcccccgggaacggcagga

SEQ ID NO: 764763 - DNA, 20 bp, mouse
ggcgcggatcggtcgcacaa

SEQ ID NO: 764764 - DNA, 20 bp, mouse
gacgcagcgccgcccgcgcg

SEQ ID NO: 764765 - DNA, 20 bp, mouse
ggagccccaaaggtggatga

SEQ ID NO: 764766 - DNA, 20 bp, mouse
gtcgcgcctcccaccgggga

SEQ ID NO: 764767 - DNA, 20 bp, mouse
gggtggtgccagatgacagg

SEQ ID NO: 764768 - DNA, 20 bp, mouse
gatggccacaacccctgcat

SEQ ID NO: 764769 - DNA, 20 bp, mouse
gtgtgggagccgtccccggt

SEQ ID NO: 764770 - DNA, 20 bp, mouse
ggaggcgcgagctggcgagc

SEQ ID NO: 764771 - DNA, 20 bp, mouse
gcagctcgcgcctcccaccg

SEQ ID NO: 764772 - DNA, 20 bp, mouse
ggcaggtggtgccagatgac

SEQ ID NO: 764773 - DNA, 20 bp, mouse
ggtggtgtgggagccgtccc

SEQ ID NO: 764774 - DNA, 20 bp, mouse
gtagggaagctttagcaaga

SEQ ID NO: 764775 - DNA, 20 bp, mouse
ggggagccgtccccggtggg

SEQ ID NO: 764776 - DNA, 20 bp, mouse
gaacccgaggcggaaccttg

SEQ ID NO: 764777 - DNA, 20 bp, mouse
ggccccagagttccgccgcc

SEQ ID NO: 764778 - DNA, 20 bp, mouse
ggccaggcggcggaactctg

SEQ ID NO: 764779 - DNA, 20 bp, mouse
gaaagtccgaggcggagaga

SEQ ID NO: 764780 - DNA, 20 bp, mouse
gcaggagtagctatgggttt

SEQ ID NO: 764781 - DNA, 20 bp, mouse
gccgccgcaaggttccgcct

SEQ ID NO: 764782 - DNA, 20 bp, mouse
ggggcttgcgggagtcggga

SEQ ID NO: 764783 - DNA, 20 bp, mouse
gacgttgtcaaagtccgagg

SEQ ID NO: 764784 - DNA, 20 bp, mouse
gcggcggaactctggggccg

SEQ ID NO: 764785 - DNA, 20 bp, mouse
gtaggtacggtctgaggatt

SEQ ID NO: 764786 - DNA, 20 bp, mouse
ggggctcccgggcaggtctc

SEQ ID NO: 764787 - DNA, 20 bp, mouse
gcgggagccccccagttcgt

SEQ ID NO: 764788 - DNA, 20 bp, mouse
gtgactcaggcccggaggag

SEQ ID NO: 764789 - DNA, 20 bp, mouse
ggcgctgcagaggttagtcg

SEQ ID NO: 764790 - DNA, 20 bp, mouse
gaggggcgcgcagtgacctg

SEQ ID NO: 764791 - DNA, 20 bp, mouse
gagaaccgctacaccataca

SEQ ID NO: 764792 - DNA, 20 bp, mouse
ggcaggtctcaggctcacgt

SEQ ID NO: 764793 - DNA, 20 bp, mouse
gaggttagtcggggcagtgt

SEQ ID NO: 764794 - DNA, 20 bp, mouse
ggtcggggcagtgtaggacg

SEQ ID NO: 764795 - DNA, 20 bp, mouse
ggcaactattatcacagtga

SEQ ID NO: 764796 - DNA, 20 bp, mouse
ggcccccgcctctcgctcgc

SEQ ID NO: 764797 - DNA, 20 bp, mouse
gggaaaccgcgtagctcaga

SEQ ID NO: 764798 - DNA, 20 bp, mouse
gcccgcctctcgctcgctgg

SEQ ID NO: 764799 - DNA, 20 bp, mouse
gggcgccatagcaacagagc

SEQ ID NO: 764800 - DNA, 20 bp, mouse
ggggcggcggaagccgttcc

SEQ ID NO: 764801 - DNA, 20 bp, mouse
gagctcagaaggcggctcac

SEQ ID NO: 764802 - DNA, 20 bp, mouse
gcccgcccgctctgttgcta

SEQ ID NO: 764803 - DNA, 20 bp, mouse
gaaccgcgtagctcagaagg

SEQ ID NO: 764804 - DNA, 20 bp, mouse
gcgggacgatccacggccca

SEQ ID NO: 764805 - DNA, 20 bp, mouse
ggaaaacggaagtactccgc

SEQ ID NO: 764806 - DNA, 20 bp, mouse
gtgcggcccgggactctagg

SEQ ID NO: 764807 - DNA, 20 bp, mouse
ggagccaacgggaaaaccta

SEQ ID NO: 764808 - DNA, 20 bp, mouse
gccacgcggccagcgtcgga

SEQ ID NO: 764809 - DNA, 20 bp, mouse
gctctgcggcccgggactct

SEQ ID NO: 764810 - DNA, 20 bp, mouse
ggggacccgggtttctgtcc

SEQ ID NO: 764811 - DNA, 20 bp, mouse
gcgccccttggtcacgtgac

SEQ ID NO: 764812 - DNA, 20 bp, mouse
gcggctgacaggtgagtcgg

SEQ ID NO: 764813 - DNA, 20 bp, mouse
gcccggcagctgacgctctg

SEQ ID NO: 764814 - DNA, 20 bp, mouse
gagctgacgctctgcggccc

SEQ ID NO: 764815 - DNA, 20 bp, mouse
gatccctggggtgggagacg

SEQ ID NO: 764816 - DNA, 20 bp, mouse
gggaagatgcatgactaagt

SEQ ID NO: 764817 - DNA, 20 bp, mouse
gccaacgccgccgcgacctc

SEQ ID NO: 764818 - DNA, 20 bp, mouse
gataccctataacaggtctg

SEQ ID NO: 764819 - DNA, 20 bp, mouse
ggtaactaagaaccaatgcg

SEQ ID NO: 764820 - DNA, 20 bp, mouse
ggaggagccaaagagacaat

SEQ ID NO: 764821 - DNA, 20 bp, mouse
gagcaacgcagctccccggc

SEQ ID NO: 764822 - DNA, 20 bp, mouse
gcatcttcccattgtctctt

SEQ ID NO: 764823 - DNA, 20 bp, mouse
gacctgtggcccggaggtcg

SEQ ID NO: 764824 - DNA, 20 bp, mouse
gcaggagcaacgcagctccc

SEQ ID NO: 764825 - DNA, 20 bp, mouse
gggtgcagatatttagaagg

SEQ ID NO: 764826 - DNA, 20 bp, mouse
gaaaaggcggctcctcccgg

SEQ ID NO: 764827 - DNA, 20 bp, mouse
gtcccggaggctttcttctt

SEQ ID NO: 764828 - DNA, 20 bp, mouse
gttgctgcctggaagcaaaa

SEQ ID NO: 764829 - DNA, 20 bp, mouse
gtaagggcgtggctaaaagg

SEQ ID NO: 764830 - DNA, 20 bp, mouse
gaggctgggctaggatgctc

SEQ ID NO: 764831 - DNA, 20 bp, mouse
gctgaggtcgggaaggtcag

SEQ ID NO: 764832 - DNA, 20 bp, mouse
ggcttccaggcagcaactct

SEQ ID NO: 764833 - DNA, 20 bp, mouse
gccgggtctgaaggaaacta

SEQ ID NO: 764834 - DNA, 20 bp, mouse
gtgcccttccacttaggcca

SEQ ID NO: 764835 - DNA, 20 bp, mouse
gaaagagctaagtggacctg

SEQ ID NO: 764836 - DNA, 20 bp, mouse
gggcgtggttgcaagttagg

SEQ ID NO: 764837 - DNA, 20 bp, mouse
ggagaactcacgcaaaaaaa

SEQ ID NO: 764838 - DNA, 20 bp, mouse
gtcacgctcagtggcgttta

SEQ ID NO: 764839 - DNA, 20 bp, mouse
gcgcacgcacgctgcacttc

SEQ ID NO: 764840 - DNA, 20 bp, mouse
gaacccggacagcgacagat

SEQ ID NO: 764841 - DNA, 20 bp, mouse
gacccagccgcggggtcctc

SEQ ID NO: 764842 - DNA, 20 bp, mouse
gcggggagattcacgctcag

SEQ ID NO: 764843 - DNA, 20 bp, mouse
gaggctctggtgctccgctg

SEQ ID NO: 764844 - DNA, 20 bp, mouse
ggcgcgtgcgcagagagtca

SEQ ID NO: 764845 - DNA, 20 bp, mouse
gggcgtttaaggttgatttg

SEQ ID NO: 764846 - DNA, 20 bp, mouse
gggtgcgaaccccgagcgaa

SEQ ID NO: 764847 - DNA, 20 bp, mouse
gaggcggagccaaagctctc

SEQ ID NO: 764848 - DNA, 20 bp, mouse
gccgagcgaagggtggagtg

SEQ ID NO: 764849 - DNA, 20 bp, mouse
ggagactcaggtcctgcaag

SEQ ID NO: 764850 - DNA, 20 bp, mouse
gagactgcgggcatgtgctg

SEQ ID NO: 764851 - DNA, 20 bp, mouse
gcgaccccatgaacagagac

SEQ ID NO: 764852 - DNA, 20 bp, mouse
gtggggactccggagctgct

SEQ ID NO: 764853 - DNA, 20 bp, mouse
gcggagtccccagagagctt

SEQ ID NO: 764854 - DNA, 20 bp, mouse
gagaatggacccaaagtatc

SEQ ID NO: 764855 - DNA, 20 bp, mouse
ggcgaaccccgagcgaaggg

SEQ ID NO: 764856 - DNA, 20 bp, mouse
ggcgccccgaggattctggt

SEQ ID NO: 764857 - DNA, 20 bp, mouse
ggggctgcttagaatatcag

SEQ ID NO: 764858 - DNA, 20 bp, mouse
gcctcggggcgcacacgaag

SEQ ID NO: 764859 - DNA, 20 bp, mouse
gtaggcttgcggcgccccca

SEQ ID NO: 764860 - DNA, 20 bp, mouse
gccacccaccagaatcctcg

SEQ ID NO: 764861 - DNA, 20 bp, mouse
gcggggcgcacacgaagcgg

SEQ ID NO: 764862 - DNA, 20 bp, mouse
ggccttccctgcaacttcct

SEQ ID NO: 764863 - DNA, 20 bp, mouse
gtgcatggagaaagctgccg

SEQ ID NO: 764864 - DNA, 20 bp, mouse
ggctgtgctagagcatctaa

SEQ ID NO: 764865 - DNA, 20 bp, mouse
gagcatctaaaggagctcct

SEQ ID NO: 764866 - DNA, 20 bp, mouse
gttaggctctaaatccgagc

SEQ ID NO: 764867 - DNA, 20 bp, mouse
gcctagcgcgcgggaaacag

SEQ ID NO: 764868 - DNA, 20 bp, mouse
ggcgtccaaaaattaatctt

SEQ ID NO: 764869 - DNA, 20 bp, mouse
gcgacactgtcgcaaaactc

SEQ ID NO: 764870 - DNA, 20 bp, mouse
ggctctaaatccgagcgggc

SEQ ID NO: 764871 - DNA, 20 bp, mouse
gaggcgtgagccagcccgct

SEQ ID NO: 764872 - DNA, 20 bp, mouse
gagagcctaagattaatttt

SEQ ID NO: 764873 - DNA, 20 bp, mouse
gaaggatctttgcgagttta

SEQ ID NO: 764874 - DNA, 20 bp, mouse
gaccggatttccggagtcaa

SEQ ID NO: 764875 - DNA, 20 bp, mouse
gaatttttggacgctgaaaa

SEQ ID NO: 764876 - DNA, 20 bp, mouse
gcaccctcaggggaggtgat

SEQ ID NO: 764877 - DNA, 20 bp, mouse
gactgtgccgggtacatcct

SEQ ID NO: 764878 - DNA, 20 bp, mouse
gtgccaatcacctcccctga

SEQ ID NO: 764879 - DNA, 20 bp, mouse
gaaggctgggcatcgagtgc

SEQ ID NO: 764880 - DNA, 20 bp, mouse
gtgggcacgaacagaaggct

SEQ ID NO: 764881 - DNA, 20 bp, mouse
gccagtacaagtagcggtgg

SEQ ID NO: 764882 - DNA, 20 bp, mouse
gtagcggtggaggcttccct

SEQ ID NO: 764883 - DNA, 20 bp, mouse
gacctcactaacctgaaata

SEQ ID NO: 764884 - DNA, 20 bp, mouse
gggtactagggtaggagata

SEQ ID NO: 764885 - DNA, 20 bp, mouse
gtcctgggactcttgaatgc

SEQ ID NO: 764886 - DNA, 20 bp, mouse
ggcccgggaccacccatcgc

SEQ ID NO: 764887 - DNA, 20 bp, mouse
ggatgggtggtcccgggcgt

SEQ ID NO: 764888 - DNA, 20 bp, mouse
gcgcacaccggaagtgtaca

SEQ ID NO: 764889 - DNA, 20 bp, mouse
gccgtccggggctcatgatg

SEQ ID NO: 764890 - DNA, 20 bp, mouse
ggaaggtcggcacgtgacgt

SEQ ID NO: 764891 - DNA, 20 bp, mouse
ggggtggtcccgggcgtagg

SEQ ID NO: 764892 - DNA, 20 bp, mouse
gcgcccgcggtggaaccgag

SEQ ID NO: 764893 - DNA, 20 bp, mouse
ggggaccacccatcgccgga

SEQ ID NO: 764894 - DNA, 20 bp, mouse
ggtcggcgcgctgacgtcag

SEQ ID NO: 764895 - DNA, 20 bp, mouse
gcacctaccctgcacagcct

SEQ ID NO: 764896 - DNA, 20 bp, mouse
gagaccaagccagaatgctc

SEQ ID NO: 764897 - DNA, 20 bp, mouse
gcgctccggggacactgctc

SEQ ID NO: 764898 - DNA, 20 bp, mouse
gtcccagtgggaactggtag

SEQ ID NO: 764899 - DNA, 20 bp, mouse
gtggcctgagcttccaagtg

SEQ ID NO: 764900 - DNA, 20 bp, mouse
gcccgcgccagctacgtcca

SEQ ID NO: 764901 - DNA, 20 bp, mouse
ggcttccaagtggggctgaa

SEQ ID NO: 764902 - DNA, 20 bp, mouse
gcagccccacttggaagctc

SEQ ID NO: 764903 - DNA, 20 bp, mouse
gggagatccgggcaccctga

SEQ ID NO: 764904 - DNA, 20 bp, mouse
gccagaatgctcaggaaccc

SEQ ID NO: 764905 - DNA, 20 bp, mouse
gtctccatggcaacgggagg

SEQ ID NO: 764906 - DNA, 20 bp, mouse
gagtggccaaccaggtgccc

SEQ ID NO: 764907 - DNA, 20 bp, mouse
gcgtgagtctcccagttcaa

SEQ ID NO: 764908 - DNA, 20 bp, mouse
gatgagcggcagccccgtaa

SEQ ID NO: 764909 - DNA, 20 bp, mouse
gaccccttaaagacaaccgt

SEQ ID NO: 764910 - DNA, 20 bp, mouse
gagctgggctctcaagagac

SEQ ID NO: 764911 - DNA, 20 bp, mouse
gtggcattgcgtcccttacg

SEQ ID NO: 764912 - DNA, 20 bp, mouse
gaagggacgcaatgccatcc

SEQ ID NO: 764913 - DNA, 20 bp, mouse
gttccagcctggacaaacat

SEQ ID NO: 764914 - DNA, 20 bp, mouse
gaaagtatttcggatcttag

SEQ ID NO: 764915 - DNA, 20 bp, mouse
gcccgcccctaccccggtcc

SEQ ID NO: 764916 - DNA, 20 bp, mouse
gcccctaaatgccaagaggg

SEQ ID NO: 764917 - DNA, 20 bp, mouse
gttgcggggatgaagttcaa

SEQ ID NO: 764918 - DNA, 20 bp, mouse
ggacccgggtctgaagcaaa

SEQ ID NO: 764919 - DNA, 20 bp, mouse
gtgggagaggcaggcgggca

SEQ ID NO: 764920 - DNA, 20 bp, mouse
gagcctgccccgcccgccgg

SEQ ID NO: 764921 - DNA, 20 bp, mouse
ggctggcatctgataggggt

SEQ ID NO: 764922 - DNA, 20 bp, mouse
gccaatgctggcatctgata

SEQ ID NO: 764923 - DNA, 20 bp, mouse
gtcggcaccgggctgaggga

SEQ ID NO: 764924 - DNA, 20 bp, mouse
gagctctcggcaccgggctg

SEQ ID NO: 764925 - DNA, 20 bp, mouse
gagggaggcgcgtcccgggt

SEQ ID NO: 764926 - DNA, 20 bp, mouse
gtatgatgtgtgacagagtc

SEQ ID NO: 764927 - DNA, 20 bp, mouse
gaaaaaacataggtataatg

SEQ ID NO: 764928 - DNA, 20 bp, mouse
gaaatatgctgaaataggaa

SEQ ID NO: 764929 - DNA, 20 bp, mouse
gtggttctagttgtagagtt

SEQ ID NO: 764930 - DNA, 20 bp, mouse
gtgccatctcttgcacctgt

SEQ ID NO: 764931 - DNA, 20 bp, mouse
gttcctacaggtgcaagaga

SEQ ID NO: 764932 - DNA, 20 bp, mouse
gaaatctaagtatatatgtg

SEQ ID NO: 764933 - DNA, 20 bp, mouse
gcagaatatggacaaagcca

SEQ ID NO: 764934 - DNA, 20 bp, mouse
ggactctgacagctgaaaat

SEQ ID NO: 764935 - DNA, 20 bp, mouse
gacagccctgacaatgacaa

SEQ ID NO: 764936 - DNA, 20 bp, mouse
gtcgccgcggccggcttctg

SEQ ID NO: 764937 - DNA, 20 bp, mouse
gctgtgaggggccctgagac

SEQ ID NO: 764938 - DNA, 20 bp, mouse
gctcgcgcccggccagggac

SEQ ID NO: 764939 - DNA, 20 bp, mouse
gccgccagggagcatcgccg

SEQ ID NO: 764940 - DNA, 20 bp, mouse
gtggtcacctaaggtagggg

SEQ ID NO: 764941 - DNA, 20 bp, mouse
gctgcggcggagcccgggta

SEQ ID NO: 764942 - DNA, 20 bp, mouse
gccagagctgctaaactccg

SEQ ID NO: 764943 - DNA, 20 bp, mouse
gtggcgggcggtcctgtctc

SEQ ID NO: 764944 - DNA, 20 bp, mouse
gcagccaggagtgtgctgag

SEQ ID NO: 764945 - DNA, 20 bp, mouse
gccaagaggtggttattcct

SEQ ID NO: 764946 - DNA, 20 bp, mouse
gcgacggggcggagactaag

SEQ ID NO: 764947 - DNA, 20 bp, mouse
gaagtcccgcccccactata

SEQ ID NO: 764948 - DNA, 20 bp, mouse
gaatcccgcccttatagtgg

SEQ ID NO: 764949 - DNA, 20 bp, mouse
gccgcccccactataagggc

SEQ ID NO: 764950 - DNA, 20 bp, mouse
gttcctgaagtcagggtcag

SEQ ID NO: 764951 - DNA, 20 bp, mouse
gaacgccgcaaggacccgga

SEQ ID NO: 764952 - DNA, 20 bp, mouse
gagactaagaggtccgcgtc

SEQ ID NO: 764953 - DNA, 20 bp, mouse
gcggaatcccgcccttatag

SEQ ID NO: 764954 - DNA, 20 bp, mouse
gaggaggccccgcccagaag

SEQ ID NO: 764955 - DNA, 20 bp, mouse
gccccgcccagaagaggtga

SEQ ID NO: 764956 - DNA, 20 bp, mouse
gacgctggggtcctgtatgt

SEQ ID NO: 764957 - DNA, 20 bp, mouse
gagcaagagtggggagtgcg

SEQ ID NO: 764958 - DNA, 20 bp, mouse
gggggaacgttggggggcga

SEQ ID NO: 764959 - DNA, 20 bp, mouse
gggggggagtaccaagacgc

SEQ ID NO: 764960 - DNA, 20 bp, mouse
gacgccgctggcctggtggg

SEQ ID NO: 764961 - DNA, 20 bp, mouse
gaagatggtctactgtgtgt

SEQ ID NO: 764962 - DNA, 20 bp, mouse
gtgggggtgggggaacgttg

SEQ ID NO: 764963 - DNA, 20 bp, mouse
gcaccaggccagcggcgtga

SEQ ID NO: 764964 - DNA, 20 bp, mouse
ggtaaggcgggcgctgtctt

SEQ ID NO: 764965 - DNA, 20 bp, mouse
gcctgcgcagtgtggctgta

SEQ ID NO: 764966 - DNA, 20 bp, mouse
gaaaactggggcgatccagg

SEQ ID NO: 764967 - DNA, 20 bp, mouse
gcgggaggagctagtcaagt

SEQ ID NO: 764968 - DNA, 20 bp, mouse
gggagctagtcaagtagggc

SEQ ID NO: 764969 - DNA, 20 bp, mouse
gggcggggcgtggtctggtc

SEQ ID NO: 764970 - DNA, 20 bp, mouse
gtgaaccagccagcaaaact

SEQ ID NO: 764971 - DNA, 20 bp, mouse
gggggcgtggtctggtcggg

SEQ ID NO: 764972 - DNA, 20 bp, mouse
gtatataagacagacgggcg

SEQ ID NO: 764973 - DNA, 20 bp, mouse
ggaggcttatataagacaga

SEQ ID NO: 764974 - DNA, 20 bp, mouse
gagcaaaactggggcgatcc

SEQ ID NO: 764975 - DNA, 20 bp, mouse
gtgacggggcggagcttggc

SEQ ID NO: 764976 - DNA, 20 bp, mouse
gaggcctgagaacattacag

SEQ ID NO: 764977 - DNA, 20 bp, mouse
ggaaggaatgggccaaggta

SEQ ID NO: 764978 - DNA, 20 bp, mouse
ggggattgggtcagagtcac

SEQ ID NO: 764979 - DNA, 20 bp, mouse
gggccaaggtaaggcagaat

SEQ ID NO: 764980 - DNA, 20 bp, mouse
gcaggggcagagaacccgtg

SEQ ID NO: 764981 - DNA, 20 bp, mouse
gatgtctcgtggggcgcatg

SEQ ID NO: 764982 - DNA, 20 bp, mouse
gaacccaggtccagaatccg

SEQ ID NO: 764983 - DNA, 20 bp, mouse
gtagacaccagagaaggaat

SEQ ID NO: 764984 - DNA, 20 bp, mouse
gcaaacggcccgagtgcttg

SEQ ID NO: 764985 - DNA, 20 bp, mouse
gatggccaagatgtctcgtg

SEQ ID NO: 764986 - DNA, 20 bp, mouse
gaggctaggagctgcgggat

SEQ ID NO: 764987 - DNA, 20 bp, mouse
gggaggcggggtcaaggatt

SEQ ID NO: 764988 - DNA, 20 bp, mouse
ggaggtgggcgggttctaga

SEQ ID NO: 764989 - DNA, 20 bp, mouse
gaggagctgcgggatgggtg

SEQ ID NO: 764990 - DNA, 20 bp, mouse
gggagtctgggttgagtcaa

SEQ ID NO: 764991 - DNA, 20 bp, mouse
gcccggctgagtaaagaata

SEQ ID NO: 764992 - DNA, 20 bp, mouse
ggcctgagctgggtcagggg

SEQ ID NO: 764993 - DNA, 20 bp, mouse
ggttggaaagaggaatgccc

SEQ ID NO: 764994 - DNA, 20 bp, mouse
ggcccaagaaccacccacgg

SEQ ID NO: 764995 - DNA, 20 bp, mouse
gccctcctgcctcgcgggtc

SEQ ID NO: 764996 - DNA, 20 bp, mouse
gccagcacacgcagcccgca

SEQ ID NO: 764997 - DNA, 20 bp, mouse
ggcggcggtgacaactgcag

SEQ ID NO: 764998 - DNA, 20 bp, mouse
gtcgggtgccagggtcgcat

SEQ ID NO: 764999 - DNA, 20 bp, mouse
gtctccagaagagtgtacag

SEQ ID NO: 765000 - DNA, 20 bp, mouse
ggggtcgcatcgggtgactc

SEQ ID NO: 765001 - DNA, 20 bp, mouse
ggtaatagagagtgaggatc

SEQ ID NO: 765002 - DNA, 20 bp, mouse
gtaaactgcggagtagagga

SEQ ID NO: 765003 - DNA, 20 bp, mouse
ggctgggtgccgcagtcccc

SEQ ID NO: 765004 - DNA, 20 bp, mouse
ggggtgccgcagtccccggg

SEQ ID NO: 765005 - DNA, 20 bp, mouse
gcggtgggaccgggacacac

SEQ ID NO: 765006 - DNA, 20 bp, mouse
ggaggagcggggcgatgcat

SEQ ID NO: 765007 - DNA, 20 bp, mouse
gtccccgcggtgccccgcta

SEQ ID NO: 765008 - DNA, 20 bp, mouse
gcatccaccactgcctcagt

SEQ ID NO: 765009 - DNA, 20 bp, mouse
ggagaaggtgagcgcgacgt

SEQ ID NO: 765010 - DNA, 20 bp, mouse
gtaggaagagtgctccagtc

SEQ ID NO: 765011 - DNA, 20 bp, mouse
gcagccccgccgcccttaaa

SEQ ID NO: 765012 - DNA, 20 bp, mouse
gacgtgggtgctgatcgccc

SEQ ID NO: 765013 - DNA, 20 bp, mouse
gtcacaggcggctgtaacct

SEQ ID NO: 765014 - DNA, 20 bp, mouse
gccagtctggctttcacagg

SEQ ID NO: 765015 - DNA, 20 bp, mouse
gtggaggagctcaccaccgg

SEQ ID NO: 765016 - DNA, 20 bp, mouse
gtcggccgaggcaggggtca

SEQ ID NO: 765017 - DNA, 20 bp, mouse
ggcggaaaggagaacctcga

SEQ ID NO: 765018 - DNA, 20 bp, mouse
gccgtctcctcgatctcttc

SEQ ID NO: 765019 - DNA, 20 bp, mouse
ggagcagcccgaagagatcg

SEQ ID NO: 765020 - DNA, 20 bp, mouse
gaggctgcctgagaacacat

SEQ ID NO: 765021 - DNA, 20 bp, mouse
gcgtaagcgcggaagaaaca

SEQ ID NO: 765022 - DNA, 20 bp, mouse
gccgcctggactacacatcc

SEQ ID NO: 765023 - DNA, 20 bp, mouse
gaggagacggaatagccctt

SEQ ID NO: 765024 - DNA, 20 bp, mouse
gcggcccggatgtgtagtcc

SEQ ID NO: 765025 - DNA, 20 bp, mouse
ggggcggtggccacctaact

SEQ ID NO: 765026 - DNA, 20 bp, mouse
gcccgcccgcagtgacttgc

SEQ ID NO: 765027 - DNA, 20 bp, mouse
gaatgactaggtcttcccat

SEQ ID NO: 765028 - DNA, 20 bp, mouse
gttctcctagtccacttcaa

SEQ ID NO: 765029 - DNA, 20 bp, mouse
gagcgcggagccatctggcc

SEQ ID NO: 765030 - DNA, 20 bp, mouse
gcgggcctgcaagtcactgc

SEQ ID NO: 765031 - DNA, 20 bp, mouse
gcggagccatctggccgggt

SEQ ID NO: 765032 - DNA, 20 bp, mouse
gagggggcttggcgcggaag

SEQ ID NO: 765033 - DNA, 20 bp, mouse
gtcactgcgggcggggctag

SEQ ID NO: 765034 - DNA, 20 bp, mouse
gagaggggataatgaagagt

SEQ ID NO: 765035 - DNA, 20 bp, mouse
gggggctagggggcttggcg

SEQ ID NO: 765036 - DNA, 20 bp, mouse
ggggaggaggggtctacgag

SEQ ID NO: 765037 - DNA, 20 bp, mouse
gtgagcccctagaactccac

SEQ ID NO: 765038 - DNA, 20 bp, mouse
gtctgccagtggagttctag

SEQ ID NO: 765039 - DNA, 20 bp, mouse
gtctcaagctcctggtcccg

SEQ ID NO: 765040 - DNA, 20 bp, mouse
ggcagagagactggcgggaa

SEQ ID NO: 765041 - DNA, 20 bp, mouse
gaacgggttaaatacacgtg

SEQ ID NO: 765042 - DNA, 20 bp, mouse
gtcactggcggtctggaggg

SEQ ID NO: 765043 - DNA, 20 bp, mouse
gctacagactgcaaccaaag

SEQ ID NO: 765044 - DNA, 20 bp, mouse
gaggcaagtgcgggaagtgg

SEQ ID NO: 765045 - DNA, 20 bp, mouse
gcggtcactggcggtctgga

SEQ ID NO: 765046 - DNA, 20 bp, mouse
ggggcggcgcccgacggcgg

SEQ ID NO: 765047 - DNA, 20 bp, mouse
gagagaggaggggcggagtg

SEQ ID NO: 765048 - DNA, 20 bp, mouse
ggacccgagtctaaaggagg

SEQ ID NO: 765049 - DNA, 20 bp, mouse
gggccggcaccttggaagct

SEQ ID NO: 765050 - DNA, 20 bp, mouse
gctggacccgagtctaaagg

SEQ ID NO: 765051 - DNA, 20 bp, mouse
gtctggagctgaagtggtcg

SEQ ID NO: 765052 - DNA, 20 bp, mouse
gcacgcgcgggccggcacct

SEQ ID NO: 765053 - DNA, 20 bp, mouse
gggtctggacccgagtctaa

SEQ ID NO: 765054 - DNA, 20 bp, mouse
gggaccccagtgtctgatgg

SEQ ID NO: 765055 - DNA, 20 bp, mouse
ggcggggcggcgcccgacgg

SEQ ID NO: 765056 - DNA, 20 bp, mouse
gtcctcctgcacccagggaa

SEQ ID NO: 765057 - DNA, 20 bp, mouse
ggcggggtgagtagccctgg

SEQ ID NO: 765058 - DNA, 20 bp, mouse
gaggctctgactgctggggc

SEQ ID NO: 765059 - DNA, 20 bp, mouse
gctgctggggcgggttgcga

SEQ ID NO: 765060 - DNA, 20 bp, mouse
gtgcgcgttgagcaagtggt

SEQ ID NO: 765061 - DNA, 20 bp, mouse
ggtcgcgtcgcgatggggtg

SEQ ID NO: 765062 - DNA, 20 bp, mouse
gagggaagggcgcacacccc

SEQ ID NO: 765063 - DNA, 20 bp, mouse
gttgtcagcggtgggagcgg

SEQ ID NO: 765064 - DNA, 20 bp, mouse
gaagcgctaggacttgtcag

SEQ ID NO: 765065 - DNA, 20 bp, mouse
gagcgcaacccgtacttccg

SEQ ID NO: 765066 - DNA, 20 bp, mouse
gcggtccctagcccgctctc

SEQ ID NO: 765067 - DNA, 20 bp, mouse
gcggcaggggcggaccgcag

SEQ ID NO: 765068 - DNA, 20 bp, mouse
gcgagccagagagcgggcta

SEQ ID NO: 765069 - DNA, 20 bp, mouse
gcgtcggggctgctcccggg

SEQ ID NO: 765070 - DNA, 20 bp, mouse
gcagccggatcgcttggagt

SEQ ID NO: 765071 - DNA, 20 bp, mouse
gcaagctgcagcgcgaatct

SEQ ID NO: 765072 - DNA, 20 bp, mouse
gtggagcggcgcggcagggg

SEQ ID NO: 765073 - DNA, 20 bp, mouse
gagcgggctagggaccgctg

SEQ ID NO: 765074 - DNA, 20 bp, mouse
ggaagcgcagtcggcaccac

SEQ ID NO: 765075 - DNA, 20 bp, mouse
gtgcagcgcagcagcaaggt

SEQ ID NO: 765076 - DNA, 20 bp, mouse
ggggctatctgtctgtggag

SEQ ID NO: 765077 - DNA, 20 bp, mouse
gggcgtggagaggtgtgagc

SEQ ID NO: 765078 - DNA, 20 bp, mouse
ggggacaagcgaggtagcga

SEQ ID NO: 765079 - DNA, 20 bp, mouse
ggggaggggcgaattggccg

SEQ ID NO: 765080 - DNA, 20 bp, mouse
gctcggggaagtgacgtgtg

SEQ ID NO: 765081 - DNA, 20 bp, mouse
gacgcggcgatctggccctg

SEQ ID NO: 765082 - DNA, 20 bp, mouse
gtcgcgcggagagaagttct

SEQ ID NO: 765083 - DNA, 20 bp, mouse
ggagggatgagctagtcttg

SEQ ID NO: 765084 - DNA, 20 bp, mouse
gctgtgggggagggacgatc

SEQ ID NO: 765085 - DNA, 20 bp, mouse
ggtgagctgcctgtgggacg

SEQ ID NO: 765086 - DNA, 20 bp, mouse
ggggcccgggatgctccaga

SEQ ID NO: 765087 - DNA, 20 bp, mouse
ggggcgccggccagtaacgt

SEQ ID NO: 765088 - DNA, 20 bp, mouse
gagggcgagagcgagcgggt

SEQ ID NO: 765089 - DNA, 20 bp, mouse
gtcgccctctggagcatccc

SEQ ID NO: 765090 - DNA, 20 bp, mouse
gggccggcgcgcaccctgtg

SEQ ID NO: 765091 - DNA, 20 bp, mouse
gcactcgcgctaggagtggg

SEQ ID NO: 765092 - DNA, 20 bp, mouse
gctagcgcgagtggtggcgg

SEQ ID NO: 765093 - DNA, 20 bp, mouse
gaaagcaagaggagcgcccg

SEQ ID NO: 765094 - DNA, 20 bp, mouse
gggagcgcccggggaaaccc

SEQ ID NO: 765095 - DNA, 20 bp, mouse
gcccggggaaaccccggaga

SEQ ID NO: 765096 - DNA, 20 bp, mouse
ggggaggcccacgatccggg

SEQ ID NO: 765097 - DNA, 20 bp, mouse
ggctgggaggcccacgatcc

SEQ ID NO: 765098 - DNA, 20 bp, mouse
gctgctgggtggtccctcac

SEQ ID NO: 765099 - DNA, 20 bp, mouse
gaggcccacgatccgggggg

SEQ ID NO: 765100 - DNA, 20 bp, mouse
gtccgcccctggctaggacc

SEQ ID NO: 765101 - DNA, 20 bp, mouse
gctgctcgggccgggaagga

SEQ ID NO: 765102 - DNA, 20 bp, mouse
gtggtccctcacgggctgta

SEQ ID NO: 765103 - DNA, 20 bp, mouse
gcagaggagctgtgccagaa

SEQ ID NO: 765104 - DNA, 20 bp, mouse
ggcccctccccccggatcgt

SEQ ID NO: 765105 - DNA, 20 bp, mouse
gcaggaatgcgcttacggga

SEQ ID NO: 765106 - DNA, 20 bp, mouse
gggcacccgcgaggtcaggc

SEQ ID NO: 765107 - DNA, 20 bp, mouse
gcccgcgcgtctgcaccgcc

SEQ ID NO: 765108 - DNA, 20 bp, mouse
gcggcggcggcgacaatgac

SEQ ID NO: 765109 - DNA, 20 bp, mouse
gccgcccggctgtcaagcgc

SEQ ID NO: 765110 - DNA, 20 bp, mouse
gtctccctgcctgacctcgc

SEQ ID NO: 765111 - DNA, 20 bp, mouse
gggagggcacccgcgaggtc

SEQ ID NO: 765112 - DNA, 20 bp, mouse
gggaaggggtggaggtgcga

SEQ ID NO: 765113 - DNA, 20 bp, mouse
gcagggagatgcgcgcagcg

SEQ ID NO: 765114 - DNA, 20 bp, mouse
gtcgcagagaatgggtgctg

SEQ ID NO: 765115 - DNA, 20 bp, mouse
gcggtgcagacgcgcgggtc

SEQ ID NO: 765116 - DNA, 20 bp, mouse
gtggggtcggccaaaagcag

SEQ ID NO: 765117 - DNA, 20 bp, mouse
gatgccacccgagactgcgt

SEQ ID NO: 765118 - DNA, 20 bp, mouse
gtgctggggcaagtgggaac

SEQ ID NO: 765119 - DNA, 20 bp, mouse
gacccgagactgcgtgggac

SEQ ID NO: 765120 - DNA, 20 bp, mouse
gtagaaggatccaagcaggt

SEQ ID NO: 765121 - DNA, 20 bp, mouse
gctcctgtcccacgcagtct

SEQ ID NO: 765122 - DNA, 20 bp, mouse
gaggggtatgactacagctt

SEQ ID NO: 765123 - DNA, 20 bp, mouse
gcagaggtgctggggcaagt

SEQ ID NO: 765124 - DNA, 20 bp, mouse
gtgcttggatccttctaggc

SEQ ID NO: 765125 - DNA, 20 bp, mouse
gtggctggcaagggtccctg

SEQ ID NO: 765126 - DNA, 20 bp, mouse
ggaagccgcagccctcggag

SEQ ID NO: 765127 - DNA, 20 bp, mouse
gctcccagttagggtgaaga

SEQ ID NO: 765128 - DNA, 20 bp, mouse
gtcggagcgcccaggtctcg

SEQ ID NO: 765129 - DNA, 20 bp, mouse
ggaggtaatgcaagagcaga

SEQ ID NO: 765130 - DNA, 20 bp, mouse
gcagaagtagagggtaaagg

SEQ ID NO: 765131 - DNA, 20 bp, mouse
gggtgcgctccgttgtgtgc

SEQ ID NO: 765132 - DNA, 20 bp, mouse
gcagctctcggcaaacttag

SEQ ID NO: 765133 - DNA, 20 bp, mouse
gcagcgagcgggacggagtt

SEQ ID NO: 765134 - DNA, 20 bp, mouse
ggaacacgccacccctccga

SEQ ID NO: 765135 - DNA, 20 bp, mouse
gccctgctcagtggcagcgg

SEQ ID NO: 765136 - DNA, 20 bp, mouse
ggggccgacaggcgatgtgt

SEQ ID NO: 765137 - DNA, 20 bp, mouse
ggcgaacaggggtgtcccgg

SEQ ID NO: 765138 - DNA, 20 bp, mouse
ggacgagctcggcccgggga

SEQ ID NO: 765139 - DNA, 20 bp, mouse
ggggcagcccccacacccct

SEQ ID NO: 765140 - DNA, 20 bp, mouse
gggaggggcgcggcgaacag

SEQ ID NO: 765141 - DNA, 20 bp, mouse
gtgccagcgcccaggggtgt

SEQ ID NO: 765142 - DNA, 20 bp, mouse
gcacagcaggctcactccgg

SEQ ID NO: 765143 - DNA, 20 bp, mouse
ggcaccccgagctcagggac

SEQ ID NO: 765144 - DNA, 20 bp, mouse
gccgcctgctggggccaccc

SEQ ID NO: 765145 - DNA, 20 bp, mouse
ggcggcgaacaggggtgtcc

SEQ ID NO: 765146 - DNA, 20 bp, mouse
gccacatagcaccaggagta

SEQ ID NO: 765147 - DNA, 20 bp, mouse
gcgcgtgcgccttgtgtgtc

SEQ ID NO: 765148 - DNA, 20 bp, mouse
ggcgccttgtgtgtcgggaa

SEQ ID NO: 765149 - DNA, 20 bp, mouse
gcatgcgcgaccacggggcg

SEQ ID NO: 765150 - DNA, 20 bp, mouse
gcagacacctcacgtgagtc

SEQ ID NO: 765151 - DNA, 20 bp, mouse
ggtggctggctgtaaggtct

SEQ ID NO: 765152 - DNA, 20 bp, mouse
gccccccttcccgacacaca

SEQ ID NO: 765153 - DNA, 20 bp, mouse
ggtggcagtggctggctgta

SEQ ID NO: 765154 - DNA, 20 bp, mouse
gggccacgcccctgtcggca

SEQ ID NO: 765155 - DNA, 20 bp, mouse
gtgaaggagcagccgttggt

SEQ ID NO: 765156 - DNA, 20 bp, mouse
gtggactgggttactacgat

SEQ ID NO: 765157 - DNA, 20 bp, mouse
ggtgggaaaagcctctagga

SEQ ID NO: 765158 - DNA, 20 bp, mouse
ggcctctaggaaggtatgtg

SEQ ID NO: 765159 - DNA, 20 bp, mouse
gatgtgaggagtctctggac

SEQ ID NO: 765160 - DNA, 20 bp, mouse
gagtgaggggtgctcttgtg

SEQ ID NO: 765161 - DNA, 20 bp, mouse
ggatctcagcctgcattcaa

SEQ ID NO: 765162 - DNA, 20 bp, mouse
gtcaatggagaacagtgtag

SEQ ID NO: 765163 - DNA, 20 bp, mouse
gtcctcacataccttcctag

SEQ ID NO: 765164 - DNA, 20 bp, mouse
gagcccacaggacagagctg

SEQ ID NO: 765165 - DNA, 20 bp, mouse
gtgggaagatctcctataac

SEQ ID NO: 765166 - DNA, 20 bp, mouse
ggccgcgagggacattagga

SEQ ID NO: 765167 - DNA, 20 bp, mouse
gttagggcctcaaaagggga

SEQ ID NO: 765168 - DNA, 20 bp, mouse
gggaaggcgagctggcatta

SEQ ID NO: 765169 - DNA, 20 bp, mouse
gtggcattagggcctcaaaa

SEQ ID NO: 765170 - DNA, 20 bp, mouse
gtgcagccgcgagggacatt

SEQ ID NO: 765171 - DNA, 20 bp, mouse
gaagtggagaaattgagcaa

SEQ ID NO: 765172 - DNA, 20 bp, mouse
gaggtctcctgcagccgcga

SEQ ID NO: 765173 - DNA, 20 bp, mouse
gactagccaccaggagaggg

SEQ ID NO: 765174 - DNA, 20 bp, mouse
gctgcaggagacctggggcg

SEQ ID NO: 765175 - DNA, 20 bp, mouse
ggtaaagtgcaccgtgaggc

SEQ ID NO: 765176 - DNA, 20 bp, mouse
ggcggaggggagggaatctg

SEQ ID NO: 765177 - DNA, 20 bp, mouse
gtgctggcgaagtgacgtga

SEQ ID NO: 765178 - DNA, 20 bp, mouse
gaagccgcgcggacagtcct

SEQ ID NO: 765179 - DNA, 20 bp, mouse
gcccacctggggagcaactg

SEQ ID NO: 765180 - DNA, 20 bp, mouse
gcagacaaaagcaaggcgga

SEQ ID NO: 765181 - DNA, 20 bp, mouse
gcaaaagcaaggcggagggg

SEQ ID NO: 765182 - DNA, 20 bp, mouse
gccagcagtagcagaggcgg

SEQ ID NO: 765183 - DNA, 20 bp, mouse
gccgcgcggacagtcctcgg

SEQ ID NO: 765184 - DNA, 20 bp, mouse
gaggccgaggcatgagaagt

SEQ ID NO: 765185 - DNA, 20 bp, mouse
gaccactcggtggatctccc

SEQ ID NO: 765186 - DNA, 20 bp, mouse
gggggaggaggccgcgagga

SEQ ID NO: 765187 - DNA, 20 bp, mouse
gcacgcgcggagctggagga

SEQ ID NO: 765188 - DNA, 20 bp, mouse
gcggctgcgggtggcggtac

SEQ ID NO: 765189 - DNA, 20 bp, mouse
gcaggagggagaggacgggc

SEQ ID NO: 765190 - DNA, 20 bp, mouse
gcccgctcgctgcagccgag

SEQ ID NO: 765191 - DNA, 20 bp, mouse
gataacccgtgcgtttcgta

SEQ ID NO: 765192 - DNA, 20 bp, mouse
gagagccgagagccggcgag

SEQ ID NO: 765193 - DNA, 20 bp, mouse
gccgagagccggcgagtggg

SEQ ID NO: 765194 - DNA, 20 bp, mouse
gtcaccaagtcccacctcct

SEQ ID NO: 765195 - DNA, 20 bp, mouse
gagcgggcgcgggcgtggag

SEQ ID NO: 765196 - DNA, 20 bp, mouse
gcatcaaggttcacgggtgg

SEQ ID NO: 765197 - DNA, 20 bp, mouse
gggatgagataagggacaaa

SEQ ID NO: 765198 - DNA, 20 bp, mouse
gttccatcaaggttcacggg

SEQ ID NO: 765199 - DNA, 20 bp, mouse
gctcctgctcacatatatat

SEQ ID NO: 765200 - DNA, 20 bp, mouse
ggggcatgatagaaaattag

SEQ ID NO: 765201 - DNA, 20 bp, mouse
gcctctcactatgctgtata

SEQ ID NO: 765202 - DNA, 20 bp, mouse
gctaattgcagctgttgctc

SEQ ID NO: 765203 - DNA, 20 bp, mouse
gactttccatcaaggttcac

SEQ ID NO: 765204 - DNA, 20 bp, mouse
gaatgacaactatctggaat

SEQ ID NO: 765205 - DNA, 20 bp, mouse
gagatcgtcactttccatca

SEQ ID NO: 765206 - DNA, 20 bp, mouse
gacgctcccggggaccacct

SEQ ID NO: 765207 - DNA, 20 bp, mouse
gctgcccaggagaggttgaa

SEQ ID NO: 765208 - DNA, 20 bp, mouse
ggggccctctagcctgtgaa

SEQ ID NO: 765209 - DNA, 20 bp, mouse
gtacaccctcgtgtcactaa

SEQ ID NO: 765210 - DNA, 20 bp, mouse
gagggagctgaagacggcta

SEQ ID NO: 765211 - DNA, 20 bp, mouse
gaccaggcgagggagaatga

SEQ ID NO: 765212 - DNA, 20 bp, mouse
ggacacgagggtgtactcga

SEQ ID NO: 765213 - DNA, 20 bp, mouse
gagggagaatgaggggatat

SEQ ID NO: 765214 - DNA, 20 bp, mouse
gcaaccgtcagccagtatcc

SEQ ID NO: 765215 - DNA, 20 bp, mouse
gcctagcccaggtggtcccc

SEQ ID NO: 765216 - DNA, 20 bp, mouse
gccatccaggtgaacctcaa

SEQ ID NO: 765217 - DNA, 20 bp, mouse
gagcacgtgttggtggaaga

SEQ ID NO: 765218 - DNA, 20 bp, mouse
gtgggggaggacatcctttg

SEQ ID NO: 765219 - DNA, 20 bp, mouse
gggtaagccatgtgacccgt

SEQ ID NO: 765220 - DNA, 20 bp, mouse
gacgtgttggtggaagaagg

SEQ ID NO: 765221 - DNA, 20 bp, mouse
gccaccaacacgtgcttttc

SEQ ID NO: 765222 - DNA, 20 bp, mouse
ggggaggacacgcctctgga

SEQ ID NO: 765223 - DNA, 20 bp, mouse
gcttaccagcaatgccatcc

SEQ ID NO: 765224 - DNA, 20 bp, mouse
gcatccagaaaagcacgtgt

SEQ ID NO: 765225 - DNA, 20 bp, mouse
gttggaggttcccagaaagg

SEQ ID NO: 765226 - DNA, 20 bp, mouse
gccgggccaccgagcaggga

SEQ ID NO: 765227 - DNA, 20 bp, mouse
gaggacgcgcagacggggcg

SEQ ID NO: 765228 - DNA, 20 bp, mouse
ggggacgcaaggtcccgggt

SEQ ID NO: 765229 - DNA, 20 bp, mouse
gcgcgccgggccaccgagca

SEQ ID NO: 765230 - DNA, 20 bp, mouse
gctggagaggagtgttatgt

SEQ ID NO: 765231 - DNA, 20 bp, mouse
gcggcccgcagtagttccgg

SEQ ID NO: 765232 - DNA, 20 bp, mouse
gagtgcgggacgctcgggga

SEQ ID NO: 765233 - DNA, 20 bp, mouse
gcggggcgagaggggaacgc

SEQ ID NO: 765234 - DNA, 20 bp, mouse
gtcaccctccggaactactg

SEQ ID NO: 765235 - DNA, 20 bp, mouse
ggtggtgttggcgagaagga

SEQ ID NO: 765236 - DNA, 20 bp, mouse
ggcgcggaaaggtgtgaatg

SEQ ID NO: 765237 - DNA, 20 bp, mouse
gaggcccaggaatgcgagaa

SEQ ID NO: 765238 - DNA, 20 bp, mouse
gtccgcgcctagccaagggg

SEQ ID NO: 765239 - DNA, 20 bp, mouse
gctgggcctcgggtccaagt

SEQ ID NO: 765240 - DNA, 20 bp, mouse
gtcctccccttggctaggcg

SEQ ID NO: 765241 - DNA, 20 bp, mouse
gtggcacttcggtattaatt

SEQ ID NO: 765242 - DNA, 20 bp, mouse
ggggacgcaggggcgtggtc

SEQ ID NO: 765243 - DNA, 20 bp, mouse
gccacgcccctgcgtcccat

SEQ ID NO: 765244 - DNA, 20 bp, mouse
gaagtcggccaatgggacgc

SEQ ID NO: 765245 - DNA, 20 bp, mouse
ggcctcgggtccaagtgggc

SEQ ID NO: 765246 - DNA, 20 bp, mouse
gtggggccaaggggcttgaa

SEQ ID NO: 765247 - DNA, 20 bp, mouse
ggcggggctgacgtgtaagg

SEQ ID NO: 765248 - DNA, 20 bp, mouse
gagggcggggctgacgtgta

SEQ ID NO: 765249 - DNA, 20 bp, mouse
gaggaccggagctgcatgga

SEQ ID NO: 765250 - DNA, 20 bp, mouse
gaatagggagagtgtagcta

SEQ ID NO: 765251 - DNA, 20 bp, mouse
gaatgggcggggctgatatg

SEQ ID NO: 765252 - DNA, 20 bp, mouse
gccccctcgcgctgtccgga

SEQ ID NO: 765253 - DNA, 20 bp, mouse
gctgagggtcaggcgatctg

SEQ ID NO: 765254 - DNA, 20 bp, mouse
gggaagagagacaaagtggt

SEQ ID NO: 765255 - DNA, 20 bp, mouse
gagggagagtgtagctaggg

SEQ ID NO: 765256 - DNA, 20 bp, mouse
gagttctgggatttggatac

SEQ ID NO: 765257 - DNA, 20 bp, mouse
ggcctcttcccgctaaaaca

SEQ ID NO: 765258 - DNA, 20 bp, mouse
gtgtaacagaatctagggta

SEQ ID NO: 765259 - DNA, 20 bp, mouse
gggaactgtctcgccagacc

SEQ ID NO: 765260 - DNA, 20 bp, mouse
gcgcaaaaccgtgtgtgcag

SEQ ID NO: 765261 - DNA, 20 bp, mouse
ggggtcagattggacctgcg

SEQ ID NO: 765262 - DNA, 20 bp, mouse
gtctggcgagacagttcccg

SEQ ID NO: 765263 - DNA, 20 bp, mouse
gttttagcgggaagaggcat

SEQ ID NO: 765264 - DNA, 20 bp, mouse
gcgcgtgcgcagtcctggtc

SEQ ID NO: 765265 - DNA, 20 bp, mouse
ggagtctcgccctgttttag

SEQ ID NO: 765266 - DNA, 20 bp, mouse
gagacaggactgctgtcaag

SEQ ID NO: 765267 - DNA, 20 bp, mouse
gtggcccggcagccgaaggc

SEQ ID NO: 765268 - DNA, 20 bp, mouse
gggggcgggtctcgcgagac

SEQ ID NO: 765269 - DNA, 20 bp, mouse
gcagccgaaggcgggctcta

SEQ ID NO: 765270 - DNA, 20 bp, mouse
gcccaaggaggtcccgatcc

SEQ ID NO: 765271 - DNA, 20 bp, mouse
ggccaggatcgggacctcct

SEQ ID NO: 765272 - DNA, 20 bp, mouse
gccaatcagatcacccaagg

SEQ ID NO: 765273 - DNA, 20 bp, mouse
ggatgatgacgccacgggca

SEQ ID NO: 765274 - DNA, 20 bp, mouse
gcaactgatgatgacgccac

SEQ ID NO: 765275 - DNA, 20 bp, mouse
gctgccatagagcccgcctt

SEQ ID NO: 765276 - DNA, 20 bp, mouse
gagctgaagaaacaccaatc

SEQ ID NO: 765277 - DNA, 20 bp, mouse
gtccaggaaggggacgccaa

SEQ ID NO: 765278 - DNA, 20 bp, mouse
gtatgctagggctgaactca

SEQ ID NO: 765279 - DNA, 20 bp, mouse
gtgcttgcctagtgtgaagg

SEQ ID NO: 765280 - DNA, 20 bp, mouse
ggtaaacaagaagacttatt

SEQ ID NO: 765281 - DNA, 20 bp, mouse
gaataacaagagaggaggat

SEQ ID NO: 765282 - DNA, 20 bp, mouse
gaaaaggctttgggaatatc

SEQ ID NO: 765283 - DNA, 20 bp, mouse
ggattggcgacgcagctctt

SEQ ID NO: 765284 - DNA, 20 bp, mouse
ggcggaaaaatgacgtcacg

SEQ ID NO: 765285 - DNA, 20 bp, mouse
gtcctggagatgagcctgat

SEQ ID NO: 765286 - DNA, 20 bp, mouse
gtctctgcgggtggaaaagt

SEQ ID NO: 765287 - DNA, 20 bp, mouse
ggccccgcccctttccgatg

SEQ ID NO: 765288 - DNA, 20 bp, mouse
gcctgcatgcccagggattg

SEQ ID NO: 765289 - DNA, 20 bp, mouse
gaggaaacctcatcggaaag

SEQ ID NO: 765290 - DNA, 20 bp, mouse
gtgagacaggacaacttttg

SEQ ID NO: 765291 - DNA, 20 bp, mouse
gcggaagctcagagtcagcg

SEQ ID NO: 765292 - DNA, 20 bp, mouse
gaaagataaggaaacctcat

SEQ ID NO: 765293 - DNA, 20 bp, mouse
ggcggggccgttaacgcggg

SEQ ID NO: 765294 - DNA, 20 bp, mouse
gcaactcccaagagacaccg

SEQ ID NO: 765295 - DNA, 20 bp, mouse
gtcttgccgcggtgtctctt

SEQ ID NO: 765296 - DNA, 20 bp, mouse
gcagggacgcgcctacgcga

SEQ ID NO: 765297 - DNA, 20 bp, mouse
gctggaagaactagccaaga

SEQ ID NO: 765298 - DNA, 20 bp, mouse
ggcgcggcttcctcacgctt

SEQ ID NO: 765299 - DNA, 20 bp, mouse
gccgctaattggtccagctc

SEQ ID NO: 765300 - DNA, 20 bp, mouse
ggagagcgccacgtccctct

SEQ ID NO: 765301 - DNA, 20 bp, mouse
gtccagaagcgccttcgcgt

SEQ ID NO: 765302 - DNA, 20 bp, mouse
gtggcgctctccgaagcgtg

SEQ ID NO: 765303 - DNA, 20 bp, mouse
gtagggtgaagtgatgcccg

SEQ ID NO: 765304 - DNA, 20 bp, mouse
ggcgggcacgcattaggctg

SEQ ID NO: 765305 - DNA, 20 bp, mouse
ggatcgcggaggactcctat

SEQ ID NO: 765306 - DNA, 20 bp, mouse
ggaggaggcggggcctatcc

SEQ ID NO: 765307 - DNA, 20 bp, mouse
gcctatccgggagtggggcg

SEQ ID NO: 765308 - DNA, 20 bp, mouse
ggcggggcctatccgggagt

SEQ ID NO: 765309 - DNA, 20 bp, mouse
gctctggcgtggaagacagg

SEQ ID NO: 765310 - DNA, 20 bp, mouse
gcagctctggcgtggaagac

SEQ ID NO: 765311 - DNA, 20 bp, mouse
gtcagcgcatcttgactaac

SEQ ID NO: 765312 - DNA, 20 bp, mouse
gcgaatctgcagctctggcg

SEQ ID NO: 765313 - DNA, 20 bp, mouse
gtcaaatggactaatgacta

SEQ ID NO: 765314 - DNA, 20 bp, mouse
gcaagccgaatctgcagctc

SEQ ID NO: 765315 - DNA, 20 bp, mouse
gggaggcgtgatgattcaaa

SEQ ID NO: 765316 - DNA, 20 bp, mouse
gtagccaatggccagagaag

SEQ ID NO: 765317 - DNA, 20 bp, mouse
ggagctcaatgggcaccgat

SEQ ID NO: 765318 - DNA, 20 bp, mouse
gaacccgcttctctggccat

SEQ ID NO: 765319 - DNA, 20 bp, mouse
gagagaagcgggttgtgttc

SEQ ID NO: 765320 - DNA, 20 bp, mouse
gcaactcaagccaaactctg

SEQ ID NO: 765321 - DNA, 20 bp, mouse
gttcccgcctccccgcccat

SEQ ID NO: 765322 - DNA, 20 bp, mouse
gtctgagctcacatcttaat

SEQ ID NO: 765323 - DNA, 20 bp, mouse
ggagccccgcccactgcctt

SEQ ID NO: 765324 - DNA, 20 bp, mouse
gagtcgcggtcccaaggcag

SEQ ID NO: 765325 - DNA, 20 bp, mouse
gcgtgcgggttcgcccttcc

SEQ ID NO: 765326 - DNA, 20 bp, mouse
ggggccgagcgaccagaagg

SEQ ID NO: 765327 - DNA, 20 bp, mouse
gtggcgccgcagagtcgtct

SEQ ID NO: 765328 - DNA, 20 bp, mouse
gtccgggcagccgaagagtg

SEQ ID NO: 765329 - DNA, 20 bp, mouse
gctactgagggtctaagtcc

SEQ ID NO: 765330 - DNA, 20 bp, mouse
ggggccgccttctggtcgct

SEQ ID NO: 765331 - DNA, 20 bp, mouse
gtctggtcgctcggccctct

SEQ ID NO: 765332 - DNA, 20 bp, mouse
gctggacttccttacccaga

SEQ ID NO: 765333 - DNA, 20 bp, mouse
gtaggtgcccgagctactga

SEQ ID NO: 765334 - DNA, 20 bp, mouse
gccgcagagtcgtctgggat

SEQ ID NO: 765335 - DNA, 20 bp, mouse
ggcggcgccacgtctcttct

SEQ ID NO: 765336 - DNA, 20 bp, mouse
gtcgcgcaagcgcacttcac

SEQ ID NO: 765337 - DNA, 20 bp, mouse
gtaagctagtagccaataag

SEQ ID NO: 765338 - DNA, 20 bp, mouse
gctaccgccgcccaatcgga

SEQ ID NO: 765339 - DNA, 20 bp, mouse
gaacactgacgccggaacaa

SEQ ID NO: 765340 - DNA, 20 bp, mouse
gcacaggccggtggacgcgt

SEQ ID NO: 765341 - DNA, 20 bp, mouse
gatcaggagcagcctcttat

SEQ ID NO: 765342 - DNA, 20 bp, mouse
gcatgcgcaagagtccaaac

SEQ ID NO: 765343 - DNA, 20 bp, mouse
gggtcattgaatctcttcag

SEQ ID NO: 765344 - DNA, 20 bp, mouse
gtgtcaacatctctaggctt

SEQ ID NO: 765345 - DNA, 20 bp, mouse
gcccacccgtacgtacccga

SEQ ID NO: 765346 - DNA, 20 bp, mouse
gggcggaagcattgtggtga

SEQ ID NO: 765347 - DNA, 20 bp, mouse
gcttccgccctcttcaaaca

SEQ ID NO: 765348 - DNA, 20 bp, mouse
gagtccctggaggtgtcacg

SEQ ID NO: 765349 - DNA, 20 bp, mouse
ggagccgcaagaacgacgat

SEQ ID NO: 765350 - DNA, 20 bp, mouse
gctttaggcaagtgtcgcgg

SEQ ID NO: 765351 - DNA, 20 bp, mouse
gacacttgcctaaaggagat

SEQ ID NO: 765352 - DNA, 20 bp, mouse
gtaaccgatcgtcgttcttg

SEQ ID NO: 765353 - DNA, 20 bp, mouse
gaacgacgatcggttaccgc

SEQ ID NO: 765354 - DNA, 20 bp, mouse
ggaagagggcggaagcattg

SEQ ID NO: 765355 - DNA, 20 bp, mouse
gctccagggactacgtcaag

SEQ ID NO: 765356 - DNA, 20 bp, mouse
gggagtggatgacagtagta

SEQ ID NO: 765357 - DNA, 20 bp, mouse
gtgctggcgacctccgtccc

SEQ ID NO: 765358 - DNA, 20 bp, mouse
ggtcccgctccccgggacgg

SEQ ID NO: 765359 - DNA, 20 bp, mouse
gacgtctttgcatacaggaa

SEQ ID NO: 765360 - DNA, 20 bp, mouse
gaggcttgcaacatagaaat

SEQ ID NO: 765361 - DNA, 20 bp, mouse
gcgtgtcccgctccccggga

SEQ ID NO: 765362 - DNA, 20 bp, mouse
gtcagtgaattgtgttgcag

SEQ ID NO: 765363 - DNA, 20 bp, mouse
ggacctccgtcccggggagc

SEQ ID NO: 765364 - DNA, 20 bp, mouse
gacacccgtgtcccgctccc

SEQ ID NO: 765365 - DNA, 20 bp, mouse
gtttgcatacaggaacggag

SEQ ID NO: 765366 - DNA, 20 bp, mouse
gtctggctgagacccacacg

SEQ ID NO: 765367 - DNA, 20 bp, mouse
ggggtctcagccagacctgg

SEQ ID NO: 765368 - DNA, 20 bp, mouse
gctgagacccacacgtggtg

SEQ ID NO: 765369 - DNA, 20 bp, mouse
gcagggtcctcaccacgtgt

SEQ ID NO: 765370 - DNA, 20 bp, mouse
gtgtgggtctcagccagacc

SEQ ID NO: 765371 - DNA, 20 bp, mouse
gcagccagacctggaggcag

SEQ ID NO: 765372 - DNA, 20 bp, mouse
gaactgtgacttggctgcac

SEQ ID NO: 765373 - DNA, 20 bp, mouse
gaccgcgcacggtccactcc

SEQ ID NO: 765374 - DNA, 20 bp, mouse
gccactccggggctgtgcgg

SEQ ID NO: 765375 - DNA, 20 bp, mouse
ggagcccgccgcctgattgg

SEQ ID NO: 765376 - DNA, 20 bp, mouse
gaactgtgacttggctgcac

SEQ ID NO: 765377 - DNA, 20 bp, mouse
ggagcccgccgcctgattgg

SEQ ID NO: 765378 - DNA, 20 bp, mouse
gaccgcgcacggtccactcc

SEQ ID NO: 765379 - DNA, 20 bp, mouse
gcaccggccgggcgcgccga

SEQ ID NO: 765380 - DNA, 20 bp, mouse
gccactccggggctgtgcgg

SEQ ID NO: 765381 - DNA, 20 bp, mouse
gggaagcggcgcctccaatc

SEQ ID NO: 765382 - DNA, 20 bp, mouse
gcggggctgtgcggaggcgc

SEQ ID NO: 765383 - DNA, 20 bp, mouse
ggccgccgctgctgcgccag

SEQ ID NO: 765384 - DNA, 20 bp, mouse
gcggctccgggcggcggaag

SEQ ID NO: 765385 - DNA, 20 bp, mouse
gcgcgagcccgccgcctgat

SEQ ID NO: 765386 - DNA, 20 bp, mouse
gtgcaggtcgggtaggggtg

SEQ ID NO: 765387 - DNA, 20 bp, mouse
gtaaagtgcaggtcgggtag

SEQ ID NO: 765388 - DNA, 20 bp, mouse
gcctctgccggaagtccgga

SEQ ID NO: 765389 - DNA, 20 bp, mouse
gtggccctctgccggaagtc

SEQ ID NO: 765390 - DNA, 20 bp, mouse
gtttcccagcacctgaagtc

SEQ ID NO: 765391 - DNA, 20 bp, mouse
gctcccataaaggtatgcga

SEQ ID NO: 765392 - DNA, 20 bp, mouse
gggcaggttaaagtgcaggt

SEQ ID NO: 765393 - DNA, 20 bp, mouse
gtgccctcgcatacctttat

SEQ ID NO: 765394 - DNA, 20 bp, mouse
gtgcctcctggacctggcga

SEQ ID NO: 765395 - DNA, 20 bp, mouse
ggactggacttccggacttc

SEQ ID NO: 765396 - DNA, 20 bp, mouse
ggctacagcgcacgtagggg

SEQ ID NO: 765397 - DNA, 20 bp, mouse
gagcgcacgtaggggtggtt

SEQ ID NO: 765398 - DNA, 20 bp, mouse
gcatcgctacagcgcacgta

SEQ ID NO: 765399 - DNA, 20 bp, mouse
gtaatctctctgagactgct

SEQ ID NO: 765400 - DNA, 20 bp, mouse
gggtgcacattaaagtatgt

SEQ ID NO: 765401 - DNA, 20 bp, mouse
ggcaaagcgtcaatcccact

SEQ ID NO: 765402 - DNA, 20 bp, mouse
ggcatctagcccagaagatc

SEQ ID NO: 765403 - DNA, 20 bp, mouse
gttcccagagtgcatcttta

SEQ ID NO: 765404 - DNA, 20 bp, mouse
gtacaattcccagagtgcat

SEQ ID NO: 765405 - DNA, 20 bp, mouse
gagagattaccgatgcactc

SEQ ID NO: 765406 - DNA, 20 bp, mouse
gaggggaagcgaactgagta

SEQ ID NO: 765407 - DNA, 20 bp, mouse
gtccccaagccagcataaag

SEQ ID NO: 765408 - DNA, 20 bp, mouse
gggagtgctgcgcgcgaggg

SEQ ID NO: 765409 - DNA, 20 bp, mouse
gggaaatcagaggggatcac

SEQ ID NO: 765410 - DNA, 20 bp, mouse
gcccgccccgcgtgtgaact

SEQ ID NO: 765411 - DNA, 20 bp, mouse
gccaacgggtggaaatcaga

SEQ ID NO: 765412 - DNA, 20 bp, mouse
gcagaggggatcaccggggt

SEQ ID NO: 765413 - DNA, 20 bp, mouse
gagggcgggccacagagtcc

SEQ ID NO: 765414 - DNA, 20 bp, mouse
gccactgaagcgtacagaag

SEQ ID NO: 765415 - DNA, 20 bp, mouse
gcactcccgcaggtgctacc

SEQ ID NO: 765416 - DNA, 20 bp, mouse
gaatgaggagctccaagtat

SEQ ID NO: 765417 - DNA, 20 bp, mouse
gagaactggagttatgagga

SEQ ID NO: 765418 - DNA, 20 bp, mouse
gcacccatacggcacccgaa

SEQ ID NO: 765419 - DNA, 20 bp, mouse
gagaagcatatatgcagtgg

SEQ ID NO: 765420 - DNA, 20 bp, mouse
gagctgtcaggagacttccc

SEQ ID NO: 765421 - DNA, 20 bp, mouse
ggcacttggtgtacttatag

SEQ ID NO: 765422 - DNA, 20 bp, mouse
gatagaatccttggggtcgg

SEQ ID NO: 765423 - DNA, 20 bp, mouse
gctcaacagtaaggggcact

SEQ ID NO: 765424 - DNA, 20 bp, mouse
gagccagttggccacccata

SEQ ID NO: 765425 - DNA, 20 bp, mouse
ggtcaggagacttcccaggc

SEQ ID NO: 765426 - DNA, 20 bp, mouse
gtggggctgaaggcttggta

SEQ ID NO: 765427 - DNA, 20 bp, mouse
gctgaaggcttggtaaggtc

SEQ ID NO: 765428 - DNA, 20 bp, mouse
gtagcctaagggccaatcca

SEQ ID NO: 765429 - DNA, 20 bp, mouse
gacaccctggattggccctt

SEQ ID NO: 765430 - DNA, 20 bp, mouse
gctgagagacccatcctgat

SEQ ID NO: 765431 - DNA, 20 bp, mouse
gaggagctccgaagacaccc

SEQ ID NO: 765432 - DNA, 20 bp, mouse
gcagccccaccctagcctaa

SEQ ID NO: 765433 - DNA, 20 bp, mouse
gagtgcgagcctcgagatgg

SEQ ID NO: 765434 - DNA, 20 bp, mouse
gcctcgagatggaggggcat

SEQ ID NO: 765435 - DNA, 20 bp, mouse
gggccaatccagggtgtctt

SEQ ID NO: 765436 - DNA, 20 bp, mouse
gaaagaccctggcggaggcg

SEQ ID NO: 765437 - DNA, 20 bp, mouse
ggtctcctctgcaacttgga

SEQ ID NO: 765438 - DNA, 20 bp, mouse
ggggtcgcgcatgctcgttt

SEQ ID NO: 765439 - DNA, 20 bp, mouse
gccaggaaagaccctggcgg

SEQ ID NO: 765440 - DNA, 20 bp, mouse
ggccaccctccaagttgcag

SEQ ID NO: 765441 - DNA, 20 bp, mouse
gggtagctgtagttttctgg

SEQ ID NO: 765442 - DNA, 20 bp, mouse
gcacgtggaagcacgaggat

SEQ ID NO: 765443 - DNA, 20 bp, mouse
gagaccaggttgtcctaagc

SEQ ID NO: 765444 - DNA, 20 bp, mouse
ggaagcacgaggattgggtc

SEQ ID NO: 765445 - DNA, 20 bp, mouse
gaaccccagaagcacaggac

SEQ ID NO: 765446 - DNA, 20 bp, mouse
gtctaaaggaagtgagaaac

SEQ ID NO: 765447 - DNA, 20 bp, mouse
gcgggactagaaagcctggc

SEQ ID NO: 765448 - DNA, 20 bp, mouse
gtccctctgcatcacatggc

SEQ ID NO: 765449 - DNA, 20 bp, mouse
gtgaacagaggcttaagtga

SEQ ID NO: 765450 - DNA, 20 bp, mouse
gtagaaagcctggctggcgt

SEQ ID NO: 765451 - DNA, 20 bp, mouse
gcccctggtggcccagctcg

SEQ ID NO: 765452 - DNA, 20 bp, mouse
gtccgcgagctgggccacca

SEQ ID NO: 765453 - DNA, 20 bp, mouse
gagtgaaggtcagtcagccc

SEQ ID NO: 765454 - DNA, 20 bp, mouse
ggttattccccaccagccca

SEQ ID NO: 765455 - DNA, 20 bp, mouse
gcgcggaggcgtgcagcttc

SEQ ID NO: 765456 - DNA, 20 bp, mouse
gctagggagagtgtgaagtg

SEQ ID NO: 765457 - DNA, 20 bp, mouse
gtgggcttccgtaatgtcat

SEQ ID NO: 765458 - DNA, 20 bp, mouse
gctcgcagcggttatcggga

SEQ ID NO: 765459 - DNA, 20 bp, mouse
ggataggctgcgcgtcactg

SEQ ID NO: 765460 - DNA, 20 bp, mouse
gtgaagtgaggctgaaaccc

SEQ ID NO: 765461 - DNA, 20 bp, mouse
ggagagacctggtcgctgat

SEQ ID NO: 765462 - DNA, 20 bp, mouse
gccagctcgcagcggttatc

SEQ ID NO: 765463 - DNA, 20 bp, mouse
gggaacctccgggagagacc

SEQ ID NO: 765464 - DNA, 20 bp, mouse
ggtgaattagctaatcgcta

SEQ ID NO: 765465 - DNA, 20 bp, mouse
gggacagtgggagcgaacgg

SEQ ID NO: 765466 - DNA, 20 bp, mouse
ggggagcacgggtgccagtg

SEQ ID NO: 765467 - DNA, 20 bp, mouse
gctggcacccgtgctcccag

SEQ ID NO: 765468 - DNA, 20 bp, mouse
gcacgggtgccagtgtggag

SEQ ID NO: 765469 - DNA, 20 bp, mouse
gaatgccctgcgcttcagtc

SEQ ID NO: 765470 - DNA, 20 bp, mouse
gggcctgttgcctgtatagg

SEQ ID NO: 765471 - DNA, 20 bp, mouse
gctgaagcgcagggcattcg

SEQ ID NO: 765472 - DNA, 20 bp, mouse
gacaggcaacaggccagcgt

SEQ ID NO: 765473 - DNA, 20 bp, mouse
gaggactttgtcccctacgc

SEQ ID NO: 765474 - DNA, 20 bp, mouse
gtaggaggttccaaggtgtc

SEQ ID NO: 765475 - DNA, 20 bp, mouse
gcgtttgcgtttagtgggaa

SEQ ID NO: 765476 - DNA, 20 bp, mouse
gctgcctcaagctgaaccat

SEQ ID NO: 765477 - DNA, 20 bp, mouse
ggtcccgcagcaccgaccaa

SEQ ID NO: 765478 - DNA, 20 bp, mouse
gccaaaaaaccacgcctcag

SEQ ID NO: 765479 - DNA, 20 bp, mouse
gcgcctgatgcccaattctg

SEQ ID NO: 765480 - DNA, 20 bp, mouse
gtcggcgcgcgcgttcgaac

SEQ ID NO: 765481 - DNA, 20 bp, mouse
gcctcaagctgaaccattgg

SEQ ID NO: 765482 - DNA, 20 bp, mouse
gtctgtgaatgaccattggt

SEQ ID NO: 765483 - DNA, 20 bp, mouse
gaggctctgtgaatgaccat

SEQ ID NO: 765484 - DNA, 20 bp, mouse
ggcagccgggctcttctgat

SEQ ID NO: 765485 - DNA, 20 bp, mouse
ggcctggcggacacctaagg

SEQ ID NO: 765486 - DNA, 20 bp, mouse
ggggtaatgctggtgaaata

SEQ ID NO: 765487 - DNA, 20 bp, mouse
ggggaactgtagtttctgga

SEQ ID NO: 765488 - DNA, 20 bp, mouse
gtggaaaggcagtaaagcac

SEQ ID NO: 765489 - DNA, 20 bp, mouse
ggacccacgccaaggaagtc

SEQ ID NO: 765490 - DNA, 20 bp, mouse
gcgctccggaggcaggaagt

SEQ ID NO: 765491 - DNA, 20 bp, mouse
gggtgcacagacccacgcca

SEQ ID NO: 765492 - DNA, 20 bp, mouse
gcgcggcagcaagaggtgtg

SEQ ID NO: 765493 - DNA, 20 bp, mouse
ggtcctgacttccttggcgt

SEQ ID NO: 765494 - DNA, 20 bp, mouse
gaaggcagtaaagcacaggg

SEQ ID NO: 765495 - DNA, 20 bp, mouse
ggtaatggggtgctgtaggg

SEQ ID NO: 765496 - DNA, 20 bp, mouse
gtatgcgttgacaagtaggt

SEQ ID NO: 765497 - DNA, 20 bp, mouse
gtggcagcctcgaggcccga

SEQ ID NO: 765498 - DNA, 20 bp, mouse
ggggtctgcatagatctgaa

SEQ ID NO: 765499 - DNA, 20 bp, mouse
gggcgtatgcgttgacaagt

SEQ ID NO: 765500 - DNA, 20 bp, mouse
ggatctgaagggctccactg

SEQ ID NO: 765501 - DNA, 20 bp, mouse
gggtctggtccggatccctc

SEQ ID NO: 765502 - DNA, 20 bp, mouse
gctgaagggctccactgcgg

SEQ ID NO: 765503 - DNA, 20 bp, mouse
ggggatccggaccagacccc

SEQ ID NO: 765504 - DNA, 20 bp, mouse
ggcgttgacaagtaggtcgg

SEQ ID NO: 765505 - DNA, 20 bp, mouse
gtgaacacggactggctaat

SEQ ID NO: 765506 - DNA, 20 bp, mouse
gggggcccgcccaaggtcac

SEQ ID NO: 765507 - DNA, 20 bp, mouse
gctgctacgcagacagcgta

SEQ ID NO: 765508 - DNA, 20 bp, mouse
gcagcggcgcccgggaccgt

SEQ ID NO: 765509 - DNA, 20 bp, mouse
gcgcagacagcgtagggctg

SEQ ID NO: 765510 - DNA, 20 bp, mouse
gaaggccgcggaagctggcg

SEQ ID NO: 765511 - DNA, 20 bp, mouse
gcgggtgaggcgcggcgcgt

SEQ ID NO: 765512 - DNA, 20 bp, mouse
ggagcggcgcgaccttggat

SEQ ID NO: 765513 - DNA, 20 bp, mouse
ggcggaagccgggtgaggcg

SEQ ID NO: 765514 - DNA, 20 bp, mouse
gcccgggaccgtggggtcgc

SEQ ID NO: 765515 - DNA, 20 bp, mouse
ggcggcgcggtcgtcgtcgg

SEQ ID NO: 765516 - DNA, 20 bp, mouse
gggctcgaggcctaagtcta

SEQ ID NO: 765517 - DNA, 20 bp, mouse
gctggcggagccctagactt

SEQ ID NO: 765518 - DNA, 20 bp, mouse
gccccgcccggcaacggtcc

SEQ ID NO: 765519 - DNA, 20 bp, mouse
gcactggcgcgcccaaagga

SEQ ID NO: 765520 - DNA, 20 bp, mouse
gtgcgcgccaggaccgttgc

SEQ ID NO: 765521 - DNA, 20 bp, mouse
ggagcactcgcccgcgggca

SEQ ID NO: 765522 - DNA, 20 bp, mouse
gcctctggagcactcgcccg

SEQ ID NO: 765523 - DNA, 20 bp, mouse
gtaaatgcgggcgaaggggg

SEQ ID NO: 765524 - DNA, 20 bp, mouse
gcgccaggaccgttgccggg

SEQ ID NO: 765525 - DNA, 20 bp, mouse
gcgggagccccgcttaaatg

SEQ ID NO: 765526 - DNA, 20 bp, mouse
ggaaccctgcgcagcacttc

SEQ ID NO: 765527 - DNA, 20 bp, mouse
gcacgaaagcgtagattttt

SEQ ID NO: 765528 - DNA, 20 bp, mouse
gggaaaggcggctattgacg

SEQ ID NO: 765529 - DNA, 20 bp, mouse
ggtgtcttgcgcgtctgtgt

SEQ ID NO: 765530 - DNA, 20 bp, mouse
gcggaaaagtgggtaccacg

SEQ ID NO: 765531 - DNA, 20 bp, mouse
gccagcggacttttacggac

SEQ ID NO: 765532 - DNA, 20 bp, mouse
ggcgctagactctagagcca

SEQ ID NO: 765533 - DNA, 20 bp, mouse
gtatcccggagtcaaaccgg

SEQ ID NO: 765534 - DNA, 20 bp, mouse
gaggtgcatacagacgaaag

SEQ ID NO: 765535 - DNA, 20 bp, mouse
gaccgagccgtcttaaagaa

SEQ ID NO: 765536 - DNA, 20 bp, mouse
gtgcacggggtcacgagagt

SEQ ID NO: 765537 - DNA, 20 bp, mouse
gcacgagagtggggcgggaa

SEQ ID NO: 765538 - DNA, 20 bp, mouse
ggtgcgcccaggatgagacc

SEQ ID NO: 765539 - DNA, 20 bp, mouse
gcggggcgatcgccggaaag

SEQ ID NO: 765540 - DNA, 20 bp, mouse
gaggggcggggcgtgcgaca

SEQ ID NO: 765541 - DNA, 20 bp, mouse
gaaagaggtgaggttgcacg

SEQ ID NO: 765542 - DNA, 20 bp, mouse
gcgatcgccggaaagaggtg

SEQ ID NO: 765543 - DNA, 20 bp, mouse
gcggggtcacgagagtgggg

SEQ ID NO: 765544 - DNA, 20 bp, mouse
gccctcctcccagcgaaaag

SEQ ID NO: 765545 - DNA, 20 bp, mouse
gctggcgtggtagaccgggc

SEQ ID NO: 765546 - DNA, 20 bp, mouse
gacgcccgaagtgctagggg

SEQ ID NO: 765547 - DNA, 20 bp, mouse
gtataggtagggcgtgttcg

SEQ ID NO: 765548 - DNA, 20 bp, mouse
ggcggagttaggtccgaagg

SEQ ID NO: 765549 - DNA, 20 bp, mouse
gggggcggggcctataggta

SEQ ID NO: 765550 - DNA, 20 bp, mouse
gtgagggcggggacttttca

SEQ ID NO: 765551 - DNA, 20 bp, mouse
gaggtagggcgtgttcgggg

SEQ ID NO: 765552 - DNA, 20 bp, mouse
gaagacgcccgaagtgctag

SEQ ID NO: 765553 - DNA, 20 bp, mouse
ggccccgcccctagcacttc

SEQ ID NO: 765554 - DNA, 20 bp, mouse
gggggcggagttaggtccga

SEQ ID NO: 765555 - DNA, 20 bp, mouse
ggcgtgttcggggcggagtt

SEQ ID NO: 765556 - DNA, 20 bp, mouse
ggcaaagcctcggacgccgg

SEQ ID NO: 765557 - DNA, 20 bp, mouse
gtcggaggctctacctgggc

SEQ ID NO: 765558 - DNA, 20 bp, mouse
gggcgtccgaggctttgcaa

SEQ ID NO: 765559 - DNA, 20 bp, mouse
gtcccggagcccggtatgag

SEQ ID NO: 765560 - DNA, 20 bp, mouse
ggcggggcggggacctaagt

SEQ ID NO: 765561 - DNA, 20 bp, mouse
gatgagaggcggacaggcct

SEQ ID NO: 765562 - DNA, 20 bp, mouse
gcggagcccggtatgagagg

SEQ ID NO: 765563 - DNA, 20 bp, mouse
ggggaagccacgcctccttc

SEQ ID NO: 765564 - DNA, 20 bp, mouse
gtgggcaggctccgtaccgc

SEQ ID NO: 765565 - DNA, 20 bp, mouse
gactgccttgtccatctcgg

SEQ ID NO: 765566 - DNA, 20 bp, mouse
gcgcgcgtcgggtacgtcgt

SEQ ID NO: 765567 - DNA, 20 bp, mouse
gcaggcgaactggagtgccg

SEQ ID NO: 765568 - DNA, 20 bp, mouse
gttcgcctgcgcagacggag

SEQ ID NO: 765569 - DNA, 20 bp, mouse
ggtaaagcgcggtcgcgcgt

SEQ ID NO: 765570 - DNA, 20 bp, mouse
gacggagaggcctggcacac

SEQ ID NO: 765571 - DNA, 20 bp, mouse
ggcgaggtttgagaagacgt

SEQ ID NO: 765572 - DNA, 20 bp, mouse
gcccgctggctgcaggttcg

SEQ ID NO: 765573 - DNA, 20 bp, mouse
ggcccgcgagggttcggagg

SEQ ID NO: 765574 - DNA, 20 bp, mouse
gacgtgcttccaggagagga

SEQ ID NO: 765575 - DNA, 20 bp, mouse
gcaggcctctccgtctgcgc

SEQ ID NO: 765576 - DNA, 20 bp, mouse
gaggaagcgcagcagttagg

SEQ ID NO: 765577 - DNA, 20 bp, mouse
gaggctcagaagacccacgg

SEQ ID NO: 765578 - DNA, 20 bp, mouse
gagaaggctcagaagaccca

SEQ ID NO: 765579 - DNA, 20 bp, mouse
gttcgcgacggatgccgaga

SEQ ID NO: 765580 - DNA, 20 bp, mouse
ggtcaagtcccacccaccgt

SEQ ID NO: 765581 - DNA, 20 bp, mouse
ggaagcgcgctgtgcggaaa

SEQ ID NO: 765582 - DNA, 20 bp, mouse
gtcagaagacccacggtggg

SEQ ID NO: 765583 - DNA, 20 bp, mouse
gtgtctgcctgctcgctatc

SEQ ID NO: 765584 - DNA, 20 bp, mouse
gcagcgcgcttccttcgcga

SEQ ID NO: 765585 - DNA, 20 bp, mouse
gtcgctatcaggtacgctga

SEQ ID NO: 765586 - DNA, 20 bp, mouse
ggcgtcgcagcgaatggcta

SEQ ID NO: 765587 - DNA, 20 bp, mouse
ggtggtcgccagtccttccc

SEQ ID NO: 765588 - DNA, 20 bp, mouse
gtagctaaacccaggctgga

SEQ ID NO: 765589 - DNA, 20 bp, mouse
gcggcagtgccggcccgatc

SEQ ID NO: 765590 - DNA, 20 bp, mouse
gtggccaatgagcccatcgc

SEQ ID NO: 765591 - DNA, 20 bp, mouse
gaatggctagggacctgatc

SEQ ID NO: 765592 - DNA, 20 bp, mouse
ggctagggacctgatcgggc

SEQ ID NO: 765593 - DNA, 20 bp, mouse
gctaaactgcgtgtgcaggt

SEQ ID NO: 765594 - DNA, 20 bp, mouse
gggtctacaccgtccagcct

SEQ ID NO: 765595 - DNA, 20 bp, mouse
gcgggccttgcagcaaatcc

SEQ ID NO: 765596 - DNA, 20 bp, mouse
gcggcggtggcgaaggggaa

SEQ ID NO: 765597 - DNA, 20 bp, mouse
gcggccctgtgaggttgcat

SEQ ID NO: 765598 - DNA, 20 bp, mouse
gtgaggttgcatagggtaag

SEQ ID NO: 765599 - DNA, 20 bp, mouse
ggccaggcggcggtggcgaa

SEQ ID NO: 765600 - DNA, 20 bp, mouse
gtgcatagggtaagtggcgt

SEQ ID NO: 765601 - DNA, 20 bp, mouse
ggggaagaggatttgagcta

SEQ ID NO: 765602 - DNA, 20 bp, mouse
gtaccctatgcaacctcaca

SEQ ID NO: 765603 - DNA, 20 bp, mouse
gaggatttgagctaggggcg

SEQ ID NO: 765604 - DNA, 20 bp, mouse
ggtaagtggcgttggccagg

SEQ ID NO: 765605 - DNA, 20 bp, mouse
gcatcagcttgctcggtgtg

SEQ ID NO: 765606 - DNA, 20 bp, mouse
gtccagtcctgcctgattgt

SEQ ID NO: 765607 - DNA, 20 bp, mouse
ggaagtgcatccgtcatggc

SEQ ID NO: 765608 - DNA, 20 bp, mouse
gtgtcttcccacaatcaggc

SEQ ID NO: 765609 - DNA, 20 bp, mouse
gagaggaagtgcatccgtca

SEQ ID NO: 765610 - DNA, 20 bp, mouse
gttcaatcacacgtgaactg

SEQ ID NO: 765611 - DNA, 20 bp, mouse
gcgtagaatagctgcatatt

SEQ ID NO: 765612 - DNA, 20 bp, mouse
gaggatagctgctatccaga

SEQ ID NO: 765613 - DNA, 20 bp, mouse
gctcctgcccggcatccatc

SEQ ID NO: 765614 - DNA, 20 bp, mouse
gccgctgtcttcccacaatc

SEQ ID NO: 765615 - DNA, 20 bp, mouse
gtgccgggcaggagaaacca

SEQ ID NO: 765616 - DNA, 20 bp, mouse
gatacccaacgtctgagcta

SEQ ID NO: 765617 - DNA, 20 bp, mouse
gtaaccctagctcagacgtt

SEQ ID NO: 765618 - DNA, 20 bp, mouse
gcccacaggaacagcggatt

SEQ ID NO: 765619 - DNA, 20 bp, mouse
ggtgagagaccaggtgtcaa

SEQ ID NO: 765620 - DNA, 20 bp, mouse
gccaggaggtgtccagtggg

SEQ ID NO: 765621 - DNA, 20 bp, mouse
ggtgaactgaggtcagaatt

SEQ ID NO: 765622 - DNA, 20 bp, mouse
gtagctgcgctattgttgac

SEQ ID NO: 765623 - DNA, 20 bp, mouse
ggctggctagagccctcaac

SEQ ID NO: 765624 - DNA, 20 bp, mouse
ggggctgaagagattccctg

SEQ ID NO: 765625 - DNA, 20 bp, mouse
gcctccccacaaatgcccac

SEQ ID NO: 765626 - DNA, 20 bp, mouse
gacaactgccccaacaaggg

SEQ ID NO: 765627 - DNA, 20 bp, mouse
gttggggcagttgtcattgg

SEQ ID NO: 765628 - DNA, 20 bp, mouse
gaccctcgtgtgggccctca

SEQ ID NO: 765629 - DNA, 20 bp, mouse
gaaccctgagggcccacacg

SEQ ID NO: 765630 - DNA, 20 bp, mouse
gtaagctataaccctcgtgt

SEQ ID NO: 765631 - DNA, 20 bp, mouse
gaacccaccccaaaccctga

SEQ ID NO: 765632 - DNA, 20 bp, mouse
gtgtgggccctcagggtttg

SEQ ID NO: 765633 - DNA, 20 bp, mouse
ggttaaacgccgcccttgtt

SEQ ID NO: 765634 - DNA, 20 bp, mouse
gcatttgagaggtatcaagc

SEQ ID NO: 765635 - DNA, 20 bp, mouse
gggcaaaatgtgtgcctggc

SEQ ID NO: 765636 - DNA, 20 bp, mouse
gggcgggccggcctttgctt

SEQ ID NO: 765637 - DNA, 20 bp, mouse
gcctgagaggcactcctcta

SEQ ID NO: 765638 - DNA, 20 bp, mouse
gaacctgcacgcatccctag

SEQ ID NO: 765639 - DNA, 20 bp, mouse
gtcccgcaaggccagaccaa

SEQ ID NO: 765640 - DNA, 20 bp, mouse
gagacccggtagtgtttatg

SEQ ID NO: 765641 - DNA, 20 bp, mouse
gcccccacataaacactacc

SEQ ID NO: 765642 - DNA, 20 bp, mouse
gcccggaacggaatcctccc

SEQ ID NO: 765643 - DNA, 20 bp, mouse
gccaatgggcggggtcgggg

SEQ ID NO: 765644 - DNA, 20 bp, mouse
gagccagctcggctcccggg

SEQ ID NO: 765645 - DNA, 20 bp, mouse
gcagaaccataggggatctg

SEQ ID NO: 765646 - DNA, 20 bp, mouse
gcaggcgcggaagtgtgcca

SEQ ID NO: 765647 - DNA, 20 bp, mouse
gcagccacgcagtcactccc

SEQ ID NO: 765648 - DNA, 20 bp, mouse
gggtgccggccaggcaggaa

SEQ ID NO: 765649 - DNA, 20 bp, mouse
gccgcaggctcagtgggcgc

SEQ ID NO: 765650 - DNA, 20 bp, mouse
gtcgcctgagcctggcttgt

SEQ ID NO: 765651 - DNA, 20 bp, mouse
gggctcagtgggcgcaggcg

SEQ ID NO: 765652 - DNA, 20 bp, mouse
gtggctgggtggtgccggcc

SEQ ID NO: 765653 - DNA, 20 bp, mouse
gtgggtatgtcgcctgagcc

SEQ ID NO: 765654 - DNA, 20 bp, mouse
gctccagccgcaggctcagt

SEQ ID NO: 765655 - DNA, 20 bp, mouse
gtgggtggtgccggccaggc

SEQ ID NO: 765656 - DNA, 20 bp, mouse
gtcggggcaaggtcggaact

SEQ ID NO: 765657 - DNA, 20 bp, mouse
gaggggcggggcaggcgatt

SEQ ID NO: 765658 - DNA, 20 bp, mouse
gccgagactcggggcaaggt

SEQ ID NO: 765659 - DNA, 20 bp, mouse
ggaccctccgcggcgagcgt

SEQ ID NO: 765660 - DNA, 20 bp, mouse
gggaaggaggcgcccgtggg

SEQ ID NO: 765661 - DNA, 20 bp, mouse
gtggcaatgacgtcaaagat

SEQ ID NO: 765662 - DNA, 20 bp, mouse
gtggggaaggaggcgcccgt

SEQ ID NO: 765663 - DNA, 20 bp, mouse
gcggagcactggatccaccg

SEQ ID NO: 765664 - DNA, 20 bp, mouse
gtgccagaagcgccggtctc

SEQ ID NO: 765665 - DNA, 20 bp, mouse
gcctgcgacccgattcaccg

SEQ ID NO: 765666 - DNA, 20 bp, mouse
gagcccgcgctccctgtcgt

SEQ ID NO: 765667 - DNA, 20 bp, mouse
gacgctgcgacaatgcgggg

SEQ ID NO: 765668 - DNA, 20 bp, mouse
gacgactgcagggacgacga

SEQ ID NO: 765669 - DNA, 20 bp, mouse
gcgacaatgcggggggggat

SEQ ID NO: 765670 - DNA, 20 bp, mouse
gtgcctctgcggtgctccgt

SEQ ID NO: 765671 - DNA, 20 bp, mouse
gtcccagaggctcccacgac

SEQ ID NO: 765672 - DNA, 20 bp, mouse
ggtaataggcgcaagagcgg

SEQ ID NO: 765673 - DNA, 20 bp, mouse
gagaacgcggattctcggaa

SEQ ID NO: 765674 - DNA, 20 bp, mouse
gactgcagggacgacgacgg

SEQ ID NO: 765675 - DNA, 20 bp, mouse
gcacccacggagcaccgcag

SEQ ID NO: 765676 - DNA, 20 bp, mouse
gttggagatggcctagggaa

SEQ ID NO: 765677 - DNA, 20 bp, mouse
ggagtgtcggacattggcga

SEQ ID NO: 765678 - DNA, 20 bp, mouse
ggagatggcctagggaaggg

SEQ ID NO: 765679 - DNA, 20 bp, mouse
gagggaagaggatacgggag

SEQ ID NO: 765680 - DNA, 20 bp, mouse
gattggcgaaggcgtgaggg

SEQ ID NO: 765681 - DNA, 20 bp, mouse
gagtgccggggaggacgaac

SEQ ID NO: 765682 - DNA, 20 bp, mouse
gagaggaagcagttgagtgt

SEQ ID NO: 765683 - DNA, 20 bp, mouse
gtgaatttggagatggccta

SEQ ID NO: 765684 - DNA, 20 bp, mouse
gaagcggcgtcttccagtgc

SEQ ID NO: 765685 - DNA, 20 bp, mouse
ggacattggcgaaggcgtga

SEQ ID NO: 765686 - DNA, 20 bp, mouse
gggcggggaagaggcctgac

SEQ ID NO: 765687 - DNA, 20 bp, mouse
gccgaagtgaccgcgagtca

SEQ ID NO: 765688 - DNA, 20 bp, mouse
gggcggcgcccttttcccga

SEQ ID NO: 765689 - DNA, 20 bp, mouse
gcctccgacccgcggtcctc

SEQ ID NO: 765690 - DNA, 20 bp, mouse
gctcgaggccgtcgggaaaa

SEQ ID NO: 765691 - DNA, 20 bp, mouse
gcgggtcggaggctcatctg

SEQ ID NO: 765692 - DNA, 20 bp, mouse
gccgcctcgcgccacacccc

SEQ ID NO: 765693 - DNA, 20 bp, mouse
gactcgcggtcacttcggag

SEQ ID NO: 765694 - DNA, 20 bp, mouse
ggggaaggttcccgcaagct

SEQ ID NO: 765695 - DNA, 20 bp, mouse
gtcccgacggcctcgagcag

SEQ ID NO: 765696 - DNA, 20 bp, mouse
gctggtgcgaggggagtccg

SEQ ID NO: 765697 - DNA, 20 bp, mouse
gaggcggtggagactgtgag

SEQ ID NO: 765698 - DNA, 20 bp, mouse
gagactgtgagcggtgaaga

SEQ ID NO: 765699 - DNA, 20 bp, mouse
gggtgggcgtggtcaagatg

SEQ ID NO: 765700 - DNA, 20 bp, mouse
gtggcgctgccctggtgcga

SEQ ID NO: 765701 - DNA, 20 bp, mouse
ggtgcgaggggagtccgcgg

SEQ ID NO: 765702 - DNA, 20 bp, mouse
gcgtaggttgacagcggagg

SEQ ID NO: 765703 - DNA, 20 bp, mouse
gggaagctggagaaggttgc

SEQ ID NO: 765704 - DNA, 20 bp, mouse
gcaagatggggctgtcaaga

SEQ ID NO: 765705 - DNA, 20 bp, mouse
gctacaccgtaggttgacag

SEQ ID NO: 765706 - DNA, 20 bp, mouse
gaagccgagggcagccggtt

SEQ ID NO: 765707 - DNA, 20 bp, mouse
gtagctgtgcaatgcatcat

SEQ ID NO: 765708 - DNA, 20 bp, mouse
gtggggacgcccttgtgttc

SEQ ID NO: 765709 - DNA, 20 bp, mouse
gaaaacaagccgagggcagc

SEQ ID NO: 765710 - DNA, 20 bp, mouse
ggcacagctagtctccgaac

SEQ ID NO: 765711 - DNA, 20 bp, mouse
ggggaggaccccgggcccga

SEQ ID NO: 765712 - DNA, 20 bp, mouse
gtgccctcggcttgttttaa

SEQ ID NO: 765713 - DNA, 20 bp, mouse
gatggccctaggccagagca

SEQ ID NO: 765714 - DNA, 20 bp, mouse
gcctcgcatggcgttctcgg

SEQ ID NO: 765715 - DNA, 20 bp, mouse
gtcgacgcgggcaggccctc

SEQ ID NO: 765716 - DNA, 20 bp, mouse
ggccgcgcgcccgtctctgg

SEQ ID NO: 765717 - DNA, 20 bp, mouse
gccacgcgctacgggctccg

SEQ ID NO: 765718 - DNA, 20 bp, mouse
ggggcgagcgcagtgatggg

SEQ ID NO: 765719 - DNA, 20 bp, mouse
gcaagagcgagcctgctgga

SEQ ID NO: 765720 - DNA, 20 bp, mouse
gcggggctgaaaaagctcgc

SEQ ID NO: 765721 - DNA, 20 bp, mouse
gtctgccgcgcgcccgtctc

SEQ ID NO: 765722 - DNA, 20 bp, mouse
gaaagcggagagcacgcgcc

SEQ ID NO: 765723 - DNA, 20 bp, mouse
ggcggggcgagcgcagtgat

SEQ ID NO: 765724 - DNA, 20 bp, mouse
gggcgcgcggcagaggcctt

SEQ ID NO: 765725 - DNA, 20 bp, mouse
gagcgctccacactgtccta

SEQ ID NO: 765726 - DNA, 20 bp, mouse
gtgacgtcgtggctgctgat

SEQ ID NO: 765727 - DNA, 20 bp, mouse
ggcagccacgacgtcagcgg

SEQ ID NO: 765728 - DNA, 20 bp, mouse
ggaaactagggcaaaacttg

SEQ ID NO: 765729 - DNA, 20 bp, mouse
ggtcgtggctgctgattggt

SEQ ID NO: 765730 - DNA, 20 bp, mouse
gttgtgggtcgtgtatacaa

SEQ ID NO: 765731 - DNA, 20 bp, mouse
gcaatgttgaggagttgaga

SEQ ID NO: 765732 - DNA, 20 bp, mouse
gacaatagacaacaatgttg

SEQ ID NO: 765733 - DNA, 20 bp, mouse
gaatttcgagcagagaccca

SEQ ID NO: 765734 - DNA, 20 bp, mouse
ggtcgtgtatacaaaggtct

SEQ ID NO: 765735 - DNA, 20 bp, mouse
gccacgacgtcagcgggggt

SEQ ID NO: 765736 - DNA, 20 bp, mouse
ggggaagcatcgagagtctc

SEQ ID NO: 765737 - DNA, 20 bp, mouse
gtgtgctcggaggcagtcga

SEQ ID NO: 765738 - DNA, 20 bp, mouse
gtgcgcggaaccggccaatg

SEQ ID NO: 765739 - DNA, 20 bp, mouse
gccaatggggccttgtggat

SEQ ID NO: 765740 - DNA, 20 bp, mouse
gcggttccgcgcagtgggtg

SEQ ID NO: 765741 - DNA, 20 bp, mouse
gccgagcgtgcctctctcta

SEQ ID NO: 765742 - DNA, 20 bp, mouse
ggactccggcccgcgcctca

SEQ ID NO: 765743 - DNA, 20 bp, mouse
ggcgcgcttgccaatccaca

SEQ ID NO: 765744 - DNA, 20 bp, mouse
ggccggagtccgccttcctt

SEQ ID NO: 765745 - DNA, 20 bp, mouse
gtcagcttttggggattaga

SEQ ID NO: 765746 - DNA, 20 bp, mouse
ggacccggggagcgggagtg

SEQ ID NO: 765747 - DNA, 20 bp, mouse
gccagagaagagcacagccc

SEQ ID NO: 765748 - DNA, 20 bp, mouse
gaaacgaggggcagcccctg

SEQ ID NO: 765749 - DNA, 20 bp, mouse
gacggaagttgggggtcttc

SEQ ID NO: 765750 - DNA, 20 bp, mouse
gattaaaaaaccaagagtga

SEQ ID NO: 765751 - DNA, 20 bp, mouse
ggctgtgctcttctctggaa

SEQ ID NO: 765752 - DNA, 20 bp, mouse
gtagttttggacccggggag

SEQ ID NO: 765753 - DNA, 20 bp, mouse
gctcatctgacggaagttgg

SEQ ID NO: 765754 - DNA, 20 bp, mouse
gatgagaaacggcatccaat

SEQ ID NO: 765755 - DNA, 20 bp, mouse
gttgtaaggtgagagctgat

SEQ ID NO: 765756 - DNA, 20 bp, mouse
gggaagttgcgcaacccata

SEQ ID NO: 765757 - DNA, 20 bp, mouse
gtaccatgtctgggatgcta

SEQ ID NO: 765758 - DNA, 20 bp, mouse
gccggtcatgctctctgcgg

SEQ ID NO: 765759 - DNA, 20 bp, mouse
gttccttagcatcccagaca

SEQ ID NO: 765760 - DNA, 20 bp, mouse
gagacgtctcacattgctct

SEQ ID NO: 765761 - DNA, 20 bp, mouse
gtaagactagtaaaccacag

SEQ ID NO: 765762 - DNA, 20 bp, mouse
ggagggcgcttcagccattt

SEQ ID NO: 765763 - DNA, 20 bp, mouse
gcaaccttctttaccatgtc

SEQ ID NO: 765764 - DNA, 20 bp, mouse
gtgctctctgcggaggctga

SEQ ID NO: 765765 - DNA, 20 bp, mouse
gaggaatcaagttgaaagaa

SEQ ID NO: 765766 - DNA, 20 bp, mouse
gtgcacccagcctgggtcac

SEQ ID NO: 765767 - DNA, 20 bp, mouse
gcccactggaactgcgaccc

SEQ ID NO: 765768 - DNA, 20 bp, mouse
gtcactggacgaggtgggtc

SEQ ID NO: 765769 - DNA, 20 bp, mouse
gctgggtcactggacgaggt

SEQ ID NO: 765770 - DNA, 20 bp, mouse
gcagcctgggtcactggacg

SEQ ID NO: 765771 - DNA, 20 bp, mouse
ggctgggtgcaagcggaggg

SEQ ID NO: 765772 - DNA, 20 bp, mouse
gcaggctgggtgcaagcgga

SEQ ID NO: 765773 - DNA, 20 bp, mouse
gactgcgcagacaacgccac

SEQ ID NO: 765774 - DNA, 20 bp, mouse
gcagcagcccgaatgcccac

SEQ ID NO: 765775 - DNA, 20 bp, mouse
gcgcacgccctggccaccta

SEQ ID NO: 765776 - DNA, 20 bp, mouse
gggagcacacgccagccctt

SEQ ID NO: 765777 - DNA, 20 bp, mouse
gtgctcctgctgacgagaat

SEQ ID NO: 765778 - DNA, 20 bp, mouse
gtcaaattctttcagcccaa

SEQ ID NO: 765779 - DNA, 20 bp, mouse
gagtgtatcttgttgccaaa

SEQ ID NO: 765780 - DNA, 20 bp, mouse
gacagccaattctcgtcagc

SEQ ID NO: 765781 - DNA, 20 bp, mouse
gcttcctgcgcagttctgat

SEQ ID NO: 765782 - DNA, 20 bp, mouse
gtgcagccaccgtctccttc

SEQ ID NO: 765783 - DNA, 20 bp, mouse
gttgagatgttctttcatgt

SEQ ID NO: 765784 - DNA, 20 bp, mouse
gcatccaatcagaactgcgc

SEQ ID NO: 765785 - DNA, 20 bp, mouse
gtcttgttgccaaagggttt

SEQ ID NO: 765786 - DNA, 20 bp, mouse
gggagctcgcgcgtgcgcac

SEQ ID NO: 765787 - DNA, 20 bp, mouse
gctcccggcgactgtttcta

SEQ ID NO: 765788 - DNA, 20 bp, mouse
gccgccggccccttctcctg

SEQ ID NO: 765789 - DNA, 20 bp, mouse
gccgccctagaaacagtcgc

SEQ ID NO: 765790 - DNA, 20 bp, mouse
ggagactggccgtggatctg

SEQ ID NO: 765791 - DNA, 20 bp, mouse
gcagtcgccgggaggaccat

SEQ ID NO: 765792 - DNA, 20 bp, mouse
ggcgcacgcgcgagctccaa

SEQ ID NO: 765793 - DNA, 20 bp, mouse
gcgcctccgaaccaatcgga

SEQ ID NO: 765794 - DNA, 20 bp, mouse
gcgcgacccaagtggccctc

SEQ ID NO: 765795 - DNA, 20 bp, mouse
gatgcgccgcgcgacccaag

SEQ ID NO: 765796 - DNA, 20 bp, mouse
gcacccccggaagtgatcgg

SEQ ID NO: 765797 - DNA, 20 bp, mouse
gaaccaagcaaggatggagt

SEQ ID NO: 765798 - DNA, 20 bp, mouse
gtgccctccgctcttctgtc

SEQ ID NO: 765799 - DNA, 20 bp, mouse
gctaccaccgatcacttccg

SEQ ID NO: 765800 - DNA, 20 bp, mouse
ggtgtggggcgtcaccacaa

SEQ ID NO: 765801 - DNA, 20 bp, mouse
gagtgggtgggatgatcgaa

SEQ ID NO: 765802 - DNA, 20 bp, mouse
gacttccgggggtgtgtttg

SEQ ID NO: 765803 - DNA, 20 bp, mouse
ggacatggggtgttgtatgg

SEQ ID NO: 765804 - DNA, 20 bp, mouse
gtcccagccggacagaagag

SEQ ID NO: 765805 - DNA, 20 bp, mouse
ggcctccttcccggtctaag

SEQ ID NO: 765806 - DNA, 20 bp, mouse
ggtcgcgcaggcgcagaaga

SEQ ID NO: 765807 - DNA, 20 bp, mouse
gcgcatgcgcaacaggttgt

SEQ ID NO: 765808 - DNA, 20 bp, mouse
gtgaggaaccacggtcgcgc

SEQ ID NO: 765809 - DNA, 20 bp, mouse
gaggctcgagttgcgagggg

SEQ ID NO: 765810 - DNA, 20 bp, mouse
gcactaggctcgagttgcga

SEQ ID NO: 765811 - DNA, 20 bp, mouse
ggcctagtgcgcttgctcag

SEQ ID NO: 765812 - DNA, 20 bp, mouse
gcgggaaaggcagttggcga

SEQ ID NO: 765813 - DNA, 20 bp, mouse
gccacccccggcctgaacta

SEQ ID NO: 765814 - DNA, 20 bp, mouse
gaattagcgcgcaggcgcaa

SEQ ID NO: 765815 - DNA, 20 bp, mouse
ggaagagggaagctggcggc

SEQ ID NO: 765816 - DNA, 20 bp, mouse
ggccaagcatgggattcccc

SEQ ID NO: 765817 - DNA, 20 bp, mouse
gggccgtggaggccaagcat

SEQ ID NO: 765818 - DNA, 20 bp, mouse
ggacctacttagctggaaaa

SEQ ID NO: 765819 - DNA, 20 bp, mouse
gagaggcaggtccaagagaa

SEQ ID NO: 765820 - DNA, 20 bp, mouse
gccagcagcaaccaatcccg

SEQ ID NO: 765821 - DNA, 20 bp, mouse
gcgcccttttccagctaagt

SEQ ID NO: 765822 - DNA, 20 bp, mouse
gcagctaagtaggtcgactc

SEQ ID NO: 765823 - DNA, 20 bp, mouse
gagggggcggacccggactc

SEQ ID NO: 765824 - DNA, 20 bp, mouse
gggagaagcagcaaactccc

SEQ ID NO: 765825 - DNA, 20 bp, mouse
gtggaaaagggcggccgtgg

SEQ ID NO: 765826 - DNA, 20 bp, mouse
gctactgggaacattccttg

SEQ ID NO: 765827 - DNA, 20 bp, mouse
ggagatggcgggagaggcgg

SEQ ID NO: 765828 - DNA, 20 bp, mouse
gacagtcccacactaggtga

SEQ ID NO: 765829 - DNA, 20 bp, mouse
gtggcgccgcctgatctact

SEQ ID NO: 765830 - DNA, 20 bp, mouse
gccaaagaggaccccctcca

SEQ ID NO: 765831 - DNA, 20 bp, mouse
ggaagggatctgttgcgcta

SEQ ID NO: 765832 - DNA, 20 bp, mouse
gcccacactaggtgagggaa

SEQ ID NO: 765833 - DNA, 20 bp, mouse
gtagggcccacgggtcctca

SEQ ID NO: 765834 - DNA, 20 bp, mouse
gaaaggtccccggagatggc

SEQ ID NO: 765835 - DNA, 20 bp, mouse
gggaatgttcccagtagatc

SEQ ID NO: 765836 - DNA, 20 bp, mouse
gctagtgagtgggtcatctg

SEQ ID NO: 765837 - DNA, 20 bp, mouse
gtccccacagggcttttcac

SEQ ID NO: 765838 - DNA, 20 bp, mouse
gagaaagccagtctagtgag

SEQ ID NO: 765839 - DNA, 20 bp, mouse
gagtactttaggttgtagtg

SEQ ID NO: 765840 - DNA, 20 bp, mouse
ggactctcagctctgaccac

SEQ ID NO: 765841 - DNA, 20 bp, mouse
ggatgacccactcactagac

SEQ ID NO: 765842 - DNA, 20 bp, mouse
gaacggtgggactattaatg

SEQ ID NO: 765843 - DNA, 20 bp, mouse
gtcatctgtggtatgagcaa

SEQ ID NO: 765844 - DNA, 20 bp, mouse
gttgtagtgaggctgtcgga

SEQ ID NO: 765845 - DNA, 20 bp, mouse
gggcaggagcacacagcgat

SEQ ID NO: 765846 - DNA, 20 bp, mouse
gcggggcggagtggagtgta

SEQ ID NO: 765847 - DNA, 20 bp, mouse
gaatcgctagaggatagaca

SEQ ID NO: 765848 - DNA, 20 bp, mouse
ggctgtgcgtagccaatccg

SEQ ID NO: 765849 - DNA, 20 bp, mouse
ggaagccaaggtgggcgggg

SEQ ID NO: 765850 - DNA, 20 bp, mouse
gggagtgtaaggatcgcttt

SEQ ID NO: 765851 - DNA, 20 bp, mouse
ggggccgcgggttgaagcca

SEQ ID NO: 765852 - DNA, 20 bp, mouse
gcagtgagggggtagcgtta

SEQ ID NO: 765853 - DNA, 20 bp, mouse
gagaggatagacagggccgc

SEQ ID NO: 765854 - DNA, 20 bp, mouse
gcgcgggttgaagccaaggt

SEQ ID NO: 765855 - DNA, 20 bp, mouse
ggttgaagccaaggtgggcg

SEQ ID NO: 765856 - DNA, 20 bp, mouse
gcgcaagaggacacaggcgt

SEQ ID NO: 765857 - DNA, 20 bp, mouse
gctgctcccgcccacgtggt

SEQ ID NO: 765858 - DNA, 20 bp, mouse
ggagacccgcaagaggacac

SEQ ID NO: 765859 - DNA, 20 bp, mouse
gctcgcccgcgcctcctgat

SEQ ID NO: 765860 - DNA, 20 bp, mouse
gaggacacaggcgtgggggc

SEQ ID NO: 765861 - DNA, 20 bp, mouse
gtgggcagacccagagagct

SEQ ID NO: 765862 - DNA, 20 bp, mouse
gctgtcaactccaaccacgt

SEQ ID NO: 765863 - DNA, 20 bp, mouse
gcgccctgctcccgcccacg

SEQ ID NO: 765864 - DNA, 20 bp, mouse
gccgagtggccgagctctct

SEQ ID NO: 765865 - DNA, 20 bp, mouse
gtgtcgctacaagtaagtca

SEQ ID NO: 765866 - DNA, 20 bp, mouse
gggcccacaccgttattcat

SEQ ID NO: 765867 - DNA, 20 bp, mouse
gacccaatgaataacggtgt

SEQ ID NO: 765868 - DNA, 20 bp, mouse
gtctctgattaggaacggag

SEQ ID NO: 765869 - DNA, 20 bp, mouse
gacgcaccagccctcttcga

SEQ ID NO: 765870 - DNA, 20 bp, mouse
gcgcccggcacgagactcgg

SEQ ID NO: 765871 - DNA, 20 bp, mouse
ggtggaggcggtctctgatt

SEQ ID NO: 765872 - DNA, 20 bp, mouse
gtctgcgggcaatgatggga

SEQ ID NO: 765873 - DNA, 20 bp, mouse
gattaggaacggaggggaag

SEQ ID NO: 765874 - DNA, 20 bp, mouse
gcccactccctctgccgcaa

SEQ ID NO: 765875 - DNA, 20 bp, mouse
ggaaaggagggacgatgggg

SEQ ID NO: 765876 - DNA, 20 bp, mouse
ggcgcagggaaccctgggat

SEQ ID NO: 765877 - DNA, 20 bp, mouse
gccgccgcgcagggaaccct

SEQ ID NO: 765878 - DNA, 20 bp, mouse
gaggccgggcggatgaggta

SEQ ID NO: 765879 - DNA, 20 bp, mouse
gcgggcggatgaggtaaggt

SEQ ID NO: 765880 - DNA, 20 bp, mouse
ggggaaccctgggatcggag

SEQ ID NO: 765881 - DNA, 20 bp, mouse
gtggaagcggtactcgtgtg

SEQ ID NO: 765882 - DNA, 20 bp, mouse
ggactctccgggcacttcag

SEQ ID NO: 765883 - DNA, 20 bp, mouse
ggtgtgaggccgggcggatg

SEQ ID NO: 765884 - DNA, 20 bp, mouse
gggaccgaagccgcactcca

SEQ ID NO: 765885 - DNA, 20 bp, mouse
ggtactcgtgtgaggccggg

SEQ ID NO: 765886 - DNA, 20 bp, mouse
gtgaaatgggacgcggtcgt

SEQ ID NO: 765887 - DNA, 20 bp, mouse
gccggacccggacctgaacc

SEQ ID NO: 765888 - DNA, 20 bp, mouse
gcgctcgggtatgctgaaat

SEQ ID NO: 765889 - DNA, 20 bp, mouse
gagcagagctgtcagcgctc

SEQ ID NO: 765890 - DNA, 20 bp, mouse
gcgggtccgggttcaggtcc

SEQ ID NO: 765891 - DNA, 20 bp, mouse
gggtcgttggatccctgacc

SEQ ID NO: 765892 - DNA, 20 bp, mouse
gactgtatacagccaactag

SEQ ID NO: 765893 - DNA, 20 bp, mouse
gggtatgctgaaatgggacg

SEQ ID NO: 765894 - DNA, 20 bp, mouse
gagtgtgccgtgagccgcgt

SEQ ID NO: 765895 - DNA, 20 bp, mouse
gcagccaactagagggttgc

SEQ ID NO: 765896 - DNA, 20 bp, mouse
gggccagattgcatcagaca

SEQ ID NO: 765897 - DNA, 20 bp, mouse
gtatgacccaggcccaggag

SEQ ID NO: 765898 - DNA, 20 bp, mouse
gaggagacagcgttataagt

SEQ ID NO: 765899 - DNA, 20 bp, mouse
gggaaggactggcctatctg

SEQ ID NO: 765900 - DNA, 20 bp, mouse
ggcatcagacagggcttgga

SEQ ID NO: 765901 - DNA, 20 bp, mouse
gaggatctgggcacagtctt

SEQ ID NO: 765902 - DNA, 20 bp, mouse
gtggcagaggctgaaatgat

SEQ ID NO: 765903 - DNA, 20 bp, mouse
gcctccctaaaccacggggt

SEQ ID NO: 765904 - DNA, 20 bp, mouse
gaaagctctcgcctcagggg

SEQ ID NO: 765905 - DNA, 20 bp, mouse
ggctcaggactgctgtctat

SEQ ID NO: 765906 - DNA, 20 bp, mouse
gcggaattgtgtttcttcgc

SEQ ID NO: 765907 - DNA, 20 bp, mouse
gaaacctgaagggacggaat

SEQ ID NO: 765908 - DNA, 20 bp, mouse
gtccccaattccgtcccttc

SEQ ID NO: 765909 - DNA, 20 bp, mouse
gtcgctggttaaaacctgaa

SEQ ID NO: 765910 - DNA, 20 bp, mouse
gagagtgctagcatgcacaa

SEQ ID NO: 765911 - DNA, 20 bp, mouse
gacctgacttatacagtgat

SEQ ID NO: 765912 - DNA, 20 bp, mouse
gccccacccagtgctcctat

SEQ ID NO: 765913 - DNA, 20 bp, mouse
ggcggagccaataggagcac

SEQ ID NO: 765914 - DNA, 20 bp, mouse
gccggcggagtgaccagcgg

SEQ ID NO: 765915 - DNA, 20 bp, mouse
gactgggtggggcattccgg

SEQ ID NO: 765916 - DNA, 20 bp, mouse
gggagaaaggctagaggcgt

SEQ ID NO: 765917 - DNA, 20 bp, mouse
gccgacgcgaccgggagtcg

SEQ ID NO: 765918 - DNA, 20 bp, mouse
ggtgcgcttgagaatgaggc

SEQ ID NO: 765919 - DNA, 20 bp, mouse
gcggtcgcgtcggagttccc

SEQ ID NO: 765920 - DNA, 20 bp, mouse
ggcctctagcctttctccta

SEQ ID NO: 765921 - DNA, 20 bp, mouse
gcatccccagggggcgccag

SEQ ID NO: 765922 - DNA, 20 bp, mouse
ggagcgtgcgcttgagaatg

SEQ ID NO: 765923 - DNA, 20 bp, mouse
gtgggacgttctattctcgt

SEQ ID NO: 765924 - DNA, 20 bp, mouse
gcggctccagccacgactcc

SEQ ID NO: 765925 - DNA, 20 bp, mouse
gagatcctcccctcagtctg

SEQ ID NO: 765926 - DNA, 20 bp, mouse
gtattgagagcgtgtctttc

SEQ ID NO: 765927 - DNA, 20 bp, mouse
gtgtctccctgcgtcttcat

SEQ ID NO: 765928 - DNA, 20 bp, mouse
ggagtgggacactcaggtgg

SEQ ID NO: 765929 - DNA, 20 bp, mouse
gtgcgggccagtagcgtgat

SEQ ID NO: 765930 - DNA, 20 bp, mouse
gaagactgctgtaagttcat

SEQ ID NO: 765931 - DNA, 20 bp, mouse
ggaaacacggcacatctctc

SEQ ID NO: 765932 - DNA, 20 bp, mouse
ggcaaactataccaatatgc

SEQ ID NO: 765933 - DNA, 20 bp, mouse
gcgcgcgcttcaaagaaata

SEQ ID NO: 765934 - DNA, 20 bp, mouse
ggagggtggggtttccgatg

SEQ ID NO: 765935 - DNA, 20 bp, mouse
gtctccggctccaaccacgc

SEQ ID NO: 765936 - DNA, 20 bp, mouse
gcgggaggagaggctaagtt

SEQ ID NO: 765937 - DNA, 20 bp, mouse
ggctcgcagcgcgggaggag

SEQ ID NO: 765938 - DNA, 20 bp, mouse
gttggcgccaggcaaggatc

SEQ ID NO: 765939 - DNA, 20 bp, mouse
ggctagaccacaattctcag

SEQ ID NO: 765940 - DNA, 20 bp, mouse
gggtgagcccctgagaattg

SEQ ID NO: 765941 - DNA, 20 bp, mouse
gggaacacggagttggcgcc

SEQ ID NO: 765942 - DNA, 20 bp, mouse
gaggcggggtcaggctccat

SEQ ID NO: 765943 - DNA, 20 bp, mouse
ggagcctgaccccgcctcca

SEQ ID NO: 765944 - DNA, 20 bp, mouse
gggagaggctaagttaggga

SEQ ID NO: 765945 - DNA, 20 bp, mouse
gctcccatggaggcggggtc

SEQ ID NO: 765946 - DNA, 20 bp, mouse
ggagctcagatgtccctcaa

SEQ ID NO: 765947 - DNA, 20 bp, mouse
gcacctcaaaccaattagaa

SEQ ID NO: 765948 - DNA, 20 bp, mouse
gtcctcagaaaaatgaacat

SEQ ID NO: 765949 - DNA, 20 bp, mouse
gagccattctaattggtttg

SEQ ID NO: 765950 - DNA, 20 bp, mouse
gtcctatgttcatttttctg

SEQ ID NO: 765951 - DNA, 20 bp, mouse
ggtatctattcttccattga

SEQ ID NO: 765952 - DNA, 20 bp, mouse
ggccagactgatttctggag

SEQ ID NO: 765953 - DNA, 20 bp, mouse
gatgtggtacattaacaaaa

SEQ ID NO: 765954 - DNA, 20 bp, mouse
gaccactccagaaatcagtc

SEQ ID NO: 765955 - DNA, 20 bp, mouse
gggatattagcctagaagct

SEQ ID NO: 765956 - DNA, 20 bp, mouse
gaagcccgaggtccacccaa

SEQ ID NO: 765957 - DNA, 20 bp, mouse
gatggtatcaaattcacgga

SEQ ID NO: 765958 - DNA, 20 bp, mouse
gagacccttgggtggacctc

SEQ ID NO: 765959 - DNA, 20 bp, mouse
gggactcaggcattctgtag

SEQ ID NO: 765960 - DNA, 20 bp, mouse
gagctgcagaactgggcaaa

SEQ ID NO: 765961 - DNA, 20 bp, mouse
gagaggacacccaacaatca

SEQ ID NO: 765962 - DNA, 20 bp, mouse
gaatttgataccatgattgt

SEQ ID NO: 765963 - DNA, 20 bp, mouse
gttgttgggtgtcctctttt

SEQ ID NO: 765964 - DNA, 20 bp, mouse
gcagtgtaatgttgagaatc

SEQ ID NO: 765965 - DNA, 20 bp, mouse
gatgcagtgttcaactgctg

SEQ ID NO: 765966 - DNA, 20 bp, mouse
gttacccagccctgcctaag

SEQ ID NO: 765967 - DNA, 20 bp, mouse
gaggactacgctgctcacgg

SEQ ID NO: 765968 - DNA, 20 bp, mouse
gcacgaaagctccgcctgta

SEQ ID NO: 765969 - DNA, 20 bp, mouse
gcacgcgtggtccctagcac

SEQ ID NO: 765970 - DNA, 20 bp, mouse
ggggctgggtaatcttgaca

SEQ ID NO: 765971 - DNA, 20 bp, mouse
gtacgctgctcacggaggtc

SEQ ID NO: 765972 - DNA, 20 bp, mouse
gcacggaggtcgggaggacc

SEQ ID NO: 765973 - DNA, 20 bp, mouse
gagcgcgcgagtttccagtc

SEQ ID NO: 765974 - DNA, 20 bp, mouse
gtgaaggcgttcaactttat

SEQ ID NO: 765975 - DNA, 20 bp, mouse
ggctgctcacggaggtcggg

SEQ ID NO: 765976 - DNA, 20 bp, mouse
gggcacccggccagacccgg

SEQ ID NO: 765977 - DNA, 20 bp, mouse
gctggccgggtgcccagcct

SEQ ID NO: 765978 - DNA, 20 bp, mouse
gtggaagtctctaggagaag

SEQ ID NO: 765979 - DNA, 20 bp, mouse
gttaaccgccgggtctggcc

SEQ ID NO: 765980 - DNA, 20 bp, mouse
gaggagaagcgggtgaaaga

SEQ ID NO: 765981 - DNA, 20 bp, mouse
gagcaagtgggataaaagaa

SEQ ID NO: 765982 - DNA, 20 bp, mouse
gctgggcacccggccagacc

SEQ ID NO: 765983 - DNA, 20 bp, mouse
gaacagttaaccgccgggtc

SEQ ID NO: 765984 - DNA, 20 bp, mouse
ggcacacaacagttaaccgc

SEQ ID NO: 765985 - DNA, 20 bp, mouse
gctgactgtcatgccatccc

SEQ ID NO: 765986 - DNA, 20 bp, mouse
gaagcagggcggccgctcgg

SEQ ID NO: 765987 - DNA, 20 bp, mouse
gaccgggccagcgaagaaat

SEQ ID NO: 765988 - DNA, 20 bp, mouse
gagcctgcgcagaagcaggg

SEQ ID NO: 765989 - DNA, 20 bp, mouse
gcggccggagctccggccgt

SEQ ID NO: 765990 - DNA, 20 bp, mouse
gggccagcgaagaaatagga

SEQ ID NO: 765991 - DNA, 20 bp, mouse
gggccgccctgcttctgcgc

SEQ ID NO: 765992 - DNA, 20 bp, mouse
gtcaagaggagcagggtcga

SEQ ID NO: 765993 - DNA, 20 bp, mouse
ggccgtgggcgggcctcgga

SEQ ID NO: 765994 - DNA, 20 bp, mouse
gggcgtggccaggccctccg

SEQ ID NO: 765995 - DNA, 20 bp, mouse
gccgcccacggccggagctc

SEQ ID NO: 765996 - DNA, 20 bp, mouse
ggagcctgcaatgatcacgt

SEQ ID NO: 765997 - DNA, 20 bp, mouse
gggggtgacaaacgaaaaag

SEQ ID NO: 765998 - DNA, 20 bp, mouse
gcccactccgcgcagccaag

SEQ ID NO: 765999 - DNA, 20 bp, mouse
gctcttgactatacataaca

SEQ ID NO: 766000 - DNA, 20 bp, mouse
ggtcacgtgtccacgtgacg

SEQ ID NO: 766001 - DNA, 20 bp, mouse
ggtgacggggtagataacgg

SEQ ID NO: 766002 - DNA, 20 bp, mouse
gtacgtgttcgtacgtacgt

SEQ ID NO: 766003 - DNA, 20 bp, mouse
gcacgtgacggggtagataa

SEQ ID NO: 766004 - DNA, 20 bp, mouse
ggtacgaacacgtacgtagt

SEQ ID NO: 766005 - DNA, 20 bp, mouse
gagacacagatatagagatt

SEQ ID NO: 766006 - DNA, 20 bp, mouse
gtctacgagcgaagcgccca

SEQ ID NO: 766007 - DNA, 20 bp, mouse
gggaggagggccctagaggt

SEQ ID NO: 766008 - DNA, 20 bp, mouse
gacagtgcctggttcatagt

SEQ ID NO: 766009 - DNA, 20 bp, mouse
gcgaggcttcagactctagt

SEQ ID NO: 766010 - DNA, 20 bp, mouse
gaacaagtaccagagtctcg

SEQ ID NO: 766011 - DNA, 20 bp, mouse
gtcagactctagttggcttc

SEQ ID NO: 766012 - DNA, 20 bp, mouse
ggcaatgtgaaagagctccc

SEQ ID NO: 766013 - DNA, 20 bp, mouse
ggtctgaagcctcgagactc

SEQ ID NO: 766014 - DNA, 20 bp, mouse
gtctcctctgcccacctcta

SEQ ID NO: 766015 - DNA, 20 bp, mouse
ggggatgaaacttcctgtaa

SEQ ID NO: 766016 - DNA, 20 bp, mouse
gtcttggcgtagagatcctg

SEQ ID NO: 766017 - DNA, 20 bp, mouse
gataagaaagcctcaaggta

SEQ ID NO: 766018 - DNA, 20 bp, mouse
gtacaggtcagccttccatc

SEQ ID NO: 766019 - DNA, 20 bp, mouse
gtccagataagaaagcctca

SEQ ID NO: 766020 - DNA, 20 bp, mouse
gaaaagttgccctactggtt

SEQ ID NO: 766021 - DNA, 20 bp, mouse
gggtgtggcctggataaaag

SEQ ID NO: 766022 - DNA, 20 bp, mouse
gtgtgaatcccaggcaacta

SEQ ID NO: 766023 - DNA, 20 bp, mouse
gcccagtagcctaaccagta

SEQ ID NO: 766024 - DNA, 20 bp, mouse
ggcctcaaggtatggactac

SEQ ID NO: 766025 - DNA, 20 bp, mouse
gccccttgccttagttgcct

SEQ ID NO: 766026 - DNA, 20 bp, mouse
gagggggcgtggctatggag

SEQ ID NO: 766027 - DNA, 20 bp, mouse
gcagcgcgggccagccacgg

SEQ ID NO: 766028 - DNA, 20 bp, mouse
ggccaagacgccagctgcta

SEQ ID NO: 766029 - DNA, 20 bp, mouse
gggcgcgagcctccggtacg

SEQ ID NO: 766030 - DNA, 20 bp, mouse
gcgcgggccagccacggagg

SEQ ID NO: 766031 - DNA, 20 bp, mouse
gcggcagcggaggctgagag

SEQ ID NO: 766032 - DNA, 20 bp, mouse
gggaaagcgccagttccggg

SEQ ID NO: 766033 - DNA, 20 bp, mouse
ggtgagaggaattaaggggt

SEQ ID NO: 766034 - DNA, 20 bp, mouse
gaaaggtgagaggaattaag

SEQ ID NO: 766035 - DNA, 20 bp, mouse
gagtggctgggcggcccggt

SEQ ID NO: 766036 - DNA, 20 bp, mouse
gtcagcaggaggatctaacc

SEQ ID NO: 766037 - DNA, 20 bp, mouse
ggaggaggaggcatggctca

SEQ ID NO: 766038 - DNA, 20 bp, mouse
gtctacagagccagaattgg

SEQ ID NO: 766039 - DNA, 20 bp, mouse
gtggctctgtagaggtcagc

SEQ ID NO: 766040 - DNA, 20 bp, mouse
gaaggatcactgcaagaccc

SEQ ID NO: 766041 - DNA, 20 bp, mouse
gagccatgcctcctcctcac

SEQ ID NO: 766042 - DNA, 20 bp, mouse
ggagccagaattgggggttg

SEQ ID NO: 766043 - DNA, 20 bp, mouse
gttctgagggtattattctt

SEQ ID NO: 766044 - DNA, 20 bp, mouse
gggatctaaccaggctaatc

SEQ ID NO: 766045 - DNA, 20 bp, mouse
gactggggcactgctgcaac

SEQ ID NO: 766046 - DNA, 20 bp, mouse
gaagctgtaaggcttatcta

SEQ ID NO: 766047 - DNA, 20 bp, mouse
gggggctccaggctcaatga

SEQ ID NO: 766048 - DNA, 20 bp, mouse
gcaaggcaggataaaataga

SEQ ID NO: 766049 - DNA, 20 bp, mouse
ggcaggataaaatagagggt

SEQ ID NO: 766050 - DNA, 20 bp, mouse
gccggtccgcagaacagagc

SEQ ID NO: 766051 - DNA, 20 bp, mouse
gggaactgggcccgtggggt

SEQ ID NO: 766052 - DNA, 20 bp, mouse
gggcgtggatggaggagtag

SEQ ID NO: 766053 - DNA, 20 bp, mouse
gagggctggaagattctcca

SEQ ID NO: 766054 - DNA, 20 bp, mouse
gcgaacaagcctcggatgtc

SEQ ID NO: 766055 - DNA, 20 bp, mouse
gagggctctggtggatgtta

SEQ ID NO: 766056 - DNA, 20 bp, mouse
gatcataagcagtggtgggg

SEQ ID NO: 766057 - DNA, 20 bp, mouse
gaacaaacctgaggagaggg

SEQ ID NO: 766058 - DNA, 20 bp, mouse
ggaggagagggtggagtggt

SEQ ID NO: 766059 - DNA, 20 bp, mouse
gactatcataagcagtggtg

SEQ ID NO: 766060 - DNA, 20 bp, mouse
gcataaacagcagtgggatg

SEQ ID NO: 766061 - DNA, 20 bp, mouse
gaaagcaagccctggaccac

SEQ ID NO: 766062 - DNA, 20 bp, mouse
gggactacggactgactgga

SEQ ID NO: 766063 - DNA, 20 bp, mouse
ggacggttggaacaaacctg

SEQ ID NO: 766064 - DNA, 20 bp, mouse
ggtagggactacggactgac

SEQ ID NO: 766065 - DNA, 20 bp, mouse
ggtcttggaggtagggacta

SEQ ID NO: 766066 - DNA, 20 bp, mouse
gtaacccaagctccctgggg

SEQ ID NO: 766067 - DNA, 20 bp, mouse
gcgaccgccccagggagctt

SEQ ID NO: 766068 - DNA, 20 bp, mouse
gggctagagtgtatctccgg

SEQ ID NO: 766069 - DNA, 20 bp, mouse
ggggaaacgctgatgtccga

SEQ ID NO: 766070 - DNA, 20 bp, mouse
ggcgccaggctgttctctcc

SEQ ID NO: 766071 - DNA, 20 bp, mouse
gtggggcggtcgggtagcac

SEQ ID NO: 766072 - DNA, 20 bp, mouse
gtcgccgctcgccctcccac

SEQ ID NO: 766073 - DNA, 20 bp, mouse
gcggagcgtccacatcccgt

SEQ ID NO: 766074 - DNA, 20 bp, mouse
ggggatgtggacgctccgat

SEQ ID NO: 766075 - DNA, 20 bp, mouse
gtggcgcggaggcccccgat

SEQ ID NO: 766076 - DNA, 20 bp, mouse
gtcagagatgggtgggcaaa

SEQ ID NO: 766077 - DNA, 20 bp, mouse
gagatcattaagtcagagat

SEQ ID NO: 766078 - DNA, 20 bp, mouse
gtgcctgaaagcactctgat

SEQ ID NO: 766079 - DNA, 20 bp, mouse
gggtgggcaaagggacaagc

SEQ ID NO: 766080 - DNA, 20 bp, mouse
gtggcatctgaaaatgcaaa

SEQ ID NO: 766081 - DNA, 20 bp, mouse
ggtaaggattccgtgtcaca

SEQ ID NO: 766082 - DNA, 20 bp, mouse
gttatcaggtcaaaattctc

SEQ ID NO: 766083 - DNA, 20 bp, mouse
gctccataggcatgctgggt

SEQ ID NO: 766084 - DNA, 20 bp, mouse
gcggccaacacttttcacca

SEQ ID NO: 766085 - DNA, 20 bp, mouse
gttgacacaaagacgaagag

SEQ ID NO: 766086 - DNA, 20 bp, mouse
gtggggagaggacactctgt

SEQ ID NO: 766087 - DNA, 20 bp, mouse
gaatagaggaacatggtaat

SEQ ID NO: 766088 - DNA, 20 bp, mouse
gcatccatgctgttaaatag

SEQ ID NO: 766089 - DNA, 20 bp, mouse
gtgctgaggcagaattctgg

SEQ ID NO: 766090 - DNA, 20 bp, mouse
gccagctggctctgttacat

SEQ ID NO: 766091 - DNA, 20 bp, mouse
gagctggatttctgcaccaa

SEQ ID NO: 766092 - DNA, 20 bp, mouse
ggacacctacagggaataaa

SEQ ID NO: 766093 - DNA, 20 bp, mouse
ggcagaattctggtggaaaa

SEQ ID NO: 766094 - DNA, 20 bp, mouse
gtattccctgtaggtgtctg

SEQ ID NO: 766095 - DNA, 20 bp, mouse
gcagctcttctgttactgga

SEQ ID NO: 766096 - DNA, 20 bp, mouse
gagggtaggtagaactgacc

SEQ ID NO: 766097 - DNA, 20 bp, mouse
ggtgcgggcagggcaagggt

SEQ ID NO: 766098 - DNA, 20 bp, mouse
gaggctgggactaaaggcgg

SEQ ID NO: 766099 - DNA, 20 bp, mouse
gagagaggggggtgcgggca

SEQ ID NO: 766100 - DNA, 20 bp, mouse
ggtacccgtgaaatgggggt

SEQ ID NO: 766101 - DNA, 20 bp, mouse
gctcccgccttcaaacacta

SEQ ID NO: 766102 - DNA, 20 bp, mouse
gttaggtacccgtgaaatgg

SEQ ID NO: 766103 - DNA, 20 bp, mouse
gagtgctagggatgtgattg

SEQ ID NO: 766104 - DNA, 20 bp, mouse
gtccctgccaagaacggtgg

SEQ ID NO: 766105 - DNA, 20 bp, mouse
gcgaccggtacataccgcac

SEQ ID NO: 766106 - DNA, 20 bp, mouse
gtggaggtctgaggattcga

SEQ ID NO: 766107 - DNA, 20 bp, mouse
gcgactgccgggacagctag

SEQ ID NO: 766108 - DNA, 20 bp, mouse
gagagcgctccgcccagcat

SEQ ID NO: 766109 - DNA, 20 bp, mouse
gagagtctggcacttggtta

SEQ ID NO: 766110 - DNA, 20 bp, mouse
gtaacagcgcctatgctggg

SEQ ID NO: 766111 - DNA, 20 bp, mouse
gtctccgtgcgccctgcgct

SEQ ID NO: 766112 - DNA, 20 bp, mouse
gcagctagaggctcttgttc

SEQ ID NO: 766113 - DNA, 20 bp, mouse
gggaaagccgcagagctgca

SEQ ID NO: 766114 - DNA, 20 bp, mouse
gggacagagagcctagaagg

SEQ ID NO: 766115 - DNA, 20 bp, mouse
ggctgctcacgacagagtca

SEQ ID NO: 766116 - DNA, 20 bp, mouse
ggccgccgccgccagtggga

SEQ ID NO: 766117 - DNA, 20 bp, mouse
gtggcccggggcgtccgcca

SEQ ID NO: 766118 - DNA, 20 bp, mouse
ggctctgcgccccgccagac

SEQ ID NO: 766119 - DNA, 20 bp, mouse
gtcctcgtccctcccactgg

SEQ ID NO: 766120 - DNA, 20 bp, mouse
gggagggacgaggaagcggg

SEQ ID NO: 766121 - DNA, 20 bp, mouse
gggaggggccgtctggtctg

SEQ ID NO: 766122 - DNA, 20 bp, mouse
gcaggtacggtgagcccagt

SEQ ID NO: 766123 - DNA, 20 bp, mouse
ggccccctggcggacgcccc

SEQ ID NO: 766124 - DNA, 20 bp, mouse
gtggtctggggaattagcac

SEQ ID NO: 766125 - DNA, 20 bp, mouse
gttccagcgtaggggacagg

SEQ ID NO: 766126 - DNA, 20 bp, mouse
gtgagccaggggtgtgtcca

SEQ ID NO: 766127 - DNA, 20 bp, mouse
gagttcccatacacaggcta

SEQ ID NO: 766128 - DNA, 20 bp, mouse
gtgaagctggagaggggcaa

SEQ ID NO: 766129 - DNA, 20 bp, mouse
ggagggctacaatagggcgt

SEQ ID NO: 766130 - DNA, 20 bp, mouse
gccccaagacctggcgtctt

SEQ ID NO: 766131 - DNA, 20 bp, mouse
gcctggcagaggtaggtcta

SEQ ID NO: 766132 - DNA, 20 bp, mouse
ggtgtgtccagggtgtgtca

SEQ ID NO: 766133 - DNA, 20 bp, mouse
ggcagatgagggctacaata

SEQ ID NO: 766134 - DNA, 20 bp, mouse
gcccaaagacgccaggtctt

SEQ ID NO: 766135 - DNA, 20 bp, mouse
gctcaggtgtgaagctggag

SEQ ID NO: 766136 - DNA, 20 bp, mouse
ggcggggaggcgggagtcga

SEQ ID NO: 766137 - DNA, 20 bp, mouse
ggactcccgcctccccgcga

SEQ ID NO: 766138 - DNA, 20 bp, mouse
gtgagaagccgacgtccagg

SEQ ID NO: 766139 - DNA, 20 bp, mouse
ggcggagccaagttttctac

SEQ ID NO: 766140 - DNA, 20 bp, mouse
gcggttgagggagctctgat

SEQ ID NO: 766141 - DNA, 20 bp, mouse
gagaaaacttggctccgccc

SEQ ID NO: 766142 - DNA, 20 bp, mouse
gtcgcgtagctgcccgtcgc

SEQ ID NO: 766143 - DNA, 20 bp, mouse
ggcaaagacagtgtaggttc

SEQ ID NO: 766144 - DNA, 20 bp, mouse
gtggacgtcggcttctcagg

SEQ ID NO: 766145 - DNA, 20 bp, mouse
gtgcgcaggcgctagcatcc

SEQ ID NO: 766146 - DNA, 20 bp, mouse
gaggcggggccaaaatttga

SEQ ID NO: 766147 - DNA, 20 bp, mouse
gccaaccgccaactgcacga

SEQ ID NO: 766148 - DNA, 20 bp, mouse
gaggccaacgagaaacgggg

SEQ ID NO: 766149 - DNA, 20 bp, mouse
ggggatcactcggaactgaa

SEQ ID NO: 766150 - DNA, 20 bp, mouse
ggaaaagggggcagaactta

SEQ ID NO: 766151 - DNA, 20 bp, mouse
gccccccccccgtttctcgt

SEQ ID NO: 766152 - DNA, 20 bp, mouse
gtgaaggccaacgagaaacg

SEQ ID NO: 766153 - DNA, 20 bp, mouse
ggggaaacgctgcttaaagt

SEQ ID NO: 766154 - DNA, 20 bp, mouse
gtagtggccaaggctcaaaa

SEQ ID NO: 766155 - DNA, 20 bp, mouse
gcccgcctcctcgtgtgaag

SEQ ID NO: 766156 - DNA, 20 bp, mouse
ggcgctgcaccaggaggtta

SEQ ID NO: 766157 - DNA, 20 bp, mouse
ggcggggagggcacgagaat

SEQ ID NO: 766158 - DNA, 20 bp, mouse
ggcgtacaggggatcttgag

SEQ ID NO: 766159 - DNA, 20 bp, mouse
gacgcccgaaagctgcggag

SEQ ID NO: 766160 - DNA, 20 bp, mouse
gaccaccaggggcaccacct

SEQ ID NO: 766161 - DNA, 20 bp, mouse
gccaccccgccctaggtgcg

SEQ ID NO: 766162 - DNA, 20 bp, mouse
ggcggcgcccacggagtcaa

SEQ ID NO: 766163 - DNA, 20 bp, mouse
gaaggactgcggagcgtaca

SEQ ID NO: 766164 - DNA, 20 bp, mouse
ggagcaccccgctccgctta

SEQ ID NO: 766165 - DNA, 20 bp, mouse
gctgcaccaggaggttaggg

SEQ ID NO: 766166 - DNA, 20 bp, mouse
gcagcagcatcaacagacta

SEQ ID NO: 766167 - DNA, 20 bp, mouse
gagcgcaagctggttgtcat

SEQ ID NO: 766168 - DNA, 20 bp, mouse
gagggtgtgggaactatcca

SEQ ID NO: 766169 - DNA, 20 bp, mouse
gacaaccagcttgcgctggc

SEQ ID NO: 766170 - DNA, 20 bp, mouse
ggcccctggggagccgaaat

SEQ ID NO: 766171 - DNA, 20 bp, mouse
gagcttgcgctggctggctc

SEQ ID NO: 766172 - DNA, 20 bp, mouse
gcaccctaggcccactggaa

SEQ ID NO: 766173 - DNA, 20 bp, mouse
ggggaactatccaaggtgct

SEQ ID NO: 766174 - DNA, 20 bp, mouse
gaatgaggatgggagcccct

SEQ ID NO: 766175 - DNA, 20 bp, mouse
ggggctcccatcctcattaa

SEQ ID NO: 766176 - DNA, 20 bp, mouse
gtcgaggtcgaaggggagga

SEQ ID NO: 766177 - DNA, 20 bp, mouse
ggtgctgcggcggaaaggga

SEQ ID NO: 766178 - DNA, 20 bp, mouse
gctgctaagggttgtagcta

SEQ ID NO: 766179 - DNA, 20 bp, mouse
gggcgcgcctcaaggagggg

SEQ ID NO: 766180 - DNA, 20 bp, mouse
gaaggggcgctggagactga

SEQ ID NO: 766181 - DNA, 20 bp, mouse
ggggtcgcagaacccacagc

SEQ ID NO: 766182 - DNA, 20 bp, mouse
gctcccgtgctgcggcggaa

SEQ ID NO: 766183 - DNA, 20 bp, mouse
gggcctggcttcgaggtcga

SEQ ID NO: 766184 - DNA, 20 bp, mouse
gcggcggaaagggacggagc

SEQ ID NO: 766185 - DNA, 20 bp, mouse
gacctcgaagccaggccccc

SEQ ID NO: 766186 - DNA, 20 bp, mouse
gcctggcagatggagagggc

SEQ ID NO: 766187 - DNA, 20 bp, mouse
gcagactgcttattgctgat

SEQ ID NO: 766188 - DNA, 20 bp, mouse
ggctggaaaagcctcggtat

SEQ ID NO: 766189 - DNA, 20 bp, mouse
gcagttttatccccaagcct

SEQ ID NO: 766190 - DNA, 20 bp, mouse
gctctggtagccaaggcttg

SEQ ID NO: 766191 - DNA, 20 bp, mouse
gaaagcctcggtatcggatg

SEQ ID NO: 766192 - DNA, 20 bp, mouse
gcccagcaggcaagaagctt

SEQ ID NO: 766193 - DNA, 20 bp, mouse
gtaactttagagggctgtag

SEQ ID NO: 766194 - DNA, 20 bp, mouse
ggcaagaagctttggtgttg

SEQ ID NO: 766195 - DNA, 20 bp, mouse
gacacattatgtaactttag

SEQ ID NO: 766196 - DNA, 20 bp, mouse
gtgggtcagggctgtggatg

SEQ ID NO: 766197 - DNA, 20 bp, mouse
gtcctcagccacctgcaaag

SEQ ID NO: 766198 - DNA, 20 bp, mouse
gttgtctcttggcttgttaa

SEQ ID NO: 766199 - DNA, 20 bp, mouse
ggctgtggatgtggcgccac

SEQ ID NO: 766200 - DNA, 20 bp, mouse
gacgtgcagcagcaatactt

SEQ ID NO: 766201 - DNA, 20 bp, mouse
gtatctgtccgctttgcagg

SEQ ID NO: 766202 - DNA, 20 bp, mouse
gcccttgtctataatgtgtt

SEQ ID NO: 766203 - DNA, 20 bp, mouse
gatcaggctcggattctctc

SEQ ID NO: 766204 - DNA, 20 bp, mouse
ggagcctgattcttgtgagc

SEQ ID NO: 766205 - DNA, 20 bp, mouse
gtgcataactaaagggagcc

SEQ ID NO: 766206 - DNA, 20 bp, mouse
gaccgcagtggcccagagag

SEQ ID NO: 766207 - DNA, 20 bp, mouse
gccgtcccgcccttaatggg

SEQ ID NO: 766208 - DNA, 20 bp, mouse
gcaagccagaggggtgtagg

SEQ ID NO: 766209 - DNA, 20 bp, mouse
gacaaggcccggccggtgac

SEQ ID NO: 766210 - DNA, 20 bp, mouse
ggcggggattggggaccacg

SEQ ID NO: 766211 - DNA, 20 bp, mouse
gcacccgtcccgcccttaat

SEQ ID NO: 766212 - DNA, 20 bp, mouse
ggcccttaaagggaccgcag

SEQ ID NO: 766213 - DNA, 20 bp, mouse
ggcacctcttggcccttaaa

SEQ ID NO: 766214 - DNA, 20 bp, mouse
gggccggtgacggggcgcgg

SEQ ID NO: 766215 - DNA, 20 bp, mouse
gggccactgcggtcccttta

SEQ ID NO: 766216 - DNA, 20 bp, mouse
gtggacgcttagaaataggt

SEQ ID NO: 766217 - DNA, 20 bp, mouse
gcactgggacccaccctctg

SEQ ID NO: 766218 - DNA, 20 bp, mouse
gtcccgccaaaggcctacgc

SEQ ID NO: 766219 - DNA, 20 bp, mouse
gccagtggacgcttagaaat

SEQ ID NO: 766220 - DNA, 20 bp, mouse
gagcgtacggagcgtgtgaa

SEQ ID NO: 766221 - DNA, 20 bp, mouse
gcctgcgtggtatataattc

SEQ ID NO: 766222 - DNA, 20 bp, mouse
gtggccggggttatggggcg

SEQ ID NO: 766223 - DNA, 20 bp, mouse
gtgacaccgcctcccgccaa

SEQ ID NO: 766224 - DNA, 20 bp, mouse
ggagcccgggagtcgagccg

SEQ ID NO: 766225 - DNA, 20 bp, mouse
gcgcctgcgtaggcctttgg

SEQ ID NO: 766226 - DNA, 20 bp, mouse
gtgtacacatagtagaagag

SEQ ID NO: 766227 - DNA, 20 bp, mouse
ggaagaggggagaccgagtc

SEQ ID NO: 766228 - DNA, 20 bp, mouse
gtgttacatggcatgttcta

SEQ ID NO: 766229 - DNA, 20 bp, mouse
gtaggaaagaacttttcata

SEQ ID NO: 766230 - DNA, 20 bp, mouse
gctttcttggggtttcttct

SEQ ID NO: 766231 - DNA, 20 bp, mouse
gaactgatctggctttcttg

SEQ ID NO: 766232 - DNA, 20 bp, mouse
gctttcttaggatcccacct

SEQ ID NO: 766233 - DNA, 20 bp, mouse
gatgtaaataggccaggccc

SEQ ID NO: 766234 - DNA, 20 bp, mouse
gtgaaaagttctttcctagg

SEQ ID NO: 766235 - DNA, 20 bp, mouse
gtttcataaggaaactgatc

SEQ ID NO: 766236 - DNA, 20 bp, mouse
ggtaaaagctggacctagga

SEQ ID NO: 766237 - DNA, 20 bp, mouse
gagggcctctaaaggggtca

SEQ ID NO: 766238 - DNA, 20 bp, mouse
ggctggacctaggatggagc

SEQ ID NO: 766239 - DNA, 20 bp, mouse
ggggccccgtccgccgaatg

SEQ ID NO: 766240 - DNA, 20 bp, mouse
gcgagcagccaatggcgtta

SEQ ID NO: 766241 - DNA, 20 bp, mouse
ggaagctggtgtccgggaga

SEQ ID NO: 766242 - DNA, 20 bp, mouse
gtcagaagccctaacgccat

SEQ ID NO: 766243 - DNA, 20 bp, mouse
gggcgttagggcttctgaac

SEQ ID NO: 766244 - DNA, 20 bp, mouse
gagaggtaaaagctggacct

SEQ ID NO: 766245 - DNA, 20 bp, mouse
gccgcgcccttcccgggaaa

SEQ ID NO: 766246 - DNA, 20 bp, mouse
gctgactggtccatgctgca

SEQ ID NO: 766247 - DNA, 20 bp, mouse
ggccagcttcatcacagctg

SEQ ID NO: 766248 - DNA, 20 bp, mouse
gggtccatgctgcaaggtcc

SEQ ID NO: 766249 - DNA, 20 bp, mouse
gatgtcagacggatagacag

SEQ ID NO: 766250 - DNA, 20 bp, mouse
gtccccagctgtaaccacct

SEQ ID NO: 766251 - DNA, 20 bp, mouse
gttacatccatcctgaacaa

SEQ ID NO: 766252 - DNA, 20 bp, mouse
gtgtcacaagtcaacaagtt

SEQ ID NO: 766253 - DNA, 20 bp, mouse
gttcaggatggatgtaaacc

SEQ ID NO: 766254 - DNA, 20 bp, mouse
gaaacccaggtggttacagc

SEQ ID NO: 766255 - DNA, 20 bp, mouse
gttgtgacacacgctcatga

SEQ ID NO: 766256 - DNA, 20 bp, mouse
gaaaatctaggaggctatct

SEQ ID NO: 766257 - DNA, 20 bp, mouse
gtgagatcccatattaaaga

SEQ ID NO: 766258 - DNA, 20 bp, mouse
ggagaaatccagcagccggc

SEQ ID NO: 766259 - DNA, 20 bp, mouse
ggcgagagaaatccagcagc

SEQ ID NO: 766260 - DNA, 20 bp, mouse
gacagctgactgctccatga

SEQ ID NO: 766261 - DNA, 20 bp, mouse
gttgttgttaaaaatctagg

SEQ ID NO: 766262 - DNA, 20 bp, mouse
gacagctgactggtccatgc

SEQ ID NO: 766263 - DNA, 20 bp, mouse
gctcgttacaatatccatca

SEQ ID NO: 766264 - DNA, 20 bp, mouse
gcgagccgtctgcaaggtcc

SEQ ID NO: 766265 - DNA, 20 bp, mouse
ggtgagacctttgtccttta

SEQ ID NO: 766266 - DNA, 20 bp, mouse
gacaacagaaactatgttta

SEQ ID NO: 766267 - DNA, 20 bp, mouse
ggtacagccccgccttgcct

SEQ ID NO: 766268 - DNA, 20 bp, mouse
gaatctaaagaaataccagc

SEQ ID NO: 766269 - DNA, 20 bp, mouse
gatggacaactggcttccag

SEQ ID NO: 766270 - DNA, 20 bp, mouse
gaggaacgaaaaacctgcta

SEQ ID NO: 766271 - DNA, 20 bp, mouse
ggattctcatcacagcaggc

SEQ ID NO: 766272 - DNA, 20 bp, mouse
gcgtttcagcacagctgtgt

SEQ ID NO: 766273 - DNA, 20 bp, mouse
ggctgtgctgaaacggtgtc

SEQ ID NO: 766274 - DNA, 20 bp, mouse
gcgacatcaatcaataagta

SEQ ID NO: 766275 - DNA, 20 bp, mouse
gttttcgttcctaggcaagg

SEQ ID NO: 766276 - DNA, 20 bp, mouse
gaactgcagaagatggctgg

SEQ ID NO: 766277 - DNA, 20 bp, mouse
gtttctgaggatcccatcga

SEQ ID NO: 766278 - DNA, 20 bp, mouse
gtgtacatgtaggagaaaag

SEQ ID NO: 766279 - DNA, 20 bp, mouse
gaccaggtaccgccaagcct

SEQ ID NO: 766280 - DNA, 20 bp, mouse
gtcagaaagcctaggcttgg

SEQ ID NO: 766281 - DNA, 20 bp, mouse
gatcgaaggaagaatgcaaa

SEQ ID NO: 766282 - DNA, 20 bp, mouse
gacccaccggagcaccacag

SEQ ID NO: 766283 - DNA, 20 bp, mouse
ggaaactgatttggcttttt

SEQ ID NO: 766284 - DNA, 20 bp, mouse
ggtggtgctccggtgggtgg

SEQ ID NO: 766285 - DNA, 20 bp, mouse
gatgcaaaaggaaactgatt

SEQ ID NO: 766286 - DNA, 20 bp, mouse
gccacagcctgctgtgagga

SEQ ID NO: 766287 - DNA, 20 bp, mouse
gctgggctccctgacactct

SEQ ID NO: 766288 - DNA, 20 bp, mouse
ggctgttgtggattcgtcac

SEQ ID NO: 766289 - DNA, 20 bp, mouse
gactgtcttggatgatgtct

SEQ ID NO: 766290 - DNA, 20 bp, mouse
gagcttataggtcagactta

SEQ ID NO: 766291 - DNA, 20 bp, mouse
gtggatgatgtcttggacga

SEQ ID NO: 766292 - DNA, 20 bp, mouse
gtttgtcttcccaagaaggg

SEQ ID NO: 766293 - DNA, 20 bp, mouse
ggagaaatccagaagatggc

SEQ ID NO: 766294 - DNA, 20 bp, mouse
gcagatgcacactcataatg

SEQ ID NO: 766295 - DNA, 20 bp, mouse
gactggtgcctgccatcttc

SEQ ID NO: 766296 - DNA, 20 bp, mouse
gtctgtgcaggtgtcccctg

SEQ ID NO: 766297 - DNA, 20 bp, mouse
ggtgtcccctgaggctctag

SEQ ID NO: 766298 - DNA, 20 bp, mouse
gagctagctggccactccca

SEQ ID NO: 766299 - DNA, 20 bp, mouse
gaagcattcggtgacagaca

SEQ ID NO: 766300 - DNA, 20 bp, mouse
ggaggctctaagtttaagct

SEQ ID NO: 766301 - DNA, 20 bp, mouse
gaggaaggacattatgttaa

SEQ ID NO: 766302 - DNA, 20 bp, mouse
gccctaacacagccaagcct

SEQ ID NO: 766303 - DNA, 20 bp, mouse
gtcctcctagctataggtag

SEQ ID NO: 766304 - DNA, 20 bp, mouse
ggaaatcgaaactcaagtgt

SEQ ID NO: 766305 - DNA, 20 bp, mouse
gcacccgggtttctagaaag

SEQ ID NO: 766306 - DNA, 20 bp, mouse
gaggtcccctaggtcccctg

SEQ ID NO: 766307 - DNA, 20 bp, mouse
ggaagcctcaggggacctag

SEQ ID NO: 766308 - DNA, 20 bp, mouse
ggggcagcctgggaacattg

SEQ ID NO: 766309 - DNA, 20 bp, mouse
gtgggtggggaggactgtgg

SEQ ID NO: 766310 - DNA, 20 bp, mouse
gaggaggtcaggaagcctca

SEQ ID NO: 766311 - DNA, 20 bp, mouse
gcctgggaacattggggacc

SEQ ID NO: 766312 - DNA, 20 bp, mouse
gggtccccaaataggaggtc

SEQ ID NO: 766313 - DNA, 20 bp, mouse
gtgttcccaggctgcccaga

SEQ ID NO: 766314 - DNA, 20 bp, mouse
gggtgtgacttctgaccctc

SEQ ID NO: 766315 - DNA, 20 bp, mouse
gtcttccctgactcaggctc

SEQ ID NO: 766316 - DNA, 20 bp, mouse
ggggagcatggctctatggg

SEQ ID NO: 766317 - DNA, 20 bp, mouse
gtggcacccaatggcggaaa

SEQ ID NO: 766318 - DNA, 20 bp, mouse
gacaataaatctccaaggag

SEQ ID NO: 766319 - DNA, 20 bp, mouse
gcacccaatggcggaaaggg

SEQ ID NO: 766320 - DNA, 20 bp, mouse
gggtctggaccgccttaaca

SEQ ID NO: 766321 - DNA, 20 bp, mouse
ggacctctggcacccaatgg

SEQ ID NO: 766322 - DNA, 20 bp, mouse
gcagacaaggtgtctctgga

SEQ ID NO: 766323 - DNA, 20 bp, mouse
gaccggccaaccccagcctc

SEQ ID NO: 766324 - DNA, 20 bp, mouse
ggtgccgagggaccagaggc

SEQ ID NO: 766325 - DNA, 20 bp, mouse
gcatgccaaccctgttaagg

SEQ ID NO: 766326 - DNA, 20 bp, mouse
gtgctcacaacagagccggt

SEQ ID NO: 766327 - DNA, 20 bp, mouse
gttcccttctgccttgaaga

SEQ ID NO: 766328 - DNA, 20 bp, mouse
gcctgtgctcacaacagagc

SEQ ID NO: 766329 - DNA, 20 bp, mouse
gaaggatgcagtctccccac

SEQ ID NO: 766330 - DNA, 20 bp, mouse
gtaagattcagcagtttcag

SEQ ID NO: 766331 - DNA, 20 bp, mouse
gcctccctccttggagaaac

SEQ ID NO: 766332 - DNA, 20 bp, mouse
gaggtcggtagttaggaatg

SEQ ID NO: 766333 - DNA, 20 bp, mouse
gcgtctcgagcgatagggtt

SEQ ID NO: 766334 - DNA, 20 bp, mouse
gttgccactgccagatcacc

SEQ ID NO: 766335 - DNA, 20 bp, mouse
gacctcagctagtctccccg

SEQ ID NO: 766336 - DNA, 20 bp, mouse
gcagactgcgcacttgggga

SEQ ID NO: 766337 - DNA, 20 bp, mouse
gcggaggctcaaggccgggt

SEQ ID NO: 766338 - DNA, 20 bp, mouse
ggccgcacaccaatcacaag

SEQ ID NO: 766339 - DNA, 20 bp, mouse
gaaagcagactgcgcacttg

SEQ ID NO: 766340 - DNA, 20 bp, mouse
gaggctcaaggccgggtggg

SEQ ID NO: 766341 - DNA, 20 bp, mouse
ggctagagaaacgcagtgag

SEQ ID NO: 766342 - DNA, 20 bp, mouse
gtctctcagttcattggtta

SEQ ID NO: 766343 - DNA, 20 bp, mouse
gttgagctctgcactgaact

SEQ ID NO: 766344 - DNA, 20 bp, mouse
gtttacccgaaggggaacgg

SEQ ID NO: 766345 - DNA, 20 bp, mouse
ggaactgagagaacgggcgg

SEQ ID NO: 766346 - DNA, 20 bp, mouse
ggcgacggaggaacggggtg

SEQ ID NO: 766347 - DNA, 20 bp, mouse
gcagcagtgtgaggcgacgg

SEQ ID NO: 766348 - DNA, 20 bp, mouse
ggaacggggtggggccacag

SEQ ID NO: 766349 - DNA, 20 bp, mouse
ggtgtgaggcgacggaggaa

SEQ ID NO: 766350 - DNA, 20 bp, mouse
ggacgcgtcccgcccctaca

SEQ ID NO: 766351 - DNA, 20 bp, mouse
gagcggggcgtcccatgagt

SEQ ID NO: 766352 - DNA, 20 bp, mouse
gtcacgtcataaagcctcga

SEQ ID NO: 766353 - DNA, 20 bp, mouse
ggggccacagtggcagccca

SEQ ID NO: 766354 - DNA, 20 bp, mouse
gtttgcgtcactctgtggga

SEQ ID NO: 766355 - DNA, 20 bp, mouse
gaaatgcgtcccacctactc

SEQ ID NO: 766356 - DNA, 20 bp, mouse
gctgggcgcaggcgtactaa

SEQ ID NO: 766357 - DNA, 20 bp, mouse
gaaactggggcccacaacaa

SEQ ID NO: 766358 - DNA, 20 bp, mouse
gacaccaagcggcgctgggt

SEQ ID NO: 766359 - DNA, 20 bp, mouse
ggcgaagcaccgccccgcct

SEQ ID NO: 766360 - DNA, 20 bp, mouse
gcaccgccccgcctgggcgc

SEQ ID NO: 766361 - DNA, 20 bp, mouse
gcagcgccgcttggtgtcct

SEQ ID NO: 766362 - DNA, 20 bp, mouse
gttggtgtcctgggaaactg

SEQ ID NO: 766363 - DNA, 20 bp, mouse
gcaagcagaacctgagttcc

SEQ ID NO: 766364 - DNA, 20 bp, mouse
gtaagggcaagctatcatct

SEQ ID NO: 766365 - DNA, 20 bp, mouse
ggggtggggctatgcagatg

SEQ ID NO: 766366 - DNA, 20 bp, mouse
gaaaagttatatactgagtc

SEQ ID NO: 766367 - DNA, 20 bp, mouse
gtacaagaagagctccagca

SEQ ID NO: 766368 - DNA, 20 bp, mouse
ggaatatgaaccttggttag

SEQ ID NO: 766369 - DNA, 20 bp, mouse
ggagggaaggccaaggtggt

SEQ ID NO: 766370 - DNA, 20 bp, mouse
gtccagagggaaggccaagg

SEQ ID NO: 766371 - DNA, 20 bp, mouse
gctgtccattgtgacctggc

SEQ ID NO: 766372 - DNA, 20 bp, mouse
ggcattatgacatagacatg

SEQ ID NO: 766373 - DNA, 20 bp, mouse
gactagttgaatatgaacct

SEQ ID NO: 766374 - DNA, 20 bp, mouse
gggacttagaagtgttccag

SEQ ID NO: 766375 - DNA, 20 bp, mouse
gtgttccagagggaaggcca

SEQ ID NO: 766376 - DNA, 20 bp, mouse
gtagaccgggaaggcggcgt

SEQ ID NO: 766377 - DNA, 20 bp, mouse
gtgggcggaaccgatacgtg

SEQ ID NO: 766378 - DNA, 20 bp, mouse
gaccctgcgcaggctcttgg

SEQ ID NO: 766379 - DNA, 20 bp, mouse
ggccttgaggaggacgtcgg

SEQ ID NO: 766380 - DNA, 20 bp, mouse
gccacgcccaccccacgtat

SEQ ID NO: 766381 - DNA, 20 bp, mouse
gcggaaccgatacgtggggt

SEQ ID NO: 766382 - DNA, 20 bp, mouse
gtccgcccacgccgccttcc

SEQ ID NO: 766383 - DNA, 20 bp, mouse
ggcgcagggtgtatgtagac

SEQ ID NO: 766384 - DNA, 20 bp, mouse
ggggtgtatgtagaccggga

SEQ ID NO: 766385 - DNA, 20 bp, mouse
gagcccccaagagcctgcgc

SEQ ID NO: 766386 - DNA, 20 bp, mouse
gtagcagagttgagaatagc

SEQ ID NO: 766387 - DNA, 20 bp, mouse
ggctaccttcctgccagaaa

SEQ ID NO: 766388 - DNA, 20 bp, mouse
ggagcaaacacgccccgttc

SEQ ID NO: 766389 - DNA, 20 bp, mouse
gcagagttgagaatagcagg

SEQ ID NO: 766390 - DNA, 20 bp, mouse
gcatccttggggagaaaatt

SEQ ID NO: 766391 - DNA, 20 bp, mouse
gacaactcatatcccaagtt

SEQ ID NO: 766392 - DNA, 20 bp, mouse
gtgtctgcacatctgtgaat

SEQ ID NO: 766393 - DNA, 20 bp, mouse
ggaagcagtttcctggtgga

SEQ ID NO: 766394 - DNA, 20 bp, mouse
gggtagagaggtcgacctca

SEQ ID NO: 766395 - DNA, 20 bp, mouse
gaatcccaattttctcccca

SEQ ID NO: 766396 - DNA, 20 bp, mouse
gagtggagccaacgtgtagg

SEQ ID NO: 766397 - DNA, 20 bp, mouse
gtgtagccctccaactcacc

SEQ ID NO: 766398 - DNA, 20 bp, mouse
ggcaagttacagtaaccttc

SEQ ID NO: 766399 - DNA, 20 bp, mouse
ggggctacatgaaatgttta

SEQ ID NO: 766400 - DNA, 20 bp, mouse
ggggcacacaaatgggatca

SEQ ID NO: 766401 - DNA, 20 bp, mouse
gtcatgctcctcctacacgt

SEQ ID NO: 766402 - DNA, 20 bp, mouse
ggcaagatagatgttactgt

SEQ ID NO: 766403 - DNA, 20 bp, mouse
ggatctttcagagcatgaaa

SEQ ID NO: 766404 - DNA, 20 bp, mouse
gagatcttgacagaatataa

SEQ ID NO: 766405 - DNA, 20 bp, mouse
gggattcctggtgagttgga

SEQ ID NO: 766406 - DNA, 20 bp, mouse
gtttctaaaacagtgaagct

SEQ ID NO: 766407 - DNA, 20 bp, mouse
gatagaggtacaaaatgctc

SEQ ID NO: 766408 - DNA, 20 bp, mouse
gaatagacattgttcagatt

SEQ ID NO: 766409 - DNA, 20 bp, mouse
gtagcaactcaggagtggga

SEQ ID NO: 766410 - DNA, 20 bp, mouse
gctcaggagtgggagggctg

SEQ ID NO: 766411 - DNA, 20 bp, mouse
gctggggagaaaggagaagt

SEQ ID NO: 766412 - DNA, 20 bp, mouse
gcaagaaatgggtataggaa

SEQ ID NO: 766413 - DNA, 20 bp, mouse
ggaactttcagagcatcaaa

SEQ ID NO: 766414 - DNA, 20 bp, mouse
gtgggtataggaagggttca

SEQ ID NO: 766415 - DNA, 20 bp, mouse
gtgggacctctttccccttg

SEQ ID NO: 766416 - DNA, 20 bp, mouse
gtagcagagttgagaatagc

SEQ ID NO: 766417 - DNA, 20 bp, mouse
ggctaccttcctgccagaaa

SEQ ID NO: 766418 - DNA, 20 bp, mouse
ggagcaaacacgccccgttc

SEQ ID NO: 766419 - DNA, 20 bp, mouse
gcagagttgagaatagcagg

SEQ ID NO: 766420 - DNA, 20 bp, mouse
gcatccttggggagaaaatt

SEQ ID NO: 766421 - DNA, 20 bp, mouse
gacaactcatatcccaagtt

SEQ ID NO: 766422 - DNA, 20 bp, mouse
gtgtctgcacatctgtgaat

SEQ ID NO: 766423 - DNA, 20 bp, mouse
ggaagcagtttcctggtgga

SEQ ID NO: 766424 - DNA, 20 bp, mouse
gggtagagaggtcgacctca

SEQ ID NO: 766425 - DNA, 20 bp, mouse
gaatcccaattttctcccca

SEQ ID NO: 766426 - DNA, 20 bp, mouse
gacaggaggatccagggagt

SEQ ID NO: 766427 - DNA, 20 bp, mouse
gtcaagagacaggaggatcc

SEQ ID NO: 766428 - DNA, 20 bp, mouse
ggaaaaggggatccagttac

SEQ ID NO: 766429 - DNA, 20 bp, mouse
ggcgaagagcctgaggaaaa

SEQ ID NO: 766430 - DNA, 20 bp, mouse
gaggtcaaggggaggtacca

SEQ ID NO: 766431 - DNA, 20 bp, mouse
gaggaagagggcaaccctat

SEQ ID NO: 766432 - DNA, 20 bp, mouse
gcagttacagggcctgaatt

SEQ ID NO: 766433 - DNA, 20 bp, mouse
ggacactattacgaagaaca

SEQ ID NO: 766434 - DNA, 20 bp, mouse
gttgacctggatcccaattc

SEQ ID NO: 766435 - DNA, 20 bp, mouse
ggcttgctaggtcttttggg

SEQ ID NO: 766436 - DNA, 20 bp, mouse
gtggcatttgattagtccat

SEQ ID NO: 766437 - DNA, 20 bp, mouse
ggtgaagcagaactttaggg

SEQ ID NO: 766438 - DNA, 20 bp, mouse
gcagactgttggttcttcag

SEQ ID NO: 766439 - DNA, 20 bp, mouse
gtaaagttctgcttcacaca

SEQ ID NO: 766440 - DNA, 20 bp, mouse
gtgaaaatcccacagttcaa

SEQ ID NO: 766441 - DNA, 20 bp, mouse
ggaactgtgggattttcaga

SEQ ID NO: 766442 - DNA, 20 bp, mouse
gctgcaggagatctactagg

SEQ ID NO: 766443 - DNA, 20 bp, mouse
gtggctgcaggagatctact

SEQ ID NO: 766444 - DNA, 20 bp, mouse
gagaaagaacagctacaggc

SEQ ID NO: 766445 - DNA, 20 bp, mouse
gctggagaaagaacagctac

SEQ ID NO: 766446 - DNA, 20 bp, mouse
gatttaaccacaggatttca

SEQ ID NO: 766447 - DNA, 20 bp, mouse
gaaagacccagggtgtgggg

SEQ ID NO: 766448 - DNA, 20 bp, mouse
gaccaccagaggagtatcaa

SEQ ID NO: 766449 - DNA, 20 bp, mouse
ggaggtgaagaattgcagga

SEQ ID NO: 766450 - DNA, 20 bp, mouse
gaggaaagacccagggtgtg

SEQ ID NO: 766451 - DNA, 20 bp, mouse
gaattgcaggagggggtact

SEQ ID NO: 766452 - DNA, 20 bp, mouse
gtggggaggcctggtttaga

SEQ ID NO: 766453 - DNA, 20 bp, mouse
gcaacgtgtgggaggagcat

SEQ ID NO: 766454 - DNA, 20 bp, mouse
gtgagagaactcaggggtct

SEQ ID NO: 766455 - DNA, 20 bp, mouse
gacaccctttgatactcctc

SEQ ID NO: 766456 - DNA, 20 bp, mouse
gatttaaccacaggatttca

SEQ ID NO: 766457 - DNA, 20 bp, mouse
gaaagacccagggtgtgggg

SEQ ID NO: 766458 - DNA, 20 bp, mouse
gaggaaagacccagggtgtg

SEQ ID NO: 766459 - DNA, 20 bp, mouse
gtggggaggcctggtttaga

SEQ ID NO: 766460 - DNA, 20 bp, mouse
ggaggtgaagaattgcagga

SEQ ID NO: 766461 - DNA, 20 bp, mouse
gtgagagaactcaggggtct

SEQ ID NO: 766462 - DNA, 20 bp, mouse
gagggcatcctcctggagtt

SEQ ID NO: 766463 - DNA, 20 bp, mouse
gagttgggggatgaggaatg

SEQ ID NO: 766464 - DNA, 20 bp, mouse
gaattgcaggagggggtact

SEQ ID NO: 766465 - DNA, 20 bp, mouse
gctcctggagttgggggatg

SEQ ID NO: 766466 - DNA, 20 bp, mouse
gtgtgtgtgtgacgggaagg

SEQ ID NO: 766467 - DNA, 20 bp, mouse
gtggcaccaaagggtgggtg

SEQ ID NO: 766468 - DNA, 20 bp, mouse
gcagtgtggcaccaaagggt

SEQ ID NO: 766469 - DNA, 20 bp, mouse
ggagaccagtgtggcaccaa

SEQ ID NO: 766470 - DNA, 20 bp, mouse
gagacctcccactcactcag

SEQ ID NO: 766471 - DNA, 20 bp, mouse
gaggaaccaaaatgtgggag

SEQ ID NO: 766472 - DNA, 20 bp, mouse
gtgggtatcaaatctctact

SEQ ID NO: 766473 - DNA, 20 bp, mouse
gtaatcgtgtcttgtgtcag

SEQ ID NO: 766474 - DNA, 20 bp, mouse
ggtgagtgggaggtctgagt

SEQ ID NO: 766475 - DNA, 20 bp, mouse
gagtgggaggaaccaaaatg

SEQ ID NO: 766476 - DNA, 20 bp, mouse
gaggtcaaggcatgttttca

SEQ ID NO: 766477 - DNA, 20 bp, mouse
gttaattgagcattcctgtt

SEQ ID NO: 766478 - DNA, 20 bp, mouse
gtgcaagcatgtagttactc

SEQ ID NO: 766479 - DNA, 20 bp, mouse
gtatgaactcatgttcttaa

SEQ ID NO: 766480 - DNA, 20 bp, mouse
ggggaataagattatctttc

SEQ ID NO: 766481 - DNA, 20 bp, mouse
gactctggctccaattgccc

SEQ ID NO: 766482 - DNA, 20 bp, mouse
gttgcaagaaagtatgttaa

SEQ ID NO: 766483 - DNA, 20 bp, mouse
gaagattatctttcaggtca

SEQ ID NO: 766484 - DNA, 20 bp, mouse
gtttcagaaagtatcttaca

SEQ ID NO: 766485 - DNA, 20 bp, mouse
ggaataatgaaattatttta

SEQ ID NO: 766486 - DNA, 20 bp, mouse
ggaagaaagaagttaatata

SEQ ID NO: 766487 - DNA, 20 bp, mouse
gatgactggatgcttatctg

SEQ ID NO: 766488 - DNA, 20 bp, mouse
ggtagtaaaagacttatgac

SEQ ID NO: 766489 - DNA, 20 bp, mouse
gaaacattgaaaaaatgagg

SEQ ID NO: 766490 - DNA, 20 bp, mouse
gaagaagttaatatatggaa

SEQ ID NO: 766491 - DNA, 20 bp, mouse
gtggttaaatgggtcatata

SEQ ID NO: 766492 - DNA, 20 bp, mouse
gctttctgatggtgaatcat

SEQ ID NO: 766493 - DNA, 20 bp, mouse
gctgtccagtacttcccatt

SEQ ID NO: 766494 - DNA, 20 bp, mouse
gagggccaaatgggaagtac

SEQ ID NO: 766495 - DNA, 20 bp, mouse
gacttcccatttggccctga

SEQ ID NO: 766496 - DNA, 20 bp, mouse
gccgcctggatgccccatca

SEQ ID NO: 766497 - DNA, 20 bp, mouse
gtgagtaactcgggtagagg

SEQ ID NO: 766498 - DNA, 20 bp, mouse
gacttacagggaagccctga

SEQ ID NO: 766499 - DNA, 20 bp, mouse
gtaactcgggtagaggggga

SEQ ID NO: 766500 - DNA, 20 bp, mouse
ggggtcacaaaatatcatca

SEQ ID NO: 766501 - DNA, 20 bp, mouse
gatgcagggcaggtgtgtga

SEQ ID NO: 766502 - DNA, 20 bp, mouse
ggggtcatggtattccctag

SEQ ID NO: 766503 - DNA, 20 bp, mouse
gcatggtattccctagtggc

SEQ ID NO: 766504 - DNA, 20 bp, mouse
gggtagacaccctgccacta

SEQ ID NO: 766505 - DNA, 20 bp, mouse
gattttgtgaccccacttac

SEQ ID NO: 766506 - DNA, 20 bp, mouse
gacgcagggcaggagtgtga

SEQ ID NO: 766507 - DNA, 20 bp, mouse
ggcacacgtccctgtccatg

SEQ ID NO: 766508 - DNA, 20 bp, mouse
gcttacagagaagtcctgat

SEQ ID NO: 766509 - DNA, 20 bp, mouse
gtaactcgggtggaggggat

SEQ ID NO: 766510 - DNA, 20 bp, mouse
ggggtcacaaaatatcatca

SEQ ID NO: 766511 - DNA, 20 bp, mouse
ggggtcatggtattccctag

SEQ ID NO: 766512 - DNA, 20 bp, mouse
gcatggtattccctagtggc

SEQ ID NO: 766513 - DNA, 20 bp, mouse
gggtagacaccctgccacta

SEQ ID NO: 766514 - DNA, 20 bp, mouse
gaatgagtaactcgggtgga

SEQ ID NO: 766515 - DNA, 20 bp, mouse
gggcagccatgggcagacgc

SEQ ID NO: 766516 - DNA, 20 bp, mouse
gcacttgagtgggttgggag

SEQ ID NO: 766517 - DNA, 20 bp, mouse
ggacttcggaggcacttgag

SEQ ID NO: 766518 - DNA, 20 bp, mouse
gctgaactgctggacttcgg

SEQ ID NO: 766519 - DNA, 20 bp, mouse
gggaggcacttgagtgggtt

SEQ ID NO: 766520 - DNA, 20 bp, mouse
gaagtcctcttgactcctga

SEQ ID NO: 766521 - DNA, 20 bp, mouse
gactttcaagtcacagaaag

SEQ ID NO: 766522 - DNA, 20 bp, mouse
ggaagtccagcagttcagat

SEQ ID NO: 766523 - DNA, 20 bp, mouse
gtggtgaggaggtgcctact

SEQ ID NO: 766524 - DNA, 20 bp, mouse
gatagaatggaggcacatca

SEQ ID NO: 766525 - DNA, 20 bp, mouse
gacactgaacgaggaggaag

SEQ ID NO: 766526 - DNA, 20 bp, mouse
gcccgcagttggagacctgg

SEQ ID NO: 766527 - DNA, 20 bp, mouse
gctgctacgcggcaattccc

SEQ ID NO: 766528 - DNA, 20 bp, mouse
ggctgctaggccaacgtggg

SEQ ID NO: 766529 - DNA, 20 bp, mouse
gaggcccgcagttggagacc

SEQ ID NO: 766530 - DNA, 20 bp, mouse
gggccgggcttcctgctctt

SEQ ID NO: 766531 - DNA, 20 bp, mouse
gagctcagactggctcctcc

SEQ ID NO: 766532 - DNA, 20 bp, mouse
ggcctccaggtctccaactg

SEQ ID NO: 766533 - DNA, 20 bp, mouse
gctacagcctagactgcccg

SEQ ID NO: 766534 - DNA, 20 bp, mouse
gtctctgatgacacagctgg

SEQ ID NO: 766535 - DNA, 20 bp, mouse
ggcagctgctaggccaacgt

SEQ ID NO: 766536 - DNA, 20 bp, mouse
gtctctgagacattgaagtg

SEQ ID NO: 766537 - DNA, 20 bp, mouse
ggatcacaagggaataactc

SEQ ID NO: 766538 - DNA, 20 bp, mouse
gctcctcagagggctcaaga

SEQ ID NO: 766539 - DNA, 20 bp, mouse
gagagctcgggtctcctcag

SEQ ID NO: 766540 - DNA, 20 bp, mouse
gggcaggtgggctgcatggg

SEQ ID NO: 766541 - DNA, 20 bp, mouse
gcacaagggaataactctgg

SEQ ID NO: 766542 - DNA, 20 bp, mouse
gaaggtgctcacatgaccag

SEQ ID NO: 766543 - DNA, 20 bp, mouse
gttccatcttgagccctctg

SEQ ID NO: 766544 - DNA, 20 bp, mouse
gaccactggtggcacactac

SEQ ID NO: 766545 - DNA, 20 bp, mouse
gttcatgcactctggcaggt

SEQ ID NO: 766546 - DNA, 20 bp, mouse
gctgctggaccattctcaag

SEQ ID NO: 766547 - DNA, 20 bp, mouse
ggcagccccagagggagggt

SEQ ID NO: 766548 - DNA, 20 bp, mouse
gcacttgcagccccagaggg

SEQ ID NO: 766549 - DNA, 20 bp, mouse
gaagcctggcttctacagca

SEQ ID NO: 766550 - DNA, 20 bp, mouse
gtgagcttgctacacatggc

SEQ ID NO: 766551 - DNA, 20 bp, mouse
gtcataggtggcataggacg

SEQ ID NO: 766552 - DNA, 20 bp, mouse
ggagcctttcaactttgtga

SEQ ID NO: 766553 - DNA, 20 bp, mouse
ggtggccaaggttacatcca

SEQ ID NO: 766554 - DNA, 20 bp, mouse
gaagccttcataggtggcat

SEQ ID NO: 766555 - DNA, 20 bp, mouse
gagcaagctcaagccttcat

SEQ ID NO: 766556 - DNA, 20 bp, mouse
gtgcggcgcgtgttcctctc

SEQ ID NO: 766557 - DNA, 20 bp, mouse
gaggccaaacagcatagtga

SEQ ID NO: 766558 - DNA, 20 bp, mouse
gtagactggggtaaatgaat

SEQ ID NO: 766559 - DNA, 20 bp, mouse
gcacgggcgctcggccgcta

SEQ ID NO: 766560 - DNA, 20 bp, mouse
ggcgctcggccgctagggcg

SEQ ID NO: 766561 - DNA, 20 bp, mouse
gggctgattccaacccagag

SEQ ID NO: 766562 - DNA, 20 bp, mouse
gtggtctctgagtatgtaca

SEQ ID NO: 766563 - DNA, 20 bp, mouse
gtcatttaccccagtctatt

SEQ ID NO: 766564 - DNA, 20 bp, mouse
ggacactcaacgacctgtat

SEQ ID NO: 766565 - DNA, 20 bp, mouse
gcgcgtgttcctctctgggt

SEQ ID NO: 766566 - DNA, 20 bp, mouse
ggcgctccagagctgcactg

SEQ ID NO: 766567 - DNA, 20 bp, mouse
ggggcgggactagttggacg

SEQ ID NO: 766568 - DNA, 20 bp, mouse
gtgaaaggggcgggactagt

SEQ ID NO: 766569 - DNA, 20 bp, mouse
gaaagtcatgggataaggag

SEQ ID NO: 766570 - DNA, 20 bp, mouse
gcgcagccgcagtgcagctc

SEQ ID NO: 766571 - DNA, 20 bp, mouse
ggggtggggggcggtgaaag

SEQ ID NO: 766572 - DNA, 20 bp, mouse
gcagcgctgggaaacagcgg

SEQ ID NO: 766573 - DNA, 20 bp, mouse
gactgcggctgcgcgagtta

SEQ ID NO: 766574 - DNA, 20 bp, mouse
gacaagagcatcgaacctag

SEQ ID NO: 766575 - DNA, 20 bp, mouse
gtggggggcggtgaaagggg

SEQ ID NO: 766576 - DNA, 20 bp, mouse
gcgcccagagagggggttca

SEQ ID NO: 766577 - DNA, 20 bp, mouse
gagtcacgtgaaaaacaatg

SEQ ID NO: 766578 - DNA, 20 bp, mouse
gctagcgacgcgcagaggtg

SEQ ID NO: 766579 - DNA, 20 bp, mouse
gggaccctaccgggctgtcc

SEQ ID NO: 766580 - DNA, 20 bp, mouse
ggtcctcccaacaaaaacac

SEQ ID NO: 766581 - DNA, 20 bp, mouse
gaaggctaaggaaccaaggt

SEQ ID NO: 766582 - DNA, 20 bp, mouse
gcagccgggacagcccggta

SEQ ID NO: 766583 - DNA, 20 bp, mouse
gttccctgaaccccctctct

SEQ ID NO: 766584 - DNA, 20 bp, mouse
gttaaatccgcccagagagg

SEQ ID NO: 766585 - DNA, 20 bp, mouse
gtggctagcctatgagggga

SEQ ID NO: 766586 - DNA, 20 bp, mouse
gagaaggaggcgggaggacc

SEQ ID NO: 766587 - DNA, 20 bp, mouse
gcacctgaaactccgatggg

SEQ ID NO: 766588 - DNA, 20 bp, mouse
gcaggtgaatgggtcaccga

SEQ ID NO: 766589 - DNA, 20 bp, mouse
ggggcactagcgacgaggtg

SEQ ID NO: 766590 - DNA, 20 bp, mouse
ggaggcgggaggaccgggca

SEQ ID NO: 766591 - DNA, 20 bp, mouse
gcctgtggggtgttggttcc

SEQ ID NO: 766592 - DNA, 20 bp, mouse
gggggagggagcgacggaga

SEQ ID NO: 766593 - DNA, 20 bp, mouse
gcccacaggggccctgaagc

SEQ ID NO: 766594 - DNA, 20 bp, mouse
gcgcacggagcaaccggcta

SEQ ID NO: 766595 - DNA, 20 bp, mouse
ggagaagggtctcaagatcg

SEQ ID NO: 766596 - DNA, 20 bp, mouse
gtgagagggaactgtgtcga

SEQ ID NO: 766597 - DNA, 20 bp, mouse
ggaactgtgtcgagggagaa

SEQ ID NO: 766598 - DNA, 20 bp, mouse
gcaaagatctacttacctcc

SEQ ID NO: 766599 - DNA, 20 bp, mouse
gcgaagagcaagacaaagaa

SEQ ID NO: 766600 - DNA, 20 bp, mouse
ggccttgggctctggttgac

SEQ ID NO: 766601 - DNA, 20 bp, mouse
gccctctcaatatgtgatta

SEQ ID NO: 766602 - DNA, 20 bp, mouse
ggatatacacatttctgatc

SEQ ID NO: 766603 - DNA, 20 bp, mouse
ggccataatcacatattgag

SEQ ID NO: 766604 - DNA, 20 bp, mouse
gtttgtcttgctcttcgctg

SEQ ID NO: 766605 - DNA, 20 bp, mouse
gagtacacaccattagtccc

SEQ ID NO: 766606 - DNA, 20 bp, mouse
gtatctgcaacatcctagaa

SEQ ID NO: 766607 - DNA, 20 bp, mouse
gtaggcacccgaaggacttg

SEQ ID NO: 766608 - DNA, 20 bp, mouse
gtcgccccctgcggccaacc

SEQ ID NO: 766609 - DNA, 20 bp, mouse
gaggcgccgctctctctctc

SEQ ID NO: 766610 - DNA, 20 bp, mouse
ggacttggggactccatagc

SEQ ID NO: 766611 - DNA, 20 bp, mouse
gccgcagggggcgaaatctg

SEQ ID NO: 766612 - DNA, 20 bp, mouse
gtgggagaatagtatgcttg

SEQ ID NO: 766613 - DNA, 20 bp, mouse
gactgcagctaggcacccga

SEQ ID NO: 766614 - DNA, 20 bp, mouse
gtggagtccccaagtccttc

SEQ ID NO: 766615 - DNA, 20 bp, mouse
gctgctacaccagttgaact

SEQ ID NO: 766616 - DNA, 20 bp, mouse
gggtccctgtagtctcctgt

SEQ ID NO: 766617 - DNA, 20 bp, mouse
gttcctgccctcagggtcac

SEQ ID NO: 766618 - DNA, 20 bp, mouse
gggaccggggaagcaaagtg

SEQ ID NO: 766619 - DNA, 20 bp, mouse
gagaacccacaggagactac

SEQ ID NO: 766620 - DNA, 20 bp, mouse
gctcctaatccatgattcta

SEQ ID NO: 766621 - DNA, 20 bp, mouse
ggcagtgcccgtgaccctga

SEQ ID NO: 766622 - DNA, 20 bp, mouse
gctgccaggggcccacctcc

SEQ ID NO: 766623 - DNA, 20 bp, mouse
gagcctcatcctctcctgaa

SEQ ID NO: 766624 - DNA, 20 bp, mouse
gtgcctttcaggagaggatg

SEQ ID NO: 766625 - DNA, 20 bp, mouse
gaagtctcggcatgccaggt

SEQ ID NO: 766626 - DNA, 20 bp, mouse
gacagggtgccttcaactcc

SEQ ID NO: 766627 - DNA, 20 bp, mouse
ggctgctgctgcagaaaccc

SEQ ID NO: 766628 - DNA, 20 bp, mouse
gtgtgaaaagcaaagataga

SEQ ID NO: 766629 - DNA, 20 bp, mouse
gaggttggacttgcccaagg

SEQ ID NO: 766630 - DNA, 20 bp, mouse
gcaacactagagagctttgc

SEQ ID NO: 766631 - DNA, 20 bp, mouse
ggtccaacctgtcttgataa

SEQ ID NO: 766632 - DNA, 20 bp, mouse
ggacaggttggacttgccca

SEQ ID NO: 766633 - DNA, 20 bp, mouse
gggacttgcccaaggaggcc

SEQ ID NO: 766634 - DNA, 20 bp, mouse
gcagatacctttatcaagac

SEQ ID NO: 766635 - DNA, 20 bp, mouse
gttgataaaggtatctgatt

SEQ ID NO: 766636 - DNA, 20 bp, mouse
gggagcgcggggcgtatggg

SEQ ID NO: 766637 - DNA, 20 bp, mouse
ggccgggcgcgtcagtgggg

SEQ ID NO: 766638 - DNA, 20 bp, mouse
gcgggccgggcgcgtcagtg

SEQ ID NO: 766639 - DNA, 20 bp, mouse
gtccccgccgggcctcgtgt

SEQ ID NO: 766640 - DNA, 20 bp, mouse
ggcggggcgtatgggcgggt

SEQ ID NO: 766641 - DNA, 20 bp, mouse
gcggggagcgcggggcgtat

SEQ ID NO: 766642 - DNA, 20 bp, mouse
gactccgtggcggccaaccc

SEQ ID NO: 766643 - DNA, 20 bp, mouse
ggcagggcgtgtccgacacg

SEQ ID NO: 766644 - DNA, 20 bp, mouse
gggcccgcgtcccccgcctc

SEQ ID NO: 766645 - DNA, 20 bp, mouse
gtggcggccaacccgggtcc

SEQ ID NO: 766646 - DNA, 20 bp, mouse
gaaaccctgaggagggtctc

SEQ ID NO: 766647 - DNA, 20 bp, mouse
ggggtgctggtggaccttga

SEQ ID NO: 766648 - DNA, 20 bp, mouse
gcttcctgggagaaaccctg

SEQ ID NO: 766649 - DNA, 20 bp, mouse
ggggtgagcgagctcttggt

SEQ ID NO: 766650 - DNA, 20 bp, mouse
ggtaggagttaagacagtca

SEQ ID NO: 766651 - DNA, 20 bp, mouse
ggaccataactgtttgtggt

SEQ ID NO: 766652 - DNA, 20 bp, mouse
gtacaagtcaaggacactaa

SEQ ID NO: 766653 - DNA, 20 bp, mouse
gaggggaccataactgtttg

SEQ ID NO: 766654 - DNA, 20 bp, mouse
gttggtaggaataccttcct

SEQ ID NO: 766655 - DNA, 20 bp, mouse
gagactatgacatacttaaa

SEQ ID NO: 766656 - DNA, 20 bp, mouse
gtgtctccctgacgacgggg

SEQ ID NO: 766657 - DNA, 20 bp, mouse
gggacgctccgcccacttct

SEQ ID NO: 766658 - DNA, 20 bp, mouse
gggcctcgtgacccagaagt

SEQ ID NO: 766659 - DNA, 20 bp, mouse
gggagcgtccccgtgtgggg

SEQ ID NO: 766660 - DNA, 20 bp, mouse
gaacccgagaggctccgggg

SEQ ID NO: 766661 - DNA, 20 bp, mouse
gtgggcggagcgtccccgtg

SEQ ID NO: 766662 - DNA, 20 bp, mouse
gctaaatggcgaaacccgag

SEQ ID NO: 766663 - DNA, 20 bp, mouse
gggcatctctgtgacgctgg

SEQ ID NO: 766664 - DNA, 20 bp, mouse
gcgcgtgtctccctgacgac

SEQ ID NO: 766665 - DNA, 20 bp, mouse
gagcgcggggcttgaacccg

SEQ ID NO: 766666 - DNA, 20 bp, mouse
gccgacgcagctaattggtc

SEQ ID NO: 766667 - DNA, 20 bp, mouse
gttccctgctaggatgagag

SEQ ID NO: 766668 - DNA, 20 bp, mouse
gcggggggttgtctctgctc

SEQ ID NO: 766669 - DNA, 20 bp, mouse
gccgttcctgctgtgattgg

SEQ ID NO: 766670 - DNA, 20 bp, mouse
gacaaaaaagggcaaaagca

SEQ ID NO: 766671 - DNA, 20 bp, mouse
gccgctccgacgcagctaat

SEQ ID NO: 766672 - DNA, 20 bp, mouse
gcaaccgctctcatcctagc

SEQ ID NO: 766673 - DNA, 20 bp, mouse
ggctgtgattggagggagtg

SEQ ID NO: 766674 - DNA, 20 bp, mouse
gaaccggcctgcggtttctg

SEQ ID NO: 766675 - DNA, 20 bp, mouse
gcggaccttccttccctgct

SEQ ID NO: 766676 - DNA, 20 bp, mouse
gcccctaaaggagaagtcca

SEQ ID NO: 766677 - DNA, 20 bp, mouse
gaaaggagaagtccacggag

SEQ ID NO: 766678 - DNA, 20 bp, mouse
ggagaagtccacggagagga

SEQ ID NO: 766679 - DNA, 20 bp, mouse
gggagcccccatcctctccg

SEQ ID NO: 766680 - DNA, 20 bp, mouse
gggagctcccacactctcca

SEQ ID NO: 766681 - DNA, 20 bp, mouse
gtccagagatcctgtttttg

SEQ ID NO: 766682 - DNA, 20 bp, mouse
ggcccctgagctctagaatg

SEQ ID NO: 766683 - DNA, 20 bp, mouse
gggagctccttggagacttg

SEQ ID NO: 766684 - DNA, 20 bp, mouse
gcaggcttgggttggagact

SEQ ID NO: 766685 - DNA, 20 bp, mouse
gtgatggagacaatgacctc

SEQ ID NO: 766686 - DNA, 20 bp, mouse
ggtaccgaagcgcctgggat

SEQ ID NO: 766687 - DNA, 20 bp, mouse
gaacgtggaaggggagtttt

SEQ ID NO: 766688 - DNA, 20 bp, mouse
gagggtggggccaagccctt

SEQ ID NO: 766689 - DNA, 20 bp, mouse
gtgaacccagaccgtggaaa

SEQ ID NO: 766690 - DNA, 20 bp, mouse
ggcaccctgtgcccctaaaa

SEQ ID NO: 766691 - DNA, 20 bp, mouse
gcgtggaaagggaacgtgga

SEQ ID NO: 766692 - DNA, 20 bp, mouse
gtgggataggcggccatgga

SEQ ID NO: 766693 - DNA, 20 bp, mouse
gaagccggctgggacataat

SEQ ID NO: 766694 - DNA, 20 bp, mouse
gatgggaggcgggtgcgcta

SEQ ID NO: 766695 - DNA, 20 bp, mouse
gaacgcgtatcccagggcac

SEQ ID NO: 766696 - DNA, 20 bp, mouse
gaatacccctggtctgggaa

SEQ ID NO: 766697 - DNA, 20 bp, mouse
gtgccgtggtgcctgaactg

SEQ ID NO: 766698 - DNA, 20 bp, mouse
gccaaccaggctgaatgccc

SEQ ID NO: 766699 - DNA, 20 bp, mouse
ggggcgttccccaatacccc

SEQ ID NO: 766700 - DNA, 20 bp, mouse
ggaacaagcaggatgataaa

SEQ ID NO: 766701 - DNA, 20 bp, mouse
gagggacagaaaggttgagt

SEQ ID NO: 766702 - DNA, 20 bp, mouse
gttccccaatacccctggtc

SEQ ID NO: 766703 - DNA, 20 bp, mouse
gagctgccataccacagttc

SEQ ID NO: 766704 - DNA, 20 bp, mouse
gactactcccttcccagacc

SEQ ID NO: 766705 - DNA, 20 bp, mouse
gaagggagtagtgaatgaca

SEQ ID NO: 766706 - DNA, 20 bp, mouse
ggactccctggggacctgtt

SEQ ID NO: 766707 - DNA, 20 bp, mouse
gccggacgctggcctggaag

SEQ ID NO: 766708 - DNA, 20 bp, mouse
gaagctggtcggccggacgc

SEQ ID NO: 766709 - DNA, 20 bp, mouse
gtggccagagccaagctggt

SEQ ID NO: 766710 - DNA, 20 bp, mouse
gtcccctaagcaaggatctc

SEQ ID NO: 766711 - DNA, 20 bp, mouse
gagatcaagtgtcagccagg

SEQ ID NO: 766712 - DNA, 20 bp, mouse
gggggccagagcaggcccta

SEQ ID NO: 766713 - DNA, 20 bp, mouse
gacatgccgtccacaaccct

SEQ ID NO: 766714 - DNA, 20 bp, mouse
gggacaaggggccgtctgtg

SEQ ID NO: 766715 - DNA, 20 bp, mouse
gtcagccgaacaggtcccca

SEQ ID NO: 766716 - DNA, 20 bp, mouse
gctctctgacaggggagaga

SEQ ID NO: 766717 - DNA, 20 bp, mouse
gaaaaagggggtcatcactg

SEQ ID NO: 766718 - DNA, 20 bp, mouse
gctggctccagcccctaatg

SEQ ID NO: 766719 - DNA, 20 bp, mouse
gaggcatctgatccacatta

SEQ ID NO: 766720 - DNA, 20 bp, mouse
gtatttgggtcttttcctag

SEQ ID NO: 766721 - DNA, 20 bp, mouse
ggagacagaccattgttgac

SEQ ID NO: 766722 - DNA, 20 bp, mouse
gcccctgtcagagagcattt

SEQ ID NO: 766723 - DNA, 20 bp, mouse
gtgactggaaccgagactag

SEQ ID NO: 766724 - DNA, 20 bp, mouse
gaaaggaagcagcagccagc

SEQ ID NO: 766725 - DNA, 20 bp, mouse
gagagacgggggatgggccg

SEQ ID NO: 766726 - DNA, 20 bp, mouse
gggagaaattctggagttga

SEQ ID NO: 766727 - DNA, 20 bp, mouse
gacatcatcgggatctaatc

SEQ ID NO: 766728 - DNA, 20 bp, mouse
gctaatctggtgtcgtctta

SEQ ID NO: 766729 - DNA, 20 bp, mouse
gacactgggccttgaatgaa

SEQ ID NO: 766730 - DNA, 20 bp, mouse
gaattcttgaaactattctg

SEQ ID NO: 766731 - DNA, 20 bp, mouse
ggagctgatcaaaaaatacg

SEQ ID NO: 766732 - DNA, 20 bp, mouse
gttcctagctccatcacaaa

SEQ ID NO: 766733 - DNA, 20 bp, mouse
gaactattctgtggcatcag

SEQ ID NO: 766734 - DNA, 20 bp, mouse
ggacatgacaagtttacact

SEQ ID NO: 766735 - DNA, 20 bp, mouse
gtgatggagctaggaaattt

SEQ ID NO: 766736 - DNA, 20 bp, mouse
gcctccctacaggtgagctc

SEQ ID NO: 766737 - DNA, 20 bp, mouse
gcctccagagctcacctgta

SEQ ID NO: 766738 - DNA, 20 bp, mouse
gggcgtgctgtcccgagtca

SEQ ID NO: 766739 - DNA, 20 bp, mouse
ggggcgttccgggtccgcgg

SEQ ID NO: 766740 - DNA, 20 bp, mouse
gccactgttcgcatcacggg

SEQ ID NO: 766741 - DNA, 20 bp, mouse
gtgcgcggaggtcccctcca

SEQ ID NO: 766742 - DNA, 20 bp, mouse
gagcgcgcaggcgtcacgga

SEQ ID NO: 766743 - DNA, 20 bp, mouse
gtaagagcgcgcaggcgtca

SEQ ID NO: 766744 - DNA, 20 bp, mouse
gtctggagggaagcaggcgg

SEQ ID NO: 766745 - DNA, 20 bp, mouse
gcctccgtcccagtgcgcgg

SEQ ID NO: 766746 - DNA, 20 bp, mouse
gtagcccggccccagaggag

SEQ ID NO: 766747 - DNA, 20 bp, mouse
gtgacgtgacgtcacagaat

SEQ ID NO: 766748 - DNA, 20 bp, mouse
ggaggagcggcctgcaagac

SEQ ID NO: 766749 - DNA, 20 bp, mouse
ggacgccacacgccggggcg

SEQ ID NO: 766750 - DNA, 20 bp, mouse
gcccacgccctgaatgtacc

SEQ ID NO: 766751 - DNA, 20 bp, mouse
gtaagaacctggtacattca

SEQ ID NO: 766752 - DNA, 20 bp, mouse
gcagatgcaaagttctgcat

SEQ ID NO: 766753 - DNA, 20 bp, mouse
gaagacagtgagcaacaggc

SEQ ID NO: 766754 - DNA, 20 bp, mouse
ggggctgagagtttggagcc

SEQ ID NO: 766755 - DNA, 20 bp, mouse
ggggtttcagtcgctcgctc

SEQ ID NO: 766756 - DNA, 20 bp, mouse
gacgacgcgcggaatcccga

SEQ ID NO: 766757 - DNA, 20 bp, mouse
ggaagcacctggctctttgg

SEQ ID NO: 766758 - DNA, 20 bp, mouse
gtctgccctgtctgagtgac

SEQ ID NO: 766759 - DNA, 20 bp, mouse
gtccgcgcgtcgtgacgtct

SEQ ID NO: 766760 - DNA, 20 bp, mouse
gtcagcacctcggacagcga

SEQ ID NO: 766761 - DNA, 20 bp, mouse
gtgggggccacatgaggtct

SEQ ID NO: 766762 - DNA, 20 bp, mouse
gcacatgaggtcttggatct

SEQ ID NO: 766763 - DNA, 20 bp, mouse
gagacgccccgccctgtctg

SEQ ID NO: 766764 - DNA, 20 bp, mouse
gcgagggtgcgcgctcacgg

SEQ ID NO: 766765 - DNA, 20 bp, mouse
ggacagcgagggccgcagac

SEQ ID NO: 766766 - DNA, 20 bp, mouse
gcgctccggaggcaggaagt

SEQ ID NO: 766767 - DNA, 20 bp, mouse
ggccggaagtgaatacgctc

SEQ ID NO: 766768 - DNA, 20 bp, mouse
gtggaaaggcagtaaagcac

SEQ ID NO: 766769 - DNA, 20 bp, mouse
ggggaactgtagtttctgga

SEQ ID NO: 766770 - DNA, 20 bp, mouse
gacaacccgcatccggcgtg

SEQ ID NO: 766771 - DNA, 20 bp, mouse
ggggagagcatcaacggccg

SEQ ID NO: 766772 - DNA, 20 bp, mouse
ggggtaatgctggtgaaata

SEQ ID NO: 766773 - DNA, 20 bp, mouse
gagaggcgcggaacacacgc

SEQ ID NO: 766774 - DNA, 20 bp, mouse
ggcgtcacgccgccagcaat

SEQ ID NO: 766775 - DNA, 20 bp, mouse
gcgaccatttgaccaattgc

SEQ ID NO: 766776 - DNA, 20 bp, mouse
gtcaccccgctgtgactcgg

SEQ ID NO: 766777 - DNA, 20 bp, mouse
ggtgtccccagcacggggta

SEQ ID NO: 766778 - DNA, 20 bp, mouse
gagtcacagcggggtgagat

SEQ ID NO: 766779 - DNA, 20 bp, mouse
ggctccgcgccaggcagcaa

SEQ ID NO: 766780 - DNA, 20 bp, mouse
gtggcccccgagtcacagcg

SEQ ID NO: 766781 - DNA, 20 bp, mouse
gccaagccgagcaggggcca

SEQ ID NO: 766782 - DNA, 20 bp, mouse
gcttcccgggaagaggtgga

SEQ ID NO: 766783 - DNA, 20 bp, mouse
gacgtcttcccgggaagagg

SEQ ID NO: 766784 - DNA, 20 bp, mouse
gaagacgtcttcccgggaag

SEQ ID NO: 766785 - DNA, 20 bp, mouse
gcgagcgctgcgactccctg

SEQ ID NO: 766786 - DNA, 20 bp, mouse
gccgggcccagcacaatcgg

SEQ ID NO: 766787 - DNA, 20 bp, mouse
ggccgccgcagcccagctac

SEQ ID NO: 766788 - DNA, 20 bp, mouse
gcagcacaatcggtggctgt

SEQ ID NO: 766789 - DNA, 20 bp, mouse
ggcagtgccaagggccgaga

SEQ ID NO: 766790 - DNA, 20 bp, mouse
gcgggcagggttggggattg

SEQ ID NO: 766791 - DNA, 20 bp, mouse
gccttggcactgcaaccctg

SEQ ID NO: 766792 - DNA, 20 bp, mouse
gtgcctgagagtggcaggtc

SEQ ID NO: 766793 - DNA, 20 bp, mouse
gtggcaggtcgggcagggtt

SEQ ID NO: 766794 - DNA, 20 bp, mouse
gggcgagcgtagggggggtg

SEQ ID NO: 766795 - DNA, 20 bp, mouse
ggccagacgagagcaatcgg

SEQ ID NO: 766796 - DNA, 20 bp, mouse
gggaagcggtgtcctggaga

SEQ ID NO: 766797 - DNA, 20 bp, mouse
gaggaagaggcacttcccgt

SEQ ID NO: 766798 - DNA, 20 bp, mouse
gcccagaaggacaaccctgg

SEQ ID NO: 766799 - DNA, 20 bp, mouse
ggcgcggagtcccccagcag

SEQ ID NO: 766800 - DNA, 20 bp, mouse
ggtggtgcgtcttcccggag

SEQ ID NO: 766801 - DNA, 20 bp, mouse
gcctggggctgagtccaaag

SEQ ID NO: 766802 - DNA, 20 bp, mouse
gctcggagctaggcgggaag

SEQ ID NO: 766803 - DNA, 20 bp, mouse
gccagagagggatgctagga

SEQ ID NO: 766804 - DNA, 20 bp, mouse
gtctcaagggggcggacctg

SEQ ID NO: 766805 - DNA, 20 bp, mouse
ggcctccagggttgtccttc

SEQ ID NO: 766806 - DNA, 20 bp, mouse
gcactcccggggaccgtgga

SEQ ID NO: 766807 - DNA, 20 bp, mouse
gtggctgggaggagccccaa

SEQ ID NO: 766808 - DNA, 20 bp, mouse
gctgacccctggccactccc

SEQ ID NO: 766809 - DNA, 20 bp, mouse
gtcccggggaccgtggaggg

SEQ ID NO: 766810 - DNA, 20 bp, mouse
ggtgccgcgcgctcgggagt

SEQ ID NO: 766811 - DNA, 20 bp, mouse
ggccccgccccctgtggacc

SEQ ID NO: 766812 - DNA, 20 bp, mouse
gcgcccccctccacggtccc

SEQ ID NO: 766813 - DNA, 20 bp, mouse
gcgcgcggcaccagctccac

SEQ ID NO: 766814 - DNA, 20 bp, mouse
gcgggacgcgcccccctcca

SEQ ID NO: 766815 - DNA, 20 bp, mouse
gggtccccgggagtggccag

SEQ ID NO: 766816 - DNA, 20 bp, mouse
gtcctcctgcgcagccctcg

SEQ ID NO: 766817 - DNA, 20 bp, mouse
ggggccacgtccggaggaag

SEQ ID NO: 766818 - DNA, 20 bp, mouse
gggacccggaagaaccatac

SEQ ID NO: 766819 - DNA, 20 bp, mouse
ggggagcaaggatctacttc

SEQ ID NO: 766820 - DNA, 20 bp, mouse
gagtgggcgggcctgtgagg

SEQ ID NO: 766821 - DNA, 20 bp, mouse
gagcaaggatctacttccgg

SEQ ID NO: 766822 - DNA, 20 bp, mouse
ggtgcttcgtactttcttct

SEQ ID NO: 766823 - DNA, 20 bp, mouse
gcgcgccagtatggttcttc

SEQ ID NO: 766824 - DNA, 20 bp, mouse
gaactcgggagtgccggagt

SEQ ID NO: 766825 - DNA, 20 bp, mouse
ggcgcctttccaaacctcga

SEQ ID NO: 766826 - DNA, 20 bp, mouse
gtcaccccgagaaggaatgt

SEQ ID NO: 766827 - DNA, 20 bp, mouse
gcctgcatttcaccccgaga

SEQ ID NO: 766828 - DNA, 20 bp, mouse
gtacaagagagaatgtgctg

SEQ ID NO: 766829 - DNA, 20 bp, mouse
ggattcgtgcacaaggtaaa

SEQ ID NO: 766830 - DNA, 20 bp, mouse
ggctgcagtgtactgcactc

SEQ ID NO: 766831 - DNA, 20 bp, mouse
gcagaaaagcacaaaaataa

SEQ ID NO: 766832 - DNA, 20 bp, mouse
gaacaaagacgggtcgggtg

SEQ ID NO: 766833 - DNA, 20 bp, mouse
gttaagaacaaagacgggtc

SEQ ID NO: 766834 - DNA, 20 bp, mouse
gctgctgttgaattccacat

SEQ ID NO: 766835 - DNA, 20 bp, mouse
gcaacagtttaaatcccatg

SEQ ID NO: 766836 - DNA, 20 bp, mouse
ggggttaagggctccctatg

SEQ ID NO: 766837 - DNA, 20 bp, mouse
gacccggagttgcctagaca

SEQ ID NO: 766838 - DNA, 20 bp, mouse
ggcatgcgacaaccctgtct

SEQ ID NO: 766839 - DNA, 20 bp, mouse
gctaggcaactccgggttaa

SEQ ID NO: 766840 - DNA, 20 bp, mouse
gtgtcgcaatggaccttggg

SEQ ID NO: 766841 - DNA, 20 bp, mouse
ggcaatggaccttgggcgga

SEQ ID NO: 766842 - DNA, 20 bp, mouse
gaccctgtctaggcaactcc

SEQ ID NO: 766843 - DNA, 20 bp, mouse
gtgctggctcttgccccata

SEQ ID NO: 766844 - DNA, 20 bp, mouse
ggggctgttcaaaacaatgg

SEQ ID NO: 766845 - DNA, 20 bp, mouse
gttacgtaaccttccgccca

SEQ ID NO: 766846 - DNA, 20 bp, mouse
gaagactgctgtaagttcat

SEQ ID NO: 766847 - DNA, 20 bp, mouse
gtgcgggccagtagcgtgat

SEQ ID NO: 766848 - DNA, 20 bp, mouse
ggagggtggggtttccgatg

SEQ ID NO: 766849 - DNA, 20 bp, mouse
gtattgagagcgtgtctttc

SEQ ID NO: 766850 - DNA, 20 bp, mouse
gtgtctccctgcgtcttcat

SEQ ID NO: 766851 - DNA, 20 bp, mouse
gggtatagtttgcggaatag

SEQ ID NO: 766852 - DNA, 20 bp, mouse
gttgaactgcctcgagggtg

SEQ ID NO: 766853 - DNA, 20 bp, mouse
gcttcagccaatcacgctac

SEQ ID NO: 766854 - DNA, 20 bp, mouse
gactgagaggaaacccccga

SEQ ID NO: 766855 - DNA, 20 bp, mouse
gaaacagagcggctcaaaac

SEQ ID NO: 766856 - DNA, 20 bp, mouse
gtgaggctaaagtctggtag

SEQ ID NO: 766857 - DNA, 20 bp, mouse
gctaaagtctggtaggggct

SEQ ID NO: 766858 - DNA, 20 bp, mouse
gaatctagagctctcagcag

SEQ ID NO: 766859 - DNA, 20 bp, mouse
gcagcagctccagccttccc

SEQ ID NO: 766860 - DNA, 20 bp, mouse
gcctcgttaaacaccttacc

SEQ ID NO: 766861 - DNA, 20 bp, mouse
gtcagtgaatgggctttcga

SEQ ID NO: 766862 - DNA, 20 bp, mouse
ggtgctagcacaaacaactt

SEQ ID NO: 766863 - DNA, 20 bp, mouse
gaggctggagctgctgtatt

SEQ ID NO: 766864 - DNA, 20 bp, mouse
gaggaaatgaggctaaagtc

SEQ ID NO: 766865 - DNA, 20 bp, mouse
gccctcccagtgaacctgag

SEQ ID NO: 766866 - DNA, 20 bp, mouse
ggggacacacacacaatagg

SEQ ID NO: 766867 - DNA, 20 bp, mouse
gggtgagtgggataacgctc

SEQ ID NO: 766868 - DNA, 20 bp, mouse
gccgttacaggcagttcttg

SEQ ID NO: 766869 - DNA, 20 bp, mouse
gacagcggaagacggtgagt

SEQ ID NO: 766870 - DNA, 20 bp, mouse
ggcgctggctgggacctcgt

SEQ ID NO: 766871 - DNA, 20 bp, mouse
gcacacacaataggaggatg

SEQ ID NO: 766872 - DNA, 20 bp, mouse
gctaagtgagagttcccttc

SEQ ID NO: 766873 - DNA, 20 bp, mouse
gtactgatacgggtctttag

SEQ ID NO: 766874 - DNA, 20 bp, mouse
gcttctggataagataccga

SEQ ID NO: 766875 - DNA, 20 bp, mouse
gataccgaaggctccgttac

SEQ ID NO: 766876 - DNA, 20 bp, mouse
ggcggggcctacgaggagga

SEQ ID NO: 766877 - DNA, 20 bp, mouse
gcggatgggcggggcctacg

SEQ ID NO: 766878 - DNA, 20 bp, mouse
gcccacagggtcacgcccat

SEQ ID NO: 766879 - DNA, 20 bp, mouse
gggctccgtgcaggtagcaa

SEQ ID NO: 766880 - DNA, 20 bp, mouse
gatgggcggggcctacgagg

SEQ ID NO: 766881 - DNA, 20 bp, mouse
gatgcccgggcccggatggg

SEQ ID NO: 766882 - DNA, 20 bp, mouse
gtctgcgtctctctacacgt

SEQ ID NO: 766883 - DNA, 20 bp, mouse
gacggcagaggcgacggaac

SEQ ID NO: 766884 - DNA, 20 bp, mouse
gcggatgcccgggcccggat

SEQ ID NO: 766885 - DNA, 20 bp, mouse
ggccaatgggcgtgaccctg

SEQ ID NO: 766886 - DNA, 20 bp, mouse
gtgtcaaggtgaatcatctg

SEQ ID NO: 766887 - DNA, 20 bp, mouse
gggaagttggaagttatcca

SEQ ID NO: 766888 - DNA, 20 bp, mouse
gtctgcctgcccatattcct

SEQ ID NO: 766889 - DNA, 20 bp, mouse
ggaaactgaagcaggatgct

SEQ ID NO: 766890 - DNA, 20 bp, mouse
gaccgcctagtaaattgtca

SEQ ID NO: 766891 - DNA, 20 bp, mouse
gacatatatcacaacatctg

SEQ ID NO: 766892 - DNA, 20 bp, mouse
gtggaagttatccagggcta

SEQ ID NO: 766893 - DNA, 20 bp, mouse
gtcttccaaggaatatgggc

SEQ ID NO: 766894 - DNA, 20 bp, mouse
gcctgtggccaattatgttt

SEQ ID NO: 766895 - DNA, 20 bp, mouse
ggggagatcaagcattccta

SEQ ID NO: 766896 - DNA, 20 bp, mouse
ggggcgagacaaaaccgtga

SEQ ID NO: 766897 - DNA, 20 bp, mouse
ggcgaggtctgcaaaccggt

SEQ ID NO: 766898 - DNA, 20 bp, mouse
gccggcctgcttgtggtcaa

SEQ ID NO: 766899 - DNA, 20 bp, mouse
gcgaagagttagggtcaccc

SEQ ID NO: 766900 - DNA, 20 bp, mouse
gccggtcggccgaagagtta

SEQ ID NO: 766901 - DNA, 20 bp, mouse
gccggctccgcgacgccccc

SEQ ID NO: 766902 - DNA, 20 bp, mouse
gcggccgacgcaatctgccc

SEQ ID NO: 766903 - DNA, 20 bp, mouse
ggcgtcgcggagccggagct

SEQ ID NO: 766904 - DNA, 20 bp, mouse
gcgcgacgccccctggctgc

SEQ ID NO: 766905 - DNA, 20 bp, mouse
ggagggggtgttctgtggat

SEQ ID NO: 766906 - DNA, 20 bp, mouse
gggaactcagggacccactc

SEQ ID NO: 766907 - DNA, 20 bp, mouse
gaagaggtggtgtccagaat

SEQ ID NO: 766908 - DNA, 20 bp, mouse
ggggaccgctgagtggtgac

SEQ ID NO: 766909 - DNA, 20 bp, mouse
gctggccagtcttagaccaa

SEQ ID NO: 766910 - DNA, 20 bp, mouse
gaggagaggagcacccaaga

SEQ ID NO: 766911 - DNA, 20 bp, mouse
ggatgtcactccacccattc

SEQ ID NO: 766912 - DNA, 20 bp, mouse
gtcagccagggaccgctgag

SEQ ID NO: 766913 - DNA, 20 bp, mouse
gccatcctgtcaccactcag

SEQ ID NO: 766914 - DNA, 20 bp, mouse
gaagtcaggtcacctgagac

SEQ ID NO: 766915 - DNA, 20 bp, mouse
gaaaggcctcttcccgtctc

SEQ ID NO: 766916 - DNA, 20 bp, mouse
ggctaacgtggtgggatggg

SEQ ID NO: 766917 - DNA, 20 bp, mouse
gaggaggccagaggtataca

SEQ ID NO: 766918 - DNA, 20 bp, mouse
gtacaaataggtatcagaag

SEQ ID NO: 766919 - DNA, 20 bp, mouse
gaagtgctaacgtggtggga

SEQ ID NO: 766920 - DNA, 20 bp, mouse
gaaggcagagaggggcaccg

SEQ ID NO: 766921 - DNA, 20 bp, mouse
gggtgggatgggtggccgta

SEQ ID NO: 766922 - DNA, 20 bp, mouse
gtttaaagtgctaacgtggt

SEQ ID NO: 766923 - DNA, 20 bp, mouse
gcctgtgtgcctgagtgagg

SEQ ID NO: 766924 - DNA, 20 bp, mouse
gaaagaaggaaagtacaaat

SEQ ID NO: 766925 - DNA, 20 bp, mouse
ggacagtccatgtatacctc

SEQ ID NO: 766926 - DNA, 20 bp, mouse
ggtacacggtattatgaaac

SEQ ID NO: 766927 - DNA, 20 bp, mouse
gcagctcaagttgccagcaa

SEQ ID NO: 766928 - DNA, 20 bp, mouse
gaaagagagtgattgctgag

SEQ ID NO: 766929 - DNA, 20 bp, mouse
gaactggagcgtaagtcctt

SEQ ID NO: 766930 - DNA, 20 bp, mouse
gttgccagcaaaggctgaac

SEQ ID NO: 766931 - DNA, 20 bp, mouse
ggcacctcggccagcacccg

SEQ ID NO: 766932 - DNA, 20 bp, mouse
gaaggggagaaggtagaccg

SEQ ID NO: 766933 - DNA, 20 bp, mouse
gggtgtggagacctgaacaa

SEQ ID NO: 766934 - DNA, 20 bp, mouse
ggagctcaaaaggctgggac

SEQ ID NO: 766935 - DNA, 20 bp, mouse
ggcagagagtcagctgtaca

SEQ ID NO: 766936 - DNA, 20 bp, mouse
ggaggggggcctgtatctaa

SEQ ID NO: 766937 - DNA, 20 bp, mouse
gtgcaccaagccccactctg

SEQ ID NO: 766938 - DNA, 20 bp, mouse
ggtggcctgcccttagatac

SEQ ID NO: 766939 - DNA, 20 bp, mouse
gggggcctgtatctaagggc

SEQ ID NO: 766940 - DNA, 20 bp, mouse
gcggatgtcccgaccctcct

SEQ ID NO: 766941 - DNA, 20 bp, mouse
gtgtcccgaccctcctaggg

SEQ ID NO: 766942 - DNA, 20 bp, mouse
gcaaggtgtggacaggactc

SEQ ID NO: 766943 - DNA, 20 bp, mouse
gcatgtgacccaccctagga

SEQ ID NO: 766944 - DNA, 20 bp, mouse
gggtgggtcacatgttcccg

SEQ ID NO: 766945 - DNA, 20 bp, mouse
ggagcccataccactctctc

SEQ ID NO: 766946 - DNA, 20 bp, mouse
gcgcaggcctagctcaacac

SEQ ID NO: 766947 - DNA, 20 bp, mouse
gtggactgcacagtctatta

SEQ ID NO: 766948 - DNA, 20 bp, mouse
gcaacacaggccacccccca

SEQ ID NO: 766949 - DNA, 20 bp, mouse
gtccaacactgagaccttgg

SEQ ID NO: 766950 - DNA, 20 bp, mouse
ggaatgcaagaaacagaggt

SEQ ID NO: 766951 - DNA, 20 bp, mouse
ggactgtgcagtccaatcgc

SEQ ID NO: 766952 - DNA, 20 bp, mouse
ggtgggcagaggggtacagt

SEQ ID NO: 766953 - DNA, 20 bp, mouse
ggcacagtctattaaggagg

SEQ ID NO: 766954 - DNA, 20 bp, mouse
gggaatttcagttcagtttc

SEQ ID NO: 766955 - DNA, 20 bp, mouse
ggtttctggcagaaattcct

SEQ ID NO: 766956 - DNA, 20 bp, mouse
gcaaagacgcgggaccgcag

SEQ ID NO: 766957 - DNA, 20 bp, mouse
gcgggaccgcagaggatggg

SEQ ID NO: 766958 - DNA, 20 bp, mouse
ggcagcctcgcgacgtactg

SEQ ID NO: 766959 - DNA, 20 bp, mouse
gtctgctagaggcggagcta

SEQ ID NO: 766960 - DNA, 20 bp, mouse
gagcagccaggcagtaagag

SEQ ID NO: 766961 - DNA, 20 bp, mouse
gctcgcgacgtactggggtc

SEQ ID NO: 766962 - DNA, 20 bp, mouse
gagacaaattgcaaagacgc

SEQ ID NO: 766963 - DNA, 20 bp, mouse
gctactagggcaccgggctg

SEQ ID NO: 766964 - DNA, 20 bp, mouse
ggtctttgcaatttgtctct

SEQ ID NO: 766965 - DNA, 20 bp, mouse
ggtcaggttctgtgaaatga

SEQ ID NO: 766966 - DNA, 20 bp, mouse
gggcgcccgcttaagcgcag

SEQ ID NO: 766967 - DNA, 20 bp, mouse
gggggaccccgcctcctcta

SEQ ID NO: 766968 - DNA, 20 bp, mouse
gcgcagtggctgaaccctag

SEQ ID NO: 766969 - DNA, 20 bp, mouse
gccgggaagcgcacagactt

SEQ ID NO: 766970 - DNA, 20 bp, mouse
ggcagccagtgacggcccgg

SEQ ID NO: 766971 - DNA, 20 bp, mouse
gagtggctgaaccctagagg

SEQ ID NO: 766972 - DNA, 20 bp, mouse
ggcgccggctggcgtgggaa

SEQ ID NO: 766973 - DNA, 20 bp, mouse
ggccagtgacggcccggagg

SEQ ID NO: 766974 - DNA, 20 bp, mouse
gcagtccagggagcaagtca

SEQ ID NO: 766975 - DNA, 20 bp, mouse
gctgaaccctagaggaggcg

SEQ ID NO: 766976 - DNA, 20 bp, mouse
ggggagagatggcaatctgg

SEQ ID NO: 766977 - DNA, 20 bp, mouse
gtggcctgatcaaacacaga

SEQ ID NO: 766978 - DNA, 20 bp, mouse
ggccccgcccccagagctaa

SEQ ID NO: 766979 - DNA, 20 bp, mouse
gatcaggccaggcgggaagg

SEQ ID NO: 766980 - DNA, 20 bp, mouse
gctggtgtctctcactactc

SEQ ID NO: 766981 - DNA, 20 bp, mouse
gtctaagttgctggtagtta

SEQ ID NO: 766982 - DNA, 20 bp, mouse
ggcttctggcgactgtgcaa

SEQ ID NO: 766983 - DNA, 20 bp, mouse
ggaagggataggttaatgaa

SEQ ID NO: 766984 - DNA, 20 bp, mouse
gttgtgagctcctccggaaa

SEQ ID NO: 766985 - DNA, 20 bp, mouse
gtgaaaaatgagcaagttgc

SEQ ID NO: 766986 - DNA, 20 bp, mouse
gacttccaggggttttcctc

SEQ ID NO: 766987 - DNA, 20 bp, mouse
gagcctcttaggcacagaga

SEQ ID NO: 766988 - DNA, 20 bp, mouse
gggagcctgaggaaaacccc

SEQ ID NO: 766989 - DNA, 20 bp, mouse
gactgcctttaatgagttac

SEQ ID NO: 766990 - DNA, 20 bp, mouse
gaataacattactatactta

SEQ ID NO: 766991 - DNA, 20 bp, mouse
ggctcctctccacaaagagt

SEQ ID NO: 766992 - DNA, 20 bp, mouse
ggagaaaactggtcctacag

SEQ ID NO: 766993 - DNA, 20 bp, mouse
gaagccaactctttgtggag

SEQ ID NO: 766994 - DNA, 20 bp, mouse
gttaaaggcagtaattacca

SEQ ID NO: 766995 - DNA, 20 bp, mouse
gcattactatacttaaggga

SEQ ID NO: 766996 - DNA, 20 bp, mouse
ggtaacctatggttgagcta

SEQ ID NO: 766997 - DNA, 20 bp, mouse
ggaccctggattaggaatta

SEQ ID NO: 766998 - DNA, 20 bp, mouse
gcggctgtgagtgggactat

SEQ ID NO: 766999 - DNA, 20 bp, mouse
ggggccgtaattcctaatcc

SEQ ID NO: 767000 - DNA, 20 bp, mouse
ggctaaagtcttgtaaccta

SEQ ID NO: 767001 - DNA, 20 bp, mouse
ggaatgattgaccctggatt

SEQ ID NO: 767002 - DNA, 20 bp, mouse
ggatgacagcggctgtgagt

SEQ ID NO: 767003 - DNA, 20 bp, mouse
gtgaaccatagctcaaccat

SEQ ID NO: 767004 - DNA, 20 bp, mouse
gtgtgagtgggactatagga

SEQ ID NO: 767005 - DNA, 20 bp, mouse
gattcctattttctcttcta

SEQ ID NO: 767006 - DNA, 20 bp, mouse
gaagagtaacataactacaa

SEQ ID NO: 767007 - DNA, 20 bp, mouse
gctgggtgtagcttcaacag

SEQ ID NO: 767008 - DNA, 20 bp, mouse
gaattttgaacacatctaat

SEQ ID NO: 767009 - DNA, 20 bp, mouse
gtttcagtttccaaagggat

SEQ ID NO: 767010 - DNA, 20 bp, mouse
gtacaagaaatgtaggcagg

SEQ ID NO: 767011 - DNA, 20 bp, mouse
gtctttcttagtcaacttct

SEQ ID NO: 767012 - DNA, 20 bp, mouse
gtcccacagcccaacagtgg

SEQ ID NO: 767013 - DNA, 20 bp, mouse
gaccaagcttcctccactgt

SEQ ID NO: 767014 - DNA, 20 bp, mouse
gttactctttggtcttcctg

SEQ ID NO: 767015 - DNA, 20 bp, mouse
gcttgtagacaggataatgg

SEQ ID NO: 767016 - DNA, 20 bp, mouse
gagtatccctaatgattagt

SEQ ID NO: 767017 - DNA, 20 bp, mouse
gtcttttcctactaatcatt

SEQ ID NO: 767018 - DNA, 20 bp, mouse
gaatacctgtttatgaaata

SEQ ID NO: 767019 - DNA, 20 bp, mouse
gaattgtgtcccagtgaatt

SEQ ID NO: 767020 - DNA, 20 bp, mouse
gatgaaataagggtattttt

SEQ ID NO: 767021 - DNA, 20 bp, mouse
gcaatgtctaagatatagaa

SEQ ID NO: 767022 - DNA, 20 bp, mouse
gaggtatgttacagactgaa

SEQ ID NO: 767023 - DNA, 20 bp, mouse
gtctccaaagttcacacttt

SEQ ID NO: 767024 - DNA, 20 bp, mouse
gctgagttgcgtagggatga

SEQ ID NO: 767025 - DNA, 20 bp, mouse
gaagataatccaaattcact

SEQ ID NO: 767026 - DNA, 20 bp, mouse
gagaattcacttggagtttg

SEQ ID NO: 767027 - DNA, 20 bp, mouse
gggggatgatgtatcattta

SEQ ID NO: 767028 - DNA, 20 bp, mouse
gtgctatgtagtagtctcaa

SEQ ID NO: 767029 - DNA, 20 bp, mouse
gtgaattctaattgtgtctt

SEQ ID NO: 767030 - DNA, 20 bp, mouse
gagacattagtcagcttcta

SEQ ID NO: 767031 - DNA, 20 bp, mouse
gtcagcttctaaggctacat

SEQ ID NO: 767032 - DNA, 20 bp, mouse
ggtacacagagaaaagaata

SEQ ID NO: 767033 - DNA, 20 bp, mouse
gattctgtgtagcataattt

SEQ ID NO: 767034 - DNA, 20 bp, mouse
ggacacaattagaattcact

SEQ ID NO: 767035 - DNA, 20 bp, mouse
gttctaaggctacataggga

SEQ ID NO: 767036 - DNA, 20 bp, mouse
gtatcacattacatatctcc

SEQ ID NO: 767037 - DNA, 20 bp, mouse
gttggaaggatctgatatga

SEQ ID NO: 767038 - DNA, 20 bp, mouse
gatgtctcccataacttgga

SEQ ID NO: 767039 - DNA, 20 bp, mouse
gtcagatccttccaagttat

SEQ ID NO: 767040 - DNA, 20 bp, mouse
gtttgcaaatgatctcttcc

SEQ ID NO: 767041 - DNA, 20 bp, mouse
gactgtactctaccatagtg

SEQ ID NO: 767042 - DNA, 20 bp, mouse
gatggtagagtacagttgtt

SEQ ID NO: 767043 - DNA, 20 bp, mouse
gcaatatgtctcccataact

SEQ ID NO: 767044 - DNA, 20 bp, mouse
gaaatgagcacacctcacta

SEQ ID NO: 767045 - DNA, 20 bp, mouse
gtaataaaagttgaaaacaa

SEQ ID NO: 767046 - DNA, 20 bp, mouse
gagtctgtaaaggcattgga

SEQ ID NO: 767047 - DNA, 20 bp, mouse
gaaaggcattggagggtttc

SEQ ID NO: 767048 - DNA, 20 bp, mouse
ggcacaagagaagaaactac

SEQ ID NO: 767049 - DNA, 20 bp, mouse
gaatgcctttacagactaaa

SEQ ID NO: 767050 - DNA, 20 bp, mouse
gtaaggttgcatagagctta

SEQ ID NO: 767051 - DNA, 20 bp, mouse
gaaaaacaatcatttgggct

SEQ ID NO: 767052 - DNA, 20 bp, mouse
gaccttacttagtaaatgcc

SEQ ID NO: 767053 - DNA, 20 bp, mouse
gtaggatcaaaagtagaacc

SEQ ID NO: 767054 - DNA, 20 bp, mouse
ggttgtgtcttaaaacttct

SEQ ID NO: 767055 - DNA, 20 bp, mouse
gcatgatcataagtcttata

SEQ ID NO: 767056 - DNA, 20 bp, mouse
gtacctcccagatgtctacc

SEQ ID NO: 767057 - DNA, 20 bp, mouse
gtaccaggtagacatctggg

SEQ ID NO: 767058 - DNA, 20 bp, mouse
gtggtcacacaaagaaaata

SEQ ID NO: 767059 - DNA, 20 bp, mouse
gagtctaccaggtagacatc

SEQ ID NO: 767060 - DNA, 20 bp, mouse
gggagaaaatagggtaaaaa

SEQ ID NO: 767061 - DNA, 20 bp, mouse
gtctacagaacctgaagaat

SEQ ID NO: 767062 - DNA, 20 bp, mouse
gtcacattggccaattctta

SEQ ID NO: 767063 - DNA, 20 bp, mouse
gagaaacataccataagaat

SEQ ID NO: 767064 - DNA, 20 bp, mouse
gtattctctaggtatacttc

SEQ ID NO: 767065 - DNA, 20 bp, mouse
gtctttaaaggaccagtggt

SEQ ID NO: 767066 - DNA, 20 bp, mouse
gagaatacagctacatgggt

SEQ ID NO: 767067 - DNA, 20 bp, mouse
gtgctactgggatttcagag

SEQ ID NO: 767068 - DNA, 20 bp, mouse
gctggtgctgattatgttac

SEQ ID NO: 767069 - DNA, 20 bp, mouse
gcagctatactttaagtcct

SEQ ID NO: 767070 - DNA, 20 bp, mouse
gatcccagtagcagcatgtt

SEQ ID NO: 767071 - DNA, 20 bp, mouse
gaatattaacatggagtggg

SEQ ID NO: 767072 - DNA, 20 bp, mouse
gtaataagaatacagctaca

SEQ ID NO: 767073 - DNA, 20 bp, mouse
gagtaatattaacatggagt

SEQ ID NO: 767074 - DNA, 20 bp, mouse
gcaactgaaacggatttata

SEQ ID NO: 767075 - DNA, 20 bp, mouse
ggcaaacttcgtgtcagttc

SEQ ID NO: 767076 - DNA, 20 bp, mouse
gtaaaagatggtgagaattg

SEQ ID NO: 767077 - DNA, 20 bp, mouse
ggagttacctcaaatgacag

SEQ ID NO: 767078 - DNA, 20 bp, mouse
gtcacaatatagtaatgcat

SEQ ID NO: 767079 - DNA, 20 bp, mouse
gtcataatattgaaatcaaa

SEQ ID NO: 767080 - DNA, 20 bp, mouse
gaaaaatccactgtcatttg

SEQ ID NO: 767081 - DNA, 20 bp, mouse
gtatatattctatgccagtc

SEQ ID NO: 767082 - DNA, 20 bp, mouse
gttttgaatctgaataaatg

SEQ ID NO: 767083 - DNA, 20 bp, mouse
ggataatatttttgtgaatt

SEQ ID NO: 767084 - DNA, 20 bp, mouse
ggaattgtggcagacctgac

SEQ ID NO: 767085 - DNA, 20 bp, mouse
gtcaaaaggaaggtaaaaga

SEQ ID NO: 767086 - DNA, 20 bp, mouse
gaaaggatgtgagatctcag

SEQ ID NO: 767087 - DNA, 20 bp, mouse
ggtatgtacttggatggaaa

SEQ ID NO: 767088 - DNA, 20 bp, mouse
gtccaaaagaggtatgtact

SEQ ID NO: 767089 - DNA, 20 bp, mouse
gttggtagtaattttataat

SEQ ID NO: 767090 - DNA, 20 bp, mouse
gtccaagtacatacctcttt

SEQ ID NO: 767091 - DNA, 20 bp, mouse
gattgcaagcaatccaaaag

SEQ ID NO: 767092 - DNA, 20 bp, mouse
gaagcatccctcttgttcac

SEQ ID NO: 767093 - DNA, 20 bp, mouse
ggagctattcctcagtattt

SEQ ID NO: 767094 - DNA, 20 bp, mouse
gaatttagcttgatccatta

SEQ ID NO: 767095 - DNA, 20 bp, mouse
gaagagggatgctttagcct

SEQ ID NO: 767096 - DNA, 20 bp, mouse
gatcaatcaacaatgactgg

SEQ ID NO: 767097 - DNA, 20 bp, mouse
ggggctattgctttaattgc

SEQ ID NO: 767098 - DNA, 20 bp, mouse
gggacctgaataacatgatg

SEQ ID NO: 767099 - DNA, 20 bp, mouse
gtgtagttttggtaatagaa

SEQ ID NO: 767100 - DNA, 20 bp, mouse
gtcaccacatcatgttattc

SEQ ID NO: 767101 - DNA, 20 bp, mouse
gataagcaatcaacaaatac

SEQ ID NO: 767102 - DNA, 20 bp, mouse
gcatgatgatcaaagaattg

SEQ ID NO: 767103 - DNA, 20 bp, mouse
gggggttttttctatgaata

SEQ ID NO: 767104 - DNA, 20 bp, mouse
gttatgtaagatgttttgat

SEQ ID NO: 767105 - DNA, 20 bp, mouse
gtccatcaatcaacaatgac

SEQ ID NO: 767106 - DNA, 20 bp, mouse
gacatgtgttgatgcaccat

SEQ ID NO: 767107 - DNA, 20 bp, mouse
gggtaaatcagacattctcc

SEQ ID NO: 767108 - DNA, 20 bp, mouse
gagctcttgattctgtctgt

SEQ ID NO: 767109 - DNA, 20 bp, mouse
gtaagactttcatgattacc

SEQ ID NO: 767110 - DNA, 20 bp, mouse
ggttttttcagcacaatcat

SEQ ID NO: 767111 - DNA, 20 bp, mouse
gctgaaaaaacatattaaat

SEQ ID NO: 767112 - DNA, 20 bp, mouse
gagaaataagtctggttatt

SEQ ID NO: 767113 - DNA, 20 bp, mouse
gaagcttctgacagctccca

SEQ ID NO: 767114 - DNA, 20 bp, mouse
gtcagtatatataatgacag

SEQ ID NO: 767115 - DNA, 20 bp, mouse
gtcagaaagctatgagaact

SEQ ID NO: 767116 - DNA, 20 bp, mouse
gaacatggggtgattttgac

SEQ ID NO: 767117 - DNA, 20 bp, mouse
ggttttggagaatagaacat

SEQ ID NO: 767118 - DNA, 20 bp, mouse
gttaagaaaatagatatctt

SEQ ID NO: 767119 - DNA, 20 bp, mouse
gaagcagtattttagaccag

SEQ ID NO: 767120 - DNA, 20 bp, mouse
gtactgcttaattgggcatt

SEQ ID NO: 767121 - DNA, 20 bp, mouse
gtgaatctcaactaacatga

SEQ ID NO: 767122 - DNA, 20 bp, mouse
gttcatagagacaataatga

SEQ ID NO: 767123 - DNA, 20 bp, mouse
gaactaacatgaaggcagat

SEQ ID NO: 767124 - DNA, 20 bp, mouse
gaattgggcatttggttgtc

SEQ ID NO: 767125 - DNA, 20 bp, mouse
gtctaaaatactgcttaatt

SEQ ID NO: 767126 - DNA, 20 bp, mouse
ggtattgaatgagtggataa

SEQ ID NO: 767127 - DNA, 20 bp, mouse
gtgaagtggttcaggaactt

SEQ ID NO: 767128 - DNA, 20 bp, mouse
gaaccactgtattgaatgag

SEQ ID NO: 767129 - DNA, 20 bp, mouse
gggttcaggaactttggtca

SEQ ID NO: 767130 - DNA, 20 bp, mouse
gcttaagcaattatgtgctg

SEQ ID NO: 767131 - DNA, 20 bp, mouse
gtgtatgtgtgcacttggaa

SEQ ID NO: 767132 - DNA, 20 bp, mouse
gtgttcacatgtagaatcaa

SEQ ID NO: 767133 - DNA, 20 bp, mouse
gaaacacaggagtacacatt

SEQ ID NO: 767134 - DNA, 20 bp, mouse
gcttactaaagccacttaag

SEQ ID NO: 767135 - DNA, 20 bp, mouse
gtaacgttagtgaataccag

SEQ ID NO: 767136 - DNA, 20 bp, mouse
gggaggagataaggtcaaaa

SEQ ID NO: 767137 - DNA, 20 bp, mouse
gttgttacttaacataataa

SEQ ID NO: 767138 - DNA, 20 bp, mouse
gctatttaaaagctactcca

SEQ ID NO: 767139 - DNA, 20 bp, mouse
gccaacttaagaaagagata

SEQ ID NO: 767140 - DNA, 20 bp, mouse
gaaagactcaaaagcaagaa

SEQ ID NO: 767141 - DNA, 20 bp, mouse
gaaaagttctattaataaaa

SEQ ID NO: 767142 - DNA, 20 bp, mouse
gaagagataaggaggagata

SEQ ID NO: 767143 - DNA, 20 bp, mouse
gaaaaattgagaaggcatca

SEQ ID NO: 767144 - DNA, 20 bp, mouse
gtgttaacatcacattattt

SEQ ID NO: 767145 - DNA, 20 bp, mouse
gttgcttttgagtctttcaa

SEQ ID NO: 767146 - DNA, 20 bp, mouse
ggacctgaggtactttacat

SEQ ID NO: 767147 - DNA, 20 bp, mouse
gtgagtcataaatgacaaag

SEQ ID NO: 767148 - DNA, 20 bp, mouse
gaaatacaactgaagatata

SEQ ID NO: 767149 - DNA, 20 bp, mouse
gtatcttcagttgtatttac

SEQ ID NO: 767150 - DNA, 20 bp, mouse
gtattatagaataagattgt

SEQ ID NO: 767151 - DNA, 20 bp, mouse
gatccaatgtaaagtacctc

SEQ ID NO: 767152 - DNA, 20 bp, mouse
gactttaaatatactgagac

SEQ ID NO: 767153 - DNA, 20 bp, mouse
gttggatgatcaataaataa

SEQ ID NO: 767154 - DNA, 20 bp, mouse
ggaatattctcatgcagaca

SEQ ID NO: 767155 - DNA, 20 bp, mouse
ggttacatcaaataaccatc

SEQ ID NO: 767156 - DNA, 20 bp, mouse
gaatacatattggacattat

SEQ ID NO: 767157 - DNA, 20 bp, mouse
gtggaagcaattgatgaaaa

SEQ ID NO: 767158 - DNA, 20 bp, mouse
ggtggaagagggtgggtttg

SEQ ID NO: 767159 - DNA, 20 bp, mouse
ggacatgagctctgggagtc

SEQ ID NO: 767160 - DNA, 20 bp, mouse
gcaattgatgaaaaaggaat

SEQ ID NO: 767161 - DNA, 20 bp, mouse
gaaaacacagtttagatacg

SEQ ID NO: 767162 - DNA, 20 bp, mouse
gttttgtcactgatttctta

SEQ ID NO: 767163 - DNA, 20 bp, mouse
gctaactggccatcagtggg

SEQ ID NO: 767164 - DNA, 20 bp, mouse
gtagcagaggatgacctaac

SEQ ID NO: 767165 - DNA, 20 bp, mouse
gagggtgggtttggggagca

SEQ ID NO: 767166 - DNA, 20 bp, mouse
gtgaaaggaagaaagtatgt

SEQ ID NO: 767167 - DNA, 20 bp, mouse
gaaaaagtgagtagaattaa

SEQ ID NO: 767168 - DNA, 20 bp, mouse
gataactctaaagttaaatg

SEQ ID NO: 767169 - DNA, 20 bp, mouse
gacatctttctattcatctg

SEQ ID NO: 767170 - DNA, 20 bp, mouse
ggaatcttattgcatcttct

SEQ ID NO: 767171 - DNA, 20 bp, mouse
gctgactagtaatgcatgtc

SEQ ID NO: 767172 - DNA, 20 bp, mouse
gatctcactgctaaaggaaa

SEQ ID NO: 767173 - DNA, 20 bp, mouse
gaatgagatctcactgctaa

SEQ ID NO: 767174 - DNA, 20 bp, mouse
gatgatagaaataaccagct

SEQ ID NO: 767175 - DNA, 20 bp, mouse
gtctttttttatagaatgac

SEQ ID NO: 767176 - DNA, 20 bp, mouse
gacaacttggggatacagtc

SEQ ID NO: 767177 - DNA, 20 bp, mouse
gtcaatgactatgacaactt

SEQ ID NO: 767178 - DNA, 20 bp, mouse
gtaaacctgttctccaccaa

SEQ ID NO: 767179 - DNA, 20 bp, mouse
gtgtaatcaaacagcatctt

SEQ ID NO: 767180 - DNA, 20 bp, mouse
gttggagtgagcactgattt

SEQ ID NO: 767181 - DNA, 20 bp, mouse
gattagctctgatgcagatg

SEQ ID NO: 767182 - DNA, 20 bp, mouse
ggcaaagaaatctcatcgat

SEQ ID NO: 767183 - DNA, 20 bp, mouse
gttttccattggtggagaac

SEQ ID NO: 767184 - DNA, 20 bp, mouse
gctatgaagctgcttccatg

SEQ ID NO: 767185 - DNA, 20 bp, mouse
gcatttttataatacattta

SEQ ID NO: 767186 - DNA, 20 bp, mouse
gaaactagataacatgattg

SEQ ID NO: 767187 - DNA, 20 bp, mouse
ggtaaatagattagatagaa

SEQ ID NO: 767188 - DNA, 20 bp, mouse
gttatctgtagttgaataat

SEQ ID NO: 767189 - DNA, 20 bp, mouse
gaaatagacaatagctagat

SEQ ID NO: 767190 - DNA, 20 bp, mouse
gtaacagtcaaatgattatt

SEQ ID NO: 767191 - DNA, 20 bp, mouse
ggtcttttctcaaactgtta

SEQ ID NO: 767192 - DNA, 20 bp, mouse
gtgatagataacagaaagat

SEQ ID NO: 767193 - DNA, 20 bp, mouse
gtagataacagaaagatagg

SEQ ID NO: 767194 - DNA, 20 bp, mouse
ggcaattttgtttaatttac

SEQ ID NO: 767195 - DNA, 20 bp, mouse
gtagatagatgatagagaga

SEQ ID NO: 767196 - DNA, 20 bp, mouse
gcattggagttacaggtcaa

SEQ ID NO: 767197 - DNA, 20 bp, mouse
gcctgtaactccaatgtcct

SEQ ID NO: 767198 - DNA, 20 bp, mouse
ggccacgtgcatttacgagt

SEQ ID NO: 767199 - DNA, 20 bp, mouse
ggtgcatttacgagtcggaa

SEQ ID NO: 767200 - DNA, 20 bp, mouse
gcgtggcatagaaacatccc

SEQ ID NO: 767201 - DNA, 20 bp, mouse
ggttgcttttatagaagtct

SEQ ID NO: 767202 - DNA, 20 bp, mouse
gctctgtttcctctaaacat

SEQ ID NO: 767203 - DNA, 20 bp, mouse
gtgtatactcctatgtttag

SEQ ID NO: 767204 - DNA, 20 bp, mouse
gatagtgcattatgaatttg

SEQ ID NO: 767205 - DNA, 20 bp, mouse
ggactctagtgcccttttct

SEQ ID NO: 767206 - DNA, 20 bp, mouse
gtatcaagtagcaaatggtg

SEQ ID NO: 767207 - DNA, 20 bp, mouse
ggagggaaggacagtattat

SEQ ID NO: 767208 - DNA, 20 bp, mouse
gaggccttgctaggaattat

SEQ ID NO: 767209 - DNA, 20 bp, mouse
gggaaggacagtattatagg

SEQ ID NO: 767210 - DNA, 20 bp, mouse
gacatgctgcacaatgtatc

SEQ ID NO: 767211 - DNA, 20 bp, mouse
gtaggaattattggaatcta

SEQ ID NO: 767212 - DNA, 20 bp, mouse
gtgtcaaaacaaggcagaca

SEQ ID NO: 767213 - DNA, 20 bp, mouse
gctgaaatcatacatatgcc

SEQ ID NO: 767214 - DNA, 20 bp, mouse
gattccaataattcctagca

SEQ ID NO: 767215 - DNA, 20 bp, mouse
gatataagataggccttgct

SEQ ID NO: 767216 - DNA, 20 bp, mouse
gaaaagaagttcagagacac

SEQ ID NO: 767217 - DNA, 20 bp, mouse
gaacctggatgtgattacat

SEQ ID NO: 767218 - DNA, 20 bp, mouse
gaatttgtagaactatgaag

SEQ ID NO: 767219 - DNA, 20 bp, mouse
gcacctatgtaatcacatcc

SEQ ID NO: 767220 - DNA, 20 bp, mouse
gataatgctagtaaaaaacc

SEQ ID NO: 767221 - DNA, 20 bp, mouse
gatgaaaagcaaagtaaaag

SEQ ID NO: 767222 - DNA, 20 bp, mouse
gtcatggtacagcatttaac

SEQ ID NO: 767223 - DNA, 20 bp, mouse
gtttataaaacagatagatt

SEQ ID NO: 767224 - DNA, 20 bp, mouse
gtcattaatttcatgttttc

SEQ ID NO: 767225 - DNA, 20 bp, mouse
gttagattaatatatgaggg

SEQ ID NO: 767226 - DNA, 20 bp, mouse
gaaatattacacaggatctg

SEQ ID NO: 767227 - DNA, 20 bp, mouse
gttcttgcttagacaggagg

SEQ ID NO: 767228 - DNA, 20 bp, mouse
gattacacaggatctgaggc

SEQ ID NO: 767229 - DNA, 20 bp, mouse
ggacaccaaactcttagaga

SEQ ID NO: 767230 - DNA, 20 bp, mouse
gaagcaagaaaattctagtc

SEQ ID NO: 767231 - DNA, 20 bp, mouse
gtcgaatgcaaccaggaatg

SEQ ID NO: 767232 - DNA, 20 bp, mouse
ggatagattggcctcattcc

SEQ ID NO: 767233 - DNA, 20 bp, mouse
ggtctagacatcacgttctc

SEQ ID NO: 767234 - DNA, 20 bp, mouse
gaattctagtctggatagat

SEQ ID NO: 767235 - DNA, 20 bp, mouse
gagaattttcttgcttagac

SEQ ID NO: 767236 - DNA, 20 bp, mouse
gcctgagagagcttgtcccc

SEQ ID NO: 767237 - DNA, 20 bp, mouse
gttatcaggccatggagact

SEQ ID NO: 767238 - DNA, 20 bp, mouse
gtcacactgagagtactgta

SEQ ID NO: 767239 - DNA, 20 bp, mouse
gaagtggtgatttcataaga

SEQ ID NO: 767240 - DNA, 20 bp, mouse
gtgctaataaaaaacttatc

SEQ ID NO: 767241 - DNA, 20 bp, mouse
gacttcactatctgttcctg

SEQ ID NO: 767242 - DNA, 20 bp, mouse
gattattctaagagtaagta

SEQ ID NO: 767243 - DNA, 20 bp, mouse
gcttctatctgaagaaatta

SEQ ID NO: 767244 - DNA, 20 bp, mouse
gtagaataattctcagcacc

SEQ ID NO: 767245 - DNA, 20 bp, mouse
gatttaaagtggatagttgg

SEQ ID NO: 767246 - DNA, 20 bp, mouse
gaaaaccactccgggtgtgg

SEQ ID NO: 767247 - DNA, 20 bp, mouse
gaatatcagagctagtacac

SEQ ID NO: 767248 - DNA, 20 bp, mouse
gacaaaaaccactccgggtg

SEQ ID NO: 767249 - DNA, 20 bp, mouse
ggatatggaaggcaaggaca

SEQ ID NO: 767250 - DNA, 20 bp, mouse
gttgccccaaatgatatgga

SEQ ID NO: 767251 - DNA, 20 bp, mouse
gccacatacaaatatagcta

SEQ ID NO: 767252 - DNA, 20 bp, mouse
gaaaaacaaaagattgtttt

SEQ ID NO: 767253 - DNA, 20 bp, mouse
gccaaatgatatggaaggca

SEQ ID NO: 767254 - DNA, 20 bp, mouse
gaaccttgccccaaatgata

SEQ ID NO: 767255 - DNA, 20 bp, mouse
gtgtgccaccacacccggag

SEQ ID NO: 767256 - DNA, 20 bp, mouse
gaaccatgggatttgagcaa

SEQ ID NO: 767257 - DNA, 20 bp, mouse
gattaaagaaacatagtaat

SEQ ID NO: 767258 - DNA, 20 bp, mouse
gatagctcgagatgaataca

SEQ ID NO: 767259 - DNA, 20 bp, mouse
gttccattgctcaaatccca

SEQ ID NO: 767260 - DNA, 20 bp, mouse
ggggtctgttaaaaatactt

SEQ ID NO: 767261 - DNA, 20 bp, mouse
gagctcactaagttacaaat

SEQ ID NO: 767262 - DNA, 20 bp, mouse
gcacatattcaatagaacca

SEQ ID NO: 767263 - DNA, 20 bp, mouse
gtttatgattctttcaaagc

SEQ ID NO: 767264 - DNA, 20 bp, mouse
gtttctttaattatttcttt

SEQ ID NO: 767265 - DNA, 20 bp, mouse
ggaaaaatgttaatatgctt

SEQ ID NO: 767266 - DNA, 20 bp, mouse
gagaattagaagtagatatt

SEQ ID NO: 767267 - DNA, 20 bp, mouse
gaatctactaatagactgat

SEQ ID NO: 767268 - DNA, 20 bp, mouse
gtaaattagactaaggttta

SEQ ID NO: 767269 - DNA, 20 bp, mouse
gttgttgccttctttattgc

SEQ ID NO: 767270 - DNA, 20 bp, mouse
gtaaaagattttacatgatt

SEQ ID NO: 767271 - DNA, 20 bp, mouse
gtcatgtaaaatcttttatg

SEQ ID NO: 767272 - DNA, 20 bp, mouse
ggttatcacacaatttctta

SEQ ID NO: 767273 - DNA, 20 bp, mouse
gtcctttgagtaaatttatt

SEQ ID NO: 767274 - DNA, 20 bp, mouse
gatagactgatagggaagaa

SEQ ID NO: 767275 - DNA, 20 bp, mouse
gaaagacaaaaatgcaaaag

SEQ ID NO: 767276 - DNA, 20 bp, mouse
gctcaagaatgggaatttct

SEQ ID NO: 767277 - DNA, 20 bp, mouse
gtaaaagtactttgtaaaca

SEQ ID NO: 767278 - DNA, 20 bp, mouse
gaagtcaattaacatggaat

SEQ ID NO: 767279 - DNA, 20 bp, mouse
gtatatgttttgagagacat

SEQ ID NO: 767280 - DNA, 20 bp, mouse
gattcaaaaccctcaagaat

SEQ ID NO: 767281 - DNA, 20 bp, mouse
gcaattaacatggaatcgga

SEQ ID NO: 767282 - DNA, 20 bp, mouse
gggtcttgacactttaaata

SEQ ID NO: 767283 - DNA, 20 bp, mouse
gcagcatttatctatcagaa

SEQ ID NO: 767284 - DNA, 20 bp, mouse
gctattaaagtcaattaaca

SEQ ID NO: 767285 - DNA, 20 bp, mouse
gtaatatcacagaatgcatt

SEQ ID NO: 767286 - DNA, 20 bp, mouse
gccgcggcaccgctcttggc

SEQ ID NO: 767287 - DNA, 20 bp, mouse
ggaacccgcggcaccgctct

SEQ ID NO: 767288 - DNA, 20 bp, mouse
gagcggtgccgcgggttccc

SEQ ID NO: 767289 - DNA, 20 bp, mouse
gtctgttaacaagagacgac

SEQ ID NO: 767290 - DNA, 20 bp, mouse
gcgacgggattggagggaca

SEQ ID NO: 767291 - DNA, 20 bp, mouse
gtcgagtagccggccaagag

SEQ ID NO: 767292 - DNA, 20 bp, mouse
gtaacaagagacgacgggat

SEQ ID NO: 767293 - DNA, 20 bp, mouse
gcaagagacgacgggattgg

SEQ ID NO: 767294 - DNA, 20 bp, mouse
gtagtgacagtaagcgtctt

SEQ ID NO: 767295 - DNA, 20 bp, mouse
ggtggtccctgagaagtcag

SEQ ID NO: 767296 - DNA, 20 bp, mouse
ggattttattgtatgatcta

SEQ ID NO: 767297 - DNA, 20 bp, mouse
ggaacattttctacttagcg

SEQ ID NO: 767298 - DNA, 20 bp, mouse
gctgttaattcagtacttga

SEQ ID NO: 767299 - DNA, 20 bp, mouse
gaagaattgattattatctt

SEQ ID NO: 767300 - DNA, 20 bp, mouse
gttaaaatgtttaaattgtt

SEQ ID NO: 767301 - DNA, 20 bp, mouse
gaaataggcgatatgtagaa

SEQ ID NO: 767302 - DNA, 20 bp, mouse
gaaatgttcaaatgtgatac

SEQ ID NO: 767303 - DNA, 20 bp, mouse
gactaactataatgtataat

SEQ ID NO: 767304 - DNA, 20 bp, mouse
ggaaaatgttcattcaacaa

SEQ ID NO: 767305 - DNA, 20 bp, mouse
ggaggaaggaggggacacta

SEQ ID NO: 767306 - DNA, 20 bp, mouse
gcatacaatgaaaattgaca

SEQ ID NO: 767307 - DNA, 20 bp, mouse
gcattttagttagtgtattg

SEQ ID NO: 767308 - DNA, 20 bp, mouse
gcttttaattcagtaattga

SEQ ID NO: 767309 - DNA, 20 bp, mouse
gaggaggggacactatggtt

SEQ ID NO: 767310 - DNA, 20 bp, mouse
gaatgttcaaatgtgttaca

SEQ ID NO: 767311 - DNA, 20 bp, mouse
gaagaattgattattatctt

SEQ ID NO: 767312 - DNA, 20 bp, mouse
gggattttttgtatgatcaa

SEQ ID NO: 767313 - DNA, 20 bp, mouse
gaaataggcgatatgtaaaa

SEQ ID NO: 767314 - DNA, 20 bp, mouse
ggaaaatgttcattcaacaa

SEQ ID NO: 767315 - DNA, 20 bp, mouse
gactaactaaaatgtataat

SEQ ID NO: 767316 - DNA, 20 bp, mouse
gttagaaatagaaacctatt

SEQ ID NO: 767317 - DNA, 20 bp, mouse
gaaaattttcactcctctag

SEQ ID NO: 767318 - DNA, 20 bp, mouse
gagaaacctattgggctgtg

SEQ ID NO: 767319 - DNA, 20 bp, mouse
ggaaaattagaatccactag

SEQ ID NO: 767320 - DNA, 20 bp, mouse
gcaaaaccacacagcccaat

SEQ ID NO: 767321 - DNA, 20 bp, mouse
ggctgtgtggttttgtttaa

SEQ ID NO: 767322 - DNA, 20 bp, mouse
ggtttctaagactgtttgct

SEQ ID NO: 767323 - DNA, 20 bp, mouse
gagtagcaaatgtatatgat

SEQ ID NO: 767324 - DNA, 20 bp, mouse
gtaagtttaggttaaaacga

SEQ ID NO: 767325 - DNA, 20 bp, mouse
gtatacatttgctactattt

SEQ ID NO: 767326 - DNA, 20 bp, mouse
gcatgtagggaattttttat

SEQ ID NO: 767327 - DNA, 20 bp, mouse
gcaatcacttgcaatgagtt

SEQ ID NO: 767328 - DNA, 20 bp, mouse
gtctgcatgattataaccaa

SEQ ID NO: 767329 - DNA, 20 bp, mouse
gttcaaagtattgacatgta

SEQ ID NO: 767330 - DNA, 20 bp, mouse
gcttgcaatgagtttggtgg

SEQ ID NO: 767331 - DNA, 20 bp, mouse
gtcacttgcaatgagtttgg

SEQ ID NO: 767332 - DNA, 20 bp, mouse
ggacttacttatgatgtatg

SEQ ID NO: 767333 - DNA, 20 bp, mouse
gtgtatgtggcatatattca

SEQ ID NO: 767334 - DNA, 20 bp, mouse
gtttaagtaacaaaaataat

SEQ ID NO: 767335 - DNA, 20 bp, mouse
gattaataaattccagatga

SEQ ID NO: 767336 - DNA, 20 bp, mouse
gttaagttgaatacagtctg

SEQ ID NO: 767337 - DNA, 20 bp, mouse
gtctgaaatatgaatctgta

SEQ ID NO: 767338 - DNA, 20 bp, mouse
gaaatcacttggaatgagtg

SEQ ID NO: 767339 - DNA, 20 bp, mouse
gaatatttttgcactgtgtc

SEQ ID NO: 767340 - DNA, 20 bp, mouse
gccaaaggaagaaaatcact

SEQ ID NO: 767341 - DNA, 20 bp, mouse
gtctgtatgattatagccaa

SEQ ID NO: 767342 - DNA, 20 bp, mouse
gatttcagaatttctaaaag

SEQ ID NO: 767343 - DNA, 20 bp, mouse
gtgcatgtgccatatagtca

SEQ ID NO: 767344 - DNA, 20 bp, mouse
gatctgtatggaatgtttta

SEQ ID NO: 767345 - DNA, 20 bp, mouse
ggtatttcagaagaagaaat

SEQ ID NO: 767346 - DNA, 20 bp, mouse
gaaatggagttcgtgttctc

SEQ ID NO: 767347 - DNA, 20 bp, mouse
gggaaaatatctcctaacat

SEQ ID NO: 767348 - DNA, 20 bp, mouse
gttcaactggcacgtgccat

SEQ ID NO: 767349 - DNA, 20 bp, mouse
gtcaaaatatgggaccctgt

SEQ ID NO: 767350 - DNA, 20 bp, mouse
gggtagatttatcaaaatat

SEQ ID NO: 767351 - DNA, 20 bp, mouse
gccatttgatgcagtcagaa

SEQ ID NO: 767352 - DNA, 20 bp, mouse
gttcctgagatgactggact

SEQ ID NO: 767353 - DNA, 20 bp, mouse
gccctctatgcaacatttac

SEQ ID NO: 767354 - DNA, 20 bp, mouse
gttggtaactgggcttactt

SEQ ID NO: 767355 - DNA, 20 bp, mouse
gcataacacctcttggactc

SEQ ID NO: 767356 - DNA, 20 bp, mouse
gaaccagagttcccttttga

SEQ ID NO: 767357 - DNA, 20 bp, mouse
gttccctcaaaagggaactc

SEQ ID NO: 767358 - DNA, 20 bp, mouse
gtgaagaaccttcgattaga

SEQ ID NO: 767359 - DNA, 20 bp, mouse
gggtttgcactttgtgcata

SEQ ID NO: 767360 - DNA, 20 bp, mouse
ggttaatgcagggttatttc

SEQ ID NO: 767361 - DNA, 20 bp, mouse
gatattatcttccctcaaaa

SEQ ID NO: 767362 - DNA, 20 bp, mouse
gttgatgcacaaaatattta

SEQ ID NO: 767363 - DNA, 20 bp, mouse
gtgggaaaagcaaatttatt

SEQ ID NO: 767364 - DNA, 20 bp, mouse
gtctaaaaccttctaatcga

SEQ ID NO: 767365 - DNA, 20 bp, mouse
gtgtcttttaatatgaactt

SEQ ID NO: 767366 - DNA, 20 bp, mouse
ggttatagggtttgtagaga

SEQ ID NO: 767367 - DNA, 20 bp, mouse
gagaaaagaattgcgttata

SEQ ID NO: 767368 - DNA, 20 bp, mouse
ggtatgatagacatcaaatt

SEQ ID NO: 767369 - DNA, 20 bp, mouse
gtctaatttgagatgtttat

SEQ ID NO: 767370 - DNA, 20 bp, mouse
ggagagagatctataagatt

SEQ ID NO: 767371 - DNA, 20 bp, mouse
gcaaatttgagaaaatatca

SEQ ID NO: 767372 - DNA, 20 bp, mouse
gatatttaagtaactcagaa

SEQ ID NO: 767373 - DNA, 20 bp, mouse
gtggtgcataaaatatttga

SEQ ID NO: 767374 - DNA, 20 bp, mouse
gtataacatacatatgaaat

SEQ ID NO: 767375 - DNA, 20 bp, mouse
ggttagtcagaaagaaaaac

SEQ ID NO: 767376 - DNA, 20 bp, mouse
gtgtcctgaagtaacgtgag

SEQ ID NO: 767377 - DNA, 20 bp, mouse
gaaggtgcagtcctcaggtg

SEQ ID NO: 767378 - DNA, 20 bp, mouse
ggatacaaggtgcagtcctc

SEQ ID NO: 767379 - DNA, 20 bp, mouse
ggttacttcaggacaagttt

SEQ ID NO: 767380 - DNA, 20 bp, mouse
gttacccctcacgttacttc

SEQ ID NO: 767381 - DNA, 20 bp, mouse
gggtaatgaattaaatgatg

SEQ ID NO: 767382 - DNA, 20 bp, mouse
gagcttcaatcaaacactgc

SEQ ID NO: 767383 - DNA, 20 bp, mouse
gaatgataagataccaggta

SEQ ID NO: 767384 - DNA, 20 bp, mouse
ggactgcaccttgtatcaaa

SEQ ID NO: 767385 - DNA, 20 bp, mouse
gtgtcttgttgagtaaaaaa

SEQ ID NO: 767386 - DNA, 20 bp, mouse
gtgcctcagtgagctttacc

SEQ ID NO: 767387 - DNA, 20 bp, mouse
gtgcttacggctgaatatga

SEQ ID NO: 767388 - DNA, 20 bp, mouse
gtcttttattattctgcccc

SEQ ID NO: 767389 - DNA, 20 bp, mouse
gttatcacagtaagtgctta

SEQ ID NO: 767390 - DNA, 20 bp, mouse
gattttaactaggtaaaaaa

SEQ ID NO: 767391 - DNA, 20 bp, mouse
gttttacctagttaaaatct

SEQ ID NO: 767392 - DNA, 20 bp, mouse
gtgttgccaagattttaact

SEQ ID NO: 767393 - DNA, 20 bp, mouse
gagctgagagatagggatat

SEQ ID NO: 767394 - DNA, 20 bp, mouse
gctcttgaatggagcagaac

SEQ ID NO: 767395 - DNA, 20 bp, mouse
gtagcatgacatataagata

SEQ ID NO: 767396 - DNA, 20 bp, mouse
gtgaagagggagtgagtaat

SEQ ID NO: 767397 - DNA, 20 bp, mouse
gatatctggcatttatgcga

SEQ ID NO: 767398 - DNA, 20 bp, mouse
gtgggacaaaaaggctccac

SEQ ID NO: 767399 - DNA, 20 bp, mouse
gataaaatgtcacatttaca

SEQ ID NO: 767400 - DNA, 20 bp, mouse
gggggtcattcttagtcctg

SEQ ID NO: 767401 - DNA, 20 bp, mouse
gtgtggaggggagacccgga

SEQ ID NO: 767402 - DNA, 20 bp, mouse
ggatggtagaggggtgaaga

SEQ ID NO: 767403 - DNA, 20 bp, mouse
gttagagacaaaggggagga

SEQ ID NO: 767404 - DNA, 20 bp, mouse
gcccacccatgtgcattctt

SEQ ID NO: 767405 - DNA, 20 bp, mouse
gtctctgctacatatgtaat

SEQ ID NO: 767406 - DNA, 20 bp, mouse
ggtactagtcacagttagat

SEQ ID NO: 767407 - DNA, 20 bp, mouse
gacttgccttgtgttgttta

SEQ ID NO: 767408 - DNA, 20 bp, mouse
gaaattagatgtaacctatt

SEQ ID NO: 767409 - DNA, 20 bp, mouse
gtctttatgtgaaccaaaca

SEQ ID NO: 767410 - DNA, 20 bp, mouse
gcatttgacaatatatggcc

SEQ ID NO: 767411 - DNA, 20 bp, mouse
gtgcagtctttattttctcc

SEQ ID NO: 767412 - DNA, 20 bp, mouse
gatatgaagtatataaaaat

SEQ ID NO: 767413 - DNA, 20 bp, mouse
gatttgctttttataaaata

SEQ ID NO: 767414 - DNA, 20 bp, mouse
gtctgaccataaacaacaca

SEQ ID NO: 767415 - DNA, 20 bp, mouse
gcctgaattttcaagaagaa

SEQ ID NO: 767416 - DNA, 20 bp, mouse
gtcacctcttacttgccttg

SEQ ID NO: 767417 - DNA, 20 bp, mouse
gctaaaaacctactgcccca

SEQ ID NO: 767418 - DNA, 20 bp, mouse
gtctgactatacaaaccaca

SEQ ID NO: 767419 - DNA, 20 bp, mouse
gatgaaacatataaaagaat

SEQ ID NO: 767420 - DNA, 20 bp, mouse
gaaaccacaaggcaagtaag

SEQ ID NO: 767421 - DNA, 20 bp, mouse
gaagaggtgaattcttcaag

SEQ ID NO: 767422 - DNA, 20 bp, mouse
gaatttgcttttgtgaaata

SEQ ID NO: 767423 - DNA, 20 bp, mouse
gtaaagatccatggggcagt

SEQ ID NO: 767424 - DNA, 20 bp, mouse
gtcttcaagtggaccaaaca

SEQ ID NO: 767425 - DNA, 20 bp, mouse
gcttatatgaatttattttc

SEQ ID NO: 767426 - DNA, 20 bp, mouse
gaatgaggacatcacacact

SEQ ID NO: 767427 - DNA, 20 bp, mouse
gatggggaccattgtcagaa

SEQ ID NO: 767428 - DNA, 20 bp, mouse
gtagtcaaataatagctaca

SEQ ID NO: 767429 - DNA, 20 bp, mouse
gttagtaaacagttcttatg

SEQ ID NO: 767430 - DNA, 20 bp, mouse
gaggtaaggcactgctaatg

SEQ ID NO: 767431 - DNA, 20 bp, mouse
gctctaagaggttggaggta

SEQ ID NO: 767432 - DNA, 20 bp, mouse
ggtggacaaccataatcaaa

SEQ ID NO: 767433 - DNA, 20 bp, mouse
gcctctttactgcctctaag

SEQ ID NO: 767434 - DNA, 20 bp, mouse
gtttactgcctctaagaggt

SEQ ID NO: 767435 - DNA, 20 bp, mouse
gcatcacacacttgggatgc

SEQ ID NO: 767436 - DNA, 20 bp, mouse
ggactgcaacttcatcttgt

SEQ ID NO: 767437 - DNA, 20 bp, mouse
gtgtattgagtattcttctt

SEQ ID NO: 767438 - DNA, 20 bp, mouse
gtatgaaatgcattgatgag

SEQ ID NO: 767439 - DNA, 20 bp, mouse
gattacacacgtgtaaaaca

SEQ ID NO: 767440 - DNA, 20 bp, mouse
gaaatgagcacacttgacta

SEQ ID NO: 767441 - DNA, 20 bp, mouse
gcttggaatgatttcattta

SEQ ID NO: 767442 - DNA, 20 bp, mouse
gtgggaaagacacatttatt

SEQ ID NO: 767443 - DNA, 20 bp, mouse
gtagtacaagtaaaatagag

SEQ ID NO: 767444 - DNA, 20 bp, mouse
gcagatattttaaaattaaa

SEQ ID NO: 767445 - DNA, 20 bp, mouse
gtagtgtgtatttcataact

SEQ ID NO: 767446 - DNA, 20 bp, mouse
gtgcagaaaagctactgagt

SEQ ID NO: 767447 - DNA, 20 bp, mouse
ggtgcaaacaaagttagaaa

SEQ ID NO: 767448 - DNA, 20 bp, mouse
ggcacattgtaaattctccc

SEQ ID NO: 767449 - DNA, 20 bp, mouse
ggaggagcaattaatcttaa

SEQ ID NO: 767450 - DNA, 20 bp, mouse
ggctcctcttcagaggattc

SEQ ID NO: 767451 - DNA, 20 bp, mouse
gcttttctgcattaccacct

SEQ ID NO: 767452 - DNA, 20 bp, mouse
gtcctggaataaagtcttca

SEQ ID NO: 767453 - DNA, 20 bp, mouse
gattaattgctcctcttcag

SEQ ID NO: 767454 - DNA, 20 bp, mouse
gtgatagtcactataatttg

SEQ ID NO: 767455 - DNA, 20 bp, mouse
gattctgagttatttctatg

SEQ ID NO: 767456 - DNA, 20 bp, mouse
gtcatactatatagtaaaat

SEQ ID NO: 767457 - DNA, 20 bp, mouse
gtgaacacttttctgtcaat

SEQ ID NO: 767458 - DNA, 20 bp, mouse
gtttgctaaaaattctgaca

SEQ ID NO: 767459 - DNA, 20 bp, mouse
gtactataaaatgcatatca

SEQ ID NO: 767460 - DNA, 20 bp, mouse
gtactttgaaaatttacact

SEQ ID NO: 767461 - DNA, 20 bp, mouse
gaatgcaatgttcttactgt

SEQ ID NO: 767462 - DNA, 20 bp, mouse
gacaattttgtcattgcttt

SEQ ID NO: 767463 - DNA, 20 bp, mouse
gtttctaatgaatgaaaata

SEQ ID NO: 767464 - DNA, 20 bp, mouse
gaatgaatgaaaatatggca

SEQ ID NO: 767465 - DNA, 20 bp, mouse
gttttcattcattagaaaag

SEQ ID NO: 767466 - DNA, 20 bp, mouse
gcgtactgaacactgataca

SEQ ID NO: 767467 - DNA, 20 bp, mouse
ggatagaagatgctgaaagc

SEQ ID NO: 767468 - DNA, 20 bp, mouse
gcatcaccaactccctatat

SEQ ID NO: 767469 - DNA, 20 bp, mouse
ggatggattcaaagcataac

SEQ ID NO: 767470 - DNA, 20 bp, mouse
gataaagcaattcctatata

SEQ ID NO: 767471 - DNA, 20 bp, mouse
gttcaaagcataacaggatg

SEQ ID NO: 767472 - DNA, 20 bp, mouse
gcttctatcaaatattatcc

SEQ ID NO: 767473 - DNA, 20 bp, mouse
gcaattcctatatagggagt

SEQ ID NO: 767474 - DNA, 20 bp, mouse
gatgaagaacatataaacat

SEQ ID NO: 767475 - DNA, 20 bp, mouse
gtcataatattgaatagata

SEQ ID NO: 767476 - DNA, 20 bp, mouse
ggaaacatcagagagtactg

SEQ ID NO: 767477 - DNA, 20 bp, mouse
gctttggttcaactcctcag

SEQ ID NO: 767478 - DNA, 20 bp, mouse
gatggcaggactagatgaat

SEQ ID NO: 767479 - DNA, 20 bp, mouse
gttgtagcaagatactaaga

SEQ ID NO: 767480 - DNA, 20 bp, mouse
gaaatgaattatgattaaaa

SEQ ID NO: 767481 - DNA, 20 bp, mouse
ggtatgcacaaatataattc

SEQ ID NO: 767482 - DNA, 20 bp, mouse
gaaacacacacacacctctg

SEQ ID NO: 767483 - DNA, 20 bp, mouse
gctattatgtaagacagaaa

SEQ ID NO: 767484 - DNA, 20 bp, mouse
gccagataatctagtcactt

SEQ ID NO: 767485 - DNA, 20 bp, mouse
gtattagctttgcatctttt

SEQ ID NO: 767486 - DNA, 20 bp, mouse
gctctaattaaaattttcat

SEQ ID NO: 767487 - DNA, 20 bp, mouse
gcatggaattcaatgtaata

SEQ ID NO: 767488 - DNA, 20 bp, mouse
gacatcttgcaaacattaca

SEQ ID NO: 767489 - DNA, 20 bp, mouse
gggctcttatcattatagtt

SEQ ID NO: 767490 - DNA, 20 bp, mouse
gttagctagatgttatatgt

SEQ ID NO: 767491 - DNA, 20 bp, mouse
gtaagtctattaatactctc

SEQ ID NO: 767492 - DNA, 20 bp, mouse
gttaaaattttcattgggtg

SEQ ID NO: 767493 - DNA, 20 bp, mouse
ggctagatgttatatgtagg

SEQ ID NO: 767494 - DNA, 20 bp, mouse
ggaagctactttgaatacta

SEQ ID NO: 767495 - DNA, 20 bp, mouse
gaatattaaacatttaaatc

SEQ ID NO: 767496 - DNA, 20 bp, mouse
gtgacagtttacgttttatt

SEQ ID NO: 767497 - DNA, 20 bp, mouse
gtagttttacactaaacatg

SEQ ID NO: 767498 - DNA, 20 bp, mouse
gtggcaaacaaaattattac

SEQ ID NO: 767499 - DNA, 20 bp, mouse
ggaattcatctgcacaaaaa

SEQ ID NO: 767500 - DNA, 20 bp, mouse
gtacatgagcctgccaatca

SEQ ID NO: 767501 - DNA, 20 bp, mouse
gctgataaaccttgattggc

SEQ ID NO: 767502 - DNA, 20 bp, mouse
gaatgctgataaaccttgat

SEQ ID NO: 767503 - DNA, 20 bp, mouse
gtgaaaactactaataatgc

SEQ ID NO: 767504 - DNA, 20 bp, mouse
gatttgaagtatttgacaaa

SEQ ID NO: 767505 - DNA, 20 bp, mouse
gtttagtgtaaaactatgac

SEQ ID NO: 767506 - DNA, 20 bp, mouse
gtttgggcaatacatatttg

SEQ ID NO: 767507 - DNA, 20 bp, mouse
gttagtgtaaaactaagaca

SEQ ID NO: 767508 - DNA, 20 bp, mouse
gtggcaaataaaattattgc

SEQ ID NO: 767509 - DNA, 20 bp, mouse
gtgacagtttatgttttact

SEQ ID NO: 767510 - DNA, 20 bp, mouse
gtacatgagcctgccaatca

SEQ ID NO: 767511 - DNA, 20 bp, mouse
ggaattcatctgcacaaaaa

SEQ ID NO: 767512 - DNA, 20 bp, mouse
gctgataaaccttgattggc

SEQ ID NO: 767513 - DNA, 20 bp, mouse
gaatgctgataaaccttgat

SEQ ID NO: 767514 - DNA, 20 bp, mouse
gtgaaaactactaataatgc

SEQ ID NO: 767515 - DNA, 20 bp, mouse
gatttgaggtatttgacaaa

SEQ ID NO: 767516 - DNA, 20 bp, mouse
gaatttgttgagtgcttctc

SEQ ID NO: 767517 - DNA, 20 bp, mouse
gtacagtcaaacagatttaa

SEQ ID NO: 767518 - DNA, 20 bp, mouse
gcaaagcgagggacaagtct

SEQ ID NO: 767519 - DNA, 20 bp, mouse
gaattatgatagcaaagcga

SEQ ID NO: 767520 - DNA, 20 bp, mouse
gataagctcaaggacttata

SEQ ID NO: 767521 - DNA, 20 bp, mouse
ggtactagttgaggcaacag

SEQ ID NO: 767522 - DNA, 20 bp, mouse
ggcaggatctaaaaccagag

SEQ ID NO: 767523 - DNA, 20 bp, mouse
gaggcaacagtggttatagt

SEQ ID NO: 767524 - DNA, 20 bp, mouse
gatctaatcaagaaacacaa

SEQ ID NO: 767525 - DNA, 20 bp, mouse
gaagaacaatgtactagttg

SEQ ID NO: 767526 - DNA, 20 bp, mouse
gagttaggagaagcaaatat

SEQ ID NO: 767527 - DNA, 20 bp, mouse
gatttaagttaatgttggac

SEQ ID NO: 767528 - DNA, 20 bp, mouse
gtatatgtgtagatgtacat

SEQ ID NO: 767529 - DNA, 20 bp, mouse
ggcagaggcaggcagaattc

SEQ ID NO: 767530 - DNA, 20 bp, mouse
gctctgatttaagttaatgt

SEQ ID NO: 767531 - DNA, 20 bp, mouse
gaggcagaattctgggtttg

SEQ ID NO: 767532 - DNA, 20 bp, mouse
gaaatattggcagataataa

SEQ ID NO: 767533 - DNA, 20 bp, mouse
gatgatataaactcaccaaa

SEQ ID NO: 767534 - DNA, 20 bp, mouse
gatagatttcaagtgccatt

SEQ ID NO: 767535 - DNA, 20 bp, mouse
ggactgctctcaatatagtt

SEQ ID NO: 767536 - DNA, 20 bp, mouse
ggaagagctcacattcgtat

SEQ ID NO: 767537 - DNA, 20 bp, mouse
gagacatacgtatgcatctt

SEQ ID NO: 767538 - DNA, 20 bp, mouse
gagctcttcctttaatctaa

SEQ ID NO: 767539 - DNA, 20 bp, mouse
gggtttataagtagttacta

SEQ ID NO: 767540 - DNA, 20 bp, mouse
gccacatcaaatgtatatca

SEQ ID NO: 767541 - DNA, 20 bp, mouse
gtattgttgctaacaataca

SEQ ID NO: 767542 - DNA, 20 bp, mouse
gatcactaatttgacatatt

SEQ ID NO: 767543 - DNA, 20 bp, mouse
gctcaatttctgttactttt

SEQ ID NO: 767544 - DNA, 20 bp, mouse
gctctgaataaaacagtcat

SEQ ID NO: 767545 - DNA, 20 bp, mouse
gttataaaccattagattaa

SEQ ID NO: 767546 - DNA, 20 bp, mouse
gctaatgagatgatgcctgg

SEQ ID NO: 767547 - DNA, 20 bp, mouse
gagtctaatgagatgatgcc

SEQ ID NO: 767548 - DNA, 20 bp, mouse
gtatttattggtgtctcctg

SEQ ID NO: 767549 - DNA, 20 bp, mouse
gcagagttcacatttcactt

SEQ ID NO: 767550 - DNA, 20 bp, mouse
gctggtaattaattatttat

SEQ ID NO: 767551 - DNA, 20 bp, mouse
ggccatggacactctccctc

SEQ ID NO: 767552 - DNA, 20 bp, mouse
gtgctctccttgttcatcgc

SEQ ID NO: 767553 - DNA, 20 bp, mouse
gacaataccttgcattttta

SEQ ID NO: 767554 - DNA, 20 bp, mouse
gaatcagaatgtgtagtgat

SEQ ID NO: 767555 - DNA, 20 bp, mouse
gagactttctaaaattttgc

SEQ ID NO: 767556 - DNA, 20 bp, mouse
gagagtggtgacactatgga

SEQ ID NO: 767557 - DNA, 20 bp, mouse
gggtgacactatggatggac

SEQ ID NO: 767558 - DNA, 20 bp, mouse
gtggtcacagtaagtcactc

SEQ ID NO: 767559 - DNA, 20 bp, mouse
gttgactgtgatcccttcaa

SEQ ID NO: 767560 - DNA, 20 bp, mouse
ggatgaagctgcaactagag

SEQ ID NO: 767561 - DNA, 20 bp, mouse
gcaaagggaggaacaagact

SEQ ID NO: 767562 - DNA, 20 bp, mouse
gttcaatcaagtaaaacaat

SEQ ID NO: 767563 - DNA, 20 bp, mouse
ggaaactagaacgcaaaggg

SEQ ID NO: 767564 - DNA, 20 bp, mouse
gaactagagtggtgacacta

SEQ ID NO: 767565 - DNA, 20 bp, mouse
gaatagaaactagaacgcaa

SEQ ID NO: 767566 - DNA, 20 bp, mouse
ggataaaaatggagatctgt

SEQ ID NO: 767567 - DNA, 20 bp, mouse
gttatatgaagtaagggata

SEQ ID NO: 767568 - DNA, 20 bp, mouse
gtgtattttatatgaagtaa

SEQ ID NO: 767569 - DNA, 20 bp, mouse
ggaaagctttctattgacta

SEQ ID NO: 767570 - DNA, 20 bp, mouse
gatttgttacatatagtcac

SEQ ID NO: 767571 - DNA, 20 bp, mouse
gaagataatataatgtaata

SEQ ID NO: 767572 - DNA, 20 bp, mouse
gcaagtagctaagataaaaa

SEQ ID NO: 767573 - DNA, 20 bp, mouse
gagactgtccactaattgtc

SEQ ID NO: 767574 - DNA, 20 bp, mouse
ggattcttcctgacaattag

SEQ ID NO: 767575 - DNA, 20 bp, mouse
gactttaaggagtctccctg

SEQ ID NO: 767576 - DNA, 20 bp, mouse
gattcaaaacttactcaaaa

SEQ ID NO: 767577 - DNA, 20 bp, mouse
ggataaaaacggacatctgt

SEQ ID NO: 767578 - DNA, 20 bp, mouse
ggaaagctctctattgacta

SEQ ID NO: 767579 - DNA, 20 bp, mouse
gttatatgaagttagagata

SEQ ID NO: 767580 - DNA, 20 bp, mouse
gagactgtccactaattgtc

SEQ ID NO: 767581 - DNA, 20 bp, mouse
gcaagttgttaagataaaaa

SEQ ID NO: 767582 - DNA, 20 bp, mouse
gactttaaggagtctccctg

SEQ ID NO: 767583 - DNA, 20 bp, mouse
ggattcttcctgacaattag

SEQ ID NO: 767584 - DNA, 20 bp, mouse
gatttgcatggctcacccac

SEQ ID NO: 767585 - DNA, 20 bp, mouse
gttaagtattctgacatttc

SEQ ID NO: 767586 - DNA, 20 bp, mouse
gtgttagaaatcgggaacag

SEQ ID NO: 767587 - DNA, 20 bp, mouse
ggaaatcgggaacagaggtg

SEQ ID NO: 767588 - DNA, 20 bp, mouse
gggcttacagccagttagtc

SEQ ID NO: 767589 - DNA, 20 bp, mouse
ggtgagttccatgaaggcca

SEQ ID NO: 767590 - DNA, 20 bp, mouse
gtgtgtagccctggccttca

SEQ ID NO: 767591 - DNA, 20 bp, mouse
gaacatttgaaattttaaaa

SEQ ID NO: 767592 - DNA, 20 bp, mouse
gtgaattggcactgttcaaa

SEQ ID NO: 767593 - DNA, 20 bp, mouse
gaaacaacatatttactcat

SEQ ID NO: 767594 - DNA, 20 bp, mouse
gagtcaatataaacatgaat

SEQ ID NO: 767595 - DNA, 20 bp, mouse
ggaacagaggtgaggggaaa

SEQ ID NO: 767596 - DNA, 20 bp, mouse
gtatacaggaaaaaacataa

SEQ ID NO: 767597 - DNA, 20 bp, mouse
gattgcttatgactgaaatt

SEQ ID NO: 767598 - DNA, 20 bp, mouse
ggtctgccggtacatagcag

SEQ ID NO: 767599 - DNA, 20 bp, mouse
gagaatcccctgctatgtac

SEQ ID NO: 767600 - DNA, 20 bp, mouse
gaattctggtgcctgtctgc

SEQ ID NO: 767601 - DNA, 20 bp, mouse
gcccctgtccagcataattc

SEQ ID NO: 767602 - DNA, 20 bp, mouse
gaccagaattatgctggaca

SEQ ID NO: 767603 - DNA, 20 bp, mouse
gacaggcaccagaattatgc

SEQ ID NO: 767604 - DNA, 20 bp, mouse
gtttaattaattaattatac

SEQ ID NO: 767605 - DNA, 20 bp, mouse
gtgaattatgaatgatacag

SEQ ID NO: 767606 - DNA, 20 bp, mouse
gggaatggatcttcaggaga

SEQ ID NO: 767607 - DNA, 20 bp, mouse
gctggcctgctttttactaa

SEQ ID NO: 767608 - DNA, 20 bp, mouse
gagtaaaaagcaggccagac

SEQ ID NO: 767609 - DNA, 20 bp, mouse
gtcattgcagaaccacacag

SEQ ID NO: 767610 - DNA, 20 bp, mouse
gaatttgcgtacatatcaca

SEQ ID NO: 767611 - DNA, 20 bp, mouse
gaaaaacatcaaagagacac

SEQ ID NO: 767612 - DNA, 20 bp, mouse
gagtatttttgctctgaatg

SEQ ID NO: 767613 - DNA, 20 bp, mouse
gttcaggatgtaaaatataa

SEQ ID NO: 767614 - DNA, 20 bp, mouse
gactgggagaaatggaagaa

SEQ ID NO: 767615 - DNA, 20 bp, mouse
gagaaggggaaactgagttc

SEQ ID NO: 767616 - DNA, 20 bp, mouse
gacaacaaagttatatgcag

SEQ ID NO: 767617 - DNA, 20 bp, mouse
gtcattgatactgttatata

SEQ ID NO: 767618 - DNA, 20 bp, mouse
gcacgtaaactaatctttca

SEQ ID NO: 767619 - DNA, 20 bp, mouse
gtccctggaagattttaaga

SEQ ID NO: 767620 - DNA, 20 bp, mouse
gtgcaaacattatttataat

SEQ ID NO: 767621 - DNA, 20 bp, mouse
ggttagggattcttcagtgc

SEQ ID NO: 767622 - DNA, 20 bp, mouse
gttcagtgctgggaaaactc

SEQ ID NO: 767623 - DNA, 20 bp, mouse
gataaattcgatcacatgtt

SEQ ID NO: 767624 - DNA, 20 bp, mouse
gtcaatgttaaaatatttga

SEQ ID NO: 767625 - DNA, 20 bp, mouse
gattcatctttatcaagaga

SEQ ID NO: 767626 - DNA, 20 bp, mouse
ggactctatggaggaactta

SEQ ID NO: 767627 - DNA, 20 bp, mouse
gaggactaagccaaatacat

SEQ ID NO: 767628 - DNA, 20 bp, mouse
gaaagcattcaaatcaaggg

SEQ ID NO: 767629 - DNA, 20 bp, mouse
gtagtcaaacaccattttac

SEQ ID NO: 767630 - DNA, 20 bp, mouse
gacataggggcacttttgac

SEQ ID NO: 767631 - DNA, 20 bp, mouse
gcaggttcagaatttatcac

SEQ ID NO: 767632 - DNA, 20 bp, mouse
gaaaagtgcccctatgtatt

SEQ ID NO: 767633 - DNA, 20 bp, mouse
gttgaaagtacgcagactaa

SEQ ID NO: 767634 - DNA, 20 bp, mouse
gtctcaggaactaaaacaga

SEQ ID NO: 767635 - DNA, 20 bp, mouse
ggatttgaatgctttgtgtg

SEQ ID NO: 767636 - DNA, 20 bp, mouse
ggtagagatttcactataag

SEQ ID NO: 767637 - DNA, 20 bp, mouse
gtgtccttctcattacccta

SEQ ID NO: 767638 - DNA, 20 bp, mouse
gctaccatagggtaatgaga

SEQ ID NO: 767639 - DNA, 20 bp, mouse
gagggcatcgtgactaccat

SEQ ID NO: 767640 - DNA, 20 bp, mouse
gaagttgggagtttgtgtag

SEQ ID NO: 767641 - DNA, 20 bp, mouse
gaacatggacacagctttat

SEQ ID NO: 767642 - DNA, 20 bp, mouse
gatttcactataaggggtaa

SEQ ID NO: 767643 - DNA, 20 bp, mouse
ggtgtccatgtttgattctt

SEQ ID NO: 767644 - DNA, 20 bp, mouse
gagtttgtgtagtggcacac

SEQ ID NO: 767645 - DNA, 20 bp, mouse
gacagtagcatacctgaatg

SEQ ID NO: 767646 - DNA, 20 bp, mouse
gtctagaaagaatagctgta

SEQ ID NO: 767647 - DNA, 20 bp, mouse
gctgtcttatcctaagattt

SEQ ID NO: 767648 - DNA, 20 bp, mouse
gaaaatagtaccgaattaaa

SEQ ID NO: 767649 - DNA, 20 bp, mouse
ggggatcttcctgaacaacc

SEQ ID NO: 767650 - DNA, 20 bp, mouse
ggatagaaaaatggtgatgg

SEQ ID NO: 767651 - DNA, 20 bp, mouse
gtggatcatgtattgagacc

SEQ ID NO: 767652 - DNA, 20 bp, mouse
gtagcaacaatcttcttcaa

SEQ ID NO: 767653 - DNA, 20 bp, mouse
gttctttctagagtactgat

SEQ ID NO: 767654 - DNA, 20 bp, mouse
gattcggtactattttatta

SEQ ID NO: 767655 - DNA, 20 bp, mouse
gtcttcatcaaaagtttcaa

SEQ ID NO: 767656 - DNA, 20 bp, mouse
gacacatagtatatataagt

SEQ ID NO: 767657 - DNA, 20 bp, mouse
gagtaaacttgcttggaaat

SEQ ID NO: 767658 - DNA, 20 bp, mouse
gaaaactttaaaatatggca

SEQ ID NO: 767659 - DNA, 20 bp, mouse
gtgtgccaagtaaacttgct

SEQ ID NO: 767660 - DNA, 20 bp, mouse
gtaaatatctgtacagtttt

SEQ ID NO: 767661 - DNA, 20 bp, mouse
gtacagttttgggtcactgc

SEQ ID NO: 767662 - DNA, 20 bp, mouse
gctttaagattaattaagcc

SEQ ID NO: 767663 - DNA, 20 bp, mouse
gaaaattcattttttctata

SEQ ID NO: 767664 - DNA, 20 bp, mouse
gaaattaatcattcttttcc

SEQ ID NO: 767665 - DNA, 20 bp, mouse
gggtttacatatattgaatt

SEQ ID NO: 767666 - DNA, 20 bp, mouse
gtatctgtttatttcagatt

SEQ ID NO: 767667 - DNA, 20 bp, mouse
gagataaaacaattattaga

SEQ ID NO: 767668 - DNA, 20 bp, mouse
gcagaattataaatagactc

SEQ ID NO: 767669 - DNA, 20 bp, mouse
gaaacacttttctgaaattc

SEQ ID NO: 767670 - DNA, 20 bp, mouse
gatgtaactgattgaataga

SEQ ID NO: 767671 - DNA, 20 bp, mouse
gatgtaaaatattgcactta

SEQ ID NO: 767672 - DNA, 20 bp, mouse
gaaagatcaaattaattaag

SEQ ID NO: 767673 - DNA, 20 bp, mouse
gaatagtacttttgtaaatt

SEQ ID NO: 767674 - DNA, 20 bp, mouse
gtttgtacataagtgtttaa

SEQ ID NO: 767675 - DNA, 20 bp, mouse
gtgagtacatgataagattt

SEQ ID NO: 767676 - DNA, 20 bp, mouse
gtctgcaggagccaatttga

SEQ ID NO: 767677 - DNA, 20 bp, mouse
gaatttgaaggaagtttact

SEQ ID NO: 767678 - DNA, 20 bp, mouse
gtgtatagttgtacagtttt

SEQ ID NO: 767679 - DNA, 20 bp, mouse
gtatgcagtattgagtactg

SEQ ID NO: 767680 - DNA, 20 bp, mouse
gaaactacatttatttctat

SEQ ID NO: 767681 - DNA, 20 bp, mouse
gaaggaggaaaggcatgaac

SEQ ID NO: 767682 - DNA, 20 bp, mouse
gtttaagattaaattaagcc

SEQ ID NO: 767683 - DNA, 20 bp, mouse
gattatatcatgaaattatt

SEQ ID NO: 767684 - DNA, 20 bp, mouse
gtgttcaaatatattgaatt

SEQ ID NO: 767685 - DNA, 20 bp, mouse
gaaattaatcatcattttcc

SEQ ID NO: 767686 - DNA, 20 bp, mouse
gagtttagaggtgtgggcat

SEQ ID NO: 767687 - DNA, 20 bp, mouse
gttcctgctaatagctaggt

SEQ ID NO: 767688 - DNA, 20 bp, mouse
ggataacagttaaaaaaatg

SEQ ID NO: 767689 - DNA, 20 bp, mouse
ggctttcagtttagaggtgt

SEQ ID NO: 767690 - DNA, 20 bp, mouse
gttgaaaacatttatgcaac

SEQ ID NO: 767691 - DNA, 20 bp, mouse
gttcctacctagctattagc

SEQ ID NO: 767692 - DNA, 20 bp, mouse
gaaaaagtaaattcctcatt

SEQ ID NO: 767693 - DNA, 20 bp, mouse
gttagaattatttaagtaac

SEQ ID NO: 767694 - DNA, 20 bp, mouse
gaatttagctttcagtttag

SEQ ID NO: 767695 - DNA, 20 bp, mouse
gataaatgttttcaaatgtg

SEQ ID NO: 767696 - DNA, 20 bp, mouse
ggagaccttgaagtcacagt

SEQ ID NO: 767697 - DNA, 20 bp, mouse
gattagatggggagacataa

SEQ ID NO: 767698 - DNA, 20 bp, mouse
gtcagtgttctgtgctggca

SEQ ID NO: 767699 - DNA, 20 bp, mouse
gctcatctttggacaaaaat

SEQ ID NO: 767700 - DNA, 20 bp, mouse
gtattttattcctctgatac

SEQ ID NO: 767701 - DNA, 20 bp, mouse
gtacatttaaattgtgacta

SEQ ID NO: 767702 - DNA, 20 bp, mouse
gtctctgcaggcaaattcat

SEQ ID NO: 767703 - DNA, 20 bp, mouse
gaagagaaaaggggaagtgt

SEQ ID NO: 767704 - DNA, 20 bp, mouse
gaaagccacagtctcatctt

SEQ ID NO: 767705 - DNA, 20 bp, mouse
gttgtccaaagatgagactg

SEQ ID NO: 767706 - DNA, 20 bp, mouse
ggaccaggatacaatagagg

SEQ ID NO: 767707 - DNA, 20 bp, mouse
ggaggatgaacaaatattga

SEQ ID NO: 767708 - DNA, 20 bp, mouse
gtttgaccaggatacaatag

SEQ ID NO: 767709 - DNA, 20 bp, mouse
gtaccacctctattgtatcc

SEQ ID NO: 767710 - DNA, 20 bp, mouse
ggtattggatatttgtctat

SEQ ID NO: 767711 - DNA, 20 bp, mouse
gatattctttttatactatg

SEQ ID NO: 767712 - DNA, 20 bp, mouse
gtagaaaactagtcatatac

SEQ ID NO: 767713 - DNA, 20 bp, mouse
gtaatgaaaaattatctgta

SEQ ID NO: 767714 - DNA, 20 bp, mouse
gaaatatccaatactaatta

SEQ ID NO: 767715 - DNA, 20 bp, mouse
gttctagcttcttcatttac

SEQ ID NO: 767716 - DNA, 20 bp, mouse
gaaggtatgtgttcatgctc

SEQ ID NO: 767717 - DNA, 20 bp, mouse
gaaaataagtaattgaatgc

SEQ ID NO: 767718 - DNA, 20 bp, mouse
ggtagtataagctggaaact

SEQ ID NO: 767719 - DNA, 20 bp, mouse
gaattgtgaggatgactttc

SEQ ID NO: 767720 - DNA, 20 bp, mouse
ggtgcaaatactgaatgtac

SEQ ID NO: 767721 - DNA, 20 bp, mouse
gtcagttgataactgaaagg

SEQ ID NO: 767722 - DNA, 20 bp, mouse
gcaagagtagtagtataagc

SEQ ID NO: 767723 - DNA, 20 bp, mouse
gtcaatgaaaatcaaagttg

SEQ ID NO: 767724 - DNA, 20 bp, mouse
gactgatggtataaatgccc

SEQ ID NO: 767725 - DNA, 20 bp, mouse
gagactgttaaaacaaaaaa

SEQ ID NO: 767726 - DNA, 20 bp, mouse
gtgaagaaagattgattgtc

SEQ ID NO: 767727 - DNA, 20 bp, mouse
gtctaacacttccatgagtg

SEQ ID NO: 767728 - DNA, 20 bp, mouse
gcgagttaacgtaactgcat

SEQ ID NO: 767729 - DNA, 20 bp, mouse
gacaaattaacaattgatga

SEQ ID NO: 767730 - DNA, 20 bp, mouse
gatactagtgtgagattaat

SEQ ID NO: 767731 - DNA, 20 bp, mouse
gtgcttttgtgacaaaagta

SEQ ID NO: 767732 - DNA, 20 bp, mouse
gttgtcattggtgagaatgt

SEQ ID NO: 767733 - DNA, 20 bp, mouse
gaacagttatgtttgaattg

SEQ ID NO: 767734 - DNA, 20 bp, mouse
ggtatggcataaattactta

SEQ ID NO: 767735 - DNA, 20 bp, mouse
gaagccagaaaaaaataaag

SEQ ID NO: 767736 - DNA, 20 bp, mouse
ggcacctaacacttcttcag

SEQ ID NO: 767737 - DNA, 20 bp, mouse
ggggttgttggaaatctgga

SEQ ID NO: 767738 - DNA, 20 bp, mouse
gtccctggaaaagccagata

SEQ ID NO: 767739 - DNA, 20 bp, mouse
gtcaaaagatttgacaacca

SEQ ID NO: 767740 - DNA, 20 bp, mouse
gaaccctatctggcttttcc

SEQ ID NO: 767741 - DNA, 20 bp, mouse
gtttccagggatcttcattc

SEQ ID NO: 767742 - DNA, 20 bp, mouse
ggatagggttgttggaaatc

SEQ ID NO: 767743 - DNA, 20 bp, mouse
ggtacctgaatgaagatccc

SEQ ID NO: 767744 - DNA, 20 bp, mouse
gggtggtgttcaccaaactc

SEQ ID NO: 767745 - DNA, 20 bp, mouse
gggtgaacaccacccacatc

SEQ ID NO: 767746 - DNA, 20 bp, mouse
gtgatgagagccaagaaaaa

SEQ ID NO: 767747 - DNA, 20 bp, mouse
gagggaagagagatgtgatc

SEQ ID NO: 767748 - DNA, 20 bp, mouse
gccctccacccctccgaaat

SEQ ID NO: 767749 - DNA, 20 bp, mouse
gctggtagagttcagttaat

SEQ ID NO: 767750 - DNA, 20 bp, mouse
gtgacatttaccaatttcgg

SEQ ID NO: 767751 - DNA, 20 bp, mouse
ggtaaatgttcactactgaa

SEQ ID NO: 767752 - DNA, 20 bp, mouse
gattaggattatgtgttaga

SEQ ID NO: 767753 - DNA, 20 bp, mouse
ggagttcagttaatgggtct

SEQ ID NO: 767754 - DNA, 20 bp, mouse
gaaaaaatgttctcttggac

SEQ ID NO: 767755 - DNA, 20 bp, mouse
ggtctacaagctgtaatctc

SEQ ID NO: 767756 - DNA, 20 bp, mouse
gtcccctttttagcattcat

SEQ ID NO: 767757 - DNA, 20 bp, mouse
gtccccatgaatgctaaaaa

SEQ ID NO: 767758 - DNA, 20 bp, mouse
gcttataagtaggaaaatca

SEQ ID NO: 767759 - DNA, 20 bp, mouse
gggcgagagaagacatccaa

SEQ ID NO: 767760 - DNA, 20 bp, mouse
gaatttgtatacttataagt

SEQ ID NO: 767761 - DNA, 20 bp, mouse
gaatttagcatttttactag

SEQ ID NO: 767762 - DNA, 20 bp, mouse
gaaggtgtatcactacagcc

SEQ ID NO: 767763 - DNA, 20 bp, mouse
gtctagcagtgtggctatga

SEQ ID NO: 767764 - DNA, 20 bp, mouse
gtgtttaagtataatactta

SEQ ID NO: 767765 - DNA, 20 bp, mouse
gacactttcaaaaactataa

SEQ ID NO: 767766 - DNA, 20 bp, mouse
gacactatgggctactgctg

SEQ ID NO: 767767 - DNA, 20 bp, mouse
gtatatcccacctatgtaga

SEQ ID NO: 767768 - DNA, 20 bp, mouse
gagctcttgtagcacactat

SEQ ID NO: 767769 - DNA, 20 bp, mouse
gttgtcaattaactcagaat

SEQ ID NO: 767770 - DNA, 20 bp, mouse
gtattgtgaaaattgggtat

SEQ ID NO: 767771 - DNA, 20 bp, mouse
gtaaggctctaactataaga

SEQ ID NO: 767772 - DNA, 20 bp, mouse
gaagaatcttcaaacatcct

SEQ ID NO: 767773 - DNA, 20 bp, mouse
gtgagtaggtttagattaac

SEQ ID NO: 767774 - DNA, 20 bp, mouse
gatttttcagccttctacat

SEQ ID NO: 767775 - DNA, 20 bp, mouse
gttcagccttctacataggt

SEQ ID NO: 767776 - DNA, 20 bp, mouse
ggaggtgatgtatatggata

SEQ ID NO: 767777 - DNA, 20 bp, mouse
gtttgtgtgtcacacaatga

SEQ ID NO: 767778 - DNA, 20 bp, mouse
gttcctatattaggtatcat

SEQ ID NO: 767779 - DNA, 20 bp, mouse
ggaccaatgatacctaatat

SEQ ID NO: 767780 - DNA, 20 bp, mouse
gtgtcagacatctaggcaaa

SEQ ID NO: 767781 - DNA, 20 bp, mouse
gctggctaggttcctatatt

SEQ ID NO: 767782 - DNA, 20 bp, mouse
gagattttatatcacacata

SEQ ID NO: 767783 - DNA, 20 bp, mouse
gaaatgtgtgtcagacatct

SEQ ID NO: 767784 - DNA, 20 bp, mouse
gaaattgaacaagaacgtga

SEQ ID NO: 767785 - DNA, 20 bp, mouse
gatatttgaggtgatgtata

SEQ ID NO: 767786 - DNA, 20 bp, mouse
gcacatatatcttgagaggc

SEQ ID NO: 767787 - DNA, 20 bp, mouse
gtccataggaacttgattcc

SEQ ID NO: 767788 - DNA, 20 bp, mouse
gatatcttgagaggcaggta

SEQ ID NO: 767789 - DNA, 20 bp, mouse
gcccaggaatcaagttccta

SEQ ID NO: 767790 - DNA, 20 bp, mouse
gaaactgagaaagatcacag

SEQ ID NO: 767791 - DNA, 20 bp, mouse
gcaaagaactgcttcattcg

SEQ ID NO: 767792 - DNA, 20 bp, mouse
gcagtgggattctattttta

SEQ ID NO: 767793 - DNA, 20 bp, mouse
gcagtatccaatgtagtcgg

SEQ ID NO: 767794 - DNA, 20 bp, mouse
ggttagtattatatatccat

SEQ ID NO: 767795 - DNA, 20 bp, mouse
ggtagttcacaaaaagtgag

SEQ ID NO: 767796 - DNA, 20 bp, mouse
ggtcatgaagagttgccctg

SEQ ID NO: 767797 - DNA, 20 bp, mouse
gttagaacacaaattgacta

SEQ ID NO: 767798 - DNA, 20 bp, mouse
gaaatccagagtgtggtata

SEQ ID NO: 767799 - DNA, 20 bp, mouse
gatagggaataaactaatgt

SEQ ID NO: 767800 - DNA, 20 bp, mouse
gcaactcttcatgaccatga

SEQ ID NO: 767801 - DNA, 20 bp, mouse
gggtgacatggtcctgaagt

SEQ ID NO: 767802 - DNA, 20 bp, mouse
gacactgaatggttgcttac

SEQ ID NO: 767803 - DNA, 20 bp, mouse
gtcacttaaggactataaaa

SEQ ID NO: 767804 - DNA, 20 bp, mouse
gagtcggtgtgtaatttcca

SEQ ID NO: 767805 - DNA, 20 bp, mouse
gtctgtcataattgataata

SEQ ID NO: 767806 - DNA, 20 bp, mouse
ggaggagaaaacaaggacat

SEQ ID NO: 767807 - DNA, 20 bp, mouse
gccatgttggagttacaatt

SEQ ID NO: 767808 - DNA, 20 bp, mouse
gcagcaatgtaaagttctct

SEQ ID NO: 767809 - DNA, 20 bp, mouse
ggtccttgttttctcctcta

SEQ ID NO: 767810 - DNA, 20 bp, mouse
gtctatgtactgttgcttta

SEQ ID NO: 767811 - DNA, 20 bp, mouse
gtgctttatggttatggggt

SEQ ID NO: 767812 - DNA, 20 bp, mouse
gaaatatattttgataagtg

SEQ ID NO: 767813 - DNA, 20 bp, mouse
gtaattataggatttaaagc

SEQ ID NO: 767814 - DNA, 20 bp, mouse
gaacaacagaacaataaaca

SEQ ID NO: 767815 - DNA, 20 bp, mouse
gtgcctaaatgaaataatgt

SEQ ID NO: 767816 - DNA, 20 bp, mouse
gggataggcagtctgaacta

SEQ ID NO: 767817 - DNA, 20 bp, mouse
gaaatacacaaacacaggag

SEQ ID NO: 767818 - DNA, 20 bp, mouse
gcctacttcctatattttat

SEQ ID NO: 767819 - DNA, 20 bp, mouse
gaataaaggcaaataatgaa

SEQ ID NO: 767820 - DNA, 20 bp, mouse
gagcaactgcttatagccaa

SEQ ID NO: 767821 - DNA, 20 bp, mouse
ggttcagactgcctatccct

SEQ ID NO: 767822 - DNA, 20 bp, mouse
gctgcttatagccaagggat

SEQ ID NO: 767823 - DNA, 20 bp, mouse
gaccactcaattccttacct

SEQ ID NO: 767824 - DNA, 20 bp, mouse
gtcatacaaatcaatatgac

SEQ ID NO: 767825 - DNA, 20 bp, mouse
gttgagttgtatcccaggta

SEQ ID NO: 767826 - DNA, 20 bp, mouse
ggaaactcttatcctgtcac

SEQ ID NO: 767827 - DNA, 20 bp, mouse
gtggatatatagagagacaa

SEQ ID NO: 767828 - DNA, 20 bp, mouse
gatcagaagcataatccatg

SEQ ID NO: 767829 - DNA, 20 bp, mouse
gcagcaagatcaaatccaca

SEQ ID NO: 767830 - DNA, 20 bp, mouse
gcaatctcacatgcagcatg

SEQ ID NO: 767831 - DNA, 20 bp, mouse
gcatgcagcatgaggtaaac

SEQ ID NO: 767832 - DNA, 20 bp, mouse
gtgagttccaaactttaaaa

SEQ ID NO: 767833 - DNA, 20 bp, mouse
gcagtctttataacttctaa

SEQ ID NO: 767834 - DNA, 20 bp, mouse
ggaattttattgatataact

SEQ ID NO: 767835 - DNA, 20 bp, mouse
gtgtagtcctttttaaagtt

SEQ ID NO: 767836 - DNA, 20 bp, mouse
gctgaggctatggatatgga

SEQ ID NO: 767837 - DNA, 20 bp, mouse
gatagtggaacagcaagatc

SEQ ID NO: 767838 - DNA, 20 bp, mouse
ggaaactcttatcctgtccc

SEQ ID NO: 767839 - DNA, 20 bp, mouse
ggacaagtggtttgaagaaa

SEQ ID NO: 767840 - DNA, 20 bp, mouse
gaattctgaggctatggata

SEQ ID NO: 767841 - DNA, 20 bp, mouse
gcagcaagatcaggttcaca

SEQ ID NO: 767842 - DNA, 20 bp, mouse
gttaagatcttcatctgcca

SEQ ID NO: 767843 - DNA, 20 bp, mouse
gggatatggagggggacaag

SEQ ID NO: 767844 - DNA, 20 bp, mouse
ggatgagtaatattttcaaa

SEQ ID NO: 767845 - DNA, 20 bp, mouse
gaatgattacatacacagaa

SEQ ID NO: 767846 - DNA, 20 bp, mouse
gtaacagaatcatctctcag

SEQ ID NO: 767847 - DNA, 20 bp, mouse
gtaaaaaaattcattgattt

SEQ ID NO: 767848 - DNA, 20 bp, mouse
ggaatctgagttaaacaaat

SEQ ID NO: 767849 - DNA, 20 bp, mouse
gggcataatcgagaataaaa

SEQ ID NO: 767850 - DNA, 20 bp, mouse
gttctcgattatgccaagta

SEQ ID NO: 767851 - DNA, 20 bp, mouse
gctctcattgaaatattaaa

SEQ ID NO: 767852 - DNA, 20 bp, mouse
gaatttactagtgtatacta

SEQ ID NO: 767853 - DNA, 20 bp, mouse
gcttaagataactgaatcat

SEQ ID NO: 767854 - DNA, 20 bp, mouse
gtgcaaggtaaaattctttg

SEQ ID NO: 767855 - DNA, 20 bp, mouse
ggcagttacaaaaacttgca

SEQ ID NO: 767856 - DNA, 20 bp, mouse
gccaaagagcatctagtcat

SEQ ID NO: 767857 - DNA, 20 bp, mouse
ggaagacccagaagaattga

SEQ ID NO: 767858 - DNA, 20 bp, mouse
gctggctccttcaattcttc

SEQ ID NO: 767859 - DNA, 20 bp, mouse
gtatgaagacaaagtgtagg

SEQ ID NO: 767860 - DNA, 20 bp, mouse
gacttcccagagactctggt

SEQ ID NO: 767861 - DNA, 20 bp, mouse
gcttacaaaaccagggccta

SEQ ID NO: 767862 - DNA, 20 bp, mouse
gtaagaagccttacaaaacc

SEQ ID NO: 767863 - DNA, 20 bp, mouse
ggatactcagctatggttgc

SEQ ID NO: 767864 - DNA, 20 bp, mouse
gtcagtgctggggcaccatc

SEQ ID NO: 767865 - DNA, 20 bp, mouse
ggaaggagccagaagtgtca

SEQ ID NO: 767866 - DNA, 20 bp, mouse
gagtaggtgatcattgaaaa

SEQ ID NO: 767867 - DNA, 20 bp, mouse
gagaaaactgcataacagta

SEQ ID NO: 767868 - DNA, 20 bp, mouse
ggtgaggaggatctagaatg

SEQ ID NO: 767869 - DNA, 20 bp, mouse
gtgtggtaaactgtattatc

SEQ ID NO: 767870 - DNA, 20 bp, mouse
gagaatgaggtgaccaaaat

SEQ ID NO: 767871 - DNA, 20 bp, mouse
ggtttgattgtagaacagtg

SEQ ID NO: 767872 - DNA, 20 bp, mouse
gacaatgttttaaccaattt

SEQ ID NO: 767873 - DNA, 20 bp, mouse
gtagtatgattttcaagttt

SEQ ID NO: 767874 - DNA, 20 bp, mouse
gcattttgttttacttagac

SEQ ID NO: 767875 - DNA, 20 bp, mouse
ggtattatcaggtactagat

SEQ ID NO: 767876 - DNA, 20 bp, mouse
gagacactgagaaaaggaca

SEQ ID NO: 767877 - DNA, 20 bp, mouse
gtatatcaaggccgagaata

SEQ ID NO: 767878 - DNA, 20 bp, mouse
ggtttctgaatgatatatca

SEQ ID NO: 767879 - DNA, 20 bp, mouse
ggacaactaggagaataaaa

SEQ ID NO: 767880 - DNA, 20 bp, mouse
gtataaattatatcaggtag

SEQ ID NO: 767881 - DNA, 20 bp, mouse
gattgctttgtgataatctt

SEQ ID NO: 767882 - DNA, 20 bp, mouse
gaaggaatataaattatatc

SEQ ID NO: 767883 - DNA, 20 bp, mouse
ggtgtcattatgccattaaa

SEQ ID NO: 767884 - DNA, 20 bp, mouse
gattatttaaatatctaaag

SEQ ID NO: 767885 - DNA, 20 bp, mouse
gtaatttatattccttttaa

SEQ ID NO: 767886 - DNA, 20 bp, mouse
gagctactgagtgcctagag

SEQ ID NO: 767887 - DNA, 20 bp, mouse
gttaataagaacatattgta

SEQ ID NO: 767888 - DNA, 20 bp, mouse
gcaagtaaatacatagggtg

SEQ ID NO: 767889 - DNA, 20 bp, mouse
gaaaataaatcttatgtcct

SEQ ID NO: 767890 - DNA, 20 bp, mouse
gtatccagtgggcaacctgc

SEQ ID NO: 767891 - DNA, 20 bp, mouse
ggaaatccaagtaaatacat

SEQ ID NO: 767892 - DNA, 20 bp, mouse
gcagccagcaggttgcccac

SEQ ID NO: 767893 - DNA, 20 bp, mouse
gctatgactggaggaatcat

SEQ ID NO: 767894 - DNA, 20 bp, mouse
gtactgagtgcctagagagg

SEQ ID NO: 767895 - DNA, 20 bp, mouse
gatgtgattaaaatgaaccc

SEQ ID NO: 767896 - DNA, 20 bp, mouse
gctaatctatgcatcttgtt

SEQ ID NO: 767897 - DNA, 20 bp, mouse
gatgatatgtagatattgag

SEQ ID NO: 767898 - DNA, 20 bp, mouse
gatatgtagatattgagtgg

SEQ ID NO: 767899 - DNA, 20 bp, mouse
gaaacaataaaattttgata

SEQ ID NO: 767900 - DNA, 20 bp, mouse
gtatactattttatcagatt

SEQ ID NO: 767901 - DNA, 20 bp, mouse
gagaaaataagattcacatt

SEQ ID NO: 767902 - DNA, 20 bp, mouse
gaatatagttgaaatggtaa

SEQ ID NO: 767903 - DNA, 20 bp, mouse
gtagtataggtcttattact

SEQ ID NO: 767904 - DNA, 20 bp, mouse
gaaccaaggtcactaattgt

SEQ ID NO: 767905 - DNA, 20 bp, mouse
gaagaaagagacaaatttga

SEQ ID NO: 767906 - DNA, 20 bp, mouse
gaggtaggtaaaattattca

SEQ ID NO: 767907 - DNA, 20 bp, mouse
gttacaaggcctctgctgtc

SEQ ID NO: 767908 - DNA, 20 bp, mouse
gatagtagatgaagtatatc

SEQ ID NO: 767909 - DNA, 20 bp, mouse
gtaaaagcctctcacactag

SEQ ID NO: 767910 - DNA, 20 bp, mouse
gtatacagccataatacatt

SEQ ID NO: 767911 - DNA, 20 bp, mouse
gactatgttccagacagcag

SEQ ID NO: 767912 - DNA, 20 bp, mouse
gttggtttgtgtgccataag

SEQ ID NO: 767913 - DNA, 20 bp, mouse
gtagatgaagtatatcaggt

SEQ ID NO: 767914 - DNA, 20 bp, mouse
gatcctgacaatcttttcat

SEQ ID NO: 767915 - DNA, 20 bp, mouse
gaactattagaaaccactta

SEQ ID NO: 767916 - DNA, 20 bp, mouse
gaccaaacattatatgccca

SEQ ID NO: 767917 - DNA, 20 bp, mouse
ggcatataatgtttggtcat

SEQ ID NO: 767918 - DNA, 20 bp, mouse
ggcaggctgccacattacat

SEQ ID NO: 767919 - DNA, 20 bp, mouse
gttatgggttttaggggttt

SEQ ID NO: 767920 - DNA, 20 bp, mouse
gctaaatgttatgggtttta

SEQ ID NO: 767921 - DNA, 20 bp, mouse
gctaatatactaaatgttat

SEQ ID NO: 767922 - DNA, 20 bp, mouse
gcggtttaaaaagctctcca

SEQ ID NO: 767923 - DNA, 20 bp, mouse
gtatgaaattattgaatagc

SEQ ID NO: 767924 - DNA, 20 bp, mouse
gtatttattttcttcttgta

SEQ ID NO: 767925 - DNA, 20 bp, mouse
gtaagattgattttaataca

SEQ ID NO: 767926 - DNA, 20 bp, mouse
gctagcctatatatagaggg

SEQ ID NO: 767927 - DNA, 20 bp, mouse
gtgtgtatgaattagactat

SEQ ID NO: 767928 - DNA, 20 bp, mouse
ggtttcccccctctatatat

SEQ ID NO: 767929 - DNA, 20 bp, mouse
gcttcctagcctatatatag

SEQ ID NO: 767930 - DNA, 20 bp, mouse
ggcatttcttgtatctgcat

SEQ ID NO: 767931 - DNA, 20 bp, mouse
gctcggtcttttctgttaac

SEQ ID NO: 767932 - DNA, 20 bp, mouse
gtatttgtttggacatcatg

SEQ ID NO: 767933 - DNA, 20 bp, mouse
gagatagaaaaggttacttt

SEQ ID NO: 767934 - DNA, 20 bp, mouse
gtagtgcaatgatatttgtt

SEQ ID NO: 767935 - DNA, 20 bp, mouse
ggtgttcataatcagactct

SEQ ID NO: 767936 - DNA, 20 bp, mouse
gggagtttgatagtgggacc

SEQ ID NO: 767937 - DNA, 20 bp, mouse
gttttgtggagtttgatagt

SEQ ID NO: 767938 - DNA, 20 bp, mouse
gagaataaaattaatttacc

SEQ ID NO: 767939 - DNA, 20 bp, mouse
gcaataaaggaaaacatttt

SEQ ID NO: 767940 - DNA, 20 bp, mouse
gtaaaataagagtataggaa

SEQ ID NO: 767941 - DNA, 20 bp, mouse
gttacttaaaataagagtat

SEQ ID NO: 767942 - DNA, 20 bp, mouse
gggcaatggaaatgtcgaaa

SEQ ID NO: 767943 - DNA, 20 bp, mouse
gacacgatgaaatgaatcca

SEQ ID NO: 767944 - DNA, 20 bp, mouse
ggtgtattagaaaatattat

SEQ ID NO: 767945 - DNA, 20 bp, mouse
gaaaattggggatatatata

SEQ ID NO: 767946 - DNA, 20 bp, mouse
gtttaaaaaatgtgatataa

SEQ ID NO: 767947 - DNA, 20 bp, mouse
gagaataaaactaatttaac

SEQ ID NO: 767948 - DNA, 20 bp, mouse
gttattcttttaagctacat

SEQ ID NO: 767949 - DNA, 20 bp, mouse
gtatctgtcatcttctttaa

SEQ ID NO: 767950 - DNA, 20 bp, mouse
gtaaaataagagtataggaa

SEQ ID NO: 767951 - DNA, 20 bp, mouse
gttacttaaaataagagtat

SEQ ID NO: 767952 - DNA, 20 bp, mouse
gggcaatggaaatgtcgaaa

SEQ ID NO: 767953 - DNA, 20 bp, mouse
ggtgtattagaaaatattat

SEQ ID NO: 767954 - DNA, 20 bp, mouse
gacagaaacaatagcaataa

SEQ ID NO: 767955 - DNA, 20 bp, mouse
ggacatttccattgcccttg

SEQ ID NO: 767956 - DNA, 20 bp, mouse
ggggaaggaatgtttcccca

SEQ ID NO: 767957 - DNA, 20 bp, mouse
gttagaatgtatcatgggga

SEQ ID NO: 767958 - DNA, 20 bp, mouse
ggtaaatgcacatgtgaaat

SEQ ID NO: 767959 - DNA, 20 bp, mouse
gcatttacatgcattgacat

SEQ ID NO: 767960 - DNA, 20 bp, mouse
gaggattatcttcttaatca

SEQ ID NO: 767961 - DNA, 20 bp, mouse
gtgaattagaatgtatcatg

SEQ ID NO: 767962 - DNA, 20 bp, mouse
gtatgcattgtgtctatgtt

SEQ ID NO: 767963 - DNA, 20 bp, mouse
gtgttgtttatctgaatatc

SEQ ID NO: 767964 - DNA, 20 bp, mouse
gaaaaataaaatgaaactga

SEQ ID NO: 767965 - DNA, 20 bp, mouse
gaaagaatatataaattaaa

SEQ ID NO: 767966 - DNA, 20 bp, mouse
gtaaagtaatggacacctaa

SEQ ID NO: 767967 - DNA, 20 bp, mouse
gacagagattatccaccatt

SEQ ID NO: 767968 - DNA, 20 bp, mouse
gagtaatggacacctaatgg

SEQ ID NO: 767969 - DNA, 20 bp, mouse
gcttgtgcacattacagaat

SEQ ID NO: 767970 - DNA, 20 bp, mouse
gacagaataggttaaagtaa

SEQ ID NO: 767971 - DNA, 20 bp, mouse
gcacagatactggtaatttt

SEQ ID NO: 767972 - DNA, 20 bp, mouse
gttactactaacaaataaga

SEQ ID NO: 767973 - DNA, 20 bp, mouse
ggactcaggctatatttcag

SEQ ID NO: 767974 - DNA, 20 bp, mouse
gaaactcaaatattagactc

SEQ ID NO: 767975 - DNA, 20 bp, mouse
gtgttaaatatcttaaaaaa

SEQ ID NO: 767976 - DNA, 20 bp, mouse
gacactgaggaatgctctat

SEQ ID NO: 767977 - DNA, 20 bp, mouse
gaataagcataattaagtag

SEQ ID NO: 767978 - DNA, 20 bp, mouse
gtataggtttacagaatgaa

SEQ ID NO: 767979 - DNA, 20 bp, mouse
gtagtgccatgatgcttatt

SEQ ID NO: 767980 - DNA, 20 bp, mouse
gtggataatttcagaaaccc

SEQ ID NO: 767981 - DNA, 20 bp, mouse
gaatactctaattcatgtac

SEQ ID NO: 767982 - DNA, 20 bp, mouse
gaggtctctttagaatatat

SEQ ID NO: 767983 - DNA, 20 bp, mouse
gtcctctataatttaagaag

SEQ ID NO: 767984 - DNA, 20 bp, mouse
ggcatttctcatatctgcat

SEQ ID NO: 767985 - DNA, 20 bp, mouse
gcagtgtgatacatatttga

SEQ ID NO: 767986 - DNA, 20 bp, mouse
gtgactcaatgtcaattagt

SEQ ID NO: 767987 - DNA, 20 bp, mouse
gacactgagaaatactccat

SEQ ID NO: 767988 - DNA, 20 bp, mouse
gtggatattctcatatgcac

SEQ ID NO: 767989 - DNA, 20 bp, mouse
gaacagcatggcactatgtt

SEQ ID NO: 767990 - DNA, 20 bp, mouse
gtatgcttattcgttgtaga

SEQ ID NO: 767991 - DNA, 20 bp, mouse
gtcttcattcgctaatccta

SEQ ID NO: 767992 - DNA, 20 bp, mouse
gcctaacctataaaatagaa

SEQ ID NO: 767993 - DNA, 20 bp, mouse
ggatttctaagtaaacagca

SEQ ID NO: 767994 - DNA, 20 bp, mouse
ggttttcttcataaacggac

SEQ ID NO: 767995 - DNA, 20 bp, mouse
ggtgtaacacacgtatttgt

SEQ ID NO: 767996 - DNA, 20 bp, mouse
gcctgtatggaagtgttttt

SEQ ID NO: 767997 - DNA, 20 bp, mouse
gtggaaagctaggtaaggaa

SEQ ID NO: 767998 - DNA, 20 bp, mouse
gtccctgagtgcctaagcct

SEQ ID NO: 767999 - DNA, 20 bp, mouse
gaccaaggcttaggcactca

SEQ ID NO: 768000 - DNA, 20 bp, mouse
gcttaggcactcagggacca

SEQ ID NO: 768001 - DNA, 20 bp, mouse
gtacttagggaggaacaatc

SEQ ID NO: 768002 - DNA, 20 bp, mouse
ggcctaagccttggtctctt

SEQ ID NO: 768003 - DNA, 20 bp, mouse
gagtgagtgtaaatgtgtac

SEQ ID NO: 768004 - DNA, 20 bp, mouse
gaagctaggtaaggaaaggg

SEQ ID NO: 768005 - DNA, 20 bp, mouse
gtccctaagtatttttgaaa

SEQ ID NO: 768006 - DNA, 20 bp, mouse
gaatactgactacaattttc

SEQ ID NO: 768007 - DNA, 20 bp, mouse
gcatggaaattgctatggta

SEQ ID NO: 768008 - DNA, 20 bp, mouse
gaaattcatggaaattgcta

SEQ ID NO: 768009 - DNA, 20 bp, mouse
ggatcctttcgatcaatttt

SEQ ID NO: 768010 - DNA, 20 bp, mouse
gtttttttgtgctcatcgta

SEQ ID NO: 768011 - DNA, 20 bp, mouse
gattgcgatcttataactaa

SEQ ID NO: 768012 - DNA, 20 bp, mouse
gtttcctaaaattgatcgaa

SEQ ID NO: 768013 - DNA, 20 bp, mouse
gtatttgatatgatcatgag

SEQ ID NO: 768014 - DNA, 20 bp, mouse
gttttaatgatcatgtcatt

SEQ ID NO: 768015 - DNA, 20 bp, mouse
gacaaaaaaaaatctatgtt

SEQ ID NO: 768016 - DNA, 20 bp, mouse
gaggaatctactaagtacac

SEQ ID NO: 768017 - DNA, 20 bp, mouse
gtgttaggtcactcactaca

SEQ ID NO: 768018 - DNA, 20 bp, mouse
gttgtaatgtggtatgatca

SEQ ID NO: 768019 - DNA, 20 bp, mouse
ggttactgaataatgagtgt

SEQ ID NO: 768020 - DNA, 20 bp, mouse
gcattatcactgcatttgtt

SEQ ID NO: 768021 - DNA, 20 bp, mouse
gtaaatacattaataaattg

SEQ ID NO: 768022 - DNA, 20 bp, mouse
gataaattatagttgtaatg

SEQ ID NO: 768023 - DNA, 20 bp, mouse
gatgaattacaaatatacac

SEQ ID NO: 768024 - DNA, 20 bp, mouse
gtattgtctgatgatattat

SEQ ID NO: 768025 - DNA, 20 bp, mouse
gcaataaattgtgatagtta

SEQ ID NO: 768026 - DNA, 20 bp, mouse
gtggggcattgtgcttagtt

SEQ ID NO: 768027 - DNA, 20 bp, mouse
gaagcacaatgccccatttc

SEQ ID NO: 768028 - DNA, 20 bp, mouse
gagttaggaaaaatataata

SEQ ID NO: 768029 - DNA, 20 bp, mouse
gtgtaaaatgactaagtctc

SEQ ID NO: 768030 - DNA, 20 bp, mouse
ggaggaattagtccagaaat

SEQ ID NO: 768031 - DNA, 20 bp, mouse
ggcctgcactaatacaacac

SEQ ID NO: 768032 - DNA, 20 bp, mouse
gcaaagcataataccatttt

SEQ ID NO: 768033 - DNA, 20 bp, mouse
gaccagtgttgtattagtgc

SEQ ID NO: 768034 - DNA, 20 bp, mouse
gttgtgaacttattggctac

SEQ ID NO: 768035 - DNA, 20 bp, mouse
gtagtttatcagataataaa

SEQ ID NO: 768036 - DNA, 20 bp, mouse
gcagtacagtgaagttataa

SEQ ID NO: 768037 - DNA, 20 bp, mouse
gcagtgaagttataaaggca

SEQ ID NO: 768038 - DNA, 20 bp, mouse
gacctatagcctatcagata

SEQ ID NO: 768039 - DNA, 20 bp, mouse
gacctggttccatatctgat

SEQ ID NO: 768040 - DNA, 20 bp, mouse
gtccatatctgataggctat

SEQ ID NO: 768041 - DNA, 20 bp, mouse
gtaaagttctcagttgttat

SEQ ID NO: 768042 - DNA, 20 bp, mouse
ggagaactttattcagcata

SEQ ID NO: 768043 - DNA, 20 bp, mouse
ggcctatcagatatggaacc

SEQ ID NO: 768044 - DNA, 20 bp, mouse
gagttataaaggcaaggagt

SEQ ID NO: 768045 - DNA, 20 bp, mouse
gtcttaataataagtgaaag

SEQ ID NO: 768046 - DNA, 20 bp, mouse
gtacaggtgaatgtataaat

SEQ ID NO: 768047 - DNA, 20 bp, mouse
gtgggattcaactgggactg

SEQ ID NO: 768048 - DNA, 20 bp, mouse
gaaaagcaatgggattcaac

SEQ ID NO: 768049 - DNA, 20 bp, mouse
gtggaatggtgcttttttca

SEQ ID NO: 768050 - DNA, 20 bp, mouse
gtgtataaatgggccatcac

SEQ ID NO: 768051 - DNA, 20 bp, mouse
gaatagtcagtgatggactg

SEQ ID NO: 768052 - DNA, 20 bp, mouse
ggtcataaagcagtacttac

SEQ ID NO: 768053 - DNA, 20 bp, mouse
gaggttggctatgtatagct

SEQ ID NO: 768054 - DNA, 20 bp, mouse
gatatatcaatagtcagtga

SEQ ID NO: 768055 - DNA, 20 bp, mouse
gagagtatggctgtttctag

SEQ ID NO: 768056 - DNA, 20 bp, mouse
ggctgactttaaatacttgt

SEQ ID NO: 768057 - DNA, 20 bp, mouse
gaagtaaatcacacttaaag

SEQ ID NO: 768058 - DNA, 20 bp, mouse
ggatttttacaatcatcctg

SEQ ID NO: 768059 - DNA, 20 bp, mouse
gtaaatacttgtgggaattt

SEQ ID NO: 768060 - DNA, 20 bp, mouse
gttatctgataacgactttt

SEQ ID NO: 768061 - DNA, 20 bp, mouse
gtatgatgcacaggatcctt

SEQ ID NO: 768062 - DNA, 20 bp, mouse
gtttataaggacttcgtgca

SEQ ID NO: 768063 - DNA, 20 bp, mouse
gatttattaatatgatgcac

SEQ ID NO: 768064 - DNA, 20 bp, mouse
gaatgatgttaagagacaga

SEQ ID NO: 768065 - DNA, 20 bp, mouse
gattacatagaaatattctg

SEQ ID NO: 768066 - DNA, 20 bp, mouse
gggagacacagacaattcag

SEQ ID NO: 768067 - DNA, 20 bp, mouse
gaaaaataaggttctacttt

SEQ ID NO: 768068 - DNA, 20 bp, mouse
gtatacatctaaaactagtg

SEQ ID NO: 768069 - DNA, 20 bp, mouse
gttaacaaatataatcacct

SEQ ID NO: 768070 - DNA, 20 bp, mouse
gcaaagaaactttcaaatta

SEQ ID NO: 768071 - DNA, 20 bp, mouse
ggttgaagatgaaacttgaa

SEQ ID NO: 768072 - DNA, 20 bp, mouse
gaccctgagataatgaaaga

SEQ ID NO: 768073 - DNA, 20 bp, mouse
gttgtcttaaagataatatg

SEQ ID NO: 768074 - DNA, 20 bp, mouse
gcacattttaatatgaatga

SEQ ID NO: 768075 - DNA, 20 bp, mouse
gatgattgttatattgaaaa

SEQ ID NO: 768076 - DNA, 20 bp, mouse
gtctgtgagtcaaatttcct

SEQ ID NO: 768077 - DNA, 20 bp, mouse
gagaataagctcgattacac

SEQ ID NO: 768078 - DNA, 20 bp, mouse
gacagaacataattggcttc

SEQ ID NO: 768079 - DNA, 20 bp, mouse
ggcatgcttcatgaatgaca

SEQ ID NO: 768080 - DNA, 20 bp, mouse
gagtattcatgtgacacagg

SEQ ID NO: 768081 - DNA, 20 bp, mouse
gttgtctcttaaatgaatca

SEQ ID NO: 768082 - DNA, 20 bp, mouse
gatggagtatacttatctca

SEQ ID NO: 768083 - DNA, 20 bp, mouse
gataagtatactccatacca

SEQ ID NO: 768084 - DNA, 20 bp, mouse
gaaatataggtattgccttc

SEQ ID NO: 768085 - DNA, 20 bp, mouse
gacttgatccaggtttcctc

SEQ ID NO: 768086 - DNA, 20 bp, mouse
gaatgaatttgtacagagga

SEQ ID NO: 768087 - DNA, 20 bp, mouse
gaatagtgaatataaaatca

SEQ ID NO: 768088 - DNA, 20 bp, mouse
gttaagaatgataaaacatg

SEQ ID NO: 768089 - DNA, 20 bp, mouse
gctcacagtaaaatctgagc

SEQ ID NO: 768090 - DNA, 20 bp, mouse
ggattttactgtgagtagtg

SEQ ID NO: 768091 - DNA, 20 bp, mouse
gcatcaatttttaatgatga

SEQ ID NO: 768092 - DNA, 20 bp, mouse
gtcattaaaaattgatgaca

SEQ ID NO: 768093 - DNA, 20 bp, mouse
gtaagaatgaaaaccattct

SEQ ID NO: 768094 - DNA, 20 bp, mouse
gcagcaatgaatttgtacag

SEQ ID NO: 768095 - DNA, 20 bp, mouse
gtttaaaatatattcaaaat

SEQ ID NO: 768096 - DNA, 20 bp, mouse
gttcctcccattgtaagata

SEQ ID NO: 768097 - DNA, 20 bp, mouse
gataaatcaccataataatt

SEQ ID NO: 768098 - DNA, 20 bp, mouse
ggatttccttatcttacaat

SEQ ID NO: 768099 - DNA, 20 bp, mouse
gttccttatcttacaatggg

SEQ ID NO: 768100 - DNA, 20 bp, mouse
gataaaattaagctatcaga

SEQ ID NO: 768101 - DNA, 20 bp, mouse
gtttttctttggggagtatc

SEQ ID NO: 768102 - DNA, 20 bp, mouse
ggtgtttaattttttctttg

SEQ ID NO: 768103 - DNA, 20 bp, mouse
gtttaatgaccaaattatta

SEQ ID NO: 768104 - DNA, 20 bp, mouse
gaattatagttttaaagcaa

SEQ ID NO: 768105 - DNA, 20 bp, mouse
gaccacaacagcaaaactat

SEQ ID NO: 768106 - DNA, 20 bp, mouse
gcaatggaagtctatatcaa

SEQ ID NO: 768107 - DNA, 20 bp, mouse
ggattctccaaactcttgag

SEQ ID NO: 768108 - DNA, 20 bp, mouse
gttccaaccactcaagagtt

SEQ ID NO: 768109 - DNA, 20 bp, mouse
gaacgtatgtaatcgtgtga

SEQ ID NO: 768110 - DNA, 20 bp, mouse
gaatatgcttgaaaaattca

SEQ ID NO: 768111 - DNA, 20 bp, mouse
ggattgagtagcaattatac

SEQ ID NO: 768112 - DNA, 20 bp, mouse
gttgttagttcaggaagcaa

SEQ ID NO: 768113 - DNA, 20 bp, mouse
ggaaaagatctaatctttta

SEQ ID NO: 768114 - DNA, 20 bp, mouse
gctccaaactcttgagtggt

SEQ ID NO: 768115 - DNA, 20 bp, mouse
gcattttatacaatgataca

SEQ ID NO: 768116 - DNA, 20 bp, mouse
gtgctttatagacacaatgt

SEQ ID NO: 768117 - DNA, 20 bp, mouse
gaaaacattgacactgtgat

SEQ ID NO: 768118 - DNA, 20 bp, mouse
gtggatcttctggattacat

SEQ ID NO: 768119 - DNA, 20 bp, mouse
gacagtgtcaatgttttgtc

SEQ ID NO: 768120 - DNA, 20 bp, mouse
gaacctattgtaattaaaag

SEQ ID NO: 768121 - DNA, 20 bp, mouse
gttttttattgtggatcttc

SEQ ID NO: 768122 - DNA, 20 bp, mouse
gtgaatctggaattatagtt

SEQ ID NO: 768123 - DNA, 20 bp, mouse
gaatgattttttttttattg

SEQ ID NO: 768124 - DNA, 20 bp, mouse
gctttcatattttttgaatc

SEQ ID NO: 768125 - DNA, 20 bp, mouse
gttccacttttaattacaat

SEQ ID NO: 768126 - DNA, 20 bp, mouse
gcaaatcttgcctaccctta

SEQ ID NO: 768127 - DNA, 20 bp, mouse
gtattcaaatatagtcccta

SEQ ID NO: 768128 - DNA, 20 bp, mouse
gaaatatagtccctaagggt

SEQ ID NO: 768129 - DNA, 20 bp, mouse
gataataatgtctccttgaa

SEQ ID NO: 768130 - DNA, 20 bp, mouse
gctgaagaccaacagtttac

SEQ ID NO: 768131 - DNA, 20 bp, mouse
gaattctgacagaggagtga

SEQ ID NO: 768132 - DNA, 20 bp, mouse
gtcaggtatcacttggaatc

SEQ ID NO: 768133 - DNA, 20 bp, mouse
gatcatggcatggacataaa

SEQ ID NO: 768134 - DNA, 20 bp, mouse
gaaaatataattatatatca

SEQ ID NO: 768135 - DNA, 20 bp, mouse
gaattcaaacactattattg

SEQ ID NO: 768136 - DNA, 20 bp, mouse
gtagtcttggtcaacaaaag

SEQ ID NO: 768137 - DNA, 20 bp, mouse
gatgaacaaaggatgtcctc

SEQ ID NO: 768138 - DNA, 20 bp, mouse
gttgttgaccaagactattc

SEQ ID NO: 768139 - DNA, 20 bp, mouse
gttgtaggtttctctaaata

SEQ ID NO: 768140 - DNA, 20 bp, mouse
gctcagttccagaatagtct

SEQ ID NO: 768141 - DNA, 20 bp, mouse
gtaaagactaggaatcattg

SEQ ID NO: 768142 - DNA, 20 bp, mouse
gatacaggtaactgacaaat

SEQ ID NO: 768143 - DNA, 20 bp, mouse
gataataaacctcatttgta

SEQ ID NO: 768144 - DNA, 20 bp, mouse
gttataatttagcatcaagt

SEQ ID NO: 768145 - DNA, 20 bp, mouse
gattttcatcattacattgt

SEQ ID NO: 768146 - DNA, 20 bp, mouse
gggcttactgatagtcaatt

SEQ ID NO: 768147 - DNA, 20 bp, mouse
gagtataaggtagttttcgt

SEQ ID NO: 768148 - DNA, 20 bp, mouse
ggaaatcactcataatatac

SEQ ID NO: 768149 - DNA, 20 bp, mouse
gattgcttcacatttgatca

SEQ ID NO: 768150 - DNA, 20 bp, mouse
gatgcacaaatattagtata

SEQ ID NO: 768151 - DNA, 20 bp, mouse
gatattataggaattgacta

SEQ ID NO: 768152 - DNA, 20 bp, mouse
gaatttaatttctgaatctc

SEQ ID NO: 768153 - DNA, 20 bp, mouse
gacagcaatattaatattat

SEQ ID NO: 768154 - DNA, 20 bp, mouse
gagttctttctcttaaaaaa

SEQ ID NO: 768155 - DNA, 20 bp, mouse
gtgtatattctttcatcttt

SEQ ID NO: 768156 - DNA, 20 bp, mouse
ggcatgttgtagcactatga

SEQ ID NO: 768157 - DNA, 20 bp, mouse
gattaagtgtatctctgagg

SEQ ID NO: 768158 - DNA, 20 bp, mouse
ggagatacacttaatttaga

SEQ ID NO: 768159 - DNA, 20 bp, mouse
gaaatagactacaaactgcc

SEQ ID NO: 768160 - DNA, 20 bp, mouse
gtgctacaacatgcaattgt

SEQ ID NO: 768161 - DNA, 20 bp, mouse
ggtgttatggatttatcatt

SEQ ID NO: 768162 - DNA, 20 bp, mouse
gctttattaaagctacgacc

SEQ ID NO: 768163 - DNA, 20 bp, mouse
gtgaggaatgaaaagtgtta

SEQ ID NO: 768164 - DNA, 20 bp, mouse
gtaaattaagtgtatctctg

SEQ ID NO: 768165 - DNA, 20 bp, mouse
gagtgtatctctgaggtggg

SEQ ID NO: 768166 - DNA, 20 bp, mouse
ggacttctgagttcaatcgt

SEQ ID NO: 768167 - DNA, 20 bp, mouse
gggcctctggcaaagttctc

SEQ ID NO: 768168 - DNA, 20 bp, mouse
gttaactacttctattttca

SEQ ID NO: 768169 - DNA, 20 bp, mouse
ggaaaattacataactgatg

SEQ ID NO: 768170 - DNA, 20 bp, mouse
ggttcagtgaagtaacaaaa

SEQ ID NO: 768171 - DNA, 20 bp, mouse
gattagcagatgagaaatca

SEQ ID NO: 768172 - DNA, 20 bp, mouse
gtccaggttagaaacattag

SEQ ID NO: 768173 - DNA, 20 bp, mouse
gcacctgagaactttgccag

SEQ ID NO: 768174 - DNA, 20 bp, mouse
gttcgtcaaaattgcaaaca

SEQ ID NO: 768175 - DNA, 20 bp, mouse
gtcctctaatgtttctaacc

SEQ ID NO: 768176 - DNA, 20 bp, mouse
gaacaagcagcagtctctgt

SEQ ID NO: 768177 - DNA, 20 bp, mouse
gtggcgctttactgtgtcag

SEQ ID NO: 768178 - DNA, 20 bp, mouse
gcaatttggggaaaacgcta

SEQ ID NO: 768179 - DNA, 20 bp, mouse
gaatagggtataagaggagg

SEQ ID NO: 768180 - DNA, 20 bp, mouse
gctcacttctctccaatttg

SEQ ID NO: 768181 - DNA, 20 bp, mouse
gtgcttgttttcagaaattt

SEQ ID NO: 768182 - DNA, 20 bp, mouse
gggaaaacgctacggtgact

SEQ ID NO: 768183 - DNA, 20 bp, mouse
gctattcacatattacacag

SEQ ID NO: 768184 - DNA, 20 bp, mouse
gatatgtgaatagatcgcat

SEQ ID NO: 768185 - DNA, 20 bp, mouse
gattaatagggtataagagg

SEQ ID NO: 768186 - DNA, 20 bp, mouse
gatagagcacaacaatataa

SEQ ID NO: 768187 - DNA, 20 bp, mouse
gtcatcgacaaaggggtaaa

SEQ ID NO: 768188 - DNA, 20 bp, mouse
gttgtcgatgaaaacttttc

SEQ ID NO: 768189 - DNA, 20 bp, mouse
gttcaatatttatactaaat

SEQ ID NO: 768190 - DNA, 20 bp, mouse
gcatttccaggtgaggaaca

SEQ ID NO: 768191 - DNA, 20 bp, mouse
gttgtgttgttaatgattgt

SEQ ID NO: 768192 - DNA, 20 bp, mouse
gacttttagaagtcatttcc

SEQ ID NO: 768193 - DNA, 20 bp, mouse
gtagaagtcatttccaggtg

SEQ ID NO: 768194 - DNA, 20 bp, mouse
gaacaatataatggtgaata

SEQ ID NO: 768195 - DNA, 20 bp, mouse
gataaaacaaaataaagagt

SEQ ID NO: 768196 - DNA, 20 bp, mouse
gaacacgctgtaatagacta

SEQ ID NO: 768197 - DNA, 20 bp, mouse
gtccttgataggaccattga

SEQ ID NO: 768198 - DNA, 20 bp, mouse
gtccatcaatggtcctatca

SEQ ID NO: 768199 - DNA, 20 bp, mouse
gtttatgagtagatagtgtg

SEQ ID NO: 768200 - DNA, 20 bp, mouse
ggacgagaagtttttgaaca

SEQ ID NO: 768201 - DNA, 20 bp, mouse
gcacaaccacattccttgat

SEQ ID NO: 768202 - DNA, 20 bp, mouse
gacaaacaaataatgctgca

SEQ ID NO: 768203 - DNA, 20 bp, mouse
ggtggaagaatactttttca

SEQ ID NO: 768204 - DNA, 20 bp, mouse
gatgggattaaataccattg

SEQ ID NO: 768205 - DNA, 20 bp, mouse
gcaaacgaaataggtactat

SEQ ID NO: 768206 - DNA, 20 bp, mouse
gtcagagcacaacaatgtga

SEQ ID NO: 768207 - DNA, 20 bp, mouse
gttcaatattcgtgacaaat

SEQ ID NO: 768208 - DNA, 20 bp, mouse
gttcttattctattagaatg

SEQ ID NO: 768209 - DNA, 20 bp, mouse
gaccacccttgctcctcacc

SEQ ID NO: 768210 - DNA, 20 bp, mouse
gttgttgatgcagatttttc

SEQ ID NO: 768211 - DNA, 20 bp, mouse
ggcatcaacaaatgggtaga

SEQ ID NO: 768212 - DNA, 20 bp, mouse
gcagatataaaaatatacat

SEQ ID NO: 768213 - DNA, 20 bp, mouse
gtacttttcattttaagatg

SEQ ID NO: 768214 - DNA, 20 bp, mouse
gttctgttcctcagaagcta

SEQ ID NO: 768215 - DNA, 20 bp, mouse
gaacatttccttagcttctg

SEQ ID NO: 768216 - DNA, 20 bp, mouse
gtgcatatctgacacaagaa

SEQ ID NO: 768217 - DNA, 20 bp, mouse
gtctttgctcatctggattt

SEQ ID NO: 768218 - DNA, 20 bp, mouse
gttaaaggtataaaagtaac

SEQ ID NO: 768219 - DNA, 20 bp, mouse
gatttaataagctgtaaaaa

SEQ ID NO: 768220 - DNA, 20 bp, mouse
gcacatatttagatccaata

SEQ ID NO: 768221 - DNA, 20 bp, mouse
gtagtcttagtgacttttat

SEQ ID NO: 768222 - DNA, 20 bp, mouse
gtatatttgttattccatat

SEQ ID NO: 768223 - DNA, 20 bp, mouse
gaagaaataatgtattatat

SEQ ID NO: 768224 - DNA, 20 bp, mouse
gtatgctagattgtaagttt

SEQ ID NO: 768225 - DNA, 20 bp, mouse
gaaagatagacttttattaa

SEQ ID NO: 768226 - DNA, 20 bp, mouse
gggtattataaagtaatata

SEQ ID NO: 768227 - DNA, 20 bp, mouse
ggcaaataatcaaactagaa

SEQ ID NO: 768228 - DNA, 20 bp, mouse
gttactttataataccaatg

SEQ ID NO: 768229 - DNA, 20 bp, mouse
gtcatagagcaccaggagaa

SEQ ID NO: 768230 - DNA, 20 bp, mouse
ggagagagtcaccattctcc

SEQ ID NO: 768231 - DNA, 20 bp, mouse
gttgaatccccagagctatc

SEQ ID NO: 768232 - DNA, 20 bp, mouse
gaaaatctgaataaacttac

SEQ ID NO: 768233 - DNA, 20 bp, mouse
gtcttaattcatagagcacc

SEQ ID NO: 768234 - DNA, 20 bp, mouse
gtttgtttcttaactgccaa

SEQ ID NO: 768235 - DNA, 20 bp, mouse
gaacctcttctgagtatgct

SEQ ID NO: 768236 - DNA, 20 bp, mouse
gcaggaaaatattccctaca

SEQ ID NO: 768237 - DNA, 20 bp, mouse
gaaaactagagtgaatttca

SEQ ID NO: 768238 - DNA, 20 bp, mouse
ggtacactggatatggcaga

SEQ ID NO: 768239 - DNA, 20 bp, mouse
gtatctgctctgagccctgt

SEQ ID NO: 768240 - DNA, 20 bp, mouse
ggagggcccaaataaaacag

SEQ ID NO: 768241 - DNA, 20 bp, mouse
gtctagttttgcagttgatg

SEQ ID NO: 768242 - DNA, 20 bp, mouse
gattttaattgcagtgacgg

SEQ ID NO: 768243 - DNA, 20 bp, mouse
gttgcatggtacactggata

SEQ ID NO: 768244 - DNA, 20 bp, mouse
gttgaatccccagagctatc

SEQ ID NO: 768245 - DNA, 20 bp, mouse
gcagttgatgaggcactgtt

SEQ ID NO: 768246 - DNA, 20 bp, mouse
gcataggcatactctgaaaa

SEQ ID NO: 768247 - DNA, 20 bp, mouse
gcaggaaaagcctcaatcat

SEQ ID NO: 768248 - DNA, 20 bp, mouse
ggccagagacaatagtattc

SEQ ID NO: 768249 - DNA, 20 bp, mouse
ggagacagtcagcatacttc

SEQ ID NO: 768250 - DNA, 20 bp, mouse
gtacctgctttgagcctgta

SEQ ID NO: 768251 - DNA, 20 bp, mouse
gtcctgaatactattgtctc

SEQ ID NO: 768252 - DNA, 20 bp, mouse
gtaattattgccaatgattg

SEQ ID NO: 768253 - DNA, 20 bp, mouse
gtcaaaacagtattccatac

SEQ ID NO: 768254 - DNA, 20 bp, mouse
gttgctttataatatctctg

SEQ ID NO: 768255 - DNA, 20 bp, mouse
ggagcaaaataaatgcatac

SEQ ID NO: 768256 - DNA, 20 bp, mouse
ggggaagtcatgtatcagat

SEQ ID NO: 768257 - DNA, 20 bp, mouse
gggtcccaccatccacagat

SEQ ID NO: 768258 - DNA, 20 bp, mouse
gttcctggaaggtgcaatca

SEQ ID NO: 768259 - DNA, 20 bp, mouse
gtgccatgattgcaccttcc

SEQ ID NO: 768260 - DNA, 20 bp, mouse
gatatcctagaggtaaaaaa

SEQ ID NO: 768261 - DNA, 20 bp, mouse
gaggaaatcttgcaacttat

SEQ ID NO: 768262 - DNA, 20 bp, mouse
ggtcactcatgcctctcatc

SEQ ID NO: 768263 - DNA, 20 bp, mouse
gtccactttttatttgaaca

SEQ ID NO: 768264 - DNA, 20 bp, mouse
gtgcagaagtaaatcactgt

SEQ ID NO: 768265 - DNA, 20 bp, mouse
gcttcctatctgtggatggt

SEQ ID NO: 768266 - DNA, 20 bp, mouse
gttgttatgggttcttatgt

SEQ ID NO: 768267 - DNA, 20 bp, mouse
gttatcatctgtaataagat

SEQ ID NO: 768268 - DNA, 20 bp, mouse
gccaagtgtatgacactaaa

SEQ ID NO: 768269 - DNA, 20 bp, mouse
ggggcaaatatactctaact

SEQ ID NO: 768270 - DNA, 20 bp, mouse
gtaatatagcattaaataaa

SEQ ID NO: 768271 - DNA, 20 bp, mouse
gatgaatgatggtttgctaa

SEQ ID NO: 768272 - DNA, 20 bp, mouse
gactctaaatacccaatata

SEQ ID NO: 768273 - DNA, 20 bp, mouse
gttaatggaacttgagagag

SEQ ID NO: 768274 - DNA, 20 bp, mouse
gtgaatgttctgccttgtta

SEQ ID NO: 768275 - DNA, 20 bp, mouse
gctgtgaatcatgtgaatca

SEQ ID NO: 768276 - DNA, 20 bp, mouse
gtatgctagcatcaaatata

SEQ ID NO: 768277 - DNA, 20 bp, mouse
gcacatgaaaaccgaaaacg

SEQ ID NO: 768278 - DNA, 20 bp, mouse
gcaaactcaatatccaacta

SEQ ID NO: 768279 - DNA, 20 bp, mouse
gagcactgagaagtttgcaa

SEQ ID NO: 768280 - DNA, 20 bp, mouse
ggtcagtgtttaccaaagtt

SEQ ID NO: 768281 - DNA, 20 bp, mouse
gaaggacattttcctaactt

SEQ ID NO: 768282 - DNA, 20 bp, mouse
ggaatgttctgcctcgtttt

SEQ ID NO: 768283 - DNA, 20 bp, mouse
gtgacatttgtaaccttagt

SEQ ID NO: 768284 - DNA, 20 bp, mouse
ggtatatttccacttagtgt

SEQ ID NO: 768285 - DNA, 20 bp, mouse
gagaaacatgaagacttttc

SEQ ID NO: 768286 - DNA, 20 bp, mouse
gattctagtgttgtgaatgc

SEQ ID NO: 768287 - DNA, 20 bp, mouse
gtgaagaacaggaaaaaagt

SEQ ID NO: 768288 - DNA, 20 bp, mouse
gactttattatgaagaatca

SEQ ID NO: 768289 - DNA, 20 bp, mouse
gaaacaacaaaggcagatga

SEQ ID NO: 768290 - DNA, 20 bp, mouse
gcagagtcatagagaatttg

SEQ ID NO: 768291 - DNA, 20 bp, mouse
gttagtaagtaggactcggc

SEQ ID NO: 768292 - DNA, 20 bp, mouse
gagcttgaaataaacaacaa

SEQ ID NO: 768293 - DNA, 20 bp, mouse
gaatagacaataattgccaa

SEQ ID NO: 768294 - DNA, 20 bp, mouse
gaagtaggaatttagtaagt

SEQ ID NO: 768295 - DNA, 20 bp, mouse
gctaagtgtatgcaagaaaa

SEQ ID NO: 768296 - DNA, 20 bp, mouse
ggaccctaaaggtggaagat

SEQ ID NO: 768297 - DNA, 20 bp, mouse
gaacccatcttccaccttta

SEQ ID NO: 768298 - DNA, 20 bp, mouse
ggagacatggaccctaaagg

SEQ ID NO: 768299 - DNA, 20 bp, mouse
gtgagagacatggaccctaa

SEQ ID NO: 768300 - DNA, 20 bp, mouse
ggatgggttatgttttatac

SEQ ID NO: 768301 - DNA, 20 bp, mouse
ggaaattcttttgagagaca

SEQ ID NO: 768302 - DNA, 20 bp, mouse
gagagagagaggaagaagta

SEQ ID NO: 768303 - DNA, 20 bp, mouse
ggataaggaggaatgtaatg

SEQ ID NO: 768304 - DNA, 20 bp, mouse
gcagaaatacatgttagata

SEQ ID NO: 768305 - DNA, 20 bp, mouse
gaaatacatgttagataagg

SEQ ID NO: 768306 - DNA, 20 bp, mouse
gcacgtaagaacctgtaaca

SEQ ID NO: 768307 - DNA, 20 bp, mouse
gaagggcaaatattcacaaa

SEQ ID NO: 768308 - DNA, 20 bp, mouse
gcttatggaactcaagagag

SEQ ID NO: 768309 - DNA, 20 bp, mouse
gctaatggccactgcaatct

SEQ ID NO: 768310 - DNA, 20 bp, mouse
gctcatctgtaattaagatg

SEQ ID NO: 768311 - DNA, 20 bp, mouse
ggaatatttgcccttgttac

SEQ ID NO: 768312 - DNA, 20 bp, mouse
gtatgttagcatcaaataaa

SEQ ID NO: 768313 - DNA, 20 bp, mouse
ggcacaaacattctgtaact

SEQ ID NO: 768314 - DNA, 20 bp, mouse
gcatctgacttaatgatttt

SEQ ID NO: 768315 - DNA, 20 bp, mouse
gttgctaaaagtaagaaatg

SEQ ID NO: 768316 - DNA, 20 bp, mouse
gagagtcatagagaatttga

SEQ ID NO: 768317 - DNA, 20 bp, mouse
gattctagtgttgtgaattc

SEQ ID NO: 768318 - DNA, 20 bp, mouse
gttctcatctggaatagaaa

SEQ ID NO: 768319 - DNA, 20 bp, mouse
ggaagaacaggaaaaaaagt

SEQ ID NO: 768320 - DNA, 20 bp, mouse
gactttattttaaagaatca

SEQ ID NO: 768321 - DNA, 20 bp, mouse
gaaacaacaaaggcagatga

SEQ ID NO: 768322 - DNA, 20 bp, mouse
gttagtaagtaggactcggc

SEQ ID NO: 768323 - DNA, 20 bp, mouse
gagcttgaaataaacaacaa

SEQ ID NO: 768324 - DNA, 20 bp, mouse
gaatagacaataattgccaa

SEQ ID NO: 768325 - DNA, 20 bp, mouse
gaagtaggaatttagtaagt

SEQ ID NO: 768326 - DNA, 20 bp, mouse
ggaagatgtggatattatga

SEQ ID NO: 768327 - DNA, 20 bp, mouse
gatggcttctcagtgtattt

SEQ ID NO: 768328 - DNA, 20 bp, mouse
gaagacttagttggctaaat

SEQ ID NO: 768329 - DNA, 20 bp, mouse
gagtggttttaagacttagt

SEQ ID NO: 768330 - DNA, 20 bp, mouse
gccaatatcatcagagaaag

SEQ ID NO: 768331 - DNA, 20 bp, mouse
gattctctaagagttatttg

SEQ ID NO: 768332 - DNA, 20 bp, mouse
gatgggatttctatgcagtt

SEQ ID NO: 768333 - DNA, 20 bp, mouse
gtgttttttgaaatatctgt

SEQ ID NO: 768334 - DNA, 20 bp, mouse
gaaattaaagtgtttaaaca

SEQ ID NO: 768335 - DNA, 20 bp, mouse
gaatatacaattatgcacaa

SEQ ID NO: 768336 - DNA, 20 bp, mouse
ggtgtttcaaatagctgcct

SEQ ID NO: 768337 - DNA, 20 bp, mouse
gctgaatattttgcccttta

SEQ ID NO: 768338 - DNA, 20 bp, mouse
gtatctgttttatagttctt

SEQ ID NO: 768339 - DNA, 20 bp, mouse
gatcctctgtcttttgtatt

SEQ ID NO: 768340 - DNA, 20 bp, mouse
gagatgcatattaatgtttt

SEQ ID NO: 768341 - DNA, 20 bp, mouse
gttccaaatacaaaagacag

SEQ ID NO: 768342 - DNA, 20 bp, mouse
gtctaatctttgcccataaa

SEQ ID NO: 768343 - DNA, 20 bp, mouse
gaaacagcaaaaaggaaaca

SEQ ID NO: 768344 - DNA, 20 bp, mouse
gataaaacagatacttctaa

SEQ ID NO: 768345 - DNA, 20 bp, mouse
gtatttaaaaaagatttcca

SEQ ID NO: 768346 - DNA, 20 bp, mouse
ggaatataagaagtagagat

SEQ ID NO: 768347 - DNA, 20 bp, mouse
gggttgttaaattgcggtca

SEQ ID NO: 768348 - DNA, 20 bp, mouse
ggaaatttttacttttgata

SEQ ID NO: 768349 - DNA, 20 bp, mouse
gacagtattatagacttatt

SEQ ID NO: 768350 - DNA, 20 bp, mouse
gacttttgatagggaacatt

SEQ ID NO: 768351 - DNA, 20 bp, mouse
gacatttggttgttaaattg

SEQ ID NO: 768352 - DNA, 20 bp, mouse
gtgaaaggaaatgacaaagt

SEQ ID NO: 768353 - DNA, 20 bp, mouse
gaagtgatgaaaattttgta

SEQ ID NO: 768354 - DNA, 20 bp, mouse
ggttgtatgtttacagagag

SEQ ID NO: 768355 - DNA, 20 bp, mouse
gtagaaatgtttattaatca

SEQ ID NO: 768356 - DNA, 20 bp, mouse
gggtaaagagacagtatctg

SEQ ID NO: 768357 - DNA, 20 bp, mouse
gtaagctatcataattgctg

SEQ ID NO: 768358 - DNA, 20 bp, mouse
gaacgcatgtagctgaattc

SEQ ID NO: 768359 - DNA, 20 bp, mouse
gcccaaaacacaaagagaat

SEQ ID NO: 768360 - DNA, 20 bp, mouse
gaaacgataaatttctctca

SEQ ID NO: 768361 - DNA, 20 bp, mouse
gtttctctcatgggcaaaaa

SEQ ID NO: 768362 - DNA, 20 bp, mouse
ggatcaataacagagtaatt

SEQ ID NO: 768363 - DNA, 20 bp, mouse
gttttttttgactgcagaga

SEQ ID NO: 768364 - DNA, 20 bp, mouse
gtactttctgtctttacatc

SEQ ID NO: 768365 - DNA, 20 bp, mouse
gacccattctctttgtgttt

SEQ ID NO: 768366 - DNA, 20 bp, mouse
gcataggtgtgtatgtaaac

SEQ ID NO: 768367 - DNA, 20 bp, mouse
gttcttgtaaatgacgagtt

SEQ ID NO: 768368 - DNA, 20 bp, mouse
gtggctcttgacacccatgt

SEQ ID NO: 768369 - DNA, 20 bp, mouse
gctggtaagcaaccccacat

SEQ ID NO: 768370 - DNA, 20 bp, mouse
gatgagtaaggctcttagag

SEQ ID NO: 768371 - DNA, 20 bp, mouse
ggaacacaatttatatacat

SEQ ID NO: 768372 - DNA, 20 bp, mouse
gaggtcaaattttgactcat

SEQ ID NO: 768373 - DNA, 20 bp, mouse
gaatgatgcctacggccccc

SEQ ID NO: 768374 - DNA, 20 bp, mouse
gtaacactgaatgatgccta

SEQ ID NO: 768375 - DNA, 20 bp, mouse
ggatttgagtaattgtccag

SEQ ID NO: 768376 - DNA, 20 bp, mouse
gcaaacttaatattctctat

SEQ ID NO: 768377 - DNA, 20 bp, mouse
gctattaagatagattattt

SEQ ID NO: 768378 - DNA, 20 bp, mouse
gattcataagtaaattacct

SEQ ID NO: 768379 - DNA, 20 bp, mouse
gaagcattataaacaagtat

SEQ ID NO: 768380 - DNA, 20 bp, mouse
gaatatttcatcaaataaaa

SEQ ID NO: 768381 - DNA, 20 bp, mouse
gttacaatttttcaataaaa

SEQ ID NO: 768382 - DNA, 20 bp, mouse
ggtgtgcaaaattttgaaac

SEQ ID NO: 768383 - DNA, 20 bp, mouse
gaagataatataatataatg

SEQ ID NO: 768384 - DNA, 20 bp, mouse
gatcagttatgtatcttagt

SEQ ID NO: 768385 - DNA, 20 bp, mouse
gatctaattttcaaatacca

SEQ ID NO: 768386 - DNA, 20 bp, mouse
ggcaaactcaatttctctat

SEQ ID NO: 768387 - DNA, 20 bp, mouse
gaatattccatcaaataaga

SEQ ID NO: 768388 - DNA, 20 bp, mouse
gaagcattgtaaacaaatat

SEQ ID NO: 768389 - DNA, 20 bp, mouse
gtaagtcagtataaattcct

SEQ ID NO: 768390 - DNA, 20 bp, mouse
ggtgtgccaaattttgaaac

SEQ ID NO: 768391 - DNA, 20 bp, mouse
gctattaagatatattaata

SEQ ID NO: 768392 - DNA, 20 bp, mouse
gaagcacatttactttttat

SEQ ID NO: 768393 - DNA, 20 bp, mouse
gttccttggtatttgaaaat

SEQ ID NO: 768394 - DNA, 20 bp, mouse
gatccaattttcaaatacca

SEQ ID NO: 768395 - DNA, 20 bp, mouse
gaacagttatgtatcttagt

SEQ ID NO: 768396 - DNA, 20 bp, mouse
gtctggatatgagacataaa

SEQ ID NO: 768397 - DNA, 20 bp, mouse
gtgagatccagtgatcctca

SEQ ID NO: 768398 - DNA, 20 bp, mouse
gcagtctcttataagttctg

SEQ ID NO: 768399 - DNA, 20 bp, mouse
gtgagcatgatgtctccaga

SEQ ID NO: 768400 - DNA, 20 bp, mouse
gctcaaagaaatttccttct

SEQ ID NO: 768401 - DNA, 20 bp, mouse
gtcttcatgttcttccaaga

SEQ ID NO: 768402 - DNA, 20 bp, mouse
gaatatttagtgttgagatt

SEQ ID NO: 768403 - DNA, 20 bp, mouse
ggtttgcatctgaatatttt

SEQ ID NO: 768404 - DNA, 20 bp, mouse
gggggggagggtcttgattc

SEQ ID NO: 768405 - DNA, 20 bp, mouse
gataaatggaattgcgtgtg

SEQ ID NO: 768406 - DNA, 20 bp, mouse
ggcttcttcatgactatgga

SEQ ID NO: 768407 - DNA, 20 bp, mouse
gacagggaaagagtgaacaa

SEQ ID NO: 768408 - DNA, 20 bp, mouse
gagtgaacaatggtatccac

SEQ ID NO: 768409 - DNA, 20 bp, mouse
gaaaagcttcttcatgacta

SEQ ID NO: 768410 - DNA, 20 bp, mouse
gacaagacattgaaattcct

SEQ ID NO: 768411 - DNA, 20 bp, mouse
gacatgatggtgtagaacca

SEQ ID NO: 768412 - DNA, 20 bp, mouse
gaacagtttagaatatcaac

SEQ ID NO: 768413 - DNA, 20 bp, mouse
gatagaatcactaatcttac

SEQ ID NO: 768414 - DNA, 20 bp, mouse
gatgtcatttctttgtctgc

SEQ ID NO: 768415 - DNA, 20 bp, mouse
gtttcatattatagagcaca

SEQ ID NO: 768416 - DNA, 20 bp, mouse
ggtaaattgattaccttcta

SEQ ID NO: 768417 - DNA, 20 bp, mouse
gatggtgacaaaaacatgaa

SEQ ID NO: 768418 - DNA, 20 bp, mouse
gtcttatattatcaatgatt

SEQ ID NO: 768419 - DNA, 20 bp, mouse
gtttttcagtaatgtttata

SEQ ID NO: 768420 - DNA, 20 bp, mouse
gttttctaacaaaccataga

SEQ ID NO: 768421 - DNA, 20 bp, mouse
gactttataccattataata

SEQ ID NO: 768422 - DNA, 20 bp, mouse
gatatacctccttattataa

SEQ ID NO: 768423 - DNA, 20 bp, mouse
gttataccattataataagg

SEQ ID NO: 768424 - DNA, 20 bp, mouse
ggtttttgtcaccatattag

SEQ ID NO: 768425 - DNA, 20 bp, mouse
gtaaataaaaataatacaat

SEQ ID NO: 768426 - DNA, 20 bp, mouse
gactcagaaacttactggat

SEQ ID NO: 768427 - DNA, 20 bp, mouse
gcaatgactcagaaacttac

SEQ ID NO: 768428 - DNA, 20 bp, mouse
gctggacactattgtgaata

SEQ ID NO: 768429 - DNA, 20 bp, mouse
gttcaggggtttcaggacaa

SEQ ID NO: 768430 - DNA, 20 bp, mouse
gatagtaatcaccttttcaa

SEQ ID NO: 768431 - DNA, 20 bp, mouse
gacctccattgggtatccaa

SEQ ID NO: 768432 - DNA, 20 bp, mouse
gtactccattggatacccaa

SEQ ID NO: 768433 - DNA, 20 bp, mouse
gtggactgagcacagtccaa

SEQ ID NO: 768434 - DNA, 20 bp, mouse
gcaggaagctccaggagttc

SEQ ID NO: 768435 - DNA, 20 bp, mouse
ggtgattactatgccacctg

SEQ ID NO: 768436 - DNA, 20 bp, mouse
gagaaagagcggaagttcaa

SEQ ID NO: 768437 - DNA, 20 bp, mouse
gtggctacatagtctgttac

SEQ ID NO: 768438 - DNA, 20 bp, mouse
ggctgggattatagccatac

SEQ ID NO: 768439 - DNA, 20 bp, mouse
gaagttggacccagaaagag

SEQ ID NO: 768440 - DNA, 20 bp, mouse
gttgaacaataaaggggctg

SEQ ID NO: 768441 - DNA, 20 bp, mouse
gtagaacctaacatgaagtg

SEQ ID NO: 768442 - DNA, 20 bp, mouse
gctattcataaaggcctgta

SEQ ID NO: 768443 - DNA, 20 bp, mouse
gttaaaccacacttcatgtt

SEQ ID NO: 768444 - DNA, 20 bp, mouse
gtattcaattactgtattgc

SEQ ID NO: 768445 - DNA, 20 bp, mouse
ggggttcttttgaacaataa

SEQ ID NO: 768446 - DNA, 20 bp, mouse
gaaagcatttccctttggta

SEQ ID NO: 768447 - DNA, 20 bp, mouse
ggtgaataccaagaataagc

SEQ ID NO: 768448 - DNA, 20 bp, mouse
gaaatcctcataaaatggta

SEQ ID NO: 768449 - DNA, 20 bp, mouse
gtttaattccagcttattct

SEQ ID NO: 768450 - DNA, 20 bp, mouse
gaattataccacattataga

SEQ ID NO: 768451 - DNA, 20 bp, mouse
gttgtttcatgccataccaa

SEQ ID NO: 768452 - DNA, 20 bp, mouse
gaatgtggtataatttcttt

SEQ ID NO: 768453 - DNA, 20 bp, mouse
gctttctctttagaaagagg

SEQ ID NO: 768454 - DNA, 20 bp, mouse
gtttctttttatgaaataga

SEQ ID NO: 768455 - DNA, 20 bp, mouse
gggcataaagcatttccctt

SEQ ID NO: 768456 - DNA, 20 bp, mouse
ggatggagaaaatgtgtgtc

SEQ ID NO: 768457 - DNA, 20 bp, mouse
gctaagttgaacatattcct

SEQ ID NO: 768458 - DNA, 20 bp, mouse
gtaaccaaagactaaactaa

SEQ ID NO: 768459 - DNA, 20 bp, mouse
gccaacaggtatttgataac

SEQ ID NO: 768460 - DNA, 20 bp, mouse
gactacatatgtaagacctc

SEQ ID NO: 768461 - DNA, 20 bp, mouse
ggttggctgatgtattccat

SEQ ID NO: 768462 - DNA, 20 bp, mouse
gctgagaaaatattcaccaa

SEQ ID NO: 768463 - DNA, 20 bp, mouse
gacacccttagtttagtctt

SEQ ID NO: 768464 - DNA, 20 bp, mouse
gttaactatataacattcct

SEQ ID NO: 768465 - DNA, 20 bp, mouse
gctgttctgaaatttctgct

SEQ ID NO: 768466 - DNA, 20 bp, mouse
gtgggtgataggtaggtaaa

SEQ ID NO: 768467 - DNA, 20 bp, mouse
gaaagatgatagatacacta

SEQ ID NO: 768468 - DNA, 20 bp, mouse
gaagaatcacttctgaggtc

SEQ ID NO: 768469 - DNA, 20 bp, mouse
gtgctgaattattgcctcag

SEQ ID NO: 768470 - DNA, 20 bp, mouse
gtgattctttactacaacga

SEQ ID NO: 768471 - DNA, 20 bp, mouse
gaaatagatgggtgataggt

SEQ ID NO: 768472 - DNA, 20 bp, mouse
gactaaggtaaataaataga

SEQ ID NO: 768473 - DNA, 20 bp, mouse
gtagtaaagaatcacttctg

SEQ ID NO: 768474 - DNA, 20 bp, mouse
gaacaactagaaagtctcct

SEQ ID NO: 768475 - DNA, 20 bp, mouse
gaaataaatagatgggtgat

SEQ ID NO: 768476 - DNA, 20 bp, mouse
gctcacgatactttaagaat

SEQ ID NO: 768477 - DNA, 20 bp, mouse
gggaaactttcaggagccac

SEQ ID NO: 768478 - DNA, 20 bp, mouse
gaatccaacatttatgagaa

SEQ ID NO: 768479 - DNA, 20 bp, mouse
gtcaagtaggacagctccag

SEQ ID NO: 768480 - DNA, 20 bp, mouse
ggtgctcagaattctcaagt

SEQ ID NO: 768481 - DNA, 20 bp, mouse
gtatgagaagggaaactttc

SEQ ID NO: 768482 - DNA, 20 bp, mouse
gtataaactttaaaaagtag

SEQ ID NO: 768483 - DNA, 20 bp, mouse
gtttcccttctcataaatgt

SEQ ID NO: 768484 - DNA, 20 bp, mouse
gaaatacaaatgaatgttgg

SEQ ID NO: 768485 - DNA, 20 bp, mouse
gacttacattttctatactt

SEQ ID NO: 768486 - DNA, 20 bp, mouse
gaaagtcagcatttttgttg

SEQ ID NO: 768487 - DNA, 20 bp, mouse
gtacataagtcattgccaac

SEQ ID NO: 768488 - DNA, 20 bp, mouse
gtatactataaatggaaaat

SEQ ID NO: 768489 - DNA, 20 bp, mouse
gttcatggttaaaaacctgt

SEQ ID NO: 768490 - DNA, 20 bp, mouse
gtagtaacctacaaaatatg

SEQ ID NO: 768491 - DNA, 20 bp, mouse
gattatgcttgtcaaagata

SEQ ID NO: 768492 - DNA, 20 bp, mouse
gtaataacactttcatttct

SEQ ID NO: 768493 - DNA, 20 bp, mouse
gttatttacctaattgttca

SEQ ID NO: 768494 - DNA, 20 bp, mouse
gtgttattaattgtaaaagt

SEQ ID NO: 768495 - DNA, 20 bp, mouse
gttaagaaagctgatgaaat

SEQ ID NO: 768496 - DNA, 20 bp, mouse
gctaatattgaattaagaat

SEQ ID NO: 768497 - DNA, 20 bp, mouse
gtgcattaattaagcccttt

SEQ ID NO: 768498 - DNA, 20 bp, mouse
gtttttagatattaacagag

SEQ ID NO: 768499 - DNA, 20 bp, mouse
gtgggtgcgtaggggcatgg

SEQ ID NO: 768500 - DNA, 20 bp, mouse
gtaggggcatggggggtgta

SEQ ID NO: 768501 - DNA, 20 bp, mouse
ggggcatggggggtgtatgg

SEQ ID NO: 768502 - DNA, 20 bp, mouse
gcttaattcaatattagtaa

SEQ ID NO: 768503 - DNA, 20 bp, mouse
ggagtgggtgcgtaggggca

SEQ ID NO: 768504 - DNA, 20 bp, mouse
gtatttatatactttcctaa

SEQ ID NO: 768505 - DNA, 20 bp, mouse
gaatatttgtaaaattttct

SEQ ID NO: 768506 - DNA, 20 bp, mouse
gtgcattaactaagcccatt

SEQ ID NO: 768507 - DNA, 20 bp, mouse
gcattcaagattattaatag

SEQ ID NO: 768508 - DNA, 20 bp, mouse
gaaattagtaaaatggaact

SEQ ID NO: 768509 - DNA, 20 bp, mouse
gattacagaaactccttaag

SEQ ID NO: 768510 - DNA, 20 bp, mouse
gttagatttgcatcctctta

SEQ ID NO: 768511 - DNA, 20 bp, mouse
ggagacagaaattagtaaaa

SEQ ID NO: 768512 - DNA, 20 bp, mouse
gaaattaaacaagaaaagag

SEQ ID NO: 768513 - DNA, 20 bp, mouse
ggaacaaatacagaaatggc

SEQ ID NO: 768514 - DNA, 20 bp, mouse
gtttgaggaaggaaaatgag

SEQ ID NO: 768515 - DNA, 20 bp, mouse
gtacaatcattttttttttg

SEQ ID NO: 768516 - DNA, 20 bp, mouse
gtgtgcatatgttctcacga

SEQ ID NO: 768517 - DNA, 20 bp, mouse
ggtaaattacttttagttgt

SEQ ID NO: 768518 - DNA, 20 bp, mouse
gtgttggcactctacttctg

SEQ ID NO: 768519 - DNA, 20 bp, mouse
gaaaaggacttgaaacacca

SEQ ID NO: 768520 - DNA, 20 bp, mouse
gtgacgttgtaacaagtaaa

SEQ ID NO: 768521 - DNA, 20 bp, mouse
ggaattctgaaagtgtgtgt

SEQ ID NO: 768522 - DNA, 20 bp, mouse
gggtattttaatcactatga

SEQ ID NO: 768523 - DNA, 20 bp, mouse
gagttgacagacagcatgaa

SEQ ID NO: 768524 - DNA, 20 bp, mouse
gaaattgattgtaatgaaaa

SEQ ID NO: 768525 - DNA, 20 bp, mouse
ggtgaactcttatctcagtt

SEQ ID NO: 768526 - DNA, 20 bp, mouse
gggcaggtggagggtatacc

SEQ ID NO: 768527 - DNA, 20 bp, mouse
gaaacagttcaataatcaat

SEQ ID NO: 768528 - DNA, 20 bp, mouse
gtaagcaaagattggggagc

SEQ ID NO: 768529 - DNA, 20 bp, mouse
gcagttcaataatcaatagg

SEQ ID NO: 768530 - DNA, 20 bp, mouse
gtggagggtataccgggctt

SEQ ID NO: 768531 - DNA, 20 bp, mouse
gagaagttgtcaattttatt

SEQ ID NO: 768532 - DNA, 20 bp, mouse
gactatgcttggcaatgatg

SEQ ID NO: 768533 - DNA, 20 bp, mouse
gttattttaagcaaagattg

SEQ ID NO: 768534 - DNA, 20 bp, mouse
gatcctggtggcaataattt

SEQ ID NO: 768535 - DNA, 20 bp, mouse
gatgtaacataaatggaaat

SEQ ID NO: 768536 - DNA, 20 bp, mouse
gctgccagatgggctggtgt

SEQ ID NO: 768537 - DNA, 20 bp, mouse
gagcacaaggcgtgaagggt

SEQ ID NO: 768538 - DNA, 20 bp, mouse
gtccactgtgcagagttcac

SEQ ID NO: 768539 - DNA, 20 bp, mouse
gtaacaccaggatgctaaaa

SEQ ID NO: 768540 - DNA, 20 bp, mouse
gctctgatctcctgccagat

SEQ ID NO: 768541 - DNA, 20 bp, mouse
gacaacttctccttatgaat

SEQ ID NO: 768542 - DNA, 20 bp, mouse
gatgacatttggggaatgtg

SEQ ID NO: 768543 - DNA, 20 bp, mouse
ggatctcctgccagatgggc

SEQ ID NO: 768544 - DNA, 20 bp, mouse
gacaaggcgtgaagggtagg

SEQ ID NO: 768545 - DNA, 20 bp, mouse
ggagggtcactggaatccag

SEQ ID NO: 768546 - DNA, 20 bp, mouse
gaacacatgtagctaaattc

SEQ ID NO: 768547 - DNA, 20 bp, mouse
gctcgccagaatttagatcc

SEQ ID NO: 768548 - DNA, 20 bp, mouse
gggatgaatcacttttttga

SEQ ID NO: 768549 - DNA, 20 bp, mouse
gtactttctctgtttacatc

SEQ ID NO: 768550 - DNA, 20 bp, mouse
ggttgaagaaactgtatctg

SEQ ID NO: 768551 - DNA, 20 bp, mouse
gacagaaaacacaaagagaa

SEQ ID NO: 768552 - DNA, 20 bp, mouse
gaatgcctggatctaaattc

SEQ ID NO: 768553 - DNA, 20 bp, mouse
gaggaaagcatagagatgag

SEQ ID NO: 768554 - DNA, 20 bp, mouse
gtttattttgactgcagagt

SEQ ID NO: 768555 - DNA, 20 bp, mouse
ggtataaagtaagtgtaaaa

SEQ ID NO: 768556 - DNA, 20 bp, mouse
gtgcctaggaagggacattg

SEQ ID NO: 768557 - DNA, 20 bp, mouse
ggaagagaatgtgcctagga

SEQ ID NO: 768558 - DNA, 20 bp, mouse
gacccacaatgtcccttcct

SEQ ID NO: 768559 - DNA, 20 bp, mouse
gtggagtcacaagcatggac

SEQ ID NO: 768560 - DNA, 20 bp, mouse
ggcaagcagagctctaccct

SEQ ID NO: 768561 - DNA, 20 bp, mouse
gaacggaagagaatgtgcct

SEQ ID NO: 768562 - DNA, 20 bp, mouse
gggacaagttggtagcagga

SEQ ID NO: 768563 - DNA, 20 bp, mouse
gaatatgagaggaattacca

SEQ ID NO: 768564 - DNA, 20 bp, mouse
ggaaattacacgtaataaaa

SEQ ID NO: 768565 - DNA, 20 bp, mouse
gcaagttggtagcaggatgg

SEQ ID NO: 768566 - DNA, 20 bp, mouse
gatggtaagtgctaactcat

SEQ ID NO: 768567 - DNA, 20 bp, mouse
gttagcacttaccatcctct

SEQ ID NO: 768568 - DNA, 20 bp, mouse
gtaagcagaatatactagat

SEQ ID NO: 768569 - DNA, 20 bp, mouse
gatcatgcataatactaacc

SEQ ID NO: 768570 - DNA, 20 bp, mouse
gaaatgaacacatgtaaaaa

SEQ ID NO: 768571 - DNA, 20 bp, mouse
gctaaataaattaagcctag

SEQ ID NO: 768572 - DNA, 20 bp, mouse
gctgtgtgttaagcagacag

SEQ ID NO: 768573 - DNA, 20 bp, mouse
gagtatcagtttaatgctta

SEQ ID NO: 768574 - DNA, 20 bp, mouse
gtgaacttccaaatttagct

SEQ ID NO: 768575 - DNA, 20 bp, mouse
gttgatttgaaccacatagc

SEQ ID NO: 768576 - DNA, 20 bp, mouse
ggctctttcgagcaaggtca

SEQ ID NO: 768577 - DNA, 20 bp, mouse
gatatgcacaaagtctaata

SEQ ID NO: 768578 - DNA, 20 bp, mouse
gctgctactcaatgaatacc

SEQ ID NO: 768579 - DNA, 20 bp, mouse
ggttcagattatactcatac

SEQ ID NO: 768580 - DNA, 20 bp, mouse
gtaccaggctctttcgagca

SEQ ID NO: 768581 - DNA, 20 bp, mouse
ggtaattatcttcacacaga

SEQ ID NO: 768582 - DNA, 20 bp, mouse
ggtattttattcatactcca

SEQ ID NO: 768583 - DNA, 20 bp, mouse
gttgtgtcaattttttttcc

SEQ ID NO: 768584 - DNA, 20 bp, mouse
ggtttgtttataaaaacact

SEQ ID NO: 768585 - DNA, 20 bp, mouse
gtataatctgaactcctttt

SEQ ID NO: 768586 - DNA, 20 bp, mouse
gtcattgagcagtagaaggt

SEQ ID NO: 768587 - DNA, 20 bp, mouse
gactatttcaaacaaggccc

SEQ ID NO: 768588 - DNA, 20 bp, mouse
ggattttcttttactattat

SEQ ID NO: 768589 - DNA, 20 bp, mouse
ggcattcattgagcagtaga

SEQ ID NO: 768590 - DNA, 20 bp, mouse
gctgttttattcataatcaa

SEQ ID NO: 768591 - DNA, 20 bp, mouse
gatatgcacaaagtgtaatt

SEQ ID NO: 768592 - DNA, 20 bp, mouse
gaataaagatctgagtagaa

SEQ ID NO: 768593 - DNA, 20 bp, mouse
gaaaatcataaagtcagcct

SEQ ID NO: 768594 - DNA, 20 bp, mouse
gtgccagactatttcaaaca

SEQ ID NO: 768595 - DNA, 20 bp, mouse
gggttgtatcatttctttcc

SEQ ID NO: 768596 - DNA, 20 bp, mouse
gaagcctagacaatggtaag

SEQ ID NO: 768597 - DNA, 20 bp, mouse
gatggtaagtggtaactcac

SEQ ID NO: 768598 - DNA, 20 bp, mouse
gtcaaacaatgattttgtga

SEQ ID NO: 768599 - DNA, 20 bp, mouse
gattgtgcataatactaaca

SEQ ID NO: 768600 - DNA, 20 bp, mouse
gtgcagaataggctagattg

SEQ ID NO: 768601 - DNA, 20 bp, mouse
gataaattaagcctagacaa

SEQ ID NO: 768602 - DNA, 20 bp, mouse
gagaacttacaaatttagca

SEQ ID NO: 768603 - DNA, 20 bp, mouse
gaacaatgattttgtgaagg

SEQ ID NO: 768604 - DNA, 20 bp, mouse
gaaaggaatatatataagca

SEQ ID NO: 768605 - DNA, 20 bp, mouse
gttaccacttaccattgtct

SEQ ID NO: 768606 - DNA, 20 bp, mouse
gatggtaagtgatatctcac

SEQ ID NO: 768607 - DNA, 20 bp, mouse
gttagcagaataaactaaat

SEQ ID NO: 768608 - DNA, 20 bp, mouse
ggtcttcttgtacagctttg

SEQ ID NO: 768609 - DNA, 20 bp, mouse
gatatcacttaccattctct

SEQ ID NO: 768610 - DNA, 20 bp, mouse
gttactaatgaaattttagt

SEQ ID NO: 768611 - DNA, 20 bp, mouse
gtgaacttcctaatttagca

SEQ ID NO: 768612 - DNA, 20 bp, mouse
gtctttttcagattttcttc

SEQ ID NO: 768613 - DNA, 20 bp, mouse
gattttgaatgttcatgtta

SEQ ID NO: 768614 - DNA, 20 bp, mouse
gatgaaatccatgctaaatt

SEQ ID NO: 768615 - DNA, 20 bp, mouse
gataaattaagccaagagaa

SEQ ID NO: 768616 - DNA, 20 bp, mouse
ggcacagcgtgacactaaag

SEQ ID NO: 768617 - DNA, 20 bp, mouse
gtatagtaaattcattcata

SEQ ID NO: 768618 - DNA, 20 bp, mouse
gctcttctctaaaactttgc

SEQ ID NO: 768619 - DNA, 20 bp, mouse
gagagggtggactcttgtcc

SEQ ID NO: 768620 - DNA, 20 bp, mouse
gttctctaaaactttgctgg

SEQ ID NO: 768621 - DNA, 20 bp, mouse
gtgagcaattgatgctagca

SEQ ID NO: 768622 - DNA, 20 bp, mouse
ggtacaaacttgaagacaag

SEQ ID NO: 768623 - DNA, 20 bp, mouse
gggcgttgtccagaagtgac

SEQ ID NO: 768624 - DNA, 20 bp, mouse
gatgaatttactatactttc

SEQ ID NO: 768625 - DNA, 20 bp, mouse
gtgaattatcttacagagtc

SEQ ID NO: 768626 - DNA, 20 bp, mouse
gatgagtcccagaaatggtt

SEQ ID NO: 768627 - DNA, 20 bp, mouse
gctgttatgagtcccagaaa

SEQ ID NO: 768628 - DNA, 20 bp, mouse
gaaccataattgtaataaca

SEQ ID NO: 768629 - DNA, 20 bp, mouse
gttgtatttgaaaggttcta

SEQ ID NO: 768630 - DNA, 20 bp, mouse
gaagacattgattttgatct

SEQ ID NO: 768631 - DNA, 20 bp, mouse
gtaatgtgaaacactttgtc

SEQ ID NO: 768632 - DNA, 20 bp, mouse
gaaactttcctaaccatttc

SEQ ID NO: 768633 - DNA, 20 bp, mouse
gagtattaggcatttttggg

SEQ ID NO: 768634 - DNA, 20 bp, mouse
gtatattgtcaataaaatgc

SEQ ID NO: 768635 - DNA, 20 bp, mouse
gggttaatattacaactaga

SEQ ID NO: 768636 - DNA, 20 bp, mouse
gaatagcatctgaggtcagg

SEQ ID NO: 768637 - DNA, 20 bp, mouse
gttcaatgaagagtgtcagg

SEQ ID NO: 768638 - DNA, 20 bp, mouse
gcagtaaagaatagcatctg

SEQ ID NO: 768639 - DNA, 20 bp, mouse
gaagaatagcatctgaggtc

SEQ ID NO: 768640 - DNA, 20 bp, mouse
gaaaactagaaagtctcctg

SEQ ID NO: 768641 - DNA, 20 bp, mouse
gctcctcttgagagtcagac

SEQ ID NO: 768642 - DNA, 20 bp, mouse
gaaataaataaatagatgat

SEQ ID NO: 768643 - DNA, 20 bp, mouse
gctgaatttatttgcctcaa

SEQ ID NO: 768644 - DNA, 20 bp, mouse
gtttttcaatgaagagtgtc

SEQ ID NO: 768645 - DNA, 20 bp, mouse
gaaagatgatagatacatga

SEQ ID NO: 768646 - DNA, 20 bp, mouse
gagcccatgacttacaaagg

SEQ ID NO: 768647 - DNA, 20 bp, mouse
gaggtagacaaacttatgat

SEQ ID NO: 768648 - DNA, 20 bp, mouse
gaatagcccatgacttacaa

SEQ ID NO: 768649 - DNA, 20 bp, mouse
gttacagaatgtgttggaag

SEQ ID NO: 768650 - DNA, 20 bp, mouse
gtacactaagtaaattgaac

SEQ ID NO: 768651 - DNA, 20 bp, mouse
gggggtaaggcagataagtg

SEQ ID NO: 768652 - DNA, 20 bp, mouse
gggaggattacagaatgtgt

SEQ ID NO: 768653 - DNA, 20 bp, mouse
gattatgttatcaacaagtt

SEQ ID NO: 768654 - DNA, 20 bp, mouse
gatcctcctttgtaagtcat

SEQ ID NO: 768655 - DNA, 20 bp, mouse
gcttgtctcctaataattac

SEQ ID NO: 768656 - DNA, 20 bp, mouse
gggcacgatggaagtctcag

SEQ ID NO: 768657 - DNA, 20 bp, mouse
gccgtcaagactggccacct

SEQ ID NO: 768658 - DNA, 20 bp, mouse
gagacgctcgccgtcaagac

SEQ ID NO: 768659 - DNA, 20 bp, mouse
gaggtcacggaacaattagc

SEQ ID NO: 768660 - DNA, 20 bp, mouse
ggatcataattttggcacga

SEQ ID NO: 768661 - DNA, 20 bp, mouse
ggaaaaaaccgtttataatc

SEQ ID NO: 768662 - DNA, 20 bp, mouse
gaattctacctgattataaa

SEQ ID NO: 768663 - DNA, 20 bp, mouse
gtctctaagtctttgtgtag

SEQ ID NO: 768664 - DNA, 20 bp, mouse
gcgtgtgtttgtgcatatgc

SEQ ID NO: 768665 - DNA, 20 bp, mouse
gacttaaatgatcataattt

SEQ ID NO: 768666 - DNA, 20 bp, mouse
ggatgtactagcaaggttag

SEQ ID NO: 768667 - DNA, 20 bp, mouse
ggatcctcattccatagagc

SEQ ID NO: 768668 - DNA, 20 bp, mouse
gttgattattatataaattg

SEQ ID NO: 768669 - DNA, 20 bp, mouse
gtattttttacaattaagac

SEQ ID NO: 768670 - DNA, 20 bp, mouse
gcctcattccatagagcagg

SEQ ID NO: 768671 - DNA, 20 bp, mouse
gtacagttttaatattgggc

SEQ ID NO: 768672 - DNA, 20 bp, mouse
gatataaggatgtactagca

SEQ ID NO: 768673 - DNA, 20 bp, mouse
gtcaaattatgaaattataa

SEQ ID NO: 768674 - DNA, 20 bp, mouse
gtgtccttctgttggtaaaa

SEQ ID NO: 768675 - DNA, 20 bp, mouse
gtcatctatatctgtaattg

SEQ ID NO: 768676 - DNA, 20 bp, mouse
gatgtcttggaatctcatga

SEQ ID NO: 768677 - DNA, 20 bp, mouse
gaaaaaagtacagtgaactt

SEQ ID NO: 768678 - DNA, 20 bp, mouse
gaaagtacagtgaactttgg

SEQ ID NO: 768679 - DNA, 20 bp, mouse
gattgattatgaataccctg

SEQ ID NO: 768680 - DNA, 20 bp, mouse
gaagtattattattcagtga

SEQ ID NO: 768681 - DNA, 20 bp, mouse
gaaaaaatgcctgtgacaga

SEQ ID NO: 768682 - DNA, 20 bp, mouse
gtattccatgttattaaata

SEQ ID NO: 768683 - DNA, 20 bp, mouse
gagggtttgttcctgaacca

SEQ ID NO: 768684 - DNA, 20 bp, mouse
gtaaattcctatagcagtga

SEQ ID NO: 768685 - DNA, 20 bp, mouse
gaatgttcttaccatggttc

SEQ ID NO: 768686 - DNA, 20 bp, mouse
gagtatcagcattaacaata

SEQ ID NO: 768687 - DNA, 20 bp, mouse
gatcttcatggaactaggca

SEQ ID NO: 768688 - DNA, 20 bp, mouse
ggctgagttgtctatagtaa

SEQ ID NO: 768689 - DNA, 20 bp, mouse
gaacctttggtttattattc

SEQ ID NO: 768690 - DNA, 20 bp, mouse
gttttcctaacacaaataga

SEQ ID NO: 768691 - DNA, 20 bp, mouse
gttggtttattattcaggta

SEQ ID NO: 768692 - DNA, 20 bp, mouse
gtcttaaatgttaaaaattg

SEQ ID NO: 768693 - DNA, 20 bp, mouse
gtagatatcacatagaattg

SEQ ID NO: 768694 - DNA, 20 bp, mouse
gaaaaccatctatttgtgtt

SEQ ID NO: 768695 - DNA, 20 bp, mouse
gaacatgtctaccatcttca

SEQ ID NO: 768696 - DNA, 20 bp, mouse
gagaatatgcaaaaactaaa

SEQ ID NO: 768697 - DNA, 20 bp, mouse
gtaaagtattaaataagttg

SEQ ID NO: 768698 - DNA, 20 bp, mouse
gaagggtagatttccatatc

SEQ ID NO: 768699 - DNA, 20 bp, mouse
gttttctagcacatacagag

SEQ ID NO: 768700 - DNA, 20 bp, mouse
ggtggttttttgacctgata

SEQ ID NO: 768701 - DNA, 20 bp, mouse
gagagaatcttatctaccaa

SEQ ID NO: 768702 - DNA, 20 bp, mouse
gctcttatcaacatttaatg

SEQ ID NO: 768703 - DNA, 20 bp, mouse
gcatttttctgtgcaccctg

SEQ ID NO: 768704 - DNA, 20 bp, mouse
gtcttatctaccaaaggaag

SEQ ID NO: 768705 - DNA, 20 bp, mouse
gagataattctgccaaataa

SEQ ID NO: 768706 - DNA, 20 bp, mouse
gataatcagaatataataga

SEQ ID NO: 768707 - DNA, 20 bp, mouse
gaaccaagatgatttataag

SEQ ID NO: 768708 - DNA, 20 bp, mouse
gtgctccaacaagacactgc

SEQ ID NO: 768709 - DNA, 20 bp, mouse
gttgctgtgtataaaaggtc

SEQ ID NO: 768710 - DNA, 20 bp, mouse
gtaaccttgctgtgtataaa

SEQ ID NO: 768711 - DNA, 20 bp, mouse
gggatgtattatcttgttga

SEQ ID NO: 768712 - DNA, 20 bp, mouse
gacacatccacctctatgag

SEQ ID NO: 768713 - DNA, 20 bp, mouse
gtttattccactcatagagg

SEQ ID NO: 768714 - DNA, 20 bp, mouse
gcacctcttataaatcatct

SEQ ID NO: 768715 - DNA, 20 bp, mouse
gaaatgtatctattcgcata

SEQ ID NO: 768716 - DNA, 20 bp, mouse
gtctattcacgggtgatcta

SEQ ID NO: 768717 - DNA, 20 bp, mouse
gtaacctgataattaaaata

SEQ ID NO: 768718 - DNA, 20 bp, mouse
gtggataggaatgaaaaacc

SEQ ID NO: 768719 - DNA, 20 bp, mouse
gtatcatggctatctattca

SEQ ID NO: 768720 - DNA, 20 bp, mouse
gtgctctggcaattaattgc

SEQ ID NO: 768721 - DNA, 20 bp, mouse
gagactagcgaaggttttgg

SEQ ID NO: 768722 - DNA, 20 bp, mouse
gtctatagttgtataacata

SEQ ID NO: 768723 - DNA, 20 bp, mouse
gaaaccaggattatatatca

SEQ ID NO: 768724 - DNA, 20 bp, mouse
gtggtatataagaaatgctc

SEQ ID NO: 768725 - DNA, 20 bp, mouse
gttgaaattataacctggat

SEQ ID NO: 768726 - DNA, 20 bp, mouse
gaacacatccactatatgag

SEQ ID NO: 768727 - DNA, 20 bp, mouse
gtgtgaataactcaaggcca

SEQ ID NO: 768728 - DNA, 20 bp, mouse
gtcaaatattagaaaaatgg

SEQ ID NO: 768729 - DNA, 20 bp, mouse
gtaccttaatatttacttca

SEQ ID NO: 768730 - DNA, 20 bp, mouse
gagaatatatccaatacaaa

SEQ ID NO: 768731 - DNA, 20 bp, mouse
gcctagatgtgaataactca

SEQ ID NO: 768732 - DNA, 20 bp, mouse
gactgcaagatactcagccc

SEQ ID NO: 768733 - DNA, 20 bp, mouse
gttttactccactcatatag

SEQ ID NO: 768734 - DNA, 20 bp, mouse
gttttcttctattgctgtat

SEQ ID NO: 768735 - DNA, 20 bp, mouse
gcaaatatatccatttgtat

SEQ ID NO: 768736 - DNA, 20 bp, mouse
gtgctctgacaagtcactgc

SEQ ID NO: 768737 - DNA, 20 bp, mouse
gaatgtaaaaggatttttga

SEQ ID NO: 768738 - DNA, 20 bp, mouse
gagaggcaaaatgtaccttt

SEQ ID NO: 768739 - DNA, 20 bp, mouse
gttgtttatatcagttcttc

SEQ ID NO: 768740 - DNA, 20 bp, mouse
gttgcaatagactcaatcaa

SEQ ID NO: 768741 - DNA, 20 bp, mouse
gtcttcttctatttgtgcat

SEQ ID NO: 768742 - DNA, 20 bp, mouse
gagatatttagttgttcaag

SEQ ID NO: 768743 - DNA, 20 bp, mouse
gtttttttatgtgaaccaaa

SEQ ID NO: 768744 - DNA, 20 bp, mouse
gcaatcaaaggaattttaat

SEQ ID NO: 768745 - DNA, 20 bp, mouse
gactgcaggctactcagaca

SEQ ID NO: 768746 - DNA, 20 bp, mouse
ggaaaaaaacaggtatctcc

SEQ ID NO: 768747 - DNA, 20 bp, mouse
gactcatcctagaaaaaaac

SEQ ID NO: 768748 - DNA, 20 bp, mouse
gccacagtacccatgaagac

SEQ ID NO: 768749 - DNA, 20 bp, mouse
gattggtatctgaatgatac

SEQ ID NO: 768750 - DNA, 20 bp, mouse
gcacgcacatgcaagaggaa

SEQ ID NO: 768751 - DNA, 20 bp, mouse
ggaggaagggagagagacta

SEQ ID NO: 768752 - DNA, 20 bp, mouse
gccaatactaagggtatgaa

SEQ ID NO: 768753 - DNA, 20 bp, mouse
gcaagaaagacatttgaaat

SEQ ID NO: 768754 - DNA, 20 bp, mouse
gtaacctatttcagaaaata

SEQ ID NO: 768755 - DNA, 20 bp, mouse
gtatgcaactccaatactaa

SEQ ID NO: 768756 - DNA, 20 bp, mouse
gaaaagtatctcctctaaat

SEQ ID NO: 768757 - DNA, 20 bp, mouse
gctcctctaaatcgggttag

SEQ ID NO: 768758 - DNA, 20 bp, mouse
ggtcctctaacccgatttag

SEQ ID NO: 768759 - DNA, 20 bp, mouse
gataagatgatgcaggagtg

SEQ ID NO: 768760 - DNA, 20 bp, mouse
gtaaaaggcaaactaatata

SEQ ID NO: 768761 - DNA, 20 bp, mouse
gttaaaagtacaaaatagat

SEQ ID NO: 768762 - DNA, 20 bp, mouse
gtattttctattggctaatt

SEQ ID NO: 768763 - DNA, 20 bp, mouse
gagtaaaaaatgataaaaat

SEQ ID NO: 768764 - DNA, 20 bp, mouse
gaaaatataaaaataatgtt

SEQ ID NO: 768765 - DNA, 20 bp, mouse
gcattcatataagatgatgc

SEQ ID NO: 768766 - DNA, 20 bp, mouse
gaaatgtagagtggaaaatg

SEQ ID NO: 768767 - DNA, 20 bp, mouse
gctaaggagactgcagcggg

SEQ ID NO: 768768 - DNA, 20 bp, mouse
ggtaatcagtagatgagtca

SEQ ID NO: 768769 - DNA, 20 bp, mouse
gaaagagtgggacagggcta

SEQ ID NO: 768770 - DNA, 20 bp, mouse
gcagaactgaagcatggatg

SEQ ID NO: 768771 - DNA, 20 bp, mouse
gctacaataatcagaggaat

SEQ ID NO: 768772 - DNA, 20 bp, mouse
gtataacattaccatcaagt

SEQ ID NO: 768773 - DNA, 20 bp, mouse
gtagttcaaaaatcctctag

SEQ ID NO: 768774 - DNA, 20 bp, mouse
gtataatatcttattctcaa

SEQ ID NO: 768775 - DNA, 20 bp, mouse
gtgacattaaacctagatat

SEQ ID NO: 768776 - DNA, 20 bp, mouse
gcaaactactttaatgaagt

SEQ ID NO: 768777 - DNA, 20 bp, mouse
gcatttttcttctatatata

SEQ ID NO: 768778 - DNA, 20 bp, mouse
gtgaactaatctatccatcc

SEQ ID NO: 768779 - DNA, 20 bp, mouse
gaaaaatgctgagtttctca

SEQ ID NO: 768780 - DNA, 20 bp, mouse
ggggtgcatttgaaaatcct

SEQ ID NO: 768781 - DNA, 20 bp, mouse
gacagctacattttgaatat

SEQ ID NO: 768782 - DNA, 20 bp, mouse
gattttgtctctttagatag

SEQ ID NO: 768783 - DNA, 20 bp, mouse
ggtagtttgtgataactaat

SEQ ID NO: 768784 - DNA, 20 bp, mouse
gaaaattttatcgtgtaccc

SEQ ID NO: 768785 - DNA, 20 bp, mouse
gtctgcagtaatgagaaaaa

SEQ ID NO: 768786 - DNA, 20 bp, mouse
ggacgcagaccaaagggcac

SEQ ID NO: 768787 - DNA, 20 bp, mouse
gagaaataataacttctgtc

SEQ ID NO: 768788 - DNA, 20 bp, mouse
gtttggagacgcagaccaaa

SEQ ID NO: 768789 - DNA, 20 bp, mouse
gaaagtcatcctgtgccctt

SEQ ID NO: 768790 - DNA, 20 bp, mouse
gtgaaactatgaggaaattt

SEQ ID NO: 768791 - DNA, 20 bp, mouse
gaacacaatatcaataatct

SEQ ID NO: 768792 - DNA, 20 bp, mouse
gatgactttatagattgaag

SEQ ID NO: 768793 - DNA, 20 bp, mouse
gactttcatttgtaggtcat

SEQ ID NO: 768794 - DNA, 20 bp, mouse
gttctttcaccagtacatag

SEQ ID NO: 768795 - DNA, 20 bp, mouse
ggactaaatgtaaaaggatc

SEQ ID NO: 768796 - DNA, 20 bp, mouse
gagctgagagtatatctcac

SEQ ID NO: 768797 - DNA, 20 bp, mouse
gtaaacttcaggtgtagcta

SEQ ID NO: 768798 - DNA, 20 bp, mouse
ggaaatcgtccaaaccccca

SEQ ID NO: 768799 - DNA, 20 bp, mouse
gtctcagctccctgggggtt

SEQ ID NO: 768800 - DNA, 20 bp, mouse
gggaatactcactaaacttc

SEQ ID NO: 768801 - DNA, 20 bp, mouse
gtgtagctagggagtgaatt

SEQ ID NO: 768802 - DNA, 20 bp, mouse
ggatatactctcagctccct

SEQ ID NO: 768803 - DNA, 20 bp, mouse
gttagaaaactctagtatta

SEQ ID NO: 768804 - DNA, 20 bp, mouse
gtattaaatcatgttgaata

SEQ ID NO: 768805 - DNA, 20 bp, mouse
gaatctttaaaaactttgga

SEQ ID NO: 768806 - DNA, 20 bp, mouse
ggggagattaacatcatctt

SEQ ID NO: 768807 - DNA, 20 bp, mouse
ggaagtggaggagcaatgat

SEQ ID NO: 768808 - DNA, 20 bp, mouse
gataaaactatggatctgac

SEQ ID NO: 768809 - DNA, 20 bp, mouse
gaagttgacagttcatgtca

SEQ ID NO: 768810 - DNA, 20 bp, mouse
gaagttgatgtagctcgacc

SEQ ID NO: 768811 - DNA, 20 bp, mouse
gttcttttttaatgaggtac

SEQ ID NO: 768812 - DNA, 20 bp, mouse
gaaatggttatttgaagacc

SEQ ID NO: 768813 - DNA, 20 bp, mouse
gtgtgagtgtatatgttata

SEQ ID NO: 768814 - DNA, 20 bp, mouse
gcttgttagttgacagtgtg

SEQ ID NO: 768815 - DNA, 20 bp, mouse
gtggatctgacaggttgtga

SEQ ID NO: 768816 - DNA, 20 bp, mouse
gccttctctggcaataagag

SEQ ID NO: 768817 - DNA, 20 bp, mouse
ggaaggaatatactctcttg

SEQ ID NO: 768818 - DNA, 20 bp, mouse
gtagccacattttaaacatt

SEQ ID NO: 768819 - DNA, 20 bp, mouse
ggtaaattgtattaagtatt

SEQ ID NO: 768820 - DNA, 20 bp, mouse
gtcaagataattttgcataa

SEQ ID NO: 768821 - DNA, 20 bp, mouse
gattttaaacattggggtga

SEQ ID NO: 768822 - DNA, 20 bp, mouse
gataagaatactgccttctc

SEQ ID NO: 768823 - DNA, 20 bp, mouse
gcactgaagattattcatct

SEQ ID NO: 768824 - DNA, 20 bp, mouse
gatatttagaagatatatct

SEQ ID NO: 768825 - DNA, 20 bp, mouse
gaaaatgtggctattttatc

SEQ ID NO: 768826 - DNA, 20 bp, mouse
gctggtcagtcggtgaagac

SEQ ID NO: 768827 - DNA, 20 bp, mouse
ggcaaaagcctgtatttgat

SEQ ID NO: 768828 - DNA, 20 bp, mouse
gaagaggcaagaggtacctt

SEQ ID NO: 768829 - DNA, 20 bp, mouse
gcctcttatttcagtagata

SEQ ID NO: 768830 - DNA, 20 bp, mouse
ggaagaatagataaattcaa

SEQ ID NO: 768831 - DNA, 20 bp, mouse
gaggtcatatttcaaaatca

SEQ ID NO: 768832 - DNA, 20 bp, mouse
ggttatattatttttacaat

SEQ ID NO: 768833 - DNA, 20 bp, mouse
gatcattacaatgtacaaat

SEQ ID NO: 768834 - DNA, 20 bp, mouse
gaggcagtgttctggtcagt

SEQ ID NO: 768835 - DNA, 20 bp, mouse
gaagctgaccaatcaaatac

SEQ ID NO: 768836 - DNA, 20 bp, mouse
gtctacttgggtgacaagag

SEQ ID NO: 768837 - DNA, 20 bp, mouse
gggagataaaagcatctact

SEQ ID NO: 768838 - DNA, 20 bp, mouse
gttagctgagataaagtagt

SEQ ID NO: 768839 - DNA, 20 bp, mouse
gtcaatgtagacttaacttc

SEQ ID NO: 768840 - DNA, 20 bp, mouse
gcatttcaagccgtctcttc

SEQ ID NO: 768841 - DNA, 20 bp, mouse
gccttatctaccagcaaaaa

SEQ ID NO: 768842 - DNA, 20 bp, mouse
gaatgcattttaaactattc

SEQ ID NO: 768843 - DNA, 20 bp, mouse
gaaagccacatctagaatat

SEQ ID NO: 768844 - DNA, 20 bp, mouse
ggtctttcacccctttttgc

SEQ ID NO: 768845 - DNA, 20 bp, mouse
gatctccaatattctagatg

SEQ ID NO: 768846 - DNA, 20 bp, mouse
gtccatttctgtatatagag

SEQ ID NO: 768847 - DNA, 20 bp, mouse
gacctctctatatacagaaa

SEQ ID NO: 768848 - DNA, 20 bp, mouse
ggtgacatcaaaccataaac

SEQ ID NO: 768849 - DNA, 20 bp, mouse
gtatcaccttgaaatgtttc

SEQ ID NO: 768850 - DNA, 20 bp, mouse
ggactcatacaaatttataa

SEQ ID NO: 768851 - DNA, 20 bp, mouse
gacattttgttcatcttatg

SEQ ID NO: 768852 - DNA, 20 bp, mouse
gttcatcttatgaggaagtg

SEQ ID NO: 768853 - DNA, 20 bp, mouse
gttgtattctcaacaaaatc

SEQ ID NO: 768854 - DNA, 20 bp, mouse
gtttaggaaacaaacatcat

SEQ ID NO: 768855 - DNA, 20 bp, mouse
gcaaaatgtgattttggatc

SEQ ID NO: 768856 - DNA, 20 bp, mouse
ggtagatttttgtcacggaa

SEQ ID NO: 768857 - DNA, 20 bp, mouse
gtatctgatccacttatagc

SEQ ID NO: 768858 - DNA, 20 bp, mouse
gatgaattaccagctataag

SEQ ID NO: 768859 - DNA, 20 bp, mouse
gcaggttctggagcttataa

SEQ ID NO: 768860 - DNA, 20 bp, mouse
gtgcattgatttattatgca

SEQ ID NO: 768861 - DNA, 20 bp, mouse
gaaacaatatgaacaggttc

SEQ ID NO: 768862 - DNA, 20 bp, mouse
gcaactacaatctttaaact

SEQ ID NO: 768863 - DNA, 20 bp, mouse
gaactattaacatgtctttc

SEQ ID NO: 768864 - DNA, 20 bp, mouse
gaggatatgactcttttgag

SEQ ID NO: 768865 - DNA, 20 bp, mouse
gttaaagtagatttttgtca

SEQ ID NO: 768866 - DNA, 20 bp, mouse
ggagaggatgtactgttgtg

SEQ ID NO: 768867 - DNA, 20 bp, mouse
gtggttgaagagagtgagac

SEQ ID NO: 768868 - DNA, 20 bp, mouse
gatgtactgttgtggggttt

SEQ ID NO: 768869 - DNA, 20 bp, mouse
gtcagagttatgcctgggag

SEQ ID NO: 768870 - DNA, 20 bp, mouse
gagaaaatcagagttatgcc

SEQ ID NO: 768871 - DNA, 20 bp, mouse
gtacctagggaagagctgta

SEQ ID NO: 768872 - DNA, 20 bp, mouse
gaattgagtccactgatgaa

SEQ ID NO: 768873 - DNA, 20 bp, mouse
gtttgtgataaaatcacaca

SEQ ID NO: 768874 - DNA, 20 bp, mouse
gtgtattattaacatctttg

SEQ ID NO: 768875 - DNA, 20 bp, mouse
gttgaagaaacagcaagatt

SEQ ID NO: 768876 - DNA, 20 bp, mouse
gggagcagctactgggttaa

SEQ ID NO: 768877 - DNA, 20 bp, mouse
gtatgaaaggacacagactt

SEQ ID NO: 768878 - DNA, 20 bp, mouse
gaagaatgggagcagctact

SEQ ID NO: 768879 - DNA, 20 bp, mouse
gacagggctttcagcaactg

SEQ ID NO: 768880 - DNA, 20 bp, mouse
gatatgaagagaccataata

SEQ ID NO: 768881 - DNA, 20 bp, mouse
gtacatgcatttaagattaa

SEQ ID NO: 768882 - DNA, 20 bp, mouse
gcctataagaacataaagac

SEQ ID NO: 768883 - DNA, 20 bp, mouse
gcacaaagttactgcagaca

SEQ ID NO: 768884 - DNA, 20 bp, mouse
gaagtgcaagtgatgcatct

SEQ ID NO: 768885 - DNA, 20 bp, mouse
gcagatacaacacatctata

SEQ ID NO: 768886 - DNA, 20 bp, mouse
gttgaagatcaatcaaatca

SEQ ID NO: 768887 - DNA, 20 bp, mouse
gttgtgaagaagaaatgtcc

SEQ ID NO: 768888 - DNA, 20 bp, mouse
gtgacatgtcacgtaatctt

SEQ ID NO: 768889 - DNA, 20 bp, mouse
gctttaacttcattgagaat

SEQ ID NO: 768890 - DNA, 20 bp, mouse
gagttacatgccctacccac

SEQ ID NO: 768891 - DNA, 20 bp, mouse
gggaaaatcaacctgtgggt

SEQ ID NO: 768892 - DNA, 20 bp, mouse
gtgaacaaatacctgatacc

SEQ ID NO: 768893 - DNA, 20 bp, mouse
gtaaagcactgaaagcattt

SEQ ID NO: 768894 - DNA, 20 bp, mouse
ggaatggaaaatcaacctgt

SEQ ID NO: 768895 - DNA, 20 bp, mouse
gcatgtcagtaatgtaagta

SEQ ID NO: 768896 - DNA, 20 bp, mouse
gatcagcagggaaattccca

SEQ ID NO: 768897 - DNA, 20 bp, mouse
gggctgagttcagtgaacaa

SEQ ID NO: 768898 - DNA, 20 bp, mouse
gacagtacctagaacactat

SEQ ID NO: 768899 - DNA, 20 bp, mouse
gttgaggcagaatcatcagc

SEQ ID NO: 768900 - DNA, 20 bp, mouse
gtgagggagaagcgaacagt

SEQ ID NO: 768901 - DNA, 20 bp, mouse
gcaaactctgctccttcctt

SEQ ID NO: 768902 - DNA, 20 bp, mouse
gtggtctataaaatcatgca

SEQ ID NO: 768903 - DNA, 20 bp, mouse
gttggggtgtgtagatcatg

SEQ ID NO: 768904 - DNA, 20 bp, mouse
gtaaatcacactcttgtatg

SEQ ID NO: 768905 - DNA, 20 bp, mouse
ggtcagttatggaagagtga

SEQ ID NO: 768906 - DNA, 20 bp, mouse
gaaaatgagtcagacaacag

SEQ ID NO: 768907 - DNA, 20 bp, mouse
gtaaccaagcatgggagaat

SEQ ID NO: 768908 - DNA, 20 bp, mouse
ggaatattcagggttctttc

SEQ ID NO: 768909 - DNA, 20 bp, mouse
gcactattattgttgtataa

SEQ ID NO: 768910 - DNA, 20 bp, mouse
gtcaccaattctcccatgct

SEQ ID NO: 768911 - DNA, 20 bp, mouse
gaactctgagtaaccaagca

SEQ ID NO: 768912 - DNA, 20 bp, mouse
gaatcaactgctctgtctgc

SEQ ID NO: 768913 - DNA, 20 bp, mouse
gcaataatagtgaatattca

SEQ ID NO: 768914 - DNA, 20 bp, mouse
gttgacattcagttaattta

SEQ ID NO: 768915 - DNA, 20 bp, mouse
gaaattttctgacttatagt

SEQ ID NO: 768916 - DNA, 20 bp, mouse
gtctctggggcatggatcct

SEQ ID NO: 768917 - DNA, 20 bp, mouse
ggatccatgccccagagaac

SEQ ID NO: 768918 - DNA, 20 bp, mouse
gcaaagagaatgcttcaaca

SEQ ID NO: 768919 - DNA, 20 bp, mouse
gatagaagacaccagttctc

SEQ ID NO: 768920 - DNA, 20 bp, mouse
gtctgaacataaaactgcat

SEQ ID NO: 768921 - DNA, 20 bp, mouse
gatttggaggaagtgctttg

SEQ ID NO: 768922 - DNA, 20 bp, mouse
gctccaaatgaaattatcca

SEQ ID NO: 768923 - DNA, 20 bp, mouse
gatccttggataatttcatt

SEQ ID NO: 768924 - DNA, 20 bp, mouse
gcatcaaaaccaaaaatgtt

SEQ ID NO: 768925 - DNA, 20 bp, mouse
gtatgttcagagaagtacct

SEQ ID NO: 768926 - DNA, 20 bp, mouse
ggctgccattactaagaagt

SEQ ID NO: 768927 - DNA, 20 bp, mouse
gcttcaaatgaaatcatctg

SEQ ID NO: 768928 - DNA, 20 bp, mouse
gaagtgggtttgttgtaatc

SEQ ID NO: 768929 - DNA, 20 bp, mouse
gcatttagtagcatctattc

SEQ ID NO: 768930 - DNA, 20 bp, mouse
gctactatagaagataaaga

SEQ ID NO: 768931 - DNA, 20 bp, mouse
gtctatagtagcaaacatgt

SEQ ID NO: 768932 - DNA, 20 bp, mouse
gcaaacccacttcttagtaa

SEQ ID NO: 768933 - DNA, 20 bp, mouse
gtcagaatagaatagattca

SEQ ID NO: 768934 - DNA, 20 bp, mouse
gactgtttctttgtttatcg

SEQ ID NO: 768935 - DNA, 20 bp, mouse
gacaatatatatatataagg

SEQ ID NO: 768936 - DNA, 20 bp, mouse
gcacttgaacaaggtagcac

SEQ ID NO: 768937 - DNA, 20 bp, mouse
ggagattagcagtgtaccta

SEQ ID NO: 768938 - DNA, 20 bp, mouse
gaataagaccaggaatctcg

SEQ ID NO: 768939 - DNA, 20 bp, mouse
gtaattaagcaacattccct

SEQ ID NO: 768940 - DNA, 20 bp, mouse
gccttgttcaagtggtttgg

SEQ ID NO: 768941 - DNA, 20 bp, mouse
gattcaggttagctattctc

SEQ ID NO: 768942 - DNA, 20 bp, mouse
gggtgataagatgtcatgtc

SEQ ID NO: 768943 - DNA, 20 bp, mouse
gtggaacatttcacaaaacc

SEQ ID NO: 768944 - DNA, 20 bp, mouse
gccaggaatctcgtggaacc

SEQ ID NO: 768945 - DNA, 20 bp, mouse
ggtatagattaacaccaatt

SEQ ID NO: 768946 - DNA, 20 bp, mouse
gtaggtacaaagattcactt

SEQ ID NO: 768947 - DNA, 20 bp, mouse
gtgttgagcccacagctaat

SEQ ID NO: 768948 - DNA, 20 bp, mouse
ggctcaacaaaatgaactag

SEQ ID NO: 768949 - DNA, 20 bp, mouse
gacaacaaacctattagctg

SEQ ID NO: 768950 - DNA, 20 bp, mouse
gctccttcatggtataacat

SEQ ID NO: 768951 - DNA, 20 bp, mouse
gcctggaacagagctatttt

SEQ ID NO: 768952 - DNA, 20 bp, mouse
gctaataaatccctccttca

SEQ ID NO: 768953 - DNA, 20 bp, mouse
gagccaatgttataccatga

SEQ ID NO: 768954 - DNA, 20 bp, mouse
ggagttgggtgttattttct

SEQ ID NO: 768955 - DNA, 20 bp, mouse
gctaagtatattaatgaact

SEQ ID NO: 768956 - DNA, 20 bp, mouse
gggctcaacaaaatcctctt

SEQ ID NO: 768957 - DNA, 20 bp, mouse
gagtagaaatggttatctat

SEQ ID NO: 768958 - DNA, 20 bp, mouse
ggagcagctaaagtgaggaa

SEQ ID NO: 768959 - DNA, 20 bp, mouse
gggtcaagatcacaacgtca

SEQ ID NO: 768960 - DNA, 20 bp, mouse
gggagttaatagaagatgta

SEQ ID NO: 768961 - DNA, 20 bp, mouse
gacaaaatcctcttaggcga

SEQ ID NO: 768962 - DNA, 20 bp, mouse
gtaatgccatagtgaactga

SEQ ID NO: 768963 - DNA, 20 bp, mouse
gagagaagaatatatagagt

SEQ ID NO: 768964 - DNA, 20 bp, mouse
gtcatatatcaagatacagt

SEQ ID NO: 768965 - DNA, 20 bp, mouse
gaagatcacaacgtcaaggc

SEQ ID NO: 768966 - DNA, 20 bp, mouse
gacaactaaaatttgcatgg

SEQ ID NO: 768967 - DNA, 20 bp, mouse
ggcctcaattgcttttacaa

SEQ ID NO: 768968 - DNA, 20 bp, mouse
gcatacagtaggtgtttagt

SEQ ID NO: 768969 - DNA, 20 bp, mouse
gacaatggtgaacatacagt

SEQ ID NO: 768970 - DNA, 20 bp, mouse
gtgcatgcatggtcccacat

SEQ ID NO: 768971 - DNA, 20 bp, mouse
gtgctggagatttaattcaa

SEQ ID NO: 768972 - DNA, 20 bp, mouse
gaataaacccttgtactttc

SEQ ID NO: 768973 - DNA, 20 bp, mouse
gatatagtaagtttatgtat

SEQ ID NO: 768974 - DNA, 20 bp, mouse
gatattgaacccataggaac

SEQ ID NO: 768975 - DNA, 20 bp, mouse
ggaagagatattgaacccat

SEQ ID NO: 768976 - DNA, 20 bp, mouse
gtgagccagtgtaacaacaa

SEQ ID NO: 768977 - DNA, 20 bp, mouse
gtctctagagagaaacaact

SEQ ID NO: 768978 - DNA, 20 bp, mouse
ggcagtgctttgctgaggtg

SEQ ID NO: 768979 - DNA, 20 bp, mouse
gtctctctagagattattca

SEQ ID NO: 768980 - DNA, 20 bp, mouse
gctgaggtgtggctgggtaa

SEQ ID NO: 768981 - DNA, 20 bp, mouse
ggtaaggcagtgctttgctg

SEQ ID NO: 768982 - DNA, 20 bp, mouse
gggtgcctttgttgttacac

SEQ ID NO: 768983 - DNA, 20 bp, mouse
gtaagtgttttatcacaatt

SEQ ID NO: 768984 - DNA, 20 bp, mouse
ggaatatataaatgactcta

SEQ ID NO: 768985 - DNA, 20 bp, mouse
gttgctttgacataaaactg

SEQ ID NO: 768986 - DNA, 20 bp, mouse
gaataatcacagtagaccta

SEQ ID NO: 768987 - DNA, 20 bp, mouse
ggtctccttagcttttccaa

SEQ ID NO: 768988 - DNA, 20 bp, mouse
gccaatggtgaacatagagt

SEQ ID NO: 768989 - DNA, 20 bp, mouse
gtctccaccctcatattgat

SEQ ID NO: 768990 - DNA, 20 bp, mouse
gctactgtgattattatacg

SEQ ID NO: 768991 - DNA, 20 bp, mouse
gtgcttgaaaagttagaaaa

SEQ ID NO: 768992 - DNA, 20 bp, mouse
gacacccatcaatatgaggg

SEQ ID NO: 768993 - DNA, 20 bp, mouse
gtgggaactgtagttgcaaa

SEQ ID NO: 768994 - DNA, 20 bp, mouse
gacatgctagaattgaactg

SEQ ID NO: 768995 - DNA, 20 bp, mouse
gcgcatgcctggtggtgtgt

SEQ ID NO: 768996 - DNA, 20 bp, mouse
gtacttgataaaaccatcgt

SEQ ID NO: 768997 - DNA, 20 bp, mouse
gacaaagctgattgaacatt

SEQ ID NO: 768998 - DNA, 20 bp, mouse
gaaattagtaaacacgtttt

SEQ ID NO: 768999 - DNA, 20 bp, mouse
gaagatagcttctacttttc

SEQ ID NO: 769000 - DNA, 20 bp, mouse
gaaagttttatttagtttct

SEQ ID NO: 769001 - DNA, 20 bp, mouse
gtaaagctttcagtcaacat

SEQ ID NO: 769002 - DNA, 20 bp, mouse
gaaagctttatgagaagtat

SEQ ID NO: 769003 - DNA, 20 bp, mouse
gatgttttatttccctacga

SEQ ID NO: 769004 - DNA, 20 bp, mouse
gatatatgatctctatttct

SEQ ID NO: 769005 - DNA, 20 bp, mouse
gagggaaataaaacattcaa

SEQ ID NO: 769006 - DNA, 20 bp, mouse
gttaataaaaccacaataga

SEQ ID NO: 769007 - DNA, 20 bp, mouse
ggacactccccatgtcatga

SEQ ID NO: 769008 - DNA, 20 bp, mouse
gtatcaactgaaactctgtt

SEQ ID NO: 769009 - DNA, 20 bp, mouse
gaattctattccttctattg

SEQ ID NO: 769010 - DNA, 20 bp, mouse
gtatgattccatcatgacat

SEQ ID NO: 769011 - DNA, 20 bp, mouse
gctgtttctcacgacctcat

SEQ ID NO: 769012 - DNA, 20 bp, mouse
gtaaattaattgaagttcag

SEQ ID NO: 769013 - DNA, 20 bp, mouse
gaccatcattttcttctaca

SEQ ID NO: 769014 - DNA, 20 bp, mouse
gcagtctgcataggactatc

SEQ ID NO: 769015 - DNA, 20 bp, mouse
gatattcttatcagataaaa

SEQ ID NO: 769016 - DNA, 20 bp, mouse
gaacaccataaactctccat

SEQ ID NO: 769017 - DNA, 20 bp, mouse
ggtaacccattcctgatatt

SEQ ID NO: 769018 - DNA, 20 bp, mouse
gctatagagatatgcacaga

SEQ ID NO: 769019 - DNA, 20 bp, mouse
gcaaacatcaatatgcaagg

SEQ ID NO: 769020 - DNA, 20 bp, mouse
gcattcccatggagagttta

SEQ ID NO: 769021 - DNA, 20 bp, mouse
gcgtggtatctagttaaaag

SEQ ID NO: 769022 - DNA, 20 bp, mouse
gctattcagttcttcttgca

SEQ ID NO: 769023 - DNA, 20 bp, mouse
gtgggaatgaaagactatta

SEQ ID NO: 769024 - DNA, 20 bp, mouse
gcatgcattcctgttttgtc

SEQ ID NO: 769025 - DNA, 20 bp, mouse
gaaacaaacatcaatatgca

SEQ ID NO: 769026 - DNA, 20 bp, mouse
gtggtcttgccaagagtgag

SEQ ID NO: 769027 - DNA, 20 bp, mouse
ggctgtgttgcaaatgcaaa

SEQ ID NO: 769028 - DNA, 20 bp, mouse
gtgagctttcagaaacctct

SEQ ID NO: 769029 - DNA, 20 bp, mouse
gttggcaagaccaagtcttt

SEQ ID NO: 769030 - DNA, 20 bp, mouse
ggtagttagccactcactct

SEQ ID NO: 769031 - DNA, 20 bp, mouse
gtagcgatgatgtaaaaata

SEQ ID NO: 769032 - DNA, 20 bp, mouse
gttcttgggcctgatgttca

SEQ ID NO: 769033 - DNA, 20 bp, mouse
gttaaaaagctaataattgc

SEQ ID NO: 769034 - DNA, 20 bp, mouse
gtcaaatttaatgacccaag

SEQ ID NO: 769035 - DNA, 20 bp, mouse
gagctcaaatctacctgagc

SEQ ID NO: 769036 - DNA, 20 bp, mouse
gcatctgtttagttcctctt

SEQ ID NO: 769037 - DNA, 20 bp, mouse
gcttgtggagattccccaag

SEQ ID NO: 769038 - DNA, 20 bp, mouse
gtttattagagcagcacttg

SEQ ID NO: 769039 - DNA, 20 bp, mouse
ggatgaagtcaaaatatcac

SEQ ID NO: 769040 - DNA, 20 bp, mouse
gtaataaaaatgtatgtgtt

SEQ ID NO: 769041 - DNA, 20 bp, mouse
gaacagcttcagtgaatagc

SEQ ID NO: 769042 - DNA, 20 bp, mouse
gtatatactatcatatcatc

SEQ ID NO: 769043 - DNA, 20 bp, mouse
gttaaatgtataaataaaag

SEQ ID NO: 769044 - DNA, 20 bp, mouse
gtcatcagcatcttctacac

SEQ ID NO: 769045 - DNA, 20 bp, mouse
ggttgtactttttggaagaa

SEQ ID NO: 769046 - DNA, 20 bp, mouse
gatctccatgatctcttaac

SEQ ID NO: 769047 - DNA, 20 bp, mouse
gtcaaagaccagtgccattg

SEQ ID NO: 769048 - DNA, 20 bp, mouse
gatgttcatttggtgtacca

SEQ ID NO: 769049 - DNA, 20 bp, mouse
gattattgaatgcctattat

SEQ ID NO: 769050 - DNA, 20 bp, mouse
gtttaaaatttaaggttggg

SEQ ID NO: 769051 - DNA, 20 bp, mouse
gacatattactctttttcct

SEQ ID NO: 769052 - DNA, 20 bp, mouse
gtacagtattaaccaataat

SEQ ID NO: 769053 - DNA, 20 bp, mouse
ggtaactgtttatgagtgac

SEQ ID NO: 769054 - DNA, 20 bp, mouse
ggtggtgcccacaatggcac

SEQ ID NO: 769055 - DNA, 20 bp, mouse
gaaaaatattttaaaattta

SEQ ID NO: 769056 - DNA, 20 bp, mouse
ggctaaggtcctatgtacaa

SEQ ID NO: 769057 - DNA, 20 bp, mouse
gggcaaaggcagtgggaatg

SEQ ID NO: 769058 - DNA, 20 bp, mouse
gtttacttaaataaaggcaa

SEQ ID NO: 769059 - DNA, 20 bp, mouse
gtttctatattcatcagaag

SEQ ID NO: 769060 - DNA, 20 bp, mouse
gactaaacactggtttggaa

SEQ ID NO: 769061 - DNA, 20 bp, mouse
gatgaccaaagactaaacac

SEQ ID NO: 769062 - DNA, 20 bp, mouse
gtttctaatattgacaagtc

SEQ ID NO: 769063 - DNA, 20 bp, mouse
gatatagaaaactctgttac

SEQ ID NO: 769064 - DNA, 20 bp, mouse
gaaataaaggcaaaggcagt

SEQ ID NO: 769065 - DNA, 20 bp, mouse
gcaaagactaaacactggtt

SEQ ID NO: 769066 - DNA, 20 bp, mouse
gtcaagaggaactaaataga

SEQ ID NO: 769067 - DNA, 20 bp, mouse
gtattagagcagaaaaactg

SEQ ID NO: 769068 - DNA, 20 bp, mouse
gatactagcttatggactta

SEQ ID NO: 769069 - DNA, 20 bp, mouse
gctcaaaacaacaccagtcc

SEQ ID NO: 769070 - DNA, 20 bp, mouse
gattaaggatgctccaggac

SEQ ID NO: 769071 - DNA, 20 bp, mouse
ggtgtgtgtatactagctta

SEQ ID NO: 769072 - DNA, 20 bp, mouse
gtaatttggtcacaaaaagc

SEQ ID NO: 769073 - DNA, 20 bp, mouse
gggaacacatgtcaacaaaa

SEQ ID NO: 769074 - DNA, 20 bp, mouse
gactgtggaaattcttcaag

SEQ ID NO: 769075 - DNA, 20 bp, mouse
gataacattaaggatgctcc

SEQ ID NO: 769076 - DNA, 20 bp, mouse
gtcaaggacaaattatcaaa

SEQ ID NO: 769077 - DNA, 20 bp, mouse
gtcaggatggttcaaatctc

SEQ ID NO: 769078 - DNA, 20 bp, mouse
gggaatcagctactcattgt

SEQ ID NO: 769079 - DNA, 20 bp, mouse
ggaagcaatgtctctagaac

SEQ ID NO: 769080 - DNA, 20 bp, mouse
gcttaattaaatgacctagg

SEQ ID NO: 769081 - DNA, 20 bp, mouse
gttcctagacttctatatac

SEQ ID NO: 769082 - DNA, 20 bp, mouse
gtcatttatattagctgggt

SEQ ID NO: 769083 - DNA, 20 bp, mouse
gcagctactcattgttggca

SEQ ID NO: 769084 - DNA, 20 bp, mouse
ggctgattcccaagatgatt

SEQ ID NO: 769085 - DNA, 20 bp, mouse
gtctttcatttatattagct

SEQ ID NO: 769086 - DNA, 20 bp, mouse
gacaatagttaacaaatagt

SEQ ID NO: 769087 - DNA, 20 bp, mouse
gtaaagagacttgaaaaaaa

SEQ ID NO: 769088 - DNA, 20 bp, mouse
gtattctaaaatttaagttt

SEQ ID NO: 769089 - DNA, 20 bp, mouse
ggtggtgtccacaataacac

SEQ ID NO: 769090 - DNA, 20 bp, mouse
gtctaaaatttaagtttggg

SEQ ID NO: 769091 - DNA, 20 bp, mouse
ggacttgaaaaaaatggttg

SEQ ID NO: 769092 - DNA, 20 bp, mouse
gtcattgggtgtatgtatca

SEQ ID NO: 769093 - DNA, 20 bp, mouse
gtcaaataccagtgttattg

SEQ ID NO: 769094 - DNA, 20 bp, mouse
gtgactaaaattatcttgtg

SEQ ID NO: 769095 - DNA, 20 bp, mouse
gactttatctaaaaaaatta

SEQ ID NO: 769096 - DNA, 20 bp, mouse
gctaacatgcccacatgctt

SEQ ID NO: 769097 - DNA, 20 bp, mouse
gggcatgttagcacagtata

SEQ ID NO: 769098 - DNA, 20 bp, mouse
gtgcccacatgcttaggaag

SEQ ID NO: 769099 - DNA, 20 bp, mouse
ggttctgtctaataattttg

SEQ ID NO: 769100 - DNA, 20 bp, mouse
ggaccacttcctaagcatgt

SEQ ID NO: 769101 - DNA, 20 bp, mouse
gtctgtttgaatactggaac

SEQ ID NO: 769102 - DNA, 20 bp, mouse
ggtgctgtaaactacaaggc

SEQ ID NO: 769103 - DNA, 20 bp, mouse
gttgaatactggaactggag

SEQ ID NO: 769104 - DNA, 20 bp, mouse
gcttcaaaactagtgtggga

SEQ ID NO: 769105 - DNA, 20 bp, mouse
gatggtttctgaaaacttct

SEQ ID NO: 769106 - DNA, 20 bp, mouse
gacagtagctaaccaacagt

SEQ ID NO: 769107 - DNA, 20 bp, mouse
gttgaagagtgcaatatgat

SEQ ID NO: 769108 - DNA, 20 bp, mouse
gtcaaggaccagtgctaatg

SEQ ID NO: 769109 - DNA, 20 bp, mouse
gggcttgatgcagatactca

SEQ ID NO: 769110 - DNA, 20 bp, mouse
gcaccaaataaacatagaaa

SEQ ID NO: 769111 - DNA, 20 bp, mouse
ggtggtacccacattagcac

SEQ ID NO: 769112 - DNA, 20 bp, mouse
gttcttaattgataaactaa

SEQ ID NO: 769113 - DNA, 20 bp, mouse
gaaagaacaacctttttaga

SEQ ID NO: 769114 - DNA, 20 bp, mouse
gatttggtgtattaaggcca

SEQ ID NO: 769115 - DNA, 20 bp, mouse
ggttaatattgcaatttgtg

SEQ ID NO: 769116 - DNA, 20 bp, mouse
gctttggtgacatttatgag

SEQ ID NO: 769117 - DNA, 20 bp, mouse
ggacattattaagagttctt

SEQ ID NO: 769118 - DNA, 20 bp, mouse
gaacaagaacatgaatctgt

SEQ ID NO: 769119 - DNA, 20 bp, mouse
gtacagtgaacgtttttagg

SEQ ID NO: 769120 - DNA, 20 bp, mouse
gtgtcataaaggatacctca

SEQ ID NO: 769121 - DNA, 20 bp, mouse
gcacacattccacacctcag

SEQ ID NO: 769122 - DNA, 20 bp, mouse
gcactacagtgaacgttttt

SEQ ID NO: 769123 - DNA, 20 bp, mouse
gtgttcttgttcacaattaa

SEQ ID NO: 769124 - DNA, 20 bp, mouse
gtgcataagaatagctattc

SEQ ID NO: 769125 - DNA, 20 bp, mouse
gagaaaactaaaaacagtgg

SEQ ID NO: 769126 - DNA, 20 bp, mouse
gcttacttggcatacatttg

SEQ ID NO: 769127 - DNA, 20 bp, mouse
gactgagagcataccataga

SEQ ID NO: 769128 - DNA, 20 bp, mouse
gaaaaggactttgatttaag

SEQ ID NO: 769129 - DNA, 20 bp, mouse
gcatggaagatatcaatagc

SEQ ID NO: 769130 - DNA, 20 bp, mouse
gactagacccagaagttctc

SEQ ID NO: 769131 - DNA, 20 bp, mouse
gcattttattagaaagaggt

SEQ ID NO: 769132 - DNA, 20 bp, mouse
gacaaaatttgctccatcta

SEQ ID NO: 769133 - DNA, 20 bp, mouse
ggcatacatttgaggcacag

SEQ ID NO: 769134 - DNA, 20 bp, mouse
gctggatccttccatatact

SEQ ID NO: 769135 - DNA, 20 bp, mouse
gtaaatcaaagtccttttgc

SEQ ID NO: 769136 - DNA, 20 bp, mouse
gaaaggaatcacatttcctt

SEQ ID NO: 769137 - DNA, 20 bp, mouse
gttacactggtccatcattc

SEQ ID NO: 769138 - DNA, 20 bp, mouse
gcttcacatctttactataa

SEQ ID NO: 769139 - DNA, 20 bp, mouse
gtccagaaattttgaaaaaa

SEQ ID NO: 769140 - DNA, 20 bp, mouse
gcacaagacattaagaagaa

SEQ ID NO: 769141 - DNA, 20 bp, mouse
gtcagtttattccagaatga

SEQ ID NO: 769142 - DNA, 20 bp, mouse
ggtctatttttgaaacaaga

SEQ ID NO: 769143 - DNA, 20 bp, mouse
gcaattgcttctttgcccca

SEQ ID NO: 769144 - DNA, 20 bp, mouse
gaccattttttcaaaatttc

SEQ ID NO: 769145 - DNA, 20 bp, mouse
gtagtaaagatgtgaagaaa

SEQ ID NO: 769146 - DNA, 20 bp, mouse
gtaaatatacaaatagagag

SEQ ID NO: 769147 - DNA, 20 bp, mouse
gcatcaaattacttagggta

SEQ ID NO: 769148 - DNA, 20 bp, mouse
gcgagtttccaagtcattta

SEQ ID NO: 769149 - DNA, 20 bp, mouse
gaactcgcatatttataaca

SEQ ID NO: 769150 - DNA, 20 bp, mouse
gtctaaatctatcaggatct

SEQ ID NO: 769151 - DNA, 20 bp, mouse
gaaccttgccttaaatgact

SEQ ID NO: 769152 - DNA, 20 bp, mouse
gactatgcatcaaattactt

SEQ ID NO: 769153 - DNA, 20 bp, mouse
ggaaaggagattccatgagt

SEQ ID NO: 769154 - DNA, 20 bp, mouse
gaatttgatgcatagtggtg

SEQ ID NO: 769155 - DNA, 20 bp, mouse
gttatgaagctggtatttaa

SEQ ID NO: 769156 - DNA, 20 bp, mouse
ggcagctccaacattgtata

SEQ ID NO: 769157 - DNA, 20 bp, mouse
gttaatccaaggcattgtac

SEQ ID NO: 769158 - DNA, 20 bp, mouse
gagctggaaatcatcttttt

SEQ ID NO: 769159 - DNA, 20 bp, mouse
gataaaggaagaaaacctgt

SEQ ID NO: 769160 - DNA, 20 bp, mouse
gactaagccttatacaatgt

SEQ ID NO: 769161 - DNA, 20 bp, mouse
gacaagccagtacaatgcct

SEQ ID NO: 769162 - DNA, 20 bp, mouse
gctacttcatcacttcctac

SEQ ID NO: 769163 - DNA, 20 bp, mouse
gctgcaattcataagtgagc

SEQ ID NO: 769164 - DNA, 20 bp, mouse
gactcattgactatagcatc

SEQ ID NO: 769165 - DNA, 20 bp, mouse
gaaacaacaaatactcccag

SEQ ID NO: 769166 - DNA, 20 bp, mouse
gaggaacttttataagtgtg

SEQ ID NO: 769167 - DNA, 20 bp, mouse
gaggtagatggtgtgtttaa

SEQ ID NO: 769168 - DNA, 20 bp, mouse
ggagagtgtagaggatgtaa

SEQ ID NO: 769169 - DNA, 20 bp, mouse
ggtagaggatgtaagggctc

SEQ ID NO: 769170 - DNA, 20 bp, mouse
gtgtatgaatataagtggaa

SEQ ID NO: 769171 - DNA, 20 bp, mouse
gatgtaagggctctggtgga

SEQ ID NO: 769172 - DNA, 20 bp, mouse
gtagctaagatttaatgagg

SEQ ID NO: 769173 - DNA, 20 bp, mouse
ggatttaatgaggaggtaga

SEQ ID NO: 769174 - DNA, 20 bp, mouse
gtcaagctctatttagagta

SEQ ID NO: 769175 - DNA, 20 bp, mouse
gtgttaagagagtcaatatg

SEQ ID NO: 769176 - DNA, 20 bp, mouse
gaaaagagataattgatccc

SEQ ID NO: 769177 - DNA, 20 bp, mouse
gatgcaaaggcattgtcttg

SEQ ID NO: 769178 - DNA, 20 bp, mouse
gccgttctctatattatctc

SEQ ID NO: 769179 - DNA, 20 bp, mouse
gtattctggagagacattat

SEQ ID NO: 769180 - DNA, 20 bp, mouse
gaaaaaaaatcattgttgag

SEQ ID NO: 769181 - DNA, 20 bp, mouse
gggacactacaaagatgcaa

SEQ ID NO: 769182 - DNA, 20 bp, mouse
ggtccttcaagcagatattc

SEQ ID NO: 769183 - DNA, 20 bp, mouse
ggatcaattatctcttttga

SEQ ID NO: 769184 - DNA, 20 bp, mouse
gaaatccaagtgtcatgcca

SEQ ID NO: 769185 - DNA, 20 bp, mouse
gtccaagtgtcatgccatgg

SEQ ID NO: 769186 - DNA, 20 bp, mouse
gtgactatctgtggagagta

SEQ ID NO: 769187 - DNA, 20 bp, mouse
ggaacctttgtgactatctg

SEQ ID NO: 769188 - DNA, 20 bp, mouse
gtattctgaggagacatgtt

SEQ ID NO: 769189 - DNA, 20 bp, mouse
gcttaacaacccaggttcat

SEQ ID NO: 769190 - DNA, 20 bp, mouse
gaaggttccagaaaggttca

SEQ ID NO: 769191 - DNA, 20 bp, mouse
gcaggttcattggaagactt

SEQ ID NO: 769192 - DNA, 20 bp, mouse
gggaagaaactattcttgaa

SEQ ID NO: 769193 - DNA, 20 bp, mouse
gagattgatcatgggtgagg

SEQ ID NO: 769194 - DNA, 20 bp, mouse
gatttgagaagattgatcat

SEQ ID NO: 769195 - DNA, 20 bp, mouse
gcaatgtccctgaacctttc

SEQ ID NO: 769196 - DNA, 20 bp, mouse
gcacaggcaggatgtcattt

SEQ ID NO: 769197 - DNA, 20 bp, mouse
gggcaggatgtcatttggga

SEQ ID NO: 769198 - DNA, 20 bp, mouse
gcgagttgtcttcatgatct

SEQ ID NO: 769199 - DNA, 20 bp, mouse
gagaccttctgttaaagcac

SEQ ID NO: 769200 - DNA, 20 bp, mouse
gggtcaggtagttgagaagt

SEQ ID NO: 769201 - DNA, 20 bp, mouse
gcaggtagttgagaagtagg

SEQ ID NO: 769202 - DNA, 20 bp, mouse
gaacactgaagagaagttta

SEQ ID NO: 769203 - DNA, 20 bp, mouse
ggtctacaaaggcaaagcta

SEQ ID NO: 769204 - DNA, 20 bp, mouse
gagtgtttcaattccatttg

SEQ ID NO: 769205 - DNA, 20 bp, mouse
gtttaaggatttttcttgag

SEQ ID NO: 769206 - DNA, 20 bp, mouse
ggttagacctatagagtttt

SEQ ID NO: 769207 - DNA, 20 bp, mouse
gataggtctaaccttctctt

SEQ ID NO: 769208 - DNA, 20 bp, mouse
gagtcttcccaaaactctat

SEQ ID NO: 769209 - DNA, 20 bp, mouse
gcaagatatggatgtatgta

SEQ ID NO: 769210 - DNA, 20 bp, mouse
gctaggtttcatctgtgact

SEQ ID NO: 769211 - DNA, 20 bp, mouse
gacatcatagaacaccccaa

SEQ ID NO: 769212 - DNA, 20 bp, mouse
gtcctctgcttgttcctttg

SEQ ID NO: 769213 - DNA, 20 bp, mouse
ggttggagattagcaagata

SEQ ID NO: 769214 - DNA, 20 bp, mouse
gtctgcataaatttttatat

SEQ ID NO: 769215 - DNA, 20 bp, mouse
ggttttttagaactatttta

SEQ ID NO: 769216 - DNA, 20 bp, mouse
gatacttagacagtagttgg

SEQ ID NO: 769217 - DNA, 20 bp, mouse
gttgatacttagacagtagt

SEQ ID NO: 769218 - DNA, 20 bp, mouse
gtgctgattcttgccattgc

SEQ ID NO: 769219 - DNA, 20 bp, mouse
gaagtcatagattttcctgg

SEQ ID NO: 769220 - DNA, 20 bp, mouse
gaaacatttcaatttccacc

SEQ ID NO: 769221 - DNA, 20 bp, mouse
gtgaaagtcatagattttcc

SEQ ID NO: 769222 - DNA, 20 bp, mouse
gcaattccttaaacattatt

SEQ ID NO: 769223 - DNA, 20 bp, mouse
gttgataaatatacctgcaa

SEQ ID NO: 769224 - DNA, 20 bp, mouse
ggtcaatagaaatacaatta

SEQ ID NO: 769225 - DNA, 20 bp, mouse
gctattccaaataatgttta

SEQ ID NO: 769226 - DNA, 20 bp, mouse
gaacacacagcctgatgaac

SEQ ID NO: 769227 - DNA, 20 bp, mouse
gtcaccaaaggcctcattca

SEQ ID NO: 769228 - DNA, 20 bp, mouse
ggaaatctaaacacgactaa

SEQ ID NO: 769229 - DNA, 20 bp, mouse
gataccctgaatgaggcctt

SEQ ID NO: 769230 - DNA, 20 bp, mouse
gtgtgtgttctcttcaccaa

SEQ ID NO: 769231 - DNA, 20 bp, mouse
gcaaaagcaccatgattaac

SEQ ID NO: 769232 - DNA, 20 bp, mouse
gtaaaattggaccatagtat

SEQ ID NO: 769233 - DNA, 20 bp, mouse
gtttcacagttacacagatg

SEQ ID NO: 769234 - DNA, 20 bp, mouse
gtattatatgaccaatacta

SEQ ID NO: 769235 - DNA, 20 bp, mouse
ggtcgtgtttagatttctgt

SEQ ID NO: 769236 - DNA, 20 bp, mouse
gtagacctctgggagctgag

SEQ ID NO: 769237 - DNA, 20 bp, mouse
gaagctaattctagacctct

SEQ ID NO: 769238 - DNA, 20 bp, mouse
gttaaatggcatcttggcta

SEQ ID NO: 769239 - DNA, 20 bp, mouse
gcccagaatagtccagtcca

SEQ ID NO: 769240 - DNA, 20 bp, mouse
gataagcataagaacccata

SEQ ID NO: 769241 - DNA, 20 bp, mouse
gttttgatcacagatgtcgt

SEQ ID NO: 769242 - DNA, 20 bp, mouse
gagtccaggggaaatggatg

SEQ ID NO: 769243 - DNA, 20 bp, mouse
gactcatgaaaatgctggta

SEQ ID NO: 769244 - DNA, 20 bp, mouse
gaatccactcatgaaaatgc

SEQ ID NO: 769245 - DNA, 20 bp, mouse
gatccctcatccatttcccc

SEQ ID NO: 769246 - DNA, 20 bp, mouse
gttgaagatgagaagtagat

SEQ ID NO: 769247 - DNA, 20 bp, mouse
gataggatgcacatgaaccc

SEQ ID NO: 769248 - DNA, 20 bp, mouse
gaagcataaaagactttggt

SEQ ID NO: 769249 - DNA, 20 bp, mouse
gccaggggataatctcaaat

SEQ ID NO: 769250 - DNA, 20 bp, mouse
ggaagcctcactcaatgtaa

SEQ ID NO: 769251 - DNA, 20 bp, mouse
gcaaagtcttttatgcttat

SEQ ID NO: 769252 - DNA, 20 bp, mouse
gcagacctttacattgagtg

SEQ ID NO: 769253 - DNA, 20 bp, mouse
ggcatgattgtgactgttaa

SEQ ID NO: 769254 - DNA, 20 bp, mouse
gtattttgtgatctcattgt

SEQ ID NO: 769255 - DNA, 20 bp, mouse
gtcaattaagatcactgtgc

SEQ ID NO: 769256 - DNA, 20 bp, mouse
gtagaaatgtagttgggttg

SEQ ID NO: 769257 - DNA, 20 bp, mouse
gaagatcttgactactgtct

SEQ ID NO: 769258 - DNA, 20 bp, mouse
gtgacctctcaagtacccaa

SEQ ID NO: 769259 - DNA, 20 bp, mouse
gctacaaacaacatttgcag

SEQ ID NO: 769260 - DNA, 20 bp, mouse
ggcacaaaatagcaagaaga

SEQ ID NO: 769261 - DNA, 20 bp, mouse
ggaaacaattatcagtcctt

SEQ ID NO: 769262 - DNA, 20 bp, mouse
gtcttctacttactctcact

SEQ ID NO: 769263 - DNA, 20 bp, mouse
gaaaaagaagcttgtcactc

SEQ ID NO: 769264 - DNA, 20 bp, mouse
gctgagagggggatagcaac

SEQ ID NO: 769265 - DNA, 20 bp, mouse
gttcagagagatataggatc

SEQ ID NO: 769266 - DNA, 20 bp, mouse
gcaatatgatataactgcat

SEQ ID NO: 769267 - DNA, 20 bp, mouse
gtgcagctatgttcacctca

SEQ ID NO: 769268 - DNA, 20 bp, mouse
gagcacatctctgtccctag

SEQ ID NO: 769269 - DNA, 20 bp, mouse
gttattacttctggtccctg

SEQ ID NO: 769270 - DNA, 20 bp, mouse
gctgtccatgaaaatccatt

SEQ ID NO: 769271 - DNA, 20 bp, mouse
gtggacaatacacactatat

SEQ ID NO: 769272 - DNA, 20 bp, mouse
ggtacttatcttattacttc

SEQ ID NO: 769273 - DNA, 20 bp, mouse
gaaaaacacaatgaaatgcc

SEQ ID NO: 769274 - DNA, 20 bp, mouse
gtatgataatatctgcccct

SEQ ID NO: 769275 - DNA, 20 bp, mouse
gtcattactgaacaaataaa

SEQ ID NO: 769276 - DNA, 20 bp, mouse
gtaccagtgggagtaagcaa

SEQ ID NO: 769277 - DNA, 20 bp, mouse
ggggagtaagcaaaggacct

SEQ ID NO: 769278 - DNA, 20 bp, mouse
gtccttaagagagaagttct

SEQ ID NO: 769279 - DNA, 20 bp, mouse
gaccttggcaaagatttcaa

SEQ ID NO: 769280 - DNA, 20 bp, mouse
gctacaaacatcattagcag

SEQ ID NO: 769281 - DNA, 20 bp, mouse
ggtcctttgcttactcccac

SEQ ID NO: 769282 - DNA, 20 bp, mouse
gtagctttgcaaatacccag

SEQ ID NO: 769283 - DNA, 20 bp, mouse
ggagaggattaccaatcctc

SEQ ID NO: 769284 - DNA, 20 bp, mouse
gttggtgtctgctgatgtta

SEQ ID NO: 769285 - DNA, 20 bp, mouse
gtagttttagaaatgctgtt

SEQ ID NO: 769286 - DNA, 20 bp, mouse
gaaagccctcatagagggac

SEQ ID NO: 769287 - DNA, 20 bp, mouse
gaattcctaatgggttttaa

SEQ ID NO: 769288 - DNA, 20 bp, mouse
ggaagggaaggaaacctggt

SEQ ID NO: 769289 - DNA, 20 bp, mouse
gagggaggttgtaaggaggc

SEQ ID NO: 769290 - DNA, 20 bp, mouse
gtcttccattaaaacccatt

SEQ ID NO: 769291 - DNA, 20 bp, mouse
gagaactctttttctcttaa

SEQ ID NO: 769292 - DNA, 20 bp, mouse
gaaaatcagatttgataggt

SEQ ID NO: 769293 - DNA, 20 bp, mouse
gcagtcaattcatccctacc

SEQ ID NO: 769294 - DNA, 20 bp, mouse
gtaggttggataattcctaa

SEQ ID NO: 769295 - DNA, 20 bp, mouse
gtgtatcatcttattacttc

SEQ ID NO: 769296 - DNA, 20 bp, mouse
gtagtgctccgtgaagcaaa

SEQ ID NO: 769297 - DNA, 20 bp, mouse
ggtcggaagtacatctcatt

SEQ ID NO: 769298 - DNA, 20 bp, mouse
ggtacttccgaccatattca

SEQ ID NO: 769299 - DNA, 20 bp, mouse
gtatacaagaaaattactcc

SEQ ID NO: 769300 - DNA, 20 bp, mouse
ggaaaattactccaggagat

SEQ ID NO: 769301 - DNA, 20 bp, mouse
gtattgaccctgaatatggt

SEQ ID NO: 769302 - DNA, 20 bp, mouse
gtaaattcgtataaaatttc

SEQ ID NO: 769303 - DNA, 20 bp, mouse
gagatgtgagaaaccagatg

SEQ ID NO: 769304 - DNA, 20 bp, mouse
ggtcaatataatgtaatttg

SEQ ID NO: 769305 - DNA, 20 bp, mouse
gtgcaacatttcctatctcc

SEQ ID NO: 769306 - DNA, 20 bp, mouse
gaatgtgagtgcactctgta

SEQ ID NO: 769307 - DNA, 20 bp, mouse
gcaagaatacccctgatata

SEQ ID NO: 769308 - DNA, 20 bp, mouse
gaacaccactccatatatca

SEQ ID NO: 769309 - DNA, 20 bp, mouse
gttagagagtagagtcaaag

SEQ ID NO: 769310 - DNA, 20 bp, mouse
gatacccctgatatatggag

SEQ ID NO: 769311 - DNA, 20 bp, mouse
ggcccatgttgaaaaatgat

SEQ ID NO: 769312 - DNA, 20 bp, mouse
gccaaggtaggaaatgatcc

SEQ ID NO: 769313 - DNA, 20 bp, mouse
gaccacctcactgtaaacca

SEQ ID NO: 769314 - DNA, 20 bp, mouse
ggcattaatgcatatgtgag

SEQ ID NO: 769315 - DNA, 20 bp, mouse
gcctcactgtaaaccaaggt

SEQ ID NO: 769316 - DNA, 20 bp, mouse
gagcaaggtcatttgatcat

SEQ ID NO: 769317 - DNA, 20 bp, mouse
gctgatatataaaggggtgt

SEQ ID NO: 769318 - DNA, 20 bp, mouse
gggaaaatgagtcaagagaa

SEQ ID NO: 769319 - DNA, 20 bp, mouse
gccactcattgttcaacgag

SEQ ID NO: 769320 - DNA, 20 bp, mouse
ggaatatccctgatatataa

SEQ ID NO: 769321 - DNA, 20 bp, mouse
gccaccccataaaccaagac

SEQ ID NO: 769322 - DNA, 20 bp, mouse
gcaaagaaggaaatctttag

SEQ ID NO: 769323 - DNA, 20 bp, mouse
gtgttcaacgagaggcagac

SEQ ID NO: 769324 - DNA, 20 bp, mouse
gtttcctgtcttggtttatg

SEQ ID NO: 769325 - DNA, 20 bp, mouse
gatgagaaaatcacctagtt

SEQ ID NO: 769326 - DNA, 20 bp, mouse
gataagtaagcagtagttag

SEQ ID NO: 769327 - DNA, 20 bp, mouse
gtgcagattcttggcattga

SEQ ID NO: 769328 - DNA, 20 bp, mouse
ggctaagagcctaatcaaat

SEQ ID NO: 769329 - DNA, 20 bp, mouse
gaaatagttcttctgtgatg

SEQ ID NO: 769330 - DNA, 20 bp, mouse
ggccatgagctacaataccg

SEQ ID NO: 769331 - DNA, 20 bp, mouse
gaaggatgccccatttgatt

SEQ ID NO: 769332 - DNA, 20 bp, mouse
ggtatatctatcatgctttc

SEQ ID NO: 769333 - DNA, 20 bp, mouse
gaagtcataggtttccttga

SEQ ID NO: 769334 - DNA, 20 bp, mouse
gaacatttcaatttccatca

SEQ ID NO: 769335 - DNA, 20 bp, mouse
gttatcacctgtctacaact

SEQ ID NO: 769336 - DNA, 20 bp, mouse
ggggcaagtaatcatttcta

SEQ ID NO: 769337 - DNA, 20 bp, mouse
gagcccaaattcaaaatgtg

SEQ ID NO: 769338 - DNA, 20 bp, mouse
gaatggaatgattagtaagt

SEQ ID NO: 769339 - DNA, 20 bp, mouse
gataaaatgttagtgtacta

SEQ ID NO: 769340 - DNA, 20 bp, mouse
gagggctaatgtaaaagtta

SEQ ID NO: 769341 - DNA, 20 bp, mouse
gaattcaaaatgtgtggtta

SEQ ID NO: 769342 - DNA, 20 bp, mouse
gtcaatcaaggcttatcact

SEQ ID NO: 769343 - DNA, 20 bp, mouse
gtagcagaagagaaacacca

SEQ ID NO: 769344 - DNA, 20 bp, mouse
gcaccagttacatcatttac

SEQ ID NO: 769345 - DNA, 20 bp, mouse
gctcacttagaagtcaatca

SEQ ID NO: 769346 - DNA, 20 bp, mouse
gtatctctctaaatatcata

SEQ ID NO: 769347 - DNA, 20 bp, mouse
ggatatttagagagataccc

SEQ ID NO: 769348 - DNA, 20 bp, mouse
ggcaaaacagcctgagcttt

SEQ ID NO: 769349 - DNA, 20 bp, mouse
gtaattctctgaggaacaga

SEQ ID NO: 769350 - DNA, 20 bp, mouse
gtaataaataaccatttctc

SEQ ID NO: 769351 - DNA, 20 bp, mouse
gctagagtagtaacatttaa

SEQ ID NO: 769352 - DNA, 20 bp, mouse
gcagatataataattctctg

SEQ ID NO: 769353 - DNA, 20 bp, mouse
gttttctgttaatagctaaa

SEQ ID NO: 769354 - DNA, 20 bp, mouse
gagagtttaagatacattct

SEQ ID NO: 769355 - DNA, 20 bp, mouse
gaaagcactcccaaaagctc

SEQ ID NO: 769356 - DNA, 20 bp, mouse
gcaggtggaggaattgcggg

SEQ ID NO: 769357 - DNA, 20 bp, mouse
gccagcaggtggaggaattg

SEQ ID NO: 769358 - DNA, 20 bp, mouse
gtaagagcaggccttttggt

SEQ ID NO: 769359 - DNA, 20 bp, mouse
gtctctgcctgcctaccaaa

SEQ ID NO: 769360 - DNA, 20 bp, mouse
gacctggacagaaagttaga

SEQ ID NO: 769361 - DNA, 20 bp, mouse
gtttctgtccaggttatgag

SEQ ID NO: 769362 - DNA, 20 bp, mouse
gatcaaaaggaatactcaag

SEQ ID NO: 769363 - DNA, 20 bp, mouse
gagcaggccttttggtaggc

SEQ ID NO: 769364 - DNA, 20 bp, mouse
gacaaaagagcccgagcttt

SEQ ID NO: 769365 - DNA, 20 bp, mouse
gtccttctaactttctgtcc

SEQ ID NO: 769366 - DNA, 20 bp, mouse
gaggcatattcttcaaaata

SEQ ID NO: 769367 - DNA, 20 bp, mouse
gcagtttctggcagaattat

SEQ ID NO: 769368 - DNA, 20 bp, mouse
gaaagaagacgcattgaaga

SEQ ID NO: 769369 - DNA, 20 bp, mouse
gaagaacataacattatttt

SEQ ID NO: 769370 - DNA, 20 bp, mouse
gaagacagtgatccagtttc

SEQ ID NO: 769371 - DNA, 20 bp, mouse
gtattagttagtccatattt

SEQ ID NO: 769372 - DNA, 20 bp, mouse
gttactcttctggtattcaa

SEQ ID NO: 769373 - DNA, 20 bp, mouse
gtgtctcaaggtctctgcag

SEQ ID NO: 769374 - DNA, 20 bp, mouse
gatgcacttccattgtctca

SEQ ID NO: 769375 - DNA, 20 bp, mouse
gaaaataataacctaacagt

SEQ ID NO: 769376 - DNA, 20 bp, mouse
gtaacaagtgttcaataact

SEQ ID NO: 769377 - DNA, 20 bp, mouse
gacatgagaactgtatgtag

SEQ ID NO: 769378 - DNA, 20 bp, mouse
gcaagggctttgctaattga

SEQ ID NO: 769379 - DNA, 20 bp, mouse
gttgcatatggcattgtaca

SEQ ID NO: 769380 - DNA, 20 bp, mouse
gaatctgtgcttattgcata

SEQ ID NO: 769381 - DNA, 20 bp, mouse
gcaaatccatatgttttcca

SEQ ID NO: 769382 - DNA, 20 bp, mouse
ggtggatcggaaacaggttc

SEQ ID NO: 769383 - DNA, 20 bp, mouse
gatcggaaacaggttctggg

SEQ ID NO: 769384 - DNA, 20 bp, mouse
gtcaatagcacatagtactt

SEQ ID NO: 769385 - DNA, 20 bp, mouse
gaaactatacagaaataccc

SEQ ID NO: 769386 - DNA, 20 bp, mouse
gacagagaatattaattaga

SEQ ID NO: 769387 - DNA, 20 bp, mouse
gggtcaggacaaaagtaaga

SEQ ID NO: 769388 - DNA, 20 bp, mouse
gatggctattgacaaaacaa

SEQ ID NO: 769389 - DNA, 20 bp, mouse
ggaaaagtatgctaatgtga

SEQ ID NO: 769390 - DNA, 20 bp, mouse
gaaagtaataaagtcaggtc

SEQ ID NO: 769391 - DNA, 20 bp, mouse
gggtcatttccaaagttaga

SEQ ID NO: 769392 - DNA, 20 bp, mouse
gatattatatccaaatgcta

SEQ ID NO: 769393 - DNA, 20 bp, mouse
gtgagaaaagtaataaagtc

SEQ ID NO: 769394 - DNA, 20 bp, mouse
gagtgttcaaagtggatttt

SEQ ID NO: 769395 - DNA, 20 bp, mouse
gatacaaaatatactttgtg

SEQ ID NO: 769396 - DNA, 20 bp, mouse
gtggacaaacaaatctgtta

SEQ ID NO: 769397 - DNA, 20 bp, mouse
gcgtagtatctcaactacat

SEQ ID NO: 769398 - DNA, 20 bp, mouse
gggtaactacagactttagt

SEQ ID NO: 769399 - DNA, 20 bp, mouse
gaagaatctgagttatttcc

SEQ ID NO: 769400 - DNA, 20 bp, mouse
ggaaaaatggattattcatc

SEQ ID NO: 769401 - DNA, 20 bp, mouse
gtagttacctactatatgcc

SEQ ID NO: 769402 - DNA, 20 bp, mouse
gcattctcttcagtagtagc

SEQ ID NO: 769403 - DNA, 20 bp, mouse
gactacatgggtcactacag

SEQ ID NO: 769404 - DNA, 20 bp, mouse
gcagattctttggtgaaaaa

SEQ ID NO: 769405 - DNA, 20 bp, mouse
gactagaaaatattctgaat

SEQ ID NO: 769406 - DNA, 20 bp, mouse
gacatgactatggtagagag

SEQ ID NO: 769407 - DNA, 20 bp, mouse
gtctgtcacctggactgata

SEQ ID NO: 769408 - DNA, 20 bp, mouse
gctaatgaagtgtctactga

SEQ ID NO: 769409 - DNA, 20 bp, mouse
gttttgctagccaactcaga

SEQ ID NO: 769410 - DNA, 20 bp, mouse
gtctactacaagaaaatatc

SEQ ID NO: 769411 - DNA, 20 bp, mouse
gttcaataccttatcagtcc

SEQ ID NO: 769412 - DNA, 20 bp, mouse
gtaaggtattgaaaacttct

SEQ ID NO: 769413 - DNA, 20 bp, mouse
gagaaaaacaccgtctgagt

SEQ ID NO: 769414 - DNA, 20 bp, mouse
gagaaaaagaaacatgacta

SEQ ID NO: 769415 - DNA, 20 bp, mouse
gaaaatacaaagaatgtcat

SEQ ID NO: 769416 - DNA, 20 bp, mouse
gtgaaagtcacaggtttctt

SEQ ID NO: 769417 - DNA, 20 bp, mouse
gttgctaagagcaaaatcaa

SEQ ID NO: 769418 - DNA, 20 bp, mouse
gaccatctgctacaatatag

SEQ ID NO: 769419 - DNA, 20 bp, mouse
gtgttgattcttgccattga

SEQ ID NO: 769420 - DNA, 20 bp, mouse
gttgctcttagcaacacttt

SEQ ID NO: 769421 - DNA, 20 bp, mouse
gtccttcctagcaagccatg

SEQ ID NO: 769422 - DNA, 20 bp, mouse
gacactttaggcagtttcta

SEQ ID NO: 769423 - DNA, 20 bp, mouse
gttctatggtaataaccaca

SEQ ID NO: 769424 - DNA, 20 bp, mouse
gaccacatggcttgctagga

SEQ ID NO: 769425 - DNA, 20 bp, mouse
gtagagaaaccaaaacaata

SEQ ID NO: 769426 - DNA, 20 bp, mouse
gtggtattatgggattatgg

SEQ ID NO: 769427 - DNA, 20 bp, mouse
gtctaacagacgatatttat

SEQ ID NO: 769428 - DNA, 20 bp, mouse
gttatatattgtgtctcatc

SEQ ID NO: 769429 - DNA, 20 bp, mouse
gtctgttagatgcgcagctt

SEQ ID NO: 769430 - DNA, 20 bp, mouse
gtcccataataccaatctgt

SEQ ID NO: 769431 - DNA, 20 bp, mouse
ggattggtattatgggatta

SEQ ID NO: 769432 - DNA, 20 bp, mouse
gcaatgataagcttgtgctt

SEQ ID NO: 769433 - DNA, 20 bp, mouse
gcaatctttctacaattttt

SEQ ID NO: 769434 - DNA, 20 bp, mouse
gttgacatcttagtattata

SEQ ID NO: 769435 - DNA, 20 bp, mouse
ggcataatttacagtagaca

SEQ ID NO: 769436 - DNA, 20 bp, mouse
gtttatgacttaaaaatata

SEQ ID NO: 769437 - DNA, 20 bp, mouse
gactatatctcagatgtctg

SEQ ID NO: 769438 - DNA, 20 bp, mouse
gtggaattatgatggtcaag

SEQ ID NO: 769439 - DNA, 20 bp, mouse
gtttcattctggaattatga

SEQ ID NO: 769440 - DNA, 20 bp, mouse
gagatactttaaacttgaga

SEQ ID NO: 769441 - DNA, 20 bp, mouse
gctccttaatgtagaatcat

SEQ ID NO: 769442 - DNA, 20 bp, mouse
ggacccatgattctacatta

SEQ ID NO: 769443 - DNA, 20 bp, mouse
gtattatgtcttagctcaga

SEQ ID NO: 769444 - DNA, 20 bp, mouse
gatactgtttaaaatattag

SEQ ID NO: 769445 - DNA, 20 bp, mouse
gtaaatctacattgtctaca

SEQ ID NO: 769446 - DNA, 20 bp, mouse
gttaatgcttaaaaaatata

SEQ ID NO: 769447 - DNA, 20 bp, mouse
gaggttttggtaagagttaa

SEQ ID NO: 769448 - DNA, 20 bp, mouse
gacagagacagagagacaac

SEQ ID NO: 769449 - DNA, 20 bp, mouse
ggaaagaaataatttaaatg

SEQ ID NO: 769450 - DNA, 20 bp, mouse
gtcctgaaatagaaacaata

SEQ ID NO: 769451 - DNA, 20 bp, mouse
gaatagaaacaataaggttt

SEQ ID NO: 769452 - DNA, 20 bp, mouse
gtttctatttcaggagtctt

SEQ ID NO: 769453 - DNA, 20 bp, mouse
gaaataatttaaatgtgggc

SEQ ID NO: 769454 - DNA, 20 bp, mouse
gtgcttcatttattgttgca

SEQ ID NO: 769455 - DNA, 20 bp, mouse
gttcatttattgttgcatgg

SEQ ID NO: 769456 - DNA, 20 bp, mouse
gtggctaagtccttagatca

SEQ ID NO: 769457 - DNA, 20 bp, mouse
gcaaaaatagatctattcct

SEQ ID NO: 769458 - DNA, 20 bp, mouse
gttaaagtgagtgataaaaa

SEQ ID NO: 769459 - DNA, 20 bp, mouse
gacaatgagtttcagagtgc

SEQ ID NO: 769460 - DNA, 20 bp, mouse
gaatgtctttccttgatcta

SEQ ID NO: 769461 - DNA, 20 bp, mouse
gatctctgaatgacaattta

SEQ ID NO: 769462 - DNA, 20 bp, mouse
gacataagcacaaaattccc

SEQ ID NO: 769463 - DNA, 20 bp, mouse
gagggaatgttcctaaatac

SEQ ID NO: 769464 - DNA, 20 bp, mouse
gagaaaaagtatagcaacat

SEQ ID NO: 769465 - DNA, 20 bp, mouse
gaggaaaatatacatctgat

SEQ ID NO: 769466 - DNA, 20 bp, mouse
gggaagctagaagagattga

SEQ ID NO: 769467 - DNA, 20 bp, mouse
gaagtaagaatggtgatcag

SEQ ID NO: 769468 - DNA, 20 bp, mouse
gctgaagaatcatggattta

SEQ ID NO: 769469 - DNA, 20 bp, mouse
ggaaatacaggaataacagt

SEQ ID NO: 769470 - DNA, 20 bp, mouse
gcttgagtgcaaagactcat

SEQ ID NO: 769471 - DNA, 20 bp, mouse
gaatgttgctagatactaaa

SEQ ID NO: 769472 - DNA, 20 bp, mouse
ggtatcagagtcagaaatac

SEQ ID NO: 769473 - DNA, 20 bp, mouse
ggggctactcttcttgtttt

SEQ ID NO: 769474 - DNA, 20 bp, mouse
gtcatggatttaaggctcct

SEQ ID NO: 769475 - DNA, 20 bp, mouse
gaatagagagttataattaa

SEQ ID NO: 769476 - DNA, 20 bp, mouse
gtatgattgtcaaatataga

SEQ ID NO: 769477 - DNA, 20 bp, mouse
gttaaagtgattgataaaaa

SEQ ID NO: 769478 - DNA, 20 bp, mouse
ggaaacaataacttaatgtt

SEQ ID NO: 769479 - DNA, 20 bp, mouse
gagaaaaagtatagcaacat

SEQ ID NO: 769480 - DNA, 20 bp, mouse
gagggaatgttcctaaatac

SEQ ID NO: 769481 - DNA, 20 bp, mouse
gtctgattggtattatgtat

SEQ ID NO: 769482 - DNA, 20 bp, mouse
ggctatactttttctagtca

SEQ ID NO: 769483 - DNA, 20 bp, mouse
gaggaaaatatacatctgat

SEQ ID NO: 769484 - DNA, 20 bp, mouse
gtaaaactacctattccata

SEQ ID NO: 769485 - DNA, 20 bp, mouse
gtgtatattttcctgtattt

SEQ ID NO: 769486 - DNA, 20 bp, mouse
gccagtgtatataagattta

SEQ ID NO: 769487 - DNA, 20 bp, mouse
gagacaatttacaaaatgtg

SEQ ID NO: 769488 - DNA, 20 bp, mouse
ggacaagatgaattatttta

SEQ ID NO: 769489 - DNA, 20 bp, mouse
ggtgaaataaaaagagatat

SEQ ID NO: 769490 - DNA, 20 bp, mouse
gatgacacgatttatgtagt

SEQ ID NO: 769491 - DNA, 20 bp, mouse
gataattcatcttgtctttc

SEQ ID NO: 769492 - DNA, 20 bp, mouse
gtggactactgcattcattt

SEQ ID NO: 769493 - DNA, 20 bp, mouse
gaaaatgaaaagactctgta

SEQ ID NO: 769494 - DNA, 20 bp, mouse
gtgaatatcaagcattagaa

SEQ ID NO: 769495 - DNA, 20 bp, mouse
ggtattaaattctcaagtgc

SEQ ID NO: 769496 - DNA, 20 bp, mouse
gagtaccatggatacacagg

SEQ ID NO: 769497 - DNA, 20 bp, mouse
gcaagcctcctgtgtatcca

SEQ ID NO: 769498 - DNA, 20 bp, mouse
gcagacagcaccattctgtt

SEQ ID NO: 769499 - DNA, 20 bp, mouse
ggggaaggagtctagtacca

SEQ ID NO: 769500 - DNA, 20 bp, mouse
gtctagtaccatggatacac

SEQ ID NO: 769501 - DNA, 20 bp, mouse
gtacctctgctcacccatta

SEQ ID NO: 769502 - DNA, 20 bp, mouse
gtgtcatagcaagaccttaa

SEQ ID NO: 769503 - DNA, 20 bp, mouse
ggtgagcagaggtaagaatt

SEQ ID NO: 769504 - DNA, 20 bp, mouse
gaaagaaaaagtgaacatac

SEQ ID NO: 769505 - DNA, 20 bp, mouse
gttgatgagtaatgtctttt

SEQ ID NO: 769506 - DNA, 20 bp, mouse
gaaagcatagagatgcgtgt

SEQ ID NO: 769507 - DNA, 20 bp, mouse
ggaagctgaacttagaccca

SEQ ID NO: 769508 - DNA, 20 bp, mouse
ggttgaagagactgtatatg

SEQ ID NO: 769509 - DNA, 20 bp, mouse
gagactgtatatgaggcaac

SEQ ID NO: 769510 - DNA, 20 bp, mouse
gctgatgtctgggcagtaat

SEQ ID NO: 769511 - DNA, 20 bp, mouse
gtcaagcagaagacttacca

SEQ ID NO: 769512 - DNA, 20 bp, mouse
gtggtggaaacttgcagtcc

SEQ ID NO: 769513 - DNA, 20 bp, mouse
gcttgagcttcaatagtgcc

SEQ ID NO: 769514 - DNA, 20 bp, mouse
gagcaatcacagaataatct

SEQ ID NO: 769515 - DNA, 20 bp, mouse
gccttgtacactttgctcaa

SEQ ID NO: 769516 - DNA, 20 bp, mouse
gacaactagaggtatgaggg

SEQ ID NO: 769517 - DNA, 20 bp, mouse
gaaactgggtaggtaggggt

SEQ ID NO: 769518 - DNA, 20 bp, mouse
gctaacaactagaggtatga

SEQ ID NO: 769519 - DNA, 20 bp, mouse
gaaaaccaaacaaactgggt

SEQ ID NO: 769520 - DNA, 20 bp, mouse
gaaacaaactgggtaggtag

SEQ ID NO: 769521 - DNA, 20 bp, mouse
gaaagcaaatcatgagcaac

SEQ ID NO: 769522 - DNA, 20 bp, mouse
gcactgaatttcaatacaaa

SEQ ID NO: 769523 - DNA, 20 bp, mouse
gaagatctcattatttagat

SEQ ID NO: 769524 - DNA, 20 bp, mouse
gcagaacaactaacaactag

SEQ ID NO: 769525 - DNA, 20 bp, mouse
gtgcaaaaaccaaacaaact

SEQ ID NO: 769526 - DNA, 20 bp, mouse
gcagcaatgtcactcatatt

SEQ ID NO: 769527 - DNA, 20 bp, mouse
gagaatgtctaattctacaa

SEQ ID NO: 769528 - DNA, 20 bp, mouse
gaacatatgcatttctattc

SEQ ID NO: 769529 - DNA, 20 bp, mouse
gcatctgatgctttttttct

SEQ ID NO: 769530 - DNA, 20 bp, mouse
gaatatccattagaagtatg

SEQ ID NO: 769531 - DNA, 20 bp, mouse
ggactacctcatacttctaa

SEQ ID NO: 769532 - DNA, 20 bp, mouse
gcactaggaaatataactaa

SEQ ID NO: 769533 - DNA, 20 bp, mouse
gaatattgttcattatgttt

SEQ ID NO: 769534 - DNA, 20 bp, mouse
gcattatgttttggttttga

SEQ ID NO: 769535 - DNA, 20 bp, mouse
gaattctatatttttataag

SEQ ID NO: 769536 - DNA, 20 bp, mouse
gggttcatgaactttacctg

SEQ ID NO: 769537 - DNA, 20 bp, mouse
gccaccaccgcctgaatatg

SEQ ID NO: 769538 - DNA, 20 bp, mouse
gttcttataggcgaaaaatg

SEQ ID NO: 769539 - DNA, 20 bp, mouse
gcaggtggatttctgggtcg

SEQ ID NO: 769540 - DNA, 20 bp, mouse
gtcagtacaaatagtcacac

SEQ ID NO: 769541 - DNA, 20 bp, mouse
gtgagtgacattgtttcccc

SEQ ID NO: 769542 - DNA, 20 bp, mouse
ggttatacacattgtctatc

SEQ ID NO: 769543 - DNA, 20 bp, mouse
gcatttgtgttgaaacttgg

SEQ ID NO: 769544 - DNA, 20 bp, mouse
gaaaccacatattcaggcgg

SEQ ID NO: 769545 - DNA, 20 bp, mouse
gatcaggaaatacttcttat

SEQ ID NO: 769546 - DNA, 20 bp, mouse
gccaactggaagtatgaggt

SEQ ID NO: 769547 - DNA, 20 bp, mouse
gattaccaactggaagtatg

SEQ ID NO: 769548 - DNA, 20 bp, mouse
gaaaaaatttaacttaatta

SEQ ID NO: 769549 - DNA, 20 bp, mouse
gagaaagaaagattaccaac

SEQ ID NO: 769550 - DNA, 20 bp, mouse
gcaagaaattcattttatag

SEQ ID NO: 769551 - DNA, 20 bp, mouse
ggtaaactcagaaacttatg

SEQ ID NO: 769552 - DNA, 20 bp, mouse
gaaaatgaatttcttgatag

SEQ ID NO: 769553 - DNA, 20 bp, mouse
gttacttcatttgtagaatt

SEQ ID NO: 769554 - DNA, 20 bp, mouse
gacagaatgaaaccatattt

SEQ ID NO: 769555 - DNA, 20 bp, mouse
ggcaatgcataattctttca

SEQ ID NO: 769556 - DNA, 20 bp, mouse
gtgtatggcattattgacca

SEQ ID NO: 769557 - DNA, 20 bp, mouse
gttacttcgtttgtaaaatt

SEQ ID NO: 769558 - DNA, 20 bp, mouse
gtcaaggattacatttagtt

SEQ ID NO: 769559 - DNA, 20 bp, mouse
gattcaggtgagttctaata

SEQ ID NO: 769560 - DNA, 20 bp, mouse
ggtgatgtatgtcctctatg

SEQ ID NO: 769561 - DNA, 20 bp, mouse
gggattagaaagacacatga

SEQ ID NO: 769562 - DNA, 20 bp, mouse
ggtctattgaatgatttgta

SEQ ID NO: 769563 - DNA, 20 bp, mouse
gcaaactttacaacaattac

SEQ ID NO: 769564 - DNA, 20 bp, mouse
gggttaacttgaaaatttca

SEQ ID NO: 769565 - DNA, 20 bp, mouse
gaaaatgaatttcctcatag

SEQ ID NO: 769566 - DNA, 20 bp, mouse
gcttccacagaagttaacag

SEQ ID NO: 769567 - DNA, 20 bp, mouse
ggagccactgttaacttctg

SEQ ID NO: 769568 - DNA, 20 bp, mouse
gagaaatatgctctatatga

SEQ ID NO: 769569 - DNA, 20 bp, mouse
gtgatggtatgcaaaaacat

SEQ ID NO: 769570 - DNA, 20 bp, mouse
gtaacttctgtggaagcaaa

SEQ ID NO: 769571 - DNA, 20 bp, mouse
gcatatggtggaatgagtgt

SEQ ID NO: 769572 - DNA, 20 bp, mouse
gaacattggttacaagtgag

SEQ ID NO: 769573 - DNA, 20 bp, mouse
ggtgagaggttacaaattat

SEQ ID NO: 769574 - DNA, 20 bp, mouse
gtttaaacaaactatcaatg

SEQ ID NO: 769575 - DNA, 20 bp, mouse
gattattggttttccttgtg

SEQ ID NO: 769576 - DNA, 20 bp, mouse
ggaacaaaagagaaccccgt

SEQ ID NO: 769577 - DNA, 20 bp, mouse
gaccccgtaggtaattattt

SEQ ID NO: 769578 - DNA, 20 bp, mouse
gcaagaataaggtatcactg

SEQ ID NO: 769579 - DNA, 20 bp, mouse
gtccaaaataattacctacg

SEQ ID NO: 769580 - DNA, 20 bp, mouse
gcaaatgctgaataaaaacc

SEQ ID NO: 769581 - DNA, 20 bp, mouse
gtattttggacatctcttag

SEQ ID NO: 769582 - DNA, 20 bp, mouse
gtctttaaatcactgtctgt

SEQ ID NO: 769583 - DNA, 20 bp, mouse
gaggctgtgagttttgccca

SEQ ID NO: 769584 - DNA, 20 bp, mouse
gataaagaacacaaaacata

SEQ ID NO: 769585 - DNA, 20 bp, mouse
gagcagtgcctgcttgtttg

SEQ ID NO: 769586 - DNA, 20 bp, mouse
ggactggaaaggggtcagtc

SEQ ID NO: 769587 - DNA, 20 bp, mouse
gtgtaagttagcatcacaga

SEQ ID NO: 769588 - DNA, 20 bp, mouse
gtgttgactaacattaaaat

SEQ ID NO: 769589 - DNA, 20 bp, mouse
gagtcaggtggagtattcca

SEQ ID NO: 769590 - DNA, 20 bp, mouse
gtttacttagaaaaaatgat

SEQ ID NO: 769591 - DNA, 20 bp, mouse
gcaaataaatctacatattt

SEQ ID NO: 769592 - DNA, 20 bp, mouse
gctttcagtattgactggaa

SEQ ID NO: 769593 - DNA, 20 bp, mouse
gatggaatttttggtttaaa

SEQ ID NO: 769594 - DNA, 20 bp, mouse
gtgttttgcataattaacct

SEQ ID NO: 769595 - DNA, 20 bp, mouse
gacattttgtttgattctac

SEQ ID NO: 769596 - DNA, 20 bp, mouse
gcagacttgaaccctaaaag

SEQ ID NO: 769597 - DNA, 20 bp, mouse
gaaagtggaagatatgttat

SEQ ID NO: 769598 - DNA, 20 bp, mouse
gctagggaagagcattccat

SEQ ID NO: 769599 - DNA, 20 bp, mouse
gagggttcaagtctgtcaag

SEQ ID NO: 769600 - DNA, 20 bp, mouse
gacgcactgagaactgttta

SEQ ID NO: 769601 - DNA, 20 bp, mouse
gaaggaagagattgatttcc

SEQ ID NO: 769602 - DNA, 20 bp, mouse
gaaaaggccatggattggaa

SEQ ID NO: 769603 - DNA, 20 bp, mouse
gataggaaaaggccatggat

SEQ ID NO: 769604 - DNA, 20 bp, mouse
gtatgttctatagagaagag

SEQ ID NO: 769605 - DNA, 20 bp, mouse
gttggaattgattaacccaa

SEQ ID NO: 769606 - DNA, 20 bp, mouse
gtaacatctacacctgagat

SEQ ID NO: 769607 - DNA, 20 bp, mouse
ggcacattagctttcactgt

SEQ ID NO: 769608 - DNA, 20 bp, mouse
ggggaagtgatgtttctgaa

SEQ ID NO: 769609 - DNA, 20 bp, mouse
gttcttacagggatgaagtg

SEQ ID NO: 769610 - DNA, 20 bp, mouse
gacttaatgcttctcttctt

SEQ ID NO: 769611 - DNA, 20 bp, mouse
gtcactgtccatctaattga

SEQ ID NO: 769612 - DNA, 20 bp, mouse
gtcatgaagtttttcttaca

SEQ ID NO: 769613 - DNA, 20 bp, mouse
gatttatgttttcctatctc

SEQ ID NO: 769614 - DNA, 20 bp, mouse
gaatgaatcctcatccatgc

SEQ ID NO: 769615 - DNA, 20 bp, mouse
gtcattagtcaagtaaaaac

SEQ ID NO: 769616 - DNA, 20 bp, mouse
gggttcattagctttcacgt

SEQ ID NO: 769617 - DNA, 20 bp, mouse
gcacacctggttcttccttt

SEQ ID NO: 769618 - DNA, 20 bp, mouse
gagtagcgcatgtgtatcat

SEQ ID NO: 769619 - DNA, 20 bp, mouse
gcattagtctaacaagaaat

SEQ ID NO: 769620 - DNA, 20 bp, mouse
gtcacattgtaagttaacat

SEQ ID NO: 769621 - DNA, 20 bp, mouse
gccaagagcaattctccaaa

SEQ ID NO: 769622 - DNA, 20 bp, mouse
ggcttttgcaggatgtagtg

SEQ ID NO: 769623 - DNA, 20 bp, mouse
gtaaaacttctgatagagcc

SEQ ID NO: 769624 - DNA, 20 bp, mouse
gtgtttctcaaagtttgcgc

SEQ ID NO: 769625 - DNA, 20 bp, mouse
gtgtgtatcataggcacacc

SEQ ID NO: 769626 - DNA, 20 bp, mouse
gtaacagcccagaattaatg

SEQ ID NO: 769627 - DNA, 20 bp, mouse
ggtgatttcctcattaattc

SEQ ID NO: 769628 - DNA, 20 bp, mouse
gagtgtgtcttatttacctt

SEQ ID NO: 769629 - DNA, 20 bp, mouse
gttgaatctcaatccagaag

SEQ ID NO: 769630 - DNA, 20 bp, mouse
gattatatagttgccacttc

SEQ ID NO: 769631 - DNA, 20 bp, mouse
ggaaatgtaattttctccaa

SEQ ID NO: 769632 - DNA, 20 bp, mouse
gttacaaataaaaaattcat

SEQ ID NO: 769633 - DNA, 20 bp, mouse
ggcttgcatattctctttat

SEQ ID NO: 769634 - DNA, 20 bp, mouse
gaactatataatacttatgc

SEQ ID NO: 769635 - DNA, 20 bp, mouse
gatgagagctaagaaaatca

SEQ ID NO: 769636 - DNA, 20 bp, mouse
gaatgtgaatggtattctgt

SEQ ID NO: 769637 - DNA, 20 bp, mouse
gtgtatgggtggtcatgagg

SEQ ID NO: 769638 - DNA, 20 bp, mouse
gccactaaagtcagaaccat

SEQ ID NO: 769639 - DNA, 20 bp, mouse
gacaaatgacaaagcattgt

SEQ ID NO: 769640 - DNA, 20 bp, mouse
gatgtggtcgaagagaccaa

SEQ ID NO: 769641 - DNA, 20 bp, mouse
gttaggtgtgacatgtatgc

SEQ ID NO: 769642 - DNA, 20 bp, mouse
ggacatgtatgccggttgac

SEQ ID NO: 769643 - DNA, 20 bp, mouse
gtgtaagacgtccagtcaac

SEQ ID NO: 769644 - DNA, 20 bp, mouse
gaaggtaaattaactgtaga

SEQ ID NO: 769645 - DNA, 20 bp, mouse
ggactgtatgggtggtcatg

SEQ ID NO: 769646 - DNA, 20 bp, mouse
ggagcactagtagtaatcag

SEQ ID NO: 769647 - DNA, 20 bp, mouse
gaacaaaagtaagaggtacc

SEQ ID NO: 769648 - DNA, 20 bp, mouse
gataaaaggttgaggtaaaa

SEQ ID NO: 769649 - DNA, 20 bp, mouse
gacaacctttttatcaattg

SEQ ID NO: 769650 - DNA, 20 bp, mouse
gggtgttattgattaaacat

SEQ ID NO: 769651 - DNA, 20 bp, mouse
ggtagagaaataaaaggttg

SEQ ID NO: 769652 - DNA, 20 bp, mouse
ggtataaagataaatttggt

SEQ ID NO: 769653 - DNA, 20 bp, mouse
ggaatgggaagcattgagaa

SEQ ID NO: 769654 - DNA, 20 bp, mouse
gcacttatttatatatatgt

SEQ ID NO: 769655 - DNA, 20 bp, mouse
ggaaaataaacaaaagtaag

SEQ ID NO: 769656 - DNA, 20 bp, mouse
ggggcatcactagtaatcag

SEQ ID NO: 769657 - DNA, 20 bp, mouse
gaggtctgaggtaggtgaac

SEQ ID NO: 769658 - DNA, 20 bp, mouse
gtgggaatcattaagacaga

SEQ ID NO: 769659 - DNA, 20 bp, mouse
gcaggggtaaagcatagttg

SEQ ID NO: 769660 - DNA, 20 bp, mouse
gtgcatggcactagccacgg

SEQ ID NO: 769661 - DNA, 20 bp, mouse
ggaggtgagactgagaccac

SEQ ID NO: 769662 - DNA, 20 bp, mouse
gaaaatgtagactgtgttgt

SEQ ID NO: 769663 - DNA, 20 bp, mouse
gtaaagataacagatttggt

SEQ ID NO: 769664 - DNA, 20 bp, mouse
ggcatagttggggatagcac

SEQ ID NO: 769665 - DNA, 20 bp, mouse
gcactgcatggcactagcca

SEQ ID NO: 769666 - DNA, 20 bp, mouse
gggagaatcttcaagttgtg

SEQ ID NO: 769667 - DNA, 20 bp, mouse
ggctgccaagaacaaaacta

SEQ ID NO: 769668 - DNA, 20 bp, mouse
gataagtgtataaagagaat

SEQ ID NO: 769669 - DNA, 20 bp, mouse
gtagttctaagtgttcttaa

SEQ ID NO: 769670 - DNA, 20 bp, mouse
gtatgcttgtggaaacctca

SEQ ID NO: 769671 - DNA, 20 bp, mouse
gtacagcagttatagctgta

SEQ ID NO: 769672 - DNA, 20 bp, mouse
gtcttaatggatgagtctca

SEQ ID NO: 769673 - DNA, 20 bp, mouse
gaaacctcatggaaatgagg

SEQ ID NO: 769674 - DNA, 20 bp, mouse
gcaagcatagagcataaact

SEQ ID NO: 769675 - DNA, 20 bp, mouse
gatacctcctcatttccatg

SEQ ID NO: 769676 - DNA, 20 bp, mouse
gcactagcttccacttagat

SEQ ID NO: 769677 - DNA, 20 bp, mouse
gggaaagcctgcaactgtgg

SEQ ID NO: 769678 - DNA, 20 bp, mouse
ggttaactgcctgtgatgaa

SEQ ID NO: 769679 - DNA, 20 bp, mouse
gatcaactgacccatctaag

SEQ ID NO: 769680 - DNA, 20 bp, mouse
gtcattcaggtagaatatcc

SEQ ID NO: 769681 - DNA, 20 bp, mouse
gagtctaattctcaaactcc

SEQ ID NO: 769682 - DNA, 20 bp, mouse
gtaattacctccacagttgc

SEQ ID NO: 769683 - DNA, 20 bp, mouse
gcatacaatgagagaaattt

SEQ ID NO: 769684 - DNA, 20 bp, mouse
gctttaaccacaattattta

SEQ ID NO: 769685 - DNA, 20 bp, mouse
gattaatttcatctctagac

SEQ ID NO: 769686 - DNA, 20 bp, mouse
gtatacatgtaacagctgga

SEQ ID NO: 769687 - DNA, 20 bp, mouse
gtctcgtgcaataaagaaac

SEQ ID NO: 769688 - DNA, 20 bp, mouse
ggggggattgagagagcaat

SEQ ID NO: 769689 - DNA, 20 bp, mouse
ggtgagaatatcagcagcac

SEQ ID NO: 769690 - DNA, 20 bp, mouse
ggacatatacatgtaacagc

SEQ ID NO: 769691 - DNA, 20 bp, mouse
gaatgctattttgcttactg

SEQ ID NO: 769692 - DNA, 20 bp, mouse
gttcaaaaatagcatacaca

SEQ ID NO: 769693 - DNA, 20 bp, mouse
gttgtaaaaacacaataacc

SEQ ID NO: 769694 - DNA, 20 bp, mouse
gaaaattattgagaacctgc

SEQ ID NO: 769695 - DNA, 20 bp, mouse
gtgcaataaagaaactggat

SEQ ID NO: 769696 - DNA, 20 bp, mouse
gcatagggatgaaagttcag

SEQ ID NO: 769697 - DNA, 20 bp, mouse
gataataggatgtactacat

SEQ ID NO: 769698 - DNA, 20 bp, mouse
gtgtctcagagtgtactgag

SEQ ID NO: 769699 - DNA, 20 bp, mouse
gagggtcagacacaggagtt

SEQ ID NO: 769700 - DNA, 20 bp, mouse
ggtgcagaattttgacctca

SEQ ID NO: 769701 - DNA, 20 bp, mouse
gctgtgcttaattgcaacag

SEQ ID NO: 769702 - DNA, 20 bp, mouse
gttgtagattagtaacatca

SEQ ID NO: 769703 - DNA, 20 bp, mouse
gggtcaaaattctgcacact

SEQ ID NO: 769704 - DNA, 20 bp, mouse
gtgtattatgcaaaaagatt

SEQ ID NO: 769705 - DNA, 20 bp, mouse
gtgtttgagagcatcacggc

SEQ ID NO: 769706 - DNA, 20 bp, mouse
gtgcctttggagatagttta

SEQ ID NO: 769707 - DNA, 20 bp, mouse
gcaaatacatagttataaca

SEQ ID NO: 769708 - DNA, 20 bp, mouse
ggctctttgatatcaattga

SEQ ID NO: 769709 - DNA, 20 bp, mouse
gttccttaaactatctccaa

SEQ ID NO: 769710 - DNA, 20 bp, mouse
gttttgatcttggcttttcc

SEQ ID NO: 769711 - DNA, 20 bp, mouse
gagactatttcttttgatct

SEQ ID NO: 769712 - DNA, 20 bp, mouse
gaatacatagagaagtaagg

SEQ ID NO: 769713 - DNA, 20 bp, mouse
gtaaaagactatcatgcctt

SEQ ID NO: 769714 - DNA, 20 bp, mouse
gaatataaagtgcttactcc

SEQ ID NO: 769715 - DNA, 20 bp, mouse
gtaaattatgtatattggcc

SEQ ID NO: 769716 - DNA, 20 bp, mouse
gagtggctcatggtattgaa

SEQ ID NO: 769717 - DNA, 20 bp, mouse
gagatgtattggctctatgc

SEQ ID NO: 769718 - DNA, 20 bp, mouse
gaagttatgctgagatgtat

SEQ ID NO: 769719 - DNA, 20 bp, mouse
gactacagagaaagcttggt

SEQ ID NO: 769720 - DNA, 20 bp, mouse
gctgaataaaggctatgaac

SEQ ID NO: 769721 - DNA, 20 bp, mouse
gaatgatgtgcagtggctca

SEQ ID NO: 769722 - DNA, 20 bp, mouse
gatgtgtttggataaagtta

SEQ ID NO: 769723 - DNA, 20 bp, mouse
gaccagaaagttctgatgtt

SEQ ID NO: 769724 - DNA, 20 bp, mouse
gggataaagttagggaatag

SEQ ID NO: 769725 - DNA, 20 bp, mouse
gactgtaccagattgctaaa

SEQ ID NO: 769726 - DNA, 20 bp, mouse
gtctctaaagagattatatc

SEQ ID NO: 769727 - DNA, 20 bp, mouse
gtcagttgtgttagtagaat

SEQ ID NO: 769728 - DNA, 20 bp, mouse
gaggatctaacacttttgtc

SEQ ID NO: 769729 - DNA, 20 bp, mouse
gttcaacacaagcaataata

SEQ ID NO: 769730 - DNA, 20 bp, mouse
gcctataattccaggttccg

SEQ ID NO: 769731 - DNA, 20 bp, mouse
ggtgttagatcctcggaacc

SEQ ID NO: 769732 - DNA, 20 bp, mouse
gacagctggaccatctttct

SEQ ID NO: 769733 - DNA, 20 bp, mouse
gatatcagggcccagaaaga

SEQ ID NO: 769734 - DNA, 20 bp, mouse
gacaaaaatcatactgaact

SEQ ID NO: 769735 - DNA, 20 bp, mouse
gagctgctcaacatgcatgc

SEQ ID NO: 769736 - DNA, 20 bp, mouse
gaagacctctaaatataaca

SEQ ID NO: 769737 - DNA, 20 bp, mouse
gggggcattaaagcacaaat

SEQ ID NO: 769738 - DNA, 20 bp, mouse
gcggatatttgttggtcttt

SEQ ID NO: 769739 - DNA, 20 bp, mouse
gaacttgttcggatatttgt

SEQ ID NO: 769740 - DNA, 20 bp, mouse
ggtcatgtccagaacttgtt

SEQ ID NO: 769741 - DNA, 20 bp, mouse
gtgttggtctttaggttggt

SEQ ID NO: 769742 - DNA, 20 bp, mouse
gatattaatagaatggaagg

SEQ ID NO: 769743 - DNA, 20 bp, mouse
gcttcacacttcttgaaagt

SEQ ID NO: 769744 - DNA, 20 bp, mouse
gtatttgttggtctttaggt

SEQ ID NO: 769745 - DNA, 20 bp, mouse
gacaaaggttaagattttag

SEQ ID NO: 769746 - DNA, 20 bp, mouse
gtacatgggatatttatcag

SEQ ID NO: 769747 - DNA, 20 bp, mouse
gtatgagcaagtgtttacat

SEQ ID NO: 769748 - DNA, 20 bp, mouse
gcacaaaaagatagaactca

SEQ ID NO: 769749 - DNA, 20 bp, mouse
gcagggccctatacattgga

SEQ ID NO: 769750 - DNA, 20 bp, mouse
ggagaaccttggacagagtt

SEQ ID NO: 769751 - DNA, 20 bp, mouse
gtactgccttccaatgtata

SEQ ID NO: 769752 - DNA, 20 bp, mouse
gtcgacagggatgaaatcca

SEQ ID NO: 769753 - DNA, 20 bp, mouse
gatgttcccaactctgtcca

SEQ ID NO: 769754 - DNA, 20 bp, mouse
gatccctgtcgagggaaaga

SEQ ID NO: 769755 - DNA, 20 bp, mouse
gcttccttctttccctcgac

SEQ ID NO: 769756 - DNA, 20 bp, mouse
gtaggcattgaccatgtttt

SEQ ID NO: 769757 - DNA, 20 bp, mouse
gtggataaagagtctttaac

SEQ ID NO: 769758 - DNA, 20 bp, mouse
gcggaatggagaggaaagga

SEQ ID NO: 769759 - DNA, 20 bp, mouse
gttttcggaatggagaggaa

SEQ ID NO: 769760 - DNA, 20 bp, mouse
gtgaacactgcttaatattg

SEQ ID NO: 769761 - DNA, 20 bp, mouse
gttacatctactctgagctt

SEQ ID NO: 769762 - DNA, 20 bp, mouse
gcatatatctgtctttaatt

SEQ ID NO: 769763 - DNA, 20 bp, mouse
gttaatgttagattttaaac

SEQ ID NO: 769764 - DNA, 20 bp, mouse
gaatagcatacacacttatt

SEQ ID NO: 769765 - DNA, 20 bp, mouse
gaccatattttgaaatttta

SEQ ID NO: 769766 - DNA, 20 bp, mouse
gacaacctggtgttttacag

SEQ ID NO: 769767 - DNA, 20 bp, mouse
gtctcatgtggaaggtagtg

SEQ ID NO: 769768 - DNA, 20 bp, mouse
ggctgaaagcacaaattcca

SEQ ID NO: 769769 - DNA, 20 bp, mouse
gacaagaaactaaaacaacc

SEQ ID NO: 769770 - DNA, 20 bp, mouse
gaattaaggaagtaaggcat

SEQ ID NO: 769771 - DNA, 20 bp, mouse
gaactaatttctcatgtgga

SEQ ID NO: 769772 - DNA, 20 bp, mouse
gatgaaaatattgaaaaact

SEQ ID NO: 769773 - DNA, 20 bp, mouse
gtcacctgaagggcacaaga

SEQ ID NO: 769774 - DNA, 20 bp, mouse
gaaagcacaaattccaggga

SEQ ID NO: 769775 - DNA, 20 bp, mouse
gttctatgcttacatattta

SEQ ID NO: 769776 - DNA, 20 bp, mouse
gtctcatgaggaaagtggtg

SEQ ID NO: 769777 - DNA, 20 bp, mouse
gacaacctgctgctttatag

SEQ ID NO: 769778 - DNA, 20 bp, mouse
gaaagcagcaggttgtcttg

SEQ ID NO: 769779 - DNA, 20 bp, mouse
gttaaggaagcaaggtacaa

SEQ ID NO: 769780 - DNA, 20 bp, mouse
gacccaaaatatgtaagcat

SEQ ID NO: 769781 - DNA, 20 bp, mouse
gaatttaggtttaagtgatc

SEQ ID NO: 769782 - DNA, 20 bp, mouse
gcatgtacgcaaatgcatat

SEQ ID NO: 769783 - DNA, 20 bp, mouse
gtaatttctcatgaggaaag

SEQ ID NO: 769784 - DNA, 20 bp, mouse
gatgagaatagtgcaaagcc

SEQ ID NO: 769785 - DNA, 20 bp, mouse
ggagaaattagtactttacc

SEQ ID NO: 769786 - DNA, 20 bp, mouse
gaatctgtgaagatcctagc

SEQ ID NO: 769787 - DNA, 20 bp, mouse
gcaaacaagttgcacagcct

SEQ ID NO: 769788 - DNA, 20 bp, mouse
ggtgaagatcctagctggca

SEQ ID NO: 769789 - DNA, 20 bp, mouse
gggttaacatcatacgctta

SEQ ID NO: 769790 - DNA, 20 bp, mouse
ggaatgtaaaatgatgaaag

SEQ ID NO: 769791 - DNA, 20 bp, mouse
gtcttctgactgttatcttc

SEQ ID NO: 769792 - DNA, 20 bp, mouse
gtgttaacctttaatattta

SEQ ID NO: 769793 - DNA, 20 bp, mouse
gttttctccataaatattaa

SEQ ID NO: 769794 - DNA, 20 bp, mouse
gtcagaagaatagagatgca

SEQ ID NO: 769795 - DNA, 20 bp, mouse
gatctaattataactctgca

SEQ ID NO: 769796 - DNA, 20 bp, mouse
gacagagtggtctgacatac

SEQ ID NO: 769797 - DNA, 20 bp, mouse
gtcccaaaggcaaacttaac

SEQ ID NO: 769798 - DNA, 20 bp, mouse
gagccagttaagtttgcctt

SEQ ID NO: 769799 - DNA, 20 bp, mouse
ggggaatttgcatgacagag

SEQ ID NO: 769800 - DNA, 20 bp, mouse
gaatagaaatggatcacatg

SEQ ID NO: 769801 - DNA, 20 bp, mouse
gtgcacagaagaaagtcaca

SEQ ID NO: 769802 - DNA, 20 bp, mouse
ggtggtctgacatactggta

SEQ ID NO: 769803 - DNA, 20 bp, mouse
gggtataatttgttccttca

SEQ ID NO: 769804 - DNA, 20 bp, mouse
gaaacttaactggctctaat

SEQ ID NO: 769805 - DNA, 20 bp, mouse
gttcgaaccactaatagaaa

SEQ ID NO: 769806 - DNA, 20 bp, mouse
ggtggcctgaacatgtggct

SEQ ID NO: 769807 - DNA, 20 bp, mouse
gttggcttatggcttgaggg

SEQ ID NO: 769808 - DNA, 20 bp, mouse
gatagcatcaggctactcta

SEQ ID NO: 769809 - DNA, 20 bp, mouse
ggcatcccagccacatgttc

SEQ ID NO: 769810 - DNA, 20 bp, mouse
gtagtgaagaagtgaccaaa

SEQ ID NO: 769811 - DNA, 20 bp, mouse
gtgaagaagtgaccaaaagg

SEQ ID NO: 769812 - DNA, 20 bp, mouse
gtgggcttggaagcacaaat

SEQ ID NO: 769813 - DNA, 20 bp, mouse
ggcatcaggctactctatgg

SEQ ID NO: 769814 - DNA, 20 bp, mouse
gaggggccattctgtatatg

SEQ ID NO: 769815 - DNA, 20 bp, mouse
gggaggcagttctttgtgat

SEQ ID NO: 769816 - DNA, 20 bp, mouse
gagtcctgaagaagccaatt

SEQ ID NO: 769817 - DNA, 20 bp, mouse
gaagccaattaggcttgata

SEQ ID NO: 769818 - DNA, 20 bp, mouse
gaagcctaattggcttcttc

SEQ ID NO: 769819 - DNA, 20 bp, mouse
gtatccatatcaagcctaat

SEQ ID NO: 769820 - DNA, 20 bp, mouse
ggtgagaggaagtgactaga

SEQ ID NO: 769821 - DNA, 20 bp, mouse
gcatggattaactttctaaa

SEQ ID NO: 769822 - DNA, 20 bp, mouse
gtcacgttctaaatacaaca

SEQ ID NO: 769823 - DNA, 20 bp, mouse
gaacagggcaatttaaaaca

SEQ ID NO: 769824 - DNA, 20 bp, mouse
gaagaaaagtaagatttcca

SEQ ID NO: 769825 - DNA, 20 bp, mouse
gcactatagatgattgagat

SEQ ID NO: 769826 - DNA, 20 bp, mouse
ggcactaagaggactttagg

SEQ ID NO: 769827 - DNA, 20 bp, mouse
gggcatgtgactacagataa

SEQ ID NO: 769828 - DNA, 20 bp, mouse
gtactatgaaaaggctaaag

SEQ ID NO: 769829 - DNA, 20 bp, mouse
gtacagataaggggaagact

SEQ ID NO: 769830 - DNA, 20 bp, mouse
gaaagaaacaacaaaggcct

SEQ ID NO: 769831 - DNA, 20 bp, mouse
gtagaaatggaactcctgaa

SEQ ID NO: 769832 - DNA, 20 bp, mouse
gtcctccaaacacatgaatc

SEQ ID NO: 769833 - DNA, 20 bp, mouse
ggttccctgattcatgtgtt

SEQ ID NO: 769834 - DNA, 20 bp, mouse
gcaggcactaagaggacttt

SEQ ID NO: 769835 - DNA, 20 bp, mouse
gccatcccataggcacagga

SEQ ID NO: 769836 - DNA, 20 bp, mouse
gtgttgaaatgtgaaaagtg

SEQ ID NO: 769837 - DNA, 20 bp, mouse
gtgaagaaagagctccagca

SEQ ID NO: 769838 - DNA, 20 bp, mouse
gtcagattagtgaatgataa

SEQ ID NO: 769839 - DNA, 20 bp, mouse
gtggtctctcactatgtact

SEQ ID NO: 769840 - DNA, 20 bp, mouse
gcactaatctgaaaaactca

SEQ ID NO: 769841 - DNA, 20 bp, mouse
ggatttcagtaaattggctc

SEQ ID NO: 769842 - DNA, 20 bp, mouse
gataggtaaatggggaaaat

SEQ ID NO: 769843 - DNA, 20 bp, mouse
gcatctacatgaagtaccac

SEQ ID NO: 769844 - DNA, 20 bp, mouse
ggccaaaataaagaatggtt

SEQ ID NO: 769845 - DNA, 20 bp, mouse
gttgaatggacattcatgca

SEQ ID NO: 769846 - DNA, 20 bp, mouse
ggggaagcttgttgtccaga

SEQ ID NO: 769847 - DNA, 20 bp, mouse
gagagatgaacttgtgtcaa

SEQ ID NO: 769848 - DNA, 20 bp, mouse
gagaaagtggatggttctgg

SEQ ID NO: 769849 - DNA, 20 bp, mouse
gtagcggaaggaccaattga

SEQ ID NO: 769850 - DNA, 20 bp, mouse
gtgttgtccagaaggctcaa

SEQ ID NO: 769851 - DNA, 20 bp, mouse
gggtgtctctgctctcttca

SEQ ID NO: 769852 - DNA, 20 bp, mouse
gagcttgaattggaagttca

SEQ ID NO: 769853 - DNA, 20 bp, mouse
gaatgaagcctgaacacaag

SEQ ID NO: 769854 - DNA, 20 bp, mouse
ggtgagaaagtggatggttc

SEQ ID NO: 769855 - DNA, 20 bp, mouse
gaatcttcatcatttcacta

SEQ ID NO: 769856 - DNA, 20 bp, mouse
gttgaagagttggctgaggt

SEQ ID NO: 769857 - DNA, 20 bp, mouse
gtgagagcaaggaatacgcc

SEQ ID NO: 769858 - DNA, 20 bp, mouse
gttgagttgtgaagatcaac

SEQ ID NO: 769859 - DNA, 20 bp, mouse
gggtctgtaaggttactcct

SEQ ID NO: 769860 - DNA, 20 bp, mouse
gtgaggatttcagcagtcaa

SEQ ID NO: 769861 - DNA, 20 bp, mouse
gagggctctagtatttttca

SEQ ID NO: 769862 - DNA, 20 bp, mouse
gtttcatcctatatcaagaa

SEQ ID NO: 769863 - DNA, 20 bp, mouse
gaatggagactaggtctgta

SEQ ID NO: 769864 - DNA, 20 bp, mouse
gcagtcaatggattataaac

SEQ ID NO: 769865 - DNA, 20 bp, mouse
ggtgatgtaaagaatcctgt

SEQ ID NO: 769866 - DNA, 20 bp, mouse
gctggggttagacacagctt

SEQ ID NO: 769867 - DNA, 20 bp, mouse
ggagagattcataacttgag

SEQ ID NO: 769868 - DNA, 20 bp, mouse
gtgacacatgccagcaatag

SEQ ID NO: 769869 - DNA, 20 bp, mouse
gctattgatagtcatggctt

SEQ ID NO: 769870 - DNA, 20 bp, mouse
gcacactttcagtccatctc

SEQ ID NO: 769871 - DNA, 20 bp, mouse
ggacaggaaatcccctcagc

SEQ ID NO: 769872 - DNA, 20 bp, mouse
ggtctctgacttcccagaga

SEQ ID NO: 769873 - DNA, 20 bp, mouse
gtagcttatccctcctgctg

SEQ ID NO: 769874 - DNA, 20 bp, mouse
gggctttgttctgagctcag

SEQ ID NO: 769875 - DNA, 20 bp, mouse
gtgagagtagtcatatcccc

SEQ ID NO: 769876 - DNA, 20 bp, mouse
gaggctgagaagaggctcaa

SEQ ID NO: 769877 - DNA, 20 bp, mouse
gctggcctgtggaagtgagg

SEQ ID NO: 769878 - DNA, 20 bp, mouse
ggaggaggagtcatatccct

SEQ ID NO: 769879 - DNA, 20 bp, mouse
ggaagatacaggctgagaag

SEQ ID NO: 769880 - DNA, 20 bp, mouse
ggactcctcctcacttccac

SEQ ID NO: 769881 - DNA, 20 bp, mouse
gccagagcgtgagagagcat

SEQ ID NO: 769882 - DNA, 20 bp, mouse
ggtcctcagcctcatttcat

SEQ ID NO: 769883 - DNA, 20 bp, mouse
gacgctctggatccatctgt

SEQ ID NO: 769884 - DNA, 20 bp, mouse
gagggaagttcagtaacttg

SEQ ID NO: 769885 - DNA, 20 bp, mouse
gacaccacacaatacatcac

SEQ ID NO: 769886 - DNA, 20 bp, mouse
gagccaaagcaagaggacct

SEQ ID NO: 769887 - DNA, 20 bp, mouse
ggatgaactccaagattagc

SEQ ID NO: 769888 - DNA, 20 bp, mouse
ggcttgaaatgccatcgtga

SEQ ID NO: 769889 - DNA, 20 bp, mouse
gttaggtaaaaatgatggca

SEQ ID NO: 769890 - DNA, 20 bp, mouse
gctgtgcctcctgctaatct

SEQ ID NO: 769891 - DNA, 20 bp, mouse
ggactctggattttttatgc

SEQ ID NO: 769892 - DNA, 20 bp, mouse
gggttttatcttcagtactt

SEQ ID NO: 769893 - DNA, 20 bp, mouse
gtgtctcctaaccatcacga

SEQ ID NO: 769894 - DNA, 20 bp, mouse
gaatttttttaactatagat

SEQ ID NO: 769895 - DNA, 20 bp, mouse
gtacatgtaacataaaggtg

SEQ ID NO: 769896 - DNA, 20 bp, mouse
ggaggcagaaggggagatat

SEQ ID NO: 769897 - DNA, 20 bp, mouse
ggaaggggagatataggccg

SEQ ID NO: 769898 - DNA, 20 bp, mouse
ggaggagaggtccaaaagtg

SEQ ID NO: 769899 - DNA, 20 bp, mouse
gacaccctgaatccacctgt

SEQ ID NO: 769900 - DNA, 20 bp, mouse
gggagatataggccgaggag

SEQ ID NO: 769901 - DNA, 20 bp, mouse
gtgacacatggtaacaatag

SEQ ID NO: 769902 - DNA, 20 bp, mouse
ggtcctaagcctcatttgat

SEQ ID NO: 769903 - DNA, 20 bp, mouse
gcattcctacaggtggattc

SEQ ID NO: 769904 - DNA, 20 bp, mouse
gtgacctgtcatgtggtgag

SEQ ID NO: 769905 - DNA, 20 bp, mouse
ggctcacagcaagagggcta

SEQ ID NO: 769906 - DNA, 20 bp, mouse
gaataaccaccccagtcttc

SEQ ID NO: 769907 - DNA, 20 bp, mouse
gtctgcagataccaatcttc

SEQ ID NO: 769908 - DNA, 20 bp, mouse
gtgaggcatgtgttcttgag

SEQ ID NO: 769909 - DNA, 20 bp, mouse
gacagtgcagcccagaagat

SEQ ID NO: 769910 - DNA, 20 bp, mouse
gttcatctgtaaaacggggc

SEQ ID NO: 769911 - DNA, 20 bp, mouse
gtatgtccctctggtaatga

SEQ ID NO: 769912 - DNA, 20 bp, mouse
ggataaccacttcaggtcta

SEQ ID NO: 769913 - DNA, 20 bp, mouse
gagagtagaatgagtgtatg

SEQ ID NO: 769914 - DNA, 20 bp, mouse
gcctgtgtcctgtgtataag

SEQ ID NO: 769915 - DNA, 20 bp, mouse
gagggcctcttatgtccctc

SEQ ID NO: 769916 - DNA, 20 bp, mouse
ggactctttggggacagtgt

SEQ ID NO: 769917 - DNA, 20 bp, mouse
gccttagaagagactctttg

SEQ ID NO: 769918 - DNA, 20 bp, mouse
ggggcagtgactgaaatgtc

SEQ ID NO: 769919 - DNA, 20 bp, mouse
gtcccctaacagctaagtga

SEQ ID NO: 769920 - DNA, 20 bp, mouse
gggccctttcccaattctcc

SEQ ID NO: 769921 - DNA, 20 bp, mouse
gcttaagggctataattccc

SEQ ID NO: 769922 - DNA, 20 bp, mouse
gatccctcacttagctgtta

SEQ ID NO: 769923 - DNA, 20 bp, mouse
gggggggtcagggagggtct

SEQ ID NO: 769924 - DNA, 20 bp, mouse
gttcccaggagaattgggaa

SEQ ID NO: 769925 - DNA, 20 bp, mouse
gcatgtggccatcctggctc

SEQ ID NO: 769926 - DNA, 20 bp, mouse
gacagatgaaaagactgaag

SEQ ID NO: 769927 - DNA, 20 bp, mouse
gtctacagatgctggaatgc

SEQ ID NO: 769928 - DNA, 20 bp, mouse
gaactagtcaatgtatacaa

SEQ ID NO: 769929 - DNA, 20 bp, mouse
gagatggaatctacagatgc

SEQ ID NO: 769930 - DNA, 20 bp, mouse
gatatgatagccctgaaaga

SEQ ID NO: 769931 - DNA, 20 bp, mouse
gatatcaggtgttacataga

SEQ ID NO: 769932 - DNA, 20 bp, mouse
gaggtgttacatagatggct

SEQ ID NO: 769933 - DNA, 20 bp, mouse
gggaataaaggattccttgg

SEQ ID NO: 769934 - DNA, 20 bp, mouse
gctgtagattccatctttca

SEQ ID NO: 769935 - DNA, 20 bp, mouse
ggcttcacatgatgcagctc

SEQ ID NO: 769936 - DNA, 20 bp, mouse
ggacagtgactgaaaatgtc

SEQ ID NO: 769937 - DNA, 20 bp, mouse
ggctgtcctggatcaggtcc

SEQ ID NO: 769938 - DNA, 20 bp, mouse
ggtgccattttgttcccagt

SEQ ID NO: 769939 - DNA, 20 bp, mouse
gactccttggaagagactct

SEQ ID NO: 769940 - DNA, 20 bp, mouse
gcccccaagagtctcttcca

SEQ ID NO: 769941 - DNA, 20 bp, mouse
ggaaaacatcaggcaaatgg

SEQ ID NO: 769942 - DNA, 20 bp, mouse
ggactcttgggggacagagc

SEQ ID NO: 769943 - DNA, 20 bp, mouse
ggcactttcccaactctcct

SEQ ID NO: 769944 - DNA, 20 bp, mouse
gcatggcagaatgattgagt

SEQ ID NO: 769945 - DNA, 20 bp, mouse
gatccctactgggaacaaaa

SEQ ID NO: 769946 - DNA, 20 bp, mouse
ggactgcggaggtaagagct

SEQ ID NO: 769947 - DNA, 20 bp, mouse
gcaagtgtgtgtctggactg

SEQ ID NO: 769948 - DNA, 20 bp, mouse
gctatctaggtccacttctc

SEQ ID NO: 769949 - DNA, 20 bp, mouse
ggaggtaagagctgggcatc

SEQ ID NO: 769950 - DNA, 20 bp, mouse
gtaacgtgagaagagtgtac

SEQ ID NO: 769951 - DNA, 20 bp, mouse
gtcactagggcactcactca

SEQ ID NO: 769952 - DNA, 20 bp, mouse
gtgacacatggcagcagtag

SEQ ID NO: 769953 - DNA, 20 bp, mouse
ggtgtgtgtctggactgcgg

SEQ ID NO: 769954 - DNA, 20 bp, mouse
gtgacctgtcatgtgttgtg

SEQ ID NO: 769955 - DNA, 20 bp, mouse
gcacacactcgatctgtctc

SEQ ID NO: 769956 - DNA, 20 bp, mouse
gcagagttttggtttagggt

SEQ ID NO: 769957 - DNA, 20 bp, mouse
gggatcgtatgtggaagtgt

SEQ ID NO: 769958 - DNA, 20 bp, mouse
ggtgatcagagttttggttt

SEQ ID NO: 769959 - DNA, 20 bp, mouse
gtttaaagaagctacctttt

SEQ ID NO: 769960 - DNA, 20 bp, mouse
ggtagtcgtgatcagagttt

SEQ ID NO: 769961 - DNA, 20 bp, mouse
gaagaagctaccttttggga

SEQ ID NO: 769962 - DNA, 20 bp, mouse
gttttgcagaggatcgtatg

SEQ ID NO: 769963 - DNA, 20 bp, mouse
gggctggtaaaattgttcag

SEQ ID NO: 769964 - DNA, 20 bp, mouse
gtctttgtgtatcatctagt

SEQ ID NO: 769965 - DNA, 20 bp, mouse
gtagggtgggataagatatg

SEQ ID NO: 769966 - DNA, 20 bp, mouse
ggcactgtgtggtttctaag

SEQ ID NO: 769967 - DNA, 20 bp, mouse
gaagagactgaggctttggg

SEQ ID NO: 769968 - DNA, 20 bp, mouse
gtaagtagatgaagagactg

SEQ ID NO: 769969 - DNA, 20 bp, mouse
gtcaaaggtgaagcactgtg

SEQ ID NO: 769970 - DNA, 20 bp, mouse
gtgcttaacatgtgtgagtc

SEQ ID NO: 769971 - DNA, 20 bp, mouse
ggagaaagagtcaaatccta

SEQ ID NO: 769972 - DNA, 20 bp, mouse
gatgtgggtcctgagctcag

SEQ ID NO: 769973 - DNA, 20 bp, mouse
gggaagtccccacagcaaga

SEQ ID NO: 769974 - DNA, 20 bp, mouse
gtctatcgatgtcatgtgtc

SEQ ID NO: 769975 - DNA, 20 bp, mouse
gatgaagagactgaggcttt

SEQ ID NO: 769976 - DNA, 20 bp, mouse
gaagcactgggtgttgtttc

SEQ ID NO: 769977 - DNA, 20 bp, mouse
gtggctgaaaggtgaagcac

SEQ ID NO: 769978 - DNA, 20 bp, mouse
gtaaagtgtgtgtgggttat

SEQ ID NO: 769979 - DNA, 20 bp, mouse
gtaacttgagaagagtatac

SEQ ID NO: 769980 - DNA, 20 bp, mouse
gtatacaactttgagctctc

SEQ ID NO: 769981 - DNA, 20 bp, mouse
ggagagcagatacccggaac

SEQ ID NO: 769982 - DNA, 20 bp, mouse
gataaggcggatgaccacca

SEQ ID NO: 769983 - DNA, 20 bp, mouse
gtctggatccatctttggga

SEQ ID NO: 769984 - DNA, 20 bp, mouse
gacactctggatccatcttt

SEQ ID NO: 769985 - DNA, 20 bp, mouse
gtcagcatgatcctgagcca

SEQ ID NO: 769986 - DNA, 20 bp, mouse
gagggcaggtctcaacagag

SEQ ID NO: 769987 - DNA, 20 bp, mouse
ggaaacagtgaagtgtgtaa

SEQ ID NO: 769988 - DNA, 20 bp, mouse
gctggtgcaggctacagaaa

SEQ ID NO: 769989 - DNA, 20 bp, mouse
gatgaagggaaaagatgttc

SEQ ID NO: 769990 - DNA, 20 bp, mouse
ggacatatatgccttcagaa

SEQ ID NO: 769991 - DNA, 20 bp, mouse
gtgtgtgtgtagaataatga

SEQ ID NO: 769992 - DNA, 20 bp, mouse
gccaagaaagattaaggtct

SEQ ID NO: 769993 - DNA, 20 bp, mouse
gcagaaaggttcttgcttgg

SEQ ID NO: 769994 - DNA, 20 bp, mouse
gctctcagatgttcatagaa

SEQ ID NO: 769995 - DNA, 20 bp, mouse
gtcgatcccaagaaagatta

SEQ ID NO: 769996 - DNA, 20 bp, mouse
gtaggtaaaaatattgacaa

SEQ ID NO: 769997 - DNA, 20 bp, mouse
ggcaaagtctcatgatgcat

SEQ ID NO: 769998 - DNA, 20 bp, mouse
gagctttgtgccaaagaaag

SEQ ID NO: 769999 - DNA, 20 bp, mouse
gtctctcatgacatttcatg

SEQ ID NO: 770000 - DNA, 20 bp, mouse
gctgtgacgccctctaaaaa

SEQ ID NO: 770001 - DNA, 20 bp, mouse
gaatatatatgtataagaat

SEQ ID NO: 770002 - DNA, 20 bp, mouse
ggatgagctccatttttaga

SEQ ID NO: 770003 - DNA, 20 bp, mouse
gattactgatagtaaaatcc

SEQ ID NO: 770004 - DNA, 20 bp, mouse
gcatacatgtttctattgtg

SEQ ID NO: 770005 - DNA, 20 bp, mouse
gaaaaatttggcatggactc

SEQ ID NO: 770006 - DNA, 20 bp, mouse
ggagcctggccaggctaatt

SEQ ID NO: 770007 - DNA, 20 bp, mouse
gctactaagtacctagagcc

SEQ ID NO: 770008 - DNA, 20 bp, mouse
gagtaaccctggtgtttatt

SEQ ID NO: 770009 - DNA, 20 bp, mouse
gctactcccaataaacacca

SEQ ID NO: 770010 - DNA, 20 bp, mouse
gaagtacctagagcctggcc

SEQ ID NO: 770011 - DNA, 20 bp, mouse
gaatacttaccactatgccc

SEQ ID NO: 770012 - DNA, 20 bp, mouse
gaagacaagtaggtactaga

SEQ ID NO: 770013 - DNA, 20 bp, mouse
gactgtgaaaaaactgcaaa

SEQ ID NO: 770014 - DNA, 20 bp, mouse
gacatcttaaacaagtcgaa

SEQ ID NO: 770015 - DNA, 20 bp, mouse
ggggttctgtacagaattag

SEQ ID NO: 770016 - DNA, 20 bp, mouse
ggtcctctggaaccactccc

SEQ ID NO: 770017 - DNA, 20 bp, mouse
gtaggggaaagactctggta

SEQ ID NO: 770018 - DNA, 20 bp, mouse
gttcctgggagtggttccag

SEQ ID NO: 770019 - DNA, 20 bp, mouse
gtcacacagggggctaacta

SEQ ID NO: 770020 - DNA, 20 bp, mouse
gcatgtccaaagttggggtt

SEQ ID NO: 770021 - DNA, 20 bp, mouse
gagcagacagtcctgttgag

SEQ ID NO: 770022 - DNA, 20 bp, mouse
gcttaataggggaaagactc

SEQ ID NO: 770023 - DNA, 20 bp, mouse
gaggcaccaattcacacagg

SEQ ID NO: 770024 - DNA, 20 bp, mouse
gtaaggcatgtccaaagttg

SEQ ID NO: 770025 - DNA, 20 bp, mouse
gtgatctctataaacttcct

SEQ ID NO: 770026 - DNA, 20 bp, mouse
gtagctatgacactggacaa

SEQ ID NO: 770027 - DNA, 20 bp, mouse
gagagatctgacatgctcac

SEQ ID NO: 770028 - DNA, 20 bp, mouse
gacaagtgtgcatccctcgt

SEQ ID NO: 770029 - DNA, 20 bp, mouse
gactgctcgtcttctgaagg

SEQ ID NO: 770030 - DNA, 20 bp, mouse
gttaactgctcgtcttctga

SEQ ID NO: 770031 - DNA, 20 bp, mouse
gttagctgaagtccccactg

SEQ ID NO: 770032 - DNA, 20 bp, mouse
gcttctgaaggtggcttgca

SEQ ID NO: 770033 - DNA, 20 bp, mouse
gtcgtcggatgaactggtag

SEQ ID NO: 770034 - DNA, 20 bp, mouse
gtagccgtggaggagacaag

SEQ ID NO: 770035 - DNA, 20 bp, mouse
gcatccctcgtcggatgaac

SEQ ID NO: 770036 - DNA, 20 bp, mouse
gttgaggtgtctgtattgga

SEQ ID NO: 770037 - DNA, 20 bp, mouse
gtgaaggtggagtgtacttg

SEQ ID NO: 770038 - DNA, 20 bp, mouse
gagtaactggtctgaggtta

SEQ ID NO: 770039 - DNA, 20 bp, mouse
gttacttgaggtgtctgtat

SEQ ID NO: 770040 - DNA, 20 bp, mouse
ggtgtctgtattggagggta

SEQ ID NO: 770041 - DNA, 20 bp, mouse
gtcttggagacacagctctc

SEQ ID NO: 770042 - DNA, 20 bp, mouse
gtcatgtagtaactggtctg

SEQ ID NO: 770043 - DNA, 20 bp, mouse
gacgccgtgaatcagaaccg

SEQ ID NO: 770044 - DNA, 20 bp, mouse
gctcaagtaacaacctgctt

SEQ ID NO: 770045 - DNA, 20 bp, mouse
gtgtacttgagggagtcatc

SEQ ID NO: 770046 - DNA, 20 bp, mouse
gttagcaagggattgacctg

SEQ ID NO: 770047 - DNA, 20 bp, mouse
gtgagccccagttactgcat

SEQ ID NO: 770048 - DNA, 20 bp, mouse
gagttgaaccaacttagcaa

SEQ ID NO: 770049 - DNA, 20 bp, mouse
gtgtggcaggcaaagcaata

SEQ ID NO: 770050 - DNA, 20 bp, mouse
gcaagggattgacctgtggc

SEQ ID NO: 770051 - DNA, 20 bp, mouse
gaagacctaagggctttgtg

SEQ ID NO: 770052 - DNA, 20 bp, mouse
gcctaagggctttgtgagga

SEQ ID NO: 770053 - DNA, 20 bp, mouse
gaaacattcacaagacctaa

SEQ ID NO: 770054 - DNA, 20 bp, mouse
gtttttaccaatgcagtaac

SEQ ID NO: 770055 - DNA, 20 bp, mouse
ggaaaaaactcacctggaac

SEQ ID NO: 770056 - DNA, 20 bp, mouse
gtagctcatggctccggggt

SEQ ID NO: 770057 - DNA, 20 bp, mouse
gggagaaagtccatcgctgg

SEQ ID NO: 770058 - DNA, 20 bp, mouse
gttcctggagaaattgtcag

SEQ ID NO: 770059 - DNA, 20 bp, mouse
gatttcaagtctgcccaccc

SEQ ID NO: 770060 - DNA, 20 bp, mouse
gactttagctcatggctccg

SEQ ID NO: 770061 - DNA, 20 bp, mouse
gtagagtttcgttcaaagac

SEQ ID NO: 770062 - DNA, 20 bp, mouse
gttgaacgaaactctaagca

SEQ ID NO: 770063 - DNA, 20 bp, mouse
gttgccatgatgaatcatca

SEQ ID NO: 770064 - DNA, 20 bp, mouse
gacttgaaatcagtgacagc

SEQ ID NO: 770065 - DNA, 20 bp, mouse
gccactccgcctaaatcttt

SEQ ID NO: 770066 - DNA, 20 bp, mouse
gaagacctcggttgtcaggg

SEQ ID NO: 770067 - DNA, 20 bp, mouse
ggaagatgaagtgagaactg

SEQ ID NO: 770068 - DNA, 20 bp, mouse
gggagttaggtcagcacatg

SEQ ID NO: 770069 - DNA, 20 bp, mouse
gtgaactgacatgggaagag

SEQ ID NO: 770070 - DNA, 20 bp, mouse
gcagttaacccgtgggataa

SEQ ID NO: 770071 - DNA, 20 bp, mouse
gtcccacgggttaactgaga

SEQ ID NO: 770072 - DNA, 20 bp, mouse
ggtcactccctttatcccac

SEQ ID NO: 770073 - DNA, 20 bp, mouse
gcatccttatgaactgacat

SEQ ID NO: 770074 - DNA, 20 bp, mouse
gggaagaatggtaggtgttg

SEQ ID NO: 770075 - DNA, 20 bp, mouse
gagggaacagggctatgtaa

SEQ ID NO: 770076 - DNA, 20 bp, mouse
gtctacacttggaatgtcat

SEQ ID NO: 770077 - DNA, 20 bp, mouse
gagaactgggattatagaaa

SEQ ID NO: 770078 - DNA, 20 bp, mouse
ggatgagtttcaagtttagt

SEQ ID NO: 770079 - DNA, 20 bp, mouse
ggagtttcaagtttagtggg

SEQ ID NO: 770080 - DNA, 20 bp, mouse
ggacagtagatgtggcataa

SEQ ID NO: 770081 - DNA, 20 bp, mouse
gatttttcttaaccagaact

SEQ ID NO: 770082 - DNA, 20 bp, mouse
gaaaatttgacaccagactc

SEQ ID NO: 770083 - DNA, 20 bp, mouse
gaattatctgacagtagatg

SEQ ID NO: 770084 - DNA, 20 bp, mouse
gtatgatactaaactttaaa

SEQ ID NO: 770085 - DNA, 20 bp, mouse
gttttaacagcagtgctgaa

SEQ ID NO: 770086 - DNA, 20 bp, mouse
gatggaacatcatagaatgg

SEQ ID NO: 770087 - DNA, 20 bp, mouse
gagcccagaggatgggaatg

SEQ ID NO: 770088 - DNA, 20 bp, mouse
ggatcagagatgctttttac

SEQ ID NO: 770089 - DNA, 20 bp, mouse
gtcaacatggatgcgtgtga

SEQ ID NO: 770090 - DNA, 20 bp, mouse
gagcaaggacctacgaggaa

SEQ ID NO: 770091 - DNA, 20 bp, mouse
gaccatagcaaggacctacg

SEQ ID NO: 770092 - DNA, 20 bp, mouse
ggataaaggtgttccatttg

SEQ ID NO: 770093 - DNA, 20 bp, mouse
gcgtttgtcaatgctttcga

SEQ ID NO: 770094 - DNA, 20 bp, mouse
ggtgtgcaacagccatgtca

SEQ ID NO: 770095 - DNA, 20 bp, mouse
gagaatcagcaaccatagca

SEQ ID NO: 770096 - DNA, 20 bp, mouse
gggagaacccatttgtttaa

SEQ ID NO: 770097 - DNA, 20 bp, mouse
gttgaagggctcaatttgaa

SEQ ID NO: 770098 - DNA, 20 bp, mouse
gaggggtcattgacattcaa

SEQ ID NO: 770099 - DNA, 20 bp, mouse
gggtggtatcaggtcattga

SEQ ID NO: 770100 - DNA, 20 bp, mouse
ggtcacataggttattcagt

SEQ ID NO: 770101 - DNA, 20 bp, mouse
gtccacacccttaaacaaat

SEQ ID NO: 770102 - DNA, 20 bp, mouse
gttcttaggtcaattagcat

SEQ ID NO: 770103 - DNA, 20 bp, mouse
gtcaaaagacacgacatcac

SEQ ID NO: 770104 - DNA, 20 bp, mouse
gataggttattcagtaggac

SEQ ID NO: 770105 - DNA, 20 bp, mouse
gaaggcctcagctttgactg

SEQ ID NO: 770106 - DNA, 20 bp, mouse
gtggacagtatgtaagtcta

SEQ ID NO: 770107 - DNA, 20 bp, mouse
ggagtgtgagcaatgaggtc

SEQ ID NO: 770108 - DNA, 20 bp, mouse
gatccaggccagtgtcccac

SEQ ID NO: 770109 - DNA, 20 bp, mouse
gttttggagtgtgagcaatg

SEQ ID NO: 770110 - DNA, 20 bp, mouse
gtgtagaatgggaacatctt

SEQ ID NO: 770111 - DNA, 20 bp, mouse
gctcacactccaaaaattca

SEQ ID NO: 770112 - DNA, 20 bp, mouse
gaagtgaatcaggagaatcc

SEQ ID NO: 770113 - DNA, 20 bp, mouse
ggagagagtggacttcccca

SEQ ID NO: 770114 - DNA, 20 bp, mouse
ggattgtaacctggacccca

SEQ ID NO: 770115 - DNA, 20 bp, mouse
gcaatttccctgtgggacac

SEQ ID NO: 770116 - DNA, 20 bp, mouse
gggatgtatagagaactagg

SEQ ID NO: 770117 - DNA, 20 bp, mouse
gataggatgtatagagaact

SEQ ID NO: 770118 - DNA, 20 bp, mouse
gctagaagatcagatgtcta

SEQ ID NO: 770119 - DNA, 20 bp, mouse
ggtggtcagaatacaacaat

SEQ ID NO: 770120 - DNA, 20 bp, mouse
gggggcactgggcctggaaa

SEQ ID NO: 770121 - DNA, 20 bp, mouse
ggatcagatgtctatggaga

SEQ ID NO: 770122 - DNA, 20 bp, mouse
ggggaaatcaggtggcaata

SEQ ID NO: 770123 - DNA, 20 bp, mouse
gaaacaaagaagggtcagag

SEQ ID NO: 770124 - DNA, 20 bp, mouse
gtggatctgggcagaaagat

SEQ ID NO: 770125 - DNA, 20 bp, mouse
gtatagagaactaggtggaa

SEQ ID NO: 770126 - DNA, 20 bp, mouse
ggtcatgctatcatcccaaa

SEQ ID NO: 770127 - DNA, 20 bp, mouse
gccactccttgtcatgttat

SEQ ID NO: 770128 - DNA, 20 bp, mouse
gatatgaatgaaaagattat

SEQ ID NO: 770129 - DNA, 20 bp, mouse
gattaccctataacatgaca

SEQ ID NO: 770130 - DNA, 20 bp, mouse
gatgttcacatttattaaaa

SEQ ID NO: 770131 - DNA, 20 bp, mouse
gaaaaggttcagagagtgaa

SEQ ID NO: 770132 - DNA, 20 bp, mouse
gttactgctaaatatgattc

SEQ ID NO: 770133 - DNA, 20 bp, mouse
gtgtgaacatacacagagag

SEQ ID NO: 770134 - DNA, 20 bp, mouse
ggtgtttagggaatttatag

SEQ ID NO: 770135 - DNA, 20 bp, mouse
gatacatgacttttaataaa

SEQ ID NO: 770136 - DNA, 20 bp, mouse
gactccatggaccagatgac

SEQ ID NO: 770137 - DNA, 20 bp, mouse
gcacatgattgacttaagag

SEQ ID NO: 770138 - DNA, 20 bp, mouse
ggaacttaactatactctaa

SEQ ID NO: 770139 - DNA, 20 bp, mouse
gtacagtgtatgtgactcca

SEQ ID NO: 770140 - DNA, 20 bp, mouse
gaggatctaatcctgtcatc

SEQ ID NO: 770141 - DNA, 20 bp, mouse
gaatctgctaattatctgca

SEQ ID NO: 770142 - DNA, 20 bp, mouse
gttgttaaaatattagtcag

SEQ ID NO: 770143 - DNA, 20 bp, mouse
gtaaacatggattatctgca

SEQ ID NO: 770144 - DNA, 20 bp, mouse
gcccagggaccaatgacttt

SEQ ID NO: 770145 - DNA, 20 bp, mouse
gagggtaatcatctacttaa

SEQ ID NO: 770146 - DNA, 20 bp, mouse
gcccaacccaaggtgttatc

SEQ ID NO: 770147 - DNA, 20 bp, mouse
gagcacaaattcatctcaag

SEQ ID NO: 770148 - DNA, 20 bp, mouse
gaggtattagctagacattg

SEQ ID NO: 770149 - DNA, 20 bp, mouse
gaccagataacaccttgggt

SEQ ID NO: 770150 - DNA, 20 bp, mouse
gatcttaccagataacacct

SEQ ID NO: 770151 - DNA, 20 bp, mouse
ggtcatcagtcttggcagaa

SEQ ID NO: 770152 - DNA, 20 bp, mouse
gtgaactaaatccaggacct

SEQ ID NO: 770153 - DNA, 20 bp, mouse
gactccttttgccaaggtcc

SEQ ID NO: 770154 - DNA, 20 bp, mouse
gtatattagcattatttggc

SEQ ID NO: 770155 - DNA, 20 bp, mouse
gaagatatattagcattatt

SEQ ID NO: 770156 - DNA, 20 bp, mouse
gtaaacaaggtggtcctggg

SEQ ID NO: 770157 - DNA, 20 bp, mouse
gcgcagactgagtctcatgg

SEQ ID NO: 770158 - DNA, 20 bp, mouse
gaggagccaagtcctcaaca

SEQ ID NO: 770159 - DNA, 20 bp, mouse
ggcgctaaaaaggatcacaa

SEQ ID NO: 770160 - DNA, 20 bp, mouse
gtgggcaaaaggcccatctc

SEQ ID NO: 770161 - DNA, 20 bp, mouse
ggactcagtctgcgctaaaa

SEQ ID NO: 770162 - DNA, 20 bp, mouse
gggtcacatggggaaagaac

SEQ ID NO: 770163 - DNA, 20 bp, mouse
gtagcgcagactgagtctca

SEQ ID NO: 770164 - DNA, 20 bp, mouse
ggggacagatctgagttggg

SEQ ID NO: 770165 - DNA, 20 bp, mouse
gctgcactgtgctgggcaaa

SEQ ID NO: 770166 - DNA, 20 bp, mouse
gaaggaagggcaggaattgt

SEQ ID NO: 770167 - DNA, 20 bp, mouse
gctccctgatagcagataca

SEQ ID NO: 770168 - DNA, 20 bp, mouse
gttaccatgtatctgctatc

SEQ ID NO: 770169 - DNA, 20 bp, mouse
gtactgtcacagaaagtttc

SEQ ID NO: 770170 - DNA, 20 bp, mouse
gtctgcatttatttgaagga

SEQ ID NO: 770171 - DNA, 20 bp, mouse
gtgtgacatctgaggctggc

SEQ ID NO: 770172 - DNA, 20 bp, mouse
gcatatctgcatttatttga

SEQ ID NO: 770173 - DNA, 20 bp, mouse
gtatgctcctgtgacatctg

SEQ ID NO: 770174 - DNA, 20 bp, mouse
ggagactctcactgattctg

SEQ ID NO: 770175 - DNA, 20 bp, mouse
gtctggtgtttgctatgtta

SEQ ID NO: 770176 - DNA, 20 bp, mouse
gacagcagttggttgttgtt

SEQ ID NO: 770177 - DNA, 20 bp, mouse
gctacactcatcatggtact

SEQ ID NO: 770178 - DNA, 20 bp, mouse
gtctctggagctgtagatga

SEQ ID NO: 770179 - DNA, 20 bp, mouse
gaaatgggcattttattctc

SEQ ID NO: 770180 - DNA, 20 bp, mouse
gagggtttttattaaaggta

SEQ ID NO: 770181 - DNA, 20 bp, mouse
gggaaaataattatctagtc

SEQ ID NO: 770182 - DNA, 20 bp, mouse
gtttttttgtactttactta

SEQ ID NO: 770183 - DNA, 20 bp, mouse
gatttatttagtgtttatca

SEQ ID NO: 770184 - DNA, 20 bp, mouse
gggtactgggaatacatact

SEQ ID NO: 770185 - DNA, 20 bp, mouse
gtccatacaaggacagaaat

SEQ ID NO: 770186 - DNA, 20 bp, mouse
gtttaccggtatctgctatc

SEQ ID NO: 770187 - DNA, 20 bp, mouse
gttctctggtctttttttac

SEQ ID NO: 770188 - DNA, 20 bp, mouse
gagttttgtttgctatgcta

SEQ ID NO: 770189 - DNA, 20 bp, mouse
gtcatatctgcatttgtttt

SEQ ID NO: 770190 - DNA, 20 bp, mouse
gtagggaaaggcaggaataa

SEQ ID NO: 770191 - DNA, 20 bp, mouse
gctgcatttgttttagggaa

SEQ ID NO: 770192 - DNA, 20 bp, mouse
gatttgttttagggaaaggc

SEQ ID NO: 770193 - DNA, 20 bp, mouse
gatagaaaaacagctctgaa

SEQ ID NO: 770194 - DNA, 20 bp, mouse
gagtgagagtctctgttcac

SEQ ID NO: 770195 - DNA, 20 bp, mouse
gtctccctgatagcagatac

SEQ ID NO: 770196 - DNA, 20 bp, mouse
gaaggacgtctgctatggat

SEQ ID NO: 770197 - DNA, 20 bp, mouse
gatgggaatgttaaactcag

SEQ ID NO: 770198 - DNA, 20 bp, mouse
gtccttacttggtagttaaa

SEQ ID NO: 770199 - DNA, 20 bp, mouse
ggtgctgcgtgttctttctc

SEQ ID NO: 770200 - DNA, 20 bp, mouse
ggtacttgagacgtgaagac

SEQ ID NO: 770201 - DNA, 20 bp, mouse
ggttaaaaggacgtctgcta

SEQ ID NO: 770202 - DNA, 20 bp, mouse
gctaagagctcaatatcaat

SEQ ID NO: 770203 - DNA, 20 bp, mouse
ggatttaaatttttccacgt

SEQ ID NO: 770204 - DNA, 20 bp, mouse
gatgacaaacagtccttact

SEQ ID NO: 770205 - DNA, 20 bp, mouse
gcaatatcaattggccacat

SEQ ID NO: 770206 - DNA, 20 bp, mouse
gctgttgtgtaggtcttttc

SEQ ID NO: 770207 - DNA, 20 bp, mouse
gcaaatgatgtgtaactctt

SEQ ID NO: 770208 - DNA, 20 bp, mouse
gatgatgtgtaactctttgg

SEQ ID NO: 770209 - DNA, 20 bp, mouse
gaaaggggaaactaagaatg

SEQ ID NO: 770210 - DNA, 20 bp, mouse
gggaatgtcaggaccagaaa

SEQ ID NO: 770211 - DNA, 20 bp, mouse
gaagcaaagtcatctgtaga

SEQ ID NO: 770212 - DNA, 20 bp, mouse
ggttcaaagagctgttgtgt

SEQ ID NO: 770213 - DNA, 20 bp, mouse
gaccagaaatgggagtggga

SEQ ID NO: 770214 - DNA, 20 bp, mouse
ggggaggggggaggggataa

SEQ ID NO: 770215 - DNA, 20 bp, mouse
gggggataagggattttcaa

SEQ ID NO: 770216 - DNA, 20 bp, mouse
ggagtatgaacaaactatgg

SEQ ID NO: 770217 - DNA, 20 bp, mouse
gttacaagagcaggggacaa

SEQ ID NO: 770218 - DNA, 20 bp, mouse
gcgacactgggatttgagtg

SEQ ID NO: 770219 - DNA, 20 bp, mouse
ggaaaaccatttggtaaatg

SEQ ID NO: 770220 - DNA, 20 bp, mouse
gaaatggctgtaaaagtaaa

SEQ ID NO: 770221 - DNA, 20 bp, mouse
gatagagtatgaacaaacta

SEQ ID NO: 770222 - DNA, 20 bp, mouse
gcaaatcccagtgtcgggca

SEQ ID NO: 770223 - DNA, 20 bp, mouse
gttcaaaacagcagatagtc

SEQ ID NO: 770224 - DNA, 20 bp, mouse
gagttggtacttacaagagc

SEQ ID NO: 770225 - DNA, 20 bp, mouse
gaggctccttgcccgacact

SEQ ID NO: 770226 - DNA, 20 bp, mouse
gttctccttaaaagggagta

SEQ ID NO: 770227 - DNA, 20 bp, mouse
gcttaaaagggagtaaggag

SEQ ID NO: 770228 - DNA, 20 bp, mouse
gaccattgatgtgatttcta

SEQ ID NO: 770229 - DNA, 20 bp, mouse
gagtctggaaaactcttcct

SEQ ID NO: 770230 - DNA, 20 bp, mouse
gatagaacaactttgtcccc

SEQ ID NO: 770231 - DNA, 20 bp, mouse
gatataaaacaataattcat

SEQ ID NO: 770232 - DNA, 20 bp, mouse
gcatgaacaaatcaggattc

SEQ ID NO: 770233 - DNA, 20 bp, mouse
gaactaggcaaaaattatga

SEQ ID NO: 770234 - DNA, 20 bp, mouse
gaaggagaaatttctcattg

SEQ ID NO: 770235 - DNA, 20 bp, mouse
gatataccagctctttccct

SEQ ID NO: 770236 - DNA, 20 bp, mouse
gaacccagttcctgtgcatt

SEQ ID NO: 770237 - DNA, 20 bp, mouse
gagtaactatggagaagctc

SEQ ID NO: 770238 - DNA, 20 bp, mouse
gacttggctacaagtaacta

SEQ ID NO: 770239 - DNA, 20 bp, mouse
gttcctaatgcacaggaact

SEQ ID NO: 770240 - DNA, 20 bp, mouse
gtgcagtatcatctcactca

SEQ ID NO: 770241 - DNA, 20 bp, mouse
gttcagtgttcctaatgcac

SEQ ID NO: 770242 - DNA, 20 bp, mouse
gagcacattgtagaatcact

SEQ ID NO: 770243 - DNA, 20 bp, mouse
gtgattctgttgtcaagtgg

SEQ ID NO: 770244 - DNA, 20 bp, mouse
gagctcagttcctttaataa

SEQ ID NO: 770245 - DNA, 20 bp, mouse
ggaagacacatgcagatgca

SEQ ID NO: 770246 - DNA, 20 bp, mouse
gaagagttgagtcttatctc

SEQ ID NO: 770247 - DNA, 20 bp, mouse
gaacttaggggcacaagaat

SEQ ID NO: 770248 - DNA, 20 bp, mouse
ggataagactcaactcttca

SEQ ID NO: 770249 - DNA, 20 bp, mouse
gtgcagctcagagtaactta

SEQ ID NO: 770250 - DNA, 20 bp, mouse
gtgagtcttatctcaggatc

SEQ ID NO: 770251 - DNA, 20 bp, mouse
gaatgcaaactcttattgta

SEQ ID NO: 770252 - DNA, 20 bp, mouse
gatatcaaagaattttcaac

SEQ ID NO: 770253 - DNA, 20 bp, mouse
gtaaattgttagttagccta

SEQ ID NO: 770254 - DNA, 20 bp, mouse
gataatttactgtgtgatac

SEQ ID NO: 770255 - DNA, 20 bp, mouse
gatgaaagatttatttataa

SEQ ID NO: 770256 - DNA, 20 bp, mouse
gtagctagtaagttttctaa

SEQ ID NO: 770257 - DNA, 20 bp, mouse
gttgaataacatgactataa

SEQ ID NO: 770258 - DNA, 20 bp, mouse
gtctagaaaacatgaagaga

SEQ ID NO: 770259 - DNA, 20 bp, mouse
gtgacaaactaatactatgt

SEQ ID NO: 770260 - DNA, 20 bp, mouse
gcaaactaatactatgtagg

SEQ ID NO: 770261 - DNA, 20 bp, mouse
gtatatgaaaagctgatgag

SEQ ID NO: 770262 - DNA, 20 bp, mouse
gaattacaaattaaaaatta

SEQ ID NO: 770263 - DNA, 20 bp, mouse
gttaataactgacttgtgat

SEQ ID NO: 770264 - DNA, 20 bp, mouse
gtattagtttgtcaaaaaac

SEQ ID NO: 770265 - DNA, 20 bp, mouse
gttgtatgataaagagctag

SEQ ID NO: 770266 - DNA, 20 bp, mouse
gagcatgagccgagtcagtg

SEQ ID NO: 770267 - DNA, 20 bp, mouse
gggaaccacccacactgact

SEQ ID NO: 770268 - DNA, 20 bp, mouse
gtgagccgagtcagtgtggg

SEQ ID NO: 770269 - DNA, 20 bp, mouse
gtttcttggaaatgctgaac

SEQ ID NO: 770270 - DNA, 20 bp, mouse
gctctagtgggattaagggt

SEQ ID NO: 770271 - DNA, 20 bp, mouse
gtgggattaagggttggctt

SEQ ID NO: 770272 - DNA, 20 bp, mouse
ggccagtgtcagtagatcat

SEQ ID NO: 770273 - DNA, 20 bp, mouse
gacctatgatctactgacac

SEQ ID NO: 770274 - DNA, 20 bp, mouse
gtgttgcttctatgtaagtc

SEQ ID NO: 770275 - DNA, 20 bp, mouse
gatgatgctaaagaatgcct

SEQ ID NO: 770276 - DNA, 20 bp, mouse
gaggaaatggaagaatcaac

SEQ ID NO: 770277 - DNA, 20 bp, mouse
gtggtagatagagagtagat

SEQ ID NO: 770278 - DNA, 20 bp, mouse
gacaagagatttttttggac

SEQ ID NO: 770279 - DNA, 20 bp, mouse
ggagatttttttggactgga

SEQ ID NO: 770280 - DNA, 20 bp, mouse
gaataataattacagcatgt

SEQ ID NO: 770281 - DNA, 20 bp, mouse
gtagatagatgatagatgat

SEQ ID NO: 770282 - DNA, 20 bp, mouse
gaattacagcatgtgggtgc

SEQ ID NO: 770283 - DNA, 20 bp, mouse
gagagaacaagagatttttt

SEQ ID NO: 770284 - DNA, 20 bp, mouse
gaacaactgaagaaaaatga

SEQ ID NO: 770285 - DNA, 20 bp, mouse
gggtgctgggaactttatgt

SEQ ID NO: 770286 - DNA, 20 bp, mouse
ggatgatgaaattcaggatg

SEQ ID NO: 770287 - DNA, 20 bp, mouse
gcacctcaattattagacaa

SEQ ID NO: 770288 - DNA, 20 bp, mouse
gagaaatcgtcctgcatgtg

SEQ ID NO: 770289 - DNA, 20 bp, mouse
gaaagaacaaagcactaagc

SEQ ID NO: 770290 - DNA, 20 bp, mouse
ggcaatgctttactggttga

SEQ ID NO: 770291 - DNA, 20 bp, mouse
gtgacgtggcacttgctcct

SEQ ID NO: 770292 - DNA, 20 bp, mouse
gtacctttgtctaataattg

SEQ ID NO: 770293 - DNA, 20 bp, mouse
gctctggtcgacctgttggt

SEQ ID NO: 770294 - DNA, 20 bp, mouse
gatagtctacatatctgacg

SEQ ID NO: 770295 - DNA, 20 bp, mouse
gctgtaaaattctacaatat

SEQ ID NO: 770296 - DNA, 20 bp, mouse
gaagctggaggcaatgaggt

SEQ ID NO: 770297 - DNA, 20 bp, mouse
gccgaggcatgacaatgtaa

SEQ ID NO: 770298 - DNA, 20 bp, mouse
ggaacatttacagaagagtc

SEQ ID NO: 770299 - DNA, 20 bp, mouse
gagaacttatatatgcaaac

SEQ ID NO: 770300 - DNA, 20 bp, mouse
gccaaatcatcaatataatt

SEQ ID NO: 770301 - DNA, 20 bp, mouse
gtagcacagttattagacca

SEQ ID NO: 770302 - DNA, 20 bp, mouse
gcaccgcatccctgcagccg

SEQ ID NO: 770303 - DNA, 20 bp, mouse
gatgttcagttagactactc

SEQ ID NO: 770304 - DNA, 20 bp, mouse
gtctgctctcttcactctaa

SEQ ID NO: 770305 - DNA, 20 bp, mouse
gtgcctcggctgcagggatg

SEQ ID NO: 770306 - DNA, 20 bp, mouse
gcatctagggtttttcttag

SEQ ID NO: 770307 - DNA, 20 bp, mouse
gtccacacaaagatagaatt

SEQ ID NO: 770308 - DNA, 20 bp, mouse
gtggaagaattttttgttaa

SEQ ID NO: 770309 - DNA, 20 bp, mouse
gaacaactactgttgtttta

SEQ ID NO: 770310 - DNA, 20 bp, mouse
ggaagaataactagttattg

SEQ ID NO: 770311 - DNA, 20 bp, mouse
ggcccaattctatctttgtg

SEQ ID NO: 770312 - DNA, 20 bp, mouse
gctattgttttaaattaaca

SEQ ID NO: 770313 - DNA, 20 bp, mouse
gaattgggcattttattttc

SEQ ID NO: 770314 - DNA, 20 bp, mouse
gtttctggagctggagatat

SEQ ID NO: 770315 - DNA, 20 bp, mouse
gtgttgttgttgttgggatc

SEQ ID NO: 770316 - DNA, 20 bp, mouse
gagtacatactaaacagagg

SEQ ID NO: 770317 - DNA, 20 bp, mouse
gcctgggaaagtactctcag

SEQ ID NO: 770318 - DNA, 20 bp, mouse
gatcactctcacaggtatgt

SEQ ID NO: 770319 - DNA, 20 bp, mouse
gaattcttatataaattcta

SEQ ID NO: 770320 - DNA, 20 bp, mouse
gctgtctgcaagatatgaga

SEQ ID NO: 770321 - DNA, 20 bp, mouse
gactttcccagggaactttc

SEQ ID NO: 770322 - DNA, 20 bp, mouse
gattcatttatcactctcac

SEQ ID NO: 770323 - DNA, 20 bp, mouse
gattagtacatactaaacag

SEQ ID NO: 770324 - DNA, 20 bp, mouse
gacaatgcctccaatattag

SEQ ID NO: 770325 - DNA, 20 bp, mouse
ggcaagatatgagagggcaa

SEQ ID NO: 770326 - DNA, 20 bp, mouse
gcatagaagtataggtatgt

SEQ ID NO: 770327 - DNA, 20 bp, mouse
gggtagatacatagaagtat

SEQ ID NO: 770328 - DNA, 20 bp, mouse
gtggtagataaataatagtg

SEQ ID NO: 770329 - DNA, 20 bp, mouse
ggactggaggtttcagagag

SEQ ID NO: 770330 - DNA, 20 bp, mouse
ggaagtataggtatgtaggt

SEQ ID NO: 770331 - DNA, 20 bp, mouse
gagataaataatagtgaggt

SEQ ID NO: 770332 - DNA, 20 bp, mouse
ggaggtttcagagaggggaa

SEQ ID NO: 770333 - DNA, 20 bp, mouse
gaacaagagattttttggac

SEQ ID NO: 770334 - DNA, 20 bp, mouse
gttggtggtttgatgctgag

SEQ ID NO: 770335 - DNA, 20 bp, mouse
gaagagattttttggactgg

SEQ ID NO: 770336 - DNA, 20 bp, mouse
gagaaacagcagggcctaca

SEQ ID NO: 770337 - DNA, 20 bp, mouse
gcaggccaggtcctcatcca

SEQ ID NO: 770338 - DNA, 20 bp, mouse
ggtcacagtctgaaggcaca

SEQ ID NO: 770339 - DNA, 20 bp, mouse
gctgcagcacatcatctaat

SEQ ID NO: 770340 - DNA, 20 bp, mouse
gtatggtcatcactgatatc

SEQ ID NO: 770341 - DNA, 20 bp, mouse
gtggtgctgaagttgctcta

SEQ ID NO: 770342 - DNA, 20 bp, mouse
gacttagcagattcaacatg

SEQ ID NO: 770343 - DNA, 20 bp, mouse
gcccaaagctatatgaagtc

SEQ ID NO: 770344 - DNA, 20 bp, mouse
gtaattcagaggctgggaaa

SEQ ID NO: 770345 - DNA, 20 bp, mouse
gcatactttaaccaggacgc

SEQ ID NO: 770346 - DNA, 20 bp, mouse
gccaggagcagtaaggtctg

SEQ ID NO: 770347 - DNA, 20 bp, mouse
ggactctgcacaggttttgt

SEQ ID NO: 770348 - DNA, 20 bp, mouse
ggaatgaaggcagacacgca

SEQ ID NO: 770349 - DNA, 20 bp, mouse
gccgatgttgagtttagaat

SEQ ID NO: 770350 - DNA, 20 bp, mouse
gttgaattccaggagcagta

SEQ ID NO: 770351 - DNA, 20 bp, mouse
gtgactagatgttcatcttg

SEQ ID NO: 770352 - DNA, 20 bp, mouse
gctgtcaatagtggctttat

SEQ ID NO: 770353 - DNA, 20 bp, mouse
gcaacatcggcttgaattcc

SEQ ID NO: 770354 - DNA, 20 bp, mouse
gctgctctgtgaatcaaagt

SEQ ID NO: 770355 - DNA, 20 bp, mouse
gtatggagtcagtgcatagc

SEQ ID NO: 770356 - DNA, 20 bp, mouse
gacaaacgtgactagagttc

SEQ ID NO: 770357 - DNA, 20 bp, mouse
gctagagttctggaacccac

SEQ ID NO: 770358 - DNA, 20 bp, mouse
gcaaatgtagggccaagcgg

SEQ ID NO: 770359 - DNA, 20 bp, mouse
gactttagcactactccctg

SEQ ID NO: 770360 - DNA, 20 bp, mouse
gaaaaggatcaaataaatgt

SEQ ID NO: 770361 - DNA, 20 bp, mouse
ggaagatcacgaatcttaac

SEQ ID NO: 770362 - DNA, 20 bp, mouse
gaacatctcttctgttagca

SEQ ID NO: 770363 - DNA, 20 bp, mouse
gatgtagggccaagcggtgg

SEQ ID NO: 770364 - DNA, 20 bp, mouse
ggatcaaataaatgtagggc

SEQ ID NO: 770365 - DNA, 20 bp, mouse
ggatcaaatgtagggccaag

SEQ ID NO: 770366 - DNA, 20 bp, mouse
gacaaacaggcgccctacat

SEQ ID NO: 770367 - DNA, 20 bp, mouse
gaaggaggcatcagattcaa

SEQ ID NO: 770368 - DNA, 20 bp, mouse
ggccacagatgtgcagaagg

SEQ ID NO: 770369 - DNA, 20 bp, mouse
gctagagttctagaacacac

SEQ ID NO: 770370 - DNA, 20 bp, mouse
ggcccccttctgcacatctg

SEQ ID NO: 770371 - DNA, 20 bp, mouse
gtgaacaaggctttgcagat

SEQ ID NO: 770372 - DNA, 20 bp, mouse
gaataagtcccagactaagc

SEQ ID NO: 770373 - DNA, 20 bp, mouse
gagtctgggacttatttgac

SEQ ID NO: 770374 - DNA, 20 bp, mouse
gctctattggcaagacaaac

SEQ ID NO: 770375 - DNA, 20 bp, mouse
ggccttctgttcagtgtagg

SEQ ID NO: 770376 - DNA, 20 bp, mouse
gaaagtccagacagtcagat

SEQ ID NO: 770377 - DNA, 20 bp, mouse
gtcactggcttaaggtgtgg

SEQ ID NO: 770378 - DNA, 20 bp, mouse
gtcttcagttaggagatcac

SEQ ID NO: 770379 - DNA, 20 bp, mouse
ggtgttgcccagctaatgtt

SEQ ID NO: 770380 - DNA, 20 bp, mouse
gccagctaatgttgggatca

SEQ ID NO: 770381 - DNA, 20 bp, mouse
gtgggcaacacaaaccagac

SEQ ID NO: 770382 - DNA, 20 bp, mouse
ggtcgaacacagacgaggtc

SEQ ID NO: 770383 - DNA, 20 bp, mouse
gaccagactggatgtggggc

SEQ ID NO: 770384 - DNA, 20 bp, mouse
ggaactccaatctgactgtc

SEQ ID NO: 770385 - DNA, 20 bp, mouse
gagtaggtcgaacacagacg

SEQ ID NO: 770386 - DNA, 20 bp, mouse
gagacagataactgtatatg

SEQ ID NO: 770387 - DNA, 20 bp, mouse
gcagtgtttccatgtctgga

SEQ ID NO: 770388 - DNA, 20 bp, mouse
ggtggaactaaatagcaaaa

SEQ ID NO: 770389 - DNA, 20 bp, mouse
gcatctttagatccaagaca

SEQ ID NO: 770390 - DNA, 20 bp, mouse
ggaatcacaacacagagata

SEQ ID NO: 770391 - DNA, 20 bp, mouse
gggttgcagatgcagctcat

SEQ ID NO: 770392 - DNA, 20 bp, mouse
gtgctttcaacgagtagtgt

SEQ ID NO: 770393 - DNA, 20 bp, mouse
gatggatccaaatgcagtaa

SEQ ID NO: 770394 - DNA, 20 bp, mouse
gtattcagtgtttccatgtc

SEQ ID NO: 770395 - DNA, 20 bp, mouse
gaatctaatgtgtacactca

SEQ ID NO: 770396 - DNA, 20 bp, mouse
gagagaggagatcactagat

SEQ ID NO: 770397 - DNA, 20 bp, mouse
gctaaaggcagcctccatgc

SEQ ID NO: 770398 - DNA, 20 bp, mouse
ggtcaaatgcaccagcatgg

SEQ ID NO: 770399 - DNA, 20 bp, mouse
gtaccactcaagcacttgag

SEQ ID NO: 770400 - DNA, 20 bp, mouse
gcagtggggaccttttggca

SEQ ID NO: 770401 - DNA, 20 bp, mouse
gatcctctcaagtgcttgag

SEQ ID NO: 770402 - DNA, 20 bp, mouse
gagtgatctcctctctaaag

SEQ ID NO: 770403 - DNA, 20 bp, mouse
gtaacctcatgctgtgaggg

SEQ ID NO: 770404 - DNA, 20 bp, mouse
gcatgattctggaatgttta

SEQ ID NO: 770405 - DNA, 20 bp, mouse
gcctaggcctccttgtctaa

SEQ ID NO: 770406 - DNA, 20 bp, mouse
gggactctttagaaaacttc

SEQ ID NO: 770407 - DNA, 20 bp, mouse
gcatctacatggtgctggta

SEQ ID NO: 770408 - DNA, 20 bp, mouse
gccctggaccagtagctaaa

SEQ ID NO: 770409 - DNA, 20 bp, mouse
gccagagaatactgggaaag

SEQ ID NO: 770410 - DNA, 20 bp, mouse
gttcaggatacctgcaaagt

SEQ ID NO: 770411 - DNA, 20 bp, mouse
gggagaaaaccagagaatac

SEQ ID NO: 770412 - DNA, 20 bp, mouse
gaagagttagatctcacaat

SEQ ID NO: 770413 - DNA, 20 bp, mouse
gcaatacctgcctactttgc

SEQ ID NO: 770414 - DNA, 20 bp, mouse
gactaacaactctcactggt

SEQ ID NO: 770415 - DNA, 20 bp, mouse
gactgactaacaactctcac

SEQ ID NO: 770416 - DNA, 20 bp, mouse
gtcttcggactggaaatcat

SEQ ID NO: 770417 - DNA, 20 bp, mouse
ggagacattcatgggactgt

SEQ ID NO: 770418 - DNA, 20 bp, mouse
gtccagtccgaagaggaaaa

SEQ ID NO: 770419 - DNA, 20 bp, mouse
gagactgatagggactaata

SEQ ID NO: 770420 - DNA, 20 bp, mouse
gtgggaactggatgaagttc

SEQ ID NO: 770421 - DNA, 20 bp, mouse
gttcatgggactgtgggaac

SEQ ID NO: 770422 - DNA, 20 bp, mouse
gaggagccaaagagactgat

SEQ ID NO: 770423 - DNA, 20 bp, mouse
gccagacagtgagacattca

SEQ ID NO: 770424 - DNA, 20 bp, mouse
gagaagaaaaagcttgattc

SEQ ID NO: 770425 - DNA, 20 bp, mouse
gagtctctttggctcctctt

SEQ ID NO: 770426 - DNA, 20 bp, mouse
ggactgaacatctctggatt

SEQ ID NO: 770427 - DNA, 20 bp, mouse
gtgaagaactgccaaagtca

SEQ ID NO: 770428 - DNA, 20 bp, mouse
gtaaaacaaatgatttagga

SEQ ID NO: 770429 - DNA, 20 bp, mouse
gctaataacatagaatgcta

SEQ ID NO: 770430 - DNA, 20 bp, mouse
gaacatagaatgctatggta

SEQ ID NO: 770431 - DNA, 20 bp, mouse
gaagtagtttcacttctttg

SEQ ID NO: 770432 - DNA, 20 bp, mouse
gatgcatccgatgaagaaaa

SEQ ID NO: 770433 - DNA, 20 bp, mouse
gagtttcacttctttgggga

SEQ ID NO: 770434 - DNA, 20 bp, mouse
gattgtcagtttacccatcc

SEQ ID NO: 770435 - DNA, 20 bp, mouse
gatttaggatggcttgaaga

SEQ ID NO: 770436 - DNA, 20 bp, mouse
ggaaacttctcagtgttctg

SEQ ID NO: 770437 - DNA, 20 bp, mouse
gagctgccaggctaaaatct

SEQ ID NO: 770438 - DNA, 20 bp, mouse
ggcaagactggatagctgcc

SEQ ID NO: 770439 - DNA, 20 bp, mouse
gggagaaaacgctctttctg

SEQ ID NO: 770440 - DNA, 20 bp, mouse
gctctttctgtggaattgaa

SEQ ID NO: 770441 - DNA, 20 bp, mouse
gatttaggattatgtgaaga

SEQ ID NO: 770442 - DNA, 20 bp, mouse
gaaagagggtttagatagag

SEQ ID NO: 770443 - DNA, 20 bp, mouse
gttgaagaactaggtcaagc

SEQ ID NO: 770444 - DNA, 20 bp, mouse
gcatttttagttgaagaact

SEQ ID NO: 770445 - DNA, 20 bp, mouse
gggtgtacagacaatatcca

SEQ ID NO: 770446 - DNA, 20 bp, mouse
gaagtagggtagagtgagaa

SEQ ID NO: 770447 - DNA, 20 bp, mouse
gaagttatctatctaaagta

SEQ ID NO: 770448 - DNA, 20 bp, mouse
ggccaaatctaggaacaaag

SEQ ID NO: 770449 - DNA, 20 bp, mouse
ggtccaaatctcagtgttat

SEQ ID NO: 770450 - DNA, 20 bp, mouse
gacgtcacacacatgacaac

SEQ ID NO: 770451 - DNA, 20 bp, mouse
ggaaaacaaactcgtgtttt

SEQ ID NO: 770452 - DNA, 20 bp, mouse
gtctacaggactgagaaacc

SEQ ID NO: 770453 - DNA, 20 bp, mouse
gtgcatcctatgaagaataa

SEQ ID NO: 770454 - DNA, 20 bp, mouse
gataaacccttattcttcat

SEQ ID NO: 770455 - DNA, 20 bp, mouse
gttcccataacactgagatt

SEQ ID NO: 770456 - DNA, 20 bp, mouse
gagggtagggcaggagtcaa

SEQ ID NO: 770457 - DNA, 20 bp, mouse
gtagctaaatagccggtggg

SEQ ID NO: 770458 - DNA, 20 bp, mouse
gtcggtagcacaaaacccaa

SEQ ID NO: 770459 - DNA, 20 bp, mouse
gacaggcagggtaacggatg

SEQ ID NO: 770460 - DNA, 20 bp, mouse
gtactgcaggaggagagggt

SEQ ID NO: 770461 - DNA, 20 bp, mouse
ggggtagctaaatagccggt

SEQ ID NO: 770462 - DNA, 20 bp, mouse
gagccagggaagtgaagcat

SEQ ID NO: 770463 - DNA, 20 bp, mouse
gggtgggaggaagagcttca

SEQ ID NO: 770464 - DNA, 20 bp, mouse
gctggctcctaaatcccgaa

SEQ ID NO: 770465 - DNA, 20 bp, mouse
gtgaggggtagctaaatagc

SEQ ID NO: 770466 - DNA, 20 bp, mouse
gatgacaatactccaggtgg

SEQ ID NO: 770467 - DNA, 20 bp, mouse
gctctagctctctaggtcaa

SEQ ID NO: 770468 - DNA, 20 bp, mouse
gttaaagatgacaatactcc

SEQ ID NO: 770469 - DNA, 20 bp, mouse
ggtcaagggtatgtccttaa

SEQ ID NO: 770470 - DNA, 20 bp, mouse
gtgttgtcatcttgtttgtt

SEQ ID NO: 770471 - DNA, 20 bp, mouse
gaatagtctctgtccctgac

SEQ ID NO: 770472 - DNA, 20 bp, mouse
gaataaacatagttcctgtc

SEQ ID NO: 770473 - DNA, 20 bp, mouse
gaagatgacaatactccagg

SEQ ID NO: 770474 - DNA, 20 bp, mouse
gcattagtttcaaagttttt

SEQ ID NO: 770475 - DNA, 20 bp, mouse
gcagcctggtctacagttct

SEQ ID NO: 770476 - DNA, 20 bp, mouse
ggcccagagggtagaaactc

SEQ ID NO: 770477 - DNA, 20 bp, mouse
ggccagtggggacagataga

SEQ ID NO: 770478 - DNA, 20 bp, mouse
gttggactgcagttgcagag

SEQ ID NO: 770479 - DNA, 20 bp, mouse
gggtcctatcatggctccta

SEQ ID NO: 770480 - DNA, 20 bp, mouse
gggagacaatagcagaggca

SEQ ID NO: 770481 - DNA, 20 bp, mouse
ggagctctggctggcccaga

SEQ ID NO: 770482 - DNA, 20 bp, mouse
gcctagggatcacaaagata

SEQ ID NO: 770483 - DNA, 20 bp, mouse
gcacagtagaggtcctatca

SEQ ID NO: 770484 - DNA, 20 bp, mouse
gggaaaagaaagggcgagtt

SEQ ID NO: 770485 - DNA, 20 bp, mouse
gtagcagaggcagggccagt

SEQ ID NO: 770486 - DNA, 20 bp, mouse
ggtacatggggggatgtctg

SEQ ID NO: 770487 - DNA, 20 bp, mouse
ggctaataggtctttatttt

SEQ ID NO: 770488 - DNA, 20 bp, mouse
gtatcatgcgtgtacatggg

SEQ ID NO: 770489 - DNA, 20 bp, mouse
gttatttcagggaagtataa

SEQ ID NO: 770490 - DNA, 20 bp, mouse
gagttcttactcagtgagag

SEQ ID NO: 770491 - DNA, 20 bp, mouse
gtgcctcaatatataagaca

SEQ ID NO: 770492 - DNA, 20 bp, mouse
ggtttgatgcatggatatct

SEQ ID NO: 770493 - DNA, 20 bp, mouse
gttttatcatgcgtgtacat

SEQ ID NO: 770494 - DNA, 20 bp, mouse
ggcttgcagatatagctatc

SEQ ID NO: 770495 - DNA, 20 bp, mouse
ggtctttgtggtttgatgca

SEQ ID NO: 770496 - DNA, 20 bp, mouse
gtcttggccatagcccaggt

SEQ ID NO: 770497 - DNA, 20 bp, mouse
ggtgggatgataacacagag

SEQ ID NO: 770498 - DNA, 20 bp, mouse
gctgtgaaatctggggtcac

SEQ ID NO: 770499 - DNA, 20 bp, mouse
ggtgcaaagctgtgaaatct

SEQ ID NO: 770500 - DNA, 20 bp, mouse
gctgggctatggccaagaca

SEQ ID NO: 770501 - DNA, 20 bp, mouse
gaatctataggctactaatg

SEQ ID NO: 770502 - DNA, 20 bp, mouse
gatggtacacatgtttgcaa

SEQ ID NO: 770503 - DNA, 20 bp, mouse
gtatcatcccacctgggcta

SEQ ID NO: 770504 - DNA, 20 bp, mouse
ggtcctctgaggccctgtct

SEQ ID NO: 770505 - DNA, 20 bp, mouse
gctgtgttatcatcccacct

SEQ ID NO: 770506 - DNA, 20 bp, mouse
gaacctgcatggctgataag

SEQ ID NO: 770507 - DNA, 20 bp, mouse
gaaatcctggggtccaaagt

SEQ ID NO: 770508 - DNA, 20 bp, mouse
gcaccccttatcagccatgc

SEQ ID NO: 770509 - DNA, 20 bp, mouse
gcataaaggtatctggatag

SEQ ID NO: 770510 - DNA, 20 bp, mouse
gcaggtttgtggaaaatcct

SEQ ID NO: 770511 - DNA, 20 bp, mouse
gtggatagtggtcacctgct

SEQ ID NO: 770512 - DNA, 20 bp, mouse
ggagagatagcattgagacg

SEQ ID NO: 770513 - DNA, 20 bp, mouse
ggtccagtaaagagtcataa

SEQ ID NO: 770514 - DNA, 20 bp, mouse
gatatgaaggctagcccagc

SEQ ID NO: 770515 - DNA, 20 bp, mouse
gaaagagtcataaaggtatc

SEQ ID NO: 770516 - DNA, 20 bp, mouse
gaaccctttaactggggcca

SEQ ID NO: 770517 - DNA, 20 bp, mouse
ggactaaagagtgactcaat

SEQ ID NO: 770518 - DNA, 20 bp, mouse
gcagtctctagcctcgcgca

SEQ ID NO: 770519 - DNA, 20 bp, mouse
gaaggagagatagcacaaag

SEQ ID NO: 770520 - DNA, 20 bp, mouse
gagtgtgtctgccctgcgcg

SEQ ID NO: 770521 - DNA, 20 bp, mouse
gaactgtagaaccctttaac

SEQ ID NO: 770522 - DNA, 20 bp, mouse
gtaaaagagatttgtagaaa

SEQ ID NO: 770523 - DNA, 20 bp, mouse
gcactcgtcatcaaacacct

SEQ ID NO: 770524 - DNA, 20 bp, mouse
gaaaccttatgcactgttaa

SEQ ID NO: 770525 - DNA, 20 bp, mouse
gagtccattaacagtgcata

SEQ ID NO: 770526 - DNA, 20 bp, mouse
gagagccaggtagtggtata

SEQ ID NO: 770527 - DNA, 20 bp, mouse
gtgggccttagaagataatc

SEQ ID NO: 770528 - DNA, 20 bp, mouse
gacaaccatataccactacc

SEQ ID NO: 770529 - DNA, 20 bp, mouse
gttatcaactctacagtact

SEQ ID NO: 770530 - DNA, 20 bp, mouse
gtcagctcaaactccctata

SEQ ID NO: 770531 - DNA, 20 bp, mouse
gttgataacaggcagatcgc

SEQ ID NO: 770532 - DNA, 20 bp, mouse
gctatataagagccaggtag

SEQ ID NO: 770533 - DNA, 20 bp, mouse
gaaacaacagcagctgatat

SEQ ID NO: 770534 - DNA, 20 bp, mouse
gttaacctgattatcttcta

SEQ ID NO: 770535 - DNA, 20 bp, mouse
ggtgcatatgtatacaagtg

SEQ ID NO: 770536 - DNA, 20 bp, mouse
ggacttagttcaaatctcca

SEQ ID NO: 770537 - DNA, 20 bp, mouse
gtttatctacagtgtactca

SEQ ID NO: 770538 - DNA, 20 bp, mouse
ggcccattgggccccagtac

SEQ ID NO: 770539 - DNA, 20 bp, mouse
gattcgtacagatccatcct

SEQ ID NO: 770540 - DNA, 20 bp, mouse
gtcaggatcaggatcatcta

SEQ ID NO: 770541 - DNA, 20 bp, mouse
gcatccaatagttgattgtg

SEQ ID NO: 770542 - DNA, 20 bp, mouse
gcagctagtcaagagctccg

SEQ ID NO: 770543 - DNA, 20 bp, mouse
gctacagtgtactcagggtc

SEQ ID NO: 770544 - DNA, 20 bp, mouse
gtagttcaaatctccaagga

SEQ ID NO: 770545 - DNA, 20 bp, mouse
gtatttaaatggtttttttt

SEQ ID NO: 770546 - DNA, 20 bp, mouse
gctgctgtttaatattgtgg

SEQ ID NO: 770547 - DNA, 20 bp, mouse
gatactgctgtttaatattg

SEQ ID NO: 770548 - DNA, 20 bp, mouse
gatacacctatcagtagtct

SEQ ID NO: 770549 - DNA, 20 bp, mouse
gtttctcctagactactgat

SEQ ID NO: 770550 - DNA, 20 bp, mouse
gcaaataaaacattttagta

SEQ ID NO: 770551 - DNA, 20 bp, mouse
gagacactgtcttttatctt

SEQ ID NO: 770552 - DNA, 20 bp, mouse
gtatttctgaacaatacaaa

SEQ ID NO: 770553 - DNA, 20 bp, mouse
ggaattaattggagatcaaa

SEQ ID NO: 770554 - DNA, 20 bp, mouse
gcattccatattatacatat

SEQ ID NO: 770555 - DNA, 20 bp, mouse
gattttcatgttgattgtgt

SEQ ID NO: 770556 - DNA, 20 bp, mouse
gaggtcatatctgctcatct

SEQ ID NO: 770557 - DNA, 20 bp, mouse
gacagctcatgcttctacag

SEQ ID NO: 770558 - DNA, 20 bp, mouse
gactgcttgggaacttctca

SEQ ID NO: 770559 - DNA, 20 bp, mouse
gactaattcagtaaatctga

SEQ ID NO: 770560 - DNA, 20 bp, mouse
gctgtgctctaggatatgaa

SEQ ID NO: 770561 - DNA, 20 bp, mouse
gcagtcactggtgcagtctc

SEQ ID NO: 770562 - DNA, 20 bp, mouse
gacttctcatggaagtgagg

SEQ ID NO: 770563 - DNA, 20 bp, mouse
gctcaggttccgcacactga

SEQ ID NO: 770564 - DNA, 20 bp, mouse
gagtttaggggtggtaattt

SEQ ID NO: 770565 - DNA, 20 bp, mouse
gttacagactctcagaatac

SEQ ID NO: 770566 - DNA, 20 bp, mouse
gacgctggactgtggatcta

SEQ ID NO: 770567 - DNA, 20 bp, mouse
gcaacccagaggcagctgta

SEQ ID NO: 770568 - DNA, 20 bp, mouse
gtgtgtaggacgctggactg

SEQ ID NO: 770569 - DNA, 20 bp, mouse
gtggatagcaagcaacccag

SEQ ID NO: 770570 - DNA, 20 bp, mouse
gtctgtacctaatagtcacg

SEQ ID NO: 770571 - DNA, 20 bp, mouse
ggggagagcagagccctata

SEQ ID NO: 770572 - DNA, 20 bp, mouse
gcctgagccacgtgactatt

SEQ ID NO: 770573 - DNA, 20 bp, mouse
gcctccctacagctgcctct

SEQ ID NO: 770574 - DNA, 20 bp, mouse
gctcttgggtggctcctgaa

SEQ ID NO: 770575 - DNA, 20 bp, mouse
ggacctcccagcagccagat

SEQ ID NO: 770576 - DNA, 20 bp, mouse
gaaagagggtatctcctctg

SEQ ID NO: 770577 - DNA, 20 bp, mouse
gtcactcaggatatccctgg

SEQ ID NO: 770578 - DNA, 20 bp, mouse
gatactgttcacaagcccgg

SEQ ID NO: 770579 - DNA, 20 bp, mouse
gaccagtgtggtctgaaaga

SEQ ID NO: 770580 - DNA, 20 bp, mouse
gatgcatctcagcactccat

SEQ ID NO: 770581 - DNA, 20 bp, mouse
gtctaaaggcacctgtccca

SEQ ID NO: 770582 - DNA, 20 bp, mouse
gtctgcattgagtgactctc

SEQ ID NO: 770583 - DNA, 20 bp, mouse
gtccacctggaaggcgatcc

SEQ ID NO: 770584 - DNA, 20 bp, mouse
gtaggaactaagtacctcag

SEQ ID NO: 770585 - DNA, 20 bp, mouse
gcagaccacactggtccacc

SEQ ID NO: 770586 - DNA, 20 bp, mouse
ggatctggaggtggcctgaa

SEQ ID NO: 770587 - DNA, 20 bp, mouse
gctgccagatgatctggagg

SEQ ID NO: 770588 - DNA, 20 bp, mouse
gccagcctcctgtagaagga

SEQ ID NO: 770589 - DNA, 20 bp, mouse
gaggccacctccagatcatc

SEQ ID NO: 770590 - DNA, 20 bp, mouse
gtggtccgggtgaactcagt

SEQ ID NO: 770591 - DNA, 20 bp, mouse
gctcccaaaaagcctgctaa

SEQ ID NO: 770592 - DNA, 20 bp, mouse
gcatgtcgagaattggttct

SEQ ID NO: 770593 - DNA, 20 bp, mouse
gcagtaggcagctgtactag

SEQ ID NO: 770594 - DNA, 20 bp, mouse
gtactagtggagctgttctg

SEQ ID NO: 770595 - DNA, 20 bp, mouse
gtgagaactaagtaaatcag

SEQ ID NO: 770596 - DNA, 20 bp, mouse
gggccatgtagccagagtga

SEQ ID NO: 770597 - DNA, 20 bp, mouse
ggggcctgaaggcttggaca

SEQ ID NO: 770598 - DNA, 20 bp, mouse
gaggtctagtccagaagatg

SEQ ID NO: 770599 - DNA, 20 bp, mouse
ggcaccctgtccaagccttc

SEQ ID NO: 770600 - DNA, 20 bp, mouse
gagcaaaggtggctccagtc

SEQ ID NO: 770601 - DNA, 20 bp, mouse
gctcctgtgctggatggcat

SEQ ID NO: 770602 - DNA, 20 bp, mouse
gccacaccgccaattagccc

SEQ ID NO: 770603 - DNA, 20 bp, mouse
gagcccatgccatccagcac

SEQ ID NO: 770604 - DNA, 20 bp, mouse
gtgcccagggcctgaaggct

SEQ ID NO: 770605 - DNA, 20 bp, mouse
gtctgtggagagtgatgacg

SEQ ID NO: 770606 - DNA, 20 bp, mouse
gcaatgaagaggggaagtag

SEQ ID NO: 770607 - DNA, 20 bp, mouse
gatggagccatcaagagggt

SEQ ID NO: 770608 - DNA, 20 bp, mouse
gcctctgcatctagcactcc

SEQ ID NO: 770609 - DNA, 20 bp, mouse
gtttgggtgcacaatgaaga

SEQ ID NO: 770610 - DNA, 20 bp, mouse
gtcctgtgagtagcagggaa

SEQ ID NO: 770611 - DNA, 20 bp, mouse
ggcacttgaagagtttgttt

SEQ ID NO: 770612 - DNA, 20 bp, mouse
gaacagggagtaatgtcagc

SEQ ID NO: 770613 - DNA, 20 bp, mouse
ggccatcaagagggtaggtt

SEQ ID NO: 770614 - DNA, 20 bp, mouse
gacaccctggatccaaaagg

SEQ ID NO: 770615 - DNA, 20 bp, mouse
gtgcccatgtggtctcatcc

SEQ ID NO: 770616 - DNA, 20 bp, mouse
gctgaagagggtacagacaa

SEQ ID NO: 770617 - DNA, 20 bp, mouse
gagtagctgggctcggaaat

SEQ ID NO: 770618 - DNA, 20 bp, mouse
gaattcctatcacaggaatc

SEQ ID NO: 770619 - DNA, 20 bp, mouse
ggctcactaggagagtagct

SEQ ID NO: 770620 - DNA, 20 bp, mouse
ggtcttcccagtttaagacc

SEQ ID NO: 770621 - DNA, 20 bp, mouse
gccaaccccttgttcaatca

SEQ ID NO: 770622 - DNA, 20 bp, mouse
gaaacctacagtggctcact

SEQ ID NO: 770623 - DNA, 20 bp, mouse
gaagaaagctggtatagaca

SEQ ID NO: 770624 - DNA, 20 bp, mouse
gttctgccaggtcttaaact

SEQ ID NO: 770625 - DNA, 20 bp, mouse
gcattcctgattcctgtgat

SEQ ID NO: 770626 - DNA, 20 bp, mouse
ggaagaaagctgctgactgt

SEQ ID NO: 770627 - DNA, 20 bp, mouse
gggactctgtagaggacaat

SEQ ID NO: 770628 - DNA, 20 bp, mouse
ggagctgacaagggtgggta

SEQ ID NO: 770629 - DNA, 20 bp, mouse
gagtcactaggactctgtag

SEQ ID NO: 770630 - DNA, 20 bp, mouse
gtaggacctgatgctcttgt

SEQ ID NO: 770631 - DNA, 20 bp, mouse
gtatccaaaggggcatctcc

SEQ ID NO: 770632 - DNA, 20 bp, mouse
gtaacagtcaactattgatt

SEQ ID NO: 770633 - DNA, 20 bp, mouse
gggcccaggagatgcccctt

SEQ ID NO: 770634 - DNA, 20 bp, mouse
ggttggatttgagctgacaa

SEQ ID NO: 770635 - DNA, 20 bp, mouse
gtggtgctccctgaagtcac

SEQ ID NO: 770636 - DNA, 20 bp, mouse
gggaaaacaggactagatat

SEQ ID NO: 770637 - DNA, 20 bp, mouse
gtgcagaaagggtaaaactt

SEQ ID NO: 770638 - DNA, 20 bp, mouse
gttgctctagaatggaaaac

SEQ ID NO: 770639 - DNA, 20 bp, mouse
gttgctgtgtgtggtgacct

SEQ ID NO: 770640 - DNA, 20 bp, mouse
gcagttcctcttgatccttg

SEQ ID NO: 770641 - DNA, 20 bp, mouse
ggacagcctcaaggatcaag

SEQ ID NO: 770642 - DNA, 20 bp, mouse
gactctgtcattattgtcat

SEQ ID NO: 770643 - DNA, 20 bp, mouse
ggaagcaaagcaaaagaatc

SEQ ID NO: 770644 - DNA, 20 bp, mouse
ggagcattatctgtgcagaa

SEQ ID NO: 770645 - DNA, 20 bp, mouse
gactctctctgtaactggag

SEQ ID NO: 770646 - DNA, 20 bp, mouse
gatgatgatcaggaacgaca

SEQ ID NO: 770647 - DNA, 20 bp, mouse
ggccgtctgcgcttggtgtg

SEQ ID NO: 770648 - DNA, 20 bp, mouse
gttcaccaacactctgaggt

SEQ ID NO: 770649 - DNA, 20 bp, mouse
ggacacccacctcagagtgt

SEQ ID NO: 770650 - DNA, 20 bp, mouse
gaagcacagagaccaatgcc

SEQ ID NO: 770651 - DNA, 20 bp, mouse
gccagctagctctgtgactt

SEQ ID NO: 770652 - DNA, 20 bp, mouse
gtcacaagtacagatctcta

SEQ ID NO: 770653 - DNA, 20 bp, mouse
gcctcatgcatgcctggcat

SEQ ID NO: 770654 - DNA, 20 bp, mouse
ggttttgctccaaaagaaga

SEQ ID NO: 770655 - DNA, 20 bp, mouse
ggagcccagatcactaaaat

SEQ ID NO: 770656 - DNA, 20 bp, mouse
ggatgattatagagatacct

SEQ ID NO: 770657 - DNA, 20 bp, mouse
gacaaacagtctgagctttt

SEQ ID NO: 770658 - DNA, 20 bp, mouse
gagagttcaagatacattat

SEQ ID NO: 770659 - DNA, 20 bp, mouse
gggataaataaccattcctc

SEQ ID NO: 770660 - DNA, 20 bp, mouse
gatagaaaatagaagtccag

SEQ ID NO: 770661 - DNA, 20 bp, mouse
gcaggtgtaataattctctg

SEQ ID NO: 770662 - DNA, 20 bp, mouse
gtatctctataatcatcaaa

SEQ ID NO: 770663 - DNA, 20 bp, mouse
gaagtcatatgaagcatatg

SEQ ID NO: 770664 - DNA, 20 bp, mouse
gatatttttttgtgtgacta

SEQ ID NO: 770665 - DNA, 20 bp, mouse
gtgaggcatttatttgcttc

SEQ ID NO: 770666 - DNA, 20 bp, mouse
gccccatgagagttcctcgg

SEQ ID NO: 770667 - DNA, 20 bp, mouse
gaccaccgaggaactctcat

SEQ ID NO: 770668 - DNA, 20 bp, mouse
gaggccccatgagagttcct

SEQ ID NO: 770669 - DNA, 20 bp, mouse
gtcatggggcctttggtact

SEQ ID NO: 770670 - DNA, 20 bp, mouse
gaacagtgaatggtggagtt

SEQ ID NO: 770671 - DNA, 20 bp, mouse
ggacaagatgacaattgttt

SEQ ID NO: 770672 - DNA, 20 bp, mouse
ggtttaggttatatgttcta

SEQ ID NO: 770673 - DNA, 20 bp, mouse
gatcaaagctcccaccaccg

SEQ ID NO: 770674 - DNA, 20 bp, mouse
gagctgcaaagtggagaaac

SEQ ID NO: 770675 - DNA, 20 bp, mouse
gctttctttccaagtaccaa

SEQ ID NO: 770676 - DNA, 20 bp, mouse
gggcaccattgattgcctca

SEQ ID NO: 770677 - DNA, 20 bp, mouse
gcaagccatgaggcaatcaa

SEQ ID NO: 770678 - DNA, 20 bp, mouse
gaatcggagtagccaatcta

SEQ ID NO: 770679 - DNA, 20 bp, mouse
gcacacaaatctactctata

SEQ ID NO: 770680 - DNA, 20 bp, mouse
gcaagaatctgtgcttacta

SEQ ID NO: 770681 - DNA, 20 bp, mouse
gggaaaacaggtggataaca

SEQ ID NO: 770682 - DNA, 20 bp, mouse
gtttgaaatagcaagccatg

SEQ ID NO: 770683 - DNA, 20 bp, mouse
gaagaagctataagtgttca

SEQ ID NO: 770684 - DNA, 20 bp, mouse
gtgttatttgggacatatta

SEQ ID NO: 770685 - DNA, 20 bp, mouse
ggtataataaaatgttattt

SEQ ID NO: 770686 - DNA, 20 bp, mouse
gagacaagggaaatatcccg

SEQ ID NO: 770687 - DNA, 20 bp, mouse
gttaaatgatcaaatcacat

SEQ ID NO: 770688 - DNA, 20 bp, mouse
gctaagagcttatgaagaca

SEQ ID NO: 770689 - DNA, 20 bp, mouse
gattcagaagctcctcatta

SEQ ID NO: 770690 - DNA, 20 bp, mouse
gagttgtacagggagaattt

SEQ ID NO: 770691 - DNA, 20 bp, mouse
gtctttgtatcagttgtaca

SEQ ID NO: 770692 - DNA, 20 bp, mouse
gaggtactacagccataatg

SEQ ID NO: 770693 - DNA, 20 bp, mouse
gaaacagaaaaatggtttac

SEQ ID NO: 770694 - DNA, 20 bp, mouse
gagcatcaaaatggaaacca

SEQ ID NO: 770695 - DNA, 20 bp, mouse
ggtttccattttgatgcttt

SEQ ID NO: 770696 - DNA, 20 bp, mouse
gaggcaaaagaaatatctcg

SEQ ID NO: 770697 - DNA, 20 bp, mouse
gcaaacgaaaaatgtcacta

SEQ ID NO: 770698 - DNA, 20 bp, mouse
gtttgccttcctaagctctt

SEQ ID NO: 770699 - DNA, 20 bp, mouse
ggtgccctaagagcttagga

SEQ ID NO: 770700 - DNA, 20 bp, mouse
gagttgttcagggagactct

SEQ ID NO: 770701 - DNA, 20 bp, mouse
gtctttgtatcagttgttca

SEQ ID NO: 770702 - DNA, 20 bp, mouse
ggttttcattttgatgtttt

SEQ ID NO: 770703 - DNA, 20 bp, mouse
gggacaacttgaacaatttc

SEQ ID NO: 770704 - DNA, 20 bp, mouse
gttttggttatgctacttga

SEQ ID NO: 770705 - DNA, 20 bp, mouse
gaattgtgccctaagagctt

SEQ ID NO: 770706 - DNA, 20 bp, mouse
gcaaggatatggaactggag

SEQ ID NO: 770707 - DNA, 20 bp, mouse
ggagctactgggcaaggata

SEQ ID NO: 770708 - DNA, 20 bp, mouse
gggatcaggtcacaacatag

SEQ ID NO: 770709 - DNA, 20 bp, mouse
gttctcttctgtgacctcta

SEQ ID NO: 770710 - DNA, 20 bp, mouse
gataacagacctaacactaa

SEQ ID NO: 770711 - DNA, 20 bp, mouse
gatattaagcctgaggttga

SEQ ID NO: 770712 - DNA, 20 bp, mouse
ggacctaacactaaaggatc

SEQ ID NO: 770713 - DNA, 20 bp, mouse
gcagtgtacaaattccttag

SEQ ID NO: 770714 - DNA, 20 bp, mouse
ggtctgttatgagagctact

SEQ ID NO: 770715 - DNA, 20 bp, mouse
ggacctgatcctttagtgtt

SEQ ID NO: 770716 - DNA, 20 bp, mouse
gtaaatgtagcctagaagtt

SEQ ID NO: 770717 - DNA, 20 bp, mouse
gccttatgagccaaacttct

SEQ ID NO: 770718 - DNA, 20 bp, mouse
ggtgcatgttctgtctctat

SEQ ID NO: 770719 - DNA, 20 bp, mouse
gcgactcattgaacccttag

SEQ ID NO: 770720 - DNA, 20 bp, mouse
gagtacaatatgagaacaag

SEQ ID NO: 770721 - DNA, 20 bp, mouse
gtacatacatgacactggca

SEQ ID NO: 770722 - DNA, 20 bp, mouse
gttctcatattgtacttagt

SEQ ID NO: 770723 - DNA, 20 bp, mouse
gacatgacactggcaaggta

SEQ ID NO: 770724 - DNA, 20 bp, mouse
ggagagtacatacatgacac

SEQ ID NO: 770725 - DNA, 20 bp, mouse
gaaactttaaaagccactaa

SEQ ID NO: 770726 - DNA, 20 bp, mouse
gctagggaggagataggtta

SEQ ID NO: 770727 - DNA, 20 bp, mouse
ggacccaagtcttcaatttt

SEQ ID NO: 770728 - DNA, 20 bp, mouse
gcatgactatgtaggaaaac

SEQ ID NO: 770729 - DNA, 20 bp, mouse
ggaggagataggttaaggtt

SEQ ID NO: 770730 - DNA, 20 bp, mouse
gaagacagaggagaaatcat

SEQ ID NO: 770731 - DNA, 20 bp, mouse
gaccagggaccatctgtata

SEQ ID NO: 770732 - DNA, 20 bp, mouse
gtggttctccctgcaaacca

SEQ ID NO: 770733 - DNA, 20 bp, mouse
gatcgcctcagcctggattc

SEQ ID NO: 770734 - DNA, 20 bp, mouse
gatccaggctgaggcgatta

SEQ ID NO: 770735 - DNA, 20 bp, mouse
gaaccataatcgcctcagcc

SEQ ID NO: 770736 - DNA, 20 bp, mouse
ggagggaactaagaatcttg

SEQ ID NO: 770737 - DNA, 20 bp, mouse
ggtaaaccatagtaaacact

SEQ ID NO: 770738 - DNA, 20 bp, mouse
gagatgctcaaattttgttc

SEQ ID NO: 770739 - DNA, 20 bp, mouse
gggagtaaatgatggcttat

SEQ ID NO: 770740 - DNA, 20 bp, mouse
ggagggctccaggtgaacca

SEQ ID NO: 770741 - DNA, 20 bp, mouse
ggacatgaagataaatgtca

SEQ ID NO: 770742 - DNA, 20 bp, mouse
gttactcttggagtaaatga

SEQ ID NO: 770743 - DNA, 20 bp, mouse
gtatggtttactaaggattg

SEQ ID NO: 770744 - DNA, 20 bp, mouse
gtggtttacaagctagagtg

SEQ ID NO: 770745 - DNA, 20 bp, mouse
gtgtttactatggtttacta

SEQ ID NO: 770746 - DNA, 20 bp, mouse
gttgctgactctagtgacat

SEQ ID NO: 770747 - DNA, 20 bp, mouse
gtttgtacttcatacaactg

SEQ ID NO: 770748 - DNA, 20 bp, mouse
gctgagtgtctgttaactag

SEQ ID NO: 770749 - DNA, 20 bp, mouse
gtgaaaacttaattaaagag

SEQ ID NO: 770750 - DNA, 20 bp, mouse
ggcagaagtctttgaataga

SEQ ID NO: 770751 - DNA, 20 bp, mouse
gagggactttagaaggaagc

SEQ ID NO: 770752 - DNA, 20 bp, mouse
gacaaaagagacagaccctt

SEQ ID NO: 770753 - DNA, 20 bp, mouse
gcttatggaaggatcatatg

SEQ ID NO: 770754 - DNA, 20 bp, mouse
ggtagttccttgatgccaaa

SEQ ID NO: 770755 - DNA, 20 bp, mouse
gtcatatgagggactttaga

SEQ ID NO: 770756 - DNA, 20 bp, mouse
gattgatgcacatggaaaac

SEQ ID NO: 770757 - DNA, 20 bp, mouse
gacaatagatacttgaaaaa

SEQ ID NO: 770758 - DNA, 20 bp, mouse
gcataaactggtggataact

SEQ ID NO: 770759 - DNA, 20 bp, mouse
gtaggatcacaggggaagtt

SEQ ID NO: 770760 - DNA, 20 bp, mouse
gtgtcataataggatcacag

SEQ ID NO: 770761 - DNA, 20 bp, mouse
gtatgatctggtgtcataat

SEQ ID NO: 770762 - DNA, 20 bp, mouse
gtacgacagacacttgtttc

SEQ ID NO: 770763 - DNA, 20 bp, mouse
gtgcctgaccttggagacac

SEQ ID NO: 770764 - DNA, 20 bp, mouse
ggaccagtgtctccaaggtc

SEQ ID NO: 770765 - DNA, 20 bp, mouse
gacacttgtttctggcatca

SEQ ID NO: 770766 - DNA, 20 bp, mouse
ggaaaacatcattggttcaa

SEQ ID NO: 770767 - DNA, 20 bp, mouse
gataagttatataatatttc

SEQ ID NO: 770768 - DNA, 20 bp, mouse
gaaaataattaaaggttgac

SEQ ID NO: 770769 - DNA, 20 bp, mouse
gttgaaataagtgtctttag

SEQ ID NO: 770770 - DNA, 20 bp, mouse
ggacaaattcttataaatag

SEQ ID NO: 770771 - DNA, 20 bp, mouse
ggatttaaaaaaataattaa

SEQ ID NO: 770772 - DNA, 20 bp, mouse
gaaacactgggttcctccta

SEQ ID NO: 770773 - DNA, 20 bp, mouse
gacagctggaaaggaaacac

SEQ ID NO: 770774 - DNA, 20 bp, mouse
gttttcattgacagctggaa

SEQ ID NO: 770775 - DNA, 20 bp, mouse
ggcaggttttcattgacagc

SEQ ID NO: 770776 - DNA, 20 bp, mouse
gctgaagtaagtggcattag

SEQ ID NO: 770777 - DNA, 20 bp, mouse
gcagacatgactgaagtaag

SEQ ID NO: 770778 - DNA, 20 bp, mouse
gagtggcattagtggtctac

SEQ ID NO: 770779 - DNA, 20 bp, mouse
ggaaaacataattggctcaa

SEQ ID NO: 770780 - DNA, 20 bp, mouse
gataaatttcataatactcc

SEQ ID NO: 770781 - DNA, 20 bp, mouse
ggagaaattctttggaattg

SEQ ID NO: 770782 - DNA, 20 bp, mouse
gccaggctactttcaaaatg

SEQ ID NO: 770783 - DNA, 20 bp, mouse
gtgaagcagcaattacactc

SEQ ID NO: 770784 - DNA, 20 bp, mouse
gaagcatttgagaaattctt

SEQ ID NO: 770785 - DNA, 20 bp, mouse
gaagataattaaaaattgac

SEQ ID NO: 770786 - DNA, 20 bp, mouse
gtaacctgtaagattgtcaa

SEQ ID NO: 770787 - DNA, 20 bp, mouse
gatacaaacctagttgggaa

SEQ ID NO: 770788 - DNA, 20 bp, mouse
gcttgttttgcctacagtac

SEQ ID NO: 770789 - DNA, 20 bp, mouse
gaaaataattgccaagttta

SEQ ID NO: 770790 - DNA, 20 bp, mouse
gttgccatcctttcccaact

SEQ ID NO: 770791 - DNA, 20 bp, mouse
gtctcatatacaaacctagt

SEQ ID NO: 770792 - DNA, 20 bp, mouse
gatgactatgttaacattat

SEQ ID NO: 770793 - DNA, 20 bp, mouse
gattaagactatttatttga

SEQ ID NO: 770794 - DNA, 20 bp, mouse
gattcactcttccctaaact

SEQ ID NO: 770795 - DNA, 20 bp, mouse
gtatgtgtgggaagaactgc

SEQ ID NO: 770796 - DNA, 20 bp, mouse
gaattcccctccacaacgtg

SEQ ID NO: 770797 - DNA, 20 bp, mouse
gacctccacacgttgtggag

SEQ ID NO: 770798 - DNA, 20 bp, mouse
ggggaattctgcaccagaca

SEQ ID NO: 770799 - DNA, 20 bp, mouse
gacatgggatgttcatcttt

SEQ ID NO: 770800 - DNA, 20 bp, mouse
gtaatgacctccacacgttg

SEQ ID NO: 770801 - DNA, 20 bp, mouse
gacttcaaagactattatct

SEQ ID NO: 770802 - DNA, 20 bp, mouse
gaatagtgcagtagaacatt

SEQ ID NO: 770803 - DNA, 20 bp, mouse
gtgatggagtaacttattag

SEQ ID NO: 770804 - DNA, 20 bp, mouse
ggtaacttattagtggtatt

SEQ ID NO: 770805 - DNA, 20 bp, mouse
gacaatgatcacaataatga

SEQ ID NO: 770806 - DNA, 20 bp, mouse
gatacagtgagatggtgcac

SEQ ID NO: 770807 - DNA, 20 bp, mouse
gtactctcctgcttttactg

SEQ ID NO: 770808 - DNA, 20 bp, mouse
gacagctcttaaggagtttg

SEQ ID NO: 770809 - DNA, 20 bp, mouse
gggttggcctgaaacttatt

SEQ ID NO: 770810 - DNA, 20 bp, mouse
gattgctactgctataatta

SEQ ID NO: 770811 - DNA, 20 bp, mouse
gtctaagcattaagaatcat

SEQ ID NO: 770812 - DNA, 20 bp, mouse
gatgctaatggtttgaggac

SEQ ID NO: 770813 - DNA, 20 bp, mouse
gctcaattttgatccctggt

SEQ ID NO: 770814 - DNA, 20 bp, mouse
gcaattattgatggatatgg

SEQ ID NO: 770815 - DNA, 20 bp, mouse
gatgcttagatacagtgaga

SEQ ID NO: 770816 - DNA, 20 bp, mouse
gaagacctacaggtgcccca

SEQ ID NO: 770817 - DNA, 20 bp, mouse
gttccccatggggcacctgt

SEQ ID NO: 770818 - DNA, 20 bp, mouse
gggagtccatgagctctctg

SEQ ID NO: 770819 - DNA, 20 bp, mouse
ggtctcactgggtctaagat

SEQ ID NO: 770820 - DNA, 20 bp, mouse
gggaaaaccaaagtctcact

SEQ ID NO: 770821 - DNA, 20 bp, mouse
gaagagctagccaggcacta

SEQ ID NO: 770822 - DNA, 20 bp, mouse
gctctggggcttttccccat

SEQ ID NO: 770823 - DNA, 20 bp, mouse
gggactccatccatagtgcc

SEQ ID NO: 770824 - DNA, 20 bp, mouse
ggctagccaggcactatgga

SEQ ID NO: 770825 - DNA, 20 bp, mouse
gcttagacccagtgagactt

SEQ ID NO: 770826 - DNA, 20 bp, mouse
gaagtgagacagcttaataa

SEQ ID NO: 770827 - DNA, 20 bp, mouse
ggtgcatgcacattattatg

SEQ ID NO: 770828 - DNA, 20 bp, mouse
gttcactaagtttgtattga

SEQ ID NO: 770829 - DNA, 20 bp, mouse
gattcaggtaggtattttgg

SEQ ID NO: 770830 - DNA, 20 bp, mouse
ggattgttgaatgttgagta

SEQ ID NO: 770831 - DNA, 20 bp, mouse
ggttcttaaaatcagggctt

SEQ ID NO: 770832 - DNA, 20 bp, mouse
gattattatgtggtagtatc

SEQ ID NO: 770833 - DNA, 20 bp, mouse
gatatgattaagacagtatg

SEQ ID NO: 770834 - DNA, 20 bp, mouse
gaatgctgtaataaaatcag

SEQ ID NO: 770835 - DNA, 20 bp, mouse
ggtatattgtatttatctca

SEQ ID NO: 770836 - DNA, 20 bp, mouse
gaggagcattggcatcctga

SEQ ID NO: 770837 - DNA, 20 bp, mouse
gtttacctatggctgaattt

SEQ ID NO: 770838 - DNA, 20 bp, mouse
gtcttagataagttactcac

SEQ ID NO: 770839 - DNA, 20 bp, mouse
gctgcttggatcagaatgct

SEQ ID NO: 770840 - DNA, 20 bp, mouse
gcagaacaaataaagacatt

SEQ ID NO: 770841 - DNA, 20 bp, mouse
gtctcttcacaaggtaaaag

SEQ ID NO: 770842 - DNA, 20 bp, mouse
gttctaactttctataacaa

SEQ ID NO: 770843 - DNA, 20 bp, mouse
gcttaagttttctaactgtc

SEQ ID NO: 770844 - DNA, 20 bp, mouse
gaatctagtaactttaccta

SEQ ID NO: 770845 - DNA, 20 bp, mouse
ggaatgctgggaaggagcat

SEQ ID NO: 770846 - DNA, 20 bp, mouse
gcgggctttagaattaactt

SEQ ID NO: 770847 - DNA, 20 bp, mouse
gtaaagcccgcattatcttc

SEQ ID NO: 770848 - DNA, 20 bp, mouse
gctggaggacttgagagaag

SEQ ID NO: 770849 - DNA, 20 bp, mouse
gttggcatagctagtgaagt

SEQ ID NO: 770850 - DNA, 20 bp, mouse
gcatattcaagtgctcttaa

SEQ ID NO: 770851 - DNA, 20 bp, mouse
gggaatgtacaaatactagt

SEQ ID NO: 770852 - DNA, 20 bp, mouse
gtacattccagaagataatg

SEQ ID NO: 770853 - DNA, 20 bp, mouse
gaaaacatagggtcagagct

SEQ ID NO: 770854 - DNA, 20 bp, mouse
gatattgctaaagtaataat

SEQ ID NO: 770855 - DNA, 20 bp, mouse
gactgtgaaacccaaaattt

SEQ ID NO: 770856 - DNA, 20 bp, mouse
gactgaagtggaaagaatct

SEQ ID NO: 770857 - DNA, 20 bp, mouse
gcatattgaagtgctcttat

SEQ ID NO: 770858 - DNA, 20 bp, mouse
ggtgggctttatatttaact

SEQ ID NO: 770859 - DNA, 20 bp, mouse
gtgtatgaataattctgttc

SEQ ID NO: 770860 - DNA, 20 bp, mouse
gacattgcaggaaactagtg

SEQ ID NO: 770861 - DNA, 20 bp, mouse
gcttggcatagctactgaag

SEQ ID NO: 770862 - DNA, 20 bp, mouse
ggcaatgtaaaaatactact

SEQ ID NO: 770863 - DNA, 20 bp, mouse
ggcattgctgaaataataat

SEQ ID NO: 770864 - DNA, 20 bp, mouse
gctgaaataataatgggaca

SEQ ID NO: 770865 - DNA, 20 bp, mouse
ggttggctactgaatttttg

SEQ ID NO: 770866 - DNA, 20 bp, mouse
gaggatggaaagagtgctgc

SEQ ID NO: 770867 - DNA, 20 bp, mouse
gaaggaacattgcatcctga

SEQ ID NO: 770868 - DNA, 20 bp, mouse
gttctagggagaaattactc

SEQ ID NO: 770869 - DNA, 20 bp, mouse
gcctgaaggaaagcatgcag

SEQ ID NO: 770870 - DNA, 20 bp, mouse
gaattccagttcagtgaaaa

SEQ ID NO: 770871 - DNA, 20 bp, mouse
gaatttatggtatttagatt

SEQ ID NO: 770872 - DNA, 20 bp, mouse
gactacctttttcactgaac

SEQ ID NO: 770873 - DNA, 20 bp, mouse
gcagggtaatatgcaatatc

SEQ ID NO: 770874 - DNA, 20 bp, mouse
gttaatgtattaatttagtc

SEQ ID NO: 770875 - DNA, 20 bp, mouse
ggaatagttaatgaaactgt

SEQ ID NO: 770876 - DNA, 20 bp, mouse
gtgtattgggaatgctgcat

SEQ ID NO: 770877 - DNA, 20 bp, mouse
gtgctctcaggcaaaaagac

SEQ ID NO: 770878 - DNA, 20 bp, mouse
gatgggagtctaattgtatt

SEQ ID NO: 770879 - DNA, 20 bp, mouse
ggctggaaaacatagatcta

SEQ ID NO: 770880 - DNA, 20 bp, mouse
ggtgatacacgactgctctc

SEQ ID NO: 770881 - DNA, 20 bp, mouse
gcaatcacatagtctcattt

SEQ ID NO: 770882 - DNA, 20 bp, mouse
gatttttaatatctgagtga

SEQ ID NO: 770883 - DNA, 20 bp, mouse
gagatactcattcatacagc

SEQ ID NO: 770884 - DNA, 20 bp, mouse
gaagtatacttgctgatatc

SEQ ID NO: 770885 - DNA, 20 bp, mouse
gctaatagacaacacacaga

SEQ ID NO: 770886 - DNA, 20 bp, mouse
ggactctcaagtctttaatt

SEQ ID NO: 770887 - DNA, 20 bp, mouse
ggtcccctcactggctctct

SEQ ID NO: 770888 - DNA, 20 bp, mouse
gaacaaaagctgaaattaga

SEQ ID NO: 770889 - DNA, 20 bp, mouse
gagggtcctttaggttagaa

SEQ ID NO: 770890 - DNA, 20 bp, mouse
ggaagacacaagggtccttt

SEQ ID NO: 770891 - DNA, 20 bp, mouse
ggggatcctttctaacctaa

SEQ ID NO: 770892 - DNA, 20 bp, mouse
gtcttcaaggcattgcagtg

SEQ ID NO: 770893 - DNA, 20 bp, mouse
gctataagaagagtttcctg

SEQ ID NO: 770894 - DNA, 20 bp, mouse
gtgtggagtcagtgggaccc

SEQ ID NO: 770895 - DNA, 20 bp, mouse
gtttagcagagtctggtttc

SEQ ID NO: 770896 - DNA, 20 bp, mouse
gtacagggccttatgcagtc

SEQ ID NO: 770897 - DNA, 20 bp, mouse
gtatcatgtgtttacttgtg

SEQ ID NO: 770898 - DNA, 20 bp, mouse
gcttctgaaacacaattctc

SEQ ID NO: 770899 - DNA, 20 bp, mouse
gtgtagccaagtaaggtatg

SEQ ID NO: 770900 - DNA, 20 bp, mouse
ggtctttcccagactgcata

SEQ ID NO: 770901 - DNA, 20 bp, mouse
gcagattatgtagccaagta

SEQ ID NO: 770902 - DNA, 20 bp, mouse
ggtcaaacctgaactttaac

SEQ ID NO: 770903 - DNA, 20 bp, mouse
ggcataacctgttaaagttc

SEQ ID NO: 770904 - DNA, 20 bp, mouse
gtttgaccacataccttact

SEQ ID NO: 770905 - DNA, 20 bp, mouse
ggattataaaatagcctcct

SEQ ID NO: 770906 - DNA, 20 bp, mouse
gactacagagactactgtat

SEQ ID NO: 770907 - DNA, 20 bp, mouse
ggatatagagaaaatagaac

SEQ ID NO: 770908 - DNA, 20 bp, mouse
gtgaatataaattactacat

SEQ ID NO: 770909 - DNA, 20 bp, mouse
gctgtaaaatgcatgtggat

SEQ ID NO: 770910 - DNA, 20 bp, mouse
gaataactactaatggtaca

SEQ ID NO: 770911 - DNA, 20 bp, mouse
gtatcagaaggtataccttc

SEQ ID NO: 770912 - DNA, 20 bp, mouse
gctttggattaatacccaga

SEQ ID NO: 770913 - DNA, 20 bp, mouse
ggatatttaataactactaa

SEQ ID NO: 770914 - DNA, 20 bp, mouse
gaaaatctactccttgctga

SEQ ID NO: 770915 - DNA, 20 bp, mouse
gcagtactgtaaaatgcatg

SEQ ID NO: 770916 - DNA, 20 bp, mouse
ggtagaattaaggtctggag

SEQ ID NO: 770917 - DNA, 20 bp, mouse
ggtgtgcatcatgcttgaaa

SEQ ID NO: 770918 - DNA, 20 bp, mouse
ggaagaaaatagtagaatta

SEQ ID NO: 770919 - DNA, 20 bp, mouse
gggcttagttattacagctt

SEQ ID NO: 770920 - DNA, 20 bp, mouse
ggtgtagatgctgagttttt

SEQ ID NO: 770921 - DNA, 20 bp, mouse
gatctgtctgataattcttc

SEQ ID NO: 770922 - DNA, 20 bp, mouse
gttttctgtaattcagtaga

SEQ ID NO: 770923 - DNA, 20 bp, mouse
gaaagtatttaagtaagagt

SEQ ID NO: 770924 - DNA, 20 bp, mouse
gttctatactgtcctttttc

SEQ ID NO: 770925 - DNA, 20 bp, mouse
ggaattaaggtctggagagg

SEQ ID NO: 770926 - DNA, 20 bp, mouse
ggtcagcaatccagtaaaag

SEQ ID NO: 770927 - DNA, 20 bp, mouse
gcagacagatccccttttac

SEQ ID NO: 770928 - DNA, 20 bp, mouse
gtctgtctgacaacttcttc

SEQ ID NO: 770929 - DNA, 20 bp, mouse
gtgaggcccacattttgtac

SEQ ID NO: 770930 - DNA, 20 bp, mouse
ggtatgcctgtacaaaatgt

SEQ ID NO: 770931 - DNA, 20 bp, mouse
gggaatagttcacagtacat

SEQ ID NO: 770932 - DNA, 20 bp, mouse
gggtttagttgttacagctc

SEQ ID NO: 770933 - DNA, 20 bp, mouse
gggcatggcacctatataca

SEQ ID NO: 770934 - DNA, 20 bp, mouse
ggaaaaaatagtagaaaaac

SEQ ID NO: 770935 - DNA, 20 bp, mouse
gagtagggtaataaaacatt

SEQ ID NO: 770936 - DNA, 20 bp, mouse
gtaaagttgggtaacaacat

SEQ ID NO: 770937 - DNA, 20 bp, mouse
gtaagtgtggaactatgact

SEQ ID NO: 770938 - DNA, 20 bp, mouse
ggacttggttgaacaataat

SEQ ID NO: 770939 - DNA, 20 bp, mouse
gcatgcttggaaatcacaat

SEQ ID NO: 770940 - DNA, 20 bp, mouse
gtgtttccaaggtcttctct

SEQ ID NO: 770941 - DNA, 20 bp, mouse
gtaaaatgccaaatttaatt

SEQ ID NO: 770942 - DNA, 20 bp, mouse
gaaatagaaatgcataagtg

SEQ ID NO: 770943 - DNA, 20 bp, mouse
gattaagaaaatatgtggaa

SEQ ID NO: 770944 - DNA, 20 bp, mouse
gattatactcagaactgaat

SEQ ID NO: 770945 - DNA, 20 bp, mouse
gcttcacctagagaagacct

SEQ ID NO: 770946 - DNA, 20 bp, mouse
ggatggggtaacgatggaat

SEQ ID NO: 770947 - DNA, 20 bp, mouse
gtttaaggatggggtaacga

SEQ ID NO: 770948 - DNA, 20 bp, mouse
gcagacagatcccatggtac

SEQ ID NO: 770949 - DNA, 20 bp, mouse
ggtctgtattccagtaccat

SEQ ID NO: 770950 - DNA, 20 bp, mouse
gttactaaactgtatacatg

SEQ ID NO: 770951 - DNA, 20 bp, mouse
gtacttgacaagttccttgg

SEQ ID NO: 770952 - DNA, 20 bp, mouse
gactgtttctatattattta

SEQ ID NO: 770953 - DNA, 20 bp, mouse
gaaacctttaacccattgcg

SEQ ID NO: 770954 - DNA, 20 bp, mouse
gatacctcgcaatgggttaa

SEQ ID NO: 770955 - DNA, 20 bp, mouse
gtagatgcatacctcgcaat

SEQ ID NO: 770956 - DNA, 20 bp, mouse
gttgcttcaaaggtttgata

SEQ ID NO: 770957 - DNA, 20 bp, mouse
gttagaaatacttgcttcaa

SEQ ID NO: 770958 - DNA, 20 bp, mouse
gaacttctacaaagtgaaga

SEQ ID NO: 770959 - DNA, 20 bp, mouse
gcctccactatttttgagtt

SEQ ID NO: 770960 - DNA, 20 bp, mouse
gagtggaggcataataaacc

SEQ ID NO: 770961 - DNA, 20 bp, mouse
gttatacagaagtacatatg

SEQ ID NO: 770962 - DNA, 20 bp, mouse
ggtgtcaaaatcatattccc

SEQ ID NO: 770963 - DNA, 20 bp, mouse
gtatgttatataactgaaaa

SEQ ID NO: 770964 - DNA, 20 bp, mouse
gcaattattgaaaaaatttt

SEQ ID NO: 770965 - DNA, 20 bp, mouse
gaagtcaatcttaattcatt

SEQ ID NO: 770966 - DNA, 20 bp, mouse
gtggggcccaacactaagag

SEQ ID NO: 770967 - DNA, 20 bp, mouse
gtgcagagaacggaggactt

SEQ ID NO: 770968 - DNA, 20 bp, mouse
gagaaatttgcattaagttc

SEQ ID NO: 770969 - DNA, 20 bp, mouse
gtatattaatgtgcagagaa

SEQ ID NO: 770970 - DNA, 20 bp, mouse
gattgtagtaacaacttgtt

SEQ ID NO: 770971 - DNA, 20 bp, mouse
gagagttctctgaaacttgt

SEQ ID NO: 770972 - DNA, 20 bp, mouse
gtggcaacatgtcatccttc

SEQ ID NO: 770973 - DNA, 20 bp, mouse
gagaggggtggcagactgca

SEQ ID NO: 770974 - DNA, 20 bp, mouse
gaattcctcaagagaaagag

SEQ ID NO: 770975 - DNA, 20 bp, mouse
gtgggccccatatggcctga

SEQ ID NO: 770976 - DNA, 20 bp, mouse
gggtagcaggggagggacct

SEQ ID NO: 770977 - DNA, 20 bp, mouse
gaatcacaaaggggtagcag

SEQ ID NO: 770978 - DNA, 20 bp, mouse
gttggaacacaatcacaaag

SEQ ID NO: 770979 - DNA, 20 bp, mouse
ggacaggaacagttagttat

SEQ ID NO: 770980 - DNA, 20 bp, mouse
gagctcaaggggatgtccct

SEQ ID NO: 770981 - DNA, 20 bp, mouse
gtgggtggaaaaggggacag

SEQ ID NO: 770982 - DNA, 20 bp, mouse
ggagggacctgggtggaaaa

SEQ ID NO: 770983 - DNA, 20 bp, mouse
gaggatctggtattggttgg

SEQ ID NO: 770984 - DNA, 20 bp, mouse
gaacaggatctggtattggt

SEQ ID NO: 770985 - DNA, 20 bp, mouse
gggcagcctcgggaggcagg

SEQ ID NO: 770986 - DNA, 20 bp, mouse
gtcatgtgctagttacatat

SEQ ID NO: 770987 - DNA, 20 bp, mouse
gaggttcctaggaccaaata

SEQ ID NO: 770988 - DNA, 20 bp, mouse
gggcctcagtttagggatgg

SEQ ID NO: 770989 - DNA, 20 bp, mouse
gatcccccatccctaaactg

SEQ ID NO: 770990 - DNA, 20 bp, mouse
gcttagaggcaaaggtaaag

SEQ ID NO: 770991 - DNA, 20 bp, mouse
gtagcatgggcctcagttta

SEQ ID NO: 770992 - DNA, 20 bp, mouse
gaaaggcctcccctcttgag

SEQ ID NO: 770993 - DNA, 20 bp, mouse
ggaaattcacatcagtgtcc

SEQ ID NO: 770994 - DNA, 20 bp, mouse
gggcccatgctatctactag

SEQ ID NO: 770995 - DNA, 20 bp, mouse
ggatcacatgcttcttaata

SEQ ID NO: 770996 - DNA, 20 bp, mouse
gtacaacatcaaatttgatt

SEQ ID NO: 770997 - DNA, 20 bp, mouse
gtatgtgcaaacatatgact

SEQ ID NO: 770998 - DNA, 20 bp, mouse
gaaagcctttggaaattggc

SEQ ID NO: 770999 - DNA, 20 bp, mouse
gagaaacatgatgatacaga

SEQ ID NO: 771000 - DNA, 20 bp, mouse
gtagaaaagcctttggaaat

SEQ ID NO: 771001 - DNA, 20 bp, mouse
ggttgagctcagaagtgaat

SEQ ID NO: 771002 - DNA, 20 bp, mouse
gtgacaaaagtgatgtttga

SEQ ID NO: 771003 - DNA, 20 bp, mouse
gaaataaaatcaaaaaccga

SEQ ID NO: 771004 - DNA, 20 bp, mouse
gaattgttttcatttaagta

SEQ ID NO: 771005 - DNA, 20 bp, mouse
gtcctgtctagaaaagcctt

SEQ ID NO: 771006 - DNA, 20 bp, mouse
gcctgggctagctatatata

SEQ ID NO: 771007 - DNA, 20 bp, mouse
gacattgctgtgactttcct

SEQ ID NO: 771008 - DNA, 20 bp, mouse
gtaacagtagtgtctctgaa

SEQ ID NO: 771009 - DNA, 20 bp, mouse
gtcaaattttacagatttag

SEQ ID NO: 771010 - DNA, 20 bp, mouse
gttcctgggaacttcttagg

SEQ ID NO: 771011 - DNA, 20 bp, mouse
gaacaaactagaaattgaga

SEQ ID NO: 771012 - DNA, 20 bp, mouse
gctctagcatcctcccatac

SEQ ID NO: 771013 - DNA, 20 bp, mouse
gcccctcctaagaagttccc

SEQ ID NO: 771014 - DNA, 20 bp, mouse
gctgggcaataaacatccac

SEQ ID NO: 771015 - DNA, 20 bp, mouse
ggatgtttattgcccagtat

SEQ ID NO: 771016 - DNA, 20 bp, mouse
gcagaaatgagctgtcaaat

SEQ ID NO: 771017 - DNA, 20 bp, mouse
ggtaagcaaatggaaatgtg

SEQ ID NO: 771018 - DNA, 20 bp, mouse
ggtttgcacagcatcatata

SEQ ID NO: 771019 - DNA, 20 bp, mouse
gaaaagcatcattagtaaat

SEQ ID NO: 771020 - DNA, 20 bp, mouse
gaaatgaaatgataattaca

SEQ ID NO: 771021 - DNA, 20 bp, mouse
gatgataattacaaggtata

SEQ ID NO: 771022 - DNA, 20 bp, mouse
gtccatataaagtttttgac

SEQ ID NO: 771023 - DNA, 20 bp, mouse
ggaaagtaatttattattag

SEQ ID NO: 771024 - DNA, 20 bp, mouse
gctataaattttatctcgaa

SEQ ID NO: 771025 - DNA, 20 bp, mouse
gaatctactttagacctatt

SEQ ID NO: 771026 - DNA, 20 bp, mouse
ggaaacaaggggttgtaaga

SEQ ID NO: 771027 - DNA, 20 bp, mouse
gagttagaggaaaaggtcga

SEQ ID NO: 771028 - DNA, 20 bp, mouse
gcaaaaaggtgcatatttcc

SEQ ID NO: 771029 - DNA, 20 bp, mouse
ggtaccatctaaaataagta

SEQ ID NO: 771030 - DNA, 20 bp, mouse
gccatctaaaataagtatgg

SEQ ID NO: 771031 - DNA, 20 bp, mouse
gcaacataaagataccaaaa

SEQ ID NO: 771032 - DNA, 20 bp, mouse
gatacattatcagaaacctt

SEQ ID NO: 771033 - DNA, 20 bp, mouse
gaaattaaatctattgtact

SEQ ID NO: 771034 - DNA, 20 bp, mouse
gtctattgtactaggaaaca

SEQ ID NO: 771035 - DNA, 20 bp, mouse
gcatctttctgttttccagt

SEQ ID NO: 771036 - DNA, 20 bp, mouse
gacccccagggaacactcta

SEQ ID NO: 771037 - DNA, 20 bp, mouse
gtctgtaagtctatacccag

SEQ ID NO: 771038 - DNA, 20 bp, mouse
gcagtggactagacagtctc

SEQ ID NO: 771039 - DNA, 20 bp, mouse
gcactctatggtgatcaagt

SEQ ID NO: 771040 - DNA, 20 bp, mouse
gacaggtcctcccaccccca

SEQ ID NO: 771041 - DNA, 20 bp, mouse
ggggtgggaggacctgttcc

SEQ ID NO: 771042 - DNA, 20 bp, mouse
gatgtgtactaaaacaaagt

SEQ ID NO: 771043 - DNA, 20 bp, mouse
gatcaccatagagtgttccc

SEQ ID NO: 771044 - DNA, 20 bp, mouse
gtgttcctggatttctaatc

SEQ ID NO: 771045 - DNA, 20 bp, mouse
gtagacctgattagaaatcc

SEQ ID NO: 771046 - DNA, 20 bp, mouse
gaacaaaaactgcatgtgtc

SEQ ID NO: 771047 - DNA, 20 bp, mouse
gcagttatattatgcacctc

SEQ ID NO: 771048 - DNA, 20 bp, mouse
gttaaggatatgcaattatt

SEQ ID NO: 771049 - DNA, 20 bp, mouse
gtaagaactctcatcattta

SEQ ID NO: 771050 - DNA, 20 bp, mouse
gttgcataagatctggaaaa

SEQ ID NO: 771051 - DNA, 20 bp, mouse
gtcattaacttttctggtga

SEQ ID NO: 771052 - DNA, 20 bp, mouse
gggtgcataatataactgca

SEQ ID NO: 771053 - DNA, 20 bp, mouse
gtcagattatttgataccag

SEQ ID NO: 771054 - DNA, 20 bp, mouse
gagtagatatgaggaaagtg

SEQ ID NO: 771055 - DNA, 20 bp, mouse
gcatatccttaaggtggtga

SEQ ID NO: 771056 - DNA, 20 bp, mouse
gcatatggaaatgatacaaa

SEQ ID NO: 771057 - DNA, 20 bp, mouse
gatcaggagcataaactgta

SEQ ID NO: 771058 - DNA, 20 bp, mouse
gataaactgtaaggaatgtg

SEQ ID NO: 771059 - DNA, 20 bp, mouse
ggtgttgagattagactcac

SEQ ID NO: 771060 - DNA, 20 bp, mouse
ggctgcactaaactatataa

SEQ ID NO: 771061 - DNA, 20 bp, mouse
gaaacgtttaattaatagta

SEQ ID NO: 771062 - DNA, 20 bp, mouse
gctctaccctcttaaatata

SEQ ID NO: 771063 - DNA, 20 bp, mouse
gtcattccatatatttaaga

SEQ ID NO: 771064 - DNA, 20 bp, mouse
ggttcttcacaagaaagaaa

SEQ ID NO: 771065 - DNA, 20 bp, mouse
gcatatgtagttataacaaa

SEQ ID NO: 771066 - DNA, 20 bp, mouse
gtgagccctgcagttgtatt

SEQ ID NO: 771067 - DNA, 20 bp, mouse
gcagttgtattaggcacccc

SEQ ID NO: 771068 - DNA, 20 bp, mouse
gaacaaagactgcatgtgtt

SEQ ID NO: 771069 - DNA, 20 bp, mouse
gcattaactttttctggtga

SEQ ID NO: 771070 - DNA, 20 bp, mouse
gttgcataagatttggataa

SEQ ID NO: 771071 - DNA, 20 bp, mouse
gactcagaatatatgatacc

SEQ ID NO: 771072 - DNA, 20 bp, mouse
gtaagaactctcatcattta

SEQ ID NO: 771073 - DNA, 20 bp, mouse
gaaatgcatgcaagtattac

SEQ ID NO: 771074 - DNA, 20 bp, mouse
gtttattcattaactttttc

SEQ ID NO: 771075 - DNA, 20 bp, mouse
gtcatatctactaactttca

SEQ ID NO: 771076 - DNA, 20 bp, mouse
gatcaggatcatccactgta

SEQ ID NO: 771077 - DNA, 20 bp, mouse
gatatattggaacttgtatc

SEQ ID NO: 771078 - DNA, 20 bp, mouse
gtatataaagtgtatttctc

SEQ ID NO: 771079 - DNA, 20 bp, mouse
gaagaatatgctaatgtcaa

SEQ ID NO: 771080 - DNA, 20 bp, mouse
gatccactgtaaggaatgta

SEQ ID NO: 771081 - DNA, 20 bp, mouse
gaaagtttatttaatactta

SEQ ID NO: 771082 - DNA, 20 bp, mouse
gatccatacattccttacag

SEQ ID NO: 771083 - DNA, 20 bp, mouse
gcatattctttctttattct

SEQ ID NO: 771084 - DNA, 20 bp, mouse
gaaactgcctgaagttcccc

SEQ ID NO: 771085 - DNA, 20 bp, mouse
gacaagtgttaatatgactg

SEQ ID NO: 771086 - DNA, 20 bp, mouse
ggagcataatgagctcatat

SEQ ID NO: 771087 - DNA, 20 bp, mouse
gtctctgttcaacgtgaatg

SEQ ID NO: 771088 - DNA, 20 bp, mouse
ggcttttagatcaaccttga

SEQ ID NO: 771089 - DNA, 20 bp, mouse
ggcctccagttatcacacac

SEQ ID NO: 771090 - DNA, 20 bp, mouse
gagaggttgtgacaaaaagg

SEQ ID NO: 771091 - DNA, 20 bp, mouse
gaaaaagggggtcagtatgc

SEQ ID NO: 771092 - DNA, 20 bp, mouse
ggggcgaaatacacatgagt

SEQ ID NO: 771093 - DNA, 20 bp, mouse
ggacacctgtgtgtgataac

SEQ ID NO: 771094 - DNA, 20 bp, mouse
gtcttctgcaatctccatca

SEQ ID NO: 771095 - DNA, 20 bp, mouse
gagctatacttgtatctcac

SEQ ID NO: 771096 - DNA, 20 bp, mouse
gactgcctccagactcagta

SEQ ID NO: 771097 - DNA, 20 bp, mouse
gcagtctcttggcctgttca

SEQ ID NO: 771098 - DNA, 20 bp, mouse
gcgtgtagatagaacacacc

SEQ ID NO: 771099 - DNA, 20 bp, mouse
gcaaaaagtgcaccctaacc

SEQ ID NO: 771100 - DNA, 20 bp, mouse
ggatagaacacacctggtta

SEQ ID NO: 771101 - DNA, 20 bp, mouse
ggactccctactgagtctgg

SEQ ID NO: 771102 - DNA, 20 bp, mouse
gtagggtgcactttttggta

SEQ ID NO: 771103 - DNA, 20 bp, mouse
ggcttgattaattgatattc

SEQ ID NO: 771104 - DNA, 20 bp, mouse
gaaggactccctactgagtc

SEQ ID NO: 771105 - DNA, 20 bp, mouse
gtttggcctcagtgaatcaa

SEQ ID NO: 771106 - DNA, 20 bp, mouse
gagaccatttcactgtagaa

SEQ ID NO: 771107 - DNA, 20 bp, mouse
gttataatagggatacacat

SEQ ID NO: 771108 - DNA, 20 bp, mouse
gcttcctttctacagtgaaa

SEQ ID NO: 771109 - DNA, 20 bp, mouse
gcgggtttgttaataacaaa

SEQ ID NO: 771110 - DNA, 20 bp, mouse
gctcagttttataactaatt

SEQ ID NO: 771111 - DNA, 20 bp, mouse
gaaactgagtactcatgctg

SEQ ID NO: 771112 - DNA, 20 bp, mouse
gaagacctatatttataata

SEQ ID NO: 771113 - DNA, 20 bp, mouse
gacaggaaacacaatagatc

SEQ ID NO: 771114 - DNA, 20 bp, mouse
ggcacctaaaattactgcat

SEQ ID NO: 771115 - DNA, 20 bp, mouse
ggtgccaatgcagtaatttt

SEQ ID NO: 771116 - DNA, 20 bp, mouse
ggagttacttacctggtaat

SEQ ID NO: 771117 - DNA, 20 bp, mouse
gcaggtaagtaactctcttt

SEQ ID NO: 771118 - DNA, 20 bp, mouse
ggatgcaaacacaacagata

SEQ ID NO: 771119 - DNA, 20 bp, mouse
gtacctggtaattggtcaaa

SEQ ID NO: 771120 - DNA, 20 bp, mouse
gttacaatagcgatgcatat

SEQ ID NO: 771121 - DNA, 20 bp, mouse
gttccatttgaccaattacc

SEQ ID NO: 771122 - DNA, 20 bp, mouse
gaatacatttgtaagatttt

SEQ ID NO: 771123 - DNA, 20 bp, mouse
gaagtttaccacactagctg

SEQ ID NO: 771124 - DNA, 20 bp, mouse
gattttttttatttcatact

SEQ ID NO: 771125 - DNA, 20 bp, mouse
gagatcatttcacactgtac

SEQ ID NO: 771126 - DNA, 20 bp, mouse
gcgtgtgtcagcatcctttc

SEQ ID NO: 771127 - DNA, 20 bp, mouse
gcaggtaaataactcccttt

SEQ ID NO: 771128 - DNA, 20 bp, mouse
gagggtttgttaagaacaaa

SEQ ID NO: 771129 - DNA, 20 bp, mouse
ggtatctctattatagatat

SEQ ID NO: 771130 - DNA, 20 bp, mouse
gtctttttagtaacacacaa

SEQ ID NO: 771131 - DNA, 20 bp, mouse
gattgaaactgttactttat

SEQ ID NO: 771132 - DNA, 20 bp, mouse
gtgggtggaaatgacctaaa

SEQ ID NO: 771133 - DNA, 20 bp, mouse
gaaactgagtactcatgctg

SEQ ID NO: 771134 - DNA, 20 bp, mouse
gagatcatttcacaccagaa

SEQ ID NO: 771135 - DNA, 20 bp, mouse
gatgggaaacacaatagata

SEQ ID NO: 771136 - DNA, 20 bp, mouse
gagaactcaacattcagtat

SEQ ID NO: 771137 - DNA, 20 bp, mouse
gtacttctttgctgccacta

SEQ ID NO: 771138 - DNA, 20 bp, mouse
ggttcacacatggtgtgaaa

SEQ ID NO: 771139 - DNA, 20 bp, mouse
gtgagttcttgtgggctgaa

SEQ ID NO: 771140 - DNA, 20 bp, mouse
ggttttataaggagccatag

SEQ ID NO: 771141 - DNA, 20 bp, mouse
gaaatacaaaatattgtata

SEQ ID NO: 771142 - DNA, 20 bp, mouse
gaacttttgatgtacagttt

SEQ ID NO: 771143 - DNA, 20 bp, mouse
gcactgtgagattttaggta

SEQ ID NO: 771144 - DNA, 20 bp, mouse
gtaaagacagacttgtctga

SEQ ID NO: 771145 - DNA, 20 bp, mouse
gttggttcaagtaccagaga

SEQ ID NO: 771146 - DNA, 20 bp, mouse
gaatctacacagtttttaga

SEQ ID NO: 771147 - DNA, 20 bp, mouse
gtcttttacaccaaagacag

SEQ ID NO: 771148 - DNA, 20 bp, mouse
ggctaagaagaaccaaatat

SEQ ID NO: 771149 - DNA, 20 bp, mouse
gcagtaatggatacttttgt

SEQ ID NO: 771150 - DNA, 20 bp, mouse
gttgacaggagtcccatatt

SEQ ID NO: 771151 - DNA, 20 bp, mouse
gttacttaagcatatcacca

SEQ ID NO: 771152 - DNA, 20 bp, mouse
gtgtctaatttgagaatact

SEQ ID NO: 771153 - DNA, 20 bp, mouse
gacatgtgtgtgttgaacct

SEQ ID NO: 771154 - DNA, 20 bp, mouse
gtaaactgcttgaaagtacc

SEQ ID NO: 771155 - DNA, 20 bp, mouse
gaggtaactacaaaacacat

SEQ ID NO: 771156 - DNA, 20 bp, mouse
gaaaaagtcaagtccagtac

SEQ ID NO: 771157 - DNA, 20 bp, mouse
gaatcactccaagtgtgata

SEQ ID NO: 771158 - DNA, 20 bp, mouse
gttgatgcatgaattccttg

SEQ ID NO: 771159 - DNA, 20 bp, mouse
gtttagatgcaagtcatata

SEQ ID NO: 771160 - DNA, 20 bp, mouse
gattccttgaggcttaatat

SEQ ID NO: 771161 - DNA, 20 bp, mouse
gctccaagtgtgatagggaa

SEQ ID NO: 771162 - DNA, 20 bp, mouse
gaactaaatcagtttctatg

SEQ ID NO: 771163 - DNA, 20 bp, mouse
gaaccattccctatcacact

SEQ ID NO: 771164 - DNA, 20 bp, mouse
gaaacccatattaagcctca

SEQ ID NO: 771165 - DNA, 20 bp, mouse
gttattatctctgatgattt

SEQ ID NO: 771166 - DNA, 20 bp, mouse
gttaatgtgaatcttcatct

SEQ ID NO: 771167 - DNA, 20 bp, mouse
gttactgtctatgtattttt

SEQ ID NO: 771168 - DNA, 20 bp, mouse
gtagacacatgtacaggctg

SEQ ID NO: 771169 - DNA, 20 bp, mouse
gaatacatagacagtaaggt

SEQ ID NO: 771170 - DNA, 20 bp, mouse
gtttgactagacacatgtac

SEQ ID NO: 771171 - DNA, 20 bp, mouse
gtaagcatttccatcgttca

SEQ ID NO: 771172 - DNA, 20 bp, mouse
gtaattttgaatacggtttt

SEQ ID NO: 771173 - DNA, 20 bp, mouse
gttgaaatatccatgaacga

SEQ ID NO: 771174 - DNA, 20 bp, mouse
gatgaagattcacattaata

SEQ ID NO: 771175 - DNA, 20 bp, mouse
gaacttatacaaaataagtt

SEQ ID NO: 771176 - DNA, 20 bp, mouse
gagtctccctgattttcctc

SEQ ID NO: 771177 - DNA, 20 bp, mouse
gtcaagcccgaggaaaatca

SEQ ID NO: 771178 - DNA, 20 bp, mouse
gtccattactaagatttcta

SEQ ID NO: 771179 - DNA, 20 bp, mouse
gacaaattcctgaataaaac

SEQ ID NO: 771180 - DNA, 20 bp, mouse
gttagtttcaatcccaatat

SEQ ID NO: 771181 - DNA, 20 bp, mouse
gtccttagaaatcttagtaa

SEQ ID NO: 771182 - DNA, 20 bp, mouse
gattgtgaatatcccaatat

SEQ ID NO: 771183 - DNA, 20 bp, mouse
gctgagttgcttcaagcccg

SEQ ID NO: 771184 - DNA, 20 bp, mouse
ggcatctaccagttttattc

SEQ ID NO: 771185 - DNA, 20 bp, mouse
gaagcccatgtaaagatctt

SEQ ID NO: 771186 - DNA, 20 bp, mouse
ggccactgcccaattaatga

SEQ ID NO: 771187 - DNA, 20 bp, mouse
ggccttcattaattgggcag

SEQ ID NO: 771188 - DNA, 20 bp, mouse
ggcttgcaatgagaatttct

SEQ ID NO: 771189 - DNA, 20 bp, mouse
gtctggacgccttcattaat

SEQ ID NO: 771190 - DNA, 20 bp, mouse
gaaaactctggccaactttt

SEQ ID NO: 771191 - DNA, 20 bp, mouse
gagcctcgcatggttttctc

SEQ ID NO: 771192 - DNA, 20 bp, mouse
ggtccagagaaaaccatgcg

SEQ ID NO: 771193 - DNA, 20 bp, mouse
gcatgataggttgtatcaaa

SEQ ID NO: 771194 - DNA, 20 bp, mouse
gaagtattagctcatgtcaa

SEQ ID NO: 771195 - DNA, 20 bp, mouse
gtgaaaacagaatactaaat

SEQ ID NO: 771196 - DNA, 20 bp, mouse
gaatcatcttagcagtgcag

SEQ ID NO: 771197 - DNA, 20 bp, mouse
ggagccatctatagagatta

SEQ ID NO: 771198 - DNA, 20 bp, mouse
gacacaatgaaaagctatgg

SEQ ID NO: 771199 - DNA, 20 bp, mouse
ggtagagagttggtaagtga

SEQ ID NO: 771200 - DNA, 20 bp, mouse
ggaaacacacattaccacta

SEQ ID NO: 771201 - DNA, 20 bp, mouse
gtgaccataatctctataga

SEQ ID NO: 771202 - DNA, 20 bp, mouse
gatacaaaaaccagccatag

SEQ ID NO: 771203 - DNA, 20 bp, mouse
gtacacttctttgatgctga

SEQ ID NO: 771204 - DNA, 20 bp, mouse
gtattgcatctttacaatat

SEQ ID NO: 771205 - DNA, 20 bp, mouse
gccttctacataaacataga

SEQ ID NO: 771206 - DNA, 20 bp, mouse
gagttctattataggaggca

SEQ ID NO: 771207 - DNA, 20 bp, mouse
ggacaggaacaattaatcag

SEQ ID NO: 771208 - DNA, 20 bp, mouse
gcagcaaagtttgcagacta

SEQ ID NO: 771209 - DNA, 20 bp, mouse
gccaggatctccccttgaac

SEQ ID NO: 771210 - DNA, 20 bp, mouse
gcttctgacgggaaaaatta

SEQ ID NO: 771211 - DNA, 20 bp, mouse
gataacatcatgtagctagt

SEQ ID NO: 771212 - DNA, 20 bp, mouse
ggatcatttcataagcatat

SEQ ID NO: 771213 - DNA, 20 bp, mouse
gttgtactagatatgtccat

SEQ ID NO: 771214 - DNA, 20 bp, mouse
ggtagatttgtctcttctga

SEQ ID NO: 771215 - DNA, 20 bp, mouse
gaggaggcatggtgagtaag

SEQ ID NO: 771216 - DNA, 20 bp, mouse
ggggaagcatgtatggacga

SEQ ID NO: 771217 - DNA, 20 bp, mouse
ggacaagaaagataatcctc

SEQ ID NO: 771218 - DNA, 20 bp, mouse
gttcctgcctgcaacggtgt

SEQ ID NO: 771219 - DNA, 20 bp, mouse
gacgatggctaaacacacat

SEQ ID NO: 771220 - DNA, 20 bp, mouse
gtggaatgcaagcacaaaag

SEQ ID NO: 771221 - DNA, 20 bp, mouse
gaagataatcctcaggtttg

SEQ ID NO: 771222 - DNA, 20 bp, mouse
gaagctcatgagtaaatatg

SEQ ID NO: 771223 - DNA, 20 bp, mouse
gaaatatggggaagcatgta

SEQ ID NO: 771224 - DNA, 20 bp, mouse
ggtgggacttactactgatg

SEQ ID NO: 771225 - DNA, 20 bp, mouse
gaaaagttaaggtcagtgta

SEQ ID NO: 771226 - DNA, 20 bp, mouse
gctagggcaacaggtcagag

SEQ ID NO: 771227 - DNA, 20 bp, mouse
gtggccaggaagggtggact

SEQ ID NO: 771228 - DNA, 20 bp, mouse
ggaaagctcgtggccaggaa

SEQ ID NO: 771229 - DNA, 20 bp, mouse
gttgagctgggatgtcaaaa

SEQ ID NO: 771230 - DNA, 20 bp, mouse
gcctggttgtcagttgagct

SEQ ID NO: 771231 - DNA, 20 bp, mouse
ggtggactgggctttagctg

SEQ ID NO: 771232 - DNA, 20 bp, mouse
ggggaaacacacagtgaatt

SEQ ID NO: 771233 - DNA, 20 bp, mouse
gtgcatgaaagctcgtggcc

SEQ ID NO: 771234 - DNA, 20 bp, mouse
gcgagctttcatgcaagccc

SEQ ID NO: 771235 - DNA, 20 bp, mouse
gggaaattggtgttttgaga

SEQ ID NO: 771236 - DNA, 20 bp, mouse
gctctgcaatagaacacaaa

SEQ ID NO: 771237 - DNA, 20 bp, mouse
gtaaggaatatgtgaataac

SEQ ID NO: 771238 - DNA, 20 bp, mouse
gcaagttattgtcagagaaa

SEQ ID NO: 771239 - DNA, 20 bp, mouse
gagacctcaaccaatactac

SEQ ID NO: 771240 - DNA, 20 bp, mouse
gagtgagagtattgcaagta

SEQ ID NO: 771241 - DNA, 20 bp, mouse
gcttggtctcaaacaattga

SEQ ID NO: 771242 - DNA, 20 bp, mouse
gaaaaggaattcctaaatta

SEQ ID NO: 771243 - DNA, 20 bp, mouse
gattgtgcttccatctactg

SEQ ID NO: 771244 - DNA, 20 bp, mouse
gaggagtcctccagtagtat

SEQ ID NO: 771245 - DNA, 20 bp, mouse
gaatacagaatttaagtatt

SEQ ID NO: 771246 - DNA, 20 bp, mouse
gagacgctcaaatgcacggt

SEQ ID NO: 771247 - DNA, 20 bp, mouse
ggctactttgcatttcaaat

SEQ ID NO: 771248 - DNA, 20 bp, mouse
gtactacagacctctcttga

SEQ ID NO: 771249 - DNA, 20 bp, mouse
gggtctgtagtagtcatcct

SEQ ID NO: 771250 - DNA, 20 bp, mouse
gatgggattacacactctct

SEQ ID NO: 771251 - DNA, 20 bp, mouse
ggtcatcctaggatattgag

SEQ ID NO: 771252 - DNA, 20 bp, mouse
gagttcacacagctgatttg

SEQ ID NO: 771253 - DNA, 20 bp, mouse
gtatccatggaaacctgtta

SEQ ID NO: 771254 - DNA, 20 bp, mouse
gtgtccttaacaggtttcca

SEQ ID NO: 771255 - DNA, 20 bp, mouse
gcctgagacgctcaaatgca

SEQ ID NO: 771256 - DNA, 20 bp, mouse
ggtgacttaggcaccccaca

SEQ ID NO: 771257 - DNA, 20 bp, mouse
gtattggacatgcagaggtt

SEQ ID NO: 771258 - DNA, 20 bp, mouse
gtttagtattggacatgcag

SEQ ID NO: 771259 - DNA, 20 bp, mouse
gcaaggtccagaaagattaa

SEQ ID NO: 771260 - DNA, 20 bp, mouse
gagtaaaagcatcaaatcaa

SEQ ID NO: 771261 - DNA, 20 bp, mouse
gaacctattatcagcatggg

SEQ ID NO: 771262 - DNA, 20 bp, mouse
gcaatatacagctttagtat

SEQ ID NO: 771263 - DNA, 20 bp, mouse
gcagagagataaagtgactt

SEQ ID NO: 771264 - DNA, 20 bp, mouse
gatgtagtgctaagtttctc

SEQ ID NO: 771265 - DNA, 20 bp, mouse
gaaccacccatgctgataat

SEQ ID NO: 771266 - DNA, 20 bp, mouse
gtaagaggcacatactcttc

SEQ ID NO: 771267 - DNA, 20 bp, mouse
gtgtgagagtatcagaatac

SEQ ID NO: 771268 - DNA, 20 bp, mouse
gatgttgaacttttggtgga

SEQ ID NO: 771269 - DNA, 20 bp, mouse
ggtactctagaaggcattgt

SEQ ID NO: 771270 - DNA, 20 bp, mouse
gaattgacacaagtgtttgt

SEQ ID NO: 771271 - DNA, 20 bp, mouse
gtattatgttgaacttttgg

SEQ ID NO: 771272 - DNA, 20 bp, mouse
gtcgatttctgtactctaga

SEQ ID NO: 771273 - DNA, 20 bp, mouse
gtatatctcatttcagactt

SEQ ID NO: 771274 - DNA, 20 bp, mouse
gataatttctacaaatacta

SEQ ID NO: 771275 - DNA, 20 bp, mouse
gttaaagagagcacaactaa

SEQ ID NO: 771276 - DNA, 20 bp, mouse
gtagtggacgtgcaaaaact

SEQ ID NO: 771277 - DNA, 20 bp, mouse
gagaaacacaaggtccagaa

SEQ ID NO: 771278 - DNA, 20 bp, mouse
ggtgactgacacaccccaca

SEQ ID NO: 771279 - DNA, 20 bp, mouse
ggagaaacttaatactagat

SEQ ID NO: 771280 - DNA, 20 bp, mouse
gttttgcacgtccactactt

SEQ ID NO: 771281 - DNA, 20 bp, mouse
gaatatacaaccccaagtag

SEQ ID NO: 771282 - DNA, 20 bp, mouse
gagactttgaacatcctttc

SEQ ID NO: 771283 - DNA, 20 bp, mouse
gagaagtatcaaataatacg

SEQ ID NO: 771284 - DNA, 20 bp, mouse
ggttgtaatcttagtaaaca

SEQ ID NO: 771285 - DNA, 20 bp, mouse
ggcaataatctgaaatgtct

SEQ ID NO: 771286 - DNA, 20 bp, mouse
ggatgtgagagtatttaaat

SEQ ID NO: 771287 - DNA, 20 bp, mouse
gtaagaggcatatactcctc

SEQ ID NO: 771288 - DNA, 20 bp, mouse
gtactccagaaagtcattgt

SEQ ID NO: 771289 - DNA, 20 bp, mouse
gttcccccacaatgactttc

SEQ ID NO: 771290 - DNA, 20 bp, mouse
gttctgtttctagttaattc

SEQ ID NO: 771291 - DNA, 20 bp, mouse
gataacttctacaaatacgc

SEQ ID NO: 771292 - DNA, 20 bp, mouse
gatatatctcattttggact

SEQ ID NO: 771293 - DNA, 20 bp, mouse
gatgtgaatgtgcactgtaa

SEQ ID NO: 771294 - DNA, 20 bp, mouse
gttgaacttttggtgaatag

SEQ ID NO: 771295 - DNA, 20 bp, mouse
gagtatttaaattggaagag

SEQ ID NO: 771296 - DNA, 20 bp, mouse
gactgacattaaagaggcag

SEQ ID NO: 771297 - DNA, 20 bp, mouse
gagtgccactgacattaaag

SEQ ID NO: 771298 - DNA, 20 bp, mouse
gaggacctcgaagtccctgt

SEQ ID NO: 771299 - DNA, 20 bp, mouse
ggcgagaggtgggaagtcct

SEQ ID NO: 771300 - DNA, 20 bp, mouse
gagaagtcatggcgagaggt

SEQ ID NO: 771301 - DNA, 20 bp, mouse
ggaagccaggggagaagtca

SEQ ID NO: 771302 - DNA, 20 bp, mouse
gagtactctctaaacaatgg

SEQ ID NO: 771303 - DNA, 20 bp, mouse
ggttcttcctaattaggaag

SEQ ID NO: 771304 - DNA, 20 bp, mouse
ggtgagaaatgtgtgatagt

SEQ ID NO: 771305 - DNA, 20 bp, mouse
gtctgaagttgtttcccaca

SEQ ID NO: 771306 - DNA, 20 bp, mouse
ggagaagggcagtggatgcg

SEQ ID NO: 771307 - DNA, 20 bp, mouse
gagtctgggtgcaactgtaa

SEQ ID NO: 771308 - DNA, 20 bp, mouse
gccttggtttttctctctaa

SEQ ID NO: 771309 - DNA, 20 bp, mouse
gaggtaatgaccctaggcgt

SEQ ID NO: 771310 - DNA, 20 bp, mouse
gaaagctaggtaatgaccct

SEQ ID NO: 771311 - DNA, 20 bp, mouse
gaagatggctcaataggata

SEQ ID NO: 771312 - DNA, 20 bp, mouse
gaatgcagagccaacgccta

SEQ ID NO: 771313 - DNA, 20 bp, mouse
ggagatcacagacatgagaa

SEQ ID NO: 771314 - DNA, 20 bp, mouse
gaagctgtaaaagttatgtc

SEQ ID NO: 771315 - DNA, 20 bp, mouse
gcattacctagctttcacat

SEQ ID NO: 771316 - DNA, 20 bp, mouse
gttgatgtctgttgctaaga

SEQ ID NO: 771317 - DNA, 20 bp, mouse
gacctggcaagctgatgtca

SEQ ID NO: 771318 - DNA, 20 bp, mouse
gaagaagggcactggatgtg

SEQ ID NO: 771319 - DNA, 20 bp, mouse
gcaatatgccccagagagat

SEQ ID NO: 771320 - DNA, 20 bp, mouse
gttgaacacctatctctctg

SEQ ID NO: 771321 - DNA, 20 bp, mouse
gacagatgtaagaagggcac

SEQ ID NO: 771322 - DNA, 20 bp, mouse
gtgtctgggagttagattgt

SEQ ID NO: 771323 - DNA, 20 bp, mouse
gtcagcaagataactcagtt

SEQ ID NO: 771324 - DNA, 20 bp, mouse
gtgaccctattaatgcgtta

SEQ ID NO: 771325 - DNA, 20 bp, mouse
ggtaattagctcttcacata

SEQ ID NO: 771326 - DNA, 20 bp, mouse
gagtctgatactattctttg

SEQ ID NO: 771327 - DNA, 20 bp, mouse
gacagaagtcaaataatgag

SEQ ID NO: 771328 - DNA, 20 bp, mouse
gaataatgagtggtcttcct

SEQ ID NO: 771329 - DNA, 20 bp, mouse
gcttgcccctttttttaacc

SEQ ID NO: 771330 - DNA, 20 bp, mouse
gttctgaaatgaaaagaacc

SEQ ID NO: 771331 - DNA, 20 bp, mouse
gcttcatctctgtattactc

SEQ ID NO: 771332 - DNA, 20 bp, mouse
gatctcacagccagttttcc

SEQ ID NO: 771333 - DNA, 20 bp, mouse
gatgtaaaatgaccccacac

SEQ ID NO: 771334 - DNA, 20 bp, mouse
gttttgttttgtccagtgtg

SEQ ID NO: 771335 - DNA, 20 bp, mouse
gagcaaacttttattgaatc

SEQ ID NO: 771336 - DNA, 20 bp, mouse
gtgggggaaaaattacccag

SEQ ID NO: 771337 - DNA, 20 bp, mouse
gggaacctcttgttcagtga

SEQ ID NO: 771338 - DNA, 20 bp, mouse
gctgcccctcactgaacaag

SEQ ID NO: 771339 - DNA, 20 bp, mouse
gggctgttttggtggatgta

SEQ ID NO: 771340 - DNA, 20 bp, mouse
gcagaagagccttcagtctc

SEQ ID NO: 771341 - DNA, 20 bp, mouse
gtaggtggaaatggacagaa

SEQ ID NO: 771342 - DNA, 20 bp, mouse
gagaagaaactgtcagctat

SEQ ID NO: 771343 - DNA, 20 bp, mouse
gggaaaaattacccagaggc

SEQ ID NO: 771344 - DNA, 20 bp, mouse
ggaagaacgggtcccaccca

SEQ ID NO: 771345 - DNA, 20 bp, mouse
gtaattatttaggtttatgt

SEQ ID NO: 771346 - DNA, 20 bp, mouse
gaaaacaagtacttggaggt

SEQ ID NO: 771347 - DNA, 20 bp, mouse
gacctgggattgatcataaa

SEQ ID NO: 771348 - DNA, 20 bp, mouse
gcctgaaaacaagtacttgg

SEQ ID NO: 771349 - DNA, 20 bp, mouse
gtaccctgaaaacaagtact

SEQ ID NO: 771350 - DNA, 20 bp, mouse
ggtaaggcaatgtttatatc

SEQ ID NO: 771351 - DNA, 20 bp, mouse
gagcaagcaaacctgcaacg

SEQ ID NO: 771352 - DNA, 20 bp, mouse
gtccctttatgatcaatccc

SEQ ID NO: 771353 - DNA, 20 bp, mouse
ggagaatgtccataatttga

SEQ ID NO: 771354 - DNA, 20 bp, mouse
gacaaaagcacccacgttgc

SEQ ID NO: 771355 - DNA, 20 bp, mouse
gatacagtttatggccttgt

SEQ ID NO: 771356 - DNA, 20 bp, mouse
ggatgcgcaagtgggcggaa

SEQ ID NO: 771357 - DNA, 20 bp, mouse
gcgcaagtgggcggaagggt

SEQ ID NO: 771358 - DNA, 20 bp, mouse
gaactgtggtctctgccagg

SEQ ID NO: 771359 - DNA, 20 bp, mouse
gtagatgatgcgcaagtggg

SEQ ID NO: 771360 - DNA, 20 bp, mouse
gagagtgtggaaacctgggg

SEQ ID NO: 771361 - DNA, 20 bp, mouse
gaaggagagtgtggaaacct

SEQ ID NO: 771362 - DNA, 20 bp, mouse
gggaaacctggggtggtgat

SEQ ID NO: 771363 - DNA, 20 bp, mouse
gctttcagttacaatcctcc

SEQ ID NO: 771364 - DNA, 20 bp, mouse
gtccagtacttgagtggtat

SEQ ID NO: 771365 - DNA, 20 bp, mouse
gagcatagatgatgcgcaag

SEQ ID NO: 771366 - DNA, 20 bp, mouse
gaaaacctggggcagtgatg

SEQ ID NO: 771367 - DNA, 20 bp, mouse
gaaggagactgtgaaaacct

SEQ ID NO: 771368 - DNA, 20 bp, mouse
gtaaatgacgtgcaagctgg

SEQ ID NO: 771369 - DNA, 20 bp, mouse
gggcaagcatgaggagtggc

SEQ ID NO: 771370 - DNA, 20 bp, mouse
ggactctttgaggactgaga

SEQ ID NO: 771371 - DNA, 20 bp, mouse
gtaatcgaggctttgaacac

SEQ ID NO: 771372 - DNA, 20 bp, mouse
gtagcttcttccatgaatgc

SEQ ID NO: 771373 - DNA, 20 bp, mouse
gctcgattacaaacttctaa

SEQ ID NO: 771374 - DNA, 20 bp, mouse
gtcaacagtgtagattttgt

SEQ ID NO: 771375 - DNA, 20 bp, mouse
gagtaaaacagaaaagtgct

SEQ ID NO: 771376 - DNA, 20 bp, mouse
ggacatgaatcaaatataca

SEQ ID NO: 771377 - DNA, 20 bp, mouse
gggatgccaagagctaaaga

SEQ ID NO: 771378 - DNA, 20 bp, mouse
gagtgagctaatacaaaata

SEQ ID NO: 771379 - DNA, 20 bp, mouse
ggtcattaatgattttaaac

SEQ ID NO: 771380 - DNA, 20 bp, mouse
gctttctgacattggatcgt

SEQ ID NO: 771381 - DNA, 20 bp, mouse
gagtcttaaaaataaggtac

SEQ ID NO: 771382 - DNA, 20 bp, mouse
gtcatgtctctttctgacat

SEQ ID NO: 771383 - DNA, 20 bp, mouse
gaatttaaattgatacctta

SEQ ID NO: 771384 - DNA, 20 bp, mouse
gtcttggaaaaaaaacctta

SEQ ID NO: 771385 - DNA, 20 bp, mouse
gcttaaaaataaggtacagg

SEQ ID NO: 771386 - DNA, 20 bp, mouse
ggtctagctggattaaggaa

SEQ ID NO: 771387 - DNA, 20 bp, mouse
gtcagtcagattgataacta

SEQ ID NO: 771388 - DNA, 20 bp, mouse
ggctgtcaatttatgagtga

SEQ ID NO: 771389 - DNA, 20 bp, mouse
gttcttgattgttttagtat

SEQ ID NO: 771390 - DNA, 20 bp, mouse
gagctggattaaggaaaggg

SEQ ID NO: 771391 - DNA, 20 bp, mouse
gatgaaagttggttgatgta

SEQ ID NO: 771392 - DNA, 20 bp, mouse
gtgagtgagggcatgaaagt

SEQ ID NO: 771393 - DNA, 20 bp, mouse
ggtaaggaagcaggtctagc

SEQ ID NO: 771394 - DNA, 20 bp, mouse
gttggttgatgtaaggaagc

SEQ ID NO: 771395 - DNA, 20 bp, mouse
gagcaggtctagctggatta

SEQ ID NO: 771396 - DNA, 20 bp, mouse
gctaaatgaccaaactcatc

SEQ ID NO: 771397 - DNA, 20 bp, mouse
gtaactagtttgttctgaga

SEQ ID NO: 771398 - DNA, 20 bp, mouse
gtttggtcatttagcatagt

SEQ ID NO: 771399 - DNA, 20 bp, mouse
gtagttaaaccagatgagtt

SEQ ID NO: 771400 - DNA, 20 bp, mouse
gaaacatgcggacaatgatc

SEQ ID NO: 771401 - DNA, 20 bp, mouse
gtttgttctgagaaggctgt

SEQ ID NO: 771402 - DNA, 20 bp, mouse
gtctaccttactttaaatct

SEQ ID NO: 771403 - DNA, 20 bp, mouse
gttttgtcaatcttaaaaac

SEQ ID NO: 771404 - DNA, 20 bp, mouse
gaggacagatacattctgac

SEQ ID NO: 771405 - DNA, 20 bp, mouse
gtttgccaagatttaaagta

SEQ ID NO: 771406 - DNA, 20 bp, mouse
gctagaaaacactgctgcag

SEQ ID NO: 771407 - DNA, 20 bp, mouse
gggtgcagtcacctaataag

SEQ ID NO: 771408 - DNA, 20 bp, mouse
gctaataagtggcaaaggaa

SEQ ID NO: 771409 - DNA, 20 bp, mouse
ggtcacctaataagtggcaa

SEQ ID NO: 771410 - DNA, 20 bp, mouse
gacacttatgttctcaacaa

SEQ ID NO: 771411 - DNA, 20 bp, mouse
gcatccaatcacaaaaaggc

SEQ ID NO: 771412 - DNA, 20 bp, mouse
gctgacatattccaattctt

SEQ ID NO: 771413 - DNA, 20 bp, mouse
gggttcatccaatcacaaaa

SEQ ID NO: 771414 - DNA, 20 bp, mouse
gttgggtctcaccaaagaat

SEQ ID NO: 771415 - DNA, 20 bp, mouse
gttatttaaaaaatgcagta

SEQ ID NO: 771416 - DNA, 20 bp, mouse
gcttacttcctcaacacagt

SEQ ID NO: 771417 - DNA, 20 bp, mouse
gaggcatagttttgatctca

SEQ ID NO: 771418 - DNA, 20 bp, mouse
gtcaaatttgagatgtagag

SEQ ID NO: 771419 - DNA, 20 bp, mouse
gaattaagttaattcattta

SEQ ID NO: 771420 - DNA, 20 bp, mouse
gcatgtgctgttgctagcag

SEQ ID NO: 771421 - DNA, 20 bp, mouse
ggtgaaaattaattgagtgc

SEQ ID NO: 771422 - DNA, 20 bp, mouse
gtttagataataattctttg

SEQ ID NO: 771423 - DNA, 20 bp, mouse
gattgtaatgtttaaaagta

SEQ ID NO: 771424 - DNA, 20 bp, mouse
gtttgaaacttcctgctact

SEQ ID NO: 771425 - DNA, 20 bp, mouse
gtactcagaaataatttaca

SEQ ID NO: 771426 - DNA, 20 bp, mouse
gtatgaactaagggcatttt

SEQ ID NO: 771427 - DNA, 20 bp, mouse
gacaaaacttaaattaacta

SEQ ID NO: 771428 - DNA, 20 bp, mouse
gttgtgtgacccagtaaatt

SEQ ID NO: 771429 - DNA, 20 bp, mouse
gaacacctgtttatgaacta

SEQ ID NO: 771430 - DNA, 20 bp, mouse
ggtatgccattctatatctt

SEQ ID NO: 771431 - DNA, 20 bp, mouse
gtgcatgagagaaagtgtgc

SEQ ID NO: 771432 - DNA, 20 bp, mouse
gtgcatagatcttattcaaa

SEQ ID NO: 771433 - DNA, 20 bp, mouse
gcaatgcctaagatatagaa

SEQ ID NO: 771434 - DNA, 20 bp, mouse
gatgcccttagttcataaac

SEQ ID NO: 771435 - DNA, 20 bp, mouse
gtaagataatccaaatttac

SEQ ID NO: 771436 - DNA, 20 bp, mouse
ggagactccaagattgtcaa

SEQ ID NO: 771437 - DNA, 20 bp, mouse
ggcttggcaggacaaggctt

SEQ ID NO: 771438 - DNA, 20 bp, mouse
gctaggaaatacacagtagg

SEQ ID NO: 771439 - DNA, 20 bp, mouse
ggcactgaggtaactcggga

SEQ ID NO: 771440 - DNA, 20 bp, mouse
gggaggggtttgctttggat

SEQ ID NO: 771441 - DNA, 20 bp, mouse
gcttctaggaaatacacagt

SEQ ID NO: 771442 - DNA, 20 bp, mouse
ggcacaaggaccagtgtgca

SEQ ID NO: 771443 - DNA, 20 bp, mouse
gcttggctgcccaggagctt

SEQ ID NO: 771444 - DNA, 20 bp, mouse
gctgaattgtcctctgcagg

SEQ ID NO: 771445 - DNA, 20 bp, mouse
gggctgccagtggagtacca

SEQ ID NO: 771446 - DNA, 20 bp, mouse
gagactaggtagcagtggtg

SEQ ID NO: 771447 - DNA, 20 bp, mouse
gaacaacataattggatcag

SEQ ID NO: 771448 - DNA, 20 bp, mouse
gtccctaagatccaattata

SEQ ID NO: 771449 - DNA, 20 bp, mouse
gacgcaaagtttctaagctg

SEQ ID NO: 771450 - DNA, 20 bp, mouse
gggagacatgcacagatgag

SEQ ID NO: 771451 - DNA, 20 bp, mouse
gtacctagtctgtgcttcag

SEQ ID NO: 771452 - DNA, 20 bp, mouse
gttagggacgctatcccaga

SEQ ID NO: 771453 - DNA, 20 bp, mouse
gtagcagtggtggggcttgt

SEQ ID NO: 771454 - DNA, 20 bp, mouse
gactgtgagtgagtcccaag

SEQ ID NO: 771455 - DNA, 20 bp, mouse
gagaaactttgcgtccttct

SEQ ID NO: 771456 - DNA, 20 bp, mouse
gggagggacgcgatatagtc

SEQ ID NO: 771457 - DNA, 20 bp, mouse
gagcgacttcggcccagaaa

SEQ ID NO: 771458 - DNA, 20 bp, mouse
ggggcaggaatgtttgggac

SEQ ID NO: 771459 - DNA, 20 bp, mouse
gggagccagcacgcctgcct

SEQ ID NO: 771460 - DNA, 20 bp, mouse
ggctacacggctccagagga

SEQ ID NO: 771461 - DNA, 20 bp, mouse
ggccaactgagatagatgga

SEQ ID NO: 771462 - DNA, 20 bp, mouse
gagcacgcctgcctggggga

SEQ ID NO: 771463 - DNA, 20 bp, mouse
gggtagccaactgagataga

SEQ ID NO: 771464 - DNA, 20 bp, mouse
ggcaggcgtgctggctccac

SEQ ID NO: 771465 - DNA, 20 bp, mouse
ggaaggggtgtgtctattca

SEQ ID NO: 771466 - DNA, 20 bp, mouse
gccaatctgtgtggcggacc

SEQ ID NO: 771467 - DNA, 20 bp, mouse
gatctaaaagccaatctgtg

SEQ ID NO: 771468 - DNA, 20 bp, mouse
gttttacagttgaacctcag

SEQ ID NO: 771469 - DNA, 20 bp, mouse
gaacagaaacttagcctctg

SEQ ID NO: 771470 - DNA, 20 bp, mouse
gtaggctacatcgtcaagct

SEQ ID NO: 771471 - DNA, 20 bp, mouse
ggagacatagcattactcgc

SEQ ID NO: 771472 - DNA, 20 bp, mouse
gaatcagaatcagaacagcc

SEQ ID NO: 771473 - DNA, 20 bp, mouse
gcctcagaagctagtcttaa

SEQ ID NO: 771474 - DNA, 20 bp, mouse
gtggagacttctccaagcac

SEQ ID NO: 771475 - DNA, 20 bp, mouse
gcattacatctcagcaatcc

SEQ ID NO: 771476 - DNA, 20 bp, mouse
gagcaggtgttgttcgttca

SEQ ID NO: 771477 - DNA, 20 bp, mouse
gcccacaagtggcccaacct

SEQ ID NO: 771478 - DNA, 20 bp, mouse
gcctttgactcagaacaata

SEQ ID NO: 771479 - DNA, 20 bp, mouse
gttgttctgagtcaaaggca

SEQ ID NO: 771480 - DNA, 20 bp, mouse
ggggttagataccaccaagc

SEQ ID NO: 771481 - DNA, 20 bp, mouse
gctgatgcctataacgccaa

SEQ ID NO: 771482 - DNA, 20 bp, mouse
gccccatgtgagtaattctg

SEQ ID NO: 771483 - DNA, 20 bp, mouse
gcacccaggaatcctctgtt

SEQ ID NO: 771484 - DNA, 20 bp, mouse
gcacacatttagccgaggtt

SEQ ID NO: 771485 - DNA, 20 bp, mouse
ggaactccttgaggagcaat

SEQ ID NO: 771486 - DNA, 20 bp, mouse
gcacacactctagagacgtt

SEQ ID NO: 771487 - DNA, 20 bp, mouse
gagagacgttaggaagtgaa

SEQ ID NO: 771488 - DNA, 20 bp, mouse
gatacacttaaattctaaaa

SEQ ID NO: 771489 - DNA, 20 bp, mouse
gaaaacgcccctcctttgtg

SEQ ID NO: 771490 - DNA, 20 bp, mouse
gcagttgtgactcctcacaa

SEQ ID NO: 771491 - DNA, 20 bp, mouse
gtggcaaaatgtcctttgca

SEQ ID NO: 771492 - DNA, 20 bp, mouse
ggtgactcctcacaaaggag

SEQ ID NO: 771493 - DNA, 20 bp, mouse
gcaccagtaaaggacatgtc

SEQ ID NO: 771494 - DNA, 20 bp, mouse
ggctcaaagtctccttgcaa

SEQ ID NO: 771495 - DNA, 20 bp, mouse
gaatttaagtgtataaacat

SEQ ID NO: 771496 - DNA, 20 bp, mouse
gaagatgcatctatcataac

SEQ ID NO: 771497 - DNA, 20 bp, mouse
gcactgttgcactttgctgt

SEQ ID NO: 771498 - DNA, 20 bp, mouse
gtcttgaagctgagagttac

SEQ ID NO: 771499 - DNA, 20 bp, mouse
gtgtttgaagaatctctcta

SEQ ID NO: 771500 - DNA, 20 bp, mouse
gcatgatagattgtgtaaga

SEQ ID NO: 771501 - DNA, 20 bp, mouse
gaaagtttatgtttgaggcc

SEQ ID NO: 771502 - DNA, 20 bp, mouse
ggcagctggttttctgcatc

SEQ ID NO: 771503 - DNA, 20 bp, mouse
gtcattaactacatacagag

SEQ ID NO: 771504 - DNA, 20 bp, mouse
ggattcttcaaacagtttcc

SEQ ID NO: 771505 - DNA, 20 bp, mouse
gaacccagaaccacagctct

SEQ ID NO: 771506 - DNA, 20 bp, mouse
gctagctatgctgttggggc

SEQ ID NO: 771507 - DNA, 20 bp, mouse
gggctgcagaatgtttcagt

SEQ ID NO: 771508 - DNA, 20 bp, mouse
gtaatgctagctatgctgtt

SEQ ID NO: 771509 - DNA, 20 bp, mouse
gtccaatgccccatctgaga

SEQ ID NO: 771510 - DNA, 20 bp, mouse
ggccccatctgagatggttc

SEQ ID NO: 771511 - DNA, 20 bp, mouse
gtgaagtagaggggtgaatc

SEQ ID NO: 771512 - DNA, 20 bp, mouse
gtgtccagaaccatctcaga

SEQ ID NO: 771513 - DNA, 20 bp, mouse
gttgaattctctggaaaatc

SEQ ID NO: 771514 - DNA, 20 bp, mouse
ggatataaaataaagtgaat

SEQ ID NO: 771515 - DNA, 20 bp, mouse
gattcagcatacatacattc

SEQ ID NO: 771516 - DNA, 20 bp, mouse
gatgacttcaaaattagagg

SEQ ID NO: 771517 - DNA, 20 bp, mouse
gtgcaatctcaacaccttag

SEQ ID NO: 771518 - DNA, 20 bp, mouse
gattgaacatcaggtgatat

SEQ ID NO: 771519 - DNA, 20 bp, mouse
gctcaacaccttagaggtta

SEQ ID NO: 771520 - DNA, 20 bp, mouse
ggagagaggatggagttcca

SEQ ID NO: 771521 - DNA, 20 bp, mouse
ggttgagattgcagatatgc

SEQ ID NO: 771522 - DNA, 20 bp, mouse
gtcagctatcattgaacatc

SEQ ID NO: 771523 - DNA, 20 bp, mouse
ggtattaaattcttcctcat

SEQ ID NO: 771524 - DNA, 20 bp, mouse
gatttctgcaatcacctatg

SEQ ID NO: 771525 - DNA, 20 bp, mouse
gattgcagaaattttgatat

SEQ ID NO: 771526 - DNA, 20 bp, mouse
ggggggggacaaggggtaga

SEQ ID NO: 771527 - DNA, 20 bp, mouse
gagctattttatttggtaat

SEQ ID NO: 771528 - DNA, 20 bp, mouse
ggatgattgacactacacat

SEQ ID NO: 771529 - DNA, 20 bp, mouse
gccatggaaaatgtactaga

SEQ ID NO: 771530 - DNA, 20 bp, mouse
gtattatttagcaacagaaa

SEQ ID NO: 771531 - DNA, 20 bp, mouse
gaaattttgtatctactctg

SEQ ID NO: 771532 - DNA, 20 bp, mouse
gaaatttttttcataatgtt

SEQ ID NO: 771533 - DNA, 20 bp, mouse
ggaaaaaaatttcgagaaca

SEQ ID NO: 771534 - DNA, 20 bp, mouse
gttttatttggtaataggaa

SEQ ID NO: 771535 - DNA, 20 bp, mouse
gagtcatatcaaaccaatca

SEQ ID NO: 771536 - DNA, 20 bp, mouse
gtgtggcaacatgagcaaga

SEQ ID NO: 771537 - DNA, 20 bp, mouse
gtgagcagaagtaaatggga

SEQ ID NO: 771538 - DNA, 20 bp, mouse
gttccaaagaacagagtgaa

SEQ ID NO: 771539 - DNA, 20 bp, mouse
gcaacatgagcagaagtaaa

SEQ ID NO: 771540 - DNA, 20 bp, mouse
gactccttgtgtttgatcac

SEQ ID NO: 771541 - DNA, 20 bp, mouse
gtttgtatggagttactagt

SEQ ID NO: 771542 - DNA, 20 bp, mouse
gaatgtcagttgggaaagga

SEQ ID NO: 771543 - DNA, 20 bp, mouse
gaaaagtagtaaggggatac

SEQ ID NO: 771544 - DNA, 20 bp, mouse
gatataatgtcagttgggaa

SEQ ID NO: 771545 - DNA, 20 bp, mouse
gtgttgtcaattcaaagttg

SEQ ID NO: 771546 - DNA, 20 bp, mouse
gtctgtctcatacataagtt

SEQ ID NO: 771547 - DNA, 20 bp, mouse
gcgacttcatactgcatgtt

SEQ ID NO: 771548 - DNA, 20 bp, mouse
gcataatatctcatattgtt

SEQ ID NO: 771549 - DNA, 20 bp, mouse
gcctaagatacacacaaaaa

SEQ ID NO: 771550 - DNA, 20 bp, mouse
gcagaaagagtcatcatgat

SEQ ID NO: 771551 - DNA, 20 bp, mouse
ggactctttctgtcatactc

SEQ ID NO: 771552 - DNA, 20 bp, mouse
ggttatgattattctcagtc

SEQ ID NO: 771553 - DNA, 20 bp, mouse
gagtctataaataatactta

SEQ ID NO: 771554 - DNA, 20 bp, mouse
gaagatctttttcattaatg

SEQ ID NO: 771555 - DNA, 20 bp, mouse
gattatggaaatatttgcat

SEQ ID NO: 771556 - DNA, 20 bp, mouse
gctggccatgatcacaattc

SEQ ID NO: 771557 - DNA, 20 bp, mouse
ggaactgaatgtttcttccc

SEQ ID NO: 771558 - DNA, 20 bp, mouse
ggcagagattagggtgagta

SEQ ID NO: 771559 - DNA, 20 bp, mouse
ggtcaacagaatgatggtgc

SEQ ID NO: 771560 - DNA, 20 bp, mouse
gatgaccagttaggggaaga

SEQ ID NO: 771561 - DNA, 20 bp, mouse
gaacctgccttacaaaacaa

SEQ ID NO: 771562 - DNA, 20 bp, mouse
gagttaggggaagagggcca

SEQ ID NO: 771563 - DNA, 20 bp, mouse
gtgttctagaagagttaatt

SEQ ID NO: 771564 - DNA, 20 bp, mouse
ggtctgtagtatgaccagtt

SEQ ID NO: 771565 - DNA, 20 bp, mouse
gcttctagataattccatgc

SEQ ID NO: 771566 - DNA, 20 bp, mouse
gaactctgaaaccctctatg

SEQ ID NO: 771567 - DNA, 20 bp, mouse
gctccactcgggtttccttc

SEQ ID NO: 771568 - DNA, 20 bp, mouse
gcacccgaaggaaacccgag

SEQ ID NO: 771569 - DNA, 20 bp, mouse
gtagggagagttccacccga

SEQ ID NO: 771570 - DNA, 20 bp, mouse
gttgatgtgttataagtaca

SEQ ID NO: 771571 - DNA, 20 bp, mouse
gatcatcaagtgcctcatag

SEQ ID NO: 771572 - DNA, 20 bp, mouse
ggcttgagtaaagcatatga

SEQ ID NO: 771573 - DNA, 20 bp, mouse
gaaattttacataatgaagt

SEQ ID NO: 771574 - DNA, 20 bp, mouse
gggtttattcaagtaatgtg

SEQ ID NO: 771575 - DNA, 20 bp, mouse
ggaatggtttaacaatgctc

SEQ ID NO: 771576 - DNA, 20 bp, mouse
gttattggaggggtaaaagc

SEQ ID NO: 771577 - DNA, 20 bp, mouse
gcatctcagttttattggag

SEQ ID NO: 771578 - DNA, 20 bp, mouse
gaagtgtgctagggcaggaa

SEQ ID NO: 771579 - DNA, 20 bp, mouse
ggaggggttgtgatgtacaa

SEQ ID NO: 771580 - DNA, 20 bp, mouse
gaagggcatctcagttttat

SEQ ID NO: 771581 - DNA, 20 bp, mouse
gctaaatagggaacttcatg

SEQ ID NO: 771582 - DNA, 20 bp, mouse
gtattgaagtgtgctagggc

SEQ ID NO: 771583 - DNA, 20 bp, mouse
gttacattgtactctaaata

SEQ ID NO: 771584 - DNA, 20 bp, mouse
gtgactattgaagtgtgcta

SEQ ID NO: 771585 - DNA, 20 bp, mouse
gctacatttgttatgactat

SEQ ID NO: 771586 - DNA, 20 bp, mouse
gaaccctacagaaacccaag

SEQ ID NO: 771587 - DNA, 20 bp, mouse
gtagatgtgttataagtgca

SEQ ID NO: 771588 - DNA, 20 bp, mouse
gatgggctctagttatgaaa

SEQ ID NO: 771589 - DNA, 20 bp, mouse
gttcgactctccctagaacc

SEQ ID NO: 771590 - DNA, 20 bp, mouse
gagtttattcaagtaatgag

SEQ ID NO: 771591 - DNA, 20 bp, mouse
gataattttacatagtgaag

SEQ ID NO: 771592 - DNA, 20 bp, mouse
gctccacttgggtttctgta

SEQ ID NO: 771593 - DNA, 20 bp, mouse
gctctctatgaggcacttga

SEQ ID NO: 771594 - DNA, 20 bp, mouse
gaacagcagcatgaaatgtg

SEQ ID NO: 771595 - DNA, 20 bp, mouse
gctagttatgaaagggagta

SEQ ID NO: 771596 - DNA, 20 bp, mouse
ggatgtgagtgcaaaagagt

SEQ ID NO: 771597 - DNA, 20 bp, mouse
gaaagtaaggcatatgtaat

SEQ ID NO: 771598 - DNA, 20 bp, mouse
gcactgtgtaaactccacta

SEQ ID NO: 771599 - DNA, 20 bp, mouse
gtcctctatgagacatttga

SEQ ID NO: 771600 - DNA, 20 bp, mouse
gcacccaaaggaatccctag

SEQ ID NO: 771601 - DNA, 20 bp, mouse
gagtgaagagaaatgatatc

SEQ ID NO: 771602 - DNA, 20 bp, mouse
gctccactagggattccttt

SEQ ID NO: 771603 - DNA, 20 bp, mouse
gttcactcaagatctcaagg

SEQ ID NO: 771604 - DNA, 20 bp, mouse
gctcttcactcaagatctca

SEQ ID NO: 771605 - DNA, 20 bp, mouse
gtttgggtgggactctctct

SEQ ID NO: 771606 - DNA, 20 bp, mouse
gtataataaacaggggttaa

SEQ ID NO: 771607 - DNA, 20 bp, mouse
gaaaggaataacttcggcaa

SEQ ID NO: 771608 - DNA, 20 bp, mouse
gctagcacatacaatacagt

SEQ ID NO: 771609 - DNA, 20 bp, mouse
gggggttaaaggaataactt

SEQ ID NO: 771610 - DNA, 20 bp, mouse
gaataatgtataataaacag

SEQ ID NO: 771611 - DNA, 20 bp, mouse
gttgggcagtatcccaaagg

SEQ ID NO: 771612 - DNA, 20 bp, mouse
gcatttgggcagtatcccaa

SEQ ID NO: 771613 - DNA, 20 bp, mouse
gaataactaaggatattgtt

SEQ ID NO: 771614 - DNA, 20 bp, mouse
gaatagcaatactatcattt

SEQ ID NO: 771615 - DNA, 20 bp, mouse
gataagacaaaatatgtccc

SEQ ID NO: 771616 - DNA, 20 bp, mouse
gctagcatataaaacacaat

SEQ ID NO: 771617 - DNA, 20 bp, mouse
gatatttcatgcaactatga

SEQ ID NO: 771618 - DNA, 20 bp, mouse
gataggacaaggcatgtctc

SEQ ID NO: 771619 - DNA, 20 bp, mouse
gtattcatttacttataaat

SEQ ID NO: 771620 - DNA, 20 bp, mouse
gtttacttataaataggaca

SEQ ID NO: 771621 - DNA, 20 bp, mouse
gaatatcaatcttacaacat

SEQ ID NO: 771622 - DNA, 20 bp, mouse
gtcagatgtgcacagacaga

SEQ ID NO: 771623 - DNA, 20 bp, mouse
gatgcacagtatccaaacag

SEQ ID NO: 771624 - DNA, 20 bp, mouse
gagcataatcatttcttttc

SEQ ID NO: 771625 - DNA, 20 bp, mouse
gttttatatgctaggcaagt

SEQ ID NO: 771626 - DNA, 20 bp, mouse
gacagtatcttgtgagtcaa

SEQ ID NO: 771627 - DNA, 20 bp, mouse
gtgtgtgcagtcatacttgt

SEQ ID NO: 771628 - DNA, 20 bp, mouse
gaagtggtttgtgtggttta

SEQ ID NO: 771629 - DNA, 20 bp, mouse
gacattataactgtgctgtg

SEQ ID NO: 771630 - DNA, 20 bp, mouse
gcaaggatctagatgcacaa

SEQ ID NO: 771631 - DNA, 20 bp, mouse
gcttgtaattgatacgttct

SEQ ID NO: 771632 - DNA, 20 bp, mouse
gactcaggactttgactcta

SEQ ID NO: 771633 - DNA, 20 bp, mouse
gtacattcaagtggtttgtg

SEQ ID NO: 771634 - DNA, 20 bp, mouse
gatatatgagtgtgcttcac

SEQ ID NO: 771635 - DNA, 20 bp, mouse
gatgtctcaagaaatcctaa

SEQ ID NO: 771636 - DNA, 20 bp, mouse
gggactacttgacacttcca

SEQ ID NO: 771637 - DNA, 20 bp, mouse
ggaagtgtcaagtagtccaa

SEQ ID NO: 771638 - DNA, 20 bp, mouse
gtgggaggaagtaagagtaa

SEQ ID NO: 771639 - DNA, 20 bp, mouse
gtttgactgtcaaaatcctt

SEQ ID NO: 771640 - DNA, 20 bp, mouse
gagattcattgcaaagacag

SEQ ID NO: 771641 - DNA, 20 bp, mouse
gggattttgacagtcaaaga

SEQ ID NO: 771642 - DNA, 20 bp, mouse
gcaaagatggtaatgattta

SEQ ID NO: 771643 - DNA, 20 bp, mouse
ggtttgaaaaaggaattctc

SEQ ID NO: 771644 - DNA, 20 bp, mouse
ggccaattgtgctaatttga

SEQ ID NO: 771645 - DNA, 20 bp, mouse
gctggtatataaagcaaagt

SEQ ID NO: 771646 - DNA, 20 bp, mouse
gcatctgtgcaatctatgta

SEQ ID NO: 771647 - DNA, 20 bp, mouse
gtagctctagttgcaggaac

SEQ ID NO: 771648 - DNA, 20 bp, mouse
gcataccatgacatatttca

SEQ ID NO: 771649 - DNA, 20 bp, mouse
gaacacttagatacttcaca

SEQ ID NO: 771650 - DNA, 20 bp, mouse
gctagccattaaatatttgt

SEQ ID NO: 771651 - DNA, 20 bp, mouse
gctgtgggttgttaaaatga

SEQ ID NO: 771652 - DNA, 20 bp, mouse
gaacccacagtaattttagc

SEQ ID NO: 771653 - DNA, 20 bp, mouse
ggataaaattgtagcttcca

SEQ ID NO: 771654 - DNA, 20 bp, mouse
gatcacgctatacaaattta

SEQ ID NO: 771655 - DNA, 20 bp, mouse
gttaaagacatgtttcacca

SEQ ID NO: 771656 - DNA, 20 bp, mouse
gtcttgaaattctacttcac

SEQ ID NO: 771657 - DNA, 20 bp, mouse
gaaagtcagttccccttata

SEQ ID NO: 771658 - DNA, 20 bp, mouse
ggggttaccatgaaccaatt

SEQ ID NO: 771659 - DNA, 20 bp, mouse
gcatggtaacccaatctcac

SEQ ID NO: 771660 - DNA, 20 bp, mouse
gagaatttcaagaccctata

SEQ ID NO: 771661 - DNA, 20 bp, mouse
gtcaaacttacaatgaaaac

SEQ ID NO: 771662 - DNA, 20 bp, mouse
gtaacaagtcctgtgagatt

SEQ ID NO: 771663 - DNA, 20 bp, mouse
gagaatggctaaggaaccac

SEQ ID NO: 771664 - DNA, 20 bp, mouse
ggtaatcagcatagctccag

SEQ ID NO: 771665 - DNA, 20 bp, mouse
gttgttaatactaattgaaa

SEQ ID NO: 771666 - DNA, 20 bp, mouse
ggtggggaaagttagatcaa

SEQ ID NO: 771667 - DNA, 20 bp, mouse
gggcaatgagttagatacgt

SEQ ID NO: 771668 - DNA, 20 bp, mouse
ggagttagatacgtgggatc

SEQ ID NO: 771669 - DNA, 20 bp, mouse
gtaccagaggctggtagcac

SEQ ID NO: 771670 - DNA, 20 bp, mouse
ggggagctctactgtgctat

SEQ ID NO: 771671 - DNA, 20 bp, mouse
gagtagaacgtggttaccag

SEQ ID NO: 771672 - DNA, 20 bp, mouse
gcagaggtgagagtagaacg

SEQ ID NO: 771673 - DNA, 20 bp, mouse
gggctggtagcacaggagta

SEQ ID NO: 771674 - DNA, 20 bp, mouse
gacaggagtatggtataggt

SEQ ID NO: 771675 - DNA, 20 bp, mouse
gaaagacggtgatgtcacag

SEQ ID NO: 771676 - DNA, 20 bp, mouse
ggattctaaagggagttcat

SEQ ID NO: 771677 - DNA, 20 bp, mouse
ggttcattggcattgacatt

SEQ ID NO: 771678 - DNA, 20 bp, mouse
gtactggtatattcgagtgt

SEQ ID NO: 771679 - DNA, 20 bp, mouse
gctacagtggctgtatccta

SEQ ID NO: 771680 - DNA, 20 bp, mouse
gaccagtagagaattggcaa

SEQ ID NO: 771681 - DNA, 20 bp, mouse
ggacaatctttttttcacat

SEQ ID NO: 771682 - DNA, 20 bp, mouse
gagccactgtaggtggtaaa

SEQ ID NO: 771683 - DNA, 20 bp, mouse
gtgacattgggtatttctgc

SEQ ID NO: 771684 - DNA, 20 bp, mouse
gtcgagtgtgggacaaacca

SEQ ID NO: 771685 - DNA, 20 bp, mouse
ggttaccttgtagatgacct

SEQ ID NO: 771686 - DNA, 20 bp, mouse
ggaaaatcctcacacttcac

SEQ ID NO: 771687 - DNA, 20 bp, mouse
gggaatgtgacattcccttg

SEQ ID NO: 771688 - DNA, 20 bp, mouse
ggggcagatctgctctaccc

SEQ ID NO: 771689 - DNA, 20 bp, mouse
ggtaaaagcacggagattat

SEQ ID NO: 771690 - DNA, 20 bp, mouse
ggatctgcccgtgaagtgtg

SEQ ID NO: 771691 - DNA, 20 bp, mouse
gggacaagagtgctcccttc

SEQ ID NO: 771692 - DNA, 20 bp, mouse
gcttggctttgtgggtccta

SEQ ID NO: 771693 - DNA, 20 bp, mouse
gtttgagggtataagagtat

SEQ ID NO: 771694 - DNA, 20 bp, mouse
gttcttattccaaagacaga

SEQ ID NO: 771695 - DNA, 20 bp, mouse
gttataccctcaaagtctag

SEQ ID NO: 771696 - DNA, 20 bp, mouse
gcagagaggtcccaggttgg

SEQ ID NO: 771697 - DNA, 20 bp, mouse
gttgcagagaggtcccaggt

SEQ ID NO: 771698 - DNA, 20 bp, mouse
ggatcttgcagagaggtccc

SEQ ID NO: 771699 - DNA, 20 bp, mouse
gttcagatggcttggaggtt

SEQ ID NO: 771700 - DNA, 20 bp, mouse
gaaaaattaaaggactgttc

SEQ ID NO: 771701 - DNA, 20 bp, mouse
ggactgttcagatggcttgg

SEQ ID NO: 771702 - DNA, 20 bp, mouse
gaagcccaacatatccaaat

SEQ ID NO: 771703 - DNA, 20 bp, mouse
gagtgatcaaagaaagtagc

SEQ ID NO: 771704 - DNA, 20 bp, mouse
gccttgctgatcttgcagag

SEQ ID NO: 771705 - DNA, 20 bp, mouse
gaatagaaaattgaggaact

SEQ ID NO: 771706 - DNA, 20 bp, mouse
gtgcagctgcactttctcta

SEQ ID NO: 771707 - DNA, 20 bp, mouse
gacgctgaggacgatgggaa

SEQ ID NO: 771708 - DNA, 20 bp, mouse
gtagactcctcacatgcgtc

SEQ ID NO: 771709 - DNA, 20 bp, mouse
gcaggtgtgaccctgtgttc

SEQ ID NO: 771710 - DNA, 20 bp, mouse
gagtggaccggacgcatgtg

SEQ ID NO: 771711 - DNA, 20 bp, mouse
ggaatgcgggagttcctggt

SEQ ID NO: 771712 - DNA, 20 bp, mouse
gcacacttggcatttctgac

SEQ ID NO: 771713 - DNA, 20 bp, mouse
gtggggaatgcgggagttcc

SEQ ID NO: 771714 - DNA, 20 bp, mouse
gcatgagaataatgacgctg

SEQ ID NO: 771715 - DNA, 20 bp, mouse
ggagtctaaatgatcccgtg

SEQ ID NO: 771716 - DNA, 20 bp, mouse
gatacaagtcttctggggta

SEQ ID NO: 771717 - DNA, 20 bp, mouse
gtatataatacaagtcttct

SEQ ID NO: 771718 - DNA, 20 bp, mouse
ggtattatatatgttcttaa

SEQ ID NO: 771719 - DNA, 20 bp, mouse
gtggaaatacaatttaatat

SEQ ID NO: 771720 - DNA, 20 bp, mouse
gttaaaataccaagtctcca

SEQ ID NO: 771721 - DNA, 20 bp, mouse
gtgctttttagggcattctg

SEQ ID NO: 771722 - DNA, 20 bp, mouse
gactcctcaagggatcagac

SEQ ID NO: 771723 - DNA, 20 bp, mouse
gaaactacagtttttctgtc

SEQ ID NO: 771724 - DNA, 20 bp, mouse
gagttactgtcctaacaata

SEQ ID NO: 771725 - DNA, 20 bp, mouse
gatgagtgtactgcttttta

SEQ ID NO: 771726 - DNA, 20 bp, mouse
gggcatttgaaggatttatg

SEQ ID NO: 771727 - DNA, 20 bp, mouse
gtctggagatgcagtatgca

SEQ ID NO: 771728 - DNA, 20 bp, mouse
gcccaattctttatcgagga

SEQ ID NO: 771729 - DNA, 20 bp, mouse
ggtaaattgttatattgata

SEQ ID NO: 771730 - DNA, 20 bp, mouse
gataatgttgtagaatattc

SEQ ID NO: 771731 - DNA, 20 bp, mouse
gagaaccactaagtacaaga

SEQ ID NO: 771732 - DNA, 20 bp, mouse
gtccagttggatgacatgaa

SEQ ID NO: 771733 - DNA, 20 bp, mouse
gatgacatgaaaggaccaaa

SEQ ID NO: 771734 - DNA, 20 bp, mouse
ggaacttgttagaatccagt

SEQ ID NO: 771735 - DNA, 20 bp, mouse
ggtacatttgataccatgta

SEQ ID NO: 771736 - DNA, 20 bp, mouse
gagaaaatcaggatctcgta

SEQ ID NO: 771737 - DNA, 20 bp, mouse
ggatatgaaatgaaattttg

SEQ ID NO: 771738 - DNA, 20 bp, mouse
gatgtactacagagttgtct

SEQ ID NO: 771739 - DNA, 20 bp, mouse
gaaattcttaacttacatag

SEQ ID NO: 771740 - DNA, 20 bp, mouse
gaaaatttactataaggaag

SEQ ID NO: 771741 - DNA, 20 bp, mouse
gtttaataaagtgaaagctt

SEQ ID NO: 771742 - DNA, 20 bp, mouse
gtctttcaaaatttactata

SEQ ID NO: 771743 - DNA, 20 bp, mouse
gatacaattaattcaactga

SEQ ID NO: 771744 - DNA, 20 bp, mouse
gaactctgtagttatcaggt

SEQ ID NO: 771745 - DNA, 20 bp, mouse
gaacatgttcaaacctttat

SEQ ID NO: 771746 - DNA, 20 bp, mouse
gagaaaatcaggaccttgta

SEQ ID NO: 771747 - DNA, 20 bp, mouse
gtgatatgaaataaatttca

SEQ ID NO: 771748 - DNA, 20 bp, mouse
gcaagctactatagattgta

SEQ ID NO: 771749 - DNA, 20 bp, mouse
gaaactcttaacttacatag

SEQ ID NO: 771750 - DNA, 20 bp, mouse
gtatgtactacagagttgtc

SEQ ID NO: 771751 - DNA, 20 bp, mouse
ggacttttattttccttaca

SEQ ID NO: 771752 - DNA, 20 bp, mouse
gcaaaatctatttaaagaag

SEQ ID NO: 771753 - DNA, 20 bp, mouse
gaactctgtagttatcaggt

SEQ ID NO: 771754 - DNA, 20 bp, mouse
gactgcacagaaaatttaaa

SEQ ID NO: 771755 - DNA, 20 bp, mouse
gaacatgttcaaacctttat

SEQ ID NO: 771756 - DNA, 20 bp, mouse
gtgctacagagccagtctgc

SEQ ID NO: 771757 - DNA, 20 bp, mouse
gaattatatctgcgaattac

SEQ ID NO: 771758 - DNA, 20 bp, mouse
gtaataaatatccagcagac

SEQ ID NO: 771759 - DNA, 20 bp, mouse
gacaaagattttttttagaa

SEQ ID NO: 771760 - DNA, 20 bp, mouse
gtaccaagtttcaaacaaga

SEQ ID NO: 771761 - DNA, 20 bp, mouse
gaaataattttgatttttac

SEQ ID NO: 771762 - DNA, 20 bp, mouse
ggtttttatgagaaatattg

SEQ ID NO: 771763 - DNA, 20 bp, mouse
gctccatcttgtttgaaact

SEQ ID NO: 771764 - DNA, 20 bp, mouse
gaaatttttctcttcagtgt

SEQ ID NO: 771765 - DNA, 20 bp, mouse
gtttgcaattaaaaagaaaa

SEQ ID NO: 771766 - DNA, 20 bp, mouse
gactttaactcagaattgac

SEQ ID NO: 771767 - DNA, 20 bp, mouse
gaatttcacaaagactacta

SEQ ID NO: 771768 - DNA, 20 bp, mouse
gactttttaatgtattcagt

SEQ ID NO: 771769 - DNA, 20 bp, mouse
gtcattctagagaaaacagc

SEQ ID NO: 771770 - DNA, 20 bp, mouse
gtacttttataattgtaaaa

SEQ ID NO: 771771 - DNA, 20 bp, mouse
gtataaacaaaatatgttca

SEQ ID NO: 771772 - DNA, 20 bp, mouse
ggagatatgtatgcattcat

SEQ ID NO: 771773 - DNA, 20 bp, mouse
gttgatgatcttaacaaacc

SEQ ID NO: 771774 - DNA, 20 bp, mouse
gctaaaataattttcatgcc

SEQ ID NO: 771775 - DNA, 20 bp, mouse
gcctcttatacaaaaatagt

SEQ ID NO: 771776 - DNA, 20 bp, mouse
gtcacacattattcactgtt

SEQ ID NO: 771777 - DNA, 20 bp, mouse
ggtagatgtctcatttgtct

SEQ ID NO: 771778 - DNA, 20 bp, mouse
gctaatgttatgataataga

SEQ ID NO: 771779 - DNA, 20 bp, mouse
gacatcatttatcaatctca

SEQ ID NO: 771780 - DNA, 20 bp, mouse
gaggcattcttataattata

SEQ ID NO: 771781 - DNA, 20 bp, mouse
gctacaaattttattaatgt

SEQ ID NO: 771782 - DNA, 20 bp, mouse
gtatattcatatttagagtt

SEQ ID NO: 771783 - DNA, 20 bp, mouse
gtagtcactatacttacagt

SEQ ID NO: 771784 - DNA, 20 bp, mouse
gagtatagtgactaacttgc

SEQ ID NO: 771785 - DNA, 20 bp, mouse
gagttacttggtttattaac

SEQ ID NO: 771786 - DNA, 20 bp, mouse
gagaacaagttggagtgtat

SEQ ID NO: 771787 - DNA, 20 bp, mouse
gattggagatgttgaaggaa

SEQ ID NO: 771788 - DNA, 20 bp, mouse
gtgactttgaaagaacaagt

SEQ ID NO: 771789 - DNA, 20 bp, mouse
gtgagattatgggtgtttaa

SEQ ID NO: 771790 - DNA, 20 bp, mouse
ggtgatacatgagagatata

SEQ ID NO: 771791 - DNA, 20 bp, mouse
gaaattgaattagttaattc

SEQ ID NO: 771792 - DNA, 20 bp, mouse
gttcattaataatgagatta

SEQ ID NO: 771793 - DNA, 20 bp, mouse
gtggatctgaaagagagtaa

SEQ ID NO: 771794 - DNA, 20 bp, mouse
gagtaaattaagagaggctg

SEQ ID NO: 771795 - DNA, 20 bp, mouse
gcctaagagtaaattaagag

SEQ ID NO: 771796 - DNA, 20 bp, mouse
gatacacctgaagtaatata

SEQ ID NO: 771797 - DNA, 20 bp, mouse
gataccaaaattttagagtc

SEQ ID NO: 771798 - DNA, 20 bp, mouse
gaatttccatatattacttc

SEQ ID NO: 771799 - DNA, 20 bp, mouse
ggcattagaaacatccattt

SEQ ID NO: 771800 - DNA, 20 bp, mouse
gtaggaaatgctaaatggtg

SEQ ID NO: 771801 - DNA, 20 bp, mouse
gtattcatctggaaatacat

SEQ ID NO: 771802 - DNA, 20 bp, mouse
gtactgtaggaaatgctaaa

SEQ ID NO: 771803 - DNA, 20 bp, mouse
gatgccagactctaaaattt

SEQ ID NO: 771804 - DNA, 20 bp, mouse
gaaatgctaaatggtgcggt

SEQ ID NO: 771805 - DNA, 20 bp, mouse
gtcactgtcaattattcatc

SEQ ID NO: 771806 - DNA, 20 bp, mouse
gggggagatagagatcacaa

SEQ ID NO: 771807 - DNA, 20 bp, mouse
gtcttctatgatcatcagga

SEQ ID NO: 771808 - DNA, 20 bp, mouse
gtcaggcaataaaagaatca

SEQ ID NO: 771809 - DNA, 20 bp, mouse
gtgacaattcatatgaacaa

SEQ ID NO: 771810 - DNA, 20 bp, mouse
gccctatagaccctatagga

SEQ ID NO: 771811 - DNA, 20 bp, mouse
gagaaaaacgtcaaaggctc

SEQ ID NO: 771812 - DNA, 20 bp, mouse
gctatagggtctatagggtc

SEQ ID NO: 771813 - DNA, 20 bp, mouse
gagtacattttccctcctat

SEQ ID NO: 771814 - DNA, 20 bp, mouse
gcagagaacgcttgaagatt

SEQ ID NO: 771815 - DNA, 20 bp, mouse
gttcatatgaattgtcatgt

SEQ ID NO: 771816 - DNA, 20 bp, mouse
ggagctacttgctatcccca

SEQ ID NO: 771817 - DNA, 20 bp, mouse
gactactgctacaggactcc

SEQ ID NO: 771818 - DNA, 20 bp, mouse
gatcacgtggtattgtactt

SEQ ID NO: 771819 - DNA, 20 bp, mouse
gtccctagaacaaattctcc

SEQ ID NO: 771820 - DNA, 20 bp, mouse
gcactgatcaactgatcacg

SEQ ID NO: 771821 - DNA, 20 bp, mouse
gggactactgttgattccct

SEQ ID NO: 771822 - DNA, 20 bp, mouse
gctccaggagaatttgttct

SEQ ID NO: 771823 - DNA, 20 bp, mouse
gggttagtcactactgctac

SEQ ID NO: 771824 - DNA, 20 bp, mouse
gacgttggatcctgtactgg

SEQ ID NO: 771825 - DNA, 20 bp, mouse
gcaacagtagtcctgcacgt

SEQ ID NO: 771826 - DNA, 20 bp, mouse
ggcattagaaatttccattt

SEQ ID NO: 771827 - DNA, 20 bp, mouse
gaataccaaattttagagtc

SEQ ID NO: 771828 - DNA, 20 bp, mouse
gcaagtgtacatattacttc

SEQ ID NO: 771829 - DNA, 20 bp, mouse
gtaggaaatgctaaatggtg

SEQ ID NO: 771830 - DNA, 20 bp, mouse
gtactgtaggaaatgctaaa

SEQ ID NO: 771831 - DNA, 20 bp, mouse
gaaatgctaaatggtgcggt

SEQ ID NO: 771832 - DNA, 20 bp, mouse
gtcactgtcaattattcatc

SEQ ID NO: 771833 - DNA, 20 bp, mouse
gaatgccagactctaaaatt

SEQ ID NO: 771834 - DNA, 20 bp, mouse
gtcactgtcactatcccaaa

SEQ ID NO: 771835 - DNA, 20 bp, mouse
gaacaatttcataatttttc

SEQ ID NO: 771836 - DNA, 20 bp, mouse
gtagtagagaagtgtcacat

SEQ ID NO: 771837 - DNA, 20 bp, mouse
gtatgagtaagagcagtcaa

SEQ ID NO: 771838 - DNA, 20 bp, mouse
gtaaactgaattgtagaatt

SEQ ID NO: 771839 - DNA, 20 bp, mouse
gtttacttttcagtctagca

SEQ ID NO: 771840 - DNA, 20 bp, mouse
gtcttactcatattattctt

SEQ ID NO: 771841 - DNA, 20 bp, mouse
gacaacacaaatcaaaatga

SEQ ID NO: 771842 - DNA, 20 bp, mouse
gttcaagtgagcattccaga

SEQ ID NO: 771843 - DNA, 20 bp, mouse
gtctttggattttctccttc

SEQ ID NO: 771844 - DNA, 20 bp, mouse
gctttaagatgaatgtttgt

SEQ ID NO: 771845 - DNA, 20 bp, mouse
gctcatattattcttaggag

SEQ ID NO: 771846 - DNA, 20 bp, mouse
ggggaagaagcccaatctat

SEQ ID NO: 771847 - DNA, 20 bp, mouse
ggagggcaattcagtttctt

SEQ ID NO: 771848 - DNA, 20 bp, mouse
gtgcatggcatctgccaata

SEQ ID NO: 771849 - DNA, 20 bp, mouse
ggtaaaatcacccaatagat

SEQ ID NO: 771850 - DNA, 20 bp, mouse
ggtaactgatagagagttta

SEQ ID NO: 771851 - DNA, 20 bp, mouse
gtactgtagattcaatatga

SEQ ID NO: 771852 - DNA, 20 bp, mouse
gctcattaatcaaaccttat

SEQ ID NO: 771853 - DNA, 20 bp, mouse
gttctgaatcttttgatcta

SEQ ID NO: 771854 - DNA, 20 bp, mouse
gtgggctgcataagtttgaa

SEQ ID NO: 771855 - DNA, 20 bp, mouse
gacttatgcagcccaagaaa

SEQ ID NO: 771856 - DNA, 20 bp, mouse
gtacatcaagagctggatag

SEQ ID NO: 771857 - DNA, 20 bp, mouse
gggtactgttctcataatct

SEQ ID NO: 771858 - DNA, 20 bp, mouse
gatgaatttttccctacttc

SEQ ID NO: 771859 - DNA, 20 bp, mouse
gtcaaagctttcctgaagta

SEQ ID NO: 771860 - DNA, 20 bp, mouse
gagcatctgacatgtgtgaa

SEQ ID NO: 771861 - DNA, 20 bp, mouse
gatcaagagctggatagtgg

SEQ ID NO: 771862 - DNA, 20 bp, mouse
gtatatttaattataaggtc

SEQ ID NO: 771863 - DNA, 20 bp, mouse
gtaaaatgtacatcaagagc

SEQ ID NO: 771864 - DNA, 20 bp, mouse
gaaatatatatttaattata

SEQ ID NO: 771865 - DNA, 20 bp, mouse
ggtgaaaggggactatgatc

SEQ ID NO: 771866 - DNA, 20 bp, mouse
ggtcctctttcacacatgtc

SEQ ID NO: 771867 - DNA, 20 bp, mouse
gttcaaagctttcttgaaat

SEQ ID NO: 771868 - DNA, 20 bp, mouse
gaagtgcacagactacctta

SEQ ID NO: 771869 - DNA, 20 bp, mouse
gaaacttagaatggtaaaaa

SEQ ID NO: 771870 - DNA, 20 bp, mouse
gcaaacctgacagttctaat

SEQ ID NO: 771871 - DNA, 20 bp, mouse
gagacttttcgtcttgagct

SEQ ID NO: 771872 - DNA, 20 bp, mouse
gacaattgcagccagcctta

SEQ ID NO: 771873 - DNA, 20 bp, mouse
ggaactggagagtgtcagca

SEQ ID NO: 771874 - DNA, 20 bp, mouse
gtaatatgtatgcatcaaaa

SEQ ID NO: 771875 - DNA, 20 bp, mouse
gctgaccaattagaactgtc

SEQ ID NO: 771876 - DNA, 20 bp, mouse
gtgtacaaagccaaacaaac

SEQ ID NO: 771877 - DNA, 20 bp, mouse
gctattgaagccagtttgtt

SEQ ID NO: 771878 - DNA, 20 bp, mouse
gtctgcatgtaaagtcatac

SEQ ID NO: 771879 - DNA, 20 bp, mouse
ggaaaaagttgatgagaatt

SEQ ID NO: 771880 - DNA, 20 bp, mouse
gatctgaaaattaaatgagt

SEQ ID NO: 771881 - DNA, 20 bp, mouse
gcataggaaatggggactag

SEQ ID NO: 771882 - DNA, 20 bp, mouse
gtaagtttgtgcatcatttg

SEQ ID NO: 771883 - DNA, 20 bp, mouse
ggggaaatgaatatgtacaa

SEQ ID NO: 771884 - DNA, 20 bp, mouse
ggaaaagtcaaggggcctct

SEQ ID NO: 771885 - DNA, 20 bp, mouse
gtatgacagatctgttataa

SEQ ID NO: 771886 - DNA, 20 bp, mouse
gtgctccacaattcacagtt

SEQ ID NO: 771887 - DNA, 20 bp, mouse
gctgtcataaattatgtatg

SEQ ID NO: 771888 - DNA, 20 bp, mouse
gctatcctaactgtgaattg

SEQ ID NO: 771889 - DNA, 20 bp, mouse
gtgtgaattgtggagcacct

SEQ ID NO: 771890 - DNA, 20 bp, mouse
gcatatacacagcacgacac

SEQ ID NO: 771891 - DNA, 20 bp, mouse
gccacattcttactgagtct

SEQ ID NO: 771892 - DNA, 20 bp, mouse
gagtctactttaatataccc

SEQ ID NO: 771893 - DNA, 20 bp, mouse
gaataaaataacacaggagg

SEQ ID NO: 771894 - DNA, 20 bp, mouse
gcacagttaggatagtggtc

SEQ ID NO: 771895 - DNA, 20 bp, mouse
gacactggtaagctaaaatg

SEQ ID NO: 771896 - DNA, 20 bp, mouse
gaatgagcataattggtgac

SEQ ID NO: 771897 - DNA, 20 bp, mouse
ggttgtcagagaaggaaacg

SEQ ID NO: 771898 - DNA, 20 bp, mouse
gacaggcttcttaagaaagc

SEQ ID NO: 771899 - DNA, 20 bp, mouse
ggtagcccaataaagctgta

SEQ ID NO: 771900 - DNA, 20 bp, mouse
ggataccatacagctttatt

SEQ ID NO: 771901 - DNA, 20 bp, mouse
gtcctgggttgatcatgtca

SEQ ID NO: 771902 - DNA, 20 bp, mouse
gaatgtccgaagttgttccc

SEQ ID NO: 771903 - DNA, 20 bp, mouse
gtgtgtccaaatgtatctgg

SEQ ID NO: 771904 - DNA, 20 bp, mouse
ggagaattaatgagcataat

SEQ ID NO: 771905 - DNA, 20 bp, mouse
ggattgatttagtattcaca

SEQ ID NO: 771906 - DNA, 20 bp, mouse
ggcagaaggctccggggcca

SEQ ID NO: 771907 - DNA, 20 bp, mouse
gtctggggaggaagccagcg

SEQ ID NO: 771908 - DNA, 20 bp, mouse
gattagaacaacatctgggg

SEQ ID NO: 771909 - DNA, 20 bp, mouse
gaaggtcaatcagactgtaa

SEQ ID NO: 771910 - DNA, 20 bp, mouse
ggcatctcaataattctaaa

SEQ ID NO: 771911 - DNA, 20 bp, mouse
ggcggcggggctgtgggcgg

SEQ ID NO: 771912 - DNA, 20 bp, mouse
ggctgtgggcggaggtctgc

SEQ ID NO: 771913 - DNA, 20 bp, mouse
gttaattagaacaacatctg

SEQ ID NO: 771914 - DNA, 20 bp, mouse
gctagtgaactggtaatcac

SEQ ID NO: 771915 - DNA, 20 bp, mouse
gctatattagccatacctag

SEQ ID NO: 771916 - DNA, 20 bp, mouse
gttggtaaacagggcatcca

SEQ ID NO: 771917 - DNA, 20 bp, mouse
gcattcagacttggtaaaca

SEQ ID NO: 771918 - DNA, 20 bp, mouse
gttgccacacaccttcatta

SEQ ID NO: 771919 - DNA, 20 bp, mouse
gtatccctaatgaaggtgtg

SEQ ID NO: 771920 - DNA, 20 bp, mouse
gtttgcagaaccatgactga

SEQ ID NO: 771921 - DNA, 20 bp, mouse
ggagctactcccccagattc

SEQ ID NO: 771922 - DNA, 20 bp, mouse
gacagaaatcttggtttgtc

SEQ ID NO: 771923 - DNA, 20 bp, mouse
ggctcagataaatatttcga

SEQ ID NO: 771924 - DNA, 20 bp, mouse
gttctacagctagcaattta

SEQ ID NO: 771925 - DNA, 20 bp, mouse
gttaaacctgtaaatgacat

SEQ ID NO: 771926 - DNA, 20 bp, mouse
gcggagtgggagtaggtcta

SEQ ID NO: 771927 - DNA, 20 bp, mouse
ggattcattactgtgaggtc

SEQ ID NO: 771928 - DNA, 20 bp, mouse
gccgtgcaggtcctgtgctt

SEQ ID NO: 771929 - DNA, 20 bp, mouse
gccaggttctcagcttgttg

SEQ ID NO: 771930 - DNA, 20 bp, mouse
gtgttggattcattactgtg

SEQ ID NO: 771931 - DNA, 20 bp, mouse
gttgttcagcctcactagga

SEQ ID NO: 771932 - DNA, 20 bp, mouse
ggaacctggtgcggccgtgc

SEQ ID NO: 771933 - DNA, 20 bp, mouse
gagcaaaaaccctcctagtg

SEQ ID NO: 771934 - DNA, 20 bp, mouse
gggacctgcacggccgcacc

SEQ ID NO: 771935 - DNA, 20 bp, mouse
gattgctcacccttattcta

SEQ ID NO: 771936 - DNA, 20 bp, mouse
gaccacttatactaccatac

SEQ ID NO: 771937 - DNA, 20 bp, mouse
gagagaggaacaccgacttc

SEQ ID NO: 771938 - DNA, 20 bp, mouse
gctggtgaaacagtggtggc

SEQ ID NO: 771939 - DNA, 20 bp, mouse
gcatactggccacctgaagt

SEQ ID NO: 771940 - DNA, 20 bp, mouse
gcctcctggtgaaacagtgg

SEQ ID NO: 771941 - DNA, 20 bp, mouse
gaacctaatattcatattgt

SEQ ID NO: 771942 - DNA, 20 bp, mouse
ggaggaacaccgacttcagg

SEQ ID NO: 771943 - DNA, 20 bp, mouse
ggccagtatggtagtataag

SEQ ID NO: 771944 - DNA, 20 bp, mouse
ggttaaacttaggaacacac

SEQ ID NO: 771945 - DNA, 20 bp, mouse
ggaggtaatcactacaaagc

SEQ ID NO: 771946 - DNA, 20 bp, mouse
gaggatgactcaactattgg

SEQ ID NO: 771947 - DNA, 20 bp, mouse
gaggggaggccttggattaa

SEQ ID NO: 771948 - DNA, 20 bp, mouse
gaggatctaaagccccgcat

SEQ ID NO: 771949 - DNA, 20 bp, mouse
gaagatgaggtttggcacag

SEQ ID NO: 771950 - DNA, 20 bp, mouse
gagcacatccagcccatgcg

SEQ ID NO: 771951 - DNA, 20 bp, mouse
gtggatgtgctctttacaaa

SEQ ID NO: 771952 - DNA, 20 bp, mouse
gatcaggatgactcaactat

SEQ ID NO: 771953 - DNA, 20 bp, mouse
gctcttttgaagatgaggtt

SEQ ID NO: 771954 - DNA, 20 bp, mouse
gggctttagatcctagcatc

SEQ ID NO: 771955 - DNA, 20 bp, mouse
ggttgagtcatcctgatgct

SEQ ID NO: 771956 - DNA, 20 bp, mouse
gttgagcatcaattaggtat

SEQ ID NO: 771957 - DNA, 20 bp, mouse
gagcagtacaattagacctc

SEQ ID NO: 771958 - DNA, 20 bp, mouse
gcaatctcagggtagttctt

SEQ ID NO: 771959 - DNA, 20 bp, mouse
gaaactcttgagcatcaatt

SEQ ID NO: 771960 - DNA, 20 bp, mouse
gatgctttgaccatagtgaa

SEQ ID NO: 771961 - DNA, 20 bp, mouse
ggtagttcttgggacacaga

SEQ ID NO: 771962 - DNA, 20 bp, mouse
gaagcaggaaggctctcatt

SEQ ID NO: 771963 - DNA, 20 bp, mouse
gctcttacactgggatacaa

SEQ ID NO: 771964 - DNA, 20 bp, mouse
gtgtcagtttaatcaatctc

SEQ ID NO: 771965 - DNA, 20 bp, mouse
ggggtgatataaagatgcaa

SEQ ID NO: 771966 - DNA, 20 bp, mouse
gaggcactccacacttgctt

SEQ ID NO: 771967 - DNA, 20 bp, mouse
ggcacactgagaagattcaa

SEQ ID NO: 771968 - DNA, 20 bp, mouse
gtgcgatggccgttctcaca

SEQ ID NO: 771969 - DNA, 20 bp, mouse
gtgtaggttaggactgtcat

SEQ ID NO: 771970 - DNA, 20 bp, mouse
gtaaccaagtgtgtcgcctg

SEQ ID NO: 771971 - DNA, 20 bp, mouse
gccgaccaatcaagaagaga

SEQ ID NO: 771972 - DNA, 20 bp, mouse
ggcagtacttgagaagcaat

SEQ ID NO: 771973 - DNA, 20 bp, mouse
gaagtgtgtcgcctgtggga

SEQ ID NO: 771974 - DNA, 20 bp, mouse
gttgaacagctttgtaggtt

SEQ ID NO: 771975 - DNA, 20 bp, mouse
ggatggacacctaacgtctc

SEQ ID NO: 771976 - DNA, 20 bp, mouse
gtggtgaaggtcagagtagg

SEQ ID NO: 771977 - DNA, 20 bp, mouse
gcaggggcagtgggaatcat

SEQ ID NO: 771978 - DNA, 20 bp, mouse
ggcttggtgaaggtcagagt

SEQ ID NO: 771979 - DNA, 20 bp, mouse
gcagggggctaaagagggtc

SEQ ID NO: 771980 - DNA, 20 bp, mouse
gtcttgacgccccatccagg

SEQ ID NO: 771981 - DNA, 20 bp, mouse
gctgtcttgacgccccatcc

SEQ ID NO: 771982 - DNA, 20 bp, mouse
gccatccagggggctaaaga

SEQ ID NO: 771983 - DNA, 20 bp, mouse
gaatgacgcctgaggctgtg

SEQ ID NO: 771984 - DNA, 20 bp, mouse
gaattgaagtttagcaagac

SEQ ID NO: 771985 - DNA, 20 bp, mouse
gggagaagatagagagactt

SEQ ID NO: 771986 - DNA, 20 bp, mouse
gctaaggctaacttattagg

SEQ ID NO: 771987 - DNA, 20 bp, mouse
ggctgaacgcactaaagggg

SEQ ID NO: 771988 - DNA, 20 bp, mouse
gttgctaaggctaacttatt

SEQ ID NO: 771989 - DNA, 20 bp, mouse
gtgtttgctgaacgcactaa

SEQ ID NO: 771990 - DNA, 20 bp, mouse
gagttgagagatgaggcttt

SEQ ID NO: 771991 - DNA, 20 bp, mouse
gttaagtgcaggtagaccaa

SEQ ID NO: 771992 - DNA, 20 bp, mouse
ggcaaggaatcacagaagca

SEQ ID NO: 771993 - DNA, 20 bp, mouse
gaaactattcaaagcacccg

SEQ ID NO: 771994 - DNA, 20 bp, mouse
gaaagaaagcctgaccttcc

SEQ ID NO: 771995 - DNA, 20 bp, mouse
gatgaaaccagctaggttct

SEQ ID NO: 771996 - DNA, 20 bp, mouse
gagaaggttctctgggattg

SEQ ID NO: 771997 - DNA, 20 bp, mouse
gggatcgccaccatgaactg

SEQ ID NO: 771998 - DNA, 20 bp, mouse
ggacttctgtgctgatcgtt

SEQ ID NO: 771999 - DNA, 20 bp, mouse
ggctctaatgtgagttgtta

SEQ ID NO: 772000 - DNA, 20 bp, mouse
ggagctaccacagttcatgg

SEQ ID NO: 772001 - DNA, 20 bp, mouse
gctaggcaactaagatgctt

SEQ ID NO: 772002 - DNA, 20 bp, mouse
gattagaggcagctctgcac

SEQ ID NO: 772003 - DNA, 20 bp, mouse
gaagtaagaattcacatata

SEQ ID NO: 772004 - DNA, 20 bp, mouse
gacaagttgttcaactttgc

SEQ ID NO: 772005 - DNA, 20 bp, mouse
gtctaatatcaacacgatat

SEQ ID NO: 772006 - DNA, 20 bp, mouse
gagtaaatcggacttagcag

SEQ ID NO: 772007 - DNA, 20 bp, mouse
gaatgcaattaagagagcca

SEQ ID NO: 772008 - DNA, 20 bp, mouse
gaggtttctgttagcgtcca

SEQ ID NO: 772009 - DNA, 20 bp, mouse
gcacaatagctgactcgagt

SEQ ID NO: 772010 - DNA, 20 bp, mouse
gtctgttaatatctcccctc

SEQ ID NO: 772011 - DNA, 20 bp, mouse
gtccaggttattgttaatga

SEQ ID NO: 772012 - DNA, 20 bp, mouse
gagtcagctattgtgtgtct

SEQ ID NO: 772013 - DNA, 20 bp, mouse
gtcttcttaaagtcccagag

SEQ ID NO: 772014 - DNA, 20 bp, mouse
ggatgacgtcacttggctcc

SEQ ID NO: 772015 - DNA, 20 bp, mouse
gagatggagcatgaaggacg

SEQ ID NO: 772016 - DNA, 20 bp, mouse
gcaccgaacaaagaccaggg

SEQ ID NO: 772017 - DNA, 20 bp, mouse
gtgaacaccgaacaaagacc

SEQ ID NO: 772018 - DNA, 20 bp, mouse
gggaagcaccagggtggttc

SEQ ID NO: 772019 - DNA, 20 bp, mouse
gcagagtcctctgttaagtg

SEQ ID NO: 772020 - DNA, 20 bp, mouse
gactaagctgtatttgtgaa

SEQ ID NO: 772021 - DNA, 20 bp, mouse
gtcactgttagaaatacaaa

SEQ ID NO: 772022 - DNA, 20 bp, mouse
gaagcattcctgaaccaccc

SEQ ID NO: 772023 - DNA, 20 bp, mouse
gagaccagggaggaatccac

SEQ ID NO: 772024 - DNA, 20 bp, mouse
gttcctccctggtctttgtt

SEQ ID NO: 772025 - DNA, 20 bp, mouse
gtgagagatagagagaaaca

SEQ ID NO: 772026 - DNA, 20 bp, mouse
ggcctgtcaggtgaggtacc

SEQ ID NO: 772027 - DNA, 20 bp, mouse
gtggtgaaatacgtccctgc

SEQ ID NO: 772028 - DNA, 20 bp, mouse
gtcctggtacctcacctgac

SEQ ID NO: 772029 - DNA, 20 bp, mouse
gaatgcttgcctgtcaggtg

SEQ ID NO: 772030 - DNA, 20 bp, mouse
gaatggattagagtgctctt

SEQ ID NO: 772031 - DNA, 20 bp, mouse
gggaaaaagccaagatgatc

SEQ ID NO: 772032 - DNA, 20 bp, mouse
gatgactgaaacatggacat

SEQ ID NO: 772033 - DNA, 20 bp, mouse
gacacaaacggtcccccagc

SEQ ID NO: 772034 - DNA, 20 bp, mouse
gtgtttaatgcttgcctgtc

SEQ ID NO: 772035 - DNA, 20 bp, mouse
gactctaatccatttaatta

SEQ ID NO: 772036 - DNA, 20 bp, mouse
gtaggaaaagcaaatatcat

SEQ ID NO: 772037 - DNA, 20 bp, mouse
gggtgaagttttattatcta

SEQ ID NO: 772038 - DNA, 20 bp, mouse
gtatatgtagatgtacataa

SEQ ID NO: 772039 - DNA, 20 bp, mouse
ggacttcttgcctagatatt

SEQ ID NO: 772040 - DNA, 20 bp, mouse
ggttcaacctgagagtatta

SEQ ID NO: 772041 - DNA, 20 bp, mouse
ggagtattatggtttgagac

SEQ ID NO: 772042 - DNA, 20 bp, mouse
gcctcaagtgagggaaggag

SEQ ID NO: 772043 - DNA, 20 bp, mouse
gtcaatacaattagttaatc

SEQ ID NO: 772044 - DNA, 20 bp, mouse
gatttaagctcttattgata

SEQ ID NO: 772045 - DNA, 20 bp, mouse
gtcttctatacctaatatct

SEQ ID NO: 772046 - DNA, 20 bp, mouse
gtgactgcatgatcagagga

SEQ ID NO: 772047 - DNA, 20 bp, mouse
gaaatagtctgcttggatga

SEQ ID NO: 772048 - DNA, 20 bp, mouse
gcagatgactgcatgatcag

SEQ ID NO: 772049 - DNA, 20 bp, mouse
gatactgatcagaacatttt

SEQ ID NO: 772050 - DNA, 20 bp, mouse
gctgcttggatgagggatga

SEQ ID NO: 772051 - DNA, 20 bp, mouse
ggcagtcatctgttgtccca

SEQ ID NO: 772052 - DNA, 20 bp, mouse
gctatttctcctgtttcctt

SEQ ID NO: 772053 - DNA, 20 bp, mouse
ggtttttaagctaaatttca

SEQ ID NO: 772054 - DNA, 20 bp, mouse
gagagacttaaaggattctg

SEQ ID NO: 772055 - DNA, 20 bp, mouse
gtgggagatagacagagagc

SEQ ID NO: 772056 - DNA, 20 bp, mouse
gaggtctgtagcacggtcta

SEQ ID NO: 772057 - DNA, 20 bp, mouse
gctgagataccaaaatgcat

SEQ ID NO: 772058 - DNA, 20 bp, mouse
gtaggaagaagctgaatgtg

SEQ ID NO: 772059 - DNA, 20 bp, mouse
ggaacatatacgtaagacaa

SEQ ID NO: 772060 - DNA, 20 bp, mouse
gaatgcaaaaaaactgacag

SEQ ID NO: 772061 - DNA, 20 bp, mouse
gtcttaggtctcagtgaaga

SEQ ID NO: 772062 - DNA, 20 bp, mouse
ggaggaatctgctgtttacg

SEQ ID NO: 772063 - DNA, 20 bp, mouse
gcattttattatatatttac

SEQ ID NO: 772064 - DNA, 20 bp, mouse
ggtttacgaggtctgtagca

SEQ ID NO: 772065 - DNA, 20 bp, mouse
gtgaatgtggggattttgtg

SEQ ID NO: 772066 - DNA, 20 bp, mouse
gaaaactggctaatcactga

SEQ ID NO: 772067 - DNA, 20 bp, mouse
gtggccctagttgtatatgt

SEQ ID NO: 772068 - DNA, 20 bp, mouse
gggagaagctggcatatagg

SEQ ID NO: 772069 - DNA, 20 bp, mouse
gtaggggaggaggatttcgg

SEQ ID NO: 772070 - DNA, 20 bp, mouse
gaaggtaagaaaagacataa

SEQ ID NO: 772071 - DNA, 20 bp, mouse
gagctggcatataggaggag

SEQ ID NO: 772072 - DNA, 20 bp, mouse
gggggatggtataggggagg

SEQ ID NO: 772073 - DNA, 20 bp, mouse
gaatatgttatgttgaaaac

SEQ ID NO: 772074 - DNA, 20 bp, mouse
gaaagacataagggacttcc

SEQ ID NO: 772075 - DNA, 20 bp, mouse
gcccactcccattctggccc

SEQ ID NO: 772076 - DNA, 20 bp, mouse
gggaacacttacttaaagag

SEQ ID NO: 772077 - DNA, 20 bp, mouse
gaattagtcttcttatggaa

SEQ ID NO: 772078 - DNA, 20 bp, mouse
ggtgtgatcacttatttctt

SEQ ID NO: 772079 - DNA, 20 bp, mouse
ggtgtgtctgttaattagag

SEQ ID NO: 772080 - DNA, 20 bp, mouse
gtcaccatgtacccaagtgt

SEQ ID NO: 772081 - DNA, 20 bp, mouse
gtctgtctcttttgtgagta

SEQ ID NO: 772082 - DNA, 20 bp, mouse
gattctgctccacaaatgta

SEQ ID NO: 772083 - DNA, 20 bp, mouse
gatagactcagcccacactt

SEQ ID NO: 772084 - DNA, 20 bp, mouse
gcagcccacacttgggtaca

SEQ ID NO: 772085 - DNA, 20 bp, mouse
ggtacatggtgactgtccat

SEQ ID NO: 772086 - DNA, 20 bp, mouse
gtggaaacatccacatgcgc

SEQ ID NO: 772087 - DNA, 20 bp, mouse
gtccagagactgaagttagg

SEQ ID NO: 772088 - DNA, 20 bp, mouse
ggaagttaggtggtcagcca

SEQ ID NO: 772089 - DNA, 20 bp, mouse
ggactacagttataaaaatg

SEQ ID NO: 772090 - DNA, 20 bp, mouse
gtaaaaagctaagtatgtat

SEQ ID NO: 772091 - DNA, 20 bp, mouse
gtgaagtgcatcacctaaga

SEQ ID NO: 772092 - DNA, 20 bp, mouse
gagtctctggactcgcatag

SEQ ID NO: 772093 - DNA, 20 bp, mouse
gtcacctaagatggagcctt

SEQ ID NO: 772094 - DNA, 20 bp, mouse
gttgactttcacatgcactt

SEQ ID NO: 772095 - DNA, 20 bp, mouse
ggtctgtgtgcccgcgcatg

SEQ ID NO: 772096 - DNA, 20 bp, mouse
ggggaaaggtcctgcttcaa

SEQ ID NO: 772097 - DNA, 20 bp, mouse
gacaagctacaggagtgcac

SEQ ID NO: 772098 - DNA, 20 bp, mouse
gctacatgagcaacaggcaa

SEQ ID NO: 772099 - DNA, 20 bp, mouse
gatccctgacatgttatgta

SEQ ID NO: 772100 - DNA, 20 bp, mouse
gcatgagcaacaggcaatgg

SEQ ID NO: 772101 - DNA, 20 bp, mouse
ggctactctgtgacctcttc

SEQ ID NO: 772102 - DNA, 20 bp, mouse
gtggtgttatgcaagtgttg

SEQ ID NO: 772103 - DNA, 20 bp, mouse
gtagccctacataacatgtc

SEQ ID NO: 772104 - DNA, 20 bp, mouse
gcatgtagggtagccagaag

SEQ ID NO: 772105 - DNA, 20 bp, mouse
gctaataaagcttgagttcc

SEQ ID NO: 772106 - DNA, 20 bp, mouse
gctaagaaaaaagtggggat

SEQ ID NO: 772107 - DNA, 20 bp, mouse
gaatgagtgggctttaagaa

SEQ ID NO: 772108 - DNA, 20 bp, mouse
gttcttagattcgtggtata

SEQ ID NO: 772109 - DNA, 20 bp, mouse
gcacgaatctaagaaaaaag

SEQ ID NO: 772110 - DNA, 20 bp, mouse
gctcaatatttgtgtgaaat

SEQ ID NO: 772111 - DNA, 20 bp, mouse
gaatatgtgtaacaacaatc

SEQ ID NO: 772112 - DNA, 20 bp, mouse
gggaaggagaataaatgagt

SEQ ID NO: 772113 - DNA, 20 bp, mouse
gaacactaagcaaaagttca

SEQ ID NO: 772114 - DNA, 20 bp, mouse
gtgagaaaatgaataattca

SEQ ID NO: 772115 - DNA, 20 bp, mouse
gtgtctgtatatcattttat

SEQ ID NO: 772116 - DNA, 20 bp, mouse
gggcaaggggatagtctagg

SEQ ID NO: 772117 - DNA, 20 bp, mouse
gaggggcaaggggatagtct

SEQ ID NO: 772118 - DNA, 20 bp, mouse
ggggttgtggaaaaaaaaca

SEQ ID NO: 772119 - DNA, 20 bp, mouse
gggatagtctaggggggttg

SEQ ID NO: 772120 - DNA, 20 bp, mouse
ggaagatatgtagagattct

SEQ ID NO: 772121 - DNA, 20 bp, mouse
gagccttgtctgtgatcaat

SEQ ID NO: 772122 - DNA, 20 bp, mouse
gtataggggaaatgccagag

SEQ ID NO: 772123 - DNA, 20 bp, mouse
gctaataaaagcaggggcaa

SEQ ID NO: 772124 - DNA, 20 bp, mouse
gaatgccagagtggtgaagt

SEQ ID NO: 772125 - DNA, 20 bp, mouse
gggcaccctaataaaagcag

SEQ ID NO: 772126 - DNA, 20 bp, mouse
gatcctaaaaaagatcgtta

SEQ ID NO: 772127 - DNA, 20 bp, mouse
gaagatcgttagggttgaaa

SEQ ID NO: 772128 - DNA, 20 bp, mouse
gaaccctaacgatctttttt

SEQ ID NO: 772129 - DNA, 20 bp, mouse
ggatcttttttaggatattg

SEQ ID NO: 772130 - DNA, 20 bp, mouse
gtagggttgaaaaggatata

SEQ ID NO: 772131 - DNA, 20 bp, mouse
gttttttaggatattgtggc

SEQ ID NO: 772132 - DNA, 20 bp, mouse
ggttagcatagagataatgg

SEQ ID NO: 772133 - DNA, 20 bp, mouse
gtaatgggggcgttcctttg

SEQ ID NO: 772134 - DNA, 20 bp, mouse
gaatgtgcatcgatttgaat

SEQ ID NO: 772135 - DNA, 20 bp, mouse
gcacaggagccatgaggtct

SEQ ID NO: 772136 - DNA, 20 bp, mouse
gatcgtatcgtctacataca

SEQ ID NO: 772137 - DNA, 20 bp, mouse
gccagaataagtgaactttc

SEQ ID NO: 772138 - DNA, 20 bp, mouse
gaaaaccttaatgctattta

SEQ ID NO: 772139 - DNA, 20 bp, mouse
gtaagactgagataggattt

SEQ ID NO: 772140 - DNA, 20 bp, mouse
gtgtaccaataagtcaagag

SEQ ID NO: 772141 - DNA, 20 bp, mouse
gatgacctctcttgacttat

SEQ ID NO: 772142 - DNA, 20 bp, mouse
gcataaatgaatgcataact

SEQ ID NO: 772143 - DNA, 20 bp, mouse
gctatgtccaaatgcaaagg

SEQ ID NO: 772144 - DNA, 20 bp, mouse
gtagtaaagcttgacaactt

SEQ ID NO: 772145 - DNA, 20 bp, mouse
gtcatccataaatagcatta

SEQ ID NO: 772146 - DNA, 20 bp, mouse
ggaggatagcaaggtactaa

SEQ ID NO: 772147 - DNA, 20 bp, mouse
gaccactcatgtgaactctg

SEQ ID NO: 772148 - DNA, 20 bp, mouse
gaagatacatagccaggaca

SEQ ID NO: 772149 - DNA, 20 bp, mouse
gtcctcagagttcacatgag

SEQ ID NO: 772150 - DNA, 20 bp, mouse
gcataaaaccatccttgtcc

SEQ ID NO: 772151 - DNA, 20 bp, mouse
gctcagtatagtaaggagaa

SEQ ID NO: 772152 - DNA, 20 bp, mouse
ggacagatacatgcattatt

SEQ ID NO: 772153 - DNA, 20 bp, mouse
gctatgtatcttgaaactga

SEQ ID NO: 772154 - DNA, 20 bp, mouse
gcattattaggaggatagca

SEQ ID NO: 772155 - DNA, 20 bp, mouse
gaagtattctcatttgactg

SEQ ID NO: 772156 - DNA, 20 bp, mouse
gactaaaagaagtcatccag

SEQ ID NO: 772157 - DNA, 20 bp, mouse
gtgactggaggctaaataat

SEQ ID NO: 772158 - DNA, 20 bp, mouse
gaggacaaagtcactctttg

SEQ ID NO: 772159 - DNA, 20 bp, mouse
gtagtcccattcatgactgg

SEQ ID NO: 772160 - DNA, 20 bp, mouse
gttagcctccagtcatgaat

SEQ ID NO: 772161 - DNA, 20 bp, mouse
gcaaagtcactctttgtggg

SEQ ID NO: 772162 - DNA, 20 bp, mouse
gttcctctcagcattatctc

SEQ ID NO: 772163 - DNA, 20 bp, mouse
gatgctgagaggaatgttgc

SEQ ID NO: 772164 - DNA, 20 bp, mouse
ggcaagtcctaaatcaccta

SEQ ID NO: 772165 - DNA, 20 bp, mouse
gaagtggtaatcatgttctt

SEQ ID NO: 772166 - DNA, 20 bp, mouse
gcaggaaatgggactttttg

SEQ ID NO: 772167 - DNA, 20 bp, mouse
gggaacttcagttctcactc

SEQ ID NO: 772168 - DNA, 20 bp, mouse
gcatgctaggatagcataat

SEQ ID NO: 772169 - DNA, 20 bp, mouse
gagaaggctccagaaacaca

SEQ ID NO: 772170 - DNA, 20 bp, mouse
gagttcctgcttactaaact

SEQ ID NO: 772171 - DNA, 20 bp, mouse
gggttctcctagactttatt

SEQ ID NO: 772172 - DNA, 20 bp, mouse
gtagactttattaggaatta

SEQ ID NO: 772173 - DNA, 20 bp, mouse
gaccttctcaggacagtgaa

SEQ ID NO: 772174 - DNA, 20 bp, mouse
gtcacttttttctggatgca

SEQ ID NO: 772175 - DNA, 20 bp, mouse
gggcaccaagtttagtaagc

SEQ ID NO: 772176 - DNA, 20 bp, mouse
gacactgagtggttgccctg

SEQ ID NO: 772177 - DNA, 20 bp, mouse
gggcaaccactcagtgtatg

SEQ ID NO: 772178 - DNA, 20 bp, mouse
ggatttagtatcatagatat

SEQ ID NO: 772179 - DNA, 20 bp, mouse
gtacaggagaataagattgt

SEQ ID NO: 772180 - DNA, 20 bp, mouse
gtaggaaaatgctgatatac

SEQ ID NO: 772181 - DNA, 20 bp, mouse
gtctgctgaggtatttggaa

SEQ ID NO: 772182 - DNA, 20 bp, mouse
gtattgcctcatacactgag

SEQ ID NO: 772183 - DNA, 20 bp, mouse
gtgctacagtcctgtgacaa

SEQ ID NO: 772184 - DNA, 20 bp, mouse
gtaagattatcagattctgg

SEQ ID NO: 772185 - DNA, 20 bp, mouse
gttttgcttcatctaccaca

SEQ ID NO: 772186 - DNA, 20 bp, mouse
gaactgggagacaagtttga

SEQ ID NO: 772187 - DNA, 20 bp, mouse
gagaacaggtatgctcatat

SEQ ID NO: 772188 - DNA, 20 bp, mouse
gggagatgaaaagaatgcat

SEQ ID NO: 772189 - DNA, 20 bp, mouse
ggagataaattagatgttca

SEQ ID NO: 772190 - DNA, 20 bp, mouse
gatcagaattcacacctaac

SEQ ID NO: 772191 - DNA, 20 bp, mouse
gttattcagaaaaggagtaa

SEQ ID NO: 772192 - DNA, 20 bp, mouse
gagtaaaaattgctactgac

SEQ ID NO: 772193 - DNA, 20 bp, mouse
gtagaaattttgctctaagg

SEQ ID NO: 772194 - DNA, 20 bp, mouse
gcaataaaatttcctccata

SEQ ID NO: 772195 - DNA, 20 bp, mouse
gtttattttcatatgagaac

SEQ ID NO: 772196 - DNA, 20 bp, mouse
gctagtctcagaaatttgtt

SEQ ID NO: 772197 - DNA, 20 bp, mouse
gagaaaatacatagttgacc

SEQ ID NO: 772198 - DNA, 20 bp, mouse
gtttcagcggtcctagaaga

SEQ ID NO: 772199 - DNA, 20 bp, mouse
gagcatttcttctttttcag

SEQ ID NO: 772200 - DNA, 20 bp, mouse
gcaaatttctgagactagct

SEQ ID NO: 772201 - DNA, 20 bp, mouse
gtatatttaagtatccaaac

SEQ ID NO: 772202 - DNA, 20 bp, mouse
gttatagtatttttccagtt

SEQ ID NO: 772203 - DNA, 20 bp, mouse
gaagacactgagaagagttg

SEQ ID NO: 772204 - DNA, 20 bp, mouse
gaatgactggctctttccat

SEQ ID NO: 772205 - DNA, 20 bp, mouse
ggtcctagaagaaggacata

SEQ ID NO: 772206 - DNA, 20 bp, mouse
ggaaagaggtctcttatatc

SEQ ID NO: 772207 - DNA, 20 bp, mouse
gaacagaatgagaaggacga

SEQ ID NO: 772208 - DNA, 20 bp, mouse
ggaccctttggtttctgaaa

SEQ ID NO: 772209 - DNA, 20 bp, mouse
ggtggagatactttcctctt

SEQ ID NO: 772210 - DNA, 20 bp, mouse
gtaaacataacttgaccctt

SEQ ID NO: 772211 - DNA, 20 bp, mouse
ggtgacctagaagctttccc

SEQ ID NO: 772212 - DNA, 20 bp, mouse
gtgaaaagatagacaagcct

SEQ ID NO: 772213 - DNA, 20 bp, mouse
gtaccttttcagaaaccaaa

SEQ ID NO: 772214 - DNA, 20 bp, mouse
gtttaaagtttggaaatgat

SEQ ID NO: 772215 - DNA, 20 bp, mouse
gcatttaaagaatcttcacc

SEQ ID NO: 772216 - DNA, 20 bp, mouse
gaagtgatgataccaagtaa

SEQ ID NO: 772217 - DNA, 20 bp, mouse
gagctagaggaatataaaga

SEQ ID NO: 772218 - DNA, 20 bp, mouse
ggcagaaacatatgagctag

SEQ ID NO: 772219 - DNA, 20 bp, mouse
gaagagaacaaggtgagaca

SEQ ID NO: 772220 - DNA, 20 bp, mouse
gccacacaaaactcatggag

SEQ ID NO: 772221 - DNA, 20 bp, mouse
gaatcttgtgagttttagac

SEQ ID NO: 772222 - DNA, 20 bp, mouse
gcatgagttttgtgtggtgt

SEQ ID NO: 772223 - DNA, 20 bp, mouse
gtatgagtgaagaagagaag

SEQ ID NO: 772224 - DNA, 20 bp, mouse
gttggtatcatcacttcatc

SEQ ID NO: 772225 - DNA, 20 bp, mouse
gacaggaaggaaaatctaaa

SEQ ID NO: 772226 - DNA, 20 bp, mouse
ggtgcgaaggataggattat

SEQ ID NO: 772227 - DNA, 20 bp, mouse
gcacttcagtggttaacgga

SEQ ID NO: 772228 - DNA, 20 bp, mouse
gttgttgtgggttaaacaaa

SEQ ID NO: 772229 - DNA, 20 bp, mouse
gtcagggctaaccacttcag

SEQ ID NO: 772230 - DNA, 20 bp, mouse
gaacctactgtgcgaaggat

SEQ ID NO: 772231 - DNA, 20 bp, mouse
gatcctatccttcgcacagt

SEQ ID NO: 772232 - DNA, 20 bp, mouse
gaacaaaggtgtgaaagtga

SEQ ID NO: 772233 - DNA, 20 bp, mouse
gttgcaaacctactgtgcga

SEQ ID NO: 772234 - DNA, 20 bp, mouse
gcacagtaggtttgcaacaa

SEQ ID NO: 772235 - DNA, 20 bp, mouse
gacagctcatgctaaaactc

SEQ ID NO: 772236 - DNA, 20 bp, mouse
gtgtagattgtcttggcaat

SEQ ID NO: 772237 - DNA, 20 bp, mouse
gacaatctacagatgatttc

SEQ ID NO: 772238 - DNA, 20 bp, mouse
gataactgctcagttgagtg

SEQ ID NO: 772239 - DNA, 20 bp, mouse
gtggatgacacaacagacaa

SEQ ID NO: 772240 - DNA, 20 bp, mouse
gaggccacagtgaagtaacc

SEQ ID NO: 772241 - DNA, 20 bp, mouse
gaatcatctgtagattgtct

SEQ ID NO: 772242 - DNA, 20 bp, mouse
gaaacctggttacttcactg

SEQ ID NO: 772243 - DNA, 20 bp, mouse
gttttactgcaaacagtacc

SEQ ID NO: 772244 - DNA, 20 bp, mouse
gcacatgcaaaatcttttgt

SEQ ID NO: 772245 - DNA, 20 bp, mouse
ggtggatcactgaagagctg

SEQ ID NO: 772246 - DNA, 20 bp, mouse
gcatacaaggatgtgagtca

SEQ ID NO: 772247 - DNA, 20 bp, mouse
ggttcttggtagagactcat

SEQ ID NO: 772248 - DNA, 20 bp, mouse
gcctaaaatcagcaatggca

SEQ ID NO: 772249 - DNA, 20 bp, mouse
gcacttcctggcacaattct

SEQ ID NO: 772250 - DNA, 20 bp, mouse
ggtgtcagttagcaaagtga

SEQ ID NO: 772251 - DNA, 20 bp, mouse
gatgtgagtcaaggaaactt

SEQ ID NO: 772252 - DNA, 20 bp, mouse
gtcacatatattatcttctt

SEQ ID NO: 772253 - DNA, 20 bp, mouse
gaattatgagacgcagagac

SEQ ID NO: 772254 - DNA, 20 bp, mouse
gctttcaagtgaggtcattt

SEQ ID NO: 772255 - DNA, 20 bp, mouse
gcatctattagtgacatatt

SEQ ID NO: 772256 - DNA, 20 bp, mouse
ggacacctactgtctcagat

SEQ ID NO: 772257 - DNA, 20 bp, mouse
gtggactgcaccaggagact

SEQ ID NO: 772258 - DNA, 20 bp, mouse
ggctctggatgccatggctg

SEQ ID NO: 772259 - DNA, 20 bp, mouse
ggatgggtacctgggtgcgg

SEQ ID NO: 772260 - DNA, 20 bp, mouse
ggtggggaaagggcctgctc

SEQ ID NO: 772261 - DNA, 20 bp, mouse
ggtatgagacccccgcaccc

SEQ ID NO: 772262 - DNA, 20 bp, mouse
gtatgtcacacatctcacat

SEQ ID NO: 772263 - DNA, 20 bp, mouse
gaagaggcatgagcattttt

SEQ ID NO: 772264 - DNA, 20 bp, mouse
ggtccgccaagaaaggacaa

SEQ ID NO: 772265 - DNA, 20 bp, mouse
gaaaaagagtccgccaagaa

SEQ ID NO: 772266 - DNA, 20 bp, mouse
gacagtatggaaagagttta

SEQ ID NO: 772267 - DNA, 20 bp, mouse
ggatctgacaacattctccc

SEQ ID NO: 772268 - DNA, 20 bp, mouse
gtgtagagttttttctctgg

SEQ ID NO: 772269 - DNA, 20 bp, mouse
gttctccctggagttttgga

SEQ ID NO: 772270 - DNA, 20 bp, mouse
ggattgtagagttttttctc

SEQ ID NO: 772271 - DNA, 20 bp, mouse
gcaagaatggcccattctga

SEQ ID NO: 772272 - DNA, 20 bp, mouse
gaataactggcacttacatt

SEQ ID NO: 772273 - DNA, 20 bp, mouse
gttcttcaattctacactgg

SEQ ID NO: 772274 - DNA, 20 bp, mouse
ggccagttattccttcagaa

SEQ ID NO: 772275 - DNA, 20 bp, mouse
gcattcataataacacagta

SEQ ID NO: 772276 - DNA, 20 bp, mouse
gtggatagatagtcacatgg

SEQ ID NO: 772277 - DNA, 20 bp, mouse
gaagaagtcaggtgtataat

SEQ ID NO: 772278 - DNA, 20 bp, mouse
gagtttgaaaacatcaattt

SEQ ID NO: 772279 - DNA, 20 bp, mouse
gatagtcacatggtggcagt

SEQ ID NO: 772280 - DNA, 20 bp, mouse
gaactgtgattctgagtgag

SEQ ID NO: 772281 - DNA, 20 bp, mouse
gcaataacatacattactgt

SEQ ID NO: 772282 - DNA, 20 bp, mouse
gatatggatagatagtcaca

SEQ ID NO: 772283 - DNA, 20 bp, mouse
ggtataatgggtaattagcc

SEQ ID NO: 772284 - DNA, 20 bp, mouse
ggagttcatttcttaatctc

SEQ ID NO: 772285 - DNA, 20 bp, mouse
gctttttcgtgagaaaatgt

SEQ ID NO: 772286 - DNA, 20 bp, mouse
gatagcactggtggtaacaa

SEQ ID NO: 772287 - DNA, 20 bp, mouse
gcgactccgtaaatactgca

SEQ ID NO: 772288 - DNA, 20 bp, mouse
gtgggtacattaagttactt

SEQ ID NO: 772289 - DNA, 20 bp, mouse
gcagactagaattacagact

SEQ ID NO: 772290 - DNA, 20 bp, mouse
ggcttgttagtactgactaa

SEQ ID NO: 772291 - DNA, 20 bp, mouse
ggtacttcagtgagtgtgtt

SEQ ID NO: 772292 - DNA, 20 bp, mouse
gtgtctagtcgctgtgtttg

SEQ ID NO: 772293 - DNA, 20 bp, mouse
gctgttactagccagcaatt

SEQ ID NO: 772294 - DNA, 20 bp, mouse
gacttaatgtacccaattgc

SEQ ID NO: 772295 - DNA, 20 bp, mouse
gcaccagtgctatcattatt

SEQ ID NO: 772296 - DNA, 20 bp, mouse
gccacgaagtcaccagtaaa

SEQ ID NO: 772297 - DNA, 20 bp, mouse
gtctctcgctccatcttaac

SEQ ID NO: 772298 - DNA, 20 bp, mouse
gcctagagagatgctcacaa

SEQ ID NO: 772299 - DNA, 20 bp, mouse
gtccatcttaacaggaggaa

SEQ ID NO: 772300 - DNA, 20 bp, mouse
gcagcaagttcaccatttac

SEQ ID NO: 772301 - DNA, 20 bp, mouse
gagagatgctcacaatggtt

SEQ ID NO: 772302 - DNA, 20 bp, mouse
gctcgctccatcttaacagg

SEQ ID NO: 772303 - DNA, 20 bp, mouse
gaaagccaaagttcatatga

SEQ ID NO: 772304 - DNA, 20 bp, mouse
gtgtagttttgcaataaggg

SEQ ID NO: 772305 - DNA, 20 bp, mouse
gctgtgagaaaatttaaagc

SEQ ID NO: 772306 - DNA, 20 bp, mouse
gctcccaagcatcgtttttg

SEQ ID NO: 772307 - DNA, 20 bp, mouse
gatagaacagggtattatgc

SEQ ID NO: 772308 - DNA, 20 bp, mouse
ggagaaagcactatagaaca

SEQ ID NO: 772309 - DNA, 20 bp, mouse
ggcgagccaagcatcgagtg

SEQ ID NO: 772310 - DNA, 20 bp, mouse
gatacccaacatgactctga

SEQ ID NO: 772311 - DNA, 20 bp, mouse
gtcccccaaaaacgatgctt

SEQ ID NO: 772312 - DNA, 20 bp, mouse
gattccatcagagtcatgtt

SEQ ID NO: 772313 - DNA, 20 bp, mouse
gtggtccctcttaaactaac

SEQ ID NO: 772314 - DNA, 20 bp, mouse
gtagtgagcaaaagtctact

SEQ ID NO: 772315 - DNA, 20 bp, mouse
ggtctcctgttagtttaaga

SEQ ID NO: 772316 - DNA, 20 bp, mouse
gtcaacagagatacaggtaa

SEQ ID NO: 772317 - DNA, 20 bp, mouse
gaagtgtctgagtaagcgga

SEQ ID NO: 772318 - DNA, 20 bp, mouse
ggctcctcaccggcatttac

SEQ ID NO: 772319 - DNA, 20 bp, mouse
ggggcagctctaagatgcct

SEQ ID NO: 772320 - DNA, 20 bp, mouse
gaaatcaatgatgagctaac

SEQ ID NO: 772321 - DNA, 20 bp, mouse
gacagtgctcacaagcttca

SEQ ID NO: 772322 - DNA, 20 bp, mouse
ggaaccgtaaagagtgcagt

SEQ ID NO: 772323 - DNA, 20 bp, mouse
gtttcctgtaaatgccggtg

SEQ ID NO: 772324 - DNA, 20 bp, mouse
gagctaagtgtctgagtaag

SEQ ID NO: 772325 - DNA, 20 bp, mouse
gaatggagttggccgtggta

SEQ ID NO: 772326 - DNA, 20 bp, mouse
gggagctagaaaagggccca

SEQ ID NO: 772327 - DNA, 20 bp, mouse
ggtaggggagaagagataga

SEQ ID NO: 772328 - DNA, 20 bp, mouse
ggagggaaggtgtttttcag

SEQ ID NO: 772329 - DNA, 20 bp, mouse
ggaggatggtcatcaatggg

SEQ ID NO: 772330 - DNA, 20 bp, mouse
ggtgggtgggtttggtgagc

SEQ ID NO: 772331 - DNA, 20 bp, mouse
gatctacttttgtacttgtc

SEQ ID NO: 772332 - DNA, 20 bp, mouse
ggtgtgtgtgtttttttaat

SEQ ID NO: 772333 - DNA, 20 bp, mouse
ggcagaggatggtcatcaat

SEQ ID NO: 772334 - DNA, 20 bp, mouse
gggtttggtgagcaggggta

SEQ ID NO: 772335 - DNA, 20 bp, mouse
ggggagaagagatagaggga

SEQ ID NO: 772336 - DNA, 20 bp, mouse
ggctccggagataccttctt

SEQ ID NO: 772337 - DNA, 20 bp, mouse
ggctcccaagaaggtatctc

SEQ ID NO: 772338 - DNA, 20 bp, mouse
ggataccttcttgggagcac

SEQ ID NO: 772339 - DNA, 20 bp, mouse
ggtagccggtgctcccaaga

SEQ ID NO: 772340 - DNA, 20 bp, mouse
gaaggtatctccggagctag

SEQ ID NO: 772341 - DNA, 20 bp, mouse
gggactcggagtctgaacag

SEQ ID NO: 772342 - DNA, 20 bp, mouse
gagtcacaaataggtgtgag

SEQ ID NO: 772343 - DNA, 20 bp, mouse
ggccaaagtgccttccttca

SEQ ID NO: 772344 - DNA, 20 bp, mouse
gtcccctgaaccctgggact

SEQ ID NO: 772345 - DNA, 20 bp, mouse
gtacaaggacgttttcaagt

SEQ ID NO: 772346 - DNA, 20 bp, mouse
gaaaaagcccaagggtgggt

SEQ ID NO: 772347 - DNA, 20 bp, mouse
gtgagtaggagtatgagctg

SEQ ID NO: 772348 - DNA, 20 bp, mouse
gccaagggtgggtgggttac

SEQ ID NO: 772349 - DNA, 20 bp, mouse
gggaagcagtgaagtaagta

SEQ ID NO: 772350 - DNA, 20 bp, mouse
gggtagctaaggtgcattaa

SEQ ID NO: 772351 - DNA, 20 bp, mouse
gagagaaaaagcccaagggt

SEQ ID NO: 772352 - DNA, 20 bp, mouse
gctgagacagggatttaagc

SEQ ID NO: 772353 - DNA, 20 bp, mouse
ggtatgagctggggtagcta

SEQ ID NO: 772354 - DNA, 20 bp, mouse
gtaaaaatgaactccctggc

SEQ ID NO: 772355 - DNA, 20 bp, mouse
gagatagagaaaaagcccaa

SEQ ID NO: 772356 - DNA, 20 bp, mouse
gaccaacagtggatgaaatt

SEQ ID NO: 772357 - DNA, 20 bp, mouse
ggcactaccagctcttacaa

SEQ ID NO: 772358 - DNA, 20 bp, mouse
gcatcgtggaaaaggaggtc

SEQ ID NO: 772359 - DNA, 20 bp, mouse
gatcatgtctggaccaacag

SEQ ID NO: 772360 - DNA, 20 bp, mouse
gcaacagcccatgtcagagg

SEQ ID NO: 772361 - DNA, 20 bp, mouse
gaaagaaggcatcgtggaaa

SEQ ID NO: 772362 - DNA, 20 bp, mouse
gggggaaagaattgccaaca

SEQ ID NO: 772363 - DNA, 20 bp, mouse
gagcgtttggtctgcagaga

SEQ ID NO: 772364 - DNA, 20 bp, mouse
gtgaaaaaaagaaggcatcg

SEQ ID NO: 772365 - DNA, 20 bp, mouse
ggaaggcatcgtggaaaagg

SEQ ID NO: 772366 - DNA, 20 bp, mouse
gtgggccgccctgtatcaat

SEQ ID NO: 772367 - DNA, 20 bp, mouse
gtaggcagggatttaaggca

SEQ ID NO: 772368 - DNA, 20 bp, mouse
gtgcggacagtggcaagttt

SEQ ID NO: 772369 - DNA, 20 bp, mouse
gcccagcccactgcggacag

SEQ ID NO: 772370 - DNA, 20 bp, mouse
gactgcctattgatacaggg

SEQ ID NO: 772371 - DNA, 20 bp, mouse
ggtatgttcgggtttgtgtc

SEQ ID NO: 772372 - DNA, 20 bp, mouse
gctaactgcctattgataca

SEQ ID NO: 772373 - DNA, 20 bp, mouse
gaaaatgctattgtaggctg

SEQ ID NO: 772374 - DNA, 20 bp, mouse
gccgaacataccagggaaga

SEQ ID NO: 772375 - DNA, 20 bp, mouse
gtgccacagatgtgtccaca

SEQ ID NO: 772376 - DNA, 20 bp, mouse
gcatgagcctggcctcacaa

SEQ ID NO: 772377 - DNA, 20 bp, mouse
gcccagggacacacttggaa

SEQ ID NO: 772378 - DNA, 20 bp, mouse
gtgggtgccaagctgtctgg

SEQ ID NO: 772379 - DNA, 20 bp, mouse
gactaagtgggcaagagtta

SEQ ID NO: 772380 - DNA, 20 bp, mouse
gatggcagtcagctgtgtta

SEQ ID NO: 772381 - DNA, 20 bp, mouse
gcattggggagattttctgt

SEQ ID NO: 772382 - DNA, 20 bp, mouse
ggatcatatttgctatctat

SEQ ID NO: 772383 - DNA, 20 bp, mouse
gtatggtgctggcacagtgt

SEQ ID NO: 772384 - DNA, 20 bp, mouse
gtgccagcaccataatgtag

SEQ ID NO: 772385 - DNA, 20 bp, mouse
gtgtcacccaccagacagct

SEQ ID NO: 772386 - DNA, 20 bp, mouse
gcatgagcctggcctcacaa

SEQ ID NO: 772387 - DNA, 20 bp, mouse
gtgggtgccaagctgtctgg

SEQ ID NO: 772388 - DNA, 20 bp, mouse
gcccagggacacacttggaa

SEQ ID NO: 772389 - DNA, 20 bp, mouse
gactaagtgggcaagagtta

SEQ ID NO: 772390 - DNA, 20 bp, mouse
ggatcatatttgctatctat

SEQ ID NO: 772391 - DNA, 20 bp, mouse
gatggcagtcagctgtgtta

SEQ ID NO: 772392 - DNA, 20 bp, mouse
gcattggggagattttctgt

SEQ ID NO: 772393 - DNA, 20 bp, mouse
gtatggtgctggcacagtgt

SEQ ID NO: 772394 - DNA, 20 bp, mouse
gatttcaaggctcccttgtg

SEQ ID NO: 772395 - DNA, 20 bp, mouse
gtgccagcaccataatgtag

SEQ ID NO: 772396 - DNA, 20 bp, mouse
gtattattatcgcatagcgt

SEQ ID NO: 772397 - DNA, 20 bp, mouse
gataataataattaagatag

SEQ ID NO: 772398 - DNA, 20 bp, mouse
gttgctggggaacttttggt

SEQ ID NO: 772399 - DNA, 20 bp, mouse
gttctcccagacatttaaag

SEQ ID NO: 772400 - DNA, 20 bp, mouse
ggaatcctctttaaatgtct

SEQ ID NO: 772401 - DNA, 20 bp, mouse
gtacaattctctgattacct

SEQ ID NO: 772402 - DNA, 20 bp, mouse
ggttattgctggggaacttt

SEQ ID NO: 772403 - DNA, 20 bp, mouse
gaggcccctcaaaccacttg

SEQ ID NO: 772404 - DNA, 20 bp, mouse
ggggcctcatagcatgaatt

SEQ ID NO: 772405 - DNA, 20 bp, mouse
gcacttgaggattcaacaaa

SEQ ID NO: 772406 - DNA, 20 bp, mouse
gggcccacctggaataaact

SEQ ID NO: 772407 - DNA, 20 bp, mouse
gccaggtgggccatgtccac

SEQ ID NO: 772408 - DNA, 20 bp, mouse
gatgtccacgggctattata

SEQ ID NO: 772409 - DNA, 20 bp, mouse
ggcttccctaaggatagaat

SEQ ID NO: 772410 - DNA, 20 bp, mouse
gaaactaaataatttgatat

SEQ ID NO: 772411 - DNA, 20 bp, mouse
gtattggccaagtttattcc

SEQ ID NO: 772412 - DNA, 20 bp, mouse
gtattcccattctatcctta

SEQ ID NO: 772413 - DNA, 20 bp, mouse
gtggccaagtttattccagg

SEQ ID NO: 772414 - DNA, 20 bp, mouse
ggccaaagtaaggaatacat

SEQ ID NO: 772415 - DNA, 20 bp, mouse
gagaagtttgaacttgacta

SEQ ID NO: 772416 - DNA, 20 bp, mouse
gaccttcagactgtgtctaa

SEQ ID NO: 772417 - DNA, 20 bp, mouse
ggggcattttggcccaatta

SEQ ID NO: 772418 - DNA, 20 bp, mouse
gaccattagacacagtctga

SEQ ID NO: 772419 - DNA, 20 bp, mouse
gatgaaataggcatagatta

SEQ ID NO: 772420 - DNA, 20 bp, mouse
gacttaggtgatacaatgtc

SEQ ID NO: 772421 - DNA, 20 bp, mouse
gttgggccaaaatgcccaga

SEQ ID NO: 772422 - DNA, 20 bp, mouse
gaaattccatctgggcattt

SEQ ID NO: 772423 - DNA, 20 bp, mouse
gtaattttatagactcaaat

SEQ ID NO: 772424 - DNA, 20 bp, mouse
gtagaacacagcccttaatt

SEQ ID NO: 772425 - DNA, 20 bp, mouse
gtctaagagtctttgtactc

SEQ ID NO: 772426 - DNA, 20 bp, mouse
gtataccagcccttttagtt

SEQ ID NO: 772427 - DNA, 20 bp, mouse
gcccagaagcatctaacatg

SEQ ID NO: 772428 - DNA, 20 bp, mouse
gaatataaagtcatgtaata

SEQ ID NO: 772429 - DNA, 20 bp, mouse
gttgacgactcccaactaaa

SEQ ID NO: 772430 - DNA, 20 bp, mouse
gcattcttagttttaatacg

SEQ ID NO: 772431 - DNA, 20 bp, mouse
gtccacatgttagatgcttc

SEQ ID NO: 772432 - DNA, 20 bp, mouse
gtatatttgttctctaaaac

SEQ ID NO: 772433 - DNA, 20 bp, mouse
gaaatcaagtatatttttct

SEQ ID NO: 772434 - DNA, 20 bp, mouse
ggactcccaactaaaagggc

SEQ ID NO: 772435 - DNA, 20 bp, mouse
gggcccaacctaagaataat

SEQ ID NO: 772436 - DNA, 20 bp, mouse
ggtagcaaaacgtggtaaaa

SEQ ID NO: 772437 - DNA, 20 bp, mouse
ggctcagtggaaatggaccc

SEQ ID NO: 772438 - DNA, 20 bp, mouse
ggaaaatgggggcagtatct

SEQ ID NO: 772439 - DNA, 20 bp, mouse
gagtatctaggtagtgtcct

SEQ ID NO: 772440 - DNA, 20 bp, mouse
ggatgtacagtaatgctcag

SEQ ID NO: 772441 - DNA, 20 bp, mouse
gaagggaaattcttttgatg

SEQ ID NO: 772442 - DNA, 20 bp, mouse
gaaaaatttgtagcaaaacg

SEQ ID NO: 772443 - DNA, 20 bp, mouse
gaagaatttcccttaccaag

SEQ ID NO: 772444 - DNA, 20 bp, mouse
gatatgcagctttgagacac

SEQ ID NO: 772445 - DNA, 20 bp, mouse
gattcttttgatgtggtaac

SEQ ID NO: 772446 - DNA, 20 bp, mouse
gtatggacactgcataaacg

SEQ ID NO: 772447 - DNA, 20 bp, mouse
gaaaatatcaaattacacta

SEQ ID NO: 772448 - DNA, 20 bp, mouse
gttatcatttttgggaggct

SEQ ID NO: 772449 - DNA, 20 bp, mouse
gtagttcactatctgtattc

SEQ ID NO: 772450 - DNA, 20 bp, mouse
gctttacatccattgggaaa

SEQ ID NO: 772451 - DNA, 20 bp, mouse
gatgtaaagtttatcatttt

SEQ ID NO: 772452 - DNA, 20 bp, mouse
gtgataaactttacatccat

SEQ ID NO: 772453 - DNA, 20 bp, mouse
ggactagagaactaactcag

SEQ ID NO: 772454 - DNA, 20 bp, mouse
gactggtcatgcagaggaac

SEQ ID NO: 772455 - DNA, 20 bp, mouse
ggagaactaactcagtggtt

SEQ ID NO: 772456 - DNA, 20 bp, mouse
gtctaagattcgttgtactc

SEQ ID NO: 772457 - DNA, 20 bp, mouse
gaagattcgttgtactcagg

SEQ ID NO: 772458 - DNA, 20 bp, mouse
gagaatgagagattgaatat

SEQ ID NO: 772459 - DNA, 20 bp, mouse
gccacactttcgggtgactc

SEQ ID NO: 772460 - DNA, 20 bp, mouse
gaagtaaaattttatgccaa

SEQ ID NO: 772461 - DNA, 20 bp, mouse
gaaaattcagcattagacac

SEQ ID NO: 772462 - DNA, 20 bp, mouse
gagtgtggagatgaaaatgg

SEQ ID NO: 772463 - DNA, 20 bp, mouse
ggaaagtgtggagatgaaaa

SEQ ID NO: 772464 - DNA, 20 bp, mouse
gaatatgtctgttacttata

SEQ ID NO: 772465 - DNA, 20 bp, mouse
gtctaatgctgaattttaat

SEQ ID NO: 772466 - DNA, 20 bp, mouse
ggtctctgggcattcctaac

SEQ ID NO: 772467 - DNA, 20 bp, mouse
gtatgtggctgtctgtcaaa

SEQ ID NO: 772468 - DNA, 20 bp, mouse
gactaagcatactaaaacat

SEQ ID NO: 772469 - DNA, 20 bp, mouse
gagttgttaatacatatatg

SEQ ID NO: 772470 - DNA, 20 bp, mouse
gacacacatacatataggga

SEQ ID NO: 772471 - DNA, 20 bp, mouse
gtaacctatctacaccagtt

SEQ ID NO: 772472 - DNA, 20 bp, mouse
gcagtgaatgtgagagacaa

SEQ ID NO: 772473 - DNA, 20 bp, mouse
gtagataggttatctagaag

SEQ ID NO: 772474 - DNA, 20 bp, mouse
gtggcataaaaagacagact

SEQ ID NO: 772475 - DNA, 20 bp, mouse
gattttttacacataaagtc

SEQ ID NO: 772476 - DNA, 20 bp, mouse
gtctctgtggcaaaggagtc

SEQ ID NO: 772477 - DNA, 20 bp, mouse
gtataaggtgccacttttaa

SEQ ID NO: 772478 - DNA, 20 bp, mouse
gtatggcagttgtcaatctt

SEQ ID NO: 772479 - DNA, 20 bp, mouse
gatgtgccaaagctaataag

SEQ ID NO: 772480 - DNA, 20 bp, mouse
gaaggcagcaaaaggaatcc

SEQ ID NO: 772481 - DNA, 20 bp, mouse
gggcccctttgagtagaacc

SEQ ID NO: 772482 - DNA, 20 bp, mouse
gatccaggttctactcaaag

SEQ ID NO: 772483 - DNA, 20 bp, mouse
gcagaaaaaatgataaaata

SEQ ID NO: 772484 - DNA, 20 bp, mouse
gaatctttggaaaacattat

SEQ ID NO: 772485 - DNA, 20 bp, mouse
ggatgtacagaaattctctg

SEQ ID NO: 772486 - DNA, 20 bp, mouse
gacttggagtcaaaactcat

SEQ ID NO: 772487 - DNA, 20 bp, mouse
gatatttgcagcaaaacata

SEQ ID NO: 772488 - DNA, 20 bp, mouse
gacacaggacttacagaagt

SEQ ID NO: 772489 - DNA, 20 bp, mouse
gatggtaacagtgtatatat

SEQ ID NO: 772490 - DNA, 20 bp, mouse
gaccatttctactatataaa

SEQ ID NO: 772491 - DNA, 20 bp, mouse
ggactccaagtttgttctcc

SEQ ID NO: 772492 - DNA, 20 bp, mouse
gaccttttatatagtagaaa

SEQ ID NO: 772493 - DNA, 20 bp, mouse
gaaagatgtttattatacct

SEQ ID NO: 772494 - DNA, 20 bp, mouse
gataaaagaaaagcatgtaa

SEQ ID NO: 772495 - DNA, 20 bp, mouse
gatcagactgagaaataatg

SEQ ID NO: 772496 - DNA, 20 bp, mouse
gttcttgcacagcacacatt

SEQ ID NO: 772497 - DNA, 20 bp, mouse
gtgagcactgctttcactac

SEQ ID NO: 772498 - DNA, 20 bp, mouse
gacgatgtgtatttcggtaa

SEQ ID NO: 772499 - DNA, 20 bp, mouse
gtttcctagcattctccctg

SEQ ID NO: 772500 - DNA, 20 bp, mouse
gtgtatttcggtaatggggt

SEQ ID NO: 772501 - DNA, 20 bp, mouse
gacacctagccagtatttgt

SEQ ID NO: 772502 - DNA, 20 bp, mouse
gggcatgttgtgatatgctg

SEQ ID NO: 772503 - DNA, 20 bp, mouse
gactccacagggagaatgct

SEQ ID NO: 772504 - DNA, 20 bp, mouse
gtgtagggtcattatttcac

SEQ ID NO: 772505 - DNA, 20 bp, mouse
gcaggctatgatctcaataa

SEQ ID NO: 772506 - DNA, 20 bp, mouse
gtcaggaataaacaggctgt

SEQ ID NO: 772507 - DNA, 20 bp, mouse
ggacatcctcttgagtgcaa

SEQ ID NO: 772508 - DNA, 20 bp, mouse
ggaaagtgttgtcatgatga

SEQ ID NO: 772509 - DNA, 20 bp, mouse
ggataatgaaacactgcagt

SEQ ID NO: 772510 - DNA, 20 bp, mouse
gaattggacaaaatacccag

SEQ ID NO: 772511 - DNA, 20 bp, mouse
gtccacatttaagataaaag

SEQ ID NO: 772512 - DNA, 20 bp, mouse
gactcagatgacaccttttc

SEQ ID NO: 772513 - DNA, 20 bp, mouse
gtgagaacagaagcattaat

SEQ ID NO: 772514 - DNA, 20 bp, mouse
gatggccttaattaaaattc

SEQ ID NO: 772515 - DNA, 20 bp, mouse
gcaaacacatacgtgagtga

SEQ ID NO: 772516 - DNA, 20 bp, mouse
gacaaattatagggaaggga

SEQ ID NO: 772517 - DNA, 20 bp, mouse
gtcacacaaattatagggaa

SEQ ID NO: 772518 - DNA, 20 bp, mouse
gatatgaagtaagatggccc

SEQ ID NO: 772519 - DNA, 20 bp, mouse
gttatgacctccttggggta

SEQ ID NO: 772520 - DNA, 20 bp, mouse
ggtgtactacacagctgtga

SEQ ID NO: 772521 - DNA, 20 bp, mouse
gttgtatcacacaaattata

SEQ ID NO: 772522 - DNA, 20 bp, mouse
gtagagaaaatgaagactgt

SEQ ID NO: 772523 - DNA, 20 bp, mouse
gggactgccttaccccaagg

SEQ ID NO: 772524 - DNA, 20 bp, mouse
gttaagttatgacctccttg

SEQ ID NO: 772525 - DNA, 20 bp, mouse
gattttacatacaatacacc

SEQ ID NO: 772526 - DNA, 20 bp, mouse
gggcaagaatacaagagtga

SEQ ID NO: 772527 - DNA, 20 bp, mouse
gaaaaagaaaatagcgaggg

SEQ ID NO: 772528 - DNA, 20 bp, mouse
ggtgaaaaagaaaatagcga

SEQ ID NO: 772529 - DNA, 20 bp, mouse
gcactatgtggaaaagagtc

SEQ ID NO: 772530 - DNA, 20 bp, mouse
gaagaaaaatgaattataat

SEQ ID NO: 772531 - DNA, 20 bp, mouse
gagcacgttttctgcaactg

SEQ ID NO: 772532 - DNA, 20 bp, mouse
gaaaaagatgtaggggtggg

SEQ ID NO: 772533 - DNA, 20 bp, mouse
gacaagtaaaaaagatgtag

SEQ ID NO: 772534 - DNA, 20 bp, mouse
gtggaatgtagacgtaattt

SEQ ID NO: 772535 - DNA, 20 bp, mouse
gacatagtgtgtttatacat

SEQ ID NO: 772536 - DNA, 20 bp, mouse
gaataaaaatgcatgactga

SEQ ID NO: 772537 - DNA, 20 bp, mouse
ggcaagcaaggaactacata

SEQ ID NO: 772538 - DNA, 20 bp, mouse
gacgtataacgaattagaag

SEQ ID NO: 772539 - DNA, 20 bp, mouse
gggggtatcctattcttcac

SEQ ID NO: 772540 - DNA, 20 bp, mouse
gagaaacatagtcagtagaa

SEQ ID NO: 772541 - DNA, 20 bp, mouse
gtcgagtaataaaagatcgt

SEQ ID NO: 772542 - DNA, 20 bp, mouse
gtatataagtgtaataattt

SEQ ID NO: 772543 - DNA, 20 bp, mouse
gaataaatgatagattatgg

SEQ ID NO: 772544 - DNA, 20 bp, mouse
gcttggctgtatgagtttaa

SEQ ID NO: 772545 - DNA, 20 bp, mouse
gtagaataaatgatagatta

SEQ ID NO: 772546 - DNA, 20 bp, mouse
gcatagaagtgctacaaagg

SEQ ID NO: 772547 - DNA, 20 bp, mouse
ggaaaaagttaaccatttat

SEQ ID NO: 772548 - DNA, 20 bp, mouse
gaccatcccaagcctataaa

SEQ ID NO: 772549 - DNA, 20 bp, mouse
gtctgggtatccatttacta

SEQ ID NO: 772550 - DNA, 20 bp, mouse
gacgctgtaagtgttaagtg

SEQ ID NO: 772551 - DNA, 20 bp, mouse
gaaccatgatgtagttatta

SEQ ID NO: 772552 - DNA, 20 bp, mouse
gtaccatagaagtgctacaa

SEQ ID NO: 772553 - DNA, 20 bp, mouse
gacatcatggtttgcttttg

SEQ ID NO: 772554 - DNA, 20 bp, mouse
ggttaaccatttataggctt

SEQ ID NO: 772555 - DNA, 20 bp, mouse
gaatacaaatataatcatat

SEQ ID NO: 772556 - DNA, 20 bp, mouse
ggaaatcaaagaatggaatc

SEQ ID NO: 772557 - DNA, 20 bp, mouse
gataaattgaagacaatagt

SEQ ID NO: 772558 - DNA, 20 bp, mouse
gcaatagtgggcttaaaaat

SEQ ID NO: 772559 - DNA, 20 bp, mouse
gagacaagttgcaagtaaaa

SEQ ID NO: 772560 - DNA, 20 bp, mouse
gtgatgggatactgatttcc

SEQ ID NO: 772561 - DNA, 20 bp, mouse
gtggatgaataatgttgttg

SEQ ID NO: 772562 - DNA, 20 bp, mouse
gcaattgcaagtgataattt

SEQ ID NO: 772563 - DNA, 20 bp, mouse
gtcattatagttagtcccat

SEQ ID NO: 772564 - DNA, 20 bp, mouse
gagcataagtttctctatga

SEQ ID NO: 772565 - DNA, 20 bp, mouse
gttgtatcttatttctatat

SEQ ID NO: 772566 - DNA, 20 bp, mouse
ggctcaaggcactctctcct

SEQ ID NO: 772567 - DNA, 20 bp, mouse
gagaatgagtagtaactcaa

SEQ ID NO: 772568 - DNA, 20 bp, mouse
gcattcactccttgcatcac

SEQ ID NO: 772569 - DNA, 20 bp, mouse
ggcttagtgccatagtaaaa

SEQ ID NO: 772570 - DNA, 20 bp, mouse
gaaggcactctctcctgggc

SEQ ID NO: 772571 - DNA, 20 bp, mouse
ggatgcaaggagtgaatggg

SEQ ID NO: 772572 - DNA, 20 bp, mouse
gatagtaaaatggatctcaa

SEQ ID NO: 772573 - DNA, 20 bp, mouse
gtgaatgggtggacattgtc

SEQ ID NO: 772574 - DNA, 20 bp, mouse
gtcacaaagtggagtaactt

SEQ ID NO: 772575 - DNA, 20 bp, mouse
gcatggtcttgcataagaca

SEQ ID NO: 772576 - DNA, 20 bp, mouse
gacattgagcaagatgtcag

SEQ ID NO: 772577 - DNA, 20 bp, mouse
gtagacacactgtggctaaa

SEQ ID NO: 772578 - DNA, 20 bp, mouse
gtgccaccattttacttaga

SEQ ID NO: 772579 - DNA, 20 bp, mouse
gtaatgtgtccgtgtaaggt

SEQ ID NO: 772580 - DNA, 20 bp, mouse
gtgtcttatccaaccttaca

SEQ ID NO: 772581 - DNA, 20 bp, mouse
gcatgcaccaacacatgtgt

SEQ ID NO: 772582 - DNA, 20 bp, mouse
gacacggacacattaaacta

SEQ ID NO: 772583 - DNA, 20 bp, mouse
gcgaagccttctaagtaaaa

SEQ ID NO: 772584 - DNA, 20 bp, mouse
gtccagaaatgtcatgatga

SEQ ID NO: 772585 - DNA, 20 bp, mouse
gacacagactatgcacagct

SEQ ID NO: 772586 - DNA, 20 bp, mouse
gtataactctgtgtattaca

SEQ ID NO: 772587 - DNA, 20 bp, mouse
gtcaaagacatggacataat

SEQ ID NO: 772588 - DNA, 20 bp, mouse
gacctatctgtccagttgta

SEQ ID NO: 772589 - DNA, 20 bp, mouse
gcttatgagagttattatta

SEQ ID NO: 772590 - DNA, 20 bp, mouse
gtattatcataccatacaac

SEQ ID NO: 772591 - DNA, 20 bp, mouse
gtaaactacgtgtatcaatt

SEQ ID NO: 772592 - DNA, 20 bp, mouse
gtgaatagacctttaaaaca

SEQ ID NO: 772593 - DNA, 20 bp, mouse
gttgatacacgtagtttatc

SEQ ID NO: 772594 - DNA, 20 bp, mouse
gcaaggtaaccatgttttaa

SEQ ID NO: 772595 - DNA, 20 bp, mouse
gaatataaatcatgttttct

SEQ ID NO: 772596 - DNA, 20 bp, mouse
gagcccagggagcttggata

SEQ ID NO: 772597 - DNA, 20 bp, mouse
ggggagaatgaattaagccc

SEQ ID NO: 772598 - DNA, 20 bp, mouse
ggactatgtgagtggaattg

SEQ ID NO: 772599 - DNA, 20 bp, mouse
gggggacaaaaataataggc

SEQ ID NO: 772600 - DNA, 20 bp, mouse
gcaggttgactatggatgta

SEQ ID NO: 772601 - DNA, 20 bp, mouse
gctatctttatttagatatt

SEQ ID NO: 772602 - DNA, 20 bp, mouse
gaaaagttttcagtgaatac

SEQ ID NO: 772603 - DNA, 20 bp, mouse
ggctgaaagcaaatagaggg

SEQ ID NO: 772604 - DNA, 20 bp, mouse
ggcttggataagggaggcat

SEQ ID NO: 772605 - DNA, 20 bp, mouse
gggataagggaggcatagga

SEQ ID NO: 772606 - DNA, 20 bp, mouse
ggcagagagggatgagttgt

SEQ ID NO: 772607 - DNA, 20 bp, mouse
gatgaagcagcctactcaaa

SEQ ID NO: 772608 - DNA, 20 bp, mouse
ggcttggataagtgaggtgc

SEQ ID NO: 772609 - DNA, 20 bp, mouse
gagagggatgagttgtagga

SEQ ID NO: 772610 - DNA, 20 bp, mouse
gtggataagtgaggtgcagg

SEQ ID NO: 772611 - DNA, 20 bp, mouse
gggggacagaaataataggt

SEQ ID NO: 772612 - DNA, 20 bp, mouse
ggccgcacacaactggggga

SEQ ID NO: 772613 - DNA, 20 bp, mouse
gatcacaactccatttgagt

SEQ ID NO: 772614 - DNA, 20 bp, mouse
gagaaataataggtaggctt

SEQ ID NO: 772615 - DNA, 20 bp, mouse
gggtccatgtttactcattg

SEQ ID NO: 772616 - DNA, 20 bp, mouse
gaggggtgaaagtgaataga

SEQ ID NO: 772617 - DNA, 20 bp, mouse
gtggattaggcaagagcaga

SEQ ID NO: 772618 - DNA, 20 bp, mouse
gaaaccatgcaaaacttaag

SEQ ID NO: 772619 - DNA, 20 bp, mouse
gagcctatgtaaatggcatt

SEQ ID NO: 772620 - DNA, 20 bp, mouse
gatcccaatgccatttacat

SEQ ID NO: 772621 - DNA, 20 bp, mouse
gacaaagatacttggtgcca

SEQ ID NO: 772622 - DNA, 20 bp, mouse
gtgaattaactaaaaggaag

SEQ ID NO: 772623 - DNA, 20 bp, mouse
gcagaagacacaaagatact

SEQ ID NO: 772624 - DNA, 20 bp, mouse
gctacatctatgtagaactt

SEQ ID NO: 772625 - DNA, 20 bp, mouse
gtttcctcttaagttttgca

SEQ ID NO: 772626 - DNA, 20 bp, mouse
gtgtcctcaaccatttatga

SEQ ID NO: 772627 - DNA, 20 bp, mouse
gttctggcgagatgtttgac

SEQ ID NO: 772628 - DNA, 20 bp, mouse
ggccagaacagtgagtgaat

SEQ ID NO: 772629 - DNA, 20 bp, mouse
gtacctaataccttcataaa

SEQ ID NO: 772630 - DNA, 20 bp, mouse
ggccaattcactcactgttc

SEQ ID NO: 772631 - DNA, 20 bp, mouse
gcaggcatgtgttacatgtt

SEQ ID NO: 772632 - DNA, 20 bp, mouse
gaaccatttatgaaggtatt

SEQ ID NO: 772633 - DNA, 20 bp, mouse
gtaggaacttctgatcttac

SEQ ID NO: 772634 - DNA, 20 bp, mouse
gtatttgttaatacaactta

SEQ ID NO: 772635 - DNA, 20 bp, mouse
gttttgcataatcaaatctt

SEQ ID NO: 772636 - DNA, 20 bp, mouse
gtgccaccatacctggtctg

SEQ ID NO: 772637 - DNA, 20 bp, mouse
gatcctcagaccaggtatgg

SEQ ID NO: 772638 - DNA, 20 bp, mouse
gccctgccccccaaatgcaa

SEQ ID NO: 772639 - DNA, 20 bp, mouse
gggggggcaggggtgactgg

SEQ ID NO: 772640 - DNA, 20 bp, mouse
ggaagggtaagggattcctg

SEQ ID NO: 772641 - DNA, 20 bp, mouse
ggagagcacacgtttgagtt

SEQ ID NO: 772642 - DNA, 20 bp, mouse
gcaggggtgactggaggaca

SEQ ID NO: 772643 - DNA, 20 bp, mouse
ggtgacttgcaaccaaatga

SEQ ID NO: 772644 - DNA, 20 bp, mouse
gccccccaaatgcaagggcc

SEQ ID NO: 772645 - DNA, 20 bp, mouse
ggcacccttagctctgtgaa

SEQ ID NO: 772646 - DNA, 20 bp, mouse
gaggaagagaatctactggt

SEQ ID NO: 772647 - DNA, 20 bp, mouse
gtagagtacatgtattaaac

SEQ ID NO: 772648 - DNA, 20 bp, mouse
gagtacatgtattaaaccgg

SEQ ID NO: 772649 - DNA, 20 bp, mouse
ggaaatggaagcaaattttc

SEQ ID NO: 772650 - DNA, 20 bp, mouse
gagcagggagaatattttct

SEQ ID NO: 772651 - DNA, 20 bp, mouse
gaattctattattgcagaac

SEQ ID NO: 772652 - DNA, 20 bp, mouse
gctcaaggaagagaatctac

SEQ ID NO: 772653 - DNA, 20 bp, mouse
gagagcttagatctttagca

SEQ ID NO: 772654 - DNA, 20 bp, mouse
gtattgaaaaacaatccttt

SEQ ID NO: 772655 - DNA, 20 bp, mouse
gacagtataatgtttttgta

SEQ ID NO: 772656 - DNA, 20 bp, mouse
gcatgtgagcccacgtgggt

SEQ ID NO: 772657 - DNA, 20 bp, mouse
gtaatgcggagaagctggac

SEQ ID NO: 772658 - DNA, 20 bp, mouse
gcacccatgtgagcccacgt

SEQ ID NO: 772659 - DNA, 20 bp, mouse
gtggacgtgtttgaatactc

SEQ ID NO: 772660 - DNA, 20 bp, mouse
gtgtgtgagccaacccacgt

SEQ ID NO: 772661 - DNA, 20 bp, mouse
gtggcaagtcagctgtaatg

SEQ ID NO: 772662 - DNA, 20 bp, mouse
gagctgtaatgcggagaagc

SEQ ID NO: 772663 - DNA, 20 bp, mouse
gtggtaattcaaggacagac

SEQ ID NO: 772664 - DNA, 20 bp, mouse
gcaaaatttcaaaaatttct

SEQ ID NO: 772665 - DNA, 20 bp, mouse
gtatttgaaaataaatttgc

SEQ ID NO: 772666 - DNA, 20 bp, mouse
ggactctatgcacgtagaaa

SEQ ID NO: 772667 - DNA, 20 bp, mouse
gctctctttagggcacatac

SEQ ID NO: 772668 - DNA, 20 bp, mouse
gtaagaataaacattcttgc

SEQ ID NO: 772669 - DNA, 20 bp, mouse
ggttattcgtgttataactg

SEQ ID NO: 772670 - DNA, 20 bp, mouse
gtatgcacgtagaaatggaa

SEQ ID NO: 772671 - DNA, 20 bp, mouse
gaacattaaaaataactaaa

SEQ ID NO: 772672 - DNA, 20 bp, mouse
gaataaacattcttgctggg

SEQ ID NO: 772673 - DNA, 20 bp, mouse
gaaacattcttgctgggcgg

SEQ ID NO: 772674 - DNA, 20 bp, mouse
gtttcaaagctgagtgtgta

SEQ ID NO: 772675 - DNA, 20 bp, mouse
gctaaggcactctctcttta

SEQ ID NO: 772676 - DNA, 20 bp, mouse
gcatgcatgcattaagtcat

SEQ ID NO: 772677 - DNA, 20 bp, mouse
gcatttctggactagctgta

SEQ ID NO: 772678 - DNA, 20 bp, mouse
ggtccttgagcatacatttc

SEQ ID NO: 772679 - DNA, 20 bp, mouse
gtggtcatttctcgagtttg

SEQ ID NO: 772680 - DNA, 20 bp, mouse
gtgtcaggcttatgtttcag

SEQ ID NO: 772681 - DNA, 20 bp, mouse
ggaatcccttacaaagagct

SEQ ID NO: 772682 - DNA, 20 bp, mouse
gtgcaagctcttcctgatca

SEQ ID NO: 772683 - DNA, 20 bp, mouse
gtagatgaaagtgtaaaaga

SEQ ID NO: 772684 - DNA, 20 bp, mouse
gattcatgaagaccttgatc

SEQ ID NO: 772685 - DNA, 20 bp, mouse
gatattccaagctctttgta

SEQ ID NO: 772686 - DNA, 20 bp, mouse
ggctctgtggcaaaaacaag

SEQ ID NO: 772687 - DNA, 20 bp, mouse
gaaaagacatgggcacagtt

SEQ ID NO: 772688 - DNA, 20 bp, mouse
gaatgtaagcataatgccct

SEQ ID NO: 772689 - DNA, 20 bp, mouse
gaggcagcctggagggtaat

SEQ ID NO: 772690 - DNA, 20 bp, mouse
ggtggcaaaaacaagaggaa

SEQ ID NO: 772691 - DNA, 20 bp, mouse
ggatgatcccattaccctcc

SEQ ID NO: 772692 - DNA, 20 bp, mouse
gccaagccaggcagcctgga

SEQ ID NO: 772693 - DNA, 20 bp, mouse
gtgcttctgagtgatgatac

SEQ ID NO: 772694 - DNA, 20 bp, mouse
gctgagtgatgatacgggaa

SEQ ID NO: 772695 - DNA, 20 bp, mouse
gttcagcaacttgatttctt

SEQ ID NO: 772696 - DNA, 20 bp, mouse
gttccaggggaaatgtgtgt

SEQ ID NO: 772697 - DNA, 20 bp, mouse
ggcccaagggcaataactct

SEQ ID NO: 772698 - DNA, 20 bp, mouse
gtataaatggcatagcccaa

SEQ ID NO: 772699 - DNA, 20 bp, mouse
gtacccagagttattgccct

SEQ ID NO: 772700 - DNA, 20 bp, mouse
gctagagaacagaaattcta

SEQ ID NO: 772701 - DNA, 20 bp, mouse
gtggctgacagcaagcattt

SEQ ID NO: 772702 - DNA, 20 bp, mouse
gttcccacacacatttcccc

SEQ ID NO: 772703 - DNA, 20 bp, mouse
gaccatgatctttgacactg

SEQ ID NO: 772704 - DNA, 20 bp, mouse
gctctgctatttatttccag

SEQ ID NO: 772705 - DNA, 20 bp, mouse
gtcatggtgagattgacttg

SEQ ID NO: 772706 - DNA, 20 bp, mouse
gagtgccctagagctattca

SEQ ID NO: 772707 - DNA, 20 bp, mouse
ggactccatccacatagaaa

SEQ ID NO: 772708 - DNA, 20 bp, mouse
gcatccacatagaaatggaa

SEQ ID NO: 772709 - DNA, 20 bp, mouse
gtgagtgtgtcaggcatgca

SEQ ID NO: 772710 - DNA, 20 bp, mouse
gacattaaaaataactgaaa

SEQ ID NO: 772711 - DNA, 20 bp, mouse
gatctactgcagatcctctc

SEQ ID NO: 772712 - DNA, 20 bp, mouse
gtgtttataagttataactg

SEQ ID NO: 772713 - DNA, 20 bp, mouse
gtttcaaagctgagtgtgtc

SEQ ID NO: 772714 - DNA, 20 bp, mouse
gagtttccctgaatagctct

SEQ ID NO: 772715 - DNA, 20 bp, mouse
gacatagaaatggaaaggac

SEQ ID NO: 772716 - DNA, 20 bp, mouse
gtggcaagtcagatgtcata

SEQ ID NO: 772717 - DNA, 20 bp, mouse
gcatgtgagcccacttggat

SEQ ID NO: 772718 - DNA, 20 bp, mouse
gagatgtcatacggagaaac

SEQ ID NO: 772719 - DNA, 20 bp, mouse
gatctgtcagagttactaca

SEQ ID NO: 772720 - DNA, 20 bp, mouse
ggtgtgtgagccaatccaag

SEQ ID NO: 772721 - DNA, 20 bp, mouse
gcatacggagaaacaggaca

SEQ ID NO: 772722 - DNA, 20 bp, mouse
gatttcccatctgctgtgct

SEQ ID NO: 772723 - DNA, 20 bp, mouse
gttgaaaatttggtaattca

SEQ ID NO: 772724 - DNA, 20 bp, mouse
gtatttgaaaataaatttgc

SEQ ID NO: 772725 - DNA, 20 bp, mouse
gttagagacttttgaaaatt

SEQ ID NO: 772726 - DNA, 20 bp, mouse
gacaaactaccagccctccg

SEQ ID NO: 772727 - DNA, 20 bp, mouse
gaccctaaacatcaaacccc

SEQ ID NO: 772728 - DNA, 20 bp, mouse
gagtgcgtggtgctgtagtc

SEQ ID NO: 772729 - DNA, 20 bp, mouse
ggtttgttcaggcccacgga

SEQ ID NO: 772730 - DNA, 20 bp, mouse
gccattgtctccacagtctg

SEQ ID NO: 772731 - DNA, 20 bp, mouse
ggtccgggggtttgatgttt

SEQ ID NO: 772732 - DNA, 20 bp, mouse
gacagcaccacgcactgatc

SEQ ID NO: 772733 - DNA, 20 bp, mouse
gttgtctccacagtctgggg

SEQ ID NO: 772734 - DNA, 20 bp, mouse
ggtgtggcagtaagaggggg

SEQ ID NO: 772735 - DNA, 20 bp, mouse
gtttgatgtcgaaggtccgg

SEQ ID NO: 772736 - DNA, 20 bp, mouse
gaccaacagtctatcctgta

SEQ ID NO: 772737 - DNA, 20 bp, mouse
gttatgtcaaacagactaga

SEQ ID NO: 772738 - DNA, 20 bp, mouse
gcctgtgaatctatgagacc

SEQ ID NO: 772739 - DNA, 20 bp, mouse
gagtctatcctgtagggtct

SEQ ID NO: 772740 - DNA, 20 bp, mouse
gaccctacaggatagactgt

SEQ ID NO: 772741 - DNA, 20 bp, mouse
gaactctgagtgactatttt

SEQ ID NO: 772742 - DNA, 20 bp, mouse
gatagactgttggtctctcc

SEQ ID NO: 772743 - DNA, 20 bp, mouse
gcaacattcccagaccctac

SEQ ID NO: 772744 - DNA, 20 bp, mouse
ggactgttggtctctccggg

SEQ ID NO: 772745 - DNA, 20 bp, mouse
ggtttgacataatgtgagga

SEQ ID NO: 772746 - DNA, 20 bp, mouse
gtgtcccatgctaacccaat

SEQ ID NO: 772747 - DNA, 20 bp, mouse
gaatccccattgggttagca

SEQ ID NO: 772748 - DNA, 20 bp, mouse
gttgtcactgaatccccatt

SEQ ID NO: 772749 - DNA, 20 bp, mouse
gtccttcttgtgtggtggtg

SEQ ID NO: 772750 - DNA, 20 bp, mouse
gtggtggtgaggcttcctcc

SEQ ID NO: 772751 - DNA, 20 bp, mouse
ggcctcaccaccacacaaga

SEQ ID NO: 772752 - DNA, 20 bp, mouse
gtctcagagtctccagagcc

SEQ ID NO: 772753 - DNA, 20 bp, mouse
gtgagagtttctgtgctgcc

SEQ ID NO: 772754 - DNA, 20 bp, mouse
ggagtttctgtgctgcctgg

SEQ ID NO: 772755 - DNA, 20 bp, mouse
ggaagacactatctgtcatt

SEQ ID NO: 772756 - DNA, 20 bp, mouse
gtatgctggaaaatagcaca

SEQ ID NO: 772757 - DNA, 20 bp, mouse
gccctcagtgtctaacacag

SEQ ID NO: 772758 - DNA, 20 bp, mouse
gtgctattttccagcatagc

SEQ ID NO: 772759 - DNA, 20 bp, mouse
ggcctctgtgttagacactg

SEQ ID NO: 772760 - DNA, 20 bp, mouse
ggacattagcagttgtttca

SEQ ID NO: 772761 - DNA, 20 bp, mouse
gtagcagttgtttcaaggca

SEQ ID NO: 772762 - DNA, 20 bp, mouse
gcagatctgagatccatggg

SEQ ID NO: 772763 - DNA, 20 bp, mouse
ggtgataacatgctgattta

SEQ ID NO: 772764 - DNA, 20 bp, mouse
gcagcaactcgagcataaca

SEQ ID NO: 772765 - DNA, 20 bp, mouse
gatttaaggacttcagtatc

SEQ ID NO: 772766 - DNA, 20 bp, mouse
gtggttctgctcactgcatg

SEQ ID NO: 772767 - DNA, 20 bp, mouse
ggcactgatagtccctttcc

SEQ ID NO: 772768 - DNA, 20 bp, mouse
gatactgaacatatctagag

SEQ ID NO: 772769 - DNA, 20 bp, mouse
gaaacatcagaatagcatcc

SEQ ID NO: 772770 - DNA, 20 bp, mouse
gcaggttaacaatgacgcag

SEQ ID NO: 772771 - DNA, 20 bp, mouse
gagatgtgatgtcctcattc

SEQ ID NO: 772772 - DNA, 20 bp, mouse
gtcattgttaacctgtcgcc

SEQ ID NO: 772773 - DNA, 20 bp, mouse
ggctccccagtaacagcctc

SEQ ID NO: 772774 - DNA, 20 bp, mouse
ggcagttctcaccaggcgac

SEQ ID NO: 772775 - DNA, 20 bp, mouse
gtttcctgaggctgttactg

SEQ ID NO: 772776 - DNA, 20 bp, mouse
gaatccaaatcgggattcag

SEQ ID NO: 772777 - DNA, 20 bp, mouse
ggttccatgctaatccaaat

SEQ ID NO: 772778 - DNA, 20 bp, mouse
gaagagaacgtagcacaagc

SEQ ID NO: 772779 - DNA, 20 bp, mouse
gttgccactgaatcccgatt

SEQ ID NO: 772780 - DNA, 20 bp, mouse
gtaacatatgaaatgagcct

SEQ ID NO: 772781 - DNA, 20 bp, mouse
gatcccgatttggattagca

SEQ ID NO: 772782 - DNA, 20 bp, mouse
gtccttcttgtgtggtggtg

SEQ ID NO: 772783 - DNA, 20 bp, mouse
gctcagagtctccagatcct

SEQ ID NO: 772784 - DNA, 20 bp, mouse
gtggtggtgaggcttcctcc

SEQ ID NO: 772785 - DNA, 20 bp, mouse
ggcctcaccaccacacaaga

SEQ ID NO: 772786 - DNA, 20 bp, mouse
gaggcaggttgcatcatccc

SEQ ID NO: 772787 - DNA, 20 bp, mouse
gacccaggaatgatggggtg

SEQ ID NO: 772788 - DNA, 20 bp, mouse
gaggacaagatggcacagca

SEQ ID NO: 772789 - DNA, 20 bp, mouse
gagcaggacccaggaatgat

SEQ ID NO: 772790 - DNA, 20 bp, mouse
gcagcagggatgagtgctcg

SEQ ID NO: 772791 - DNA, 20 bp, mouse
gccattataacaacactgaa

SEQ ID NO: 772792 - DNA, 20 bp, mouse
gaatgtaactaggagagtta

SEQ ID NO: 772793 - DNA, 20 bp, mouse
gtatggcagaggtttctgtt

SEQ ID NO: 772794 - DNA, 20 bp, mouse
gaatgagcagagatcagcca

SEQ ID NO: 772795 - DNA, 20 bp, mouse
ggtaaatcaagctatggcag

SEQ ID NO: 772796 - DNA, 20 bp, mouse
gaaataatctttggctttta

SEQ ID NO: 772797 - DNA, 20 bp, mouse
gtttaaccattgggttagca

SEQ ID NO: 772798 - DNA, 20 bp, mouse
gctggtttttttttaaccat

SEQ ID NO: 772799 - DNA, 20 bp, mouse
ggagagaagacactgtcatt

SEQ ID NO: 772800 - DNA, 20 bp, mouse
gctcagagtctccagatcct

SEQ ID NO: 772801 - DNA, 20 bp, mouse
gtgaaggtgaggcttcctcc

SEQ ID NO: 772802 - DNA, 20 bp, mouse
gtaaaatatgaaataatctt

SEQ ID NO: 772803 - DNA, 20 bp, mouse
gtttggcttttatggtttga

SEQ ID NO: 772804 - DNA, 20 bp, mouse
gttccaagctttaaaaaaaa

SEQ ID NO: 772805 - DNA, 20 bp, mouse
gtgagagtttctgtgctgcc

SEQ ID NO: 772806 - DNA, 20 bp, mouse
gggctgggatccaggaagaa

SEQ ID NO: 772807 - DNA, 20 bp, mouse
gatcctgtctgacctaggat

SEQ ID NO: 772808 - DNA, 20 bp, mouse
gaaccatcagggactctcat

SEQ ID NO: 772809 - DNA, 20 bp, mouse
gacagtgagacttgcatcag

SEQ ID NO: 772810 - DNA, 20 bp, mouse
gctaggatgggctgggatcc

SEQ ID NO: 772811 - DNA, 20 bp, mouse
gagggtccagctcccatctt

SEQ ID NO: 772812 - DNA, 20 bp, mouse
gagcaatcaaagctccttca

SEQ ID NO: 772813 - DNA, 20 bp, mouse
gtgtgtggttaattgaagtc

SEQ ID NO: 772814 - DNA, 20 bp, mouse
gagcccatcctaggtcagac

SEQ ID NO: 772815 - DNA, 20 bp, mouse
ggctccttcagggtctcatg

SEQ ID NO: 772816 - DNA, 20 bp, mouse
gaagtctgtgccaacattac

SEQ ID NO: 772817 - DNA, 20 bp, mouse
ggtaaaccacagagcttctt

SEQ ID NO: 772818 - DNA, 20 bp, mouse
gtgggtgttttaatccaaat

SEQ ID NO: 772819 - DNA, 20 bp, mouse
gaccggcaaattgagaaatc

SEQ ID NO: 772820 - DNA, 20 bp, mouse
gagacataaatgtcttttac

SEQ ID NO: 772821 - DNA, 20 bp, mouse
gccttaggcaagtgaattca

SEQ ID NO: 772822 - DNA, 20 bp, mouse
gtgatgaaagtcttcctatt

SEQ ID NO: 772823 - DNA, 20 bp, mouse
gacttaatggacttaaagga

SEQ ID NO: 772824 - DNA, 20 bp, mouse
gattttgactaatatactgt

SEQ ID NO: 772825 - DNA, 20 bp, mouse
gtattggtaccctgtaatgt

SEQ ID NO: 772826 - DNA, 20 bp, mouse
ggattcattaagtgttccca

SEQ ID NO: 772827 - DNA, 20 bp, mouse
gcaactgaaagtctttttaa

SEQ ID NO: 772828 - DNA, 20 bp, mouse
gaggctagtgcattcaagca

SEQ ID NO: 772829 - DNA, 20 bp, mouse
ggtaatccacaaagattctt

SEQ ID NO: 772830 - DNA, 20 bp, mouse
gaggtaccttgagatggacc

SEQ ID NO: 772831 - DNA, 20 bp, mouse
gctaaaacataaggatctgg

SEQ ID NO: 772832 - DNA, 20 bp, mouse
gattttgtctaatacacctt

SEQ ID NO: 772833 - DNA, 20 bp, mouse
gttaaggaattagcttaatt

SEQ ID NO: 772834 - DNA, 20 bp, mouse
gcaattatcaaattaaatcc

SEQ ID NO: 772835 - DNA, 20 bp, mouse
ggtgatccaaagaatctttg

SEQ ID NO: 772836 - DNA, 20 bp, mouse
gtaaaaacaagtgtactaag

SEQ ID NO: 772837 - DNA, 20 bp, mouse
ggttagcaatggatataaca

SEQ ID NO: 772838 - DNA, 20 bp, mouse
gtgagagatgccaggatcgg

SEQ ID NO: 772839 - DNA, 20 bp, mouse
gttaaaagacatatagtcat

SEQ ID NO: 772840 - DNA, 20 bp, mouse
gcatctgataatagttctga

SEQ ID NO: 772841 - DNA, 20 bp, mouse
gccatgatttaatactgtct

SEQ ID NO: 772842 - DNA, 20 bp, mouse
gcaacagaatgtgtttttaa

SEQ ID NO: 772843 - DNA, 20 bp, mouse
gggcatcttgatctacaact

SEQ ID NO: 772844 - DNA, 20 bp, mouse
ggacaaatatctccatatta

SEQ ID NO: 772845 - DNA, 20 bp, mouse
gctccatgggtcccactatc

SEQ ID NO: 772846 - DNA, 20 bp, mouse
gaaaaattcagttgatttca

SEQ ID NO: 772847 - DNA, 20 bp, mouse
gaaaccagatagtggaaccc

SEQ ID NO: 772848 - DNA, 20 bp, mouse
gcaactgaatttttcttata

SEQ ID NO: 772849 - DNA, 20 bp, mouse
gttccctgggttccactatc

SEQ ID NO: 772850 - DNA, 20 bp, mouse
gataagctgaaaccagatag

SEQ ID NO: 772851 - DNA, 20 bp, mouse
gaattacaggcaccttgatc

SEQ ID NO: 772852 - DNA, 20 bp, mouse
gaatcgtcttagtgaattac

SEQ ID NO: 772853 - DNA, 20 bp, mouse
ggttagaacacatatattaa

SEQ ID NO: 772854 - DNA, 20 bp, mouse
gtcttgaatgtacttaccta

SEQ ID NO: 772855 - DNA, 20 bp, mouse
gtcaatccatttccagatca

SEQ ID NO: 772856 - DNA, 20 bp, mouse
ggggctagtgatggttggtt

SEQ ID NO: 772857 - DNA, 20 bp, mouse
gcacaataatgggctagtga

SEQ ID NO: 772858 - DNA, 20 bp, mouse
gcattgggcaactggattca

SEQ ID NO: 772859 - DNA, 20 bp, mouse
gtgcaaatggtcaaagcatc

SEQ ID NO: 772860 - DNA, 20 bp, mouse
gataactgaatgtttcttag

SEQ ID NO: 772861 - DNA, 20 bp, mouse
gtaaattggtgccagcaaaa

SEQ ID NO: 772862 - DNA, 20 bp, mouse
ggtgaaatcaaggcaacttg

SEQ ID NO: 772863 - DNA, 20 bp, mouse
gagaaaaagcattgggcaac

SEQ ID NO: 772864 - DNA, 20 bp, mouse
gatagactctggggaattag

SEQ ID NO: 772865 - DNA, 20 bp, mouse
gctatttcttggtgaaatca

SEQ ID NO: 772866 - DNA, 20 bp, mouse
ggtaatgagctactaatatt

SEQ ID NO: 772867 - DNA, 20 bp, mouse
gggcaccttgatatggaaat

SEQ ID NO: 772868 - DNA, 20 bp, mouse
gaaatccaggcaccttgata

SEQ ID NO: 772869 - DNA, 20 bp, mouse
gcagacccatttccatatca

SEQ ID NO: 772870 - DNA, 20 bp, mouse
gtgacaaaagtcttcatatt

SEQ ID NO: 772871 - DNA, 20 bp, mouse
gagtaaaatattaggatctt

SEQ ID NO: 772872 - DNA, 20 bp, mouse
ggcacaaacttatgcgctta

SEQ ID NO: 772873 - DNA, 20 bp, mouse
gtgatccaaagaagctgggt

SEQ ID NO: 772874 - DNA, 20 bp, mouse
gccttaattttaaattctct

SEQ ID NO: 772875 - DNA, 20 bp, mouse
ggtaacccacccagcttctt

SEQ ID NO: 772876 - DNA, 20 bp, mouse
gggatgctgctggttagaac

SEQ ID NO: 772877 - DNA, 20 bp, mouse
gggagctacaatggatctgt

SEQ ID NO: 772878 - DNA, 20 bp, mouse
ggagattttgtcagagtaat

SEQ ID NO: 772879 - DNA, 20 bp, mouse
gtgcaggcattcagagcatt

SEQ ID NO: 772880 - DNA, 20 bp, mouse
gtaccgaaagcaggatatgc

SEQ ID NO: 772881 - DNA, 20 bp, mouse
gaaatccaggcatagtaatc

SEQ ID NO: 772882 - DNA, 20 bp, mouse
gaggtcctgattactatgcc

SEQ ID NO: 772883 - DNA, 20 bp, mouse
gtgactaatgtttttagttc

SEQ ID NO: 772884 - DNA, 20 bp, mouse
gattcataggaagacagcat

SEQ ID NO: 772885 - DNA, 20 bp, mouse
gtcggtagttctacagattc

SEQ ID NO: 772886 - DNA, 20 bp, mouse
gtattaagatagtgatattt

SEQ ID NO: 772887 - DNA, 20 bp, mouse
gtgacaaaagtcctcatact

SEQ ID NO: 772888 - DNA, 20 bp, mouse
gtaaggatcgggggaaatta

SEQ ID NO: 772889 - DNA, 20 bp, mouse
ggggttttaatccaagtatg

SEQ ID NO: 772890 - DNA, 20 bp, mouse
ggcttcttcaatataaggat

SEQ ID NO: 772891 - DNA, 20 bp, mouse
gcaaacgatcaatgctttaa

SEQ ID NO: 772892 - DNA, 20 bp, mouse
gtcttcaatataaggatcgg

SEQ ID NO: 772893 - DNA, 20 bp, mouse
gttatattgaagaagctctg

SEQ ID NO: 772894 - DNA, 20 bp, mouse
gattttgtctaatacaccac

SEQ ID NO: 772895 - DNA, 20 bp, mouse
gagatggaactagatctgat

SEQ ID NO: 772896 - DNA, 20 bp, mouse
gaacaactgactgttttaga

SEQ ID NO: 772897 - DNA, 20 bp, mouse
gtagacccagttcctgatca

SEQ ID NO: 772898 - DNA, 20 bp, mouse
gaaatccagacaccttgatc

SEQ ID NO: 772899 - DNA, 20 bp, mouse
gagtcagttgtttttaaggt

SEQ ID NO: 772900 - DNA, 20 bp, mouse
gagttcctgatcaaggtgtc

SEQ ID NO: 772901 - DNA, 20 bp, mouse
gcagatacaaagaagatccc

SEQ ID NO: 772902 - DNA, 20 bp, mouse
gcattccagaaaggttaaaa

SEQ ID NO: 772903 - DNA, 20 bp, mouse
gtaaaatggatgaacaatca

SEQ ID NO: 772904 - DNA, 20 bp, mouse
gccttaatccaaaatcatca

SEQ ID NO: 772905 - DNA, 20 bp, mouse
gaattaaggtagtgtaaccc

SEQ ID NO: 772906 - DNA, 20 bp, mouse
gggagtggggaaggtgtgaa

SEQ ID NO: 772907 - DNA, 20 bp, mouse
ggtaactcagaataccacta

SEQ ID NO: 772908 - DNA, 20 bp, mouse
ggaaactcagagaacataat

SEQ ID NO: 772909 - DNA, 20 bp, mouse
gccagcttaacatgtttttg

SEQ ID NO: 772910 - DNA, 20 bp, mouse
gtagaatgttaaatggaggt

SEQ ID NO: 772911 - DNA, 20 bp, mouse
gaactaatggtttagatctg

SEQ ID NO: 772912 - DNA, 20 bp, mouse
gtccccactccaacattttc

SEQ ID NO: 772913 - DNA, 20 bp, mouse
gctagaagcatatcaactaa

SEQ ID NO: 772914 - DNA, 20 bp, mouse
ggatgtttaagaaaccatag

SEQ ID NO: 772915 - DNA, 20 bp, mouse
gaagtctctgagttatacat

SEQ ID NO: 772916 - DNA, 20 bp, mouse
gaagacgctagagagatttg

SEQ ID NO: 772917 - DNA, 20 bp, mouse
gaagacagagaggatcccag

SEQ ID NO: 772918 - DNA, 20 bp, mouse
gaaagcaactgtgaacgtta

SEQ ID NO: 772919 - DNA, 20 bp, mouse
gttacctgttgaagtagcaa

SEQ ID NO: 772920 - DNA, 20 bp, mouse
gaggaaagtttgtttgtcca

SEQ ID NO: 772921 - DNA, 20 bp, mouse
gcaggtaattgtgttcccca

SEQ ID NO: 772922 - DNA, 20 bp, mouse
ggatgtgaagtcttatcccc

SEQ ID NO: 772923 - DNA, 20 bp, mouse
gtagcgtcttatttatttgg

SEQ ID NO: 772924 - DNA, 20 bp, mouse
ggtcactgttacagtgccat

SEQ ID NO: 772925 - DNA, 20 bp, mouse
gtaagtttccactgtctcct

SEQ ID NO: 772926 - DNA, 20 bp, mouse
gcatctggggacaaggcaaa

SEQ ID NO: 772927 - DNA, 20 bp, mouse
gccctcttctaaaacagtat

SEQ ID NO: 772928 - DNA, 20 bp, mouse
gtggcaaattctctcatttc

SEQ ID NO: 772929 - DNA, 20 bp, mouse
gaacttgcagctgcacaatc

SEQ ID NO: 772930 - DNA, 20 bp, mouse
gattaaaactgtcttatttt

SEQ ID NO: 772931 - DNA, 20 bp, mouse
gttaacattcaacagcatct

SEQ ID NO: 772932 - DNA, 20 bp, mouse
gcactcattctgcatgcatg

SEQ ID NO: 772933 - DNA, 20 bp, mouse
gttaaatattaatgcaaatt

SEQ ID NO: 772934 - DNA, 20 bp, mouse
gacagatattgatttgcagt

SEQ ID NO: 772935 - DNA, 20 bp, mouse
gattattcagccatttaaag

SEQ ID NO: 772936 - DNA, 20 bp, mouse
gagaggggacagtagaaagt

SEQ ID NO: 772937 - DNA, 20 bp, mouse
gggtaggaaacattaggact

SEQ ID NO: 772938 - DNA, 20 bp, mouse
gtctgtaagatgaccctcac

SEQ ID NO: 772939 - DNA, 20 bp, mouse
ggataaagctagactaaggc

SEQ ID NO: 772940 - DNA, 20 bp, mouse
gatagggttgagtctcaaga

SEQ ID NO: 772941 - DNA, 20 bp, mouse
gcccaatggtaggaaacatt

SEQ ID NO: 772942 - DNA, 20 bp, mouse
gtttgtttcacagactgcac

SEQ ID NO: 772943 - DNA, 20 bp, mouse
ggtgtgatagaaaaactgat

SEQ ID NO: 772944 - DNA, 20 bp, mouse
gcaaaaataccaaggcctta

SEQ ID NO: 772945 - DNA, 20 bp, mouse
ggtgtatgttgaaggctcag

SEQ ID NO: 772946 - DNA, 20 bp, mouse
gtaccttccaggttgaacat

SEQ ID NO: 772947 - DNA, 20 bp, mouse
gtctggtgtatggtgacagt

SEQ ID NO: 772948 - DNA, 20 bp, mouse
ggtaaggtcaagagaatctc

SEQ ID NO: 772949 - DNA, 20 bp, mouse
gctggaaggtacaaggtgga

SEQ ID NO: 772950 - DNA, 20 bp, mouse
gtaacaaggtagtgatcttc

SEQ ID NO: 772951 - DNA, 20 bp, mouse
gcagttctccaaaagttata

SEQ ID NO: 772952 - DNA, 20 bp, mouse
gctgttttgggagttcatga

SEQ ID NO: 772953 - DNA, 20 bp, mouse
gattaggtaattaggatgta

SEQ ID NO: 772954 - DNA, 20 bp, mouse
gttcgagcccatgttcaacc

SEQ ID NO: 772955 - DNA, 20 bp, mouse
gaacttgagattaggtaatt

SEQ ID NO: 772956 - DNA, 20 bp, mouse
gtataactgtggaaatgaaa

SEQ ID NO: 772957 - DNA, 20 bp, mouse
gaaaaaaactactgtcatgt

SEQ ID NO: 772958 - DNA, 20 bp, mouse
gtaaagcctaaaggatcagc

SEQ ID NO: 772959 - DNA, 20 bp, mouse
ggtttgtaaaagttttcaga

SEQ ID NO: 772960 - DNA, 20 bp, mouse
ggatatattaactataactg

SEQ ID NO: 772961 - DNA, 20 bp, mouse
gaaaaccaggaaggaacttt

SEQ ID NO: 772962 - DNA, 20 bp, mouse
gtcagggggacaaaatagca

SEQ ID NO: 772963 - DNA, 20 bp, mouse
gtcatcctaaagttccttcc

SEQ ID NO: 772964 - DNA, 20 bp, mouse
gctttgttctactcaatcag

SEQ ID NO: 772965 - DNA, 20 bp, mouse
ggagttgatttgcaagatgc

SEQ ID NO: 772966 - DNA, 20 bp, mouse
ggatactcaggcatgttcct

SEQ ID NO: 772967 - DNA, 20 bp, mouse
gaccctgttgcatcacagaa

SEQ ID NO: 772968 - DNA, 20 bp, mouse
ggaacatgcctgagtatcac

SEQ ID NO: 772969 - DNA, 20 bp, mouse
gttaggttggtgctttagaa

SEQ ID NO: 772970 - DNA, 20 bp, mouse
gtgtctagtgttcccagtta

SEQ ID NO: 772971 - DNA, 20 bp, mouse
ggaactatgtggaattgaaa

SEQ ID NO: 772972 - DNA, 20 bp, mouse
ggaattaagcacgacattgt

SEQ ID NO: 772973 - DNA, 20 bp, mouse
ggaattatagaagttagcac

SEQ ID NO: 772974 - DNA, 20 bp, mouse
gttcctttctgtgatgcaac

SEQ ID NO: 772975 - DNA, 20 bp, mouse
gcccagttaggggaaatttc

SEQ ID NO: 772976 - DNA, 20 bp, mouse
gactgcaaggtcaaagtaga

SEQ ID NO: 772977 - DNA, 20 bp, mouse
gaagctgaatactggtagag

SEQ ID NO: 772978 - DNA, 20 bp, mouse
gctgaagtggccaagtggat

SEQ ID NO: 772979 - DNA, 20 bp, mouse
gagagagtgaagctgaatac

SEQ ID NO: 772980 - DNA, 20 bp, mouse
gggaacctaaatctgacttt

SEQ ID NO: 772981 - DNA, 20 bp, mouse
gctggtagagaggctgactt

SEQ ID NO: 772982 - DNA, 20 bp, mouse
gtatgatgatgagaatacaa

SEQ ID NO: 772983 - DNA, 20 bp, mouse
ggctaaccagccacagtcag

SEQ ID NO: 772984 - DNA, 20 bp, mouse
ggttttgacgacacaggttt

SEQ ID NO: 772985 - DNA, 20 bp, mouse
gtcacaggttttgacgacac

SEQ ID NO: 772986 - DNA, 20 bp, mouse
gtagctctagtagcactaga

SEQ ID NO: 772987 - DNA, 20 bp, mouse
gcagatcagaggatcaattt

SEQ ID NO: 772988 - DNA, 20 bp, mouse
gtgacctgctaccataccac

SEQ ID NO: 772989 - DNA, 20 bp, mouse
gaagcctgtggtatggtagc

SEQ ID NO: 772990 - DNA, 20 bp, mouse
gccaaaagcccatgtattac

SEQ ID NO: 772991 - DNA, 20 bp, mouse
gaccacaggcttaaaaacaa

SEQ ID NO: 772992 - DNA, 20 bp, mouse
gcagggcctcagtttatgac

SEQ ID NO: 772993 - DNA, 20 bp, mouse
ggatgtcattaaattgttgg

SEQ ID NO: 772994 - DNA, 20 bp, mouse
gataaaccagtcataaactg

SEQ ID NO: 772995 - DNA, 20 bp, mouse
gatcgccttgatgggaacag

SEQ ID NO: 772996 - DNA, 20 bp, mouse
gtaccaaagtccccaaatca

SEQ ID NO: 772997 - DNA, 20 bp, mouse
gtaaagtttaagcttctaaa

SEQ ID NO: 772998 - DNA, 20 bp, mouse
gctaccttatttgggacagt

SEQ ID NO: 772999 - DNA, 20 bp, mouse
gaagccaagctaccttattt

SEQ ID NO: 773000 - DNA, 20 bp, mouse
gaagcctactgtcccaaata

SEQ ID NO: 773001 - DNA, 20 bp, mouse
gttccttgatttggggactt

SEQ ID NO: 773002 - DNA, 20 bp, mouse
gcagagcatcttccttgatt

SEQ ID NO: 773003 - DNA, 20 bp, mouse
gggacagtaggcttatagat

SEQ ID NO: 773004 - DNA, 20 bp, mouse
gagtccattagggaagtgta

SEQ ID NO: 773005 - DNA, 20 bp, mouse
gtgtttaactgcataacctt

SEQ ID NO: 773006 - DNA, 20 bp, mouse
gaagctgaaatgttacttct

SEQ ID NO: 773007 - DNA, 20 bp, mouse
ggtgtggtttacatgcgtat

SEQ ID NO: 773008 - DNA, 20 bp, mouse
gatcagagacatagaagtaa

SEQ ID NO: 773009 - DNA, 20 bp, mouse
gtcacttctaccatcatctt

SEQ ID NO: 773010 - DNA, 20 bp, mouse
gttgaacttacccaagatga

SEQ ID NO: 773011 - DNA, 20 bp, mouse
gaagtaacatttcagcttgt

SEQ ID NO: 773012 - DNA, 20 bp, mouse
gggtttacatgcgtataggt

SEQ ID NO: 773013 - DNA, 20 bp, mouse
gatgatattattatgttgtg

SEQ ID NO: 773014 - DNA, 20 bp, mouse
gtcaccctttttattacata

SEQ ID NO: 773015 - DNA, 20 bp, mouse
gggaagagtttcatattttg

SEQ ID NO: 773016 - DNA, 20 bp, mouse
gttacagcaaccctggtgaa

SEQ ID NO: 773017 - DNA, 20 bp, mouse
gaccataattggggcctctt

SEQ ID NO: 773018 - DNA, 20 bp, mouse
gaaaggccactcacaggtgt

SEQ ID NO: 773019 - DNA, 20 bp, mouse
gaaagtggttcccttcacca

SEQ ID NO: 773020 - DNA, 20 bp, mouse
gcaccagggttgctgtaaat

SEQ ID NO: 773021 - DNA, 20 bp, mouse
gccccaagaggccccaatta

SEQ ID NO: 773022 - DNA, 20 bp, mouse
ggtcaggtgaaatattaaag

SEQ ID NO: 773023 - DNA, 20 bp, mouse
gagactctattaaccccaag

SEQ ID NO: 773024 - DNA, 20 bp, mouse
gtgcaggtgggttttattag

SEQ ID NO: 773025 - DNA, 20 bp, mouse
gttcccatttacagcaaccc

SEQ ID NO: 773026 - DNA, 20 bp, mouse
gttccttaatgctgaaggtt

SEQ ID NO: 773027 - DNA, 20 bp, mouse
gtccctaaccttcagcatta

SEQ ID NO: 773028 - DNA, 20 bp, mouse
gacagaatctccagcatgta

SEQ ID NO: 773029 - DNA, 20 bp, mouse
gcttactttggttgtcttca

SEQ ID NO: 773030 - DNA, 20 bp, mouse
gataagatgtgcttgagcct

SEQ ID NO: 773031 - DNA, 20 bp, mouse
gcaaagttccttaatgctga

SEQ ID NO: 773032 - DNA, 20 bp, mouse
gattaatgaggttagaggtt

SEQ ID NO: 773033 - DNA, 20 bp, mouse
ggaactaatatactttgata

SEQ ID NO: 773034 - DNA, 20 bp, mouse
gaagacaaccaaagtaagta

SEQ ID NO: 773035 - DNA, 20 bp, mouse
gttagaggttagggaatttt

SEQ ID NO: 773036 - DNA, 20 bp, mouse
gcatcccagattgggtaact

SEQ ID NO: 773037 - DNA, 20 bp, mouse
gcagagcccagccatatcac

SEQ ID NO: 773038 - DNA, 20 bp, mouse
gggtatctgcatcccagatt

SEQ ID NO: 773039 - DNA, 20 bp, mouse
gaaaatgttaagccactctc

SEQ ID NO: 773040 - DNA, 20 bp, mouse
ggttccccagttacccaatc

SEQ ID NO: 773041 - DNA, 20 bp, mouse
ggtgagaatcaaattctgtg

SEQ ID NO: 773042 - DNA, 20 bp, mouse
gcagatacctgtgatatggc

SEQ ID NO: 773043 - DNA, 20 bp, mouse
gtcagtataaatggatcaag

SEQ ID NO: 773044 - DNA, 20 bp, mouse
gtacagcagcatgcaaaggc

SEQ ID NO: 773045 - DNA, 20 bp, mouse
gataaaagtacagaccactg

SEQ ID NO: 773046 - DNA, 20 bp, mouse
gggagcctataaagacttat

SEQ ID NO: 773047 - DNA, 20 bp, mouse
gtataggtatataaattaga

SEQ ID NO: 773048 - DNA, 20 bp, mouse
gtatacctataagtctttat

SEQ ID NO: 773049 - DNA, 20 bp, mouse
gttgacaatgagataaggtg

SEQ ID NO: 773050 - DNA, 20 bp, mouse
gtaaatggcatcattgaatt

SEQ ID NO: 773051 - DNA, 20 bp, mouse
gtgaagttgacaatgagata

SEQ ID NO: 773052 - DNA, 20 bp, mouse
gagttgaaagcagtagatac

SEQ ID NO: 773053 - DNA, 20 bp, mouse
gatctcatgatgactgccat

SEQ ID NO: 773054 - DNA, 20 bp, mouse
gaagtaagaaatttacttag

SEQ ID NO: 773055 - DNA, 20 bp, mouse
gaacctttgacttctaactt

SEQ ID NO: 773056 - DNA, 20 bp, mouse
gtagactttttcaacttgta

SEQ ID NO: 773057 - DNA, 20 bp, mouse
gtctccccagaactctgaaa

SEQ ID NO: 773058 - DNA, 20 bp, mouse
gcaaagtggaaatcagtact

SEQ ID NO: 773059 - DNA, 20 bp, mouse
gcagtgtgaaatagaagcta

SEQ ID NO: 773060 - DNA, 20 bp, mouse
gagagcatcctcactcaaag

SEQ ID NO: 773061 - DNA, 20 bp, mouse
gtcaccatttcagagttctg

SEQ ID NO: 773062 - DNA, 20 bp, mouse
gagatttcattgcaggccag

SEQ ID NO: 773063 - DNA, 20 bp, mouse
gaatctcaatgccattcatt

SEQ ID NO: 773064 - DNA, 20 bp, mouse
gggcattgagatttcattgc

SEQ ID NO: 773065 - DNA, 20 bp, mouse
ggaagatctcaagaatgtag

SEQ ID NO: 773066 - DNA, 20 bp, mouse
gactgaaggtctctcgctcc

SEQ ID NO: 773067 - DNA, 20 bp, mouse
gttaaacagacttggagtta

SEQ ID NO: 773068 - DNA, 20 bp, mouse
gtggtcatagcagggaatgt

SEQ ID NO: 773069 - DNA, 20 bp, mouse
gtcatgacaaatggtgataa

SEQ ID NO: 773070 - DNA, 20 bp, mouse
gaatgaggaggctaaggact

SEQ ID NO: 773071 - DNA, 20 bp, mouse
gtggcaagaagaccatgaat

SEQ ID NO: 773072 - DNA, 20 bp, mouse
gaagaagaccatgaatggga

SEQ ID NO: 773073 - DNA, 20 bp, mouse
gaaaatagctcgggtaaatt

SEQ ID NO: 773074 - DNA, 20 bp, mouse
gggagatggtggtcatagca

SEQ ID NO: 773075 - DNA, 20 bp, mouse
gtctgtacatttgtctcaag

SEQ ID NO: 773076 - DNA, 20 bp, mouse
gataaggaagctgctgatat

SEQ ID NO: 773077 - DNA, 20 bp, mouse
ggtccagaagacagtactta

SEQ ID NO: 773078 - DNA, 20 bp, mouse
gatgaggaatcccctccatc

SEQ ID NO: 773079 - DNA, 20 bp, mouse
gtaccataagtactgtcttc

SEQ ID NO: 773080 - DNA, 20 bp, mouse
gactggcatcgtggtgcttt

SEQ ID NO: 773081 - DNA, 20 bp, mouse
gtgaactggaatacctcatg

SEQ ID NO: 773082 - DNA, 20 bp, mouse
gccagttcatgcattgcata

SEQ ID NO: 773083 - DNA, 20 bp, mouse
gatcccctccatcaggctga

SEQ ID NO: 773084 - DNA, 20 bp, mouse
gcttcatagaactggcatcg

SEQ ID NO: 773085 - DNA, 20 bp, mouse
gagccttcagcctgatggag

SEQ ID NO: 773086 - DNA, 20 bp, mouse
ggggccttatccaatgggaa

SEQ ID NO: 773087 - DNA, 20 bp, mouse
gagaaaagctatgcccatca

SEQ ID NO: 773088 - DNA, 20 bp, mouse
gttaaaggaacccttcccat

SEQ ID NO: 773089 - DNA, 20 bp, mouse
gcattggataaggcccggga

SEQ ID NO: 773090 - DNA, 20 bp, mouse
ggaacccttcccattggata

SEQ ID NO: 773091 - DNA, 20 bp, mouse
gaacctcaaaacccatacta

SEQ ID NO: 773092 - DNA, 20 bp, mouse
gacgaggtgtgaaagaaaca

SEQ ID NO: 773093 - DNA, 20 bp, mouse
gcaggtgtcttaggaaaacg

SEQ ID NO: 773094 - DNA, 20 bp, mouse
gggttttgaggtttgtttaa

SEQ ID NO: 773095 - DNA, 20 bp, mouse
gaagactagaaccaggattc

SEQ ID NO: 773096 - DNA, 20 bp, mouse
gtctgggagcacatgctgta

SEQ ID NO: 773097 - DNA, 20 bp, mouse
gtgtgttaccagaactactg

SEQ ID NO: 773098 - DNA, 20 bp, mouse
gcaggaatttaagaactttg

SEQ ID NO: 773099 - DNA, 20 bp, mouse
gggaggtagtgtggcaactc

SEQ ID NO: 773100 - DNA, 20 bp, mouse
ggttgtctccgcagtagttc

SEQ ID NO: 773101 - DNA, 20 bp, mouse
ggagaaatggcaagtttagc

SEQ ID NO: 773102 - DNA, 20 bp, mouse
gaatggcaagtttagcagga

SEQ ID NO: 773103 - DNA, 20 bp, mouse
ggatgtacgacagcttgatc

SEQ ID NO: 773104 - DNA, 20 bp, mouse
gtctcgtttcttggacaaac

SEQ ID NO: 773105 - DNA, 20 bp, mouse
gcaagtttagcaggagggtc

SEQ ID NO: 773106 - DNA, 20 bp, mouse
gctaggagtccttcacccac

SEQ ID NO: 773107 - DNA, 20 bp, mouse
gatgtgtggagtctgagtta

SEQ ID NO: 773108 - DNA, 20 bp, mouse
gttcagccatactctcctgt

SEQ ID NO: 773109 - DNA, 20 bp, mouse
gtgactttgggaggaactag

SEQ ID NO: 773110 - DNA, 20 bp, mouse
gaggtgataaaagctggcta

SEQ ID NO: 773111 - DNA, 20 bp, mouse
gtaaaaggaggatatgacgt

SEQ ID NO: 773112 - DNA, 20 bp, mouse
gacaggatggctgaactaag

SEQ ID NO: 773113 - DNA, 20 bp, mouse
gacatcatgtcaccaatgtg

SEQ ID NO: 773114 - DNA, 20 bp, mouse
gttcagatactcagctaccc

SEQ ID NO: 773115 - DNA, 20 bp, mouse
ggggatggggtgactttggg

SEQ ID NO: 773116 - DNA, 20 bp, mouse
ggagctggagtcgtggctca

SEQ ID NO: 773117 - DNA, 20 bp, mouse
gcaggtatgggactttgaag

SEQ ID NO: 773118 - DNA, 20 bp, mouse
gcctatcagtgagcggctgg

SEQ ID NO: 773119 - DNA, 20 bp, mouse
gtacctgcaccagggtgtct

SEQ ID NO: 773120 - DNA, 20 bp, mouse
ggatccctctgccgaggata

SEQ ID NO: 773121 - DNA, 20 bp, mouse
gatttgggatggactgtttc

SEQ ID NO: 773122 - DNA, 20 bp, mouse
gttttccatatcctcggcag

SEQ ID NO: 773123 - DNA, 20 bp, mouse
gttttcagatccctctgccg

SEQ ID NO: 773124 - DNA, 20 bp, mouse
gtggagtcgtggctcagggg

SEQ ID NO: 773125 - DNA, 20 bp, mouse
gaactggaggatttcaggca

SEQ ID NO: 773126 - DNA, 20 bp, mouse
ggaggaggggctggagtggc

SEQ ID NO: 773127 - DNA, 20 bp, mouse
gtcctcctccggccgctcac

SEQ ID NO: 773128 - DNA, 20 bp, mouse
gcctaccagtgagcggccgg

SEQ ID NO: 773129 - DNA, 20 bp, mouse
gaccagtgagcggccggagg

SEQ ID NO: 773130 - DNA, 20 bp, mouse
gaacttgaggatttcaagca

SEQ ID NO: 773131 - DNA, 20 bp, mouse
gtgatgtaaaattatcccag

SEQ ID NO: 773132 - DNA, 20 bp, mouse
gtacaccctggtgcaggtgt

SEQ ID NO: 773133 - DNA, 20 bp, mouse
ggatctctctgccaaggata

SEQ ID NO: 773134 - DNA, 20 bp, mouse
gttttcagatctctctgcca

SEQ ID NO: 773135 - DNA, 20 bp, mouse
gggctggagtggctggagga

SEQ ID NO: 773136 - DNA, 20 bp, mouse
gctagagacactggcaccaa

SEQ ID NO: 773137 - DNA, 20 bp, mouse
gaagcctcaacgctatctca

SEQ ID NO: 773138 - DNA, 20 bp, mouse
gaaaccctgagatagcgttg

SEQ ID NO: 773139 - DNA, 20 bp, mouse
ggacactggcaccaaaggtg

SEQ ID NO: 773140 - DNA, 20 bp, mouse
gcccttggcccctaagaagc

SEQ ID NO: 773141 - DNA, 20 bp, mouse
ggtgtctctaggattctttg

SEQ ID NO: 773142 - DNA, 20 bp, mouse
gggcactgtacttcctgccc

SEQ ID NO: 773143 - DNA, 20 bp, mouse
gctaagaagctggcttgata

SEQ ID NO: 773144 - DNA, 20 bp, mouse
gtgatcctaacaagaccctg

SEQ ID NO: 773145 - DNA, 20 bp, mouse
gggggtgcacccctcaagga

SEQ ID NO: 773146 - DNA, 20 bp, mouse
gactatacttggaaaatggt

SEQ ID NO: 773147 - DNA, 20 bp, mouse
gcatgactatacttggaaaa

SEQ ID NO: 773148 - DNA, 20 bp, mouse
gccccgtggtactgtgtcaa

SEQ ID NO: 773149 - DNA, 20 bp, mouse
gtacagggagtacatagcaa

SEQ ID NO: 773150 - DNA, 20 bp, mouse
gggaatgtagaagttgatag

SEQ ID NO: 773151 - DNA, 20 bp, mouse
gtccgttgacacagtaccac

SEQ ID NO: 773152 - DNA, 20 bp, mouse
gtcaacggagcttgcatttg

SEQ ID NO: 773153 - DNA, 20 bp, mouse
gcttgcatttggggaggtaa

SEQ ID NO: 773154 - DNA, 20 bp, mouse
gtacaggcctctgagagaat

SEQ ID NO: 773155 - DNA, 20 bp, mouse
gggcctgtatttctgatcat

SEQ ID NO: 773156 - DNA, 20 bp, mouse
gaagtgggagagaaacacat

SEQ ID NO: 773157 - DNA, 20 bp, mouse
gcacttagagggtagtgaag

SEQ ID NO: 773158 - DNA, 20 bp, mouse
gcacagatgaatacacttag

SEQ ID NO: 773159 - DNA, 20 bp, mouse
ggatagaaatggccctgtag

SEQ ID NO: 773160 - DNA, 20 bp, mouse
ggtgagtcccaaaggagtcc

SEQ ID NO: 773161 - DNA, 20 bp, mouse
gttcgttcagcatgtagtct

SEQ ID NO: 773162 - DNA, 20 bp, mouse
gaattatccaggacctctac

SEQ ID NO: 773163 - DNA, 20 bp, mouse
gtgggagagaaacacatggg

SEQ ID NO: 773164 - DNA, 20 bp, mouse
gaagaggctgtgagtcccaa

SEQ ID NO: 773165 - DNA, 20 bp, mouse
gtattctttgtggggctaag

SEQ ID NO: 773166 - DNA, 20 bp, mouse
gaactgaatcagattagaaa

SEQ ID NO: 773167 - DNA, 20 bp, mouse
gggggagagtatgaaaatag

SEQ ID NO: 773168 - DNA, 20 bp, mouse
gaaatagaaaggacccctag

SEQ ID NO: 773169 - DNA, 20 bp, mouse
gtttgataggcttcagtttc

SEQ ID NO: 773170 - DNA, 20 bp, mouse
ggaggtaaaatggacactca

SEQ ID NO: 773171 - DNA, 20 bp, mouse
ggagcagagactttgtttcc

SEQ ID NO: 773172 - DNA, 20 bp, mouse
gtcctggcagtgtttatacc

SEQ ID NO: 773173 - DNA, 20 bp, mouse
gtgtctgttcactagtgcct

SEQ ID NO: 773174 - DNA, 20 bp, mouse
gagcaggctataaaaatcca

SEQ ID NO: 773175 - DNA, 20 bp, mouse
gatatctgtcttggccacta

SEQ ID NO: 773176 - DNA, 20 bp, mouse
gtcttcatacatgcaatgga

SEQ ID NO: 773177 - DNA, 20 bp, mouse
gattgcatgtatgaagataa

SEQ ID NO: 773178 - DNA, 20 bp, mouse
gatgttccctagatatatgt

SEQ ID NO: 773179 - DNA, 20 bp, mouse
gattataatttctacaaata

SEQ ID NO: 773180 - DNA, 20 bp, mouse
gaaaccaaattacaaacaac

SEQ ID NO: 773181 - DNA, 20 bp, mouse
gaccaggagacaggagaaga

SEQ ID NO: 773182 - DNA, 20 bp, mouse
gaagagaaggaccaggagac

SEQ ID NO: 773183 - DNA, 20 bp, mouse
ggcaatggaaggaagatgat

SEQ ID NO: 773184 - DNA, 20 bp, mouse
gaaaaaccaacatatatcta

SEQ ID NO: 773185 - DNA, 20 bp, mouse
gtctctcttgcttcaagttc

SEQ ID NO: 773186 - DNA, 20 bp, mouse
gtctcagactaattaactat

SEQ ID NO: 773187 - DNA, 20 bp, mouse
gactgggcacttgaagccca

SEQ ID NO: 773188 - DNA, 20 bp, mouse
gtacatccccctgccatccc

SEQ ID NO: 773189 - DNA, 20 bp, mouse
gaatgactatgcatatttcc

SEQ ID NO: 773190 - DNA, 20 bp, mouse
gggctttttggctttcttat

SEQ ID NO: 773191 - DNA, 20 bp, mouse
gctagttgtttttacatatt

SEQ ID NO: 773192 - DNA, 20 bp, mouse
gtcagagatggtgcatacat

SEQ ID NO: 773193 - DNA, 20 bp, mouse
gagggggatgtattcagaga

SEQ ID NO: 773194 - DNA, 20 bp, mouse
gtgcatacataggtgtatat

SEQ ID NO: 773195 - DNA, 20 bp, mouse
gtgtaaaaacaactagtgtt

SEQ ID NO: 773196 - DNA, 20 bp, mouse
ggcttagtggtatttagaaa

SEQ ID NO: 773197 - DNA, 20 bp, mouse
gaaggaagatgattagtcaa

SEQ ID NO: 773198 - DNA, 20 bp, mouse
ggtggtatttagaaaaggat

SEQ ID NO: 773199 - DNA, 20 bp, mouse
gaagcagaaatctgtgttac

SEQ ID NO: 773200 - DNA, 20 bp, mouse
gcaaacaacaattgagcaga

SEQ ID NO: 773201 - DNA, 20 bp, mouse
ggacagcattaatttcactt

SEQ ID NO: 773202 - DNA, 20 bp, mouse
gctgtcatacatgcaatgga

SEQ ID NO: 773203 - DNA, 20 bp, mouse
gtctcaatagaagtgcttag

SEQ ID NO: 773204 - DNA, 20 bp, mouse
gattgagcagaaggccagag

SEQ ID NO: 773205 - DNA, 20 bp, mouse
gtggctaattctttcctctc

SEQ ID NO: 773206 - DNA, 20 bp, mouse
ggaggcccagaaatagcagg

SEQ ID NO: 773207 - DNA, 20 bp, mouse
gtaaggcatagtaattactt

SEQ ID NO: 773208 - DNA, 20 bp, mouse
gtagcagggggatgtatgca

SEQ ID NO: 773209 - DNA, 20 bp, mouse
gctgtatgtctcattaagta

SEQ ID NO: 773210 - DNA, 20 bp, mouse
gctgaattcctctaggatgc

SEQ ID NO: 773211 - DNA, 20 bp, mouse
gacatccccctgctatttct

SEQ ID NO: 773212 - DNA, 20 bp, mouse
gcttgaggcccagaaatagc

SEQ ID NO: 773213 - DNA, 20 bp, mouse
ggcatagttattttatactc

SEQ ID NO: 773214 - DNA, 20 bp, mouse
gcaagtgcccagcatcctag

SEQ ID NO: 773215 - DNA, 20 bp, mouse
gacaggaactgaattcctct

SEQ ID NO: 773216 - DNA, 20 bp, mouse
gagacatagaactgtcttct

SEQ ID NO: 773217 - DNA, 20 bp, mouse
gatgactgcaaaatccactg

SEQ ID NO: 773218 - DNA, 20 bp, mouse
gctaagacattggagaatgt

SEQ ID NO: 773219 - DNA, 20 bp, mouse
ggaagatgattagttaagag

SEQ ID NO: 773220 - DNA, 20 bp, mouse
gcttctgatatctgtcacac

SEQ ID NO: 773221 - DNA, 20 bp, mouse
gaaatactaatctaagacat

SEQ ID NO: 773222 - DNA, 20 bp, mouse
ggaacaaacaacagtcaccc

SEQ ID NO: 773223 - DNA, 20 bp, mouse
gcctgctacctgctcatcct

SEQ ID NO: 773224 - DNA, 20 bp, mouse
gacagtcacccaggatgagc

SEQ ID NO: 773225 - DNA, 20 bp, mouse
gggagaatgtgggatgtttg

SEQ ID NO: 773226 - DNA, 20 bp, mouse
ggaacagacaaaagtcaacc

SEQ ID NO: 773227 - DNA, 20 bp, mouse
gaaacagtgtacaaatatct

SEQ ID NO: 773228 - DNA, 20 bp, mouse
gaaagtcaaccaggatgatc

SEQ ID NO: 773229 - DNA, 20 bp, mouse
gggtgcctgtcataaagtaa

SEQ ID NO: 773230 - DNA, 20 bp, mouse
gaaagaataatctactacat

SEQ ID NO: 773231 - DNA, 20 bp, mouse
gtgtcataaagtaatggaat

SEQ ID NO: 773232 - DNA, 20 bp, mouse
gttcttaacatctctctact

SEQ ID NO: 773233 - DNA, 20 bp, mouse
gtattctttcatacttggac

SEQ ID NO: 773234 - DNA, 20 bp, mouse
gggggttaattagtttacag

SEQ ID NO: 773235 - DNA, 20 bp, mouse
gcttgggtcttttgaggatc

SEQ ID NO: 773236 - DNA, 20 bp, mouse
gctgtcatacatggtgtaga

SEQ ID NO: 773237 - DNA, 20 bp, mouse
gtacatgaatgagttggaaa

SEQ ID NO: 773238 - DNA, 20 bp, mouse
ggcagaatctgaaaacatca

SEQ ID NO: 773239 - DNA, 20 bp, mouse
gttctgctgcctgtcataca

SEQ ID NO: 773240 - DNA, 20 bp, mouse
gaaatttaggtacacttttc

SEQ ID NO: 773241 - DNA, 20 bp, mouse
gcagtgggtctaactcatag

SEQ ID NO: 773242 - DNA, 20 bp, mouse
ggggaggtacatgaatgagt

SEQ ID NO: 773243 - DNA, 20 bp, mouse
gaaatggtaatcaaatgcat

SEQ ID NO: 773244 - DNA, 20 bp, mouse
gcagaaatatgaatgttaca

SEQ ID NO: 773245 - DNA, 20 bp, mouse
gaattatgatgataaaattt

SEQ ID NO: 773246 - DNA, 20 bp, mouse
gcatcaacggctcccatctc

SEQ ID NO: 773247 - DNA, 20 bp, mouse
gactgatcagtgaccatcaa

SEQ ID NO: 773248 - DNA, 20 bp, mouse
gctcaggggctttggaaagt

SEQ ID NO: 773249 - DNA, 20 bp, mouse
gtacaagatcaggattcctc

SEQ ID NO: 773250 - DNA, 20 bp, mouse
gagtctactgcaatctaaga

SEQ ID NO: 773251 - DNA, 20 bp, mouse
gactgtcttcaattttggca

SEQ ID NO: 773252 - DNA, 20 bp, mouse
gctgcataagtcataagaat

SEQ ID NO: 773253 - DNA, 20 bp, mouse
gcttgatatacttagtaaga

SEQ ID NO: 773254 - DNA, 20 bp, mouse
gagctagactgtcaatttgt

SEQ ID NO: 773255 - DNA, 20 bp, mouse
ggcattcacaattacttcag

SEQ ID NO: 773256 - DNA, 20 bp, mouse
gtggaatttggggcactgaa

SEQ ID NO: 773257 - DNA, 20 bp, mouse
gaacacctttcattccccca

SEQ ID NO: 773258 - DNA, 20 bp, mouse
gctctctattaatgccaaca

SEQ ID NO: 773259 - DNA, 20 bp, mouse
gaatgaaaggtgttgggacc

SEQ ID NO: 773260 - DNA, 20 bp, mouse
gttgatcattgtatccatgt

SEQ ID NO: 773261 - DNA, 20 bp, mouse
ggatatctctgtggaatttg

SEQ ID NO: 773262 - DNA, 20 bp, mouse
gagctacagggaatcttctt

SEQ ID NO: 773263 - DNA, 20 bp, mouse
gatagacttatttcgtctaa

SEQ ID NO: 773264 - DNA, 20 bp, mouse
gtagaacaatttctttaatg

SEQ ID NO: 773265 - DNA, 20 bp, mouse
gttttccttgggggaatgaa

SEQ ID NO: 773266 - DNA, 20 bp, mouse
gaagaataggacataaaagg

SEQ ID NO: 773267 - DNA, 20 bp, mouse
gaaaaagaataggacataaa

SEQ ID NO: 773268 - DNA, 20 bp, mouse
gttgggtagcaagggcagag

SEQ ID NO: 773269 - DNA, 20 bp, mouse
gccagtatagggggaattcc

SEQ ID NO: 773270 - DNA, 20 bp, mouse
ggataagtaacttaatgctt

SEQ ID NO: 773271 - DNA, 20 bp, mouse
ggaattccaggtccagaaat

SEQ ID NO: 773272 - DNA, 20 bp, mouse
gttctatgccccagtatagg

SEQ ID NO: 773273 - DNA, 20 bp, mouse
ggctttgtggtttagttcta

SEQ ID NO: 773274 - DNA, 20 bp, mouse
gctagttgctcatcaatagg

SEQ ID NO: 773275 - DNA, 20 bp, mouse
gccactcccatttctggacc

SEQ ID NO: 773276 - DNA, 20 bp, mouse
gactcagctctgatgacatc

SEQ ID NO: 773277 - DNA, 20 bp, mouse
ggcaggctcccttaggtcca

SEQ ID NO: 773278 - DNA, 20 bp, mouse
gcctaagggagcctgctctc

SEQ ID NO: 773279 - DNA, 20 bp, mouse
gggtccagggatgagaatgc

SEQ ID NO: 773280 - DNA, 20 bp, mouse
gctgagtcactcacagttac

SEQ ID NO: 773281 - DNA, 20 bp, mouse
gggctctgtttatgagaagg

SEQ ID NO: 773282 - DNA, 20 bp, mouse
ggggttggcaggaatctttg

SEQ ID NO: 773283 - DNA, 20 bp, mouse
gtagtcactgattccattgg

SEQ ID NO: 773284 - DNA, 20 bp, mouse
gactcttaattgttctagaa

SEQ ID NO: 773285 - DNA, 20 bp, mouse
ggattcctgccaacccccaa

SEQ ID NO: 773286 - DNA, 20 bp, mouse
gcacaagatcagggctcctc

SEQ ID NO: 773287 - DNA, 20 bp, mouse
gtgtaatccagcctttacta

SEQ ID NO: 773288 - DNA, 20 bp, mouse
gagctagactatcaacttgt

SEQ ID NO: 773289 - DNA, 20 bp, mouse
gagtagatttgccttagtaa

SEQ ID NO: 773290 - DNA, 20 bp, mouse
ggactatcaacttgtgggaa

SEQ ID NO: 773291 - DNA, 20 bp, mouse
ggatttgccttagtaaaggc

SEQ ID NO: 773292 - DNA, 20 bp, mouse
gtgtcaaagccctgaggtgg

SEQ ID NO: 773293 - DNA, 20 bp, mouse
ggggtaattgcacaagatca

SEQ ID NO: 773294 - DNA, 20 bp, mouse
gatcatctgcccccacctca

SEQ ID NO: 773295 - DNA, 20 bp, mouse
gaattccttcatgtacttag

SEQ ID NO: 773296 - DNA, 20 bp, mouse
gaaaacctgcaaaaggtagt

SEQ ID NO: 773297 - DNA, 20 bp, mouse
gacctgcaaaaggtagttgg

SEQ ID NO: 773298 - DNA, 20 bp, mouse
gcacaggataagcaagaagt

SEQ ID NO: 773299 - DNA, 20 bp, mouse
gagagataaaaacctgcaaa

SEQ ID NO: 773300 - DNA, 20 bp, mouse
gagagcagaaatatgttaca

SEQ ID NO: 773301 - DNA, 20 bp, mouse
gattcatatcttagtagaca

SEQ ID NO: 773302 - DNA, 20 bp, mouse
gaagaccatgaacttaacat

SEQ ID NO: 773303 - DNA, 20 bp, mouse
gtcctccaactaccttttgc

SEQ ID NO: 773304 - DNA, 20 bp, mouse
gacagggtttgagtttgaag

SEQ ID NO: 773305 - DNA, 20 bp, mouse
gaaggcccatgttaagttca

SEQ ID NO: 773306 - DNA, 20 bp, mouse
ggaagcatcttggaaatgat

SEQ ID NO: 773307 - DNA, 20 bp, mouse
gcccagggtgagcaggaaat

SEQ ID NO: 773308 - DNA, 20 bp, mouse
gaaatggcatagaagcatct

SEQ ID NO: 773309 - DNA, 20 bp, mouse
gatatatgttctacaacaat

SEQ ID NO: 773310 - DNA, 20 bp, mouse
gtaaacaatctagttaccca

SEQ ID NO: 773311 - DNA, 20 bp, mouse
gggagcatgtgagattttct

SEQ ID NO: 773312 - DNA, 20 bp, mouse
gctagttacccagggtgagc

SEQ ID NO: 773313 - DNA, 20 bp, mouse
ggaaaatcactagtccattt

SEQ ID NO: 773314 - DNA, 20 bp, mouse
ggtaatgtttacagtgatca

SEQ ID NO: 773315 - DNA, 20 bp, mouse
gtttctataaagttccaaaa

SEQ ID NO: 773316 - DNA, 20 bp, mouse
gaatgtgctaagtcaatact

SEQ ID NO: 773317 - DNA, 20 bp, mouse
gaggaaagtagaaaatgcta

SEQ ID NO: 773318 - DNA, 20 bp, mouse
gtttattcaatgacatagtg

SEQ ID NO: 773319 - DNA, 20 bp, mouse
gtttaattgaaatatggata

SEQ ID NO: 773320 - DNA, 20 bp, mouse
gcatctaccaaggacaactg

SEQ ID NO: 773321 - DNA, 20 bp, mouse
gcaacagactgtacaagatt

SEQ ID NO: 773322 - DNA, 20 bp, mouse
gtaaagaatgtgaacaataa

SEQ ID NO: 773323 - DNA, 20 bp, mouse
ggaaatatggatatggatgt

SEQ ID NO: 773324 - DNA, 20 bp, mouse
gtctcaggcagaaaatgtaa

SEQ ID NO: 773325 - DNA, 20 bp, mouse
gtgtatgttatcatctacca

SEQ ID NO: 773326 - DNA, 20 bp, mouse
ggaaggtaacagctcattgt

SEQ ID NO: 773327 - DNA, 20 bp, mouse
gcttggaaagctaaagctgg

SEQ ID NO: 773328 - DNA, 20 bp, mouse
gtacataaagcaatgataca

SEQ ID NO: 773329 - DNA, 20 bp, mouse
gtccaaaaacttaagcaggt

SEQ ID NO: 773330 - DNA, 20 bp, mouse
gacttgttatcacagccact

SEQ ID NO: 773331 - DNA, 20 bp, mouse
gtgagtccaaaaacttaagc

SEQ ID NO: 773332 - DNA, 20 bp, mouse
gtctcaatctaaaattaaaa

SEQ ID NO: 773333 - DNA, 20 bp, mouse
gtcctacctgcttaagtttt

SEQ ID NO: 773334 - DNA, 20 bp, mouse
gtggtctcaaacttgctaca

SEQ ID NO: 773335 - DNA, 20 bp, mouse
gcaaacttgctacatggccc

SEQ ID NO: 773336 - DNA, 20 bp, mouse
gtcagagaggtgctgaatga

SEQ ID NO: 773337 - DNA, 20 bp, mouse
gagggaatgtgtgaagttat

SEQ ID NO: 773338 - DNA, 20 bp, mouse
gctactcagttcatatgagt

SEQ ID NO: 773339 - DNA, 20 bp, mouse
gggagtacagtcaaataagc

SEQ ID NO: 773340 - DNA, 20 bp, mouse
gaagtccaggaaatctactt

SEQ ID NO: 773341 - DNA, 20 bp, mouse
gtaggctattcaggcatgcg

SEQ ID NO: 773342 - DNA, 20 bp, mouse
gaggccactagaactttcta

SEQ ID NO: 773343 - DNA, 20 bp, mouse
gttctggctccttataagga

SEQ ID NO: 773344 - DNA, 20 bp, mouse
ggaagtgtgtccttggtaat

SEQ ID NO: 773345 - DNA, 20 bp, mouse
gtcatatgagtaggctattc

SEQ ID NO: 773346 - DNA, 20 bp, mouse
ggccagagaagctcacaggt

SEQ ID NO: 773347 - DNA, 20 bp, mouse
gaagtcctccagatccagta

SEQ ID NO: 773348 - DNA, 20 bp, mouse
gcaaagagccctactggatc

SEQ ID NO: 773349 - DNA, 20 bp, mouse
gtaaggtagagaatgtcctc

SEQ ID NO: 773350 - DNA, 20 bp, mouse
gccagtagggctctttggtg

SEQ ID NO: 773351 - DNA, 20 bp, mouse
gaaggacactaagaccacaa

SEQ ID NO: 773352 - DNA, 20 bp, mouse
gtcccacctgtgagcttctc

SEQ ID NO: 773353 - DNA, 20 bp, mouse
gggaggacttgatttcccag

SEQ ID NO: 773354 - DNA, 20 bp, mouse
gctgggcagcaagcacccta

SEQ ID NO: 773355 - DNA, 20 bp, mouse
gggtagagaatgtcctcagg

SEQ ID NO: 773356 - DNA, 20 bp, mouse
gcaacccccagcatcttaaa

SEQ ID NO: 773357 - DNA, 20 bp, mouse
gacaaacactgacatagcaa

SEQ ID NO: 773358 - DNA, 20 bp, mouse
ggctgtagatatgtgggctg

SEQ ID NO: 773359 - DNA, 20 bp, mouse
ggctttgtatcagtaactgc

SEQ ID NO: 773360 - DNA, 20 bp, mouse
ggggaaagaacatttacctg

SEQ ID NO: 773361 - DNA, 20 bp, mouse
gtggtgacctaacccaatat

SEQ ID NO: 773362 - DNA, 20 bp, mouse
gatgtaggagaaaacacaag

SEQ ID NO: 773363 - DNA, 20 bp, mouse
ggggggttgctgtagatatg

SEQ ID NO: 773364 - DNA, 20 bp, mouse
gtgtgatgattgatagttag

SEQ ID NO: 773365 - DNA, 20 bp, mouse
gccaggtgcattcaagatgt

SEQ ID NO: 773366 - DNA, 20 bp, mouse
gtacaatatccggttctcct

SEQ ID NO: 773367 - DNA, 20 bp, mouse
gtatcatttggaaggaaggt

SEQ ID NO: 773368 - DNA, 20 bp, mouse
gtctaatacacccaatgcac

SEQ ID NO: 773369 - DNA, 20 bp, mouse
ggaaccggatattgtactct

SEQ ID NO: 773370 - DNA, 20 bp, mouse
gtataaatatatcatttgga

SEQ ID NO: 773371 - DNA, 20 bp, mouse
gaagaaaaatacaccagttt

SEQ ID NO: 773372 - DNA, 20 bp, mouse
gtgttttggtatatagttaa

SEQ ID NO: 773373 - DNA, 20 bp, mouse
gggtatatagttaaaggact

SEQ ID NO: 773374 - DNA, 20 bp, mouse
gaatatatcatttggaagga

SEQ ID NO: 773375 - DNA, 20 bp, mouse
gttcatcctcccaggagaac

SEQ ID NO: 773376 - DNA, 20 bp, mouse
gtataacagttaaaggaact

SEQ ID NO: 773377 - DNA, 20 bp, mouse
ggctatctgaacacacaaat

SEQ ID NO: 773378 - DNA, 20 bp, mouse
gtatgtttgtaacgtgtagc

SEQ ID NO: 773379 - DNA, 20 bp, mouse
gatgccaaggtagccaaaat

SEQ ID NO: 773380 - DNA, 20 bp, mouse
gatcccaaaccatgcattgg

SEQ ID NO: 773381 - DNA, 20 bp, mouse
gttattgtaacctacattag

SEQ ID NO: 773382 - DNA, 20 bp, mouse
gcttgctaaccaccaatgca

SEQ ID NO: 773383 - DNA, 20 bp, mouse
gatcatttgtatggaggaaa

SEQ ID NO: 773384 - DNA, 20 bp, mouse
ggtttgggatttgagggttt

SEQ ID NO: 773385 - DNA, 20 bp, mouse
gtaaccaccaatgcatggtt

SEQ ID NO: 773386 - DNA, 20 bp, mouse
ggatgtgtgaaagtgttgac

SEQ ID NO: 773387 - DNA, 20 bp, mouse
gggaaattccccaaattata

SEQ ID NO: 773388 - DNA, 20 bp, mouse
gaaattagagccatataatt

SEQ ID NO: 773389 - DNA, 20 bp, mouse
ggctctaatttcatagatct

SEQ ID NO: 773390 - DNA, 20 bp, mouse
ggaaataatcaaatcttaga

SEQ ID NO: 773391 - DNA, 20 bp, mouse
gggaatttcctgttggtcca

SEQ ID NO: 773392 - DNA, 20 bp, mouse
gtggagttgctgcaccgagc

SEQ ID NO: 773393 - DNA, 20 bp, mouse
ggcagcaactccacatttcc

SEQ ID NO: 773394 - DNA, 20 bp, mouse
gcatataacagtttactcaa

SEQ ID NO: 773395 - DNA, 20 bp, mouse
gtaaatgactacttttgcca

SEQ ID NO: 773396 - DNA, 20 bp, mouse
ggtgcaagaagactattgaa

SEQ ID NO: 773397 - DNA, 20 bp, mouse
gcactcttctgctttttatc

SEQ ID NO: 773398 - DNA, 20 bp, mouse
ggtgtctctagttctactat

SEQ ID NO: 773399 - DNA, 20 bp, mouse
gtattactgagtaagttatt

SEQ ID NO: 773400 - DNA, 20 bp, mouse
gtgagattgaaaagttgtct

SEQ ID NO: 773401 - DNA, 20 bp, mouse
gcactgaaccaagagaggag

SEQ ID NO: 773402 - DNA, 20 bp, mouse
gacttttcaatctcatgaga

SEQ ID NO: 773403 - DNA, 20 bp, mouse
gaaccatctggcatatgcat

SEQ ID NO: 773404 - DNA, 20 bp, mouse
gtaaatgcccactcctctct

SEQ ID NO: 773405 - DNA, 20 bp, mouse
ggccctatgcatatgccaga

SEQ ID NO: 773406 - DNA, 20 bp, mouse
gatcatttggatggagagaa

SEQ ID NO: 773407 - DNA, 20 bp, mouse
gcagaactctcagtgagatg

SEQ ID NO: 773408 - DNA, 20 bp, mouse
gacagttgcaatacttaaaa

SEQ ID NO: 773409 - DNA, 20 bp, mouse
gtaatgcacacacaattcac

SEQ ID NO: 773410 - DNA, 20 bp, mouse
gtagaattacatcatttgga

SEQ ID NO: 773411 - DNA, 20 bp, mouse
ggataacatttgattatcct

SEQ ID NO: 773412 - DNA, 20 bp, mouse
gtttctttagcgtgaagagt

SEQ ID NO: 773413 - DNA, 20 bp, mouse
ggccacagtagccaaacact

SEQ ID NO: 773414 - DNA, 20 bp, mouse
ggagtgtcaatttgtttgta

SEQ ID NO: 773415 - DNA, 20 bp, mouse
ggtatactgttaaagaaact

SEQ ID NO: 773416 - DNA, 20 bp, mouse
ggtgtggggagaaatgtcta

SEQ ID NO: 773417 - DNA, 20 bp, mouse
ggtaccatcaagcaactgac

SEQ ID NO: 773418 - DNA, 20 bp, mouse
gaactacctctcatggtgtg

SEQ ID NO: 773419 - DNA, 20 bp, mouse
gggagaaatgtctaaggcaa

SEQ ID NO: 773420 - DNA, 20 bp, mouse
gtggagccagtaagggctag

SEQ ID NO: 773421 - DNA, 20 bp, mouse
ggcagaactggagccagtaa

SEQ ID NO: 773422 - DNA, 20 bp, mouse
gcctaggcaacacagtgagg

SEQ ID NO: 773423 - DNA, 20 bp, mouse
gtcagtctcgtgtgtcacca

SEQ ID NO: 773424 - DNA, 20 bp, mouse
ggtccagctaaaagcagaac

SEQ ID NO: 773425 - DNA, 20 bp, mouse
gcgcataggaaactcagcat

SEQ ID NO: 773426 - DNA, 20 bp, mouse
gaatgcttgagcctaggagg

SEQ ID NO: 773427 - DNA, 20 bp, mouse
gtacactactcaacaggctg

SEQ ID NO: 773428 - DNA, 20 bp, mouse
gaggataaatgcttgagcct

SEQ ID NO: 773429 - DNA, 20 bp, mouse
gtgttgagtagtgtagacta

SEQ ID NO: 773430 - DNA, 20 bp, mouse
gcaggagtgaagcacttacc

SEQ ID NO: 773431 - DNA, 20 bp, mouse
gaagctggcttccgcctcct

SEQ ID NO: 773432 - DNA, 20 bp, mouse
gataaatgcttgagcctagg

SEQ ID NO: 773433 - DNA, 20 bp, mouse
gaaagcactggaatcaatct

SEQ ID NO: 773434 - DNA, 20 bp, mouse
gtttaggaatggagggaaca

SEQ ID NO: 773435 - DNA, 20 bp, mouse
gttaaaggtatcttagaact

SEQ ID NO: 773436 - DNA, 20 bp, mouse
gttgaagctgaacagggaag

SEQ ID NO: 773437 - DNA, 20 bp, mouse
gtaggcgtgtaacctgttcg

SEQ ID NO: 773438 - DNA, 20 bp, mouse
gttcactgaatccttaatgg

SEQ ID NO: 773439 - DNA, 20 bp, mouse
gaaagtaacaggaataagaa

SEQ ID NO: 773440 - DNA, 20 bp, mouse
gataagaaaggctaaaaggc

SEQ ID NO: 773441 - DNA, 20 bp, mouse
gagccgcccctcccccatta

SEQ ID NO: 773442 - DNA, 20 bp, mouse
gaggagatggtggaaaccca

SEQ ID NO: 773443 - DNA, 20 bp, mouse
gagcaataacagcctcgaac

SEQ ID NO: 773444 - DNA, 20 bp, mouse
ggtttcccttgaagctgaac

SEQ ID NO: 773445 - DNA, 20 bp, mouse
gggcatcaaggcagatcctt

SEQ ID NO: 773446 - DNA, 20 bp, mouse
gtgatgggccaacaactcaa

SEQ ID NO: 773447 - DNA, 20 bp, mouse
ggtagaggatgtgatttcct

SEQ ID NO: 773448 - DNA, 20 bp, mouse
gactgagacatcattgtgat

SEQ ID NO: 773449 - DNA, 20 bp, mouse
ggcccccaaaactgttgtgt

SEQ ID NO: 773450 - DNA, 20 bp, mouse
gagccccacacaacagtttt

SEQ ID NO: 773451 - DNA, 20 bp, mouse
gttgtgtggggctcaatatg

SEQ ID NO: 773452 - DNA, 20 bp, mouse
gttgacctcccttgagttgt

SEQ ID NO: 773453 - DNA, 20 bp, mouse
gaaggtacgaatataacaca

SEQ ID NO: 773454 - DNA, 20 bp, mouse
gatttggggcagagatattt

SEQ ID NO: 773455 - DNA, 20 bp, mouse
gtgggccaacaactcaaggg

SEQ ID NO: 773456 - DNA, 20 bp, mouse
gtggaacagatttcctggta

SEQ ID NO: 773457 - DNA, 20 bp, mouse
gtgtagacatcgagtcagca

SEQ ID NO: 773458 - DNA, 20 bp, mouse
ggtggactttaaataggaaa

SEQ ID NO: 773459 - DNA, 20 bp, mouse
gataggaaagggaagtagtc

SEQ ID NO: 773460 - DNA, 20 bp, mouse
ggcacatctgtgttgtaaaa

SEQ ID NO: 773461 - DNA, 20 bp, mouse
gccatctagtagtcaaagag

SEQ ID NO: 773462 - DNA, 20 bp, mouse
gggtaaggtggactttaaat

SEQ ID NO: 773463 - DNA, 20 bp, mouse
gtgactactagatggacagc

SEQ ID NO: 773464 - DNA, 20 bp, mouse
gaacagatttcctggtaagg

SEQ ID NO: 773465 - DNA, 20 bp, mouse
gaaagtttgtatgtaaaatg

SEQ ID NO: 773466 - DNA, 20 bp, mouse
gtaggtctacccttatattc

SEQ ID NO: 773467 - DNA, 20 bp, mouse
gtataacatacctgaatata

SEQ ID NO: 773468 - DNA, 20 bp, mouse
gtacatgtagataggcatat

SEQ ID NO: 773469 - DNA, 20 bp, mouse
gatattgtttacatgtagat

SEQ ID NO: 773470 - DNA, 20 bp, mouse
gttttgacacaagtatttat

SEQ ID NO: 773471 - DNA, 20 bp, mouse
ggtataacatatctacagtg

SEQ ID NO: 773472 - DNA, 20 bp, mouse
gcttgcagctaaggcaagaa

SEQ ID NO: 773473 - DNA, 20 bp, mouse
gcatcctaactttatagcta

SEQ ID NO: 773474 - DNA, 20 bp, mouse
gcttaaaatgtatggtgaag

SEQ ID NO: 773475 - DNA, 20 bp, mouse
gagaagcaggattagaaaac

SEQ ID NO: 773476 - DNA, 20 bp, mouse
gagcacaaatcagaattaat

SEQ ID NO: 773477 - DNA, 20 bp, mouse
ggtagaacctgaaaatttgc

SEQ ID NO: 773478 - DNA, 20 bp, mouse
gggttgtcaaagctgactct

SEQ ID NO: 773479 - DNA, 20 bp, mouse
gtgagaagacacttgcactg

SEQ ID NO: 773480 - DNA, 20 bp, mouse
gtgactcttaacacgtgatc

SEQ ID NO: 773481 - DNA, 20 bp, mouse
ggttactaaaagttttattc

SEQ ID NO: 773482 - DNA, 20 bp, mouse
gcaagtgtcttctcaaagcc

SEQ ID NO: 773483 - DNA, 20 bp, mouse
ggttttattcaggaggtccg

SEQ ID NO: 773484 - DNA, 20 bp, mouse
gatttgattgtacaccattg

SEQ ID NO: 773485 - DNA, 20 bp, mouse
gaccatcatgcttagacatc

SEQ ID NO: 773486 - DNA, 20 bp, mouse
gcaaaaggcaaataagtttt

SEQ ID NO: 773487 - DNA, 20 bp, mouse
gagacattattggtcccaaa

SEQ ID NO: 773488 - DNA, 20 bp, mouse
gtgttcatacaagaatcaaa

SEQ ID NO: 773489 - DNA, 20 bp, mouse
ggagtatggatgtagctctt

SEQ ID NO: 773490 - DNA, 20 bp, mouse
gcttgtatgaacaatatgtc

SEQ ID NO: 773491 - DNA, 20 bp, mouse
gatatctgtttattaatcca

SEQ ID NO: 773492 - DNA, 20 bp, mouse
gtaataaacagatatccatt

SEQ ID NO: 773493 - DNA, 20 bp, mouse
gcaattttgttgtgcaaggg

SEQ ID NO: 773494 - DNA, 20 bp, mouse
gtgggaccaataatgtctct

SEQ ID NO: 773495 - DNA, 20 bp, mouse
ggaagaagacaaatagaaaa

SEQ ID NO: 773496 - DNA, 20 bp, mouse
gaaaatcagaactctagtaa

SEQ ID NO: 773497 - DNA, 20 bp, mouse
gggcacatattgctatacat

SEQ ID NO: 773498 - DNA, 20 bp, mouse
gctaaactattactctttaa

SEQ ID NO: 773499 - DNA, 20 bp, mouse
gggcatatatgttatttaat

SEQ ID NO: 773500 - DNA, 20 bp, mouse
gacatatatgccgaattgtt

SEQ ID NO: 773501 - DNA, 20 bp, mouse
gtaaacaattttggttcaat

SEQ ID NO: 773502 - DNA, 20 bp, mouse
gaatattttagctgttaaga

SEQ ID NO: 773503 - DNA, 20 bp, mouse
gccttatattatgaagtaaa

SEQ ID NO: 773504 - DNA, 20 bp, mouse
gtttatatttctaaatgaac

SEQ ID NO: 773505 - DNA, 20 bp, mouse
gttactttttccaaacaatt

SEQ ID NO: 773506 - DNA, 20 bp, mouse
gactgcaggactgggtggtg

SEQ ID NO: 773507 - DNA, 20 bp, mouse
ggacgaatgcagttgactgc

SEQ ID NO: 773508 - DNA, 20 bp, mouse
gctacagtaagcaggatgaa

SEQ ID NO: 773509 - DNA, 20 bp, mouse
gcaaaaaagggcagtttccc

SEQ ID NO: 773510 - DNA, 20 bp, mouse
gagttgactgcaggactggg

SEQ ID NO: 773511 - DNA, 20 bp, mouse
gtggtctgctacagtctcaa

SEQ ID NO: 773512 - DNA, 20 bp, mouse
gcaaagcatgtagtagaaga

SEQ ID NO: 773513 - DNA, 20 bp, mouse
ggtagcagaccaaggatatt

SEQ ID NO: 773514 - DNA, 20 bp, mouse
gatgaatgggttattaagtg

SEQ ID NO: 773515 - DNA, 20 bp, mouse
gtgcagttgactgcaggact

SEQ ID NO: 773516 - DNA, 20 bp, mouse
gttaaatggcattttttgta

SEQ ID NO: 773517 - DNA, 20 bp, mouse
gagtgaggcaagtgtgatcc

SEQ ID NO: 773518 - DNA, 20 bp, mouse
ggggaagactgtaagttata

SEQ ID NO: 773519 - DNA, 20 bp, mouse
gtttggagaagtcccatcag

SEQ ID NO: 773520 - DNA, 20 bp, mouse
gtgcctcactagccatcata

SEQ ID NO: 773521 - DNA, 20 bp, mouse
ggatcatctgtaccactgat

SEQ ID NO: 773522 - DNA, 20 bp, mouse
gcatgatagagtatttcaaa

SEQ ID NO: 773523 - DNA, 20 bp, mouse
gagagaaaaatcacaaacaa

SEQ ID NO: 773524 - DNA, 20 bp, mouse
gctaaaagacttaaagtttc

SEQ ID NO: 773525 - DNA, 20 bp, mouse
gttccatatgatggctagtg

SEQ ID NO: 773526 - DNA, 20 bp, mouse
gggttctaaatacaccaagt

SEQ ID NO: 773527 - DNA, 20 bp, mouse
gtaaaactaacagctagatc

SEQ ID NO: 773528 - DNA, 20 bp, mouse
gcgtgtgagttctgctatca

SEQ ID NO: 773529 - DNA, 20 bp, mouse
ggaaaacatcatggaatgac

SEQ ID NO: 773530 - DNA, 20 bp, mouse
gaagatttatagatttgagg

SEQ ID NO: 773531 - DNA, 20 bp, mouse
ggctatgaaatagtcccact

SEQ ID NO: 773532 - DNA, 20 bp, mouse
gatcatggaatgacaggaaa

SEQ ID NO: 773533 - DNA, 20 bp, mouse
gactgtactcagtataatct

SEQ ID NO: 773534 - DNA, 20 bp, mouse
gattggcaatccctctaatt

SEQ ID NO: 773535 - DNA, 20 bp, mouse
gcattgaacaaatacatctc

SEQ ID NO: 773536 - DNA, 20 bp, mouse
ggactactagtagtcagaag

SEQ ID NO: 773537 - DNA, 20 bp, mouse
ggtccagaggaaaaacataa

SEQ ID NO: 773538 - DNA, 20 bp, mouse
gtcctctttcatcctgtaga

SEQ ID NO: 773539 - DNA, 20 bp, mouse
ggtagactatggcagcagtc

SEQ ID NO: 773540 - DNA, 20 bp, mouse
gtcaacaactaggatatagt

SEQ ID NO: 773541 - DNA, 20 bp, mouse
gtttcatcctgtagatggaa

SEQ ID NO: 773542 - DNA, 20 bp, mouse
gctcaatccattccatctac

SEQ ID NO: 773543 - DNA, 20 bp, mouse
gcacctttatgtttttcctc

SEQ ID NO: 773544 - DNA, 20 bp, mouse
gttaaaacaataattctatg

SEQ ID NO: 773545 - DNA, 20 bp, mouse
ggggagcacttaactaggaa

SEQ ID NO: 773546 - DNA, 20 bp, mouse
gggtggacactcaagagatc

SEQ ID NO: 773547 - DNA, 20 bp, mouse
gggataggggagaactgtgt

SEQ ID NO: 773548 - DNA, 20 bp, mouse
gcccatcaatgtgaaatgat

SEQ ID NO: 773549 - DNA, 20 bp, mouse
gaactctgagtacatggctg

SEQ ID NO: 773550 - DNA, 20 bp, mouse
gtaggggagaactgtgttgg

SEQ ID NO: 773551 - DNA, 20 bp, mouse
ggattggtttcaacatcagt

SEQ ID NO: 773552 - DNA, 20 bp, mouse
gaatccctatgttgtgatac

SEQ ID NO: 773553 - DNA, 20 bp, mouse
gttcaacatcagtaggtggc

SEQ ID NO: 773554 - DNA, 20 bp, mouse
gacactcagaagaataaacc

SEQ ID NO: 773555 - DNA, 20 bp, mouse
gatttcacattgatggggat

SEQ ID NO: 773556 - DNA, 20 bp, mouse
gttaactgacacccaacttt

SEQ ID NO: 773557 - DNA, 20 bp, mouse
gtcagcaagtggacatttga

SEQ ID NO: 773558 - DNA, 20 bp, mouse
gtaatactcttccaaaagtt

SEQ ID NO: 773559 - DNA, 20 bp, mouse
gattctaagtatttaagcac

SEQ ID NO: 773560 - DNA, 20 bp, mouse
gtacttagaataactgacac

SEQ ID NO: 773561 - DNA, 20 bp, mouse
gtgaaatgactttttaagtc

SEQ ID NO: 773562 - DNA, 20 bp, mouse
gtcagagttttatgcatgca

SEQ ID NO: 773563 - DNA, 20 bp, mouse
gaatcataactaaagtctag

SEQ ID NO: 773564 - DNA, 20 bp, mouse
gaatattagtaaatatcagt

SEQ ID NO: 773565 - DNA, 20 bp, mouse
gaggatataaagagctacta

SEQ ID NO: 773566 - DNA, 20 bp, mouse
ggttacagacttggaaccac

SEQ ID NO: 773567 - DNA, 20 bp, mouse
ggtgggcatccaattttcag

SEQ ID NO: 773568 - DNA, 20 bp, mouse
gcatctgacttggggaaaaa

SEQ ID NO: 773569 - DNA, 20 bp, mouse
gcaccaaaaacatctgactt

SEQ ID NO: 773570 - DNA, 20 bp, mouse
gatgtcagtagttacagact

SEQ ID NO: 773571 - DNA, 20 bp, mouse
gaaaaataagtggtgtctta

SEQ ID NO: 773572 - DNA, 20 bp, mouse
gatgatatttttgttcatat

SEQ ID NO: 773573 - DNA, 20 bp, mouse
gtaggccatagaaataatac

SEQ ID NO: 773574 - DNA, 20 bp, mouse
ggtataaaggcagttcttga

SEQ ID NO: 773575 - DNA, 20 bp, mouse
gtagtaactttctaaaagag

SEQ ID NO: 773576 - DNA, 20 bp, mouse
gattagactaggtccagtgt

SEQ ID NO: 773577 - DNA, 20 bp, mouse
gcagaatcataatggctgcc

SEQ ID NO: 773578 - DNA, 20 bp, mouse
gcctcttatttcacacttcc

SEQ ID NO: 773579 - DNA, 20 bp, mouse
gtaatgtgaaagattagact

SEQ ID NO: 773580 - DNA, 20 bp, mouse
gctaatatctctacccacac

SEQ ID NO: 773581 - DNA, 20 bp, mouse
gttagagaaaacaaagatgt

SEQ ID NO: 773582 - DNA, 20 bp, mouse
gtaaagtttcagaatcataa

SEQ ID NO: 773583 - DNA, 20 bp, mouse
ggttaaaaagtatatttgcc

SEQ ID NO: 773584 - DNA, 20 bp, mouse
gctatacttacaaattcaaa

SEQ ID NO: 773585 - DNA, 20 bp, mouse
gaattctaaatatacttttt

SEQ ID NO: 773586 - DNA, 20 bp, mouse
gactgtgcagccatgatatt

SEQ ID NO: 773587 - DNA, 20 bp, mouse
ggccctgcacttatgaatgt

SEQ ID NO: 773588 - DNA, 20 bp, mouse
gagcttctggacattcttag

SEQ ID NO: 773589 - DNA, 20 bp, mouse
gttgatgcaagtcttctcac

SEQ ID NO: 773590 - DNA, 20 bp, mouse
gagcgagagttggaaatcct

SEQ ID NO: 773591 - DNA, 20 bp, mouse
gactctcgctgagaaaactt

SEQ ID NO: 773592 - DNA, 20 bp, mouse
gaaattaatcagctgggaaa

SEQ ID NO: 773593 - DNA, 20 bp, mouse
ggaccagtttatcataatgt

SEQ ID NO: 773594 - DNA, 20 bp, mouse
gactctacttagttcattac

SEQ ID NO: 773595 - DNA, 20 bp, mouse
ggccgacattcataagtgca

SEQ ID NO: 773596 - DNA, 20 bp, mouse
gggttccagaaactcaactt

SEQ ID NO: 773597 - DNA, 20 bp, mouse
gtgtagtgcatcacataggg

SEQ ID NO: 773598 - DNA, 20 bp, mouse
ggtaacggactttgctgccc

SEQ ID NO: 773599 - DNA, 20 bp, mouse
gtcaacttaggttgtcagcc

SEQ ID NO: 773600 - DNA, 20 bp, mouse
gagagagaaccaaatgtaca

SEQ ID NO: 773601 - DNA, 20 bp, mouse
gttttgtagtgcatcacata

SEQ ID NO: 773602 - DNA, 20 bp, mouse
ggatgtttccaaagtacata

SEQ ID NO: 773603 - DNA, 20 bp, mouse
gggacactaatagaaaaggc

SEQ ID NO: 773604 - DNA, 20 bp, mouse
gttagtgtgccccatgtaag

SEQ ID NO: 773605 - DNA, 20 bp, mouse
gttgatcttatatgctgata

SEQ ID NO: 773606 - DNA, 20 bp, mouse
gcagagctaacggatagaga

SEQ ID NO: 773607 - DNA, 20 bp, mouse
ggacttgcaaaattggtgtc

SEQ ID NO: 773608 - DNA, 20 bp, mouse
gagaccagtggaggcagcaa

SEQ ID NO: 773609 - DNA, 20 bp, mouse
gtcaaacacatggacatcag

SEQ ID NO: 773610 - DNA, 20 bp, mouse
gtatgattaacagagaccag

SEQ ID NO: 773611 - DNA, 20 bp, mouse
gataatcacctggtttctct

SEQ ID NO: 773612 - DNA, 20 bp, mouse
gtctcttggcttcaaacaca

SEQ ID NO: 773613 - DNA, 20 bp, mouse
gatattttataatgctcaac

SEQ ID NO: 773614 - DNA, 20 bp, mouse
gtaaggattgtctcaaacta

SEQ ID NO: 773615 - DNA, 20 bp, mouse
gcaggaaattccagagctaa

SEQ ID NO: 773616 - DNA, 20 bp, mouse
gtgaagtgcatcacctaggg

SEQ ID NO: 773617 - DNA, 20 bp, mouse
gttaatggaccttgctgcca

SEQ ID NO: 773618 - DNA, 20 bp, mouse
ggagaaaactcactgattaa

SEQ ID NO: 773619 - DNA, 20 bp, mouse
gggacactgatagaaaaggt

SEQ ID NO: 773620 - DNA, 20 bp, mouse
gttttgaagtgcatcaccta

SEQ ID NO: 773621 - DNA, 20 bp, mouse
ggttcagtttctggatcata

SEQ ID NO: 773622 - DNA, 20 bp, mouse
gcagtttctggatcatatgg

SEQ ID NO: 773623 - DNA, 20 bp, mouse
gatcacctagggtggaacct

SEQ ID NO: 773624 - DNA, 20 bp, mouse
gtatttattggagtgcttgt

SEQ ID NO: 773625 - DNA, 20 bp, mouse
gattggagtgcttgtggggt

SEQ ID NO: 773626 - DNA, 20 bp, mouse
gaaggattggctctaactaa

SEQ ID NO: 773627 - DNA, 20 bp, mouse
gctactaaatacagtgttgt

SEQ ID NO: 773628 - DNA, 20 bp, mouse
gataaagaaagacggtatca

SEQ ID NO: 773629 - DNA, 20 bp, mouse
gttcttggcttcagaaacat

SEQ ID NO: 773630 - DNA, 20 bp, mouse
gttcataataatttaaggat

SEQ ID NO: 773631 - DNA, 20 bp, mouse
gagctttgggagcgcttccc

SEQ ID NO: 773632 - DNA, 20 bp, mouse
gttctagggatatttcaaaa

SEQ ID NO: 773633 - DNA, 20 bp, mouse
gtaagtaccgtgagaaagcc

SEQ ID NO: 773634 - DNA, 20 bp, mouse
gtagataaagaacaagcact

SEQ ID NO: 773635 - DNA, 20 bp, mouse
gtttcaattgctaccaacac

SEQ ID NO: 773636 - DNA, 20 bp, mouse
gttaacaagtcaagaatatt

SEQ ID NO: 773637 - DNA, 20 bp, mouse
gcagttcagttgaagcagac

SEQ ID NO: 773638 - DNA, 20 bp, mouse
gcaagtcaagaatattagga

SEQ ID NO: 773639 - DNA, 20 bp, mouse
gcccagctggatttaggcta

SEQ ID NO: 773640 - DNA, 20 bp, mouse
gagtgtgaatgttcaaggct

SEQ ID NO: 773641 - DNA, 20 bp, mouse
gtggtaataagttctcatca

SEQ ID NO: 773642 - DNA, 20 bp, mouse
gacatgaaaatgactataca

SEQ ID NO: 773643 - DNA, 20 bp, mouse
gtttaaccccagctggattt

SEQ ID NO: 773644 - DNA, 20 bp, mouse
gtaatgaaacagaataagac

SEQ ID NO: 773645 - DNA, 20 bp, mouse
ggtcattttcatgtggaatg

SEQ ID NO: 773646 - DNA, 20 bp, mouse
ggtgcaggggcaaaccagaa

SEQ ID NO: 773647 - DNA, 20 bp, mouse
gcctaggtggccctgtgcag

SEQ ID NO: 773648 - DNA, 20 bp, mouse
gaaaatagagggttgtttca

SEQ ID NO: 773649 - DNA, 20 bp, mouse
gtgtttcatggtgcacactg

SEQ ID NO: 773650 - DNA, 20 bp, mouse
gaaaaaattaaatccattac

SEQ ID NO: 773651 - DNA, 20 bp, mouse
gtgaggaacaaagacaaata

SEQ ID NO: 773652 - DNA, 20 bp, mouse
gacgtaaaacacgcgacata

SEQ ID NO: 773653 - DNA, 20 bp, mouse
gatatctatgttacctgtaa

SEQ ID NO: 773654 - DNA, 20 bp, mouse
gagagtacattgcacatgac

SEQ ID NO: 773655 - DNA, 20 bp, mouse
gaagagttagtatgcccttc

SEQ ID NO: 773656 - DNA, 20 bp, mouse
gcaaaggaatcttgatccat

SEQ ID NO: 773657 - DNA, 20 bp, mouse
gggttggaactgtatagaag

SEQ ID NO: 773658 - DNA, 20 bp, mouse
gtctcatatttgatccccaa

SEQ ID NO: 773659 - DNA, 20 bp, mouse
gtctcactgacgagagtgta

SEQ ID NO: 773660 - DNA, 20 bp, mouse
gtcagatagcacatggcttt

SEQ ID NO: 773661 - DNA, 20 bp, mouse
ggagttagagcattttatta

SEQ ID NO: 773662 - DNA, 20 bp, mouse
gtgctataggtactcaaaga

SEQ ID NO: 773663 - DNA, 20 bp, mouse
ggtggtattagagatatatt

SEQ ID NO: 773664 - DNA, 20 bp, mouse
gctgggttagatcgatgcat

SEQ ID NO: 773665 - DNA, 20 bp, mouse
ggaggatatcagatagcaca

SEQ ID NO: 773666 - DNA, 20 bp, mouse
ggcacagggcttagtagcga

SEQ ID NO: 773667 - DNA, 20 bp, mouse
gccccttgataaaacactat

SEQ ID NO: 773668 - DNA, 20 bp, mouse
gataggcaagtgctgagtaa

SEQ ID NO: 773669 - DNA, 20 bp, mouse
gccctatagtgttttatcaa

SEQ ID NO: 773670 - DNA, 20 bp, mouse
gtttctgacagcagacagtt

SEQ ID NO: 773671 - DNA, 20 bp, mouse
gattttgaagaggtaaactg

SEQ ID NO: 773672 - DNA, 20 bp, mouse
gatgtctttgtttctacact

SEQ ID NO: 773673 - DNA, 20 bp, mouse
gtgaaagtaaggggtacagc

SEQ ID NO: 773674 - DNA, 20 bp, mouse
gtgatcttgaacattcggaa

SEQ ID NO: 773675 - DNA, 20 bp, mouse
gcgatggagaagaaaagcat

SEQ ID NO: 773676 - DNA, 20 bp, mouse
gactgtgatcatcttcaatg

SEQ ID NO: 773677 - DNA, 20 bp, mouse
gtatttgacttagtatttca

SEQ ID NO: 773678 - DNA, 20 bp, mouse
gcaaaacacataaccttaaa

SEQ ID NO: 773679 - DNA, 20 bp, mouse
gtcttcaagatttaaattgt

SEQ ID NO: 773680 - DNA, 20 bp, mouse
ggtagaatttaactactatg

SEQ ID NO: 773681 - DNA, 20 bp, mouse
gcttaatatgagatctttac

SEQ ID NO: 773682 - DNA, 20 bp, mouse
ggtgttttacaaccttattg

SEQ ID NO: 773683 - DNA, 20 bp, mouse
gcctctctttgtagtaagaa

SEQ ID NO: 773684 - DNA, 20 bp, mouse
ggagaaattcagtaacaaaa

SEQ ID NO: 773685 - DNA, 20 bp, mouse
gttaattttcttgccattta

SEQ ID NO: 773686 - DNA, 20 bp, mouse
ggacactgtccataagatac

SEQ ID NO: 773687 - DNA, 20 bp, mouse
gtagaggaatagttgtagcc

SEQ ID NO: 773688 - DNA, 20 bp, mouse
gagaacatagtgattggctt

SEQ ID NO: 773689 - DNA, 20 bp, mouse
gtcttatggacagtgtctta

SEQ ID NO: 773690 - DNA, 20 bp, mouse
gttgaaagatagtgtcttag

SEQ ID NO: 773691 - DNA, 20 bp, mouse
ggcaaaaagaacatagtgat

SEQ ID NO: 773692 - DNA, 20 bp, mouse
gaatggataaagttgcagat

SEQ ID NO: 773693 - DNA, 20 bp, mouse
ggaaacactccagtatctta

SEQ ID NO: 773694 - DNA, 20 bp, mouse
gaagataggtaacatatttt

SEQ ID NO: 773695 - DNA, 20 bp, mouse
gactgtattgtctcacatcc

SEQ ID NO: 773696 - DNA, 20 bp, mouse
gaaggccttcatctgtccta

SEQ ID NO: 773697 - DNA, 20 bp, mouse
ggtgattcaaagcgtctgat

SEQ ID NO: 773698 - DNA, 20 bp, mouse
gcagacgctttgaatcacga

SEQ ID NO: 773699 - DNA, 20 bp, mouse
ggtagtggcatataatcgtc

SEQ ID NO: 773700 - DNA, 20 bp, mouse
gtgaagatgggttattgaag

SEQ ID NO: 773701 - DNA, 20 bp, mouse
gccttcatgtggatgtgatt

SEQ ID NO: 773702 - DNA, 20 bp, mouse
gtctgccttaggacagatga

SEQ ID NO: 773703 - DNA, 20 bp, mouse
ggatgtgatttggcatcaga

SEQ ID NO: 773704 - DNA, 20 bp, mouse
gaaggttgtgagcatggtag

SEQ ID NO: 773705 - DNA, 20 bp, mouse
gagcgtctgattggcagatg

SEQ ID NO: 773706 - DNA, 20 bp, mouse
gagggacctgtagtgaatcg

SEQ ID NO: 773707 - DNA, 20 bp, mouse
gggaggggtggctgcaaaaa

SEQ ID NO: 773708 - DNA, 20 bp, mouse
gacttggtaagatatccctt

SEQ ID NO: 773709 - DNA, 20 bp, mouse
gaagagtgagcctgtggcag

SEQ ID NO: 773710 - DNA, 20 bp, mouse
ggtaatacagaaccctagtg

SEQ ID NO: 773711 - DNA, 20 bp, mouse
gggctgagaaaggattactt

SEQ ID NO: 773712 - DNA, 20 bp, mouse
gtcaagcactggccacacta

SEQ ID NO: 773713 - DNA, 20 bp, mouse
ggcaaagctagctaaggaag

SEQ ID NO: 773714 - DNA, 20 bp, mouse
gatggtccacgattcactac

SEQ ID NO: 773715 - DNA, 20 bp, mouse
gtaagaccaaaggctcctct

SEQ ID NO: 773716 - DNA, 20 bp, mouse
gtggggaagaacctacagat

SEQ ID NO: 773717 - DNA, 20 bp, mouse
gaaagtggaggggggttcga

SEQ ID NO: 773718 - DNA, 20 bp, mouse
gctggcttcaaacccccttt

SEQ ID NO: 773719 - DNA, 20 bp, mouse
gtgccaccatgcctatctgt

SEQ ID NO: 773720 - DNA, 20 bp, mouse
gcaaacaagcagataactaa

SEQ ID NO: 773721 - DNA, 20 bp, mouse
gaatggtctgagctccaaaa

SEQ ID NO: 773722 - DNA, 20 bp, mouse
gtaagactggaactagagct

SEQ ID NO: 773723 - DNA, 20 bp, mouse
ggtggatcagagatcaagaa

SEQ ID NO: 773724 - DNA, 20 bp, mouse
gacaagcagataactaaagg

SEQ ID NO: 773725 - DNA, 20 bp, mouse
gctagttccagtcttaacct

SEQ ID NO: 773726 - DNA, 20 bp, mouse
gtaaattgagagtggagggt

SEQ ID NO: 773727 - DNA, 20 bp, mouse
gtaggattgcagttggacct

SEQ ID NO: 773728 - DNA, 20 bp, mouse
gtaaggtaaattgagagtgg

SEQ ID NO: 773729 - DNA, 20 bp, mouse
gggtaccactgggcctgaga

SEQ ID NO: 773730 - DNA, 20 bp, mouse
gttttaaggtaaattgagag

SEQ ID NO: 773731 - DNA, 20 bp, mouse
ggtacccatctcaggcccag

SEQ ID NO: 773732 - DNA, 20 bp, mouse
gcttgtattcagtcctacat

SEQ ID NO: 773733 - DNA, 20 bp, mouse
gagtagcagctaaagtctta

SEQ ID NO: 773734 - DNA, 20 bp, mouse
gaaagtcttatgggtaccac

SEQ ID NO: 773735 - DNA, 20 bp, mouse
gatgttgaagtacccatctc

SEQ ID NO: 773736 - DNA, 20 bp, mouse
ggaaaagtcctaatgataat

SEQ ID NO: 773737 - DNA, 20 bp, mouse
gaatgctgaagcatcatctc

SEQ ID NO: 773738 - DNA, 20 bp, mouse
gtagctgctactctctgacg

SEQ ID NO: 773739 - DNA, 20 bp, mouse
gagtaaggaaggtatccaag

SEQ ID NO: 773740 - DNA, 20 bp, mouse
gtacatttaaagtggagggt

SEQ ID NO: 773741 - DNA, 20 bp, mouse
gaaggtacatttaaagtgga

SEQ ID NO: 773742 - DNA, 20 bp, mouse
gaagaaaaattcagtaagga

SEQ ID NO: 773743 - DNA, 20 bp, mouse
gaaagtctcataggtaccac

SEQ ID NO: 773744 - DNA, 20 bp, mouse
ggtgtcttcaaagtgtttca

SEQ ID NO: 773745 - DNA, 20 bp, mouse
gagcatcatctcaggccccg

SEQ ID NO: 773746 - DNA, 20 bp, mouse
gccaaaggccaacagagcaa

SEQ ID NO: 773747 - DNA, 20 bp, mouse
gcacatgaaaacccgaggat

SEQ ID NO: 773748 - DNA, 20 bp, mouse
gctgtggacagcaagaatgc

SEQ ID NO: 773749 - DNA, 20 bp, mouse
gagagatccaggtatcagaa

SEQ ID NO: 773750 - DNA, 20 bp, mouse
ggaaaattacccccatcctc

SEQ ID NO: 773751 - DNA, 20 bp, mouse
gaaactgtataactatgaag

SEQ ID NO: 773752 - DNA, 20 bp, mouse
ggtgaggaacagagagatcc

SEQ ID NO: 773753 - DNA, 20 bp, mouse
gtaactatgaaggggacaag

SEQ ID NO: 773754 - DNA, 20 bp, mouse
gatctccacatgaaaacccg

SEQ ID NO: 773755 - DNA, 20 bp, mouse
gtgtgatgttttaaaatctg

SEQ ID NO: 773756 - DNA, 20 bp, mouse
gaatgtatttacatctgcga

SEQ ID NO: 773757 - DNA, 20 bp, mouse
ggtcaataggccagatatga

SEQ ID NO: 773758 - DNA, 20 bp, mouse
gttgcacagtccttcatatc

SEQ ID NO: 773759 - DNA, 20 bp, mouse
ggtaattatcaagtttccgt

SEQ ID NO: 773760 - DNA, 20 bp, mouse
gattactgtgcctttggcta

SEQ ID NO: 773761 - DNA, 20 bp, mouse
gaaagtgacttagagtcaat

SEQ ID NO: 773762 - DNA, 20 bp, mouse
gttgataattactgtgcctt

SEQ ID NO: 773763 - DNA, 20 bp, mouse
gtacactcgaattttcaact

SEQ ID NO: 773764 - DNA, 20 bp, mouse
ggtgtaaacaaaataacaac

SEQ ID NO: 773765 - DNA, 20 bp, mouse
gtacatgtctccatagccaa

SEQ ID NO: 773766 - DNA, 20 bp, mouse
gcagccatgctgtggaggta

SEQ ID NO: 773767 - DNA, 20 bp, mouse
gtggaggtaaggactgcaag

SEQ ID NO: 773768 - DNA, 20 bp, mouse
gggtaaggactgcaagggga

SEQ ID NO: 773769 - DNA, 20 bp, mouse
ggagagacaaaggttatagt

SEQ ID NO: 773770 - DNA, 20 bp, mouse
gcacactacttccctgatca

SEQ ID NO: 773771 - DNA, 20 bp, mouse
ggtacctcttgcctgcaatt

SEQ ID NO: 773772 - DNA, 20 bp, mouse
gtggtcaatctgacttagat

SEQ ID NO: 773773 - DNA, 20 bp, mouse
gggacccaattgcaggcaag

SEQ ID NO: 773774 - DNA, 20 bp, mouse
gattgagcagaccgtgatca

SEQ ID NO: 773775 - DNA, 20 bp, mouse
gcagcaggcatttgtaagat

SEQ ID NO: 773776 - DNA, 20 bp, mouse
gaggtgcggcacaacggcta

SEQ ID NO: 773777 - DNA, 20 bp, mouse
gggagcatgtgcttaaggaa

SEQ ID NO: 773778 - DNA, 20 bp, mouse
gtcacggagagcttatgaac

SEQ ID NO: 773779 - DNA, 20 bp, mouse
gccgttgtgccgcacctgac

SEQ ID NO: 773780 - DNA, 20 bp, mouse
ggagagcttatgaacaggag

SEQ ID NO: 773781 - DNA, 20 bp, mouse
gtcaggcagagttagatgtt

SEQ ID NO: 773782 - DNA, 20 bp, mouse
gcaaagtgctttttcttatg

SEQ ID NO: 773783 - DNA, 20 bp, mouse
ggatctctaattattgaatt

SEQ ID NO: 773784 - DNA, 20 bp, mouse
gtatgtatactaagaataca

SEQ ID NO: 773785 - DNA, 20 bp, mouse
gtgtttggagcatgtgctta

SEQ ID NO: 773786 - DNA, 20 bp, mouse
gcactgtgcggatcttggga

SEQ ID NO: 773787 - DNA, 20 bp, mouse
gtgtcacctcttcagagacg

SEQ ID NO: 773788 - DNA, 20 bp, mouse
gatcttatagctgtccagaa

SEQ ID NO: 773789 - DNA, 20 bp, mouse
gggtaagttgtatacccttc

SEQ ID NO: 773790 - DNA, 20 bp, mouse
gtcttcagagacgaggtaga

SEQ ID NO: 773791 - DNA, 20 bp, mouse
gtcatcactgtgcggatctt

SEQ ID NO: 773792 - DNA, 20 bp, mouse
gcatcatcactcgaagactg

SEQ ID NO: 773793 - DNA, 20 bp, mouse
ggaacttcaagtgttccttt

SEQ ID NO: 773794 - DNA, 20 bp, mouse
gcatttccagcttcacatgt

SEQ ID NO: 773795 - DNA, 20 bp, mouse
gaatgactaacttatttctt

SEQ ID NO: 773796 - DNA, 20 bp, mouse
gtgtcagcacagtgctggaa

SEQ ID NO: 773797 - DNA, 20 bp, mouse
ggaatcgggtaaatggatat

SEQ ID NO: 773798 - DNA, 20 bp, mouse
gaaggcagcaggtagcatca

SEQ ID NO: 773799 - DNA, 20 bp, mouse
ggatattggcacacacatgc

SEQ ID NO: 773800 - DNA, 20 bp, mouse
gctctgaagaatcgggtaaa

SEQ ID NO: 773801 - DNA, 20 bp, mouse
gtgccttctctctgaagaat

SEQ ID NO: 773802 - DNA, 20 bp, mouse
gactggcaggtcagtaaagt

SEQ ID NO: 773803 - DNA, 20 bp, mouse
gcactgtgctgacagtggtg

SEQ ID NO: 773804 - DNA, 20 bp, mouse
gtccaaatctgcaaggcagt

SEQ ID NO: 773805 - DNA, 20 bp, mouse
gcgtggctttaaggcatctg

SEQ ID NO: 773806 - DNA, 20 bp, mouse
gtatgatgcgacaccagatg

SEQ ID NO: 773807 - DNA, 20 bp, mouse
gtccaaagacattgtggtcc

SEQ ID NO: 773808 - DNA, 20 bp, mouse
gcattgtggtccaggggaat

SEQ ID NO: 773809 - DNA, 20 bp, mouse
gtatgtgcatagatcatgag

SEQ ID NO: 773810 - DNA, 20 bp, mouse
gtggcttgacggagtttgca

SEQ ID NO: 773811 - DNA, 20 bp, mouse
gtgcgacaccagatgtggtc

SEQ ID NO: 773812 - DNA, 20 bp, mouse
gtgagtgggcctgtggttcc

SEQ ID NO: 773813 - DNA, 20 bp, mouse
gccctcgtccaaagacattg

SEQ ID NO: 773814 - DNA, 20 bp, mouse
gtgcaggatcagtgttgaat

SEQ ID NO: 773815 - DNA, 20 bp, mouse
gtcaaagctattccaaggta

SEQ ID NO: 773816 - DNA, 20 bp, mouse
gattggaaatacataagtat

SEQ ID NO: 773817 - DNA, 20 bp, mouse
gcaaaggacatgaaactatg

SEQ ID NO: 773818 - DNA, 20 bp, mouse
gttggaataagtacagctgc

SEQ ID NO: 773819 - DNA, 20 bp, mouse
gtccatatgccatgaaaaat

SEQ ID NO: 773820 - DNA, 20 bp, mouse
gtccaatttttcatggcata

SEQ ID NO: 773821 - DNA, 20 bp, mouse
gagagaacacgacagacatg

SEQ ID NO: 773822 - DNA, 20 bp, mouse
gtgtttgtatagtagtccca

SEQ ID NO: 773823 - DNA, 20 bp, mouse
gccttgtcttagcaatgcaa

SEQ ID NO: 773824 - DNA, 20 bp, mouse
gggttctaaattaaatcccc

SEQ ID NO: 773825 - DNA, 20 bp, mouse
gaagagctacaggtatagct

SEQ ID NO: 773826 - DNA, 20 bp, mouse
ggatgtaacttggtctggga

SEQ ID NO: 773827 - DNA, 20 bp, mouse
ggcagattctaatgggactg

SEQ ID NO: 773828 - DNA, 20 bp, mouse
gtcatgatgtaacttggtct

SEQ ID NO: 773829 - DNA, 20 bp, mouse
gactgcttggtttgtatctg

SEQ ID NO: 773830 - DNA, 20 bp, mouse
gaaaaggtgtcactttggaa

SEQ ID NO: 773831 - DNA, 20 bp, mouse
gggcttttgatcaagtaagg

SEQ ID NO: 773832 - DNA, 20 bp, mouse
gagcccattaaaaataaacg

SEQ ID NO: 773833 - DNA, 20 bp, mouse
gcatgtaaaaggtgtcactt

SEQ ID NO: 773834 - DNA, 20 bp, mouse
gcaagattgcaagactaaga

SEQ ID NO: 773835 - DNA, 20 bp, mouse
gcttggtctgggaaggattt

SEQ ID NO: 773836 - DNA, 20 bp, mouse
ggtagtactcttccaaaagc

SEQ ID NO: 773837 - DNA, 20 bp, mouse
gaattattctaattatgcac

SEQ ID NO: 773838 - DNA, 20 bp, mouse
ggaaacatgacaaaactatt

SEQ ID NO: 773839 - DNA, 20 bp, mouse
gtcatcaagtggaatttgat

SEQ ID NO: 773840 - DNA, 20 bp, mouse
gtaattagaataattggcac

SEQ ID NO: 773841 - DNA, 20 bp, mouse
gagatataaaggagttactg

SEQ ID NO: 773842 - DNA, 20 bp, mouse
gtttacatgcaaagatataa

SEQ ID NO: 773843 - DNA, 20 bp, mouse
gactcacagctaaaatctag

SEQ ID NO: 773844 - DNA, 20 bp, mouse
gtgtgaaacatactttgtct

SEQ ID NO: 773845 - DNA, 20 bp, mouse
gggattgtatactcatcaag

SEQ ID NO: 773846 - DNA, 20 bp, mouse
gaatgtagggttacatggta

SEQ ID NO: 773847 - DNA, 20 bp, mouse
gaatcataagtagaacaaag

SEQ ID NO: 773848 - DNA, 20 bp, mouse
gagttcaaactgcctgaatc

SEQ ID NO: 773849 - DNA, 20 bp, mouse
gtgttattaaatgtgctcaa

SEQ ID NO: 773850 - DNA, 20 bp, mouse
gtacttacatcagtttatac

SEQ ID NO: 773851 - DNA, 20 bp, mouse
gtttatacaggaagtggatc

SEQ ID NO: 773852 - DNA, 20 bp, mouse
ggaaaatttagtaagcatgc

SEQ ID NO: 773853 - DNA, 20 bp, mouse
ggccttgtattttatagtca

SEQ ID NO: 773854 - DNA, 20 bp, mouse
gggttacaacatctaaatgt

SEQ ID NO: 773855 - DNA, 20 bp, mouse
gggatcgggataccagattc

SEQ ID NO: 773856 - DNA, 20 bp, mouse
gacacacaaaatataacaag

SEQ ID NO: 773857 - DNA, 20 bp, mouse
gatatgaagtataggtggaa

SEQ ID NO: 773858 - DNA, 20 bp, mouse
ggaaaagtttagtttggtat

SEQ ID NO: 773859 - DNA, 20 bp, mouse
ggtatgcagtacaacaaaaa

SEQ ID NO: 773860 - DNA, 20 bp, mouse
gatattaatagtgaagtatt

SEQ ID NO: 773861 - DNA, 20 bp, mouse
gacagtgtgagagatgtatg

SEQ ID NO: 773862 - DNA, 20 bp, mouse
gatactagttatatgccttt

SEQ ID NO: 773863 - DNA, 20 bp, mouse
gtcactcagatatgaagtat

SEQ ID NO: 773864 - DNA, 20 bp, mouse
gttaacaaagctgtaaaatg

SEQ ID NO: 773865 - DNA, 20 bp, mouse
gtcagcttctttcttcaact

SEQ ID NO: 773866 - DNA, 20 bp, mouse
ggtattcatgtgctgggcaa

SEQ ID NO: 773867 - DNA, 20 bp, mouse
gaaaagcaaggaagcctccc

SEQ ID NO: 773868 - DNA, 20 bp, mouse
gtctctgtcttcaacctggg

SEQ ID NO: 773869 - DNA, 20 bp, mouse
gtgtagagagataatgaagt

SEQ ID NO: 773870 - DNA, 20 bp, mouse
gaaaaatggtattcatgtgc

SEQ ID NO: 773871 - DNA, 20 bp, mouse
gcatgaataccattttttct

SEQ ID NO: 773872 - DNA, 20 bp, mouse
gccacatttccaagaaaaaa

SEQ ID NO: 773873 - DNA, 20 bp, mouse
gacagtgtaagaggtatatg

SEQ ID NO: 773874 - DNA, 20 bp, mouse
gttcagatatgaaatacagg

SEQ ID NO: 773875 - DNA, 20 bp, mouse
gaaaatgattagttttgata

SEQ ID NO: 773876 - DNA, 20 bp, mouse
ggatcagcactgggcaccga

SEQ ID NO: 773877 - DNA, 20 bp, mouse
gatggaaatactatattctt

SEQ ID NO: 773878 - DNA, 20 bp, mouse
gccgaaggatcattgaatta

SEQ ID NO: 773879 - DNA, 20 bp, mouse
gcttctcactttacaatgat

SEQ ID NO: 773880 - DNA, 20 bp, mouse
gtggagactggctctctcct

SEQ ID NO: 773881 - DNA, 20 bp, mouse
gaatatagtatttccatgat

SEQ ID NO: 773882 - DNA, 20 bp, mouse
gcctgtccacagccgctcct

SEQ ID NO: 773883 - DNA, 20 bp, mouse
gttattgcctctgcccatca

SEQ ID NO: 773884 - DNA, 20 bp, mouse
gtatatacacaaataacccc

SEQ ID NO: 773885 - DNA, 20 bp, mouse
gatttaatatctctctacaa

SEQ ID NO: 773886 - DNA, 20 bp, mouse
ggatatttgtatttggtcaa

SEQ ID NO: 773887 - DNA, 20 bp, mouse
gacatacagtttattcaaaa

SEQ ID NO: 773888 - DNA, 20 bp, mouse
gtctctgaagtcaaagtttg

SEQ ID NO: 773889 - DNA, 20 bp, mouse
gtattttttgccattggtaa

SEQ ID NO: 773890 - DNA, 20 bp, mouse
gattatggacctcaacactg

SEQ ID NO: 773891 - DNA, 20 bp, mouse
gttgtatttggtcaaaggaa

SEQ ID NO: 773892 - DNA, 20 bp, mouse
gcaaatgtatgtcttattca

SEQ ID NO: 773893 - DNA, 20 bp, mouse
gtatttgtattttttgccat

SEQ ID NO: 773894 - DNA, 20 bp, mouse
gacaatgaatttcctggaag

SEQ ID NO: 773895 - DNA, 20 bp, mouse
gctcaaactttgtcattcta

SEQ ID NO: 773896 - DNA, 20 bp, mouse
ggtactgcataaatagagaa

SEQ ID NO: 773897 - DNA, 20 bp, mouse
gtctctgaagtcaagatttc

SEQ ID NO: 773898 - DNA, 20 bp, mouse
gcaatctttaaatcttaaaa

SEQ ID NO: 773899 - DNA, 20 bp, mouse
gttcacattctatttaaaga

SEQ ID NO: 773900 - DNA, 20 bp, mouse
gcttaattgatgtgtgcatg

SEQ ID NO: 773901 - DNA, 20 bp, mouse
gtataattttggtaaaagga

SEQ ID NO: 773902 - DNA, 20 bp, mouse
gattatggacctccaccttg

SEQ ID NO: 773903 - DNA, 20 bp, mouse
gcaggcacaggacatacatc

SEQ ID NO: 773904 - DNA, 20 bp, mouse
gagagatctttccctcaagg

SEQ ID NO: 773905 - DNA, 20 bp, mouse
gcaaaatttaaagtggttag

SEQ ID NO: 773906 - DNA, 20 bp, mouse
gaaacacaatgcttcaaaca

SEQ ID NO: 773907 - DNA, 20 bp, mouse
gtaatggagacattccagaa

SEQ ID NO: 773908 - DNA, 20 bp, mouse
gcacataaacctataaacat

SEQ ID NO: 773909 - DNA, 20 bp, mouse
gcctggacatacacaacttt

SEQ ID NO: 773910 - DNA, 20 bp, mouse
gtaaacattctgttaatgca

SEQ ID NO: 773911 - DNA, 20 bp, mouse
gtatttctaggtggaacaac

SEQ ID NO: 773912 - DNA, 20 bp, mouse
gaggttccagtgtcccatcc

SEQ ID NO: 773913 - DNA, 20 bp, mouse
gattgatgaggaaactaaat

SEQ ID NO: 773914 - DNA, 20 bp, mouse
gatagtttaatatttctagg

SEQ ID NO: 773915 - DNA, 20 bp, mouse
gtatttgtaatttattgatg

SEQ ID NO: 773916 - DNA, 20 bp, mouse
gagctcctcacaaccatcta

SEQ ID NO: 773917 - DNA, 20 bp, mouse
gcacgcacaaaaacatttca

SEQ ID NO: 773918 - DNA, 20 bp, mouse
gtgcaacatgtgggtaattg

SEQ ID NO: 773919 - DNA, 20 bp, mouse
gactacatatagcacaaata

SEQ ID NO: 773920 - DNA, 20 bp, mouse
gatctgcaaaagaggatgta

SEQ ID NO: 773921 - DNA, 20 bp, mouse
gtggccccaaatatgttctt

SEQ ID NO: 773922 - DNA, 20 bp, mouse
gtcaggagcctaagaattga

SEQ ID NO: 773923 - DNA, 20 bp, mouse
gttgaggttgaacttacatt

SEQ ID NO: 773924 - DNA, 20 bp, mouse
gattaagttactgacagcat

SEQ ID NO: 773925 - DNA, 20 bp, mouse
gtagaccctaagaacatatt

SEQ ID NO: 773926 - DNA, 20 bp, mouse
gataataagtgcatgaagtc

SEQ ID NO: 773927 - DNA, 20 bp, mouse
gggtcagaggccccatactc

SEQ ID NO: 773928 - DNA, 20 bp, mouse
gccaaatgtgcctgagtatg

SEQ ID NO: 773929 - DNA, 20 bp, mouse
gggtaaaggcaaaagaacag

SEQ ID NO: 773930 - DNA, 20 bp, mouse
gaaaaacatgctcaggtcag

SEQ ID NO: 773931 - DNA, 20 bp, mouse
ggggggtaaggagatgcaca

SEQ ID NO: 773932 - DNA, 20 bp, mouse
gacatttggaaaccactaac

SEQ ID NO: 773933 - DNA, 20 bp, mouse
ggaagaaccaatccgtggtg

SEQ ID NO: 773934 - DNA, 20 bp, mouse
gaaattgaagaaccaatccg

SEQ ID NO: 773935 - DNA, 20 bp, mouse
gaaatagcacactatcattc

SEQ ID NO: 773936 - DNA, 20 bp, mouse
gtaaaggtcagtgacaaggc

SEQ ID NO: 773937 - DNA, 20 bp, mouse
gtgacaaggcaggtgaactc

SEQ ID NO: 773938 - DNA, 20 bp, mouse
gatagagatctactgaaatg

SEQ ID NO: 773939 - DNA, 20 bp, mouse
gactcaacaagaaagataaa

SEQ ID NO: 773940 - DNA, 20 bp, mouse
gtaagtattaggttgtgtta

SEQ ID NO: 773941 - DNA, 20 bp, mouse
ggcaccttatgatgaagtaa

SEQ ID NO: 773942 - DNA, 20 bp, mouse
gcttatgatgaagtaatggt

SEQ ID NO: 773943 - DNA, 20 bp, mouse
gtataaaattcaatgattca

SEQ ID NO: 773944 - DNA, 20 bp, mouse
gtttctaaaggtcagtgaca

SEQ ID NO: 773945 - DNA, 20 bp, mouse
gattgagcataggtaaatgt

SEQ ID NO: 773946 - DNA, 20 bp, mouse
gcaagtaggaacttcatagt

SEQ ID NO: 773947 - DNA, 20 bp, mouse
gtcagtcagtgactctcctc

SEQ ID NO: 773948 - DNA, 20 bp, mouse
ggcagaggcttgtttgcaat

SEQ ID NO: 773949 - DNA, 20 bp, mouse
gataaaaacaagtttgttcc

SEQ ID NO: 773950 - DNA, 20 bp, mouse
gagtgactctcctctggttc

SEQ ID NO: 773951 - DNA, 20 bp, mouse
gtactggagaaaagaacaat

SEQ ID NO: 773952 - DNA, 20 bp, mouse
ggagcactaagagttagccc

SEQ ID NO: 773953 - DNA, 20 bp, mouse
gaggtacatacattaactac

SEQ ID NO: 773954 - DNA, 20 bp, mouse
ggtataggaactatatacat

SEQ ID NO: 773955 - DNA, 20 bp, mouse
ggtttgttccaggtatgtat

SEQ ID NO: 773956 - DNA, 20 bp, mouse
gacagggaggcatttatcat

SEQ ID NO: 773957 - DNA, 20 bp, mouse
gagtaagcatattatccaaa

SEQ ID NO: 773958 - DNA, 20 bp, mouse
gagttgcaggagtaaaactc

SEQ ID NO: 773959 - DNA, 20 bp, mouse
gtcaggtaagacgagttggc

SEQ ID NO: 773960 - DNA, 20 bp, mouse
gactcctgcaactcacaagg

SEQ ID NO: 773961 - DNA, 20 bp, mouse
ggtctccaactatgtattat

SEQ ID NO: 773962 - DNA, 20 bp, mouse
gatttcctataatacatagt

SEQ ID NO: 773963 - DNA, 20 bp, mouse
gaagcatattatccaaaagg

SEQ ID NO: 773964 - DNA, 20 bp, mouse
gacattcaggtaagacgagt

SEQ ID NO: 773965 - DNA, 20 bp, mouse
gataatatgcttacttgtaa

SEQ ID NO: 773966 - DNA, 20 bp, mouse
gaaaacatccattgctagct

SEQ ID NO: 773967 - DNA, 20 bp, mouse
gcaccacgcccagctagcaa

SEQ ID NO: 773968 - DNA, 20 bp, mouse
gaaccccaaacatctattgt

SEQ ID NO: 773969 - DNA, 20 bp, mouse
ggcaatggatgttttaatca

SEQ ID NO: 773970 - DNA, 20 bp, mouse
gaaccaacaatagatgtttg

SEQ ID NO: 773971 - DNA, 20 bp, mouse
gtatgtatctgtgtgaaata

SEQ ID NO: 773972 - DNA, 20 bp, mouse
gactggcaagatggtatttg

SEQ ID NO: 773973 - DNA, 20 bp, mouse
gtctgcttacataattttca

SEQ ID NO: 773974 - DNA, 20 bp, mouse
gaagatggtatttgaggtaa

SEQ ID NO: 773975 - DNA, 20 bp, mouse
gaaaattattggattttgac

SEQ ID NO: 773976 - DNA, 20 bp, mouse
gaactcacaacatgagtgaa

SEQ ID NO: 773977 - DNA, 20 bp, mouse
gtcagaaaaagctagaaata

SEQ ID NO: 773978 - DNA, 20 bp, mouse
gagtcaggatatatttgggt

SEQ ID NO: 773979 - DNA, 20 bp, mouse
gttcctgaggagaacgatgc

SEQ ID NO: 773980 - DNA, 20 bp, mouse
gttcctgcatcgttctcctc

SEQ ID NO: 773981 - DNA, 20 bp, mouse
gatcatcaatgttatattca

SEQ ID NO: 773982 - DNA, 20 bp, mouse
gactttggttttcagaggtc

SEQ ID NO: 773983 - DNA, 20 bp, mouse
gtgatgattgctccaatttt

SEQ ID NO: 773984 - DNA, 20 bp, mouse
gggttttcagaggtcaggct

SEQ ID NO: 773985 - DNA, 20 bp, mouse
gaagttaaatatttaaagtc

SEQ ID NO: 773986 - DNA, 20 bp, mouse
ggtgatgcagataaacgcac

SEQ ID NO: 773987 - DNA, 20 bp, mouse
gccaaaatttgaagtaacca

SEQ ID NO: 773988 - DNA, 20 bp, mouse
gataaattattattttgaaa

SEQ ID NO: 773989 - DNA, 20 bp, mouse
gaacttcaatataatatcca

SEQ ID NO: 773990 - DNA, 20 bp, mouse
ggatggagatagtacagaga

SEQ ID NO: 773991 - DNA, 20 bp, mouse
gagttccaagaatcaaactc

SEQ ID NO: 773992 - DNA, 20 bp, mouse
gggaaaagaactctaactcc

SEQ ID NO: 773993 - DNA, 20 bp, mouse
gacatccagagtttgattct

SEQ ID NO: 773994 - DNA, 20 bp, mouse
gattcttggaactcacaagg

SEQ ID NO: 773995 - DNA, 20 bp, mouse
gcagagagggatttataaat

SEQ ID NO: 773996 - DNA, 20 bp, mouse
gtgtctgaagagagtgatac

SEQ ID NO: 773997 - DNA, 20 bp, mouse
gccaaaatttggatcaacca

SEQ ID NO: 773998 - DNA, 20 bp, mouse
ggtgatacaggtaaatgcac

SEQ ID NO: 773999 - DNA, 20 bp, mouse
gaccacatttctagcttttc

SEQ ID NO: 774000 - DNA, 20 bp, mouse
gataaattattattttgaaa

SEQ ID NO: 774001 - DNA, 20 bp, mouse
gaactttactataatatcca

SEQ ID NO: 774002 - DNA, 20 bp, mouse
gggaaaagagctttaactcc

SEQ ID NO: 774003 - DNA, 20 bp, mouse
ggatggagatagtacagaga

SEQ ID NO: 774004 - DNA, 20 bp, mouse
gagttccaagaatcaaactc

SEQ ID NO: 774005 - DNA, 20 bp, mouse
gacatccagagtttgattct

SEQ ID NO: 774006 - DNA, 20 bp, mouse
gaatgtcagaggtcaggctt

SEQ ID NO: 774007 - DNA, 20 bp, mouse
ggtacaaagggattataaat

SEQ ID NO: 774008 - DNA, 20 bp, mouse
ggcgacacaggtaaacgcat

SEQ ID NO: 774009 - DNA, 20 bp, mouse
gtacttttaatgcctttcat

SEQ ID NO: 774010 - DNA, 20 bp, mouse
gggagaagaaagctaattcc

SEQ ID NO: 774011 - DNA, 20 bp, mouse
gcatataatatacccatgaa

SEQ ID NO: 774012 - DNA, 20 bp, mouse
gttccttgaaattataagtt

SEQ ID NO: 774013 - DNA, 20 bp, mouse
ggtgatggagacagtacaaa

SEQ ID NO: 774014 - DNA, 20 bp, mouse
gataaattattattttgaaa

SEQ ID NO: 774015 - DNA, 20 bp, mouse
gctcctaacttataatttca

SEQ ID NO: 774016 - DNA, 20 bp, mouse
gggctggtgagtaagatgtc

SEQ ID NO: 774017 - DNA, 20 bp, mouse
gcctgatgaacaggacgcta

SEQ ID NO: 774018 - DNA, 20 bp, mouse
gaaggagatgaaacctctaa

SEQ ID NO: 774019 - DNA, 20 bp, mouse
gactcaccagcctgatgaac

SEQ ID NO: 774020 - DNA, 20 bp, mouse
gtctgaggacaacacaaagc

SEQ ID NO: 774021 - DNA, 20 bp, mouse
gaagttgtttaaaatcagtt

SEQ ID NO: 774022 - DNA, 20 bp, mouse
gcatcactttacaaaattcg

SEQ ID NO: 774023 - DNA, 20 bp, mouse
gtgagtattacactttcagc

SEQ ID NO: 774024 - DNA, 20 bp, mouse
gttacaaagctttctattga

SEQ ID NO: 774025 - DNA, 20 bp, mouse
ggttttgcaagacataccat

SEQ ID NO: 774026 - DNA, 20 bp, mouse
gtgtaattggggtgctagat

SEQ ID NO: 774027 - DNA, 20 bp, mouse
ggctgtgatggaggcagtac

SEQ ID NO: 774028 - DNA, 20 bp, mouse
gtgatggaggcagtacagga

SEQ ID NO: 774029 - DNA, 20 bp, mouse
ggtcatttaaaacatgtaat

SEQ ID NO: 774030 - DNA, 20 bp, mouse
gctggatttaatagattgta

SEQ ID NO: 774031 - DNA, 20 bp, mouse
gaagagtcctaatattataa

SEQ ID NO: 774032 - DNA, 20 bp, mouse
gcctaatattataatggaaa

SEQ ID NO: 774033 - DNA, 20 bp, mouse
gatgaagaaataattgttaa

SEQ ID NO: 774034 - DNA, 20 bp, mouse
gatttcttcattacctatac

SEQ ID NO: 774035 - DNA, 20 bp, mouse
gaaaggtcagaaattactga

SEQ ID NO: 774036 - DNA, 20 bp, mouse
gcatggcatgtcaaagattg

SEQ ID NO: 774037 - DNA, 20 bp, mouse
gaactctggtaagtacattt

SEQ ID NO: 774038 - DNA, 20 bp, mouse
gcccaataacacaatgaaac

SEQ ID NO: 774039 - DNA, 20 bp, mouse
gtatgagaagactggctgcg

SEQ ID NO: 774040 - DNA, 20 bp, mouse
gtagagcagactggatggat

SEQ ID NO: 774041 - DNA, 20 bp, mouse
gaccttcaacagaaattaca

SEQ ID NO: 774042 - DNA, 20 bp, mouse
gtaaatagctatatacagaa

SEQ ID NO: 774043 - DNA, 20 bp, mouse
gccagagttcttcagtattg

SEQ ID NO: 774044 - DNA, 20 bp, mouse
ggaaggatttatgagaagac

SEQ ID NO: 774045 - DNA, 20 bp, mouse
gtgtaaatataaattagagg

SEQ ID NO: 774046 - DNA, 20 bp, mouse
ggctgtgatgaagacagtac

SEQ ID NO: 774047 - DNA, 20 bp, mouse
gtatctatatgttaatggaa

SEQ ID NO: 774048 - DNA, 20 bp, mouse
gaaaccctatataagtaact

SEQ ID NO: 774049 - DNA, 20 bp, mouse
gacttctatctatatgttaa

SEQ ID NO: 774050 - DNA, 20 bp, mouse
gaatatacttttgaattcat

SEQ ID NO: 774051 - DNA, 20 bp, mouse
gcattccaagttacttatat

SEQ ID NO: 774052 - DNA, 20 bp, mouse
gctatcaactgttattttca

SEQ ID NO: 774053 - DNA, 20 bp, mouse
gaatggaatttatgaatatg

SEQ ID NO: 774054 - DNA, 20 bp, mouse
gtttcatgagtctcacactt

SEQ ID NO: 774055 - DNA, 20 bp, mouse
gtagggtttaaaatatttta

SEQ ID NO: 774056 - DNA, 20 bp, mouse
gtgtgatggagacagatata

SEQ ID NO: 774057 - DNA, 20 bp, mouse
gtggagggtggatcagtgtg

SEQ ID NO: 774058 - DNA, 20 bp, mouse
gagtgtggggggattaaata

SEQ ID NO: 774059 - DNA, 20 bp, mouse
gatggagacagatataggga

SEQ ID NO: 774060 - DNA, 20 bp, mouse
gcattgaataaaaaagataa

SEQ ID NO: 774061 - DNA, 20 bp, mouse
gaaatgtataacaaataata

SEQ ID NO: 774062 - DNA, 20 bp, mouse
gcaatttttgaataacaaat

SEQ ID NO: 774063 - DNA, 20 bp, mouse
gcttctcaccactgagttca

SEQ ID NO: 774064 - DNA, 20 bp, mouse
gttttattccttgaactcag

SEQ ID NO: 774065 - DNA, 20 bp, mouse
ggggatgtggaacaattgga

SEQ ID NO: 774066 - DNA, 20 bp, mouse
gatacctggagcccacaaga

SEQ ID NO: 774067 - DNA, 20 bp, mouse
gtggagcccacaagatggga

SEQ ID NO: 774068 - DNA, 20 bp, mouse
gggtaacatgacatatgtgt

SEQ ID NO: 774069 - DNA, 20 bp, mouse
ggtacaaatgatgataatac

SEQ ID NO: 774070 - DNA, 20 bp, mouse
gttggcccagtaagatagct

SEQ ID NO: 774071 - DNA, 20 bp, mouse
ggtgatgaagatattacaaa

SEQ ID NO: 774072 - DNA, 20 bp, mouse
gtgtgtctgtaagggggtac

SEQ ID NO: 774073 - DNA, 20 bp, mouse
gacagatagtgtttgatacc

SEQ ID NO: 774074 - DNA, 20 bp, mouse
gatttcatttaattggggca

SEQ ID NO: 774075 - DNA, 20 bp, mouse
gtttttttgtgtctgtaagg

SEQ ID NO: 774076 - DNA, 20 bp, mouse
gacaattcatgttttactca

SEQ ID NO: 774077 - DNA, 20 bp, mouse
gaggatggggggacaaaata

SEQ ID NO: 774078 - DNA, 20 bp, mouse
ggtaagaatgaataaacaat

SEQ ID NO: 774079 - DNA, 20 bp, mouse
ggctgtgatggaaacagaat

SEQ ID NO: 774080 - DNA, 20 bp, mouse
gtggagggtggatcaggatg

SEQ ID NO: 774081 - DNA, 20 bp, mouse
gcattgaataaaaagataaa

SEQ ID NO: 774082 - DNA, 20 bp, mouse
ggtgaaagaattaataaaaa

SEQ ID NO: 774083 - DNA, 20 bp, mouse
gtaatttattattcaaaaat

SEQ ID NO: 774084 - DNA, 20 bp, mouse
gcttctcaccactgagttca

SEQ ID NO: 774085 - DNA, 20 bp, mouse
gttttattccttgaactcag

SEQ ID NO: 774086 - DNA, 20 bp, mouse
gagacttggaccagtaagat

SEQ ID NO: 774087 - DNA, 20 bp, mouse
ggtacaaataatgaaaatgg

SEQ ID NO: 774088 - DNA, 20 bp, mouse
gtgtaatgttctccatgccc

SEQ ID NO: 774089 - DNA, 20 bp, mouse
gacttcatttcagttaaccg

SEQ ID NO: 774090 - DNA, 20 bp, mouse
gttggaccagtaagataggt

SEQ ID NO: 774091 - DNA, 20 bp, mouse
gtgtaccatttcatgcttgg

SEQ ID NO: 774092 - DNA, 20 bp, mouse
gaatatattattcaaaacat

SEQ ID NO: 774093 - DNA, 20 bp, mouse
gtacctgtaacctaaaagat

SEQ ID NO: 774094 - DNA, 20 bp, mouse
gatttcagttaaccggggca

SEQ ID NO: 774095 - DNA, 20 bp, mouse
gttcccatcttttaggttac

SEQ ID NO: 774096 - DNA, 20 bp, mouse
ggggacaagggaatcctccc

SEQ ID NO: 774097 - DNA, 20 bp, mouse
gttaaaccagctctagacct

SEQ ID NO: 774098 - DNA, 20 bp, mouse
gaaccagctctagacctggg

SEQ ID NO: 774099 - DNA, 20 bp, mouse
gtcagtgactgggacattcc

SEQ ID NO: 774100 - DNA, 20 bp, mouse
gcccacctgtgttactgtcc

SEQ ID NO: 774101 - DNA, 20 bp, mouse
gaaacgtgggtggaggtcat

SEQ ID NO: 774102 - DNA, 20 bp, mouse
gatcctcccaggtctagagc

SEQ ID NO: 774103 - DNA, 20 bp, mouse
gtgcacatgtcttaaaacgt

SEQ ID NO: 774104 - DNA, 20 bp, mouse
gataggacaatgtcaggcac

SEQ ID NO: 774105 - DNA, 20 bp, mouse
gtaaaacatggaaaacatat

SEQ ID NO: 774106 - DNA, 20 bp, mouse
gcaatgtagcaagaatcttg

SEQ ID NO: 774107 - DNA, 20 bp, mouse
gcatatgtcttcagtctcat

SEQ ID NO: 774108 - DNA, 20 bp, mouse
gtgcccaaagcaatttgaat

SEQ ID NO: 774109 - DNA, 20 bp, mouse
gaaaccaattcaaattgctt

SEQ ID NO: 774110 - DNA, 20 bp, mouse
gagattcttgctacattgtt

SEQ ID NO: 774111 - DNA, 20 bp, mouse
ggcataaggtcaagtttgta

SEQ ID NO: 774112 - DNA, 20 bp, mouse
gtacctgagacatgttctgg

SEQ ID NO: 774113 - DNA, 20 bp, mouse
gcataatagcatgttttaac

SEQ ID NO: 774114 - DNA, 20 bp, mouse
gcatgttctggtggtctcac

SEQ ID NO: 774115 - DNA, 20 bp, mouse
ggcatacctgagacatgttc

SEQ ID NO: 774116 - DNA, 20 bp, mouse
gtactgcaggcaaataagtt

SEQ ID NO: 774117 - DNA, 20 bp, mouse
gaatgtagactcattactgc

SEQ ID NO: 774118 - DNA, 20 bp, mouse
gatgaatgcttgtcctatta

SEQ ID NO: 774119 - DNA, 20 bp, mouse
gatgagtctacatttcaagt

SEQ ID NO: 774120 - DNA, 20 bp, mouse
gacaggaaaggatttataag

SEQ ID NO: 774121 - DNA, 20 bp, mouse
gtaagaaccatgtaaaatat

SEQ ID NO: 774122 - DNA, 20 bp, mouse
gtagtagccaatattttaca

SEQ ID NO: 774123 - DNA, 20 bp, mouse
gttatattttatgaataatg

SEQ ID NO: 774124 - DNA, 20 bp, mouse
gtgctttcattttccctaat

SEQ ID NO: 774125 - DNA, 20 bp, mouse
ggaaaagaaaatgacatgtg

SEQ ID NO: 774126 - DNA, 20 bp, mouse
gtgactaaatatcagcgctg

SEQ ID NO: 774127 - DNA, 20 bp, mouse
gtcttagaacgtatttagtc

SEQ ID NO: 774128 - DNA, 20 bp, mouse
gtttgcaatatattccaaac

SEQ ID NO: 774129 - DNA, 20 bp, mouse
ggtactgtatggtttttaaa

SEQ ID NO: 774130 - DNA, 20 bp, mouse
ggcgctggggagactgagga

SEQ ID NO: 774131 - DNA, 20 bp, mouse
gaaaagacaaaagaaaatac

SEQ ID NO: 774132 - DNA, 20 bp, mouse
gtcattcagggaactgttac

SEQ ID NO: 774133 - DNA, 20 bp, mouse
gatcagcgctggggagactg

SEQ ID NO: 774134 - DNA, 20 bp, mouse
gtttatgttcaatcaaacaa

SEQ ID NO: 774135 - DNA, 20 bp, mouse
gcatttggaagaatcataat

SEQ ID NO: 774136 - DNA, 20 bp, mouse
ggtctttaataatagttatg

SEQ ID NO: 774137 - DNA, 20 bp, mouse
gaatgcaatggtggcagact

SEQ ID NO: 774138 - DNA, 20 bp, mouse
ggattttagcaatgcaatgg

SEQ ID NO: 774139 - DNA, 20 bp, mouse
gtaaatctgtttcttaaaaa

SEQ ID NO: 774140 - DNA, 20 bp, mouse
ggctgattttagcaatgcaa

SEQ ID NO: 774141 - DNA, 20 bp, mouse
gcctggggaaggttactagg

SEQ ID NO: 774142 - DNA, 20 bp, mouse
gctggggttgtagttcatac

SEQ ID NO: 774143 - DNA, 20 bp, mouse
gctccctggggaaggttact

SEQ ID NO: 774144 - DNA, 20 bp, mouse
gtttcttaaaaatggagctg

SEQ ID NO: 774145 - DNA, 20 bp, mouse
gttttaatactccctgggga

SEQ ID NO: 774146 - DNA, 20 bp, mouse
ggtgtgctatggactaataa

SEQ ID NO: 774147 - DNA, 20 bp, mouse
gcttacttataaaaccacag

SEQ ID NO: 774148 - DNA, 20 bp, mouse
gatcgaacaaaattttggtc

SEQ ID NO: 774149 - DNA, 20 bp, mouse
gtaacagatacattatttga

SEQ ID NO: 774150 - DNA, 20 bp, mouse
gatagtaaaatatacctctg

SEQ ID NO: 774151 - DNA, 20 bp, mouse
gataaaattctgtcttatcc

SEQ ID NO: 774152 - DNA, 20 bp, mouse
ggtgcttagaaacattagta

SEQ ID NO: 774153 - DNA, 20 bp, mouse
gatcacagaattgtgtgcta

SEQ ID NO: 774154 - DNA, 20 bp, mouse
gatataagtagtctagaatg

SEQ ID NO: 774155 - DNA, 20 bp, mouse
gtttatttctgataccctca

SEQ ID NO: 774156 - DNA, 20 bp, mouse
ggctgtgatggagacagtat

SEQ ID NO: 774157 - DNA, 20 bp, mouse
ggacagggttaaggaagtag

SEQ ID NO: 774158 - DNA, 20 bp, mouse
gactttaagaatctcatcta

SEQ ID NO: 774159 - DNA, 20 bp, mouse
gattgtttaagagacgtttc

SEQ ID NO: 774160 - DNA, 20 bp, mouse
ggatggggagggaaatgggg

SEQ ID NO: 774161 - DNA, 20 bp, mouse
gaggggatggggagggaaat

SEQ ID NO: 774162 - DNA, 20 bp, mouse
gtaggaaattgggtgagaga

SEQ ID NO: 774163 - DNA, 20 bp, mouse
ggcattaatcaaaacataat

SEQ ID NO: 774164 - DNA, 20 bp, mouse
gtacagttttaaatacaatt

SEQ ID NO: 774165 - DNA, 20 bp, mouse
gataagaggaagatggagtt

SEQ ID NO: 774166 - DNA, 20 bp, mouse
ggtaaacatcagttaattca

SEQ ID NO: 774167 - DNA, 20 bp, mouse
gcatgtaaactaacaacatg

SEQ ID NO: 774168 - DNA, 20 bp, mouse
gtttttccaagaaatcagtg

SEQ ID NO: 774169 - DNA, 20 bp, mouse
gtcaaagtagatgaaatact

SEQ ID NO: 774170 - DNA, 20 bp, mouse
ggcaaagcacacaatattca

SEQ ID NO: 774171 - DNA, 20 bp, mouse
gtgccacaaaacctatggtt

SEQ ID NO: 774172 - DNA, 20 bp, mouse
gaaataggaaagggaaataa

SEQ ID NO: 774173 - DNA, 20 bp, mouse
gtgccaaaccataggttttg

SEQ ID NO: 774174 - DNA, 20 bp, mouse
ggttagtttacatgccaatg

SEQ ID NO: 774175 - DNA, 20 bp, mouse
ggttgttctttattcctcat

SEQ ID NO: 774176 - DNA, 20 bp, mouse
gtgctcaaaccccaaaaagt

SEQ ID NO: 774177 - DNA, 20 bp, mouse
gaaacttaaacctacttttt

SEQ ID NO: 774178 - DNA, 20 bp, mouse
gatggagttacagaattgag

SEQ ID NO: 774179 - DNA, 20 bp, mouse
ggtaggtttaagtttcttct

SEQ ID NO: 774180 - DNA, 20 bp, mouse
gagtgactaagagcaaagtt

SEQ ID NO: 774181 - DNA, 20 bp, mouse
gacagtgactgtattaataa

SEQ ID NO: 774182 - DNA, 20 bp, mouse
gattttctatgatggtactc

SEQ ID NO: 774183 - DNA, 20 bp, mouse
gttattgaatttactgactc

SEQ ID NO: 774184 - DNA, 20 bp, mouse
gagcccattattttctatga

SEQ ID NO: 774185 - DNA, 20 bp, mouse
gagagaatgatatggaactt

SEQ ID NO: 774186 - DNA, 20 bp, mouse
gaaaagaaagcaaacaagtt

SEQ ID NO: 774187 - DNA, 20 bp, mouse
gaaacttaatataaggattg

SEQ ID NO: 774188 - DNA, 20 bp, mouse
gtttaaaatggtttagtgat

SEQ ID NO: 774189 - DNA, 20 bp, mouse
gggtaatataattcacctta

SEQ ID NO: 774190 - DNA, 20 bp, mouse
gtttacatgacagctttaat

SEQ ID NO: 774191 - DNA, 20 bp, mouse
gataggtttctttatccata

SEQ ID NO: 774192 - DNA, 20 bp, mouse
ggtaatcttaaacaaaatac

SEQ ID NO: 774193 - DNA, 20 bp, mouse
ggaaaagaaaatctgggtag

SEQ ID NO: 774194 - DNA, 20 bp, mouse
gaaaaacataagatttaaaa

SEQ ID NO: 774195 - DNA, 20 bp, mouse
gcagtattaaacttaatata

SEQ ID NO: 774196 - DNA, 20 bp, mouse
gtgactctacaatttaaatg

SEQ ID NO: 774197 - DNA, 20 bp, mouse
gatgatggagatagtacagg

SEQ ID NO: 774198 - DNA, 20 bp, mouse
ggtgagtaattatacatgct

SEQ ID NO: 774199 - DNA, 20 bp, mouse
gtatgagacagaaagattta

SEQ ID NO: 774200 - DNA, 20 bp, mouse
ggtataattactcacctgca

SEQ ID NO: 774201 - DNA, 20 bp, mouse
ggtgatgaagttaatatctt

SEQ ID NO: 774202 - DNA, 20 bp, mouse
gattgtagagtcatccttgc

SEQ ID NO: 774203 - DNA, 20 bp, mouse
gattttttgctttaaggaaa

SEQ ID NO: 774204 - DNA, 20 bp, mouse
gatgtttattttttgcttta

SEQ ID NO: 774205 - DNA, 20 bp, mouse
ggctatgatggagatagtac

SEQ ID NO: 774206 - DNA, 20 bp, mouse
ggaattgaagtcaggttctg

SEQ ID NO: 774207 - DNA, 20 bp, mouse
gataacaaaatgtgagtggc

SEQ ID NO: 774208 - DNA, 20 bp, mouse
ggacatgctctttttaacag

SEQ ID NO: 774209 - DNA, 20 bp, mouse
gccctataacaaaatgtgag

SEQ ID NO: 774210 - DNA, 20 bp, mouse
gcaatacaaaagtttgatat

SEQ ID NO: 774211 - DNA, 20 bp, mouse
gctactgaactatgtgctcc

SEQ ID NO: 774212 - DNA, 20 bp, mouse
gtttgggggggatccaggga

SEQ ID NO: 774213 - DNA, 20 bp, mouse
gtaactggccttcaagctta

SEQ ID NO: 774214 - DNA, 20 bp, mouse
gcattaatatggtggacaaa

SEQ ID NO: 774215 - DNA, 20 bp, mouse
ggttgttttgggggggatcc

SEQ ID NO: 774216 - DNA, 20 bp, mouse
gggagctgatttcttttagg

SEQ ID NO: 774217 - DNA, 20 bp, mouse
ggggagagactgaatgtaga

SEQ ID NO: 774218 - DNA, 20 bp, mouse
gccaaatggagttgacatga

SEQ ID NO: 774219 - DNA, 20 bp, mouse
gtcatacagacccaaacagt

SEQ ID NO: 774220 - DNA, 20 bp, mouse
ggaaatcagctccaactgtt

SEQ ID NO: 774221 - DNA, 20 bp, mouse
ggttggagctgatttctttt

SEQ ID NO: 774222 - DNA, 20 bp, mouse
gagggtgctcacaggctggc

SEQ ID NO: 774223 - DNA, 20 bp, mouse
gagagactgaatgtagaagg

SEQ ID NO: 774224 - DNA, 20 bp, mouse
gcagacagcatatctgattc

SEQ ID NO: 774225 - DNA, 20 bp, mouse
gtgtctggaacaacaaagat

SEQ ID NO: 774226 - DNA, 20 bp, mouse
gtcacagcacagagcataaa

SEQ ID NO: 774227 - DNA, 20 bp, mouse
gaaatagaagtggaggaatg

SEQ ID NO: 774228 - DNA, 20 bp, mouse
gctcattaatgcaagtggtt

SEQ ID NO: 774229 - DNA, 20 bp, mouse
ggcccttgaaatagaagtgg

SEQ ID NO: 774230 - DNA, 20 bp, mouse
gtcactagttgtgtattgtg

SEQ ID NO: 774231 - DNA, 20 bp, mouse
gcaggctagagctatttgac

SEQ ID NO: 774232 - DNA, 20 bp, mouse
gaagggctcattaatgcaag

SEQ ID NO: 774233 - DNA, 20 bp, mouse
gtcataaaaataaagtacat

SEQ ID NO: 774234 - DNA, 20 bp, mouse
gataaaattttactacttaa

SEQ ID NO: 774235 - DNA, 20 bp, mouse
gtcctccacttctatttcaa

SEQ ID NO: 774236 - DNA, 20 bp, mouse
gcacaaatggacaagttaaa

SEQ ID NO: 774237 - DNA, 20 bp, mouse
ggaaccccacaagatctcca

SEQ ID NO: 774238 - DNA, 20 bp, mouse
gggaaatacccataagatta

SEQ ID NO: 774239 - DNA, 20 bp, mouse
gtggggttcaggtgactttt

SEQ ID NO: 774240 - DNA, 20 bp, mouse
gggtatgctcattttgacag

SEQ ID NO: 774241 - DNA, 20 bp, mouse
gtcctccgtccactgtatta

SEQ ID NO: 774242 - DNA, 20 bp, mouse
gctttaactaatatgaaata

SEQ ID NO: 774243 - DNA, 20 bp, mouse
gagagtgtatacatttgcca

SEQ ID NO: 774244 - DNA, 20 bp, mouse
gaactaatatgaaatatggc

SEQ ID NO: 774245 - DNA, 20 bp, mouse
gcttactctcatcttggcat

SEQ ID NO: 774246 - DNA, 20 bp, mouse
ggaaaagcataaaatgtcat

SEQ ID NO: 774247 - DNA, 20 bp, mouse
gtggagaatagctacacaat

SEQ ID NO: 774248 - DNA, 20 bp, mouse
gtgattctggcttagaattt

SEQ ID NO: 774249 - DNA, 20 bp, mouse
gggaaataacaatatgattc

SEQ ID NO: 774250 - DNA, 20 bp, mouse
gtatctctaacaacattatg

SEQ ID NO: 774251 - DNA, 20 bp, mouse
gggaagataatgtgtagtaa

SEQ ID NO: 774252 - DNA, 20 bp, mouse
gcaccctccatacatttcta

SEQ ID NO: 774253 - DNA, 20 bp, mouse
gaatcttttatacataaaag

SEQ ID NO: 774254 - DNA, 20 bp, mouse
gagacaccaacatgtttgaa

SEQ ID NO: 774255 - DNA, 20 bp, mouse
gtcataattcttcaagtgaa

SEQ ID NO: 774256 - DNA, 20 bp, mouse
gaaaacacccattgtcaatt

SEQ ID NO: 774257 - DNA, 20 bp, mouse
gtaaggcagactataacaaa

SEQ ID NO: 774258 - DNA, 20 bp, mouse
gatagtctgccttaactcct

SEQ ID NO: 774259 - DNA, 20 bp, mouse
gtactctccaaattgacaat

SEQ ID NO: 774260 - DNA, 20 bp, mouse
gttctaggtgtttccacaat

SEQ ID NO: 774261 - DNA, 20 bp, mouse
gaaataaataatacctattg

SEQ ID NO: 774262 - DNA, 20 bp, mouse
gattttcacactatataact

SEQ ID NO: 774263 - DNA, 20 bp, mouse
gtattttataggaacaaagt

SEQ ID NO: 774264 - DNA, 20 bp, mouse
gatttaataatatgcatatc

SEQ ID NO: 774265 - DNA, 20 bp, mouse
gttgacaatgggtgtttttg

SEQ ID NO: 774266 - DNA, 20 bp, mouse
gacgttagaaaataccacgt

SEQ ID NO: 774267 - DNA, 20 bp, mouse
gaagatgcacagagtggctc

SEQ ID NO: 774268 - DNA, 20 bp, mouse
ggtgataggagttagagctt

SEQ ID NO: 774269 - DNA, 20 bp, mouse
ggtgaatcgtagattcagaa

SEQ ID NO: 774270 - DNA, 20 bp, mouse
gtagtgagtgctctggcaaa

SEQ ID NO: 774271 - DNA, 20 bp, mouse
gatagataaaagtgataaac

SEQ ID NO: 774272 - DNA, 20 bp, mouse
ggattcagaatggtcctacg

SEQ ID NO: 774273 - DNA, 20 bp, mouse
ggcatacatcatataaagat

SEQ ID NO: 774274 - DNA, 20 bp, mouse
ggtagacattccttggtgat

SEQ ID NO: 774275 - DNA, 20 bp, mouse
gggttgagcacccatcacca

SEQ ID NO: 774276 - DNA, 20 bp, mouse
gaattcgagcacaggtgcta

SEQ ID NO: 774277 - DNA, 20 bp, mouse
gctgcctcaggactgtatcc

SEQ ID NO: 774278 - DNA, 20 bp, mouse
gaaggacaaaattcgagcac

SEQ ID NO: 774279 - DNA, 20 bp, mouse
gattgagccgaccctggcct

SEQ ID NO: 774280 - DNA, 20 bp, mouse
gtcacatagatccttttgca

SEQ ID NO: 774281 - DNA, 20 bp, mouse
gaagcctggatacagtcctg

SEQ ID NO: 774282 - DNA, 20 bp, mouse
gctacctagggcattggtga

SEQ ID NO: 774283 - DNA, 20 bp, mouse
gtggccttcaccaatgccct

SEQ ID NO: 774284 - DNA, 20 bp, mouse
gtatggaatgccacagttcc

SEQ ID NO: 774285 - DNA, 20 bp, mouse
gtcggctcaatgactaccta

SEQ ID NO: 774286 - DNA, 20 bp, mouse
gttggtacttggcagatctg

SEQ ID NO: 774287 - DNA, 20 bp, mouse
gagatctggggctcagaggg

SEQ ID NO: 774288 - DNA, 20 bp, mouse
gtagactgatgattggtact

SEQ ID NO: 774289 - DNA, 20 bp, mouse
gttgtcagctaacttcagtt

SEQ ID NO: 774290 - DNA, 20 bp, mouse
ggaaagcaggcccagatccc

SEQ ID NO: 774291 - DNA, 20 bp, mouse
ggtctgagataaggtctggg

SEQ ID NO: 774292 - DNA, 20 bp, mouse
gataaggtctggggggtaga

SEQ ID NO: 774293 - DNA, 20 bp, mouse
gttagctgacaacccaagtg

SEQ ID NO: 774294 - DNA, 20 bp, mouse
ggaggagtgacagtaggctg

SEQ ID NO: 774295 - DNA, 20 bp, mouse
gcaagctgagtcatgtagtg

SEQ ID NO: 774296 - DNA, 20 bp, mouse
ggagttctggcataggttga

SEQ ID NO: 774297 - DNA, 20 bp, mouse
gaatgctaaaggaagtacag

SEQ ID NO: 774298 - DNA, 20 bp, mouse
gtggcacaagacagaactcc

SEQ ID NO: 774299 - DNA, 20 bp, mouse
gggttcctctgattacagat

SEQ ID NO: 774300 - DNA, 20 bp, mouse
gtacaatgtaagcacctcag

SEQ ID NO: 774301 - DNA, 20 bp, mouse
gtacgccaatctgtaatcag

SEQ ID NO: 774302 - DNA, 20 bp, mouse
gcacgtagacgtattgatca

SEQ ID NO: 774303 - DNA, 20 bp, mouse
gggaaaggttttaacctcat

SEQ ID NO: 774304 - DNA, 20 bp, mouse
gggagtccagttcatccata

SEQ ID NO: 774305 - DNA, 20 bp, mouse
gacacggtttttatgttaca

SEQ ID NO: 774306 - DNA, 20 bp, mouse
ggtggaagtgagtttcaaga

SEQ ID NO: 774307 - DNA, 20 bp, mouse
ggaactgtagcagatcctga

SEQ ID NO: 774308 - DNA, 20 bp, mouse
gtgacccatccctgcaaaca

SEQ ID NO: 774309 - DNA, 20 bp, mouse
gcacaccatcccaggaccga

SEQ ID NO: 774310 - DNA, 20 bp, mouse
gaacaaggctgacccgtcct

SEQ ID NO: 774311 - DNA, 20 bp, mouse
gagaaacatccctcggtcct

SEQ ID NO: 774312 - DNA, 20 bp, mouse
gtcacttccacatctaccaa

SEQ ID NO: 774313 - DNA, 20 bp, mouse
gtgtcagcccttggtagatg

SEQ ID NO: 774314 - DNA, 20 bp, mouse
gggccctgctggagtctcaa

SEQ ID NO: 774315 - DNA, 20 bp, mouse
ggggctgacacctgagcaat

SEQ ID NO: 774316 - DNA, 20 bp, mouse
gacccactgcctgtcaccta

SEQ ID NO: 774317 - DNA, 20 bp, mouse
gtgcctgtcacctaggggag

SEQ ID NO: 774318 - DNA, 20 bp, mouse
gcccccctcccctaggtgac

SEQ ID NO: 774319 - DNA, 20 bp, mouse
gcccctaggtgacaggcagt

SEQ ID NO: 774320 - DNA, 20 bp, mouse
ggcaaagatgctgaagagca

SEQ ID NO: 774321 - DNA, 20 bp, mouse
gtctatccaggtactcccaa

SEQ ID NO: 774322 - DNA, 20 bp, mouse
gacaaggacctctctctgcc

SEQ ID NO: 774323 - DNA, 20 bp, mouse
gggtactcccaaggggagct

SEQ ID NO: 774324 - DNA, 20 bp, mouse
ggctctctgattctggaaca

SEQ ID NO: 774325 - DNA, 20 bp, mouse
ggatgacttcctacaagcac

SEQ ID NO: 774326 - DNA, 20 bp, mouse
gtgtgcaaacatcagaggac

SEQ ID NO: 774327 - DNA, 20 bp, mouse
gggtgtgtgtcgtagtgaac

SEQ ID NO: 774328 - DNA, 20 bp, mouse
gaaaatggagacacgtctgg

SEQ ID NO: 774329 - DNA, 20 bp, mouse
gcagcattcttgtggagagg

SEQ ID NO: 774330 - DNA, 20 bp, mouse
ggctgatccgtgagctccca

SEQ ID NO: 774331 - DNA, 20 bp, mouse
gcatccccacatgactgcaa

SEQ ID NO: 774332 - DNA, 20 bp, mouse
gcaagaacatgtacacactg

SEQ ID NO: 774333 - DNA, 20 bp, mouse
gccagctttacctgagtctc

SEQ ID NO: 774334 - DNA, 20 bp, mouse
gttccctttgcagtcatgtg

SEQ ID NO: 774335 - DNA, 20 bp, mouse
gaacatatctgaccaggtgg

SEQ ID NO: 774336 - DNA, 20 bp, mouse
gagtgggccagggttctcag

SEQ ID NO: 774337 - DNA, 20 bp, mouse
ggcagctaaggcatactaag

SEQ ID NO: 774338 - DNA, 20 bp, mouse
gcagttctcagagtatcata

SEQ ID NO: 774339 - DNA, 20 bp, mouse
gcctggcccactccttgata

SEQ ID NO: 774340 - DNA, 20 bp, mouse
gttacagaatggcatgtagg

SEQ ID NO: 774341 - DNA, 20 bp, mouse
gtcaagggagtgatttagag

SEQ ID NO: 774342 - DNA, 20 bp, mouse
ggcaggggttccttctgttc

SEQ ID NO: 774343 - DNA, 20 bp, mouse
gctgggtttgtcatcctcaa

SEQ ID NO: 774344 - DNA, 20 bp, mouse
ggcccactccttgataaggt

SEQ ID NO: 774345 - DNA, 20 bp, mouse
gtattgcccatcacaggcag

SEQ ID NO: 774346 - DNA, 20 bp, mouse
gaaagatcctgcatctctaa

SEQ ID NO: 774347 - DNA, 20 bp, mouse
gacttcagggagtatggaac

SEQ ID NO: 774348 - DNA, 20 bp, mouse
gtgtcctggtaacatgagag

SEQ ID NO: 774349 - DNA, 20 bp, mouse
gttacccccatgtaatactg

SEQ ID NO: 774350 - DNA, 20 bp, mouse
gccaaacctcagtattacat

SEQ ID NO: 774351 - DNA, 20 bp, mouse
gagaatgacacctgcagcct

SEQ ID NO: 774352 - DNA, 20 bp, mouse
gaggaacgggaatacccctc

SEQ ID NO: 774353 - DNA, 20 bp, mouse
ggggggaacaagagtcccaa

SEQ ID NO: 774354 - DNA, 20 bp, mouse
gggtctcaacacatctgcat

SEQ ID NO: 774355 - DNA, 20 bp, mouse
ggagctctcagacagcgggt

SEQ ID NO: 774356 - DNA, 20 bp, mouse
gcatgcacagtgttggtgag

SEQ ID NO: 774357 - DNA, 20 bp, mouse
ggtgtggaggacaatggcca

SEQ ID NO: 774358 - DNA, 20 bp, mouse
gagcttgggtcattaagtca

SEQ ID NO: 774359 - DNA, 20 bp, mouse
gcatgagaatcccaatgata

SEQ ID NO: 774360 - DNA, 20 bp, mouse
gtacagaaaggcttgagtgt

SEQ ID NO: 774361 - DNA, 20 bp, mouse
gtgtgcatgcaccatatcat

SEQ ID NO: 774362 - DNA, 20 bp, mouse
gacaagtctgcagggagctt

SEQ ID NO: 774363 - DNA, 20 bp, mouse
gacagagtatgtgactcccc

SEQ ID NO: 774364 - DNA, 20 bp, mouse
gtatggtgcatgcacagtgt

SEQ ID NO: 774365 - DNA, 20 bp, mouse
gaactcttctatatctatat

SEQ ID NO: 774366 - DNA, 20 bp, mouse
ggggactatgaaggatgcaa

SEQ ID NO: 774367 - DNA, 20 bp, mouse
gacacactgactggagagta

SEQ ID NO: 774368 - DNA, 20 bp, mouse
ggcaatctttccctcaatat

SEQ ID NO: 774369 - DNA, 20 bp, mouse
gtgttcatggagtctgtatt

SEQ ID NO: 774370 - DNA, 20 bp, mouse
gtcaaccaggacacactgac

SEQ ID NO: 774371 - DNA, 20 bp, mouse
gctctccagtcagtgtgtcc

SEQ ID NO: 774372 - DNA, 20 bp, mouse
gctcagggaccttgtattca

SEQ ID NO: 774373 - DNA, 20 bp, mouse
gctgactggagagtatggtt

SEQ ID NO: 774374 - DNA, 20 bp, mouse
gacatctcatcccatattga

SEQ ID NO: 774375 - DNA, 20 bp, mouse
gggagagtatggtttggtac

SEQ ID NO: 774376 - DNA, 20 bp, mouse
ggaaagatcccgaatctcta

SEQ ID NO: 774377 - DNA, 20 bp, mouse
gggtgagtctcaccatatct

SEQ ID NO: 774378 - DNA, 20 bp, mouse
gcttatgccatgcgatactg

SEQ ID NO: 774379 - DNA, 20 bp, mouse
gtctgtgtctcctggtaaca

SEQ ID NO: 774380 - DNA, 20 bp, mouse
gtaactacccagcccagata

SEQ ID NO: 774381 - DNA, 20 bp, mouse
gcaagaacaggaagagtcca

SEQ ID NO: 774382 - DNA, 20 bp, mouse
gcccaaacctcagtatcgca

SEQ ID NO: 774383 - DNA, 20 bp, mouse
gttcctgtaacagctctgat

SEQ ID NO: 774384 - DNA, 20 bp, mouse
gagtctcaccatatctgggc

SEQ ID NO: 774385 - DNA, 20 bp, mouse
gggaaagaaacctcccagtg

SEQ ID NO: 774386 - DNA, 20 bp, mouse
gtcagctaaggcataccaag

SEQ ID NO: 774387 - DNA, 20 bp, mouse
gggtccaggattgcttctca

SEQ ID NO: 774388 - DNA, 20 bp, mouse
gagagaggacgattgggatc

SEQ ID NO: 774389 - DNA, 20 bp, mouse
gtcaaggagacacagggtat

SEQ ID NO: 774390 - DNA, 20 bp, mouse
gcatgtatgccagtcagcta

SEQ ID NO: 774391 - DNA, 20 bp, mouse
gggcaggcagaaaaacagtt

SEQ ID NO: 774392 - DNA, 20 bp, mouse
ggagtgactcggggtggcaa

SEQ ID NO: 774393 - DNA, 20 bp, mouse
gaaaggaccaaacttatcaa

SEQ ID NO: 774394 - DNA, 20 bp, mouse
gggacgattgggatctggag

SEQ ID NO: 774395 - DNA, 20 bp, mouse
gagcaagcagaatctctaga

SEQ ID NO: 774396 - DNA, 20 bp, mouse
gtcaaccagggcatagttat

SEQ ID NO: 774397 - DNA, 20 bp, mouse
gcacagactgaatctgtata

SEQ ID NO: 774398 - DNA, 20 bp, mouse
gagactgtcttgtggatcat

SEQ ID NO: 774399 - DNA, 20 bp, mouse
ggtctccaataactatgccc

SEQ ID NO: 774400 - DNA, 20 bp, mouse
ggctcacaatccttcattca

SEQ ID NO: 774401 - DNA, 20 bp, mouse
gacagactaaagtaaatagc

SEQ ID NO: 774402 - DNA, 20 bp, mouse
gtgtaaccaggaacttgttc

SEQ ID NO: 774403 - DNA, 20 bp, mouse
gtggctgctgtcctagagtg

SEQ ID NO: 774404 - DNA, 20 bp, mouse
gtggttgactcacacaaaca

SEQ ID NO: 774405 - DNA, 20 bp, mouse
gcactagcacgtgaagctag

SEQ ID NO: 774406 - DNA, 20 bp, mouse
gagggtgaaagttgctaggt

SEQ ID NO: 774407 - DNA, 20 bp, mouse
gagaagcaggtcctgaagga

SEQ ID NO: 774408 - DNA, 20 bp, mouse
gtgggaaggaaggcacaaaa

SEQ ID NO: 774409 - DNA, 20 bp, mouse
gctcttgattcagatctaca

SEQ ID NO: 774410 - DNA, 20 bp, mouse
gtggaaacactgtgctctgt

SEQ ID NO: 774411 - DNA, 20 bp, mouse
gggaaatacctgctgtgatt

SEQ ID NO: 774412 - DNA, 20 bp, mouse
gagtgtagcatccctccttc

SEQ ID NO: 774413 - DNA, 20 bp, mouse
ggccagtaggccaggtggga

SEQ ID NO: 774414 - DNA, 20 bp, mouse
gattgagaagccagtaggcc

SEQ ID NO: 774415 - DNA, 20 bp, mouse
gaaaatatttcacttctttc

SEQ ID NO: 774416 - DNA, 20 bp, mouse
gaatagttgcaaggccactt

SEQ ID NO: 774417 - DNA, 20 bp, mouse
ggcaaggccactttggccaa

SEQ ID NO: 774418 - DNA, 20 bp, mouse
gcctcagcatgtcaatgttc

SEQ ID NO: 774419 - DNA, 20 bp, mouse
gctcaggcctttggccaaag

SEQ ID NO: 774420 - DNA, 20 bp, mouse
ggcatgcaacagaacagcct

SEQ ID NO: 774421 - DNA, 20 bp, mouse
ggtcacatgtgagctggagc

SEQ ID NO: 774422 - DNA, 20 bp, mouse
ggagaggggcctggtcccaa

SEQ ID NO: 774423 - DNA, 20 bp, mouse
gtggccaaaggcctgaggca

SEQ ID NO: 774424 - DNA, 20 bp, mouse
ggtcccaagggcagatgggg

SEQ ID NO: 774425 - DNA, 20 bp, mouse
gctggtcccaagggcagatg

SEQ ID NO: 774426 - DNA, 20 bp, mouse
ggacttagcatcaataggtc

SEQ ID NO: 774427 - DNA, 20 bp, mouse
gaaggtgacttagcatcaat

SEQ ID NO: 774428 - DNA, 20 bp, mouse
gctactgtttccaggatttc

SEQ ID NO: 774429 - DNA, 20 bp, mouse
gaatgtatttgtatctgtga

SEQ ID NO: 774430 - DNA, 20 bp, mouse
gaggacgggctactgtttcc

SEQ ID NO: 774431 - DNA, 20 bp, mouse
gctgtaaacaaaataccaac

SEQ ID NO: 774432 - DNA, 20 bp, mouse
gaattttctgctgtcagaag

SEQ ID NO: 774433 - DNA, 20 bp, mouse
gtacagttgaattttcagct

SEQ ID NO: 774434 - DNA, 20 bp, mouse
gatcaataggtcaggtatga

SEQ ID NO: 774435 - DNA, 20 bp, mouse
gctatgctctcctgaaatcc

SEQ ID NO: 774436 - DNA, 20 bp, mouse
gcctcctgattcagaatgat

SEQ ID NO: 774437 - DNA, 20 bp, mouse
gataggcaggtattgagtaa

SEQ ID NO: 774438 - DNA, 20 bp, mouse
ggaaagtggggagtacagct

SEQ ID NO: 774439 - DNA, 20 bp, mouse
gaggctaagtatagaaacaa

SEQ ID NO: 774440 - DNA, 20 bp, mouse
gaaagaagaggcttacacga

SEQ ID NO: 774441 - DNA, 20 bp, mouse
gtttcacatgttcaaaatta

SEQ ID NO: 774442 - DNA, 20 bp, mouse
gcagtttaccacttgaaatc

SEQ ID NO: 774443 - DNA, 20 bp, mouse
gtttgaaaccagatttcaag

SEQ ID NO: 774444 - DNA, 20 bp, mouse
gagcttagtggcaatgagga

SEQ ID NO: 774445 - DNA, 20 bp, mouse
gcaatgaggaaggagagcat

SEQ ID NO: 774446 - DNA, 20 bp, mouse
gtctctagaaccaacagtag

SEQ ID NO: 774447 - DNA, 20 bp, mouse
gtagtgtttgattggggatg

SEQ ID NO: 774448 - DNA, 20 bp, mouse
ggcgtgtgtgtgaagatcac

SEQ ID NO: 774449 - DNA, 20 bp, mouse
gtcactatgtggtcagactc

SEQ ID NO: 774450 - DNA, 20 bp, mouse
gcacacacacacacgagttc

SEQ ID NO: 774451 - DNA, 20 bp, mouse
ggaggcaggaccctatgaca

SEQ ID NO: 774452 - DNA, 20 bp, mouse
gcaggaccctatgacatgga

SEQ ID NO: 774453 - DNA, 20 bp, mouse
gaattctctccctctactgt

SEQ ID NO: 774454 - DNA, 20 bp, mouse
gagcacccttccatgtcata

SEQ ID NO: 774455 - DNA, 20 bp, mouse
gagatcacaggagaacttta

SEQ ID NO: 774456 - DNA, 20 bp, mouse
gagcacctgctgtggaggta

SEQ ID NO: 774457 - DNA, 20 bp, mouse
gaggtgtgaagcagtgtaca

SEQ ID NO: 774458 - DNA, 20 bp, mouse
gctcatcttcttgaacatgt

SEQ ID NO: 774459 - DNA, 20 bp, mouse
gatctggagaggttgctcta

SEQ ID NO: 774460 - DNA, 20 bp, mouse
gagcaggtgctctccacacg

SEQ ID NO: 774461 - DNA, 20 bp, mouse
gacacgaggacacttttaga

SEQ ID NO: 774462 - DNA, 20 bp, mouse
gtgtagatttgaatcaaaga

SEQ ID NO: 774463 - DNA, 20 bp, mouse
gtctcttcttgtatctggag

SEQ ID NO: 774464 - DNA, 20 bp, mouse
gcatggctacttggccatag

SEQ ID NO: 774465 - DNA, 20 bp, mouse
gcttgataatgacaccccta

SEQ ID NO: 774466 - DNA, 20 bp, mouse
gtgtcccaaggagactggga

SEQ ID NO: 774467 - DNA, 20 bp, mouse
gaaggacccaagtcaaagtg

SEQ ID NO: 774468 - DNA, 20 bp, mouse
gagcctgaggctcacatgat

SEQ ID NO: 774469 - DNA, 20 bp, mouse
gtgctgcagccagactacag

SEQ ID NO: 774470 - DNA, 20 bp, mouse
gaaatgtagtatatgagagg

SEQ ID NO: 774471 - DNA, 20 bp, mouse
gaagccagccaagatcggtg

SEQ ID NO: 774472 - DNA, 20 bp, mouse
gggtccttcccagtctcctt

SEQ ID NO: 774473 - DNA, 20 bp, mouse
ggatgttcggagataaaaca

SEQ ID NO: 774474 - DNA, 20 bp, mouse
gctctgtgctcaatgtacac

SEQ ID NO: 774475 - DNA, 20 bp, mouse
gacatgatgggaatctacct

SEQ ID NO: 774476 - DNA, 20 bp, mouse
gaggggaacaagggcttctg

SEQ ID NO: 774477 - DNA, 20 bp, mouse
gcaccaggatcctgtaggtg

SEQ ID NO: 774478 - DNA, 20 bp, mouse
gccactggggccctggtaat

SEQ ID NO: 774479 - DNA, 20 bp, mouse
gctgacttagccaattacca

SEQ ID NO: 774480 - DNA, 20 bp, mouse
gggctaagtcagacctgaga

SEQ ID NO: 774481 - DNA, 20 bp, mouse
gagggaggtacttgtatgca

SEQ ID NO: 774482 - DNA, 20 bp, mouse
gcacactaatccccacctac

SEQ ID NO: 774483 - DNA, 20 bp, mouse
gacccatcatagtgacaaaa

SEQ ID NO: 774484 - DNA, 20 bp, mouse
gcagggccccagtggtcacc

SEQ ID NO: 774485 - DNA, 20 bp, mouse
ggggagtcagtggggttgat

SEQ ID NO: 774486 - DNA, 20 bp, mouse
ggcaagcaatgatttgtgga

SEQ ID NO: 774487 - DNA, 20 bp, mouse
ggctggggcaggtcctaaca

SEQ ID NO: 774488 - DNA, 20 bp, mouse
ggtccctgaaagaccctgtt

SEQ ID NO: 774489 - DNA, 20 bp, mouse
gtgtgactatcacttgaccc

SEQ ID NO: 774490 - DNA, 20 bp, mouse
gggaaggatcttattaaata

SEQ ID NO: 774491 - DNA, 20 bp, mouse
ggactaacaattaaacgacg

SEQ ID NO: 774492 - DNA, 20 bp, mouse
gccaccacgattttaaacaa

SEQ ID NO: 774493 - DNA, 20 bp, mouse
ggttgacttcgttgtctatt

SEQ ID NO: 774494 - DNA, 20 bp, mouse
gttcttttttggatgacaat

SEQ ID NO: 774495 - DNA, 20 bp, mouse
ggttgtaaagtgacatttta

SEQ ID NO: 774496 - DNA, 20 bp, mouse
gtcactgtgtgcattaactg

SEQ ID NO: 774497 - DNA, 20 bp, mouse
gctatgtggatgtcactcat

SEQ ID NO: 774498 - DNA, 20 bp, mouse
ggattcgctgctaagattca

SEQ ID NO: 774499 - DNA, 20 bp, mouse
gaattggagatagttctatg

SEQ ID NO: 774500 - DNA, 20 bp, mouse
gagcagcgaatcataaggtg

SEQ ID NO: 774501 - DNA, 20 bp, mouse
gcagtccaaagtagccagtg

SEQ ID NO: 774502 - DNA, 20 bp, mouse
gagccatctcctctccacac

SEQ ID NO: 774503 - DNA, 20 bp, mouse
ggattcaaggtctagctccc

SEQ ID NO: 774504 - DNA, 20 bp, mouse
gcttccagctctgtaattgg

SEQ ID NO: 774505 - DNA, 20 bp, mouse
ggtgctatcactgggagctt

SEQ ID NO: 774506 - DNA, 20 bp, mouse
gcacaaggggaaaagtaatt

SEQ ID NO: 774507 - DNA, 20 bp, mouse
gtcaccctcctgaacaaagc

SEQ ID NO: 774508 - DNA, 20 bp, mouse
gtggtagttgatgtccacat

SEQ ID NO: 774509 - DNA, 20 bp, mouse
gtaagctatgttctgtatct

SEQ ID NO: 774510 - DNA, 20 bp, mouse
ggagctagaaactcctggaa

SEQ ID NO: 774511 - DNA, 20 bp, mouse
ggagggtgatgcacgtagct

SEQ ID NO: 774512 - DNA, 20 bp, mouse
ggtgatgcacgtagctgggt

SEQ ID NO: 774513 - DNA, 20 bp, mouse
gtccatatctgtatgtaagt

SEQ ID NO: 774514 - DNA, 20 bp, mouse
gaagctcatactgtgttcaa

SEQ ID NO: 774515 - DNA, 20 bp, mouse
gatccacagaagtctagatg

SEQ ID NO: 774516 - DNA, 20 bp, mouse
gcaccaagagacctgttatg

SEQ ID NO: 774517 - DNA, 20 bp, mouse
gtaaatctgagggaaagatg

SEQ ID NO: 774518 - DNA, 20 bp, mouse
gaaccccataacaggtctct

SEQ ID NO: 774519 - DNA, 20 bp, mouse
gcaaccccattcagcatttt

SEQ ID NO: 774520 - DNA, 20 bp, mouse
ggagttgtggacttctagag

SEQ ID NO: 774521 - DNA, 20 bp, mouse
ggtctcttggtgaaaagatg

SEQ ID NO: 774522 - DNA, 20 bp, mouse
ggtggacttctagagtggga

SEQ ID NO: 774523 - DNA, 20 bp, mouse
gagaatagcagaaagcattc

SEQ ID NO: 774524 - DNA, 20 bp, mouse
ggcattctggtcagcaattg

SEQ ID NO: 774525 - DNA, 20 bp, mouse
gtcttcccaaaatgctgaat

SEQ ID NO: 774526 - DNA, 20 bp, mouse
ggggaaaggtcctgcttcaa

SEQ ID NO: 774527 - DNA, 20 bp, mouse
gacaagctacaggagtgcac

SEQ ID NO: 774528 - DNA, 20 bp, mouse
gctacatgagcaacaggcaa

SEQ ID NO: 774529 - DNA, 20 bp, mouse
gatccctgacatgttatgta

SEQ ID NO: 774530 - DNA, 20 bp, mouse
gcatgagcaacaggcaatgg

SEQ ID NO: 774531 - DNA, 20 bp, mouse
ggctactctgtgacctcttc

SEQ ID NO: 774532 - DNA, 20 bp, mouse
gtggtgttatgcaagtgttg

SEQ ID NO: 774533 - DNA, 20 bp, mouse
gtagccctacataacatgtc

SEQ ID NO: 774534 - DNA, 20 bp, mouse
gaagcttgagatccaggttt

SEQ ID NO: 774535 - DNA, 20 bp, mouse
gcatgtagggtagccagaag

SEQ ID NO: 774536 - DNA, 20 bp, mouse
gtgaaagaaggacgttgctt

SEQ ID NO: 774537 - DNA, 20 bp, mouse
ggttgcttaggcccaaggga

SEQ ID NO: 774538 - DNA, 20 bp, mouse
gtgctgactggctaaaaagt

SEQ ID NO: 774539 - DNA, 20 bp, mouse
gaggagagggatgtttttaa

SEQ ID NO: 774540 - DNA, 20 bp, mouse
gcagagaagcaagcactcct

SEQ ID NO: 774541 - DNA, 20 bp, mouse
gggacgttgcttaggcccaa

SEQ ID NO: 774542 - DNA, 20 bp, mouse
gcagagattgactcagaaaa

SEQ ID NO: 774543 - DNA, 20 bp, mouse
ggaaggctctctggaagatt

SEQ ID NO: 774544 - DNA, 20 bp, mouse
gaacagaatgagagagggcc

SEQ ID NO: 774545 - DNA, 20 bp, mouse
gctctggaagattaggcttt

SEQ ID NO: 774546 - DNA, 20 bp, mouse
gtgggatggggtgaaggaca

SEQ ID NO: 774547 - DNA, 20 bp, mouse
gagacgggttagtatcacta

SEQ ID NO: 774548 - DNA, 20 bp, mouse
gatatcatacagaactaaaa

SEQ ID NO: 774549 - DNA, 20 bp, mouse
gatgtctttgctgtgggatg

SEQ ID NO: 774550 - DNA, 20 bp, mouse
gggctgtagaaccatttctg

SEQ ID NO: 774551 - DNA, 20 bp, mouse
gaacttgcaaaaaggtttat

SEQ ID NO: 774552 - DNA, 20 bp, mouse
gaatatacaaagcagaagac

SEQ ID NO: 774553 - DNA, 20 bp, mouse
gaatacagagtctgttggat

SEQ ID NO: 774554 - DNA, 20 bp, mouse
gtataataatgtctttgctg

SEQ ID NO: 774555 - DNA, 20 bp, mouse
gatactagaaacttgcaaaa

SEQ ID NO: 774556 - DNA, 20 bp, mouse
ggattagatatcatgacaat

SEQ ID NO: 774557 - DNA, 20 bp, mouse
gaggtcatctggagtacaga

SEQ ID NO: 774558 - DNA, 20 bp, mouse
ggctgatagtggatcctctg

SEQ ID NO: 774559 - DNA, 20 bp, mouse
gtcagaagcatctctattaa

SEQ ID NO: 774560 - DNA, 20 bp, mouse
gcttgcagataagtaaacta

SEQ ID NO: 774561 - DNA, 20 bp, mouse
gagtgtagtttgagttggga

SEQ ID NO: 774562 - DNA, 20 bp, mouse
gacactgactctgctgatag

SEQ ID NO: 774563 - DNA, 20 bp, mouse
gagcatctctattaaaggtg

SEQ ID NO: 774564 - DNA, 20 bp, mouse
gtttacttatctgcaagttt

SEQ ID NO: 774565 - DNA, 20 bp, mouse
gactacactctaaataaaaa

SEQ ID NO: 774566 - DNA, 20 bp, mouse
gcaggggcatcatctctcac

SEQ ID NO: 774567 - DNA, 20 bp, mouse
gcaaggagatgcataatatt

SEQ ID NO: 774568 - DNA, 20 bp, mouse
gcaaagatgaggatctattc

SEQ ID NO: 774569 - DNA, 20 bp, mouse
gttatgcatctccttgacta

SEQ ID NO: 774570 - DNA, 20 bp, mouse
ggatctattctggagctgtc

SEQ ID NO: 774571 - DNA, 20 bp, mouse
gtttagaaagccaacttgaa

SEQ ID NO: 774572 - DNA, 20 bp, mouse
gattaagtgacctttcaagt

SEQ ID NO: 774573 - DNA, 20 bp, mouse
gtagcacatagctctcaacc

SEQ ID NO: 774574 - DNA, 20 bp, mouse
gtttcattccacctcactat

SEQ ID NO: 774575 - DNA, 20 bp, mouse
gacagaaacaggcatgctca

SEQ ID NO: 774576 - DNA, 20 bp, mouse
ggtaaagactgtgtactgat

SEQ ID NO: 774577 - DNA, 20 bp, mouse
gaagcagactgcttccttag

SEQ ID NO: 774578 - DNA, 20 bp, mouse
gttaattcattcagtatatg

SEQ ID NO: 774579 - DNA, 20 bp, mouse
gatgctgggtattctattgt

SEQ ID NO: 774580 - DNA, 20 bp, mouse
gtctacagaggtgcattgat

SEQ ID NO: 774581 - DNA, 20 bp, mouse
ggcagtctgcttgtcaacac

SEQ ID NO: 774582 - DNA, 20 bp, mouse
gatcttctaatgtcccacta

SEQ ID NO: 774583 - DNA, 20 bp, mouse
gaaaatgtcttgctacattt

SEQ ID NO: 774584 - DNA, 20 bp, mouse
gcaataaataaatcgccctg

SEQ ID NO: 774585 - DNA, 20 bp, mouse
ggagcatggtttcataaccc

SEQ ID NO: 774586 - DNA, 20 bp, mouse
gcataaacacagtgggttaa

SEQ ID NO: 774587 - DNA, 20 bp, mouse
gagtacatacaccaagagaa

SEQ ID NO: 774588 - DNA, 20 bp, mouse
gagttcatcataaacacagt

SEQ ID NO: 774589 - DNA, 20 bp, mouse
ggaatgaagagttccagtat

SEQ ID NO: 774590 - DNA, 20 bp, mouse
gttgtcttttggtgaaggag

SEQ ID NO: 774591 - DNA, 20 bp, mouse
ggaaattatctttccagttt

SEQ ID NO: 774592 - DNA, 20 bp, mouse
gtcccgttgtcttttggtga

SEQ ID NO: 774593 - DNA, 20 bp, mouse
gtctttgctaccttaaattt

SEQ ID NO: 774594 - DNA, 20 bp, mouse
gtgtcttacagctcctaaac

SEQ ID NO: 774595 - DNA, 20 bp, mouse
gttttgatacaccagaaatc

SEQ ID NO: 774596 - DNA, 20 bp, mouse
gaaacactcaacacctgcat

SEQ ID NO: 774597 - DNA, 20 bp, mouse
ggattctaatagtatcccta

SEQ ID NO: 774598 - DNA, 20 bp, mouse
gtgttgaagtattttcatct

SEQ ID NO: 774599 - DNA, 20 bp, mouse
ggtgcataccataagccata

SEQ ID NO: 774600 - DNA, 20 bp, mouse
gcagcaatcgtgagaataaa

SEQ ID NO: 774601 - DNA, 20 bp, mouse
gtcttctaactttgttccac

SEQ ID NO: 774602 - DNA, 20 bp, mouse
gtgaagtattttcatcttgg

SEQ ID NO: 774603 - DNA, 20 bp, mouse
gtaactttgttccacaggct

SEQ ID NO: 774604 - DNA, 20 bp, mouse
gagggcagagagatcactac

SEQ ID NO: 774605 - DNA, 20 bp, mouse
gcatggggagaggtggaaag

SEQ ID NO: 774606 - DNA, 20 bp, mouse
gaaggtctgtgagaacctga

SEQ ID NO: 774607 - DNA, 20 bp, mouse
ggatatgattctattaatct

SEQ ID NO: 774608 - DNA, 20 bp, mouse
gtctgatataatctgggcat

SEQ ID NO: 774609 - DNA, 20 bp, mouse
ggtagctaagagtcatggcc

SEQ ID NO: 774610 - DNA, 20 bp, mouse
gatcacttctgatataatct

SEQ ID NO: 774611 - DNA, 20 bp, mouse
gctcttagctacgtcccatc

SEQ ID NO: 774612 - DNA, 20 bp, mouse
gcaatcggacaccaagcctc

SEQ ID NO: 774613 - DNA, 20 bp, mouse
gaggtcaaaagccagaggct

SEQ ID NO: 774614 - DNA, 20 bp, mouse
gcttggtgtccgattgtctc

SEQ ID NO: 774615 - DNA, 20 bp, mouse
gagaactaatatttctggcc

SEQ ID NO: 774616 - DNA, 20 bp, mouse
gaatgtgtccggatggagat

SEQ ID NO: 774617 - DNA, 20 bp, mouse
gaattataggagactggtgg

SEQ ID NO: 774618 - DNA, 20 bp, mouse
gggcaaagatccattttcaa

SEQ ID NO: 774619 - DNA, 20 bp, mouse
gcagaattataggagactgg

SEQ ID NO: 774620 - DNA, 20 bp, mouse
gaggagggacattgggtaga

SEQ ID NO: 774621 - DNA, 20 bp, mouse
ggtgaagttagagtgagaaa

SEQ ID NO: 774622 - DNA, 20 bp, mouse
gggagtacacactgtttctg

SEQ ID NO: 774623 - DNA, 20 bp, mouse
gaaccagaattataggagac

SEQ ID NO: 774624 - DNA, 20 bp, mouse
gaggtggagactgaaggggc

SEQ ID NO: 774625 - DNA, 20 bp, mouse
gaaggatgagcccaggctgt

SEQ ID NO: 774626 - DNA, 20 bp, mouse
gtaaagaagaagcataggac

SEQ ID NO: 774627 - DNA, 20 bp, mouse
gtagatctagggataagcta

SEQ ID NO: 774628 - DNA, 20 bp, mouse
gatgtctaaagaagaagcat

SEQ ID NO: 774629 - DNA, 20 bp, mouse
ggagactaaaattgtcagtc

SEQ ID NO: 774630 - DNA, 20 bp, mouse
gtagtcttcacaattgaacc

SEQ ID NO: 774631 - DNA, 20 bp, mouse
gcttccaccaaattagatct

SEQ ID NO: 774632 - DNA, 20 bp, mouse
gtatctgtcatgatcatggt

SEQ ID NO: 774633 - DNA, 20 bp, mouse
gtgaagttatccaaagacat

SEQ ID NO: 774634 - DNA, 20 bp, mouse
gcttatccctagatctaatt

SEQ ID NO: 774635 - DNA, 20 bp, mouse
gatccctagatctaatttgg

SEQ ID NO: 774636 - DNA, 20 bp, mouse
gccccttccccaaacagtta

SEQ ID NO: 774637 - DNA, 20 bp, mouse
gtaccttaactgtttgggga

SEQ ID NO: 774638 - DNA, 20 bp, mouse
ggttaaggtatcatgagtgc

SEQ ID NO: 774639 - DNA, 20 bp, mouse
ggtttggggaaggggggttg

SEQ ID NO: 774640 - DNA, 20 bp, mouse
gcatgataccttaactgttt

SEQ ID NO: 774641 - DNA, 20 bp, mouse
gctaggaagcagagaagcag

SEQ ID NO: 774642 - DNA, 20 bp, mouse
ggacctagaacctgtagacc

SEQ ID NO: 774643 - DNA, 20 bp, mouse
ggcttgagcttggagaaaga

SEQ ID NO: 774644 - DNA, 20 bp, mouse
gttaggatgtgcatgtgaca

SEQ ID NO: 774645 - DNA, 20 bp, mouse
ggattcctcacagtcaatac

SEQ ID NO: 774646 - DNA, 20 bp, mouse
gccccttccccaaacagtta

SEQ ID NO: 774647 - DNA, 20 bp, mouse
gtaccttaactgtttgggga

SEQ ID NO: 774648 - DNA, 20 bp, mouse
ggttaaggtatcatgagtgc

SEQ ID NO: 774649 - DNA, 20 bp, mouse
ggtttggggaaggggggttg

SEQ ID NO: 774650 - DNA, 20 bp, mouse
gcatgataccttaactgttt

SEQ ID NO: 774651 - DNA, 20 bp, mouse
gctaggaagcagagaagcag

SEQ ID NO: 774652 - DNA, 20 bp, mouse
ggacctagaacctgtagacc

SEQ ID NO: 774653 - DNA, 20 bp, mouse
ggcttgagcttggagaaaga

SEQ ID NO: 774654 - DNA, 20 bp, mouse
gttaggatgtgcatgtgaca

SEQ ID NO: 774655 - DNA, 20 bp, mouse
ggattcctcacagtcaatac

SEQ ID NO: 774656 - DNA, 20 bp, mouse
gtaatgcaatatagatctga

SEQ ID NO: 774657 - DNA, 20 bp, mouse
ggaagatgaaagacaagaac

SEQ ID NO: 774658 - DNA, 20 bp, mouse
gaatatagatctgaaggctt

SEQ ID NO: 774659 - DNA, 20 bp, mouse
ggctacatatcttgcatttt

SEQ ID NO: 774660 - DNA, 20 bp, mouse
gacaaagaacaaaaactata

SEQ ID NO: 774661 - DNA, 20 bp, mouse
gctgttgagtttaggtcagc

SEQ ID NO: 774662 - DNA, 20 bp, mouse
gtgaacatgtaccatgattg

SEQ ID NO: 774663 - DNA, 20 bp, mouse
gtttggtaatgagagctgtg

SEQ ID NO: 774664 - DNA, 20 bp, mouse
gatctatattgcattatgca

SEQ ID NO: 774665 - DNA, 20 bp, mouse
ggtgtgttcttatattaaaa

SEQ ID NO: 774666 - DNA, 20 bp, mouse
gaagactgcaatatcaaaaa

SEQ ID NO: 774667 - DNA, 20 bp, mouse
gtatctggtaatttagtaaa

SEQ ID NO: 774668 - DNA, 20 bp, mouse
ggaccctgcaaagacaagtt

SEQ ID NO: 774669 - DNA, 20 bp, mouse
gatgaccaccaatagatgac

SEQ ID NO: 774670 - DNA, 20 bp, mouse
gttcctcataccagtcttgt

SEQ ID NO: 774671 - DNA, 20 bp, mouse
gcataccagtcttgttggat

SEQ ID NO: 774672 - DNA, 20 bp, mouse
gaacatcaacattaagctag

SEQ ID NO: 774673 - DNA, 20 bp, mouse
gctggtatgaggaatacact

SEQ ID NO: 774674 - DNA, 20 bp, mouse
gtgttcctatccaacaagac

SEQ ID NO: 774675 - DNA, 20 bp, mouse
gtataattcttatcatgctc

SEQ ID NO: 774676 - DNA, 20 bp, mouse
gctaagaatgcaaaaaaaat

SEQ ID NO: 774677 - DNA, 20 bp, mouse
ggtgaacagccaaggagagt

SEQ ID NO: 774678 - DNA, 20 bp, mouse
gtctagagagtcacacctga

SEQ ID NO: 774679 - DNA, 20 bp, mouse
gtctctagacatagctttct

SEQ ID NO: 774680 - DNA, 20 bp, mouse
gttaaagatgtccaggcatt

SEQ ID NO: 774681 - DNA, 20 bp, mouse
gcagaacaggtgaacagcca

SEQ ID NO: 774682 - DNA, 20 bp, mouse
gactatttattcacataatc

SEQ ID NO: 774683 - DNA, 20 bp, mouse
gcttttaaatcccacagaac

SEQ ID NO: 774684 - DNA, 20 bp, mouse
gagcctacttaaagatgtcc

SEQ ID NO: 774685 - DNA, 20 bp, mouse
gaaggtccattccaaatgcc

SEQ ID NO: 774686 - DNA, 20 bp, mouse
ggagatctgatgctcttatc

SEQ ID NO: 774687 - DNA, 20 bp, mouse
ggtgcccactagacagacct

SEQ ID NO: 774688 - DNA, 20 bp, mouse
gctatgtcaacgtgtctctg

SEQ ID NO: 774689 - DNA, 20 bp, mouse
gagaaaaattattcctgggc

SEQ ID NO: 774690 - DNA, 20 bp, mouse
ggttgggaagttatatagat

SEQ ID NO: 774691 - DNA, 20 bp, mouse
gatattatttaggtatttgt

SEQ ID NO: 774692 - DNA, 20 bp, mouse
gttttaaaaatactggaaat

SEQ ID NO: 774693 - DNA, 20 bp, mouse
gagtctgcctatgtgaacac

SEQ ID NO: 774694 - DNA, 20 bp, mouse
gcaacaagaaaaattattcc

SEQ ID NO: 774695 - DNA, 20 bp, mouse
gtttcccaggtctgtctagt

SEQ ID NO: 774696 - DNA, 20 bp, mouse
ggggctgactgtagcattat

SEQ ID NO: 774697 - DNA, 20 bp, mouse
gcatatgctcaaaacctctt

SEQ ID NO: 774698 - DNA, 20 bp, mouse
gacctcacccctctgatgga

SEQ ID NO: 774699 - DNA, 20 bp, mouse
gttcacatgttgatcctaag

SEQ ID NO: 774700 - DNA, 20 bp, mouse
gctcacaaccagtatctttc

SEQ ID NO: 774701 - DNA, 20 bp, mouse
gcatcacttcatgagcaaaa

SEQ ID NO: 774702 - DNA, 20 bp, mouse
gaacgatgggtccatctagg

SEQ ID NO: 774703 - DNA, 20 bp, mouse
gggaaggcaatactacttaa

SEQ ID NO: 774704 - DNA, 20 bp, mouse
gtagtattgccttccatcag

SEQ ID NO: 774705 - DNA, 20 bp, mouse
gtatgacctcacccctctga

SEQ ID NO: 774706 - DNA, 20 bp, mouse
gtggagccatttgcagttgg

SEQ ID NO: 774707 - DNA, 20 bp, mouse
ggagagtcagtaattttcag

SEQ ID NO: 774708 - DNA, 20 bp, mouse
gatccactgaggctggaaca

SEQ ID NO: 774709 - DNA, 20 bp, mouse
gtctcctcatgcaggcatgt

SEQ ID NO: 774710 - DNA, 20 bp, mouse
gaaggctttgtctctagatg

SEQ ID NO: 774711 - DNA, 20 bp, mouse
gaaggaatgctgtaaaatag

SEQ ID NO: 774712 - DNA, 20 bp, mouse
ggtacacacctctaggctca

SEQ ID NO: 774713 - DNA, 20 bp, mouse
ggagccaacatgcctgcatg

SEQ ID NO: 774714 - DNA, 20 bp, mouse
gtcagtaattttcaggggtg

SEQ ID NO: 774715 - DNA, 20 bp, mouse
gggtaacacttaaaggatac

SEQ ID NO: 774716 - DNA, 20 bp, mouse
gcagctgacaagagaacctc

SEQ ID NO: 774717 - DNA, 20 bp, mouse
gtatgcatgcaaagatacat

SEQ ID NO: 774718 - DNA, 20 bp, mouse
gtataagtaactgtaaagct

SEQ ID NO: 774719 - DNA, 20 bp, mouse
gagaaaagaaaagattcccg

SEQ ID NO: 774720 - DNA, 20 bp, mouse
ggtaaggtgaaagagataat

SEQ ID NO: 774721 - DNA, 20 bp, mouse
ggcaaagatacatgggaacc

SEQ ID NO: 774722 - DNA, 20 bp, mouse
gtgcatctcatgttgacttc

SEQ ID NO: 774723 - DNA, 20 bp, mouse
gctatataaaaagaatagaa

SEQ ID NO: 774724 - DNA, 20 bp, mouse
gttttttgttgtattaatgg

SEQ ID NO: 774725 - DNA, 20 bp, mouse
gtaaaatttctcactgtatc

SEQ ID NO: 774726 - DNA, 20 bp, mouse
gacagacaggaggggtgtga

SEQ ID NO: 774727 - DNA, 20 bp, mouse
gaagcaagctacagacagga

SEQ ID NO: 774728 - DNA, 20 bp, mouse
ggagaccaaaacagggctaa

SEQ ID NO: 774729 - DNA, 20 bp, mouse
ggtgcctaaaggggagaggc

SEQ ID NO: 774730 - DNA, 20 bp, mouse
gaatgagtctgtgcctaaag

SEQ ID NO: 774731 - DNA, 20 bp, mouse
gaaaggggagaggcaggttg

SEQ ID NO: 774732 - DNA, 20 bp, mouse
gtattcctttagccctgttt

SEQ ID NO: 774733 - DNA, 20 bp, mouse
ggttaaggagcacagaagac

SEQ ID NO: 774734 - DNA, 20 bp, mouse
gagaccaaatgtgattgtta

SEQ ID NO: 774735 - DNA, 20 bp, mouse
ggttagcatagatcttctcc

SEQ ID NO: 774736 - DNA, 20 bp, mouse
gtgggtgtgccgtttccccc

SEQ ID NO: 774737 - DNA, 20 bp, mouse
ggcttcactcccagagaggt

SEQ ID NO: 774738 - DNA, 20 bp, mouse
ggcgtcctttaagctaactg

SEQ ID NO: 774739 - DNA, 20 bp, mouse
gtcacatggaggttgtacaa

SEQ ID NO: 774740 - DNA, 20 bp, mouse
gtgtcttcctggaaagacaa

SEQ ID NO: 774741 - DNA, 20 bp, mouse
gaagtgattaatagtccagg

SEQ ID NO: 774742 - DNA, 20 bp, mouse
gtgttacaatccgacctctc

SEQ ID NO: 774743 - DNA, 20 bp, mouse
gactgtggctgatgtgtatc

SEQ ID NO: 774744 - DNA, 20 bp, mouse
gaatggcttcactcccagag

SEQ ID NO: 774745 - DNA, 20 bp, mouse
gctgctgaataaccaacaat

SEQ ID NO: 774746 - DNA, 20 bp, mouse
ggaactgctagaaaaagata

SEQ ID NO: 774747 - DNA, 20 bp, mouse
gtgcaaaaataaaacaacag

SEQ ID NO: 774748 - DNA, 20 bp, mouse
gtagcagttcatacgtggtg

SEQ ID NO: 774749 - DNA, 20 bp, mouse
gttttctagcagttcatacg

SEQ ID NO: 774750 - DNA, 20 bp, mouse
gaaaattgtcaaaagaattg

SEQ ID NO: 774751 - DNA, 20 bp, mouse
gtatctctaatatgtaaaca

SEQ ID NO: 774752 - DNA, 20 bp, mouse
gtatgtaaacatggattgtt

SEQ ID NO: 774753 - DNA, 20 bp, mouse
gattcttttgacaattttca

SEQ ID NO: 774754 - DNA, 20 bp, mouse
ggaaaagaaacagtcgggca

SEQ ID NO: 774755 - DNA, 20 bp, mouse
gttaaaagaaaagaaacagt

SEQ ID NO: 774756 - DNA, 20 bp, mouse
gggccaggcactagcaaaaa

SEQ ID NO: 774757 - DNA, 20 bp, mouse
ggaggcaagaaagcagggcc

SEQ ID NO: 774758 - DNA, 20 bp, mouse
ggagtagaggcaagaaagca

SEQ ID NO: 774759 - DNA, 20 bp, mouse
gtcaacctctataatacaaa

SEQ ID NO: 774760 - DNA, 20 bp, mouse
gctatatctaatgagagtag

SEQ ID NO: 774761 - DNA, 20 bp, mouse
ggctcggttgatggcaacca

SEQ ID NO: 774762 - DNA, 20 bp, mouse
gacaccatggtggaaggtca

SEQ ID NO: 774763 - DNA, 20 bp, mouse
gtaatccctttgtattatag

SEQ ID NO: 774764 - DNA, 20 bp, mouse
gactgtagaatttatgtcag

SEQ ID NO: 774765 - DNA, 20 bp, mouse
gaaccatttttgctagtgcc

SEQ ID NO: 774766 - DNA, 20 bp, mouse
gaagtaaactatgagatggt

SEQ ID NO: 774767 - DNA, 20 bp, mouse
gagttattctctctggagac

SEQ ID NO: 774768 - DNA, 20 bp, mouse
gctccggcatatgtggtaaa

SEQ ID NO: 774769 - DNA, 20 bp, mouse
gatctgcaagttattctctc

SEQ ID NO: 774770 - DNA, 20 bp, mouse
gtctgtctctccggcatatg

SEQ ID NO: 774771 - DNA, 20 bp, mouse
ggattaagaaagataaatag

SEQ ID NO: 774772 - DNA, 20 bp, mouse
gactcattttcttctacttg

SEQ ID NO: 774773 - DNA, 20 bp, mouse
gttttaagtaaactatgaga

SEQ ID NO: 774774 - DNA, 20 bp, mouse
gttccttttaccacatatgc

SEQ ID NO: 774775 - DNA, 20 bp, mouse
gacttgtgggagagagaggg

SEQ ID NO: 774776 - DNA, 20 bp, mouse
gaaaggacttagagtatctt

SEQ ID NO: 774777 - DNA, 20 bp, mouse
ggaattgccttttgccattt

SEQ ID NO: 774778 - DNA, 20 bp, mouse
gaagttgcttaaggttgtgt

SEQ ID NO: 774779 - DNA, 20 bp, mouse
gcagttaacatcttccaaaa

SEQ ID NO: 774780 - DNA, 20 bp, mouse
gaaagtagtgcaaagacttt

SEQ ID NO: 774781 - DNA, 20 bp, mouse
gcatcttccaaaatggcaaa

SEQ ID NO: 774782 - DNA, 20 bp, mouse
gaaaaagcaatcattctttt

SEQ ID NO: 774783 - DNA, 20 bp, mouse
ggagatcactaaaaataatt

SEQ ID NO: 774784 - DNA, 20 bp, mouse
gttaatggcttaatcttaag

SEQ ID NO: 774785 - DNA, 20 bp, mouse
gacatttcaaattttattga

SEQ ID NO: 774786 - DNA, 20 bp, mouse
gtcagagactatacaggctt

SEQ ID NO: 774787 - DNA, 20 bp, mouse
ggaagtcagagcagattgaa

SEQ ID NO: 774788 - DNA, 20 bp, mouse
gatttcagcactggataggt

SEQ ID NO: 774789 - DNA, 20 bp, mouse
gagcaaggacacaatagcat

SEQ ID NO: 774790 - DNA, 20 bp, mouse
gtataatttcagcactggat

SEQ ID NO: 774791 - DNA, 20 bp, mouse
gcagagcagattgaaagggg

SEQ ID NO: 774792 - DNA, 20 bp, mouse
gtccttgctactcattgaaa

SEQ ID NO: 774793 - DNA, 20 bp, mouse
ggggcccccctcttaatcca

SEQ ID NO: 774794 - DNA, 20 bp, mouse
gaggacaacttcatcaataa

SEQ ID NO: 774795 - DNA, 20 bp, mouse
gctgtgtgacttctaagaga

SEQ ID NO: 774796 - DNA, 20 bp, mouse
gacagggtgaattatcatga

SEQ ID NO: 774797 - DNA, 20 bp, mouse
gagaccaactctagaggaca

SEQ ID NO: 774798 - DNA, 20 bp, mouse
gcattcaggactaaggagtc

SEQ ID NO: 774799 - DNA, 20 bp, mouse
gtagaggacatggtgccata

SEQ ID NO: 774800 - DNA, 20 bp, mouse
gttagagagaccaactctag

SEQ ID NO: 774801 - DNA, 20 bp, mouse
gactgaagaaatatctacta

SEQ ID NO: 774802 - DNA, 20 bp, mouse
gaaaagataaacagaccaca

SEQ ID NO: 774803 - DNA, 20 bp, mouse
ggacaagttaatgtatttga

SEQ ID NO: 774804 - DNA, 20 bp, mouse
ggttctatcactcacttaca

SEQ ID NO: 774805 - DNA, 20 bp, mouse
gaatcttatacatcaccttg

SEQ ID NO: 774806 - DNA, 20 bp, mouse
ggattctccctgaggtagga

SEQ ID NO: 774807 - DNA, 20 bp, mouse
gttttatctgatatttcata

SEQ ID NO: 774808 - DNA, 20 bp, mouse
gttaagattctccctgaggt

SEQ ID NO: 774809 - DNA, 20 bp, mouse
gtataacccttcctacctca

SEQ ID NO: 774810 - DNA, 20 bp, mouse
gtaagctattcaagtctcta

SEQ ID NO: 774811 - DNA, 20 bp, mouse
gacagttaagattctccctg

SEQ ID NO: 774812 - DNA, 20 bp, mouse
gagggaaaagtgaatattct

SEQ ID NO: 774813 - DNA, 20 bp, mouse
gaacacagagtatgtattta

SEQ ID NO: 774814 - DNA, 20 bp, mouse
gtagcttaatgcatgattat

SEQ ID NO: 774815 - DNA, 20 bp, mouse
gatactcatgtagatgagaa

SEQ ID NO: 774816 - DNA, 20 bp, mouse
gtaaaatattagaacatatt

SEQ ID NO: 774817 - DNA, 20 bp, mouse
gctgaggatcataacagcca

SEQ ID NO: 774818 - DNA, 20 bp, mouse
gggaaggaagaatgtaatac

SEQ ID NO: 774819 - DNA, 20 bp, mouse
gttagaacatattaggattg

SEQ ID NO: 774820 - DNA, 20 bp, mouse
gactctggctcatgatagga

SEQ ID NO: 774821 - DNA, 20 bp, mouse
gagaaagcataaattggtca

SEQ ID NO: 774822 - DNA, 20 bp, mouse
gtcccccagaaagcataaat

SEQ ID NO: 774823 - DNA, 20 bp, mouse
gaccaatttatgctttctgg

SEQ ID NO: 774824 - DNA, 20 bp, mouse
gttctctttgacaaattact

SEQ ID NO: 774825 - DNA, 20 bp, mouse
gaaaataaatttctatggtc

SEQ ID NO: 774826 - DNA, 20 bp, mouse
gagattggagtctctcacac

SEQ ID NO: 774827 - DNA, 20 bp, mouse
ggaagagagttggcatttaa

SEQ ID NO: 774828 - DNA, 20 bp, mouse
ggtgaatagctgaagagagt

SEQ ID NO: 774829 - DNA, 20 bp, mouse
gcagctattcacccataatg

SEQ ID NO: 774830 - DNA, 20 bp, mouse
gttttctgtgtttctaagat

SEQ ID NO: 774831 - DNA, 20 bp, mouse
gcttaaagactttgtttctc

SEQ ID NO: 774832 - DNA, 20 bp, mouse
gatagacatttaagtttcac

SEQ ID NO: 774833 - DNA, 20 bp, mouse
ggtctttaagaaggtttttc

SEQ ID NO: 774834 - DNA, 20 bp, mouse
gatttatgtgattagtttct

SEQ ID NO: 774835 - DNA, 20 bp, mouse
gtaaatagtgatttctaaaa

SEQ ID NO: 774836 - DNA, 20 bp, mouse
gtaaaatattagaacatgtc

SEQ ID NO: 774837 - DNA, 20 bp, mouse
gttagaacatgtcaggattg

SEQ ID NO: 774838 - DNA, 20 bp, mouse
gctgaggattataacatcca

SEQ ID NO: 774839 - DNA, 20 bp, mouse
gaacaccttatgctttgtga

SEQ ID NO: 774840 - DNA, 20 bp, mouse
gagcaactgtagttcatgat

SEQ ID NO: 774841 - DNA, 20 bp, mouse
gactgtagttcatgatagga

SEQ ID NO: 774842 - DNA, 20 bp, mouse
gggccctgatttaagaagag

SEQ ID NO: 774843 - DNA, 20 bp, mouse
gctcaacagattctacctct

SEQ ID NO: 774844 - DNA, 20 bp, mouse
gctaggaaaatattttcttt

SEQ ID NO: 774845 - DNA, 20 bp, mouse
gggatccctcacaaagcata

SEQ ID NO: 774846 - DNA, 20 bp, mouse
gattatagtctcttagttta

SEQ ID NO: 774847 - DNA, 20 bp, mouse
ggcttctagaattctatgtg

SEQ ID NO: 774848 - DNA, 20 bp, mouse
gctgagtctcccacattgaa

SEQ ID NO: 774849 - DNA, 20 bp, mouse
gctcctgctcactttaagcc

SEQ ID NO: 774850 - DNA, 20 bp, mouse
gaaagactgtttctctggat

SEQ ID NO: 774851 - DNA, 20 bp, mouse
gaataaaaacctttcaatgt

SEQ ID NO: 774852 - DNA, 20 bp, mouse
gaagagagttgcttattgaa

SEQ ID NO: 774853 - DNA, 20 bp, mouse
ggcttattgaaaggaaaata

SEQ ID NO: 774854 - DNA, 20 bp, mouse
gttgctattcacccataatt

SEQ ID NO: 774855 - DNA, 20 bp, mouse
gagcatattgtagaaattta

SEQ ID NO: 774856 - DNA, 20 bp, mouse
gtagaaatgcacctaacatg

SEQ ID NO: 774857 - DNA, 20 bp, mouse
gtcaactgagacctgcctat

SEQ ID NO: 774858 - DNA, 20 bp, mouse
gcttaatgattactactcat

SEQ ID NO: 774859 - DNA, 20 bp, mouse
gatatgttttaccccatgtt

SEQ ID NO: 774860 - DNA, 20 bp, mouse
gttaagatttagatattaat

SEQ ID NO: 774861 - DNA, 20 bp, mouse
ggaacaatttctatctctct

SEQ ID NO: 774862 - DNA, 20 bp, mouse
gtggagactatgctaatcca

SEQ ID NO: 774863 - DNA, 20 bp, mouse
gttaaaagtgatcatccaat

SEQ ID NO: 774864 - DNA, 20 bp, mouse
gactagcaaataataacaac

SEQ ID NO: 774865 - DNA, 20 bp, mouse
ggtgcagaatatccatttta

SEQ ID NO: 774866 - DNA, 20 bp, mouse
gccacaaggaaaaatcttgg

SEQ ID NO: 774867 - DNA, 20 bp, mouse
gtagcctacacatgttcttc

SEQ ID NO: 774868 - DNA, 20 bp, mouse
gatccctaattattggttat

SEQ ID NO: 774869 - DNA, 20 bp, mouse
gaagtgcactgcataccaca

SEQ ID NO: 774870 - DNA, 20 bp, mouse
ggccctataaccaataatta

SEQ ID NO: 774871 - DNA, 20 bp, mouse
gagcccctgaatatagtact

SEQ ID NO: 774872 - DNA, 20 bp, mouse
gaagacctgttactatttaa

SEQ ID NO: 774873 - DNA, 20 bp, mouse
gttcccagtactatattcag

SEQ ID NO: 774874 - DNA, 20 bp, mouse
gcttccagaagaacatgtgt

SEQ ID NO: 774875 - DNA, 20 bp, mouse
gcatttaactggtagctctc

SEQ ID NO: 774876 - DNA, 20 bp, mouse
gctttctctagttcagtcta

SEQ ID NO: 774877 - DNA, 20 bp, mouse
ggggttgtatataatatcat

SEQ ID NO: 774878 - DNA, 20 bp, mouse
ggagggaatatgtgagacct

SEQ ID NO: 774879 - DNA, 20 bp, mouse
ggtaaggctcaaagattgga

SEQ ID NO: 774880 - DNA, 20 bp, mouse
gaagagatacaatcacacat

SEQ ID NO: 774881 - DNA, 20 bp, mouse
gtcttagaggtaagagagta

SEQ ID NO: 774882 - DNA, 20 bp, mouse
gtgaacatcttcaaagacca

SEQ ID NO: 774883 - DNA, 20 bp, mouse
gtagcttagtgcgctcttag

SEQ ID NO: 774884 - DNA, 20 bp, mouse
ggaaacattttaacagaagt

SEQ ID NO: 774885 - DNA, 20 bp, mouse
ggttggttatttatattgaa

SEQ ID NO: 774886 - DNA, 20 bp, mouse
ggaggaggaagtcaatacac

SEQ ID NO: 774887 - DNA, 20 bp, mouse
gaaaacctaaatctgagttt

SEQ ID NO: 774888 - DNA, 20 bp, mouse
gatcacctaaactcagattt

SEQ ID NO: 774889 - DNA, 20 bp, mouse
gtaaaaccataaattctgca

SEQ ID NO: 774890 - DNA, 20 bp, mouse
gattaaggttcttcattgca

SEQ ID NO: 774891 - DNA, 20 bp, mouse
ggagatatgtgagagctaaa

SEQ ID NO: 774892 - DNA, 20 bp, mouse
gattaaatgtatctcaataa

SEQ ID NO: 774893 - DNA, 20 bp, mouse
gatgtcaacatatagataat

SEQ ID NO: 774894 - DNA, 20 bp, mouse
gatatagataataggcatta

SEQ ID NO: 774895 - DNA, 20 bp, mouse
gatatatttacaagaattcc

SEQ ID NO: 774896 - DNA, 20 bp, mouse
gttgcctgttatcccattct

SEQ ID NO: 774897 - DNA, 20 bp, mouse
gagaacacaaaatgatgatg

SEQ ID NO: 774898 - DNA, 20 bp, mouse
gcaaaatgatgatgaggcag

SEQ ID NO: 774899 - DNA, 20 bp, mouse
gctgtggtacctatgcccag

SEQ ID NO: 774900 - DNA, 20 bp, mouse
gctgttgtaggattcagtat

SEQ ID NO: 774901 - DNA, 20 bp, mouse
ggtggtcagaattattcaaa

SEQ ID NO: 774902 - DNA, 20 bp, mouse
gtgtaacaggctgtgtttta

SEQ ID NO: 774903 - DNA, 20 bp, mouse
gtaggattcagtataggaaa

SEQ ID NO: 774904 - DNA, 20 bp, mouse
gatctgccttgaatttgctg

SEQ ID NO: 774905 - DNA, 20 bp, mouse
gatacagaatgttttcattc

SEQ ID NO: 774906 - DNA, 20 bp, mouse
gctgagtggtgacttttcaa

SEQ ID NO: 774907 - DNA, 20 bp, mouse
gggaggcctttcattctaat

SEQ ID NO: 774908 - DNA, 20 bp, mouse
ggaaaactaaagaatgtgta

SEQ ID NO: 774909 - DNA, 20 bp, mouse
gggagcaaacagtttcagta

SEQ ID NO: 774910 - DNA, 20 bp, mouse
gtgcatcccattagaatgaa

SEQ ID NO: 774911 - DNA, 20 bp, mouse
gtgtaaggcctatggtataa

SEQ ID NO: 774912 - DNA, 20 bp, mouse
gtatctgttatgagttctgg

SEQ ID NO: 774913 - DNA, 20 bp, mouse
gataacttatccagcataaa

SEQ ID NO: 774914 - DNA, 20 bp, mouse
gagttatctgttatgagttc

SEQ ID NO: 774915 - DNA, 20 bp, mouse
gcagggaataccttttatgc

SEQ ID NO: 774916 - DNA, 20 bp, mouse
gggctttggtattgatgttg

SEQ ID NO: 774917 - DNA, 20 bp, mouse
gtattaatttgcatcggctt

SEQ ID NO: 774918 - DNA, 20 bp, mouse
gtgatgacagaatatataat

SEQ ID NO: 774919 - DNA, 20 bp, mouse
ggtatcaactaacccaattg

SEQ ID NO: 774920 - DNA, 20 bp, mouse
gtgtttggtgacttcaacag

SEQ ID NO: 774921 - DNA, 20 bp, mouse
gggtacatactacctcaatt

SEQ ID NO: 774922 - DNA, 20 bp, mouse
gagaatatttcttgtcaaag

SEQ ID NO: 774923 - DNA, 20 bp, mouse
gcaatttttatcttgattca

SEQ ID NO: 774924 - DNA, 20 bp, mouse
gaatgattttttaatggttg

SEQ ID NO: 774925 - DNA, 20 bp, mouse
gggtattgatgttgaggtaa

SEQ ID NO: 774926 - DNA, 20 bp, mouse
gtaattttaaagagttatta

SEQ ID NO: 774927 - DNA, 20 bp, mouse
gataactctttaaaattacg

SEQ ID NO: 774928 - DNA, 20 bp, mouse
gttaattttgatgtgtttgt

SEQ ID NO: 774929 - DNA, 20 bp, mouse
gagaaaaggagaacttacag

SEQ ID NO: 774930 - DNA, 20 bp, mouse
gtttcttttgtatagtattt

SEQ ID NO: 774931 - DNA, 20 bp, mouse
gtctgacagcagtaaggtta

SEQ ID NO: 774932 - DNA, 20 bp, mouse
gcatataatgctaaatggaa

SEQ ID NO: 774933 - DNA, 20 bp, mouse
ggtacacaaaatgctataca

SEQ ID NO: 774934 - DNA, 20 bp, mouse
gtacttgatatgccatacca

SEQ ID NO: 774935 - DNA, 20 bp, mouse
gaaagttgtagatgaatccc

SEQ ID NO: 774936 - DNA, 20 bp, mouse
gggatcctggatcaaataaa

SEQ ID NO: 774937 - DNA, 20 bp, mouse
gatctttgctaaaaaaagca

SEQ ID NO: 774938 - DNA, 20 bp, mouse
gtcctggatcaaataaaagg

SEQ ID NO: 774939 - DNA, 20 bp, mouse
gggattggtttcttggacaa

SEQ ID NO: 774940 - DNA, 20 bp, mouse
gcagaataatactgtgataa

SEQ ID NO: 774941 - DNA, 20 bp, mouse
gcactctcatctgttctcag

SEQ ID NO: 774942 - DNA, 20 bp, mouse
gacctccttttatttgatcc

SEQ ID NO: 774943 - DNA, 20 bp, mouse
ggcagggttgaatgctactc

SEQ ID NO: 774944 - DNA, 20 bp, mouse
gttctgtaaagccataaaag

SEQ ID NO: 774945 - DNA, 20 bp, mouse
gcagtttcctgaataaggat

SEQ ID NO: 774946 - DNA, 20 bp, mouse
gtgctgtcatctgttctcaa

SEQ ID NO: 774947 - DNA, 20 bp, mouse
gggtcatgaaaggtctatga

SEQ ID NO: 774948 - DNA, 20 bp, mouse
gcagtagctctttgtttagt

SEQ ID NO: 774949 - DNA, 20 bp, mouse
gaggtctatgatggttgtca

SEQ ID NO: 774950 - DNA, 20 bp, mouse
gctgttctcaagggaaactt

SEQ ID NO: 774951 - DNA, 20 bp, mouse
gtctcaagggaaactttgga

SEQ ID NO: 774952 - DNA, 20 bp, mouse
gcacaataaccacaaacaga

SEQ ID NO: 774953 - DNA, 20 bp, mouse
gttcagtggtatttgtgacc

SEQ ID NO: 774954 - DNA, 20 bp, mouse
gggtatttgtgacctggctg

SEQ ID NO: 774955 - DNA, 20 bp, mouse
gccagtctttgttctccata

SEQ ID NO: 774956 - DNA, 20 bp, mouse
gtcctcctctggctataaga

SEQ ID NO: 774957 - DNA, 20 bp, mouse
gaagtttaacataatctgga

SEQ ID NO: 774958 - DNA, 20 bp, mouse
gctttctttgagaccagctg

SEQ ID NO: 774959 - DNA, 20 bp, mouse
gtttcaggagccaccccagc

SEQ ID NO: 774960 - DNA, 20 bp, mouse
ggaaaggatagtcttaaccc

SEQ ID NO: 774961 - DNA, 20 bp, mouse
gtgaatgaagtacgaccaca

SEQ ID NO: 774962 - DNA, 20 bp, mouse
ggaggctatataatattcca

SEQ ID NO: 774963 - DNA, 20 bp, mouse
gtcatccatcttatagccag

SEQ ID NO: 774964 - DNA, 20 bp, mouse
gagtgaagtttaacataatc

SEQ ID NO: 774965 - DNA, 20 bp, mouse
gtcgaagatttaaagccatg

SEQ ID NO: 774966 - DNA, 20 bp, mouse
gagtctacagatgatagttg

SEQ ID NO: 774967 - DNA, 20 bp, mouse
ggagagtaccatggaacatt

SEQ ID NO: 774968 - DNA, 20 bp, mouse
ggtttcccacatcagtctca

SEQ ID NO: 774969 - DNA, 20 bp, mouse
gtttaccatgagactgatgt

SEQ ID NO: 774970 - DNA, 20 bp, mouse
ggtgacaggggaaagttcct

SEQ ID NO: 774971 - DNA, 20 bp, mouse
gaagatccatgagagtacca

SEQ ID NO: 774972 - DNA, 20 bp, mouse
gcacacccacatccccaatc

SEQ ID NO: 774973 - DNA, 20 bp, mouse
gcaggggaaagttcctagga

SEQ ID NO: 774974 - DNA, 20 bp, mouse
ggaacttgcctcattccaga

SEQ ID NO: 774975 - DNA, 20 bp, mouse
gatgttgaaacaacattata

SEQ ID NO: 774976 - DNA, 20 bp, mouse
gtggagaatacctgctgggg

SEQ ID NO: 774977 - DNA, 20 bp, mouse
gctctgctgtcagaaagaaa

SEQ ID NO: 774978 - DNA, 20 bp, mouse
gttgtctataccagactttt

SEQ ID NO: 774979 - DNA, 20 bp, mouse
gatgtggtttccaaaaagtc

SEQ ID NO: 774980 - DNA, 20 bp, mouse
gatgtggagaatacctgctg

SEQ ID NO: 774981 - DNA, 20 bp, mouse
gatggagcatctctcactca

SEQ ID NO: 774982 - DNA, 20 bp, mouse
gtgaaaacaagatgttgtag

SEQ ID NO: 774983 - DNA, 20 bp, mouse
gacaatgtgactgagaagtc

SEQ ID NO: 774984 - DNA, 20 bp, mouse
ggtcagacggtcacaatgct

SEQ ID NO: 774985 - DNA, 20 bp, mouse
gtgatgaagaagtgaagcac

SEQ ID NO: 774986 - DNA, 20 bp, mouse
gtaggatggtaggatatagt

SEQ ID NO: 774987 - DNA, 20 bp, mouse
gggtagaatagtggatctgt

SEQ ID NO: 774988 - DNA, 20 bp, mouse
ggggtaaacacttcagtgat

SEQ ID NO: 774989 - DNA, 20 bp, mouse
ggaagtgtttaccccagcca

SEQ ID NO: 774990 - DNA, 20 bp, mouse
gtttctgcatccccactcca

SEQ ID NO: 774991 - DNA, 20 bp, mouse
gctaatatgaccacttagga

SEQ ID NO: 774992 - DNA, 20 bp, mouse
gttctggacgacttgctaag

SEQ ID NO: 774993 - DNA, 20 bp, mouse
gtatatcctaccatcctaag

SEQ ID NO: 774994 - DNA, 20 bp, mouse
gaaaaggtccaggaactatg

SEQ ID NO: 774995 - DNA, 20 bp, mouse
gaagtggtcatattagaaaa

SEQ ID NO: 774996 - DNA, 20 bp, mouse
gtataatgagacttcgctgc

SEQ ID NO: 774997 - DNA, 20 bp, mouse
gagactaccctgtcctgtga

SEQ ID NO: 774998 - DNA, 20 bp, mouse
gcatggtccttcacaggaca

SEQ ID NO: 774999 - DNA, 20 bp, mouse
gaggcttctgtgctagtaac

SEQ ID NO: 775000 - DNA, 20 bp, mouse
gttatctaacatgatacttt

SEQ ID NO: 775001 - DNA, 20 bp, mouse
gtgtaaagaagtatatctaa

SEQ ID NO: 775002 - DNA, 20 bp, mouse
gaaacaccaaatttacaaat

SEQ ID NO: 775003 - DNA, 20 bp, mouse
gtagcacagaagcctgaagc

SEQ ID NO: 775004 - DNA, 20 bp, mouse
gagaaacaagagcctgcttc

SEQ ID NO: 775005 - DNA, 20 bp, mouse
gttggtgtttcttgtattta

SEQ ID NO: 775006 - DNA, 20 bp, mouse
gtagctctttaaaaatacgt

SEQ ID NO: 775007 - DNA, 20 bp, mouse
gttgatgtgtttgttggaac

SEQ ID NO: 775008 - DNA, 20 bp, mouse
gtatttttaaagagctatta

SEQ ID NO: 775009 - DNA, 20 bp, mouse
gttaattttgatgtgtttgt

SEQ ID NO: 775010 - DNA, 20 bp, mouse
ggaaaaggagaacttacaat

SEQ ID NO: 775011 - DNA, 20 bp, mouse
gtctgacagcagtaaggtta

SEQ ID NO: 775012 - DNA, 20 bp, mouse
gcatataatgctaaatggaa

SEQ ID NO: 775013 - DNA, 20 bp, mouse
ggtacacaaaatgctataca

SEQ ID NO: 775014 - DNA, 20 bp, mouse
gtacttgatatgccatacca

SEQ ID NO: 775015 - DNA, 20 bp, mouse
gaaagttgtagatgaatccc

SEQ ID NO: 775016 - DNA, 20 bp, mouse
gtgtcataaaccacagtttg

SEQ ID NO: 775017 - DNA, 20 bp, mouse
ggaggggggagataatgctt

SEQ ID NO: 775018 - DNA, 20 bp, mouse
ggtgttgtagaatgttgcta

SEQ ID NO: 775019 - DNA, 20 bp, mouse
ggttacatggtgagtttggg

SEQ ID NO: 775020 - DNA, 20 bp, mouse
gaacaaatgagaagtaaacc

SEQ ID NO: 775021 - DNA, 20 bp, mouse
gcactgctctaattaaaact

SEQ ID NO: 775022 - DNA, 20 bp, mouse
gaagagttacatggtgagtt

SEQ ID NO: 775023 - DNA, 20 bp, mouse
ggagtttggggggataatcc

SEQ ID NO: 775024 - DNA, 20 bp, mouse
gtcaaaatttgcttaattct

SEQ ID NO: 775025 - DNA, 20 bp, mouse
gcaaacacagatatatgatc

SEQ ID NO: 775026 - DNA, 20 bp, mouse
gactcaatgatgcagagaaa

SEQ ID NO: 775027 - DNA, 20 bp, mouse
ggggactgagaaggcaccac

SEQ ID NO: 775028 - DNA, 20 bp, mouse
gggggaaaataggattagaa

SEQ ID NO: 775029 - DNA, 20 bp, mouse
gccactgttactctctagtg

SEQ ID NO: 775030 - DNA, 20 bp, mouse
ggagtgctgcgggactgaga

SEQ ID NO: 775031 - DNA, 20 bp, mouse
gtgttactctctagtgggga

SEQ ID NO: 775032 - DNA, 20 bp, mouse
gaatcctctccaagtgaagt

SEQ ID NO: 775033 - DNA, 20 bp, mouse
gataggattagaatggcgaa

SEQ ID NO: 775034 - DNA, 20 bp, mouse
gagaggcatgtgagtgctgc

SEQ ID NO: 775035 - DNA, 20 bp, mouse
gcagtgtatgttagttgttg

SEQ ID NO: 775036 - DNA, 20 bp, mouse
gtttggcgtgatgaagagaa

SEQ ID NO: 775037 - DNA, 20 bp, mouse
gttagaagtgggctagtgga

SEQ ID NO: 775038 - DNA, 20 bp, mouse
gggagtggaaaccatagatg

SEQ ID NO: 775039 - DNA, 20 bp, mouse
ggctttacccacagtttcaa

SEQ ID NO: 775040 - DNA, 20 bp, mouse
ggtcattagaagtgggctag

SEQ ID NO: 775041 - DNA, 20 bp, mouse
gggagagagggaagccggaa

SEQ ID NO: 775042 - DNA, 20 bp, mouse
ggtgaagtcccaattatttt

SEQ ID NO: 775043 - DNA, 20 bp, mouse
gcttctaatgacctcatcta

SEQ ID NO: 775044 - DNA, 20 bp, mouse
gaggaaattattctgcaaaa

SEQ ID NO: 775045 - DNA, 20 bp, mouse
gcatcacgccaaaaataatt

SEQ ID NO: 775046 - DNA, 20 bp, mouse
gaaggttaatgctgctgcac

SEQ ID NO: 775047 - DNA, 20 bp, mouse
gttagttcctccatcatcat

SEQ ID NO: 775048 - DNA, 20 bp, mouse
ggcatttaagccaatgatga

SEQ ID NO: 775049 - DNA, 20 bp, mouse
ggatgacattttggaaacct

SEQ ID NO: 775050 - DNA, 20 bp, mouse
ggaggaactaaaataatgga

SEQ ID NO: 775051 - DNA, 20 bp, mouse
gttaaatagttgaccattca

SEQ ID NO: 775052 - DNA, 20 bp, mouse
ggataatcttctcagcaggg

SEQ ID NO: 775053 - DNA, 20 bp, mouse
gagatgaaatattgtacatt

SEQ ID NO: 775054 - DNA, 20 bp, mouse
gtcaggataatcttctcagc

SEQ ID NO: 775055 - DNA, 20 bp, mouse
gattacagcaaaatgttaaa

SEQ ID NO: 775056 - DNA, 20 bp, mouse
gaacagattcatctttttaa

SEQ ID NO: 775057 - DNA, 20 bp, mouse
gacagacactctctaggctt

SEQ ID NO: 775058 - DNA, 20 bp, mouse
gaggacttgggttgtagtgt

SEQ ID NO: 775059 - DNA, 20 bp, mouse
gaattgaagctccctcctag

SEQ ID NO: 775060 - DNA, 20 bp, mouse
gtttaaaggtgtcattaatt

SEQ ID NO: 775061 - DNA, 20 bp, mouse
gtctttatgcactcttatta

SEQ ID NO: 775062 - DNA, 20 bp, mouse
gtgttcctttggaaaatgag

SEQ ID NO: 775063 - DNA, 20 bp, mouse
gttaacacaatagctcctct

SEQ ID NO: 775064 - DNA, 20 bp, mouse
gaaattagctaggagtatgt

SEQ ID NO: 775065 - DNA, 20 bp, mouse
gacacaatagctcctctagg

SEQ ID NO: 775066 - DNA, 20 bp, mouse
gggtccttcctcatcttctt

SEQ ID NO: 775067 - DNA, 20 bp, mouse
gctgacagcagggaaaattg

SEQ ID NO: 775068 - DNA, 20 bp, mouse
gaagtgccagggaacctaag

SEQ ID NO: 775069 - DNA, 20 bp, mouse
gtggagaacacttgctgtag

SEQ ID NO: 775070 - DNA, 20 bp, mouse
gaaattgaggtgctcaaggc

SEQ ID NO: 775071 - DNA, 20 bp, mouse
gccagtaagccatatgttct

SEQ ID NO: 775072 - DNA, 20 bp, mouse
ggcactgtccccagaacata

SEQ ID NO: 775073 - DNA, 20 bp, mouse
gctttccctttctgacagca

SEQ ID NO: 775074 - DNA, 20 bp, mouse
gcatggaaaatgacattatc

SEQ ID NO: 775075 - DNA, 20 bp, mouse
gttgaatcatgagttacaac

SEQ ID NO: 775076 - DNA, 20 bp, mouse
gtatcactgttcagcagcca

SEQ ID NO: 775077 - DNA, 20 bp, mouse
gagggtgaggtttagcagtg

SEQ ID NO: 775078 - DNA, 20 bp, mouse
gctctgtggcattgccaccc

SEQ ID NO: 775079 - DNA, 20 bp, mouse
gaaaaaccttcgaagtgaaa

SEQ ID NO: 775080 - DNA, 20 bp, mouse
gtggtgctgaactaattcca

SEQ ID NO: 775081 - DNA, 20 bp, mouse
gaactcccttttcacttcga

SEQ ID NO: 775082 - DNA, 20 bp, mouse
gaagttgtatctcataatat

SEQ ID NO: 775083 - DNA, 20 bp, mouse
gcacatttctaatggaatca

SEQ ID NO: 775084 - DNA, 20 bp, mouse
gatgaaaaatacattagaaa

SEQ ID NO: 775085 - DNA, 20 bp, mouse
gttattttaaacagcacatt

SEQ ID NO: 775086 - DNA, 20 bp, mouse
gtagttaatgataatttccg

SEQ ID NO: 775087 - DNA, 20 bp, mouse
gggtgtggacatagccctca

SEQ ID NO: 775088 - DNA, 20 bp, mouse
gatataacgacatattaaaa

SEQ ID NO: 775089 - DNA, 20 bp, mouse
gatgtgtgatgtattactga

SEQ ID NO: 775090 - DNA, 20 bp, mouse
ggctatgtccacaccttact

SEQ ID NO: 775091 - DNA, 20 bp, mouse
ggacaaaattttacctagta

SEQ ID NO: 775092 - DNA, 20 bp, mouse
gactatgaacaagcaatcac

SEQ ID NO: 775093 - DNA, 20 bp, mouse
gtcaaattttgattagcaat

SEQ ID NO: 775094 - DNA, 20 bp, mouse
gatagtgttatagcattttg

SEQ ID NO: 775095 - DNA, 20 bp, mouse
gaattttacctagtaaggtg

SEQ ID NO: 775096 - DNA, 20 bp, mouse
gtgtagaagttgttcaatag

SEQ ID NO: 775097 - DNA, 20 bp, mouse
gctagccctcatagcaagct

SEQ ID NO: 775098 - DNA, 20 bp, mouse
ggacacaactttatctagta

SEQ ID NO: 775099 - DNA, 20 bp, mouse
gtcaaattttgattactgag

SEQ ID NO: 775100 - DNA, 20 bp, mouse
gaactttatctagtagggtg

SEQ ID NO: 775101 - DNA, 20 bp, mouse
gacaaaaggaaaagtcataa

SEQ ID NO: 775102 - DNA, 20 bp, mouse
gtgggtccaacttatacaaa

SEQ ID NO: 775103 - DNA, 20 bp, mouse
gaactcccagcttgctatga

SEQ ID NO: 775104 - DNA, 20 bp, mouse
gatctgatgacattttaaaa

SEQ ID NO: 775105 - DNA, 20 bp, mouse
gcttttccttttgtataagt

SEQ ID NO: 775106 - DNA, 20 bp, mouse
gaagcctagatgttcctaaa

SEQ ID NO: 775107 - DNA, 20 bp, mouse
gggcttctctgattcatgga

SEQ ID NO: 775108 - DNA, 20 bp, mouse
ggtgccatttaggaacatct

SEQ ID NO: 775109 - DNA, 20 bp, mouse
gagctgtaatcaccctctga

SEQ ID NO: 775110 - DNA, 20 bp, mouse
gggtagaattctccccactg

SEQ ID NO: 775111 - DNA, 20 bp, mouse
gaatgatgtccagcagtccg

SEQ ID NO: 775112 - DNA, 20 bp, mouse
gattatgtggaagacatcct

SEQ ID NO: 775113 - DNA, 20 bp, mouse
gtaaggaaaatgtgccattt

SEQ ID NO: 775114 - DNA, 20 bp, mouse
gtctaggcttctctgattca

SEQ ID NO: 775115 - DNA, 20 bp, mouse
gttgtagagaataaagcaca

SEQ ID NO: 775116 - DNA, 20 bp, mouse
gggtgaagatccagataaga

SEQ ID NO: 775117 - DNA, 20 bp, mouse
ggactttaacaattatagca

SEQ ID NO: 775118 - DNA, 20 bp, mouse
gctgtgaaggatagtgttat

SEQ ID NO: 775119 - DNA, 20 bp, mouse
gggattggactgatgctaag

SEQ ID NO: 775120 - DNA, 20 bp, mouse
gctcttggatccatctgatt

SEQ ID NO: 775121 - DNA, 20 bp, mouse
gaaacaagcaaacatgggat

SEQ ID NO: 775122 - DNA, 20 bp, mouse
ggccttagaataagaacaat

SEQ ID NO: 775123 - DNA, 20 bp, mouse
gatccatctgatttgggaat

SEQ ID NO: 775124 - DNA, 20 bp, mouse
ggcccattgttcttattcta

SEQ ID NO: 775125 - DNA, 20 bp, mouse
gagcccattcccaaatcaga

SEQ ID NO: 775126 - DNA, 20 bp, mouse
gagagtgctatggaagtcaa

SEQ ID NO: 775127 - DNA, 20 bp, mouse
gcatgggggcaacaagtcca

SEQ ID NO: 775128 - DNA, 20 bp, mouse
gtgcacatagttattcagat

SEQ ID NO: 775129 - DNA, 20 bp, mouse
gggagtgaataggttagttg

SEQ ID NO: 775130 - DNA, 20 bp, mouse
gcatgatctgtgtgcctaaa

SEQ ID NO: 775131 - DNA, 20 bp, mouse
gctggcatcaatggacggag

SEQ ID NO: 775132 - DNA, 20 bp, mouse
gtattagactgagagtgcta

SEQ ID NO: 775133 - DNA, 20 bp, mouse
gcagaattagtgttgactta

SEQ ID NO: 775134 - DNA, 20 bp, mouse
ggggtgaggcaggagtgaat

SEQ ID NO: 775135 - DNA, 20 bp, mouse
gtgaataactatgtgcagct

SEQ ID NO: 775136 - DNA, 20 bp, mouse
gacacactccagagcatctg

SEQ ID NO: 775137 - DNA, 20 bp, mouse
ggaacatcagaacttaatag

SEQ ID NO: 775138 - DNA, 20 bp, mouse
gcatcagaacttaatagggg

SEQ ID NO: 775139 - DNA, 20 bp, mouse
gtctccaaaccttgaagaag

SEQ ID NO: 775140 - DNA, 20 bp, mouse
gacttaataggggaggtgaa

SEQ ID NO: 775141 - DNA, 20 bp, mouse
gcttcagacctcagatgctc

SEQ ID NO: 775142 - DNA, 20 bp, mouse
gagttctgatgttccaacac

SEQ ID NO: 775143 - DNA, 20 bp, mouse
gatatagcatccttcaaaac

SEQ ID NO: 775144 - DNA, 20 bp, mouse
gtgttagctgtctggttagc

SEQ ID NO: 775145 - DNA, 20 bp, mouse
gttgaagaagaggcctgtgt

SEQ ID NO: 775146 - DNA, 20 bp, mouse
gtcatgattcagtgacaccc

SEQ ID NO: 775147 - DNA, 20 bp, mouse
gtactaaattaacaatgagc

SEQ ID NO: 775148 - DNA, 20 bp, mouse
gcttggagctgaaggaaaac

SEQ ID NO: 775149 - DNA, 20 bp, mouse
gcttctcctcattcatggat

SEQ ID NO: 775150 - DNA, 20 bp, mouse
gcatcgatcgtagtaatact

SEQ ID NO: 775151 - DNA, 20 bp, mouse
gaggttttgcatatcatagt

SEQ ID NO: 775152 - DNA, 20 bp, mouse
gaacatattgctttatggaa

SEQ ID NO: 775153 - DNA, 20 bp, mouse
gatcctcttattgtcttttt

SEQ ID NO: 775154 - DNA, 20 bp, mouse
gagacaaacatattgcttta

SEQ ID NO: 775155 - DNA, 20 bp, mouse
gattatgaaataacacttta

SEQ ID NO: 775156 - DNA, 20 bp, mouse
ggccaagtggtctaaggaaa

SEQ ID NO: 775157 - DNA, 20 bp, mouse
gataatttgggacgtcagga

SEQ ID NO: 775158 - DNA, 20 bp, mouse
gaacataaatttgtttgaat

SEQ ID NO: 775159 - DNA, 20 bp, mouse
gtaaccaaaagattataatt

SEQ ID NO: 775160 - DNA, 20 bp, mouse
gacattagaagtcctcaatc

SEQ ID NO: 775161 - DNA, 20 bp, mouse
ggaatgtttgagatgtagtc

SEQ ID NO: 775162 - DNA, 20 bp, mouse
gatgatgtgttggacattaa

SEQ ID NO: 775163 - DNA, 20 bp, mouse
gtgtagtcaggatactactg

SEQ ID NO: 775164 - DNA, 20 bp, mouse
gaatgtccaacacatcattg

SEQ ID NO: 775165 - DNA, 20 bp, mouse
gtttataacacttataatag

SEQ ID NO: 775166 - DNA, 20 bp, mouse
ggcaaagtcaagtacatatc

SEQ ID NO: 775167 - DNA, 20 bp, mouse
gggcacacctggtgcacgaa

SEQ ID NO: 775168 - DNA, 20 bp, mouse
gttgttaaagctttgctctc

SEQ ID NO: 775169 - DNA, 20 bp, mouse
gcacacagcttataagtcat

SEQ ID NO: 775170 - DNA, 20 bp, mouse
gggtatggccccccaaatga

SEQ ID NO: 775171 - DNA, 20 bp, mouse
gcctgctattccagggagtc

SEQ ID NO: 775172 - DNA, 20 bp, mouse
gccccaactggctttagttg

SEQ ID NO: 775173 - DNA, 20 bp, mouse
gtgactttgctcttcgtgtt

SEQ ID NO: 775174 - DNA, 20 bp, mouse
gtcgaggtcagccttcattt

SEQ ID NO: 775175 - DNA, 20 bp, mouse
gactaaagccagttggggta

SEQ ID NO: 775176 - DNA, 20 bp, mouse
gggagtctgcccagtcctaa

SEQ ID NO: 775177 - DNA, 20 bp, mouse
gggtctgtatcgagaaaaca

SEQ ID NO: 775178 - DNA, 20 bp, mouse
gtacagacctttcagtacta

SEQ ID NO: 775179 - DNA, 20 bp, mouse
gctaaatcccataagcccgt

SEQ ID NO: 775180 - DNA, 20 bp, mouse
gctttcagtactagggttga

SEQ ID NO: 775181 - DNA, 20 bp, mouse
gcaggatcagtaacacccac

SEQ ID NO: 775182 - DNA, 20 bp, mouse
ggatcctgcataaaactcac

SEQ ID NO: 775183 - DNA, 20 bp, mouse
ggcttgtagaacagtcttct

SEQ ID NO: 775184 - DNA, 20 bp, mouse
ggtaacacccacgggcttat

SEQ ID NO: 775185 - DNA, 20 bp, mouse
gtgttcctttgatgttatca

SEQ ID NO: 775186 - DNA, 20 bp, mouse
gtaagtatttagctacactc

SEQ ID NO: 775187 - DNA, 20 bp, mouse
gcagaagaggtccctgtaaa

SEQ ID NO: 775188 - DNA, 20 bp, mouse
gtgtttgaagcccctttaca

SEQ ID NO: 775189 - DNA, 20 bp, mouse
gaaagtctcttgaacagaag

SEQ ID NO: 775190 - DNA, 20 bp, mouse
gttagcatttcaatctgaaa

SEQ ID NO: 775191 - DNA, 20 bp, mouse
gaaacaaagaatataaatta

SEQ ID NO: 775192 - DNA, 20 bp, mouse
ggattcacacaattttgaaa

SEQ ID NO: 775193 - DNA, 20 bp, mouse
gactgtacacagaaaataac

SEQ ID NO: 775194 - DNA, 20 bp, mouse
gtaaatacttagtcactaat

SEQ ID NO: 775195 - DNA, 20 bp, mouse
gaagaaaagaaatcagattc

SEQ ID NO: 775196 - DNA, 20 bp, mouse
gatgtcatgcaactccacag

SEQ ID NO: 775197 - DNA, 20 bp, mouse
gtcccgggaccttctagata

SEQ ID NO: 775198 - DNA, 20 bp, mouse
gagttgcatgacatcctcac

SEQ ID NO: 775199 - DNA, 20 bp, mouse
gtccatatctagaaggtccc

SEQ ID NO: 775200 - DNA, 20 bp, mouse
ggattacaatataagagtac

SEQ ID NO: 775201 - DNA, 20 bp, mouse
gcaatactccaaataaaaca

SEQ ID NO: 775202 - DNA, 20 bp, mouse
gtggtaatttaatcattccc

SEQ ID NO: 775203 - DNA, 20 bp, mouse
gtaccatgaaaaaactttgt

SEQ ID NO: 775204 - DNA, 20 bp, mouse
gcagaatgccttgttttatt

SEQ ID NO: 775205 - DNA, 20 bp, mouse
gctgatatgggactcctgtg

SEQ ID NO: 775206 - DNA, 20 bp, mouse
gaatacgtttgtgtccgcat

SEQ ID NO: 775207 - DNA, 20 bp, mouse
ggaaactgagacatgttcct

SEQ ID NO: 775208 - DNA, 20 bp, mouse
ggtctcagtttcactgttta

SEQ ID NO: 775209 - DNA, 20 bp, mouse
gacctagtgttataagaaac

SEQ ID NO: 775210 - DNA, 20 bp, mouse
gtcaaaacaataatgtctat

SEQ ID NO: 775211 - DNA, 20 bp, mouse
gcttggtcacagtgatgtca

SEQ ID NO: 775212 - DNA, 20 bp, mouse
gcaataatgtctatgggctc

SEQ ID NO: 775213 - DNA, 20 bp, mouse
gcagaagaatgtgaaaccca

SEQ ID NO: 775214 - DNA, 20 bp, mouse
gttctaagagtcagtcctag

SEQ ID NO: 775215 - DNA, 20 bp, mouse
gcctagaggacatgaatgct

SEQ ID NO: 775216 - DNA, 20 bp, mouse
gagttggctaagattaagtc

SEQ ID NO: 775217 - DNA, 20 bp, mouse
gcatataagacatgtaatga

SEQ ID NO: 775218 - DNA, 20 bp, mouse
gtaaatgtgatactcacagt

SEQ ID NO: 775219 - DNA, 20 bp, mouse
gttttagacctcagagtctc

SEQ ID NO: 775220 - DNA, 20 bp, mouse
gagttctcttcttcaagatc

SEQ ID NO: 775221 - DNA, 20 bp, mouse
gatggttactcaaaaacagc

SEQ ID NO: 775222 - DNA, 20 bp, mouse
gtagtatcaaaatgcaaaac

SEQ ID NO: 775223 - DNA, 20 bp, mouse
gattactcaattaaggaaaa

SEQ ID NO: 775224 - DNA, 20 bp, mouse
gcaaatgaattactcaatta

SEQ ID NO: 775225 - DNA, 20 bp, mouse
gatcactgatataaaaatat

SEQ ID NO: 775226 - DNA, 20 bp, mouse
ggaagaaaaatgagggagat

SEQ ID NO: 775227 - DNA, 20 bp, mouse
gtgtagtgtacatattgtgt

SEQ ID NO: 775228 - DNA, 20 bp, mouse
gcacacacataaactatcat

SEQ ID NO: 775229 - DNA, 20 bp, mouse
gttatagaatatatgtcata

SEQ ID NO: 775230 - DNA, 20 bp, mouse
gtctttgtcaagtccttgtc

SEQ ID NO: 775231 - DNA, 20 bp, mouse
gacacaatcagagactgaat

SEQ ID NO: 775232 - DNA, 20 bp, mouse
gggtgagagcataacacaga

SEQ ID NO: 775233 - DNA, 20 bp, mouse
ggcaaagagaagaaaaatga

SEQ ID NO: 775234 - DNA, 20 bp, mouse
gtctctgattgtgtcaatct

SEQ ID NO: 775235 - DNA, 20 bp, mouse
ggactgaatgggatttcaca

SEQ ID NO: 775236 - DNA, 20 bp, mouse
ggagagcagtctaatcttca

SEQ ID NO: 775237 - DNA, 20 bp, mouse
ggtagttcccttgctactaa

SEQ ID NO: 775238 - DNA, 20 bp, mouse
ggaactacatttggaggcac

SEQ ID NO: 775239 - DNA, 20 bp, mouse
gaaaacctttgtaaatcctc

SEQ ID NO: 775240 - DNA, 20 bp, mouse
gagaggacacttttatcttg

SEQ ID NO: 775241 - DNA, 20 bp, mouse
gtgaaatgtctgcagattgt

SEQ ID NO: 775242 - DNA, 20 bp, mouse
ggtaaatttagatgtatttt

SEQ ID NO: 775243 - DNA, 20 bp, mouse
ggtgcttcataatccaccaa

SEQ ID NO: 775244 - DNA, 20 bp, mouse
gaggttaaaaaaaattcccg

SEQ ID NO: 775245 - DNA, 20 bp, mouse
gatttcgtttgctattacac

SEQ ID NO: 775246 - DNA, 20 bp, mouse
gcaccagggtcacagtttta

SEQ ID NO: 775247 - DNA, 20 bp, mouse
gctccctaaaactgtgaccc

SEQ ID NO: 775248 - DNA, 20 bp, mouse
gtccatgtaagagtgctcat

SEQ ID NO: 775249 - DNA, 20 bp, mouse
gcatgggctgccagttgtgg

SEQ ID NO: 775250 - DNA, 20 bp, mouse
gaccaatgaaaatacagctc

SEQ ID NO: 775251 - DNA, 20 bp, mouse
gtaacatgatgacatgatct

SEQ ID NO: 775252 - DNA, 20 bp, mouse
ggcccatgagcactcttaca

SEQ ID NO: 775253 - DNA, 20 bp, mouse
gactcacttgtaagctcacc

SEQ ID NO: 775254 - DNA, 20 bp, mouse
gggacagctctcagtctata

SEQ ID NO: 775255 - DNA, 20 bp, mouse
gtccagagctgtattttcat

SEQ ID NO: 775256 - DNA, 20 bp, mouse
gtctgcactactatcatggc

SEQ ID NO: 775257 - DNA, 20 bp, mouse
gtaaacccatatctcattac

SEQ ID NO: 775258 - DNA, 20 bp, mouse
gactctctaaggacgactac

SEQ ID NO: 775259 - DNA, 20 bp, mouse
gtgaaatgttggcactgaca

SEQ ID NO: 775260 - DNA, 20 bp, mouse
ggaacccgaaattgaaatgt

SEQ ID NO: 775261 - DNA, 20 bp, mouse
gagtgccaacatttcaattt

SEQ ID NO: 775262 - DNA, 20 bp, mouse
gtgtcacaatttaagtgtag

SEQ ID NO: 775263 - DNA, 20 bp, mouse
gtgtatgcaattactctcta

SEQ ID NO: 775264 - DNA, 20 bp, mouse
gcttttctgcactactatca

SEQ ID NO: 775265 - DNA, 20 bp, mouse
gcagtgaaaagtttcagacg

SEQ ID NO: 775266 - DNA, 20 bp, mouse
gaaagccctctctgatctta

SEQ ID NO: 775267 - DNA, 20 bp, mouse
gtcacccttaagatcagaga

SEQ ID NO: 775268 - DNA, 20 bp, mouse
gaatgccttgatggcagtaa

SEQ ID NO: 775269 - DNA, 20 bp, mouse
gaatggaggaaaagagattg

SEQ ID NO: 775270 - DNA, 20 bp, mouse
gctttaatgggcttgcattt

SEQ ID NO: 775271 - DNA, 20 bp, mouse
gatgttaacgaacaatgaaa

SEQ ID NO: 775272 - DNA, 20 bp, mouse
ggcttggaaaaattgaatgg

SEQ ID NO: 775273 - DNA, 20 bp, mouse
gtcagcttggaaaaattgaa

SEQ ID NO: 775274 - DNA, 20 bp, mouse
gaagtaatgaaatgcatcaa

SEQ ID NO: 775275 - DNA, 20 bp, mouse
ggaatatatgtaagcgctaa

SEQ ID NO: 775276 - DNA, 20 bp, mouse
ggagggatggggtgtaatga

SEQ ID NO: 775277 - DNA, 20 bp, mouse
gactctgtacaaggagggat

SEQ ID NO: 775278 - DNA, 20 bp, mouse
gaaaaacaatacaatgtggt

SEQ ID NO: 775279 - DNA, 20 bp, mouse
gagccaagaaggagtcccca

SEQ ID NO: 775280 - DNA, 20 bp, mouse
gtactctgcagggctgggtt

SEQ ID NO: 775281 - DNA, 20 bp, mouse
gggagcatccttactctgca

SEQ ID NO: 775282 - DNA, 20 bp, mouse
gagggctgtagtccctgcat

SEQ ID NO: 775283 - DNA, 20 bp, mouse
ggtacagagtcatctgaagc

SEQ ID NO: 775284 - DNA, 20 bp, mouse
gcagatgactctgtacaagg

SEQ ID NO: 775285 - DNA, 20 bp, mouse
gccctgcatgggcgggaccc

SEQ ID NO: 775286 - DNA, 20 bp, mouse
gaatgggattgaggttatga

SEQ ID NO: 775287 - DNA, 20 bp, mouse
gtcacaaacacatctctgtc

SEQ ID NO: 775288 - DNA, 20 bp, mouse
gcataagccgccaccatcac

SEQ ID NO: 775289 - DNA, 20 bp, mouse
gaagagtatagctgatgaat

SEQ ID NO: 775290 - DNA, 20 bp, mouse
gatcacaaataactgtcatt

SEQ ID NO: 775291 - DNA, 20 bp, mouse
gcagttatttgtgatgtgaa

SEQ ID NO: 775292 - DNA, 20 bp, mouse
gccttaaatcagtactctgg

SEQ ID NO: 775293 - DNA, 20 bp, mouse
gtataagtaccctgtgatgg

SEQ ID NO: 775294 - DNA, 20 bp, mouse
gcagccatatttaaggaatt

SEQ ID NO: 775295 - DNA, 20 bp, mouse
gcatcccaattccttaaata

SEQ ID NO: 775296 - DNA, 20 bp, mouse
gacacaaccgatgggtaaat

SEQ ID NO: 775297 - DNA, 20 bp, mouse
gtggtctccattagactcaa

SEQ ID NO: 775298 - DNA, 20 bp, mouse
gtcccactgagtgttctatc

SEQ ID NO: 775299 - DNA, 20 bp, mouse
gaccagatagaacactcagt

SEQ ID NO: 775300 - DNA, 20 bp, mouse
gaggcatgcagtcaaaactt

SEQ ID NO: 775301 - DNA, 20 bp, mouse
gccttttcctatttacccat

SEQ ID NO: 775302 - DNA, 20 bp, mouse
gaaactttccctgtgtcact

SEQ ID NO: 775303 - DNA, 20 bp, mouse
gaagagagtagttatttaag

SEQ ID NO: 775304 - DNA, 20 bp, mouse
gtagccagaagataaaaatg

SEQ ID NO: 775305 - DNA, 20 bp, mouse
gtgaacaaattgccgatcac

SEQ ID NO: 775306 - DNA, 20 bp, mouse
gatgtaggtgagacatgaat

SEQ ID NO: 775307 - DNA, 20 bp, mouse
gttatgtcaggttatatctg

SEQ ID NO: 775308 - DNA, 20 bp, mouse
gattgagttggtcataatgt

SEQ ID NO: 775309 - DNA, 20 bp, mouse
gataagctgcattttatgtc

SEQ ID NO: 775310 - DNA, 20 bp, mouse
gcaattttatattgcattga

SEQ ID NO: 775311 - DNA, 20 bp, mouse
gattgatggtcacattgagt

SEQ ID NO: 775312 - DNA, 20 bp, mouse
gccctttctctagagaaaga

SEQ ID NO: 775313 - DNA, 20 bp, mouse
gttaattaaactaattgact

SEQ ID NO: 775314 - DNA, 20 bp, mouse
gctttctttcttgtctgtta

SEQ ID NO: 775315 - DNA, 20 bp, mouse
ggccttctttctctagagaa

SEQ ID NO: 775316 - DNA, 20 bp, mouse
ggtcttgaatagaaatctat

SEQ ID NO: 775317 - DNA, 20 bp, mouse
gtgtcagaagctgaacagta

SEQ ID NO: 775318 - DNA, 20 bp, mouse
gtattcctgtgctctgtaag

SEQ ID NO: 775319 - DNA, 20 bp, mouse
gcaggaataggacagaattc

SEQ ID NO: 775320 - DNA, 20 bp, mouse
gtgaacaaagtttttctacc

SEQ ID NO: 775321 - DNA, 20 bp, mouse
ggaataggacagaattctgg

SEQ ID NO: 775322 - DNA, 20 bp, mouse
gctattaaaaatgtaagagt

SEQ ID NO: 775323 - DNA, 20 bp, mouse
ggatgaaatagtgtttaaat

SEQ ID NO: 775324 - DNA, 20 bp, mouse
gcctttctgtgatattggcc

SEQ ID NO: 775325 - DNA, 20 bp, mouse
gaatcacctttctgtgatat

SEQ ID NO: 775326 - DNA, 20 bp, mouse
gcctacctgagaaaatatgt

SEQ ID NO: 775327 - DNA, 20 bp, mouse
gtcagtattgtacttctcag

SEQ ID NO: 775328 - DNA, 20 bp, mouse
gtaggagtaggacagaactc

SEQ ID NO: 775329 - DNA, 20 bp, mouse
gttctgtgatattgttcagg

SEQ ID NO: 775330 - DNA, 20 bp, mouse
gtcttatggagcttaggagt

SEQ ID NO: 775331 - DNA, 20 bp, mouse
gttattctcttatggagctt

SEQ ID NO: 775332 - DNA, 20 bp, mouse
ggcaattatgtgtactatat

SEQ ID NO: 775333 - DNA, 20 bp, mouse
gattggcacttattctctta

SEQ ID NO: 775334 - DNA, 20 bp, mouse
ggattatcaagattatttgt

SEQ ID NO: 775335 - DNA, 20 bp, mouse
gattttctgtgatattgttc

SEQ ID NO: 775336 - DNA, 20 bp, mouse
ggaaggtgagaaaactggta

SEQ ID NO: 775337 - DNA, 20 bp, mouse
gacatgcaacaagtgagtaa

SEQ ID NO: 775338 - DNA, 20 bp, mouse
gaagtgagtaatgggatttc

SEQ ID NO: 775339 - DNA, 20 bp, mouse
gacattctcatctttttccc

SEQ ID NO: 775340 - DNA, 20 bp, mouse
ggtagagaatattgatattc

SEQ ID NO: 775341 - DNA, 20 bp, mouse
gatgggatttcagggaacca

SEQ ID NO: 775342 - DNA, 20 bp, mouse
gggctaacctagatcaaagt

SEQ ID NO: 775343 - DNA, 20 bp, mouse
gccctcagatttacagtcag

SEQ ID NO: 775344 - DNA, 20 bp, mouse
gacctctgactgtaaatctg

SEQ ID NO: 775345 - DNA, 20 bp, mouse
gtcttatgtcaatttctaca

SEQ ID NO: 775346 - DNA, 20 bp, mouse
gaaccctactaacatagacg

SEQ ID NO: 775347 - DNA, 20 bp, mouse
gaagtgagagggagatcctg

SEQ ID NO: 775348 - DNA, 20 bp, mouse
gagaccccgtctatgttagt

SEQ ID NO: 775349 - DNA, 20 bp, mouse
gtacaaaggagagactctgg

SEQ ID NO: 775350 - DNA, 20 bp, mouse
ggtctcatgagcatctacaa

SEQ ID NO: 775351 - DNA, 20 bp, mouse
gagcatcaacagagggaaat

SEQ ID NO: 775352 - DNA, 20 bp, mouse
gtagatgctcatgagacctc

SEQ ID NO: 775353 - DNA, 20 bp, mouse
gccagaactgactttcccaa

SEQ ID NO: 775354 - DNA, 20 bp, mouse
gctggtccacaagaactgga

SEQ ID NO: 775355 - DNA, 20 bp, mouse
gtaagctccagcatcaacag

SEQ ID NO: 775356 - DNA, 20 bp, mouse
gagtagacagggcagaatct

SEQ ID NO: 775357 - DNA, 20 bp, mouse
gcctaatagtctagtagaca

SEQ ID NO: 775358 - DNA, 20 bp, mouse
gggcccaagagaggacgtaa

SEQ ID NO: 775359 - DNA, 20 bp, mouse
gctcaggcatatactgggcc

SEQ ID NO: 775360 - DNA, 20 bp, mouse
gctgttctcaggcatatact

SEQ ID NO: 775361 - DNA, 20 bp, mouse
gtgaggcaaagtctggttaa

SEQ ID NO: 775362 - DNA, 20 bp, mouse
ggtctccaacacaaaatgtc

SEQ ID NO: 775363 - DNA, 20 bp, mouse
gtattgtatctaatggtaat

SEQ ID NO: 775364 - DNA, 20 bp, mouse
gttcctttacgtcctctctt

SEQ ID NO: 775365 - DNA, 20 bp, mouse
gattctaagtatatgatatc

SEQ ID NO: 775366 - DNA, 20 bp, mouse
gggtgcactcatgaaactat

SEQ ID NO: 775367 - DNA, 20 bp, mouse
gatggtagaaacatgtctca

SEQ ID NO: 775368 - DNA, 20 bp, mouse
gctcatgaaactattggttt

SEQ ID NO: 775369 - DNA, 20 bp, mouse
gcaagatctgtgcttactgg

SEQ ID NO: 775370 - DNA, 20 bp, mouse
gagggtcagatcttcttgct

SEQ ID NO: 775371 - DNA, 20 bp, mouse
ggcagaagggaagcagttgt

SEQ ID NO: 775372 - DNA, 20 bp, mouse
gtgatcatcagctacaaact

SEQ ID NO: 775373 - DNA, 20 bp, mouse
gtcattctacatcatgaaac

SEQ ID NO: 775374 - DNA, 20 bp, mouse
gagtgtttacaattaaaagc

SEQ ID NO: 775375 - DNA, 20 bp, mouse
gtttcaagatctgtgcttac

SEQ ID NO: 775376 - DNA, 20 bp, mouse
ggcaagagtctcaagatagg

SEQ ID NO: 775377 - DNA, 20 bp, mouse
gccagcaagagtctcaagat

SEQ ID NO: 775378 - DNA, 20 bp, mouse
ggggtttattcagttctttc

SEQ ID NO: 775379 - DNA, 20 bp, mouse
gtggatcgttccatggcatt

SEQ ID NO: 775380 - DNA, 20 bp, mouse
gattatgtctaaaaatagga

SEQ ID NO: 775381 - DNA, 20 bp, mouse
ggtggagtgagaaagggcca

SEQ ID NO: 775382 - DNA, 20 bp, mouse
gtatgattatgtctaaaaat

SEQ ID NO: 775383 - DNA, 20 bp, mouse
gagcttcaacatattaagaa

SEQ ID NO: 775384 - DNA, 20 bp, mouse
ggtggtgtcataatgttcat

SEQ ID NO: 775385 - DNA, 20 bp, mouse
gtattaagaatggacttccc

SEQ ID NO: 775386 - DNA, 20 bp, mouse
gctaaaatgaagggctacat

SEQ ID NO: 775387 - DNA, 20 bp, mouse
gttctgaaaagtctgagctg

SEQ ID NO: 775388 - DNA, 20 bp, mouse
gaagcaatgttgagtactat

SEQ ID NO: 775389 - DNA, 20 bp, mouse
gactgagttcacagccttaa

SEQ ID NO: 775390 - DNA, 20 bp, mouse
gaatagaagctatgggcaac

SEQ ID NO: 775391 - DNA, 20 bp, mouse
gcaactggtctatatatcta

SEQ ID NO: 775392 - DNA, 20 bp, mouse
gttgttttatcttaccttta

SEQ ID NO: 775393 - DNA, 20 bp, mouse
ggatgaatgaatagaagcta

SEQ ID NO: 775394 - DNA, 20 bp, mouse
gtaaggagtttagagtgtag

SEQ ID NO: 775395 - DNA, 20 bp, mouse
gccaaacttctctaaaatga

SEQ ID NO: 775396 - DNA, 20 bp, mouse
gatatgcctaggcaaagagg

SEQ ID NO: 775397 - DNA, 20 bp, mouse
gaaaacaaacgtatattgga

SEQ ID NO: 775398 - DNA, 20 bp, mouse
ggtttcaaatgagctcatta

SEQ ID NO: 775399 - DNA, 20 bp, mouse
gtaatagtgtctgtgatctc

SEQ ID NO: 775400 - DNA, 20 bp, mouse
gagactgtagtggtggccac

SEQ ID NO: 775401 - DNA, 20 bp, mouse
gaataagtaatgatatgcct

SEQ ID NO: 775402 - DNA, 20 bp, mouse
gaaaaactgggagactgtag

SEQ ID NO: 775403 - DNA, 20 bp, mouse
gaaacaaaacaaacgtatat

SEQ ID NO: 775404 - DNA, 20 bp, mouse
gggccactgggagtcataag

SEQ ID NO: 775405 - DNA, 20 bp, mouse
gatgatatgcctaggcaaag

SEQ ID NO: 775406 - DNA, 20 bp, mouse
gactaagagtctgaatgaga

SEQ ID NO: 775407 - DNA, 20 bp, mouse
gaaaccctggggactgtaat

SEQ ID NO: 775408 - DNA, 20 bp, mouse
gcagactcttagtagcttcc

SEQ ID NO: 775409 - DNA, 20 bp, mouse
ggtcatgcttatgaagtttg

SEQ ID NO: 775410 - DNA, 20 bp, mouse
gagcctcttcccatagctgg

SEQ ID NO: 775411 - DNA, 20 bp, mouse
gtgaggcacatggagatagc

SEQ ID NO: 775412 - DNA, 20 bp, mouse
gatggtcaactcccacaaaa

SEQ ID NO: 775413 - DNA, 20 bp, mouse
gacataccattgctgttcct

SEQ ID NO: 775414 - DNA, 20 bp, mouse
gggaatcggaaacctttttg

SEQ ID NO: 775415 - DNA, 20 bp, mouse
ggttatgaacctccagctat

SEQ ID NO: 775416 - DNA, 20 bp, mouse
gcaggctaaaggcctctaga

SEQ ID NO: 775417 - DNA, 20 bp, mouse
gaaaatgataggggtgtagg

SEQ ID NO: 775418 - DNA, 20 bp, mouse
gaaagcaagtaaccatccaa

SEQ ID NO: 775419 - DNA, 20 bp, mouse
gcaggcatgccgtcaaccct

SEQ ID NO: 775420 - DNA, 20 bp, mouse
gagtcagacaatattcacta

SEQ ID NO: 775421 - DNA, 20 bp, mouse
gcacgaagggctttatccaa

SEQ ID NO: 775422 - DNA, 20 bp, mouse
ggcatgcctgccctgaaatt

SEQ ID NO: 775423 - DNA, 20 bp, mouse
gaaccagacacctaatttca

SEQ ID NO: 775424 - DNA, 20 bp, mouse
gaggctttaaaagattcttg

SEQ ID NO: 775425 - DNA, 20 bp, mouse
gatccaagggagcaggctaa

SEQ ID NO: 775426 - DNA, 20 bp, mouse
gtgagtaaccacggtgtatc

SEQ ID NO: 775427 - DNA, 20 bp, mouse
gccagttagaaggtaattgg

SEQ ID NO: 775428 - DNA, 20 bp, mouse
gacagcaatgagcttacatc

SEQ ID NO: 775429 - DNA, 20 bp, mouse
gaggtcatcccgatacaccg

SEQ ID NO: 775430 - DNA, 20 bp, mouse
gatgtggagtaaagagagtc

SEQ ID NO: 775431 - DNA, 20 bp, mouse
gaccgtggttactcaatctt

SEQ ID NO: 775432 - DNA, 20 bp, mouse
gctagcttcgactggaaaac

SEQ ID NO: 775433 - DNA, 20 bp, mouse
gtcctaagattgagtaacca

SEQ ID NO: 775434 - DNA, 20 bp, mouse
gcccacagtcttgtagtctg

SEQ ID NO: 775435 - DNA, 20 bp, mouse
gtaaagtaatttatcatcca

SEQ ID NO: 775436 - DNA, 20 bp, mouse
gccattaagagcaatactca

SEQ ID NO: 775437 - DNA, 20 bp, mouse
gcctgcttagatcaggatgt

SEQ ID NO: 775438 - DNA, 20 bp, mouse
gttagatcaggatgtgggac

SEQ ID NO: 775439 - DNA, 20 bp, mouse
gaccatgactctctttgggg

SEQ ID NO: 775440 - DNA, 20 bp, mouse
gatgtgggactggatttagc

SEQ ID NO: 775441 - DNA, 20 bp, mouse
gtcatgaccatgactctctt

SEQ ID NO: 775442 - DNA, 20 bp, mouse
gtcctaaaatcaagcgtgta

SEQ ID NO: 775443 - DNA, 20 bp, mouse
gcctgatctaagcaggcaac

SEQ ID NO: 775444 - DNA, 20 bp, mouse
gaccatacacgcttgatttt

SEQ ID NO: 775445 - DNA, 20 bp, mouse
gaatgtgggaattaacacca

SEQ ID NO: 775446 - DNA, 20 bp, mouse
gcctcagcagccataccctt

SEQ ID NO: 775447 - DNA, 20 bp, mouse
gcggacgtatggtccctcag

SEQ ID NO: 775448 - DNA, 20 bp, mouse
ggcacagacacctatcccaa

SEQ ID NO: 775449 - DNA, 20 bp, mouse
ggaagctcacaagtggattg

SEQ ID NO: 775450 - DNA, 20 bp, mouse
gtgagcttgcaagcccctga

SEQ ID NO: 775451 - DNA, 20 bp, mouse
gtgaggacctgagatcccaa

SEQ ID NO: 775452 - DNA, 20 bp, mouse
ggcagcggggacccagcctt

SEQ ID NO: 775453 - DNA, 20 bp, mouse
gtgggcctctctgaaggtct

SEQ ID NO: 775454 - DNA, 20 bp, mouse
gtacgtccgaagctcacaag

SEQ ID NO: 775455 - DNA, 20 bp, mouse
gttgccctagaccttcagag

SEQ ID NO: 775456 - DNA, 20 bp, mouse
gagacataacctatctgtga

SEQ ID NO: 775457 - DNA, 20 bp, mouse
gacaactacatatacttcca

SEQ ID NO: 775458 - DNA, 20 bp, mouse
gaagtctacccttcacagat

SEQ ID NO: 775459 - DNA, 20 bp, mouse
gaatagtgttggtacttaca

SEQ ID NO: 775460 - DNA, 20 bp, mouse
gtactcctcatcctgaatat

SEQ ID NO: 775461 - DNA, 20 bp, mouse
gctgggggctttctaggtat

SEQ ID NO: 775462 - DNA, 20 bp, mouse
gacttacagggctatttgca

SEQ ID NO: 775463 - DNA, 20 bp, mouse
gtttctaggtatgggaaaac

SEQ ID NO: 775464 - DNA, 20 bp, mouse
gattctaaataccaatattc

SEQ ID NO: 775465 - DNA, 20 bp, mouse
gggtctgaagttttttggga

SEQ ID NO: 775466 - DNA, 20 bp, mouse
gtgccccttcaatatgacag

SEQ ID NO: 775467 - DNA, 20 bp, mouse
gaagccactgtcatattgaa

SEQ ID NO: 775468 - DNA, 20 bp, mouse
gaaaagggagaaagtgccaa

SEQ ID NO: 775469 - DNA, 20 bp, mouse
gcaatgagcaagcaatctac

SEQ ID NO: 775470 - DNA, 20 bp, mouse
gataggaggtgcttgcaagc

SEQ ID NO: 775471 - DNA, 20 bp, mouse
ggcacctcctatttctaaga

SEQ ID NO: 775472 - DNA, 20 bp, mouse
gaaggtaaatgttcaactct

SEQ ID NO: 775473 - DNA, 20 bp, mouse
gtatgtggcgaaaaggattc

SEQ ID NO: 775474 - DNA, 20 bp, mouse
gaaaggaatttgtgtaagtc

SEQ ID NO: 775475 - DNA, 20 bp, mouse
gatttttccatcttagaaat

SEQ ID NO: 775476 - DNA, 20 bp, mouse
gaattaggtaggttgctcag

SEQ ID NO: 775477 - DNA, 20 bp, mouse
ggagttgctgtcagtagctc

SEQ ID NO: 775478 - DNA, 20 bp, mouse
gtgaagccctaattagcaac

SEQ ID NO: 775479 - DNA, 20 bp, mouse
gaccacacaaagaatgaatt

SEQ ID NO: 775480 - DNA, 20 bp, mouse
gaggtccaggcacaaatcag

SEQ ID NO: 775481 - DNA, 20 bp, mouse
gatagcaatgatgagagcca

SEQ ID NO: 775482 - DNA, 20 bp, mouse
gaaagtgatgatttttgaga

SEQ ID NO: 775483 - DNA, 20 bp, mouse
gttaataaacagaatttcca

SEQ ID NO: 775484 - DNA, 20 bp, mouse
gtagcaactggataattaaa

SEQ ID NO: 775485 - DNA, 20 bp, mouse
ggcaaggaagaacaagatac

SEQ ID NO: 775486 - DNA, 20 bp, mouse
gtggtccagtctgaaacatg

SEQ ID NO: 775487 - DNA, 20 bp, mouse
gtagccctcatgtttcagac

SEQ ID NO: 775488 - DNA, 20 bp, mouse
gaattcttcaaacatctttc

SEQ ID NO: 775489 - DNA, 20 bp, mouse
gcactcaagttagaacaatt

SEQ ID NO: 775490 - DNA, 20 bp, mouse
gcaagttagaacaattagga

SEQ ID NO: 775491 - DNA, 20 bp, mouse
gacttgaatggacatttagt

SEQ ID NO: 775492 - DNA, 20 bp, mouse
gaactaggtagtctaaatct

SEQ ID NO: 775493 - DNA, 20 bp, mouse
ggctcctgtcagctagcgct

SEQ ID NO: 775494 - DNA, 20 bp, mouse
gagagacatattttgaaact

SEQ ID NO: 775495 - DNA, 20 bp, mouse
gacagaacaagatctgcaaa

SEQ ID NO: 775496 - DNA, 20 bp, mouse
gtcaatgtggaagtgggcat

SEQ ID NO: 775497 - DNA, 20 bp, mouse
gaggagaaatggctttaatg

SEQ ID NO: 775498 - DNA, 20 bp, mouse
gcattctcagacgttgatgc

SEQ ID NO: 775499 - DNA, 20 bp, mouse
ggaagtgggcattgggtgac

SEQ ID NO: 775500 - DNA, 20 bp, mouse
gttggcaatggcagtcaatg

SEQ ID NO: 775501 - DNA, 20 bp, mouse
gcagctggcattcagtgtgc

SEQ ID NO: 775502 - DNA, 20 bp, mouse
gaatagatacattttctccc

SEQ ID NO: 775503 - DNA, 20 bp, mouse
gagtcattttgagcagatat

SEQ ID NO: 775504 - DNA, 20 bp, mouse
gcattgggtgactgggcagc

SEQ ID NO: 775505 - DNA, 20 bp, mouse
gatggcagtcaatgtggaag

SEQ ID NO: 775506 - DNA, 20 bp, mouse
ggccaatgagacatgggtgt

SEQ ID NO: 775507 - DNA, 20 bp, mouse
gtagagataggactgaaact

SEQ ID NO: 775508 - DNA, 20 bp, mouse
ggatcttgctgtcatggtgg

SEQ ID NO: 775509 - DNA, 20 bp, mouse
gaccaacacccatgtctcat

SEQ ID NO: 775510 - DNA, 20 bp, mouse
gtaggattgctgaactgtca

SEQ ID NO: 775511 - DNA, 20 bp, mouse
ggggtgttggttgattttat

SEQ ID NO: 775512 - DNA, 20 bp, mouse
gatacctgccaatgagacat

SEQ ID NO: 775513 - DNA, 20 bp, mouse
gtatacatcctttatattga

SEQ ID NO: 775514 - DNA, 20 bp, mouse
gagtgatcttgctgtcatgg

SEQ ID NO: 775515 - DNA, 20 bp, mouse
gttaagacttattgaatctg

SEQ ID NO: 775516 - DNA, 20 bp, mouse
gttacctggaaagacaacat

SEQ ID NO: 775517 - DNA, 20 bp, mouse
gcagctatagtcctagagta

SEQ ID NO: 775518 - DNA, 20 bp, mouse
ggaagtacaccccttactct

SEQ ID NO: 775519 - DNA, 20 bp, mouse
gaccagtgagctgtgttttt

SEQ ID NO: 775520 - DNA, 20 bp, mouse
gctgaatactcatgcagtat

SEQ ID NO: 775521 - DNA, 20 bp, mouse
gctaacggttcttgttttca

SEQ ID NO: 775522 - DNA, 20 bp, mouse
gtcccaaaaacacagctcac

SEQ ID NO: 775523 - DNA, 20 bp, mouse
gaaaaatcagatcccaaatc

SEQ ID NO: 775524 - DNA, 20 bp, mouse
gctttccaggtaatatgata

SEQ ID NO: 775525 - DNA, 20 bp, mouse
gttcaagtttcatcagttat

SEQ ID NO: 775526 - DNA, 20 bp, mouse
gaccacataattattattaa

SEQ ID NO: 775527 - DNA, 20 bp, mouse
ggcctttaataataattatg

SEQ ID NO: 775528 - DNA, 20 bp, mouse
gaatgcaatggtggcagact

SEQ ID NO: 775529 - DNA, 20 bp, mouse
ggattttagcaatgcaatgg

SEQ ID NO: 775530 - DNA, 20 bp, mouse
gtaagtctgtttctttaaaa

SEQ ID NO: 775531 - DNA, 20 bp, mouse
gactgattttagcaatgcaa

SEQ ID NO: 775532 - DNA, 20 bp, mouse
gcctggggaaggttactagg

SEQ ID NO: 775533 - DNA, 20 bp, mouse
gtctcatattgaaacactta

SEQ ID NO: 775534 - DNA, 20 bp, mouse
gctggggttgtagttcatac

SEQ ID NO: 775535 - DNA, 20 bp, mouse
gctccctggggaaggttact

SEQ ID NO: 775536 - DNA, 20 bp, mouse
ggtaggaccttcagccttgg

SEQ ID NO: 775537 - DNA, 20 bp, mouse
gtgtccttgctgccctcgtg

SEQ ID NO: 775538 - DNA, 20 bp, mouse
gtagaaggcaacttctccca

SEQ ID NO: 775539 - DNA, 20 bp, mouse
gacctgttccagccgcacga

SEQ ID NO: 775540 - DNA, 20 bp, mouse
gcccgtaggaccttcagcct

SEQ ID NO: 775541 - DNA, 20 bp, mouse
gtggtacttattaaactccg

SEQ ID NO: 775542 - DNA, 20 bp, mouse
ggccctcgtgcggctggaac

SEQ ID NO: 775543 - DNA, 20 bp, mouse
gccacagactctacactaga

SEQ ID NO: 775544 - DNA, 20 bp, mouse
gaataagtaccactagagtt

SEQ ID NO: 775545 - DNA, 20 bp, mouse
gttattaaactccgaggact

SEQ ID NO: 775546 - DNA, 20 bp, mouse
gcatcaatgagccctattaa

SEQ ID NO: 775547 - DNA, 20 bp, mouse
gttcttggaggacgtatgaa

SEQ ID NO: 775548 - DNA, 20 bp, mouse
gaatgtgagtgtggaagtaa

SEQ ID NO: 775549 - DNA, 20 bp, mouse
gaaaattaaagccattaata

SEQ ID NO: 775550 - DNA, 20 bp, mouse
ggggaaaaaggttcacctta

SEQ ID NO: 775551 - DNA, 20 bp, mouse
gacaaaataataactcaaca

SEQ ID NO: 775552 - DNA, 20 bp, mouse
gaattaattaattagttgta

SEQ ID NO: 775553 - DNA, 20 bp, mouse
gggcttgacaagtgatttct

SEQ ID NO: 775554 - DNA, 20 bp, mouse
gaaaggttcaccttaaggca

SEQ ID NO: 775555 - DNA, 20 bp, mouse
gcttgtcaagccctgcctta

SEQ ID NO: 775556 - DNA, 20 bp, mouse
gcagtggtgtccaagtgaaa

SEQ ID NO: 775557 - DNA, 20 bp, mouse
gcctcagagctataacccat

SEQ ID NO: 775558 - DNA, 20 bp, mouse
gacatcaatcaccatgagtc

SEQ ID NO: 775559 - DNA, 20 bp, mouse
gaagacatgctaccatgagg

SEQ ID NO: 775560 - DNA, 20 bp, mouse
gaatgagatggatctgaaac

SEQ ID NO: 775561 - DNA, 20 bp, mouse
ggctaccatgaggtggcagt

SEQ ID NO: 775562 - DNA, 20 bp, mouse
gcatcatttcagacttaaat

SEQ ID NO: 775563 - DNA, 20 bp, mouse
gtcttcctactgccacctca

SEQ ID NO: 775564 - DNA, 20 bp, mouse
gtattttcaaccctttcact

SEQ ID NO: 775565 - DNA, 20 bp, mouse
ggcataagaacatgaacatt

SEQ ID NO: 775566 - DNA, 20 bp, mouse
gcactcacagtattccttgg

SEQ ID NO: 775567 - DNA, 20 bp, mouse
gtgtacctagaaatctccac

SEQ ID NO: 775568 - DNA, 20 bp, mouse
ggttctccaaatcatccctt

SEQ ID NO: 775569 - DNA, 20 bp, mouse
gcattagagaaatcctatta

SEQ ID NO: 775570 - DNA, 20 bp, mouse
gagtatatttgatttgccta

SEQ ID NO: 775571 - DNA, 20 bp, mouse
gattcatagtatgtatatat

SEQ ID NO: 775572 - DNA, 20 bp, mouse
gatttgcctaagggatgatt

SEQ ID NO: 775573 - DNA, 20 bp, mouse
gcttataatgctgaaatatc

SEQ ID NO: 775574 - DNA, 20 bp, mouse
gggaaaaatgatctccacca

SEQ ID NO: 775575 - DNA, 20 bp, mouse
gaatcactcacagtattcct

SEQ ID NO: 775576 - DNA, 20 bp, mouse
gataaagtcaagccagccaa

SEQ ID NO: 775577 - DNA, 20 bp, mouse
gttaatttagcaataaactt

SEQ ID NO: 775578 - DNA, 20 bp, mouse
gaataaacttaggagtgtac

SEQ ID NO: 775579 - DNA, 20 bp, mouse
gcaagtagtagtgactggcc

SEQ ID NO: 775580 - DNA, 20 bp, mouse
ggtcaagccagccaagggtt

SEQ ID NO: 775581 - DNA, 20 bp, mouse
gaaacttgtgtccaaaccct

SEQ ID NO: 775582 - DNA, 20 bp, mouse
gctcacatcagtgtgtataa

SEQ ID NO: 775583 - DNA, 20 bp, mouse
gttcaattctgagaaatcaa

SEQ ID NO: 775584 - DNA, 20 bp, mouse
gtaaatggctgtgtaaattt

SEQ ID NO: 775585 - DNA, 20 bp, mouse
gtattttcaactctattgac

SEQ ID NO: 775586 - DNA, 20 bp, mouse
gcataagtggggtgatcagc

SEQ ID NO: 775587 - DNA, 20 bp, mouse
gtgaaagcgaagccataagt

SEQ ID NO: 775588 - DNA, 20 bp, mouse
gaaattgttaagagtcttac

SEQ ID NO: 775589 - DNA, 20 bp, mouse
gtcttaacaatttctcattt

SEQ ID NO: 775590 - DNA, 20 bp, mouse
gaaaaatgtgagttacttgg

SEQ ID NO: 775591 - DNA, 20 bp, mouse
gtaatgtcaatatactgtaa

SEQ ID NO: 775592 - DNA, 20 bp, mouse
gatgattaatattattcaaa

SEQ ID NO: 775593 - DNA, 20 bp, mouse
gcaaatgaaaaacagcagga

SEQ ID NO: 775594 - DNA, 20 bp, mouse
gtaacaatttctcatttggg

SEQ ID NO: 775595 - DNA, 20 bp, mouse
gaaggtaagaaattataaga

SEQ ID NO: 775596 - DNA, 20 bp, mouse
gagatggagagaatgattac

SEQ ID NO: 775597 - DNA, 20 bp, mouse
gtaaatcaaaggtaagcaga

SEQ ID NO: 775598 - DNA, 20 bp, mouse
gaagagaaggttagtcttag

SEQ ID NO: 775599 - DNA, 20 bp, mouse
gcttaccaacactgtgaaca

SEQ ID NO: 775600 - DNA, 20 bp, mouse
gctattttaaatcgttttgt

SEQ ID NO: 775601 - DNA, 20 bp, mouse
gccatcttcatgtcctattc

SEQ ID NO: 775602 - DNA, 20 bp, mouse
gattcagcatcaaatgctgt

SEQ ID NO: 775603 - DNA, 20 bp, mouse
gaaatatatcagtcaagaga

SEQ ID NO: 775604 - DNA, 20 bp, mouse
gttgatttataatctttttc

SEQ ID NO: 775605 - DNA, 20 bp, mouse
gggtaaaaccacaaggagtc

SEQ ID NO: 775606 - DNA, 20 bp, mouse
gcagttgattaagcagttta

SEQ ID NO: 775607 - DNA, 20 bp, mouse
gaatgtcagtgacctagaac

SEQ ID NO: 775608 - DNA, 20 bp, mouse
gtaaatggtgactaagctag

SEQ ID NO: 775609 - DNA, 20 bp, mouse
gagaacaggatataaacaaa

SEQ ID NO: 775610 - DNA, 20 bp, mouse
gaggaagaatttgaattggt

SEQ ID NO: 775611 - DNA, 20 bp, mouse
gaagaatttgaattggttgg

SEQ ID NO: 775612 - DNA, 20 bp, mouse
gaatagggtatataataata

SEQ ID NO: 775613 - DNA, 20 bp, mouse
gtttcctgaaactcactaaa

SEQ ID NO: 775614 - DNA, 20 bp, mouse
gtgttctagatttaaagata

SEQ ID NO: 775615 - DNA, 20 bp, mouse
gtataaacaaaaggtaatgg

SEQ ID NO: 775616 - DNA, 20 bp, mouse
gtgacattagaggaagacaa

SEQ ID NO: 775617 - DNA, 20 bp, mouse
gtggaattacacttatgagt

SEQ ID NO: 775618 - DNA, 20 bp, mouse
gaagacaagggagaacaatg

SEQ ID NO: 775619 - DNA, 20 bp, mouse
gacagtgaggagaaatttac

SEQ ID NO: 775620 - DNA, 20 bp, mouse
ggaaaataacatgcttaaca

SEQ ID NO: 775621 - DNA, 20 bp, mouse
gaaaaattaatataaggctt

SEQ ID NO: 775622 - DNA, 20 bp, mouse
ggaggatcagttgacattag

SEQ ID NO: 775623 - DNA, 20 bp, mouse
gtttagttgaagtgaataac

SEQ ID NO: 775624 - DNA, 20 bp, mouse
gatagttttaaattttcatc

SEQ ID NO: 775625 - DNA, 20 bp, mouse
gaattttagcttctatttca

SEQ ID NO: 775626 - DNA, 20 bp, mouse
gctcttgggctaaacgtcta

SEQ ID NO: 775627 - DNA, 20 bp, mouse
gtggagggatctactgtaac

SEQ ID NO: 775628 - DNA, 20 bp, mouse
gagaaatgtttctcagactg

SEQ ID NO: 775629 - DNA, 20 bp, mouse
ggatacaactcaatgctctt

SEQ ID NO: 775630 - DNA, 20 bp, mouse
gggaggaaagttctcaagag

SEQ ID NO: 775631 - DNA, 20 bp, mouse
gtagaagaaatgtccagtac

SEQ ID NO: 775632 - DNA, 20 bp, mouse
gccaagagatgtctaaaacg

SEQ ID NO: 775633 - DNA, 20 bp, mouse
gaattctgtcatgtaaccta

SEQ ID NO: 775634 - DNA, 20 bp, mouse
gttacatgacagaattattc

SEQ ID NO: 775635 - DNA, 20 bp, mouse
gatcgtatcctgttccctgg

SEQ ID NO: 775636 - DNA, 20 bp, mouse
gcacacagatgcaaatattg

SEQ ID NO: 775637 - DNA, 20 bp, mouse
gcatctgtgtgaaagcatta

SEQ ID NO: 775638 - DNA, 20 bp, mouse
gatgagacctcatccagcct

SEQ ID NO: 775639 - DNA, 20 bp, mouse
gacacagagaccattctagt

SEQ ID NO: 775640 - DNA, 20 bp, mouse
gactacagcattaacgattg

SEQ ID NO: 775641 - DNA, 20 bp, mouse
gtgaggaatacagccaaggc

SEQ ID NO: 775642 - DNA, 20 bp, mouse
ggaaagagactcaaagctta

SEQ ID NO: 775643 - DNA, 20 bp, mouse
gatacagccaaggctggatg

SEQ ID NO: 775644 - DNA, 20 bp, mouse
gtcacatggacagaaaagga

SEQ ID NO: 775645 - DNA, 20 bp, mouse
gttatggtgacctactagaa

SEQ ID NO: 775646 - DNA, 20 bp, mouse
ggagtagaacactggttctg

SEQ ID NO: 775647 - DNA, 20 bp, mouse
gaacacacctattatgataa

SEQ ID NO: 775648 - DNA, 20 bp, mouse
gaaagggcctttatcataat

SEQ ID NO: 775649 - DNA, 20 bp, mouse
gtacacatttcaaatggttg

SEQ ID NO: 775650 - DNA, 20 bp, mouse
gacattaaacatctaagaca

SEQ ID NO: 775651 - DNA, 20 bp, mouse
ggattacttttggaggcatg

SEQ ID NO: 775652 - DNA, 20 bp, mouse
gaattcttgaatatttgaag

SEQ ID NO: 775653 - DNA, 20 bp, mouse
gcatgaacagtaagacttta

SEQ ID NO: 775654 - DNA, 20 bp, mouse
gctggaaaggagtagaacac

SEQ ID NO: 775655 - DNA, 20 bp, mouse
gaccactgagctactggccc

SEQ ID NO: 775656 - DNA, 20 bp, mouse
ggatttcagtgcactaatgg

SEQ ID NO: 775657 - DNA, 20 bp, mouse
gcaaaattttacatggcatc

SEQ ID NO: 775658 - DNA, 20 bp, mouse
gcatgatttcagtgcactaa

SEQ ID NO: 775659 - DNA, 20 bp, mouse
ggggaaaggttaaaaataac

SEQ ID NO: 775660 - DNA, 20 bp, mouse
gaattgggggtctccaaata

SEQ ID NO: 775661 - DNA, 20 bp, mouse
gacaaaatgtttacatgaaa

SEQ ID NO: 775662 - DNA, 20 bp, mouse
gcagagttggttcacaaagc

SEQ ID NO: 775663 - DNA, 20 bp, mouse
gaagtatccaaaattttaca

SEQ ID NO: 775664 - DNA, 20 bp, mouse
gatattgtatatacaattgg

SEQ ID NO: 775665 - DNA, 20 bp, mouse
ggtggttttatgcacagagt

SEQ ID NO: 775666 - DNA, 20 bp, mouse
gaagcctgtgtgacctggtt

SEQ ID NO: 775667 - DNA, 20 bp, mouse
ggtcacacaggcttctgtat

SEQ ID NO: 775668 - DNA, 20 bp, mouse
gcatttgaaggaatctacac

SEQ ID NO: 775669 - DNA, 20 bp, mouse
gatgaacaagaacagaatgg

SEQ ID NO: 775670 - DNA, 20 bp, mouse
ggaacctaaccaggtcacac

SEQ ID NO: 775671 - DNA, 20 bp, mouse
gtgaagaaaaaacttcattt

SEQ ID NO: 775672 - DNA, 20 bp, mouse
gacaggcaagttaaggagca

SEQ ID NO: 775673 - DNA, 20 bp, mouse
gtgtggatatgaacctaacc

SEQ ID NO: 775674 - DNA, 20 bp, mouse
gaaacttcatttaggttata

SEQ ID NO: 775675 - DNA, 20 bp, mouse
gtatatgtgaaagtaggcca

SEQ ID NO: 775676 - DNA, 20 bp, mouse
gaacactgatacaaagaaga

SEQ ID NO: 775677 - DNA, 20 bp, mouse
gagaaatgcagactgcagag

SEQ ID NO: 775678 - DNA, 20 bp, mouse
gctgatgctgtgtgaaattc

SEQ ID NO: 775679 - DNA, 20 bp, mouse
gaatttcagtgcagtaatgg

SEQ ID NO: 775680 - DNA, 20 bp, mouse
ggagttaatctggttctcat

SEQ ID NO: 775681 - DNA, 20 bp, mouse
ggaggatggaatttcaggtt

SEQ ID NO: 775682 - DNA, 20 bp, mouse
gtatactcaacattgcgggg

SEQ ID NO: 775683 - DNA, 20 bp, mouse
gtgcagactgcagagtggcc

SEQ ID NO: 775684 - DNA, 20 bp, mouse
ggttatgtacagagttaatc

SEQ ID NO: 775685 - DNA, 20 bp, mouse
gttaatctggttctcatggg

SEQ ID NO: 775686 - DNA, 20 bp, mouse
gcactcagagttaaagaaaa

SEQ ID NO: 775687 - DNA, 20 bp, mouse
gctagtgttcacagtaagga

SEQ ID NO: 775688 - DNA, 20 bp, mouse
gggaaagaatcaaaggcatt

SEQ ID NO: 775689 - DNA, 20 bp, mouse
gaaaactagtgttcacagta

SEQ ID NO: 775690 - DNA, 20 bp, mouse
gttcaggggctatatatgag

SEQ ID NO: 775691 - DNA, 20 bp, mouse
gatatatagcccctgaaaag

SEQ ID NO: 775692 - DNA, 20 bp, mouse
gcttctcacatttttagtgt

SEQ ID NO: 775693 - DNA, 20 bp, mouse
gctcatgccaataaacataa

SEQ ID NO: 775694 - DNA, 20 bp, mouse
gagtgaactcccctcttttc

SEQ ID NO: 775695 - DNA, 20 bp, mouse
gctgtgaacactagttttaa

SEQ ID NO: 775696 - DNA, 20 bp, mouse
gaatggaagcgcttaatgag

SEQ ID NO: 775697 - DNA, 20 bp, mouse
gcccagtgtctctcaaagtg

SEQ ID NO: 775698 - DNA, 20 bp, mouse
gttaagcgcttccattatca

SEQ ID NO: 775699 - DNA, 20 bp, mouse
ggagagacactgggcatggg

SEQ ID NO: 775700 - DNA, 20 bp, mouse
gaaaagtaatttagcttgct

SEQ ID NO: 775701 - DNA, 20 bp, mouse
gtttcccaggtccttgataa

SEQ ID NO: 775702 - DNA, 20 bp, mouse
ggaacaatattgattacaat

SEQ ID NO: 775703 - DNA, 20 bp, mouse
gtaggtctcagaagtaagac

SEQ ID NO: 775704 - DNA, 20 bp, mouse
gggatgtttttctatttccc

SEQ ID NO: 775705 - DNA, 20 bp, mouse
gaaatattacaggttttctc

SEQ ID NO: 775706 - DNA, 20 bp, mouse
gggagggagagactccatat

SEQ ID NO: 775707 - DNA, 20 bp, mouse
gagaagttagggtctctcaa

SEQ ID NO: 775708 - DNA, 20 bp, mouse
gtgtcttctattccctctgt

SEQ ID NO: 775709 - DNA, 20 bp, mouse
gtaaacacgcatgggaggga

SEQ ID NO: 775710 - DNA, 20 bp, mouse
gacacataaacacgcatggg

SEQ ID NO: 775711 - DNA, 20 bp, mouse
gacacgcatgggagggatgg

SEQ ID NO: 775712 - DNA, 20 bp, mouse
gaagagaaagtgttgtttgt

SEQ ID NO: 775713 - DNA, 20 bp, mouse
gcacacacataaacacgcat

SEQ ID NO: 775714 - DNA, 20 bp, mouse
gtataactggactgaaatta

SEQ ID NO: 775715 - DNA, 20 bp, mouse
ggatgactcaacaagttgtt

SEQ ID NO: 775716 - DNA, 20 bp, mouse
ggatttagataattaggttc

SEQ ID NO: 775717 - DNA, 20 bp, mouse
gcagatatgttcagttgact

SEQ ID NO: 775718 - DNA, 20 bp, mouse
gattcacattagttatgata

SEQ ID NO: 775719 - DNA, 20 bp, mouse
gtatatgaaggtagagcaag

SEQ ID NO: 775720 - DNA, 20 bp, mouse
gtgaaagactagaatgctat

SEQ ID NO: 775721 - DNA, 20 bp, mouse
gttttcatgtgcaagtgaaa

SEQ ID NO: 775722 - DNA, 20 bp, mouse
gtctggctctgaatatatga

SEQ ID NO: 775723 - DNA, 20 bp, mouse
gtgcagagattggcacaaaa

SEQ ID NO: 775724 - DNA, 20 bp, mouse
ggtacttgcttgctctacac

SEQ ID NO: 775725 - DNA, 20 bp, mouse
gaagcaagtactgaagcagc

SEQ ID NO: 775726 - DNA, 20 bp, mouse
gttggggagacgttttcttg

SEQ ID NO: 775727 - DNA, 20 bp, mouse
gaccctctctttattatctc

SEQ ID NO: 775728 - DNA, 20 bp, mouse
gtgaagacaaaattgctctg

SEQ ID NO: 775729 - DNA, 20 bp, mouse
ggctcaactgctggcatctg

SEQ ID NO: 775730 - DNA, 20 bp, mouse
gcaactgctggcatctgagg

SEQ ID NO: 775731 - DNA, 20 bp, mouse
ggtaaaaaatgagaattttg

SEQ ID NO: 775732 - DNA, 20 bp, mouse
ggctaatttttaaacccagt

SEQ ID NO: 775733 - DNA, 20 bp, mouse
gaggtctatagctcaactgc

SEQ ID NO: 775734 - DNA, 20 bp, mouse
gtaattttgtcatttccaac

SEQ ID NO: 775735 - DNA, 20 bp, mouse
gtctcagtcttctcaaaaga

SEQ ID NO: 775736 - DNA, 20 bp, mouse
gattcaaattaattacgata

SEQ ID NO: 775737 - DNA, 20 bp, mouse
gtagtagcgcctgagaaaca

SEQ ID NO: 775738 - DNA, 20 bp, mouse
gtgcagagattggcagaaaa

SEQ ID NO: 775739 - DNA, 20 bp, mouse
gttgaaagactagaatgctg

SEQ ID NO: 775740 - DNA, 20 bp, mouse
gttttcatgtgcaggtgaaa

SEQ ID NO: 775741 - DNA, 20 bp, mouse
ggtacttgcttgctctacac

SEQ ID NO: 775742 - DNA, 20 bp, mouse
gcaaagcaatgtgcagagat

SEQ ID NO: 775743 - DNA, 20 bp, mouse
gtatatgaaggtaaagcaag

SEQ ID NO: 775744 - DNA, 20 bp, mouse
gaagcaagtactgaagcagc

SEQ ID NO: 775745 - DNA, 20 bp, mouse
gtctgactctgaatatatga

SEQ ID NO: 775746 - DNA, 20 bp, mouse
gtttccaagaagtgaagata

SEQ ID NO: 775747 - DNA, 20 bp, mouse
gtataaaacaaatgtaagtg

SEQ ID NO: 775748 - DNA, 20 bp, mouse
gctgccctatcttcacttct

SEQ ID NO: 775749 - DNA, 20 bp, mouse
gttgtggtcttaaaatgatc

SEQ ID NO: 775750 - DNA, 20 bp, mouse
gttgttttataagatgttat

SEQ ID NO: 775751 - DNA, 20 bp, mouse
gacaaaaggactcattataa

SEQ ID NO: 775752 - DNA, 20 bp, mouse
gaggactcattataagggaa

SEQ ID NO: 775753 - DNA, 20 bp, mouse
ggcaagcaatgagatttatc

SEQ ID NO: 775754 - DNA, 20 bp, mouse
gcagatagaaattaattttg

SEQ ID NO: 775755 - DNA, 20 bp, mouse
gatgtcatcaggaatatgtg

SEQ ID NO: 775756 - DNA, 20 bp, mouse
gagaactgacctctcctcaa

SEQ ID NO: 775757 - DNA, 20 bp, mouse
gtgtcatggcacatgaacag

SEQ ID NO: 775758 - DNA, 20 bp, mouse
gaaaaccataagaggtaatc

SEQ ID NO: 775759 - DNA, 20 bp, mouse
gaagtagtaagagggctctg

SEQ ID NO: 775760 - DNA, 20 bp, mouse
gaatgccagattacctctta

SEQ ID NO: 775761 - DNA, 20 bp, mouse
gggctttttaacagaatgaa

SEQ ID NO: 775762 - DNA, 20 bp, mouse
gttcatagaggaaaaatcaa

SEQ ID NO: 775763 - DNA, 20 bp, mouse
gttatatgctatctccttgt

SEQ ID NO: 775764 - DNA, 20 bp, mouse
gctcactatgaatacccaca

SEQ ID NO: 775765 - DNA, 20 bp, mouse
gatcagcattcttcttaaaa

SEQ ID NO: 775766 - DNA, 20 bp, mouse
gtcactgggacaggttcaag

SEQ ID NO: 775767 - DNA, 20 bp, mouse
ggggacaggttcaagcggga

SEQ ID NO: 775768 - DNA, 20 bp, mouse
gtggaagtgaagattgatgt

SEQ ID NO: 775769 - DNA, 20 bp, mouse
gttgtctatgctcatactta

SEQ ID NO: 775770 - DNA, 20 bp, mouse
gggtgattttaaaacttcac

SEQ ID NO: 775771 - DNA, 20 bp, mouse
ggaatatggctattagtgaa

SEQ ID NO: 775772 - DNA, 20 bp, mouse
gactcaggggattagtttta

SEQ ID NO: 775773 - DNA, 20 bp, mouse
gaggggattagttttatgga

SEQ ID NO: 775774 - DNA, 20 bp, mouse
gatcaatgacattgatcaat

SEQ ID NO: 775775 - DNA, 20 bp, mouse
gtttaaaacttcactgggac

SEQ ID NO: 775776 - DNA, 20 bp, mouse
gtcagcctggttcagatatg

SEQ ID NO: 775777 - DNA, 20 bp, mouse
gtactgagtgctgtgtcatg

SEQ ID NO: 775778 - DNA, 20 bp, mouse
gggaactgacatgtaatagg

SEQ ID NO: 775779 - DNA, 20 bp, mouse
gggaaataaagttagattga

SEQ ID NO: 775780 - DNA, 20 bp, mouse
gtgtgggatgcagactacct

SEQ ID NO: 775781 - DNA, 20 bp, mouse
gtttgtactaaagataaaat

SEQ ID NO: 775782 - DNA, 20 bp, mouse
gtgttgagtgtttgggctta

SEQ ID NO: 775783 - DNA, 20 bp, mouse
gctgagtctagctgtcatga

SEQ ID NO: 775784 - DNA, 20 bp, mouse
gtctagctgtcatgagggat

SEQ ID NO: 775785 - DNA, 20 bp, mouse
gactgtgtaagtagcgctga

SEQ ID NO: 775786 - DNA, 20 bp, mouse
gatcagaagggtaagacagt

SEQ ID NO: 775787 - DNA, 20 bp, mouse
gtgaacattttcagatcaga

SEQ ID NO: 775788 - DNA, 20 bp, mouse
gaccaaggccaatgatgatt

SEQ ID NO: 775789 - DNA, 20 bp, mouse
gggaagggtctgatcagcat

SEQ ID NO: 775790 - DNA, 20 bp, mouse
gatcagcattggagactcca

SEQ ID NO: 775791 - DNA, 20 bp, mouse
gggcagttttaagtggtcag

SEQ ID NO: 775792 - DNA, 20 bp, mouse
gggcaaaagtgatgtggtgc

SEQ ID NO: 775793 - DNA, 20 bp, mouse
ggtcagtggattaagtcttg

SEQ ID NO: 775794 - DNA, 20 bp, mouse
gtctaataatctgcactcat

SEQ ID NO: 775795 - DNA, 20 bp, mouse
gattagaaagtcaggttgta

SEQ ID NO: 775796 - DNA, 20 bp, mouse
gtctttatggcggtctttac

SEQ ID NO: 775797 - DNA, 20 bp, mouse
ggaccgccataaagaaattg

SEQ ID NO: 775798 - DNA, 20 bp, mouse
gtgattaagtagatatttca

SEQ ID NO: 775799 - DNA, 20 bp, mouse
gtttagaaaaaaatccagat

SEQ ID NO: 775800 - DNA, 20 bp, mouse
gttcttaatggttgtgtgtt

SEQ ID NO: 775801 - DNA, 20 bp, mouse
gatatactgaatacacaagt

SEQ ID NO: 775802 - DNA, 20 bp, mouse
gattcagtatatgacaaaag

SEQ ID NO: 775803 - DNA, 20 bp, mouse
ggttttgaataatcaaccat

SEQ ID NO: 775804 - DNA, 20 bp, mouse
gaggcttaatatattgatat

SEQ ID NO: 775805 - DNA, 20 bp, mouse
ggatgagaaagtaaaaccta

SEQ ID NO: 775806 - DNA, 20 bp, mouse
gaggcatggcccacgtttga

SEQ ID NO: 775807 - DNA, 20 bp, mouse
gttcccgatccctcaaacgt

SEQ ID NO: 775808 - DNA, 20 bp, mouse
gggcccacgtttgagggatc

SEQ ID NO: 775809 - DNA, 20 bp, mouse
gtcattgtcagggaattgaa

SEQ ID NO: 775810 - DNA, 20 bp, mouse
ggcttcttgacataagtgtc

SEQ ID NO: 775811 - DNA, 20 bp, mouse
ggtcatctaggacgttctag

SEQ ID NO: 775812 - DNA, 20 bp, mouse
ggatatgatggatacctatt

SEQ ID NO: 775813 - DNA, 20 bp, mouse
gtaatatttttcagagaggt

SEQ ID NO: 775814 - DNA, 20 bp, mouse
ggttatagtggttccctgag

SEQ ID NO: 775815 - DNA, 20 bp, mouse
gttatttcccttcaatctac

SEQ ID NO: 775816 - DNA, 20 bp, mouse
gacttggaagggacaattag

SEQ ID NO: 775817 - DNA, 20 bp, mouse
gggagggggctgacttggaa

SEQ ID NO: 775818 - DNA, 20 bp, mouse
gcctacctgggattttctaa

SEQ ID NO: 775819 - DNA, 20 bp, mouse
gaatgtgaaaatagccaaac

SEQ ID NO: 775820 - DNA, 20 bp, mouse
gataaaaacaatcaatgttc

SEQ ID NO: 775821 - DNA, 20 bp, mouse
gggttcttttgttcctacct

SEQ ID NO: 775822 - DNA, 20 bp, mouse
gaatggctattaattcttaa

SEQ ID NO: 775823 - DNA, 20 bp, mouse
gatagcataactagattaca

SEQ ID NO: 775824 - DNA, 20 bp, mouse
gttcttaatggttgactttt

SEQ ID NO: 775825 - DNA, 20 bp, mouse
gattttgaataattaagcat

SEQ ID NO: 775826 - DNA, 20 bp, mouse
gagcgtatagcacagctggc

SEQ ID NO: 775827 - DNA, 20 bp, mouse
gtatctaatgatgcagaaca

SEQ ID NO: 775828 - DNA, 20 bp, mouse
gtcgtttgttttaggacata

SEQ ID NO: 775829 - DNA, 20 bp, mouse
gttcacttttcagattctac

SEQ ID NO: 775830 - DNA, 20 bp, mouse
gttcagattctacagggact

SEQ ID NO: 775831 - DNA, 20 bp, mouse
gacgaatgtatataaaaatg

SEQ ID NO: 775832 - DNA, 20 bp, mouse
gcagctggcaggtgtctctg

SEQ ID NO: 775833 - DNA, 20 bp, mouse
ggagagacctgggtgggaga

SEQ ID NO: 775834 - DNA, 20 bp, mouse
ggacttcacaaataacacac

SEQ ID NO: 775835 - DNA, 20 bp, mouse
gagaagaaaacaatcactgg

SEQ ID NO: 775836 - DNA, 20 bp, mouse
gattcaggtaaggacaaaat

SEQ ID NO: 775837 - DNA, 20 bp, mouse
gtaacttacagaaatgattc

SEQ ID NO: 775838 - DNA, 20 bp, mouse
gaggacaaatatcaagcgaa

SEQ ID NO: 775839 - DNA, 20 bp, mouse
gtacagaaatgattcaggta

SEQ ID NO: 775840 - DNA, 20 bp, mouse
gtgacatttaaatacttagg

SEQ ID NO: 775841 - DNA, 20 bp, mouse
gatacttagggggaaaagaa

SEQ ID NO: 775842 - DNA, 20 bp, mouse
ggactgacatttaaatactt

SEQ ID NO: 775843 - DNA, 20 bp, mouse
gaaaccacaagagctcatag

SEQ ID NO: 775844 - DNA, 20 bp, mouse
gtgtcctctatgagctcttg

SEQ ID NO: 775845 - DNA, 20 bp, mouse
gaataaactctatgtaagtt

SEQ ID NO: 775846 - DNA, 20 bp, mouse
gacactggaaaggtgtggtc

SEQ ID NO: 775847 - DNA, 20 bp, mouse
gaagccttgcctaccatagg

SEQ ID NO: 775848 - DNA, 20 bp, mouse
gagatctgctgcatggaaag

SEQ ID NO: 775849 - DNA, 20 bp, mouse
gcacctgttcctcctatggt

SEQ ID NO: 775850 - DNA, 20 bp, mouse
gttccacataggtctttccc

SEQ ID NO: 775851 - DNA, 20 bp, mouse
ggcagtgctaacgtgggaaa

SEQ ID NO: 775852 - DNA, 20 bp, mouse
ggtgaagccttgcctaccat

SEQ ID NO: 775853 - DNA, 20 bp, mouse
gaggtgagttatcaaagcca

SEQ ID NO: 775854 - DNA, 20 bp, mouse
gagccagggaaagacctatg

SEQ ID NO: 775855 - DNA, 20 bp, mouse
ggtgtatgggtcccagacac

SEQ ID NO: 775856 - DNA, 20 bp, mouse
gctggggacaggataaacag

SEQ ID NO: 775857 - DNA, 20 bp, mouse
gtctaggtgaactttctctt

SEQ ID NO: 775858 - DNA, 20 bp, mouse
gagggtgttggaatagtttc

SEQ ID NO: 775859 - DNA, 20 bp, mouse
gggaacaagtacaagctagg

SEQ ID NO: 775860 - DNA, 20 bp, mouse
gaggaaggggagagaaattt

SEQ ID NO: 775861 - DNA, 20 bp, mouse
gtgggggtgggtcagatcac

SEQ ID NO: 775862 - DNA, 20 bp, mouse
gacctagaggctagtggcta

SEQ ID NO: 775863 - DNA, 20 bp, mouse
gtgaggcaaacaagaggaag

SEQ ID NO: 775864 - DNA, 20 bp, mouse
ggatggaacaagtacaagct

SEQ ID NO: 775865 - DNA, 20 bp, mouse
gaggcagatataacttttat

SEQ ID NO: 775866 - DNA, 20 bp, mouse
gtcctcagatgacctcatat

SEQ ID NO: 775867 - DNA, 20 bp, mouse
gagcagaggcaggggtagaa

SEQ ID NO: 775868 - DNA, 20 bp, mouse
gaaatgggtgactgatgagg

SEQ ID NO: 775869 - DNA, 20 bp, mouse
gtcagatgacctcatatggg

SEQ ID NO: 775870 - DNA, 20 bp, mouse
gttggggagaaaactggtgt

SEQ ID NO: 775871 - DNA, 20 bp, mouse
ggtcagagtcctcccatatg

SEQ ID NO: 775872 - DNA, 20 bp, mouse
gcagagaccaagactgtcct

SEQ ID NO: 775873 - DNA, 20 bp, mouse
gctaacactcatggataact

SEQ ID NO: 775874 - DNA, 20 bp, mouse
gacactaggaagcaaggagg

SEQ ID NO: 775875 - DNA, 20 bp, mouse
gcagtcttggtctctgtatt

SEQ ID NO: 775876 - DNA, 20 bp, mouse
gtaagtatgtatttccaagg

SEQ ID NO: 775877 - DNA, 20 bp, mouse
ggtaaaactggaggcctctg

SEQ ID NO: 775878 - DNA, 20 bp, mouse
gttatattgcataccctcag

SEQ ID NO: 775879 - DNA, 20 bp, mouse
gtttggtctatgcatagaag

SEQ ID NO: 775880 - DNA, 20 bp, mouse
gactctaattagttttttga

SEQ ID NO: 775881 - DNA, 20 bp, mouse
gggacctagttttgtaaaac

SEQ ID NO: 775882 - DNA, 20 bp, mouse
gaaagataatttaacctttc

SEQ ID NO: 775883 - DNA, 20 bp, mouse
gttgcatctcgataaaagtt

SEQ ID NO: 775884 - DNA, 20 bp, mouse
gtagtattatattcggccta

SEQ ID NO: 775885 - DNA, 20 bp, mouse
ggcacacctctgaaccacct

SEQ ID NO: 775886 - DNA, 20 bp, mouse
gtgttcttaagaggcatact

SEQ ID NO: 775887 - DNA, 20 bp, mouse
gtcctgggaagtactttgtg

SEQ ID NO: 775888 - DNA, 20 bp, mouse
gtattccaggtttagtgtcc

SEQ ID NO: 775889 - DNA, 20 bp, mouse
gtgctacaatgacacatgtt

SEQ ID NO: 775890 - DNA, 20 bp, mouse
gatccatgtatgtgtagaat

SEQ ID NO: 775891 - DNA, 20 bp, mouse
gtacctattctacacataca

SEQ ID NO: 775892 - DNA, 20 bp, mouse
ggtttatgtgcctagagcaa

SEQ ID NO: 775893 - DNA, 20 bp, mouse
gacctcacaaagtacttccc

SEQ ID NO: 775894 - DNA, 20 bp, mouse
gtggatttttatgtgactcc

SEQ ID NO: 775895 - DNA, 20 bp, mouse
gcttcccaggacactaaacc

SEQ ID NO: 775896 - DNA, 20 bp, mouse
gaattctcttgggtgtatct

SEQ ID NO: 775897 - DNA, 20 bp, mouse
gtggaggggtggaaagcatg

SEQ ID NO: 775898 - DNA, 20 bp, mouse
gtcttggcttgcttttcctg

SEQ ID NO: 775899 - DNA, 20 bp, mouse
ggatttggaagaacatggag

SEQ ID NO: 775900 - DNA, 20 bp, mouse
gtaaattgcataattctctt

SEQ ID NO: 775901 - DNA, 20 bp, mouse
ggagatgaatcttaaatgtc

SEQ ID NO: 775902 - DNA, 20 bp, mouse
gactgggtagtgaggtataa

SEQ ID NO: 775903 - DNA, 20 bp, mouse
gctcaatactttgagcctat

SEQ ID NO: 775904 - DNA, 20 bp, mouse
gtagtgaggtataaaggatt

SEQ ID NO: 775905 - DNA, 20 bp, mouse
gtaactttaagagtctcctt

SEQ ID NO: 775906 - DNA, 20 bp, mouse
gtaaggattacagtgttata

SEQ ID NO: 775907 - DNA, 20 bp, mouse
ggaatcaattaggactggta

SEQ ID NO: 775908 - DNA, 20 bp, mouse
ggtagagaatcaattaggac

SEQ ID NO: 775909 - DNA, 20 bp, mouse
gtatcagtagagaatcaatt

SEQ ID NO: 775910 - DNA, 20 bp, mouse
gagtcatgttggtgtcataa

SEQ ID NO: 775911 - DNA, 20 bp, mouse
gcacacctgctcttcccatt

SEQ ID NO: 775912 - DNA, 20 bp, mouse
gaagacctctaagcatccaa

SEQ ID NO: 775913 - DNA, 20 bp, mouse
gagtattgatattactgatt

SEQ ID NO: 775914 - DNA, 20 bp, mouse
ggcccaaaccagcttccctt

SEQ ID NO: 775915 - DNA, 20 bp, mouse
gtaagcaaccgaagggaagc

SEQ ID NO: 775916 - DNA, 20 bp, mouse
gtcccttgggattcccaaca

SEQ ID NO: 775917 - DNA, 20 bp, mouse
ggccatgttgggaatcccaa

SEQ ID NO: 775918 - DNA, 20 bp, mouse
ggtgacattagaaatccctt

SEQ ID NO: 775919 - DNA, 20 bp, mouse
ggttgagggggagaaagaat

SEQ ID NO: 775920 - DNA, 20 bp, mouse
gtcacttgtgcaaaaagtat

SEQ ID NO: 775921 - DNA, 20 bp, mouse
gtctgaggatcttgaaaaat

SEQ ID NO: 775922 - DNA, 20 bp, mouse
gctgtgaacttgtgctaaaa

SEQ ID NO: 775923 - DNA, 20 bp, mouse
gtgatgagtttatgagagta

SEQ ID NO: 775924 - DNA, 20 bp, mouse
gtaatcaaatgtggactgat

SEQ ID NO: 775925 - DNA, 20 bp, mouse
ggattagccataatcaaatg

SEQ ID NO: 775926 - DNA, 20 bp, mouse
gaagcaaagctactcactag

SEQ ID NO: 775927 - DNA, 20 bp, mouse
gttcacttgggatactcaac

SEQ ID NO: 775928 - DNA, 20 bp, mouse
ggggaaagacatcattttac

SEQ ID NO: 775929 - DNA, 20 bp, mouse
ggtaacatcagagttcactt

SEQ ID NO: 775930 - DNA, 20 bp, mouse
gagtgagtagctttgcttct

SEQ ID NO: 775931 - DNA, 20 bp, mouse
gacaaaaccaggacccatat

SEQ ID NO: 775932 - DNA, 20 bp, mouse
gtaatcatcaattcaaaatt

SEQ ID NO: 775933 - DNA, 20 bp, mouse
gtctagagagatacttcttc

SEQ ID NO: 775934 - DNA, 20 bp, mouse
ggtctatgcacaaagaaaac

SEQ ID NO: 775935 - DNA, 20 bp, mouse
gcaacacaattttgccaata

SEQ ID NO: 775936 - DNA, 20 bp, mouse
gtggtccctggaaagggaga

SEQ ID NO: 775937 - DNA, 20 bp, mouse
gaaggcaggctgtgtgacag

SEQ ID NO: 775938 - DNA, 20 bp, mouse
gaacctcctgggacaggaca

SEQ ID NO: 775939 - DNA, 20 bp, mouse
ggccccaaggatcagtgtcc

SEQ ID NO: 775940 - DNA, 20 bp, mouse
gactatgtggtccctggaaa

SEQ ID NO: 775941 - DNA, 20 bp, mouse
gaggttcagtgtgttaaggt

SEQ ID NO: 775942 - DNA, 20 bp, mouse
gcctgctgatatgaggtgga

SEQ ID NO: 775943 - DNA, 20 bp, mouse
ggacctggacactgatcctt

SEQ ID NO: 775944 - DNA, 20 bp, mouse
gtagagttgaactttaaatt

SEQ ID NO: 775945 - DNA, 20 bp, mouse
gatggaatctggagcgtccc

SEQ ID NO: 775946 - DNA, 20 bp, mouse
gctcctggaaatattcctct

SEQ ID NO: 775947 - DNA, 20 bp, mouse
gtgccaagaggaatatttcc

SEQ ID NO: 775948 - DNA, 20 bp, mouse
gatctgatgttataatacta

SEQ ID NO: 775949 - DNA, 20 bp, mouse
gtctgaagaagaatcttcta

SEQ ID NO: 775950 - DNA, 20 bp, mouse
gagcaaacttatttactagt

SEQ ID NO: 775951 - DNA, 20 bp, mouse
gataatactagggttcatat

SEQ ID NO: 775952 - DNA, 20 bp, mouse
gtcattagtaagtcacctcc

SEQ ID NO: 775953 - DNA, 20 bp, mouse
gagagtatcatatttattac

SEQ ID NO: 775954 - DNA, 20 bp, mouse
gatgagcaaagccaaaacac

SEQ ID NO: 775955 - DNA, 20 bp, mouse
gacaatttcgtataagtatt

SEQ ID NO: 775956 - DNA, 20 bp, mouse
gaaggtcagccaaaggcccc

SEQ ID NO: 775957 - DNA, 20 bp, mouse
gtggtgtaatgagagtaaga

SEQ ID NO: 775958 - DNA, 20 bp, mouse
gtacacagaaaccacctcat

SEQ ID NO: 775959 - DNA, 20 bp, mouse
gttggggtcagagttagggg

SEQ ID NO: 775960 - DNA, 20 bp, mouse
gggcctttggctgaccttgg

SEQ ID NO: 775961 - DNA, 20 bp, mouse
ggtcacacacatatgagtta

SEQ ID NO: 775962 - DNA, 20 bp, mouse
gtggatcaaaagggcatttt

SEQ ID NO: 775963 - DNA, 20 bp, mouse
gacacgtgaaatactataaa

SEQ ID NO: 775964 - DNA, 20 bp, mouse
gaatagtagtagtatctaga

SEQ ID NO: 775965 - DNA, 20 bp, mouse
gagagtaaactcatttttcc

SEQ ID NO: 775966 - DNA, 20 bp, mouse
gatgagccatgacatgacac

SEQ ID NO: 775967 - DNA, 20 bp, mouse
gaaagagaagcatcactatg

SEQ ID NO: 775968 - DNA, 20 bp, mouse
gagtaagaaatataacaaga

SEQ ID NO: 775969 - DNA, 20 bp, mouse
gaaaatatgccaaatttgaa

SEQ ID NO: 775970 - DNA, 20 bp, mouse
gctgtaccagtgtcatgtca

SEQ ID NO: 775971 - DNA, 20 bp, mouse
gaacaattctgagtccagaa

SEQ ID NO: 775972 - DNA, 20 bp, mouse
gaatgatttccattcaaatt

SEQ ID NO: 775973 - DNA, 20 bp, mouse
gaactacagtcatttagtaa

SEQ ID NO: 775974 - DNA, 20 bp, mouse
gacacttacacagtgaactg

SEQ ID NO: 775975 - DNA, 20 bp, mouse
gttccaggatcttgtcacta

SEQ ID NO: 775976 - DNA, 20 bp, mouse
ggcacatggaagtactagta

SEQ ID NO: 775977 - DNA, 20 bp, mouse
gcatctgggaatggttgtac

SEQ ID NO: 775978 - DNA, 20 bp, mouse
gtactagaacagaaatgcat

SEQ ID NO: 775979 - DNA, 20 bp, mouse
gcagcaggactcaaggaagt

SEQ ID NO: 775980 - DNA, 20 bp, mouse
ggagttgaatacctcctttg

SEQ ID NO: 775981 - DNA, 20 bp, mouse
gaattactcaattacctcaa

SEQ ID NO: 775982 - DNA, 20 bp, mouse
gtaggaggtaatagtacagc

SEQ ID NO: 775983 - DNA, 20 bp, mouse
gactaggtgcatgtatttgt

SEQ ID NO: 775984 - DNA, 20 bp, mouse
ggttctagtacatctgggaa

SEQ ID NO: 775985 - DNA, 20 bp, mouse
ggcttgctaatatttaaatt

SEQ ID NO: 775986 - DNA, 20 bp, mouse
ggggtagcacaaagtgtcat

SEQ ID NO: 775987 - DNA, 20 bp, mouse
gtgtcattggatatgacaat

SEQ ID NO: 775988 - DNA, 20 bp, mouse
gcatgttgttagagtcattc

SEQ ID NO: 775989 - DNA, 20 bp, mouse
gtaagaagtcacctcaagcc

SEQ ID NO: 775990 - DNA, 20 bp, mouse
gagggcagagagacaaacag

SEQ ID NO: 775991 - DNA, 20 bp, mouse
gaagaaagagacaaagatga

SEQ ID NO: 775992 - DNA, 20 bp, mouse
gaggcagacagagagtgaaa

SEQ ID NO: 775993 - DNA, 20 bp, mouse
ggacaaacagagggacagac

SEQ ID NO: 775994 - DNA, 20 bp, mouse
gtacctattctgcacataga

SEQ ID NO: 775995 - DNA, 20 bp, mouse
gatccatctatgtgcagaat

SEQ ID NO: 775996 - DNA, 20 bp, mouse
gtcactgtggaatgctcaac

SEQ ID NO: 775997 - DNA, 20 bp, mouse
ggaactactgcagatcactg

SEQ ID NO: 775998 - DNA, 20 bp, mouse
ggtgatctgcagtagttcta

SEQ ID NO: 775999 - DNA, 20 bp, mouse
gatctgcagtagttctaagg

SEQ ID NO: 776000 - DNA, 20 bp, mouse
gagtatgctcagttagtaga

SEQ ID NO: 776001 - DNA, 20 bp, mouse
gaaggaaaaatttattatac

SEQ ID NO: 776002 - DNA, 20 bp, mouse
gaactgagcatactggtcac

SEQ ID NO: 776003 - DNA, 20 bp, mouse
gcaactaacttatctaatga

SEQ ID NO: 776004 - DNA, 20 bp, mouse
gcattaagatctcaggacaa

SEQ ID NO: 776005 - DNA, 20 bp, mouse
gatgctcagttagtagaggg

SEQ ID NO: 776006 - DNA, 20 bp, mouse
gaaaactgtcagcaaggctg

SEQ ID NO: 776007 - DNA, 20 bp, mouse
gcatcaaataaatggacaag

SEQ ID NO: 776008 - DNA, 20 bp, mouse
gcattcaatggtattgctgt

SEQ ID NO: 776009 - DNA, 20 bp, mouse
gaactgactaagccacctct

SEQ ID NO: 776010 - DNA, 20 bp, mouse
gatagaatttgctttctgta

SEQ ID NO: 776011 - DNA, 20 bp, mouse
gaagtggtcagaagaaccag

SEQ ID NO: 776012 - DNA, 20 bp, mouse
gaaattaatgcaggtcactg

SEQ ID NO: 776013 - DNA, 20 bp, mouse
gcacatctgaaaattaatgc

SEQ ID NO: 776014 - DNA, 20 bp, mouse
gctgagtacaagccattata

SEQ ID NO: 776015 - DNA, 20 bp, mouse
gaggaaaatgatgattgtat

SEQ ID NO: 776016 - DNA, 20 bp, mouse
gttattgggaggaacacagg

SEQ ID NO: 776017 - DNA, 20 bp, mouse
gtgtgaaagactggggtttt

SEQ ID NO: 776018 - DNA, 20 bp, mouse
ggccctctcaggttattggg

SEQ ID NO: 776019 - DNA, 20 bp, mouse
gacagccctctcaggttatt

SEQ ID NO: 776020 - DNA, 20 bp, mouse
gttcctcccaataacctgag

SEQ ID NO: 776021 - DNA, 20 bp, mouse
gcctcagacccacataagga

SEQ ID NO: 776022 - DNA, 20 bp, mouse
gctaactaggtaaggttatc

SEQ ID NO: 776023 - DNA, 20 bp, mouse
gtccatattgtgaaagactg

SEQ ID NO: 776024 - DNA, 20 bp, mouse
gaccccagtctttcacaata

SEQ ID NO: 776025 - DNA, 20 bp, mouse
ggagcacaccatccttatgt

SEQ ID NO: 776026 - DNA, 20 bp, mouse
gtctccttacatcttctaat

SEQ ID NO: 776027 - DNA, 20 bp, mouse
gcttctcccaggaccagaaa

SEQ ID NO: 776028 - DNA, 20 bp, mouse
gtaacctattagaagatgta

SEQ ID NO: 776029 - DNA, 20 bp, mouse
gtgtttagtagcttgacaat

SEQ ID NO: 776030 - DNA, 20 bp, mouse
gaaaaaagaatccttctccc

SEQ ID NO: 776031 - DNA, 20 bp, mouse
gtaaatacatagtttgatgt

SEQ ID NO: 776032 - DNA, 20 bp, mouse
gcacacacatcaattgtttc

SEQ ID NO: 776033 - DNA, 20 bp, mouse
ggagagagagtagtacatgc

SEQ ID NO: 776034 - DNA, 20 bp, mouse
ggaaatgggatgggtggttt

SEQ ID NO: 776035 - DNA, 20 bp, mouse
gagaagatgtaaggagagaa

SEQ ID NO: 776036 - DNA, 20 bp, mouse
gatgaactgaagcctacaga

SEQ ID NO: 776037 - DNA, 20 bp, mouse
ggtcgtgcatgggaccacag

SEQ ID NO: 776038 - DNA, 20 bp, mouse
gtgaggaaggtggatgattc

SEQ ID NO: 776039 - DNA, 20 bp, mouse
gcctctctctcattcagcgt

SEQ ID NO: 776040 - DNA, 20 bp, mouse
gacagagagtgtggccaagc

SEQ ID NO: 776041 - DNA, 20 bp, mouse
ggggtgaggagtctgtccca

SEQ ID NO: 776042 - DNA, 20 bp, mouse
ggaggatgcaggtcgtgcat

SEQ ID NO: 776043 - DNA, 20 bp, mouse
gcttccaagtacagtcgttt

SEQ ID NO: 776044 - DNA, 20 bp, mouse
gcagactcctcaccctctgt

SEQ ID NO: 776045 - DNA, 20 bp, mouse
gcagttcatccgtgtgagga

SEQ ID NO: 776046 - DNA, 20 bp, mouse
gcctgggccaattctggctg

SEQ ID NO: 776047 - DNA, 20 bp, mouse
gagtaaatccatgagtggat

SEQ ID NO: 776048 - DNA, 20 bp, mouse
gccctcacgcccacctgggt

SEQ ID NO: 776049 - DNA, 20 bp, mouse
gtcacaagtaaatccatgag

SEQ ID NO: 776050 - DNA, 20 bp, mouse
gagttggagaaagtgacttg

SEQ ID NO: 776051 - DNA, 20 bp, mouse
ggatcaggaaccatgcttgc

SEQ ID NO: 776052 - DNA, 20 bp, mouse
gagaaagtgacttggggatc

SEQ ID NO: 776053 - DNA, 20 bp, mouse
gggggactgacctgcaagca

SEQ ID NO: 776054 - DNA, 20 bp, mouse
gcaagtctccagtctagtta

SEQ ID NO: 776055 - DNA, 20 bp, mouse
gagcattcctgggccaattc

SEQ ID NO: 776056 - DNA, 20 bp, mouse
gactgccaagagtcgcccca

SEQ ID NO: 776057 - DNA, 20 bp, mouse
gacatgtagaattcaatctg

SEQ ID NO: 776058 - DNA, 20 bp, mouse
gtgctgccattcatagagga

SEQ ID NO: 776059 - DNA, 20 bp, mouse
gaagatcaaggtcttgagaa

SEQ ID NO: 776060 - DNA, 20 bp, mouse
gtattccctggggcgactct

SEQ ID NO: 776061 - DNA, 20 bp, mouse
gtgcaaacacaatattccct

SEQ ID NO: 776062 - DNA, 20 bp, mouse
gtgtgatgtacatacaagaa

SEQ ID NO: 776063 - DNA, 20 bp, mouse
gagacatctcattgtgtgta

SEQ ID NO: 776064 - DNA, 20 bp, mouse
gtcatagaggagggactatt

SEQ ID NO: 776065 - DNA, 20 bp, mouse
gaagagctcttttaagatca

SEQ ID NO: 776066 - DNA, 20 bp, mouse
gaggacagagtaatctaggt

SEQ ID NO: 776067 - DNA, 20 bp, mouse
gtaatctaggtaggtccttg

SEQ ID NO: 776068 - DNA, 20 bp, mouse
gactcaggacagagtaatct

SEQ ID NO: 776069 - DNA, 20 bp, mouse
gttaaagaaagtatcagtga

SEQ ID NO: 776070 - DNA, 20 bp, mouse
gtgcacaccacatgcaaacc

SEQ ID NO: 776071 - DNA, 20 bp, mouse
gtcataaatataagcaaata

SEQ ID NO: 776072 - DNA, 20 bp, mouse
ggcctgaatttaaaacagta

SEQ ID NO: 776073 - DNA, 20 bp, mouse
ggataaatacttctaatgaa

SEQ ID NO: 776074 - DNA, 20 bp, mouse
ggcaatgaacaaatttatga

SEQ ID NO: 776075 - DNA, 20 bp, mouse
gatcaagtttacctacactc

SEQ ID NO: 776076 - DNA, 20 bp, mouse
gacggcacggtcatatctaa

SEQ ID NO: 776077 - DNA, 20 bp, mouse
ggaccgtgccgttaggtatt

SEQ ID NO: 776078 - DNA, 20 bp, mouse
gtttccctgccaattatcaa

SEQ ID NO: 776079 - DNA, 20 bp, mouse
gtcacaaggtgctgcttctt

SEQ ID NO: 776080 - DNA, 20 bp, mouse
gcagacccttgataattggc

SEQ ID NO: 776081 - DNA, 20 bp, mouse
ggtttcagacccttgataat

SEQ ID NO: 776082 - DNA, 20 bp, mouse
gatgcaacatgtgactatca

SEQ ID NO: 776083 - DNA, 20 bp, mouse
ggaccaaatacctaacggca

SEQ ID NO: 776084 - DNA, 20 bp, mouse
gtatctcccaaaaaccagga

SEQ ID NO: 776085 - DNA, 20 bp, mouse
gataaggaagaccttcaaga

SEQ ID NO: 776086 - DNA, 20 bp, mouse
gcaacttcagaagttcactc

SEQ ID NO: 776087 - DNA, 20 bp, mouse
gtctgcttatgcactaggat

SEQ ID NO: 776088 - DNA, 20 bp, mouse
gccctgaatcagtaatctgg

SEQ ID NO: 776089 - DNA, 20 bp, mouse
gatgtctctgcttatgcact

SEQ ID NO: 776090 - DNA, 20 bp, mouse
ggaagttcatgtacaaaata

SEQ ID NO: 776091 - DNA, 20 bp, mouse
gccctccagattactgattc

SEQ ID NO: 776092 - DNA, 20 bp, mouse
gcaggatcctttggaagaag

SEQ ID NO: 776093 - DNA, 20 bp, mouse
ggttcatgtacaaaataggg

SEQ ID NO: 776094 - DNA, 20 bp, mouse
gcaaaagtttgggtgcattc

SEQ ID NO: 776095 - DNA, 20 bp, mouse
gatcttgataattacttatt

SEQ ID NO: 776096 - DNA, 20 bp, mouse
gtgttgctctcattcaagac

SEQ ID NO: 776097 - DNA, 20 bp, mouse
gaatgagagcaacacctcaa

SEQ ID NO: 776098 - DNA, 20 bp, mouse
gaataacaaagatttaatta

SEQ ID NO: 776099 - DNA, 20 bp, mouse
gtaaatttgataaagcatat

SEQ ID NO: 776100 - DNA, 20 bp, mouse
ggagagcagcataagccaca

SEQ ID NO: 776101 - DNA, 20 bp, mouse
gattatcagtggactccttg

SEQ ID NO: 776102 - DNA, 20 bp, mouse
gatccatcttatgactttgt

SEQ ID NO: 776103 - DNA, 20 bp, mouse
gcaggcttctaataacacaa

SEQ ID NO: 776104 - DNA, 20 bp, mouse
gtgatgtcatctggcaagtt

SEQ ID NO: 776105 - DNA, 20 bp, mouse
gggtcccagtgtattatctg

SEQ ID NO: 776106 - DNA, 20 bp, mouse
gagaaggatttggaggatgg

SEQ ID NO: 776107 - DNA, 20 bp, mouse
gagtttaaattctcctggga

SEQ ID NO: 776108 - DNA, 20 bp, mouse
gaaaagcagtggttataaga

SEQ ID NO: 776109 - DNA, 20 bp, mouse
gggttataagaaggatttgg

SEQ ID NO: 776110 - DNA, 20 bp, mouse
ggccctctgttagtctctga

SEQ ID NO: 776111 - DNA, 20 bp, mouse
gatatagtttaaattctcct

SEQ ID NO: 776112 - DNA, 20 bp, mouse
ggttagtctctgaaggcatt

SEQ ID NO: 776113 - DNA, 20 bp, mouse
gtaaaaattaagaccactgc

SEQ ID NO: 776114 - DNA, 20 bp, mouse
gtctggctagttttgacagg

SEQ ID NO: 776115 - DNA, 20 bp, mouse
ggtttctggctagttttgac

SEQ ID NO: 776116 - DNA, 20 bp, mouse
gaattcttgggtgcaggaga

SEQ ID NO: 776117 - DNA, 20 bp, mouse
gcacccaagaattccgtgtc

SEQ ID NO: 776118 - DNA, 20 bp, mouse
ggggacacctgggtcttcgg

SEQ ID NO: 776119 - DNA, 20 bp, mouse
ggacctgacacggaattctt

SEQ ID NO: 776120 - DNA, 20 bp, mouse
gaagacctttggctattctc

SEQ ID NO: 776121 - DNA, 20 bp, mouse
ggggctatagagacctgaca

SEQ ID NO: 776122 - DNA, 20 bp, mouse
gaaggaaggtagggacacct

SEQ ID NO: 776123 - DNA, 20 bp, mouse
gcacctgggtcttcggagga

SEQ ID NO: 776124 - DNA, 20 bp, mouse
gccagagaaaagcgtcatgg

SEQ ID NO: 776125 - DNA, 20 bp, mouse
ggggctcagttcataaacgc

SEQ ID NO: 776126 - DNA, 20 bp, mouse
ggagaagcagcagctctata

SEQ ID NO: 776127 - DNA, 20 bp, mouse
ggaagagtaatctgacaatc

SEQ ID NO: 776128 - DNA, 20 bp, mouse
gagttctgaggcttaatttt

SEQ ID NO: 776129 - DNA, 20 bp, mouse
gttcctggcatgaaattgag

SEQ ID NO: 776130 - DNA, 20 bp, mouse
gcctcagaactcatgattga

SEQ ID NO: 776131 - DNA, 20 bp, mouse
gagaaagcacttgacaacaa

SEQ ID NO: 776132 - DNA, 20 bp, mouse
gatctgacaatcagggttcc

SEQ ID NO: 776133 - DNA, 20 bp, mouse
ggcaatcagactatacatga

SEQ ID NO: 776134 - DNA, 20 bp, mouse
gtcaagtctggaaatgaatt

SEQ ID NO: 776135 - DNA, 20 bp, mouse
gagaacaatatttgatcaga

SEQ ID NO: 776136 - DNA, 20 bp, mouse
gggatccaaactctctaagt

SEQ ID NO: 776137 - DNA, 20 bp, mouse
ggtcatgttcgaagagacat

SEQ ID NO: 776138 - DNA, 20 bp, mouse
gtcatccaacttagagagtt

SEQ ID NO: 776139 - DNA, 20 bp, mouse
gcagctttgatggatcatca

SEQ ID NO: 776140 - DNA, 20 bp, mouse
gataataagaattgtgtaga

SEQ ID NO: 776141 - DNA, 20 bp, mouse
ggcttaaacattagcagcaa

SEQ ID NO: 776142 - DNA, 20 bp, mouse
gtaaatataaccattgataa

SEQ ID NO: 776143 - DNA, 20 bp, mouse
gcatttctttcgttgctact

SEQ ID NO: 776144 - DNA, 20 bp, mouse
gaagaaaagaatgttcacct

SEQ ID NO: 776145 - DNA, 20 bp, mouse
ggaaaaaatttaaattagtg

SEQ ID NO: 776146 - DNA, 20 bp, mouse
ggtactttttaagtactata

SEQ ID NO: 776147 - DNA, 20 bp, mouse
gataacaattaagtttacaa

SEQ ID NO: 776148 - DNA, 20 bp, mouse
gtagtacttaaaaagtacat

SEQ ID NO: 776149 - DNA, 20 bp, mouse
gagcacttgtttaatacaaa

SEQ ID NO: 776150 - DNA, 20 bp, mouse
gtgtagctgtttttgataat

SEQ ID NO: 776151 - DNA, 20 bp, mouse
gattgaacaacaatccaaac

SEQ ID NO: 776152 - DNA, 20 bp, mouse
gtgcaaaacaaaatgtgctt

SEQ ID NO: 776153 - DNA, 20 bp, mouse
gacatgaattgactgttgtt

SEQ ID NO: 776154 - DNA, 20 bp, mouse
gctagactgcaatcaccaaa

SEQ ID NO: 776155 - DNA, 20 bp, mouse
gttgactgttgttaggcaca

SEQ ID NO: 776156 - DNA, 20 bp, mouse
gcataactacaagtaatcaa

SEQ ID NO: 776157 - DNA, 20 bp, mouse
ggggtgctataataaattag

SEQ ID NO: 776158 - DNA, 20 bp, mouse
gaaatagaaaacatttgaaa

SEQ ID NO: 776159 - DNA, 20 bp, mouse
gaatttaatttgtacatgga

SEQ ID NO: 776160 - DNA, 20 bp, mouse
gatatcacatccagcatata

SEQ ID NO: 776161 - DNA, 20 bp, mouse
gtacaagtaatcaaaggaac

SEQ ID NO: 776162 - DNA, 20 bp, mouse
gtcagaatttaatttgtaca

SEQ ID NO: 776163 - DNA, 20 bp, mouse
gaaacagaataatggaaaaa

SEQ ID NO: 776164 - DNA, 20 bp, mouse
gaataaagatgaagattaaa

SEQ ID NO: 776165 - DNA, 20 bp, mouse
gttcatataaccttatatgc

SEQ ID NO: 776166 - DNA, 20 bp, mouse
gcaagtaatcaaagaaacag

SEQ ID NO: 776167 - DNA, 20 bp, mouse
gggggactacaataaattag

SEQ ID NO: 776168 - DNA, 20 bp, mouse
gaatttaatttgtacattga

SEQ ID NO: 776169 - DNA, 20 bp, mouse
gtgtctgttttaaaaaacac

SEQ ID NO: 776170 - DNA, 20 bp, mouse
gaaacagaataatggaaaaa

SEQ ID NO: 776171 - DNA, 20 bp, mouse
gaataaagatgaagattaaa

SEQ ID NO: 776172 - DNA, 20 bp, mouse
gttcatataacattatatgc

SEQ ID NO: 776173 - DNA, 20 bp, mouse
gtattatttgaaaagataaa

SEQ ID NO: 776174 - DNA, 20 bp, mouse
gttctatgtaaacagaataa

SEQ ID NO: 776175 - DNA, 20 bp, mouse
ggaaatagaaaacacttgaa

SEQ ID NO: 776176 - DNA, 20 bp, mouse
gttcaaagatgagtagtggt

SEQ ID NO: 776177 - DNA, 20 bp, mouse
gtcatgaagaattgagtaga

SEQ ID NO: 776178 - DNA, 20 bp, mouse
ggaagtatggaaagaaaact

SEQ ID NO: 776179 - DNA, 20 bp, mouse
gtactggcagtgtttgaaaa

SEQ ID NO: 776180 - DNA, 20 bp, mouse
gcaaagcttgaatatttttg

SEQ ID NO: 776181 - DNA, 20 bp, mouse
gatgaaatttatggccacaa

SEQ ID NO: 776182 - DNA, 20 bp, mouse
gctgtaattattaacactac

SEQ ID NO: 776183 - DNA, 20 bp, mouse
gataagatttttttttaata

SEQ ID NO: 776184 - DNA, 20 bp, mouse
gccagagctgttttccattg

SEQ ID NO: 776185 - DNA, 20 bp, mouse
gtactagcattccctgatta

SEQ ID NO: 776186 - DNA, 20 bp, mouse
ggaatcgtaatcaatcagtt

SEQ ID NO: 776187 - DNA, 20 bp, mouse
gattataaaaagtataactg

SEQ ID NO: 776188 - DNA, 20 bp, mouse
gtcaatcagttaggtaagtt

SEQ ID NO: 776189 - DNA, 20 bp, mouse
gagtgctctttccatacttc

SEQ ID NO: 776190 - DNA, 20 bp, mouse
ggtcaaagatgagtagaggt

SEQ ID NO: 776191 - DNA, 20 bp, mouse
gtatatgagacttttttatg

SEQ ID NO: 776192 - DNA, 20 bp, mouse
gctttttataattctgtaca

SEQ ID NO: 776193 - DNA, 20 bp, mouse
gatcaagcaacacagctatg

SEQ ID NO: 776194 - DNA, 20 bp, mouse
gccagagctgttttgcattg

SEQ ID NO: 776195 - DNA, 20 bp, mouse
gtactagcattccctgatta

SEQ ID NO: 776196 - DNA, 20 bp, mouse
gaatcactttgtttaatttc

SEQ ID NO: 776197 - DNA, 20 bp, mouse
gttcaaggatgactagtggc

SEQ ID NO: 776198 - DNA, 20 bp, mouse
gagtgtaatgtaatgttgaa

SEQ ID NO: 776199 - DNA, 20 bp, mouse
gcctattcaaggatgactag

SEQ ID NO: 776200 - DNA, 20 bp, mouse
gtgtccttctttcctattca

SEQ ID NO: 776201 - DNA, 20 bp, mouse
gacatagcgtgtttatgcga

SEQ ID NO: 776202 - DNA, 20 bp, mouse
gcaaagtgaacagaatcacc

SEQ ID NO: 776203 - DNA, 20 bp, mouse
gattaaacaaagtgattaaa

SEQ ID NO: 776204 - DNA, 20 bp, mouse
gccagagctgcctctcttta

SEQ ID NO: 776205 - DNA, 20 bp, mouse
gatgtatatataattgagaa

SEQ ID NO: 776206 - DNA, 20 bp, mouse
gaagtgtaaacaatataatg

SEQ ID NO: 776207 - DNA, 20 bp, mouse
gtgagagatgagatggtgat

SEQ ID NO: 776208 - DNA, 20 bp, mouse
gaacacagtaatttgaaagc

SEQ ID NO: 776209 - DNA, 20 bp, mouse
gtaaccaaaatgctaaaaca

SEQ ID NO: 776210 - DNA, 20 bp, mouse
gaagaaaatattaccatcac

SEQ ID NO: 776211 - DNA, 20 bp, mouse
ggtgttctttagcacatact

SEQ ID NO: 776212 - DNA, 20 bp, mouse
gtatattgctaggccagtga

SEQ ID NO: 776213 - DNA, 20 bp, mouse
gaatatttcaaatttgggga

SEQ ID NO: 776214 - DNA, 20 bp, mouse
gggttaatatttcaaatttg

SEQ ID NO: 776215 - DNA, 20 bp, mouse
gaaacactgaaatggagttt

SEQ ID NO: 776216 - DNA, 20 bp, mouse
gggaccatgctccagtaaag

SEQ ID NO: 776217 - DNA, 20 bp, mouse
gaaagtcccggatctatcag

SEQ ID NO: 776218 - DNA, 20 bp, mouse
gtctgtctattcagatttgt

SEQ ID NO: 776219 - DNA, 20 bp, mouse
ggagaatgggcacaaagtcc

SEQ ID NO: 776220 - DNA, 20 bp, mouse
gaagttatcaagcattattt

SEQ ID NO: 776221 - DNA, 20 bp, mouse
gctggaggctacattgttaa

SEQ ID NO: 776222 - DNA, 20 bp, mouse
gtggagcatggtccacttac

SEQ ID NO: 776223 - DNA, 20 bp, mouse
ggcacatattaaaaactata

SEQ ID NO: 776224 - DNA, 20 bp, mouse
gatagtgcctctgatagatc

SEQ ID NO: 776225 - DNA, 20 bp, mouse
gcaatgtagcctccagtaag

SEQ ID NO: 776226 - DNA, 20 bp, mouse
ggaagagcatgaaacaagct

SEQ ID NO: 776227 - DNA, 20 bp, mouse
gacagtctgtgtttacttgt

SEQ ID NO: 776228 - DNA, 20 bp, mouse
gttgaagtaaacagcatgac

SEQ ID NO: 776229 - DNA, 20 bp, mouse
ggatgaatatcttttatgtg

SEQ ID NO: 776230 - DNA, 20 bp, mouse
gggaatatatgaaaaaacta

SEQ ID NO: 776231 - DNA, 20 bp, mouse
ggattttattactgataaca

SEQ ID NO: 776232 - DNA, 20 bp, mouse
gatacaaattttagtgatat

SEQ ID NO: 776233 - DNA, 20 bp, mouse
ggcttttattattgatcaca

SEQ ID NO: 776234 - DNA, 20 bp, mouse
ggtgatattggattatttta

SEQ ID NO: 776235 - DNA, 20 bp, mouse
ggagatatatggatggattt

SEQ ID NO: 776236 - DNA, 20 bp, mouse
ggtacttcacggaacagctg

SEQ ID NO: 776237 - DNA, 20 bp, mouse
gaaggctatcctatttacac

SEQ ID NO: 776238 - DNA, 20 bp, mouse
gtttactgggactgatggga

SEQ ID NO: 776239 - DNA, 20 bp, mouse
gataatgatgatgatagcta

SEQ ID NO: 776240 - DNA, 20 bp, mouse
gtttgataagatatagaaaa

SEQ ID NO: 776241 - DNA, 20 bp, mouse
gtagctttactgggactgat

SEQ ID NO: 776242 - DNA, 20 bp, mouse
gtgagaacactagctttact

SEQ ID NO: 776243 - DNA, 20 bp, mouse
gtatatcttatcaaagaggt

SEQ ID NO: 776244 - DNA, 20 bp, mouse
gtgattatacaatattagtg

SEQ ID NO: 776245 - DNA, 20 bp, mouse
gcattatttagataaacaga

SEQ ID NO: 776246 - DNA, 20 bp, mouse
gcaggaggactctaggtagc

SEQ ID NO: 776247 - DNA, 20 bp, mouse
ggaggactctaggtagccgg

SEQ ID NO: 776248 - DNA, 20 bp, mouse
gccagcattggttgtttaag

SEQ ID NO: 776249 - DNA, 20 bp, mouse
gaacatgggtatagtcagac

SEQ ID NO: 776250 - DNA, 20 bp, mouse
gaatgtgaaccctgaaacat

SEQ ID NO: 776251 - DNA, 20 bp, mouse
gtcagacaggtttgttatga

SEQ ID NO: 776252 - DNA, 20 bp, mouse
gtcctcctgaaaatgctttt

SEQ ID NO: 776253 - DNA, 20 bp, mouse
gatgctgggtaatacttcaa

SEQ ID NO: 776254 - DNA, 20 bp, mouse
gtgactatacccatgtttca

SEQ ID NO: 776255 - DNA, 20 bp, mouse
gactgctagatagatccaag

SEQ ID NO: 776256 - DNA, 20 bp, mouse
ggggaaacataatctcttcc

SEQ ID NO: 776257 - DNA, 20 bp, mouse
gggtttaatttccattgccc

SEQ ID NO: 776258 - DNA, 20 bp, mouse
gctcgtaaatatattttaca

SEQ ID NO: 776259 - DNA, 20 bp, mouse
gttttacaggggactggatg

SEQ ID NO: 776260 - DNA, 20 bp, mouse
gacaaaatacatcttctgta

SEQ ID NO: 776261 - DNA, 20 bp, mouse
gggaaaaatgaaatgttctc

SEQ ID NO: 776262 - DNA, 20 bp, mouse
gtaatagatttcattgctct

SEQ ID NO: 776263 - DNA, 20 bp, mouse
gaatatattttacaggggac

SEQ ID NO: 776264 - DNA, 20 bp, mouse
gctgttgtttgattcaagaa

SEQ ID NO: 776265 - DNA, 20 bp, mouse
ggtggtttccagcattctta

SEQ ID NO: 776266 - DNA, 20 bp, mouse
ggccctaaaagaaattggtt

SEQ ID NO: 776267 - DNA, 20 bp, mouse
gtaatgctgagacaaaggtg

SEQ ID NO: 776268 - DNA, 20 bp, mouse
gtagcttctacatttcataa

SEQ ID NO: 776269 - DNA, 20 bp, mouse
gtaaagatttctagttaaga

SEQ ID NO: 776270 - DNA, 20 bp, mouse
gtgaagacttaaatccatac

SEQ ID NO: 776271 - DNA, 20 bp, mouse
gaccaaaccaatttctttta

SEQ ID NO: 776272 - DNA, 20 bp, mouse
ggtaaaagattctgttgttt

SEQ ID NO: 776273 - DNA, 20 bp, mouse
ggttttctagacatcagtta

SEQ ID NO: 776274 - DNA, 20 bp, mouse
gaaaatatcctcagaaaatg

SEQ ID NO: 776275 - DNA, 20 bp, mouse
gtggactaatgctgagacaa

SEQ ID NO: 776276 - DNA, 20 bp, mouse
gtagctgccccaatgggtgg

SEQ ID NO: 776277 - DNA, 20 bp, mouse
gacacaggggtaatggaaga

SEQ ID NO: 776278 - DNA, 20 bp, mouse
gcagttcccaccacccattg

SEQ ID NO: 776279 - DNA, 20 bp, mouse
gtgcatattagctgccccaa

SEQ ID NO: 776280 - DNA, 20 bp, mouse
gaaacaatgtcgatattttg

SEQ ID NO: 776281 - DNA, 20 bp, mouse
gtattagctgccccaatggg

SEQ ID NO: 776282 - DNA, 20 bp, mouse
gtaactacaaaagtcagtat

SEQ ID NO: 776283 - DNA, 20 bp, mouse
gaagtaagcttttacatgta

SEQ ID NO: 776284 - DNA, 20 bp, mouse
gcatcattaatagattacac

SEQ ID NO: 776285 - DNA, 20 bp, mouse
gaagctaatatttggctttc

SEQ ID NO: 776286 - DNA, 20 bp, mouse
gtataaggatcaaacctcac

SEQ ID NO: 776287 - DNA, 20 bp, mouse
gcagaatttaacccacatgg

SEQ ID NO: 776288 - DNA, 20 bp, mouse
gtaggggaaatgaataaata

SEQ ID NO: 776289 - DNA, 20 bp, mouse
gttgaatgtgagtaaattag

SEQ ID NO: 776290 - DNA, 20 bp, mouse
gtctcagaatttaacccaca

SEQ ID NO: 776291 - DNA, 20 bp, mouse
ggatgaccttgtattaaagt

SEQ ID NO: 776292 - DNA, 20 bp, mouse
gacattacatccttcctata

SEQ ID NO: 776293 - DNA, 20 bp, mouse
gaaaaacccatatgattaca

SEQ ID NO: 776294 - DNA, 20 bp, mouse
gtgatagtgagtatgtgtgt

SEQ ID NO: 776295 - DNA, 20 bp, mouse
gatactcactatcatattga

SEQ ID NO: 776296 - DNA, 20 bp, mouse
gttctcagcaacaatgctat

SEQ ID NO: 776297 - DNA, 20 bp, mouse
ggaagaagacaggggtagat

SEQ ID NO: 776298 - DNA, 20 bp, mouse
gcattatattgactgatcaa

SEQ ID NO: 776299 - DNA, 20 bp, mouse
ggggtgattaacatgggatc

SEQ ID NO: 776300 - DNA, 20 bp, mouse
ggaatcactaggctagactc

SEQ ID NO: 776301 - DNA, 20 bp, mouse
gcccttgccagacatttctc

SEQ ID NO: 776302 - DNA, 20 bp, mouse
gcatatacattccagggtat

SEQ ID NO: 776303 - DNA, 20 bp, mouse
gtatatgtattcctttgaag

SEQ ID NO: 776304 - DNA, 20 bp, mouse
gtccaagagaaacgttaaaa

SEQ ID NO: 776305 - DNA, 20 bp, mouse
gcaaataggaaacacttttc

SEQ ID NO: 776306 - DNA, 20 bp, mouse
gctcatgctggttgtagttt

SEQ ID NO: 776307 - DNA, 20 bp, mouse
gcaggttgggatagtctagg

SEQ ID NO: 776308 - DNA, 20 bp, mouse
gtaggtgggatagtctaaga

SEQ ID NO: 776309 - DNA, 20 bp, mouse
gtcaaagagaaattacatcc

SEQ ID NO: 776310 - DNA, 20 bp, mouse
gcaacaggttgggatagtct

SEQ ID NO: 776311 - DNA, 20 bp, mouse
gacaaaagatactacccaaa

SEQ ID NO: 776312 - DNA, 20 bp, mouse
gaaatgagcaatgtgacaac

SEQ ID NO: 776313 - DNA, 20 bp, mouse
ggtgacttgaaaacatttcc

SEQ ID NO: 776314 - DNA, 20 bp, mouse
gtaatcttaaatcctcatgc

SEQ ID NO: 776315 - DNA, 20 bp, mouse
gtactacccaaaaggccaac

SEQ ID NO: 776316 - DNA, 20 bp, mouse
gttaaacttgttctactcat

SEQ ID NO: 776317 - DNA, 20 bp, mouse
gaaggccatcgtcaactatg

SEQ ID NO: 776318 - DNA, 20 bp, mouse
gctattatgcagcacataat

SEQ ID NO: 776319 - DNA, 20 bp, mouse
gcttgctatggaatttaatg

SEQ ID NO: 776320 - DNA, 20 bp, mouse
gctcacctcatagttgacga

SEQ ID NO: 776321 - DNA, 20 bp, mouse
gtatcagtctatgcttgcta

SEQ ID NO: 776322 - DNA, 20 bp, mouse
gtacatcaaagaatattttt

SEQ ID NO: 776323 - DNA, 20 bp, mouse
gtacacatgatcattatccc

SEQ ID NO: 776324 - DNA, 20 bp, mouse
gttgattgattgattaaaac

SEQ ID NO: 776325 - DNA, 20 bp, mouse
gtggtgaatctccagtgctt

SEQ ID NO: 776326 - DNA, 20 bp, mouse
gatcgcctatagtctgtctg

SEQ ID NO: 776327 - DNA, 20 bp, mouse
ggattcctcagacagactat

SEQ ID NO: 776328 - DNA, 20 bp, mouse
gtctgaggaatcaagtacac

SEQ ID NO: 776329 - DNA, 20 bp, mouse
ggatttgtagtttaatccga

SEQ ID NO: 776330 - DNA, 20 bp, mouse
gctataggcgatttttaaaa

SEQ ID NO: 776331 - DNA, 20 bp, mouse
gtataatcagaacaaaaata

SEQ ID NO: 776332 - DNA, 20 bp, mouse
ggatactgattatcttaaat

SEQ ID NO: 776333 - DNA, 20 bp, mouse
gttttgcatatgaaacctgt

SEQ ID NO: 776334 - DNA, 20 bp, mouse
gggtattcagtattacaact

SEQ ID NO: 776335 - DNA, 20 bp, mouse
gaaatagaaataggttaatg

SEQ ID NO: 776336 - DNA, 20 bp, mouse
ggaagtggactggctgatta

SEQ ID NO: 776337 - DNA, 20 bp, mouse
ggctgattatggaccagaat

SEQ ID NO: 776338 - DNA, 20 bp, mouse
gcattggtgtaaatagacta

SEQ ID NO: 776339 - DNA, 20 bp, mouse
gttaataactactggatatc

SEQ ID NO: 776340 - DNA, 20 bp, mouse
gcagtccacttctattccat

SEQ ID NO: 776341 - DNA, 20 bp, mouse
gctgccaaaacaagattctg

SEQ ID NO: 776342 - DNA, 20 bp, mouse
gaatatttaaacccccattc

SEQ ID NO: 776343 - DNA, 20 bp, mouse
gcattttaagcataggttga

SEQ ID NO: 776344 - DNA, 20 bp, mouse
ggatccacagaatcttgttt

SEQ ID NO: 776345 - DNA, 20 bp, mouse
gcagttctgtggatctagcc

SEQ ID NO: 776346 - DNA, 20 bp, mouse
gtggagccttattgttttct

SEQ ID NO: 776347 - DNA, 20 bp, mouse
gtcatctgtacaatatatat

SEQ ID NO: 776348 - DNA, 20 bp, mouse
gatacacttgagtttagtgt

SEQ ID NO: 776349 - DNA, 20 bp, mouse
gtttcatgtgctgcgcttgc

SEQ ID NO: 776350 - DNA, 20 bp, mouse
gatatattgtacagatgatg

SEQ ID NO: 776351 - DNA, 20 bp, mouse
gtatatcaatgatattattt

SEQ ID NO: 776352 - DNA, 20 bp, mouse
gtgtattctatgcttgacaa

SEQ ID NO: 776353 - DNA, 20 bp, mouse
gtggttatgcagcacagaat

SEQ ID NO: 776354 - DNA, 20 bp, mouse
gtgaaagagaaacagatgac

SEQ ID NO: 776355 - DNA, 20 bp, mouse
ggatgaagaaatagtcatcc

SEQ ID NO: 776356 - DNA, 20 bp, mouse
gcaggtgtgttaggcgatta

SEQ ID NO: 776357 - DNA, 20 bp, mouse
ggcataaatcagtatatcaa

SEQ ID NO: 776358 - DNA, 20 bp, mouse
gtatcaagggatattatttt

SEQ ID NO: 776359 - DNA, 20 bp, mouse
gcacctaaaaacaaatgcac

SEQ ID NO: 776360 - DNA, 20 bp, mouse
gctggatattcagaaatgag

SEQ ID NO: 776361 - DNA, 20 bp, mouse
gacccagtgcatttgttttt

SEQ ID NO: 776362 - DNA, 20 bp, mouse
gaataatctgtgattgacaa

SEQ ID NO: 776363 - DNA, 20 bp, mouse
gtagttatgcagcacagaat

SEQ ID NO: 776364 - DNA, 20 bp, mouse
gtgaaagagaaacagatgac

SEQ ID NO: 776365 - DNA, 20 bp, mouse
ggataaagaaatagtcatcc

SEQ ID NO: 776366 - DNA, 20 bp, mouse
gtgggtgacaaaaagaagag

SEQ ID NO: 776367 - DNA, 20 bp, mouse
gctagtctacttatatcagt

SEQ ID NO: 776368 - DNA, 20 bp, mouse
gctacattcgagtttagctt

SEQ ID NO: 776369 - DNA, 20 bp, mouse
gttgctgaatatccagtgct

SEQ ID NO: 776370 - DNA, 20 bp, mouse
ggcttataatggtgtttgat

SEQ ID NO: 776371 - DNA, 20 bp, mouse
gaagcatagattaatataat

SEQ ID NO: 776372 - DNA, 20 bp, mouse
gtaatataattggtatatcc

SEQ ID NO: 776373 - DNA, 20 bp, mouse
gattctttttttccaagcac

SEQ ID NO: 776374 - DNA, 20 bp, mouse
gtgtagtatatagttcatga

SEQ ID NO: 776375 - DNA, 20 bp, mouse
gctggatattcagcaatgaa

SEQ ID NO: 776376 - DNA, 20 bp, mouse
gaattatcttgtgccactgg

SEQ ID NO: 776377 - DNA, 20 bp, mouse
gagtggcacaagataattct

SEQ ID NO: 776378 - DNA, 20 bp, mouse
gtttaatttaataggataga

SEQ ID NO: 776379 - DNA, 20 bp, mouse
gggaataaatttccaagctg

SEQ ID NO: 776380 - DNA, 20 bp, mouse
gagaaaaatgcaaacatgtt

SEQ ID NO: 776381 - DNA, 20 bp, mouse
gaaatgaagtatacatgcaa

SEQ ID NO: 776382 - DNA, 20 bp, mouse
gaatttattccaagtatgtt

SEQ ID NO: 776383 - DNA, 20 bp, mouse
gcaaattgaaatccacagct

SEQ ID NO: 776384 - DNA, 20 bp, mouse
gtttttattcccaacatact

SEQ ID NO: 776385 - DNA, 20 bp, mouse
gtagagggatgtgtagaaat

SEQ ID NO: 776386 - DNA, 20 bp, mouse
ggtgtccaaagattctacaa

SEQ ID NO: 776387 - DNA, 20 bp, mouse
ggagagcagctctggatagg

SEQ ID NO: 776388 - DNA, 20 bp, mouse
ggcagctctggataggagga

SEQ ID NO: 776389 - DNA, 20 bp, mouse
gctgtcctttgtagaatctt

SEQ ID NO: 776390 - DNA, 20 bp, mouse
gagtatctatggaactcccc

SEQ ID NO: 776391 - DNA, 20 bp, mouse
gattgaaagagttcacttaa

SEQ ID NO: 776392 - DNA, 20 bp, mouse
gtccatagatactaaactaa

SEQ ID NO: 776393 - DNA, 20 bp, mouse
gttgtctaactgcaaggtga

SEQ ID NO: 776394 - DNA, 20 bp, mouse
ggcctttagtttagtatcta

SEQ ID NO: 776395 - DNA, 20 bp, mouse
gtttaccttgtctaactgca

SEQ ID NO: 776396 - DNA, 20 bp, mouse
gagactaactttagaatcaa

SEQ ID NO: 776397 - DNA, 20 bp, mouse
gttttgtgagtgtttgtcgg

SEQ ID NO: 776398 - DNA, 20 bp, mouse
gaagttttgtgagtgtttgt

SEQ ID NO: 776399 - DNA, 20 bp, mouse
ggcatacatgtcctcggatt

SEQ ID NO: 776400 - DNA, 20 bp, mouse
gtcatcagcaccagcaaaac

SEQ ID NO: 776401 - DNA, 20 bp, mouse
gtttggagctgcttttgtta

SEQ ID NO: 776402 - DNA, 20 bp, mouse
gtttggaaatgatggcactt

SEQ ID NO: 776403 - DNA, 20 bp, mouse
ggactttgcacaaatttcaa

SEQ ID NO: 776404 - DNA, 20 bp, mouse
gataatagcatacatgtcct

SEQ ID NO: 776405 - DNA, 20 bp, mouse
gggcaaaaaaatattttttt

SEQ ID NO: 776406 - DNA, 20 bp, mouse
ggaaaagaaagttgtatcat

SEQ ID NO: 776407 - DNA, 20 bp, mouse
gcctgagataggagtcaaaa

SEQ ID NO: 776408 - DNA, 20 bp, mouse
ggcagatgatagggactgta

SEQ ID NO: 776409 - DNA, 20 bp, mouse
gtaggagtcaaaagggatct

SEQ ID NO: 776410 - DNA, 20 bp, mouse
ggaaatacatgcagatgata

SEQ ID NO: 776411 - DNA, 20 bp, mouse
gtccagccaagtctagagcc

SEQ ID NO: 776412 - DNA, 20 bp, mouse
gagcatacaggttagtgttg

SEQ ID NO: 776413 - DNA, 20 bp, mouse
gctaggccctggtgctcaaa

SEQ ID NO: 776414 - DNA, 20 bp, mouse
gtctaagtgctatagcatac

SEQ ID NO: 776415 - DNA, 20 bp, mouse
gttgtgtagtgcagaagtaa

SEQ ID NO: 776416 - DNA, 20 bp, mouse
gtttagaaaaagactaactt

SEQ ID NO: 776417 - DNA, 20 bp, mouse
gagactaactttggagccaa

SEQ ID NO: 776418 - DNA, 20 bp, mouse
gatttctgagtatgtccctt

SEQ ID NO: 776419 - DNA, 20 bp, mouse
gacatgcatatcttcacatt

SEQ ID NO: 776420 - DNA, 20 bp, mouse
gtttggatgtgatatcactt

SEQ ID NO: 776421 - DNA, 20 bp, mouse
gtaccactctctaagcataa

SEQ ID NO: 776422 - DNA, 20 bp, mouse
gttttgtgagtgtttttctt

SEQ ID NO: 776423 - DNA, 20 bp, mouse
gtataattatttttttattc

SEQ ID NO: 776424 - DNA, 20 bp, mouse
gttatttataactgtttttc

SEQ ID NO: 776425 - DNA, 20 bp, mouse
gttatttttttattctggct

SEQ ID NO: 776426 - DNA, 20 bp, mouse
ggcaagttctgatccagaag

SEQ ID NO: 776427 - DNA, 20 bp, mouse
gggagctttgtctagttggt

SEQ ID NO: 776428 - DNA, 20 bp, mouse
gaacaggacaaatattcatt

SEQ ID NO: 776429 - DNA, 20 bp, mouse
gttttggagctttgtctagt

SEQ ID NO: 776430 - DNA, 20 bp, mouse
gagggtgaaagttccaaatg

SEQ ID NO: 776431 - DNA, 20 bp, mouse
gcagaacttgctatgcatat

SEQ ID NO: 776432 - DNA, 20 bp, mouse
ggctcttacatcttgcatgt

SEQ ID NO: 776433 - DNA, 20 bp, mouse
gctcactacacagccccttc

SEQ ID NO: 776434 - DNA, 20 bp, mouse
gaggaggtgagaacagctta

SEQ ID NO: 776435 - DNA, 20 bp, mouse
gctcaggcaagagttaaagg

SEQ ID NO: 776436 - DNA, 20 bp, mouse
ggatggctcttcattatgat

SEQ ID NO: 776437 - DNA, 20 bp, mouse
gaggacgaaagtcaaagccc

SEQ ID NO: 776438 - DNA, 20 bp, mouse
gaagcagagcgtaggagacc

SEQ ID NO: 776439 - DNA, 20 bp, mouse
gatctctgaacatcagagtt

SEQ ID NO: 776440 - DNA, 20 bp, mouse
gtggaagcggatcaagagat

SEQ ID NO: 776441 - DNA, 20 bp, mouse
gcgaactggcagagaaaatc

SEQ ID NO: 776442 - DNA, 20 bp, mouse
gcgtggggcaagccaagcct

SEQ ID NO: 776443 - DNA, 20 bp, mouse
gcacgtcttaggaaagcgtc

SEQ ID NO: 776444 - DNA, 20 bp, mouse
gaaggagcaagagaaataac

SEQ ID NO: 776445 - DNA, 20 bp, mouse
gcagttcgttaggttgacac

SEQ ID NO: 776446 - DNA, 20 bp, mouse
gaacagctgcacatcacaga

SEQ ID NO: 776447 - DNA, 20 bp, mouse
gtctgagataggtcaactaa

SEQ ID NO: 776448 - DNA, 20 bp, mouse
gatgttaaaagtcagttcag

SEQ ID NO: 776449 - DNA, 20 bp, mouse
gaggacgatgatgcaattga

SEQ ID NO: 776450 - DNA, 20 bp, mouse
gtgacctatctcagaaatca

SEQ ID NO: 776451 - DNA, 20 bp, mouse
ggtccatagcatccataatg

SEQ ID NO: 776452 - DNA, 20 bp, mouse
ggctgaaaacaaaggggcct

SEQ ID NO: 776453 - DNA, 20 bp, mouse
gatagccatcctaagctact

SEQ ID NO: 776454 - DNA, 20 bp, mouse
gacttgactgactgagtccc

SEQ ID NO: 776455 - DNA, 20 bp, mouse
ggatgatgcaattgaaggga

SEQ ID NO: 776456 - DNA, 20 bp, mouse
gtgcaatagcgaaaatctac

SEQ ID NO: 776457 - DNA, 20 bp, mouse
gaattcataggtatttctgg

SEQ ID NO: 776458 - DNA, 20 bp, mouse
gtttctgtacttacattttg

SEQ ID NO: 776459 - DNA, 20 bp, mouse
gtacacttttccttcctagc

SEQ ID NO: 776460 - DNA, 20 bp, mouse
gaaatataattatgagacat

SEQ ID NO: 776461 - DNA, 20 bp, mouse
gtgaaattcataggtatttc

SEQ ID NO: 776462 - DNA, 20 bp, mouse
ggaaattgaaatgtttttag

SEQ ID NO: 776463 - DNA, 20 bp, mouse
gacttctgtattgtagcaga

SEQ ID NO: 776464 - DNA, 20 bp, mouse
gcaattccttaaacattatc

SEQ ID NO: 776465 - DNA, 20 bp, mouse
gtacagcaaatgtaatacag

SEQ ID NO: 776466 - DNA, 20 bp, mouse
gccagggagaggaaccctga

SEQ ID NO: 776467 - DNA, 20 bp, mouse
gaggaaccctgagggctgtg

SEQ ID NO: 776468 - DNA, 20 bp, mouse
gtggatccccacagccctca

SEQ ID NO: 776469 - DNA, 20 bp, mouse
gactgctgtggtgtgctcca

SEQ ID NO: 776470 - DNA, 20 bp, mouse
gtgtggtgtgctccagggag

SEQ ID NO: 776471 - DNA, 20 bp, mouse
gcttgctgaggaagatgctg

SEQ ID NO: 776472 - DNA, 20 bp, mouse
gcagaggcagacagtgggtg

SEQ ID NO: 776473 - DNA, 20 bp, mouse
ggatgctggggatgctgaac

SEQ ID NO: 776474 - DNA, 20 bp, mouse
gccactcagaggcagacagt

SEQ ID NO: 776475 - DNA, 20 bp, mouse
gagcaagagcaggagatgac

SEQ ID NO: 776476 - DNA, 20 bp, mouse
ggcctgggaaagctcatggt

SEQ ID NO: 776477 - DNA, 20 bp, mouse
gaccgaccatgagctttccc

SEQ ID NO: 776478 - DNA, 20 bp, mouse
gataggatataaatgggaat

SEQ ID NO: 776479 - DNA, 20 bp, mouse
ggaaaatgggccattagcct

SEQ ID NO: 776480 - DNA, 20 bp, mouse
ggctgcattaaagtctctct

SEQ ID NO: 776481 - DNA, 20 bp, mouse
gatgagctttcccaggctaa

SEQ ID NO: 776482 - DNA, 20 bp, mouse
ggcgggggcgacttttcttg

SEQ ID NO: 776483 - DNA, 20 bp, mouse
gatattagacattgtttgtg

SEQ ID NO: 776484 - DNA, 20 bp, mouse
gttctttcataggatataaa

SEQ ID NO: 776485 - DNA, 20 bp, mouse
ggcagatatttcttttatgc

SEQ ID NO: 776486 - DNA, 20 bp, mouse
ggaaggaaggggacttataa

SEQ ID NO: 776487 - DNA, 20 bp, mouse
ggggacttataaaggtctag

SEQ ID NO: 776488 - DNA, 20 bp, mouse
gagaaatggctgtactctct

SEQ ID NO: 776489 - DNA, 20 bp, mouse
gacagatatgtcttttatgt

SEQ ID NO: 776490 - DNA, 20 bp, mouse
gactcacaagaccccattct

SEQ ID NO: 776491 - DNA, 20 bp, mouse
gaaaggatataaataggaat

SEQ ID NO: 776492 - DNA, 20 bp, mouse
ggcttagtaagcccagaatg

SEQ ID NO: 776493 - DNA, 20 bp, mouse
ggtgagtcttgtaactgtct

SEQ ID NO: 776494 - DNA, 20 bp, mouse
gttagccatttcctgctaga

SEQ ID NO: 776495 - DNA, 20 bp, mouse
ggaccaacatcccatttgct

SEQ ID NO: 776496 - DNA, 20 bp, mouse
gggtagaagtcagaaaatgg

SEQ ID NO: 776497 - DNA, 20 bp, mouse
ggtcagcatgagggatcatt

SEQ ID NO: 776498 - DNA, 20 bp, mouse
ggtggtcagggtgtattgtg

SEQ ID NO: 776499 - DNA, 20 bp, mouse
ggtagctgactagcagttaa

SEQ ID NO: 776500 - DNA, 20 bp, mouse
gttagcacatatcaggagag

SEQ ID NO: 776501 - DNA, 20 bp, mouse
gataaggattgtcagcatga

SEQ ID NO: 776502 - DNA, 20 bp, mouse
gtgctagtcagctaccaccc

SEQ ID NO: 776503 - DNA, 20 bp, mouse
gataataggaaactaagagc

SEQ ID NO: 776504 - DNA, 20 bp, mouse
ggaagtgttcagagttaatg

SEQ ID NO: 776505 - DNA, 20 bp, mouse
ggtgctaataaaatgttacc

SEQ ID NO: 776506 - DNA, 20 bp, mouse
gagttatcaggagttctttt

SEQ ID NO: 776507 - DNA, 20 bp, mouse
gaaagaactccagagttatc

SEQ ID NO: 776508 - DNA, 20 bp, mouse
gaattgattcatgtttggtt

SEQ ID NO: 776509 - DNA, 20 bp, mouse
gagatacagtctataccttc

SEQ ID NO: 776510 - DNA, 20 bp, mouse
gttcttgttggtgccttcta

SEQ ID NO: 776511 - DNA, 20 bp, mouse
gatacagatatttccataga

SEQ ID NO: 776512 - DNA, 20 bp, mouse
gcatttccaccattttgtaa

SEQ ID NO: 776513 - DNA, 20 bp, mouse
gatagaccattacaaaatgg

SEQ ID NO: 776514 - DNA, 20 bp, mouse
gtggttttcatttgaaacgt

SEQ ID NO: 776515 - DNA, 20 bp, mouse
gtaagaaatatttgctagtt

SEQ ID NO: 776516 - DNA, 20 bp, mouse
gttaaggcagacagagtaaa

SEQ ID NO: 776517 - DNA, 20 bp, mouse
gtactggggatatttagaga

SEQ ID NO: 776518 - DNA, 20 bp, mouse
gaagttgatgcttctaatta

SEQ ID NO: 776519 - DNA, 20 bp, mouse
gtaaatatccccagtaccct

SEQ ID NO: 776520 - DNA, 20 bp, mouse
gaattatttctcaacttttg

SEQ ID NO: 776521 - DNA, 20 bp, mouse
gtttatactgagggatacaa

SEQ ID NO: 776522 - DNA, 20 bp, mouse
gttgttttcttcatgatact

SEQ ID NO: 776523 - DNA, 20 bp, mouse
gactgagggatacaagggta

SEQ ID NO: 776524 - DNA, 20 bp, mouse
ggagaaataattacaagtaa

SEQ ID NO: 776525 - DNA, 20 bp, mouse
gtttgtactgttttcactaa

SEQ ID NO: 776526 - DNA, 20 bp, mouse
gcatggaaacttacaagctt

SEQ ID NO: 776527 - DNA, 20 bp, mouse
gcttacaagcttgggagaat

SEQ ID NO: 776528 - DNA, 20 bp, mouse
gtcatatgaaccagttgttt

SEQ ID NO: 776529 - DNA, 20 bp, mouse
gggtactctatcagaatata

SEQ ID NO: 776530 - DNA, 20 bp, mouse
gggcttgaaattataactgg

SEQ ID NO: 776531 - DNA, 20 bp, mouse
ggatgatatcatcagcacta

SEQ ID NO: 776532 - DNA, 20 bp, mouse
gtataactggtgggggattt

SEQ ID NO: 776533 - DNA, 20 bp, mouse
gagaagcttcctatcttgct

SEQ ID NO: 776534 - DNA, 20 bp, mouse
ggtgggcttgaaattataac

SEQ ID NO: 776535 - DNA, 20 bp, mouse
gaatattaattaccaagaca

SEQ ID NO: 776536 - DNA, 20 bp, mouse
ggtgtagtttcttctgcaag

SEQ ID NO: 776537 - DNA, 20 bp, mouse
gttgtaatctatatctaatt

SEQ ID NO: 776538 - DNA, 20 bp, mouse
gttcactgtttaccgctctc

SEQ ID NO: 776539 - DNA, 20 bp, mouse
gtttaagatatatcacaaac

SEQ ID NO: 776540 - DNA, 20 bp, mouse
gatctaattgggctttcttg

SEQ ID NO: 776541 - DNA, 20 bp, mouse
gattcaatactttagtttat

SEQ ID NO: 776542 - DNA, 20 bp, mouse
gatgcctttcctggaatatc

SEQ ID NO: 776543 - DNA, 20 bp, mouse
gattgcggaccagatattcc

SEQ ID NO: 776544 - DNA, 20 bp, mouse
gatgcatgtttaatcaatcg

SEQ ID NO: 776545 - DNA, 20 bp, mouse
gaagtagtggagccagagag

SEQ ID NO: 776546 - DNA, 20 bp, mouse
gcataaaggagaaactcact

SEQ ID NO: 776547 - DNA, 20 bp, mouse
gctgtttcagcacttcataa

SEQ ID NO: 776548 - DNA, 20 bp, mouse
gtccttacaaactagacact

SEQ ID NO: 776549 - DNA, 20 bp, mouse
gatgatactatctctttatt

SEQ ID NO: 776550 - DNA, 20 bp, mouse
ggggtggtacatagcagaga

SEQ ID NO: 776551 - DNA, 20 bp, mouse
gaattgttaagtgatcacta

SEQ ID NO: 776552 - DNA, 20 bp, mouse
gatcacttaacaattcaggg

SEQ ID NO: 776553 - DNA, 20 bp, mouse
ggtgatcacttaacaattca

SEQ ID NO: 776554 - DNA, 20 bp, mouse
gacaaactagacacttggaa

SEQ ID NO: 776555 - DNA, 20 bp, mouse
gttaactctggaagtcttca

SEQ ID NO: 776556 - DNA, 20 bp, mouse
gcacaaaggagaaacacact

SEQ ID NO: 776557 - DNA, 20 bp, mouse
gaaaagagagatagtatcat

SEQ ID NO: 776558 - DNA, 20 bp, mouse
gcaatgaatagaaaaaaaac

SEQ ID NO: 776559 - DNA, 20 bp, mouse
gctatttcagcaattcacaa

SEQ ID NO: 776560 - DNA, 20 bp, mouse
gacaaactagacacttgaaa

SEQ ID NO: 776561 - DNA, 20 bp, mouse
gttaactctggaagtcttca

SEQ ID NO: 776562 - DNA, 20 bp, mouse
gtgtgaaataaaaatacctt

SEQ ID NO: 776563 - DNA, 20 bp, mouse
gtacacaataaggtcagttc

SEQ ID NO: 776564 - DNA, 20 bp, mouse
gtaaggatttctaactcatg

SEQ ID NO: 776565 - DNA, 20 bp, mouse
gggtcagttctggtctctgt

SEQ ID NO: 776566 - DNA, 20 bp, mouse
gacctcttcaacaattatac

SEQ ID NO: 776567 - DNA, 20 bp, mouse
gacacaaatctatagttcaa

SEQ ID NO: 776568 - DNA, 20 bp, mouse
gcaaatgatttctatttaat

SEQ ID NO: 776569 - DNA, 20 bp, mouse
gtcctgtataattgttgaag

SEQ ID NO: 776570 - DNA, 20 bp, mouse
gatagaaatcatttgttaaa

SEQ ID NO: 776571 - DNA, 20 bp, mouse
gagatattgtttcacttcac

SEQ ID NO: 776572 - DNA, 20 bp, mouse
gatttaaaaacaacacatac

SEQ ID NO: 776573 - DNA, 20 bp, mouse
gtaaatggaaaaatatttta

SEQ ID NO: 776574 - DNA, 20 bp, mouse
gataaaaacaacacatatta

SEQ ID NO: 776575 - DNA, 20 bp, mouse
gcacatactggctggagaga

SEQ ID NO: 776576 - DNA, 20 bp, mouse
gaggatcatatatagactgt

SEQ ID NO: 776577 - DNA, 20 bp, mouse
ggggaaatatttttgtacat

SEQ ID NO: 776578 - DNA, 20 bp, mouse
gagtgtaaacacagtataaa

SEQ ID NO: 776579 - DNA, 20 bp, mouse
gtgttgttttacattggcta

SEQ ID NO: 776580 - DNA, 20 bp, mouse
gagtatacaatatggcaaac

SEQ ID NO: 776581 - DNA, 20 bp, mouse
gcattatttccaaacttcta

SEQ ID NO: 776582 - DNA, 20 bp, mouse
gtgagaggagattagaaaat

SEQ ID NO: 776583 - DNA, 20 bp, mouse
gcaagattgtttttgtttaa

SEQ ID NO: 776584 - DNA, 20 bp, mouse
gtatgttacacatagaaatt

SEQ ID NO: 776585 - DNA, 20 bp, mouse
gacaaaaacaatcttgctga

SEQ ID NO: 776586 - DNA, 20 bp, mouse
gagaaccacatgtagaatat

SEQ ID NO: 776587 - DNA, 20 bp, mouse
gagagattggaaattcctac

SEQ ID NO: 776588 - DNA, 20 bp, mouse
gattctgtgaagttaagcaa

SEQ ID NO: 776589 - DNA, 20 bp, mouse
gggtttataattgctcaaga

SEQ ID NO: 776590 - DNA, 20 bp, mouse
gtaaaccaatattctacatg

SEQ ID NO: 776591 - DNA, 20 bp, mouse
gtagcaaactatagaagttt

SEQ ID NO: 776592 - DNA, 20 bp, mouse
gctaaacctaagtgctgtaa

SEQ ID NO: 776593 - DNA, 20 bp, mouse
gcaagatttttttgtttaag

SEQ ID NO: 776594 - DNA, 20 bp, mouse
gagaaaatatttttgtgcat

SEQ ID NO: 776595 - DNA, 20 bp, mouse
ggcaatggaatatttccagt

SEQ ID NO: 776596 - DNA, 20 bp, mouse
gattcggttggcaaacataa

SEQ ID NO: 776597 - DNA, 20 bp, mouse
gttggcaaacataagggctt

SEQ ID NO: 776598 - DNA, 20 bp, mouse
gccaggagtagtaatttaca

SEQ ID NO: 776599 - DNA, 20 bp, mouse
gtaaaatctttcactgtctt

SEQ ID NO: 776600 - DNA, 20 bp, mouse
gatacatatatatattcggt

SEQ ID NO: 776601 - DNA, 20 bp, mouse
gcaggatcaggttcagtttc

SEQ ID NO: 776602 - DNA, 20 bp, mouse
gtatttattcaattgctctt

SEQ ID NO: 776603 - DNA, 20 bp, mouse
gagattttacttcaggactt

SEQ ID NO: 776604 - DNA, 20 bp, mouse
gcagtgaaagattttacttc

SEQ ID NO: 776605 - DNA, 20 bp, mouse
gtttataaataaaaacctca

SEQ ID NO: 776606 - DNA, 20 bp, mouse
gaatttctggggctcagaag

SEQ ID NO: 776607 - DNA, 20 bp, mouse
gggaatttgacttattcttt

SEQ ID NO: 776608 - DNA, 20 bp, mouse
gaaactacaatttgtaattg

SEQ ID NO: 776609 - DNA, 20 bp, mouse
gttttctagcccaaaatttc

SEQ ID NO: 776610 - DNA, 20 bp, mouse
gttatggtattgtctctttg

SEQ ID NO: 776611 - DNA, 20 bp, mouse
gtctgagccccagaaatttt

SEQ ID NO: 776612 - DNA, 20 bp, mouse
gcatttgaaaattgatttta

SEQ ID NO: 776613 - DNA, 20 bp, mouse
gtcttgacgaccattgtgac

SEQ ID NO: 776614 - DNA, 20 bp, mouse
ggtgaacatgatttccaaaa

SEQ ID NO: 776615 - DNA, 20 bp, mouse
gcaatggtcgtcaagaatct

SEQ ID NO: 776616 - DNA, 20 bp, mouse
gcaggcaagtggagtcctcg

SEQ ID NO: 776617 - DNA, 20 bp, mouse
ggactccacttgcctgacac

SEQ ID NO: 776618 - DNA, 20 bp, mouse
gtgtaggcataatcacattc

SEQ ID NO: 776619 - DNA, 20 bp, mouse
gtgtccttgtgctgtttcat

SEQ ID NO: 776620 - DNA, 20 bp, mouse
gaatggttatggcatttttg

SEQ ID NO: 776621 - DNA, 20 bp, mouse
gcatcaccacaatccaatat

SEQ ID NO: 776622 - DNA, 20 bp, mouse
gaaagcctgtgtcaggcaag

SEQ ID NO: 776623 - DNA, 20 bp, mouse
gtggtgaaatttccctatat

SEQ ID NO: 776624 - DNA, 20 bp, mouse
gggttatggcatttttgagg

SEQ ID NO: 776625 - DNA, 20 bp, mouse
gacctcaaatggcctgctaa

SEQ ID NO: 776626 - DNA, 20 bp, mouse
gaagtagagaacaaatgagg

SEQ ID NO: 776627 - DNA, 20 bp, mouse
ggtcaccagaagatatgcaa

SEQ ID NO: 776628 - DNA, 20 bp, mouse
gtactcttcaggctaatgtg

SEQ ID NO: 776629 - DNA, 20 bp, mouse
gcctccgtatacatgaacta

SEQ ID NO: 776630 - DNA, 20 bp, mouse
gcaggctaatgtgtggattg

SEQ ID NO: 776631 - DNA, 20 bp, mouse
gctagacctctatactcttc

SEQ ID NO: 776632 - DNA, 20 bp, mouse
ggattgtggcaacacatatg

SEQ ID NO: 776633 - DNA, 20 bp, mouse
gtagtttcagctaagtatgc

SEQ ID NO: 776634 - DNA, 20 bp, mouse
gctgaaactataaatacatc

SEQ ID NO: 776635 - DNA, 20 bp, mouse
gattagcctgaagagtatag

SEQ ID NO: 776636 - DNA, 20 bp, mouse
gggcacctgacacaacactg

SEQ ID NO: 776637 - DNA, 20 bp, mouse
ggtcatcgctgtattaccat

SEQ ID NO: 776638 - DNA, 20 bp, mouse
gaggacctcagtgttgtgtc

SEQ ID NO: 776639 - DNA, 20 bp, mouse
gccaaaagcgattaatttaa

SEQ ID NO: 776640 - DNA, 20 bp, mouse
gaaaatatcaaagattttat

SEQ ID NO: 776641 - DNA, 20 bp, mouse
gtttaaagtactttttactg

SEQ ID NO: 776642 - DNA, 20 bp, mouse
gatgcttcttcattaaccaa

SEQ ID NO: 776643 - DNA, 20 bp, mouse
ggggaaaagaagttagggaa

SEQ ID NO: 776644 - DNA, 20 bp, mouse
gacacataaaaatagtagta

SEQ ID NO: 776645 - DNA, 20 bp, mouse
gtcttttaaaactctgttct

SEQ ID NO: 776646 - DNA, 20 bp, mouse
gtatccagggatcagaagtg

SEQ ID NO: 776647 - DNA, 20 bp, mouse
gctgccccacttctgatccc

SEQ ID NO: 776648 - DNA, 20 bp, mouse
gttgtaacatatcccccaaa

SEQ ID NO: 776649 - DNA, 20 bp, mouse
gttctgatccctggatattt

SEQ ID NO: 776650 - DNA, 20 bp, mouse
gtcatggtattgcccctttg

SEQ ID NO: 776651 - DNA, 20 bp, mouse
gacacagaattatatgccat

SEQ ID NO: 776652 - DNA, 20 bp, mouse
gtttctagcctgaaatttca

SEQ ID NO: 776653 - DNA, 20 bp, mouse
gttattctgatttttggagg

SEQ ID NO: 776654 - DNA, 20 bp, mouse
gttctagcccaaaatatcca

SEQ ID NO: 776655 - DNA, 20 bp, mouse
gggagggggcacatggggac

SEQ ID NO: 776656 - DNA, 20 bp, mouse
gcattaaaatatttttgcac

SEQ ID NO: 776657 - DNA, 20 bp, mouse
gcctcatcaaacatcagtga

SEQ ID NO: 776658 - DNA, 20 bp, mouse
gacaggctcattcagtctgt

SEQ ID NO: 776659 - DNA, 20 bp, mouse
gactttctaatttgttcatt

SEQ ID NO: 776660 - DNA, 20 bp, mouse
ggagaactcagggacagaac

SEQ ID NO: 776661 - DNA, 20 bp, mouse
gctctcttcccaaattacta

SEQ ID NO: 776662 - DNA, 20 bp, mouse
gcaaaataagggaaaataaa

SEQ ID NO: 776663 - DNA, 20 bp, mouse
gttcatttcatggacttcat

SEQ ID NO: 776664 - DNA, 20 bp, mouse
gacacaagccatagtaattt

SEQ ID NO: 776665 - DNA, 20 bp, mouse
gtcagtgaaggaaatgcaac

SEQ ID NO: 776666 - DNA, 20 bp, mouse
gaaccattgctattattgta

SEQ ID NO: 776667 - DNA, 20 bp, mouse
gccacaatagtcagtatatg

SEQ ID NO: 776668 - DNA, 20 bp, mouse
ggataaaaagaactgtttgg

SEQ ID NO: 776669 - DNA, 20 bp, mouse
gattgtggaaaaaacaactc

SEQ ID NO: 776670 - DNA, 20 bp, mouse
gtattgtatggcttcacttc

SEQ ID NO: 776671 - DNA, 20 bp, mouse
gcaatgttgcagcacatcaa

SEQ ID NO: 776672 - DNA, 20 bp, mouse
gctattgcatgtattctcgg

SEQ ID NO: 776673 - DNA, 20 bp, mouse
gaacaactctggaatatcta

SEQ ID NO: 776674 - DNA, 20 bp, mouse
gatggaaaacctttattgaa

SEQ ID NO: 776675 - DNA, 20 bp, mouse
ggctatagagtagtaaatct

SEQ ID NO: 776676 - DNA, 20 bp, mouse
gagtttgtgtagtagagaca

SEQ ID NO: 776677 - DNA, 20 bp, mouse
gataaaaaaaagcacaggct

SEQ ID NO: 776678 - DNA, 20 bp, mouse
gtatattgtatatttttagt

SEQ ID NO: 776679 - DNA, 20 bp, mouse
gtttaggattacatgtttga

SEQ ID NO: 776680 - DNA, 20 bp, mouse
ggtcacataaaaaaaagcac

SEQ ID NO: 776681 - DNA, 20 bp, mouse
ggacatctaaaggcttattt

SEQ ID NO: 776682 - DNA, 20 bp, mouse
gtttaattaaagactagttt

SEQ ID NO: 776683 - DNA, 20 bp, mouse
gaaaaatatacaatatacaa

SEQ ID NO: 776684 - DNA, 20 bp, mouse
gcaagtatagaatatatgat

SEQ ID NO: 776685 - DNA, 20 bp, mouse
gtatattttctgacatctaa

SEQ ID NO: 776686 - DNA, 20 bp, mouse
gaagtcatatcattagaaga

SEQ ID NO: 776687 - DNA, 20 bp, mouse
gacctcctgttatacataag

SEQ ID NO: 776688 - DNA, 20 bp, mouse
ggcctcttatgtataacagg

SEQ ID NO: 776689 - DNA, 20 bp, mouse
gggtaaaaaatatctgtcaa

SEQ ID NO: 776690 - DNA, 20 bp, mouse
gcctcttttaaaggtattta

SEQ ID NO: 776691 - DNA, 20 bp, mouse
gtaggagctgttattaccta

SEQ ID NO: 776692 - DNA, 20 bp, mouse
gttttacttcatgtctaatt

SEQ ID NO: 776693 - DNA, 20 bp, mouse
gttaaaagaggaaatagaag

SEQ ID NO: 776694 - DNA, 20 bp, mouse
gaaacatttgtgtttttagg

SEQ ID NO: 776695 - DNA, 20 bp, mouse
gaaaacacaaatgtttcctt

SEQ ID NO: 776696 - DNA, 20 bp, mouse
ggatgtcgtaggtgttaaga

SEQ ID NO: 776697 - DNA, 20 bp, mouse
gaatatgtgtagataactta

SEQ ID NO: 776698 - DNA, 20 bp, mouse
gtataaatttgtagtcatat

SEQ ID NO: 776699 - DNA, 20 bp, mouse
ggtagtgtttatattaacta

SEQ ID NO: 776700 - DNA, 20 bp, mouse
gataatatccagctttacga

SEQ ID NO: 776701 - DNA, 20 bp, mouse
gtatgtctccttcgtaaagc

SEQ ID NO: 776702 - DNA, 20 bp, mouse
gacaaagatgtgattatgaa

SEQ ID NO: 776703 - DNA, 20 bp, mouse
gtatactctttgaaaatatt

SEQ ID NO: 776704 - DNA, 20 bp, mouse
gttattatacaatgtatata

SEQ ID NO: 776705 - DNA, 20 bp, mouse
gtatgaactcttgcagcata

SEQ ID NO: 776706 - DNA, 20 bp, mouse
gacaaataattccacccaac

SEQ ID NO: 776707 - DNA, 20 bp, mouse
gactgctcatttggaaattc

SEQ ID NO: 776708 - DNA, 20 bp, mouse
ggctatcttcagtacacttg

SEQ ID NO: 776709 - DNA, 20 bp, mouse
gtatacttaaatcaatatca

SEQ ID NO: 776710 - DNA, 20 bp, mouse
gtataagaattaactacagc

SEQ ID NO: 776711 - DNA, 20 bp, mouse
gtcttcagtacacttgtgga

SEQ ID NO: 776712 - DNA, 20 bp, mouse
gtaaatataggctggcttgt

SEQ ID NO: 776713 - DNA, 20 bp, mouse
gtaagacaaattctggatat

SEQ ID NO: 776714 - DNA, 20 bp, mouse
gagaattatgttactcttta

SEQ ID NO: 776715 - DNA, 20 bp, mouse
gaaaattttcactgctcatt

SEQ ID NO: 776716 - DNA, 20 bp, mouse
gcagatgtgtaattgttttg

SEQ ID NO: 776717 - DNA, 20 bp, mouse
gctaaatatctgtagattca

SEQ ID NO: 776718 - DNA, 20 bp, mouse
ggggtgagaagtgtgaacaa

SEQ ID NO: 776719 - DNA, 20 bp, mouse
gacaacgtgtagctgaaatt

SEQ ID NO: 776720 - DNA, 20 bp, mouse
gtaaaaacccactgagcatt

SEQ ID NO: 776721 - DNA, 20 bp, mouse
gtcgaacccaaatgctcagt

SEQ ID NO: 776722 - DNA, 20 bp, mouse
gtgaacaatggtccaaaaca

SEQ ID NO: 776723 - DNA, 20 bp, mouse
gaaatcacaaaatgtagata

SEQ ID NO: 776724 - DNA, 20 bp, mouse
gcttggcattagaaaattgc

SEQ ID NO: 776725 - DNA, 20 bp, mouse
gctacagatatttagtataa

SEQ ID NO: 776726 - DNA, 20 bp, mouse
gtggttaaaattagcaattg

SEQ ID NO: 776727 - DNA, 20 bp, mouse
gtatttgtcaagaactaagg

SEQ ID NO: 776728 - DNA, 20 bp, mouse
ggaaaatgataataacaggt

SEQ ID NO: 776729 - DNA, 20 bp, mouse
ggaaaaaatctaggcactgt

SEQ ID NO: 776730 - DNA, 20 bp, mouse
gtcttgatcattacttcttt

SEQ ID NO: 776731 - DNA, 20 bp, mouse
gatctaggcactgttggcta

SEQ ID NO: 776732 - DNA, 20 bp, mouse
gcaatgataaactcttaacc

SEQ ID NO: 776733 - DNA, 20 bp, mouse
ggctaatcagatagaagacc

SEQ ID NO: 776734 - DNA, 20 bp, mouse
gctatctgattagcttcagt

SEQ ID NO: 776735 - DNA, 20 bp, mouse
gacatgtgttttctttatct

SEQ ID NO: 776736 - DNA, 20 bp, mouse
gtaataatgaggaaatagta

SEQ ID NO: 776737 - DNA, 20 bp, mouse
gactgaatggtcaaaagcct

SEQ ID NO: 776738 - DNA, 20 bp, mouse
gtccaggtgagttcaatctc

SEQ ID NO: 776739 - DNA, 20 bp, mouse
gaccttgggcatgactcaat

SEQ ID NO: 776740 - DNA, 20 bp, mouse
gtatggctgtgatttaacca

SEQ ID NO: 776741 - DNA, 20 bp, mouse
gcgagactaaaaggcaagaa

SEQ ID NO: 776742 - DNA, 20 bp, mouse
gccatctaaagttctccgta

SEQ ID NO: 776743 - DNA, 20 bp, mouse
gctcacctggactaataatg

SEQ ID NO: 776744 - DNA, 20 bp, mouse
ggcaagaagggaatcatggc

SEQ ID NO: 776745 - DNA, 20 bp, mouse
gtatggggcatcttaattct

SEQ ID NO: 776746 - DNA, 20 bp, mouse
ggtgattgccttggaactat

SEQ ID NO: 776747 - DNA, 20 bp, mouse
gctcaaaactacctcaacaa

SEQ ID NO: 776748 - DNA, 20 bp, mouse
gacgtagataaggccatgac

SEQ ID NO: 776749 - DNA, 20 bp, mouse
gctaattacctatagttcca

SEQ ID NO: 776750 - DNA, 20 bp, mouse
gcattgcaaaagacctgtca

SEQ ID NO: 776751 - DNA, 20 bp, mouse
ggtaatgaattcctttgttg

SEQ ID NO: 776752 - DNA, 20 bp, mouse
gacatttgtagacgtagata

SEQ ID NO: 776753 - DNA, 20 bp, mouse
gaaaatttagcaagtagatc

SEQ ID NO: 776754 - DNA, 20 bp, mouse
gaacatttatataatcctaa

SEQ ID NO: 776755 - DNA, 20 bp, mouse
gaggcaatcaccagatgcat

SEQ ID NO: 776756 - DNA, 20 bp, mouse
gtcaattacagctagactgt

SEQ ID NO: 776757 - DNA, 20 bp, mouse
gcactaacctacagtaatac

SEQ ID NO: 776758 - DNA, 20 bp, mouse
gaaaatctcagagttgagtc

SEQ ID NO: 776759 - DNA, 20 bp, mouse
ggtctcctaaaatcttttct

SEQ ID NO: 776760 - DNA, 20 bp, mouse
gataaaactgtgtattaaac

SEQ ID NO: 776761 - DNA, 20 bp, mouse
ggttaagattatctaaacag

SEQ ID NO: 776762 - DNA, 20 bp, mouse
gtttaatattagttattgac

SEQ ID NO: 776763 - DNA, 20 bp, mouse
gaaagattcatttaggtcac

SEQ ID NO: 776764 - DNA, 20 bp, mouse
gttctgggaaaagaagttag

SEQ ID NO: 776765 - DNA, 20 bp, mouse
gcaaaagcaaattaatttaa

SEQ ID NO: 776766 - DNA, 20 bp, mouse
gagaatgtgtatgtagataa

SEQ ID NO: 776767 - DNA, 20 bp, mouse
gccactccttgtcctgttac

SEQ ID NO: 776768 - DNA, 20 bp, mouse
gtgtgctctaattcattaaa

SEQ ID NO: 776769 - DNA, 20 bp, mouse
gaaaacaattaccctgtaac

SEQ ID NO: 776770 - DNA, 20 bp, mouse
ggttatgctatcaccccaaa

SEQ ID NO: 776771 - DNA, 20 bp, mouse
gtcatgtttactaccttttg

SEQ ID NO: 776772 - DNA, 20 bp, mouse
gatatgaatgaaaaggatat

SEQ ID NO: 776773 - DNA, 20 bp, mouse
gttcatgtatatgaatgaaa

SEQ ID NO: 776774 - DNA, 20 bp, mouse
gattaccctgtaacaggaca

SEQ ID NO: 776775 - DNA, 20 bp, mouse
gaaaaggttcagagagtgaa

SEQ ID NO: 776776 - DNA, 20 bp, mouse
gcaggattcaggctctaagg

SEQ ID NO: 776777 - DNA, 20 bp, mouse
gtgaaatcttgccctctctt

SEQ ID NO: 776778 - DNA, 20 bp, mouse
gccaggagtagtgattaact

SEQ ID NO: 776779 - DNA, 20 bp, mouse
gcctcaagaaacatatgaac

SEQ ID NO: 776780 - DNA, 20 bp, mouse
gcttcaggattcaggctcta

SEQ ID NO: 776781 - DNA, 20 bp, mouse
gtacaatgtttgatcttttc

SEQ ID NO: 776782 - DNA, 20 bp, mouse
gctgcacatttgaaaatgtg

SEQ ID NO: 776783 - DNA, 20 bp, mouse
ggagggcaagatttcacttc

SEQ ID NO: 776784 - DNA, 20 bp, mouse
gacaaacacactggttgctt

SEQ ID NO: 776785 - DNA, 20 bp, mouse
gagatttcacttcaggattc

SEQ ID NO: 776786 - DNA, 20 bp, mouse
gaactcatcttgtgcttcat

SEQ ID NO: 776787 - DNA, 20 bp, mouse
gcagggtgagaacttaggga

SEQ ID NO: 776788 - DNA, 20 bp, mouse
gaaaatggtcatgcttaaaa

SEQ ID NO: 776789 - DNA, 20 bp, mouse
ggagaacttagggaaggaac

SEQ ID NO: 776790 - DNA, 20 bp, mouse
gtatgtgatattagttgttt

SEQ ID NO: 776791 - DNA, 20 bp, mouse
gttgctttatactcatagca

SEQ ID NO: 776792 - DNA, 20 bp, mouse
gaaaaataaagtactgaaaa

SEQ ID NO: 776793 - DNA, 20 bp, mouse
gtgggaaggaaatgctctaa

SEQ ID NO: 776794 - DNA, 20 bp, mouse
gagtagctaacttgttcatt

SEQ ID NO: 776795 - DNA, 20 bp, mouse
ggatgtttgatgaggaaggg

SEQ ID NO: 776796 - DNA, 20 bp, mouse
gtaccttggaacagggcaac

SEQ ID NO: 776797 - DNA, 20 bp, mouse
gctagttttgtatctagatt

SEQ ID NO: 776798 - DNA, 20 bp, mouse
ggttattcatattcaacaca

SEQ ID NO: 776799 - DNA, 20 bp, mouse
ggagaacaacttcacattca

SEQ ID NO: 776800 - DNA, 20 bp, mouse
gttgtggaaacccaaacagg

SEQ ID NO: 776801 - DNA, 20 bp, mouse
gtatgctgtttctacctgta

SEQ ID NO: 776802 - DNA, 20 bp, mouse
gaatttgtggaaacccaaac

SEQ ID NO: 776803 - DNA, 20 bp, mouse
gcttgaacagccccctgttt

SEQ ID NO: 776804 - DNA, 20 bp, mouse
gttgttctctgtacaaagaa

SEQ ID NO: 776805 - DNA, 20 bp, mouse
gttcagtagtgatgttgtct

SEQ ID NO: 776806 - DNA, 20 bp, mouse
gcagcaagtcttacaaggaa

SEQ ID NO: 776807 - DNA, 20 bp, mouse
gaaaagggatatatacttat

SEQ ID NO: 776808 - DNA, 20 bp, mouse
ggctgcatgtgcatttttcc

SEQ ID NO: 776809 - DNA, 20 bp, mouse
gaaaaatgttagatgaaacc

SEQ ID NO: 776810 - DNA, 20 bp, mouse
gaccaaagagcttatttaat

SEQ ID NO: 776811 - DNA, 20 bp, mouse
gtaccatactatattgaaaa

SEQ ID NO: 776812 - DNA, 20 bp, mouse
gttcaatatagtatggtata

SEQ ID NO: 776813 - DNA, 20 bp, mouse
gatcccttttcaatatagta

SEQ ID NO: 776814 - DNA, 20 bp, mouse
gtaataatgaacacaagtat

SEQ ID NO: 776815 - DNA, 20 bp, mouse
ggtaaagttaataattacta

SEQ ID NO: 776816 - DNA, 20 bp, mouse
gagcaggggtgcagggtaca

SEQ ID NO: 776817 - DNA, 20 bp, mouse
gaagcaagaaccagtgacac

SEQ ID NO: 776818 - DNA, 20 bp, mouse
gcccccttctgccttagtgt

SEQ ID NO: 776819 - DNA, 20 bp, mouse
ggcttcagaggctcaagcag

SEQ ID NO: 776820 - DNA, 20 bp, mouse
gacacatgattatatgctat

SEQ ID NO: 776821 - DNA, 20 bp, mouse
gtacctacactaaggcagaa

SEQ ID NO: 776822 - DNA, 20 bp, mouse
ggctagagaacacttgaaaa

SEQ ID NO: 776823 - DNA, 20 bp, mouse
ggagggagttatatgaagaa

SEQ ID NO: 776824 - DNA, 20 bp, mouse
gatgccctgcatggttatag

SEQ ID NO: 776825 - DNA, 20 bp, mouse
gaatttatatacctacacta

SEQ ID NO: 776826 - DNA, 20 bp, mouse
gaaacttactaaggatatgg

SEQ ID NO: 776827 - DNA, 20 bp, mouse
gttgttctttaaacttacta

SEQ ID NO: 776828 - DNA, 20 bp, mouse
gtttaaacttactaaggata

SEQ ID NO: 776829 - DNA, 20 bp, mouse
ggtctattgaaataaaatat

SEQ ID NO: 776830 - DNA, 20 bp, mouse
gagataactctgtatattcc

SEQ ID NO: 776831 - DNA, 20 bp, mouse
gtagtcataaaacgtaattt

SEQ ID NO: 776832 - DNA, 20 bp, mouse
ggtttgatatttaaaatttg

SEQ ID NO: 776833 - DNA, 20 bp, mouse
gattacgttttatgactacc

SEQ ID NO: 776834 - DNA, 20 bp, mouse
gtttaaaaatattttgacat

SEQ ID NO: 776835 - DNA, 20 bp, mouse
gaataaaatataggaaagat

SEQ ID NO: 776836 - DNA, 20 bp, mouse
gcacacctggacaatccatt

SEQ ID NO: 776837 - DNA, 20 bp, mouse
gttatcccaatggattgtcc

SEQ ID NO: 776838 - DNA, 20 bp, mouse
gtgaacattaacgaaactga

SEQ ID NO: 776839 - DNA, 20 bp, mouse
gtccattgggataaagtatt

SEQ ID NO: 776840 - DNA, 20 bp, mouse
gtcccaatactttatcccaa

SEQ ID NO: 776841 - DNA, 20 bp, mouse
gtttgtctgtacaaatttac

SEQ ID NO: 776842 - DNA, 20 bp, mouse
ggtctgtacaaatttacagg

SEQ ID NO: 776843 - DNA, 20 bp, mouse
gttctgaactaccacacacc

SEQ ID NO: 776844 - DNA, 20 bp, mouse
gaggcagaggacttacatat

SEQ ID NO: 776845 - DNA, 20 bp, mouse
gacaaagaaagatgctgaaa

SEQ ID NO: 776846 - DNA, 20 bp, mouse
ggaaatgagtatctgataca

SEQ ID NO: 776847 - DNA, 20 bp, mouse
gaacaaaaagctatcagagg

SEQ ID NO: 776848 - DNA, 20 bp, mouse
gtacaacaaaaagctatcag

SEQ ID NO: 776849 - DNA, 20 bp, mouse
ggattcccaagatttatttt

SEQ ID NO: 776850 - DNA, 20 bp, mouse
gaataaaatctgaaaattat

SEQ ID NO: 776851 - DNA, 20 bp, mouse
gcttgggaatctgtagtagt

SEQ ID NO: 776852 - DNA, 20 bp, mouse
gtctgaccaatgagtaaatg

SEQ ID NO: 776853 - DNA, 20 bp, mouse
ggtaaatgtggaaacttagc

SEQ ID NO: 776854 - DNA, 20 bp, mouse
gagatggctcagtgagtaag

SEQ ID NO: 776855 - DNA, 20 bp, mouse
gttaacctaaaataaatctt

SEQ ID NO: 776856 - DNA, 20 bp, mouse
gaagagttgttaggagtatg

SEQ ID NO: 776857 - DNA, 20 bp, mouse
gcctcctaactcagatccat

SEQ ID NO: 776858 - DNA, 20 bp, mouse
gtacttaatgccttgggaaa

SEQ ID NO: 776859 - DNA, 20 bp, mouse
gtaggaggctaaagaatatt

SEQ ID NO: 776860 - DNA, 20 bp, mouse
gaaaaccatcaagagttgtt

SEQ ID NO: 776861 - DNA, 20 bp, mouse
gtactgcctataatctccca

SEQ ID NO: 776862 - DNA, 20 bp, mouse
gttggttcgatgacagaatc

SEQ ID NO: 776863 - DNA, 20 bp, mouse
gagcttatacttaatgcctt

SEQ ID NO: 776864 - DNA, 20 bp, mouse
ggatggtcctcccttttgct

SEQ ID NO: 776865 - DNA, 20 bp, mouse
gtactcctaacaactcttga

SEQ ID NO: 776866 - DNA, 20 bp, mouse
gagagcaacatctctaaagt

SEQ ID NO: 776867 - DNA, 20 bp, mouse
gctctaaagtgggctatact

SEQ ID NO: 776868 - DNA, 20 bp, mouse
gaacatgtttcaagtgactt

SEQ ID NO: 776869 - DNA, 20 bp, mouse
ggaatttcaaggtttaagcc

SEQ ID NO: 776870 - DNA, 20 bp, mouse
gttatgtctttgtggtatct

SEQ ID NO: 776871 - DNA, 20 bp, mouse
gatttatctcttattcgcat

SEQ ID NO: 776872 - DNA, 20 bp, mouse
gatgtgttggggatcaggaa

SEQ ID NO: 776873 - DNA, 20 bp, mouse
gtgtgtgggtttatgtgttg

SEQ ID NO: 776874 - DNA, 20 bp, mouse
gggtttatgtgttggggatc

SEQ ID NO: 776875 - DNA, 20 bp, mouse
gctggctttttaaatgttga

SEQ ID NO: 776876 - DNA, 20 bp, mouse
gacttagtcaatagcgttgt

SEQ ID NO: 776877 - DNA, 20 bp, mouse
gcaggtaaagatccatgatg

SEQ ID NO: 776878 - DNA, 20 bp, mouse
gtacctgttccaattagtga

SEQ ID NO: 776879 - DNA, 20 bp, mouse
gtgccttcactaattggaac

SEQ ID NO: 776880 - DNA, 20 bp, mouse
gaataagtttaagcaataca

SEQ ID NO: 776881 - DNA, 20 bp, mouse
gtattaatattaagtttcta

SEQ ID NO: 776882 - DNA, 20 bp, mouse
gaatttccaaaatagtagtc

SEQ ID NO: 776883 - DNA, 20 bp, mouse
gcagacataattaattgaaa

SEQ ID NO: 776884 - DNA, 20 bp, mouse
gttttagtcatttgaaacat

SEQ ID NO: 776885 - DNA, 20 bp, mouse
gaaatactgtccaactaaac

SEQ ID NO: 776886 - DNA, 20 bp, mouse
gttctattaacagaacagta

SEQ ID NO: 776887 - DNA, 20 bp, mouse
gactaccagtcctctcctat

SEQ ID NO: 776888 - DNA, 20 bp, mouse
gggagaggactggtagttat

SEQ ID NO: 776889 - DNA, 20 bp, mouse
gctatccaataggagaggac

SEQ ID NO: 776890 - DNA, 20 bp, mouse
gcaatgctatccaataggag

SEQ ID NO: 776891 - DNA, 20 bp, mouse
gtaaagcacatgttcataga

SEQ ID NO: 776892 - DNA, 20 bp, mouse
gatgtacaatgctatccaat

SEQ ID NO: 776893 - DNA, 20 bp, mouse
gctatgaaagtagaatttta

SEQ ID NO: 776894 - DNA, 20 bp, mouse
gtagaattttatggcagaaa

SEQ ID NO: 776895 - DNA, 20 bp, mouse
gcaggtatttcaaaaataat

SEQ ID NO: 776896 - DNA, 20 bp, mouse
ggagacctatgcttgtcttg

SEQ ID NO: 776897 - DNA, 20 bp, mouse
gtgagccacaagacaagcat

SEQ ID NO: 776898 - DNA, 20 bp, mouse
gtgcaaggagacaaaattta

SEQ ID NO: 776899 - DNA, 20 bp, mouse
gcaatcaacttaatatgtaa

SEQ ID NO: 776900 - DNA, 20 bp, mouse
gaaggagacaaaatttatgg

SEQ ID NO: 776901 - DNA, 20 bp, mouse
gataaattacttgtttatta

SEQ ID NO: 776902 - DNA, 20 bp, mouse
ggttctttaatactttgtta

SEQ ID NO: 776903 - DNA, 20 bp, mouse
gtaaggtctctaataatgca

SEQ ID NO: 776904 - DNA, 20 bp, mouse
gacttgtttattatggaaat

SEQ ID NO: 776905 - DNA, 20 bp, mouse
ggtggaatctttttaaaaag

SEQ ID NO: 776906 - DNA, 20 bp, mouse
gatggatactagagatatgg

SEQ ID NO: 776907 - DNA, 20 bp, mouse
gagggctgtgctaaggaata

SEQ ID NO: 776908 - DNA, 20 bp, mouse
ggagcaaatagtaagagctt

SEQ ID NO: 776909 - DNA, 20 bp, mouse
ggcatctaagctttaatttc

SEQ ID NO: 776910 - DNA, 20 bp, mouse
gatgttaaatatctttgcat

SEQ ID NO: 776911 - DNA, 20 bp, mouse
gttcaaagaatatctataag

SEQ ID NO: 776912 - DNA, 20 bp, mouse
gagagaattcaactcatcat

SEQ ID NO: 776913 - DNA, 20 bp, mouse
gagtacagacaatattatag

SEQ ID NO: 776914 - DNA, 20 bp, mouse
gtgttactatttttaatcta

SEQ ID NO: 776915 - DNA, 20 bp, mouse
gaattctctattacattatt

SEQ ID NO: 776916 - DNA, 20 bp, mouse
gaaattacagggaagagctt

SEQ ID NO: 776917 - DNA, 20 bp, mouse
gtattactcttttcatctaa

SEQ ID NO: 776918 - DNA, 20 bp, mouse
ggtgtcttgtagaaattaca

SEQ ID NO: 776919 - DNA, 20 bp, mouse
gaagtaagcttcctggtctc

SEQ ID NO: 776920 - DNA, 20 bp, mouse
gaagacacaagtaagcttcc

SEQ ID NO: 776921 - DNA, 20 bp, mouse
gattttaagatccagagacc

SEQ ID NO: 776922 - DNA, 20 bp, mouse
gttgaagtctatagtttaat

SEQ ID NO: 776923 - DNA, 20 bp, mouse
gttcacagaaaagctataag

SEQ ID NO: 776924 - DNA, 20 bp, mouse
gaaatattaaatatctgcat

SEQ ID NO: 776925 - DNA, 20 bp, mouse
gatttcagacaatatcatag

SEQ ID NO: 776926 - DNA, 20 bp, mouse
gttttagcttcatgatatct

SEQ ID NO: 776927 - DNA, 20 bp, mouse
gtttctctccttagttaaag

SEQ ID NO: 776928 - DNA, 20 bp, mouse
gtatcaaacctctttaacta

SEQ ID NO: 776929 - DNA, 20 bp, mouse
gaaactagtatttgaaatgt

SEQ ID NO: 776930 - DNA, 20 bp, mouse
gatgtgtgtctttatgtgca

SEQ ID NO: 776931 - DNA, 20 bp, mouse
gggaacagaaaggatgagag

SEQ ID NO: 776932 - DNA, 20 bp, mouse
gtagggctgtaccaaaaagt

SEQ ID NO: 776933 - DNA, 20 bp, mouse
gaaaaagaccatctctaaat

SEQ ID NO: 776934 - DNA, 20 bp, mouse
gagagagagagaatggtagc

SEQ ID NO: 776935 - DNA, 20 bp, mouse
ggagagagaattatgtgaag

SEQ ID NO: 776936 - DNA, 20 bp, mouse
ggtagttattgtggccaata

SEQ ID NO: 776937 - DNA, 20 bp, mouse
gaatgaagaaattttttcgt

SEQ ID NO: 776938 - DNA, 20 bp, mouse
gatcatggtaatgtaatgta

SEQ ID NO: 776939 - DNA, 20 bp, mouse
gtgagccagatgacaataat

SEQ ID NO: 776940 - DNA, 20 bp, mouse
gtctaaaatggtagttattg

SEQ ID NO: 776941 - DNA, 20 bp, mouse
gctaatggcacatccttgag

SEQ ID NO: 776942 - DNA, 20 bp, mouse
gatagggacaattaattaat

SEQ ID NO: 776943 - DNA, 20 bp, mouse
gggctcaaattaagtatgaa

SEQ ID NO: 776944 - DNA, 20 bp, mouse
ggcttcctattattgtcatc

SEQ ID NO: 776945 - DNA, 20 bp, mouse
ggaaatacatgtaatggaat

SEQ ID NO: 776946 - DNA, 20 bp, mouse
gtgttagcatagagatatgg

SEQ ID NO: 776947 - DNA, 20 bp, mouse
ggtggctgggatgactacct

SEQ ID NO: 776948 - DNA, 20 bp, mouse
gatatgggggagttcctttg

SEQ ID NO: 776949 - DNA, 20 bp, mouse
gatcctaaaaaagatcgtta

SEQ ID NO: 776950 - DNA, 20 bp, mouse
gaagatcgttagggttgaaa

SEQ ID NO: 776951 - DNA, 20 bp, mouse
gaaccctaacgatctttttt

SEQ ID NO: 776952 - DNA, 20 bp, mouse
ggatcttttttaggatattg

SEQ ID NO: 776953 - DNA, 20 bp, mouse
gtagggttgaaaaggatata

SEQ ID NO: 776954 - DNA, 20 bp, mouse
gttttttaggatattgtggc

SEQ ID NO: 776955 - DNA, 20 bp, mouse
gaatgtgcatcgatttgaat

SEQ ID NO: 776956 - DNA, 20 bp, mouse
gtgtctccatacttggagac

SEQ ID NO: 776957 - DNA, 20 bp, mouse
gaagtgactcagagaggcaa

SEQ ID NO: 776958 - DNA, 20 bp, mouse
ggagacaaatcaatacatta

SEQ ID NO: 776959 - DNA, 20 bp, mouse
gatattccagtctccaagta

SEQ ID NO: 776960 - DNA, 20 bp, mouse
gaaatgaaagtgactcagag

SEQ ID NO: 776961 - DNA, 20 bp, mouse
gcacatatttgctcactggc

SEQ ID NO: 776962 - DNA, 20 bp, mouse
gtatgtgacataatagtaaa

SEQ ID NO: 776963 - DNA, 20 bp, mouse
gattgatttgtctccatact

SEQ ID NO: 776964 - DNA, 20 bp, mouse
gttggcacatatttgctcac

SEQ ID NO: 776965 - DNA, 20 bp, mouse
gaaaatcagaacagaaaata

SEQ ID NO: 776966 - DNA, 20 bp, mouse
gtacctaaatgcaaggttgg

SEQ ID NO: 776967 - DNA, 20 bp, mouse
gaacccccaaccttgcattt

SEQ ID NO: 776968 - DNA, 20 bp, mouse
gtgcttgctgagggtttttt

SEQ ID NO: 776969 - DNA, 20 bp, mouse
gttgtccatttgtaatactt

SEQ ID NO: 776970 - DNA, 20 bp, mouse
ggtctcactacctaaatgca

SEQ ID NO: 776971 - DNA, 20 bp, mouse
gtaaacctaagtattacaaa

SEQ ID NO: 776972 - DNA, 20 bp, mouse
gaatggacaatatgtccaac

SEQ ID NO: 776973 - DNA, 20 bp, mouse
gcactacctaaatgcaaggt

SEQ ID NO: 776974 - DNA, 20 bp, mouse
gatttaggtagtgagacacc

SEQ ID NO: 776975 - DNA, 20 bp, mouse
ggaagatatatatattggga

SEQ ID NO: 776976 - DNA, 20 bp, mouse
gttcagacagagaaactcta

SEQ ID NO: 776977 - DNA, 20 bp, mouse
gacagaactgtactagtgat

SEQ ID NO: 776978 - DNA, 20 bp, mouse
ggttgaaataccataaacat

SEQ ID NO: 776979 - DNA, 20 bp, mouse
gatcaggaaattaaagatgc

SEQ ID NO: 776980 - DNA, 20 bp, mouse
gctggcttttccaatgttta

SEQ ID NO: 776981 - DNA, 20 bp, mouse
gatagaagtttatagcttag

SEQ ID NO: 776982 - DNA, 20 bp, mouse
ggtggtctatattgagaaag

SEQ ID NO: 776983 - DNA, 20 bp, mouse
ggtctatattgagaaagagg

SEQ ID NO: 776984 - DNA, 20 bp, mouse
gtttaggtgactaaattatc

SEQ ID NO: 776985 - DNA, 20 bp, mouse
ggacagagaaactctaagga

SEQ ID NO: 776986 - DNA, 20 bp, mouse
gaaagtccatctctgtccaa

SEQ ID NO: 776987 - DNA, 20 bp, mouse
gtagcagtcctcccctgaat

SEQ ID NO: 776988 - DNA, 20 bp, mouse
gacttatggctcctattcag

SEQ ID NO: 776989 - DNA, 20 bp, mouse
gaggtattagaagctcccct

SEQ ID NO: 776990 - DNA, 20 bp, mouse
gctttggtgtactaaaagtt

SEQ ID NO: 776991 - DNA, 20 bp, mouse
gttaactgaactttgtggta

SEQ ID NO: 776992 - DNA, 20 bp, mouse
gatgcatttttagtttttac

SEQ ID NO: 776993 - DNA, 20 bp, mouse
gctattaaatttttaatgtt

SEQ ID NO: 776994 - DNA, 20 bp, mouse
gataaagtgaggcatgtgag

SEQ ID NO: 776995 - DNA, 20 bp, mouse
gtatggctcctattcagggg

SEQ ID NO: 776996 - DNA, 20 bp, mouse
gaagtccatctctgtataat

SEQ ID NO: 776997 - DNA, 20 bp, mouse
gagctcctattatacagaga

SEQ ID NO: 776998 - DNA, 20 bp, mouse
gtctgcaatactttggaaga

SEQ ID NO: 776999 - DNA, 20 bp, mouse
gatgcatggctttaattttt

SEQ ID NO: 777000 - DNA, 20 bp, mouse
gctttgatatactgaaagtt

SEQ ID NO: 777001 - DNA, 20 bp, mouse
gttagatgtcttccctgaat

SEQ ID NO: 777002 - DNA, 20 bp, mouse
gacgcattttcagttttcac

SEQ ID NO: 777003 - DNA, 20 bp, mouse
gaaggacatctgcaatactt

SEQ ID NO: 777004 - DNA, 20 bp, mouse
gtctcatttctaaatttcaa

SEQ ID NO: 777005 - DNA, 20 bp, mouse
gtaaaacaatgattaatgaa

SEQ ID NO: 777006 - DNA, 20 bp, mouse
gcccacggtcatagggtagt

SEQ ID NO: 777007 - DNA, 20 bp, mouse
gtaaacagctgctacaggac

SEQ ID NO: 777008 - DNA, 20 bp, mouse
gcgttgaggcccacggtcat

SEQ ID NO: 777009 - DNA, 20 bp, mouse
ggtgatgaggaacgaggcac

SEQ ID NO: 777010 - DNA, 20 bp, mouse
gtcaccttgtggacccgttg

SEQ ID NO: 777011 - DNA, 20 bp, mouse
gcacaaggtgatgaggaacg

SEQ ID NO: 777012 - DNA, 20 bp, mouse
gaatttgaatgctgtatcac

SEQ ID NO: 777013 - DNA, 20 bp, mouse
ggggcctcaacgggtccaca

SEQ ID NO: 777014 - DNA, 20 bp, mouse
ggaggcacaggagaccatgc

SEQ ID NO: 777015 - DNA, 20 bp, mouse
gccccactaccctatgaccg

SEQ ID NO: 777016 - DNA, 20 bp, mouse
gtgggttcaaccagctaata

SEQ ID NO: 777017 - DNA, 20 bp, mouse
gatgtagagtccatattagc

SEQ ID NO: 777018 - DNA, 20 bp, mouse
gttaatgtacgtagtactaa

SEQ ID NO: 777019 - DNA, 20 bp, mouse
gtaaatatggtagtcatttt

SEQ ID NO: 777020 - DNA, 20 bp, mouse
gtattcagaaatgaatacta

SEQ ID NO: 777021 - DNA, 20 bp, mouse
gatatggtagtcattttagg

SEQ ID NO: 777022 - DNA, 20 bp, mouse
gaattgttgatacagtacaa

SEQ ID NO: 777023 - DNA, 20 bp, mouse
gatcagtggtttagtaaata

SEQ ID NO: 777024 - DNA, 20 bp, mouse
gaaaatatttcaacttaaac

SEQ ID NO: 777025 - DNA, 20 bp, mouse
gaatttaagaaatggtatag

SEQ ID NO: 777026 - DNA, 20 bp, mouse
ggcagctgtgtaaacttatt

SEQ ID NO: 777027 - DNA, 20 bp, mouse
gttctcttaagggagcagca

SEQ ID NO: 777028 - DNA, 20 bp, mouse
gaagttgaaacatgttatta

SEQ ID NO: 777029 - DNA, 20 bp, mouse
gttggaataacattacattt

SEQ ID NO: 777030 - DNA, 20 bp, mouse
gttaaaatgtgaagtgttac

SEQ ID NO: 777031 - DNA, 20 bp, mouse
ggttatagctgattatttat

SEQ ID NO: 777032 - DNA, 20 bp, mouse
gacagaaagctaagagtata

SEQ ID NO: 777033 - DNA, 20 bp, mouse
gtgtttcatgaactgaaaat

SEQ ID NO: 777034 - DNA, 20 bp, mouse
gcagaggtttttttataaag

SEQ ID NO: 777035 - DNA, 20 bp, mouse
gtcttttttttattataaac

SEQ ID NO: 777036 - DNA, 20 bp, mouse
gggagagaaaccaaatgtag

SEQ ID NO: 777037 - DNA, 20 bp, mouse
ggaagtatgatttaaactgt

SEQ ID NO: 777038 - DNA, 20 bp, mouse
gtactctttgccactacatt

SEQ ID NO: 777039 - DNA, 20 bp, mouse
gaaggcataatcaggtaaat

SEQ ID NO: 777040 - DNA, 20 bp, mouse
gctttctatagtttaattat

SEQ ID NO: 777041 - DNA, 20 bp, mouse
gataatattaatagttaata

SEQ ID NO: 777042 - DNA, 20 bp, mouse
gcaagattggaacgaaatga

SEQ ID NO: 777043 - DNA, 20 bp, mouse
gaatcatataaaaacaagat

SEQ ID NO: 777044 - DNA, 20 bp, mouse
gtaaaatgtttatcaaatat

SEQ ID NO: 777045 - DNA, 20 bp, mouse
gtttaattgttctgagcatt

SEQ ID NO: 777046 - DNA, 20 bp, mouse
gtacaagaatataattattg

SEQ ID NO: 777047 - DNA, 20 bp, mouse
gtctctagatatcgtgattt

SEQ ID NO: 777048 - DNA, 20 bp, mouse
gaatcccagagttcatcata

SEQ ID NO: 777049 - DNA, 20 bp, mouse
gaatcaaggaaagtgctatc

SEQ ID NO: 777050 - DNA, 20 bp, mouse
gcagcataagaagacaaggc

SEQ ID NO: 777051 - DNA, 20 bp, mouse
ggcagatagatggttcattg

SEQ ID NO: 777052 - DNA, 20 bp, mouse
gatgctacagactacaaaat

SEQ ID NO: 777053 - DNA, 20 bp, mouse
gaaacattaaggatggttcc

SEQ ID NO: 777054 - DNA, 20 bp, mouse
gactatagtttgcaaatctt

SEQ ID NO: 777055 - DNA, 20 bp, mouse
gtagccatatgatgaactct

SEQ ID NO: 777056 - DNA, 20 bp, mouse
gctcatgttgcattcttagt

SEQ ID NO: 777057 - DNA, 20 bp, mouse
gtagatagccatatttaggt

SEQ ID NO: 777058 - DNA, 20 bp, mouse
gtctgtaatgagttgataat

SEQ ID NO: 777059 - DNA, 20 bp, mouse
gggataaattggaaagacta

SEQ ID NO: 777060 - DNA, 20 bp, mouse
gtattgttacccttctgtag

SEQ ID NO: 777061 - DNA, 20 bp, mouse
gcattcttagttggaataga

SEQ ID NO: 777062 - DNA, 20 bp, mouse
gatctagtaattaatatctg

SEQ ID NO: 777063 - DNA, 20 bp, mouse
gagtttgtcctacctaaata

SEQ ID NO: 777064 - DNA, 20 bp, mouse
gtacataaaatttcactcag

SEQ ID NO: 777065 - DNA, 20 bp, mouse
ggactaattttcagaaatga

SEQ ID NO: 777066 - DNA, 20 bp, mouse
ggaggctattgcactcattc

SEQ ID NO: 777067 - DNA, 20 bp, mouse
gaaaacagatgagataattt

SEQ ID NO: 777068 - DNA, 20 bp, mouse
gtatataaagggattcatcg

SEQ ID NO: 777069 - DNA, 20 bp, mouse
gcatcaggtgatgcatcaaa

SEQ ID NO: 777070 - DNA, 20 bp, mouse
gactactgtgtacattacag

SEQ ID NO: 777071 - DNA, 20 bp, mouse
gattcttatcaataatattc

SEQ ID NO: 777072 - DNA, 20 bp, mouse
gctgtcattctgcacaaagt

SEQ ID NO: 777073 - DNA, 20 bp, mouse
ggtgtttatttaagttctgc

SEQ ID NO: 777074 - DNA, 20 bp, mouse
gcagtggaagaataccaaac

SEQ ID NO: 777075 - DNA, 20 bp, mouse
gactaaatgtgatacacatg

SEQ ID NO: 777076 - DNA, 20 bp, mouse
gcagccaaggtctatagcaa

SEQ ID NO: 777077 - DNA, 20 bp, mouse
gaataattctacttatgttt

SEQ ID NO: 777078 - DNA, 20 bp, mouse
gtatcccttgctatagacct

SEQ ID NO: 777079 - DNA, 20 bp, mouse
gagacatacagagatcaact

SEQ ID NO: 777080 - DNA, 20 bp, mouse
gaatagaaagtaatgaaagg

SEQ ID NO: 777081 - DNA, 20 bp, mouse
ggaaaatagaaagtaatgaa

SEQ ID NO: 777082 - DNA, 20 bp, mouse
gttaatctcagcactacaga

SEQ ID NO: 777083 - DNA, 20 bp, mouse
gtgctcgataaatattaaaa

SEQ ID NO: 777084 - DNA, 20 bp, mouse
gatgtttttaattttcaaat

SEQ ID NO: 777085 - DNA, 20 bp, mouse
gtcaccatactctgttctaa

SEQ ID NO: 777086 - DNA, 20 bp, mouse
gtaggggaatagcatgaaga

SEQ ID NO: 777087 - DNA, 20 bp, mouse
gtcagccaaggtctacagag

SEQ ID NO: 777088 - DNA, 20 bp, mouse
gtatgccactctgtagacct

SEQ ID NO: 777089 - DNA, 20 bp, mouse
gaacttaataatgaggaact

SEQ ID NO: 777090 - DNA, 20 bp, mouse
ggagtaaatgcattatgtgt

SEQ ID NO: 777091 - DNA, 20 bp, mouse
gatgtttttaattttcatgt

SEQ ID NO: 777092 - DNA, 20 bp, mouse
gactgattaacttaataatg

SEQ ID NO: 777093 - DNA, 20 bp, mouse
gttggagaaaatagaaaata

SEQ ID NO: 777094 - DNA, 20 bp, mouse
gtctgtagtgctgagattga

SEQ ID NO: 777095 - DNA, 20 bp, mouse
gcatctacacaatgacttct

SEQ ID NO: 777096 - DNA, 20 bp, mouse
ggatgcaataagaaattctg

SEQ ID NO: 777097 - DNA, 20 bp, mouse
gcaaggcctagtatagcaaa

SEQ ID NO: 777098 - DNA, 20 bp, mouse
gaatctcaaaaaatttaaac

SEQ ID NO: 777099 - DNA, 20 bp, mouse
ggtaaatataatgcaattaa

SEQ ID NO: 777100 - DNA, 20 bp, mouse
gcaaatagtttattttggtt

SEQ ID NO: 777101 - DNA, 20 bp, mouse
ggcaataagaaattctgtgg

SEQ ID NO: 777102 - DNA, 20 bp, mouse
gcagtagcctatattctaaa

SEQ ID NO: 777103 - DNA, 20 bp, mouse
gagatggccttttagaatat

SEQ ID NO: 777104 - DNA, 20 bp, mouse
gtgtaacttatgtaaaaaca

SEQ ID NO: 777105 - DNA, 20 bp, mouse
gtgtaatatgattcattttg

SEQ ID NO: 777106 - DNA, 20 bp, mouse
gctacataggacatcctaga

SEQ ID NO: 777107 - DNA, 20 bp, mouse
gtctgtcctaagttgatcat

SEQ ID NO: 777108 - DNA, 20 bp, mouse
gggaccttatatatgattta

SEQ ID NO: 777109 - DNA, 20 bp, mouse
ggtcctcccatgatcaactt

SEQ ID NO: 777110 - DNA, 20 bp, mouse
gtcatgggaggacaattatg

SEQ ID NO: 777111 - DNA, 20 bp, mouse
gagagcatgcataaaatgat

SEQ ID NO: 777112 - DNA, 20 bp, mouse
gattgctaaaatggaaatat

SEQ ID NO: 777113 - DNA, 20 bp, mouse
gtcactttccattgctaaaa

SEQ ID NO: 777114 - DNA, 20 bp, mouse
ggtttcagtataaaagttca

SEQ ID NO: 777115 - DNA, 20 bp, mouse
gaggatgtcctatgtagcta

SEQ ID NO: 777116 - DNA, 20 bp, mouse
ggtataagagatatgaggac

SEQ ID NO: 777117 - DNA, 20 bp, mouse
gagtcaacagaattgatagc

SEQ ID NO: 777118 - DNA, 20 bp, mouse
gaagcaatgggcaccaatat

SEQ ID NO: 777119 - DNA, 20 bp, mouse
gtaagagatatgaggactgg

SEQ ID NO: 777120 - DNA, 20 bp, mouse
ggaagaatttgaaaatatag

SEQ ID NO: 777121 - DNA, 20 bp, mouse
gacacatgctaaaaaattaa

SEQ ID NO: 777122 - DNA, 20 bp, mouse
gtagttttcacaaattcttt

SEQ ID NO: 777123 - DNA, 20 bp, mouse
gaggtttactatgctcttta

SEQ ID NO: 777124 - DNA, 20 bp, mouse
gttctggaccatgccaatat

SEQ ID NO: 777125 - DNA, 20 bp, mouse
gatgggcaccaatattggca

SEQ ID NO: 777126 - DNA, 20 bp, mouse
gttagaaatcttgttgaagt

SEQ ID NO: 777127 - DNA, 20 bp, mouse
gatgtaaagaacactgtatt

SEQ ID NO: 777128 - DNA, 20 bp, mouse
ggggagatgagaaaattata

SEQ ID NO: 777129 - DNA, 20 bp, mouse
gtatgagaaagattttttgt

SEQ ID NO: 777130 - DNA, 20 bp, mouse
gatagagtgttaaagtacat

SEQ ID NO: 777131 - DNA, 20 bp, mouse
gaaaatatataaagtttctt

SEQ ID NO: 777132 - DNA, 20 bp, mouse
gagtggataatcagagacat

SEQ ID NO: 777133 - DNA, 20 bp, mouse
gcaacaagatttctaaaata

SEQ ID NO: 777134 - DNA, 20 bp, mouse
gcaaacaataaaatgtactc

SEQ ID NO: 777135 - DNA, 20 bp, mouse
gaaagtagaaataataatag

SEQ ID NO: 777136 - DNA, 20 bp, mouse
ggcaaaagggatgatatgat

SEQ ID NO: 777137 - DNA, 20 bp, mouse
gcataagttaatattaatta

SEQ ID NO: 777138 - DNA, 20 bp, mouse
gaagaagggcttaatatgtg

SEQ ID NO: 777139 - DNA, 20 bp, mouse
gatgatatgataggaaatag

SEQ ID NO: 777140 - DNA, 20 bp, mouse
gtacttacacaaagaataat

SEQ ID NO: 777141 - DNA, 20 bp, mouse
ggagcagacaaaaagcaaaa

SEQ ID NO: 777142 - DNA, 20 bp, mouse
gtatgataggaaatagagga

SEQ ID NO: 777143 - DNA, 20 bp, mouse
gtcaagaatcttcaaaagaa

SEQ ID NO: 777144 - DNA, 20 bp, mouse
gtctataattaaatattctt

SEQ ID NO: 777145 - DNA, 20 bp, mouse
gaagtcattttgtttgattt

SEQ ID NO: 777146 - DNA, 20 bp, mouse
gcatgcctgtatcttaaatg

SEQ ID NO: 777147 - DNA, 20 bp, mouse
gagtcagtacttaatttcat

SEQ ID NO: 777148 - DNA, 20 bp, mouse
gtacacctcatttaagatac

SEQ ID NO: 777149 - DNA, 20 bp, mouse
gccatgcttcagcattgctt

SEQ ID NO: 777150 - DNA, 20 bp, mouse
gcacatgtggatttcagaat

SEQ ID NO: 777151 - DNA, 20 bp, mouse
gcaactggagttcttgcctc

SEQ ID NO: 777152 - DNA, 20 bp, mouse
gtaaaagaaagatgaagtga

SEQ ID NO: 777153 - DNA, 20 bp, mouse
gttatacaattacacacatg

SEQ ID NO: 777154 - DNA, 20 bp, mouse
gattttcaacttgaatcctg

SEQ ID NO: 777155 - DNA, 20 bp, mouse
gttgttttaccttgcagaaa

SEQ ID NO: 777156 - DNA, 20 bp, mouse
gtggacacaatgcttcattt

SEQ ID NO: 777157 - DNA, 20 bp, mouse
gacctggtaagtagtcttgt

SEQ ID NO: 777158 - DNA, 20 bp, mouse
gggtaagtagtcttgtaggt

SEQ ID NO: 777159 - DNA, 20 bp, mouse
gatggaaggaaaaattgcaa

SEQ ID NO: 777160 - DNA, 20 bp, mouse
gtcgcacaataaaagcctga

SEQ ID NO: 777161 - DNA, 20 bp, mouse
ggtagtcagtttatcaatct

SEQ ID NO: 777162 - DNA, 20 bp, mouse
gaatattaagtattatctac

SEQ ID NO: 777163 - DNA, 20 bp, mouse
gggaaaatatatatgccttc

SEQ ID NO: 777164 - DNA, 20 bp, mouse
ggtttatcaatcttggcaac

SEQ ID NO: 777165 - DNA, 20 bp, mouse
gaaaaggaaagaggggataa

SEQ ID NO: 777166 - DNA, 20 bp, mouse
ggcactaaccagcctccatt

SEQ ID NO: 777167 - DNA, 20 bp, mouse
gacttagagtagcccaatgg

SEQ ID NO: 777168 - DNA, 20 bp, mouse
gaattcatagaaattcacta

SEQ ID NO: 777169 - DNA, 20 bp, mouse
gtgcggatgtatataagcat

SEQ ID NO: 777170 - DNA, 20 bp, mouse
ggaagaaagcacaatttgca

SEQ ID NO: 777171 - DNA, 20 bp, mouse
gactacttagagtagcccaa

SEQ ID NO: 777172 - DNA, 20 bp, mouse
gtcaaataacaaggttatgg

SEQ ID NO: 777173 - DNA, 20 bp, mouse
gatgtatataagcatgggtc

SEQ ID NO: 777174 - DNA, 20 bp, mouse
ggtagctggactttattagt

SEQ ID NO: 777175 - DNA, 20 bp, mouse
gaaacactgttttgtttgac

SEQ ID NO: 777176 - DNA, 20 bp, mouse
gagaaaccagcataaagatc

SEQ ID NO: 777177 - DNA, 20 bp, mouse
gactactccaaaaaggtctt

SEQ ID NO: 777178 - DNA, 20 bp, mouse
ggccacacctaagacctttt

SEQ ID NO: 777179 - DNA, 20 bp, mouse
gtctttatgctggtttctgg

SEQ ID NO: 777180 - DNA, 20 bp, mouse
gtcgctccctatagtctcct

SEQ ID NO: 777181 - DNA, 20 bp, mouse
gcagttctaatgaagagctt

SEQ ID NO: 777182 - DNA, 20 bp, mouse
gtccaaaaaggtcttaggtg

SEQ ID NO: 777183 - DNA, 20 bp, mouse
gctcttcattagaactgcat

SEQ ID NO: 777184 - DNA, 20 bp, mouse
gcaggaatactactccaaaa

SEQ ID NO: 777185 - DNA, 20 bp, mouse
gacacagcagacttttcatg

SEQ ID NO: 777186 - DNA, 20 bp, mouse
ggcaggaagtccattttacc

SEQ ID NO: 777187 - DNA, 20 bp, mouse
gcttggaaagtaagacttcc

SEQ ID NO: 777188 - DNA, 20 bp, mouse
gagcaataccacattaatat

SEQ ID NO: 777189 - DNA, 20 bp, mouse
ggagcttccagacaacaata

SEQ ID NO: 777190 - DNA, 20 bp, mouse
gaaatgttctcactgaagct

SEQ ID NO: 777191 - DNA, 20 bp, mouse
gaaatgaacaggagaagtag

SEQ ID NO: 777192 - DNA, 20 bp, mouse
gtatctgtcctatattaatg

SEQ ID NO: 777193 - DNA, 20 bp, mouse
ggtttctccatattgttgtc

SEQ ID NO: 777194 - DNA, 20 bp, mouse
gaaaagtatgatctcacatg

SEQ ID NO: 777195 - DNA, 20 bp, mouse
gatgaactacaaaatacttc

SEQ ID NO: 777196 - DNA, 20 bp, mouse
gtacaaagaccagaagtaga

SEQ ID NO: 777197 - DNA, 20 bp, mouse
ggaacataaaatatcaacta

SEQ ID NO: 777198 - DNA, 20 bp, mouse
ggaagccagatttagatgta

SEQ ID NO: 777199 - DNA, 20 bp, mouse
gtcacaaaagcaaatgtaca

SEQ ID NO: 777200 - DNA, 20 bp, mouse
gatgttgagaggaagagaat

SEQ ID NO: 777201 - DNA, 20 bp, mouse
gtcacaatcagcaagctaaa

SEQ ID NO: 777202 - DNA, 20 bp, mouse
gtgttccatacatctaaatc

SEQ ID NO: 777203 - DNA, 20 bp, mouse
gtattatcttgtttacaaac

SEQ ID NO: 777204 - DNA, 20 bp, mouse
gaatattatttaatgttgag

SEQ ID NO: 777205 - DNA, 20 bp, mouse
ggaccagaagtagaaggcaa

SEQ ID NO: 777206 - DNA, 20 bp, mouse
gtctggggctcataattctg

SEQ ID NO: 777207 - DNA, 20 bp, mouse
gctaaagttggattacatgt

SEQ ID NO: 777208 - DNA, 20 bp, mouse
gaacacggtcctggtaatga

SEQ ID NO: 777209 - DNA, 20 bp, mouse
gctaatagcatgcttgtccc

SEQ ID NO: 777210 - DNA, 20 bp, mouse
ggtactcaaggcctgtaaaa

SEQ ID NO: 777211 - DNA, 20 bp, mouse
gtgtgaaaagtctgctgtgg

SEQ ID NO: 777212 - DNA, 20 bp, mouse
ggttggctgctactgcaatc

SEQ ID NO: 777213 - DNA, 20 bp, mouse
gcagtttaatgaggtggttt

SEQ ID NO: 777214 - DNA, 20 bp, mouse
ggtggtgttccttcattacc

SEQ ID NO: 777215 - DNA, 20 bp, mouse
gaactgtatgaacacggtcc

SEQ ID NO: 777216 - DNA, 20 bp, mouse
gtaataagaacacattatac

SEQ ID NO: 777217 - DNA, 20 bp, mouse
gcagagagatattgtggagt

SEQ ID NO: 777218 - DNA, 20 bp, mouse
ggaaaaggaaacgggtggca

SEQ ID NO: 777219 - DNA, 20 bp, mouse
ggcatggaagtagttagaaa

SEQ ID NO: 777220 - DNA, 20 bp, mouse
gggtggtgacttttatggag

SEQ ID NO: 777221 - DNA, 20 bp, mouse
gcagctggtggtgactttta

SEQ ID NO: 777222 - DNA, 20 bp, mouse
gcttctgtgcccattgaagg

SEQ ID NO: 777223 - DNA, 20 bp, mouse
gaaggcattttgtaaaattt

SEQ ID NO: 777224 - DNA, 20 bp, mouse
gatcagtatcacattgtatt

SEQ ID NO: 777225 - DNA, 20 bp, mouse
gtaaagacttgagcatggca

SEQ ID NO: 777226 - DNA, 20 bp, mouse
gaacaattctcatatatgaa

SEQ ID NO: 777227 - DNA, 20 bp, mouse
gttaatgcatagaacagaca

SEQ ID NO: 777228 - DNA, 20 bp, mouse
gaaggaaggaagaatggaaa

SEQ ID NO: 777229 - DNA, 20 bp, mouse
gaggaaaaggttctagggtt

SEQ ID NO: 777230 - DNA, 20 bp, mouse
gatacttgaaacattgaaga

SEQ ID NO: 777231 - DNA, 20 bp, mouse
gggaaatagtaaagtaaaaa

SEQ ID NO: 777232 - DNA, 20 bp, mouse
ggagaagaagagaagacata

SEQ ID NO: 777233 - DNA, 20 bp, mouse
gagtgcttagttctctacaa

SEQ ID NO: 777234 - DNA, 20 bp, mouse
gatggtttcttatgaattgc

SEQ ID NO: 777235 - DNA, 20 bp, mouse
gtactcaggaaaaggttcta

SEQ ID NO: 777236 - DNA, 20 bp, mouse
gaagagctttgttttctgtt

SEQ ID NO: 777237 - DNA, 20 bp, mouse
gttattgcatataactgaca

SEQ ID NO: 777238 - DNA, 20 bp, mouse
ggaaattaaggacgaaagaa

SEQ ID NO: 777239 - DNA, 20 bp, mouse
gatgatgtcttatgaatagc

SEQ ID NO: 777240 - DNA, 20 bp, mouse
gaggaaggaagaaagaagta

SEQ ID NO: 777241 - DNA, 20 bp, mouse
gaatacttgaaacattgaaa

SEQ ID NO: 777242 - DNA, 20 bp, mouse
gttaaggacgaaagaaagga

SEQ ID NO: 777243 - DNA, 20 bp, mouse
gtctctaccatgttttctaa

SEQ ID NO: 777244 - DNA, 20 bp, mouse
gtactcaggaaaaggttctg

SEQ ID NO: 777245 - DNA, 20 bp, mouse
gagctggtttacaaacatat

SEQ ID NO: 777246 - DNA, 20 bp, mouse
gaaagtgaatgtactgagaa

SEQ ID NO: 777247 - DNA, 20 bp, mouse
ggcataacccttcccatctc

SEQ ID NO: 777248 - DNA, 20 bp, mouse
gttgtaatatctttacaacc

SEQ ID NO: 777249 - DNA, 20 bp, mouse
gctttttcctgagatgggaa

SEQ ID NO: 777250 - DNA, 20 bp, mouse
gtctcttctatgttactatt

SEQ ID NO: 777251 - DNA, 20 bp, mouse
gattaagctttttcctgaga

SEQ ID NO: 777252 - DNA, 20 bp, mouse
gatgtaaattaagtaatatg

SEQ ID NO: 777253 - DNA, 20 bp, mouse
gcaaactattcaaatctcta

SEQ ID NO: 777254 - DNA, 20 bp, mouse
gtagtaacatagaagagaaa

SEQ ID NO: 777255 - DNA, 20 bp, mouse
gttgtactgttctgacctcc

SEQ ID NO: 777256 - DNA, 20 bp, mouse
gttcaggaggaaagtttcat

SEQ ID NO: 777257 - DNA, 20 bp, mouse
gacaatgccaacagaaaaga

SEQ ID NO: 777258 - DNA, 20 bp, mouse
gccaacagaaaagagggtag

SEQ ID NO: 777259 - DNA, 20 bp, mouse
gaccagtgatgatatgtcct

SEQ ID NO: 777260 - DNA, 20 bp, mouse
gaccaaggacatatcatcac

SEQ ID NO: 777261 - DNA, 20 bp, mouse
gaatgaaataaggaagaatt

SEQ ID NO: 777262 - DNA, 20 bp, mouse
gtaagcactgtagaggtaac

SEQ ID NO: 777263 - DNA, 20 bp, mouse
gagacaaaatttatttattc

SEQ ID NO: 777264 - DNA, 20 bp, mouse
gtaagatactccaaccactt

SEQ ID NO: 777265 - DNA, 20 bp, mouse
gcaaaatttatttattcagg

SEQ ID NO: 777266 - DNA, 20 bp, mouse
gataaacaggtgcacaatag

SEQ ID NO: 777267 - DNA, 20 bp, mouse
gatggcatggtaaagaccta

SEQ ID NO: 777268 - DNA, 20 bp, mouse
gtatggtaacctaataccac

SEQ ID NO: 777269 - DNA, 20 bp, mouse
gcaattacatcctcataaac

SEQ ID NO: 777270 - DNA, 20 bp, mouse
gattctcaagttttctgata

SEQ ID NO: 777271 - DNA, 20 bp, mouse
gtagtaataatatttgtgtg

SEQ ID NO: 777272 - DNA, 20 bp, mouse
ggacaatagcaatcttagaa

SEQ ID NO: 777273 - DNA, 20 bp, mouse
gatagcaatcttagaaagga

SEQ ID NO: 777274 - DNA, 20 bp, mouse
gaggcatttaattaaaagtt

SEQ ID NO: 777275 - DNA, 20 bp, mouse
gctctattttgtcttaagaa

SEQ ID NO: 777276 - DNA, 20 bp, mouse
gatggtcaggaaaattaatt

SEQ ID NO: 777277 - DNA, 20 bp, mouse
gatctacacacatttaagaa

SEQ ID NO: 777278 - DNA, 20 bp, mouse
gaataatagcaatcatcgtg

SEQ ID NO: 777279 - DNA, 20 bp, mouse
gtcaaatgatttagagggat

SEQ ID NO: 777280 - DNA, 20 bp, mouse
gactagcagtatatttcaat

SEQ ID NO: 777281 - DNA, 20 bp, mouse
gttcacttcaaatgatttag

SEQ ID NO: 777282 - DNA, 20 bp, mouse
gatattattgaactactaga

SEQ ID NO: 777283 - DNA, 20 bp, mouse
gcacacatttaagaatggtc

SEQ ID NO: 777284 - DNA, 20 bp, mouse
gtacagaaaaattccataaa

SEQ ID NO: 777285 - DNA, 20 bp, mouse
gaagaaagatatgctttcaa

SEQ ID NO: 777286 - DNA, 20 bp, mouse
gtgagcccacagtcatactg

SEQ ID NO: 777287 - DNA, 20 bp, mouse
gaatatccacagtatgactg

SEQ ID NO: 777288 - DNA, 20 bp, mouse
gtgcagggactagtacaacc

SEQ ID NO: 777289 - DNA, 20 bp, mouse
gcatataagtgccacttgat

SEQ ID NO: 777290 - DNA, 20 bp, mouse
ggtattaattgtagaagaat

SEQ ID NO: 777291 - DNA, 20 bp, mouse
gtataataataagcacttta

SEQ ID NO: 777292 - DNA, 20 bp, mouse
gattgtatataaactttgtg

SEQ ID NO: 777293 - DNA, 20 bp, mouse
gcattgacttgtctaaaatt

SEQ ID NO: 777294 - DNA, 20 bp, mouse
gtgttgtaaaataatcaaca

SEQ ID NO: 777295 - DNA, 20 bp, mouse
gaattaatacaaattctgca

SEQ ID NO: 777296 - DNA, 20 bp, mouse
gcctgacagtggaacgttga

SEQ ID NO: 777297 - DNA, 20 bp, mouse
gccactgtcagggttcaagt

SEQ ID NO: 777298 - DNA, 20 bp, mouse
gactgacgtgtgttctccac

SEQ ID NO: 777299 - DNA, 20 bp, mouse
gcaatgagtgatatatggca

SEQ ID NO: 777300 - DNA, 20 bp, mouse
gttatggctctttttttcag

SEQ ID NO: 777301 - DNA, 20 bp, mouse
gtaatgcaatcagtcaccag

SEQ ID NO: 777302 - DNA, 20 bp, mouse
gatattaaaaacctcttaga

SEQ ID NO: 777303 - DNA, 20 bp, mouse
gcaatatcacaccctctaag

SEQ ID NO: 777304 - DNA, 20 bp, mouse
gggcaaggtatagaggaagt

SEQ ID NO: 777305 - DNA, 20 bp, mouse
gaataataacttgtaattta

SEQ ID NO: 777306 - DNA, 20 bp, mouse
ggcagttctaagtagagata

SEQ ID NO: 777307 - DNA, 20 bp, mouse
gaggttatctggtcttcatg

SEQ ID NO: 777308 - DNA, 20 bp, mouse
gcagagttgatccatcataa

SEQ ID NO: 777309 - DNA, 20 bp, mouse
gaagttctgatcattcagaa

SEQ ID NO: 777310 - DNA, 20 bp, mouse
ggtgctgtaatcctttatga

SEQ ID NO: 777311 - DNA, 20 bp, mouse
gaaatgttgagaagtgaagt

SEQ ID NO: 777312 - DNA, 20 bp, mouse
gagttattccaacacataaa

SEQ ID NO: 777313 - DNA, 20 bp, mouse
gagaagaatgagatttcaaa

SEQ ID NO: 777314 - DNA, 20 bp, mouse
gaacacttccagaggttatc

SEQ ID NO: 777315 - DNA, 20 bp, mouse
gaaaggaatggatacagaga

SEQ ID NO: 777316 - DNA, 20 bp, mouse
ggtgaaaaccagagaacctc

SEQ ID NO: 777317 - DNA, 20 bp, mouse
gctgatctaaatatttccag

SEQ ID NO: 777318 - DNA, 20 bp, mouse
gtattgagacctaatgggaa

SEQ ID NO: 777319 - DNA, 20 bp, mouse
gaaaacacatgtctcctaaa

SEQ ID NO: 777320 - DNA, 20 bp, mouse
gacctggtattgagacctaa

SEQ ID NO: 777321 - DNA, 20 bp, mouse
gtttcacaaggttcaaactt

SEQ ID NO: 777322 - DNA, 20 bp, mouse
ggttacactttcattcagaa

SEQ ID NO: 777323 - DNA, 20 bp, mouse
gataaagttggtgaagactt

SEQ ID NO: 777324 - DNA, 20 bp, mouse
gcccattaggtctcaatacc

SEQ ID NO: 777325 - DNA, 20 bp, mouse
ggttgattcccattcccatt

SEQ ID NO: 777326 - DNA, 20 bp, mouse
gtcaaggttgaagtacagtt

SEQ ID NO: 777327 - DNA, 20 bp, mouse
gtagtggatgaatgcatcag

SEQ ID NO: 777328 - DNA, 20 bp, mouse
gcatggctctttcttttctc

SEQ ID NO: 777329 - DNA, 20 bp, mouse
gcatcaaactttcaatgtca

SEQ ID NO: 777330 - DNA, 20 bp, mouse
gaagagtcaataattactcc

SEQ ID NO: 777331 - DNA, 20 bp, mouse
gtatggcaaaatttataggg

SEQ ID NO: 777332 - DNA, 20 bp, mouse
gccacttaactgaaaattca

SEQ ID NO: 777333 - DNA, 20 bp, mouse
gttcaaaagaaataaatttt

SEQ ID NO: 777334 - DNA, 20 bp, mouse
ggatatatggcaaaatttat

SEQ ID NO: 777335 - DNA, 20 bp, mouse
gattgactcttttatgacct

SEQ ID NO: 777336 - DNA, 20 bp, mouse
gccacattacccatgatcta

SEQ ID NO: 777337 - DNA, 20 bp, mouse
gaactgagatggggattgat

SEQ ID NO: 777338 - DNA, 20 bp, mouse
gtgtcaccataactgagatg

SEQ ID NO: 777339 - DNA, 20 bp, mouse
gggggattgatgggggtaat

SEQ ID NO: 777340 - DNA, 20 bp, mouse
gggaagcatcaaataaaatc

SEQ ID NO: 777341 - DNA, 20 bp, mouse
gtgtataggtcatgtatagg

SEQ ID NO: 777342 - DNA, 20 bp, mouse
gtgatgcttccctagatcat

SEQ ID NO: 777343 - DNA, 20 bp, mouse
gttttgtataggtcatgtat

SEQ ID NO: 777344 - DNA, 20 bp, mouse
gataagcaacactagtctaa

SEQ ID NO: 777345 - DNA, 20 bp, mouse
ggccagtgtgagtctaaaaa

SEQ ID NO: 777346 - DNA, 20 bp, mouse
gccctggagtgagtcctgaa

SEQ ID NO: 777347 - DNA, 20 bp, mouse
gtatctctatagtgcagact

SEQ ID NO: 777348 - DNA, 20 bp, mouse
gtcttagctcaactgcatgc

SEQ ID NO: 777349 - DNA, 20 bp, mouse
gcaggatagatttgtaatga

SEQ ID NO: 777350 - DNA, 20 bp, mouse
ggatagatttgtaatgatgg

SEQ ID NO: 777351 - DNA, 20 bp, mouse
gtaagagattgtaagaagcc

SEQ ID NO: 777352 - DNA, 20 bp, mouse
gtagacatagacatataacc

SEQ ID NO: 777353 - DNA, 20 bp, mouse
gggcgatgcttttcctctac

SEQ ID NO: 777354 - DNA, 20 bp, mouse
ggaggggaaggcatctcaaa

SEQ ID NO: 777355 - DNA, 20 bp, mouse
gttgctcagagacaggagag

SEQ ID NO: 777356 - DNA, 20 bp, mouse
gcagagcagggcatggtaaa

SEQ ID NO: 777357 - DNA, 20 bp, mouse
gcagctgactctaacttcct

SEQ ID NO: 777358 - DNA, 20 bp, mouse
gaacttcctgggcacagtaa

SEQ ID NO: 777359 - DNA, 20 bp, mouse
ggatgctcaacctctcattc

SEQ ID NO: 777360 - DNA, 20 bp, mouse
gtagtaactcgtacagagca

SEQ ID NO: 777361 - DNA, 20 bp, mouse
gttgcactacgtacattgta

SEQ ID NO: 777362 - DNA, 20 bp, mouse
gaggaatacagagtctgtgt

SEQ ID NO: 777363 - DNA, 20 bp, mouse
gtctgtacgagttactaaat

SEQ ID NO: 777364 - DNA, 20 bp, mouse
ggcaaagtgagattactata

SEQ ID NO: 777365 - DNA, 20 bp, mouse
gaaattgggacttcttctct

SEQ ID NO: 777366 - DNA, 20 bp, mouse
gaacttctagaacacggtaa

SEQ ID NO: 777367 - DNA, 20 bp, mouse
gcagaaactagtgtagagta

SEQ ID NO: 777368 - DNA, 20 bp, mouse
gccaaaggaggtttgtacta

SEQ ID NO: 777369 - DNA, 20 bp, mouse
gcattgctgagaagaggtac

SEQ ID NO: 777370 - DNA, 20 bp, mouse
ggatatttaccccttcattc

SEQ ID NO: 777371 - DNA, 20 bp, mouse
gaggaggtttgtactatggt

SEQ ID NO: 777372 - DNA, 20 bp, mouse
gcacagaccctccggacttc

SEQ ID NO: 777373 - DNA, 20 bp, mouse
gtaaagtgtggattgctcta

SEQ ID NO: 777374 - DNA, 20 bp, mouse
gaagattcattgctgagaag

SEQ ID NO: 777375 - DNA, 20 bp, mouse
gcttctgcctgaagtccgga

SEQ ID NO: 777376 - DNA, 20 bp, mouse
ggggtcagacagatactcac

SEQ ID NO: 777377 - DNA, 20 bp, mouse
gacttcgtgctagttccata

SEQ ID NO: 777378 - DNA, 20 bp, mouse
gggagaccctctaactgctc

SEQ ID NO: 777379 - DNA, 20 bp, mouse
gggtcctcacctgtaaaatc

SEQ ID NO: 777380 - DNA, 20 bp, mouse
ggacaggagatagtagagtg

SEQ ID NO: 777381 - DNA, 20 bp, mouse
gaaaagagtcattaggggag

SEQ ID NO: 777382 - DNA, 20 bp, mouse
gcagttagagggtctccgtt

SEQ ID NO: 777383 - DNA, 20 bp, mouse
gcacacaccacagaagtaca

SEQ ID NO: 777384 - DNA, 20 bp, mouse
gtggcttccatgtacttctg

SEQ ID NO: 777385 - DNA, 20 bp, mouse
gacatggaagccaaaggagc

SEQ ID NO: 777386 - DNA, 20 bp, mouse
gtgggctttgagataactct

SEQ ID NO: 777387 - DNA, 20 bp, mouse
ggagcatagctcatttccca

SEQ ID NO: 777388 - DNA, 20 bp, mouse
ggccttcagcattgactcta

SEQ ID NO: 777389 - DNA, 20 bp, mouse
gtgttcttgcctaataaatg

SEQ ID NO: 777390 - DNA, 20 bp, mouse
gagtataaacagagccagca

SEQ ID NO: 777391 - DNA, 20 bp, mouse
gtgctcagtcacactattag

SEQ ID NO: 777392 - DNA, 20 bp, mouse
gagctcaaactgttccctgc

SEQ ID NO: 777393 - DNA, 20 bp, mouse
gccacatttaacaaagccta

SEQ ID NO: 777394 - DNA, 20 bp, mouse
ggattctttaatcagtccat

SEQ ID NO: 777395 - DNA, 20 bp, mouse
gcagcattgactctaaggta

SEQ ID NO: 777396 - DNA, 20 bp, mouse
gtgagggaataagttggaga

SEQ ID NO: 777397 - DNA, 20 bp, mouse
gaccctgtcagaggtggttt

SEQ ID NO: 777398 - DNA, 20 bp, mouse
gggcaccaatggcccactac

SEQ ID NO: 777399 - DNA, 20 bp, mouse
gtcactgaccctgtcagagg

SEQ ID NO: 777400 - DNA, 20 bp, mouse
gcagagtgaaagggtcagta

SEQ ID NO: 777401 - DNA, 20 bp, mouse
gtgtacctgtagtgggccat

SEQ ID NO: 777402 - DNA, 20 bp, mouse
gttcccaaaccacctctgac

SEQ ID NO: 777403 - DNA, 20 bp, mouse
gtctttaggaataatataca

SEQ ID NO: 777404 - DNA, 20 bp, mouse
gttctgaagtgtgtgcacaa

SEQ ID NO: 777405 - DNA, 20 bp, mouse
gacagagggtcaaatacaca

SEQ ID NO: 777406 - DNA, 20 bp, mouse
gcaagatgctacagaggcga

SEQ ID NO: 777407 - DNA, 20 bp, mouse
gaagatataaggcacatcaa

SEQ ID NO: 777408 - DNA, 20 bp, mouse
gtagagtcaagatgctacag

SEQ ID NO: 777409 - DNA, 20 bp, mouse
gagtaggagaatgatggtca

SEQ ID NO: 777410 - DNA, 20 bp, mouse
ggcctgcagtaggagaatga

SEQ ID NO: 777411 - DNA, 20 bp, mouse
ggcgttgctcagttgtagtc

SEQ ID NO: 777412 - DNA, 20 bp, mouse
gaccatcattctcctactgc

SEQ ID NO: 777413 - DNA, 20 bp, mouse
gttattcaggaatattattc

SEQ ID NO: 777414 - DNA, 20 bp, mouse
gatattgaagccatttattc

SEQ ID NO: 777415 - DNA, 20 bp, mouse
gctcaggtctcaaagtacaa

SEQ ID NO: 777416 - DNA, 20 bp, mouse
gtagaactgagatactgcag

SEQ ID NO: 777417 - DNA, 20 bp, mouse
gcttctgtgctgtcataaaa

SEQ ID NO: 777418 - DNA, 20 bp, mouse
gatccggtctcaaactacaa

SEQ ID NO: 777419 - DNA, 20 bp, mouse
gtggttgattgatgggtgca

SEQ ID NO: 777420 - DNA, 20 bp, mouse
gcgagtaacacagtgagtct

SEQ ID NO: 777421 - DNA, 20 bp, mouse
gtgttactcgtttgtagtta

SEQ ID NO: 777422 - DNA, 20 bp, mouse
gatcaatcaaccacattaat

SEQ ID NO: 777423 - DNA, 20 bp, mouse
gagggcaagtacaaattgca

SEQ ID NO: 777424 - DNA, 20 bp, mouse
gactacattctttgagagtt

SEQ ID NO: 777425 - DNA, 20 bp, mouse
gaaaaaattctgttgttatc

SEQ ID NO: 777426 - DNA, 20 bp, mouse
gcaacaaagcctgatctctt

SEQ ID NO: 777427 - DNA, 20 bp, mouse
ggacctgattaaaaatgaaa

SEQ ID NO: 777428 - DNA, 20 bp, mouse
gcatgggagaggaattgaaa

SEQ ID NO: 777429 - DNA, 20 bp, mouse
gagtgacagtagcatgggag

SEQ ID NO: 777430 - DNA, 20 bp, mouse
gtctcttgggaaaatacttg

SEQ ID NO: 777431 - DNA, 20 bp, mouse
gagggtcatctgcttgagag

SEQ ID NO: 777432 - DNA, 20 bp, mouse
gagagtgggtagcctacgta

SEQ ID NO: 777433 - DNA, 20 bp, mouse
gccaaaaggggtagcagata

SEQ ID NO: 777434 - DNA, 20 bp, mouse
gacaattcataaaccctctt

SEQ ID NO: 777435 - DNA, 20 bp, mouse
gtttatgaattgtaatctcg

SEQ ID NO: 777436 - DNA, 20 bp, mouse
gtagaaccgagatgctgcag

SEQ ID NO: 777437 - DNA, 20 bp, mouse
gatggtccatctcccacttc

SEQ ID NO: 777438 - DNA, 20 bp, mouse
ggaaaagacgaggtacatca

SEQ ID NO: 777439 - DNA, 20 bp, mouse
gtggtcagttgatgggttct

SEQ ID NO: 777440 - DNA, 20 bp, mouse
gctaggaataatattcttgg

SEQ ID NO: 777441 - DNA, 20 bp, mouse
gtggcaccgaggagttataa

SEQ ID NO: 777442 - DNA, 20 bp, mouse
ggactcttctgtgctctcac

SEQ ID NO: 777443 - DNA, 20 bp, mouse
gacgggagggcaagtacaaa

SEQ ID NO: 777444 - DNA, 20 bp, mouse
gggttctacttctaccttga

SEQ ID NO: 777445 - DNA, 20 bp, mouse
gggtaatcttagaaaagacg

SEQ ID NO: 777446 - DNA, 20 bp, mouse
gaggtagatggttaagatag

SEQ ID NO: 777447 - DNA, 20 bp, mouse
gtggaatgttgaagagggct

SEQ ID NO: 777448 - DNA, 20 bp, mouse
gaccagaagtaggaggtaga

SEQ ID NO: 777449 - DNA, 20 bp, mouse
gccactaaaccagaagtagg

SEQ ID NO: 777450 - DNA, 20 bp, mouse
gctgcaactcccgtaagata

SEQ ID NO: 777451 - DNA, 20 bp, mouse
gcgtaagatatggacagcaa

SEQ ID NO: 777452 - DNA, 20 bp, mouse
gtctgagatcacatatacaa

SEQ ID NO: 777453 - DNA, 20 bp, mouse
gtcctaatctcatgttaatg

SEQ ID NO: 777454 - DNA, 20 bp, mouse
gaatattattccttaagaaa

SEQ ID NO: 777455 - DNA, 20 bp, mouse
gatattgaagccatttctta

SEQ ID NO: 777456 - DNA, 20 bp, mouse
gcagaagcaagaataatcgt

SEQ ID NO: 777457 - DNA, 20 bp, mouse
gaggtgaatgtcatggtaga

SEQ ID NO: 777458 - DNA, 20 bp, mouse
gacttgggaggtgaatgtca

SEQ ID NO: 777459 - DNA, 20 bp, mouse
gtcttttgagattatcactt

SEQ ID NO: 777460 - DNA, 20 bp, mouse
gtacttgtcagcataagagt

SEQ ID NO: 777461 - DNA, 20 bp, mouse
gtgttctttgtgtaatttta

SEQ ID NO: 777462 - DNA, 20 bp, mouse
ggtaattttaaggatgttgg

SEQ ID NO: 777463 - DNA, 20 bp, mouse
gtgtgtaattttaaggatgt

SEQ ID NO: 777464 - DNA, 20 bp, mouse
gagacatgggagtattattc

SEQ ID NO: 777465 - DNA, 20 bp, mouse
gaatctcaaaagaatggaaa

SEQ ID NO: 777466 - DNA, 20 bp, mouse
ggggttgctcagaggtagtt

SEQ ID NO: 777467 - DNA, 20 bp, mouse
gggctcactgggttgctcag

SEQ ID NO: 777468 - DNA, 20 bp, mouse
gacaaaggtaagtattgaac

SEQ ID NO: 777469 - DNA, 20 bp, mouse
gccttctctaccacagaggt

SEQ ID NO: 777470 - DNA, 20 bp, mouse
gtgctatttaccaacctctg

SEQ ID NO: 777471 - DNA, 20 bp, mouse
gaggttctgctccttggact

SEQ ID NO: 777472 - DNA, 20 bp, mouse
ggcttctgtactctctgaaa

SEQ ID NO: 777473 - DNA, 20 bp, mouse
gtaaccattattatctttgt

SEQ ID NO: 777474 - DNA, 20 bp, mouse
gctacattttatggtagtta

SEQ ID NO: 777475 - DNA, 20 bp, mouse
gcttgtaaagtcatatacaa

SEQ ID NO: 777476 - DNA, 20 bp, mouse
gttgaaaaccagtgccaaca

SEQ ID NO: 777477 - DNA, 20 bp, mouse
gcagaagcaaaaattactat

SEQ ID NO: 777478 - DNA, 20 bp, mouse
gcacacagatgttcttaaag

SEQ ID NO: 777479 - DNA, 20 bp, mouse
gtaagtaatcctatccttgt

SEQ ID NO: 777480 - DNA, 20 bp, mouse
gatgacacaaagaaccatca

SEQ ID NO: 777481 - DNA, 20 bp, mouse
gtctaagagtagagaaaaaa

SEQ ID NO: 777482 - DNA, 20 bp, mouse
gtataatattctcaaagaag

SEQ ID NO: 777483 - DNA, 20 bp, mouse
gtacttatattcttccatga

SEQ ID NO: 777484 - DNA, 20 bp, mouse
gaagtgataatctcaaagga

SEQ ID NO: 777485 - DNA, 20 bp, mouse
gtcattttaaggatattggt

SEQ ID NO: 777486 - DNA, 20 bp, mouse
gaaaaaggacagttgggtgc

SEQ ID NO: 777487 - DNA, 20 bp, mouse
ggtgaagggtcacattagca

SEQ ID NO: 777488 - DNA, 20 bp, mouse
gttaatcttcattaggagtt

SEQ ID NO: 777489 - DNA, 20 bp, mouse
gtgatttaaaaaggacagtt

SEQ ID NO: 777490 - DNA, 20 bp, mouse
gcatcagcagttacatattt

SEQ ID NO: 777491 - DNA, 20 bp, mouse
gctctgtcagtgatttaaaa

SEQ ID NO: 777492 - DNA, 20 bp, mouse
gtatttggctggttttttta

SEQ ID NO: 777493 - DNA, 20 bp, mouse
gggctcatgcattaaagact

SEQ ID NO: 777494 - DNA, 20 bp, mouse
gaaagaagtaaatatttctc

SEQ ID NO: 777495 - DNA, 20 bp, mouse
gcaactgtaactgtcccttt

SEQ ID NO: 777496 - DNA, 20 bp, mouse
gatcctaattggggaaggaa

SEQ ID NO: 777497 - DNA, 20 bp, mouse
gaaagaaacaaatcctaatt

SEQ ID NO: 777498 - DNA, 20 bp, mouse
gcattcaattgttgcaacac

SEQ ID NO: 777499 - DNA, 20 bp, mouse
gccctaccaaagttacactg

SEQ ID NO: 777500 - DNA, 20 bp, mouse
ggtcccttccttccccaatt

SEQ ID NO: 777501 - DNA, 20 bp, mouse
gagtagctataaagtctctg

SEQ ID NO: 777502 - DNA, 20 bp, mouse
gacattccacagtgtaactt

SEQ ID NO: 777503 - DNA, 20 bp, mouse
gtccacagtgtaactttggt

SEQ ID NO: 777504 - DNA, 20 bp, mouse
gtttatcagacaaaaaattt

SEQ ID NO: 777505 - DNA, 20 bp, mouse
gattttgagaatatgctgca

SEQ ID NO: 777506 - DNA, 20 bp, mouse
ggcagcaagagatgatctat

SEQ ID NO: 777507 - DNA, 20 bp, mouse
ggctaaacaaatcatgggta

SEQ ID NO: 777508 - DNA, 20 bp, mouse
gttgctgcaacagcagagtt

SEQ ID NO: 777509 - DNA, 20 bp, mouse
gtagacagctaaacaaatca

SEQ ID NO: 777510 - DNA, 20 bp, mouse
gctctctgagcacagtgtaa

SEQ ID NO: 777511 - DNA, 20 bp, mouse
ggagaaattagcaattagtt

SEQ ID NO: 777512 - DNA, 20 bp, mouse
gttgtactgtcactcatatt

SEQ ID NO: 777513 - DNA, 20 bp, mouse
gcaccatgaactccaatgtc

SEQ ID NO: 777514 - DNA, 20 bp, mouse
gaagttgttaataatgaaaa

SEQ ID NO: 777515 - DNA, 20 bp, mouse
gggaaggctcaaggtgaata

SEQ ID NO: 777516 - DNA, 20 bp, mouse
ggaaggctccagatgaatca

SEQ ID NO: 777517 - DNA, 20 bp, mouse
gccctctgtgcacagcgaac

SEQ ID NO: 777518 - DNA, 20 bp, mouse
gaacacttcagaaagatgct

SEQ ID NO: 777519 - DNA, 20 bp, mouse
gtgaagtgttatacacaaga

SEQ ID NO: 777520 - DNA, 20 bp, mouse
gagagcagagcaaaagttat

SEQ ID NO: 777521 - DNA, 20 bp, mouse
gtgctacaagaagttccctt

SEQ ID NO: 777522 - DNA, 20 bp, mouse
gtaccatgaactccgatgtc

SEQ ID NO: 777523 - DNA, 20 bp, mouse
gtagtgtttactaacattta

SEQ ID NO: 777524 - DNA, 20 bp, mouse
gttaagattacatacaattt

SEQ ID NO: 777525 - DNA, 20 bp, mouse
gtcctgttcgctgtgcacag

SEQ ID NO: 777526 - DNA, 20 bp, mouse
ggagttctgactgtactttt

SEQ ID NO: 777527 - DNA, 20 bp, mouse
gctaggaattagtgcggaag

SEQ ID NO: 777528 - DNA, 20 bp, mouse
gacttcactaggaattagtg

SEQ ID NO: 777529 - DNA, 20 bp, mouse
ggaagtctaggaaaaccaag

SEQ ID NO: 777530 - DNA, 20 bp, mouse
ggagtaatgtgaagagacac

SEQ ID NO: 777531 - DNA, 20 bp, mouse
gggagaaatggggctttttg

SEQ ID NO: 777532 - DNA, 20 bp, mouse
gactggagttcttgctaact

SEQ ID NO: 777533 - DNA, 20 bp, mouse
gactgtccagagattgtcta

SEQ ID NO: 777534 - DNA, 20 bp, mouse
gctaattcctagtgaagtct

SEQ ID NO: 777535 - DNA, 20 bp, mouse
gagttcttgctaactgggtt

SEQ ID NO: 777536 - DNA, 20 bp, mouse
gccagggagaggaaccctga

SEQ ID NO: 777537 - DNA, 20 bp, mouse
ggcagggaattgaactgctg

SEQ ID NO: 777538 - DNA, 20 bp, mouse
gaggaaccctgagggctgtg

SEQ ID NO: 777539 - DNA, 20 bp, mouse
gtggatccccacagccctca

SEQ ID NO: 777540 - DNA, 20 bp, mouse
gaactgctgtggtgtgctcc

SEQ ID NO: 777541 - DNA, 20 bp, mouse
gtgtggtgtgctccagggag

SEQ ID NO: 777542 - DNA, 20 bp, mouse
gccactcagaggcaaacagt

SEQ ID NO: 777543 - DNA, 20 bp, mouse
gggaataggagcagagacta

SEQ ID NO: 777544 - DNA, 20 bp, mouse
gcttgctgaggaagatgctg

SEQ ID NO: 777545 - DNA, 20 bp, mouse
gcagaggcaaacagtgggtg

SEQ ID NO: 777546 - DNA, 20 bp, mouse
gaatgagttgggtgccacta

SEQ ID NO: 777547 - DNA, 20 bp, mouse
gatagagtccactagctgag

SEQ ID NO: 777548 - DNA, 20 bp, mouse
gacatcagtctcctttgccc

SEQ ID NO: 777549 - DNA, 20 bp, mouse
gtaggtgacgggcctggaga

SEQ ID NO: 777550 - DNA, 20 bp, mouse
gtggactctatctgaccagg

SEQ ID NO: 777551 - DNA, 20 bp, mouse
gtagtggactctatctgacc

SEQ ID NO: 777552 - DNA, 20 bp, mouse
gctgttctccaccacactcc

SEQ ID NO: 777553 - DNA, 20 bp, mouse
gaagaaaagtccttaggtga

SEQ ID NO: 777554 - DNA, 20 bp, mouse
gtttcagtgtgttaccgtag

SEQ ID NO: 777555 - DNA, 20 bp, mouse
ggagaaaagggcaaagaaac

SEQ ID NO: 777556 - DNA, 20 bp, mouse
ggatccaggggttcaaacca

SEQ ID NO: 777557 - DNA, 20 bp, mouse
ggaacccctggatccatagc

SEQ ID NO: 777558 - DNA, 20 bp, mouse
ggcagagatggataggtttg

SEQ ID NO: 777559 - DNA, 20 bp, mouse
ggagaccaacatggagtctg

SEQ ID NO: 777560 - DNA, 20 bp, mouse
gggatccatagcaggaaaag

SEQ ID NO: 777561 - DNA, 20 bp, mouse
gtttcctgctatggatccag

SEQ ID NO: 777562 - DNA, 20 bp, mouse
gggagtctgaggtcggagct

SEQ ID NO: 777563 - DNA, 20 bp, mouse
gcggagctaggctatcacgg

SEQ ID NO: 777564 - DNA, 20 bp, mouse
gtcctcatgtgagaccaaca

SEQ ID NO: 777565 - DNA, 20 bp, mouse
gtccatgttggtctcacatg

SEQ ID NO: 777566 - DNA, 20 bp, mouse
gaatcttgagacttggtctt

SEQ ID NO: 777567 - DNA, 20 bp, mouse
gatgtctgaagcagatgtct

SEQ ID NO: 777568 - DNA, 20 bp, mouse
gagacatcattaatgtagga

SEQ ID NO: 777569 - DNA, 20 bp, mouse
gctgtcaagaaaaacttaag

SEQ ID NO: 777570 - DNA, 20 bp, mouse
gcttcagacatcattaatgt

SEQ ID NO: 777571 - DNA, 20 bp, mouse
gttcgttcataccatattag

SEQ ID NO: 777572 - DNA, 20 bp, mouse
gagtcagtaatcttgagact

SEQ ID NO: 777573 - DNA, 20 bp, mouse
gattactgactttgtgatat

SEQ ID NO: 777574 - DNA, 20 bp, mouse
gactcttcttcttatagttt

SEQ ID NO: 777575 - DNA, 20 bp, mouse
gaaattttcttacagtcata

SEQ ID NO: 777576 - DNA, 20 bp, mouse
gcactggtggggaaagaacc

SEQ ID NO: 777577 - DNA, 20 bp, mouse
ggtggggaaagaaccaggat

SEQ ID NO: 777578 - DNA, 20 bp, mouse
gttccccaccagtgaagtgt

SEQ ID NO: 777579 - DNA, 20 bp, mouse
gcaacccacacttcactggt

SEQ ID NO: 777580 - DNA, 20 bp, mouse
gtactcaacccacacttcac

SEQ ID NO: 777581 - DNA, 20 bp, mouse
gtgaggccttggccactgac

SEQ ID NO: 777582 - DNA, 20 bp, mouse
ggtggatattaacttaactg

SEQ ID NO: 777583 - DNA, 20 bp, mouse
gggccttggccactgactgg

SEQ ID NO: 777584 - DNA, 20 bp, mouse
gcacataaaattggaggctg

SEQ ID NO: 777585 - DNA, 20 bp, mouse
ggtataagataatttgccga

SEQ ID NO: 777586 - DNA, 20 bp, mouse
gcaaggatttggcctgtata

SEQ ID NO: 777587 - DNA, 20 bp, mouse
gttgtatgaaagacggttgg

SEQ ID NO: 777588 - DNA, 20 bp, mouse
gaggcaatgattgtattaaa

SEQ ID NO: 777589 - DNA, 20 bp, mouse
gctctatgttgtatgaaaga

SEQ ID NO: 777590 - DNA, 20 bp, mouse
gttgcataggaaggggagtt

SEQ ID NO: 777591 - DNA, 20 bp, mouse
gttaaagggattagttctaa

SEQ ID NO: 777592 - DNA, 20 bp, mouse
gttagcagttataggctgta

SEQ ID NO: 777593 - DNA, 20 bp, mouse
gcccttcctatgcaaggatt

SEQ ID NO: 777594 - DNA, 20 bp, mouse
gtgtggcctttctctagaga

SEQ ID NO: 777595 - DNA, 20 bp, mouse
ggccaaatccttgcatagga

SEQ ID NO: 777596 - DNA, 20 bp, mouse
gccactcatggtcatgataa

SEQ ID NO: 777597 - DNA, 20 bp, mouse
gaaactactgaattgaaggc

SEQ ID NO: 777598 - DNA, 20 bp, mouse
gggagactctattccactca

SEQ ID NO: 777599 - DNA, 20 bp, mouse
gacttaaactactgaattga

SEQ ID NO: 777600 - DNA, 20 bp, mouse
gacctctattcagattagac

SEQ ID NO: 777601 - DNA, 20 bp, mouse
ggttcaacttggctgtacct

SEQ ID NO: 777602 - DNA, 20 bp, mouse
gcgtgactgctcacaaacca

SEQ ID NO: 777603 - DNA, 20 bp, mouse
gccctgtctaatctgaatag

SEQ ID NO: 777604 - DNA, 20 bp, mouse
gaagctagtaaatcaagtaa

SEQ ID NO: 777605 - DNA, 20 bp, mouse
gttcatatacaactgactat

SEQ ID NO: 777606 - DNA, 20 bp, mouse
gtaagggagaagggtaaagc

SEQ ID NO: 777607 - DNA, 20 bp, mouse
gaatgcatttcatgtttaaa

SEQ ID NO: 777608 - DNA, 20 bp, mouse
gatgatatcacattactcaa

SEQ ID NO: 777609 - DNA, 20 bp, mouse
gaatgtgatatcatgaaatg

SEQ ID NO: 777610 - DNA, 20 bp, mouse
gaacaatactaaagagagaa

SEQ ID NO: 777611 - DNA, 20 bp, mouse
gcaatgagaggatgtgttaa

SEQ ID NO: 777612 - DNA, 20 bp, mouse
gccaaacttctatataattg

SEQ ID NO: 777613 - DNA, 20 bp, mouse
gtgtctatctgctagtttaa

SEQ ID NO: 777614 - DNA, 20 bp, mouse
gactcttctatctcaatgag

SEQ ID NO: 777615 - DNA, 20 bp, mouse
gttagaaaaactaagggaga

SEQ ID NO: 777616 - DNA, 20 bp, mouse
gagtaagacaagacgaggag

SEQ ID NO: 777617 - DNA, 20 bp, mouse
gaaaacaaggagctgctggg

SEQ ID NO: 777618 - DNA, 20 bp, mouse
gaagacaagacgaggagcgg

SEQ ID NO: 777619 - DNA, 20 bp, mouse
gtcaaatgctagtggtcctg

SEQ ID NO: 777620 - DNA, 20 bp, mouse
gtgattctgtcaaatgctag

SEQ ID NO: 777621 - DNA, 20 bp, mouse
gctttgggtaagggaaaaag

SEQ ID NO: 777622 - DNA, 20 bp, mouse
gtagtggtcctgaggaaaca

SEQ ID NO: 777623 - DNA, 20 bp, mouse
ggaatcagaggctccagtaa

SEQ ID NO: 777624 - DNA, 20 bp, mouse
gcctctgattctttgggtaa

SEQ ID NO: 777625 - DNA, 20 bp, mouse
ggaacaggtgcatcctttac

SEQ ID NO: 777626 - DNA, 20 bp, mouse
ggatgagatcaatgggagat

SEQ ID NO: 777627 - DNA, 20 bp, mouse
gcctcaagagatgagatcaa

SEQ ID NO: 777628 - DNA, 20 bp, mouse
gagtgctttactttatatgc

SEQ ID NO: 777629 - DNA, 20 bp, mouse
gaaagtttgaatgaaatctg

SEQ ID NO: 777630 - DNA, 20 bp, mouse
gagaaggtcatacctttgtc

SEQ ID NO: 777631 - DNA, 20 bp, mouse
gtaagggaaggaactatctt

SEQ ID NO: 777632 - DNA, 20 bp, mouse
gagaagcagctgtgacttct

SEQ ID NO: 777633 - DNA, 20 bp, mouse
gcaaagtgattttgtagagc

SEQ ID NO: 777634 - DNA, 20 bp, mouse
gttgtgaaggtactgtataa

SEQ ID NO: 777635 - DNA, 20 bp, mouse
gtctatcttagttttgtgtg

SEQ ID NO: 777636 - DNA, 20 bp, mouse
gtgagcagaaattaccattc

SEQ ID NO: 777637 - DNA, 20 bp, mouse
gccccatagtggtacattta

SEQ ID NO: 777638 - DNA, 20 bp, mouse
gacacctgtgaagtgaatga

SEQ ID NO: 777639 - DNA, 20 bp, mouse
gaatcactcagctatcaaat

SEQ ID NO: 777640 - DNA, 20 bp, mouse
ggtgacaaatgttgagatga

SEQ ID NO: 777641 - DNA, 20 bp, mouse
gcaattgacagcaatagttg

SEQ ID NO: 777642 - DNA, 20 bp, mouse
gacacaaccacagtagtatt

SEQ ID NO: 777643 - DNA, 20 bp, mouse
ggagtgatatttccccatag

SEQ ID NO: 777644 - DNA, 20 bp, mouse
ggttagcttcaagttgtcac

SEQ ID NO: 777645 - DNA, 20 bp, mouse
gagacttgaagcaatgatgt

SEQ ID NO: 777646 - DNA, 20 bp, mouse
gccactgacctcatctctta

SEQ ID NO: 777647 - DNA, 20 bp, mouse
gtaagggaaatcttttgttg

SEQ ID NO: 777648 - DNA, 20 bp, mouse
gaagagcaggtgtgtcttct

SEQ ID NO: 777649 - DNA, 20 bp, mouse
gaaaagtgactttgtaggac

SEQ ID NO: 777650 - DNA, 20 bp, mouse
gagagtacttactcaagagc

SEQ ID NO: 777651 - DNA, 20 bp, mouse
gatgtaaaggaagtttgaat

SEQ ID NO: 777652 - DNA, 20 bp, mouse
gatgatgaaggcaatgtata

SEQ ID NO: 777653 - DNA, 20 bp, mouse
gcttttgttgtggtatgttt

SEQ ID NO: 777654 - DNA, 20 bp, mouse
gatatgggaagaaaccaggc

SEQ ID NO: 777655 - DNA, 20 bp, mouse
gatgtatatgggaagaaacc

SEQ ID NO: 777656 - DNA, 20 bp, mouse
gagaagaggtagttggaatc

SEQ ID NO: 777657 - DNA, 20 bp, mouse
gccaactacctcttctcttc

SEQ ID NO: 777658 - DNA, 20 bp, mouse
gtcagggaaaactattgctc

SEQ ID NO: 777659 - DNA, 20 bp, mouse
gagaatactcttctctttgg

SEQ ID NO: 777660 - DNA, 20 bp, mouse
gtaattttaagaaagactga

SEQ ID NO: 777661 - DNA, 20 bp, mouse
gtcagggagagtattctaag

SEQ ID NO: 777662 - DNA, 20 bp, mouse
gacacacacgatattcttat

SEQ ID NO: 777663 - DNA, 20 bp, mouse
gcttctctttgggggattac

SEQ ID NO: 777664 - DNA, 20 bp, mouse
gagttgtataagcatctaaa

SEQ ID NO: 777665 - DNA, 20 bp, mouse
gactctccctgaagggataa

SEQ ID NO: 777666 - DNA, 20 bp, mouse
gtactattgaattctaacat

SEQ ID NO: 777667 - DNA, 20 bp, mouse
gaaacttgaagtataagcag

SEQ ID NO: 777668 - DNA, 20 bp, mouse
gttgaaaaatatattgataa

SEQ ID NO: 777669 - DNA, 20 bp, mouse
gggaggaaattgaatggacc

SEQ ID NO: 777670 - DNA, 20 bp, mouse
gtaatggtttcactgataca

SEQ ID NO: 777671 - DNA, 20 bp, mouse
gttcatggtagtgtgagtaa

SEQ ID NO: 777672 - DNA, 20 bp, mouse
gcaattgtcatttcacttca

SEQ ID NO: 777673 - DNA, 20 bp, mouse
gttgtgagagaagatatgat

SEQ ID NO: 777674 - DNA, 20 bp, mouse
gtgaatcatgttagcacaaa

SEQ ID NO: 777675 - DNA, 20 bp, mouse
gacaaagtttcttcagagac

SEQ ID NO: 777676 - DNA, 20 bp, mouse
ggattctgtacacctagtta

SEQ ID NO: 777677 - DNA, 20 bp, mouse
gtgttcttctagccataact

SEQ ID NO: 777678 - DNA, 20 bp, mouse
gggctgtactgaaggaagac

SEQ ID NO: 777679 - DNA, 20 bp, mouse
gtttgggagggctgtactga

SEQ ID NO: 777680 - DNA, 20 bp, mouse
gaaacaacaatatacattca

SEQ ID NO: 777681 - DNA, 20 bp, mouse
gtcatggaaagaatgtcttc

SEQ ID NO: 777682 - DNA, 20 bp, mouse
gctattttcattgttttggg

SEQ ID NO: 777683 - DNA, 20 bp, mouse
gacagaattatgaatctgca

SEQ ID NO: 777684 - DNA, 20 bp, mouse
gtagttttagattaaggata

SEQ ID NO: 777685 - DNA, 20 bp, mouse
gtgtactgaaggaagacagg

SEQ ID NO: 777686 - DNA, 20 bp, mouse
gtaccaacatacacttcaca

SEQ ID NO: 777687 - DNA, 20 bp, mouse
ggtagtgtttattctagtca

SEQ ID NO: 777688 - DNA, 20 bp, mouse
gataaaatatgacaaaataa

SEQ ID NO: 777689 - DNA, 20 bp, mouse
gaagaggtggtgggtgaaaa

SEQ ID NO: 777690 - DNA, 20 bp, mouse
gaagcattttaagaggtggt

SEQ ID NO: 777691 - DNA, 20 bp, mouse
gagttgcaacgtctctgata

SEQ ID NO: 777692 - DNA, 20 bp, mouse
gacaaaagcattttaagagg

SEQ ID NO: 777693 - DNA, 20 bp, mouse
gaattatgttatatggcggc

SEQ ID NO: 777694 - DNA, 20 bp, mouse
ggaaagaagacaggaggtgg

SEQ ID NO: 777695 - DNA, 20 bp, mouse
gaaaataggaagcagctacc

SEQ ID NO: 777696 - DNA, 20 bp, mouse
gcccactggcaaacttattg

SEQ ID NO: 777697 - DNA, 20 bp, mouse
gctgatagaactgaggtgtt

SEQ ID NO: 777698 - DNA, 20 bp, mouse
gctatgggaagcaggacatc

SEQ ID NO: 777699 - DNA, 20 bp, mouse
ggcctcaataagtttgccag

SEQ ID NO: 777700 - DNA, 20 bp, mouse
gttggtaaataacttaagca

SEQ ID NO: 777701 - DNA, 20 bp, mouse
ggggaatcaaaataagagta

SEQ ID NO: 777702 - DNA, 20 bp, mouse
gcagttctatcagaataacc

SEQ ID NO: 777703 - DNA, 20 bp, mouse
gaaataacttaagcagggac

SEQ ID NO: 777704 - DNA, 20 bp, mouse
gtttcagtgacatgaaacaa

SEQ ID NO: 777705 - DNA, 20 bp, mouse
gagcttttgttcatgacaac

SEQ ID NO: 777706 - DNA, 20 bp, mouse
gcattctcaaagaatatccg

SEQ ID NO: 777707 - DNA, 20 bp, mouse
gtatttacaagataggcatg

SEQ ID NO: 777708 - DNA, 20 bp, mouse
gaaatcaatatttacaagat

SEQ ID NO: 777709 - DNA, 20 bp, mouse
gcaaaatattagcaccattc

SEQ ID NO: 777710 - DNA, 20 bp, mouse
gttatgatgaacgttttcca

SEQ ID NO: 777711 - DNA, 20 bp, mouse
ggaattcaagattttcattt

SEQ ID NO: 777712 - DNA, 20 bp, mouse
gatttattatatctgttcat

SEQ ID NO: 777713 - DNA, 20 bp, mouse
gaaaaacccaaaaatacatg

SEQ ID NO: 777714 - DNA, 20 bp, mouse
gcaaattcctcatgtatttt

SEQ ID NO: 777715 - DNA, 20 bp, mouse
gtttcttcctttacaattaa

SEQ ID NO: 777716 - DNA, 20 bp, mouse
gtcctgaaatagtataccaa

SEQ ID NO: 777717 - DNA, 20 bp, mouse
gcacagttgcttataattgc

SEQ ID NO: 777718 - DNA, 20 bp, mouse
gtggactgatgtctgtcctg

SEQ ID NO: 777719 - DNA, 20 bp, mouse
gatttcaggagattcactca

SEQ ID NO: 777720 - DNA, 20 bp, mouse
gttataagcaactgtgtggt

SEQ ID NO: 777721 - DNA, 20 bp, mouse
ggcctttggtatactatttc

SEQ ID NO: 777722 - DNA, 20 bp, mouse
gtcgtggctgagacgaagtc

SEQ ID NO: 777723 - DNA, 20 bp, mouse
gtgggaagtgagaagtgcca

SEQ ID NO: 777724 - DNA, 20 bp, mouse
ggaaaaggaggaagcactct

SEQ ID NO: 777725 - DNA, 20 bp, mouse
gacgaagtcaggaaagtcct

SEQ ID NO: 777726 - DNA, 20 bp, mouse
ggaagctgtgtgtggaagaa

SEQ ID NO: 777727 - DNA, 20 bp, mouse
gagacaacagatacagattc

SEQ ID NO: 777728 - DNA, 20 bp, mouse
gctgacttacatgaccttag

SEQ ID NO: 777729 - DNA, 20 bp, mouse
gcagagagggcttccctcac

SEQ ID NO: 777730 - DNA, 20 bp, mouse
gcctgcatatatgtagtaaa

SEQ ID NO: 777731 - DNA, 20 bp, mouse
gggaagaaactggcacaggg

SEQ ID NO: 777732 - DNA, 20 bp, mouse
gctataatcactctagttag

SEQ ID NO: 777733 - DNA, 20 bp, mouse
gaagaagggggtagtgaatg

SEQ ID NO: 777734 - DNA, 20 bp, mouse
gaggagaggaacagagatct

SEQ ID NO: 777735 - DNA, 20 bp, mouse
gaactagagtgattataggc

SEQ ID NO: 777736 - DNA, 20 bp, mouse
gctgaagcaaagtccagaac

SEQ ID NO: 777737 - DNA, 20 bp, mouse
gtaaaagttatgatcttgat

SEQ ID NO: 777738 - DNA, 20 bp, mouse
gaactttgatgaagtaatgt

SEQ ID NO: 777739 - DNA, 20 bp, mouse
ggttcattattgctcaagat

SEQ ID NO: 777740 - DNA, 20 bp, mouse
gcactaccaattttcattta

SEQ ID NO: 777741 - DNA, 20 bp, mouse
gatgatcttgatgggctgga

SEQ ID NO: 777742 - DNA, 20 bp, mouse
gtatatacttctactatgac

SEQ ID NO: 777743 - DNA, 20 bp, mouse
gatatacaaggagttaagtt

SEQ ID NO: 777744 - DNA, 20 bp, mouse
gatttatggataaaatatag

SEQ ID NO: 777745 - DNA, 20 bp, mouse
gaaatatattagcatattag

SEQ ID NO: 777746 - DNA, 20 bp, mouse
gcctaaatgacagtcttcat

SEQ ID NO: 777747 - DNA, 20 bp, mouse
gttcattggctgtcaatgca

SEQ ID NO: 777748 - DNA, 20 bp, mouse
gaaggttgacatgcataaat

SEQ ID NO: 777749 - DNA, 20 bp, mouse
gaatacaagaattttcttgg

SEQ ID NO: 777750 - DNA, 20 bp, mouse
gtatgagcgagacgtgtgga

SEQ ID NO: 777751 - DNA, 20 bp, mouse
gtctagaatgtagtgagtta

SEQ ID NO: 777752 - DNA, 20 bp, mouse
gctagaacagaaactgacag

SEQ ID NO: 777753 - DNA, 20 bp, mouse
gtaagcaaagtgaaaacaca

SEQ ID NO: 777754 - DNA, 20 bp, mouse
gagaggtcttttggcgtccc

SEQ ID NO: 777755 - DNA, 20 bp, mouse
gctcttatgagcgagacgtg

SEQ ID NO: 777756 - DNA, 20 bp, mouse
gggtaagcttaagatactgg

SEQ ID NO: 777757 - DNA, 20 bp, mouse
ggatgagagatctactcaat

SEQ ID NO: 777758 - DNA, 20 bp, mouse
gtgcagtgtgtgattatctc

SEQ ID NO: 777759 - DNA, 20 bp, mouse
gctaggtaagcttaagatac

SEQ ID NO: 777760 - DNA, 20 bp, mouse
gcagggaaggcccctgtctt

SEQ ID NO: 777761 - DNA, 20 bp, mouse
gaggggccttccctgcagta

SEQ ID NO: 777762 - DNA, 20 bp, mouse
gacacaatgtaccttgccca

SEQ ID NO: 777763 - DNA, 20 bp, mouse
gtcccagcaaatcttgcgac

SEQ ID NO: 777764 - DNA, 20 bp, mouse
gtccctgtcgcaagatttgc

SEQ ID NO: 777765 - DNA, 20 bp, mouse
ggggttcatcttatgaagtg

SEQ ID NO: 777766 - DNA, 20 bp, mouse
gggggtaatcagattttcag

SEQ ID NO: 777767 - DNA, 20 bp, mouse
gaagtagtcagtaagatgaa

SEQ ID NO: 777768 - DNA, 20 bp, mouse
ggtctgtaattctttgtaca

SEQ ID NO: 777769 - DNA, 20 bp, mouse
gtacttggattcatgattga

SEQ ID NO: 777770 - DNA, 20 bp, mouse
gcatgagctttgaaagcttt

SEQ ID NO: 777771 - DNA, 20 bp, mouse
gtgatttcaattgttatact

SEQ ID NO: 777772 - DNA, 20 bp, mouse
gagggctttaagagaggaaa

SEQ ID NO: 777773 - DNA, 20 bp, mouse
gtatgggagggctttaagag

SEQ ID NO: 777774 - DNA, 20 bp, mouse
gaaagaaaaagggaggacaa

SEQ ID NO: 777775 - DNA, 20 bp, mouse
gagaaagaggagaagtttat

SEQ ID NO: 777776 - DNA, 20 bp, mouse
gtaaagagaggtagtcagta

SEQ ID NO: 777777 - DNA, 20 bp, mouse
gatatgggagggtttaagag

SEQ ID NO: 777778 - DNA, 20 bp, mouse
gagaggtagtcagtaaggtg

SEQ ID NO: 777779 - DNA, 20 bp, mouse
gcacgacgtggcttaaagag

SEQ ID NO: 777780 - DNA, 20 bp, mouse
gtgaacaaagtgacacgacg

SEQ ID NO: 777781 - DNA, 20 bp, mouse
gaaagctttcgatgcccatg

SEQ ID NO: 777782 - DNA, 20 bp, mouse
ggttgtctataattttgtag

SEQ ID NO: 777783 - DNA, 20 bp, mouse
gtaaacaagactaataaatt

SEQ ID NO: 777784 - DNA, 20 bp, mouse
ggtagagggttgatgcctca

SEQ ID NO: 777785 - DNA, 20 bp, mouse
gtttaagagaggaaatgcaa

SEQ ID NO: 777786 - DNA, 20 bp, mouse
gcaaggacctacttggtgat

SEQ ID NO: 777787 - DNA, 20 bp, mouse
gaggcaggtgagacaggtaa

SEQ ID NO: 777788 - DNA, 20 bp, mouse
gggtaaaaggcaggtgagac

SEQ ID NO: 777789 - DNA, 20 bp, mouse
gtggcaactaaacaggtaaa

SEQ ID NO: 777790 - DNA, 20 bp, mouse
gtccaaacccatcaccaagt

SEQ ID NO: 777791 - DNA, 20 bp, mouse
gctgactttctggttaatga

SEQ ID NO: 777792 - DNA, 20 bp, mouse
gactagtgcctctgactttc

SEQ ID NO: 777793 - DNA, 20 bp, mouse
gaggcaatgagatagcactg

SEQ ID NO: 777794 - DNA, 20 bp, mouse
ggtaaacattgtgagagcag

SEQ ID NO: 777795 - DNA, 20 bp, mouse
gacctacttggtgatgggtt

SEQ ID NO: 777796 - DNA, 20 bp, mouse
gaaaggaggcatattcatgg

SEQ ID NO: 777797 - DNA, 20 bp, mouse
gagctgagacatgattgttg

SEQ ID NO: 777798 - DNA, 20 bp, mouse
ggcaactaaagattacattt

SEQ ID NO: 777799 - DNA, 20 bp, mouse
gatgaaaggaggcatattca

SEQ ID NO: 777800 - DNA, 20 bp, mouse
gtttagttgcacatgaaagg

SEQ ID NO: 777801 - DNA, 20 bp, mouse
gcatttacccacacaactca

SEQ ID NO: 777802 - DNA, 20 bp, mouse
gaacttggaaacaaatttaa

SEQ ID NO: 777803 - DNA, 20 bp, mouse
gtccgagttcacacccaact

SEQ ID NO: 777804 - DNA, 20 bp, mouse
gggaaaaattgactctgttg

SEQ ID NO: 777805 - DNA, 20 bp, mouse
gggtgatacattagaagctc

SEQ ID NO: 777806 - DNA, 20 bp, mouse
gagctgagacaggattgatg

SEQ ID NO: 777807 - DNA, 20 bp, mouse
gtcacaagctagaaatttaa

SEQ ID NO: 777808 - DNA, 20 bp, mouse
gatatatgtaggcctttgac

SEQ ID NO: 777809 - DNA, 20 bp, mouse
gtgagacgggggtctaacaa

SEQ ID NO: 777810 - DNA, 20 bp, mouse
gttgagttgtggtttaaatt

SEQ ID NO: 777811 - DNA, 20 bp, mouse
gtttaacttttagtttcatt

SEQ ID NO: 777812 - DNA, 20 bp, mouse
ggtggctttgacagcagtta

SEQ ID NO: 777813 - DNA, 20 bp, mouse
gttattttgcttctacatac

SEQ ID NO: 777814 - DNA, 20 bp, mouse
gatttaaaggagatatatgt

SEQ ID NO: 777815 - DNA, 20 bp, mouse
gtacattatattatcactcc

SEQ ID NO: 777816 - DNA, 20 bp, mouse
gttatgaatggagtgttctt

SEQ ID NO: 777817 - DNA, 20 bp, mouse
gaagtatattagtattactg

SEQ ID NO: 777818 - DNA, 20 bp, mouse
ggcaaagtctctcttatgaa

SEQ ID NO: 777819 - DNA, 20 bp, mouse
gataaagttcaaatcaaggt

SEQ ID NO: 777820 - DNA, 20 bp, mouse
gtaaaaaatgaattgtattc

SEQ ID NO: 777821 - DNA, 20 bp, mouse
gtcttctttgctctctcgtt

SEQ ID NO: 777822 - DNA, 20 bp, mouse
gtaaagtgagttaacattat

SEQ ID NO: 777823 - DNA, 20 bp, mouse
gaaaaataaagttcaaatca

SEQ ID NO: 777824 - DNA, 20 bp, mouse
gacaaacactcttatgttac

SEQ ID NO: 777825 - DNA, 20 bp, mouse
gcatgagagaaatttttaat

SEQ ID NO: 777826 - DNA, 20 bp, mouse
ggatttccacatactaaata

SEQ ID NO: 777827 - DNA, 20 bp, mouse
gaatactaaggccaaaggtt

SEQ ID NO: 777828 - DNA, 20 bp, mouse
gctgtaccatatttagtatg

SEQ ID NO: 777829 - DNA, 20 bp, mouse
gttagaaatactaaggccaa

SEQ ID NO: 777830 - DNA, 20 bp, mouse
gagctgtgtctcttaataaa

SEQ ID NO: 777831 - DNA, 20 bp, mouse
gaaacataaagttcttattc

SEQ ID NO: 777832 - DNA, 20 bp, mouse
gtcaattaaatgacagttaa

SEQ ID NO: 777833 - DNA, 20 bp, mouse
gtgttatgtgcaattgtttt

SEQ ID NO: 777834 - DNA, 20 bp, mouse
gctctattcacaaaagttga

SEQ ID NO: 777835 - DNA, 20 bp, mouse
gattgcacataacacataaa

SEQ ID NO: 777836 - DNA, 20 bp, mouse
gaacttctacatagtaaaga

SEQ ID NO: 777837 - DNA, 20 bp, mouse
gttaagaataataggatcag

SEQ ID NO: 777838 - DNA, 20 bp, mouse
gtatatgtgacaaagtaaaa

SEQ ID NO: 777839 - DNA, 20 bp, mouse
gggtcatattgaattgtagg

SEQ ID NO: 777840 - DNA, 20 bp, mouse
gcgtggtcatattgaattgt

SEQ ID NO: 777841 - DNA, 20 bp, mouse
gaagatggtacagtaaaacg

SEQ ID NO: 777842 - DNA, 20 bp, mouse
gtgattcacaaaagttgagg

SEQ ID NO: 777843 - DNA, 20 bp, mouse
gtctctgccatttataattt

SEQ ID NO: 777844 - DNA, 20 bp, mouse
gattgtgcctaaattataaa

SEQ ID NO: 777845 - DNA, 20 bp, mouse
gtcaacttttgtgaatcaga

SEQ ID NO: 777846 - DNA, 20 bp, mouse
ggatctacaacaattgagtg

SEQ ID NO: 777847 - DNA, 20 bp, mouse
ggtgatatggaatctatcaa

SEQ ID NO: 777848 - DNA, 20 bp, mouse
gtaatgatcaaagtgctcac

SEQ ID NO: 777849 - DNA, 20 bp, mouse
gttaaggcctgctcaaaagt

SEQ ID NO: 777850 - DNA, 20 bp, mouse
ggtaaatggcactaaaatca

SEQ ID NO: 777851 - DNA, 20 bp, mouse
gaccaggcctacttttgagc

SEQ ID NO: 777852 - DNA, 20 bp, mouse
gatgtccttaagagtgtaaa

SEQ ID NO: 777853 - DNA, 20 bp, mouse
gagtgccatttacactctta

SEQ ID NO: 777854 - DNA, 20 bp, mouse
gtaaggtctatgactttata

SEQ ID NO: 777855 - DNA, 20 bp, mouse
ggtctatgactttataaggc

SEQ ID NO: 777856 - DNA, 20 bp, mouse
gtgctagaatgattcatcca

SEQ ID NO: 777857 - DNA, 20 bp, mouse
gattcatccatggtagtata

SEQ ID NO: 777858 - DNA, 20 bp, mouse
gtggtacccatatactacca

SEQ ID NO: 777859 - DNA, 20 bp, mouse
gtcactatcaaatgtaatta

SEQ ID NO: 777860 - DNA, 20 bp, mouse
gtcaaatgtaattatggcta

SEQ ID NO: 777861 - DNA, 20 bp, mouse
gtcttaaaacactcaattaa

SEQ ID NO: 777862 - DNA, 20 bp, mouse
gaagaattttttttttgccc

SEQ ID NO: 777863 - DNA, 20 bp, mouse
gttataagaactaattttat

SEQ ID NO: 777864 - DNA, 20 bp, mouse
gttctagtctactggatttt

SEQ ID NO: 777865 - DNA, 20 bp, mouse
gttacatgtctcttttctcc

SEQ ID NO: 777866 - DNA, 20 bp, mouse
ggctccatctagtctcactc

SEQ ID NO: 777867 - DNA, 20 bp, mouse
ggttgcccttccagggatta

SEQ ID NO: 777868 - DNA, 20 bp, mouse
gagaaccaggaacacagacc

SEQ ID NO: 777869 - DNA, 20 bp, mouse
gagacaggcagagacaacgg

SEQ ID NO: 777870 - DNA, 20 bp, mouse
gtagacaacgcccactttta

SEQ ID NO: 777871 - DNA, 20 bp, mouse
gtggaagggcaaccagaacc

SEQ ID NO: 777872 - DNA, 20 bp, mouse
gccaagtgcgctctgatagg

SEQ ID NO: 777873 - DNA, 20 bp, mouse
gtatctttatagctgccctt

SEQ ID NO: 777874 - DNA, 20 bp, mouse
gaagccaagtgcgctctgat

SEQ ID NO: 777875 - DNA, 20 bp, mouse
gctaaccaggtctgtgttcc

SEQ ID NO: 777876 - DNA, 20 bp, mouse
gagggtggatggggtcgccg

SEQ ID NO: 777877 - DNA, 20 bp, mouse
gaaaagttgtgtaacaagaa

SEQ ID NO: 777878 - DNA, 20 bp, mouse
gggatggggtcgccgaggaa

SEQ ID NO: 777879 - DNA, 20 bp, mouse
gggaagggaaactcggaagt

SEQ ID NO: 777880 - DNA, 20 bp, mouse
gttgttacacaacttttcag

SEQ ID NO: 777881 - DNA, 20 bp, mouse
gtgtaacaagaagggtggat

SEQ ID NO: 777882 - DNA, 20 bp, mouse
gtgacccagcaggtgtgggt

SEQ ID NO: 777883 - DNA, 20 bp, mouse
gtactatgacccagcaggtg

SEQ ID NO: 777884 - DNA, 20 bp, mouse
gcctaccaacccacacctgc

SEQ ID NO: 777885 - DNA, 20 bp, mouse
gagaataatgagaatcctta

SEQ ID NO: 777886 - DNA, 20 bp, mouse
gaatgtctaaagtaaagctc

SEQ ID NO: 777887 - DNA, 20 bp, mouse
gcttaaggcaattatattga

SEQ ID NO: 777888 - DNA, 20 bp, mouse
ggtgaaaattaattgagctc

SEQ ID NO: 777889 - DNA, 20 bp, mouse
gttcaaataataaatggaat

SEQ ID NO: 777890 - DNA, 20 bp, mouse
gtttgaaacttgttactaat

SEQ ID NO: 777891 - DNA, 20 bp, mouse
gaaaatatcccactgtgtca

SEQ ID NO: 777892 - DNA, 20 bp, mouse
gatctaagctaattcactta

SEQ ID NO: 777893 - DNA, 20 bp, mouse
gtaaactttattcagttaat

SEQ ID NO: 777894 - DNA, 20 bp, mouse
gaatacttccttgacacagt

SEQ ID NO: 777895 - DNA, 20 bp, mouse
gacaagtttcaaataataaa

SEQ ID NO: 777896 - DNA, 20 bp, mouse
gaggatgaggattctgtctt

SEQ ID NO: 777897 - DNA, 20 bp, mouse
gtcctcaacacagacagtca

SEQ ID NO: 777898 - DNA, 20 bp, mouse
gtatataaattatctgccat

SEQ ID NO: 777899 - DNA, 20 bp, mouse
gacctggtgctactaggatg

SEQ ID NO: 777900 - DNA, 20 bp, mouse
ggttaaagctattatataca

SEQ ID NO: 777901 - DNA, 20 bp, mouse
gattcactgttttttaggaa

SEQ ID NO: 777902 - DNA, 20 bp, mouse
ggctattatatacagggcaa

SEQ ID NO: 777903 - DNA, 20 bp, mouse
gtcctcatcctagtagcacc

SEQ ID NO: 777904 - DNA, 20 bp, mouse
gatctaaattggataaaaag

SEQ ID NO: 777905 - DNA, 20 bp, mouse
gaatgtgtaatttggatttt

SEQ ID NO: 777906 - DNA, 20 bp, mouse
ggtagaaaagtgtcccactg

SEQ ID NO: 777907 - DNA, 20 bp, mouse
gcttgcttctgcaccacagt

SEQ ID NO: 777908 - DNA, 20 bp, mouse
gttgggaatcaatgattatt

SEQ ID NO: 777909 - DNA, 20 bp, mouse
gcctttgtgaaagttgattt

SEQ ID NO: 777910 - DNA, 20 bp, mouse
gctaagttgagatggaaagt

SEQ ID NO: 777911 - DNA, 20 bp, mouse
gtggaccatctttagctata

SEQ ID NO: 777912 - DNA, 20 bp, mouse
gtaacactaggattaagacc

SEQ ID NO: 777913 - DNA, 20 bp, mouse
gtgagtaccagcagggaaag

SEQ ID NO: 777914 - DNA, 20 bp, mouse
gaccccatctaaggaactat

SEQ ID NO: 777915 - DNA, 20 bp, mouse
ggctataaggactggacaca

SEQ ID NO: 777916 - DNA, 20 bp, mouse
ggatgacctgggtataacat

SEQ ID NO: 777917 - DNA, 20 bp, mouse
gtgggtactccttttttctt

SEQ ID NO: 777918 - DNA, 20 bp, mouse
ggttatacccaggtcatcct

SEQ ID NO: 777919 - DNA, 20 bp, mouse
gggtgaattgcagaccagtg

SEQ ID NO: 777920 - DNA, 20 bp, mouse
gcagaaacaaatatccatcc

SEQ ID NO: 777921 - DNA, 20 bp, mouse
gacaagcccatgttataccc

SEQ ID NO: 777922 - DNA, 20 bp, mouse
ggtggaatatagtgaatgct

SEQ ID NO: 777923 - DNA, 20 bp, mouse
gagggttcctaggatgacct

SEQ ID NO: 777924 - DNA, 20 bp, mouse
gggaatataattgaaaccta

SEQ ID NO: 777925 - DNA, 20 bp, mouse
gcttgatagcctaagaaaaa

SEQ ID NO: 777926 - DNA, 20 bp, mouse
gtattaggaattggaaaaat

SEQ ID NO: 777927 - DNA, 20 bp, mouse
gatctaatatgataaagtaa

SEQ ID NO: 777928 - DNA, 20 bp, mouse
gcagtattgaatacaatgtt

SEQ ID NO: 777929 - DNA, 20 bp, mouse
ggtaattatatacatgaaaa

SEQ ID NO: 777930 - DNA, 20 bp, mouse
ggtattcaatactgtaaaca

SEQ ID NO: 777931 - DNA, 20 bp, mouse
gataatcattcactgttttt

SEQ ID NO: 777932 - DNA, 20 bp, mouse
gtcatatatatgtgttataa

SEQ ID NO: 777933 - DNA, 20 bp, mouse
gaagcgctctgaagatccct

SEQ ID NO: 777934 - DNA, 20 bp, mouse
gagtgaaagtgcctgtgttg

SEQ ID NO: 777935 - DNA, 20 bp, mouse
gccctaggaaaagtatattt

SEQ ID NO: 777936 - DNA, 20 bp, mouse
gtatttataacatgtctctt

SEQ ID NO: 777937 - DNA, 20 bp, mouse
gctctgctcaaatcaaagag

SEQ ID NO: 777938 - DNA, 20 bp, mouse
gagcagagattttgcagtcc

SEQ ID NO: 777939 - DNA, 20 bp, mouse
gtaattgtagatattgtttt

SEQ ID NO: 777940 - DNA, 20 bp, mouse
gtcttgatttttaacctact

SEQ ID NO: 777941 - DNA, 20 bp, mouse
gtcaaagagaggatggccaa

SEQ ID NO: 777942 - DNA, 20 bp, mouse
gtatggctataaatcacttg

SEQ ID NO: 777943 - DNA, 20 bp, mouse
gcatatagaaaatcaaaaat

SEQ ID NO: 777944 - DNA, 20 bp, mouse
gctgaaacaaggtagaaaat

SEQ ID NO: 777945 - DNA, 20 bp, mouse
ggctcaaatcaaagagagga

SEQ ID NO: 777946 - DNA, 20 bp, mouse
gcatatacaagtgttataca

SEQ ID NO: 777947 - DNA, 20 bp, mouse
gagtcagtataacagactta

SEQ ID NO: 777948 - DNA, 20 bp, mouse
gacatacttgacacgtgatg

SEQ ID NO: 777949 - DNA, 20 bp, mouse
ggtctaaaaaataagagctc

SEQ ID NO: 777950 - DNA, 20 bp, mouse
ggtattcaatactgtaaaca

SEQ ID NO: 777951 - DNA, 20 bp, mouse
gtttgagactttgcaatgaa

SEQ ID NO: 777952 - DNA, 20 bp, mouse
gaagagctctggagatccct

SEQ ID NO: 777953 - DNA, 20 bp, mouse
gagtgaaagtgcctgtgttg

SEQ ID NO: 777954 - DNA, 20 bp, mouse
gccctaggaaaagtatattt

SEQ ID NO: 777955 - DNA, 20 bp, mouse
gaagcttacatcctcaacac

SEQ ID NO: 777956 - DNA, 20 bp, mouse
gtcaaaaagaggatggcaaa

SEQ ID NO: 777957 - DNA, 20 bp, mouse
ggaatgctcaaatcaaaaag

SEQ ID NO: 777958 - DNA, 20 bp, mouse
gtcattgagtgataggggaa

SEQ ID NO: 777959 - DNA, 20 bp, mouse
gttcagagattatgcagtcc

SEQ ID NO: 777960 - DNA, 20 bp, mouse
gatttatagcatgtctctat

SEQ ID NO: 777961 - DNA, 20 bp, mouse
gtatggctatgaatctcatg

SEQ ID NO: 777962 - DNA, 20 bp, mouse
gatgtaagaattatttttat

SEQ ID NO: 777963 - DNA, 20 bp, mouse
gatgaacaacaaaaatcagt

SEQ ID NO: 777964 - DNA, 20 bp, mouse
gctgaaacaaggtaaaaaat

SEQ ID NO: 777965 - DNA, 20 bp, mouse
gttcaattcctcactatcaa

SEQ ID NO: 777966 - DNA, 20 bp, mouse
gcctgggacccaaacatatt

SEQ ID NO: 777967 - DNA, 20 bp, mouse
gataaggaagtggagatatc

SEQ ID NO: 777968 - DNA, 20 bp, mouse
gagggctatgactattgata

SEQ ID NO: 777969 - DNA, 20 bp, mouse
ggcactgagtaaacatgaat

SEQ ID NO: 777970 - DNA, 20 bp, mouse
ggaaactagcacctaaagca

SEQ ID NO: 777971 - DNA, 20 bp, mouse
gaataccatacttccttaga

SEQ ID NO: 777972 - DNA, 20 bp, mouse
gattacatgcctaatatgtt

SEQ ID NO: 777973 - DNA, 20 bp, mouse
gttgacttacttgtttcagt

SEQ ID NO: 777974 - DNA, 20 bp, mouse
gcaccccctctaaggaagta

SEQ ID NO: 777975 - DNA, 20 bp, mouse
gatgatgacaacaccaatga

SEQ ID NO: 777976 - DNA, 20 bp, mouse
gcgtggacaaaacattcagt

SEQ ID NO: 777977 - DNA, 20 bp, mouse
gcaaaacattcagttggcta

SEQ ID NO: 777978 - DNA, 20 bp, mouse
gatgcaactggcagtgtgtt

SEQ ID NO: 777979 - DNA, 20 bp, mouse
ggtaaggctactattaatag

SEQ ID NO: 777980 - DNA, 20 bp, mouse
gatatgctgctccttcgcca

SEQ ID NO: 777981 - DNA, 20 bp, mouse
gtcggtggtggagaaagtct

SEQ ID NO: 777982 - DNA, 20 bp, mouse
gaacaagaaacgtctgcact

SEQ ID NO: 777983 - DNA, 20 bp, mouse
gattatgagcaatctttctg

SEQ ID NO: 777984 - DNA, 20 bp, mouse
gatacagcaaaactatttcg

SEQ ID NO: 777985 - DNA, 20 bp, mouse
gcacagaatgtctatgcttt

SEQ ID NO: 777986 - DNA, 20 bp, mouse
ggcagaaggaaatgcatagt

SEQ ID NO: 777987 - DNA, 20 bp, mouse
gctttgagtgtgattactat

SEQ ID NO: 777988 - DNA, 20 bp, mouse
gttcttttttatgataggca

SEQ ID NO: 777989 - DNA, 20 bp, mouse
gcaaatttcttttttatgat

SEQ ID NO: 777990 - DNA, 20 bp, mouse
gttactgtatcatagagtac

SEQ ID NO: 777991 - DNA, 20 bp, mouse
gtacttcatattagtttttc

SEQ ID NO: 777992 - DNA, 20 bp, mouse
gcattttacagatgtccatg

SEQ ID NO: 777993 - DNA, 20 bp, mouse
gtaatttgtacaatacctca

SEQ ID NO: 777994 - DNA, 20 bp, mouse
gagaaggaatactatctgtg

SEQ ID NO: 777995 - DNA, 20 bp, mouse
gtgctcaaagaaaatgccat

SEQ ID NO: 777996 - DNA, 20 bp, mouse
gtaagctcccctaggccatt

SEQ ID NO: 777997 - DNA, 20 bp, mouse
gtaaggtagcatactcctaa

SEQ ID NO: 777998 - DNA, 20 bp, mouse
gcatactcctaatggcctag

SEQ ID NO: 777999 - DNA, 20 bp, mouse
gaatatgggtaagctcccct

SEQ ID NO: 778000 - DNA, 20 bp, mouse
gcagctcggtagggacatga

SEQ ID NO: 778001 - DNA, 20 bp, mouse
gcactctggggctctgtcgc

SEQ ID NO: 778002 - DNA, 20 bp, mouse
gcggtagggacatgatggaa

SEQ ID NO: 778003 - DNA, 20 bp, mouse
ggggccatgttcagctcggt

SEQ ID NO: 778004 - DNA, 20 bp, mouse
ggaattatgcaggaattcca

SEQ ID NO: 778005 - DNA, 20 bp, mouse
gcagaagtgctgatggctgt

SEQ ID NO: 778006 - DNA, 20 bp, mouse
ggccctgcaaattattctca

SEQ ID NO: 778007 - DNA, 20 bp, mouse
gctccctgagaataatttgc

SEQ ID NO: 778008 - DNA, 20 bp, mouse
gtaccctccgtgctataata

SEQ ID NO: 778009 - DNA, 20 bp, mouse
gagatcatttgcataaagag

SEQ ID NO: 778010 - DNA, 20 bp, mouse
gggaagagaagttccctttt

SEQ ID NO: 778011 - DNA, 20 bp, mouse
gtgagcctgaatgaaactgg

SEQ ID NO: 778012 - DNA, 20 bp, mouse
gattctcagggagattttta

SEQ ID NO: 778013 - DNA, 20 bp, mouse
gggaacttgtagtgattaat

SEQ ID NO: 778014 - DNA, 20 bp, mouse
gttcacaagcttacccaaaa

SEQ ID NO: 778015 - DNA, 20 bp, mouse
gttagaggagtttaaattac

SEQ ID NO: 778016 - DNA, 20 bp, mouse
ggggtgcatggggtaggata

SEQ ID NO: 778017 - DNA, 20 bp, mouse
gagagtttagatcacagggg

SEQ ID NO: 778018 - DNA, 20 bp, mouse
gtaacaggggtgcatggggt

SEQ ID NO: 778019 - DNA, 20 bp, mouse
gtggcttggaaattgtctcc

SEQ ID NO: 778020 - DNA, 20 bp, mouse
ggaaatgagtagtgagtaac

SEQ ID NO: 778021 - DNA, 20 bp, mouse
ggaaggaaaccatctgcaat

SEQ ID NO: 778022 - DNA, 20 bp, mouse
gctcctgggtaaaaatttta

SEQ ID NO: 778023 - DNA, 20 bp, mouse
ggtgagtaacaggggtgcat

SEQ ID NO: 778024 - DNA, 20 bp, mouse
gtttctaaagaagggaagag

SEQ ID NO: 778025 - DNA, 20 bp, mouse
gaaaccatctgcaattggct

SEQ ID NO: 778026 - DNA, 20 bp, mouse
ggcccttggaaattatcttc

SEQ ID NO: 778027 - DNA, 20 bp, mouse
ggggatagaggggtgggcta

SEQ ID NO: 778028 - DNA, 20 bp, mouse
gacccagaagataatttcca

SEQ ID NO: 778029 - DNA, 20 bp, mouse
gttccaagggcaattgcaga

SEQ ID NO: 778030 - DNA, 20 bp, mouse
gactctagaaatgaggattg

SEQ ID NO: 778031 - DNA, 20 bp, mouse
ggaagagaagacactagcct

SEQ ID NO: 778032 - DNA, 20 bp, mouse
gggggtatctttcttcagtt

SEQ ID NO: 778033 - DNA, 20 bp, mouse
gctaaggataatagagagtt

SEQ ID NO: 778034 - DNA, 20 bp, mouse
ggcatctggaatgaaggaac

SEQ ID NO: 778035 - DNA, 20 bp, mouse
gaagctgtttttcatgatga

SEQ ID NO: 778036 - DNA, 20 bp, mouse
ggctgccaacagttcttcat

SEQ ID NO: 778037 - DNA, 20 bp, mouse
ggctcttctttgtgggttta

SEQ ID NO: 778038 - DNA, 20 bp, mouse
gaatggtcaaagtttttcat

SEQ ID NO: 778039 - DNA, 20 bp, mouse
gtaaaatatcagcatcatcg

SEQ ID NO: 778040 - DNA, 20 bp, mouse
gattaaaagacattaacatg

SEQ ID NO: 778041 - DNA, 20 bp, mouse
ggaattaaaataattttact

SEQ ID NO: 778042 - DNA, 20 bp, mouse
gcattttaatggtcatcgta

SEQ ID NO: 778043 - DNA, 20 bp, mouse
gtctcttcacttataattag

SEQ ID NO: 778044 - DNA, 20 bp, mouse
gatttgaagaaacattttaa

SEQ ID NO: 778045 - DNA, 20 bp, mouse
gtgttatagctcttctttgt

SEQ ID NO: 778046 - DNA, 20 bp, mouse
gtcatcagtcaagacaggag

SEQ ID NO: 778047 - DNA, 20 bp, mouse
ggtatctcatcagtcaagac

SEQ ID NO: 778048 - DNA, 20 bp, mouse
gtctcctgtcctatcacata

SEQ ID NO: 778049 - DNA, 20 bp, mouse
gctaaactacgagaatacat

SEQ ID NO: 778050 - DNA, 20 bp, mouse
gtcacacttccatatgtgat

SEQ ID NO: 778051 - DNA, 20 bp, mouse
gcgtagtttagatcatgaat

SEQ ID NO: 778052 - DNA, 20 bp, mouse
gaagaaaaagttagcacagg

SEQ ID NO: 778053 - DNA, 20 bp, mouse
ggacaaacatataagggaca

SEQ ID NO: 778054 - DNA, 20 bp, mouse
gactgagatatttacaaatt

SEQ ID NO: 778055 - DNA, 20 bp, mouse
gaaatctgacaaacatataa

SEQ ID NO: 778056 - DNA, 20 bp, mouse
gggttattaagatagaaggg

SEQ ID NO: 778057 - DNA, 20 bp, mouse
gtctggttattaagatagaa

SEQ ID NO: 778058 - DNA, 20 bp, mouse
gaataccacaagaagatcat

SEQ ID NO: 778059 - DNA, 20 bp, mouse
gtttaaacaggtccagaaaa

SEQ ID NO: 778060 - DNA, 20 bp, mouse
gtggaagcttgtgcaatgct

SEQ ID NO: 778061 - DNA, 20 bp, mouse
ggatcttcttgtggtattgg

SEQ ID NO: 778062 - DNA, 20 bp, mouse
ggtgttatatgatacttttc

SEQ ID NO: 778063 - DNA, 20 bp, mouse
gtagctattcaaaacttcaa

SEQ ID NO: 778064 - DNA, 20 bp, mouse
ggtgttaaacagaactctgt

SEQ ID NO: 778065 - DNA, 20 bp, mouse
gttgatatttgctatttgac

SEQ ID NO: 778066 - DNA, 20 bp, mouse
gaatccattgacaatgactg

SEQ ID NO: 778067 - DNA, 20 bp, mouse
ggaagtataatatcttagat

SEQ ID NO: 778068 - DNA, 20 bp, mouse
gataacagtagcttatgtta

SEQ ID NO: 778069 - DNA, 20 bp, mouse
gcaagtgtagcaatggttgc

SEQ ID NO: 778070 - DNA, 20 bp, mouse
gccattgctacacttgatga

SEQ ID NO: 778071 - DNA, 20 bp, mouse
gaacaatgttcattacctta

SEQ ID NO: 778072 - DNA, 20 bp, mouse
gatttctctatagagtgatt

SEQ ID NO: 778073 - DNA, 20 bp, mouse
gttatggttttatgttaaaa

SEQ ID NO: 778074 - DNA, 20 bp, mouse
gacccctcagtcattgtcaa

SEQ ID NO: 778075 - DNA, 20 bp, mouse
gaggggtcagacacattcag

SEQ ID NO: 778076 - DNA, 20 bp, mouse
gtgaaccaacgcgttcattg

SEQ ID NO: 778077 - DNA, 20 bp, mouse
ggagcagagtggtgatgcta

SEQ ID NO: 778078 - DNA, 20 bp, mouse
gcttgcctcaatgaacgcgt

SEQ ID NO: 778079 - DNA, 20 bp, mouse
ggcgttcattgaggcaagag

SEQ ID NO: 778080 - DNA, 20 bp, mouse
gagcactctatctagtcttc

SEQ ID NO: 778081 - DNA, 20 bp, mouse
gtattaaaaatgattctcaa

SEQ ID NO: 778082 - DNA, 20 bp, mouse
gtgtcttctaggaattctca

SEQ ID NO: 778083 - DNA, 20 bp, mouse
gtaacatgatatttttttga

SEQ ID NO: 778084 - DNA, 20 bp, mouse
gaatttcttgaatgtcttct

SEQ ID NO: 778085 - DNA, 20 bp, mouse
gctttaccactgtgaaacaa

SEQ ID NO: 778086 - DNA, 20 bp, mouse
ggagaaggacaaatgagtca

SEQ ID NO: 778087 - DNA, 20 bp, mouse
ggaaccctaaggtaatcagg

SEQ ID NO: 778088 - DNA, 20 bp, mouse
gagtattcgagctttcactt

SEQ ID NO: 778089 - DNA, 20 bp, mouse
gaatattaggacttattcca

SEQ ID NO: 778090 - DNA, 20 bp, mouse
gactgatcagatgcattcag

SEQ ID NO: 778091 - DNA, 20 bp, mouse
gtaagagcagcattcaccaa

SEQ ID NO: 778092 - DNA, 20 bp, mouse
gacagaaccctaaggtaatc

SEQ ID NO: 778093 - DNA, 20 bp, mouse
gagtattttagcatatactg

SEQ ID NO: 778094 - DNA, 20 bp, mouse
gtttccacctgattacctta

SEQ ID NO: 778095 - DNA, 20 bp, mouse
gtgtggtggtcttttgcctt

SEQ ID NO: 778096 - DNA, 20 bp, mouse
gaaaacacagaggcatagag

SEQ ID NO: 778097 - DNA, 20 bp, mouse
gtgactgtacaatcagtgga

SEQ ID NO: 778098 - DNA, 20 bp, mouse
gggaaggaaaactgacatgt

SEQ ID NO: 778099 - DNA, 20 bp, mouse
gaagactctcctgtttcctt

SEQ ID NO: 778100 - DNA, 20 bp, mouse
ggatatgactgtacaatcag

SEQ ID NO: 778101 - DNA, 20 bp, mouse
gttactacttataacctttt

SEQ ID NO: 778102 - DNA, 20 bp, mouse
gacgatgcacacatcctaaa

SEQ ID NO: 778103 - DNA, 20 bp, mouse
gacagtcatatcttgtccca

SEQ ID NO: 778104 - DNA, 20 bp, mouse
ggttataagtagtaatgtca

SEQ ID NO: 778105 - DNA, 20 bp, mouse
gatggacagagaaaacacag

SEQ ID NO: 778106 - DNA, 20 bp, mouse
ggtggtgttgtggctgattc

SEQ ID NO: 778107 - DNA, 20 bp, mouse
gtcaaacatgaatcaatagc

SEQ ID NO: 778108 - DNA, 20 bp, mouse
gttctaaatccactttattt

SEQ ID NO: 778109 - DNA, 20 bp, mouse
ggaccagtgaagctttgcac

SEQ ID NO: 778110 - DNA, 20 bp, mouse
gagactagcaaagtgtttgt

SEQ ID NO: 778111 - DNA, 20 bp, mouse
gacaccatgcaatgcttggc

SEQ ID NO: 778112 - DNA, 20 bp, mouse
gtctggatggtaagctagaa

SEQ ID NO: 778113 - DNA, 20 bp, mouse
gactacttttaaacaggtcc

SEQ ID NO: 778114 - DNA, 20 bp, mouse
gaacaccacaagaagttcat

SEQ ID NO: 778115 - DNA, 20 bp, mouse
ggtatactgacaatgaagag

SEQ ID NO: 778116 - DNA, 20 bp, mouse
gactcagagatggaagtaga

SEQ ID NO: 778117 - DNA, 20 bp, mouse
ggaagtagaggggaaactca

SEQ ID NO: 778118 - DNA, 20 bp, mouse
ggcagacagaagctactaaa

SEQ ID NO: 778119 - DNA, 20 bp, mouse
gtctctgcaaatgaagctcc

SEQ ID NO: 778120 - DNA, 20 bp, mouse
gatcaagattacattccatt

SEQ ID NO: 778121 - DNA, 20 bp, mouse
gtggaagaacctctctgggc

SEQ ID NO: 778122 - DNA, 20 bp, mouse
gatagttgttcttctcttac

SEQ ID NO: 778123 - DNA, 20 bp, mouse
gcacatttcaatgccacaag

SEQ ID NO: 778124 - DNA, 20 bp, mouse
gctgttttactatcctcttg

SEQ ID NO: 778125 - DNA, 20 bp, mouse
ggtctcccttcctgcatttc

SEQ ID NO: 778126 - DNA, 20 bp, mouse
gtcaccgctttaagttttag

SEQ ID NO: 778127 - DNA, 20 bp, mouse
gtgtcccctaaaacttaaag

SEQ ID NO: 778128 - DNA, 20 bp, mouse
gttggaaagttcagctaagt

SEQ ID NO: 778129 - DNA, 20 bp, mouse
gcagtggcagtatagaagag

SEQ ID NO: 778130 - DNA, 20 bp, mouse
gccagtggcttgcaatctgt

SEQ ID NO: 778131 - DNA, 20 bp, mouse
gggggacagttaaaaacaaa

SEQ ID NO: 778132 - DNA, 20 bp, mouse
gaagcctttgcagaaccctc

SEQ ID NO: 778133 - DNA, 20 bp, mouse
gatagtgtaggatatctgat

SEQ ID NO: 778134 - DNA, 20 bp, mouse
gtgtaataaagggtttctgc

SEQ ID NO: 778135 - DNA, 20 bp, mouse
gtggaagtgtttataataaa

SEQ ID NO: 778136 - DNA, 20 bp, mouse
gagcttgtctatctaaagtg

SEQ ID NO: 778137 - DNA, 20 bp, mouse
gttggagggaaagattaaaa

SEQ ID NO: 778138 - DNA, 20 bp, mouse
gagagtggaagccatattgt

SEQ ID NO: 778139 - DNA, 20 bp, mouse
gctaaagtgaggccatgatc

SEQ ID NO: 778140 - DNA, 20 bp, mouse
gaaaatggaaactctaaaat

SEQ ID NO: 778141 - DNA, 20 bp, mouse
gactcacatattgaggcaat

SEQ ID NO: 778142 - DNA, 20 bp, mouse
gaaactgaattaccagatca

SEQ ID NO: 778143 - DNA, 20 bp, mouse
ggtcttgaactagaagctgt

SEQ ID NO: 778144 - DNA, 20 bp, mouse
gcacaaaaagtgtgaagaaa

SEQ ID NO: 778145 - DNA, 20 bp, mouse
gccaagattcattagtgata

SEQ ID NO: 778146 - DNA, 20 bp, mouse
gtggctaacaggggtatgaa

SEQ ID NO: 778147 - DNA, 20 bp, mouse
gctggtcagcagcggataca

SEQ ID NO: 778148 - DNA, 20 bp, mouse
gcaacaattcctttggactg

SEQ ID NO: 778149 - DNA, 20 bp, mouse
gaggctatttgaatggacat

SEQ ID NO: 778150 - DNA, 20 bp, mouse
gtcagcagcggatacaagga

SEQ ID NO: 778151 - DNA, 20 bp, mouse
gcttttcttatggctaacag

SEQ ID NO: 778152 - DNA, 20 bp, mouse
gtttgaatggacattggtgc

SEQ ID NO: 778153 - DNA, 20 bp, mouse
gatggttgacttttaacaag

SEQ ID NO: 778154 - DNA, 20 bp, mouse
gtatagacaccacagtccaa

SEQ ID NO: 778155 - DNA, 20 bp, mouse
gaagaaatcaacaattcctt

SEQ ID NO: 778156 - DNA, 20 bp, mouse
gtgcgattctgaacattttg

SEQ ID NO: 778157 - DNA, 20 bp, mouse
gttgtggctcagacttgcta

SEQ ID NO: 778158 - DNA, 20 bp, mouse
gtaggattggataggtccta

SEQ ID NO: 778159 - DNA, 20 bp, mouse
ggtgaagtggccacctgctt

SEQ ID NO: 778160 - DNA, 20 bp, mouse
gtgaataatctcacctgagg

SEQ ID NO: 778161 - DNA, 20 bp, mouse
gcaaaattctgaccctcctc

SEQ ID NO: 778162 - DNA, 20 bp, mouse
ggattgaataatctcacctg

SEQ ID NO: 778163 - DNA, 20 bp, mouse
gcacctgccatgcagtgaag

SEQ ID NO: 778164 - DNA, 20 bp, mouse
ggacctatccaatcctaagc

SEQ ID NO: 778165 - DNA, 20 bp, mouse
gcacctgcttaggattggat

SEQ ID NO: 778166 - DNA, 20 bp, mouse
ggaaacttgttattctatca

SEQ ID NO: 778167 - DNA, 20 bp, mouse
gcaggaattctctgggtgaa

SEQ ID NO: 778168 - DNA, 20 bp, mouse
gactagaatagcaaagggag

SEQ ID NO: 778169 - DNA, 20 bp, mouse
ggtgaacaatgcattcattg

SEQ ID NO: 778170 - DNA, 20 bp, mouse
gagtactctacgtagacttc

SEQ ID NO: 778171 - DNA, 20 bp, mouse
ggagtagtgactttatagat

SEQ ID NO: 778172 - DNA, 20 bp, mouse
ggtagagtactgctgtttcc

SEQ ID NO: 778173 - DNA, 20 bp, mouse
gagtgactttatagatgggc

SEQ ID NO: 778174 - DNA, 20 bp, mouse
ggtgattcctttgaagatag

SEQ ID NO: 778175 - DNA, 20 bp, mouse
gttgttcacactgattccaa

SEQ ID NO: 778176 - DNA, 20 bp, mouse
gacttgctacagtaatggaa

SEQ ID NO: 778177 - DNA, 20 bp, mouse
gttctctgtcatttgtttgg

SEQ ID NO: 778178 - DNA, 20 bp, mouse
gcaggtacttgctacagtaa

SEQ ID NO: 778179 - DNA, 20 bp, mouse
gaacctagaattacatatca

SEQ ID NO: 778180 - DNA, 20 bp, mouse
ggatgctactcaagagaaat

SEQ ID NO: 778181 - DNA, 20 bp, mouse
gagccatgatatgtaattct

SEQ ID NO: 778182 - DNA, 20 bp, mouse
gggtcataagatgaatactt

SEQ ID NO: 778183 - DNA, 20 bp, mouse
ggtcaagtcattaccatctg

SEQ ID NO: 778184 - DNA, 20 bp, mouse
gtgacaagttaaaactctta

SEQ ID NO: 778185 - DNA, 20 bp, mouse
gggcatgggttctaaataag

SEQ ID NO: 778186 - DNA, 20 bp, mouse
gtagaatctcagttggggcg

SEQ ID NO: 778187 - DNA, 20 bp, mouse
ggcatatagaatctcagttg

SEQ ID NO: 778188 - DNA, 20 bp, mouse
gagtactatctacagaccat

SEQ ID NO: 778189 - DNA, 20 bp, mouse
ggtgtctatagctgaaacta

SEQ ID NO: 778190 - DNA, 20 bp, mouse
gtcaagaaggctcatgaatg

SEQ ID NO: 778191 - DNA, 20 bp, mouse
ggacaagtgtacatgggccc

SEQ ID NO: 778192 - DNA, 20 bp, mouse
gagggtaagatttgcaacaa

SEQ ID NO: 778193 - DNA, 20 bp, mouse
ggtttgatgggtgggtggta

SEQ ID NO: 778194 - DNA, 20 bp, mouse
gaatgatgacaagtgtacat

SEQ ID NO: 778195 - DNA, 20 bp, mouse
gtgagattctatatgcatgc

SEQ ID NO: 778196 - DNA, 20 bp, mouse
gcatctgcttcttgtctcac

SEQ ID NO: 778197 - DNA, 20 bp, mouse
ggggtgggaggatctattcc

SEQ ID NO: 778198 - DNA, 20 bp, mouse
ggtaaacacagcatagattc

SEQ ID NO: 778199 - DNA, 20 bp, mouse
gcctctagtgagaaatgggt

SEQ ID NO: 778200 - DNA, 20 bp, mouse
ggcacagcagaggaaattaa

SEQ ID NO: 778201 - DNA, 20 bp, mouse
ggggaattgtatcgatctct

SEQ ID NO: 778202 - DNA, 20 bp, mouse
gatgtccctctagtgagaaa

SEQ ID NO: 778203 - DNA, 20 bp, mouse
ggatcgatacaattcccaga

SEQ ID NO: 778204 - DNA, 20 bp, mouse
gtgaagtcttgtatgcataa

SEQ ID NO: 778205 - DNA, 20 bp, mouse
gacaggctaaaaagattaac

SEQ ID NO: 778206 - DNA, 20 bp, mouse
gtaactaagctgtacatgca

SEQ ID NO: 778207 - DNA, 20 bp, mouse
ggaaaaccctggggaagcat

SEQ ID NO: 778208 - DNA, 20 bp, mouse
gtggctcttttgatgttagt

SEQ ID NO: 778209 - DNA, 20 bp, mouse
gcccaagggcctcaatgagt

SEQ ID NO: 778210 - DNA, 20 bp, mouse
gaatgagttggataatcctt

SEQ ID NO: 778211 - DNA, 20 bp, mouse
gcacttggtaatatgaccca

SEQ ID NO: 778212 - DNA, 20 bp, mouse
gggccttccaagttttaatc

SEQ ID NO: 778213 - DNA, 20 bp, mouse
gaatgtaatggcaattagaa

SEQ ID NO: 778214 - DNA, 20 bp, mouse
gtgtacagcttagttagtaa

SEQ ID NO: 778215 - DNA, 20 bp, mouse
gaatgtttcgagaaaaccct

SEQ ID NO: 778216 - DNA, 20 bp, mouse
gttcccctacgcccactctg

SEQ ID NO: 778217 - DNA, 20 bp, mouse
gaggatggaaaagagggacg

SEQ ID NO: 778218 - DNA, 20 bp, mouse
gctcaagtcatcatgatggg

SEQ ID NO: 778219 - DNA, 20 bp, mouse
gcccgtgctatggtggtaat

SEQ ID NO: 778220 - DNA, 20 bp, mouse
gtatgcccattttccttggc

SEQ ID NO: 778221 - DNA, 20 bp, mouse
gatccacagagtgggcgtag

SEQ ID NO: 778222 - DNA, 20 bp, mouse
gtgggtatgcccattttcct

SEQ ID NO: 778223 - DNA, 20 bp, mouse
gtaccaccatagcacgggcc

SEQ ID NO: 778224 - DNA, 20 bp, mouse
gaattatctctgcaccttct

SEQ ID NO: 778225 - DNA, 20 bp, mouse
gtgctgccaggcccgtgcta

SEQ ID NO: 778226 - DNA, 20 bp, mouse
gtgggacaggggtgattcta

SEQ ID NO: 778227 - DNA, 20 bp, mouse
gcctgtcccaaaatctgggg

SEQ ID NO: 778228 - DNA, 20 bp, mouse
gcaattcaccatctcctctt

SEQ ID NO: 778229 - DNA, 20 bp, mouse
gaggagatggtgaattgtat

SEQ ID NO: 778230 - DNA, 20 bp, mouse
gataaaagtcggtggtagga

SEQ ID NO: 778231 - DNA, 20 bp, mouse
gtcacccctgtcccaaaatc

SEQ ID NO: 778232 - DNA, 20 bp, mouse
gtaccaggaggaagcctaag

SEQ ID NO: 778233 - DNA, 20 bp, mouse
gagatggtgaattgtattgg

SEQ ID NO: 778234 - DNA, 20 bp, mouse
ggtgattctagggaatgtga

SEQ ID NO: 778235 - DNA, 20 bp, mouse
gggtggttcataaaagtcgg

SEQ ID NO: 778236 - DNA, 20 bp, mouse
gatgacgatgattctagtca

SEQ ID NO: 778237 - DNA, 20 bp, mouse
gtctatggtccttcaggaca

SEQ ID NO: 778238 - DNA, 20 bp, mouse
gagcaatagatttgtatcta

SEQ ID NO: 778239 - DNA, 20 bp, mouse
gtttgtatctatggtccttc

SEQ ID NO: 778240 - DNA, 20 bp, mouse
ggctgtgacttcatggtaaa

SEQ ID NO: 778241 - DNA, 20 bp, mouse
ggtgctgataatgtacctca

SEQ ID NO: 778242 - DNA, 20 bp, mouse
gtatttatttatttaatcag

SEQ ID NO: 778243 - DNA, 20 bp, mouse
gattatgaataacaaaaaat

SEQ ID NO: 778244 - DNA, 20 bp, mouse
gattggattttaaaaatagt

SEQ ID NO: 778245 - DNA, 20 bp, mouse
gggctgaagctgtgacttca

SEQ ID NO: 778246 - DNA, 20 bp, mouse
ggtggtatctatgttctcag

SEQ ID NO: 778247 - DNA, 20 bp, mouse
gatgttctcaggggcaaaca

SEQ ID NO: 778248 - DNA, 20 bp, mouse
gtctgtgatgcaacttatgt

SEQ ID NO: 778249 - DNA, 20 bp, mouse
gggaataataataagcttcc

SEQ ID NO: 778250 - DNA, 20 bp, mouse
gtctaagttctttgaataac

SEQ ID NO: 778251 - DNA, 20 bp, mouse
gattcccagtctatgtaaac

SEQ ID NO: 778252 - DNA, 20 bp, mouse
gttgccagtttacatagact

SEQ ID NO: 778253 - DNA, 20 bp, mouse
gataactggcgcaaataata

SEQ ID NO: 778254 - DNA, 20 bp, mouse
ggaactagggatgtagacat

SEQ ID NO: 778255 - DNA, 20 bp, mouse
ggaagattcaggaccaactg

SEQ ID NO: 778256 - DNA, 20 bp, mouse
gagacacaaacccagattct

SEQ ID NO: 778257 - DNA, 20 bp, mouse
gaccataatctgcattaaaa

SEQ ID NO: 778258 - DNA, 20 bp, mouse
gattcttaagtccaagaatc

SEQ ID NO: 778259 - DNA, 20 bp, mouse
gacctaataaatcaaaagta

SEQ ID NO: 778260 - DNA, 20 bp, mouse
gaccttacttttgatttatt

SEQ ID NO: 778261 - DNA, 20 bp, mouse
gaatgcagattatggtgaca

SEQ ID NO: 778262 - DNA, 20 bp, mouse
ggccattttaatgcagatta

SEQ ID NO: 778263 - DNA, 20 bp, mouse
gcccacctataaaccactga

SEQ ID NO: 778264 - DNA, 20 bp, mouse
gagaacatgaatctcaagag

SEQ ID NO: 778265 - DNA, 20 bp, mouse
gtgggaaaaacaatgctcat

SEQ ID NO: 778266 - DNA, 20 bp, mouse
gtctgtgattcaactcatgt

SEQ ID NO: 778267 - DNA, 20 bp, mouse
gggaataataataagctccc

SEQ ID NO: 778268 - DNA, 20 bp, mouse
gtctaagttccttgaaaaac

SEQ ID NO: 778269 - DNA, 20 bp, mouse
ggtgttctcagggacaaaca

SEQ ID NO: 778270 - DNA, 20 bp, mouse
gattcccagtctatgtaaac

SEQ ID NO: 778271 - DNA, 20 bp, mouse
gtatttgtgccagtttttca

SEQ ID NO: 778272 - DNA, 20 bp, mouse
gtttttcttgatttgttgtt

SEQ ID NO: 778273 - DNA, 20 bp, mouse
gttgccagtttacatagact

SEQ ID NO: 778274 - DNA, 20 bp, mouse
gaaaaactggcacaaataat

SEQ ID NO: 778275 - DNA, 20 bp, mouse
ggaactagggatgcagacat

SEQ ID NO: 778276 - DNA, 20 bp, mouse
gacagacttactcataacaa

SEQ ID NO: 778277 - DNA, 20 bp, mouse
gaccataatctgcaatataa

SEQ ID NO: 778278 - DNA, 20 bp, mouse
gaaagtagagagacattggt

SEQ ID NO: 778279 - DNA, 20 bp, mouse
gaagtagatacaaagattct

SEQ ID NO: 778280 - DNA, 20 bp, mouse
gtatcttatggttaaaaaaa

SEQ ID NO: 778281 - DNA, 20 bp, mouse
gtaacaaagtagagagacat

SEQ ID NO: 778282 - DNA, 20 bp, mouse
ggccattatattgcagatta

SEQ ID NO: 778283 - DNA, 20 bp, mouse
gagaacatgaatctcaagag

SEQ ID NO: 778284 - DNA, 20 bp, mouse
gcccacctataaaccactga

SEQ ID NO: 778285 - DNA, 20 bp, mouse
gcccatcagtggtttatagg

SEQ ID NO: 778286 - DNA, 20 bp, mouse
gcaaagggaaggacaagact

SEQ ID NO: 778287 - DNA, 20 bp, mouse
gcacagcattgattgagcaa

SEQ ID NO: 778288 - DNA, 20 bp, mouse
gttagtgctgtggtgaaagt

SEQ ID NO: 778289 - DNA, 20 bp, mouse
gactgccaaaggacaaagac

SEQ ID NO: 778290 - DNA, 20 bp, mouse
gaaatagcatagagaactgc

SEQ ID NO: 778291 - DNA, 20 bp, mouse
gaaaggaggagcgaccagga

SEQ ID NO: 778292 - DNA, 20 bp, mouse
gatgacaattttttcagtgt

SEQ ID NO: 778293 - DNA, 20 bp, mouse
ggatggtggacaggaaggac

SEQ ID NO: 778294 - DNA, 20 bp, mouse
gttgaaaaggaggagcgacc

SEQ ID NO: 778295 - DNA, 20 bp, mouse
gttattggagactcagaaca

SEQ ID NO: 778296 - DNA, 20 bp, mouse
gtcagctaaagtggctagca

SEQ ID NO: 778297 - DNA, 20 bp, mouse
gcctgttgcaaaacaaaaga

SEQ ID NO: 778298 - DNA, 20 bp, mouse
gactgagacagagaaatcac

SEQ ID NO: 778299 - DNA, 20 bp, mouse
ggcactgagtgacattcact

SEQ ID NO: 778300 - DNA, 20 bp, mouse
ggtggatatttgagagctga

SEQ ID NO: 778301 - DNA, 20 bp, mouse
gaagtactcacatacagcta

SEQ ID NO: 778302 - DNA, 20 bp, mouse
gataacctttgaggggcaag

SEQ ID NO: 778303 - DNA, 20 bp, mouse
gaaactaaaccttacaaaca

SEQ ID NO: 778304 - DNA, 20 bp, mouse
ggaaaaatataacctttgag

SEQ ID NO: 778305 - DNA, 20 bp, mouse
gcagggtctttcactttatt

SEQ ID NO: 778306 - DNA, 20 bp, mouse
ggaaaactttaaggcaaggt

SEQ ID NO: 778307 - DNA, 20 bp, mouse
ggaacaatattccatactcc

SEQ ID NO: 778308 - DNA, 20 bp, mouse
gttttctggtagagtctgtg

SEQ ID NO: 778309 - DNA, 20 bp, mouse
gaatagattaaactgtatct

SEQ ID NO: 778310 - DNA, 20 bp, mouse
gaaatgaaaactttaaggca

SEQ ID NO: 778311 - DNA, 20 bp, mouse
ggagcacattatctgtaaat

SEQ ID NO: 778312 - DNA, 20 bp, mouse
gactataaaattaataaaaa

SEQ ID NO: 778313 - DNA, 20 bp, mouse
gctaggaataaatgtaagca

SEQ ID NO: 778314 - DNA, 20 bp, mouse
ggaaattttaaaaatcaaac

SEQ ID NO: 778315 - DNA, 20 bp, mouse
gcttttttaaagaaaaataa

SEQ ID NO: 778316 - DNA, 20 bp, mouse
gtaaagacttataaatgaat

SEQ ID NO: 778317 - DNA, 20 bp, mouse
ggaaattaaagaatacttca

SEQ ID NO: 778318 - DNA, 20 bp, mouse
gtaggtctacacaattttgg

SEQ ID NO: 778319 - DNA, 20 bp, mouse
ggttcccgaaagctcacctc

SEQ ID NO: 778320 - DNA, 20 bp, mouse
gtttccagaggtgagctttc

SEQ ID NO: 778321 - DNA, 20 bp, mouse
gaattaggtctacacaattt

SEQ ID NO: 778322 - DNA, 20 bp, mouse
gcttttctactttattatac

SEQ ID NO: 778323 - DNA, 20 bp, mouse
gttaatagaaaagactattt

SEQ ID NO: 778324 - DNA, 20 bp, mouse
gctttgtgaaatgtttccag

SEQ ID NO: 778325 - DNA, 20 bp, mouse
gtattttggagacattaatt

SEQ ID NO: 778326 - DNA, 20 bp, mouse
gtgctcactgacacctgaag

SEQ ID NO: 778327 - DNA, 20 bp, mouse
gtgtcaaaaagttaatgtga

SEQ ID NO: 778328 - DNA, 20 bp, mouse
gtataaatctaacaaaatct

SEQ ID NO: 778329 - DNA, 20 bp, mouse
gcatgctgagaacctatccc

SEQ ID NO: 778330 - DNA, 20 bp, mouse
gataggttctcagcatgcac

SEQ ID NO: 778331 - DNA, 20 bp, mouse
ggtgttagaatccttagaac

SEQ ID NO: 778332 - DNA, 20 bp, mouse
gtggtatgcatgcatatatt

SEQ ID NO: 778333 - DNA, 20 bp, mouse
ggtgagcacttgtatgcatg

SEQ ID NO: 778334 - DNA, 20 bp, mouse
gatgcttgatagaagaatgc

SEQ ID NO: 778335 - DNA, 20 bp, mouse
gaagaaataagaaaggctgt

SEQ ID NO: 778336 - DNA, 20 bp, mouse
gtcccacagatcaaaagtgg

SEQ ID NO: 778337 - DNA, 20 bp, mouse
gaaagattgcagttgccaaa

SEQ ID NO: 778338 - DNA, 20 bp, mouse
gagagtaacataactcttga

SEQ ID NO: 778339 - DNA, 20 bp, mouse
gttcctccacttttgatctg

SEQ ID NO: 778340 - DNA, 20 bp, mouse
gaattttgctcagatctaat

SEQ ID NO: 778341 - DNA, 20 bp, mouse
gaaattactgaagtctacat

SEQ ID NO: 778342 - DNA, 20 bp, mouse
gatctgtctagtcaacttct

SEQ ID NO: 778343 - DNA, 20 bp, mouse
ggactcccacagatcaaaag

SEQ ID NO: 778344 - DNA, 20 bp, mouse
gtctacaagaaatacaggca

SEQ ID NO: 778345 - DNA, 20 bp, mouse
gggagtggccaaccaataaa

SEQ ID NO: 778346 - DNA, 20 bp, mouse
ggaaatgattgtagcttctg

SEQ ID NO: 778347 - DNA, 20 bp, mouse
gataactacacaatctttgt

SEQ ID NO: 778348 - DNA, 20 bp, mouse
gaaatatcatgtataatctt

SEQ ID NO: 778349 - DNA, 20 bp, mouse
gatgtataatcttgggtaca

SEQ ID NO: 778350 - DNA, 20 bp, mouse
gtaattcaataacagattat

SEQ ID NO: 778351 - DNA, 20 bp, mouse
gttctgtggatggttagcta

SEQ ID NO: 778352 - DNA, 20 bp, mouse
ggcagatggaaaaacctgat

SEQ ID NO: 778353 - DNA, 20 bp, mouse
gatgcagctgaagtcattaa

SEQ ID NO: 778354 - DNA, 20 bp, mouse
gatgaaacttacttagcaga

SEQ ID NO: 778355 - DNA, 20 bp, mouse
gggcaaatggctgtcctatc

SEQ ID NO: 778356 - DNA, 20 bp, mouse
gtgccagagagggttatcgt

SEQ ID NO: 778357 - DNA, 20 bp, mouse
gtaaccctctctggcaactc

SEQ ID NO: 778358 - DNA, 20 bp, mouse
ggccacaggcgagtgttcat

SEQ ID NO: 778359 - DNA, 20 bp, mouse
ggaggcgtgagcttggccac

SEQ ID NO: 778360 - DNA, 20 bp, mouse
ggccccacgataaccctctc

SEQ ID NO: 778361 - DNA, 20 bp, mouse
gtgccggcggatgacagtga

SEQ ID NO: 778362 - DNA, 20 bp, mouse
gggcacgcaggtccgcgggg

SEQ ID NO: 778363 - DNA, 20 bp, mouse
gaacctgcgaggaccgcggt

SEQ ID NO: 778364 - DNA, 20 bp, mouse
gacagccagagttgccagag

SEQ ID NO: 778365 - DNA, 20 bp, mouse
ggggagggcgatctgccgac

SEQ ID NO: 778366 - DNA, 20 bp, mouse
ggggctgctaaagaagtctg

SEQ ID NO: 778367 - DNA, 20 bp, mouse
ggtagagagattcgcgagga

SEQ ID NO: 778368 - DNA, 20 bp, mouse
gtgagctgggccggcccgag

SEQ ID NO: 778369 - DNA, 20 bp, mouse
ggcgagctgaagaagcgggt

SEQ ID NO: 778370 - DNA, 20 bp, mouse
gaaagggcgagctgaagaag

SEQ ID NO: 778371 - DNA, 20 bp, mouse
ggcagaggcgccaatgagct

SEQ ID NO: 778372 - DNA, 20 bp, mouse
gcacagccaatgggcgcccg

SEQ ID NO: 778373 - DNA, 20 bp, mouse
gccgctcaatgaaacccgcc

SEQ ID NO: 778374 - DNA, 20 bp, mouse
gcgatggccaaccagttcta

SEQ ID NO: 778375 - DNA, 20 bp, mouse
ggtagcgtcaggccagggta

SEQ ID NO: 778376 - DNA, 20 bp, mouse
gtaaccagcccaggatagat

SEQ ID NO: 778377 - DNA, 20 bp, mouse
gcagcccaggatagatagga

SEQ ID NO: 778378 - DNA, 20 bp, mouse
ggagccctcctatctatcct

SEQ ID NO: 778379 - DNA, 20 bp, mouse
gtactgcaagaggttagttc

SEQ ID NO: 778380 - DNA, 20 bp, mouse
ggcaccgccctgaatgatga

SEQ ID NO: 778381 - DNA, 20 bp, mouse
gacctcttgcagtaaaagag

SEQ ID NO: 778382 - DNA, 20 bp, mouse
ggacgtgccatcatcattca

SEQ ID NO: 778383 - DNA, 20 bp, mouse
gccccacaatgaatatgaat

SEQ ID NO: 778384 - DNA, 20 bp, mouse
gaataggaatccttgctaac

SEQ ID NO: 778385 - DNA, 20 bp, mouse
gacacaccaatgtgcagtgc

SEQ ID NO: 778386 - DNA, 20 bp, mouse
gcactaagaaacagacagca

SEQ ID NO: 778387 - DNA, 20 bp, mouse
gtcaaccgtcgcgggaggaa

SEQ ID NO: 778388 - DNA, 20 bp, mouse
gaggatgactcaaccgtcgc

SEQ ID NO: 778389 - DNA, 20 bp, mouse
gctgtctgtttcttagtgaa

SEQ ID NO: 778390 - DNA, 20 bp, mouse
gaaaggtcatgaagcatgac

SEQ ID NO: 778391 - DNA, 20 bp, mouse
gggctgaccacgacaattat

SEQ ID NO: 778392 - DNA, 20 bp, mouse
gtcttaggttgtgtctcttg

SEQ ID NO: 778393 - DNA, 20 bp, mouse
gatgactcaaccgtcgcggg

SEQ ID NO: 778394 - DNA, 20 bp, mouse
gagccgctcttatctagcag

SEQ ID NO: 778395 - DNA, 20 bp, mouse
gaactccagcactcagggcc

SEQ ID NO: 778396 - DNA, 20 bp, mouse
gcgtctcgcccccgtgtggt

SEQ ID NO: 778397 - DNA, 20 bp, mouse
ggggactggggaaacggact

SEQ ID NO: 778398 - DNA, 20 bp, mouse
gctcgcccccgtgtggtggg

SEQ ID NO: 778399 - DNA, 20 bp, mouse
gtcccagtcctggccggctg

SEQ ID NO: 778400 - DNA, 20 bp, mouse
gcctgccctggggacctctc

SEQ ID NO: 778401 - DNA, 20 bp, mouse
gtccccagggcaggaagtga

SEQ ID NO: 778402 - DNA, 20 bp, mouse
gatcctcctcccaccacacg

SEQ ID NO: 778403 - DNA, 20 bp, mouse
ggctgcggctgtacggactg

SEQ ID NO: 778404 - DNA, 20 bp, mouse
gcaaggaggtgtagagttcc

SEQ ID NO: 778405 - DNA, 20 bp, mouse
gtggcaggtagcttaaatct

SEQ ID NO: 778406 - DNA, 20 bp, mouse
ggtaactcagtgtgcagaca

SEQ ID NO: 778407 - DNA, 20 bp, mouse
ggctcttggtcagatttatg

SEQ ID NO: 778408 - DNA, 20 bp, mouse
gcctctgtcaacccaggaac

SEQ ID NO: 778409 - DNA, 20 bp, mouse
gtctgcacactgagttactg

SEQ ID NO: 778410 - DNA, 20 bp, mouse
ggggctgtcctttgaattac

SEQ ID NO: 778411 - DNA, 20 bp, mouse
gactgggctccaggtcacag

SEQ ID NO: 778412 - DNA, 20 bp, mouse
gccagtgtctcagcaattta

SEQ ID NO: 778413 - DNA, 20 bp, mouse
gcaaaattgtatccggttcc

SEQ ID NO: 778414 - DNA, 20 bp, mouse
gtgctgagacactgggctcc

SEQ ID NO: 778415 - DNA, 20 bp, mouse
gattaaagtccactgtgacc

SEQ ID NO: 778416 - DNA, 20 bp, mouse
gcacctgatcagcaccacat

SEQ ID NO: 778417 - DNA, 20 bp, mouse
ggctctgcagtcctcctatg

SEQ ID NO: 778418 - DNA, 20 bp, mouse
ggactcaaatttattgcaag

SEQ ID NO: 778419 - DNA, 20 bp, mouse
gagctatgtaaggcactctc

SEQ ID NO: 778420 - DNA, 20 bp, mouse
gataatagtagccacgatgg

SEQ ID NO: 778421 - DNA, 20 bp, mouse
gtcaggtggttgcagagctt

SEQ ID NO: 778422 - DNA, 20 bp, mouse
gagaatacttcatgcaaatt

SEQ ID NO: 778423 - DNA, 20 bp, mouse
gcttcatgcaaattagggct

SEQ ID NO: 778424 - DNA, 20 bp, mouse
gtgaaaagaacataaaaatg

SEQ ID NO: 778425 - DNA, 20 bp, mouse
gataataatagtagccacga

SEQ ID NO: 778426 - DNA, 20 bp, mouse
gaggcaggctggagggtgat

SEQ ID NO: 778427 - DNA, 20 bp, mouse
gtggagggtgatgggctccc

SEQ ID NO: 778428 - DNA, 20 bp, mouse
ggcactgatatcaactgctg

SEQ ID NO: 778429 - DNA, 20 bp, mouse
gactaccactgtagtcaagg

SEQ ID NO: 778430 - DNA, 20 bp, mouse
gccacccagttctcagaaca

SEQ ID NO: 778431 - DNA, 20 bp, mouse
gtgtccaactgcctcctaac

SEQ ID NO: 778432 - DNA, 20 bp, mouse
gttctcagaacaggggacac

SEQ ID NO: 778433 - DNA, 20 bp, mouse
gcacagggctgttgggagat

SEQ ID NO: 778434 - DNA, 20 bp, mouse
gaagaatggaatactccaca

SEQ ID NO: 778435 - DNA, 20 bp, mouse
ggcacctgacaggacctgac

SEQ ID NO: 778436 - DNA, 20 bp, mouse
gcacaagtaggagtcagggg

SEQ ID NO: 778437 - DNA, 20 bp, mouse
ggcagcacaagtaggagtca

SEQ ID NO: 778438 - DNA, 20 bp, mouse
gccaacgaactagccaaata

SEQ ID NO: 778439 - DNA, 20 bp, mouse
ggaccaagggcagcacaagt

SEQ ID NO: 778440 - DNA, 20 bp, mouse
gtatggctctctctgaccaa

SEQ ID NO: 778441 - DNA, 20 bp, mouse
gggtcagagagagccatatt

SEQ ID NO: 778442 - DNA, 20 bp, mouse
gctcctacttgtgctgccct

SEQ ID NO: 778443 - DNA, 20 bp, mouse
ggatcttttgcagggaaggg

SEQ ID NO: 778444 - DNA, 20 bp, mouse
gctcactggcctattggtca

SEQ ID NO: 778445 - DNA, 20 bp, mouse
gtgtacagatctgagccggc

SEQ ID NO: 778446 - DNA, 20 bp, mouse
gtaaactagtgctacatcta

SEQ ID NO: 778447 - DNA, 20 bp, mouse
gtatggctctctttcaccaa

SEQ ID NO: 778448 - DNA, 20 bp, mouse
gccaagggcagcacttgcca

SEQ ID NO: 778449 - DNA, 20 bp, mouse
gagcacttgccaaggagtca

SEQ ID NO: 778450 - DNA, 20 bp, mouse
ggcagcctcccctgactcct

SEQ ID NO: 778451 - DNA, 20 bp, mouse
gaagagaagaaatggagccc

SEQ ID NO: 778452 - DNA, 20 bp, mouse
gtgtacagatctgagctggc

SEQ ID NO: 778453 - DNA, 20 bp, mouse
gcttgccaaggagtcagggg

SEQ ID NO: 778454 - DNA, 20 bp, mouse
gaaatggagccctggccaat

SEQ ID NO: 778455 - DNA, 20 bp, mouse
ggctcactggcctattggcc

SEQ ID NO: 778456 - DNA, 20 bp, mouse
gggggacagagctttctcag

SEQ ID NO: 778457 - DNA, 20 bp, mouse
gcagcggcgccgaatggccc

SEQ ID NO: 778458 - DNA, 20 bp, mouse
ggagccgcctccacagtcct

SEQ ID NO: 778459 - DNA, 20 bp, mouse
gcccagcacaaatgaaccga

SEQ ID NO: 778460 - DNA, 20 bp, mouse
ggcacgtgctcactgatccc

SEQ ID NO: 778461 - DNA, 20 bp, mouse
gcaaatgaaccgagggggtg

SEQ ID NO: 778462 - DNA, 20 bp, mouse
gaagtctccgaggactgtgg

SEQ ID NO: 778463 - DNA, 20 bp, mouse
gaactcagactcaggggctc

SEQ ID NO: 778464 - DNA, 20 bp, mouse
gtcacggagcgctgggaccg

SEQ ID NO: 778465 - DNA, 20 bp, mouse
gcggagcgctgggaccgagg

SEQ ID NO: 778466 - DNA, 20 bp, mouse
gttctggtcccgagtggggt

SEQ ID NO: 778467 - DNA, 20 bp, mouse
gaccagaagcggcgtgcgtc

SEQ ID NO: 778468 - DNA, 20 bp, mouse
ggccgcttctggtcccgagt

SEQ ID NO: 778469 - DNA, 20 bp, mouse
gggtgccccgcctctgatgt

SEQ ID NO: 778470 - DNA, 20 bp, mouse
gtagacgcccacatcagagg

SEQ ID NO: 778471 - DNA, 20 bp, mouse
gacaagtgctggtgaaagac

SEQ ID NO: 778472 - DNA, 20 bp, mouse
gtcagcagggtcttataaag

SEQ ID NO: 778473 - DNA, 20 bp, mouse
gaccagacgcacgccgcttc

SEQ ID NO: 778474 - DNA, 20 bp, mouse
gagcagcaagcattacattg

SEQ ID NO: 778475 - DNA, 20 bp, mouse
gtgtgggcgtctatcaagac

SEQ ID NO: 778476 - DNA, 20 bp, mouse
ggggtcgaacgtttcaggtt

SEQ ID NO: 778477 - DNA, 20 bp, mouse
ggggcggggtcgaacgtttc

SEQ ID NO: 778478 - DNA, 20 bp, mouse
gccaatggctatagaagggg

SEQ ID NO: 778479 - DNA, 20 bp, mouse
ggggcgggaccgtactcgat

SEQ ID NO: 778480 - DNA, 20 bp, mouse
ggctgccaatggctatagaa

SEQ ID NO: 778481 - DNA, 20 bp, mouse
gaggagaaaccaatcgttgg

SEQ ID NO: 778482 - DNA, 20 bp, mouse
gcgggcccgggaggataggt

SEQ ID NO: 778483 - DNA, 20 bp, mouse
gtggtggaagctgcctcgaa

SEQ ID NO: 778484 - DNA, 20 bp, mouse
gtatcctcccgggcccgggg

SEQ ID NO: 778485 - DNA, 20 bp, mouse
gtcctcatgcccatcgagta

SEQ ID NO: 778486 - DNA, 20 bp, mouse
gtgccctgagaagaacctga

SEQ ID NO: 778487 - DNA, 20 bp, mouse
gggggcgggtaggggcagaa

SEQ ID NO: 778488 - DNA, 20 bp, mouse
gagcaccaggctggcttctt

SEQ ID NO: 778489 - DNA, 20 bp, mouse
gaatccctcaggttcttctc

SEQ ID NO: 778490 - DNA, 20 bp, mouse
gcaggcggagcgatgggcgg

SEQ ID NO: 778491 - DNA, 20 bp, mouse
gagccagcctggtgctccaa

SEQ ID NO: 778492 - DNA, 20 bp, mouse
gcacacagagccaggactag

SEQ ID NO: 778493 - DNA, 20 bp, mouse
ggcccccagttcctgaagtg

SEQ ID NO: 778494 - DNA, 20 bp, mouse
ggggcgctgacgtcagaccc

SEQ ID NO: 778495 - DNA, 20 bp, mouse
gggcagaagggggaatgtac

SEQ ID NO: 778496 - DNA, 20 bp, mouse
ggcgcaccgcgcaagtgggt

SEQ ID NO: 778497 - DNA, 20 bp, mouse
gggtctgccaacactaacaa

SEQ ID NO: 778498 - DNA, 20 bp, mouse
gcgccggcgtggcatagaag

SEQ ID NO: 778499 - DNA, 20 bp, mouse
gaccgcgcaagtgggtaggc

SEQ ID NO: 778500 - DNA, 20 bp, mouse
gaaggcgcgcaccgcgcaag

SEQ ID NO: 778501 - DNA, 20 bp, mouse
gctaacaaaggtcctctacc

SEQ ID NO: 778502 - DNA, 20 bp, mouse
gacggaattaagtagagcac

SEQ ID NO: 778503 - DNA, 20 bp, mouse
ggtcagcagtatcctgggca

SEQ ID NO: 778504 - DNA, 20 bp, mouse
gtgcgcgccttgctggaggg

SEQ ID NO: 778505 - DNA, 20 bp, mouse
gttgaaaagcgagaccagac

SEQ ID NO: 778506 - DNA, 20 bp, mouse
gcaggcagagagtcaacaac

SEQ ID NO: 778507 - DNA, 20 bp, mouse
gagaggaagattcttaggcc

SEQ ID NO: 778508 - DNA, 20 bp, mouse
gggctgtataagatcaacat

SEQ ID NO: 778509 - DNA, 20 bp, mouse
gtggagtcaaatgaagcctc

SEQ ID NO: 778510 - DNA, 20 bp, mouse
gagatcaacatggggcaaga

SEQ ID NO: 778511 - DNA, 20 bp, mouse
gtgaacaaaaaagcatagac

SEQ ID NO: 778512 - DNA, 20 bp, mouse
gacaaaaaagcatagacagg

SEQ ID NO: 778513 - DNA, 20 bp, mouse
gtcattattgctgtgatgaa

SEQ ID NO: 778514 - DNA, 20 bp, mouse
gctaagaatcttcctctgta

SEQ ID NO: 778515 - DNA, 20 bp, mouse
gttgaatcagatccatacag

SEQ ID NO: 778516 - DNA, 20 bp, mouse
gcacagtaattgcgaagcag

SEQ ID NO: 778517 - DNA, 20 bp, mouse
gacactagcagttgtgtgtt

SEQ ID NO: 778518 - DNA, 20 bp, mouse
ggtcttcaataaacaagtta

SEQ ID NO: 778519 - DNA, 20 bp, mouse
gggtctgtgagtatcaccgt

SEQ ID NO: 778520 - DNA, 20 bp, mouse
gcaatatggtgcatgtagaa

SEQ ID NO: 778521 - DNA, 20 bp, mouse
gttgaatcagaggcctactt

SEQ ID NO: 778522 - DNA, 20 bp, mouse
gacacatgaatcactggaaa

SEQ ID NO: 778523 - DNA, 20 bp, mouse
gtggctgtatcaatgcaata

SEQ ID NO: 778524 - DNA, 20 bp, mouse
ggtgggaatgattcagggta

SEQ ID NO: 778525 - DNA, 20 bp, mouse
ggtcaaaatgagtttggtca

SEQ ID NO: 778526 - DNA, 20 bp, mouse
gtcgatggtgtcaataatat

SEQ ID NO: 778527 - DNA, 20 bp, mouse
gagctgtggtgtctcttcag

SEQ ID NO: 778528 - DNA, 20 bp, mouse
gtggtatggtaccctcccaa

SEQ ID NO: 778529 - DNA, 20 bp, mouse
gttgaatcagaggcagactt

SEQ ID NO: 778530 - DNA, 20 bp, mouse
gctgaaaatgagcgagtggg

SEQ ID NO: 778531 - DNA, 20 bp, mouse
gtatgcttaaataagtactg

SEQ ID NO: 778532 - DNA, 20 bp, mouse
gggcatgagatacaaccact

SEQ ID NO: 778533 - DNA, 20 bp, mouse
gtaaatcagttcttggcttt

SEQ ID NO: 778534 - DNA, 20 bp, mouse
gtcacacagggcaactggta

SEQ ID NO: 778535 - DNA, 20 bp, mouse
ggcttcaataaatcagttct

SEQ ID NO: 778536 - DNA, 20 bp, mouse
gggaactgctggcatgtgtg

SEQ ID NO: 778537 - DNA, 20 bp, mouse
ggtaacacgtatttaggcac

SEQ ID NO: 778538 - DNA, 20 bp, mouse
gtgaaagctatgctcagagg

SEQ ID NO: 778539 - DNA, 20 bp, mouse
gtgcagccagggtcgagagc

SEQ ID NO: 778540 - DNA, 20 bp, mouse
ggctggcatgtgtgcggcag

SEQ ID NO: 778541 - DNA, 20 bp, mouse
ggtgctttgagaacaatcca

SEQ ID NO: 778542 - DNA, 20 bp, mouse
gatgctcagaggtggattgg

SEQ ID NO: 778543 - DNA, 20 bp, mouse
gcttctgcaggtgattccaa

SEQ ID NO: 778544 - DNA, 20 bp, mouse
gacgaggccttcttatgtgc

SEQ ID NO: 778545 - DNA, 20 bp, mouse
gactttagacaaggaactgc

SEQ ID NO: 778546 - DNA, 20 bp, mouse
gaggctgcacaaacgggccg

SEQ ID NO: 778547 - DNA, 20 bp, mouse
gaagaagaggagcactacac

SEQ ID NO: 778548 - DNA, 20 bp, mouse
gctacacaggtcccgcccag

SEQ ID NO: 778549 - DNA, 20 bp, mouse
ggcgcggggagccactgggc

SEQ ID NO: 778550 - DNA, 20 bp, mouse
gcgcatgcgcatgtcatccg

SEQ ID NO: 778551 - DNA, 20 bp, mouse
gggctccgccctcaaagtgt

SEQ ID NO: 778552 - DNA, 20 bp, mouse
gtcggagacggactgactac

SEQ ID NO: 778553 - DNA, 20 bp, mouse
gacccacaggaacgctaggc

SEQ ID NO: 778554 - DNA, 20 bp, mouse
gtgggtggttatttcggaga

SEQ ID NO: 778555 - DNA, 20 bp, mouse
ggcatgcgcggggagccact

SEQ ID NO: 778556 - DNA, 20 bp, mouse
gtgggtatgcaaatgtgcgg

SEQ ID NO: 778557 - DNA, 20 bp, mouse
gcaaacgcacgctcctacgt

SEQ ID NO: 778558 - DNA, 20 bp, mouse
gcgcggcggaggtggtgggg

SEQ ID NO: 778559 - DNA, 20 bp, mouse
gcgctcgcggcggaggtggt

SEQ ID NO: 778560 - DNA, 20 bp, mouse
ggaagtgaagcgtcagaggg

SEQ ID NO: 778561 - DNA, 20 bp, mouse
ggcctcgacgtccgtacgtt

SEQ ID NO: 778562 - DNA, 20 bp, mouse
gcccacgagcggccgtttaa

SEQ ID NO: 778563 - DNA, 20 bp, mouse
gggacgtcgaggcgtcgacg

SEQ ID NO: 778564 - DNA, 20 bp, mouse
gggcggaagtgaagcgtcag

SEQ ID NO: 778565 - DNA, 20 bp, mouse
gagcacgcacggcccacggg

SEQ ID NO: 778566 - DNA, 20 bp, mouse
gacaaagagaaggaagactg

SEQ ID NO: 778567 - DNA, 20 bp, mouse
ggaggtcagaaggacgtgta

SEQ ID NO: 778568 - DNA, 20 bp, mouse
ggaagactgcggcgcatgca

SEQ ID NO: 778569 - DNA, 20 bp, mouse
gaggggaagttcatctgctg

SEQ ID NO: 778570 - DNA, 20 bp, mouse
gaggacgtgtagggtccctt

SEQ ID NO: 778571 - DNA, 20 bp, mouse
gaagcgctcaggccatcttg

SEQ ID NO: 778572 - DNA, 20 bp, mouse
gtatggtcaggggagtagcc

SEQ ID NO: 778573 - DNA, 20 bp, mouse
gctactcccctgaccataca

SEQ ID NO: 778574 - DNA, 20 bp, mouse
ggcctgagcgcttggaggtc

SEQ ID NO: 778575 - DNA, 20 bp, mouse
gcagggctagaagtactccc

SEQ ID NO: 778576 - DNA, 20 bp, mouse
gtcggggcccgcgtgcttca

SEQ ID NO: 778577 - DNA, 20 bp, mouse
gtcctccagggacgctgcac

SEQ ID NO: 778578 - DNA, 20 bp, mouse
gaaccaggctacacctgctg

SEQ ID NO: 778579 - DNA, 20 bp, mouse
gagggacgctgcacgggacg

SEQ ID NO: 778580 - DNA, 20 bp, mouse
ggggtccagatgcgagactc

SEQ ID NO: 778581 - DNA, 20 bp, mouse
gccaacaggactcgcccact

SEQ ID NO: 778582 - DNA, 20 bp, mouse
gagggctgctccccggagga

SEQ ID NO: 778583 - DNA, 20 bp, mouse
gactgcgcgctcatcccggc

SEQ ID NO: 778584 - DNA, 20 bp, mouse
ggcgctccgcgggctggtga

SEQ ID NO: 778585 - DNA, 20 bp, mouse
ggagacagaagcacccacta

SEQ ID NO: 778586 - DNA, 20 bp, mouse
ggaccgcagggtggagtcat

SEQ ID NO: 778587 - DNA, 20 bp, mouse
gggagagcggccaccctgga

SEQ ID NO: 778588 - DNA, 20 bp, mouse
gggaagtagaactaggagag

SEQ ID NO: 778589 - DNA, 20 bp, mouse
ggagtcatgggacgagagaa

SEQ ID NO: 778590 - DNA, 20 bp, mouse
gagaggcaggtgtaccgccc

SEQ ID NO: 778591 - DNA, 20 bp, mouse
ggggttggtgggagaccgca

SEQ ID NO: 778592 - DNA, 20 bp, mouse
gggccaccctggagggttgg

SEQ ID NO: 778593 - DNA, 20 bp, mouse
gcaaaaggatggataatggg

SEQ ID NO: 778594 - DNA, 20 bp, mouse
ggtagcccggcgcttcccta

SEQ ID NO: 778595 - DNA, 20 bp, mouse
gagcggccaccctggagggt

SEQ ID NO: 778596 - DNA, 20 bp, mouse
gcgtggatcgctctgggcga

SEQ ID NO: 778597 - DNA, 20 bp, mouse
gggtccgcccctgctggcaa

SEQ ID NO: 778598 - DNA, 20 bp, mouse
gtggcccttgccagcagggg

SEQ ID NO: 778599 - DNA, 20 bp, mouse
gggatcgctctgggcgaagg

SEQ ID NO: 778600 - DNA, 20 bp, mouse
gcagagcgatccacggattg

SEQ ID NO: 778601 - DNA, 20 bp, mouse
gaggggcggacccagcgctt

SEQ ID NO: 778602 - DNA, 20 bp, mouse
gcactcagtccctcaatccg

SEQ ID NO: 778603 - DNA, 20 bp, mouse
gccggagggccaggcacgcc

SEQ ID NO: 778604 - DNA, 20 bp, mouse
gacctgaagttgggtatcaa

SEQ ID NO: 778605 - DNA, 20 bp, mouse
gacactgaagggttgattgt

SEQ ID NO: 778606 - DNA, 20 bp, mouse
gtggccctgagccacccctg

SEQ ID NO: 778607 - DNA, 20 bp, mouse
gaggcctgggctgatcctgc

SEQ ID NO: 778608 - DNA, 20 bp, mouse
gatggaagtgagggtaggag

SEQ ID NO: 778609 - DNA, 20 bp, mouse
gtttctgagtccaatccaca

SEQ ID NO: 778610 - DNA, 20 bp, mouse
gaggggatgatctaagtcct

SEQ ID NO: 778611 - DNA, 20 bp, mouse
gactcagaaacatggaagtg

SEQ ID NO: 778612 - DNA, 20 bp, mouse
gtggattggactcagaaaca

SEQ ID NO: 778613 - DNA, 20 bp, mouse
gtgagtccaatccacagggg

SEQ ID NO: 778614 - DNA, 20 bp, mouse
gtggtgtgtgtgcaggcaaa

SEQ ID NO: 778615 - DNA, 20 bp, mouse
gtgatctcttaattgggccc

SEQ ID NO: 778616 - DNA, 20 bp, mouse
ggcacccagccttgttatcc

SEQ ID NO: 778617 - DNA, 20 bp, mouse
gaacaaggctgggtgctttg

SEQ ID NO: 778618 - DNA, 20 bp, mouse
ggtcagaaacctggataaca

SEQ ID NO: 778619 - DNA, 20 bp, mouse
gagcctgaagccaaaggcag

SEQ ID NO: 778620 - DNA, 20 bp, mouse
gggtgctttggggtcagtat

SEQ ID NO: 778621 - DNA, 20 bp, mouse
gtctctggatagggacactc

SEQ ID NO: 778622 - DNA, 20 bp, mouse
gcagaggtgggaatgaggta

SEQ ID NO: 778623 - DNA, 20 bp, mouse
ggaaacctggataacaaggc

SEQ ID NO: 778624 - DNA, 20 bp, mouse
gtttaaaggagggtgctgta

SEQ ID NO: 778625 - DNA, 20 bp, mouse
ggatgctgacctatattctt

SEQ ID NO: 778626 - DNA, 20 bp, mouse
ggggacccacgcgggagggt

SEQ ID NO: 778627 - DNA, 20 bp, mouse
gtagaagggcgtggcctcca

SEQ ID NO: 778628 - DNA, 20 bp, mouse
ggtaacaggagattccggga

SEQ ID NO: 778629 - DNA, 20 bp, mouse
gcagactgcggaagagtctt

SEQ ID NO: 778630 - DNA, 20 bp, mouse
gctgcggaagagtcttagga

SEQ ID NO: 778631 - DNA, 20 bp, mouse
gatgaggccgcaaggtagaa

SEQ ID NO: 778632 - DNA, 20 bp, mouse
ggctcgggacccacgcggga

SEQ ID NO: 778633 - DNA, 20 bp, mouse
gtaggagggcggggccaaaa

SEQ ID NO: 778634 - DNA, 20 bp, mouse
ggccgcaaggtagaagggcg

SEQ ID NO: 778635 - DNA, 20 bp, mouse
gactgcaagtgctagctagt

SEQ ID NO: 778636 - DNA, 20 bp, mouse
gtgtgcatgcgaatgcctat

SEQ ID NO: 778637 - DNA, 20 bp, mouse
gagcctcctgcccagtgtcc

SEQ ID NO: 778638 - DNA, 20 bp, mouse
gggaagtgtgaagatgtcat

SEQ ID NO: 778639 - DNA, 20 bp, mouse
gggggactacacatgctcag

SEQ ID NO: 778640 - DNA, 20 bp, mouse
gtgagagtcacagtggtcac

SEQ ID NO: 778641 - DNA, 20 bp, mouse
gagactcttgtgggctgatc

SEQ ID NO: 778642 - DNA, 20 bp, mouse
gctcagtggctccctgcttc

SEQ ID NO: 778643 - DNA, 20 bp, mouse
gttaagtagcagtgctgagt

SEQ ID NO: 778644 - DNA, 20 bp, mouse
ggtcacagtggtcactgggg

SEQ ID NO: 778645 - DNA, 20 bp, mouse
gtagcatctcccttcatgca

SEQ ID NO: 778646 - DNA, 20 bp, mouse
gccagggtcccacaggtgat

SEQ ID NO: 778647 - DNA, 20 bp, mouse
gaagcctgcatcttctcctc

SEQ ID NO: 778648 - DNA, 20 bp, mouse
gctaggtaccaatcacctgt

SEQ ID NO: 778649 - DNA, 20 bp, mouse
gagaaagcttgggctatctt

SEQ ID NO: 778650 - DNA, 20 bp, mouse
gagctctacaaagtttgcta

SEQ ID NO: 778651 - DNA, 20 bp, mouse
gtcaaccttttattcactgg

SEQ ID NO: 778652 - DNA, 20 bp, mouse
gaaattgaacaactgcgtgt

SEQ ID NO: 778653 - DNA, 20 bp, mouse
gcggtgaacatctctccact

SEQ ID NO: 778654 - DNA, 20 bp, mouse
gcagcagagatctcaacaga

SEQ ID NO: 778655 - DNA, 20 bp, mouse
gaagtttgctagggagcaat

SEQ ID NO: 778656 - DNA, 20 bp, mouse
gagcgcgcgcgaggcctctc

SEQ ID NO: 778657 - DNA, 20 bp, mouse
gcctgggctccgctgactcc

SEQ ID NO: 778658 - DNA, 20 bp, mouse
gagtcagcggagcccaggca

SEQ ID NO: 778659 - DNA, 20 bp, mouse
gagtctgcgcccgcgatcgg

SEQ ID NO: 778660 - DNA, 20 bp, mouse
gtgactccgaagtggcacgg

SEQ ID NO: 778661 - DNA, 20 bp, mouse
ggggcgggcgctgcaccacc

SEQ ID NO: 778662 - DNA, 20 bp, mouse
ggcaccacgtggtccggagg

SEQ ID NO: 778663 - DNA, 20 bp, mouse
gtccgaagtggcacgggggt

SEQ ID NO: 778664 - DNA, 20 bp, mouse
ggctccgagctgggccagag

SEQ ID NO: 778665 - DNA, 20 bp, mouse
gcaccaccgggctccgagct

SEQ ID NO: 778666 - DNA, 20 bp, mouse
gttagtgagccttggcagag

SEQ ID NO: 778667 - DNA, 20 bp, mouse
gggcggggataggctgagat

SEQ ID NO: 778668 - DNA, 20 bp, mouse
gtacagtgacaagagtgcat

SEQ ID NO: 778669 - DNA, 20 bp, mouse
gcagagcggcagactggcct

SEQ ID NO: 778670 - DNA, 20 bp, mouse
ggagaagcggcaagcagctt

SEQ ID NO: 778671 - DNA, 20 bp, mouse
ggggcgtggcttggagagga

SEQ ID NO: 778672 - DNA, 20 bp, mouse
ggcctgggtcagctctgagg

SEQ ID NO: 778673 - DNA, 20 bp, mouse
gtaaggtccagtaactgaaa

SEQ ID NO: 778674 - DNA, 20 bp, mouse
gagcaaggtgcgccggggac

SEQ ID NO: 778675 - DNA, 20 bp, mouse
gaagcatcagaccgcccgcc

SEQ ID NO: 778676 - DNA, 20 bp, mouse
ggggctgcgcaggttggaga

SEQ ID NO: 778677 - DNA, 20 bp, mouse
ggaaggctgcggctgagaga

SEQ ID NO: 778678 - DNA, 20 bp, mouse
gaaggaggggctgcgcaggt

SEQ ID NO: 778679 - DNA, 20 bp, mouse
gcaaaaatggagacatgaac

SEQ ID NO: 778680 - DNA, 20 bp, mouse
gttactggacagttctgggc

SEQ ID NO: 778681 - DNA, 20 bp, mouse
gccccttctggctgccgcac

SEQ ID NO: 778682 - DNA, 20 bp, mouse
gcaggaaagctggcaaaata

SEQ ID NO: 778683 - DNA, 20 bp, mouse
gagctggcaaaatatggtct

SEQ ID NO: 778684 - DNA, 20 bp, mouse
gtgctttactggacagttct

SEQ ID NO: 778685 - DNA, 20 bp, mouse
gctgtggtactctgctttac

SEQ ID NO: 778686 - DNA, 20 bp, mouse
gcatcagccaggaaagtcgt

SEQ ID NO: 778687 - DNA, 20 bp, mouse
gcggaagtgcatagagactg

SEQ ID NO: 778688 - DNA, 20 bp, mouse
gaaggagtgtaaattggggt

SEQ ID NO: 778689 - DNA, 20 bp, mouse
gtctatgcacttccgtgtaa

SEQ ID NO: 778690 - DNA, 20 bp, mouse
gcgtgtaaaggagtgtaaat

SEQ ID NO: 778691 - DNA, 20 bp, mouse
ggatccagaggctagagggg

SEQ ID NO: 778692 - DNA, 20 bp, mouse
ggatatggggatgtgggtaa

SEQ ID NO: 778693 - DNA, 20 bp, mouse
gcagaggctagaggggaggg

SEQ ID NO: 778694 - DNA, 20 bp, mouse
gaacagaccaacgactttcc

SEQ ID NO: 778695 - DNA, 20 bp, mouse
gggaagagtgttgaggtata

SEQ ID NO: 778696 - DNA, 20 bp, mouse
gccctggccaatagatgagg

SEQ ID NO: 778697 - DNA, 20 bp, mouse
gtctccctggccaatagatg

SEQ ID NO: 778698 - DNA, 20 bp, mouse
gaacaggaattctttgtgtg

SEQ ID NO: 778699 - DNA, 20 bp, mouse
gcagggcacttgaaagaatg

SEQ ID NO: 778700 - DNA, 20 bp, mouse
gcaaccactcgtcctctccc

SEQ ID NO: 778701 - DNA, 20 bp, mouse
gatcagagaagaaggtgtag

SEQ ID NO: 778702 - DNA, 20 bp, mouse
gtaagtgaagaaatgagatt

SEQ ID NO: 778703 - DNA, 20 bp, mouse
ggaggacgagtggttggcca

SEQ ID NO: 778704 - DNA, 20 bp, mouse
gcatccaagaaacctcagct

SEQ ID NO: 778705 - DNA, 20 bp, mouse
gccacagtgctctagggata

SEQ ID NO: 778706 - DNA, 20 bp, mouse
ggagacagaccctggggctc

SEQ ID NO: 778707 - DNA, 20 bp, mouse
ggaaccgcggagacagaccc

SEQ ID NO: 778708 - DNA, 20 bp, mouse
ggccccagggtctgtctccg

SEQ ID NO: 778709 - DNA, 20 bp, mouse
gtctgtctccgcggttcgtt

SEQ ID NO: 778710 - DNA, 20 bp, mouse
gttcaggggcgtgaccgagt

SEQ ID NO: 778711 - DNA, 20 bp, mouse
gcccaggcaggtgagattga

SEQ ID NO: 778712 - DNA, 20 bp, mouse
gtagctgcatcagatggccc

SEQ ID NO: 778713 - DNA, 20 bp, mouse
gaggggcggagcgttgggcg

SEQ ID NO: 778714 - DNA, 20 bp, mouse
gctacagaggggcggagcgt

SEQ ID NO: 778715 - DNA, 20 bp, mouse
ggggatagagcctctcttgg

SEQ ID NO: 778716 - DNA, 20 bp, mouse
gacaccgcccaccgccttgt

SEQ ID NO: 778717 - DNA, 20 bp, mouse
gaccccgcccacaaggcggt

SEQ ID NO: 778718 - DNA, 20 bp, mouse
ggagccgtcggaggcggtgc

SEQ ID NO: 778719 - DNA, 20 bp, mouse
gtgtgggcggggtgtgttcg

SEQ ID NO: 778720 - DNA, 20 bp, mouse
gctcccgcagccggacgcac

SEQ ID NO: 778721 - DNA, 20 bp, mouse
gtaccccgcaccgcctccga

SEQ ID NO: 778722 - DNA, 20 bp, mouse
ggctccgggagcaaagccac

SEQ ID NO: 778723 - DNA, 20 bp, mouse
ggtggagctcgcggaggtgc

SEQ ID NO: 778724 - DNA, 20 bp, mouse
gaagcgaggcctgacagcgt

SEQ ID NO: 778725 - DNA, 20 bp, mouse
gcctccgcgagctccacgat

SEQ ID NO: 778726 - DNA, 20 bp, mouse
gcacccacctgggtcccacg

SEQ ID NO: 778727 - DNA, 20 bp, mouse
ggatacccagcatctgtcgt

SEQ ID NO: 778728 - DNA, 20 bp, mouse
gcatcctcgtgggacccagg

SEQ ID NO: 778729 - DNA, 20 bp, mouse
gtgtcgtgggcagcatagag

SEQ ID NO: 778730 - DNA, 20 bp, mouse
ggcggcagggccccacggat

SEQ ID NO: 778731 - DNA, 20 bp, mouse
gctcctagcgagtgacacta

SEQ ID NO: 778732 - DNA, 20 bp, mouse
gacccctcctacaagatcta

SEQ ID NO: 778733 - DNA, 20 bp, mouse
gcgcctggacccacccacct

SEQ ID NO: 778734 - DNA, 20 bp, mouse
gggtccgcggcagggcccca

SEQ ID NO: 778735 - DNA, 20 bp, mouse
gctactgtggtcacgcaggt

SEQ ID NO: 778736 - DNA, 20 bp, mouse
gtcaagggaccctctaaccc

SEQ ID NO: 778737 - DNA, 20 bp, mouse
gtatgtacctggacattcac

SEQ ID NO: 778738 - DNA, 20 bp, mouse
gccacgggcagagatctcaa

SEQ ID NO: 778739 - DNA, 20 bp, mouse
ggacaagtggggcacccagc

SEQ ID NO: 778740 - DNA, 20 bp, mouse
gtggacacctgtgaatgtcc

SEQ ID NO: 778741 - DNA, 20 bp, mouse
gccccggcgagggacaagtg

SEQ ID NO: 778742 - DNA, 20 bp, mouse
ggactgctcaaagaggagtg

SEQ ID NO: 778743 - DNA, 20 bp, mouse
ggcccggtgaccacatgatt

SEQ ID NO: 778744 - DNA, 20 bp, mouse
gggggccgaaacaggaactg

SEQ ID NO: 778745 - DNA, 20 bp, mouse
gactgcaggggttcgtctca

SEQ ID NO: 778746 - DNA, 20 bp, mouse
ggtaccgctcgctccgtggt

SEQ ID NO: 778747 - DNA, 20 bp, mouse
gggagcgagcggtaccaagg

SEQ ID NO: 778748 - DNA, 20 bp, mouse
gcacggagcgagcggtacca

SEQ ID NO: 778749 - DNA, 20 bp, mouse
ggaggagcaaggcttccctc

SEQ ID NO: 778750 - DNA, 20 bp, mouse
gggtagatgctacatgggcg

SEQ ID NO: 778751 - DNA, 20 bp, mouse
ggggcgggtcaggtcgcttg

SEQ ID NO: 778752 - DNA, 20 bp, mouse
ggggcgttcccaggaaatgg

SEQ ID NO: 778753 - DNA, 20 bp, mouse
gaaggggcaggcttcaagga

SEQ ID NO: 778754 - DNA, 20 bp, mouse
ggcgcggagcagggcgggta

SEQ ID NO: 778755 - DNA, 20 bp, mouse
gtcgcttggggcacgtcgtc

SEQ ID NO: 778756 - DNA, 20 bp, mouse
gaatttgcttgggccctctc

SEQ ID NO: 778757 - DNA, 20 bp, mouse
ggcacaccccgcaccagaga

SEQ ID NO: 778758 - DNA, 20 bp, mouse
gacgtcatgaacccccggga

SEQ ID NO: 778759 - DNA, 20 bp, mouse
gacagcttccggtacgaagc

SEQ ID NO: 778760 - DNA, 20 bp, mouse
gactcgccacgccctcccgg

SEQ ID NO: 778761 - DNA, 20 bp, mouse
gaaagccaccagcttcgtac

SEQ ID NO: 778762 - DNA, 20 bp, mouse
ggtgcggggtgtgcgtattc

SEQ ID NO: 778763 - DNA, 20 bp, mouse
ggagggcccaagcaaattgg

SEQ ID NO: 778764 - DNA, 20 bp, mouse
ggcttgggccctctctggtg

SEQ ID NO: 778765 - DNA, 20 bp, mouse
gaggaaggacggaccctttg

SEQ ID NO: 778766 - DNA, 20 bp, mouse
ggtgccctaagaaaccaatg

SEQ ID NO: 778767 - DNA, 20 bp, mouse
gggaacccactattggttgg

SEQ ID NO: 778768 - DNA, 20 bp, mouse
gcggtcccttcccccggaaa

SEQ ID NO: 778769 - DNA, 20 bp, mouse
gccgggaacccactattggt

SEQ ID NO: 778770 - DNA, 20 bp, mouse
gctagctgtctggaagttaa

SEQ ID NO: 778771 - DNA, 20 bp, mouse
gcgcgcacggtcccttcccc

SEQ ID NO: 778772 - DNA, 20 bp, mouse
ggccgcaagcccgttgactc

SEQ ID NO: 778773 - DNA, 20 bp, mouse
gaagcccgggaacccactat

SEQ ID NO: 778774 - DNA, 20 bp, mouse
gggcctatggcccgagtcaa

SEQ ID NO: 778775 - DNA, 20 bp, mouse
gagatcccccaaccaatagt

SEQ ID NO: 778776 - DNA, 20 bp, mouse
ggaggcggggcgtgcgggaa

SEQ ID NO: 778777 - DNA, 20 bp, mouse
gcggaagcagaggcgacttc

SEQ ID NO: 778778 - DNA, 20 bp, mouse
gcctccttgcgctgcggagt

SEQ ID NO: 778779 - DNA, 20 bp, mouse
gtcccgctggctcgccgctc

SEQ ID NO: 778780 - DNA, 20 bp, mouse
ggaggaggcagggtcggcct

SEQ ID NO: 778781 - DNA, 20 bp, mouse
gcggggcgtgcgggaaaggg

SEQ ID NO: 778782 - DNA, 20 bp, mouse
gctgcctcctccttgcgctg

SEQ ID NO: 778783 - DNA, 20 bp, mouse
gggcgagccagcgggagcca

SEQ ID NO: 778784 - DNA, 20 bp, mouse
ggaaagggaggcatggcgtg

SEQ ID NO: 778785 - DNA, 20 bp, mouse
gtgtcaggtacagtccagag

SEQ ID NO: 778786 - DNA, 20 bp, mouse
gagagcggagggacggaagt

SEQ ID NO: 778787 - DNA, 20 bp, mouse
gcctccgctctcccagagga

SEQ ID NO: 778788 - DNA, 20 bp, mouse
ggggctcggggagacgagac

SEQ ID NO: 778789 - DNA, 20 bp, mouse
gcggagggacggaagtaggc

SEQ ID NO: 778790 - DNA, 20 bp, mouse
gtaagcagggggtagccggg

SEQ ID NO: 778791 - DNA, 20 bp, mouse
gcatgtcccgttctgacggg

SEQ ID NO: 778792 - DNA, 20 bp, mouse
gcggggaccgacctgaaagc

SEQ ID NO: 778793 - DNA, 20 bp, mouse
gtgaaagcaggtcacgtggt

SEQ ID NO: 778794 - DNA, 20 bp, mouse
gcgggaggctggttggtgga

SEQ ID NO: 778795 - DNA, 20 bp, mouse
gcgtccctccgctctcccag

SEQ ID NO: 778796 - DNA, 20 bp, mouse
ggggagccgcgcgacaacgt

SEQ ID NO: 778797 - DNA, 20 bp, mouse
ggtgctcagtggtcggttac

SEQ ID NO: 778798 - DNA, 20 bp, mouse
gaactgaagacacagaaggt

SEQ ID NO: 778799 - DNA, 20 bp, mouse
ggcgcggtcgagtgacgtca

SEQ ID NO: 778800 - DNA, 20 bp, mouse
gcgctctagtctccaggcgg

SEQ ID NO: 778801 - DNA, 20 bp, mouse
gagcggcccacgttgtcgcg

SEQ ID NO: 778802 - DNA, 20 bp, mouse
gcgcccttcagcttgtgtaa

SEQ ID NO: 778803 - DNA, 20 bp, mouse
gacacagaaggtgggcggtg

SEQ ID NO: 778804 - DNA, 20 bp, mouse
gaccactgagcaccgccgcc

SEQ ID NO: 778805 - DNA, 20 bp, mouse
gggtcagccctgcgccactc

SEQ ID NO: 778806 - DNA, 20 bp, mouse
ggagatccgcggccgaggaa

SEQ ID NO: 778807 - DNA, 20 bp, mouse
gacaacgctgcggcgaacta

SEQ ID NO: 778808 - DNA, 20 bp, mouse
ggtgagtgaggggaagcggt

SEQ ID NO: 778809 - DNA, 20 bp, mouse
gggcccagcctggaccggac

SEQ ID NO: 778810 - DNA, 20 bp, mouse
gcggcggtgtatagtggacg

SEQ ID NO: 778811 - DNA, 20 bp, mouse
gtacgcatgtgcacacgatg

SEQ ID NO: 778812 - DNA, 20 bp, mouse
gggcagccggcggtgtatag

SEQ ID NO: 778813 - DNA, 20 bp, mouse
gcatgcgtagaaggatgacc

SEQ ID NO: 778814 - DNA, 20 bp, mouse
gccgcggatctccttaacta

SEQ ID NO: 778815 - DNA, 20 bp, mouse
ggcggcgaactagggacagc

SEQ ID NO: 778816 - DNA, 20 bp, mouse
gagcctgtgtcaggaccagt

SEQ ID NO: 778817 - DNA, 20 bp, mouse
gtgagggagctgcataaagc

SEQ ID NO: 778818 - DNA, 20 bp, mouse
gaacctactggtcctgacac

SEQ ID NO: 778819 - DNA, 20 bp, mouse
gagctccatgggataaaaga

SEQ ID NO: 778820 - DNA, 20 bp, mouse
ggtcaggaccagtaggttga

SEQ ID NO: 778821 - DNA, 20 bp, mouse
gtgcagctccctcaacctac

SEQ ID NO: 778822 - DNA, 20 bp, mouse
gatgaaggagccccaagtca

SEQ ID NO: 778823 - DNA, 20 bp, mouse
gtcactatgaaccctgactt

SEQ ID NO: 778824 - DNA, 20 bp, mouse
ggcagccaagtgcccagcaa

SEQ ID NO: 778825 - DNA, 20 bp, mouse
ggccacagctctactgtccc

SEQ ID NO: 778826 - DNA, 20 bp, mouse
gtgctggggagaatgtgcca

SEQ ID NO: 778827 - DNA, 20 bp, mouse
gcatggtcaaggtggatact

SEQ ID NO: 778828 - DNA, 20 bp, mouse
gtcatgggataagacaggta

SEQ ID NO: 778829 - DNA, 20 bp, mouse
gatgaaggggtccctggtca

SEQ ID NO: 778830 - DNA, 20 bp, mouse
gggaggggtgataaacgaat

SEQ ID NO: 778831 - DNA, 20 bp, mouse
gccttcatagcccccttgga

SEQ ID NO: 778832 - DNA, 20 bp, mouse
ggaccccttcatagccccct

SEQ ID NO: 778833 - DNA, 20 bp, mouse
gtcactatgaaccctgacca

SEQ ID NO: 778834 - DNA, 20 bp, mouse
gaggctgtataggggtcccc

SEQ ID NO: 778835 - DNA, 20 bp, mouse
ggccagggcctctagagccc

SEQ ID NO: 778836 - DNA, 20 bp, mouse
gagccagctggctgtgacac

SEQ ID NO: 778837 - DNA, 20 bp, mouse
gcccccaagcatgataagaa

SEQ ID NO: 778838 - DNA, 20 bp, mouse
gtgcagctctctcagccagc

SEQ ID NO: 778839 - DNA, 20 bp, mouse
ggcagccaaatgcccaaaaa

SEQ ID NO: 778840 - DNA, 20 bp, mouse
ggcttcatgggataagagag

SEQ ID NO: 778841 - DNA, 20 bp, mouse
gggcatgggactgcagccag

SEQ ID NO: 778842 - DNA, 20 bp, mouse
gttcactatgaacttgacct

SEQ ID NO: 778843 - DNA, 20 bp, mouse
gaccccttcttatcatgctt

SEQ ID NO: 778844 - DNA, 20 bp, mouse
gggaccccttcccagcctag

SEQ ID NO: 778845 - DNA, 20 bp, mouse
gtcaaccctttttgggcatt

SEQ ID NO: 778846 - DNA, 20 bp, mouse
gtgcccggtgatgctcgggg

SEQ ID NO: 778847 - DNA, 20 bp, mouse
ggaagtaggccgtgcaactc

SEQ ID NO: 778848 - DNA, 20 bp, mouse
gagcgtgcccggtgatgctc

SEQ ID NO: 778849 - DNA, 20 bp, mouse
gcccgcccacagcaggaagt

SEQ ID NO: 778850 - DNA, 20 bp, mouse
gaggctgaaggcgcctcccg

SEQ ID NO: 778851 - DNA, 20 bp, mouse
ggggctggctcggcagtagt

SEQ ID NO: 778852 - DNA, 20 bp, mouse
ggaaggacgtccagcgaagt

SEQ ID NO: 778853 - DNA, 20 bp, mouse
gcagccgtgcttcggtccga

SEQ ID NO: 778854 - DNA, 20 bp, mouse
gcagcctccccgagcatcac

SEQ ID NO: 778855 - DNA, 20 bp, mouse
gcgtccttcggaccgaagca

SEQ ID NO: 778856 - DNA, 20 bp, mouse
gggctcttcccattagtcag

SEQ ID NO: 778857 - DNA, 20 bp, mouse
gcgccgccgccgctgactaa

SEQ ID NO: 778858 - DNA, 20 bp, mouse
gctctaaaaaggtggatcca

SEQ ID NO: 778859 - DNA, 20 bp, mouse
ggtggatccaggggagggcg

SEQ ID NO: 778860 - DNA, 20 bp, mouse
gagcctaagcgcctgaggtg

SEQ ID NO: 778861 - DNA, 20 bp, mouse
gggggccagcggtgggggtc

SEQ ID NO: 778862 - DNA, 20 bp, mouse
ggcccccacctcaggcgctt

SEQ ID NO: 778863 - DNA, 20 bp, mouse
gtttccacggctctctaaaa

SEQ ID NO: 778864 - DNA, 20 bp, mouse
gtctgcgctctccctattgg

SEQ ID NO: 778865 - DNA, 20 bp, mouse
gaaaaaggtggatccagggg

SEQ ID NO: 778866 - DNA, 20 bp, mouse
ggggtgccaaagctcgcggt

SEQ ID NO: 778867 - DNA, 20 bp, mouse
gcgcttgtgcaacacgtgaa

SEQ ID NO: 778868 - DNA, 20 bp, mouse
ggtaatcccgggagtgaatg

SEQ ID NO: 778869 - DNA, 20 bp, mouse
gtcagggtgggacgttctgc

SEQ ID NO: 778870 - DNA, 20 bp, mouse
gggcccaggcagcgacggtt

SEQ ID NO: 778871 - DNA, 20 bp, mouse
gggcgcctcctgggagttgt

SEQ ID NO: 778872 - DNA, 20 bp, mouse
ggccgggcgggccggtgagg

SEQ ID NO: 778873 - DNA, 20 bp, mouse
gccggctcggggagctgatt

SEQ ID NO: 778874 - DNA, 20 bp, mouse
gtgcggggtgccaaagctcg

SEQ ID NO: 778875 - DNA, 20 bp, mouse
gaagtcttcgactacaagat

SEQ ID NO: 778876 - DNA, 20 bp, mouse
gaatcctgaggtgtggtatg

SEQ ID NO: 778877 - DNA, 20 bp, mouse
gggcgtcaaagcctccaggg

SEQ ID NO: 778878 - DNA, 20 bp, mouse
ggcccaatctcgccgatgat

SEQ ID NO: 778879 - DNA, 20 bp, mouse
gttaaggagcgaggagggga

SEQ ID NO: 778880 - DNA, 20 bp, mouse
gatgcgacccgcctccctgg

SEQ ID NO: 778881 - DNA, 20 bp, mouse
ggaaagcttggggcgctaat

SEQ ID NO: 778882 - DNA, 20 bp, mouse
gtagcgccccaagctttcat

SEQ ID NO: 778883 - DNA, 20 bp, mouse
gcaggattaaggagcgagga

SEQ ID NO: 778884 - DNA, 20 bp, mouse
ggccgctgccaggtttgggg

SEQ ID NO: 778885 - DNA, 20 bp, mouse
gacaatgcgacccgcctccc

SEQ ID NO: 778886 - DNA, 20 bp, mouse
gagccccgccgcgggaagga

SEQ ID NO: 778887 - DNA, 20 bp, mouse
gggacattggcatttctctc

SEQ ID NO: 778888 - DNA, 20 bp, mouse
gggaaggagggctcgactgc

SEQ ID NO: 778889 - DNA, 20 bp, mouse
ggctcgactgccgggaagga

SEQ ID NO: 778890 - DNA, 20 bp, mouse
gcggggacgctgcgcggcgg

SEQ ID NO: 778891 - DNA, 20 bp, mouse
gaaggcgcgacgcgtcctcc

SEQ ID NO: 778892 - DNA, 20 bp, mouse
gccgcccagtgagaagctca

SEQ ID NO: 778893 - DNA, 20 bp, mouse
gagaatgcagagctcacggc

SEQ ID NO: 778894 - DNA, 20 bp, mouse
gggcagggctacaaaatcat

SEQ ID NO: 778895 - DNA, 20 bp, mouse
gggaagtactagccattcgg

SEQ ID NO: 778896 - DNA, 20 bp, mouse
gaaggtggaaggaaccccgt

SEQ ID NO: 778897 - DNA, 20 bp, mouse
gacagagatcgggtgcgcgt

SEQ ID NO: 778898 - DNA, 20 bp, mouse
gtgggtggggcctgttcgga

SEQ ID NO: 778899 - DNA, 20 bp, mouse
gaccccgtgggccaagagtt

SEQ ID NO: 778900 - DNA, 20 bp, mouse
gccgctctggctaaggtgga

SEQ ID NO: 778901 - DNA, 20 bp, mouse
gccctccgccgctctggcta

SEQ ID NO: 778902 - DNA, 20 bp, mouse
gccgccgcctcggctcagag

SEQ ID NO: 778903 - DNA, 20 bp, mouse
gaagagttaggcagacgacg

SEQ ID NO: 778904 - DNA, 20 bp, mouse
gtcggcggagcgcggagtgg

SEQ ID NO: 778905 - DNA, 20 bp, mouse
gccaggcgctgggagaacaa

SEQ ID NO: 778906 - DNA, 20 bp, mouse
gcctcctcccgcctcgacca

SEQ ID NO: 778907 - DNA, 20 bp, mouse
gcacttctcgggcaagttcg

SEQ ID NO: 778908 - DNA, 20 bp, mouse
gccgccctccagccacttct

SEQ ID NO: 778909 - DNA, 20 bp, mouse
ggccgggccctggtcgaggc

SEQ ID NO: 778910 - DNA, 20 bp, mouse
gagggggcaacaaaaggcta

SEQ ID NO: 778911 - DNA, 20 bp, mouse
ggggccctggtcgaggcggg

SEQ ID NO: 778912 - DNA, 20 bp, mouse
gcgggcctggcagacagagt

SEQ ID NO: 778913 - DNA, 20 bp, mouse
gactgcaaggttcgaggagc

SEQ ID NO: 778914 - DNA, 20 bp, mouse
gcggggccgggccctggtcg

SEQ ID NO: 778915 - DNA, 20 bp, mouse
gaacttgcccgagaagtggc

SEQ ID NO: 778916 - DNA, 20 bp, mouse
ggggctccccaagagagtat

SEQ ID NO: 778917 - DNA, 20 bp, mouse
gtggggcagacgatcccgaa

SEQ ID NO: 778918 - DNA, 20 bp, mouse
ggcggcgccatctttgattg

SEQ ID NO: 778919 - DNA, 20 bp, mouse
ggcggtgaccggagcctcaa

SEQ ID NO: 778920 - DNA, 20 bp, mouse
gcccgaaaggaggcggtgac

SEQ ID NO: 778921 - DNA, 20 bp, mouse
gagacgatcccgaaaggagg

SEQ ID NO: 778922 - DNA, 20 bp, mouse
gtccgctagcattgaagcgg

SEQ ID NO: 778923 - DNA, 20 bp, mouse
gagctcacacgacaccggaa

SEQ ID NO: 778924 - DNA, 20 bp, mouse
gaaagaggcagcaggcggga

SEQ ID NO: 778925 - DNA, 20 bp, mouse
gcgtctgccccaatcaaaga

SEQ ID NO: 778926 - DNA, 20 bp, mouse
gaggctccgccccacggcgg

SEQ ID NO: 778927 - DNA, 20 bp, mouse
gacgccccgggtatcccgaa

SEQ ID NO: 778928 - DNA, 20 bp, mouse
gataccgagtcaatagtgtg

SEQ ID NO: 778929 - DNA, 20 bp, mouse
ggctgctttccgagaaagga

SEQ ID NO: 778930 - DNA, 20 bp, mouse
ggatccgcgggtcaggagca

SEQ ID NO: 778931 - DNA, 20 bp, mouse
gcaggaggcgtggtctagag

SEQ ID NO: 778932 - DNA, 20 bp, mouse
ggcagcggactagacctggg

SEQ ID NO: 778933 - DNA, 20 bp, mouse
gagctcggcgccaacatttc

SEQ ID NO: 778934 - DNA, 20 bp, mouse
gtaactgtccgcctccgccg

SEQ ID NO: 778935 - DNA, 20 bp, mouse
gacgcgcgcgccagaaatgt

SEQ ID NO: 778936 - DNA, 20 bp, mouse
ggggtcgggagccaaagggt

SEQ ID NO: 778937 - DNA, 20 bp, mouse
gtgtgagccggattatgata

SEQ ID NO: 778938 - DNA, 20 bp, mouse
gcaaccgtgagaagcgtctg

SEQ ID NO: 778939 - DNA, 20 bp, mouse
gcctcggccctatcataatc

SEQ ID NO: 778940 - DNA, 20 bp, mouse
ggaggaaggggagtgacctt

SEQ ID NO: 778941 - DNA, 20 bp, mouse
ggccactcccccgtgtgagc

SEQ ID NO: 778942 - DNA, 20 bp, mouse
gcgcccagccaatcacccct

SEQ ID NO: 778943 - DNA, 20 bp, mouse
gcataatccggctcacacgg

SEQ ID NO: 778944 - DNA, 20 bp, mouse
gataaacccaccttctccaa

SEQ ID NO: 778945 - DNA, 20 bp, mouse
ggctgggcgtgaacgatccc

SEQ ID NO: 778946 - DNA, 20 bp, mouse
gccactgtgtagctaagaag

SEQ ID NO: 778947 - DNA, 20 bp, mouse
ggcagcaactggcactgtga

SEQ ID NO: 778948 - DNA, 20 bp, mouse
ggagagtatgaagtcctcgc

SEQ ID NO: 778949 - DNA, 20 bp, mouse
gaaacacattgggtaagagc

SEQ ID NO: 778950 - DNA, 20 bp, mouse
ggtacagaatttcttatagg

SEQ ID NO: 778951 - DNA, 20 bp, mouse
gaatggcttctaaacacatt

SEQ ID NO: 778952 - DNA, 20 bp, mouse
gaaagcattcccaaaccaca

SEQ ID NO: 778953 - DNA, 20 bp, mouse
ggagctggcacctgcctgcg

SEQ ID NO: 778954 - DNA, 20 bp, mouse
ggtatgaagtcctcgcaggc

SEQ ID NO: 778955 - DNA, 20 bp, mouse
gataaaatagtgtctccctg

SEQ ID NO: 778956 - DNA, 20 bp, mouse
gaaaaccccgggtggaccaa

SEQ ID NO: 778957 - DNA, 20 bp, mouse
gctgctggggaggcacgctg

SEQ ID NO: 778958 - DNA, 20 bp, mouse
gcaggctccgggcaaggact

SEQ ID NO: 778959 - DNA, 20 bp, mouse
gggcggatcggctgctgggg

SEQ ID NO: 778960 - DNA, 20 bp, mouse
gaggcggagcgagggagcgg

SEQ ID NO: 778961 - DNA, 20 bp, mouse
gtggggacccagtccttgcc

SEQ ID NO: 778962 - DNA, 20 bp, mouse
ggggtggaccaagggcggat

SEQ ID NO: 778963 - DNA, 20 bp, mouse
gaccccgggtggaccaaggg

SEQ ID NO: 778964 - DNA, 20 bp, mouse
gcctcctccccggtgcaggc

SEQ ID NO: 778965 - DNA, 20 bp, mouse
gtatgccccccagcctgcac

SEQ ID NO: 778966 - DNA, 20 bp, mouse
ggagcccgcgggaacgatcg

SEQ ID NO: 778967 - DNA, 20 bp, mouse
ggctggatcccgcacgaagg

SEQ ID NO: 778968 - DNA, 20 bp, mouse
gccaccgcgcccccttcgtg

SEQ ID NO: 778969 - DNA, 20 bp, mouse
gtctcccgggcagggtcttt

SEQ ID NO: 778970 - DNA, 20 bp, mouse
gcgccaggcagggaccagat

SEQ ID NO: 778971 - DNA, 20 bp, mouse
ggctcccgccgctgcaggac

SEQ ID NO: 778972 - DNA, 20 bp, mouse
gggtccctgcctggcgtcca

SEQ ID NO: 778973 - DNA, 20 bp, mouse
gggagcagagcgggacacca

SEQ ID NO: 778974 - DNA, 20 bp, mouse
gggcgctggatcccgcacga

SEQ ID NO: 778975 - DNA, 20 bp, mouse
gcagccccgatcgttcccgc

SEQ ID NO: 778976 - DNA, 20 bp, mouse
gctctcgggaggactaagga

SEQ ID NO: 778977 - DNA, 20 bp, mouse
ggggaggactaaggacggag

SEQ ID NO: 778978 - DNA, 20 bp, mouse
gctgcccccctgctctcggg

SEQ ID NO: 778979 - DNA, 20 bp, mouse
ggggaggaggcaacggagga

SEQ ID NO: 778980 - DNA, 20 bp, mouse
ggaggggcacaatccccact

SEQ ID NO: 778981 - DNA, 20 bp, mouse
ggctctgcccccctgctctc

SEQ ID NO: 778982 - DNA, 20 bp, mouse
gagtcctcccgagagcaggg

SEQ ID NO: 778983 - DNA, 20 bp, mouse
ggcttggcgggaggaggcaa

SEQ ID NO: 778984 - DNA, 20 bp, mouse
gggagtggtaccaaatgact

SEQ ID NO: 778985 - DNA, 20 bp, mouse
gtggggagatccggctggag

SEQ ID NO: 778986 - DNA, 20 bp, mouse
gtcctgagagggaacctcga

SEQ ID NO: 778987 - DNA, 20 bp, mouse
gcagaaaggcggtgtcaggg

SEQ ID NO: 778988 - DNA, 20 bp, mouse
gtagccggccctccacccca

SEQ ID NO: 778989 - DNA, 20 bp, mouse
gcggcgtcacgtgacgggaa

SEQ ID NO: 778990 - DNA, 20 bp, mouse
gaccccagggcttcctgaga

SEQ ID NO: 778991 - DNA, 20 bp, mouse
gtgctggcagctcgtggtga

SEQ ID NO: 778992 - DNA, 20 bp, mouse
ggcccagaaaggcggtgtca

SEQ ID NO: 778993 - DNA, 20 bp, mouse
gtccccgggtagcttctgct

SEQ ID NO: 778994 - DNA, 20 bp, mouse
gaggctgccaggagaaattg

SEQ ID NO: 778995 - DNA, 20 bp, mouse
gccgcccagcagaagctacc

SEQ ID NO: 778996 - DNA, 20 bp, mouse
gagcccgccctatacacaat

SEQ ID NO: 778997 - DNA, 20 bp, mouse
gggaccagggcgtgagtggg

SEQ ID NO: 778998 - DNA, 20 bp, mouse
ggggtctccgagagcctagg

SEQ ID NO: 778999 - DNA, 20 bp, mouse
gcgagagcctaggcgggacc

SEQ ID NO: 779000 - DNA, 20 bp, mouse
ggagtgggcggggccaggtg

SEQ ID NO: 779001 - DNA, 20 bp, mouse
gaaacaaagcatgcttgact

SEQ ID NO: 779002 - DNA, 20 bp, mouse
gtcacgccctggtcccgcct

SEQ ID NO: 779003 - DNA, 20 bp, mouse
gtgtatagggcgggctgtta

SEQ ID NO: 779004 - DNA, 20 bp, mouse
ggcgggaccagggcgtgagt

SEQ ID NO: 779005 - DNA, 20 bp, mouse
gtcgcctattgtgtataggg

SEQ ID NO: 779006 - DNA, 20 bp, mouse
gagaaaggaaaggggcaggt

SEQ ID NO: 779007 - DNA, 20 bp, mouse
gtcagtgctgaggctactct

SEQ ID NO: 779008 - DNA, 20 bp, mouse
gcatgtgagagtcctgttta

SEQ ID NO: 779009 - DNA, 20 bp, mouse
gatggaacagtcatagcctc

SEQ ID NO: 779010 - DNA, 20 bp, mouse
gtttagggaacagaggagtc

SEQ ID NO: 779011 - DNA, 20 bp, mouse
gtgaggctactctgggcaag

SEQ ID NO: 779012 - DNA, 20 bp, mouse
gcttggaaaaagttgcaaga

SEQ ID NO: 779013 - DNA, 20 bp, mouse
gaactatgacacagttaccc

SEQ ID NO: 779014 - DNA, 20 bp, mouse
gctatgccggtaacaagaga

SEQ ID NO: 779015 - DNA, 20 bp, mouse
gtgtacaatatgtactatgc

SEQ ID NO: 779016 - DNA, 20 bp, mouse
ggggccacggcagatacgcg

SEQ ID NO: 779017 - DNA, 20 bp, mouse
gaacgactccgaagacgctg

SEQ ID NO: 779018 - DNA, 20 bp, mouse
gcggtgcgatggctgggcca

SEQ ID NO: 779019 - DNA, 20 bp, mouse
gctagcgtcccggtccgcca

SEQ ID NO: 779020 - DNA, 20 bp, mouse
gagcgctcccgggaggccaa

SEQ ID NO: 779021 - DNA, 20 bp, mouse
gcagccgcgcgtatctgccg

SEQ ID NO: 779022 - DNA, 20 bp, mouse
gcaaaaccagcgctcccggg

SEQ ID NO: 779023 - DNA, 20 bp, mouse
gcacatggtggattgatagg

SEQ ID NO: 779024 - DNA, 20 bp, mouse
gcgtaggtgaagaaacgcga

SEQ ID NO: 779025 - DNA, 20 bp, mouse
gcgcgcacctttggcctccc

SEQ ID NO: 779026 - DNA, 20 bp, mouse
ggacgcacgtgcttcggaga

SEQ ID NO: 779027 - DNA, 20 bp, mouse
gcggcccgccgcaactacgc

SEQ ID NO: 779028 - DNA, 20 bp, mouse
gtggccggacgggacgagga

SEQ ID NO: 779029 - DNA, 20 bp, mouse
gtatgccaggggagcggcag

SEQ ID NO: 779030 - DNA, 20 bp, mouse
gtcgctgtcacgtgaggcgg

SEQ ID NO: 779031 - DNA, 20 bp, mouse
ggggagcgaacccaagccag

SEQ ID NO: 779032 - DNA, 20 bp, mouse
gtgggaggagcgtgaacggt

SEQ ID NO: 779033 - DNA, 20 bp, mouse
gagggagcgaaaagaataac

SEQ ID NO: 779034 - DNA, 20 bp, mouse
ggaggcgcgggccaccctat

SEQ ID NO: 779035 - DNA, 20 bp, mouse
gcaactacgcaggcgtacgg

SEQ ID NO: 779036 - DNA, 20 bp, mouse
ggtgtggtcacgtgattcga

SEQ ID NO: 779037 - DNA, 20 bp, mouse
ggagtctgcctgttcccacg

SEQ ID NO: 779038 - DNA, 20 bp, mouse
gcccacgtgggcgattggtg

SEQ ID NO: 779039 - DNA, 20 bp, mouse
gttaggcccttcagcgagca

SEQ ID NO: 779040 - DNA, 20 bp, mouse
gaccctcacggcacaaagaa

SEQ ID NO: 779041 - DNA, 20 bp, mouse
gaagggcctaacgcgggcga

SEQ ID NO: 779042 - DNA, 20 bp, mouse
gcaatcgcccacgtgggaac

SEQ ID NO: 779043 - DNA, 20 bp, mouse
gctcgctgaagggcctaacg

SEQ ID NO: 779044 - DNA, 20 bp, mouse
gacgaagccagagaccctca

SEQ ID NO: 779045 - DNA, 20 bp, mouse
gtcgcgctccagaaccacgt

SEQ ID NO: 779046 - DNA, 20 bp, mouse
gagccccaggcgttcctgcc

SEQ ID NO: 779047 - DNA, 20 bp, mouse
gaaacctggcaggaacgcct

SEQ ID NO: 779048 - DNA, 20 bp, mouse
gaggaccgccggcccaaggg

SEQ ID NO: 779049 - DNA, 20 bp, mouse
gggtggcagcaaagttctaa

SEQ ID NO: 779050 - DNA, 20 bp, mouse
gcttaaatgcggcatagtgt

SEQ ID NO: 779051 - DNA, 20 bp, mouse
gcagtgagatctactgaatc

SEQ ID NO: 779052 - DNA, 20 bp, mouse
gctgatagcgactcatgaaa

SEQ ID NO: 779053 - DNA, 20 bp, mouse
gaagtgacgtcaccgccctt

SEQ ID NO: 779054 - DNA, 20 bp, mouse
gagaaggaccgccggcccaa

SEQ ID NO: 779055 - DNA, 20 bp, mouse
ggcagcaaagttctaacgga

SEQ ID NO: 779056 - DNA, 20 bp, mouse
gagcaggggccctttaagac

SEQ ID NO: 779057 - DNA, 20 bp, mouse
gggccctggccagtcttaaa

SEQ ID NO: 779058 - DNA, 20 bp, mouse
gaaactgaacccgggaaggg

SEQ ID NO: 779059 - DNA, 20 bp, mouse
gcgctggggtgggaagtgag

SEQ ID NO: 779060 - DNA, 20 bp, mouse
gcccgggttcagtttgaagg

SEQ ID NO: 779061 - DNA, 20 bp, mouse
ggggtgaatgaacttggccc

SEQ ID NO: 779062 - DNA, 20 bp, mouse
gagcctaccactcactggta

SEQ ID NO: 779063 - DNA, 20 bp, mouse
gttcaaactgaacccgggaa

SEQ ID NO: 779064 - DNA, 20 bp, mouse
gtggtaaggaagagacctag

SEQ ID NO: 779065 - DNA, 20 bp, mouse
gcagtttgaaggaggaacta

SEQ ID NO: 779066 - DNA, 20 bp, mouse
gaggggcgggtccacggaga

SEQ ID NO: 779067 - DNA, 20 bp, mouse
gtccacgcgccgcacctggt

SEQ ID NO: 779068 - DNA, 20 bp, mouse
gcggctccgcccaccaggtg

SEQ ID NO: 779069 - DNA, 20 bp, mouse
gcgtggacgaggccgccgat

SEQ ID NO: 779070 - DNA, 20 bp, mouse
gccgcgactccaccaatcgg

SEQ ID NO: 779071 - DNA, 20 bp, mouse
gcctaggcctcgtgaggacc

SEQ ID NO: 779072 - DNA, 20 bp, mouse
gtcgccgcgactccaccaat

SEQ ID NO: 779073 - DNA, 20 bp, mouse
gcccgagcctaggcctcgtg

SEQ ID NO: 779074 - DNA, 20 bp, mouse
ggtggagtcgcggcgagggg

SEQ ID NO: 779075 - DNA, 20 bp, mouse
gcaggtgcggcgcgtggacg

SEQ ID NO: 779076 - DNA, 20 bp, mouse
gaggaggagcgggcatgtca

SEQ ID NO: 779077 - DNA, 20 bp, mouse
gctgcccgctcaccccaaga

SEQ ID NO: 779078 - DNA, 20 bp, mouse
gtggccgcctggggagactt

SEQ ID NO: 779079 - DNA, 20 bp, mouse
gcgccccgtcgggcataaag

SEQ ID NO: 779080 - DNA, 20 bp, mouse
gggccaacatctcgtgaggt

SEQ ID NO: 779081 - DNA, 20 bp, mouse
gtcccgacagcccaagcgag

SEQ ID NO: 779082 - DNA, 20 bp, mouse
ggaggtcagccccacgccca

SEQ ID NO: 779083 - DNA, 20 bp, mouse
ggtgggaagggcactcaaca

SEQ ID NO: 779084 - DNA, 20 bp, mouse
gatcttcagggatcagtcca

SEQ ID NO: 779085 - DNA, 20 bp, mouse
ggaacgaattcgaagaaaac

SEQ ID NO: 779086 - DNA, 20 bp, mouse
gggtcccaaggggatgtagg

SEQ ID NO: 779087 - DNA, 20 bp, mouse
gcgggcagcaccggtgagaa

SEQ ID NO: 779088 - DNA, 20 bp, mouse
ggggaaccgcgcccgtcgca

SEQ ID NO: 779089 - DNA, 20 bp, mouse
gttcccccctacatcccctt

SEQ ID NO: 779090 - DNA, 20 bp, mouse
gaccaggagcaaattcctgt

SEQ ID NO: 779091 - DNA, 20 bp, mouse
gaacgatcgggaccctgcga

SEQ ID NO: 779092 - DNA, 20 bp, mouse
gctacggggcaagtgtccag

SEQ ID NO: 779093 - DNA, 20 bp, mouse
gcaccggtgagaagggaagt

SEQ ID NO: 779094 - DNA, 20 bp, mouse
gggatgtaggggggaacgat

SEQ ID NO: 779095 - DNA, 20 bp, mouse
gacccacaggaatttgctcc

SEQ ID NO: 779096 - DNA, 20 bp, mouse
gcgcaggcgcaggcagagtt

SEQ ID NO: 779097 - DNA, 20 bp, mouse
ggggagaaatcgcacggcaa

SEQ ID NO: 779098 - DNA, 20 bp, mouse
gctgccaaagtccgctgccc

SEQ ID NO: 779099 - DNA, 20 bp, mouse
gagggaggggagaaatcgca

SEQ ID NO: 779100 - DNA, 20 bp, mouse
gcacacagaaagtgtcgagt

SEQ ID NO: 779101 - DNA, 20 bp, mouse
gaaatcgcacggcaagggga

SEQ ID NO: 779102 - DNA, 20 bp, mouse
gcagggaggggacaccggtc

SEQ ID NO: 779103 - DNA, 20 bp, mouse
gtcgagtgggattatcaggg

SEQ ID NO: 779104 - DNA, 20 bp, mouse
gtgacccgggcagcggactt

SEQ ID NO: 779105 - DNA, 20 bp, mouse
gagtaggcggctcggtgcta

SEQ ID NO: 779106 - DNA, 20 bp, mouse
gcaagcccggcgcccgctaa

SEQ ID NO: 779107 - DNA, 20 bp, mouse
ggccccgcctcccctcgcgg

SEQ ID NO: 779108 - DNA, 20 bp, mouse
ggagcaaggctgcagcgccc

SEQ ID NO: 779109 - DNA, 20 bp, mouse
gtggaccattagcgggcgcc

SEQ ID NO: 779110 - DNA, 20 bp, mouse
ggcccctggcccggagtcca

SEQ ID NO: 779111 - DNA, 20 bp, mouse
ggatagcaactgagtcttaa

SEQ ID NO: 779112 - DNA, 20 bp, mouse
gaaaggcgcaggtttgcttg

SEQ ID NO: 779113 - DNA, 20 bp, mouse
ggtttgaattgagtcacctt

SEQ ID NO: 779114 - DNA, 20 bp, mouse
gcgcccgccgcgaggggagg

SEQ ID NO: 779115 - DNA, 20 bp, mouse
gaacgcccatcccctctttt

SEQ ID NO: 779116 - DNA, 20 bp, mouse
gcaaaagagccggtcttagg

SEQ ID NO: 779117 - DNA, 20 bp, mouse
gaatggccgtcctgcggcga

SEQ ID NO: 779118 - DNA, 20 bp, mouse
ggccgccggagcagacgaga

SEQ ID NO: 779119 - DNA, 20 bp, mouse
ggaacggggcgtggtccgct

SEQ ID NO: 779120 - DNA, 20 bp, mouse
gcagccagctgcgacccggg

SEQ ID NO: 779121 - DNA, 20 bp, mouse
gtggtccgctcggcaggggc

SEQ ID NO: 779122 - DNA, 20 bp, mouse
ggattcccgcccctgccgag

SEQ ID NO: 779123 - DNA, 20 bp, mouse
gcggagcagacgagacggca

SEQ ID NO: 779124 - DNA, 20 bp, mouse
ggggcgtggtccgctcggca

SEQ ID NO: 779125 - DNA, 20 bp, mouse
gcaggggcgggaatcccgcc

SEQ ID NO: 779126 - DNA, 20 bp, mouse
gacgccttgcaggtcctgga

SEQ ID NO: 779127 - DNA, 20 bp, mouse
ggcaagtgggcggggcagtg

SEQ ID NO: 779128 - DNA, 20 bp, mouse
gacctgcaaggcgtcctacg

SEQ ID NO: 779129 - DNA, 20 bp, mouse
gaataataatggtcgttttt

SEQ ID NO: 779130 - DNA, 20 bp, mouse
gcgtggccaagccacagaag

SEQ ID NO: 779131 - DNA, 20 bp, mouse
gtggcgtcagcaagtgggcg

SEQ ID NO: 779132 - DNA, 20 bp, mouse
ggtaggtggcgtcagcaagt

SEQ ID NO: 779133 - DNA, 20 bp, mouse
ggctaatctctccgcttctg

SEQ ID NO: 779134 - DNA, 20 bp, mouse
gtaggacgccttgcaggtcc

SEQ ID NO: 779135 - DNA, 20 bp, mouse
gactgcgcatgcgtaagccg

SEQ ID NO: 779136 - DNA, 20 bp, mouse
gggagccccgcctttctctt

SEQ ID NO: 779137 - DNA, 20 bp, mouse
ggagcccggccgaacctcag

SEQ ID NO: 779138 - DNA, 20 bp, mouse
gacgccctcaggccctgcgt

SEQ ID NO: 779139 - DNA, 20 bp, mouse
gtcccctacgcagggcctga

SEQ ID NO: 779140 - DNA, 20 bp, mouse
gtgtgtacgcagcaggcagt

SEQ ID NO: 779141 - DNA, 20 bp, mouse
gcagtgggtactcaccgaag

SEQ ID NO: 779142 - DNA, 20 bp, mouse
gttacagtagccacgccctc

SEQ ID NO: 779143 - DNA, 20 bp, mouse
gcgcctcgccggctgctgat

SEQ ID NO: 779144 - DNA, 20 bp, mouse
gctcccccaagagaaaggcg

SEQ ID NO: 779145 - DNA, 20 bp, mouse
ggtgagcaccgggcagtggt

SEQ ID NO: 779146 - DNA, 20 bp, mouse
gtgcagagcgtgcaagacgg

SEQ ID NO: 779147 - DNA, 20 bp, mouse
ggggtgcagagcgtgcaaga

SEQ ID NO: 779148 - DNA, 20 bp, mouse
gcaaccagaacaaactccac

SEQ ID NO: 779149 - DNA, 20 bp, mouse
gtccacaggctcatggaagg

SEQ ID NO: 779150 - DNA, 20 bp, mouse
gcacacccgcgcgcctccgg

SEQ ID NO: 779151 - DNA, 20 bp, mouse
gagcgtgcaagacggaggcc

SEQ ID NO: 779152 - DNA, 20 bp, mouse
gaactccacaggctcatgga

SEQ ID NO: 779153 - DNA, 20 bp, mouse
ggtgagcgcgccccgcttgg

SEQ ID NO: 779154 - DNA, 20 bp, mouse
gtgcaaccccagtgcatccc

SEQ ID NO: 779155 - DNA, 20 bp, mouse
gacggaggcctgggatgcac

SEQ ID NO: 779156 - DNA, 20 bp, mouse
gtaagagaaagcaacgacag

SEQ ID NO: 779157 - DNA, 20 bp, mouse
gggtgagagactggaaaaaa

SEQ ID NO: 779158 - DNA, 20 bp, mouse
gaaaaagggagtgattgagg

SEQ ID NO: 779159 - DNA, 20 bp, mouse
ggcaacagatagaacaaatg

SEQ ID NO: 779160 - DNA, 20 bp, mouse
gcgacaggggttggagtaag

SEQ ID NO: 779161 - DNA, 20 bp, mouse
gggaaaaaagggagtgattg

SEQ ID NO: 779162 - DNA, 20 bp, mouse
gattgaggaggaaggctaga

SEQ ID NO: 779163 - DNA, 20 bp, mouse
gagaactcgactaaaagctc

SEQ ID NO: 779164 - DNA, 20 bp, mouse
gatgttccgctgaaaatctg

SEQ ID NO: 779165 - DNA, 20 bp, mouse
gagcgatagtagctcaactc

SEQ ID NO: 779166 - DNA, 20 bp, mouse
gccctactctatctctaaca

SEQ ID NO: 779167 - DNA, 20 bp, mouse
gggctgatctgataaggtag

SEQ ID NO: 779168 - DNA, 20 bp, mouse
gatctgataaggtagtggaa

SEQ ID NO: 779169 - DNA, 20 bp, mouse
ggaactttaagcctaactcc

SEQ ID NO: 779170 - DNA, 20 bp, mouse
ggacagtacaaaaccccaga

SEQ ID NO: 779171 - DNA, 20 bp, mouse
gtgagcatgtaatatatgca

SEQ ID NO: 779172 - DNA, 20 bp, mouse
gaatgctttcagttgcagag

SEQ ID NO: 779173 - DNA, 20 bp, mouse
gatggatgggagtgctaagt

SEQ ID NO: 779174 - DNA, 20 bp, mouse
ggccttgttagagatagagt

SEQ ID NO: 779175 - DNA, 20 bp, mouse
ggaaatcaacaggaatacac

SEQ ID NO: 779176 - DNA, 20 bp, mouse
gacaaggcagggagtttatt

SEQ ID NO: 779177 - DNA, 20 bp, mouse
gaccccaggcaatctgtcct

SEQ ID NO: 779178 - DNA, 20 bp, mouse
gaaactccctgccttgtcat

SEQ ID NO: 779179 - DNA, 20 bp, mouse
ggaagctaaccgcctctgcc

SEQ ID NO: 779180 - DNA, 20 bp, mouse
gtgcctggctgctgtcccag

SEQ ID NO: 779181 - DNA, 20 bp, mouse
gggccagggccacacctctc

SEQ ID NO: 779182 - DNA, 20 bp, mouse
gctgtccttggcagggaagt

SEQ ID NO: 779183 - DNA, 20 bp, mouse
ggaaaattgaaagtcaagct

SEQ ID NO: 779184 - DNA, 20 bp, mouse
ggtgaattccagggcagaat

SEQ ID NO: 779185 - DNA, 20 bp, mouse
gctgccaaggacagattgcc

SEQ ID NO: 779186 - DNA, 20 bp, mouse
gagctggtgctgctgaataa

SEQ ID NO: 779187 - DNA, 20 bp, mouse
ggctgggctgacaacccaga

SEQ ID NO: 779188 - DNA, 20 bp, mouse
gcagaggggcggggctgccg

SEQ ID NO: 779189 - DNA, 20 bp, mouse
gggattcagcatgcgttcct

SEQ ID NO: 779190 - DNA, 20 bp, mouse
gtccgagataaagccctgtc

SEQ ID NO: 779191 - DNA, 20 bp, mouse
gagacacctgaagccggaca

SEQ ID NO: 779192 - DNA, 20 bp, mouse
gttgcagagggcatgcagat

SEQ ID NO: 779193 - DNA, 20 bp, mouse
gctgacaacccagaggggcg

SEQ ID NO: 779194 - DNA, 20 bp, mouse
gcatgccctctgcaatctgt

SEQ ID NO: 779195 - DNA, 20 bp, mouse
gtggcaggagcttccattcc

SEQ ID NO: 779196 - DNA, 20 bp, mouse
gaggacccaggtgagggaat

SEQ ID NO: 779197 - DNA, 20 bp, mouse
gagaggccttccctggggaa

SEQ ID NO: 779198 - DNA, 20 bp, mouse
ggggagcaatgagacaagct

SEQ ID NO: 779199 - DNA, 20 bp, mouse
gccccagggaaggcctctgg

SEQ ID NO: 779200 - DNA, 20 bp, mouse
gaggagtgggcctctgtaaa

SEQ ID NO: 779201 - DNA, 20 bp, mouse
ggcttctaggacccaggtga

SEQ ID NO: 779202 - DNA, 20 bp, mouse
gtcccccagaggccttccct

SEQ ID NO: 779203 - DNA, 20 bp, mouse
gttgactcctccccaggcta

SEQ ID NO: 779204 - DNA, 20 bp, mouse
ggaggagtcaagagcctgag

SEQ ID NO: 779205 - DNA, 20 bp, mouse
gctccccaggctagggtgac

SEQ ID NO: 779206 - DNA, 20 bp, mouse
gggacaatataccaacgctt

SEQ ID NO: 779207 - DNA, 20 bp, mouse
gggctaacacggtgtattaa

SEQ ID NO: 779208 - DNA, 20 bp, mouse
gtagctggctgtaactaatc

SEQ ID NO: 779209 - DNA, 20 bp, mouse
gtaatgggcaggtgtgtagc

SEQ ID NO: 779210 - DNA, 20 bp, mouse
gacacggtgtattaatgggc

SEQ ID NO: 779211 - DNA, 20 bp, mouse
gtaatccgggctcaggcaag

SEQ ID NO: 779212 - DNA, 20 bp, mouse
gggtataaacaagtattgtt

SEQ ID NO: 779213 - DNA, 20 bp, mouse
gataacttattcctaagcgt

SEQ ID NO: 779214 - DNA, 20 bp, mouse
gaaaatgtcggtaccataat

SEQ ID NO: 779215 - DNA, 20 bp, mouse
ggcagcctcttgcctgagcc

SEQ ID NO: 779216 - DNA, 20 bp, mouse
gcaaaatggagtttcttgga

SEQ ID NO: 779217 - DNA, 20 bp, mouse
ggagtgcctgggtgataagg

SEQ ID NO: 779218 - DNA, 20 bp, mouse
gcaagggaatgtctcctacg

SEQ ID NO: 779219 - DNA, 20 bp, mouse
gaggagtgggtggcttatta

SEQ ID NO: 779220 - DNA, 20 bp, mouse
gaaggattgctgattttcag

SEQ ID NO: 779221 - DNA, 20 bp, mouse
gtcctcttccactgttcaag

SEQ ID NO: 779222 - DNA, 20 bp, mouse
gcatacaaaatggagtttct

SEQ ID NO: 779223 - DNA, 20 bp, mouse
gccacccccccttatcaccc

SEQ ID NO: 779224 - DNA, 20 bp, mouse
gatagaatccccttgaacag

SEQ ID NO: 779225 - DNA, 20 bp, mouse
gttcagcagagcagcctcgt

SEQ ID NO: 779226 - DNA, 20 bp, mouse
ggggaccagagtagaccatc

SEQ ID NO: 779227 - DNA, 20 bp, mouse
ggcaggggcaacgggttgca

SEQ ID NO: 779228 - DNA, 20 bp, mouse
gtgagggcagggtgtactgg

SEQ ID NO: 779229 - DNA, 20 bp, mouse
ggactgagggcagggtgtac

SEQ ID NO: 779230 - DNA, 20 bp, mouse
gggtgccgcccgtcggttcc

SEQ ID NO: 779231 - DNA, 20 bp, mouse
ggggaggggtgggataccag

SEQ ID NO: 779232 - DNA, 20 bp, mouse
ggggcccacccaaaagtcta

SEQ ID NO: 779233 - DNA, 20 bp, mouse
ggcgcagcggcaggggcaac

SEQ ID NO: 779234 - DNA, 20 bp, mouse
ggcggctggcacctgactga

SEQ ID NO: 779235 - DNA, 20 bp, mouse
gcacccctccccaccagtcc

SEQ ID NO: 779236 - DNA, 20 bp, mouse
gagccctgaggagcttgcgg

SEQ ID NO: 779237 - DNA, 20 bp, mouse
gagggccaaagaaggagcca

SEQ ID NO: 779238 - DNA, 20 bp, mouse
gaagtgggcggggacaagga

SEQ ID NO: 779239 - DNA, 20 bp, mouse
gggggctactgagagtcaga

SEQ ID NO: 779240 - DNA, 20 bp, mouse
gtgggggaggcataagtggg

SEQ ID NO: 779241 - DNA, 20 bp, mouse
gactctcagtagcccccttt

SEQ ID NO: 779242 - DNA, 20 bp, mouse
gacggtggggcaggcgaagc

SEQ ID NO: 779243 - DNA, 20 bp, mouse
gaaggctcagaccgtagaaa

SEQ ID NO: 779244 - DNA, 20 bp, mouse
ggtgagccagagtcccgccc

SEQ ID NO: 779245 - DNA, 20 bp, mouse
gcaaggcccagctccccagg

SEQ ID NO: 779246 - DNA, 20 bp, mouse
gcgcctctctgcctcgtcat

SEQ ID NO: 779247 - DNA, 20 bp, mouse
gcccacggagtaattaacga

SEQ ID NO: 779248 - DNA, 20 bp, mouse
gcagccccccaagtggaatg

SEQ ID NO: 779249 - DNA, 20 bp, mouse
gcagccgccacaggcaagta

SEQ ID NO: 779250 - DNA, 20 bp, mouse
ggcaccccattccacttggg

SEQ ID NO: 779251 - DNA, 20 bp, mouse
gagtcgtgaagccaatgacg

SEQ ID NO: 779252 - DNA, 20 bp, mouse
gcgactgcgcagtctcgcgg

SEQ ID NO: 779253 - DNA, 20 bp, mouse
gggcgtggcaggaggcgtgg

SEQ ID NO: 779254 - DNA, 20 bp, mouse
gagactgcgcagtcgccgct

SEQ ID NO: 779255 - DNA, 20 bp, mouse
gacctggacccggagaagag

SEQ ID NO: 779256 - DNA, 20 bp, mouse
gtggtagacgccacaagctg

SEQ ID NO: 779257 - DNA, 20 bp, mouse
gcttgtggcgtctaccagca

SEQ ID NO: 779258 - DNA, 20 bp, mouse
gccagcagggctctgttgag

SEQ ID NO: 779259 - DNA, 20 bp, mouse
ggtgtgcaactggattccag

SEQ ID NO: 779260 - DNA, 20 bp, mouse
gacacattataaaattacag

SEQ ID NO: 779261 - DNA, 20 bp, mouse
gggggttggccccttcctat

SEQ ID NO: 779262 - DNA, 20 bp, mouse
gatacccagccaataggaag

SEQ ID NO: 779263 - DNA, 20 bp, mouse
ggcatggcatgacatttgtg

SEQ ID NO: 779264 - DNA, 20 bp, mouse
ggctcataaactgaaagaac

SEQ ID NO: 779265 - DNA, 20 bp, mouse
gtggaggcaagcttgctaac

SEQ ID NO: 779266 - DNA, 20 bp, mouse
gatctgggacggaggactta

SEQ ID NO: 779267 - DNA, 20 bp, mouse
ggtggccagcataagtactg

SEQ ID NO: 779268 - DNA, 20 bp, mouse
gagcataagtactggggtgt

SEQ ID NO: 779269 - DNA, 20 bp, mouse
gggacacccgggtactctgc

SEQ ID NO: 779270 - DNA, 20 bp, mouse
gccccgcaaagcctcggaag

SEQ ID NO: 779271 - DNA, 20 bp, mouse
ggactccagccctgtcagtg

SEQ ID NO: 779272 - DNA, 20 bp, mouse
gagagtacccgggtgtccca

SEQ ID NO: 779273 - DNA, 20 bp, mouse
ggagggcaatgctgccatct

SEQ ID NO: 779274 - DNA, 20 bp, mouse
gcttagggcagatgtcagtc

SEQ ID NO: 779275 - DNA, 20 bp, mouse
gtggccacggtccaggaaac

SEQ ID NO: 779276 - DNA, 20 bp, mouse
ggcgaggggaccaatcagga

SEQ ID NO: 779277 - DNA, 20 bp, mouse
gctcggcgaggggaccaatc

SEQ ID NO: 779278 - DNA, 20 bp, mouse
ggtggccgctgctgctttag

SEQ ID NO: 779279 - DNA, 20 bp, mouse
ggcctcctcccggcaggcgc

SEQ ID NO: 779280 - DNA, 20 bp, mouse
gggcggagtgggggactctc

SEQ ID NO: 779281 - DNA, 20 bp, mouse
gccgcccgcctgcgcctgcc

SEQ ID NO: 779282 - DNA, 20 bp, mouse
gcccgtgagcagctcggcga

SEQ ID NO: 779283 - DNA, 20 bp, mouse
gaggctcggcccagaggccc

SEQ ID NO: 779284 - DNA, 20 bp, mouse
gtccgggcgctgacatttgc

SEQ ID NO: 779285 - DNA, 20 bp, mouse
ggtgcccggagaaaatctct

SEQ ID NO: 779286 - DNA, 20 bp, mouse
gctgccctggagagcttggg

SEQ ID NO: 779287 - DNA, 20 bp, mouse
gaggccgcgaaggctccgaa

SEQ ID NO: 779288 - DNA, 20 bp, mouse
ggcgtccccccaagctctcc

SEQ ID NO: 779289 - DNA, 20 bp, mouse
gctccctttggcagtcgtca

SEQ ID NO: 779290 - DNA, 20 bp, mouse
gtgggctgctcctgctgccc

SEQ ID NO: 779291 - DNA, 20 bp, mouse
gttagccccgcaggaccttt

SEQ ID NO: 779292 - DNA, 20 bp, mouse
ggaaggaggggccacaagga

SEQ ID NO: 779293 - DNA, 20 bp, mouse
gcctttgggaaagtggaatg

SEQ ID NO: 779294 - DNA, 20 bp, mouse
gaggagggcaattaataacc

SEQ ID NO: 779295 - DNA, 20 bp, mouse
gctaggggcgttgcgaagga

SEQ ID NO: 779296 - DNA, 20 bp, mouse
gaatcaggagagttggtcag

SEQ ID NO: 779297 - DNA, 20 bp, mouse
gcaaacgggccccaaaacac

SEQ ID NO: 779298 - DNA, 20 bp, mouse
gagggaggcctcctgtcaaa

SEQ ID NO: 779299 - DNA, 20 bp, mouse
ggtcggaagccggcaatcag

SEQ ID NO: 779300 - DNA, 20 bp, mouse
gctagcccaatcaggagagt

SEQ ID NO: 779301 - DNA, 20 bp, mouse
gttggggcccgtttgacagg

SEQ ID NO: 779302 - DNA, 20 bp, mouse
ggttttggggcccgtttgac

SEQ ID NO: 779303 - DNA, 20 bp, mouse
gtcttgctgggacacagtgg

SEQ ID NO: 779304 - DNA, 20 bp, mouse
gcacaccctgcgattgacgt

SEQ ID NO: 779305 - DNA, 20 bp, mouse
ggcgagacgtcacagaaagt

SEQ ID NO: 779306 - DNA, 20 bp, mouse
gcctccagcggagacctcat

SEQ ID NO: 779307 - DNA, 20 bp, mouse
ggggccgccccgcttgaatg

SEQ ID NO: 779308 - DNA, 20 bp, mouse
ggggcggccccgccctccag

SEQ ID NO: 779309 - DNA, 20 bp, mouse
ggcagccagcaaccgtagtc

SEQ ID NO: 779310 - DNA, 20 bp, mouse
gtggccggggagggcgaggc

SEQ ID NO: 779311 - DNA, 20 bp, mouse
gaggtctccgctggagggcg

SEQ ID NO: 779312 - DNA, 20 bp, mouse
gacgcccatgaggtctccgc

SEQ ID NO: 779313 - DNA, 20 bp, mouse
gccgcgtcacgtggtcccac

SEQ ID NO: 779314 - DNA, 20 bp, mouse
gtgcgctcccaacctgacta

SEQ ID NO: 779315 - DNA, 20 bp, mouse
gccaacctgactacggttgc

SEQ ID NO: 779316 - DNA, 20 bp, mouse
gtgagcactacccaccacga

SEQ ID NO: 779317 - DNA, 20 bp, mouse
gaggcgcagtgggaccagac

SEQ ID NO: 779318 - DNA, 20 bp, mouse
gaggcaccatagagaaagat

SEQ ID NO: 779319 - DNA, 20 bp, mouse
gtggcagccaggtcacgtgg

SEQ ID NO: 779320 - DNA, 20 bp, mouse
ggacaggtcaaggatgactg

SEQ ID NO: 779321 - DNA, 20 bp, mouse
gtggccgcgccgctgtcgcc

SEQ ID NO: 779322 - DNA, 20 bp, mouse
gccaccgggcggagcggcgc

SEQ ID NO: 779323 - DNA, 20 bp, mouse
gggacgacgcctggcgacag

SEQ ID NO: 779324 - DNA, 20 bp, mouse
ggtgctcagtgaggcgcagt

SEQ ID NO: 779325 - DNA, 20 bp, mouse
ggacaaggaaaggatgataa

SEQ ID NO: 779326 - DNA, 20 bp, mouse
gcggaggggaggtgccccac

SEQ ID NO: 779327 - DNA, 20 bp, mouse
ggaagcgcgaaggcagttct

SEQ ID NO: 779328 - DNA, 20 bp, mouse
ggtaagcgacagacaccctc

SEQ ID NO: 779329 - DNA, 20 bp, mouse
ggcgaaggcagttctaggtt

SEQ ID NO: 779330 - DNA, 20 bp, mouse
ggccccacggcgctcagggc

SEQ ID NO: 779331 - DNA, 20 bp, mouse
gtgggtcggcctacccggag

SEQ ID NO: 779332 - DNA, 20 bp, mouse
gacaccctcgggcctgctcg

SEQ ID NO: 779333 - DNA, 20 bp, mouse
gcctgagcgccgtggggcgg

SEQ ID NO: 779334 - DNA, 20 bp, mouse
gacgcctgggtcggcctacc

SEQ ID NO: 779335 - DNA, 20 bp, mouse
gtgtagtccgcgagcccgtg

SEQ ID NO: 779336 - DNA, 20 bp, mouse
gaggcacgacgggaacagca

SEQ ID NO: 779337 - DNA, 20 bp, mouse
ggtgacccgcgtcccgtctg

SEQ ID NO: 779338 - DNA, 20 bp, mouse
gccggccttggagggagaca

SEQ ID NO: 779339 - DNA, 20 bp, mouse
gcagtgggacggtacggaga

SEQ ID NO: 779340 - DNA, 20 bp, mouse
gcgggacgcgggtcacgccc

SEQ ID NO: 779341 - DNA, 20 bp, mouse
gcccctgcacggaagtacgt

SEQ ID NO: 779342 - DNA, 20 bp, mouse
gagagctcggccggccttgg

SEQ ID NO: 779343 - DNA, 20 bp, mouse
gagaacgccgggagagaacc

SEQ ID NO: 779344 - DNA, 20 bp, mouse
gaggaccgcagacgggacgc

SEQ ID NO: 779345 - DNA, 20 bp, mouse
gacatccgggatctcctcct

SEQ ID NO: 779346 - DNA, 20 bp, mouse
gacccaacggggacatagac

SEQ ID NO: 779347 - DNA, 20 bp, mouse
gacatgctacggggacccaa

SEQ ID NO: 779348 - DNA, 20 bp, mouse
gctacaaagcgtgccgtaat

SEQ ID NO: 779349 - DNA, 20 bp, mouse
gacaaaggtaggagtgtctg

SEQ ID NO: 779350 - DNA, 20 bp, mouse
gttcagggtcagaacatagt

SEQ ID NO: 779351 - DNA, 20 bp, mouse
ggggtccccgtagcatgtaa

SEQ ID NO: 779352 - DNA, 20 bp, mouse
gggcacgctttgtagaaaag

SEQ ID NO: 779353 - DNA, 20 bp, mouse
gggcgccattacatgctacg

SEQ ID NO: 779354 - DNA, 20 bp, mouse
gtgtagaaaagcggactcct

SEQ ID NO: 779355 - DNA, 20 bp, mouse
gtgggggcgtagccccgaga

SEQ ID NO: 779356 - DNA, 20 bp, mouse
ggagacgccgacatgggcta

SEQ ID NO: 779357 - DNA, 20 bp, mouse
gcaggcgccctagcccatgt

SEQ ID NO: 779358 - DNA, 20 bp, mouse
gtccggcgcgccgcccagag

SEQ ID NO: 779359 - DNA, 20 bp, mouse
gtgcgcgctcggaccgctct

SEQ ID NO: 779360 - DNA, 20 bp, mouse
ggcccagccccgcctcaagg

SEQ ID NO: 779361 - DNA, 20 bp, mouse
gaaggcccagccccgcctca

SEQ ID NO: 779362 - DNA, 20 bp, mouse
gagctgggattgtgcgatta

SEQ ID NO: 779363 - DNA, 20 bp, mouse
gtcaaggcggctccggatcc

SEQ ID NO: 779364 - DNA, 20 bp, mouse
gaaaccgggagacgccgaca

SEQ ID NO: 779365 - DNA, 20 bp, mouse
gccaatggcgccccgggtga

SEQ ID NO: 779366 - DNA, 20 bp, mouse
ggggcggggcacggtggaag

SEQ ID NO: 779367 - DNA, 20 bp, mouse
gcgcctcccggctccgtccg

SEQ ID NO: 779368 - DNA, 20 bp, mouse
gcctacccgcaccacttcgg

SEQ ID NO: 779369 - DNA, 20 bp, mouse
gggcgcagccaggaaggcgg

SEQ ID NO: 779370 - DNA, 20 bp, mouse
gtcggggccgcggacggagc

SEQ ID NO: 779371 - DNA, 20 bp, mouse
ggggcgctgcgcgcgaccgc

SEQ ID NO: 779372 - DNA, 20 bp, mouse
gcgcccccgccgaagtggtg

SEQ ID NO: 779373 - DNA, 20 bp, mouse
gcgcgtgcatggggacacag

SEQ ID NO: 779374 - DNA, 20 bp, mouse
ggagcgcggcgcagccagga

SEQ ID NO: 779375 - DNA, 20 bp, mouse
ggcgcgaccgaggccaacgg

SEQ ID NO: 779376 - DNA, 20 bp, mouse
gccaaagcggtcccgagggc

SEQ ID NO: 779377 - DNA, 20 bp, mouse
gagccccaaagcggtcccga

SEQ ID NO: 779378 - DNA, 20 bp, mouse
gcaaaagtgcctccgcccgg

SEQ ID NO: 779379 - DNA, 20 bp, mouse
gcccgagggcggggctgctg

SEQ ID NO: 779380 - DNA, 20 bp, mouse
gtccccgagcccccgggcgg

SEQ ID NO: 779381 - DNA, 20 bp, mouse
gcagttggcgccagccctaa

SEQ ID NO: 779382 - DNA, 20 bp, mouse
gaacgcgcggggtcacgcgc

SEQ ID NO: 779383 - DNA, 20 bp, mouse
gcgccgggcaagcgccaaac

SEQ ID NO: 779384 - DNA, 20 bp, mouse
gcccgcagcagccccgccct

SEQ ID NO: 779385 - DNA, 20 bp, mouse
gcgggcgggaggaggcccgg

SEQ ID NO: 779386 - DNA, 20 bp, mouse
gttagcgcgcgaccggggcg

SEQ ID NO: 779387 - DNA, 20 bp, mouse
ggctaactctgggtctaggt

SEQ ID NO: 779388 - DNA, 20 bp, mouse
ggggctcggcctccaatagg

SEQ ID NO: 779389 - DNA, 20 bp, mouse
gggggcgcgcggaggtaacc

SEQ ID NO: 779390 - DNA, 20 bp, mouse
gaacgagttgaggagggcga

SEQ ID NO: 779391 - DNA, 20 bp, mouse
gctagagcggactgagtgac

SEQ ID NO: 779392 - DNA, 20 bp, mouse
gaaggctgcgccggagttgc

SEQ ID NO: 779393 - DNA, 20 bp, mouse
gccggtcgcgcgctaactct

SEQ ID NO: 779394 - DNA, 20 bp, mouse
gcgcggcccgggcaagggga

SEQ ID NO: 779395 - DNA, 20 bp, mouse
ggcgcgctaactctgggtct

SEQ ID NO: 779396 - DNA, 20 bp, mouse
gaacgttctggtagtgtcgg

SEQ ID NO: 779397 - DNA, 20 bp, mouse
ggctgcacggggggaagagc

SEQ ID NO: 779398 - DNA, 20 bp, mouse
gacggcgctgagggaaaaat

SEQ ID NO: 779399 - DNA, 20 bp, mouse
gacaacagggggaggaaaac

SEQ ID NO: 779400 - DNA, 20 bp, mouse
gaaacaggccgctgctgcac

SEQ ID NO: 779401 - DNA, 20 bp, mouse
gaagagcaggcaacaaatcc

SEQ ID NO: 779402 - DNA, 20 bp, mouse
gcaggccgctgctgcacggg

SEQ ID NO: 779403 - DNA, 20 bp, mouse
gaagaagaaaagaccgaaga

SEQ ID NO: 779404 - DNA, 20 bp, mouse
gaggataagaaggagtataa

SEQ ID NO: 779405 - DNA, 20 bp, mouse
gaagaaaagaccgaagaggg

SEQ ID NO: 779406 - DNA, 20 bp, mouse
ggacacagcaactggtagat

SEQ ID NO: 779407 - DNA, 20 bp, mouse
gcacgacggcctgtaattaa

SEQ ID NO: 779408 - DNA, 20 bp, mouse
ggagggggggcgatctggag

SEQ ID NO: 779409 - DNA, 20 bp, mouse
ggcacacgtcccttaattac

SEQ ID NO: 779410 - DNA, 20 bp, mouse
ggatgggcttcttggaagaa

SEQ ID NO: 779411 - DNA, 20 bp, mouse
gaaactaacgagataatccg

SEQ ID NO: 779412 - DNA, 20 bp, mouse
ggagaggaccgagagccgga

SEQ ID NO: 779413 - DNA, 20 bp, mouse
ggaaaaaaaaccaccaagga

SEQ ID NO: 779414 - DNA, 20 bp, mouse
ggaccgagagccggagggaa

SEQ ID NO: 779415 - DNA, 20 bp, mouse
gtcagctctgcttctcgtcc

SEQ ID NO: 779416 - DNA, 20 bp, mouse
gtagcagggcggtgactaaa

SEQ ID NO: 779417 - DNA, 20 bp, mouse
ggcggtgctgcaatgggcac

SEQ ID NO: 779418 - DNA, 20 bp, mouse
gaccactaggagacgctgag

SEQ ID NO: 779419 - DNA, 20 bp, mouse
ggagaagagcgtgagagcaa

SEQ ID NO: 779420 - DNA, 20 bp, mouse
ggggcaccggttggtacaaa

SEQ ID NO: 779421 - DNA, 20 bp, mouse
ggagggcggagattctagca

SEQ ID NO: 779422 - DNA, 20 bp, mouse
gaagagggcggtgctgcaat

SEQ ID NO: 779423 - DNA, 20 bp, mouse
ggaaacggggtgcaacagga

SEQ ID NO: 779424 - DNA, 20 bp, mouse
ggagagcaagggggaccact

SEQ ID NO: 779425 - DNA, 20 bp, mouse
gggcggagattctagcaggg

SEQ ID NO: 779426 - DNA, 20 bp, mouse
ggaccagaaggctacttcgc

SEQ ID NO: 779427 - DNA, 20 bp, mouse
gagccggcgaagtagccttc

SEQ ID NO: 779428 - DNA, 20 bp, mouse
gtgctgctctggccctctca

SEQ ID NO: 779429 - DNA, 20 bp, mouse
gcgtgcggggaacaccccta

SEQ ID NO: 779430 - DNA, 20 bp, mouse
ggacagcgggggaaatgcaa

SEQ ID NO: 779431 - DNA, 20 bp, mouse
ggcgcagttgcaactctcac

SEQ ID NO: 779432 - DNA, 20 bp, mouse
ggggctctcctaaaacaaaa

SEQ ID NO: 779433 - DNA, 20 bp, mouse
ggcggggaacacccctaagg

SEQ ID NO: 779434 - DNA, 20 bp, mouse
gagtagaagtccatggggta

SEQ ID NO: 779435 - DNA, 20 bp, mouse
gaggtgcagcaagggtccag

SEQ ID NO: 779436 - DNA, 20 bp, mouse
gagcaacttattgatgtagg

SEQ ID NO: 779437 - DNA, 20 bp, mouse
gcataagatgtctttgcatg

SEQ ID NO: 779438 - DNA, 20 bp, mouse
gaatgttttttgttagatgt

SEQ ID NO: 779439 - DNA, 20 bp, mouse
gctgttctcaattacctatc

SEQ ID NO: 779440 - DNA, 20 bp, mouse
gacagactatattgtgctct

SEQ ID NO: 779441 - DNA, 20 bp, mouse
gatttattaactgagactgg

SEQ ID NO: 779442 - DNA, 20 bp, mouse
gctgtgtacttatccctgat

SEQ ID NO: 779443 - DNA, 20 bp, mouse
gggaagcaacttattgatgt

SEQ ID NO: 779444 - DNA, 20 bp, mouse
gtggatgaggggttagtcac

SEQ ID NO: 779445 - DNA, 20 bp, mouse
gttgcttcctccagtgttcc

SEQ ID NO: 779446 - DNA, 20 bp, mouse
ggtcagggatattgatttgt

SEQ ID NO: 779447 - DNA, 20 bp, mouse
gtccctgctagtgtcaggtc

SEQ ID NO: 779448 - DNA, 20 bp, mouse
gctcactccctgctagtgtc

SEQ ID NO: 779449 - DNA, 20 bp, mouse
gtccctgacctgacactagc

SEQ ID NO: 779450 - DNA, 20 bp, mouse
ggagctggataccaggaaat

SEQ ID NO: 779451 - DNA, 20 bp, mouse
gagctctgcagttgagatgg

SEQ ID NO: 779452 - DNA, 20 bp, mouse
gctgagaactacagctgttc

SEQ ID NO: 779453 - DNA, 20 bp, mouse
ggggagtgagtattcaccac

SEQ ID NO: 779454 - DNA, 20 bp, mouse
gtgattgccagacaagtctc

SEQ ID NO: 779455 - DNA, 20 bp, mouse
gaagtctatacaagattatc

SEQ ID NO: 779456 - DNA, 20 bp, mouse
ggatttggagtcttcgggaa

SEQ ID NO: 779457 - DNA, 20 bp, mouse
gcaaatcttcagtaagtaaa

SEQ ID NO: 779458 - DNA, 20 bp, mouse
gaagaagatagcctcaccaa

SEQ ID NO: 779459 - DNA, 20 bp, mouse
gtcttcagtaagtaaaggga

SEQ ID NO: 779460 - DNA, 20 bp, mouse
gactgaagatttggagtctt

SEQ ID NO: 779461 - DNA, 20 bp, mouse
gcctctgccagcactgtgtc

SEQ ID NO: 779462 - DNA, 20 bp, mouse
gtatgacttacatggaagtt

SEQ ID NO: 779463 - DNA, 20 bp, mouse
ggggcaggttcataagagca

SEQ ID NO: 779464 - DNA, 20 bp, mouse
gtgcaggcctgacacagtgc

SEQ ID NO: 779465 - DNA, 20 bp, mouse
ggaattactggagaaagctt

SEQ ID NO: 779466 - DNA, 20 bp, mouse
ggaggccacctcacccgcag

SEQ ID NO: 779467 - DNA, 20 bp, mouse
gagagcgatggcgcatgcgt

SEQ ID NO: 779468 - DNA, 20 bp, mouse
gcgacaggtaacaaataggt

SEQ ID NO: 779469 - DNA, 20 bp, mouse
ggggcggggtggcacgacgg

SEQ ID NO: 779470 - DNA, 20 bp, mouse
ggggcaggggaggtccgggg

SEQ ID NO: 779471 - DNA, 20 bp, mouse
gggagtggccgagagagcga

SEQ ID NO: 779472 - DNA, 20 bp, mouse
gagcgggcacggaaagggag

SEQ ID NO: 779473 - DNA, 20 bp, mouse
gcacctcacccgcagcggaa

SEQ ID NO: 779474 - DNA, 20 bp, mouse
gtgagcacgctgggcagggg

SEQ ID NO: 779475 - DNA, 20 bp, mouse
ggctgggcaggggaggtccg

SEQ ID NO: 779476 - DNA, 20 bp, mouse
ggataggggtatgaagcaga

SEQ ID NO: 779477 - DNA, 20 bp, mouse
gccgccggaaccggtcggac

SEQ ID NO: 779478 - DNA, 20 bp, mouse
gcccggccgccggaaccggt

SEQ ID NO: 779479 - DNA, 20 bp, mouse
ggaggtgggggccaactcgt

SEQ ID NO: 779480 - DNA, 20 bp, mouse
ggctcccagtcgggctgcat

SEQ ID NO: 779481 - DNA, 20 bp, mouse
ggcagcccgactgggagctg

SEQ ID NO: 779482 - DNA, 20 bp, mouse
gtgtcaggtaaagggagggg

SEQ ID NO: 779483 - DNA, 20 bp, mouse
gagctcgctacctgtccgac

SEQ ID NO: 779484 - DNA, 20 bp, mouse
gggagacaaatcaacttcgg

SEQ ID NO: 779485 - DNA, 20 bp, mouse
gctataaagtgcatgtgata

SEQ ID NO: 779486 - DNA, 20 bp, mouse
gcaagtgggcgacgtcccga

SEQ ID NO: 779487 - DNA, 20 bp, mouse
ggacaccctaagttagttcg

SEQ ID NO: 779488 - DNA, 20 bp, mouse
gcgcccctcgaactaactta

SEQ ID NO: 779489 - DNA, 20 bp, mouse
gcctgggcacctcgccaagt

SEQ ID NO: 779490 - DNA, 20 bp, mouse
ggaggtgcccaggtccgggg

SEQ ID NO: 779491 - DNA, 20 bp, mouse
gttcgaggggcggatggcta

SEQ ID NO: 779492 - DNA, 20 bp, mouse
gttggaccctggtgcttcgt

SEQ ID NO: 779493 - DNA, 20 bp, mouse
gcacacgcggcgtcacgccc

SEQ ID NO: 779494 - DNA, 20 bp, mouse
gtggcgaggtgcccaggtcc

SEQ ID NO: 779495 - DNA, 20 bp, mouse
gcgggagcgaggcaagacga

SEQ ID NO: 779496 - DNA, 20 bp, mouse
ggtcacagatcaggtagtga

SEQ ID NO: 779497 - DNA, 20 bp, mouse
gagacctgacgtcacagatc

SEQ ID NO: 779498 - DNA, 20 bp, mouse
gctacctgatctgtgacgtc

SEQ ID NO: 779499 - DNA, 20 bp, mouse
ggacaggatgcgctgttaag

SEQ ID NO: 779500 - DNA, 20 bp, mouse
gctcttagtttcaatctctg

SEQ ID NO: 779501 - DNA, 20 bp, mouse
ggattgaaactaagagacag

SEQ ID NO: 779502 - DNA, 20 bp, mouse
gtacagtttgggaaatggaa

SEQ ID NO: 779503 - DNA, 20 bp, mouse
gactcagaactttgacgctg

SEQ ID NO: 779504 - DNA, 20 bp, mouse
ggaggattgcctaaaattcg

SEQ ID NO: 779505 - DNA, 20 bp, mouse
gccaaactgtaattgttccc

SEQ ID NO: 779506 - DNA, 20 bp, mouse
gggccccggcacaacccgcg

SEQ ID NO: 779507 - DNA, 20 bp, mouse
gaggggctcacggctaggaa

SEQ ID NO: 779508 - DNA, 20 bp, mouse
gggtgtgcccgcagatgagc

SEQ ID NO: 779509 - DNA, 20 bp, mouse
gagctggagcccagcacctc

SEQ ID NO: 779510 - DNA, 20 bp, mouse
gagccccgcgggttgtgccg

SEQ ID NO: 779511 - DNA, 20 bp, mouse
gtcaagaagcgagacaggga

SEQ ID NO: 779512 - DNA, 20 bp, mouse
gcagggaggggctcacggct

SEQ ID NO: 779513 - DNA, 20 bp, mouse
ggcgctgcactcaggctgga

SEQ ID NO: 779514 - DNA, 20 bp, mouse
gaaggggcggcaccgctctg

SEQ ID NO: 779515 - DNA, 20 bp, mouse
gagcggcgggcgctgcactc

SEQ ID NO: 779516 - DNA, 20 bp, mouse
gacaatggagtcccaaacag

SEQ ID NO: 779517 - DNA, 20 bp, mouse
gatactgccagggatggccg

SEQ ID NO: 779518 - DNA, 20 bp, mouse
gacaggagggagtgacagat

SEQ ID NO: 779519 - DNA, 20 bp, mouse
gcagccctccctccaggagt

SEQ ID NO: 779520 - DNA, 20 bp, mouse
gaggatcccccactcctgga

SEQ ID NO: 779521 - DNA, 20 bp, mouse
gcagggaggaggatactgcc

SEQ ID NO: 779522 - DNA, 20 bp, mouse
gaatgtgcactgctctgcaa

SEQ ID NO: 779523 - DNA, 20 bp, mouse
ggctctgtgacgcagcgcag

SEQ ID NO: 779524 - DNA, 20 bp, mouse
gggagtgggggatcctaacc

SEQ ID NO: 779525 - DNA, 20 bp, mouse
gcgagctctcttaggtacaa

SEQ ID NO: 779526 - DNA, 20 bp, mouse
gtgtcagcagcattaagcag

SEQ ID NO: 779527 - DNA, 20 bp, mouse
gacaaatggcagtgagcacc

SEQ ID NO: 779528 - DNA, 20 bp, mouse
gacactgccagggatggtcg

SEQ ID NO: 779529 - DNA, 20 bp, mouse
gtcccccctcctggagggag

SEQ ID NO: 779530 - DNA, 20 bp, mouse
gtaggatcccccctcctgga

SEQ ID NO: 779531 - DNA, 20 bp, mouse
gaggaggggggatcctaacc

SEQ ID NO: 779532 - DNA, 20 bp, mouse
gcttgggtacagtggagccc

SEQ ID NO: 779533 - DNA, 20 bp, mouse
gttaaactctaaactctccc

SEQ ID NO: 779534 - DNA, 20 bp, mouse
gagaaagaccaggtgcactt

SEQ ID NO: 779535 - DNA, 20 bp, mouse
gacatcagggggtgacagat

SEQ ID NO: 779536 - DNA, 20 bp, mouse
ggcagcgccgccgccgtccg

SEQ ID NO: 779537 - DNA, 20 bp, mouse
gccgtccggggtttactatt

SEQ ID NO: 779538 - DNA, 20 bp, mouse
gacaggctagaggcagttag

SEQ ID NO: 779539 - DNA, 20 bp, mouse
gagtaaaccccggacggcgg

SEQ ID NO: 779540 - DNA, 20 bp, mouse
gaaaagcgtccaacacgaac

SEQ ID NO: 779541 - DNA, 20 bp, mouse
gtccaacacgaacaggctag

SEQ ID NO: 779542 - DNA, 20 bp, mouse
ggcctctagcctgttcgtgt

SEQ ID NO: 779543 - DNA, 20 bp, mouse
gacaaagttaagggtcatcg

SEQ ID NO: 779544 - DNA, 20 bp, mouse
gcgctgcatgtgagcgcttt

SEQ ID NO: 779545 - DNA, 20 bp, mouse
gcagtcccaatagtaaaccc

SEQ ID NO: 779546 - DNA, 20 bp, mouse
gaggctcgggacagccgcag

SEQ ID NO: 779547 - DNA, 20 bp, mouse
gaggcctgggaacatagcac

SEQ ID NO: 779548 - DNA, 20 bp, mouse
gtgtcccgagcctctaagac

SEQ ID NO: 779549 - DNA, 20 bp, mouse
gcggccggtcttagaggctc

SEQ ID NO: 779550 - DNA, 20 bp, mouse
gaagcggaagtgatgctcgc

SEQ ID NO: 779551 - DNA, 20 bp, mouse
ggcactggttactgcgcggt

SEQ ID NO: 779552 - DNA, 20 bp, mouse
gcgcggtcggccggtcttag

SEQ ID NO: 779553 - DNA, 20 bp, mouse
gctcactgcccggacagcgc

SEQ ID NO: 779554 - DNA, 20 bp, mouse
gcccaaatgggtcctctccc

SEQ ID NO: 779555 - DNA, 20 bp, mouse
gtctcgtgagccacgttcgg

SEQ ID NO: 779556 - DNA, 20 bp, mouse
gcaaaagggtgacccggtcg

SEQ ID NO: 779557 - DNA, 20 bp, mouse
gtctaccgccgcggccaaaa

SEQ ID NO: 779558 - DNA, 20 bp, mouse
ggtcgctggcacccagtgga

SEQ ID NO: 779559 - DNA, 20 bp, mouse
ggtcgccatggagatagcgc

SEQ ID NO: 779560 - DNA, 20 bp, mouse
gaccgccatggtcacccggt

SEQ ID NO: 779561 - DNA, 20 bp, mouse
gagtgactgttcctgcgcca

SEQ ID NO: 779562 - DNA, 20 bp, mouse
gcgcaagctcgagggatcgc

SEQ ID NO: 779563 - DNA, 20 bp, mouse
gggagatagcgccggaaaga

SEQ ID NO: 779564 - DNA, 20 bp, mouse
gaccctgcctgggcgcaggt

SEQ ID NO: 779565 - DNA, 20 bp, mouse
ggacccggtcgcggtcgcca

SEQ ID NO: 779566 - DNA, 20 bp, mouse
gcgggcgcgcaggtgtgcgg

SEQ ID NO: 779567 - DNA, 20 bp, mouse
gcgaagccccgcggggtcta

SEQ ID NO: 779568 - DNA, 20 bp, mouse
gcgcctgcccggggcaggaa

SEQ ID NO: 779569 - DNA, 20 bp, mouse
gactggggaggcggcgccac

SEQ ID NO: 779570 - DNA, 20 bp, mouse
gcctcgccggccagtcccga

SEQ ID NO: 779571 - DNA, 20 bp, mouse
gcacgcagctgcaaggctcg

SEQ ID NO: 779572 - DNA, 20 bp, mouse
ggggactcacccggtccctc

SEQ ID NO: 779573 - DNA, 20 bp, mouse
ggtgcgggcgcgcaggtgtg

SEQ ID NO: 779574 - DNA, 20 bp, mouse
gccgggaggcgaagccccgc

SEQ ID NO: 779575 - DNA, 20 bp, mouse
gacgctgaatcgggacgagt

SEQ ID NO: 779576 - DNA, 20 bp, mouse
ggcgccgagctgcagagcga

SEQ ID NO: 779577 - DNA, 20 bp, mouse
gcgtccccgcagcgaactct

SEQ ID NO: 779578 - DNA, 20 bp, mouse
gtggagttgggactctgctc

SEQ ID NO: 779579 - DNA, 20 bp, mouse
gggagcccgagagttcgctg

SEQ ID NO: 779580 - DNA, 20 bp, mouse
gctggcaggtgtctgttctt

SEQ ID NO: 779581 - DNA, 20 bp, mouse
gctgcggggacgcgcggaaa

SEQ ID NO: 779582 - DNA, 20 bp, mouse
ggagctggaggcgaccacgc

SEQ ID NO: 779583 - DNA, 20 bp, mouse
gcagctctggggaccgggga

SEQ ID NO: 779584 - DNA, 20 bp, mouse
gagcgacggccacgagctgg

SEQ ID NO: 779585 - DNA, 20 bp, mouse
gtaccaagagccatccgcgg

SEQ ID NO: 779586 - DNA, 20 bp, mouse
gagggcggatcgaaacggcg

SEQ ID NO: 779587 - DNA, 20 bp, mouse
gccaccgcggagggacggtg

SEQ ID NO: 779588 - DNA, 20 bp, mouse
gctcccccaccgtccctccg

SEQ ID NO: 779589 - DNA, 20 bp, mouse
gcggcctgctccaccgcgga

SEQ ID NO: 779590 - DNA, 20 bp, mouse
ggcggccgatggtccgtccc

SEQ ID NO: 779591 - DNA, 20 bp, mouse
ggggagaggggagaaggcta

SEQ ID NO: 779592 - DNA, 20 bp, mouse
gctctccccggggcgacgtg

SEQ ID NO: 779593 - DNA, 20 bp, mouse
gcgcagcggtccagaaagtc

SEQ ID NO: 779594 - DNA, 20 bp, mouse
ggggggagggcggatcgaaa

SEQ ID NO: 779595 - DNA, 20 bp, mouse
ggacccaaggttagaatcgc

SEQ ID NO: 779596 - DNA, 20 bp, mouse
gtggtccaggacaggattaa

SEQ ID NO: 779597 - DNA, 20 bp, mouse
ggcagaagacatactggaag

SEQ ID NO: 779598 - DNA, 20 bp, mouse
gaggactctggacgtggtcc

SEQ ID NO: 779599 - DNA, 20 bp, mouse
gggtttccatagcctccctc

SEQ ID NO: 779600 - DNA, 20 bp, mouse
ggactgggagatcaggactc

SEQ ID NO: 779601 - DNA, 20 bp, mouse
gggctatggaaacccatcac

SEQ ID NO: 779602 - DNA, 20 bp, mouse
ggggatccctagtctcctat

SEQ ID NO: 779603 - DNA, 20 bp, mouse
gggtaaccagagggaggcta

SEQ ID NO: 779604 - DNA, 20 bp, mouse
gtctccacgactgggagatc

SEQ ID NO: 779605 - DNA, 20 bp, mouse
gaaggaggcagaagacatac

SEQ ID NO: 779606 - DNA, 20 bp, mouse
ggtcctccccggaatgtcct

SEQ ID NO: 779607 - DNA, 20 bp, mouse
gtacagctataggtcctccc

SEQ ID NO: 779608 - DNA, 20 bp, mouse
gctgtgctgccagagaaggg

SEQ ID NO: 779609 - DNA, 20 bp, mouse
gtggcagcacaggaatatct

SEQ ID NO: 779610 - DNA, 20 bp, mouse
gaatgacagccgcccttctc

SEQ ID NO: 779611 - DNA, 20 bp, mouse
gttcctgtgctgccagagaa

SEQ ID NO: 779612 - DNA, 20 bp, mouse
gaggctctgaggctagagcg

SEQ ID NO: 779613 - DNA, 20 bp, mouse
ggagcggggcactcacaacc

SEQ ID NO: 779614 - DNA, 20 bp, mouse
gtccccaggacattccgggg

SEQ ID NO: 779615 - DNA, 20 bp, mouse
gtttcccaagcgatcaaaac

SEQ ID NO: 779616 - DNA, 20 bp, mouse
gctctggccgcaggcctctg

SEQ ID NO: 779617 - DNA, 20 bp, mouse
gtggccgcaggcctctgcgg

SEQ ID NO: 779618 - DNA, 20 bp, mouse
gctgcggccctcaggctcga

SEQ ID NO: 779619 - DNA, 20 bp, mouse
ggaggcctgcggccagaggg

SEQ ID NO: 779620 - DNA, 20 bp, mouse
ggacactcgggcctgaggcg

SEQ ID NO: 779621 - DNA, 20 bp, mouse
gaggccggttgcgaacgttg

SEQ ID NO: 779622 - DNA, 20 bp, mouse
gcgggccgcggtgcgcgagg

SEQ ID NO: 779623 - DNA, 20 bp, mouse
gcgcggcgcagccatggcgt

SEQ ID NO: 779624 - DNA, 20 bp, mouse
gagctctgcgtccccggccg

SEQ ID NO: 779625 - DNA, 20 bp, mouse
gttcgcaaccggcctctccg

SEQ ID NO: 779626 - DNA, 20 bp, mouse
gtcgtggaggagttcactga

SEQ ID NO: 779627 - DNA, 20 bp, mouse
gagagcagaagtgctcgtgg

SEQ ID NO: 779628 - DNA, 20 bp, mouse
gtagagagcagaagtgctcg

SEQ ID NO: 779629 - DNA, 20 bp, mouse
gctgcgtgtcggcaggtgga

SEQ ID NO: 779630 - DNA, 20 bp, mouse
gccgccatcttgagtgtggc

SEQ ID NO: 779631 - DNA, 20 bp, mouse
gcgccggggaagcctggccg

SEQ ID NO: 779632 - DNA, 20 bp, mouse
ggcggcagtttgctctgttt

SEQ ID NO: 779633 - DNA, 20 bp, mouse
ggtggccgccatgcttggtg

SEQ ID NO: 779634 - DNA, 20 bp, mouse
ggagtgctaaaccgaaggag

SEQ ID NO: 779635 - DNA, 20 bp, mouse
gttgagtgtggccggacaag

SEQ ID NO: 779636 - DNA, 20 bp, mouse
ggtggagcactgtctaaaga

SEQ ID NO: 779637 - DNA, 20 bp, mouse
ggcagtgcccagacataaaa

SEQ ID NO: 779638 - DNA, 20 bp, mouse
gaagagaagcagcctggaag

SEQ ID NO: 779639 - DNA, 20 bp, mouse
gggcaggcccttcatttgca

SEQ ID NO: 779640 - DNA, 20 bp, mouse
ggagtgagggagcccttaca

SEQ ID NO: 779641 - DNA, 20 bp, mouse
gggctagagagacttgggag

SEQ ID NO: 779642 - DNA, 20 bp, mouse
gggcctgcctctaaacagcg

SEQ ID NO: 779643 - DNA, 20 bp, mouse
gatcgtctctgctaatgacc

SEQ ID NO: 779644 - DNA, 20 bp, mouse
gacaagaggctagagagact

SEQ ID NO: 779645 - DNA, 20 bp, mouse
gtggacctgaaacttagatg

SEQ ID NO: 779646 - DNA, 20 bp, mouse
gccaccctccgtgccaccag

SEQ ID NO: 779647 - DNA, 20 bp, mouse
ggcaccacatatgtccgcta

SEQ ID NO: 779648 - DNA, 20 bp, mouse
gggatgccttaggaaggcaa

SEQ ID NO: 779649 - DNA, 20 bp, mouse
gtctacccctggtggcacgg

SEQ ID NO: 779650 - DNA, 20 bp, mouse
gactcggtcagctcacagcc

SEQ ID NO: 779651 - DNA, 20 bp, mouse
gcagccaccagcaaagccgc

SEQ ID NO: 779652 - DNA, 20 bp, mouse
gacagcgccgcgcgctgact

SEQ ID NO: 779653 - DNA, 20 bp, mouse
gtagcctgcggctttgctgg

SEQ ID NO: 779654 - DNA, 20 bp, mouse
gtctctgaggccatccactg

SEQ ID NO: 779655 - DNA, 20 bp, mouse
ggcggcgatcccagtgatcc

SEQ ID NO: 779656 - DNA, 20 bp, mouse
gctgcagaggacatgtggtg

SEQ ID NO: 779657 - DNA, 20 bp, mouse
gtcaaggtcaacaggtttgt

SEQ ID NO: 779658 - DNA, 20 bp, mouse
ggggccacatggataggctg

SEQ ID NO: 779659 - DNA, 20 bp, mouse
gggagacagcgcgctgagag

SEQ ID NO: 779660 - DNA, 20 bp, mouse
gaagcagccaagcagccggg

SEQ ID NO: 779661 - DNA, 20 bp, mouse
gtgaagacgtgtgagatctt

SEQ ID NO: 779662 - DNA, 20 bp, mouse
ggggtgggatcagaagcata

SEQ ID NO: 779663 - DNA, 20 bp, mouse
gagggcatacaaacactctt

SEQ ID NO: 779664 - DNA, 20 bp, mouse
gtccacgcttcaaggtcaac

SEQ ID NO: 779665 - DNA, 20 bp, mouse
gactcttgggccacatggat

SEQ ID NO: 779666 - DNA, 20 bp, mouse
gggaaacaggagctgctctc

SEQ ID NO: 779667 - DNA, 20 bp, mouse
gtagccagtagctttatctc

SEQ ID NO: 779668 - DNA, 20 bp, mouse
gcccactccaggaacctgac

SEQ ID NO: 779669 - DNA, 20 bp, mouse
gggcccaggcggagccttga

SEQ ID NO: 779670 - DNA, 20 bp, mouse
gacgaagagggagtgtccaa

SEQ ID NO: 779671 - DNA, 20 bp, mouse
gtgctctccggaaaccacca

SEQ ID NO: 779672 - DNA, 20 bp, mouse
gacccctcaaggctccgcct

SEQ ID NO: 779673 - DNA, 20 bp, mouse
gggagccttgaggggtagtg

SEQ ID NO: 779674 - DNA, 20 bp, mouse
gtgggcctgggtggcctcac

SEQ ID NO: 779675 - DNA, 20 bp, mouse
gccagccccactacccctca

SEQ ID NO: 779676 - DNA, 20 bp, mouse
gccagtgtggagcttctctt

SEQ ID NO: 779677 - DNA, 20 bp, mouse
ggctcctcccggggctctcc

SEQ ID NO: 779678 - DNA, 20 bp, mouse
gcagcccggagagccccggg

SEQ ID NO: 779679 - DNA, 20 bp, mouse
gctgcaggtgcggcggggtg

SEQ ID NO: 779680 - DNA, 20 bp, mouse
gtcttcagtaagactggaaa

SEQ ID NO: 779681 - DNA, 20 bp, mouse
ggaagactgcaggtgcggcg

SEQ ID NO: 779682 - DNA, 20 bp, mouse
gcacactctcggcctctcgt

SEQ ID NO: 779683 - DNA, 20 bp, mouse
gagcctggtggtgcagttgg

SEQ ID NO: 779684 - DNA, 20 bp, mouse
gggtttgcaaggggtgtggg

SEQ ID NO: 779685 - DNA, 20 bp, mouse
gccaatgctgggcagttcct

SEQ ID NO: 779686 - DNA, 20 bp, mouse
gcaagagtgggcagttacaa

SEQ ID NO: 779687 - DNA, 20 bp, mouse
gcagctggctagggccctct

SEQ ID NO: 779688 - DNA, 20 bp, mouse
gccctagccagctgcatctc

SEQ ID NO: 779689 - DNA, 20 bp, mouse
gtgatgtcacagcaggggtg

SEQ ID NO: 779690 - DNA, 20 bp, mouse
gctgtgacatcacaggggag

SEQ ID NO: 779691 - DNA, 20 bp, mouse
ggcaatctggagcccgggat

SEQ ID NO: 779692 - DNA, 20 bp, mouse
ggggtggggtctccaatccc

SEQ ID NO: 779693 - DNA, 20 bp, mouse
gacaaagcagctggtgagct

SEQ ID NO: 779694 - DNA, 20 bp, mouse
gttggagaatacaaagcagc

SEQ ID NO: 779695 - DNA, 20 bp, mouse
ggatgagctaactcaagagt

SEQ ID NO: 779696 - DNA, 20 bp, mouse
gcaccctggggtggcagagg

SEQ ID NO: 779697 - DNA, 20 bp, mouse
gaagagtggtatagcactaa

SEQ ID NO: 779698 - DNA, 20 bp, mouse
ggagttggggcgtcaccctg

SEQ ID NO: 779699 - DNA, 20 bp, mouse
gaactcgtgaccctctcaaa

SEQ ID NO: 779700 - DNA, 20 bp, mouse
gttggggcgtcaccctgggg

SEQ ID NO: 779701 - DNA, 20 bp, mouse
gcgtcaccctggggtggcag

SEQ ID NO: 779702 - DNA, 20 bp, mouse
gctaagggacgaattacctc

SEQ ID NO: 779703 - DNA, 20 bp, mouse
ggtcagctcccggagggaca

SEQ ID NO: 779704 - DNA, 20 bp, mouse
gccaccaccaccaccgggtc

SEQ ID NO: 779705 - DNA, 20 bp, mouse
gagctcggcccggaaatagg

SEQ ID NO: 779706 - DNA, 20 bp, mouse
gcggaagggacccacagtgc

SEQ ID NO: 779707 - DNA, 20 bp, mouse
gtagcgaggccaggacaaca

SEQ ID NO: 779708 - DNA, 20 bp, mouse
gcgctcgaaaggaaccccgt

SEQ ID NO: 779709 - DNA, 20 bp, mouse
gaatagaggcagaatccgga

SEQ ID NO: 779710 - DNA, 20 bp, mouse
gcctcgctactcatgctgtc

SEQ ID NO: 779711 - DNA, 20 bp, mouse
gtgcggaggcgaggaagaag

SEQ ID NO: 779712 - DNA, 20 bp, mouse
gcccacagtgcaggaagtaa

SEQ ID NO: 779713 - DNA, 20 bp, mouse
ggtcaggcagatgtataggt

SEQ ID NO: 779714 - DNA, 20 bp, mouse
gggtagggagagctaggcta

SEQ ID NO: 779715 - DNA, 20 bp, mouse
ggagtcccgtgggaggaggt

SEQ ID NO: 779716 - DNA, 20 bp, mouse
gggaccctatgcatagagag

SEQ ID NO: 779717 - DNA, 20 bp, mouse
gagggactctggacaaaagg

SEQ ID NO: 779718 - DNA, 20 bp, mouse
ggctacaccagctggggttt

SEQ ID NO: 779719 - DNA, 20 bp, mouse
gtatgcatagggtccaaccc

SEQ ID NO: 779720 - DNA, 20 bp, mouse
gttgtccagagtccctgggt

SEQ ID NO: 779721 - DNA, 20 bp, mouse
ggggcggggctacaccagct

SEQ ID NO: 779722 - DNA, 20 bp, mouse
gaggccaagaagccatgcat

SEQ ID NO: 779723 - DNA, 20 bp, mouse
gttagccgcagctgaactgg

SEQ ID NO: 779724 - DNA, 20 bp, mouse
gatggtgggcagtcaacacg

SEQ ID NO: 779725 - DNA, 20 bp, mouse
gctggcctgaatcccatgca

SEQ ID NO: 779726 - DNA, 20 bp, mouse
gcgtctgggggaggctagcg

SEQ ID NO: 779727 - DNA, 20 bp, mouse
ggaaatggatgggtctgagt

SEQ ID NO: 779728 - DNA, 20 bp, mouse
gccagacgcccgcacaaaga

SEQ ID NO: 779729 - DNA, 20 bp, mouse
gtgggtcttacaacatttga

SEQ ID NO: 779730 - DNA, 20 bp, mouse
gtccaaaagagcacaaggaa

SEQ ID NO: 779731 - DNA, 20 bp, mouse
gcccagtgtgactcagacaa

SEQ ID NO: 779732 - DNA, 20 bp, mouse
gcccccgctgcagtcactgg

SEQ ID NO: 779733 - DNA, 20 bp, mouse
gtacatgtggactgaacaaa

SEQ ID NO: 779734 - DNA, 20 bp, mouse
gccgcccccgctgcagtcac

SEQ ID NO: 779735 - DNA, 20 bp, mouse
gtgaggcagtggtcgcatct

SEQ ID NO: 779736 - DNA, 20 bp, mouse
gcctctggaagcagagatcg

SEQ ID NO: 779737 - DNA, 20 bp, mouse
gcggcggcccggagcttgca

SEQ ID NO: 779738 - DNA, 20 bp, mouse
gcggcccggagcttgcacgg

SEQ ID NO: 779739 - DNA, 20 bp, mouse
ggctccgggccgccggctca

SEQ ID NO: 779740 - DNA, 20 bp, mouse
gcggccttgccaggcgtgca

SEQ ID NO: 779741 - DNA, 20 bp, mouse
ggctcagggctgggcgccca

SEQ ID NO: 779742 - DNA, 20 bp, mouse
gtgcccctgcacgcctggca

SEQ ID NO: 779743 - DNA, 20 bp, mouse
gccgccaccactcgaatcag

SEQ ID NO: 779744 - DNA, 20 bp, mouse
gtgctccgcggggaggcaag

SEQ ID NO: 779745 - DNA, 20 bp, mouse
gagggctgggcgcccagggc

SEQ ID NO: 779746 - DNA, 20 bp, mouse
gtggtagaaggaaataaggt

SEQ ID NO: 779747 - DNA, 20 bp, mouse
gtggcttagaagtcttatct

SEQ ID NO: 779748 - DNA, 20 bp, mouse
ggttgtggtagaaggaaata

SEQ ID NO: 779749 - DNA, 20 bp, mouse
ggattaacgtcatctgctca

SEQ ID NO: 779750 - DNA, 20 bp, mouse
gccttgcttgcacagaacgt

SEQ ID NO: 779751 - DNA, 20 bp, mouse
gactaaatccagtaggtttg

SEQ ID NO: 779752 - DNA, 20 bp, mouse
ggaggatgatctagattgag

SEQ ID NO: 779753 - DNA, 20 bp, mouse
gctgctctttgaattttggg

SEQ ID NO: 779754 - DNA, 20 bp, mouse
ggagtaaaaaggtacaactc

SEQ ID NO: 779755 - DNA, 20 bp, mouse
gaagaaaaacattcgagttg

SEQ ID NO: 779756 - DNA, 20 bp, mouse
ggaacagctgcaaattggac

SEQ ID NO: 779757 - DNA, 20 bp, mouse
gctatggaacagctgcaaat

SEQ ID NO: 779758 - DNA, 20 bp, mouse
gcatactagccctaaaaaaa

SEQ ID NO: 779759 - DNA, 20 bp, mouse
gtgttccatagactgcgcta

SEQ ID NO: 779760 - DNA, 20 bp, mouse
gtagtccttagcgcagtcta

SEQ ID NO: 779761 - DNA, 20 bp, mouse
gtcatcacgtgtgaacccat

SEQ ID NO: 779762 - DNA, 20 bp, mouse
gtcagcactctgatttgtca

SEQ ID NO: 779763 - DNA, 20 bp, mouse
gggttctttgatcgatacaa

SEQ ID NO: 779764 - DNA, 20 bp, mouse
gtatcgatcaaagaacccat

SEQ ID NO: 779765 - DNA, 20 bp, mouse
gcaaagggaaacaaaattgc

SEQ ID NO: 779766 - DNA, 20 bp, mouse
ggcagagccggtgacagcac

SEQ ID NO: 779767 - DNA, 20 bp, mouse
gaagcccacaaggggaaatg

SEQ ID NO: 779768 - DNA, 20 bp, mouse
gtaagggcgcatatgcattc

SEQ ID NO: 779769 - DNA, 20 bp, mouse
gccacaaggggaaatgagga

SEQ ID NO: 779770 - DNA, 20 bp, mouse
gacgccatattcttaacatg

SEQ ID NO: 779771 - DNA, 20 bp, mouse
gacacgcaaccaataactac

SEQ ID NO: 779772 - DNA, 20 bp, mouse
gttgaatccagtgctgtcac

SEQ ID NO: 779773 - DNA, 20 bp, mouse
gtgttaagaatatggcgtgg

SEQ ID NO: 779774 - DNA, 20 bp, mouse
gcttctgtcccttacagcct

SEQ ID NO: 779775 - DNA, 20 bp, mouse
gtattacagaagcccacaag

SEQ ID NO: 779776 - DNA, 20 bp, mouse
ggtgtgcagtagcagagatg

SEQ ID NO: 779777 - DNA, 20 bp, mouse
gctgcacttgtccccttcac

SEQ ID NO: 779778 - DNA, 20 bp, mouse
gggctcacggactaggaatt

SEQ ID NO: 779779 - DNA, 20 bp, mouse
gttacctacagggactgtgg

SEQ ID NO: 779780 - DNA, 20 bp, mouse
gtagcagagatggggttaaa

SEQ ID NO: 779781 - DNA, 20 bp, mouse
gtgaaccaatcttacctaca

SEQ ID NO: 779782 - DNA, 20 bp, mouse
gagcgggaagtgctgcatta

SEQ ID NO: 779783 - DNA, 20 bp, mouse
ggaaaattccatccagttca

SEQ ID NO: 779784 - DNA, 20 bp, mouse
gcattaccttgctgaacgta

SEQ ID NO: 779785 - DNA, 20 bp, mouse
ggggtagagtcaaagactac

SEQ ID NO: 779786 - DNA, 20 bp, mouse
gtggaagcatctgtttagaa

SEQ ID NO: 779787 - DNA, 20 bp, mouse
gacccgcttggggacgcggt

SEQ ID NO: 779788 - DNA, 20 bp, mouse
gccggtcagcgtgtccgcca

SEQ ID NO: 779789 - DNA, 20 bp, mouse
ggcagactctgggcagacgc

SEQ ID NO: 779790 - DNA, 20 bp, mouse
gacggctgttgagcaaggag

SEQ ID NO: 779791 - DNA, 20 bp, mouse
gaggcggaaggcgaccgtcc

SEQ ID NO: 779792 - DNA, 20 bp, mouse
ggaccgaccgcgtccccaag

SEQ ID NO: 779793 - DNA, 20 bp, mouse
gtggggcagcagcggaggga

SEQ ID NO: 779794 - DNA, 20 bp, mouse
gtgcggagcggggcggagta

SEQ ID NO: 779795 - DNA, 20 bp, mouse
gtgctcacagccaggctatg

SEQ ID NO: 779796 - DNA, 20 bp, mouse
gctagctctgacaatctgtt

SEQ ID NO: 779797 - DNA, 20 bp, mouse
gccagagggcatattctcgg

SEQ ID NO: 779798 - DNA, 20 bp, mouse
gtctgacaatctgttgggat

SEQ ID NO: 779799 - DNA, 20 bp, mouse
gaagggtgacagagtcagct

SEQ ID NO: 779800 - DNA, 20 bp, mouse
gcaatctgttgggatgggac

SEQ ID NO: 779801 - DNA, 20 bp, mouse
gcagccagagggcatattct

SEQ ID NO: 779802 - DNA, 20 bp, mouse
gaaaacccttggaggttatc

SEQ ID NO: 779803 - DNA, 20 bp, mouse
gtattctcgggggtgggaca

SEQ ID NO: 779804 - DNA, 20 bp, mouse
gagggcatattctcgggggt

SEQ ID NO: 779805 - DNA, 20 bp, mouse
gtcagagctagaaaaaccct

SEQ ID NO: 779806 - DNA, 20 bp, mouse
gtccgacggtccccatcgct

SEQ ID NO: 779807 - DNA, 20 bp, mouse
gcccactcagcctagcgatg

SEQ ID NO: 779808 - DNA, 20 bp, mouse
gagggagcactcaaggccca

SEQ ID NO: 779809 - DNA, 20 bp, mouse
ggctgagtgggcagagctag

SEQ ID NO: 779810 - DNA, 20 bp, mouse
gaaccctcaggctaaactga

SEQ ID NO: 779811 - DNA, 20 bp, mouse
ggtaactgggactaccagga

SEQ ID NO: 779812 - DNA, 20 bp, mouse
gttcctgggaagatggaagg

SEQ ID NO: 779813 - DNA, 20 bp, mouse
gaggtggcagatgaggtaac

SEQ ID NO: 779814 - DNA, 20 bp, mouse
gggaagtgacactgtctctc

SEQ ID NO: 779815 - DNA, 20 bp, mouse
gggaccatcagtttagcctg

SEQ ID NO: 779816 - DNA, 20 bp, mouse
gtcctcgcgtgggccagcct

SEQ ID NO: 779817 - DNA, 20 bp, mouse
gcctaggcttggaacacccc

SEQ ID NO: 779818 - DNA, 20 bp, mouse
ggcggcaggggaatataaaa

SEQ ID NO: 779819 - DNA, 20 bp, mouse
gggcctgggcgactcccggg

SEQ ID NO: 779820 - DNA, 20 bp, mouse
gcctacaggaacccgggcgg

SEQ ID NO: 779821 - DNA, 20 bp, mouse
gacccacccgggagtcgccc

SEQ ID NO: 779822 - DNA, 20 bp, mouse
ggaagccccatggtaaccac

SEQ ID NO: 779823 - DNA, 20 bp, mouse
gccgggcctgggcgactccc

SEQ ID NO: 779824 - DNA, 20 bp, mouse
gcccatggtaaccacgggaa

SEQ ID NO: 779825 - DNA, 20 bp, mouse
gacgggaacggtggcgtggc

SEQ ID NO: 779826 - DNA, 20 bp, mouse
ggcggctcgggccttcccga

SEQ ID NO: 779827 - DNA, 20 bp, mouse
ggccttcccgaaggctccag

SEQ ID NO: 779828 - DNA, 20 bp, mouse
gtgccggtggtaatggatgt

SEQ ID NO: 779829 - DNA, 20 bp, mouse
gggtcccacgcggcgcaagg

SEQ ID NO: 779830 - DNA, 20 bp, mouse
gcgggcggagactgtgacga

SEQ ID NO: 779831 - DNA, 20 bp, mouse
gacgtggcggaggctcaagc

SEQ ID NO: 779832 - DNA, 20 bp, mouse
gccctggtgccggtcccacg

SEQ ID NO: 779833 - DNA, 20 bp, mouse
ggtgcagcgcgtggcggctc

SEQ ID NO: 779834 - DNA, 20 bp, mouse
gtatcctgggaggggagtgg

SEQ ID NO: 779835 - DNA, 20 bp, mouse
gggaggtggggacgtggcgg

SEQ ID NO: 779836 - DNA, 20 bp, mouse
gccaacccaggcgggtcacg

SEQ ID NO: 779837 - DNA, 20 bp, mouse
gttcagactagctgtctctc

SEQ ID NO: 779838 - DNA, 20 bp, mouse
gtacagccacgtgacccgcc

SEQ ID NO: 779839 - DNA, 20 bp, mouse
ggggattggtgagctcagag

SEQ ID NO: 779840 - DNA, 20 bp, mouse
gcagccaaccccaacccagg

SEQ ID NO: 779841 - DNA, 20 bp, mouse
gagcactcagcgaagtgaag

SEQ ID NO: 779842 - DNA, 20 bp, mouse
ggaggatatcggtaatggaa

SEQ ID NO: 779843 - DNA, 20 bp, mouse
gttggtgagctcagagcggc

SEQ ID NO: 779844 - DNA, 20 bp, mouse
ggatatcggtaatggaaggg

SEQ ID NO: 779845 - DNA, 20 bp, mouse
ggcccggcccagcctgaggc

SEQ ID NO: 779846 - DNA, 20 bp, mouse
ggggacgcgcgaccctgcga

SEQ ID NO: 779847 - DNA, 20 bp, mouse
gccaccgtgcctgtcacatt

SEQ ID NO: 779848 - DNA, 20 bp, mouse
ggccaagggcgggcgacgga

SEQ ID NO: 779849 - DNA, 20 bp, mouse
gctaaggaattcagtgctga

SEQ ID NO: 779850 - DNA, 20 bp, mouse
gggcgggcgacggaaggctg

SEQ ID NO: 779851 - DNA, 20 bp, mouse
gggaatcagtgtggagttag

SEQ ID NO: 779852 - DNA, 20 bp, mouse
gaggggacggaggcggccaa

SEQ ID NO: 779853 - DNA, 20 bp, mouse
gctctcgcccggcgccgccc

SEQ ID NO: 779854 - DNA, 20 bp, mouse
ggcgcccctgggcccatcgc

SEQ ID NO: 779855 - DNA, 20 bp, mouse
gagcggcgggccaggcacta

SEQ ID NO: 779856 - DNA, 20 bp, mouse
ggggactggacacccactca

SEQ ID NO: 779857 - DNA, 20 bp, mouse
gtggtggcccagccttgagt

SEQ ID NO: 779858 - DNA, 20 bp, mouse
gtccagtccccgcacggcga

SEQ ID NO: 779859 - DNA, 20 bp, mouse
ggacgcgcgcagcgaggggg

SEQ ID NO: 779860 - DNA, 20 bp, mouse
gagctccttggccaatcgga

SEQ ID NO: 779861 - DNA, 20 bp, mouse
gcggcctcgtggctcctgat

SEQ ID NO: 779862 - DNA, 20 bp, mouse
gagacccgccctcgccgtgc

SEQ ID NO: 779863 - DNA, 20 bp, mouse
gtgggtgtccagtccccgca

SEQ ID NO: 779864 - DNA, 20 bp, mouse
gcgcagcgagggggaggcgt

SEQ ID NO: 779865 - DNA, 20 bp, mouse
gggcgggtctctcagctcct

SEQ ID NO: 779866 - DNA, 20 bp, mouse
ggatctcagtatggaccgat

SEQ ID NO: 779867 - DNA, 20 bp, mouse
gcgggtgtgagcgaggtccc

SEQ ID NO: 779868 - DNA, 20 bp, mouse
gaggtcccaggatctcagta

SEQ ID NO: 779869 - DNA, 20 bp, mouse
gcccggcggtcactaggaga

SEQ ID NO: 779870 - DNA, 20 bp, mouse
gtacacggagccgcacccat

SEQ ID NO: 779871 - DNA, 20 bp, mouse
gtcactaggagacggtgctc

SEQ ID NO: 779872 - DNA, 20 bp, mouse
gacacccggctggtcgttta

SEQ ID NO: 779873 - DNA, 20 bp, mouse
gcagtatggaccgatgggtg

SEQ ID NO: 779874 - DNA, 20 bp, mouse
ggaccagccgggtgtgagcg

SEQ ID NO: 779875 - DNA, 20 bp, mouse
gaaacatggaggcacatcag

SEQ ID NO: 779876 - DNA, 20 bp, mouse
gaaccccctcctctcagtta

SEQ ID NO: 779877 - DNA, 20 bp, mouse
gacctcctggagttggccac

SEQ ID NO: 779878 - DNA, 20 bp, mouse
gagccctaactgagaggagg

SEQ ID NO: 779879 - DNA, 20 bp, mouse
ggggctaaggatcacgttgt

SEQ ID NO: 779880 - DNA, 20 bp, mouse
gtctgtgggagggatccaag

SEQ ID NO: 779881 - DNA, 20 bp, mouse
gactgcagagaatggacttc

SEQ ID NO: 779882 - DNA, 20 bp, mouse
gacctggagctgggcggcta

SEQ ID NO: 779883 - DNA, 20 bp, mouse
gttaaggtgtctcacttcct

SEQ ID NO: 779884 - DNA, 20 bp, mouse
gagcagtgggcgtggggctt

SEQ ID NO: 779885 - DNA, 20 bp, mouse
gaccagccctaactgagagg

SEQ ID NO: 779886 - DNA, 20 bp, mouse
gggtactgagcggagactgt

SEQ ID NO: 779887 - DNA, 20 bp, mouse
gctactggctactcaagact

SEQ ID NO: 779888 - DNA, 20 bp, mouse
gagactagggagacaagtac

SEQ ID NO: 779889 - DNA, 20 bp, mouse
gggggacagacgcagatcct

SEQ ID NO: 779890 - DNA, 20 bp, mouse
ggatctgcgtctgtcccccg

SEQ ID NO: 779891 - DNA, 20 bp, mouse
ggaggaaaagccttgctcag

SEQ ID NO: 779892 - DNA, 20 bp, mouse
gtcagtgcagcctccctcgg

SEQ ID NO: 779893 - DNA, 20 bp, mouse
ggctgcaggctctagtctac

SEQ ID NO: 779894 - DNA, 20 bp, mouse
gggctgcactgatctgtggg

SEQ ID NO: 779895 - DNA, 20 bp, mouse
gtctgctcttccttgcctct

SEQ ID NO: 779896 - DNA, 20 bp, mouse
ggccgcgccgcgtctctcgc

SEQ ID NO: 779897 - DNA, 20 bp, mouse
gggggaatgagtcaccgctc

SEQ ID NO: 779898 - DNA, 20 bp, mouse
gtaacgggagcattgggtac

SEQ ID NO: 779899 - DNA, 20 bp, mouse
ggcgccgcgtctctcgcggg

SEQ ID NO: 779900 - DNA, 20 bp, mouse
ggtcagggagtgctgacact

SEQ ID NO: 779901 - DNA, 20 bp, mouse
gagagacgcggcgcggccat

SEQ ID NO: 779902 - DNA, 20 bp, mouse
ggggcaggcgggagctaggc

SEQ ID NO: 779903 - DNA, 20 bp, mouse
gggggcgtgatgctcaccaa

SEQ ID NO: 779904 - DNA, 20 bp, mouse
ggggagctaggctgggcgag

SEQ ID NO: 779905 - DNA, 20 bp, mouse
gcgtctctcgcgggggggtg

SEQ ID NO: 779906 - DNA, 20 bp, mouse
gccactgacccggggaatgt

SEQ ID NO: 779907 - DNA, 20 bp, mouse
gtggtgcagccactgacccg

SEQ ID NO: 779908 - DNA, 20 bp, mouse
gccagcacagcttgagtcgg

SEQ ID NO: 779909 - DNA, 20 bp, mouse
gacagcttgagtcggtggtg

SEQ ID NO: 779910 - DNA, 20 bp, mouse
gagggcagaccgacattccc

SEQ ID NO: 779911 - DNA, 20 bp, mouse
gtcgccagcacagcttgagt

SEQ ID NO: 779912 - DNA, 20 bp, mouse
ggtgccaattagtcagggac

SEQ ID NO: 779913 - DNA, 20 bp, mouse
gcaaaggtgccaattagtca

SEQ ID NO: 779914 - DNA, 20 bp, mouse
gtcagtagggctaatcacaa

SEQ ID NO: 779915 - DNA, 20 bp, mouse
gaagccgagctccgtgtgac

SEQ ID NO: 779916 - DNA, 20 bp, mouse
gcctcccagggcctggcgga

SEQ ID NO: 779917 - DNA, 20 bp, mouse
gtggagctacagggagaaaa

SEQ ID NO: 779918 - DNA, 20 bp, mouse
gggcgtgcgcagacttggga

SEQ ID NO: 779919 - DNA, 20 bp, mouse
gcgcgagggcggctgggaac

SEQ ID NO: 779920 - DNA, 20 bp, mouse
gcggccgacaggggaatcca

SEQ ID NO: 779921 - DNA, 20 bp, mouse
gaggggcgggccaagcgggg

SEQ ID NO: 779922 - DNA, 20 bp, mouse
gagcaagcaagggagcggga

SEQ ID NO: 779923 - DNA, 20 bp, mouse
gctgaggcgcagggcacact

SEQ ID NO: 779924 - DNA, 20 bp, mouse
ggggaagagtctggccccgg

SEQ ID NO: 779925 - DNA, 20 bp, mouse
gcgggcgcgaggagcaggct

SEQ ID NO: 779926 - DNA, 20 bp, mouse
ggaggcggaggaaagcgcag

SEQ ID NO: 779927 - DNA, 20 bp, mouse
ggggcggggcgtgtgcgcaa

SEQ ID NO: 779928 - DNA, 20 bp, mouse
gcagaagccccgccccgcct

SEQ ID NO: 779929 - DNA, 20 bp, mouse
gcctacgcgagcgacggcgc

SEQ ID NO: 779930 - DNA, 20 bp, mouse
ggcgcaggcgccacagccag

SEQ ID NO: 779931 - DNA, 20 bp, mouse
gaaagggcgggacggccagt

SEQ ID NO: 779932 - DNA, 20 bp, mouse
gcccacgcgcgtctgacgcc

SEQ ID NO: 779933 - DNA, 20 bp, mouse
gcagggccctacgcgagcga

SEQ ID NO: 779934 - DNA, 20 bp, mouse
gcgagcgacggcgccggagg

SEQ ID NO: 779935 - DNA, 20 bp, mouse
gtggccgtcccgccctttcc

SEQ ID NO: 779936 - DNA, 20 bp, mouse
gcgcagagagtccctcacaa

SEQ ID NO: 779937 - DNA, 20 bp, mouse
gagagtccctcacaagggcg

SEQ ID NO: 779938 - DNA, 20 bp, mouse
gccagtccacgcccttgtga

SEQ ID NO: 779939 - DNA, 20 bp, mouse
ggcaaggtctacacagtcag

SEQ ID NO: 779940 - DNA, 20 bp, mouse
gggtgacaatggattttcat

SEQ ID NO: 779941 - DNA, 20 bp, mouse
gaggtctacacagtcagggg

SEQ ID NO: 779942 - DNA, 20 bp, mouse
gaaatccattgtcacctgaa

SEQ ID NO: 779943 - DNA, 20 bp, mouse
gtaagcaagcgtaaaattca

SEQ ID NO: 779944 - DNA, 20 bp, mouse
gagcaacatacatcttattg

SEQ ID NO: 779945 - DNA, 20 bp, mouse
gattattaagtgtgcctttc

SEQ ID NO: 779946 - DNA, 20 bp, mouse
gtgggccagtggggtctctc

SEQ ID NO: 779947 - DNA, 20 bp, mouse
ggggtccagagagaccccac

SEQ ID NO: 779948 - DNA, 20 bp, mouse
gtgggcgcgtgcgcggtaca

SEQ ID NO: 779949 - DNA, 20 bp, mouse
gtgtccatcctctcctagca

SEQ ID NO: 779950 - DNA, 20 bp, mouse
ggggatgagaacctccccaa

SEQ ID NO: 779951 - DNA, 20 bp, mouse
ggcaaggactgtctgcttga

SEQ ID NO: 779952 - DNA, 20 bp, mouse
ggctctgtggccagccgttg

SEQ ID NO: 779953 - DNA, 20 bp, mouse
gtaatgaggtgaaacatctg

SEQ ID NO: 779954 - DNA, 20 bp, mouse
gttgaaggtctgggccagtg

SEQ ID NO: 779955 - DNA, 20 bp, mouse
gggtctctctggaccctgct

SEQ ID NO: 779956 - DNA, 20 bp, mouse
gcccgggcgctgctggtcga

SEQ ID NO: 779957 - DNA, 20 bp, mouse
gcgactgcgcccaggtctcg

SEQ ID NO: 779958 - DNA, 20 bp, mouse
gggacgctgtgacaccttgc

SEQ ID NO: 779959 - DNA, 20 bp, mouse
gctaaagtacagctactagg

SEQ ID NO: 779960 - DNA, 20 bp, mouse
ggaagggcgcctcgagacct

SEQ ID NO: 779961 - DNA, 20 bp, mouse
gagcagcgcccggggcggga

SEQ ID NO: 779962 - DNA, 20 bp, mouse
gcagtcacaccagagtgacc

SEQ ID NO: 779963 - DNA, 20 bp, mouse
gtgacctggagccgcccgca

SEQ ID NO: 779964 - DNA, 20 bp, mouse
ggccccgggggcccaaggcg

SEQ ID NO: 779965 - DNA, 20 bp, mouse
gcgctgtgacaccttgcggg

SEQ ID NO: 779966 - DNA, 20 bp, mouse
ggggaaagaggcggtgtcat

SEQ ID NO: 779967 - DNA, 20 bp, mouse
ggggtggagaaaacgtctgg

SEQ ID NO: 779968 - DNA, 20 bp, mouse
gaaaacagaccggtgggtgt

SEQ ID NO: 779969 - DNA, 20 bp, mouse
gacctggtcaaggccatcac

SEQ ID NO: 779970 - DNA, 20 bp, mouse
ggtggacaaaacagaccggt

SEQ ID NO: 779971 - DNA, 20 bp, mouse
gagccctcccaagcaaagat

SEQ ID NO: 779972 - DNA, 20 bp, mouse
ggggagcgagccagaggggc

SEQ ID NO: 779973 - DNA, 20 bp, mouse
gcaagcaaagatcgggatcc

SEQ ID NO: 779974 - DNA, 20 bp, mouse
gcgcgcgggggggagcagtc

SEQ ID NO: 779975 - DNA, 20 bp, mouse
gtagctatacggtccggacc

SEQ ID NO: 779976 - DNA, 20 bp, mouse
ggaaacccggaaccttgcac

SEQ ID NO: 779977 - DNA, 20 bp, mouse
ggtagctgcgctaaggagga

SEQ ID NO: 779978 - DNA, 20 bp, mouse
gcaagccagtgcaaggttcc

SEQ ID NO: 779979 - DNA, 20 bp, mouse
gcgggaagcaagccagtgca

SEQ ID NO: 779980 - DNA, 20 bp, mouse
gagagattgtagctgcgcta

SEQ ID NO: 779981 - DNA, 20 bp, mouse
gggcggggcgttaggaaacc

SEQ ID NO: 779982 - DNA, 20 bp, mouse
ggtgccaagggccgccccag

SEQ ID NO: 779983 - DNA, 20 bp, mouse
gccgccccagtggggaccaa

SEQ ID NO: 779984 - DNA, 20 bp, mouse
ggctacaatctcttgatccc

SEQ ID NO: 779985 - DNA, 20 bp, mouse
gtgcttcccgcttgctctga

SEQ ID NO: 779986 - DNA, 20 bp, mouse
gggtgctggttggtcttgtt

SEQ ID NO: 779987 - DNA, 20 bp, mouse
gagtgtccggaacccaggta

SEQ ID NO: 779988 - DNA, 20 bp, mouse
gagcctccctacctgggttc

SEQ ID NO: 779989 - DNA, 20 bp, mouse
gcgcccgtgccgccgacctc

SEQ ID NO: 779990 - DNA, 20 bp, mouse
gaaccagcaccaccagtgtc

SEQ ID NO: 779991 - DNA, 20 bp, mouse
gccaccagtgtccggaaccc

SEQ ID NO: 779992 - DNA, 20 bp, mouse
gggcacgggcgggctgcttc

SEQ ID NO: 779993 - DNA, 20 bp, mouse
gacccggaggtcggcggcac

SEQ ID NO: 779994 - DNA, 20 bp, mouse
gggtcttgttcggttggttg

SEQ ID NO: 779995 - DNA, 20 bp, mouse
ggaaatcagcctccctacct

SEQ ID NO: 779996 - DNA, 20 bp, mouse
gcgagctcggggtaacgggc

SEQ ID NO: 779997 - DNA, 20 bp, mouse
ggggcgggcccacaacatgg

SEQ ID NO: 779998 - DNA, 20 bp, mouse
ggcgcaggggactacgggaa

SEQ ID NO: 779999 - DNA, 20 bp, mouse
gcatgggcgggcccacaaca

SEQ ID NO: 780000 - DNA, 20 bp, mouse
gtaaggactcaacaggaggt

SEQ ID NO: 780001 - DNA, 20 bp, mouse
gtacctaaggactcaacagg

SEQ ID NO: 780002 - DNA, 20 bp, mouse
gtgggcccgcccatgggtgg

SEQ ID NO: 780003 - DNA, 20 bp, mouse
gcggcgggccccagtctgag

SEQ ID NO: 780004 - DNA, 20 bp, mouse
ggaggccccacctctaaggc

SEQ ID NO: 780005 - DNA, 20 bp, mouse
gcggaaggtcgtcacagtgc

SEQ ID NO: 780006 - DNA, 20 bp, mouse
gtgagagcccaaagcggggt

SEQ ID NO: 780007 - DNA, 20 bp, mouse
gtggatgagagcccaaagcg

SEQ ID NO: 780008 - DNA, 20 bp, mouse
gtccctgaaacactcagggg

SEQ ID NO: 780009 - DNA, 20 bp, mouse
gagcccaaagcggggtgggc

SEQ ID NO: 780010 - DNA, 20 bp, mouse
ggggctaggctactgaccag

SEQ ID NO: 780011 - DNA, 20 bp, mouse
gagtgaaagcagctggtcag

SEQ ID NO: 780012 - DNA, 20 bp, mouse
gcaggtgacaggcagactcc

SEQ ID NO: 780013 - DNA, 20 bp, mouse
ggaagctcacagcgtagcca

SEQ ID NO: 780014 - DNA, 20 bp, mouse
gtgggggtgaagggggtcgg

SEQ ID NO: 780015 - DNA, 20 bp, mouse
ggtcagggggagcacttaaa

SEQ ID NO: 780016 - DNA, 20 bp, mouse
ggcgcccgcctggctcgcga

SEQ ID NO: 780017 - DNA, 20 bp, mouse
gcgcctggctcgcgagggga

SEQ ID NO: 780018 - DNA, 20 bp, mouse
gcaggcttcgcgctaggggc

SEQ ID NO: 780019 - DNA, 20 bp, mouse
gccctagcgcgaagcctgct

SEQ ID NO: 780020 - DNA, 20 bp, mouse
gtgacagaaacgctggtggg

SEQ ID NO: 780021 - DNA, 20 bp, mouse
gctggctcgcgaggggaagg

SEQ ID NO: 780022 - DNA, 20 bp, mouse
gtaaaactacgcctcccagc

SEQ ID NO: 780023 - DNA, 20 bp, mouse
gctgccggaggcgaatctta

SEQ ID NO: 780024 - DNA, 20 bp, mouse
gcagctgcaactgtcttcgc

SEQ ID NO: 780025 - DNA, 20 bp, mouse
gaacccgtaagattcgcctc

SEQ ID NO: 780026 - DNA, 20 bp, mouse
gctcacctgtggaccttctc

SEQ ID NO: 780027 - DNA, 20 bp, mouse
gggaacgccccccagttgcc

SEQ ID NO: 780028 - DNA, 20 bp, mouse
gagccctgggaagaccttaa

SEQ ID NO: 780029 - DNA, 20 bp, mouse
gcaactggggggcgttccaa

SEQ ID NO: 780030 - DNA, 20 bp, mouse
gaggttgcctggcaactggg

SEQ ID NO: 780031 - DNA, 20 bp, mouse
ggctctgttgtcacctgaga

SEQ ID NO: 780032 - DNA, 20 bp, mouse
ggtcacctgagaaggtccac

SEQ ID NO: 780033 - DNA, 20 bp, mouse
gtgtccataaggctcacctg

SEQ ID NO: 780034 - DNA, 20 bp, mouse
gacgtagactggagagatgc

SEQ ID NO: 780035 - DNA, 20 bp, mouse
gaggaggttgcctggcaact

SEQ ID NO: 780036 - DNA, 20 bp, mouse
gggtagcagccgcccgagga

SEQ ID NO: 780037 - DNA, 20 bp, mouse
gtgcacgccgaggcctgcta

SEQ ID NO: 780038 - DNA, 20 bp, mouse
gaggcctgctagggactcca

SEQ ID NO: 780039 - DNA, 20 bp, mouse
gccccgcggcccccgggaag

SEQ ID NO: 780040 - DNA, 20 bp, mouse
gggctgtagccccttcccgg

SEQ ID NO: 780041 - DNA, 20 bp, mouse
gtccctccgccctcctcggg

SEQ ID NO: 780042 - DNA, 20 bp, mouse
ggccgcccgaggagggcgga

SEQ ID NO: 780043 - DNA, 20 bp, mouse
gtgggcgtgtccgaaagggg

SEQ ID NO: 780044 - DNA, 20 bp, mouse
gccggggcgcggtcccggac

SEQ ID NO: 780045 - DNA, 20 bp, mouse
gtgggtgggcgtgtccgaaa

SEQ ID NO: 780046 - DNA, 20 bp, mouse
ggcgcgccccagggcgtctc

SEQ ID NO: 780047 - DNA, 20 bp, mouse
gactcaggcgagcgacgtga

SEQ ID NO: 780048 - DNA, 20 bp, mouse
gccgccgcagggagcgtgag

SEQ ID NO: 780049 - DNA, 20 bp, mouse
gcgcgctcgctcccgcggct

SEQ ID NO: 780050 - DNA, 20 bp, mouse
gcgtctccggcgcccagccg

SEQ ID NO: 780051 - DNA, 20 bp, mouse
ggcacccaatcaccgcccac

SEQ ID NO: 780052 - DNA, 20 bp, mouse
ggggcgccggagacgccctg

SEQ ID NO: 780053 - DNA, 20 bp, mouse
gaggcccgcgggcggtgtcc

SEQ ID NO: 780054 - DNA, 20 bp, mouse
gtatcccggtgactctcatc

SEQ ID NO: 780055 - DNA, 20 bp, mouse
gaggcggcgcggtgcggcag

SEQ ID NO: 780056 - DNA, 20 bp, mouse
gaacccgacacacacggata

SEQ ID NO: 780057 - DNA, 20 bp, mouse
gtgagccaatggcgacgcgg

SEQ ID NO: 780058 - DNA, 20 bp, mouse
ggcagcaccgcggtacccgg

SEQ ID NO: 780059 - DNA, 20 bp, mouse
ggaggcggcgcggattagag

SEQ ID NO: 780060 - DNA, 20 bp, mouse
ggggggttcacgcatgatag

SEQ ID NO: 780061 - DNA, 20 bp, mouse
gtgcgcaggtggcagcaccg

SEQ ID NO: 780062 - DNA, 20 bp, mouse
ggcgcggcctccgggtaccg

SEQ ID NO: 780063 - DNA, 20 bp, mouse
gaatcaaacacaccgagctg

SEQ ID NO: 780064 - DNA, 20 bp, mouse
ggggagtgggccgtgggata

SEQ ID NO: 780065 - DNA, 20 bp, mouse
gagctggggagcaggcggcc

SEQ ID NO: 780066 - DNA, 20 bp, mouse
ggcggtgtggtgcagaaaga

SEQ ID NO: 780067 - DNA, 20 bp, mouse
ggcgcaaagacgtcctccct

SEQ ID NO: 780068 - DNA, 20 bp, mouse
gcgcccggatcaccgcggtg

SEQ ID NO: 780069 - DNA, 20 bp, mouse
ggcctgcgcccggatcaccg

SEQ ID NO: 780070 - DNA, 20 bp, mouse
ggaaggaggcgggtcgggag

SEQ ID NO: 780071 - DNA, 20 bp, mouse
ggtcccctgctgtccaccca

SEQ ID NO: 780072 - DNA, 20 bp, mouse
gcaaagacgtcctccctggg

SEQ ID NO: 780073 - DNA, 20 bp, mouse
gggcagcgaaaattcacgag

SEQ ID NO: 780074 - DNA, 20 bp, mouse
ggatgtcggcaaacccgtgc

SEQ ID NO: 780075 - DNA, 20 bp, mouse
ggaaacgagcagcgggcggt

SEQ ID NO: 780076 - DNA, 20 bp, mouse
gaagctaaaggaactacctt

SEQ ID NO: 780077 - DNA, 20 bp, mouse
gccaacacgggtcactccct

SEQ ID NO: 780078 - DNA, 20 bp, mouse
ggcccagcggcgctccagat

SEQ ID NO: 780079 - DNA, 20 bp, mouse
gcccgctgtgctcgccctat

SEQ ID NO: 780080 - DNA, 20 bp, mouse
gtggatgcaggcaaccaata

SEQ ID NO: 780081 - DNA, 20 bp, mouse
gtgggccgaagggcggggtc

SEQ ID NO: 780082 - DNA, 20 bp, mouse
gaagggcggggtctggatgc

SEQ ID NO: 780083 - DNA, 20 bp, mouse
ggtagttcctttagcttctg

SEQ ID NO: 780084 - DNA, 20 bp, mouse
gggatagtctaaagcggagg

SEQ ID NO: 780085 - DNA, 20 bp, mouse
gagggcgagcacagcgggcg

SEQ ID NO: 780086 - DNA, 20 bp, mouse
gtccctgcgccaggtggctc

SEQ ID NO: 780087 - DNA, 20 bp, mouse
gacccggggagcagatccta

SEQ ID NO: 780088 - DNA, 20 bp, mouse
gtgcggggatgctgtcggtg

SEQ ID NO: 780089 - DNA, 20 bp, mouse
gatcccgagccacctggcgc

SEQ ID NO: 780090 - DNA, 20 bp, mouse
gagccataggatctgctccc

SEQ ID NO: 780091 - DNA, 20 bp, mouse
gagtctaaggaggtgcagcg

SEQ ID NO: 780092 - DNA, 20 bp, mouse
gtccccgcagcggggactgc

SEQ ID NO: 780093 - DNA, 20 bp, mouse
gcccgctgcggggatgctgt

SEQ ID NO: 780094 - DNA, 20 bp, mouse
gccaccggcctcctagtctc

SEQ ID NO: 780095 - DNA, 20 bp, mouse
ggatgctgtcggtggggttg

SEQ ID NO: 780096 - DNA, 20 bp, mouse
gcatctaaagtaggagtgtg

SEQ ID NO: 780097 - DNA, 20 bp, mouse
gcttgcctagctagacccct

SEQ ID NO: 780098 - DNA, 20 bp, mouse
gtcatccaaggggtctagct

SEQ ID NO: 780099 - DNA, 20 bp, mouse
gttctcttctcatctaaagt

SEQ ID NO: 780100 - DNA, 20 bp, mouse
gcacaattcagcaagggatt

SEQ ID NO: 780101 - DNA, 20 bp, mouse
gaagggattaggtgacagac

SEQ ID NO: 780102 - DNA, 20 bp, mouse
gacagcagttgctatattgg

SEQ ID NO: 780103 - DNA, 20 bp, mouse
ggaacaaaccagtccaagtg

SEQ ID NO: 780104 - DNA, 20 bp, mouse
gtccactttagagtgagctg

SEQ ID NO: 780105 - DNA, 20 bp, mouse
ggacagggcacctcctcact

SEQ ID NO: 780106 - DNA, 20 bp, mouse
ggcccagtcacctaagtcat

SEQ ID NO: 780107 - DNA, 20 bp, mouse
gcatgggctgtcaatctagg

SEQ ID NO: 780108 - DNA, 20 bp, mouse
gaccctctgagcctccttgt

SEQ ID NO: 780109 - DNA, 20 bp, mouse
gtcaatctaggaggctggga

SEQ ID NO: 780110 - DNA, 20 bp, mouse
gccctcagagaggcagtcgc

SEQ ID NO: 780111 - DNA, 20 bp, mouse
gaggggacctgaaatcagcc

SEQ ID NO: 780112 - DNA, 20 bp, mouse
gacctgaaatcagccaggtt

SEQ ID NO: 780113 - DNA, 20 bp, mouse
gagagaggcagtcgcagggt

SEQ ID NO: 780114 - DNA, 20 bp, mouse
gaggtgtttgaaactctctg

SEQ ID NO: 780115 - DNA, 20 bp, mouse
gttgcagggtgaaattaaaa

SEQ ID NO: 780116 - DNA, 20 bp, mouse
gcactcctgccctgtccctt

SEQ ID NO: 780117 - DNA, 20 bp, mouse
gagggcggggccaggcttga

SEQ ID NO: 780118 - DNA, 20 bp, mouse
gtgacaacttgcgggcagag

SEQ ID NO: 780119 - DNA, 20 bp, mouse
gtgagggggagcgtccagaa

SEQ ID NO: 780120 - DNA, 20 bp, mouse
gtgcgggcagaggggcttgg

SEQ ID NO: 780121 - DNA, 20 bp, mouse
gggacagggcaggagtgaat

SEQ ID NO: 780122 - DNA, 20 bp, mouse
gcaggagtagccgaagggac

SEQ ID NO: 780123 - DNA, 20 bp, mouse
ggccggagaatgcttctcag

SEQ ID NO: 780124 - DNA, 20 bp, mouse
gggggccaggcttgacggac

SEQ ID NO: 780125 - DNA, 20 bp, mouse
gcttctcagaggaaaccctg

SEQ ID NO: 780126 - DNA, 20 bp, mouse
gtgtgtctgctgagggtccc

SEQ ID NO: 780127 - DNA, 20 bp, mouse
ggtccctgcaaaccctggca

SEQ ID NO: 780128 - DNA, 20 bp, mouse
gcgtccctgccagggtttgc

SEQ ID NO: 780129 - DNA, 20 bp, mouse
gggaagacagggcctggctg

SEQ ID NO: 780130 - DNA, 20 bp, mouse
gtgaccttgggcatgtgatc

SEQ ID NO: 780131 - DNA, 20 bp, mouse
ggctgaggtcatcatctccc

SEQ ID NO: 780132 - DNA, 20 bp, mouse
gcacttgcgccacaactggc

SEQ ID NO: 780133 - DNA, 20 bp, mouse
gggtgcagacagttgatcta

SEQ ID NO: 780134 - DNA, 20 bp, mouse
ggatcttcacagtagaggcg

SEQ ID NO: 780135 - DNA, 20 bp, mouse
gcacttggttgctggaagac

SEQ ID NO: 780136 - DNA, 20 bp, mouse
gaacctggggctcccacccc

SEQ ID NO: 780137 - DNA, 20 bp, mouse
gtcttcaggactggccggaa

SEQ ID NO: 780138 - DNA, 20 bp, mouse
ggcggagctgggtactttaa

SEQ ID NO: 780139 - DNA, 20 bp, mouse
gggagggggaggacacgcag

SEQ ID NO: 780140 - DNA, 20 bp, mouse
gccagtcctgaagagaggat

SEQ ID NO: 780141 - DNA, 20 bp, mouse
gttggccagcacatctgggg

SEQ ID NO: 780142 - DNA, 20 bp, mouse
gcttgcgccctgagctggag

SEQ ID NO: 780143 - DNA, 20 bp, mouse
gagcacatctggggtggtta

SEQ ID NO: 780144 - DNA, 20 bp, mouse
ggaagagaggattggctctt

SEQ ID NO: 780145 - DNA, 20 bp, mouse
ggcaaatatcagaacccttc

SEQ ID NO: 780146 - DNA, 20 bp, mouse
gcccaggcaggggtggctaa

SEQ ID NO: 780147 - DNA, 20 bp, mouse
ggggcactcggaagcctgtg

SEQ ID NO: 780148 - DNA, 20 bp, mouse
gagccactggggcacctgag

SEQ ID NO: 780149 - DNA, 20 bp, mouse
gactgtggacacccatgggt

SEQ ID NO: 780150 - DNA, 20 bp, mouse
gggctcgcctggcactataa

SEQ ID NO: 780151 - DNA, 20 bp, mouse
ggcctgcaacagcagaagag

SEQ ID NO: 780152 - DNA, 20 bp, mouse
gctccactcaggtgccccag

SEQ ID NO: 780153 - DNA, 20 bp, mouse
ggcctgtgaggggagagcac

SEQ ID NO: 780154 - DNA, 20 bp, mouse
gcctgggtggcccagggtag

SEQ ID NO: 780155 - DNA, 20 bp, mouse
gaaactgaggcccagggtag

SEQ ID NO: 780156 - DNA, 20 bp, mouse
gaagttatgacaggcatcgg

SEQ ID NO: 780157 - DNA, 20 bp, mouse
gcccatacggccttgagatc

SEQ ID NO: 780158 - DNA, 20 bp, mouse
ggcagcagctagaatctcac

SEQ ID NO: 780159 - DNA, 20 bp, mouse
gtctcgctgctgctcttgca

SEQ ID NO: 780160 - DNA, 20 bp, mouse
gtcggagaagagcctcacgg

SEQ ID NO: 780161 - DNA, 20 bp, mouse
gtgaaagagtcgccccaatg

SEQ ID NO: 780162 - DNA, 20 bp, mouse
ggacatgcaccaggccctgc

SEQ ID NO: 780163 - DNA, 20 bp, mouse
gcacagtgatgactcccata

SEQ ID NO: 780164 - DNA, 20 bp, mouse
gagggattcgaagttatgac

SEQ ID NO: 780165 - DNA, 20 bp, mouse
gagatggaacaagtttggga

SEQ ID NO: 780166 - DNA, 20 bp, mouse
gccagccttgaggccaaaac

SEQ ID NO: 780167 - DNA, 20 bp, mouse
gcagcccgcccccttgttaa

SEQ ID NO: 780168 - DNA, 20 bp, mouse
gccctgcagccctaggaaat

SEQ ID NO: 780169 - DNA, 20 bp, mouse
gtctgcccttcccactggtc

SEQ ID NO: 780170 - DNA, 20 bp, mouse
ggttagactccaatttccta

SEQ ID NO: 780171 - DNA, 20 bp, mouse
gtcaacctgttttggcctca

SEQ ID NO: 780172 - DNA, 20 bp, mouse
gccccttgttaagggttcac

SEQ ID NO: 780173 - DNA, 20 bp, mouse
gaaattggagtctaacagct

SEQ ID NO: 780174 - DNA, 20 bp, mouse
ggtgctacatctcaagatta

SEQ ID NO: 780175 - DNA, 20 bp, mouse
gcacctgtgaacccttaaca

SEQ ID NO: 780176 - DNA, 20 bp, mouse
gtgaaggggcggagccgtgg

SEQ ID NO: 780177 - DNA, 20 bp, mouse
gcctgcgcggggagcaagag

SEQ ID NO: 780178 - DNA, 20 bp, mouse
gccaaatccgaggccatgag

SEQ ID NO: 780179 - DNA, 20 bp, mouse
gacagtgattggcgagctgt

SEQ ID NO: 780180 - DNA, 20 bp, mouse
gagctcgccaatcactgtga

SEQ ID NO: 780181 - DNA, 20 bp, mouse
gtaaggcatggctaactagg

SEQ ID NO: 780182 - DNA, 20 bp, mouse
gttggcgagctgtgggtgaa

SEQ ID NO: 780183 - DNA, 20 bp, mouse
gggggaactcctcttatgat

SEQ ID NO: 780184 - DNA, 20 bp, mouse
gcggtaaggcatggctaact

SEQ ID NO: 780185 - DNA, 20 bp, mouse
gaagacgcagaagactagac

SEQ ID NO: 780186 - DNA, 20 bp, mouse
gggacaaagtatacatacag

SEQ ID NO: 780187 - DNA, 20 bp, mouse
gatacagtggatgtgaaaga

SEQ ID NO: 780188 - DNA, 20 bp, mouse
gggaactgggatataagctg

SEQ ID NO: 780189 - DNA, 20 bp, mouse
ggcagtggacaattgcagaa

SEQ ID NO: 780190 - DNA, 20 bp, mouse
gttgtcctctgttatgttct

SEQ ID NO: 780191 - DNA, 20 bp, mouse
gtggctggagatgtgaaaac

SEQ ID NO: 780192 - DNA, 20 bp, mouse
gaccctgaaaacttaaaagt

SEQ ID NO: 780193 - DNA, 20 bp, mouse
gtctgggtcaaatattgata

SEQ ID NO: 780194 - DNA, 20 bp, mouse
ggctctcttgcggcttcttg

SEQ ID NO: 780195 - DNA, 20 bp, mouse
gggtccgtctaagtaagcgc

SEQ ID NO: 780196 - DNA, 20 bp, mouse
ggggacgcaagctcgccggt

SEQ ID NO: 780197 - DNA, 20 bp, mouse
gcaagctcgccggtcggctc

SEQ ID NO: 780198 - DNA, 20 bp, mouse
gggacgggacgcaagctcgc

SEQ ID NO: 780199 - DNA, 20 bp, mouse
gggccgcgcgcccttccgca

SEQ ID NO: 780200 - DNA, 20 bp, mouse
gcttccgcagggtgagctgg

SEQ ID NO: 780201 - DNA, 20 bp, mouse
ggacccgccaggaagaggga

SEQ ID NO: 780202 - DNA, 20 bp, mouse
gcagccgccagctcaccctg

SEQ ID NO: 780203 - DNA, 20 bp, mouse
gagggcccgcggcgcatgcg

SEQ ID NO: 780204 - DNA, 20 bp, mouse
gccagtgcaccgggtacccg

SEQ ID NO: 780205 - DNA, 20 bp, mouse
gcggctgtacccgagccgac

SEQ ID NO: 780206 - DNA, 20 bp, mouse
gcaaagagcgcgcactgcga

SEQ ID NO: 780207 - DNA, 20 bp, mouse
gaaagatggaggctcaagtc

SEQ ID NO: 780208 - DNA, 20 bp, mouse
gcgcactgcgagggaaagtg

SEQ ID NO: 780209 - DNA, 20 bp, mouse
gtggctgcggggctagttgc

SEQ ID NO: 780210 - DNA, 20 bp, mouse
gaaggcagttacaggaaaga

SEQ ID NO: 780211 - DNA, 20 bp, mouse
gaacaaagtcagtacttggc

SEQ ID NO: 780212 - DNA, 20 bp, mouse
gggtgctggggcccgaggag

SEQ ID NO: 780213 - DNA, 20 bp, mouse
gtgcggggctagttgcgggg

SEQ ID NO: 780214 - DNA, 20 bp, mouse
gagtcccgcccctggctgcg

SEQ ID NO: 780215 - DNA, 20 bp, mouse
ggcagtgcgcgctctttgct

SEQ ID NO: 780216 - DNA, 20 bp, mouse
gaatgggagcgtcccttccc

SEQ ID NO: 780217 - DNA, 20 bp, mouse
gggtggaggcagcaccagag

SEQ ID NO: 780218 - DNA, 20 bp, mouse
gggacgctcccatttcttac

SEQ ID NO: 780219 - DNA, 20 bp, mouse
gccctacaccagtaagaaat

SEQ ID NO: 780220 - DNA, 20 bp, mouse
gaacccattcacataggaga

SEQ ID NO: 780221 - DNA, 20 bp, mouse
gtagtacatccacctgtctc

SEQ ID NO: 780222 - DNA, 20 bp, mouse
gctaagagccaccccctccg

SEQ ID NO: 780223 - DNA, 20 bp, mouse
gccggaagagaccacctacg

SEQ ID NO: 780224 - DNA, 20 bp, mouse
gggaagctagccaaactggg

SEQ ID NO: 780225 - DNA, 20 bp, mouse
ggatgtactagttcgaggac

SEQ ID NO: 780226 - DNA, 20 bp, mouse
gcgctcgaggcgtgtcaccg

SEQ ID NO: 780227 - DNA, 20 bp, mouse
gccccctggtgtcggagaag

SEQ ID NO: 780228 - DNA, 20 bp, mouse
ggtgacacgcctcgagcgga

SEQ ID NO: 780229 - DNA, 20 bp, mouse
gcctgggaattgtagtgcta

SEQ ID NO: 780230 - DNA, 20 bp, mouse
gcaggagcccgtggccttct

SEQ ID NO: 780231 - DNA, 20 bp, mouse
gaaggccacgggctcctggg

SEQ ID NO: 780232 - DNA, 20 bp, mouse
gaactatctgaggaccggtg

SEQ ID NO: 780233 - DNA, 20 bp, mouse
gtgaggaccggtgaggcgga

SEQ ID NO: 780234 - DNA, 20 bp, mouse
gctgggaactatctgaggac

SEQ ID NO: 780235 - DNA, 20 bp, mouse
ggccgcttctccgacaccag

SEQ ID NO: 780236 - DNA, 20 bp, mouse
ggaggacaccaagaactcca

SEQ ID NO: 780237 - DNA, 20 bp, mouse
ggccctagaaccttcctatc

SEQ ID NO: 780238 - DNA, 20 bp, mouse
gacgggattgagcaacgagg

SEQ ID NO: 780239 - DNA, 20 bp, mouse
gacctgataggaaggttcta

SEQ ID NO: 780240 - DNA, 20 bp, mouse
gaaagctctctgcaggctgt

SEQ ID NO: 780241 - DNA, 20 bp, mouse
gcagggcaagcacccctctt

SEQ ID NO: 780242 - DNA, 20 bp, mouse
ggaaaagccacctgatagga

SEQ ID NO: 780243 - DNA, 20 bp, mouse
gactagaaaagccacctgat

SEQ ID NO: 780244 - DNA, 20 bp, mouse
gtctgcaggctgtgggcttg

SEQ ID NO: 780245 - DNA, 20 bp, mouse
gaggaagtgaagaaataacc

SEQ ID NO: 780246 - DNA, 20 bp, mouse
ggggttgggcggagcgagaa

SEQ ID NO: 780247 - DNA, 20 bp, mouse
ggggcggagcgagaagggtg

SEQ ID NO: 780248 - DNA, 20 bp, mouse
gggttgctgcgaggctaatg

SEQ ID NO: 780249 - DNA, 20 bp, mouse
ggagcgagaagggtggggcg

SEQ ID NO: 780250 - DNA, 20 bp, mouse
gctggagcttcgcaaaatca

SEQ ID NO: 780251 - DNA, 20 bp, mouse
gggtgccaacgggcggggtt

SEQ ID NO: 780252 - DNA, 20 bp, mouse
gactgctgcggcacgtcacg

SEQ ID NO: 780253 - DNA, 20 bp, mouse
gggggcggtgccaacgggcg

SEQ ID NO: 780254 - DNA, 20 bp, mouse
gcccgcgcgctgctccgcct

SEQ ID NO: 780255 - DNA, 20 bp, mouse
gctgcggcacgtcacggggg

SEQ ID NO: 780256 - DNA, 20 bp, mouse
gctagcctgtactgtcccta

SEQ ID NO: 780257 - DNA, 20 bp, mouse
gctctccctagggacagtac

SEQ ID NO: 780258 - DNA, 20 bp, mouse
gagcagttctgtttagaaaa

SEQ ID NO: 780259 - DNA, 20 bp, mouse
gaggtggtgcccagagagga

SEQ ID NO: 780260 - DNA, 20 bp, mouse
gcatcaccacaggctcaaga

SEQ ID NO: 780261 - DNA, 20 bp, mouse
gaaaccctgcacttcttagg

SEQ ID NO: 780262 - DNA, 20 bp, mouse
ggggctggaaggaggtagac

SEQ ID NO: 780263 - DNA, 20 bp, mouse
gtcctggaagaggaggagac

SEQ ID NO: 780264 - DNA, 20 bp, mouse
gagtcggcttggagagccat

SEQ ID NO: 780265 - DNA, 20 bp, mouse
gttctggtgcgccttcgagt

SEQ ID NO: 780266 - DNA, 20 bp, mouse
gaagaaggggaagtgacttc

SEQ ID NO: 780267 - DNA, 20 bp, mouse
gtggcggtggaggacactgg

SEQ ID NO: 780268 - DNA, 20 bp, mouse
gggcctccaagctctggcgg

SEQ ID NO: 780269 - DNA, 20 bp, mouse
ggtctcggctagtaaggccg

SEQ ID NO: 780270 - DNA, 20 bp, mouse
gacttccggcctccaagctc

SEQ ID NO: 780271 - DNA, 20 bp, mouse
gtccggcctccaagctctgg

SEQ ID NO: 780272 - DNA, 20 bp, mouse
ggtgccctgcagcgatgagg

SEQ ID NO: 780273 - DNA, 20 bp, mouse
gggcctggatccctcacgcc

SEQ ID NO: 780274 - DNA, 20 bp, mouse
gctccaagctctggcggtgg

SEQ ID NO: 780275 - DNA, 20 bp, mouse
gagcgcctctgtctgaagaa

SEQ ID NO: 780276 - DNA, 20 bp, mouse
gtatcctggacaagaataga

SEQ ID NO: 780277 - DNA, 20 bp, mouse
gcgtcaggatgtaggtagtc

SEQ ID NO: 780278 - DNA, 20 bp, mouse
gcccaagcgggaggctttgt

SEQ ID NO: 780279 - DNA, 20 bp, mouse
gctggactgacccaagcggg

SEQ ID NO: 780280 - DNA, 20 bp, mouse
gtgccaaaagaatcatgttg

SEQ ID NO: 780281 - DNA, 20 bp, mouse
gtgtctgagcgtcaggatgt

SEQ ID NO: 780282 - DNA, 20 bp, mouse
gcaaaagcccggaggtatcg

SEQ ID NO: 780283 - DNA, 20 bp, mouse
gagtcctggactgacccaag

SEQ ID NO: 780284 - DNA, 20 bp, mouse
gttaacctggctctcaggac

SEQ ID NO: 780285 - DNA, 20 bp, mouse
gagccacaacatgattcttt

SEQ ID NO: 780286 - DNA, 20 bp, mouse
gtaccgggctggctgtgctt

SEQ ID NO: 780287 - DNA, 20 bp, mouse
gcgaacccgaagtaccgggc

SEQ ID NO: 780288 - DNA, 20 bp, mouse
ggctctccgccaatcagcta

SEQ ID NO: 780289 - DNA, 20 bp, mouse
gcccgcaggcagccaaaaag

SEQ ID NO: 780290 - DNA, 20 bp, mouse
ggggctggagtcgtgtcccc

SEQ ID NO: 780291 - DNA, 20 bp, mouse
gcggcggcgcgcttcataga

SEQ ID NO: 780292 - DNA, 20 bp, mouse
gcggggctacggagtcaaag

SEQ ID NO: 780293 - DNA, 20 bp, mouse
gccggtgggctgtggggcta

SEQ ID NO: 780294 - DNA, 20 bp, mouse
ggaggggccgcccggaagcg

SEQ ID NO: 780295 - DNA, 20 bp, mouse
gacgcgaccccgcttccggg

SEQ ID NO: 780296 - DNA, 20 bp, mouse
gcgggctgagggaccgtcgt

SEQ ID NO: 780297 - DNA, 20 bp, mouse
ggccctgtcgtctgcccggg

SEQ ID NO: 780298 - DNA, 20 bp, mouse
ggccccccgggcagacgaca

SEQ ID NO: 780299 - DNA, 20 bp, mouse
gagccatcggcgaacgcgag

SEQ ID NO: 780300 - DNA, 20 bp, mouse
ggggccgaggcgggtcacag

SEQ ID NO: 780301 - DNA, 20 bp, mouse
gccaagcggcggggcgaagc

SEQ ID NO: 780302 - DNA, 20 bp, mouse
ggcccgctcgcgttcgccga

SEQ ID NO: 780303 - DNA, 20 bp, mouse
gcacacctgcgcgcccacgg

SEQ ID NO: 780304 - DNA, 20 bp, mouse
gaaagtgcgagactgacggt

SEQ ID NO: 780305 - DNA, 20 bp, mouse
ggagcccagacccccgaacg

SEQ ID NO: 780306 - DNA, 20 bp, mouse
gagaacgcggctccgaaggt

SEQ ID NO: 780307 - DNA, 20 bp, mouse
gacgcggctccgaaggtcgg

SEQ ID NO: 780308 - DNA, 20 bp, mouse
ggaatcacatcagtctggtg

SEQ ID NO: 780309 - DNA, 20 bp, mouse
gtgggcggggccggcggtga

SEQ ID NO: 780310 - DNA, 20 bp, mouse
gagagagaacgcggctccga

SEQ ID NO: 780311 - DNA, 20 bp, mouse
gccgggcaggggtgtttgtt

SEQ ID NO: 780312 - DNA, 20 bp, mouse
gtcccagctaggccaataga

SEQ ID NO: 780313 - DNA, 20 bp, mouse
gctatgggagctgggaacta

SEQ ID NO: 780314 - DNA, 20 bp, mouse
gaggtcggtggctcttattc

SEQ ID NO: 780315 - DNA, 20 bp, mouse
gccacagaatcacatcagtc

SEQ ID NO: 780316 - DNA, 20 bp, mouse
gagctgggagtctccatcga

SEQ ID NO: 780317 - DNA, 20 bp, mouse
gggagactcccagctctgat

SEQ ID NO: 780318 - DNA, 20 bp, mouse
gcaacgccccgtccatctat

SEQ ID NO: 780319 - DNA, 20 bp, mouse
gagaatgccgctcacttacc

SEQ ID NO: 780320 - DNA, 20 bp, mouse
gtgggagtctccatcgaggg

SEQ ID NO: 780321 - DNA, 20 bp, mouse
gagatggacggggcgttgtc

SEQ ID NO: 780322 - DNA, 20 bp, mouse
ggccccccagcgccattcat

SEQ ID NO: 780323 - DNA, 20 bp, mouse
gacttctgaaagagctgggc

SEQ ID NO: 780324 - DNA, 20 bp, mouse
gggggcgagacgcgcgtgtg

SEQ ID NO: 780325 - DNA, 20 bp, mouse
gttgtccggcagccaatgaa

SEQ ID NO: 780326 - DNA, 20 bp, mouse
ggtacctcttgttggagcct

SEQ ID NO: 780327 - DNA, 20 bp, mouse
gctgaagaggcgctgagggg

SEQ ID NO: 780328 - DNA, 20 bp, mouse
gacacagaggcttagtgaag

SEQ ID NO: 780329 - DNA, 20 bp, mouse
gcaacccaggctccaacaag

SEQ ID NO: 780330 - DNA, 20 bp, mouse
gcctgtctggtacctcttgt

SEQ ID NO: 780331 - DNA, 20 bp, mouse
gagcgcctcttcagaaaaaa

SEQ ID NO: 780332 - DNA, 20 bp, mouse
gttttctgaagaggcgctga

SEQ ID NO: 780333 - DNA, 20 bp, mouse
ggcagagacaatcagaacat

SEQ ID NO: 780334 - DNA, 20 bp, mouse
gcgcccctttttttctgaag

SEQ ID NO: 780335 - DNA, 20 bp, mouse
gtataggtccagatcccttg

SEQ ID NO: 780336 - DNA, 20 bp, mouse
ggcaagtcctgggaagccgt

SEQ ID NO: 780337 - DNA, 20 bp, mouse
gcaaccctccaggaactaca

SEQ ID NO: 780338 - DNA, 20 bp, mouse
gtccggcgcgcctaaggaag

SEQ ID NO: 780339 - DNA, 20 bp, mouse
gccggaagttggggcttccg

SEQ ID NO: 780340 - DNA, 20 bp, mouse
gtcgcgcgccggctgaggaa

SEQ ID NO: 780341 - DNA, 20 bp, mouse
ggtgacgtcccacgtaacgg

SEQ ID NO: 780342 - DNA, 20 bp, mouse
gttaggcgcgccggaagttg

SEQ ID NO: 780343 - DNA, 20 bp, mouse
gtctgcgacgagcttaagga

SEQ ID NO: 780344 - DNA, 20 bp, mouse
gtaaggaaggaagccgcggg

SEQ ID NO: 780345 - DNA, 20 bp, mouse
gcacgtgacgtcccacgtaa

SEQ ID NO: 780346 - DNA, 20 bp, mouse
gaaagtggcgtcatgacccg

SEQ ID NO: 780347 - DNA, 20 bp, mouse
gggggcgggctttcacaggg

SEQ ID NO: 780348 - DNA, 20 bp, mouse
gccgaggggcgggctttcac

SEQ ID NO: 780349 - DNA, 20 bp, mouse
ggtagtctagtcatctgtta

SEQ ID NO: 780350 - DNA, 20 bp, mouse
gtggccacgcgcagcggcag

SEQ ID NO: 780351 - DNA, 20 bp, mouse
ggcgtcatgacccgaggggc

SEQ ID NO: 780352 - DNA, 20 bp, mouse
ggggcaggagccttcggcaa

SEQ ID NO: 780353 - DNA, 20 bp, mouse
ggtgaggcgcagaacccctt

SEQ ID NO: 780354 - DNA, 20 bp, mouse
ggggccgtcgccattgccga

SEQ ID NO: 780355 - DNA, 20 bp, mouse
gggtcatgacgccactttca

SEQ ID NO: 780356 - DNA, 20 bp, mouse
gggcaggaagcgccctagga

SEQ ID NO: 780357 - DNA, 20 bp, mouse
gaggaagcgccctaggaggg

SEQ ID NO: 780358 - DNA, 20 bp, mouse
gggtccccagtagcccactc

SEQ ID NO: 780359 - DNA, 20 bp, mouse
gtgacgtcatagcatagcta

SEQ ID NO: 780360 - DNA, 20 bp, mouse
gcgccctgagtgggctactg

SEQ ID NO: 780361 - DNA, 20 bp, mouse
gtggaaacttctacactgtc

SEQ ID NO: 780362 - DNA, 20 bp, mouse
gctgcctggaaacaaaagat

SEQ ID NO: 780363 - DNA, 20 bp, mouse
gacaagtacgagggtgtgtg

SEQ ID NO: 780364 - DNA, 20 bp, mouse
gaaagcctgctccagtagat

SEQ ID NO: 780365 - DNA, 20 bp, mouse
gtcatagcatagctagggag

SEQ ID NO: 780366 - DNA, 20 bp, mouse
gcaggcttgggagacttcga

SEQ ID NO: 780367 - DNA, 20 bp, mouse
gggtcggaacagtcaggctt

SEQ ID NO: 780368 - DNA, 20 bp, mouse
ggcctcaggtcggaacagtc

SEQ ID NO: 780369 - DNA, 20 bp, mouse
gcacgtgcaccccatggccc

SEQ ID NO: 780370 - DNA, 20 bp, mouse
ggctaagggaagaggagaca

SEQ ID NO: 780371 - DNA, 20 bp, mouse
gcaagctaccagagttggtg

SEQ ID NO: 780372 - DNA, 20 bp, mouse
gtgttccgacctgaggctaa

SEQ ID NO: 780373 - DNA, 20 bp, mouse
gcgacctagcttggaacttg

SEQ ID NO: 780374 - DNA, 20 bp, mouse
gagcctccccccaccaactc

SEQ ID NO: 780375 - DNA, 20 bp, mouse
gtcttcccttagcctcaggt

SEQ ID NO: 780376 - DNA, 20 bp, mouse
gggcccaatcggagaccgct

SEQ ID NO: 780377 - DNA, 20 bp, mouse
ggagctgaccgggtgatggg

SEQ ID NO: 780378 - DNA, 20 bp, mouse
ggcaccaatcagtggtttta

SEQ ID NO: 780379 - DNA, 20 bp, mouse
gcacctagcggtctccgatt

SEQ ID NO: 780380 - DNA, 20 bp, mouse
gtcgcgtggcagagtcccac

SEQ ID NO: 780381 - DNA, 20 bp, mouse
gatgggcggggcctactcgg

SEQ ID NO: 780382 - DNA, 20 bp, mouse
gggcggggcctactcggagg

SEQ ID NO: 780383 - DNA, 20 bp, mouse
gtgccatggggactagtggg

SEQ ID NO: 780384 - DNA, 20 bp, mouse
gcggaggcggggcagcgagc

SEQ ID NO: 780385 - DNA, 20 bp, mouse
gggctcccaaaaaagtaaag

SEQ ID NO: 780386 - DNA, 20 bp, mouse
gagaacgtgcagcccaggtg

SEQ ID NO: 780387 - DNA, 20 bp, mouse
ggcaaacctggggcgcggat

SEQ ID NO: 780388 - DNA, 20 bp, mouse
gtggggcgcggatgggaagg

SEQ ID NO: 780389 - DNA, 20 bp, mouse
gtttctggggaacaacggtg

SEQ ID NO: 780390 - DNA, 20 bp, mouse
gatgggaagggggttaggct

SEQ ID NO: 780391 - DNA, 20 bp, mouse
gcagctgtgggtctcagccc

SEQ ID NO: 780392 - DNA, 20 bp, mouse
gcccagaaaccagaccttct

SEQ ID NO: 780393 - DNA, 20 bp, mouse
gggcaggcgtggccacacct

SEQ ID NO: 780394 - DNA, 20 bp, mouse
gtactgctttcctttgctga

SEQ ID NO: 780395 - DNA, 20 bp, mouse
ggcttggctgtgagccaaga

SEQ ID NO: 780396 - DNA, 20 bp, mouse
gagctccggagagatagcga

SEQ ID NO: 780397 - DNA, 20 bp, mouse
gctgctggagggaaggcggt

SEQ ID NO: 780398 - DNA, 20 bp, mouse
gtggcgccgcggggaggtcg

SEQ ID NO: 780399 - DNA, 20 bp, mouse
ggcgctccgggctcgaccaa

SEQ ID NO: 780400 - DNA, 20 bp, mouse
ggctggcaggcggtggtcag

SEQ ID NO: 780401 - DNA, 20 bp, mouse
ggagatagcgaggggcgctc

SEQ ID NO: 780402 - DNA, 20 bp, mouse
gcgggcacggcaaggagggg

SEQ ID NO: 780403 - DNA, 20 bp, mouse
ggcggtggtcagcggggctg

SEQ ID NO: 780404 - DNA, 20 bp, mouse
gaggaggggcggcagcacgt

SEQ ID NO: 780405 - DNA, 20 bp, mouse
gccgaggtccctcccgcgga

SEQ ID NO: 780406 - DNA, 20 bp, mouse
ggggcgaagccaggcggctt

SEQ ID NO: 780407 - DNA, 20 bp, mouse
ggtgaaagggggagtgtgga

SEQ ID NO: 780408 - DNA, 20 bp, mouse
gaaagctgtagcaattgagg

SEQ ID NO: 780409 - DNA, 20 bp, mouse
gtcagcggacagtcctccta

SEQ ID NO: 780410 - DNA, 20 bp, mouse
gcccgcagggggatggtaga

SEQ ID NO: 780411 - DNA, 20 bp, mouse
gcagtagctgggagaggttt

SEQ ID NO: 780412 - DNA, 20 bp, mouse
gggagtagcccgcaggggga

SEQ ID NO: 780413 - DNA, 20 bp, mouse
ggcctggcttcgcccctagg

SEQ ID NO: 780414 - DNA, 20 bp, mouse
ggccgcctggcttcgcccct

SEQ ID NO: 780415 - DNA, 20 bp, mouse
gtcctcctaggggcgaagcc

SEQ ID NO: 780416 - DNA, 20 bp, mouse
gagagtcgaatgagagtcca

SEQ ID NO: 780417 - DNA, 20 bp, mouse
gtggctcggcaggaacatag

SEQ ID NO: 780418 - DNA, 20 bp, mouse
gggaaccagtgcagccggga

SEQ ID NO: 780419 - DNA, 20 bp, mouse
ggcgaccgtccagtcctcga

SEQ ID NO: 780420 - DNA, 20 bp, mouse
gggcagtcacgggaccctcg

SEQ ID NO: 780421 - DNA, 20 bp, mouse
gcgaatgagagtccagggcg

SEQ ID NO: 780422 - DNA, 20 bp, mouse
gctagcgcgcggaacctgtg

SEQ ID NO: 780423 - DNA, 20 bp, mouse
ggagtccagggcggggatag

SEQ ID NO: 780424 - DNA, 20 bp, mouse
gtgggtgtgctgtgtagcgg

SEQ ID NO: 780425 - DNA, 20 bp, mouse
ggactgccgagcgatcgagc

SEQ ID NO: 780426 - DNA, 20 bp, mouse
gcgccctcccaggcgtggga

SEQ ID NO: 780427 - DNA, 20 bp, mouse
gcggcctccgcccacaagga

SEQ ID NO: 780428 - DNA, 20 bp, mouse
gccccctcccacgcctggga

SEQ ID NO: 780429 - DNA, 20 bp, mouse
gaaccggctggattgaaaga

SEQ ID NO: 780430 - DNA, 20 bp, mouse
gaccgcgccctcccaggcgt

SEQ ID NO: 780431 - DNA, 20 bp, mouse
gcgcctggaggaaaacccta

SEQ ID NO: 780432 - DNA, 20 bp, mouse
ggctgcctccgcccccggat

SEQ ID NO: 780433 - DNA, 20 bp, mouse
gactcgaggcggggttctgg

SEQ ID NO: 780434 - DNA, 20 bp, mouse
gcaccctcccagcccatccg

SEQ ID NO: 780435 - DNA, 20 bp, mouse
gagctcctgctgtgtccagg

SEQ ID NO: 780436 - DNA, 20 bp, mouse
gggaagcagccccagatctg

SEQ ID NO: 780437 - DNA, 20 bp, mouse
gaatcaggaatcccagtagt

SEQ ID NO: 780438 - DNA, 20 bp, mouse
gggaatcccagtagtgggtt

SEQ ID NO: 780439 - DNA, 20 bp, mouse
gtaaagccacttagtataga

SEQ ID NO: 780440 - DNA, 20 bp, mouse
gaagaacccagcctcagatc

SEQ ID NO: 780441 - DNA, 20 bp, mouse
gcggctccttctatactaag

SEQ ID NO: 780442 - DNA, 20 bp, mouse
gtactctactcggctatatt

SEQ ID NO: 780443 - DNA, 20 bp, mouse
ggagaacagatgagtgtcta

SEQ ID NO: 780444 - DNA, 20 bp, mouse
gttccaacaacaaaatcagg

SEQ ID NO: 780445 - DNA, 20 bp, mouse
gcatctccgctcaatttggc

SEQ ID NO: 780446 - DNA, 20 bp, mouse
gtggctctctcgcgggtcgg

SEQ ID NO: 780447 - DNA, 20 bp, mouse
ggcgcggtgcggagcgtctg

SEQ ID NO: 780448 - DNA, 20 bp, mouse
gcgcgggcgcgagggataca

SEQ ID NO: 780449 - DNA, 20 bp, mouse
gtggggccctaaactatatc

SEQ ID NO: 780450 - DNA, 20 bp, mouse
gaactcagggtgactgggtc

SEQ ID NO: 780451 - DNA, 20 bp, mouse
gacagcagcagctcttgagg

SEQ ID NO: 780452 - DNA, 20 bp, mouse
gcctgcacgaggcccagcct

SEQ ID NO: 780453 - DNA, 20 bp, mouse
gtcacatggtgcactctctg

SEQ ID NO: 780454 - DNA, 20 bp, mouse
ggggtcgggggtccgacttg

SEQ ID NO: 780455 - DNA, 20 bp, mouse
gccagccattggcccaggct

SEQ ID NO: 780456 - DNA, 20 bp, mouse
gccgccgtcgctcgcgagtg

SEQ ID NO: 780457 - DNA, 20 bp, mouse
gctcgcgagtggggcacctg

SEQ ID NO: 780458 - DNA, 20 bp, mouse
ggccgcgcgcgctacgctct

SEQ ID NO: 780459 - DNA, 20 bp, mouse
gcctgtaaggacacgtgctg

SEQ ID NO: 780460 - DNA, 20 bp, mouse
ggcgaggcgcggagacgtca

SEQ ID NO: 780461 - DNA, 20 bp, mouse
gtcgctccgcccctggggtg

SEQ ID NO: 780462 - DNA, 20 bp, mouse
ggtgccccactcgcgagcga

SEQ ID NO: 780463 - DNA, 20 bp, mouse
ggggtctagacaagaccagg

SEQ ID NO: 780464 - DNA, 20 bp, mouse
gcttgtgattagtgagctgg

SEQ ID NO: 780465 - DNA, 20 bp, mouse
ggtagcgcgcgcggccacca

SEQ ID NO: 780466 - DNA, 20 bp, mouse
gctagaccgagcctcttaag

SEQ ID NO: 780467 - DNA, 20 bp, mouse
gcctcttaaggggatcctaa

SEQ ID NO: 780468 - DNA, 20 bp, mouse
gcggcgccgccgtgggtccc

SEQ ID NO: 780469 - DNA, 20 bp, mouse
gaccagctgtacgaccgggg

SEQ ID NO: 780470 - DNA, 20 bp, mouse
ggccaccagctgtacgaccg

SEQ ID NO: 780471 - DNA, 20 bp, mouse
gcactggcaagaaaacgctc

SEQ ID NO: 780472 - DNA, 20 bp, mouse
gtgggtcccaggggagtcgc

SEQ ID NO: 780473 - DNA, 20 bp, mouse
gctggtggcacgctcccttt

SEQ ID NO: 780474 - DNA, 20 bp, mouse
ggggtgaggggcggtggcga

SEQ ID NO: 780475 - DNA, 20 bp, mouse
gggagctccggaagaagcgt

SEQ ID NO: 780476 - DNA, 20 bp, mouse
gtggctgcgtgtatatgaac

SEQ ID NO: 780477 - DNA, 20 bp, mouse
gggagcgctatcaacttctc

SEQ ID NO: 780478 - DNA, 20 bp, mouse
ggggaggcgcggcccggttg

SEQ ID NO: 780479 - DNA, 20 bp, mouse
gtgcgtgtatatgaactggg

SEQ ID NO: 780480 - DNA, 20 bp, mouse
gacctgctggagcaccggcg

SEQ ID NO: 780481 - DNA, 20 bp, mouse
ggcagcctagcgcagcgtgg

SEQ ID NO: 780482 - DNA, 20 bp, mouse
gcctagcgcagcgtggaggc

SEQ ID NO: 780483 - DNA, 20 bp, mouse
gcccccacctgctggagcac

SEQ ID NO: 780484 - DNA, 20 bp, mouse
gagagcaggtccagctggtt

SEQ ID NO: 780485 - DNA, 20 bp, mouse
ggggaacacgcgcctgcgtt

SEQ ID NO: 780486 - DNA, 20 bp, mouse
gggtaaccccaagactcagt

SEQ ID NO: 780487 - DNA, 20 bp, mouse
gaagccaggcccacgcccaa

SEQ ID NO: 780488 - DNA, 20 bp, mouse
gggcctagagatggggacta

SEQ ID NO: 780489 - DNA, 20 bp, mouse
gggaggcggggcctagagat

SEQ ID NO: 780490 - DNA, 20 bp, mouse
gcaggcgaggcgaacgcgct

SEQ ID NO: 780491 - DNA, 20 bp, mouse
gcccaatggtggtccgcaaa

SEQ ID NO: 780492 - DNA, 20 bp, mouse
gccaggcccacgcccaatgg

SEQ ID NO: 780493 - DNA, 20 bp, mouse
gaaagggagtagccaattag

SEQ ID NO: 780494 - DNA, 20 bp, mouse
gaatggtggtccgcaaatgg

SEQ ID NO: 780495 - DNA, 20 bp, mouse
ggcccaaagtagcctctaat

SEQ ID NO: 780496 - DNA, 20 bp, mouse
gcggaccccgacactcagca

SEQ ID NO: 780497 - DNA, 20 bp, mouse
gtcctggaaaataatgactt

SEQ ID NO: 780498 - DNA, 20 bp, mouse
gagctgccgtgctgagtgtc

SEQ ID NO: 780499 - DNA, 20 bp, mouse
gacaagcccttttccttcag

SEQ ID NO: 780500 - DNA, 20 bp, mouse
gtaatgagggtgcactgggg

SEQ ID NO: 780501 - DNA, 20 bp, mouse
gtgcggtgggactttgagag

SEQ ID NO: 780502 - DNA, 20 bp, mouse
gacccaagtcattattttcc

SEQ ID NO: 780503 - DNA, 20 bp, mouse
gttctactctaagggttctt

SEQ ID NO: 780504 - DNA, 20 bp, mouse
ggcacagcacaacaaagagc

SEQ ID NO: 780505 - DNA, 20 bp, mouse
gatctcgcttagtttatctc

SEQ ID NO: 780506 - DNA, 20 bp, mouse
ggggtgcttggagtcccggg

SEQ ID NO: 780507 - DNA, 20 bp, mouse
gtctctggggagcgtggaga

SEQ ID NO: 780508 - DNA, 20 bp, mouse
ggccaccctccgacccgccc

SEQ ID NO: 780509 - DNA, 20 bp, mouse
ggccactgtcccaaggtctc

SEQ ID NO: 780510 - DNA, 20 bp, mouse
gcacgctccccagagacctt

SEQ ID NO: 780511 - DNA, 20 bp, mouse
gagccctcagagcccggctt

SEQ ID NO: 780512 - DNA, 20 bp, mouse
gaagccaaagccgggctctg

SEQ ID NO: 780513 - DNA, 20 bp, mouse
ggccgcgcgctccccgggag

SEQ ID NO: 780514 - DNA, 20 bp, mouse
gcccgatagtctctgggacg

SEQ ID NO: 780515 - DNA, 20 bp, mouse
ggggagggagcgggcggtcc

SEQ ID NO: 780516 - DNA, 20 bp, mouse
gtcggggccagaggaccagt

SEQ ID NO: 780517 - DNA, 20 bp, mouse
ggggccgcccactggtcctc

SEQ ID NO: 780518 - DNA, 20 bp, mouse
gaaccagagtataatagggt

SEQ ID NO: 780519 - DNA, 20 bp, mouse
gggtcctctggccccgaggc

SEQ ID NO: 780520 - DNA, 20 bp, mouse
gtgggcagaaacagttcctc

SEQ ID NO: 780521 - DNA, 20 bp, mouse
gggaaagagcttcaccagaa

SEQ ID NO: 780522 - DNA, 20 bp, mouse
gcaagtctggggccgcccac

SEQ ID NO: 780523 - DNA, 20 bp, mouse
ggcggcaccgcgcatgtggg

SEQ ID NO: 780524 - DNA, 20 bp, mouse
ggggcatgccactgtagtag

SEQ ID NO: 780525 - DNA, 20 bp, mouse
gcaggctccgcccacatgcg

SEQ ID NO: 780526 - DNA, 20 bp, mouse
ggactccccgggcctctcaa

SEQ ID NO: 780527 - DNA, 20 bp, mouse
gggttcccctagctgagggt

SEQ ID NO: 780528 - DNA, 20 bp, mouse
ggctctcccaccctcagcta

SEQ ID NO: 780529 - DNA, 20 bp, mouse
ggagtcgtgaccacgcctgg

SEQ ID NO: 780530 - DNA, 20 bp, mouse
ggggcctctcaagggttaag

SEQ ID NO: 780531 - DNA, 20 bp, mouse
gtggctgcgggacctctcag

SEQ ID NO: 780532 - DNA, 20 bp, mouse
gaggcgtggtcacgactccc

SEQ ID NO: 780533 - DNA, 20 bp, mouse
ggccagtgcacagcgatcta

SEQ ID NO: 780534 - DNA, 20 bp, mouse
gtgagggtgggagagcccgg

SEQ ID NO: 780535 - DNA, 20 bp, mouse
gcccgtagatcgctgtgcac

SEQ ID NO: 780536 - DNA, 20 bp, mouse
gctaacccaagcaagacgga

SEQ ID NO: 780537 - DNA, 20 bp, mouse
ggtacaggcagcgcctgaga

SEQ ID NO: 780538 - DNA, 20 bp, mouse
gaccggggacaaactgaatc

SEQ ID NO: 780539 - DNA, 20 bp, mouse
ggtacctggctttttctgat

SEQ ID NO: 780540 - DNA, 20 bp, mouse
gcgtaaccttgttttggcgg

SEQ ID NO: 780541 - DNA, 20 bp, mouse
gccccgctgattggaagcga

SEQ ID NO: 780542 - DNA, 20 bp, mouse
gcacgctgggaatacccacc

SEQ ID NO: 780543 - DNA, 20 bp, mouse
gtatacgccgggaatgatga

SEQ ID NO: 780544 - DNA, 20 bp, mouse
gctagaggcgggggagtagt

SEQ ID NO: 780545 - DNA, 20 bp, mouse
gctacgtcactctccttctc

SEQ ID NO: 780546 - DNA, 20 bp, mouse
ggaggccttccccacggcgg

SEQ ID NO: 780547 - DNA, 20 bp, mouse
gtggggaaggcctccctccg

SEQ ID NO: 780548 - DNA, 20 bp, mouse
gtccgcgagctgaccggagg

SEQ ID NO: 780549 - DNA, 20 bp, mouse
ggggagaaacgaccctgagg

SEQ ID NO: 780550 - DNA, 20 bp, mouse
gtgggctgcgtccccttcca

SEQ ID NO: 780551 - DNA, 20 bp, mouse
gagaaacgaccctgaggcgg

SEQ ID NO: 780552 - DNA, 20 bp, mouse
gcgcaggcgtggcccccacg

SEQ ID NO: 780553 - DNA, 20 bp, mouse
gctctccggggagcgaggtt

SEQ ID NO: 780554 - DNA, 20 bp, mouse
gaccggaagctgtggggcaa

SEQ ID NO: 780555 - DNA, 20 bp, mouse
gagggaggccttccccacgg

SEQ ID NO: 780556 - DNA, 20 bp, mouse
gggaacggtgtggaccaatg

SEQ ID NO: 780557 - DNA, 20 bp, mouse
ggacaccatgtgggccggaa

SEQ ID NO: 780558 - DNA, 20 bp, mouse
gccccccctccccttggagt

SEQ ID NO: 780559 - DNA, 20 bp, mouse
gcgacccactccaaggggag

SEQ ID NO: 780560 - DNA, 20 bp, mouse
gtcaactcgacccactccaa

SEQ ID NO: 780561 - DNA, 20 bp, mouse
gcatgtgggccggaacggtg

SEQ ID NO: 780562 - DNA, 20 bp, mouse
ggggcccattggcaagctta

SEQ ID NO: 780563 - DNA, 20 bp, mouse
ggctccctcggtcaccgtag

SEQ ID NO: 780564 - DNA, 20 bp, mouse
gtctacaccagccgtctcac

SEQ ID NO: 780565 - DNA, 20 bp, mouse
gccactgacaccatgtgggc

SEQ ID NO: 780566 - DNA, 20 bp, mouse
gaatccgagctggctagggg

SEQ ID NO: 780567 - DNA, 20 bp, mouse
gctcgcggatgcacaagaga

SEQ ID NO: 780568 - DNA, 20 bp, mouse
gtccagaggtcttgtccaat

SEQ ID NO: 780569 - DNA, 20 bp, mouse
gcgtccagagtgcctgtcgt

SEQ ID NO: 780570 - DNA, 20 bp, mouse
ggatggtggcgcggtctctt

SEQ ID NO: 780571 - DNA, 20 bp, mouse
ggcgccgtcggggtccgggg

SEQ ID NO: 780572 - DNA, 20 bp, mouse
gagtgcctgtcgttggatgg

SEQ ID NO: 780573 - DNA, 20 bp, mouse
gaggcactctggacggatga

SEQ ID NO: 780574 - DNA, 20 bp, mouse
ggactcgccgaccgcggctg

SEQ ID NO: 780575 - DNA, 20 bp, mouse
gcgatcgtggaggggcccaa

SEQ ID NO: 780576 - DNA, 20 bp, mouse
gcggcccagcaaccccgcaa

SEQ ID NO: 780577 - DNA, 20 bp, mouse
ggggaccggggccttttgtt

SEQ ID NO: 780578 - DNA, 20 bp, mouse
gggaccgagcgagccgggga

SEQ ID NO: 780579 - DNA, 20 bp, mouse
gggtcccggccgccccttgc

SEQ ID NO: 780580 - DNA, 20 bp, mouse
ggctgcggggggccacggag

SEQ ID NO: 780581 - DNA, 20 bp, mouse
ggaggaggcctgagtcacgt

SEQ ID NO: 780582 - DNA, 20 bp, mouse
gagcgagccggggaaggccg

SEQ ID NO: 780583 - DNA, 20 bp, mouse
gaggggtcgagaggcatcct

SEQ ID NO: 780584 - DNA, 20 bp, mouse
ggctagaaataggggtcgag

SEQ ID NO: 780585 - DNA, 20 bp, mouse
gaaccccgcaaggggcggcc

SEQ ID NO: 780586 - DNA, 20 bp, mouse
gagacaagcaagtgtcccag

SEQ ID NO: 780587 - DNA, 20 bp, mouse
ggtggcctggcctccagcac

SEQ ID NO: 780588 - DNA, 20 bp, mouse
gccagaggccaggactggga

SEQ ID NO: 780589 - DNA, 20 bp, mouse
gcctccagcacaggcggacg

SEQ ID NO: 780590 - DNA, 20 bp, mouse
gggccctcccttcccagtcc

SEQ ID NO: 780591 - DNA, 20 bp, mouse
ggacacttgcttgtctagga

SEQ ID NO: 780592 - DNA, 20 bp, mouse
gggagagggcgcatggaaga

SEQ ID NO: 780593 - DNA, 20 bp, mouse
gcttgcttgtctaggacggt

SEQ ID NO: 780594 - DNA, 20 bp, mouse
gagcacaggcggacgggggg

SEQ ID NO: 780595 - DNA, 20 bp, mouse
gaggggaccgggcttcaaag

SEQ ID NO: 780596 - DNA, 20 bp, mouse
ggggaaaaccgggttcccag

SEQ ID NO: 780597 - DNA, 20 bp, mouse
gagggaggctgtcagcagaa

SEQ ID NO: 780598 - DNA, 20 bp, mouse
gctagctcgtgctccgggga

SEQ ID NO: 780599 - DNA, 20 bp, mouse
ggcgctgacgcgggcgaggt

SEQ ID NO: 780600 - DNA, 20 bp, mouse
gaacctacgcggggaaaacc

SEQ ID NO: 780601 - DNA, 20 bp, mouse
gcgcgctcggagtggccgga

SEQ ID NO: 780602 - DNA, 20 bp, mouse
gtcagcatcaacgctctcaa

SEQ ID NO: 780603 - DNA, 20 bp, mouse
gacgctctcaatggtggaca

SEQ ID NO: 780604 - DNA, 20 bp, mouse
gccacacacacacggctcta

SEQ ID NO: 780605 - DNA, 20 bp, mouse
gtccggaagcgcgctgacgc

SEQ ID NO: 780606 - DNA, 20 bp, mouse
gaacgccgcagctacgtgga

SEQ ID NO: 780607 - DNA, 20 bp, mouse
gtctggggttagatcgtgtc

SEQ ID NO: 780608 - DNA, 20 bp, mouse
gcaaccctgatgcaagggga

SEQ ID NO: 780609 - DNA, 20 bp, mouse
gcggcccgctcccgccgggg

SEQ ID NO: 780610 - DNA, 20 bp, mouse
gggcgcggagcgctggaaga

SEQ ID NO: 780611 - DNA, 20 bp, mouse
gcggctacagcgcacggcgg

SEQ ID NO: 780612 - DNA, 20 bp, mouse
gccgcagctacgtggagggt

SEQ ID NO: 780613 - DNA, 20 bp, mouse
gtgaccatccccttgcatca

SEQ ID NO: 780614 - DNA, 20 bp, mouse
ggagaggggtcgagctgcca

SEQ ID NO: 780615 - DNA, 20 bp, mouse
gtgaagaccaggtccgagtg

SEQ ID NO: 780616 - DNA, 20 bp, mouse
gtttccgtgtggttggtgcc

SEQ ID NO: 780617 - DNA, 20 bp, mouse
gtggagagaaggagggccgt

SEQ ID NO: 780618 - DNA, 20 bp, mouse
gccacagtgcttcgtctgtt

SEQ ID NO: 780619 - DNA, 20 bp, mouse
ggagggtcaggctttccgtg

SEQ ID NO: 780620 - DNA, 20 bp, mouse
gccccggcctcccagagaaa

SEQ ID NO: 780621 - DNA, 20 bp, mouse
gcaccctggcaattagagga

SEQ ID NO: 780622 - DNA, 20 bp, mouse
gcgtctgttgggaaacaatc

SEQ ID NO: 780623 - DNA, 20 bp, mouse
ggttctctacatatctgatc

SEQ ID NO: 780624 - DNA, 20 bp, mouse
gaaaatactgtattaatcag

SEQ ID NO: 780625 - DNA, 20 bp, mouse
gccccagcattcatcaagga

SEQ ID NO: 780626 - DNA, 20 bp, mouse
ggggactggaggtgggacga

SEQ ID NO: 780627 - DNA, 20 bp, mouse
gacgaggggcggggcctatg

SEQ ID NO: 780628 - DNA, 20 bp, mouse
gtggactgaaggagaggaga

SEQ ID NO: 780629 - DNA, 20 bp, mouse
ggaggaggggccaagacggg

SEQ ID NO: 780630 - DNA, 20 bp, mouse
gagcagaggaggggccaaga

SEQ ID NO: 780631 - DNA, 20 bp, mouse
gtacgtggaccacacagtga

SEQ ID NO: 780632 - DNA, 20 bp, mouse
gcagaggcggggaagaaggc

SEQ ID NO: 780633 - DNA, 20 bp, mouse
gcggaactggactgaaggag

SEQ ID NO: 780634 - DNA, 20 bp, mouse
gggcgggtccaaacaggagg

SEQ ID NO: 780635 - DNA, 20 bp, mouse
gtgggagccgcaagcctacg

SEQ ID NO: 780636 - DNA, 20 bp, mouse
gacagcctgggtattgggaa

SEQ ID NO: 780637 - DNA, 20 bp, mouse
gaaagtgggtgtgtcggtat

SEQ ID NO: 780638 - DNA, 20 bp, mouse
ggaaacagcagagactagac

SEQ ID NO: 780639 - DNA, 20 bp, mouse
gaagggaggaactattcagc

SEQ ID NO: 780640 - DNA, 20 bp, mouse
gaggagttgagccaaggagt

SEQ ID NO: 780641 - DNA, 20 bp, mouse
gtggcttgaaggacacgatc

SEQ ID NO: 780642 - DNA, 20 bp, mouse
gggtatgggctacgctgatt

SEQ ID NO: 780643 - DNA, 20 bp, mouse
ggctggctaggaaggaaagt

SEQ ID NO: 780644 - DNA, 20 bp, mouse
gatgggctacgctgattggg

SEQ ID NO: 780645 - DNA, 20 bp, mouse
ggtaagacagcctgggtatt

SEQ ID NO: 780646 - DNA, 20 bp, mouse
gccagccagggagtctgcgg

SEQ ID NO: 780647 - DNA, 20 bp, mouse
ggctgctgagatggtggcga

SEQ ID NO: 780648 - DNA, 20 bp, mouse
gtctgcggcggctgctgaga

SEQ ID NO: 780649 - DNA, 20 bp, mouse
ggcagccgccgcagactccc

SEQ ID NO: 780650 - DNA, 20 bp, mouse
gcaaacgcgctctccagtgt

SEQ ID NO: 780651 - DNA, 20 bp, mouse
gacagcccggcccttccgca

SEQ ID NO: 780652 - DNA, 20 bp, mouse
gggtccagccagggagtctg

SEQ ID NO: 780653 - DNA, 20 bp, mouse
gtccctggctggaccagggt

SEQ ID NO: 780654 - DNA, 20 bp, mouse
gctagggcagggtaatgtgt

SEQ ID NO: 780655 - DNA, 20 bp, mouse
gcagcggcacgtaacttagg

SEQ ID NO: 780656 - DNA, 20 bp, mouse
gcgccgcgcgagcacgagaa

SEQ ID NO: 780657 - DNA, 20 bp, mouse
gtgcacgcgcatctcggttc

SEQ ID NO: 780658 - DNA, 20 bp, mouse
gcaagggccgggttagcacg

SEQ ID NO: 780659 - DNA, 20 bp, mouse
ggggccgcgccgggaccgag

SEQ ID NO: 780660 - DNA, 20 bp, mouse
ggaggccgctgagaccgctc

SEQ ID NO: 780661 - DNA, 20 bp, mouse
gagggcgggcttccgctcaa

SEQ ID NO: 780662 - DNA, 20 bp, mouse
gggttccggagcggtctcag

SEQ ID NO: 780663 - DNA, 20 bp, mouse
gtgctaacccggcccttgag

SEQ ID NO: 780664 - DNA, 20 bp, mouse
ggctggagggccacacagcg

SEQ ID NO: 780665 - DNA, 20 bp, mouse
gacacagcgcggctgttcca

SEQ ID NO: 780666 - DNA, 20 bp, mouse
gggcgcgggcggcgctcggt

SEQ ID NO: 780667 - DNA, 20 bp, mouse
gggggcgcgcggcgcagctg

SEQ ID NO: 780668 - DNA, 20 bp, mouse
gggggcgggcccagagcgtc

SEQ ID NO: 780669 - DNA, 20 bp, mouse
ggcggcggcggcgtagcgtg

SEQ ID NO: 780670 - DNA, 20 bp, mouse
ggcagggagaggccatcgaa

SEQ ID NO: 780671 - DNA, 20 bp, mouse
gcggcggccgggaacggaga

SEQ ID NO: 780672 - DNA, 20 bp, mouse
gggaaagacgccctcggcgg

SEQ ID NO: 780673 - DNA, 20 bp, mouse
gcggacggacggacgggcct

SEQ ID NO: 780674 - DNA, 20 bp, mouse
ggctgcggtcccggtggctc

SEQ ID NO: 780675 - DNA, 20 bp, mouse
ggcggtcccggtggctcagg

SEQ ID NO: 780676 - DNA, 20 bp, mouse
gcaactgcgcctagggcacc

SEQ ID NO: 780677 - DNA, 20 bp, mouse
gataccctgcgggggtctga

SEQ ID NO: 780678 - DNA, 20 bp, mouse
ggacttgaactcggttctta

SEQ ID NO: 780679 - DNA, 20 bp, mouse
gagacccccgcagggtatcc

SEQ ID NO: 780680 - DNA, 20 bp, mouse
gcccaccttgacaggggtgt

SEQ ID NO: 780681 - DNA, 20 bp, mouse
gggttcttagggtagcacac

SEQ ID NO: 780682 - DNA, 20 bp, mouse
gtgagggagagtcccggctc

SEQ ID NO: 780683 - DNA, 20 bp, mouse
ggcggctctggacttgaact

SEQ ID NO: 780684 - DNA, 20 bp, mouse
gaacgtgtctgctgtggatc

SEQ ID NO: 780685 - DNA, 20 bp, mouse
gagattgagcaactgcgcct

SEQ ID NO: 780686 - DNA, 20 bp, mouse
gacccggggcctctcggtgg

SEQ ID NO: 780687 - DNA, 20 bp, mouse
gggtacccggggcctctcgg

SEQ ID NO: 780688 - DNA, 20 bp, mouse
ggggcaatgctgggtacccg

SEQ ID NO: 780689 - DNA, 20 bp, mouse
gccatcttcccccacccagt

SEQ ID NO: 780690 - DNA, 20 bp, mouse
gctgggtacccggggcctct

SEQ ID NO: 780691 - DNA, 20 bp, mouse
gggggcaccgtgctccttca

SEQ ID NO: 780692 - DNA, 20 bp, mouse
gttggcaggaacccaaaagg

SEQ ID NO: 780693 - DNA, 20 bp, mouse
ggggtgtcagccgactgggt

SEQ ID NO: 780694 - DNA, 20 bp, mouse
gaccggaagtgggactgaaa

SEQ ID NO: 780695 - DNA, 20 bp, mouse
gtgcccccaccgagaggccc

SEQ ID NO: 780696 - DNA, 20 bp, mouse
gcacgaaagcgtgagatcac

SEQ ID NO: 780697 - DNA, 20 bp, mouse
gcggggcagcccaagcgcgg

SEQ ID NO: 780698 - DNA, 20 bp, mouse
ggaaagcgtgagatcaccgg

SEQ ID NO: 780699 - DNA, 20 bp, mouse
gagcgtgggatgggtgcggg

SEQ ID NO: 780700 - DNA, 20 bp, mouse
gcgacgccgcaagacctgac

SEQ ID NO: 780701 - DNA, 20 bp, mouse
gcccaagcgggcgccacgtg

SEQ ID NO: 780702 - DNA, 20 bp, mouse
gcccaagcgcgggggatgcc

SEQ ID NO: 780703 - DNA, 20 bp, mouse
ggccgtggcagcgatgagaa

SEQ ID NO: 780704 - DNA, 20 bp, mouse
gcgctttcgtggtagagcgt

SEQ ID NO: 780705 - DNA, 20 bp, mouse
gtgcagagggtcatcgtcag

SEQ ID NO: 780706 - DNA, 20 bp, mouse
gggaacctgcttggggatag

SEQ ID NO: 780707 - DNA, 20 bp, mouse
gaggcctggtgtcacttctt

SEQ ID NO: 780708 - DNA, 20 bp, mouse
gcgacagtggtgctctcatc

SEQ ID NO: 780709 - DNA, 20 bp, mouse
gcatcctctggaacctgctt

SEQ ID NO: 780710 - DNA, 20 bp, mouse
gatccccaagcaggttccag

SEQ ID NO: 780711 - DNA, 20 bp, mouse
ggctgccgctctcacgagat

SEQ ID NO: 780712 - DNA, 20 bp, mouse
gagagcaccactgtcgccct

SEQ ID NO: 780713 - DNA, 20 bp, mouse
gaagagagacttctcagaac

SEQ ID NO: 780714 - DNA, 20 bp, mouse
gcaccccaagaagtgacacc

SEQ ID NO: 780715 - DNA, 20 bp, mouse
ggaagagctccatcccggcc

SEQ ID NO: 780716 - DNA, 20 bp, mouse
gggcgggtcccgggaactca

SEQ ID NO: 780717 - DNA, 20 bp, mouse
gtcagagtgtcaggtctccc

SEQ ID NO: 780718 - DNA, 20 bp, mouse
gttgacaatcccacagacca

SEQ ID NO: 780719 - DNA, 20 bp, mouse
ggctgcaagtccgctgaggt

SEQ ID NO: 780720 - DNA, 20 bp, mouse
gcgggacccgcccacctcag

SEQ ID NO: 780721 - DNA, 20 bp, mouse
gggaagtagcgccatattgg

SEQ ID NO: 780722 - DNA, 20 bp, mouse
gtgacaaataaccttcccag

SEQ ID NO: 780723 - DNA, 20 bp, mouse
gtcaggtctccctggtctgt

SEQ ID NO: 780724 - DNA, 20 bp, mouse
gccgggaactcaaggctggg

SEQ ID NO: 780725 - DNA, 20 bp, mouse
gtgtgcccgagggcgggccc

SEQ ID NO: 780726 - DNA, 20 bp, mouse
ggagtggagcacacaccttg

SEQ ID NO: 780727 - DNA, 20 bp, mouse
gaagagcagggaggaccgta

SEQ ID NO: 780728 - DNA, 20 bp, mouse
gtgttcaggggcaatgatgg

SEQ ID NO: 780729 - DNA, 20 bp, mouse
ggggatcatgaccaatcaat

SEQ ID NO: 780730 - DNA, 20 bp, mouse
gggtggagaagctgaaccga

SEQ ID NO: 780731 - DNA, 20 bp, mouse
gagcagggaggaccgtaagg

SEQ ID NO: 780732 - DNA, 20 bp, mouse
gaggcatccagctgttagaa

SEQ ID NO: 780733 - DNA, 20 bp, mouse
gcatccagctgttagaaggg

SEQ ID NO: 780734 - DNA, 20 bp, mouse
ggggactcattcaattggga

SEQ ID NO: 780735 - DNA, 20 bp, mouse
ggagacaaacggcaaagtag

SEQ ID NO: 780736 - DNA, 20 bp, mouse
gtctccaaaggtgaaaccaa

SEQ ID NO: 780737 - DNA, 20 bp, mouse
gctcctgatcaaatgagtct

SEQ ID NO: 780738 - DNA, 20 bp, mouse
gaccccgagtgccacgctgc

SEQ ID NO: 780739 - DNA, 20 bp, mouse
gaacccaaggagataattat

SEQ ID NO: 780740 - DNA, 20 bp, mouse
gtgaacagcatagacatcaa

SEQ ID NO: 780741 - DNA, 20 bp, mouse
gctcccagactcatttgatc

SEQ ID NO: 780742 - DNA, 20 bp, mouse
ggaaagcaggagagatcaga

SEQ ID NO: 780743 - DNA, 20 bp, mouse
gtgggggaaggggtgatcag

SEQ ID NO: 780744 - DNA, 20 bp, mouse
gaggagagatcagagggaac

SEQ ID NO: 780745 - DNA, 20 bp, mouse
ggagcccttggtttcacctt

SEQ ID NO: 780746 - DNA, 20 bp, mouse
gagaccacgcccctcgtcct

SEQ ID NO: 780747 - DNA, 20 bp, mouse
ggcggggcgaagcggaggcg

SEQ ID NO: 780748 - DNA, 20 bp, mouse
gggcatccgagcagcgtgga

SEQ ID NO: 780749 - DNA, 20 bp, mouse
gtgggagagaggccgagggg

SEQ ID NO: 780750 - DNA, 20 bp, mouse
gtgaagctccgccttgaccc

SEQ ID NO: 780751 - DNA, 20 bp, mouse
gccgccttgacccaggacga

SEQ ID NO: 780752 - DNA, 20 bp, mouse
gccgagcagcgtggagggcg

SEQ ID NO: 780753 - DNA, 20 bp, mouse
gcgcccctcgtcctgggtca

SEQ ID NO: 780754 - DNA, 20 bp, mouse
gaagcgcccctcctggtgat

SEQ ID NO: 780755 - DNA, 20 bp, mouse
gctccagctagtgatcgcct

SEQ ID NO: 780756 - DNA, 20 bp, mouse
gggcagaacgtgtgtcagtc

SEQ ID NO: 780757 - DNA, 20 bp, mouse
ggggtccgagagattcttgt

SEQ ID NO: 780758 - DNA, 20 bp, mouse
gccggcggggaaccccgccc

SEQ ID NO: 780759 - DNA, 20 bp, mouse
ggctgctggcggagccgacg

SEQ ID NO: 780760 - DNA, 20 bp, mouse
gggggacccggcagccgcca

SEQ ID NO: 780761 - DNA, 20 bp, mouse
ggcgctcctctccgccccgt

SEQ ID NO: 780762 - DNA, 20 bp, mouse
ggagataaggggtgctcctg

SEQ ID NO: 780763 - DNA, 20 bp, mouse
ggctggcggagccgacgggg

SEQ ID NO: 780764 - DNA, 20 bp, mouse
ggacccggcagccgccaggg

SEQ ID NO: 780765 - DNA, 20 bp, mouse
ggcggggaaccccgccctgg

SEQ ID NO: 780766 - DNA, 20 bp, mouse
gaggaaaggccaatgatcta

SEQ ID NO: 780767 - DNA, 20 bp, mouse
gagccagaagaggaatggca

SEQ ID NO: 780768 - DNA, 20 bp, mouse
gaaccctgccattcctcttc

SEQ ID NO: 780769 - DNA, 20 bp, mouse
gaaaaagagtccttgctcat

SEQ ID NO: 780770 - DNA, 20 bp, mouse
ggagttgtgccagccagaag

SEQ ID NO: 780771 - DNA, 20 bp, mouse
gaattctagtgtggaaggaa

SEQ ID NO: 780772 - DNA, 20 bp, mouse
ggctgacctccgtagatcat

SEQ ID NO: 780773 - DNA, 20 bp, mouse
gttgctcattggttgataga

SEQ ID NO: 780774 - DNA, 20 bp, mouse
gaaaggccaatgatctacgg

SEQ ID NO: 780775 - DNA, 20 bp, mouse
gcaactcacaaattctagtg

SEQ ID NO: 780776 - DNA, 20 bp, mouse
gaggggcgggacacccagta

SEQ ID NO: 780777 - DNA, 20 bp, mouse
ggctggcgaaggaggaacta

SEQ ID NO: 780778 - DNA, 20 bp, mouse
gggctaagagggtttggcta

SEQ ID NO: 780779 - DNA, 20 bp, mouse
gaggggcggcccgggtagaa

SEQ ID NO: 780780 - DNA, 20 bp, mouse
gtggaccggctaagagggtt

SEQ ID NO: 780781 - DNA, 20 bp, mouse
ggggccagaggttgactggc

SEQ ID NO: 780782 - DNA, 20 bp, mouse
gggcggggccagaggttgac

SEQ ID NO: 780783 - DNA, 20 bp, mouse
ggctaggggcgggccggatg

SEQ ID NO: 780784 - DNA, 20 bp, mouse
gctccagccaggtaaaggac

SEQ ID NO: 780785 - DNA, 20 bp, mouse
ggcgggacacccagtagggc

SEQ ID NO: 780786 - DNA, 20 bp, mouse
gagaaggcatgggcggtctc

SEQ ID NO: 780787 - DNA, 20 bp, mouse
gggcatgggcggtctcgggg

SEQ ID NO: 780788 - DNA, 20 bp, mouse
gaggtaggtgcccaaaggtg

SEQ ID NO: 780789 - DNA, 20 bp, mouse
gttggtagacccaaggtgct

SEQ ID NO: 780790 - DNA, 20 bp, mouse
gtcttgttgcagggaccaat

SEQ ID NO: 780791 - DNA, 20 bp, mouse
gaggcccagcccttccggcc

SEQ ID NO: 780792 - DNA, 20 bp, mouse
ggacgggcgcggccggacgc

SEQ ID NO: 780793 - DNA, 20 bp, mouse
gcgaagcagcctggccggaa

SEQ ID NO: 780794 - DNA, 20 bp, mouse
gagcgcgcgaaacacaggca

SEQ ID NO: 780795 - DNA, 20 bp, mouse
gtccctgcaacaagaacgtc

SEQ ID NO: 780796 - DNA, 20 bp, mouse
ggggacgcgggaagctttga

SEQ ID NO: 780797 - DNA, 20 bp, mouse
gttcagctaaggggcacctg

SEQ ID NO: 780798 - DNA, 20 bp, mouse
ggggaggagagcccatcgct

SEQ ID NO: 780799 - DNA, 20 bp, mouse
gaaggggcacctgaggctga

SEQ ID NO: 780800 - DNA, 20 bp, mouse
ggcggcgcgccctcctgtcg

SEQ ID NO: 780801 - DNA, 20 bp, mouse
gcaggctgtcccggcagggg

SEQ ID NO: 780802 - DNA, 20 bp, mouse
gtctgggaggagccgagcga

SEQ ID NO: 780803 - DNA, 20 bp, mouse
gagtacctaccagagagtac

SEQ ID NO: 780804 - DNA, 20 bp, mouse
ggccccttagctgaaatttg

SEQ ID NO: 780805 - DNA, 20 bp, mouse
ggcggggcagggcggcctct

SEQ ID NO: 780806 - DNA, 20 bp, mouse
gggggcggagcgaatgaagt

SEQ ID NO: 780807 - DNA, 20 bp, mouse
gcctagaaagactccagaat

SEQ ID NO: 780808 - DNA, 20 bp, mouse
gatgggagaaagggtcctat

SEQ ID NO: 780809 - DNA, 20 bp, mouse
ggcggagcgaatgaagtggg

SEQ ID NO: 780810 - DNA, 20 bp, mouse
gccagaatgggcggagctag

SEQ ID NO: 780811 - DNA, 20 bp, mouse
gggaagttttagtctgagat

SEQ ID NO: 780812 - DNA, 20 bp, mouse
gccggtgccaaggaatgtgc

SEQ ID NO: 780813 - DNA, 20 bp, mouse
gtcacttgggatgaagggtc

SEQ ID NO: 780814 - DNA, 20 bp, mouse
ggaagagagggtggagttgc

SEQ ID NO: 780815 - DNA, 20 bp, mouse
gccaaggaatgtgctgggag

SEQ ID NO: 780816 - DNA, 20 bp, mouse
gagaagctgcagactggcgg

SEQ ID NO: 780817 - DNA, 20 bp, mouse
ggaacctaggctcagataag

SEQ ID NO: 780818 - DNA, 20 bp, mouse
ggaagtcccgggatgcgtcg

SEQ ID NO: 780819 - DNA, 20 bp, mouse
ggggagctgcgtcccaaact

SEQ ID NO: 780820 - DNA, 20 bp, mouse
gtcactccacgacgcatccc

SEQ ID NO: 780821 - DNA, 20 bp, mouse
ggtgcccagcgccgccctcc

SEQ ID NO: 780822 - DNA, 20 bp, mouse
gcaggcgagaagctgcagac

SEQ ID NO: 780823 - DNA, 20 bp, mouse
gagctgcagactggcggagg

SEQ ID NO: 780824 - DNA, 20 bp, mouse
gtagaaggcccagagaacct

SEQ ID NO: 780825 - DNA, 20 bp, mouse
gacgccccaagcccggaggg

SEQ ID NO: 780826 - DNA, 20 bp, mouse
gggtgggtgcgagggtctaa

SEQ ID NO: 780827 - DNA, 20 bp, mouse
gcggcgtcagtcaacttcct

SEQ ID NO: 780828 - DNA, 20 bp, mouse
gggtgcgagggtctaaaggt

SEQ ID NO: 780829 - DNA, 20 bp, mouse
ggctgtctcaagcccccgag

SEQ ID NO: 780830 - DNA, 20 bp, mouse
ggtagcagcagagtgtgcac

SEQ ID NO: 780831 - DNA, 20 bp, mouse
gcctcccctgggccgggaaa

SEQ ID NO: 780832 - DNA, 20 bp, mouse
ggaggaggggacaacccgga

SEQ ID NO: 780833 - DNA, 20 bp, mouse
gttgcaattaagaaggtctg

SEQ ID NO: 780834 - DNA, 20 bp, mouse
gaacttcctcggctgggctg

SEQ ID NO: 780835 - DNA, 20 bp, mouse
ggggctgggcagccctcccc

SEQ ID NO: 780836 - DNA, 20 bp, mouse
gggtaggagacgcaagacag

SEQ ID NO: 780837 - DNA, 20 bp, mouse
gggtcgcagcccgagaaggg

SEQ ID NO: 780838 - DNA, 20 bp, mouse
gagcggtcgcagcccgagaa

SEQ ID NO: 780839 - DNA, 20 bp, mouse
ggcgcccagggcgagagggt

SEQ ID NO: 780840 - DNA, 20 bp, mouse
gcacctccatccccccgccg

SEQ ID NO: 780841 - DNA, 20 bp, mouse
ggatgtgcgcgaggcgctgg

SEQ ID NO: 780842 - DNA, 20 bp, mouse
ggcgccggcggccgcgtctc

SEQ ID NO: 780843 - DNA, 20 bp, mouse
ggcgcagacaccctaacccc

SEQ ID NO: 780844 - DNA, 20 bp, mouse
gccgagaagggggggatggt

SEQ ID NO: 780845 - DNA, 20 bp, mouse
gggtgggcaagggtgggcga

SEQ ID NO: 780846 - DNA, 20 bp, mouse
gggcccgagcacagcgccgc

SEQ ID NO: 780847 - DNA, 20 bp, mouse
gagcccgcggcgctgtgctc

SEQ ID NO: 780848 - DNA, 20 bp, mouse
ggaaccgagcggccgggcag

SEQ ID NO: 780849 - DNA, 20 bp, mouse
gtgggtggggcgtcccggag

SEQ ID NO: 780850 - DNA, 20 bp, mouse
gacctcgctggagccctctg

SEQ ID NO: 780851 - DNA, 20 bp, mouse
gcagcctacggcaagtgggc

SEQ ID NO: 780852 - DNA, 20 bp, mouse
gcctacggcaagtgggctgg

SEQ ID NO: 780853 - DNA, 20 bp, mouse
gcgaagcgcgtcgcagcccg

SEQ ID NO: 780854 - DNA, 20 bp, mouse
gcccccagagggctccagcg

SEQ ID NO: 780855 - DNA, 20 bp, mouse
gaggaggggacggcgaggca

SEQ ID NO: 780856 - DNA, 20 bp, mouse
ggatctgggagctaccacag

SEQ ID NO: 780857 - DNA, 20 bp, mouse
gggcgcgcggggccagagtt

SEQ ID NO: 780858 - DNA, 20 bp, mouse
gaccacaggggaattgaaac

SEQ ID NO: 780859 - DNA, 20 bp, mouse
gcctgggcccggctcttaaa

SEQ ID NO: 780860 - DNA, 20 bp, mouse
ggggaattgtaacgggatct

SEQ ID NO: 780861 - DNA, 20 bp, mouse
gctacccaaggtctagttac

SEQ ID NO: 780862 - DNA, 20 bp, mouse
ggccccagtaactagacctt

SEQ ID NO: 780863 - DNA, 20 bp, mouse
ggcgcggggccagagttggg

SEQ ID NO: 780864 - DNA, 20 bp, mouse
ggaggcgttgcaccgagccc

SEQ ID NO: 780865 - DNA, 20 bp, mouse
gtgggaggaaacttttgcgc

SEQ ID NO: 780866 - DNA, 20 bp, mouse
gtgtgtcaggggcggaagaa

SEQ ID NO: 780867 - DNA, 20 bp, mouse
gagggccagcaaccctgaat

SEQ ID NO: 780868 - DNA, 20 bp, mouse
gcctgctaatgtccgattca

SEQ ID NO: 780869 - DNA, 20 bp, mouse
ggcggagcggcggtgctcgc

SEQ ID NO: 780870 - DNA, 20 bp, mouse
gcactcccgccttctctacc

SEQ ID NO: 780871 - DNA, 20 bp, mouse
gccggtgtcaggtgtgtcag

SEQ ID NO: 780872 - DNA, 20 bp, mouse
gcgcaggcgcagaaccgcga

SEQ ID NO: 780873 - DNA, 20 bp, mouse
ggtactgaggaacagctcac

SEQ ID NO: 780874 - DNA, 20 bp, mouse
gtctcgaatccagggctgta

SEQ ID NO: 780875 - DNA, 20 bp, mouse
ggagacccgggtagagaagg

SEQ ID NO: 780876 - DNA, 20 bp, mouse
ggggaggcagcggataaggg

SEQ ID NO: 780877 - DNA, 20 bp, mouse
gcaggtgcgcgcttcccatt

SEQ ID NO: 780878 - DNA, 20 bp, mouse
gaaggcaggaccaatcgcga

SEQ ID NO: 780879 - DNA, 20 bp, mouse
gtgagcgcgcgcacgtgccg

SEQ ID NO: 780880 - DNA, 20 bp, mouse
gcgcgcttcccattgggtgt

SEQ ID NO: 780881 - DNA, 20 bp, mouse
gcggataagggaggctgcgg

SEQ ID NO: 780882 - DNA, 20 bp, mouse
gcgcgcacgtgccgcggccg

SEQ ID NO: 780883 - DNA, 20 bp, mouse
gcgggggaggcagcggataa

SEQ ID NO: 780884 - DNA, 20 bp, mouse
gccctcccagcgaggctcgg

SEQ ID NO: 780885 - DNA, 20 bp, mouse
ggcgctccgcccacacccaa

SEQ ID NO: 780886 - DNA, 20 bp, mouse
gcgtgggcgggtcctgatgg

SEQ ID NO: 780887 - DNA, 20 bp, mouse
gtggcgtgggcgggtcctga

SEQ ID NO: 780888 - DNA, 20 bp, mouse
gaaccggagagcccagaaaa

SEQ ID NO: 780889 - DNA, 20 bp, mouse
ggcgcgccgcggggactcca

SEQ ID NO: 780890 - DNA, 20 bp, mouse
gttggaaaggcaccaggtag

SEQ ID NO: 780891 - DNA, 20 bp, mouse
gctctgggggcgggactcgg

SEQ ID NO: 780892 - DNA, 20 bp, mouse
gcgcgcgcgggaggagctac

SEQ ID NO: 780893 - DNA, 20 bp, mouse
gcaggcaagtggagcagacc

SEQ ID NO: 780894 - DNA, 20 bp, mouse
ggcaagtggagcagacctgg

SEQ ID NO: 780895 - DNA, 20 bp, mouse
gcagcggtccgcctgggaaa

SEQ ID NO: 780896 - DNA, 20 bp, mouse
gcggaagtgcgatacttcac

SEQ ID NO: 780897 - DNA, 20 bp, mouse
ggtaaaggcgagcaggaaaa

SEQ ID NO: 780898 - DNA, 20 bp, mouse
gacgggacggggcactaaag

SEQ ID NO: 780899 - DNA, 20 bp, mouse
ggtctcgcgcttcccacttc

SEQ ID NO: 780900 - DNA, 20 bp, mouse
ggctgtgtgcggcccggaag

SEQ ID NO: 780901 - DNA, 20 bp, mouse
ggcgaggcccgatactcacg

SEQ ID NO: 780902 - DNA, 20 bp, mouse
gtgacgagaaaagacgggac

SEQ ID NO: 780903 - DNA, 20 bp, mouse
ggccgcacacagccgtaaag

SEQ ID NO: 780904 - DNA, 20 bp, mouse
gggcgtcccgcgtgagtatc

SEQ ID NO: 780905 - DNA, 20 bp, mouse
gacggctgctttccggtggt

SEQ ID NO: 780906 - DNA, 20 bp, mouse
gagcagaaccggggtcctga

SEQ ID NO: 780907 - DNA, 20 bp, mouse
gctacaaagctggagtctgt

SEQ ID NO: 780908 - DNA, 20 bp, mouse
ggaggccaactctgctttga

SEQ ID NO: 780909 - DNA, 20 bp, mouse
gaaccggggtcctgatggtc

SEQ ID NO: 780910 - DNA, 20 bp, mouse
gcagaccttcaaagcagagt

SEQ ID NO: 780911 - DNA, 20 bp, mouse
gaccgtcattctttaggaaa

SEQ ID NO: 780912 - DNA, 20 bp, mouse
gcccaatgctatagaagaaa

SEQ ID NO: 780913 - DNA, 20 bp, mouse
ggctcagaccgtcattcttt

SEQ ID NO: 780914 - DNA, 20 bp, mouse
ggttctgctcattaaggctt

SEQ ID NO: 780915 - DNA, 20 bp, mouse
gccaggctggattctcatac

SEQ ID NO: 780916 - DNA, 20 bp, mouse
gtgagcccaggccccggggt

SEQ ID NO: 780917 - DNA, 20 bp, mouse
gtgggcggtaccgttgtctg

SEQ ID NO: 780918 - DNA, 20 bp, mouse
gtggggggaggagcgaatag

SEQ ID NO: 780919 - DNA, 20 bp, mouse
gcagagaggggcaattgcgc

SEQ ID NO: 780920 - DNA, 20 bp, mouse
gaggccaggggcaaatagag

SEQ ID NO: 780921 - DNA, 20 bp, mouse
ggagcgaatagaggctactg

SEQ ID NO: 780922 - DNA, 20 bp, mouse
gcctcggcctgcgtcatgtc

SEQ ID NO: 780923 - DNA, 20 bp, mouse
gtgcgcaggcgcccgcaggg

SEQ ID NO: 780924 - DNA, 20 bp, mouse
gcaggccgaggcggaagcga

SEQ ID NO: 780925 - DNA, 20 bp, mouse
gctagcacatgcgaattcac

SEQ ID NO: 780926 - DNA, 20 bp, mouse
gggcgcgcgaactgctcttg

SEQ ID NO: 780927 - DNA, 20 bp, mouse
ggtcctccccagaaactttc

SEQ ID NO: 780928 - DNA, 20 bp, mouse
ggcgcccgcccactacgatt

SEQ ID NO: 780929 - DNA, 20 bp, mouse
ggcggtccctgggcaccctg

SEQ ID NO: 780930 - DNA, 20 bp, mouse
gagccggaaagtttctgggg

SEQ ID NO: 780931 - DNA, 20 bp, mouse
ggggaggacactgcggtccc

SEQ ID NO: 780932 - DNA, 20 bp, mouse
gttcgcagccggaaagtttc

SEQ ID NO: 780933 - DNA, 20 bp, mouse
gtcagggcgctgccgtcgat

SEQ ID NO: 780934 - DNA, 20 bp, mouse
gttccggctgcgaaccgggt

SEQ ID NO: 780935 - DNA, 20 bp, mouse
gaagaaggcggcttgaaggt

SEQ ID NO: 780936 - DNA, 20 bp, mouse
gagtgactggggaaaacttg

SEQ ID NO: 780937 - DNA, 20 bp, mouse
gaggctggatcaggggtcgg

SEQ ID NO: 780938 - DNA, 20 bp, mouse
gggcctagaaatcacttccg

SEQ ID NO: 780939 - DNA, 20 bp, mouse
ggaactgaacggcctccagg

SEQ ID NO: 780940 - DNA, 20 bp, mouse
ggaaacttccaaggtggcgc

SEQ ID NO: 780941 - DNA, 20 bp, mouse
gaggccggggttagagaggt

SEQ ID NO: 780942 - DNA, 20 bp, mouse
gacagtgaaacggtgtcttg

SEQ ID NO: 780943 - DNA, 20 bp, mouse
gagacctggaagatgaacgt

SEQ ID NO: 780944 - DNA, 20 bp, mouse
ggaggaagaccggaactgaa

SEQ ID NO: 780945 - DNA, 20 bp, mouse
ggtgacgggtgaagggtgat

SEQ ID NO: 780946 - DNA, 20 bp, mouse
gcggccctcctgcgaggaca

SEQ ID NO: 780947 - DNA, 20 bp, mouse
gggggtggccctgtcctcgc

SEQ ID NO: 780948 - DNA, 20 bp, mouse
gggcccagagcggcctctgc

SEQ ID NO: 780949 - DNA, 20 bp, mouse
gtgtccagcagaggccgctc

SEQ ID NO: 780950 - DNA, 20 bp, mouse
ggcggcctctgctggacagc

SEQ ID NO: 780951 - DNA, 20 bp, mouse
gctcctggcgcacaggtccc

SEQ ID NO: 780952 - DNA, 20 bp, mouse
gggtgggaggggtttggcga

SEQ ID NO: 780953 - DNA, 20 bp, mouse
gcccacccggccctcctgcg

SEQ ID NO: 780954 - DNA, 20 bp, mouse
gaggcaaaacaaagtgtgag

SEQ ID NO: 780955 - DNA, 20 bp, mouse
gcctcgaggtcgcctctcta

SEQ ID NO: 780956 - DNA, 20 bp, mouse
gccctccgggctgcctagaa

SEQ ID NO: 780957 - DNA, 20 bp, mouse
ggatcaaccaggttcaggac

SEQ ID NO: 780958 - DNA, 20 bp, mouse
gactggaattatagacccag

SEQ ID NO: 780959 - DNA, 20 bp, mouse
gaaacagcacaggacacttc

SEQ ID NO: 780960 - DNA, 20 bp, mouse
gagcagcgtggggatgtcgg

SEQ ID NO: 780961 - DNA, 20 bp, mouse
ggatcaagagacatatggac

SEQ ID NO: 780962 - DNA, 20 bp, mouse
ggggcggagcccgggccctc

SEQ ID NO: 780963 - DNA, 20 bp, mouse
gctcttgatcaaccaggttc

SEQ ID NO: 780964 - DNA, 20 bp, mouse
gtaggcagcccggagggccc

SEQ ID NO: 780965 - DNA, 20 bp, mouse
gagatctgacgcaggcgcag

SEQ ID NO: 780966 - DNA, 20 bp, mouse
ggggacccggggaatctgac

SEQ ID NO: 780967 - DNA, 20 bp, mouse
gcgccctggccccttcccag

SEQ ID NO: 780968 - DNA, 20 bp, mouse
gggtctctgcctctgggaag

SEQ ID NO: 780969 - DNA, 20 bp, mouse
gggcggggcctcagctcata

SEQ ID NO: 780970 - DNA, 20 bp, mouse
gcggctctgcacgcttgcgg

SEQ ID NO: 780971 - DNA, 20 bp, mouse
gggcagagaccagcgtgcac

SEQ ID NO: 780972 - DNA, 20 bp, mouse
gtgggacaaaccgacaaaag

SEQ ID NO: 780973 - DNA, 20 bp, mouse
gcctccgcgcgcgagcttgg

SEQ ID NO: 780974 - DNA, 20 bp, mouse
gggcctcagctcatagggcg

SEQ ID NO: 780975 - DNA, 20 bp, mouse
ggctgggacccaacctccca

SEQ ID NO: 780976 - DNA, 20 bp, mouse
gtagctaagaggctagtggg

SEQ ID NO: 780977 - DNA, 20 bp, mouse
gagaaagtctaggagacatc

SEQ ID NO: 780978 - DNA, 20 bp, mouse
gaagaggctagtgggtggtt

SEQ ID NO: 780979 - DNA, 20 bp, mouse
gtggctaatcacccttccta

SEQ ID NO: 780980 - DNA, 20 bp, mouse
gcagaagcctagagattctt

SEQ ID NO: 780981 - DNA, 20 bp, mouse
gccccaccccaagaatctct

SEQ ID NO: 780982 - DNA, 20 bp, mouse
gtgctcatgtctgggaccca

SEQ ID NO: 780983 - DNA, 20 bp, mouse
gccactagctaagaggctag

SEQ ID NO: 780984 - DNA, 20 bp, mouse
gagtgggtggttcggcagaa

SEQ ID NO: 780985 - DNA, 20 bp, mouse
ggtctaccccactagctaag

SEQ ID NO: 780986 - DNA, 20 bp, mouse
gacgtggtgggtatgatggc

SEQ ID NO: 780987 - DNA, 20 bp, mouse
gagcacgcgcggaagttcca

SEQ ID NO: 780988 - DNA, 20 bp, mouse
gcaaactcgctccgcctcta

SEQ ID NO: 780989 - DNA, 20 bp, mouse
gcggcccgcgacagcacgcg

SEQ ID NO: 780990 - DNA, 20 bp, mouse
ggatcacgtggtgggtatga

SEQ ID NO: 780991 - DNA, 20 bp, mouse
gaggcggagcgagtttgcgg

SEQ ID NO: 780992 - DNA, 20 bp, mouse
gcggaagtcgggaggttcga

SEQ ID NO: 780993 - DNA, 20 bp, mouse
ggggcgggaccgccactgat

SEQ ID NO: 780994 - DNA, 20 bp, mouse
gtccaagggcgccatagagg

SEQ ID NO: 780995 - DNA, 20 bp, mouse
gcgtgatcgtcaagcgtggc

SEQ ID NO: 780996 - DNA, 20 bp, mouse
ggacccgcgccccgcatctc

SEQ ID NO: 780997 - DNA, 20 bp, mouse
gagccggcgcccttgtctta

SEQ ID NO: 780998 - DNA, 20 bp, mouse
ggagccgcgcggtccccagc

SEQ ID NO: 780999 - DNA, 20 bp, mouse
gggaccgcgcggctcgacgg

SEQ ID NO: 781000 - DNA, 20 bp, mouse
gtggggaccgcgcggctcga

SEQ ID NO: 781001 - DNA, 20 bp, mouse
ggcggggcgcgggtcctcac

SEQ ID NO: 781002 - DNA, 20 bp, mouse
ggggctccggccgggaaaac

SEQ ID NO: 781003 - DNA, 20 bp, mouse
gggcgacccggcgtgcctcg

SEQ ID NO: 781004 - DNA, 20 bp, mouse
gggccggactcccgcgtctg

SEQ ID NO: 781005 - DNA, 20 bp, mouse
ggcgacgcctcgaggcacgc

SEQ ID NO: 781006 - DNA, 20 bp, mouse
gtctggagctgctaaggagg

SEQ ID NO: 781007 - DNA, 20 bp, mouse
gcacctcgctatcccaggat

SEQ ID NO: 781008 - DNA, 20 bp, mouse
gtgcgggcggggcccagctc

SEQ ID NO: 781009 - DNA, 20 bp, mouse
ggaggctagagctcgggtgg

SEQ ID NO: 781010 - DNA, 20 bp, mouse
gggcctggaggctagagctc

SEQ ID NO: 781011 - DNA, 20 bp, mouse
gaggagaacaaagtgcctgg

SEQ ID NO: 781012 - DNA, 20 bp, mouse
gagctctggagctgctaagg

SEQ ID NO: 781013 - DNA, 20 bp, mouse
gtgtagctcaggtggagtgc

SEQ ID NO: 781014 - DNA, 20 bp, mouse
gaagagccctcgaccagcag

SEQ ID NO: 781015 - DNA, 20 bp, mouse
ggctcgggtggaggattgac

SEQ ID NO: 781016 - DNA, 20 bp, mouse
gcgcgcccgcccacaggtcc

SEQ ID NO: 781017 - DNA, 20 bp, mouse
gtcccggggcggtttccact

SEQ ID NO: 781018 - DNA, 20 bp, mouse
ggggactggcgggacccgag

SEQ ID NO: 781019 - DNA, 20 bp, mouse
ggcccgcccacaggtcccgg

SEQ ID NO: 781020 - DNA, 20 bp, mouse
gtggggcggccaggactgat

SEQ ID NO: 781021 - DNA, 20 bp, mouse
ggctcagtgcggggaaacac

SEQ ID NO: 781022 - DNA, 20 bp, mouse
gtgcggggaaacacgggatc

SEQ ID NO: 781023 - DNA, 20 bp, mouse
ggggcggtttccacttgggg

SEQ ID NO: 781024 - DNA, 20 bp, mouse
ggggatcctccgggacctgt

SEQ ID NO: 781025 - DNA, 20 bp, mouse
gcggggcagctgggatcctc

SEQ ID NO: 781026 - DNA, 20 bp, mouse
gagagcagggctctacgctt

SEQ ID NO: 781027 - DNA, 20 bp, mouse
gtagaccggccgccactata

SEQ ID NO: 781028 - DNA, 20 bp, mouse
gggggagagtagtctgaatt

SEQ ID NO: 781029 - DNA, 20 bp, mouse
gaggcatccgccccgactcg

SEQ ID NO: 781030 - DNA, 20 bp, mouse
ggaggcatccgctccggcga

SEQ ID NO: 781031 - DNA, 20 bp, mouse
ggccagcagtgcgagttcaa

SEQ ID NO: 781032 - DNA, 20 bp, mouse
gccggtctacatcctgaaag

SEQ ID NO: 781033 - DNA, 20 bp, mouse
ggcgagggaggcatccgctc

SEQ ID NO: 781034 - DNA, 20 bp, mouse
ggatgcctccctcgccggag

SEQ ID NO: 781035 - DNA, 20 bp, mouse
gacatcctgaaagtgggcgg

SEQ ID NO: 781036 - DNA, 20 bp, mouse
gaggggccagtcagtccgag

SEQ ID NO: 781037 - DNA, 20 bp, mouse
gtcacgaagggtcgctagat

SEQ ID NO: 781038 - DNA, 20 bp, mouse
gccctcatgcagctttgact

SEQ ID NO: 781039 - DNA, 20 bp, mouse
gaacccagagccaaaatcac

SEQ ID NO: 781040 - DNA, 20 bp, mouse
gaacgcctgactagcaggga

SEQ ID NO: 781041 - DNA, 20 bp, mouse
gtgccctgcagaggactcta

SEQ ID NO: 781042 - DNA, 20 bp, mouse
gcagtcagtccgagcggctt

SEQ ID NO: 781043 - DNA, 20 bp, mouse
gccagcttttggccgctagt

SEQ ID NO: 781044 - DNA, 20 bp, mouse
gctagctgaaggctcacgaa

SEQ ID NO: 781045 - DNA, 20 bp, mouse
gataacagccacctcttcca

SEQ ID NO: 781046 - DNA, 20 bp, mouse
gcggacctacgccccttaga

SEQ ID NO: 781047 - DNA, 20 bp, mouse
gtcctgcgactgtccagctg

SEQ ID NO: 781048 - DNA, 20 bp, mouse
gcctgaacgctaggctgatc

SEQ ID NO: 781049 - DNA, 20 bp, mouse
gtccccagctggacagtcgc

SEQ ID NO: 781050 - DNA, 20 bp, mouse
gtcgaatctgggagacttga

SEQ ID NO: 781051 - DNA, 20 bp, mouse
gatctgggagacttgatgga

SEQ ID NO: 781052 - DNA, 20 bp, mouse
gtacggattggggttaaata

SEQ ID NO: 781053 - DNA, 20 bp, mouse
gtctcccagattcgaatttt

SEQ ID NO: 781054 - DNA, 20 bp, mouse
gtccagctggggagaaggcg

SEQ ID NO: 781055 - DNA, 20 bp, mouse
ggtcgcaggacatccctcta

SEQ ID NO: 781056 - DNA, 20 bp, mouse
gcgccctggctagcaccctg

SEQ ID NO: 781057 - DNA, 20 bp, mouse
gtcactgcgcacgcgcgccc

SEQ ID NO: 781058 - DNA, 20 bp, mouse
ggtacagcacgcaccgcggt

SEQ ID NO: 781059 - DNA, 20 bp, mouse
gcaccgcggttggtcggaag

SEQ ID NO: 781060 - DNA, 20 bp, mouse
gcaccccagggtgctagcca

SEQ ID NO: 781061 - DNA, 20 bp, mouse
gggaagaggacacctgatcg

SEQ ID NO: 781062 - DNA, 20 bp, mouse
gcgcggtgcgtgctgtacct

SEQ ID NO: 781063 - DNA, 20 bp, mouse
gcgcagtgatccagagttga

SEQ ID NO: 781064 - DNA, 20 bp, mouse
gtgcccgagaccgcacgctg

SEQ ID NO: 781065 - DNA, 20 bp, mouse
gtgggcgtgtccccacccca

SEQ ID NO: 781066 - DNA, 20 bp, mouse
gcgggcccctcgttttccta

SEQ ID NO: 781067 - DNA, 20 bp, mouse
ggacggccgtaggaaaacga

SEQ ID NO: 781068 - DNA, 20 bp, mouse
gggaaaacgaggggcccgaa

SEQ ID NO: 781069 - DNA, 20 bp, mouse
gcagctgggcggtcacatct

SEQ ID NO: 781070 - DNA, 20 bp, mouse
ggggaccgctggagagcgat

SEQ ID NO: 781071 - DNA, 20 bp, mouse
gcacgcgcgcacacccctcg

SEQ ID NO: 781072 - DNA, 20 bp, mouse
gagcggggctcgcccctctc

SEQ ID NO: 781073 - DNA, 20 bp, mouse
gccacccccgcccggactga

SEQ ID NO: 781074 - DNA, 20 bp, mouse
ggctgccgatcgctctccag

SEQ ID NO: 781075 - DNA, 20 bp, mouse
gacaatggatggtgatgaca

SEQ ID NO: 781076 - DNA, 20 bp, mouse
ggtagcggggacggcgggtc

SEQ ID NO: 781077 - DNA, 20 bp, mouse
ggccgtacgagtagcgggga

SEQ ID NO: 781078 - DNA, 20 bp, mouse
ggctctgcggagaacaagga

SEQ ID NO: 781079 - DNA, 20 bp, mouse
gagccggggcaggggaaaca

SEQ ID NO: 781080 - DNA, 20 bp, mouse
ggtcggaagcatgcagggat

SEQ ID NO: 781081 - DNA, 20 bp, mouse
gggggacggcgggtcgggac

SEQ ID NO: 781082 - DNA, 20 bp, mouse
ggactccctccatcccacag

SEQ ID NO: 781083 - DNA, 20 bp, mouse
gagccagacgcggatagcca

SEQ ID NO: 781084 - DNA, 20 bp, mouse
gcccgctactcgtacggctg

SEQ ID NO: 781085 - DNA, 20 bp, mouse
gtacgagtagcggggacggc

SEQ ID NO: 781086 - DNA, 20 bp, mouse
gcgcacgccctggccaccta

SEQ ID NO: 781087 - DNA, 20 bp, mouse
ggcaaggctctcccgaccat

SEQ ID NO: 781088 - DNA, 20 bp, mouse
gtacgcacctaaagcagggg

SEQ ID NO: 781089 - DNA, 20 bp, mouse
ggccctggccacctatggtc

SEQ ID NO: 781090 - DNA, 20 bp, mouse
gaaagcaggggaggcgacct

SEQ ID NO: 781091 - DNA, 20 bp, mouse
gaggggaggcgacctgggca

SEQ ID NO: 781092 - DNA, 20 bp, mouse
gcgtgcgcccgctctgcttc

SEQ ID NO: 781093 - DNA, 20 bp, mouse
ggaacagggaagcgcccctg

SEQ ID NO: 781094 - DNA, 20 bp, mouse
gagcacaagctggcgatccc

SEQ ID NO: 781095 - DNA, 20 bp, mouse
gctccgacccggaagcagag

SEQ ID NO: 781096 - DNA, 20 bp, mouse
gggcacttccggaatcttgg

SEQ ID NO: 781097 - DNA, 20 bp, mouse
gggaaagccgcactcacggg

SEQ ID NO: 781098 - DNA, 20 bp, mouse
gagaggctggagaggttttc

SEQ ID NO: 781099 - DNA, 20 bp, mouse
ggcgggagagcgaggctctt

SEQ ID NO: 781100 - DNA, 20 bp, mouse
gatgctccggtcccacgctc

SEQ ID NO: 781101 - DNA, 20 bp, mouse
gcagcctctctccagagcgt

SEQ ID NO: 781102 - DNA, 20 bp, mouse
ggaactggagagcacggatg

SEQ ID NO: 781103 - DNA, 20 bp, mouse
gaagccgcactcacgggagg

SEQ ID NO: 781104 - DNA, 20 bp, mouse
gggtcccacgctctggagag

SEQ ID NO: 781105 - DNA, 20 bp, mouse
gccgccccctcccgtgagtg

SEQ ID NO: 781106 - DNA, 20 bp, mouse
gcctggggcccccgtgccca

SEQ ID NO: 781107 - DNA, 20 bp, mouse
gcagctcctcgcagggcgga

SEQ ID NO: 781108 - DNA, 20 bp, mouse
ggcggagggcggcgcgaggg

SEQ ID NO: 781109 - DNA, 20 bp, mouse
gctcgtagccagggcagccc

SEQ ID NO: 781110 - DNA, 20 bp, mouse
gggcgcagcagctcctcgca

SEQ ID NO: 781111 - DNA, 20 bp, mouse
gcccagcaagcggcaagcca

SEQ ID NO: 781112 - DNA, 20 bp, mouse
ggctgggggctatagacgca

SEQ ID NO: 781113 - DNA, 20 bp, mouse
ggcagcagctcctcgcaggg

SEQ ID NO: 781114 - DNA, 20 bp, mouse
gcagggcatcctcgtagcca

SEQ ID NO: 781115 - DNA, 20 bp, mouse
gaggggcaagtgcatgctag

SEQ ID NO: 781116 - DNA, 20 bp, mouse
gcggtgaggctgcacaaaag

SEQ ID NO: 781117 - DNA, 20 bp, mouse
gacctcggggtcagtaggca

SEQ ID NO: 781118 - DNA, 20 bp, mouse
gtgtgggactaattgattct

SEQ ID NO: 781119 - DNA, 20 bp, mouse
gcgtgcctggcactacgcgc

SEQ ID NO: 781120 - DNA, 20 bp, mouse
gggaccctgcgcgtagtgcc

SEQ ID NO: 781121 - DNA, 20 bp, mouse
gcccccgcccgcaatacagc

SEQ ID NO: 781122 - DNA, 20 bp, mouse
gcctactgaccccgaggtcc

SEQ ID NO: 781123 - DNA, 20 bp, mouse
gtagtcctgcgccaggattc

SEQ ID NO: 781124 - DNA, 20 bp, mouse
ggcgtagtgccaggcacgac

SEQ ID NO: 781125 - DNA, 20 bp, mouse
gtctgaccgtacatgtttgt

SEQ ID NO: 781126 - DNA, 20 bp, mouse
ggagagaccccgtgatgcca

SEQ ID NO: 781127 - DNA, 20 bp, mouse
gtggattgatggagaggcgg

SEQ ID NO: 781128 - DNA, 20 bp, mouse
gctgtctgcagccaccgggg

SEQ ID NO: 781129 - DNA, 20 bp, mouse
gcttggaagactaggggcag

SEQ ID NO: 781130 - DNA, 20 bp, mouse
gcaagactccatggcatcac

SEQ ID NO: 781131 - DNA, 20 bp, mouse
gtggttggagggccgctcag

SEQ ID NO: 781132 - DNA, 20 bp, mouse
ggtctggattgatggagagg

SEQ ID NO: 781133 - DNA, 20 bp, mouse
gcagtctttcagtggattta

SEQ ID NO: 781134 - DNA, 20 bp, mouse
gggttctggcagtctttcag

SEQ ID NO: 781135 - DNA, 20 bp, mouse
gctagtcttccaagactcca

SEQ ID NO: 781136 - DNA, 20 bp, mouse
gcgcgcgcaaacagttgcta

SEQ ID NO: 781137 - DNA, 20 bp, mouse
gaggctctgtagtgggtgtc

SEQ ID NO: 781138 - DNA, 20 bp, mouse
gcgagcccgcccagggagat

SEQ ID NO: 781139 - DNA, 20 bp, mouse
ggcggggcagcaacagtcgc

SEQ ID NO: 781140 - DNA, 20 bp, mouse
gacttggagtggggcgtgga

SEQ ID NO: 781141 - DNA, 20 bp, mouse
gacccactacagagcctcgg

SEQ ID NO: 781142 - DNA, 20 bp, mouse
gggcctaaggcgacagattc

SEQ ID NO: 781143 - DNA, 20 bp, mouse
gccctcgggacgggactccc

SEQ ID NO: 781144 - DNA, 20 bp, mouse
gagggtgtctggttggttct

SEQ ID NO: 781145 - DNA, 20 bp, mouse
gtacgacggccacctttcca

SEQ ID NO: 781146 - DNA, 20 bp, mouse
gaacttaggagtctatcctg

SEQ ID NO: 781147 - DNA, 20 bp, mouse
gccctctgtcccacctgcaa

SEQ ID NO: 781148 - DNA, 20 bp, mouse
gatggcttagatcatggtga

SEQ ID NO: 781149 - DNA, 20 bp, mouse
gagctacagggaaatcagta

SEQ ID NO: 781150 - DNA, 20 bp, mouse
ggaaaaataaaggtattggt

SEQ ID NO: 781151 - DNA, 20 bp, mouse
gtcctttgcaggtgggacag

SEQ ID NO: 781152 - DNA, 20 bp, mouse
ggagagggtgacctgtcctt

SEQ ID NO: 781153 - DNA, 20 bp, mouse
gggctcttttctcacttgag

SEQ ID NO: 781154 - DNA, 20 bp, mouse
gtgtcgttctcctttgcagg

SEQ ID NO: 781155 - DNA, 20 bp, mouse
gtggagaactcaccatgaag

SEQ ID NO: 781156 - DNA, 20 bp, mouse
gacacagaagagataaggga

SEQ ID NO: 781157 - DNA, 20 bp, mouse
gagtctacatgcaactcccc

SEQ ID NO: 781158 - DNA, 20 bp, mouse
gttgcaattggggagttcaa

SEQ ID NO: 781159 - DNA, 20 bp, mouse
ggagttgcatgtagactatt

SEQ ID NO: 781160 - DNA, 20 bp, mouse
gtcccacattatcatacatt

SEQ ID NO: 781161 - DNA, 20 bp, mouse
gcaagggtgaaggaagaaat

SEQ ID NO: 781162 - DNA, 20 bp, mouse
gggaaatgtttggtcatcct

SEQ ID NO: 781163 - DNA, 20 bp, mouse
gacttctctctacactaagt

SEQ ID NO: 781164 - DNA, 20 bp, mouse
gtgtgactctgaattacaag

SEQ ID NO: 781165 - DNA, 20 bp, mouse
gaagttccctgcacagctta

SEQ ID NO: 781166 - DNA, 20 bp, mouse
gcacgcgcgggccgtcggag

SEQ ID NO: 781167 - DNA, 20 bp, mouse
gcggcgggaaagagatccct

SEQ ID NO: 781168 - DNA, 20 bp, mouse
ggaggaggagccgcaagccg

SEQ ID NO: 781169 - DNA, 20 bp, mouse
gtgtgcagttaggaaaacgg

SEQ ID NO: 781170 - DNA, 20 bp, mouse
gtctccgcccaatcagtgac

SEQ ID NO: 781171 - DNA, 20 bp, mouse
ggtgcgcagtgtctcgccta

SEQ ID NO: 781172 - DNA, 20 bp, mouse
gaccaagtcaaggcaccccg

SEQ ID NO: 781173 - DNA, 20 bp, mouse
ggaggttcccgtcactgatt

SEQ ID NO: 781174 - DNA, 20 bp, mouse
gaaagccttgtgaatgtcac

SEQ ID NO: 781175 - DNA, 20 bp, mouse
gcggggacagatttggcgtt

SEQ ID NO: 781176 - DNA, 20 bp, mouse
gcctgaggcaaatctggggt

SEQ ID NO: 781177 - DNA, 20 bp, mouse
gcaggtggcgccatgttcca

SEQ ID NO: 781178 - DNA, 20 bp, mouse
gttctgcggcagtgtcagtc

SEQ ID NO: 781179 - DNA, 20 bp, mouse
gggcagcgtggttggttctg

SEQ ID NO: 781180 - DNA, 20 bp, mouse
gcaggacctgaggcaaatct

SEQ ID NO: 781181 - DNA, 20 bp, mouse
gcagtgtcagtcaggacctg

SEQ ID NO: 781182 - DNA, 20 bp, mouse
gctgggcggggcttaagatg

SEQ ID NO: 781183 - DNA, 20 bp, mouse
ggaaccaaccacgctgcccc

SEQ ID NO: 781184 - DNA, 20 bp, mouse
ggttccaggggcagcgtggt

SEQ ID NO: 781185 - DNA, 20 bp, mouse
gaaggcagggggggccctgg

SEQ ID NO: 781186 - DNA, 20 bp, mouse
ggatgcgcacgtgctgagtc

SEQ ID NO: 781187 - DNA, 20 bp, mouse
gagtgggggcaggaagcgag

SEQ ID NO: 781188 - DNA, 20 bp, mouse
gggtggggaggcggaggatc

SEQ ID NO: 781189 - DNA, 20 bp, mouse
gtcctccgctgggtgagggg

SEQ ID NO: 781190 - DNA, 20 bp, mouse
ggggacgtgcatcctccgct

SEQ ID NO: 781191 - DNA, 20 bp, mouse
gcccccccctcacccagcgg

SEQ ID NO: 781192 - DNA, 20 bp, mouse
ggggttgtataaatagggaa

SEQ ID NO: 781193 - DNA, 20 bp, mouse
ggcgttcggcacaaagaaag

SEQ ID NO: 781194 - DNA, 20 bp, mouse
gggggggggttgtataaata

SEQ ID NO: 781195 - DNA, 20 bp, mouse
gaaagcagcgagctcggcgt

SEQ ID NO: 781196 - DNA, 20 bp, mouse
gggccgaagcggggcggaaa

SEQ ID NO: 781197 - DNA, 20 bp, mouse
ggtccctgcggcccgaaagg

SEQ ID NO: 781198 - DNA, 20 bp, mouse
gctgagtgcgattcccggga

SEQ ID NO: 781199 - DNA, 20 bp, mouse
ggaaccgagcggggccgaag

SEQ ID NO: 781200 - DNA, 20 bp, mouse
gggaaagggccgagtccctg

SEQ ID NO: 781201 - DNA, 20 bp, mouse
ggacctgggtgcgacgggga

SEQ ID NO: 781202 - DNA, 20 bp, mouse
gcaggctcgcaacttcactg

SEQ ID NO: 781203 - DNA, 20 bp, mouse
gccagccccggcaaactcgc

SEQ ID NO: 781204 - DNA, 20 bp, mouse
ggagagagaggggcgtggat

SEQ ID NO: 781205 - DNA, 20 bp, mouse
gtgcaaggaagcacacgggg

SEQ ID NO: 781206 - DNA, 20 bp, mouse
ggggacgccaggctcggtga

SEQ ID NO: 781207 - DNA, 20 bp, mouse
ggaagccaagaactaggagg

SEQ ID NO: 781208 - DNA, 20 bp, mouse
gtacccctcctcctagttct

SEQ ID NO: 781209 - DNA, 20 bp, mouse
gggggtaagggttccggaga

SEQ ID NO: 781210 - DNA, 20 bp, mouse
gagggtaagagaaaggcgga

SEQ ID NO: 781211 - DNA, 20 bp, mouse
ggaggggtagagtttctggg

SEQ ID NO: 781212 - DNA, 20 bp, mouse
gttggaaggggcatcgagga

SEQ ID NO: 781213 - DNA, 20 bp, mouse
ggaggaggggtagagtttct

SEQ ID NO: 781214 - DNA, 20 bp, mouse
gtagagtttctgggcgggga

SEQ ID NO: 781215 - DNA, 20 bp, mouse
ggaggaagggtggtccacag

SEQ ID NO: 781216 - DNA, 20 bp, mouse
ggcacgccgcggcgaccgaa

SEQ ID NO: 781217 - DNA, 20 bp, mouse
gtgcagccgcaacccacctg

SEQ ID NO: 781218 - DNA, 20 bp, mouse
gaggcagcctaggagccgag

SEQ ID NO: 781219 - DNA, 20 bp, mouse
gcgggcgccgctcggctcct

SEQ ID NO: 781220 - DNA, 20 bp, mouse
gcggccggagactggagcct

SEQ ID NO: 781221 - DNA, 20 bp, mouse
gcgcccgcttggacatcccg

SEQ ID NO: 781222 - DNA, 20 bp, mouse
gggcgaccgaagggccagga

SEQ ID NO: 781223 - DNA, 20 bp, mouse
gcggcccccgcccccggaaa

SEQ ID NO: 781224 - DNA, 20 bp, mouse
gcggcccgagggcgccagga

SEQ ID NO: 781225 - DNA, 20 bp, mouse
gccagagctgaggccgggta

SEQ ID NO: 781226 - DNA, 20 bp, mouse
gcctggggaccgtcagggat

SEQ ID NO: 781227 - DNA, 20 bp, mouse
gtccccctctgggtcggcgg

SEQ ID NO: 781228 - DNA, 20 bp, mouse
ggcgaagatcgggtgaggga

SEQ ID NO: 781229 - DNA, 20 bp, mouse
gggaggcctggggaccgtca

SEQ ID NO: 781230 - DNA, 20 bp, mouse
ggcaccgcgaagatcgggtg

SEQ ID NO: 781231 - DNA, 20 bp, mouse
gtctcaagagaagggtggac

SEQ ID NO: 781232 - DNA, 20 bp, mouse
gggcctccgccgacccagag

SEQ ID NO: 781233 - DNA, 20 bp, mouse
gagctagtccccctctgggt

SEQ ID NO: 781234 - DNA, 20 bp, mouse
gtagtccccctctgggtcgg

SEQ ID NO: 781235 - DNA, 20 bp, mouse
gagccagtgaggatggaaaa

SEQ ID NO: 781236 - DNA, 20 bp, mouse
gtaccctgaaggaagtatag

SEQ ID NO: 781237 - DNA, 20 bp, mouse
ggaaggacacagccggtcac

SEQ ID NO: 781238 - DNA, 20 bp, mouse
ggaggagggaagtgtgcatg

SEQ ID NO: 781239 - DNA, 20 bp, mouse
gtgcctctatacttccttca

SEQ ID NO: 781240 - DNA, 20 bp, mouse
gccccgcagaaggacacagc

SEQ ID NO: 781241 - DNA, 20 bp, mouse
gagtatagaggcattcagac

SEQ ID NO: 781242 - DNA, 20 bp, mouse
gaccggctgtgtccttctgc

SEQ ID NO: 781243 - DNA, 20 bp, mouse
ggactctgaagccccgcaga

SEQ ID NO: 781244 - DNA, 20 bp, mouse
gggcttcagagtccaccttg

SEQ ID NO: 781245 - DNA, 20 bp, mouse
gtgtgggttaccctgcctca

SEQ ID NO: 781246 - DNA, 20 bp, mouse
gcgggccaagaaccagggaa

SEQ ID NO: 781247 - DNA, 20 bp, mouse
gcactgcgggccaagaacca

SEQ ID NO: 781248 - DNA, 20 bp, mouse
gagtgcggggcggtgcgccg

SEQ ID NO: 781249 - DNA, 20 bp, mouse
gcgggggcgcgacgtgtctg

SEQ ID NO: 781250 - DNA, 20 bp, mouse
gctgcccagcgtgccagacg

SEQ ID NO: 781251 - DNA, 20 bp, mouse
gaggcctggtccgccccgtc

SEQ ID NO: 781252 - DNA, 20 bp, mouse
gctggccgaaggtgtgcaag

SEQ ID NO: 781253 - DNA, 20 bp, mouse
gccgccccgtctggcacgct

SEQ ID NO: 781254 - DNA, 20 bp, mouse
gtagtcgcgcgcctagggga

SEQ ID NO: 781255 - DNA, 20 bp, mouse
gccgccttggacttttatag

SEQ ID NO: 781256 - DNA, 20 bp, mouse
gaagagagggagtctcccgc

SEQ ID NO: 781257 - DNA, 20 bp, mouse
gcagacccctgaagactctt

SEQ ID NO: 781258 - DNA, 20 bp, mouse
gcccctgaagactcttagga

SEQ ID NO: 781259 - DNA, 20 bp, mouse
gcgcgcccggcaaccaatga

SEQ ID NO: 781260 - DNA, 20 bp, mouse
ggggcttaagccgaacctca

SEQ ID NO: 781261 - DNA, 20 bp, mouse
ggctgggcgtgtgcagttac

SEQ ID NO: 781262 - DNA, 20 bp, mouse
gagaccacgaggggtcgaaa

SEQ ID NO: 781263 - DNA, 20 bp, mouse
ggccagagttgggttcagct

SEQ ID NO: 781264 - DNA, 20 bp, mouse
gaggggtcgaaagggatctc

SEQ ID NO: 781265 - DNA, 20 bp, mouse
gcaaccaatgagggcattgc

SEQ ID NO: 781266 - DNA, 20 bp, mouse
ggctccggatcatgcatgga

SEQ ID NO: 781267 - DNA, 20 bp, mouse
ggcactgtcacaaagtgaca

SEQ ID NO: 781268 - DNA, 20 bp, mouse
gaaaacgcagctcccctcga

SEQ ID NO: 781269 - DNA, 20 bp, mouse
ggcactcggctccccttcga

SEQ ID NO: 781270 - DNA, 20 bp, mouse
ggaggggagctgcgttttca

SEQ ID NO: 781271 - DNA, 20 bp, mouse
gagtcgctccggatcatgca

SEQ ID NO: 781272 - DNA, 20 bp, mouse
gaagctccaaatatagacga

SEQ ID NO: 781273 - DNA, 20 bp, mouse
gtaattgaaaagatcagtcg

SEQ ID NO: 781274 - DNA, 20 bp, mouse
gtagccttccatgcatgatc

SEQ ID NO: 781275 - DNA, 20 bp, mouse
gctacaaatagggacggaaa

SEQ ID NO: 781276 - DNA, 20 bp, mouse
gggcgcgtctgcaaccgggt

SEQ ID NO: 781277 - DNA, 20 bp, mouse
gccgcgcccagcttctggaa

SEQ ID NO: 781278 - DNA, 20 bp, mouse
gggcccgcaaggcgcagctg

SEQ ID NO: 781279 - DNA, 20 bp, mouse
gggcgggtggaggcggactt

SEQ ID NO: 781280 - DNA, 20 bp, mouse
gggatcgcagcaggggtgaa

SEQ ID NO: 781281 - DNA, 20 bp, mouse
ggaaggggcgcgtctgcaac

SEQ ID NO: 781282 - DNA, 20 bp, mouse
gttcctgagcccagaggttg

SEQ ID NO: 781283 - DNA, 20 bp, mouse
gcgagcccggcgggtggagg

SEQ ID NO: 781284 - DNA, 20 bp, mouse
ggctgagaggagggatcgag

SEQ ID NO: 781285 - DNA, 20 bp, mouse
gaagttaagccgaatgacac

SEQ ID NO: 781286 - DNA, 20 bp, mouse
gggcctcggcgggataaaac

SEQ ID NO: 781287 - DNA, 20 bp, mouse
gaggccctgggagatgtgtc

SEQ ID NO: 781288 - DNA, 20 bp, mouse
ggaagggggggattttgcaa

SEQ ID NO: 781289 - DNA, 20 bp, mouse
gcacccagccagccaatccg

SEQ ID NO: 781290 - DNA, 20 bp, mouse
gtcgccagacacatctccca

SEQ ID NO: 781291 - DNA, 20 bp, mouse
ggtccctttcccatgagcag

SEQ ID NO: 781292 - DNA, 20 bp, mouse
gcagcaggccaggaagtact

SEQ ID NO: 781293 - DNA, 20 bp, mouse
gaggctctcaggcctcggat

SEQ ID NO: 781294 - DNA, 20 bp, mouse
gaatcctaactcagcaggcc

SEQ ID NO: 781295 - DNA, 20 bp, mouse
gaggagttagaaacattcgc

SEQ ID NO: 781296 - DNA, 20 bp, mouse
gggagccagccagaaacaga

SEQ ID NO: 781297 - DNA, 20 bp, mouse
gggtgagtgacagctcagtc

SEQ ID NO: 781298 - DNA, 20 bp, mouse
gtctggctggctccgcacct

SEQ ID NO: 781299 - DNA, 20 bp, mouse
gcgcgggcccacctcttttg

SEQ ID NO: 781300 - DNA, 20 bp, mouse
gcgaacagaagctttggtct

SEQ ID NO: 781301 - DNA, 20 bp, mouse
gtcaatctaagcagcaacgt

SEQ ID NO: 781302 - DNA, 20 bp, mouse
gtccttccgccgtctgtttc

SEQ ID NO: 781303 - DNA, 20 bp, mouse
ggccagccagaaacagacgg

SEQ ID NO: 781304 - DNA, 20 bp, mouse
gtacaacgcagattgctcgc

SEQ ID NO: 781305 - DNA, 20 bp, mouse
ggacacaccccaaaagaggt

SEQ ID NO: 781306 - DNA, 20 bp, mouse
gtcctcgcgccccactactt

SEQ ID NO: 781307 - DNA, 20 bp, mouse
gggaacaacactggagtcgg

SEQ ID NO: 781308 - DNA, 20 bp, mouse
gtagcggcgcgggggactgt

SEQ ID NO: 781309 - DNA, 20 bp, mouse
gagactccgcccaagtagtg

SEQ ID NO: 781310 - DNA, 20 bp, mouse
gcaggcactgagtgggaggg

SEQ ID NO: 781311 - DNA, 20 bp, mouse
gctgccctctagcggcgcgg

SEQ ID NO: 781312 - DNA, 20 bp, mouse
ggaggccggggagaagcgga

SEQ ID NO: 781313 - DNA, 20 bp, mouse
ggggaggctgccacacgtaa

SEQ ID NO: 781314 - DNA, 20 bp, mouse
gcccaccagccgggtcgtcg

SEQ ID NO: 781315 - DNA, 20 bp, mouse
gagtcccccgcgccgctaga

SEQ ID NO: 781316 - DNA, 20 bp, mouse
ggctcggcaggggagtatgt

SEQ ID NO: 781317 - DNA, 20 bp, mouse
gtgcccgaagcggtggtgta

SEQ ID NO: 781318 - DNA, 20 bp, mouse
gggactcccgtcaccccgtg

SEQ ID NO: 781319 - DNA, 20 bp, mouse
gaccaccacaccagctcggc

SEQ ID NO: 781320 - DNA, 20 bp, mouse
gcgtccgaggcccggagcgc

SEQ ID NO: 781321 - DNA, 20 bp, mouse
gtggtgtaaggagcgctgtg

SEQ ID NO: 781322 - DNA, 20 bp, mouse
gctcccctgccgagctggtg

SEQ ID NO: 781323 - DNA, 20 bp, mouse
gcccccgcccgtccgaggcc

SEQ ID NO: 781324 - DNA, 20 bp, mouse
ggcactgatgcccgaagcgg

SEQ ID NO: 781325 - DNA, 20 bp, mouse
ggctgtgcggcgcgcaaggc

SEQ ID NO: 781326 - DNA, 20 bp, mouse
gcgcctgcgtggcccggata

SEQ ID NO: 781327 - DNA, 20 bp, mouse
gcgcgcgtgaactggaaaca

SEQ ID NO: 781328 - DNA, 20 bp, mouse
gccctctgcagaggaagcgg

SEQ ID NO: 781329 - DNA, 20 bp, mouse
gcggtggctccgccttatcc

SEQ ID NO: 781330 - DNA, 20 bp, mouse
gctgcgtggcccggataagg

SEQ ID NO: 781331 - DNA, 20 bp, mouse
gcgctggcgcctgcgtggcc

SEQ ID NO: 781332 - DNA, 20 bp, mouse
gggtaacaacacgcgttcgc

SEQ ID NO: 781333 - DNA, 20 bp, mouse
gaagcaggacggtggaattc

SEQ ID NO: 781334 - DNA, 20 bp, mouse
ggcagagtgaggtaacaacg

SEQ ID NO: 781335 - DNA, 20 bp, mouse
ggcgttcgctggcgcctgcg

SEQ ID NO: 781336 - DNA, 20 bp, mouse
gagggcgcgcgcattttcaa

SEQ ID NO: 781337 - DNA, 20 bp, mouse
gagactacggggcggcacta

SEQ ID NO: 781338 - DNA, 20 bp, mouse
gccgccccgtagtcttctgg

SEQ ID NO: 781339 - DNA, 20 bp, mouse
gaaactccagtaaacctggg

SEQ ID NO: 781340 - DNA, 20 bp, mouse
gaagaaatcttccagagcga

SEQ ID NO: 781341 - DNA, 20 bp, mouse
gacccacatgggaagatcag

SEQ ID NO: 781342 - DNA, 20 bp, mouse
gactgcgagtgttggcggga

SEQ ID NO: 781343 - DNA, 20 bp, mouse
gcggttactgcgagtgttgg

SEQ ID NO: 781344 - DNA, 20 bp, mouse
gaaaggccgcggcccgccga

SEQ ID NO: 781345 - DNA, 20 bp, mouse
gtgcttcttacacaccgcgg

SEQ ID NO: 781346 - DNA, 20 bp, mouse
gccctgtgtaagggtcgatg

SEQ ID NO: 781347 - DNA, 20 bp, mouse
gatcccggggcccacagatc

SEQ ID NO: 781348 - DNA, 20 bp, mouse
gctgctgaatagctaggatt

SEQ ID NO: 781349 - DNA, 20 bp, mouse
gccaacgaggtcaagatccc

SEQ ID NO: 781350 - DNA, 20 bp, mouse
ggggcaggtaagcacttgct

SEQ ID NO: 781351 - DNA, 20 bp, mouse
gcccaggcctcacacgtgac

SEQ ID NO: 781352 - DNA, 20 bp, mouse
ggccaccatgccctgtgtaa

SEQ ID NO: 781353 - DNA, 20 bp, mouse
ggacctgggtaagcagactg

SEQ ID NO: 781354 - DNA, 20 bp, mouse
gagccaggctcagtggaatc

SEQ ID NO: 781355 - DNA, 20 bp, mouse
gtcactgagctactctgcaa

SEQ ID NO: 781356 - DNA, 20 bp, mouse
gagacggttgaggggagcga

SEQ ID NO: 781357 - DNA, 20 bp, mouse
gctcgcgcgggtctggtcgc

SEQ ID NO: 781358 - DNA, 20 bp, mouse
gagcgctcgccacaacggtt

SEQ ID NO: 781359 - DNA, 20 bp, mouse
ggccgagcgactgccgaggg

SEQ ID NO: 781360 - DNA, 20 bp, mouse
ggcagccgagcgactgccga

SEQ ID NO: 781361 - DNA, 20 bp, mouse
ggagcagcgcggcagagagg

SEQ ID NO: 781362 - DNA, 20 bp, mouse
gggctgcgcagctcctagag

SEQ ID NO: 781363 - DNA, 20 bp, mouse
gcgcggcgggagacggttga

SEQ ID NO: 781364 - DNA, 20 bp, mouse
gaccagacccgcgcgagcgt

SEQ ID NO: 781365 - DNA, 20 bp, mouse
gcggttggcgcggcgggaga

SEQ ID NO: 781366 - DNA, 20 bp, mouse
gcgcgtgctgcgctgagaac

SEQ ID NO: 781367 - DNA, 20 bp, mouse
gcgcggctgcagagcttgtg

SEQ ID NO: 781368 - DNA, 20 bp, mouse
ggcagactcacatagtatga

SEQ ID NO: 781369 - DNA, 20 bp, mouse
gacaaaactgtgtgctcccg

SEQ ID NO: 781370 - DNA, 20 bp, mouse
gcaagtcttacccacaaaca

SEQ ID NO: 781371 - DNA, 20 bp, mouse
ggtacaagatattgttgaac

SEQ ID NO: 781372 - DNA, 20 bp, mouse
gtcaaagctatcgtggtaaa

SEQ ID NO: 781373 - DNA, 20 bp, mouse
gagagcaccaaccatactaa

SEQ ID NO: 781374 - DNA, 20 bp, mouse
gtacacactatcttagttag

SEQ ID NO: 781375 - DNA, 20 bp, mouse
gctacaaagatgctgcgatt

SEQ ID NO: 781376 - DNA, 20 bp, mouse
ggacgcttcaggagcagagg

SEQ ID NO: 781377 - DNA, 20 bp, mouse
gtctgctcctgaagcgtccg

SEQ ID NO: 781378 - DNA, 20 bp, mouse
gcacgtgcgaactggaactg

SEQ ID NO: 781379 - DNA, 20 bp, mouse
gtgaagaggcctagtgagtg

SEQ ID NO: 781380 - DNA, 20 bp, mouse
gtgtgcgcgcgcactcggcc

SEQ ID NO: 781381 - DNA, 20 bp, mouse
ggggatcaccacgacttctc

SEQ ID NO: 781382 - DNA, 20 bp, mouse
gtctacgcggaactcatcaa

SEQ ID NO: 781383 - DNA, 20 bp, mouse
ggacctgccggaaagtgtgt

SEQ ID NO: 781384 - DNA, 20 bp, mouse
gtcaggagcagaggaggtct

SEQ ID NO: 781385 - DNA, 20 bp, mouse
gtcctggccgcggacgcttc

SEQ ID NO: 781386 - DNA, 20 bp, mouse
gtcagtgcacaactgccaac

SEQ ID NO: 781387 - DNA, 20 bp, mouse
gttcctggagaactttacta

SEQ ID NO: 781388 - DNA, 20 bp, mouse
gtggagaactttactaggga

SEQ ID NO: 781389 - DNA, 20 bp, mouse
gttccagtatatctgattgg

SEQ ID NO: 781390 - DNA, 20 bp, mouse
gtgtcatttagtatacaaat

SEQ ID NO: 781391 - DNA, 20 bp, mouse
gaaaaatatacctgaaacat

SEQ ID NO: 781392 - DNA, 20 bp, mouse
gaatccatggttcaggttca

SEQ ID NO: 781393 - DNA, 20 bp, mouse
gtagtatacaaataggttcc

SEQ ID NO: 781394 - DNA, 20 bp, mouse
gttcatcagcaatactgggg

SEQ ID NO: 781395 - DNA, 20 bp, mouse
gagttggctttcaggatggt

SEQ ID NO: 781396 - DNA, 20 bp, mouse
gacgctgggtggaaagtagg

SEQ ID NO: 781397 - DNA, 20 bp, mouse
gaggccgaggaggagacgct

SEQ ID NO: 781398 - DNA, 20 bp, mouse
ggggagggagcggagaggcc

SEQ ID NO: 781399 - DNA, 20 bp, mouse
gtcaccgcgtagacgaacga

SEQ ID NO: 781400 - DNA, 20 bp, mouse
gaggactagccaatcataga

SEQ ID NO: 781401 - DNA, 20 bp, mouse
gggagaggggagggggccga

SEQ ID NO: 781402 - DNA, 20 bp, mouse
gggaggaggagcccactttc

SEQ ID NO: 781403 - DNA, 20 bp, mouse
gtcctctgacccccgcctcc

SEQ ID NO: 781404 - DNA, 20 bp, mouse
gcgtagacgaacgaggggtg

SEQ ID NO: 781405 - DNA, 20 bp, mouse
gactagccaatcatagaagg

SEQ ID NO: 781406 - DNA, 20 bp, mouse
ggggcggccggggagagact

SEQ ID NO: 781407 - DNA, 20 bp, mouse
gcatggcctcggaacccagg

SEQ ID NO: 781408 - DNA, 20 bp, mouse
gcggggagacgcaggccagg

SEQ ID NO: 781409 - DNA, 20 bp, mouse
gggccaacccagtctctccc

SEQ ID NO: 781410 - DNA, 20 bp, mouse
gggccggggagagactgggt

SEQ ID NO: 781411 - DNA, 20 bp, mouse
gagtccgcaccacccgacca

SEQ ID NO: 781412 - DNA, 20 bp, mouse
gttccgaggccatggtcggg

SEQ ID NO: 781413 - DNA, 20 bp, mouse
ggggttccgaggccatggtc

SEQ ID NO: 781414 - DNA, 20 bp, mouse
ggactgaagactggtatctg

SEQ ID NO: 781415 - DNA, 20 bp, mouse
ggggaacgagggaggcggct

SEQ ID NO: 781416 - DNA, 20 bp, mouse
gcgtacgcggagaatggggt

SEQ ID NO: 781417 - DNA, 20 bp, mouse
gaaggtgactaggtaggttg

SEQ ID NO: 781418 - DNA, 20 bp, mouse
gttgtggagtagagaaccgg

SEQ ID NO: 781419 - DNA, 20 bp, mouse
gtgtcagtgtgaggcggtag

SEQ ID NO: 781420 - DNA, 20 bp, mouse
gaccggaggctgtcagtgtg

SEQ ID NO: 781421 - DNA, 20 bp, mouse
ggcggtagggggcctgagaa

SEQ ID NO: 781422 - DNA, 20 bp, mouse
ggggctaaagtcactatggg

SEQ ID NO: 781423 - DNA, 20 bp, mouse
gaggttgtggagtagagaac

SEQ ID NO: 781424 - DNA, 20 bp, mouse
gtgggctagccggatagtta

SEQ ID NO: 781425 - DNA, 20 bp, mouse
ggggcgggctgaggctaaga

SEQ ID NO: 781426 - DNA, 20 bp, mouse
gccggcgcggcccgcgactg

SEQ ID NO: 781427 - DNA, 20 bp, mouse
ggggccgcccggcgcggcga

SEQ ID NO: 781428 - DNA, 20 bp, mouse
ggcccgcgactgaggggacg

SEQ ID NO: 781429 - DNA, 20 bp, mouse
gaggagactgaggacagcgg

SEQ ID NO: 781430 - DNA, 20 bp, mouse
gccggctccggcttccgccg

SEQ ID NO: 781431 - DNA, 20 bp, mouse
gctgtcctcagtctcctccg

SEQ ID NO: 781432 - DNA, 20 bp, mouse
gtccgcgtcccctcagtcgc

SEQ ID NO: 781433 - DNA, 20 bp, mouse
ggaagcggcgcgctcgccgg

SEQ ID NO: 781434 - DNA, 20 bp, mouse
gtcctcagtctcctccgcgg

SEQ ID NO: 781435 - DNA, 20 bp, mouse
gggaagccggagccggacgc

SEQ ID NO: 781436 - DNA, 20 bp, mouse
gcacagggggcgtgtcctga

SEQ ID NO: 781437 - DNA, 20 bp, mouse
ggccccaaacagcttctcaa

SEQ ID NO: 781438 - DNA, 20 bp, mouse
gaacggctgctgagggttga

SEQ ID NO: 781439 - DNA, 20 bp, mouse
gggggcgcatcgcgaaggag

SEQ ID NO: 781440 - DNA, 20 bp, mouse
gtggtgacggcgcccacagg

SEQ ID NO: 781441 - DNA, 20 bp, mouse
gtagctagtcgctgaggagg

SEQ ID NO: 781442 - DNA, 20 bp, mouse
gagggacgagggcctatgat

SEQ ID NO: 781443 - DNA, 20 bp, mouse
ggaggcactggagtaagcaa

SEQ ID NO: 781444 - DNA, 20 bp, mouse
gtgtttggggcgcatcgcga

SEQ ID NO: 781445 - DNA, 20 bp, mouse
gtggagtaagcaagggacga

SEQ ID NO: 781446 - DNA, 20 bp, mouse
ggacttgaacgcccaggcag

SEQ ID NO: 781447 - DNA, 20 bp, mouse
gtcagtgtctagtgtctagt

SEQ ID NO: 781448 - DNA, 20 bp, mouse
ggacactgagaaaagagggg

SEQ ID NO: 781449 - DNA, 20 bp, mouse
gcaccaaaaaagataaacca

SEQ ID NO: 781450 - DNA, 20 bp, mouse
gcagcccaggaagacaagag

SEQ ID NO: 781451 - DNA, 20 bp, mouse
gggggtccagtgcaagttgt

SEQ ID NO: 781452 - DNA, 20 bp, mouse
gaaaggtgctgtctgatgag

SEQ ID NO: 781453 - DNA, 20 bp, mouse
gttcaagtccagcttttcat

SEQ ID NO: 781454 - DNA, 20 bp, mouse
gaggaagacctaaaactgaa

SEQ ID NO: 781455 - DNA, 20 bp, mouse
gacgcagtacctctctccct

SEQ ID NO: 781456 - DNA, 20 bp, mouse
ggtgagcatggctgcgtgat

SEQ ID NO: 781457 - DNA, 20 bp, mouse
ggggcggggcagagatccgg

SEQ ID NO: 781458 - DNA, 20 bp, mouse
ggccatgctcacagagcaca

SEQ ID NO: 781459 - DNA, 20 bp, mouse
ggctcacagagcacagggca

SEQ ID NO: 781460 - DNA, 20 bp, mouse
gtggctgcgtgatgggctcc

SEQ ID NO: 781461 - DNA, 20 bp, mouse
ggatgtcaaagcttttgccc

SEQ ID NO: 781462 - DNA, 20 bp, mouse
gaagcagcaggccaccgcgg

SEQ ID NO: 781463 - DNA, 20 bp, mouse
gggcaagcagcaggccaccg

SEQ ID NO: 781464 - DNA, 20 bp, mouse
ggttactgtaacaataggtc

SEQ ID NO: 781465 - DNA, 20 bp, mouse
gggcagagatccggtggccg

SEQ ID NO: 781466 - DNA, 20 bp, mouse
gtgctcagggcttaaagacc

SEQ ID NO: 781467 - DNA, 20 bp, mouse
gggcaccgaaggcccccgaa

SEQ ID NO: 781468 - DNA, 20 bp, mouse
ggcgcggcggccatcccctt

SEQ ID NO: 781469 - DNA, 20 bp, mouse
gtgtctccacccgtcctggg

SEQ ID NO: 781470 - DNA, 20 bp, mouse
ggagttgtctccacccgtcc

SEQ ID NO: 781471 - DNA, 20 bp, mouse
ggcatggtcgagctgcagag

SEQ ID NO: 781472 - DNA, 20 bp, mouse
gcgaaggcccccgaagggga

SEQ ID NO: 781473 - DNA, 20 bp, mouse
gcggcggccatccccttcgg

SEQ ID NO: 781474 - DNA, 20 bp, mouse
gagacccggctgccgcgacc

SEQ ID NO: 781475 - DNA, 20 bp, mouse
gacataggacctgcatgtaa

SEQ ID NO: 781476 - DNA, 20 bp, mouse
gggtacgcggggttgaaagc

SEQ ID NO: 781477 - DNA, 20 bp, mouse
gtcccctgccggagccgcta

SEQ ID NO: 781478 - DNA, 20 bp, mouse
gaacccggtggcaccgccgt

SEQ ID NO: 781479 - DNA, 20 bp, mouse
ggacccggcagagattgaga

SEQ ID NO: 781480 - DNA, 20 bp, mouse
gtcgacgggcgggtgggcga

SEQ ID NO: 781481 - DNA, 20 bp, mouse
gaccgccgtcgggttgaaaa

SEQ ID NO: 781482 - DNA, 20 bp, mouse
ggacaacgtgggcaaaactg

SEQ ID NO: 781483 - DNA, 20 bp, mouse
gcgggaccgggagcggtcga

SEQ ID NO: 781484 - DNA, 20 bp, mouse
gggcgtcgcaggactggcgg

SEQ ID NO: 781485 - DNA, 20 bp, mouse
gaccgggagcggtcgacggg

SEQ ID NO: 781486 - DNA, 20 bp, mouse
gaaggcggtccgcattgcgt

SEQ ID NO: 781487 - DNA, 20 bp, mouse
gcggcagcgcagaggcgcgg

SEQ ID NO: 781488 - DNA, 20 bp, mouse
gagaccccggggcgggtgga

SEQ ID NO: 781489 - DNA, 20 bp, mouse
gttagcgcttccggggtcga

SEQ ID NO: 781490 - DNA, 20 bp, mouse
ggaggcgcggaggataccag

SEQ ID NO: 781491 - DNA, 20 bp, mouse
gcgagacggccagtaaccag

SEQ ID NO: 781492 - DNA, 20 bp, mouse
ggaagcgctaaccgccccgg

SEQ ID NO: 781493 - DNA, 20 bp, mouse
ggcggctccttggacagcgt

SEQ ID NO: 781494 - DNA, 20 bp, mouse
gggcgaggtctgagatagag

SEQ ID NO: 781495 - DNA, 20 bp, mouse
gagacctcgccgctggttac

SEQ ID NO: 781496 - DNA, 20 bp, mouse
gtgggcggggccccactctg

SEQ ID NO: 781497 - DNA, 20 bp, mouse
gtggccccgcccccgctcaa

SEQ ID NO: 781498 - DNA, 20 bp, mouse
gtagcgtcgaagggcggtta

SEQ ID NO: 781499 - DNA, 20 bp, mouse
gtcgaagggcggttagggtt

SEQ ID NO: 781500 - DNA, 20 bp, mouse
gtgaccatcacagccaatca

SEQ ID NO: 781501 - DNA, 20 bp, mouse
gaggccctgcccttgagcgg

SEQ ID NO: 781502 - DNA, 20 bp, mouse
gccgcccccgctcaagggca

SEQ ID NO: 781503 - DNA, 20 bp, mouse
gcagagaggggcacccgcga

SEQ ID NO: 781504 - DNA, 20 bp, mouse
gaccgcccttcgacgctaaa

SEQ ID NO: 781505 - DNA, 20 bp, mouse
gacgctaaacggcttctagc

SEQ ID NO: 781506 - DNA, 20 bp, mouse
ggcgggcggctgcggcactg

SEQ ID NO: 781507 - DNA, 20 bp, mouse
ggggagctccgcagaagcgc

SEQ ID NO: 781508 - DNA, 20 bp, mouse
ggccccggatcctccctgta

SEQ ID NO: 781509 - DNA, 20 bp, mouse
gggcccctggtgagccgcat

SEQ ID NO: 781510 - DNA, 20 bp, mouse
gctgtaatcggatccgggga

SEQ ID NO: 781511 - DNA, 20 bp, mouse
ggggcccgccgcgctgtaat

SEQ ID NO: 781512 - DNA, 20 bp, mouse
ggcggccaggactgagatga

SEQ ID NO: 781513 - DNA, 20 bp, mouse
ggggagagagccatacaggg

SEQ ID NO: 781514 - DNA, 20 bp, mouse
gagggtccatcgctccctcc

SEQ ID NO: 781515 - DNA, 20 bp, mouse
gagcgctgggcgggaaggac

SEQ ID NO: 781516 - DNA, 20 bp, mouse
gaaccgcactaggacccgga

SEQ ID NO: 781517 - DNA, 20 bp, mouse
ggcgcagagccggtcgccta

SEQ ID NO: 781518 - DNA, 20 bp, mouse
gctccctccgggtcctagtg

SEQ ID NO: 781519 - DNA, 20 bp, mouse
ggagggagctggtccgactg

SEQ ID NO: 781520 - DNA, 20 bp, mouse
ggcctagggcttacgcatat

SEQ ID NO: 781521 - DNA, 20 bp, mouse
gtgcgtaagccctaggcgac

SEQ ID NO: 781522 - DNA, 20 bp, mouse
ggacctctcaccctcgtcaa

SEQ ID NO: 781523 - DNA, 20 bp, mouse
gctcccaagcctactcgcca

SEQ ID NO: 781524 - DNA, 20 bp, mouse
ggggcggagcttagagctca

SEQ ID NO: 781525 - DNA, 20 bp, mouse
ggctgctggagcgccttggt

SEQ ID NO: 781526 - DNA, 20 bp, mouse
gtaaagctggtagcagtcac

SEQ ID NO: 781527 - DNA, 20 bp, mouse
gtgcgcctgcgcgtcgtcgc

SEQ ID NO: 781528 - DNA, 20 bp, mouse
gcagtcacaggcttgcattc

SEQ ID NO: 781529 - DNA, 20 bp, mouse
gagggccagcgacgacgcgc

SEQ ID NO: 781530 - DNA, 20 bp, mouse
gtcgtcgctggccctaaagc

SEQ ID NO: 781531 - DNA, 20 bp, mouse
ggtgacacacactgcacctc

SEQ ID NO: 781532 - DNA, 20 bp, mouse
gcttgcattcaggctcaagg

SEQ ID NO: 781533 - DNA, 20 bp, mouse
ggatacacaggaacagaagt

SEQ ID NO: 781534 - DNA, 20 bp, mouse
gagatggctaacgcagaacg

SEQ ID NO: 781535 - DNA, 20 bp, mouse
gatgaagtccttgttctgtg

SEQ ID NO: 781536 - DNA, 20 bp, mouse
gcctcccagcgggaccagat

SEQ ID NO: 781537 - DNA, 20 bp, mouse
gccacctcccggccgaagtg

SEQ ID NO: 781538 - DNA, 20 bp, mouse
gccgaaggggtcctggatgg

SEQ ID NO: 781539 - DNA, 20 bp, mouse
ggcccccccgccccccactt

SEQ ID NO: 781540 - DNA, 20 bp, mouse
gtcggccttaggcaagtggg

SEQ ID NO: 781541 - DNA, 20 bp, mouse
gggtggagcccggaccgatc

SEQ ID NO: 781542 - DNA, 20 bp, mouse
gcagcgggaccagatcggtc

SEQ ID NO: 781543 - DNA, 20 bp, mouse
ggtaaggtgaagagccgaaa

SEQ ID NO: 781544 - DNA, 20 bp, mouse
gggtcagggtcccctcccag

SEQ ID NO: 781545 - DNA, 20 bp, mouse
gtccggccggagctgtaata

SEQ ID NO: 781546 - DNA, 20 bp, mouse
gaggccaggcgtcaccctgg

SEQ ID NO: 781547 - DNA, 20 bp, mouse
gcccccaccagggtgacgcc

SEQ ID NO: 781548 - DNA, 20 bp, mouse
gcccaaggtgagactaggtg

SEQ ID NO: 781549 - DNA, 20 bp, mouse
gaggaggccaggcgtcaccc

SEQ ID NO: 781550 - DNA, 20 bp, mouse
gtgaaggcgagggacgcaag

SEQ ID NO: 781551 - DNA, 20 bp, mouse
ggaggccggagatgcgggag

SEQ ID NO: 781552 - DNA, 20 bp, mouse
gccggagatgcgggagagga

SEQ ID NO: 781553 - DNA, 20 bp, mouse
ggaggcgctcgggcatgctt

SEQ ID NO: 781554 - DNA, 20 bp, mouse
gcccgagcgcctcctcccac

SEQ ID NO: 781555 - DNA, 20 bp, mouse
ggcgctgctcccgccggcgc

SEQ ID NO: 781556 - DNA, 20 bp, mouse
gcggggcagaacgctcgctt

SEQ ID NO: 781557 - DNA, 20 bp, mouse
gggtcccgaggcgcttgcag

SEQ ID NO: 781558 - DNA, 20 bp, mouse
gccaccgagcgactgttcgt

SEQ ID NO: 781559 - DNA, 20 bp, mouse
gcaagcgcctcgggacctgc

SEQ ID NO: 781560 - DNA, 20 bp, mouse
ggaaaccccgctccttggag

SEQ ID NO: 781561 - DNA, 20 bp, mouse
gagtcccctgcaagcgcctc

SEQ ID NO: 781562 - DNA, 20 bp, mouse
ggtccccagccgcaggtaat

SEQ ID NO: 781563 - DNA, 20 bp, mouse
ggtcacgcggcagccaggag

SEQ ID NO: 781564 - DNA, 20 bp, mouse
ggcgtgacgtaactacttga

SEQ ID NO: 781565 - DNA, 20 bp, mouse
gggggactgggaactttccg

SEQ ID NO: 781566 - DNA, 20 bp, mouse
gccctcccagcaggcggcta

SEQ ID NO: 781567 - DNA, 20 bp, mouse
gtgcagggagtggggacaaa

SEQ ID NO: 781568 - DNA, 20 bp, mouse
gagtgccctagccgcctgct

SEQ ID NO: 781569 - DNA, 20 bp, mouse
gaacctcaggagcggtgcgg

SEQ ID NO: 781570 - DNA, 20 bp, mouse
gtgagcgagtggaaggcggg

SEQ ID NO: 781571 - DNA, 20 bp, mouse
gaagaacctcaggagcggtg

SEQ ID NO: 781572 - DNA, 20 bp, mouse
gtggcgcagcaccaactgat

SEQ ID NO: 781573 - DNA, 20 bp, mouse
gtccccctcgccattgaaaa

SEQ ID NO: 781574 - DNA, 20 bp, mouse
gggggtgagcgagtggaagg

SEQ ID NO: 781575 - DNA, 20 bp, mouse
ggagaggggggaccacccgg

SEQ ID NO: 781576 - DNA, 20 bp, mouse
ggctgaagaggatgaggcca

SEQ ID NO: 781577 - DNA, 20 bp, mouse
gccacctacaggaaaaggga

SEQ ID NO: 781578 - DNA, 20 bp, mouse
gtgggacaggctggatgaga

SEQ ID NO: 781579 - DNA, 20 bp, mouse
ggtgactccttgtccctcat

SEQ ID NO: 781580 - DNA, 20 bp, mouse
ggcggcaaggcagccaatga

SEQ ID NO: 781581 - DNA, 20 bp, mouse
gcctagagggacatcagcat

SEQ ID NO: 781582 - DNA, 20 bp, mouse
gagagatggggagccctaga

SEQ ID NO: 781583 - DNA, 20 bp, mouse
gagtccagcaagtgtaggaa

SEQ ID NO: 781584 - DNA, 20 bp, mouse
gaaaccccacctacaggaaa

SEQ ID NO: 781585 - DNA, 20 bp, mouse
gaggtgctgtccatgcggca

SEQ ID NO: 781586 - DNA, 20 bp, mouse
gagcccgcgctaagtctcgg

SEQ ID NO: 781587 - DNA, 20 bp, mouse
gtcggcccacgcccaatggg

SEQ ID NO: 781588 - DNA, 20 bp, mouse
gtccgcctcccattgggcgt

SEQ ID NO: 781589 - DNA, 20 bp, mouse
gctgccgcagcggaggaggg

SEQ ID NO: 781590 - DNA, 20 bp, mouse
gccgcgctaagtctcggcgg

SEQ ID NO: 781591 - DNA, 20 bp, mouse
gtctggctccccacgccgat

SEQ ID NO: 781592 - DNA, 20 bp, mouse
gcggctgccgcagcggagga

SEQ ID NO: 781593 - DNA, 20 bp, mouse
ggaggagggcggctcggaga

SEQ ID NO: 781594 - DNA, 20 bp, mouse
gagccaagacgcggaggaaa

SEQ ID NO: 781595 - DNA, 20 bp, mouse
gttctcggcccacgcccaat

SEQ ID NO: 781596 - DNA, 20 bp, mouse
gagggtggcgggcgcgggtt

SEQ ID NO: 781597 - DNA, 20 bp, mouse
gtacagcaggagagcggtgt

SEQ ID NO: 781598 - DNA, 20 bp, mouse
ggcgggttggggacccgcta

SEQ ID NO: 781599 - DNA, 20 bp, mouse
ggctggagtcaccggagcga

SEQ ID NO: 781600 - DNA, 20 bp, mouse
ggagtcaccggagcgaggga

SEQ ID NO: 781601 - DNA, 20 bp, mouse
ggcgctcccgcgcccctagc

SEQ ID NO: 781602 - DNA, 20 bp, mouse
gtggggacccgctaggggcg

SEQ ID NO: 781603 - DNA, 20 bp, mouse
ggcggcacgcttggagaaag

SEQ ID NO: 781604 - DNA, 20 bp, mouse
gtgggggtggggagaccggg

SEQ ID NO: 781605 - DNA, 20 bp, mouse
gactccagcagcttcggatt

SEQ ID NO: 781606 - DNA, 20 bp, mouse
gccaaggcgcgaggcgggga

SEQ ID NO: 781607 - DNA, 20 bp, mouse
gcaaaaagggctctgttccg

SEQ ID NO: 781608 - DNA, 20 bp, mouse
ggcccagcggctccggtctt

SEQ ID NO: 781609 - DNA, 20 bp, mouse
ggggacaagcaaagtaggaa

SEQ ID NO: 781610 - DNA, 20 bp, mouse
gcggcagctcgggctctctc

SEQ ID NO: 781611 - DNA, 20 bp, mouse
ggagaagtgggccagatttg

SEQ ID NO: 781612 - DNA, 20 bp, mouse
gggcctgggacaagcaaagt

SEQ ID NO: 781613 - DNA, 20 bp, mouse
gcaagcggaaacttacacac

SEQ ID NO: 781614 - DNA, 20 bp, mouse
gtgcaggggctctgcagttc

SEQ ID NO: 781615 - DNA, 20 bp, mouse
gtcagggtactctactcagt

SEQ ID NO: 781616 - DNA, 20 bp, mouse
gagcaaagctatgaaatcgg

SEQ ID NO: 781617 - DNA, 20 bp, mouse
gaacgacgacgagcagaaca

SEQ ID NO: 781618 - DNA, 20 bp, mouse
gcgaaaattaaaatgaagac

SEQ ID NO: 781619 - DNA, 20 bp, mouse
gcctgtaggtttaattttaa

SEQ ID NO: 781620 - DNA, 20 bp, mouse
gaagatcagtctcaacttct

SEQ ID NO: 781621 - DNA, 20 bp, mouse
gcaaagctgatagtgtttct

SEQ ID NO: 781622 - DNA, 20 bp, mouse
gcttttctggcttgcatctt

SEQ ID NO: 781623 - DNA, 20 bp, mouse
gtttctcggtgtctgcctgt

SEQ ID NO: 781624 - DNA, 20 bp, mouse
gtaattttcgctattggtga

SEQ ID NO: 781625 - DNA, 20 bp, mouse
gaacagctattattctggaa

SEQ ID NO: 781626 - DNA, 20 bp, mouse
gcatccgcgcgacactggcc

SEQ ID NO: 781627 - DNA, 20 bp, mouse
gcacgaccgggcactcctaa

SEQ ID NO: 781628 - DNA, 20 bp, mouse
ggagttccccgcattgagac

SEQ ID NO: 781629 - DNA, 20 bp, mouse
gcccgccgcctctctggctg

SEQ ID NO: 781630 - DNA, 20 bp, mouse
gcgcgcggatgcacggagcc

SEQ ID NO: 781631 - DNA, 20 bp, mouse
gactctgctagacgcgaaag

SEQ ID NO: 781632 - DNA, 20 bp, mouse
gtcaccgggccagtgtcgcg

SEQ ID NO: 781633 - DNA, 20 bp, mouse
gacccccgccccagtggctt

SEQ ID NO: 781634 - DNA, 20 bp, mouse
gccgtgcatccgcgcgacac

SEQ ID NO: 781635 - DNA, 20 bp, mouse
gccggtgaaagctcacgacc

SEQ ID NO: 781636 - DNA, 20 bp, mouse
gagagtcggccgatgggagg

SEQ ID NO: 781637 - DNA, 20 bp, mouse
gcggttccggccccttccca

SEQ ID NO: 781638 - DNA, 20 bp, mouse
gcgtagagtcggccgatggg

SEQ ID NO: 781639 - DNA, 20 bp, mouse
gcggtcctcctctccgggaa

SEQ ID NO: 781640 - DNA, 20 bp, mouse
ggggcggcggagcctggtag

SEQ ID NO: 781641 - DNA, 20 bp, mouse
gggccagccccggaggaggg

SEQ ID NO: 781642 - DNA, 20 bp, mouse
gagcgcgtagagtcggccga

SEQ ID NO: 781643 - DNA, 20 bp, mouse
gcgggaaaggaagaaacgag

SEQ ID NO: 781644 - DNA, 20 bp, mouse
gacactgcgcgccacgggct

SEQ ID NO: 781645 - DNA, 20 bp, mouse
gcccctcggtcctcctctcc

SEQ ID NO: 781646 - DNA, 20 bp, mouse
ggcggcgggcagaagagacc

SEQ ID NO: 781647 - DNA, 20 bp, mouse
gcaaggtgctaacagaaaat

SEQ ID NO: 781648 - DNA, 20 bp, mouse
gcaaaataaaggggcggatg

SEQ ID NO: 781649 - DNA, 20 bp, mouse
gtggcggaggagcggcgctg

SEQ ID NO: 781650 - DNA, 20 bp, mouse
gaccgacaatccctttaatg

SEQ ID NO: 781651 - DNA, 20 bp, mouse
ggggggtaggatgtgagacc

SEQ ID NO: 781652 - DNA, 20 bp, mouse
gcttgcaatgagttagcact

SEQ ID NO: 781653 - DNA, 20 bp, mouse
gttaatgtggaaaggcttag

SEQ ID NO: 781654 - DNA, 20 bp, mouse
gtccacattaaagggattgt

SEQ ID NO: 781655 - DNA, 20 bp, mouse
gagggattgtcggtggttgg

SEQ ID NO: 781656 - DNA, 20 bp, mouse
gcggctgccgaggggcgctg

SEQ ID NO: 781657 - DNA, 20 bp, mouse
gccagcacccggggtggctc

SEQ ID NO: 781658 - DNA, 20 bp, mouse
gggcagccgcgaaaacctgg

SEQ ID NO: 781659 - DNA, 20 bp, mouse
gcccacctccgggtcctgat

SEQ ID NO: 781660 - DNA, 20 bp, mouse
gaaaacagctctcccgggac

SEQ ID NO: 781661 - DNA, 20 bp, mouse
gacgaccgaggccccacctc

SEQ ID NO: 781662 - DNA, 20 bp, mouse
gaaacctggaggaacgatcc

SEQ ID NO: 781663 - DNA, 20 bp, mouse
gcactgagcatgcccggcag

SEQ ID NO: 781664 - DNA, 20 bp, mouse
ggaggaacgatcccggtccc

SEQ ID NO: 781665 - DNA, 20 bp, mouse
gcgggagggggcgcggaaca

SEQ ID NO: 781666 - DNA, 20 bp, mouse
gatggtggttaccatgggca

SEQ ID NO: 781667 - DNA, 20 bp, mouse
ggaaccattcggcattaaaa

SEQ ID NO: 781668 - DNA, 20 bp, mouse
ggcaaacagacgctcatgga

SEQ ID NO: 781669 - DNA, 20 bp, mouse
gcgacaccctgtggctaaac

SEQ ID NO: 781670 - DNA, 20 bp, mouse
ggcgaaacttcaggacattg

SEQ ID NO: 781671 - DNA, 20 bp, mouse
ggtttccctggccttgccca

SEQ ID NO: 781672 - DNA, 20 bp, mouse
gtagataacaacagtttccc

SEQ ID NO: 781673 - DNA, 20 bp, mouse
ggtgtaaaacgcttcaacac

SEQ ID NO: 781674 - DNA, 20 bp, mouse
ggatacttgtacatctgtgt

SEQ ID NO: 781675 - DNA, 20 bp, mouse
gtcaacactggcgaaacttc

SEQ ID NO: 781676 - DNA, 20 bp, mouse
gtagaggctagtaataggag

SEQ ID NO: 781677 - DNA, 20 bp, mouse
gctaaccgcagtgccgccaa

SEQ ID NO: 781678 - DNA, 20 bp, mouse
gcaacctctgctcaacgcta

SEQ ID NO: 781679 - DNA, 20 bp, mouse
gccgcagtgccgccaaaggc

SEQ ID NO: 781680 - DNA, 20 bp, mouse
gagtgtgcccctagagctgg

SEQ ID NO: 781681 - DNA, 20 bp, mouse
gagtgcaaaaacagcttacc

SEQ ID NO: 781682 - DNA, 20 bp, mouse
gttgaggtcagtctgtttgt

SEQ ID NO: 781683 - DNA, 20 bp, mouse
ggaaacacatggagtgaatg

SEQ ID NO: 781684 - DNA, 20 bp, mouse
gcaaaaacagcttacctggc

SEQ ID NO: 781685 - DNA, 20 bp, mouse
gtccttgggaattgagaagc

SEQ ID NO: 781686 - DNA, 20 bp, mouse
gtcagctcagaggtatgagt

SEQ ID NO: 781687 - DNA, 20 bp, mouse
gcctctgagctgaaagtacg

SEQ ID NO: 781688 - DNA, 20 bp, mouse
gtggtggcgctgtcgactaa

SEQ ID NO: 781689 - DNA, 20 bp, mouse
ggactaagggagagaattat

SEQ ID NO: 781690 - DNA, 20 bp, mouse
ggagtaggatactgatattt

SEQ ID NO: 781691 - DNA, 20 bp, mouse
gtaggatactgatatttagg

SEQ ID NO: 781692 - DNA, 20 bp, mouse
gcagctaaaactcaaaacta

SEQ ID NO: 781693 - DNA, 20 bp, mouse
gcatgaaaagggacacttgg

SEQ ID NO: 781694 - DNA, 20 bp, mouse
gcattcagaaggcacacaac

SEQ ID NO: 781695 - DNA, 20 bp, mouse
gacagagagcatggccggtt

SEQ ID NO: 781696 - DNA, 20 bp, mouse
gaacatggagcttgcaattc

SEQ ID NO: 781697 - DNA, 20 bp, mouse
ggctgtgtgtgtaaactaaa

SEQ ID NO: 781698 - DNA, 20 bp, mouse
gaaggtggattcagctcctc

SEQ ID NO: 781699 - DNA, 20 bp, mouse
gttacctggtaagagtcccg

SEQ ID NO: 781700 - DNA, 20 bp, mouse
ggctcctcgggactcttacc

SEQ ID NO: 781701 - DNA, 20 bp, mouse
ggtagacctaagaaagaagg

SEQ ID NO: 781702 - DNA, 20 bp, mouse
gtgaatccaccttctttctt

SEQ ID NO: 781703 - DNA, 20 bp, mouse
gaagagatcctggtctgcta

SEQ ID NO: 781704 - DNA, 20 bp, mouse
gtactgaattaagttttgag

SEQ ID NO: 781705 - DNA, 20 bp, mouse
gcttaccaggtaaaaaagaa

SEQ ID NO: 781706 - DNA, 20 bp, mouse
gcaagcagcatactagacag

SEQ ID NO: 781707 - DNA, 20 bp, mouse
gacggctggtatcaactccg

SEQ ID NO: 781708 - DNA, 20 bp, mouse
gcctggccagatggtgaata

SEQ ID NO: 781709 - DNA, 20 bp, mouse
gccagacacaggctgaaaat

SEQ ID NO: 781710 - DNA, 20 bp, mouse
gatggtggcagtctttagaa

SEQ ID NO: 781711 - DNA, 20 bp, mouse
gaaggataccgaaacacatc

SEQ ID NO: 781712 - DNA, 20 bp, mouse
gtggcaaaatgaaatgtaag

SEQ ID NO: 781713 - DNA, 20 bp, mouse
gttgataccagccgtcactg

SEQ ID NO: 781714 - DNA, 20 bp, mouse
gaaatcatatgtagaatttc

SEQ ID NO: 781715 - DNA, 20 bp, mouse
gcaagtctgctttaatggaa

SEQ ID NO: 781716 - DNA, 20 bp, mouse
gccaactgcctgctgatcta

SEQ ID NO: 781717 - DNA, 20 bp, mouse
gagcgtgtgacgggtttctt

SEQ ID NO: 781718 - DNA, 20 bp, mouse
gggagtctgaggacgctaaa

SEQ ID NO: 781719 - DNA, 20 bp, mouse
gctaggtgaaccggagtctg

SEQ ID NO: 781720 - DNA, 20 bp, mouse
ggaacgcatggtggcggtgt

SEQ ID NO: 781721 - DNA, 20 bp, mouse
gagaaatctttggatcaaca

SEQ ID NO: 781722 - DNA, 20 bp, mouse
gtccaaactcagcgtgtgac

SEQ ID NO: 781723 - DNA, 20 bp, mouse
gtccaagtctgggcatcata

SEQ ID NO: 781724 - DNA, 20 bp, mouse
gaaaacttttatccaagtct

SEQ ID NO: 781725 - DNA, 20 bp, mouse
gtggattcaagatatagagt

SEQ ID NO: 781726 - DNA, 20 bp, mouse
gacacagcttaactacctca

SEQ ID NO: 781727 - DNA, 20 bp, mouse
gaggctgccatacgagactt

SEQ ID NO: 781728 - DNA, 20 bp, mouse
gcatacgagacttaggtgaa

SEQ ID NO: 781729 - DNA, 20 bp, mouse
gaatgtgtggcccacttttt

SEQ ID NO: 781730 - DNA, 20 bp, mouse
gctgtaaaggctaaaatgtg

SEQ ID NO: 781731 - DNA, 20 bp, mouse
ggtctcgtatggcagccttg

SEQ ID NO: 781732 - DNA, 20 bp, mouse
gctactgaaggacaactgaa

SEQ ID NO: 781733 - DNA, 20 bp, mouse
gaacactttgacctaaaaag

SEQ ID NO: 781734 - DNA, 20 bp, mouse
gtgtaaaacagaacgcttgg

SEQ ID NO: 781735 - DNA, 20 bp, mouse
gatgtgcctgaagctactga

SEQ ID NO: 781736 - DNA, 20 bp, mouse
gttaagtataaacactggtg

SEQ ID NO: 781737 - DNA, 20 bp, mouse
gagacactgctgacaatatt

SEQ ID NO: 781738 - DNA, 20 bp, mouse
gtgcaggctaaaaagaggaa

SEQ ID NO: 781739 - DNA, 20 bp, mouse
gggcgctgcaggctaaaaag

SEQ ID NO: 781740 - DNA, 20 bp, mouse
gaagaggaaaggtatggaaa

SEQ ID NO: 781741 - DNA, 20 bp, mouse
gccgagttaagtataaacac

SEQ ID NO: 781742 - DNA, 20 bp, mouse
gaagtctcatcacaagtaga

SEQ ID NO: 781743 - DNA, 20 bp, mouse
gaaaggactcagttgatgtc

SEQ ID NO: 781744 - DNA, 20 bp, mouse
gtcacaagtagaaggtagat

SEQ ID NO: 781745 - DNA, 20 bp, mouse
ggcactcacaaaacgcaagg

SEQ ID NO: 781746 - DNA, 20 bp, mouse
gcaagaaggcacagcaataa

SEQ ID NO: 781747 - DNA, 20 bp, mouse
ggcacagcaataagggaggt

SEQ ID NO: 781748 - DNA, 20 bp, mouse
ggaaggcacagcaataaggg

SEQ ID NO: 781749 - DNA, 20 bp, mouse
gaaggcggcgctgtaggata

SEQ ID NO: 781750 - DNA, 20 bp, mouse
gcttgcccactgccagataa

SEQ ID NO: 781751 - DNA, 20 bp, mouse
gacaagagaaatgtcattgc

SEQ ID NO: 781752 - DNA, 20 bp, mouse
ggaacacaaggcggcgctgt

SEQ ID NO: 781753 - DNA, 20 bp, mouse
gggaaccacaactgccttct

SEQ ID NO: 781754 - DNA, 20 bp, mouse
ggttgtggttccattaatag

SEQ ID NO: 781755 - DNA, 20 bp, mouse
gtaaggaagcaaaacctaga

SEQ ID NO: 781756 - DNA, 20 bp, mouse
gaaaaagaagccagtggttg

SEQ ID NO: 781757 - DNA, 20 bp, mouse
ggcgccaccgtgcggtctca

SEQ ID NO: 781758 - DNA, 20 bp, mouse
gattctaggtggtgagaaac

SEQ ID NO: 781759 - DNA, 20 bp, mouse
ggctccgtgagaccgcacgg

SEQ ID NO: 781760 - DNA, 20 bp, mouse
gtctcaccacctagaatcaa

SEQ ID NO: 781761 - DNA, 20 bp, mouse
gaacctgagaacacacaccg

SEQ ID NO: 781762 - DNA, 20 bp, mouse
ggagaaactggccctgacaa

SEQ ID NO: 781763 - DNA, 20 bp, mouse
gtgcgtgaaaaactgtcccc

SEQ ID NO: 781764 - DNA, 20 bp, mouse
gtagtttagttcatgggtct

SEQ ID NO: 781765 - DNA, 20 bp, mouse
gactatgtaaccgcaaccac

SEQ ID NO: 781766 - DNA, 20 bp, mouse
gtgtgaagaaccaatttgaa

SEQ ID NO: 781767 - DNA, 20 bp, mouse
gaaaccaaaataacatgcta

SEQ ID NO: 781768 - DNA, 20 bp, mouse
gcccgctcatgcaaacaaag

SEQ ID NO: 781769 - DNA, 20 bp, mouse
gagacaaaatagaattagca

SEQ ID NO: 781770 - DNA, 20 bp, mouse
gttcccatagcatgttattt

SEQ ID NO: 781771 - DNA, 20 bp, mouse
gtcccctttgtttgcatgag

SEQ ID NO: 781772 - DNA, 20 bp, mouse
gcagcgtgattgctcagtta

SEQ ID NO: 781773 - DNA, 20 bp, mouse
gctcagttatggctgcaaac

SEQ ID NO: 781774 - DNA, 20 bp, mouse
gtatgaaatatgttatcaga

SEQ ID NO: 781775 - DNA, 20 bp, mouse
gtttcataaagatgtatgtg

SEQ ID NO: 781776 - DNA, 20 bp, mouse
gtggccttggttaggtgaaa

SEQ ID NO: 781777 - DNA, 20 bp, mouse
gaccaaggccaagtgataaa

SEQ ID NO: 781778 - DNA, 20 bp, mouse
gggcaaagagatagtgttca

SEQ ID NO: 781779 - DNA, 20 bp, mouse
gttaaagcacttggtatttc

SEQ ID NO: 781780 - DNA, 20 bp, mouse
gtgttcacggaacgtttcag

SEQ ID NO: 781781 - DNA, 20 bp, mouse
gctctcctaaggctgacctt

SEQ ID NO: 781782 - DNA, 20 bp, mouse
gtgaaagatggcatacttta

SEQ ID NO: 781783 - DNA, 20 bp, mouse
gaacctgtgaagacacatgg

SEQ ID NO: 781784 - DNA, 20 bp, mouse
gcgctgcaggataatgttac

SEQ ID NO: 781785 - DNA, 20 bp, mouse
gctgaactgctgtgtgtagt

SEQ ID NO: 781786 - DNA, 20 bp, mouse
gtggaagaaaggctgatcgc

SEQ ID NO: 781787 - DNA, 20 bp, mouse
ggcttctacaatactatgta

SEQ ID NO: 781788 - DNA, 20 bp, mouse
gtccacattagattgtggtt

SEQ ID NO: 781789 - DNA, 20 bp, mouse
gactatgtaaggcgtggata

SEQ ID NO: 781790 - DNA, 20 bp, mouse
gtcaagcaatgcacagagga

SEQ ID NO: 781791 - DNA, 20 bp, mouse
gcacagaggaaggataagca

SEQ ID NO: 781792 - DNA, 20 bp, mouse
gacttcctagttaaaatcta

SEQ ID NO: 781793 - DNA, 20 bp, mouse
gtacaatactatgtaaggcg

SEQ ID NO: 781794 - DNA, 20 bp, mouse
gagaaattaactttatgaga

SEQ ID NO: 781795 - DNA, 20 bp, mouse
gcctcagaaataaaaggaac

SEQ ID NO: 781796 - DNA, 20 bp, mouse
gagacacatggtggcgctat

SEQ ID NO: 781797 - DNA, 20 bp, mouse
gacaaaatgtcttgtgttgt

SEQ ID NO: 781798 - DNA, 20 bp, mouse
gaatgatttcatacagagta

SEQ ID NO: 781799 - DNA, 20 bp, mouse
gtagatagacataaaatttt

SEQ ID NO: 781800 - DNA, 20 bp, mouse
gcaaatatttaccaaagcgg

SEQ ID NO: 781801 - DNA, 20 bp, mouse
gcaaatatttaccaccgctt

SEQ ID NO: 781802 - DNA, 20 bp, mouse
gcaacaaatatttaccaaag

SEQ ID NO: 781803 - DNA, 20 bp, mouse
ggtgtaaatggtaatgtaat

SEQ ID NO: 781804 - DNA, 20 bp, mouse
gtatttctacacatctattg

SEQ ID NO: 781805 - DNA, 20 bp, mouse
gatttgtaattatattttaa

SEQ ID NO: 781806 - DNA, 20 bp, mouse
ggacctgcatagtcacatgg

SEQ ID NO: 781807 - DNA, 20 bp, mouse
gcatggtggcgctgcaggac

SEQ ID NO: 781808 - DNA, 20 bp, mouse
gtgtgactatgcaggtcatt

SEQ ID NO: 781809 - DNA, 20 bp, mouse
gcgccaccatgtgactatgc

SEQ ID NO: 781810 - DNA, 20 bp, mouse
gatcacaataaattactgtc

SEQ ID NO: 781811 - DNA, 20 bp, mouse
gctctcagaaaaggcagaaa

SEQ ID NO: 781812 - DNA, 20 bp, mouse
gtgggcaaatagttgtttgg

SEQ ID NO: 781813 - DNA, 20 bp, mouse
gtaaatggtaccattttctt

SEQ ID NO: 781814 - DNA, 20 bp, mouse
gttgaagttgagtctggtat

SEQ ID NO: 781815 - DNA, 20 bp, mouse
gtgtttctcaacagcagctc

SEQ ID NO: 781816 - DNA, 20 bp, mouse
ggaagagcatagtcaacgca

SEQ ID NO: 781817 - DNA, 20 bp, mouse
gaagtgcttcttcagatccc

SEQ ID NO: 781818 - DNA, 20 bp, mouse
gccaactggaaccacaattt

SEQ ID NO: 781819 - DNA, 20 bp, mouse
gaaaaatgaggaccgaaaaa

SEQ ID NO: 781820 - DNA, 20 bp, mouse
gttgtgatttttagaatcta

SEQ ID NO: 781821 - DNA, 20 bp, mouse
gattctttttacagtctatt

SEQ ID NO: 781822 - DNA, 20 bp, mouse
ggagcatagtcaacgcatgg

SEQ ID NO: 781823 - DNA, 20 bp, mouse
gggctaagactttaaaaatg

SEQ ID NO: 781824 - DNA, 20 bp, mouse
gtcttcaacagattgcagca

SEQ ID NO: 781825 - DNA, 20 bp, mouse
gtttttgttgaacgaaagac

SEQ ID NO: 781826 - DNA, 20 bp, mouse
gacaagaaactccttcagta

SEQ ID NO: 781827 - DNA, 20 bp, mouse
ggtgccacacaagttaaact

SEQ ID NO: 781828 - DNA, 20 bp, mouse
ggggtcaagagatttgataa

SEQ ID NO: 781829 - DNA, 20 bp, mouse
gtacaagtgcacacctgcta

SEQ ID NO: 781830 - DNA, 20 bp, mouse
ggtgagggtagtaccctagc

SEQ ID NO: 781831 - DNA, 20 bp, mouse
gataagacagcttatatcaa

SEQ ID NO: 781832 - DNA, 20 bp, mouse
gtaggtagtaattacaggtg

SEQ ID NO: 781833 - DNA, 20 bp, mouse
gaatctcttgaccctactga

SEQ ID NO: 781834 - DNA, 20 bp, mouse
gactgagaacgaacgcatgg

SEQ ID NO: 781835 - DNA, 20 bp, mouse
gagaaccattatgaaaactg

SEQ ID NO: 781836 - DNA, 20 bp, mouse
gtaagtggaactccccaagt

SEQ ID NO: 781837 - DNA, 20 bp, mouse
gaaagggaacacaatgaaaa

SEQ ID NO: 781838 - DNA, 20 bp, mouse
ggtactaaaacttcccactt

SEQ ID NO: 781839 - DNA, 20 bp, mouse
gtttaacaagtgagcgaaaa

SEQ ID NO: 781840 - DNA, 20 bp, mouse
gagtgaataaggacgcttgg

SEQ ID NO: 781841 - DNA, 20 bp, mouse
ggattcggtaatggcttcca

SEQ ID NO: 781842 - DNA, 20 bp, mouse
gttcccaactgcttgttaac

SEQ ID NO: 781843 - DNA, 20 bp, mouse
gtgcatcggcctgttaatga

SEQ ID NO: 781844 - DNA, 20 bp, mouse
ggcctgttaatgatggttgt

SEQ ID NO: 781845 - DNA, 20 bp, mouse
gatgggttctgctgatgccc

SEQ ID NO: 781846 - DNA, 20 bp, mouse
gtcccaccaattggccatat

SEQ ID NO: 781847 - DNA, 20 bp, mouse
gtggcggttatttcatcgtc

SEQ ID NO: 781848 - DNA, 20 bp, mouse
gtcccatatggccaattggt

SEQ ID NO: 781849 - DNA, 20 bp, mouse
gaaattcttctggcacatgc

SEQ ID NO: 781850 - DNA, 20 bp, mouse
gaggaccaggaagcatttag

SEQ ID NO: 781851 - DNA, 20 bp, mouse
ggcttttctaaatgtccctt

SEQ ID NO: 781852 - DNA, 20 bp, mouse
gtttcaatatgaacgcaggg

SEQ ID NO: 781853 - DNA, 20 bp, mouse
gctgctttaagttgtataat

SEQ ID NO: 781854 - DNA, 20 bp, mouse
gttaattcaattatcccata

SEQ ID NO: 781855 - DNA, 20 bp, mouse
gattgacagcattttcaaat

SEQ ID NO: 781856 - DNA, 20 bp, mouse
gaaaaaccggcgttgtgctt

SEQ ID NO: 781857 - DNA, 20 bp, mouse
gttctcagttcagccctgtt

SEQ ID NO: 781858 - DNA, 20 bp, mouse
gactagaatagcacacacgg

SEQ ID NO: 781859 - DNA, 20 bp, mouse
gattactgcagcaaatgtgt

SEQ ID NO: 781860 - DNA, 20 bp, mouse
gtgaaatgtaacatatgcat

SEQ ID NO: 781861 - DNA, 20 bp, mouse
gagaacaacaaggagtcatc

SEQ ID NO: 781862 - DNA, 20 bp, mouse
gtgtaacatatgcataggaa

SEQ ID NO: 781863 - DNA, 20 bp, mouse
gtgttctgaacactaaagat

SEQ ID NO: 781864 - DNA, 20 bp, mouse
gctcttcctaagcacaacgc

SEQ ID NO: 781865 - DNA, 20 bp, mouse
gatgttacatttcattgtaa

SEQ ID NO: 781866 - DNA, 20 bp, mouse
gctcctcaggtgcacagttt

SEQ ID NO: 781867 - DNA, 20 bp, mouse
gtatcaaagtggacgcaggg

SEQ ID NO: 781868 - DNA, 20 bp, mouse
gttcactttcacgactcctc

SEQ ID NO: 781869 - DNA, 20 bp, mouse
gcacggtgataaactatcaa

SEQ ID NO: 781870 - DNA, 20 bp, mouse
gctagtctttgcataaatgg

SEQ ID NO: 781871 - DNA, 20 bp, mouse
ggtatgcaaatgttttttct

SEQ ID NO: 781872 - DNA, 20 bp, mouse
ggaaatagctacaaaccaaa

SEQ ID NO: 781873 - DNA, 20 bp, mouse
gcaactagtctttgcataaa

SEQ ID NO: 781874 - DNA, 20 bp, mouse
gtattgcaacaagcgattcc

SEQ ID NO: 781875 - DNA, 20 bp, mouse
gcacttttaaaacgacaatt

SEQ ID NO: 781876 - DNA, 20 bp, mouse
gtaaaagatacttcactgta

SEQ ID NO: 781877 - DNA, 20 bp, mouse
gctgtcgtaaatatctacga

SEQ ID NO: 781878 - DNA, 20 bp, mouse
gaaaagacgacatagttcct

SEQ ID NO: 781879 - DNA, 20 bp, mouse
ggctagagtagtacacacgg

SEQ ID NO: 781880 - DNA, 20 bp, mouse
gtatacagcacgagtcacca

SEQ ID NO: 781881 - DNA, 20 bp, mouse
gcgtgctgtatacttaagac

SEQ ID NO: 781882 - DNA, 20 bp, mouse
gcttgggtaagtttcgtcta

SEQ ID NO: 781883 - DNA, 20 bp, mouse
gagatacttcactgtagggc

SEQ ID NO: 781884 - DNA, 20 bp, mouse
gttaaaactagtgaatagca

SEQ ID NO: 781885 - DNA, 20 bp, mouse
gttcctttgctagctttctt

SEQ ID NO: 781886 - DNA, 20 bp, mouse
gcgccaccctgtgtcttttt

SEQ ID NO: 781887 - DNA, 20 bp, mouse
gtcaaagtatatgtgggaag

SEQ ID NO: 781888 - DNA, 20 bp, mouse
gatcccaaaaagacacaggg

SEQ ID NO: 781889 - DNA, 20 bp, mouse
gcaaaagttcaaagtatatg

SEQ ID NO: 781890 - DNA, 20 bp, mouse
gactgtgttttgacactaaa

SEQ ID NO: 781891 - DNA, 20 bp, mouse
gtatctaattatgcagtata

SEQ ID NO: 781892 - DNA, 20 bp, mouse
ggtatattgtttttgttctc

SEQ ID NO: 781893 - DNA, 20 bp, mouse
gtgatacaattctagcttta

SEQ ID NO: 781894 - DNA, 20 bp, mouse
ggcaaaccaaaatttaatat

SEQ ID NO: 781895 - DNA, 20 bp, mouse
gattatcccaaaaagacaca

SEQ ID NO: 781896 - DNA, 20 bp, mouse
gagcgctggacaggaaactc

SEQ ID NO: 781897 - DNA, 20 bp, mouse
ggggagcaaactcaatctgc

SEQ ID NO: 781898 - DNA, 20 bp, mouse
gccggggcgccgaaagggga

SEQ ID NO: 781899 - DNA, 20 bp, mouse
gtcatcccggggcgccgaaa

SEQ ID NO: 781900 - DNA, 20 bp, mouse
ggtgtcctgctcaaagaacc

SEQ ID NO: 781901 - DNA, 20 bp, mouse
ggcattcttcgtgcagttat

SEQ ID NO: 781902 - DNA, 20 bp, mouse
gtcttcgtgcagttattggc

SEQ ID NO: 781903 - DNA, 20 bp, mouse
gggcaaaacgagagcaaatt

SEQ ID NO: 781904 - DNA, 20 bp, mouse
gcaggaacttcactttgctc

SEQ ID NO: 781905 - DNA, 20 bp, mouse
gaatgaagatgctggagatc

SEQ ID NO: 781906 - DNA, 20 bp, mouse
ggggctgtgggacggaaggt

SEQ ID NO: 781907 - DNA, 20 bp, mouse
gaaaaggcagagtccccgag

SEQ ID NO: 781908 - DNA, 20 bp, mouse
gctggcgtccgtccctatgg

SEQ ID NO: 781909 - DNA, 20 bp, mouse
gcagacaagcaaggtaagct

SEQ ID NO: 781910 - DNA, 20 bp, mouse
gtggccggggcgagcattgc

SEQ ID NO: 781911 - DNA, 20 bp, mouse
gccagcacgcgtagtggccg

SEQ ID NO: 781912 - DNA, 20 bp, mouse
gtgctgaagtcggaccacag

SEQ ID NO: 781913 - DNA, 20 bp, mouse
gggactgttacactgcgaac

SEQ ID NO: 781914 - DNA, 20 bp, mouse
gttagcggccatcagaactg

SEQ ID NO: 781915 - DNA, 20 bp, mouse
gggaccacaggggctctcac

SEQ ID NO: 781916 - DNA, 20 bp, mouse
gagactgtcgcattgagaga

SEQ ID NO: 781917 - DNA, 20 bp, mouse
gaagccgcagcggctcggag

SEQ ID NO: 781918 - DNA, 20 bp, mouse
gcgactggcaagagactcag

SEQ ID NO: 781919 - DNA, 20 bp, mouse
ggagtggtcggctagaccga

SEQ ID NO: 781920 - DNA, 20 bp, mouse
gccgagcgcaccgccgtcgg

SEQ ID NO: 781921 - DNA, 20 bp, mouse
gggtccgcgcgtccgcctgc

SEQ ID NO: 781922 - DNA, 20 bp, mouse
gcttccgagcgcaccgccgt

SEQ ID NO: 781923 - DNA, 20 bp, mouse
gctgcctagagctgtcaaac

SEQ ID NO: 781924 - DNA, 20 bp, mouse
gtgacagctctaggcagggt

SEQ ID NO: 781925 - DNA, 20 bp, mouse
gcggggcgcaaaccggcagg

SEQ ID NO: 781926 - DNA, 20 bp, mouse
gacgcggtgcaaaggacggt

SEQ ID NO: 781927 - DNA, 20 bp, mouse
gcagggaagccagtagagga

SEQ ID NO: 781928 - DNA, 20 bp, mouse
gtcggctttcgcaacacctc

SEQ ID NO: 781929 - DNA, 20 bp, mouse
ggaaagccgagactcgaccg

SEQ ID NO: 781930 - DNA, 20 bp, mouse
gcaagcaccgccttcttcct

SEQ ID NO: 781931 - DNA, 20 bp, mouse
ggctcggagacgcggtgcaa

SEQ ID NO: 781932 - DNA, 20 bp, mouse
ggctggcccgcgcgtgtcac

SEQ ID NO: 781933 - DNA, 20 bp, mouse
ggcttggacgtattgcggaa

SEQ ID NO: 781934 - DNA, 20 bp, mouse
ggcggtgcttggacgtattg

SEQ ID NO: 781935 - DNA, 20 bp, mouse
gtggaaacaccaggcgggat

SEQ ID NO: 781936 - DNA, 20 bp, mouse
gcacacggggagctaaagag

SEQ ID NO: 781937 - DNA, 20 bp, mouse
gcggtggtcgttatggaggg

SEQ ID NO: 781938 - DNA, 20 bp, mouse
gccgttggaaggacgcccgt

SEQ ID NO: 781939 - DNA, 20 bp, mouse
gggagctaaagagggggcga

SEQ ID NO: 781940 - DNA, 20 bp, mouse
gacgaccaccgattgttggg

SEQ ID NO: 781941 - DNA, 20 bp, mouse
gtgaggagacgccatcttaa

SEQ ID NO: 781942 - DNA, 20 bp, mouse
gctgcccccccaacaatcgg

SEQ ID NO: 781943 - DNA, 20 bp, mouse
gccgcaggcggtaccggaag

SEQ ID NO: 781944 - DNA, 20 bp, mouse
gccgctgcccccccaacaat

SEQ ID NO: 781945 - DNA, 20 bp, mouse
gtcccaggactcccacactc

SEQ ID NO: 781946 - DNA, 20 bp, mouse
gaggtcacgtgggtgagtag

SEQ ID NO: 781947 - DNA, 20 bp, mouse
gtgaaggaatgaggtcacgt

SEQ ID NO: 781948 - DNA, 20 bp, mouse
ggggccggcgagcgcgaagg

SEQ ID NO: 781949 - DNA, 20 bp, mouse
gccacccagcgctcgctctc

SEQ ID NO: 781950 - DNA, 20 bp, mouse
gaagcccagcgcaaggcggt

SEQ ID NO: 781951 - DNA, 20 bp, mouse
gaggtgcgaggaccccgaat

SEQ ID NO: 781952 - DNA, 20 bp, mouse
gggaagcgaggagtcgagag

SEQ ID NO: 781953 - DNA, 20 bp, mouse
ggcccggagccgctggggac

SEQ ID NO: 781954 - DNA, 20 bp, mouse
ggtagggatcgcagagtcgg

SEQ ID NO: 781955 - DNA, 20 bp, mouse
gccggggcccggagccgctg

SEQ ID NO: 781956 - DNA, 20 bp, mouse
ggaagctggctcggcgagac

SEQ ID NO: 781957 - DNA, 20 bp, mouse
gtggctcggcgagacaggca

SEQ ID NO: 781958 - DNA, 20 bp, mouse
gtgcaggcagcaattgactc

SEQ ID NO: 781959 - DNA, 20 bp, mouse
gaggcggggcctctgaaagg

SEQ ID NO: 781960 - DNA, 20 bp, mouse
ggacaggcagggtggagctc

SEQ ID NO: 781961 - DNA, 20 bp, mouse
gtgcacgcgcctgcgctctc

SEQ ID NO: 781962 - DNA, 20 bp, mouse
gcacaggtgagaggtgggtc

SEQ ID NO: 781963 - DNA, 20 bp, mouse
ggtggtcacaggtgagaggt

SEQ ID NO: 781964 - DNA, 20 bp, mouse
gcccacctcgcaaacgagag

SEQ ID NO: 781965 - DNA, 20 bp, mouse
gaaggcggagcctatagggg

SEQ ID NO: 781966 - DNA, 20 bp, mouse
gagcacgagccggcgggcgt

SEQ ID NO: 781967 - DNA, 20 bp, mouse
ggggcgtggcccacgaggaa

SEQ ID NO: 781968 - DNA, 20 bp, mouse
gccccacgccctttcctcgt

SEQ ID NO: 781969 - DNA, 20 bp, mouse
ggcccccagcccacgcccgc

SEQ ID NO: 781970 - DNA, 20 bp, mouse
ggaggaaagggcgtggggac

SEQ ID NO: 781971 - DNA, 20 bp, mouse
gagggcactcagggtgtccc

SEQ ID NO: 781972 - DNA, 20 bp, mouse
gtgtcacacaggagcaacaa

SEQ ID NO: 781973 - DNA, 20 bp, mouse
gaaccctgagagggatggcg

SEQ ID NO: 781974 - DNA, 20 bp, mouse
gggggcgtggtcggcgagag

SEQ ID NO: 781975 - DNA, 20 bp, mouse
gggtgtcccaggcgcctagg

SEQ ID NO: 781976 - DNA, 20 bp, mouse
gaggtgaggcggagctgctc

SEQ ID NO: 781977 - DNA, 20 bp, mouse
gagctgctcaggttggggcg

SEQ ID NO: 781978 - DNA, 20 bp, mouse
gaggcggagctgctcaggtt

SEQ ID NO: 781979 - DNA, 20 bp, mouse
gtgcgcactggtacgaaagg

SEQ ID NO: 781980 - DNA, 20 bp, mouse
gaggcgccggcgctccgcag

SEQ ID NO: 781981 - DNA, 20 bp, mouse
gtccgtctcagcctcgtcca

SEQ ID NO: 781982 - DNA, 20 bp, mouse
gcgtgtgggccacgccttga

SEQ ID NO: 781983 - DNA, 20 bp, mouse
gatggcggggatcagaaatc

SEQ ID NO: 781984 - DNA, 20 bp, mouse
ggaaaacaagcgcgcctctg

SEQ ID NO: 781985 - DNA, 20 bp, mouse
gcgaggcaaggcgagtcgga

SEQ ID NO: 781986 - DNA, 20 bp, mouse
ggggtcaccctcatgggaga

SEQ ID NO: 781987 - DNA, 20 bp, mouse
gccgccccacgtcacgtcga

SEQ ID NO: 781988 - DNA, 20 bp, mouse
gcggacgagggccctcggaa

SEQ ID NO: 781989 - DNA, 20 bp, mouse
gtggggcaccccagataaat

SEQ ID NO: 781990 - DNA, 20 bp, mouse
ggcgtccggcccagccatgg

SEQ ID NO: 781991 - DNA, 20 bp, mouse
gggagaggggtgcgaggaat

SEQ ID NO: 781992 - DNA, 20 bp, mouse
ggacgcctcgggtgcggcgg

SEQ ID NO: 781993 - DNA, 20 bp, mouse
gctagcgcgccgaggggttg

SEQ ID NO: 781994 - DNA, 20 bp, mouse
ggacacgttcccaagtcggt

SEQ ID NO: 781995 - DNA, 20 bp, mouse
gcgccgggacgcctcgggtg

SEQ ID NO: 781996 - DNA, 20 bp, mouse
gcgaaagccatcaaggtctg

SEQ ID NO: 781997 - DNA, 20 bp, mouse
gagggaccacccagatcaac

SEQ ID NO: 781998 - DNA, 20 bp, mouse
gcaaccggaaaatggggagt

SEQ ID NO: 781999 - DNA, 20 bp, mouse
gcccccaactccccattttc

SEQ ID NO: 782000 - DNA, 20 bp, mouse
gagagccggggcgttatgat

SEQ ID NO: 782001 - DNA, 20 bp, mouse
gccgtggcgaggtccttcag

SEQ ID NO: 782002 - DNA, 20 bp, mouse
gctgcccgaagcggactcga

SEQ ID NO: 782003 - DNA, 20 bp, mouse
gtcgcaggggctgaagatct

SEQ ID NO: 782004 - DNA, 20 bp, mouse
gataacgccccggctctggt

SEQ ID NO: 782005 - DNA, 20 bp, mouse
gggcccgggacacaagatgg

SEQ ID NO: 782006 - DNA, 20 bp, mouse
gactcactatggctgataga

SEQ ID NO: 782007 - DNA, 20 bp, mouse
ggttgtgtaaggactcacta

SEQ ID NO: 782008 - DNA, 20 bp, mouse
ggacgtaaggggcaggcctt

SEQ ID NO: 782009 - DNA, 20 bp, mouse
ggacccccacctgacaatta

SEQ ID NO: 782010 - DNA, 20 bp, mouse
gggctcgcctctgacgtaag

SEQ ID NO: 782011 - DNA, 20 bp, mouse
ggaccatggctatgatccaa

SEQ ID NO: 782012 - DNA, 20 bp, mouse
gggcctgccccttacgtcag

SEQ ID NO: 782013 - DNA, 20 bp, mouse
gcgggtccagctgaggggca

SEQ ID NO: 782014 - DNA, 20 bp, mouse
ggagataatgattgaacttg

SEQ ID NO: 782015 - DNA, 20 bp, mouse
gagcctccgggtccagctga

SEQ ID NO: 782016 - DNA, 20 bp, mouse
gacagcgtggctggccgagt

SEQ ID NO: 782017 - DNA, 20 bp, mouse
gagcccggggccttgagccc

SEQ ID NO: 782018 - DNA, 20 bp, mouse
gagcccgggctcaaggcccc

SEQ ID NO: 782019 - DNA, 20 bp, mouse
gtaggccggctcactagccc

SEQ ID NO: 782020 - DNA, 20 bp, mouse
gccccggggcggaacctagc

SEQ ID NO: 782021 - DNA, 20 bp, mouse
gagtgagccggcctacagaa

SEQ ID NO: 782022 - DNA, 20 bp, mouse
gaaccagctaggttccgccc

SEQ ID NO: 782023 - DNA, 20 bp, mouse
gaggcgggcagtccccgggg

SEQ ID NO: 782024 - DNA, 20 bp, mouse
gcaaaacaagttaagagtga

SEQ ID NO: 782025 - DNA, 20 bp, mouse
gaggaggcgggcagtccccg

SEQ ID NO: 782026 - DNA, 20 bp, mouse
gcccgagcgtcacgtgactc

SEQ ID NO: 782027 - DNA, 20 bp, mouse
gcgggggcgagaactcgccg

SEQ ID NO: 782028 - DNA, 20 bp, mouse
ggagccgcagtgcgaactcc

SEQ ID NO: 782029 - DNA, 20 bp, mouse
gccagaatgcccactcaact

SEQ ID NO: 782030 - DNA, 20 bp, mouse
gggggcggtacgtgactcca

SEQ ID NO: 782031 - DNA, 20 bp, mouse
ggtgacgctcgggccttccg

SEQ ID NO: 782032 - DNA, 20 bp, mouse
gacgtaccgcccctctagtc

SEQ ID NO: 782033 - DNA, 20 bp, mouse
gggctccgctgtgtttttta

SEQ ID NO: 782034 - DNA, 20 bp, mouse
ggggtaggaatgcactacaa

SEQ ID NO: 782035 - DNA, 20 bp, mouse
gagcgcggtctcctcggcaa

SEQ ID NO: 782036 - DNA, 20 bp, mouse
gggcgataaccagtgctcgg

SEQ ID NO: 782037 - DNA, 20 bp, mouse
gctcgccggccgcaggacgg

SEQ ID NO: 782038 - DNA, 20 bp, mouse
gcccgcatcagccagagccg

SEQ ID NO: 782039 - DNA, 20 bp, mouse
gtggagcccagtagcgagcg

SEQ ID NO: 782040 - DNA, 20 bp, mouse
gcacggtcctgatgaagcag

SEQ ID NO: 782041 - DNA, 20 bp, mouse
gtgcacctgcctccgtcctg

SEQ ID NO: 782042 - DNA, 20 bp, mouse
ggcccgcggcgggggagtcc

SEQ ID NO: 782043 - DNA, 20 bp, mouse
gagcggccggtctgctccta

SEQ ID NO: 782044 - DNA, 20 bp, mouse
gccaagaaggcggcacacgt

SEQ ID NO: 782045 - DNA, 20 bp, mouse
gtagcaatctagacagccat

SEQ ID NO: 782046 - DNA, 20 bp, mouse
gagggcgttcagcgagaggg

SEQ ID NO: 782047 - DNA, 20 bp, mouse
gtccaacccagctgagggtg

SEQ ID NO: 782048 - DNA, 20 bp, mouse
gaacgcgaggcttgcccaag

SEQ ID NO: 782049 - DNA, 20 bp, mouse
gaacacccccaccctcagct

SEQ ID NO: 782050 - DNA, 20 bp, mouse
gggcagggcgttcagcgaga

SEQ ID NO: 782051 - DNA, 20 bp, mouse
gtctccgcgggtctctgtat

SEQ ID NO: 782052 - DNA, 20 bp, mouse
gacgcgcagctcccaggagg

SEQ ID NO: 782053 - DNA, 20 bp, mouse
ggcggagtccaacccagctg

SEQ ID NO: 782054 - DNA, 20 bp, mouse
gcgggagctgccagccgctt

SEQ ID NO: 782055 - DNA, 20 bp, mouse
gggaggagccccagctctcg

SEQ ID NO: 782056 - DNA, 20 bp, mouse
gcaaaccagtgggtggaaag

SEQ ID NO: 782057 - DNA, 20 bp, mouse
gtagcagcggatgtttacag

SEQ ID NO: 782058 - DNA, 20 bp, mouse
gtgaactgagcatgtgcggt

SEQ ID NO: 782059 - DNA, 20 bp, mouse
ggaagatgctggcgtgtcga

SEQ ID NO: 782060 - DNA, 20 bp, mouse
gacctagtgactgaccaatc

SEQ ID NO: 782061 - DNA, 20 bp, mouse
gccagtgggtggaaagtggc

SEQ ID NO: 782062 - DNA, 20 bp, mouse
gctggcgtgtcgacgggaga

SEQ ID NO: 782063 - DNA, 20 bp, mouse
ggtgactgaccaatcaggca

SEQ ID NO: 782064 - DNA, 20 bp, mouse
gaggtagcctggcagggtca

SEQ ID NO: 782065 - DNA, 20 bp, mouse
gcattaggccgggatatgct

SEQ ID NO: 782066 - DNA, 20 bp, mouse
gggcatcacggggttcgcgt

SEQ ID NO: 782067 - DNA, 20 bp, mouse
ggggctgcggggtaggagcc

SEQ ID NO: 782068 - DNA, 20 bp, mouse
gtgcggggtaggagcctggg

SEQ ID NO: 782069 - DNA, 20 bp, mouse
gtaggagcctgggaggcgag

SEQ ID NO: 782070 - DNA, 20 bp, mouse
gcgccccaccgcgtatgcaa

SEQ ID NO: 782071 - DNA, 20 bp, mouse
gccaccgcgtatgcaaaggc

SEQ ID NO: 782072 - DNA, 20 bp, mouse
gtgggaggcgaggggcatca

SEQ ID NO: 782073 - DNA, 20 bp, mouse
gcaaatcgagctgtgcgcgg

SEQ ID NO: 782074 - DNA, 20 bp, mouse
gcggcggcctgccttgaagc

SEQ ID NO: 782075 - DNA, 20 bp, mouse
gcgggccttgctcaaaccac

SEQ ID NO: 782076 - DNA, 20 bp, mouse
ggaaacttatagaggagtac

SEQ ID NO: 782077 - DNA, 20 bp, mouse
gttacagaataagccattgc

SEQ ID NO: 782078 - DNA, 20 bp, mouse
gtcaacttaggaatgttgaa

SEQ ID NO: 782079 - DNA, 20 bp, mouse
gatggtgctgtcacaaatgg

SEQ ID NO: 782080 - DNA, 20 bp, mouse
gcaaatggtgctgtcacaaa

SEQ ID NO: 782081 - DNA, 20 bp, mouse
ggccactaacaaattgtaaa

SEQ ID NO: 782082 - DNA, 20 bp, mouse
gaacaaagatttctcaactt

SEQ ID NO: 782083 - DNA, 20 bp, mouse
ggtcttttttttctactgtg

SEQ ID NO: 782084 - DNA, 20 bp, mouse
gtccttttacaatttgttag

SEQ ID NO: 782085 - DNA, 20 bp, mouse
gctcaagtctaagtgaatca

SEQ ID NO: 782086 - DNA, 20 bp, mouse
ggggacggatgtgacgtcgt

SEQ ID NO: 782087 - DNA, 20 bp, mouse
gaggacctggaacccgagac

SEQ ID NO: 782088 - DNA, 20 bp, mouse
ggaacccaccgttccacgat

SEQ ID NO: 782089 - DNA, 20 bp, mouse
ggtgacggctatggaggact

SEQ ID NO: 782090 - DNA, 20 bp, mouse
gggaacgaggtgtgtggtga

SEQ ID NO: 782091 - DNA, 20 bp, mouse
gaggtgtgtggtgacggcta

SEQ ID NO: 782092 - DNA, 20 bp, mouse
gctggaacccgagacgggga

SEQ ID NO: 782093 - DNA, 20 bp, mouse
gagtacggactcaccgatcg

SEQ ID NO: 782094 - DNA, 20 bp, mouse
gctcaccgatcgtggaacgg

SEQ ID NO: 782095 - DNA, 20 bp, mouse
gtgtgtggtgacggctatgg

SEQ ID NO: 782096 - DNA, 20 bp, mouse
gaacgccgcgcctcgctcat

SEQ ID NO: 782097 - DNA, 20 bp, mouse
gagtgcccagagcgcaccgg

SEQ ID NO: 782098 - DNA, 20 bp, mouse
gcgctccgctgacgctccaa

SEQ ID NO: 782099 - DNA, 20 bp, mouse
gtcattggcgtggatgaaga

SEQ ID NO: 782100 - DNA, 20 bp, mouse
gtagcaccgcctcgggaaaa

SEQ ID NO: 782101 - DNA, 20 bp, mouse
gcgtcgactgggcggcggga

SEQ ID NO: 782102 - DNA, 20 bp, mouse
ggcgacagaaaaaacgactt

SEQ ID NO: 782103 - DNA, 20 bp, mouse
gcggcgttcccggggctcgc

SEQ ID NO: 782104 - DNA, 20 bp, mouse
gagcgtcggcgtaccaattg

SEQ ID NO: 782105 - DNA, 20 bp, mouse
ggccacacggggctccggat

SEQ ID NO: 782106 - DNA, 20 bp, mouse
gcgcacgggcgcctcctgtt

SEQ ID NO: 782107 - DNA, 20 bp, mouse
gcagaagcagcatctggccg

SEQ ID NO: 782108 - DNA, 20 bp, mouse
gaagcagcatctggccgggg

SEQ ID NO: 782109 - DNA, 20 bp, mouse
gtctgcaggcttctcccaac

SEQ ID NO: 782110 - DNA, 20 bp, mouse
gaggcgctgcgcgtacccgt

SEQ ID NO: 782111 - DNA, 20 bp, mouse
gcccgtggggaccgctccgc

SEQ ID NO: 782112 - DNA, 20 bp, mouse
gttgcaaactcggacccgac

SEQ ID NO: 782113 - DNA, 20 bp, mouse
ggccatccgggttgcaaact

SEQ ID NO: 782114 - DNA, 20 bp, mouse
gaacccggatggcactgcac

SEQ ID NO: 782115 - DNA, 20 bp, mouse
ggaggaagccgcgccccctc

SEQ ID NO: 782116 - DNA, 20 bp, mouse
gcgcccacacaagtctgcga

SEQ ID NO: 782117 - DNA, 20 bp, mouse
gcctcacacgggaacattct

SEQ ID NO: 782118 - DNA, 20 bp, mouse
gagtccctccctctccttgg

SEQ ID NO: 782119 - DNA, 20 bp, mouse
gaccttgcaaacttactctt

SEQ ID NO: 782120 - DNA, 20 bp, mouse
gccaagaagtttcctgtctg

SEQ ID NO: 782121 - DNA, 20 bp, mouse
gcgtccaattaggtaatcgg

SEQ ID NO: 782122 - DNA, 20 bp, mouse
gctccttcgcagacttgtgt

SEQ ID NO: 782123 - DNA, 20 bp, mouse
gccccgcaggtggagctcag

SEQ ID NO: 782124 - DNA, 20 bp, mouse
gtcccaagagtaagtttgca

SEQ ID NO: 782125 - DNA, 20 bp, mouse
ggggatcaaagccccgcagg

SEQ ID NO: 782126 - DNA, 20 bp, mouse
gcggagaagtagcgaagtga

SEQ ID NO: 782127 - DNA, 20 bp, mouse
ggagaggcggcccaagtcgg

SEQ ID NO: 782128 - DNA, 20 bp, mouse
gcaggcctgagtagtcgaac

SEQ ID NO: 782129 - DNA, 20 bp, mouse
gcggccgtcccatattttgg

SEQ ID NO: 782130 - DNA, 20 bp, mouse
gtggagaatgggactcctca

SEQ ID NO: 782131 - DNA, 20 bp, mouse
gaaggagaggcggcccaagt

SEQ ID NO: 782132 - DNA, 20 bp, mouse
gtacccaatggcgactcacc

SEQ ID NO: 782133 - DNA, 20 bp, mouse
gtctagagccaccaaaatat

SEQ ID NO: 782134 - DNA, 20 bp, mouse
ggcgcccgttagaacctgtt

SEQ ID NO: 782135 - DNA, 20 bp, mouse
gacccggccgtcccatattt

SEQ ID NO: 782136 - DNA, 20 bp, mouse
gcaccagtgcggaagaagtc

SEQ ID NO: 782137 - DNA, 20 bp, mouse
gccgggcgggctagtgttgt

SEQ ID NO: 782138 - DNA, 20 bp, mouse
gcggcacagcagcgcagggt

SEQ ID NO: 782139 - DNA, 20 bp, mouse
gcggcagaaccaggcggcag

SEQ ID NO: 782140 - DNA, 20 bp, mouse
gacagcagcgcagggtaggc

SEQ ID NO: 782141 - DNA, 20 bp, mouse
gcaaccacgttccttcgtct

SEQ ID NO: 782142 - DNA, 20 bp, mouse
gtggtgctctggttcttgag

SEQ ID NO: 782143 - DNA, 20 bp, mouse
ggtgtgcggcacagcagcgc

SEQ ID NO: 782144 - DNA, 20 bp, mouse
gcgcgtgcgcactgacccct

SEQ ID NO: 782145 - DNA, 20 bp, mouse
gacgcccagacgaaggaacg

SEQ ID NO: 782146 - DNA, 20 bp, mouse
gacctagagaggcctctgaa

SEQ ID NO: 782147 - DNA, 20 bp, mouse
ggaagtgtgcagtgggacag

SEQ ID NO: 782148 - DNA, 20 bp, mouse
gtggggactggccaactggg

SEQ ID NO: 782149 - DNA, 20 bp, mouse
gcacccggggctgcttcatc

SEQ ID NO: 782150 - DNA, 20 bp, mouse
ggtccccaggcaaaggacag

SEQ ID NO: 782151 - DNA, 20 bp, mouse
gtagatgccgagaaagcaac

SEQ ID NO: 782152 - DNA, 20 bp, mouse
ggccccgggtgtgtgggcgt

SEQ ID NO: 782153 - DNA, 20 bp, mouse
gccccacgcccacacacccg

SEQ ID NO: 782154 - DNA, 20 bp, mouse
gtgaagcagccccgggtgtg

SEQ ID NO: 782155 - DNA, 20 bp, mouse
gagtgggtagccaagagact

SEQ ID NO: 782156 - DNA, 20 bp, mouse
gccgcccaggggacaggctg

SEQ ID NO: 782157 - DNA, 20 bp, mouse
gctgcggccgcccaggggac

SEQ ID NO: 782158 - DNA, 20 bp, mouse
gcccctgggcggccgcaggg

SEQ ID NO: 782159 - DNA, 20 bp, mouse
ggctggaagtccactatgga

SEQ ID NO: 782160 - DNA, 20 bp, mouse
gcccccaccccggaaaacca

SEQ ID NO: 782161 - DNA, 20 bp, mouse
ggtcctgggtaccgctggcg

SEQ ID NO: 782162 - DNA, 20 bp, mouse
gcgcgtcccctggggaaatt

SEQ ID NO: 782163 - DNA, 20 bp, mouse
gtaaagcgagagttaagggc

SEQ ID NO: 782164 - DNA, 20 bp, mouse
ggaccagccttggttttccg

SEQ ID NO: 782165 - DNA, 20 bp, mouse
gcagccttggttttccgggg

SEQ ID NO: 782166 - DNA, 20 bp, mouse
gtcacatggtactgactcta

SEQ ID NO: 782167 - DNA, 20 bp, mouse
gtaaaaggctagggtgtagg

SEQ ID NO: 782168 - DNA, 20 bp, mouse
gacacacagggggtataggt

SEQ ID NO: 782169 - DNA, 20 bp, mouse
ggagctggggatttgggaat

SEQ ID NO: 782170 - DNA, 20 bp, mouse
gctagtacctactatctctt

SEQ ID NO: 782171 - DNA, 20 bp, mouse
ggtgccgagacctcaagaag

SEQ ID NO: 782172 - DNA, 20 bp, mouse
gccttctagacaaggtaaga

SEQ ID NO: 782173 - DNA, 20 bp, mouse
ggacctcaagaagcggatgg

SEQ ID NO: 782174 - DNA, 20 bp, mouse
gagtataagagcccctcctc

SEQ ID NO: 782175 - DNA, 20 bp, mouse
gcctcctcagggcaaatgaa

SEQ ID NO: 782176 - DNA, 20 bp, mouse
gagcgcaaagagccacctag

SEQ ID NO: 782177 - DNA, 20 bp, mouse
gggagcacagtggaactgcg

SEQ ID NO: 782178 - DNA, 20 bp, mouse
gagggtgggttcaaggggtg

SEQ ID NO: 782179 - DNA, 20 bp, mouse
gcctcccgccaaccaatgag

SEQ ID NO: 782180 - DNA, 20 bp, mouse
gcacagtggaactgcgtggc

SEQ ID NO: 782181 - DNA, 20 bp, mouse
gtgaatgagggtgggttcaa

SEQ ID NO: 782182 - DNA, 20 bp, mouse
ggccacctagtggagcacag

SEQ ID NO: 782183 - DNA, 20 bp, mouse
gtccactgtgctccactagg

SEQ ID NO: 782184 - DNA, 20 bp, mouse
gacaggtgaatgcctctcat

SEQ ID NO: 782185 - DNA, 20 bp, mouse
gaaattccttggttcctgga

SEQ ID NO: 782186 - DNA, 20 bp, mouse
gaggaggggggagaccatgg

SEQ ID NO: 782187 - DNA, 20 bp, mouse
gacaatgtgaggttgagcta

SEQ ID NO: 782188 - DNA, 20 bp, mouse
gagaagacagaaaacgaagt

SEQ ID NO: 782189 - DNA, 20 bp, mouse
gagggtaagacggagagagc

SEQ ID NO: 782190 - DNA, 20 bp, mouse
gcctgccaccactgggttca

SEQ ID NO: 782191 - DNA, 20 bp, mouse
gagctccttgaacccagtgg

SEQ ID NO: 782192 - DNA, 20 bp, mouse
gctgctgcatttccaaacta

SEQ ID NO: 782193 - DNA, 20 bp, mouse
gagaaaacgaagtagggaac

SEQ ID NO: 782194 - DNA, 20 bp, mouse
gcgaagtagggaaccggtaa

SEQ ID NO: 782195 - DNA, 20 bp, mouse
gtctgtcttctcatccccca

SEQ ID NO: 782196 - DNA, 20 bp, mouse
gaactggatggtattcccgg

SEQ ID NO: 782197 - DNA, 20 bp, mouse
ggtggagaagtgactaaaat

SEQ ID NO: 782198 - DNA, 20 bp, mouse
ggagaactggatggtattcc

SEQ ID NO: 782199 - DNA, 20 bp, mouse
ggaaaagaaactggtgggat

SEQ ID NO: 782200 - DNA, 20 bp, mouse
ggaagtgactaaaataggca

SEQ ID NO: 782201 - DNA, 20 bp, mouse
gtgactaaaataggcaggga

SEQ ID NO: 782202 - DNA, 20 bp, mouse
gtcttgacgtcagatctacc

SEQ ID NO: 782203 - DNA, 20 bp, mouse
gagagaaaatagatggaagg

SEQ ID NO: 782204 - DNA, 20 bp, mouse
gaccatccagttctcagtcc

SEQ ID NO: 782205 - DNA, 20 bp, mouse
ggatggtattcccggcgggg

SEQ ID NO: 782206 - DNA, 20 bp, mouse
ggtacgcaggcgcagaatta

SEQ ID NO: 782207 - DNA, 20 bp, mouse
gcgccatggagatgtccaag

SEQ ID NO: 782208 - DNA, 20 bp, mouse
gtgccccttggacatctcca

SEQ ID NO: 782209 - DNA, 20 bp, mouse
ggactcagtgggctgaaatc

SEQ ID NO: 782210 - DNA, 20 bp, mouse
gcgtacagtaggagacagtg

SEQ ID NO: 782211 - DNA, 20 bp, mouse
gcatctccatggcgatgcgc

SEQ ID NO: 782212 - DNA, 20 bp, mouse
gaggcgcagaattagggctc

SEQ ID NO: 782213 - DNA, 20 bp, mouse
ggcacagcagcagcgctctg

SEQ ID NO: 782214 - DNA, 20 bp, mouse
gggttgccatggcagtataa

SEQ ID NO: 782215 - DNA, 20 bp, mouse
gagtataagggcagttgcta

SEQ ID NO: 782216 - DNA, 20 bp, mouse
gtggctgcccgggtccccgg

SEQ ID NO: 782217 - DNA, 20 bp, mouse
ggcggggcccgccgatcctc

SEQ ID NO: 782218 - DNA, 20 bp, mouse
gcgggcagccagctgggcag

SEQ ID NO: 782219 - DNA, 20 bp, mouse
ggcctccagccctctagaat

SEQ ID NO: 782220 - DNA, 20 bp, mouse
gcccctcggggcctctgaag

SEQ ID NO: 782221 - DNA, 20 bp, mouse
gcgcccccgccagctcggag

SEQ ID NO: 782222 - DNA, 20 bp, mouse
gggcgggctcggggcggccc

SEQ ID NO: 782223 - DNA, 20 bp, mouse
gcgcgcccgccagcggccaa

SEQ ID NO: 782224 - DNA, 20 bp, mouse
gtggaggcgagcgccagccc

SEQ ID NO: 782225 - DNA, 20 bp, mouse
ggcccgccagcggccaatgg

SEQ ID NO: 782226 - DNA, 20 bp, mouse
gggaggggttgtccttgtat

SEQ ID NO: 782227 - DNA, 20 bp, mouse
gaagctgatcacgaaggagg

SEQ ID NO: 782228 - DNA, 20 bp, mouse
gagggggcgtggagaaaagt

SEQ ID NO: 782229 - DNA, 20 bp, mouse
gcggcagcgaggagtcccga

SEQ ID NO: 782230 - DNA, 20 bp, mouse
ggagaaagtgaggttcccga

SEQ ID NO: 782231 - DNA, 20 bp, mouse
gagtgggcggggccaaataa

SEQ ID NO: 782232 - DNA, 20 bp, mouse
gggagcaggttcaaggtaac

SEQ ID NO: 782233 - DNA, 20 bp, mouse
gccacccctcccaggtgggg

SEQ ID NO: 782234 - DNA, 20 bp, mouse
gaccttgaacctgctcctaa

SEQ ID NO: 782235 - DNA, 20 bp, mouse
ggacggagagcgattgacgt

SEQ ID NO: 782236 - DNA, 20 bp, mouse
gcgtgagggcggaggagtag

SEQ ID NO: 782237 - DNA, 20 bp, mouse
gtgggaaaggaggggtgctc

SEQ ID NO: 782238 - DNA, 20 bp, mouse
gcgcgctgctcggagccgga

SEQ ID NO: 782239 - DNA, 20 bp, mouse
ggaaaggaggggtgctccgg

SEQ ID NO: 782240 - DNA, 20 bp, mouse
ggccccgctcgtgagggcgg

SEQ ID NO: 782241 - DNA, 20 bp, mouse
ggagccgggttcagcagagg

SEQ ID NO: 782242 - DNA, 20 bp, mouse
gtacagcagggagaacaggg

SEQ ID NO: 782243 - DNA, 20 bp, mouse
gcctctcgctgcgctccctc

SEQ ID NO: 782244 - DNA, 20 bp, mouse
ggcagcccggcggaataaaa

SEQ ID NO: 782245 - DNA, 20 bp, mouse
gagcgcgccgggactgtgag

SEQ ID NO: 782246 - DNA, 20 bp, mouse
gcaggggaggctcgagactt

SEQ ID NO: 782247 - DNA, 20 bp, mouse
gccctgggcccgcgctcgtg

SEQ ID NO: 782248 - DNA, 20 bp, mouse
ggggatgcccagagccctcc

SEQ ID NO: 782249 - DNA, 20 bp, mouse
gccggcccccggctgctggc

SEQ ID NO: 782250 - DNA, 20 bp, mouse
gaacacggcgctgcccggag

SEQ ID NO: 782251 - DNA, 20 bp, mouse
ggagactgccgcacgagcgc

SEQ ID NO: 782252 - DNA, 20 bp, mouse
ggggatatggggaactcacg

SEQ ID NO: 782253 - DNA, 20 bp, mouse
gcctcccctgcgccggcccc

SEQ ID NO: 782254 - DNA, 20 bp, mouse
gctgcccggagtggcagcct

SEQ ID NO: 782255 - DNA, 20 bp, mouse
gaggctgaactcacctgctg

SEQ ID NO: 782256 - DNA, 20 bp, mouse
gcccccggggagccaagcgg

SEQ ID NO: 782257 - DNA, 20 bp, mouse
ggaactcccacagccctcac

SEQ ID NO: 782258 - DNA, 20 bp, mouse
gctgtgacagaagctgtcgg

SEQ ID NO: 782259 - DNA, 20 bp, mouse
ggggctccgcttgggtctca

SEQ ID NO: 782260 - DNA, 20 bp, mouse
gcgacggagaagagccgcga

SEQ ID NO: 782261 - DNA, 20 bp, mouse
ggaagccgagagtttccgta

SEQ ID NO: 782262 - DNA, 20 bp, mouse
gtgaccagcgggccgagctc

SEQ ID NO: 782263 - DNA, 20 bp, mouse
gagggggcggccaagcctgg

SEQ ID NO: 782264 - DNA, 20 bp, mouse
gtgtccctcgggctccgctt

SEQ ID NO: 782265 - DNA, 20 bp, mouse
gagacccaagcggagcccga

SEQ ID NO: 782266 - DNA, 20 bp, mouse
gaggcggggtgccaactcag

SEQ ID NO: 782267 - DNA, 20 bp, mouse
gggagtggggattaagaggg

SEQ ID NO: 782268 - DNA, 20 bp, mouse
gtcaaatgacgctcagagtg

SEQ ID NO: 782269 - DNA, 20 bp, mouse
gacgccaccccgagccccat

SEQ ID NO: 782270 - DNA, 20 bp, mouse
gtaagaggggggaatgtaac

SEQ ID NO: 782271 - DNA, 20 bp, mouse
gattggagtggggattaaga

SEQ ID NO: 782272 - DNA, 20 bp, mouse
gttgcagcccaattaggatt

SEQ ID NO: 782273 - DNA, 20 bp, mouse
ggtgaagagtcatgggtcac

SEQ ID NO: 782274 - DNA, 20 bp, mouse
gccacgcagtgaagagtcat

SEQ ID NO: 782275 - DNA, 20 bp, mouse
gccagggagggaagggatac

SEQ ID NO: 782276 - DNA, 20 bp, mouse
gtggggagcggaggttaaga

SEQ ID NO: 782277 - DNA, 20 bp, mouse
gtggcccttagagagatcgg

SEQ ID NO: 782278 - DNA, 20 bp, mouse
ggaccccaacctgattggca

SEQ ID NO: 782279 - DNA, 20 bp, mouse
gaggaagggctgaagaagta

SEQ ID NO: 782280 - DNA, 20 bp, mouse
gggtcgaggaggcgggacgt

SEQ ID NO: 782281 - DNA, 20 bp, mouse
ggaggaggcgggacgtggga

SEQ ID NO: 782282 - DNA, 20 bp, mouse
gaaggtgaccccaacctgat

SEQ ID NO: 782283 - DNA, 20 bp, mouse
ggggacttggtcgaggaggc

SEQ ID NO: 782284 - DNA, 20 bp, mouse
gaatctcacgcaggtttgaa

SEQ ID NO: 782285 - DNA, 20 bp, mouse
gccccgcctgtcttcagatc

SEQ ID NO: 782286 - DNA, 20 bp, mouse
ggcagggaggagtcctgaaa

SEQ ID NO: 782287 - DNA, 20 bp, mouse
gttaaacgcgaggggtaggt

SEQ ID NO: 782288 - DNA, 20 bp, mouse
gcgccaaggcttaaacgcga

SEQ ID NO: 782289 - DNA, 20 bp, mouse
ggaggggcggagtcgacgtg

SEQ ID NO: 782290 - DNA, 20 bp, mouse
ggcgccagacggcccacgtg

SEQ ID NO: 782291 - DNA, 20 bp, mouse
gaggtcttctggggacgcga

SEQ ID NO: 782292 - DNA, 20 bp, mouse
gccccagaagaccttgtgat

SEQ ID NO: 782293 - DNA, 20 bp, mouse
ggggccgtctggcgcggcca

SEQ ID NO: 782294 - DNA, 20 bp, mouse
gaggcttaaacgcgaggggt

SEQ ID NO: 782295 - DNA, 20 bp, mouse
ggcgaggggtaggtgggtgc

SEQ ID NO: 782296 - DNA, 20 bp, mouse
gggaccagagtgtacttcgg

SEQ ID NO: 782297 - DNA, 20 bp, mouse
ggggccccgccgaacaggat

SEQ ID NO: 782298 - DNA, 20 bp, mouse
gtggccctcaacctgcgcct

SEQ ID NO: 782299 - DNA, 20 bp, mouse
gcgcgcagacgcatagagca

SEQ ID NO: 782300 - DNA, 20 bp, mouse
gaagcccacatccaaggcgc

SEQ ID NO: 782301 - DNA, 20 bp, mouse
gggaggggatctggaggtag

SEQ ID NO: 782302 - DNA, 20 bp, mouse
ggtgcccccgaagtacactc

SEQ ID NO: 782303 - DNA, 20 bp, mouse
gtcttcaggagaggcgggaa

SEQ ID NO: 782304 - DNA, 20 bp, mouse
gcggtcccagtccttctcgg

SEQ ID NO: 782305 - DNA, 20 bp, mouse
gcatccaaggcgcaggttga

SEQ ID NO: 782306 - DNA, 20 bp, mouse
gaacccgcatcccaggagga

SEQ ID NO: 782307 - DNA, 20 bp, mouse
gtgggatgcgggttcttcat

SEQ ID NO: 782308 - DNA, 20 bp, mouse
gtcagggagagctcagtcat

SEQ ID NO: 782309 - DNA, 20 bp, mouse
gtgcaagaagatgctcagaa

SEQ ID NO: 782310 - DNA, 20 bp, mouse
gggaaacagacataacagaa

SEQ ID NO: 782311 - DNA, 20 bp, mouse
ggaagaacccgcatcccagg

SEQ ID NO: 782312 - DNA, 20 bp, mouse
ggagacagatgtagctaatg

SEQ ID NO: 782313 - DNA, 20 bp, mouse
gatgcgggttcttcattggt

SEQ ID NO: 782314 - DNA, 20 bp, mouse
gtcttcttgcagctgggccc

SEQ ID NO: 782315 - DNA, 20 bp, mouse
ggaggacttcgtactgcaga

SEQ ID NO: 782316 - DNA, 20 bp, mouse
gccagaggggccgggcgcgt

SEQ ID NO: 782317 - DNA, 20 bp, mouse
gcgcccggcccctctggaag

SEQ ID NO: 782318 - DNA, 20 bp, mouse
gggcgcggggaagggatccg

SEQ ID NO: 782319 - DNA, 20 bp, mouse
gaggcaggcgcggggtcggc

SEQ ID NO: 782320 - DNA, 20 bp, mouse
gcggaggtggcattgacaag

SEQ ID NO: 782321 - DNA, 20 bp, mouse
ggcccctcgccttctccgca

SEQ ID NO: 782322 - DNA, 20 bp, mouse
ggtcggcgggctcggaattc

SEQ ID NO: 782323 - DNA, 20 bp, mouse
ggaagcggaactactctgtc

SEQ ID NO: 782324 - DNA, 20 bp, mouse
ggggttgcggggagacgccc

SEQ ID NO: 782325 - DNA, 20 bp, mouse
ggactgagccgaagcgctgg

SEQ ID NO: 782326 - DNA, 20 bp, mouse
ggggagcggccggggcccat

SEQ ID NO: 782327 - DNA, 20 bp, mouse
gcaggccagccaatgggccc

SEQ ID NO: 782328 - DNA, 20 bp, mouse
ggctggcctgccttacccac

SEQ ID NO: 782329 - DNA, 20 bp, mouse
ggcagcaagttcaggcccgg

SEQ ID NO: 782330 - DNA, 20 bp, mouse
gaaagcagcaagttcaggcc

SEQ ID NO: 782331 - DNA, 20 bp, mouse
gagttcaggcccggtgggta

SEQ ID NO: 782332 - DNA, 20 bp, mouse
ggtaccactccacctgggag

SEQ ID NO: 782333 - DNA, 20 bp, mouse
ggcgtcgcaaaagagcataa

SEQ ID NO: 782334 - DNA, 20 bp, mouse
gagcataaaggaccattccc

SEQ ID NO: 782335 - DNA, 20 bp, mouse
gagcacgggagcgtctggtg

SEQ ID NO: 782336 - DNA, 20 bp, mouse
gaacctgccccgttcgtctg

SEQ ID NO: 782337 - DNA, 20 bp, mouse
gcacctgcaacacagaccat

SEQ ID NO: 782338 - DNA, 20 bp, mouse
ggtctgtgttgcaggtgccc

SEQ ID NO: 782339 - DNA, 20 bp, mouse
gctccacagacgaacggggc

SEQ ID NO: 782340 - DNA, 20 bp, mouse
ggagcacgcgcaagcgtcga

SEQ ID NO: 782341 - DNA, 20 bp, mouse
gtgagctgcacgcacagttg

SEQ ID NO: 782342 - DNA, 20 bp, mouse
gaccattggccgctcgatct

SEQ ID NO: 782343 - DNA, 20 bp, mouse
gcggctcctaagaatgctta

SEQ ID NO: 782344 - DNA, 20 bp, mouse
gggggggtgtggcccggctg

SEQ ID NO: 782345 - DNA, 20 bp, mouse
gggccgctcgatctgggcgg

SEQ ID NO: 782346 - DNA, 20 bp, mouse
gcctgtaggggtggcccaca

SEQ ID NO: 782347 - DNA, 20 bp, mouse
ggccacggctgcgaggatct

SEQ ID NO: 782348 - DNA, 20 bp, mouse
gtgggacctcacaccgaggc

SEQ ID NO: 782349 - DNA, 20 bp, mouse
gacagggacaccggggaacg

SEQ ID NO: 782350 - DNA, 20 bp, mouse
gcacccctacaggaagtgag

SEQ ID NO: 782351 - DNA, 20 bp, mouse
gaccgaggccgggctgtctt

SEQ ID NO: 782352 - DNA, 20 bp, mouse
gaggagacacgtagccgtgt

SEQ ID NO: 782353 - DNA, 20 bp, mouse
ggctacgtgtctcctcggac

SEQ ID NO: 782354 - DNA, 20 bp, mouse
gtcccaagacagcccggcct

SEQ ID NO: 782355 - DNA, 20 bp, mouse
gacagcccggcctcggtgtg

SEQ ID NO: 782356 - DNA, 20 bp, mouse
gcaaaacagactaacacaca

SEQ ID NO: 782357 - DNA, 20 bp, mouse
gttcagagctatttctgcaa

SEQ ID NO: 782358 - DNA, 20 bp, mouse
ggctgtatgagtgttactga

SEQ ID NO: 782359 - DNA, 20 bp, mouse
gagggctgatcaagcttttg

SEQ ID NO: 782360 - DNA, 20 bp, mouse
gtaaggggactttaataatc

SEQ ID NO: 782361 - DNA, 20 bp, mouse
gttccataagagaattaaca

SEQ ID NO: 782362 - DNA, 20 bp, mouse
ggcaagggtcatcaatatcc

SEQ ID NO: 782363 - DNA, 20 bp, mouse
gtgccttgttaattctctta

SEQ ID NO: 782364 - DNA, 20 bp, mouse
ggctggttggagaattcaaa

SEQ ID NO: 782365 - DNA, 20 bp, mouse
gagaacagaaagaagttagc

SEQ ID NO: 782366 - DNA, 20 bp, mouse
gagaacaggcaactagaggt

SEQ ID NO: 782367 - DNA, 20 bp, mouse
ggaccccatagcaggacaag

SEQ ID NO: 782368 - DNA, 20 bp, mouse
gcctccacctccacaagggt

SEQ ID NO: 782369 - DNA, 20 bp, mouse
gtaagggactagtgagagat

SEQ ID NO: 782370 - DNA, 20 bp, mouse
gtgggagaacaggcaactag

SEQ ID NO: 782371 - DNA, 20 bp, mouse
gggagggaacgatgcctggg

SEQ ID NO: 782372 - DNA, 20 bp, mouse
gtcgatcggggtaccaggaa

SEQ ID NO: 782373 - DNA, 20 bp, mouse
gaaggctcgatcggggtacc

SEQ ID NO: 782374 - DNA, 20 bp, mouse
gccacaagaggggctagaaa

SEQ ID NO: 782375 - DNA, 20 bp, mouse
ggggagctaaggctcgatcg

SEQ ID NO: 782376 - DNA, 20 bp, mouse
gagagcgcgcccagaaacga

SEQ ID NO: 782377 - DNA, 20 bp, mouse
gaacgccttaggcaataggt

SEQ ID NO: 782378 - DNA, 20 bp, mouse
gcgagggcacctcccatcgg

SEQ ID NO: 782379 - DNA, 20 bp, mouse
gcgcgcccagaaacgaggga

SEQ ID NO: 782380 - DNA, 20 bp, mouse
gcggatgggtgtaaagaaaa

SEQ ID NO: 782381 - DNA, 20 bp, mouse
gtagcaagcgacaggaggct

SEQ ID NO: 782382 - DNA, 20 bp, mouse
gcgagaacgccttaggcaat

SEQ ID NO: 782383 - DNA, 20 bp, mouse
gggtactgttgcttcggagt

SEQ ID NO: 782384 - DNA, 20 bp, mouse
gaaggctctaggggctagac

SEQ ID NO: 782385 - DNA, 20 bp, mouse
gtgtccccacctattgccta

SEQ ID NO: 782386 - DNA, 20 bp, mouse
gtgtcggtcgcgtgcgggga

SEQ ID NO: 782387 - DNA, 20 bp, mouse
ggtccgaaccccaaactcgg

SEQ ID NO: 782388 - DNA, 20 bp, mouse
gtttggggttcggacgaagg

SEQ ID NO: 782389 - DNA, 20 bp, mouse
gaaaacctcgcgctgttccg

SEQ ID NO: 782390 - DNA, 20 bp, mouse
ggcgacgagctcggcccgac

SEQ ID NO: 782391 - DNA, 20 bp, mouse
ggccgagggccgagtcgtcg

SEQ ID NO: 782392 - DNA, 20 bp, mouse
ggagggggcgtcttccggtc

SEQ ID NO: 782393 - DNA, 20 bp, mouse
gctggggcgctcgtcactcg

SEQ ID NO: 782394 - DNA, 20 bp, mouse
ggcggggagggggcgtcttc

SEQ ID NO: 782395 - DNA, 20 bp, mouse
gagacgctggggaatgggaa

SEQ ID NO: 782396 - DNA, 20 bp, mouse
gagggtgcctggcaggtaag

SEQ ID NO: 782397 - DNA, 20 bp, mouse
ggacaagaacaatggctcta

SEQ ID NO: 782398 - DNA, 20 bp, mouse
gggaccaggggtacagctaa

SEQ ID NO: 782399 - DNA, 20 bp, mouse
ggctgcctggaagcatactt

SEQ ID NO: 782400 - DNA, 20 bp, mouse
ggacccggagcttgtgataa

SEQ ID NO: 782401 - DNA, 20 bp, mouse
gaaaaccaaagtatgcttcc

SEQ ID NO: 782402 - DNA, 20 bp, mouse
ggggaagccatggagaagtt

SEQ ID NO: 782403 - DNA, 20 bp, mouse
gggtgtcattcaaaccagaa

SEQ ID NO: 782404 - DNA, 20 bp, mouse
gggaactggagcatgctgcc

SEQ ID NO: 782405 - DNA, 20 bp, mouse
gctcaagccgcttacctgcc

SEQ ID NO: 782406 - DNA, 20 bp, mouse
gaacagtgacagttcgatgg

SEQ ID NO: 782407 - DNA, 20 bp, mouse
gcgaactgtcactgtttctg

SEQ ID NO: 782408 - DNA, 20 bp, mouse
gggactggaggtaaccctat

SEQ ID NO: 782409 - DNA, 20 bp, mouse
gtttctggggatccgaaggc

SEQ ID NO: 782410 - DNA, 20 bp, mouse
gaccgacaccctaatctcag

SEQ ID NO: 782411 - DNA, 20 bp, mouse
gcggggtcagatctcgagct

SEQ ID NO: 782412 - DNA, 20 bp, mouse
gacctctgagattagggtgt

SEQ ID NO: 782413 - DNA, 20 bp, mouse
gtcagatctcgagctgggac

SEQ ID NO: 782414 - DNA, 20 bp, mouse
ggatcctcaggttggagtga

SEQ ID NO: 782415 - DNA, 20 bp, mouse
gcacgtgttaggccggaagg

SEQ ID NO: 782416 - DNA, 20 bp, mouse
gggaaacaggatgacggtat

SEQ ID NO: 782417 - DNA, 20 bp, mouse
ggggagcccagtagttatgg

SEQ ID NO: 782418 - DNA, 20 bp, mouse
ggtagctcgcgctgtcacgt

SEQ ID NO: 782419 - DNA, 20 bp, mouse
ggtgacagcgcgagctacgg

SEQ ID NO: 782420 - DNA, 20 bp, mouse
ggggccgggtgacactcggt

SEQ ID NO: 782421 - DNA, 20 bp, mouse
gcgggagcggcgtgggtccc

SEQ ID NO: 782422 - DNA, 20 bp, mouse
ggacgttgacaactggaaac

SEQ ID NO: 782423 - DNA, 20 bp, mouse
gttaactagacgttgacaac

SEQ ID NO: 782424 - DNA, 20 bp, mouse
gacccctttggggcggagtc

SEQ ID NO: 782425 - DNA, 20 bp, mouse
ggggcgggatggggcgggat

SEQ ID NO: 782426 - DNA, 20 bp, mouse
gaggcggcgaggcagagcta

SEQ ID NO: 782427 - DNA, 20 bp, mouse
gcggccaccagccagagtgg

SEQ ID NO: 782428 - DNA, 20 bp, mouse
ggaagtgagacgtggaaata

SEQ ID NO: 782429 - DNA, 20 bp, mouse
ggtcccgcagccaatcgtgg

SEQ ID NO: 782430 - DNA, 20 bp, mouse
gtgagacgtggaaatagggg

SEQ ID NO: 782431 - DNA, 20 bp, mouse
gaataggggcggggctcagg

SEQ ID NO: 782432 - DNA, 20 bp, mouse
gggaaataggggcggggctc

SEQ ID NO: 782433 - DNA, 20 bp, mouse
gcaggggggcggggcgccgt

SEQ ID NO: 782434 - DNA, 20 bp, mouse
ggcagctcggccgccacgat

SEQ ID NO: 782435 - DNA, 20 bp, mouse
gcggccgccacgattggctg

SEQ ID NO: 782436 - DNA, 20 bp, mouse
ggggttatggactcattcat

SEQ ID NO: 782437 - DNA, 20 bp, mouse
gagggtctaggaacccagac

SEQ ID NO: 782438 - DNA, 20 bp, mouse
gtatggactcattcatggga

SEQ ID NO: 782439 - DNA, 20 bp, mouse
gaaaagggggcttctatgtc

SEQ ID NO: 782440 - DNA, 20 bp, mouse
ggctctggttggcccggcct

SEQ ID NO: 782441 - DNA, 20 bp, mouse
gtgggttcctagaccctccc

SEQ ID NO: 782442 - DNA, 20 bp, mouse
gaaaagggctctggttggcc

SEQ ID NO: 782443 - DNA, 20 bp, mouse
ggcccggcctgggagggtct

SEQ ID NO: 782444 - DNA, 20 bp, mouse
gtgagtccataaccccacac

SEQ ID NO: 782445 - DNA, 20 bp, mouse
gtggttggcccggcctggga

SEQ ID NO: 782446 - DNA, 20 bp, mouse
gagggcgcttgtgggttccc

SEQ ID NO: 782447 - DNA, 20 bp, mouse
gcctaggaatcattagggtg

SEQ ID NO: 782448 - DNA, 20 bp, mouse
ggatcctgcgatgggaaaag

SEQ ID NO: 782449 - DNA, 20 bp, mouse
gcccacaagcgccctcttag

SEQ ID NO: 782450 - DNA, 20 bp, mouse
gaacgcgcagttcagagcct

SEQ ID NO: 782451 - DNA, 20 bp, mouse
gaggggcagaacctctaaga

SEQ ID NO: 782452 - DNA, 20 bp, mouse
gccagtcctaggaatcatta

SEQ ID NO: 782453 - DNA, 20 bp, mouse
gggctgccgggcctcggcca

SEQ ID NO: 782454 - DNA, 20 bp, mouse
gaggcccggcagccccaact

SEQ ID NO: 782455 - DNA, 20 bp, mouse
gtggagtgagggtcccagta

SEQ ID NO: 782456 - DNA, 20 bp, mouse
gcgggctgagacacacagga

SEQ ID NO: 782457 - DNA, 20 bp, mouse
ggccgggcaagagtaggagg

SEQ ID NO: 782458 - DNA, 20 bp, mouse
gtctcagcccgaagctgcgg

SEQ ID NO: 782459 - DNA, 20 bp, mouse
gcaggagcccacaacttcct

SEQ ID NO: 782460 - DNA, 20 bp, mouse
gggaaagggacacccaaggc

SEQ ID NO: 782461 - DNA, 20 bp, mouse
gcccaaggccgggcaagagt

SEQ ID NO: 782462 - DNA, 20 bp, mouse
gcagaagagaccacgccatg

SEQ ID NO: 782463 - DNA, 20 bp, mouse
gttgccacgcaacgtctgga

SEQ ID NO: 782464 - DNA, 20 bp, mouse
ggcaacgtctggagggcctt

SEQ ID NO: 782465 - DNA, 20 bp, mouse
gagctcacccgccgcagctt

SEQ ID NO: 782466 - DNA, 20 bp, mouse
gtgtgcggcgcctgcgtggt

SEQ ID NO: 782467 - DNA, 20 bp, mouse
gcctgcgtggtgggatcagg

SEQ ID NO: 782468 - DNA, 20 bp, mouse
ggcgccgcacaggcgagccc

SEQ ID NO: 782469 - DNA, 20 bp, mouse
gcgctggcggcccagtccgt

SEQ ID NO: 782470 - DNA, 20 bp, mouse
ggcgcctgcgtggtgggatc

SEQ ID NO: 782471 - DNA, 20 bp, mouse
gtcacctgggctcgcctgtg

SEQ ID NO: 782472 - DNA, 20 bp, mouse
gcgcctgtgcggcgcctgcg

SEQ ID NO: 782473 - DNA, 20 bp, mouse
gaccaaagcgtcgctcacct

SEQ ID NO: 782474 - DNA, 20 bp, mouse
gaaaaatagagcagaatcta

SEQ ID NO: 782475 - DNA, 20 bp, mouse
gccgcgcaggcgcagtcgga

SEQ ID NO: 782476 - DNA, 20 bp, mouse
gtaaaccctaacatcggaga

SEQ ID NO: 782477 - DNA, 20 bp, mouse
ggaaccttcccaaaccacca

SEQ ID NO: 782478 - DNA, 20 bp, mouse
ggaggcgtagtgcaggacct

SEQ ID NO: 782479 - DNA, 20 bp, mouse
gccgaaataaaccctaacat

SEQ ID NO: 782480 - DNA, 20 bp, mouse
gcggaagcgaggcgtagtgc

SEQ ID NO: 782481 - DNA, 20 bp, mouse
gcggtgcttgactcacttcc

SEQ ID NO: 782482 - DNA, 20 bp, mouse
gagacggatccttggtggtt

SEQ ID NO: 782483 - DNA, 20 bp, mouse
gaacatcggagacggatcct

SEQ ID NO: 782484 - DNA, 20 bp, mouse
gtgctgtgttaaggtcgatt

SEQ ID NO: 782485 - DNA, 20 bp, mouse
gtgtgttaaggtcgatttgg

SEQ ID NO: 782486 - DNA, 20 bp, mouse
gacaacctgaattggattgc

SEQ ID NO: 782487 - DNA, 20 bp, mouse
gaagcttatctcggcgtctg

SEQ ID NO: 782488 - DNA, 20 bp, mouse
gcgtccgccgcgacgccgga

SEQ ID NO: 782489 - DNA, 20 bp, mouse
gcagtccagcaatccaattc

SEQ ID NO: 782490 - DNA, 20 bp, mouse
gcgccggaaggccgtgtgat

SEQ ID NO: 782491 - DNA, 20 bp, mouse
ggcgtctgaggaggagctac

SEQ ID NO: 782492 - DNA, 20 bp, mouse
gcggccttccggcgtcgcgg

SEQ ID NO: 782493 - DNA, 20 bp, mouse
gaaagctgccgtggactctg

SEQ ID NO: 782494 - DNA, 20 bp, mouse
ggagataagcttcttgtgat

SEQ ID NO: 782495 - DNA, 20 bp, mouse
gactctgcggaccaatcaca

SEQ ID NO: 782496 - DNA, 20 bp, mouse
ggcagtagtagacgagaaga

SEQ ID NO: 782497 - DNA, 20 bp, mouse
gcacaagggcccatagaccc

SEQ ID NO: 782498 - DNA, 20 bp, mouse
gcccttgtgcatcaagttct

SEQ ID NO: 782499 - DNA, 20 bp, mouse
gcgagaagatggagcgcaac

SEQ ID NO: 782500 - DNA, 20 bp, mouse
gctaaacagacagtgggtcc

SEQ ID NO: 782501 - DNA, 20 bp, mouse
ggacctctgcgcatgtgcaa

SEQ ID NO: 782502 - DNA, 20 bp, mouse
gtactgccatgtccaagaca

SEQ ID NO: 782503 - DNA, 20 bp, mouse
gcaggctgaccttgactcac

SEQ ID NO: 782504 - DNA, 20 bp, mouse
gtaccgttgcacatgcgcag

SEQ ID NO: 782505 - DNA, 20 bp, mouse
gcaacggtagctcagttgcc

SEQ ID NO: 782506 - DNA, 20 bp, mouse
gtcctcaggaacccgggcga

SEQ ID NO: 782507 - DNA, 20 bp, mouse
ggggcgaaggctgagagcgt

SEQ ID NO: 782508 - DNA, 20 bp, mouse
gtccaggcgctaccttgtta

SEQ ID NO: 782509 - DNA, 20 bp, mouse
gtccggtgggtgggactata

SEQ ID NO: 782510 - DNA, 20 bp, mouse
gccgcccccaggcacgaaaa

SEQ ID NO: 782511 - DNA, 20 bp, mouse
ggggcggggagaagaccgga

SEQ ID NO: 782512 - DNA, 20 bp, mouse
ggctgacccgaggtaagcat

SEQ ID NO: 782513 - DNA, 20 bp, mouse
gcccccaggcacgaaaaggg

SEQ ID NO: 782514 - DNA, 20 bp, mouse
ggtcccacccaccggaggca

SEQ ID NO: 782515 - DNA, 20 bp, mouse
ggacaggccgtgcctccggt

SEQ ID NO: 782516 - DNA, 20 bp, mouse
gtgagtggcaagcatgcgag

SEQ ID NO: 782517 - DNA, 20 bp, mouse
gcgcatgcgtgaggcacgaa

SEQ ID NO: 782518 - DNA, 20 bp, mouse
gcgccggcagggtgcaaggt

SEQ ID NO: 782519 - DNA, 20 bp, mouse
ggcagggtgcaaggtggggt

SEQ ID NO: 782520 - DNA, 20 bp, mouse
gggaaattgagtgaagatgg

SEQ ID NO: 782521 - DNA, 20 bp, mouse
ggcgcatgcgcatggggtag

SEQ ID NO: 782522 - DNA, 20 bp, mouse
gggctcgccggcagggtgca

SEQ ID NO: 782523 - DNA, 20 bp, mouse
gggccacaagtctgtaccgg

SEQ ID NO: 782524 - DNA, 20 bp, mouse
gtggcaagcatgcgaggggc

SEQ ID NO: 782525 - DNA, 20 bp, mouse
gtggggtgggagaaacaacg

SEQ ID NO: 782526 - DNA, 20 bp, mouse
gggcggcggccagaagtacc

SEQ ID NO: 782527 - DNA, 20 bp, mouse
gagacgcgcggggaggtgga

SEQ ID NO: 782528 - DNA, 20 bp, mouse
ggcaagcgcccagggagcac

SEQ ID NO: 782529 - DNA, 20 bp, mouse
gcccgcgcgtctcccgagaa

SEQ ID NO: 782530 - DNA, 20 bp, mouse
gcgcgtctcccgagaaggga

SEQ ID NO: 782531 - DNA, 20 bp, mouse
gccagcgggcggagtacagt

SEQ ID NO: 782532 - DNA, 20 bp, mouse
gtccctctggaaccccggtg

SEQ ID NO: 782533 - DNA, 20 bp, mouse
gggcgctggggcccccagtg

SEQ ID NO: 782534 - DNA, 20 bp, mouse
ggccacgccagccccactgg

SEQ ID NO: 782535 - DNA, 20 bp, mouse
gagaagggagggcgcagcgg

SEQ ID NO: 782536 - DNA, 20 bp, mouse
gaggccctggggagctcggt

SEQ ID NO: 782537 - DNA, 20 bp, mouse
gaaccgcctggcaccctggg

SEQ ID NO: 782538 - DNA, 20 bp, mouse
gagagcggagcggatccggg

SEQ ID NO: 782539 - DNA, 20 bp, mouse
gcaccctgggcggtggactt

SEQ ID NO: 782540 - DNA, 20 bp, mouse
gtctctgtgcagtaccgagt

SEQ ID NO: 782541 - DNA, 20 bp, mouse
gcagccaaagtccaccgccc

SEQ ID NO: 782542 - DNA, 20 bp, mouse
gaaagagagcggagcggatc

SEQ ID NO: 782543 - DNA, 20 bp, mouse
gaggtgagactggaagggcg

SEQ ID NO: 782544 - DNA, 20 bp, mouse
gaggaaccgcctggcaccct

SEQ ID NO: 782545 - DNA, 20 bp, mouse
ggggccttctggaaagctga

SEQ ID NO: 782546 - DNA, 20 bp, mouse
gggcaccgcccagtcacttc

SEQ ID NO: 782547 - DNA, 20 bp, mouse
gaacaataggcttacggaac

SEQ ID NO: 782548 - DNA, 20 bp, mouse
gaccggcggtcaagacaaga

SEQ ID NO: 782549 - DNA, 20 bp, mouse
gggtaaaaggcgaagagtga

SEQ ID NO: 782550 - DNA, 20 bp, mouse
gggcgctcgaaactcgagac

SEQ ID NO: 782551 - DNA, 20 bp, mouse
gtatggctgtgtgtaggcgc

SEQ ID NO: 782552 - DNA, 20 bp, mouse
gggcgggaacaataggctta

SEQ ID NO: 782553 - DNA, 20 bp, mouse
gcggcggcaagcagaagccg

SEQ ID NO: 782554 - DNA, 20 bp, mouse
gaaagcctagtgtttcccgg

SEQ ID NO: 782555 - DNA, 20 bp, mouse
gggtggaagaagccggcggg

SEQ ID NO: 782556 - DNA, 20 bp, mouse
gctggggtctgtctcctgta

SEQ ID NO: 782557 - DNA, 20 bp, mouse
ggagagaaagtggacataaa

SEQ ID NO: 782558 - DNA, 20 bp, mouse
gtatgtccatcaagtgatgc

SEQ ID NO: 782559 - DNA, 20 bp, mouse
ggtgtgagtgttgaaggcaa

SEQ ID NO: 782560 - DNA, 20 bp, mouse
ggtaactgccaatttaacca

SEQ ID NO: 782561 - DNA, 20 bp, mouse
gccgctctgtgaatcctttg

SEQ ID NO: 782562 - DNA, 20 bp, mouse
ggtcacacatagagccgtac

SEQ ID NO: 782563 - DNA, 20 bp, mouse
gctctctcaataacaacctg

SEQ ID NO: 782564 - DNA, 20 bp, mouse
gatattatgaaggtccactc

SEQ ID NO: 782565 - DNA, 20 bp, mouse
ggtgttttccctggttaaat

SEQ ID NO: 782566 - DNA, 20 bp, mouse
gtactactgaccgactgctc

SEQ ID NO: 782567 - DNA, 20 bp, mouse
gcagtagcagctcacatgtg

SEQ ID NO: 782568 - DNA, 20 bp, mouse
gctctctagcagctgaagca

SEQ ID NO: 782569 - DNA, 20 bp, mouse
gtgtgtggattgctcccgtg

SEQ ID NO: 782570 - DNA, 20 bp, mouse
gctggggtctgtctcctgta

SEQ ID NO: 782571 - DNA, 20 bp, mouse
gcagaactgccgtctttgac

SEQ ID NO: 782572 - DNA, 20 bp, mouse
gttctggcagagccttcctt

SEQ ID NO: 782573 - DNA, 20 bp, mouse
gggtactgcttcctaccatc

SEQ ID NO: 782574 - DNA, 20 bp, mouse
gtctgatgtgcttctgtgca

SEQ ID NO: 782575 - DNA, 20 bp, mouse
gtatgtccatcaagtgatgc

SEQ ID NO: 782576 - DNA, 20 bp, mouse
gcagccacgcgtggaatctt

SEQ ID NO: 782577 - DNA, 20 bp, mouse
gaggacttcgtgtggatggt

SEQ ID NO: 782578 - DNA, 20 bp, mouse
gcggcccgcaggacttcgtg

SEQ ID NO: 782579 - DNA, 20 bp, mouse
gcacaggcgcccagtacgag

SEQ ID NO: 782580 - DNA, 20 bp, mouse
gaaactctgaacacacccag

SEQ ID NO: 782581 - DNA, 20 bp, mouse
gcaagggcgagcgcgctcac

SEQ ID NO: 782582 - DNA, 20 bp, mouse
gttggcctggctaggttctg

SEQ ID NO: 782583 - DNA, 20 bp, mouse
ggttgcccgcgtatcctcgg

SEQ ID NO: 782584 - DNA, 20 bp, mouse
gccgcaggacttcgtgtgga

SEQ ID NO: 782585 - DNA, 20 bp, mouse
gacactgcgcggtagaccgg

SEQ ID NO: 782586 - DNA, 20 bp, mouse
gcatagggctgggtggccaa

SEQ ID NO: 782587 - DNA, 20 bp, mouse
gctggcaccccgtgtgggga

SEQ ID NO: 782588 - DNA, 20 bp, mouse
ggggctccgcgccccaagga

SEQ ID NO: 782589 - DNA, 20 bp, mouse
gccgcactgcataaagaaca

SEQ ID NO: 782590 - DNA, 20 bp, mouse
gccccaaggaagggaaatct

SEQ ID NO: 782591 - DNA, 20 bp, mouse
gcacagcggagccgcctaga

SEQ ID NO: 782592 - DNA, 20 bp, mouse
ggcgggcagccatcattgta

SEQ ID NO: 782593 - DNA, 20 bp, mouse
gggaaagaggaaagcatcta

SEQ ID NO: 782594 - DNA, 20 bp, mouse
ggtaccacacctgcccccac

SEQ ID NO: 782595 - DNA, 20 bp, mouse
gaacagggctccgcgcccca

SEQ ID NO: 782596 - DNA, 20 bp, mouse
ggggaggggccctaccacat

SEQ ID NO: 782597 - DNA, 20 bp, mouse
gccgctgcaggagacttgag

SEQ ID NO: 782598 - DNA, 20 bp, mouse
ggataagcggaaggcagcga

SEQ ID NO: 782599 - DNA, 20 bp, mouse
gggagcaagccggccgggat

SEQ ID NO: 782600 - DNA, 20 bp, mouse
gctactgaagtccaagtgat

SEQ ID NO: 782601 - DNA, 20 bp, mouse
gtacgagggctcccactcct

SEQ ID NO: 782602 - DNA, 20 bp, mouse
gagtgcgcgggactctggga

SEQ ID NO: 782603 - DNA, 20 bp, mouse
gtgcagcgggtcggctacga

SEQ ID NO: 782604 - DNA, 20 bp, mouse
gcaagtctcctgcagcgggt

SEQ ID NO: 782605 - DNA, 20 bp, mouse
gtccccggtagcagaaacgt

SEQ ID NO: 782606 - DNA, 20 bp, mouse
gtggtcggcggggaggtcgg

SEQ ID NO: 782607 - DNA, 20 bp, mouse
gagcgccagcagcacggaca

SEQ ID NO: 782608 - DNA, 20 bp, mouse
gtctcctcggcgctgtgcgc

SEQ ID NO: 782609 - DNA, 20 bp, mouse
gacaacagccggagccccga

SEQ ID NO: 782610 - DNA, 20 bp, mouse
gggaagagtcggagggagtg

SEQ ID NO: 782611 - DNA, 20 bp, mouse
gacagcgccgaggagagttg

SEQ ID NO: 782612 - DNA, 20 bp, mouse
gcccgggagcacctccccga

SEQ ID NO: 782613 - DNA, 20 bp, mouse
gcgcgcgagtgggacgggtg

SEQ ID NO: 782614 - DNA, 20 bp, mouse
gagcacctccccgagggccc

SEQ ID NO: 782615 - DNA, 20 bp, mouse
gcatcgcccaagctcggggt

SEQ ID NO: 782616 - DNA, 20 bp, mouse
gtccccgaggggtccaagtc

SEQ ID NO: 782617 - DNA, 20 bp, mouse
gggagcgcgcgcccacggcc

SEQ ID NO: 782618 - DNA, 20 bp, mouse
gcgcatccgggaccccgcgg

SEQ ID NO: 782619 - DNA, 20 bp, mouse
gcggccggtcgccactgggg

SEQ ID NO: 782620 - DNA, 20 bp, mouse
gatcgcgcgcccaacggacc

SEQ ID NO: 782621 - DNA, 20 bp, mouse
gcggccgccccagtggcgac

SEQ ID NO: 782622 - DNA, 20 bp, mouse
ggctcggccggtcgccactg

SEQ ID NO: 782623 - DNA, 20 bp, mouse
gcgcgcgcccacggcccggc

SEQ ID NO: 782624 - DNA, 20 bp, mouse
ggggcgcgcgctcccccgcg

SEQ ID NO: 782625 - DNA, 20 bp, mouse
gcgcccaacggaccaggctg

SEQ ID NO: 782626 - DNA, 20 bp, mouse
ggagtcctgctgaagctcat

SEQ ID NO: 782627 - DNA, 20 bp, mouse
gcttcagcaggactcagaga

SEQ ID NO: 782628 - DNA, 20 bp, mouse
gaggtctttgaacctcgatg

SEQ ID NO: 782629 - DNA, 20 bp, mouse
gcgctcgctcactgcggtac

SEQ ID NO: 782630 - DNA, 20 bp, mouse
gttctatctggccatgtctc

SEQ ID NO: 782631 - DNA, 20 bp, mouse
gggaggctgcacttgaagtc

SEQ ID NO: 782632 - DNA, 20 bp, mouse
gcacaggcagacacagtctg

SEQ ID NO: 782633 - DNA, 20 bp, mouse
gagagcccatgagcttcagc

SEQ ID NO: 782634 - DNA, 20 bp, mouse
gtcgctcactgcggtactgg

SEQ ID NO: 782635 - DNA, 20 bp, mouse
ggtggttaaatgtacagcta

SEQ ID NO: 782636 - DNA, 20 bp, mouse
ggcgggaatgggttgtgcgt

SEQ ID NO: 782637 - DNA, 20 bp, mouse
gccccctccccggcgggaat

SEQ ID NO: 782638 - DNA, 20 bp, mouse
gccaaagggctcttggagat

SEQ ID NO: 782639 - DNA, 20 bp, mouse
gggagcagcaaacaacgcac

SEQ ID NO: 782640 - DNA, 20 bp, mouse
gaacccattcccgccgggga

SEQ ID NO: 782641 - DNA, 20 bp, mouse
gtgacaccccgccaaccagt

SEQ ID NO: 782642 - DNA, 20 bp, mouse
gaatgggttgtgcgtgggtg

SEQ ID NO: 782643 - DNA, 20 bp, mouse
gaaaggggacctgggataaa

SEQ ID NO: 782644 - DNA, 20 bp, mouse
ggcacaacccattcccgccg

SEQ ID NO: 782645 - DNA, 20 bp, mouse
gcaaggctagggcggagtca

SEQ ID NO: 782646 - DNA, 20 bp, mouse
gttaaaagcacatgctggat

SEQ ID NO: 782647 - DNA, 20 bp, mouse
gcagtggagggtatttttca

SEQ ID NO: 782648 - DNA, 20 bp, mouse
ggggtccgcacactcttccc

SEQ ID NO: 782649 - DNA, 20 bp, mouse
gacaaaccccatccacaagg

SEQ ID NO: 782650 - DNA, 20 bp, mouse
gagagcaagaggagcatact

SEQ ID NO: 782651 - DNA, 20 bp, mouse
gtgggccaatagcgtttgat

SEQ ID NO: 782652 - DNA, 20 bp, mouse
gcaaacaagctgcattaact

SEQ ID NO: 782653 - DNA, 20 bp, mouse
gcactttggcgcattttcag

SEQ ID NO: 782654 - DNA, 20 bp, mouse
gcaccagcctccttgtggat

SEQ ID NO: 782655 - DNA, 20 bp, mouse
gtgtcacaaggagctttatc

SEQ ID NO: 782656 - DNA, 20 bp, mouse
gtgtccctgaagtttccccc

SEQ ID NO: 782657 - DNA, 20 bp, mouse
ggtgggagatgcagagcagt

SEQ ID NO: 782658 - DNA, 20 bp, mouse
ggcctcaggtagcccaaatt

SEQ ID NO: 782659 - DNA, 20 bp, mouse
gagttagtgaatagagtcgc

SEQ ID NO: 782660 - DNA, 20 bp, mouse
gcgccccggagcatctaaaa

SEQ ID NO: 782661 - DNA, 20 bp, mouse
gtcagcctccccagatggaa

SEQ ID NO: 782662 - DNA, 20 bp, mouse
gactgcctcagagtgagatg

SEQ ID NO: 782663 - DNA, 20 bp, mouse
gccaccctgggggaaacttc

SEQ ID NO: 782664 - DNA, 20 bp, mouse
gtactgctccacctgtctgt

SEQ ID NO: 782665 - DNA, 20 bp, mouse
gtgagttcaaagccaaattt

SEQ ID NO: 782666 - DNA, 20 bp, mouse
gcaagtgtgtgaccaaaaca

SEQ ID NO: 782667 - DNA, 20 bp, mouse
gtgtgaccaaaacagggctg

SEQ ID NO: 782668 - DNA, 20 bp, mouse
ggcaccctcgggactggagg

SEQ ID NO: 782669 - DNA, 20 bp, mouse
gtagagctgcagtcagaagt

SEQ ID NO: 782670 - DNA, 20 bp, mouse
gagtgaccacaagggcaggg

SEQ ID NO: 782671 - DNA, 20 bp, mouse
ggaggcaccctcgggactgg

SEQ ID NO: 782672 - DNA, 20 bp, mouse
ggactgcagctctaacttgt

SEQ ID NO: 782673 - DNA, 20 bp, mouse
gcagctctaacttgtgggta

SEQ ID NO: 782674 - DNA, 20 bp, mouse
gaggtctcctggcctgtctg

SEQ ID NO: 782675 - DNA, 20 bp, mouse
gcagaaatagcctgagactg

SEQ ID NO: 782676 - DNA, 20 bp, mouse
ggaaatctctggtcacacaa

SEQ ID NO: 782677 - DNA, 20 bp, mouse
ggcaccatgcactcttcaca

SEQ ID NO: 782678 - DNA, 20 bp, mouse
gaaatcaaataagtgatcat

SEQ ID NO: 782679 - DNA, 20 bp, mouse
gcaaataagtgatcattggc

SEQ ID NO: 782680 - DNA, 20 bp, mouse
gaagcgagaatgatttcgaa

SEQ ID NO: 782681 - DNA, 20 bp, mouse
gtttccttgtgaagagtgca

SEQ ID NO: 782682 - DNA, 20 bp, mouse
gttcttctagacctccttca

SEQ ID NO: 782683 - DNA, 20 bp, mouse
gagaaagtaagtcatcagcc

SEQ ID NO: 782684 - DNA, 20 bp, mouse
gcaaatggggactaaaggag

SEQ ID NO: 782685 - DNA, 20 bp, mouse
gagaaacacttctgtaccaa

SEQ ID NO: 782686 - DNA, 20 bp, mouse
gctagcaggcgagaatggat

SEQ ID NO: 782687 - DNA, 20 bp, mouse
gaccgtagacagacagggag

SEQ ID NO: 782688 - DNA, 20 bp, mouse
gaggccacatccagtgtacg

SEQ ID NO: 782689 - DNA, 20 bp, mouse
gcgcatgcgcggagccgcag

SEQ ID NO: 782690 - DNA, 20 bp, mouse
gtaaagcggactttgctcgg

SEQ ID NO: 782691 - DNA, 20 bp, mouse
gggactacatctcccagagg

SEQ ID NO: 782692 - DNA, 20 bp, mouse
gtcagaaggcggtggcgcag

SEQ ID NO: 782693 - DNA, 20 bp, mouse
gacactccccaatcctttca

SEQ ID NO: 782694 - DNA, 20 bp, mouse
gagattccctgaaaggattg

SEQ ID NO: 782695 - DNA, 20 bp, mouse
ggtggggcggcgtcagaagg

SEQ ID NO: 782696 - DNA, 20 bp, mouse
ggcggcgcgcacacaaaggg

SEQ ID NO: 782697 - DNA, 20 bp, mouse
gccagaagagggatgaccag

SEQ ID NO: 782698 - DNA, 20 bp, mouse
ggccgcaaggaggattttcg

SEQ ID NO: 782699 - DNA, 20 bp, mouse
gggcctggtccagacccccc

SEQ ID NO: 782700 - DNA, 20 bp, mouse
ggccgggaggccgctgcgga

SEQ ID NO: 782701 - DNA, 20 bp, mouse
ggcggcgacgcagccagaag

SEQ ID NO: 782702 - DNA, 20 bp, mouse
ggaggcggcccgggcggact

SEQ ID NO: 782703 - DNA, 20 bp, mouse
ggggcggactcggggacccg

SEQ ID NO: 782704 - DNA, 20 bp, mouse
ggcgcacacaaagggcggga

SEQ ID NO: 782705 - DNA, 20 bp, mouse
ggggcgacccgggcaagctg

SEQ ID NO: 782706 - DNA, 20 bp, mouse
gggggcctggaagagagaat

SEQ ID NO: 782707 - DNA, 20 bp, mouse
gcgtgttccagataccgctg

SEQ ID NO: 782708 - DNA, 20 bp, mouse
gcctcactcgtgcacaggat

SEQ ID NO: 782709 - DNA, 20 bp, mouse
gtgtcaggaactgatgtcat

SEQ ID NO: 782710 - DNA, 20 bp, mouse
gtggtctgataagggccaag

SEQ ID NO: 782711 - DNA, 20 bp, mouse
gctgaacctcactcgtgcac

SEQ ID NO: 782712 - DNA, 20 bp, mouse
gagagccagcgagggcagaa

SEQ ID NO: 782713 - DNA, 20 bp, mouse
gagagcaaggggccagccga

SEQ ID NO: 782714 - DNA, 20 bp, mouse
ggttcaaaaagagccagcga

SEQ ID NO: 782715 - DNA, 20 bp, mouse
gctcgtgcacaggatgggtt

SEQ ID NO: 782716 - DNA, 20 bp, mouse
gtgtggggttacctagtctc

SEQ ID NO: 782717 - DNA, 20 bp, mouse
ggggagctgccgacagattt

SEQ ID NO: 782718 - DNA, 20 bp, mouse
gcgggtctctgagcagagac

SEQ ID NO: 782719 - DNA, 20 bp, mouse
gcaggcgagctgggacttcc

SEQ ID NO: 782720 - DNA, 20 bp, mouse
gtgggcttcctgcttgttac

SEQ ID NO: 782721 - DNA, 20 bp, mouse
gctctgagcagagacaggtt

SEQ ID NO: 782722 - DNA, 20 bp, mouse
ggaaggcccaccaccttccc

SEQ ID NO: 782723 - DNA, 20 bp, mouse
ggtttggggtaaagctaggt

SEQ ID NO: 782724 - DNA, 20 bp, mouse
gggcagctccccaagcaaag

SEQ ID NO: 782725 - DNA, 20 bp, mouse
gacaggttgggccactcatg

SEQ ID NO: 782726 - DNA, 20 bp, mouse
gctaaccctaagcgcttctg

SEQ ID NO: 782727 - DNA, 20 bp, mouse
gttgccgcctggctcttgcc

SEQ ID NO: 782728 - DNA, 20 bp, mouse
gaccccgatagctgtcacac

SEQ ID NO: 782729 - DNA, 20 bp, mouse
gctatcggggtggtttgtat

SEQ ID NO: 782730 - DNA, 20 bp, mouse
gggaacctcagaagcgctta

SEQ ID NO: 782731 - DNA, 20 bp, mouse
ggcctgtctgtgctcttgta

SEQ ID NO: 782732 - DNA, 20 bp, mouse
gcatggggcagggagaccga

SEQ ID NO: 782733 - DNA, 20 bp, mouse
ggctcctgtgtgacagctat

SEQ ID NO: 782734 - DNA, 20 bp, mouse
gcagccgggcaagagccagg

SEQ ID NO: 782735 - DNA, 20 bp, mouse
ggctcttgtaaggtaaccag

SEQ ID NO: 782736 - DNA, 20 bp, mouse
gcggggacggagagcgtcag

SEQ ID NO: 782737 - DNA, 20 bp, mouse
gcagcggcttcgctcgggga

SEQ ID NO: 782738 - DNA, 20 bp, mouse
gctcctctgggacaaactct

SEQ ID NO: 782739 - DNA, 20 bp, mouse
ggccaaggctggcttgtcat

SEQ ID NO: 782740 - DNA, 20 bp, mouse
gcgggagctccacgactaga

SEQ ID NO: 782741 - DNA, 20 bp, mouse
gacaagccagccttggcgat

SEQ ID NO: 782742 - DNA, 20 bp, mouse
gcctccgggactctccaaga

SEQ ID NO: 782743 - DNA, 20 bp, mouse
gtggcaggctgcactgtaca

SEQ ID NO: 782744 - DNA, 20 bp, mouse
gtgtgcccggcaacaagagc

SEQ ID NO: 782745 - DNA, 20 bp, mouse
gcactagtggtctgagacta

SEQ ID NO: 782746 - DNA, 20 bp, mouse
ggaaggggtcatacagttaa

SEQ ID NO: 782747 - DNA, 20 bp, mouse
gaaggccacccaagtccagt

SEQ ID NO: 782748 - DNA, 20 bp, mouse
gcaagtccagtaggtagccc

SEQ ID NO: 782749 - DNA, 20 bp, mouse
ggctacctactggacttggg

SEQ ID NO: 782750 - DNA, 20 bp, mouse
ggagggagccaccattacct

SEQ ID NO: 782751 - DNA, 20 bp, mouse
gatggcccagttgtttctga

SEQ ID NO: 782752 - DNA, 20 bp, mouse
gcatacagttaagggtctga

SEQ ID NO: 782753 - DNA, 20 bp, mouse
gaggaggaagctagaggaac

SEQ ID NO: 782754 - DNA, 20 bp, mouse
gatgactttcactggttgta

SEQ ID NO: 782755 - DNA, 20 bp, mouse
gaaggcggtaaccccagccc

SEQ ID NO: 782756 - DNA, 20 bp, mouse
gcacttaagcccagcgtcat

SEQ ID NO: 782757 - DNA, 20 bp, mouse
gagaagatgcccctgtcatt

SEQ ID NO: 782758 - DNA, 20 bp, mouse
ggggcatcttctcgcagtga

SEQ ID NO: 782759 - DNA, 20 bp, mouse
gacttaggagttgtctgata

SEQ ID NO: 782760 - DNA, 20 bp, mouse
gtagcccagggcagatgttc

SEQ ID NO: 782761 - DNA, 20 bp, mouse
gaaccagatgcaaggaaggt

SEQ ID NO: 782762 - DNA, 20 bp, mouse
ggccctaagcctatgacgct

SEQ ID NO: 782763 - DNA, 20 bp, mouse
ggacgctgggcttaagtggc

SEQ ID NO: 782764 - DNA, 20 bp, mouse
ggggcaccaaaccagatgca

SEQ ID NO: 782765 - DNA, 20 bp, mouse
gtaagagtacagaatatctc

SEQ ID NO: 782766 - DNA, 20 bp, mouse
gcccgccggctgtccggaca

SEQ ID NO: 782767 - DNA, 20 bp, mouse
ggccgcgcccaggagcccgc

SEQ ID NO: 782768 - DNA, 20 bp, mouse
gtgcgcaggagagttacgtg

SEQ ID NO: 782769 - DNA, 20 bp, mouse
gggcgcggcgcctagcgcag

SEQ ID NO: 782770 - DNA, 20 bp, mouse
ggccctgtccggacagccgg

SEQ ID NO: 782771 - DNA, 20 bp, mouse
ggcggagcggagtgaggctc

SEQ ID NO: 782772 - DNA, 20 bp, mouse
ggacgggcggagcacggaga

SEQ ID NO: 782773 - DNA, 20 bp, mouse
ggacgcgcgcggtgccccga

SEQ ID NO: 782774 - DNA, 20 bp, mouse
gcggtaggccgaacaaactc

SEQ ID NO: 782775 - DNA, 20 bp, mouse
gcgtcgtgacgtcacggtgg

SEQ ID NO: 782776 - DNA, 20 bp, mouse
ggggcacctcagctaatcac

SEQ ID NO: 782777 - DNA, 20 bp, mouse
gcgctcggctgggagaaaag

SEQ ID NO: 782778 - DNA, 20 bp, mouse
ggggaaaaccggagaccaat

SEQ ID NO: 782779 - DNA, 20 bp, mouse
gagcaggcagccggcctggg

SEQ ID NO: 782780 - DNA, 20 bp, mouse
gcgccagcagcttactggag

SEQ ID NO: 782781 - DNA, 20 bp, mouse
gcctgcctgtggcaactgac

SEQ ID NO: 782782 - DNA, 20 bp, mouse
gtgagcctgtcagttgccac

SEQ ID NO: 782783 - DNA, 20 bp, mouse
gagtgcccagagctagcgac

SEQ ID NO: 782784 - DNA, 20 bp, mouse
gtgctggcgcagaagccgat

SEQ ID NO: 782785 - DNA, 20 bp, mouse
gttctgcgccagcagcttac

SEQ ID NO: 782786 - DNA, 20 bp, mouse
gtgggtgagcgcccctagtc

SEQ ID NO: 782787 - DNA, 20 bp, mouse
gcgtccgccgggccgaggag

SEQ ID NO: 782788 - DNA, 20 bp, mouse
gccgcctcggcgcttctcga

SEQ ID NO: 782789 - DNA, 20 bp, mouse
ggcgcccgcactccgagctg

SEQ ID NO: 782790 - DNA, 20 bp, mouse
gggtccccagctcggagtgc

SEQ ID NO: 782791 - DNA, 20 bp, mouse
ggcttccggggaaatgtcgg

SEQ ID NO: 782792 - DNA, 20 bp, mouse
gcctagtcgggctaccgtag

SEQ ID NO: 782793 - DNA, 20 bp, mouse
ggtgcctctcctcggcccgg

SEQ ID NO: 782794 - DNA, 20 bp, mouse
gagtgcgggcgccgagggct

SEQ ID NO: 782795 - DNA, 20 bp, mouse
gggagcgagcgcctcgactc

SEQ ID NO: 782796 - DNA, 20 bp, mouse
gcagctatgcgactcaaagt

SEQ ID NO: 782797 - DNA, 20 bp, mouse
gacgccttcctagaactctt

SEQ ID NO: 782798 - DNA, 20 bp, mouse
gcggggatcaacatcctcgg

SEQ ID NO: 782799 - DNA, 20 bp, mouse
ggggtcctagcgcccctccg

SEQ ID NO: 782800 - DNA, 20 bp, mouse
gccaaaggtcccaaggccgg

SEQ ID NO: 782801 - DNA, 20 bp, mouse
ggagtcgcatagctgcatcc

SEQ ID NO: 782802 - DNA, 20 bp, mouse
ggggacctttggaggagtga

SEQ ID NO: 782803 - DNA, 20 bp, mouse
gcacctgctaaccttagcca

SEQ ID NO: 782804 - DNA, 20 bp, mouse
ggagatagagctccagtgag

SEQ ID NO: 782805 - DNA, 20 bp, mouse
gttaggaagtcaaatctcac

SEQ ID NO: 782806 - DNA, 20 bp, mouse
gaggaggaccgacactggga

SEQ ID NO: 782807 - DNA, 20 bp, mouse
ggacgtgcaaggactgaaag

SEQ ID NO: 782808 - DNA, 20 bp, mouse
gtcctcctctgggtccccaa

SEQ ID NO: 782809 - DNA, 20 bp, mouse
ggaggcgcgggcggagcaga

SEQ ID NO: 782810 - DNA, 20 bp, mouse
gccagtgtcggtcctcctct

SEQ ID NO: 782811 - DNA, 20 bp, mouse
gcactgggaggggacgtgca

SEQ ID NO: 782812 - DNA, 20 bp, mouse
gtggataaggagctccccaa

SEQ ID NO: 782813 - DNA, 20 bp, mouse
gtggacagccaagaaccgga

SEQ ID NO: 782814 - DNA, 20 bp, mouse
gagggctagtgcagactagg

SEQ ID NO: 782815 - DNA, 20 bp, mouse
gagcacgcctaggtgccctc

SEQ ID NO: 782816 - DNA, 20 bp, mouse
gcggggcgggccagcgccgt

SEQ ID NO: 782817 - DNA, 20 bp, mouse
gtgggaggaggggcgtgtgg

SEQ ID NO: 782818 - DNA, 20 bp, mouse
gaaaagaaggggcgagagaa

SEQ ID NO: 782819 - DNA, 20 bp, mouse
gaaccagagctggcagctcg

SEQ ID NO: 782820 - DNA, 20 bp, mouse
ggcccctcctcccacggcgc

SEQ ID NO: 782821 - DNA, 20 bp, mouse
ggggcgagagaacggaatag

SEQ ID NO: 782822 - DNA, 20 bp, mouse
ggggaccctaggtgaggaaa

SEQ ID NO: 782823 - DNA, 20 bp, mouse
gaggagggggagaggcgttt

SEQ ID NO: 782824 - DNA, 20 bp, mouse
gtgggaagggaccctaggtg

SEQ ID NO: 782825 - DNA, 20 bp, mouse
ggccgccgcgccgggagggc

SEQ ID NO: 782826 - DNA, 20 bp, mouse
gagggtacgcgcttctgcag

SEQ ID NO: 782827 - DNA, 20 bp, mouse
ggcagaagcgcgtaccctca

SEQ ID NO: 782828 - DNA, 20 bp, mouse
ggcctggggagcagccctga

SEQ ID NO: 782829 - DNA, 20 bp, mouse
ggagcctgtaacagagaaga

SEQ ID NO: 782830 - DNA, 20 bp, mouse
gccagccgagccaccgagtg

SEQ ID NO: 782831 - DNA, 20 bp, mouse
gaaggcgagaggttcctgga

SEQ ID NO: 782832 - DNA, 20 bp, mouse
ggcagcggctccccctccat

SEQ ID NO: 782833 - DNA, 20 bp, mouse
gtggctcctccctcactcgg

SEQ ID NO: 782834 - DNA, 20 bp, mouse
gacagggcccgcgctatcct

SEQ ID NO: 782835 - DNA, 20 bp, mouse
gccgagccaccgagtgaggg

SEQ ID NO: 782836 - DNA, 20 bp, mouse
gacgctccgcggtcccctcc

SEQ ID NO: 782837 - DNA, 20 bp, mouse
ggctgacggcagcaaatatg

SEQ ID NO: 782838 - DNA, 20 bp, mouse
ggctgccgtcagccccggga

SEQ ID NO: 782839 - DNA, 20 bp, mouse
gcgacggggagcgagcgcgg

SEQ ID NO: 782840 - DNA, 20 bp, mouse
gggactgcccggagccctca

SEQ ID NO: 782841 - DNA, 20 bp, mouse
gcaggtgatcggtggtgcgg

SEQ ID NO: 782842 - DNA, 20 bp, mouse
ggcaccaccgatcacctgtc

SEQ ID NO: 782843 - DNA, 20 bp, mouse
ggctttaggagcgacccggc

SEQ ID NO: 782844 - DNA, 20 bp, mouse
gcgctcctaaagccagcgac

SEQ ID NO: 782845 - DNA, 20 bp, mouse
gcagcgacggggagcgagcg

SEQ ID NO: 782846 - DNA, 20 bp, mouse
gtggaagcgaggctagggtc

SEQ ID NO: 782847 - DNA, 20 bp, mouse
gcggccaggggctaaggatc

SEQ ID NO: 782848 - DNA, 20 bp, mouse
ggggtgtcaaggtggcgatg

SEQ ID NO: 782849 - DNA, 20 bp, mouse
ggggtttaggggcgcgtcta

SEQ ID NO: 782850 - DNA, 20 bp, mouse
gttcctcaatcaggtgtccc

SEQ ID NO: 782851 - DNA, 20 bp, mouse
gcgggcgcgtggcagccgtc

SEQ ID NO: 782852 - DNA, 20 bp, mouse
ggagaggcggggcgggttta

SEQ ID NO: 782853 - DNA, 20 bp, mouse
gttcccctctccataaaagg

SEQ ID NO: 782854 - DNA, 20 bp, mouse
gagcgaggctagggtcgggg

SEQ ID NO: 782855 - DNA, 20 bp, mouse
gtacagacgggtggcgggga

SEQ ID NO: 782856 - DNA, 20 bp, mouse
gggaaccaagggaggtcctc

SEQ ID NO: 782857 - DNA, 20 bp, mouse
gaagggagagtgcaagaggt

SEQ ID NO: 782858 - DNA, 20 bp, mouse
gaggctagattcacagtcac

SEQ ID NO: 782859 - DNA, 20 bp, mouse
gccctcccggcgctgactcc

SEQ ID NO: 782860 - DNA, 20 bp, mouse
gggcaaagactgctgcttga

SEQ ID NO: 782861 - DNA, 20 bp, mouse
gcggccggagggaagccctc

SEQ ID NO: 782862 - DNA, 20 bp, mouse
gaaacactgtgctaatgggt

SEQ ID NO: 782863 - DNA, 20 bp, mouse
gcggagggaagccctcaggg

SEQ ID NO: 782864 - DNA, 20 bp, mouse
gtggtcctggccctgcagac

SEQ ID NO: 782865 - DNA, 20 bp, mouse
gccggcgctgactccgggcc

SEQ ID NO: 782866 - DNA, 20 bp, mouse
ggcagacggagcccacactg

SEQ ID NO: 782867 - DNA, 20 bp, mouse
gcccgcgcgccgcccgctgg

SEQ ID NO: 782868 - DNA, 20 bp, mouse
gctaaggcagggcaggacgc

SEQ ID NO: 782869 - DNA, 20 bp, mouse
ggtacccgagggaacttcgg

SEQ ID NO: 782870 - DNA, 20 bp, mouse
gaccccaaataaggagtctg

SEQ ID NO: 782871 - DNA, 20 bp, mouse
gaggtgctggcgcagacagg

SEQ ID NO: 782872 - DNA, 20 bp, mouse
gctggcgggccaacaggtgc

SEQ ID NO: 782873 - DNA, 20 bp, mouse
ggacccgcgcggcactcgca

SEQ ID NO: 782874 - DNA, 20 bp, mouse
gcgggaagccgggagagctt

SEQ ID NO: 782875 - DNA, 20 bp, mouse
gtgggagtggggatcccctt

SEQ ID NO: 782876 - DNA, 20 bp, mouse
gaaaccctgggagacgggaa

SEQ ID NO: 782877 - DNA, 20 bp, mouse
ggcagccgctgtccaccgga

SEQ ID NO: 782878 - DNA, 20 bp, mouse
gcggctgggaacagggatcc

SEQ ID NO: 782879 - DNA, 20 bp, mouse
ggagccagacgctgtgacgc

SEQ ID NO: 782880 - DNA, 20 bp, mouse
gagtagggcacaaagtggtc

SEQ ID NO: 782881 - DNA, 20 bp, mouse
ggggcagtgcggctgggaac

SEQ ID NO: 782882 - DNA, 20 bp, mouse
ggcccccctccggtggacag

SEQ ID NO: 782883 - DNA, 20 bp, mouse
gcgtctggctcttctgcgga

SEQ ID NO: 782884 - DNA, 20 bp, mouse
ggagccggcgtcacagcgtc

SEQ ID NO: 782885 - DNA, 20 bp, mouse
gacgtggattcgcccccctc

SEQ ID NO: 782886 - DNA, 20 bp, mouse
gggagcaaaccagatggggt

SEQ ID NO: 782887 - DNA, 20 bp, mouse
gtcagagagcaaggagtcct

SEQ ID NO: 782888 - DNA, 20 bp, mouse
gtgctcttatgcaatcaggg

SEQ ID NO: 782889 - DNA, 20 bp, mouse
gtcgttgttgttgaagtctg

SEQ ID NO: 782890 - DNA, 20 bp, mouse
ggaggggggagcaaaccaga

SEQ ID NO: 782891 - DNA, 20 bp, mouse
ggaagtctgggggttgggac

SEQ ID NO: 782892 - DNA, 20 bp, mouse
gctgccgggaaagaggtttc

SEQ ID NO: 782893 - DNA, 20 bp, mouse
gcggctgcgtcgttttgaac

SEQ ID NO: 782894 - DNA, 20 bp, mouse
gtcaacaacaacgaggaggg

SEQ ID NO: 782895 - DNA, 20 bp, mouse
gctggggagaaattctaacg

SEQ ID NO: 782896 - DNA, 20 bp, mouse
gtggggaaggcggggaggtg

SEQ ID NO: 782897 - DNA, 20 bp, mouse
gtgaaagagccggtgaaggg

SEQ ID NO: 782898 - DNA, 20 bp, mouse
ggccaagcttggggaaggcg

SEQ ID NO: 782899 - DNA, 20 bp, mouse
ggtggggggagcggtggagc

SEQ ID NO: 782900 - DNA, 20 bp, mouse
ggacaggcatcaggcaagtg

SEQ ID NO: 782901 - DNA, 20 bp, mouse
gccccaggtaccatggtaaa

SEQ ID NO: 782902 - DNA, 20 bp, mouse
gtctaataaaagtgactcag

SEQ ID NO: 782903 - DNA, 20 bp, mouse
gtcctgaaagagccggtgaa

SEQ ID NO: 782904 - DNA, 20 bp, mouse
ggtgactcagtggctggcgt

SEQ ID NO: 782905 - DNA, 20 bp, mouse
gaagcttggggaaggcgggg

SEQ ID NO: 782906 - DNA, 20 bp, mouse
gggaagacaaatgactagga

SEQ ID NO: 782907 - DNA, 20 bp, mouse
ggcgcctgggacaccacagc

SEQ ID NO: 782908 - DNA, 20 bp, mouse
gaagaccctaccagagaagg

SEQ ID NO: 782909 - DNA, 20 bp, mouse
gggaggattcggtttcactg

SEQ ID NO: 782910 - DNA, 20 bp, mouse
gactgggaagacaaatgact

SEQ ID NO: 782911 - DNA, 20 bp, mouse
gaagagatcacattacacag

SEQ ID NO: 782912 - DNA, 20 bp, mouse
gggaatcagtccaccttctc

SEQ ID NO: 782913 - DNA, 20 bp, mouse
gacaccacagctggaggatt

SEQ ID NO: 782914 - DNA, 20 bp, mouse
gcctaaggtgacctagatga

SEQ ID NO: 782915 - DNA, 20 bp, mouse
gccgtcaccactccaccagg

SEQ ID NO: 782916 - DNA, 20 bp, mouse
gggcgcctgcgtgggaaagt

SEQ ID NO: 782917 - DNA, 20 bp, mouse
gtgtcccagggcgcctgcgt

SEQ ID NO: 782918 - DNA, 20 bp, mouse
gtggctacgcccttctgagg

SEQ ID NO: 782919 - DNA, 20 bp, mouse
gcgccagcaaccattctggt

SEQ ID NO: 782920 - DNA, 20 bp, mouse
gcgggcctgtggtacagctt

SEQ ID NO: 782921 - DNA, 20 bp, mouse
ggtctgcaggccaaccagaa

SEQ ID NO: 782922 - DNA, 20 bp, mouse
ggccccccactttcccacgc

SEQ ID NO: 782923 - DNA, 20 bp, mouse
gcacaggcccgactgggcaa

SEQ ID NO: 782924 - DNA, 20 bp, mouse
gggcgcctcaaggagacttg

SEQ ID NO: 782925 - DNA, 20 bp, mouse
gggccaaccagaatggttgc

SEQ ID NO: 782926 - DNA, 20 bp, mouse
gaagcagaacatcagcctga

SEQ ID NO: 782927 - DNA, 20 bp, mouse
gctactctgtcataatctgg

SEQ ID NO: 782928 - DNA, 20 bp, mouse
gtgagaaaaacctatctact

SEQ ID NO: 782929 - DNA, 20 bp, mouse
gataaagctttaatgccctc

SEQ ID NO: 782930 - DNA, 20 bp, mouse
ggaggtcatgttttctaatg

SEQ ID NO: 782931 - DNA, 20 bp, mouse
gaattcagaactgtcacaat

SEQ ID NO: 782932 - DNA, 20 bp, mouse
gctcctactctgtcataatc

SEQ ID NO: 782933 - DNA, 20 bp, mouse
gttaaagctttatatcacgt

SEQ ID NO: 782934 - DNA, 20 bp, mouse
gttgatctttaaagtacact

SEQ ID NO: 782935 - DNA, 20 bp, mouse
gacttgtttatatactgtcc

SEQ ID NO: 782936 - DNA, 20 bp, mouse
gtgcagaggcggggcccaga

SEQ ID NO: 782937 - DNA, 20 bp, mouse
ggtccagcagaggtgacgtg

SEQ ID NO: 782938 - DNA, 20 bp, mouse
gggaccgcgactcgctaggt

SEQ ID NO: 782939 - DNA, 20 bp, mouse
gcctctgcatgcgtagccaa

SEQ ID NO: 782940 - DNA, 20 bp, mouse
ggcgcgctctgccaaagcct

SEQ ID NO: 782941 - DNA, 20 bp, mouse
ggcgagtcgcggtccagcag

SEQ ID NO: 782942 - DNA, 20 bp, mouse
gtgagagtcccgtcttcctg

SEQ ID NO: 782943 - DNA, 20 bp, mouse
gaggcgtcgaaactagccgt

SEQ ID NO: 782944 - DNA, 20 bp, mouse
gtctgccaaagcctgggggc

SEQ ID NO: 782945 - DNA, 20 bp, mouse
ggcgactcgctaggtgggcg

SEQ ID NO: 782946 - DNA, 20 bp, mouse
gccgccgcagattctccaaa

SEQ ID NO: 782947 - DNA, 20 bp, mouse
gtgggcgtgcccgtgaaggt

SEQ ID NO: 782948 - DNA, 20 bp, mouse
gtgcccgtgaaggttggagg

SEQ ID NO: 782949 - DNA, 20 bp, mouse
ggcggcgcaaaccggccggt

SEQ ID NO: 782950 - DNA, 20 bp, mouse
gcacgctccccgccttggac

SEQ ID NO: 782951 - DNA, 20 bp, mouse
ggtgagaggcggagtctgag

SEQ ID NO: 782952 - DNA, 20 bp, mouse
gaatctgcggcggcgcaaac

SEQ ID NO: 782953 - DNA, 20 bp, mouse
gcggccggcagaacgctatt

SEQ ID NO: 782954 - DNA, 20 bp, mouse
gtgcggcggcgcaaaccggc

SEQ ID NO: 782955 - DNA, 20 bp, mouse
gtccaggccccgccttgcat

SEQ ID NO: 782956 - DNA, 20 bp, mouse
gtcaccaactgggaggtcta

SEQ ID NO: 782957 - DNA, 20 bp, mouse
ggcccctcaggggcggagat

SEQ ID NO: 782958 - DNA, 20 bp, mouse
gagtctgaaaggcccctcag

SEQ ID NO: 782959 - DNA, 20 bp, mouse
gaggtctagggaatgcttgc

SEQ ID NO: 782960 - DNA, 20 bp, mouse
gttaataggcaccaggcagg

SEQ ID NO: 782961 - DNA, 20 bp, mouse
ggcagagagtgggggacatc

SEQ ID NO: 782962 - DNA, 20 bp, mouse
gggacatctggtcaccaact

SEQ ID NO: 782963 - DNA, 20 bp, mouse
gagggaagataaagtctgaa

SEQ ID NO: 782964 - DNA, 20 bp, mouse
gtggcacctggctgggtctc

SEQ ID NO: 782965 - DNA, 20 bp, mouse
ggcacacaggcagcaagaca

SEQ ID NO: 782966 - DNA, 20 bp, mouse
gaggcagctcctccattcag

SEQ ID NO: 782967 - DNA, 20 bp, mouse
ggtactggggtctcaggagg

SEQ ID NO: 782968 - DNA, 20 bp, mouse
gccagtacctgccccctgaa

SEQ ID NO: 782969 - DNA, 20 bp, mouse
ggtacctgccccctgaatgg

SEQ ID NO: 782970 - DNA, 20 bp, mouse
gtctcaggaggagggcggga

SEQ ID NO: 782971 - DNA, 20 bp, mouse
gcctgtgttgagctagtgtc

SEQ ID NO: 782972 - DNA, 20 bp, mouse
gaagaggtgtgaggcttggt

SEQ ID NO: 782973 - DNA, 20 bp, mouse
gaggaggagggcgggatggt

SEQ ID NO: 782974 - DNA, 20 bp, mouse
gaatctcatgacttctactg

SEQ ID NO: 782975 - DNA, 20 bp, mouse
gtactggggcctctgtttga

SEQ ID NO: 782976 - DNA, 20 bp, mouse
gaggcggaggggtgaagtca

SEQ ID NO: 782977 - DNA, 20 bp, mouse
gcccgccggtctggctgtgg

SEQ ID NO: 782978 - DNA, 20 bp, mouse
gggggtcggtgggaagtagg

SEQ ID NO: 782979 - DNA, 20 bp, mouse
gcgaggcggggcggacgctt

SEQ ID NO: 782980 - DNA, 20 bp, mouse
gacgcccgccggtctggctg

SEQ ID NO: 782981 - DNA, 20 bp, mouse
gggccccgagcaggcctagg

SEQ ID NO: 782982 - DNA, 20 bp, mouse
ggtggcggaggcctggacgg

SEQ ID NO: 782983 - DNA, 20 bp, mouse
ggcctccgccacagccagac

SEQ ID NO: 782984 - DNA, 20 bp, mouse
gcggaagtgaggcccgcgaa

SEQ ID NO: 782985 - DNA, 20 bp, mouse
ggccccgcgcgcccgccaat

SEQ ID NO: 782986 - DNA, 20 bp, mouse
ggggcggggcggtgtaggcg

SEQ ID NO: 782987 - DNA, 20 bp, mouse
gcccaggtccggaaagagtg

SEQ ID NO: 782988 - DNA, 20 bp, mouse
gaggggcgcgcccgcgcgga

SEQ ID NO: 782989 - DNA, 20 bp, mouse
gaagggggcacctcacacta

SEQ ID NO: 782990 - DNA, 20 bp, mouse
gcgaatcagggcgagagccg

SEQ ID NO: 782991 - DNA, 20 bp, mouse
gccaatccccgcacgaatca

SEQ ID NO: 782992 - DNA, 20 bp, mouse
gctgcctgagccctccgcgc

SEQ ID NO: 782993 - DNA, 20 bp, mouse
ggcgcccgcgcggagggctc

SEQ ID NO: 782994 - DNA, 20 bp, mouse
gtgccgcgaccaccaatcac

SEQ ID NO: 782995 - DNA, 20 bp, mouse
gcggggcttgagcactccga

SEQ ID NO: 782996 - DNA, 20 bp, mouse
gcgtcctcaggcaaagtccg

SEQ ID NO: 782997 - DNA, 20 bp, mouse
ggtggggaaactaacttctg

SEQ ID NO: 782998 - DNA, 20 bp, mouse
gacgcagagtagcagctgtg

SEQ ID NO: 782999 - DNA, 20 bp, mouse
gctgccaaagcatgcgcacc

SEQ ID NO: 783000 - DNA, 20 bp, mouse
gaaagcatgcgcaccaggct

SEQ ID NO: 783001 - DNA, 20 bp, mouse
gtgggggcagagtgagttgt

SEQ ID NO: 783002 - DNA, 20 bp, mouse
ggtagcagctgtgaggatgg

SEQ ID NO: 783003 - DNA, 20 bp, mouse
gtcaaatgactggaattctc

SEQ ID NO: 783004 - DNA, 20 bp, mouse
gcaggcaaagtccgaggcag

SEQ ID NO: 783005 - DNA, 20 bp, mouse
gagagtagcagctgtgagga

SEQ ID NO: 783006 - DNA, 20 bp, mouse
gggcggggcagggcgaggat

SEQ ID NO: 783007 - DNA, 20 bp, mouse
gaggatgggcggggaatgaa

SEQ ID NO: 783008 - DNA, 20 bp, mouse
gggcgagcggagtagcggag

SEQ ID NO: 783009 - DNA, 20 bp, mouse
ggtgcgtggccaattgaaag

SEQ ID NO: 783010 - DNA, 20 bp, mouse
gcaaaccggtaacctctacc

SEQ ID NO: 783011 - DNA, 20 bp, mouse
gggcggggaatgaaggggcg

SEQ ID NO: 783012 - DNA, 20 bp, mouse
gtggacttcgctcatgtgcg

SEQ ID NO: 783013 - DNA, 20 bp, mouse
gctacccggccgctttcaat

SEQ ID NO: 783014 - DNA, 20 bp, mouse
gctggaaggggccacgagag

SEQ ID NO: 783015 - DNA, 20 bp, mouse
gcaccgcccgctagaagccg

SEQ ID NO: 783016 - DNA, 20 bp, mouse
gagagcccgcggaggagagg

SEQ ID NO: 783017 - DNA, 20 bp, mouse
gagcgcccgcctctcctccg

SEQ ID NO: 783018 - DNA, 20 bp, mouse
gggcctgggtgcgatcatct

SEQ ID NO: 783019 - DNA, 20 bp, mouse
ggccagagcccgcggaggag

SEQ ID NO: 783020 - DNA, 20 bp, mouse
ggggcggggcccggcgtgag

SEQ ID NO: 783021 - DNA, 20 bp, mouse
gcgctcggtaggtctgaaga

SEQ ID NO: 783022 - DNA, 20 bp, mouse
ggggcagcgtagcccgccac

SEQ ID NO: 783023 - DNA, 20 bp, mouse
gcacggggcacgagcaccgc

SEQ ID NO: 783024 - DNA, 20 bp, mouse
gccagcggccgcagcttctc

SEQ ID NO: 783025 - DNA, 20 bp, mouse
gcacagccgagcgtttccag

SEQ ID NO: 783026 - DNA, 20 bp, mouse
gaagctggctggctgtggat

SEQ ID NO: 783027 - DNA, 20 bp, mouse
gcagaagccaaactgactgt

SEQ ID NO: 783028 - DNA, 20 bp, mouse
gcgtgtacccatggacacca

SEQ ID NO: 783029 - DNA, 20 bp, mouse
gctgactgtaggaagctggc

SEQ ID NO: 783030 - DNA, 20 bp, mouse
ggagaagctgagtatatgga

SEQ ID NO: 783031 - DNA, 20 bp, mouse
gtgggtacacgctttgaaca

SEQ ID NO: 783032 - DNA, 20 bp, mouse
gaccatgtttaaggtcatgt

SEQ ID NO: 783033 - DNA, 20 bp, mouse
gggccattgttgagtaagag

SEQ ID NO: 783034 - DNA, 20 bp, mouse
gtgagggagctttagaagaa

SEQ ID NO: 783035 - DNA, 20 bp, mouse
gtgaacagggctgctaggct

SEQ ID NO: 783036 - DNA, 20 bp, mouse
gagcacggacagcacggagg

SEQ ID NO: 783037 - DNA, 20 bp, mouse
gagggcggaggaagtacgaa

SEQ ID NO: 783038 - DNA, 20 bp, mouse
gccacggcggccactcgctc

SEQ ID NO: 783039 - DNA, 20 bp, mouse
gggaaccacgcccccgtagg

SEQ ID NO: 783040 - DNA, 20 bp, mouse
ggaagtacgaaagggtgcaa

SEQ ID NO: 783041 - DNA, 20 bp, mouse
gcagcacggaggagggcgaa

SEQ ID NO: 783042 - DNA, 20 bp, mouse
gcccagggccccgcctacat

SEQ ID NO: 783043 - DNA, 20 bp, mouse
gcggagcacggacagcacgg

SEQ ID NO: 783044 - DNA, 20 bp, mouse
gaagacacgcccatgtaggc

SEQ ID NO: 783045 - DNA, 20 bp, mouse
ggctggaaccacgcccccgt

SEQ ID NO: 783046 - DNA, 20 bp, mouse
gcccacctccttaaccgtga

SEQ ID NO: 783047 - DNA, 20 bp, mouse
ggggcgcgcacaaacaactc

SEQ ID NO: 783048 - DNA, 20 bp, mouse
gggcccccaagaagtgtagt

SEQ ID NO: 783049 - DNA, 20 bp, mouse
gcctccaacgcctagccaat

SEQ ID NO: 783050 - DNA, 20 bp, mouse
gtgtcgaagcgcaaggctat

SEQ ID NO: 783051 - DNA, 20 bp, mouse
ggagacaggggaaagaacca

SEQ ID NO: 783052 - DNA, 20 bp, mouse
gaagggttagcgggactctg

SEQ ID NO: 783053 - DNA, 20 bp, mouse
gggaggcatcgccagggcaa

SEQ ID NO: 783054 - DNA, 20 bp, mouse
gggcgccgggacaagccgat

SEQ ID NO: 783055 - DNA, 20 bp, mouse
ggcggccgaagcccgtctcc

SEQ ID NO: 783056 - DNA, 20 bp, mouse
gggcgcgcgtgggatgtgag

SEQ ID NO: 783057 - DNA, 20 bp, mouse
ggggatgtgaggggcgctaa

SEQ ID NO: 783058 - DNA, 20 bp, mouse
gaggggcgctaaggggtacg

SEQ ID NO: 783059 - DNA, 20 bp, mouse
ggcacgcgcgcgctgctgat

SEQ ID NO: 783060 - DNA, 20 bp, mouse
gcacgcgcgccgcgtacgtg

SEQ ID NO: 783061 - DNA, 20 bp, mouse
gcggaagaggggcctcgggt

SEQ ID NO: 783062 - DNA, 20 bp, mouse
gctaaaaatagctcaggcgt

SEQ ID NO: 783063 - DNA, 20 bp, mouse
ggcgcgccgcgtacgtgcgg

SEQ ID NO: 783064 - DNA, 20 bp, mouse
gaaggaagcttaggcggcgg

SEQ ID NO: 783065 - DNA, 20 bp, mouse
gtttaaggaagcttaggcgg

SEQ ID NO: 783066 - DNA, 20 bp, mouse
gaggccatggaaaccgtgtc

SEQ ID NO: 783067 - DNA, 20 bp, mouse
gcaggcatccgggatgacgt

SEQ ID NO: 783068 - DNA, 20 bp, mouse
gtcatcccggatgcctgctg

SEQ ID NO: 783069 - DNA, 20 bp, mouse
gcaaggggcaaagggtgaga

SEQ ID NO: 783070 - DNA, 20 bp, mouse
gagtgaccgcggccaaaggg

SEQ ID NO: 783071 - DNA, 20 bp, mouse
gtggcacagtgatcccgaca

SEQ ID NO: 783072 - DNA, 20 bp, mouse
ggggctcctccctttggccg

SEQ ID NO: 783073 - DNA, 20 bp, mouse
gtctagtgaccgcggccaaa

SEQ ID NO: 783074 - DNA, 20 bp, mouse
gcctggctggagttgtggag

SEQ ID NO: 783075 - DNA, 20 bp, mouse
ggggcgtggaggtagataaa

SEQ ID NO: 783076 - DNA, 20 bp, mouse
gtctgctgtaggtggggaca

SEQ ID NO: 783077 - DNA, 20 bp, mouse
gacctcgccagactctaatc

SEQ ID NO: 783078 - DNA, 20 bp, mouse
gagagtctggcgaggtcctg

SEQ ID NO: 783079 - DNA, 20 bp, mouse
gagcaagaaggctgtgggta

SEQ ID NO: 783080 - DNA, 20 bp, mouse
gcgggcggggtcgcgagcga

SEQ ID NO: 783081 - DNA, 20 bp, mouse
ggaggtcctgcgggcccgct

SEQ ID NO: 783082 - DNA, 20 bp, mouse
gcacaacgcgtgggtttgta

SEQ ID NO: 783083 - DNA, 20 bp, mouse
gggcggggacagatccgccc

SEQ ID NO: 783084 - DNA, 20 bp, mouse
gtaactcccggattagagtc

SEQ ID NO: 783085 - DNA, 20 bp, mouse
gccaacccggcatgaaagct

SEQ ID NO: 783086 - DNA, 20 bp, mouse
gctcggcagcgcagaggagg

SEQ ID NO: 783087 - DNA, 20 bp, mouse
gcacctggcccgcgccttgt

SEQ ID NO: 783088 - DNA, 20 bp, mouse
gccgaggtgtccacatcctc

SEQ ID NO: 783089 - DNA, 20 bp, mouse
gaagggtctcagtctagagg

SEQ ID NO: 783090 - DNA, 20 bp, mouse
ggaaccgaccccctgtgctt

SEQ ID NO: 783091 - DNA, 20 bp, mouse
gtctagaggcggttttcagg

SEQ ID NO: 783092 - DNA, 20 bp, mouse
gctggggaccgcgacatcga

SEQ ID NO: 783093 - DNA, 20 bp, mouse
gggatgtggacacctcggaa

SEQ ID NO: 783094 - DNA, 20 bp, mouse
gtcccaccccacaataggaa

SEQ ID NO: 783095 - DNA, 20 bp, mouse
gggcggccccgggatcacat

SEQ ID NO: 783096 - DNA, 20 bp, mouse
ggggactgctgcctgtctta

SEQ ID NO: 783097 - DNA, 20 bp, mouse
gtctccaccaagcacttgta

SEQ ID NO: 783098 - DNA, 20 bp, mouse
ggtctggtggggctatcctg

SEQ ID NO: 783099 - DNA, 20 bp, mouse
gaagtctgacctcttgtcag

SEQ ID NO: 783100 - DNA, 20 bp, mouse
gcagcagtcccactgacaag

SEQ ID NO: 783101 - DNA, 20 bp, mouse
ggaacccagctgttggggtc

SEQ ID NO: 783102 - DNA, 20 bp, mouse
ggaaggaattagcaggtggt

SEQ ID NO: 783103 - DNA, 20 bp, mouse
gacaggaaacaggtagtgaa

SEQ ID NO: 783104 - DNA, 20 bp, mouse
ggtgcttggtggagaactgt

SEQ ID NO: 783105 - DNA, 20 bp, mouse
gctagtctgaagaccctaga

SEQ ID NO: 783106 - DNA, 20 bp, mouse
gagagacagcgcctggtcag

SEQ ID NO: 783107 - DNA, 20 bp, mouse
gtccccgcccaaggaggctt

SEQ ID NO: 783108 - DNA, 20 bp, mouse
gtgtaacccgaagcctcctt

SEQ ID NO: 783109 - DNA, 20 bp, mouse
gcttgggcggggagaggtct

SEQ ID NO: 783110 - DNA, 20 bp, mouse
ggcagcagggataaatctcc

SEQ ID NO: 783111 - DNA, 20 bp, mouse
gcaagtagacgataaacagg

SEQ ID NO: 783112 - DNA, 20 bp, mouse
ggtcagaggcgctcccagct

SEQ ID NO: 783113 - DNA, 20 bp, mouse
gacccgaagcctccttgggc

SEQ ID NO: 783114 - DNA, 20 bp, mouse
ggagcaagtagacgataaac

SEQ ID NO: 783115 - DNA, 20 bp, mouse
ggcagccccaggagctaagt

SEQ ID NO: 783116 - DNA, 20 bp, mouse
ggggcgcgggcacgaacgga

SEQ ID NO: 783117 - DNA, 20 bp, mouse
gtcctcggagcccccaaagt

SEQ ID NO: 783118 - DNA, 20 bp, mouse
gaaagtgaggggcgggtcct

SEQ ID NO: 783119 - DNA, 20 bp, mouse
ggagggatgcaggactgcgg

SEQ ID NO: 783120 - DNA, 20 bp, mouse
ggccccgcgcgcacaccgat

SEQ ID NO: 783121 - DNA, 20 bp, mouse
gcggagcccccaaagtggga

SEQ ID NO: 783122 - DNA, 20 bp, mouse
gcccgaccctcccactttgg

SEQ ID NO: 783123 - DNA, 20 bp, mouse
gcctccccgggctagagcac

SEQ ID NO: 783124 - DNA, 20 bp, mouse
gcgaacggaggggggatcgg

SEQ ID NO: 783125 - DNA, 20 bp, mouse
gcaagcggaccctattctgg

SEQ ID NO: 783126 - DNA, 20 bp, mouse
gcaagtcacagagcacaaca

SEQ ID NO: 783127 - DNA, 20 bp, mouse
gggcggggccacgtcgctca

SEQ ID NO: 783128 - DNA, 20 bp, mouse
gggggcgtgaccattagggg

SEQ ID NO: 783129 - DNA, 20 bp, mouse
gccgcccagcccggaccatg

SEQ ID NO: 783130 - DNA, 20 bp, mouse
gggtcacgcccccatggtcc

SEQ ID NO: 783131 - DNA, 20 bp, mouse
gacgtcgctcagggcttaga

SEQ ID NO: 783132 - DNA, 20 bp, mouse
gagtctccggggtgtagtct

SEQ ID NO: 783133 - DNA, 20 bp, mouse
gggaggcggaagttccccac

SEQ ID NO: 783134 - DNA, 20 bp, mouse
gcatgggggcgtgaccatta

SEQ ID NO: 783135 - DNA, 20 bp, mouse
gccggggtgtagtcttggac

SEQ ID NO: 783136 - DNA, 20 bp, mouse
gagagcctgaagcggggcac

SEQ ID NO: 783137 - DNA, 20 bp, mouse
ggcagcgacccgactggcga

SEQ ID NO: 783138 - DNA, 20 bp, mouse
gtggacatcccggggtcggt

SEQ ID NO: 783139 - DNA, 20 bp, mouse
gtgggcgagagcctgaagcg

SEQ ID NO: 783140 - DNA, 20 bp, mouse
gcgagtggacatcccggggt

SEQ ID NO: 783141 - DNA, 20 bp, mouse
gcaaacgagtggacatcccg

SEQ ID NO: 783142 - DNA, 20 bp, mouse
gcctcccactggcggagtgg

SEQ ID NO: 783143 - DNA, 20 bp, mouse
gtgggaggcgcaaggggctt

SEQ ID NO: 783144 - DNA, 20 bp, mouse
gcgccagtgggaggcgcaag

SEQ ID NO: 783145 - DNA, 20 bp, mouse
gggctgggcagcgacccgac

SEQ ID NO: 783146 - DNA, 20 bp, mouse
gctagccgcgccaaatggaa

SEQ ID NO: 783147 - DNA, 20 bp, mouse
gacccggagggccagagggg

SEQ ID NO: 783148 - DNA, 20 bp, mouse
gcgaggcaggggcgcggagt

SEQ ID NO: 783149 - DNA, 20 bp, mouse
gtggctgcgcaatggcgggt

SEQ ID NO: 783150 - DNA, 20 bp, mouse
gcgggtgggcgggacccgga

SEQ ID NO: 783151 - DNA, 20 bp, mouse
gtggaggccgggcgaggcag

SEQ ID NO: 783152 - DNA, 20 bp, mouse
gctccgtgacgtcacaaaac

SEQ ID NO: 783153 - DNA, 20 bp, mouse
gccctgttgctggtgaaggt

SEQ ID NO: 783154 - DNA, 20 bp, mouse
gcacccggggcagaccgcag

SEQ ID NO: 783155 - DNA, 20 bp, mouse
gcgggacccggagggccaga

SEQ ID NO: 783156 - DNA, 20 bp, mouse
gaaagccacgggtaacccca

SEQ ID NO: 783157 - DNA, 20 bp, mouse
gtaccccctggggttacccg

SEQ ID NO: 783158 - DNA, 20 bp, mouse
gttgcagggtgtggtgataa

SEQ ID NO: 783159 - DNA, 20 bp, mouse
gtgagattacccaatggatg

SEQ ID NO: 783160 - DNA, 20 bp, mouse
gagtgcagggtggcccctcc

SEQ ID NO: 783161 - DNA, 20 bp, mouse
gccccagggggtagagtgca

SEQ ID NO: 783162 - DNA, 20 bp, mouse
gcgccagtaggtcgtcacgt

SEQ ID NO: 783163 - DNA, 20 bp, mouse
gagcggctgcacaaaagcca

SEQ ID NO: 783164 - DNA, 20 bp, mouse
gaccctgcactctaccccct

SEQ ID NO: 783165 - DNA, 20 bp, mouse
gtgacgacctactggcgcag

SEQ ID NO: 783166 - DNA, 20 bp, mouse
ggggccccaacccggaaata

SEQ ID NO: 783167 - DNA, 20 bp, mouse
gggcccggcgcgcttgtcga

SEQ ID NO: 783168 - DNA, 20 bp, mouse
gccggcgcgcttgtcgaggg

SEQ ID NO: 783169 - DNA, 20 bp, mouse
gcctccccgtcacttctgat

SEQ ID NO: 783170 - DNA, 20 bp, mouse
gaaatacggctcttggtcgg

SEQ ID NO: 783171 - DNA, 20 bp, mouse
gaggagcggcggctacgtcg

SEQ ID NO: 783172 - DNA, 20 bp, mouse
gcgagccaatcagaagtgac

SEQ ID NO: 783173 - DNA, 20 bp, mouse
gcggaaatacggctcttggt

SEQ ID NO: 783174 - DNA, 20 bp, mouse
gttccctgtcaggtaaactg

SEQ ID NO: 783175 - DNA, 20 bp, mouse
gagcgcgccgggccccaacc

SEQ ID NO: 783176 - DNA, 20 bp, mouse
ggatgggaaccatcttagaa

SEQ ID NO: 783177 - DNA, 20 bp, mouse
gcttccagccccttctaaga

SEQ ID NO: 783178 - DNA, 20 bp, mouse
gttagttaggacagagaaac

SEQ ID NO: 783179 - DNA, 20 bp, mouse
ggaaacctgagcctaactgt

SEQ ID NO: 783180 - DNA, 20 bp, mouse
gtctaccgatgtggcacatc

SEQ ID NO: 783181 - DNA, 20 bp, mouse
gcagacctacagttaggctc

SEQ ID NO: 783182 - DNA, 20 bp, mouse
gtcctaactaatcctcatgt

SEQ ID NO: 783183 - DNA, 20 bp, mouse
gaagtatgaagtagcttgag

SEQ ID NO: 783184 - DNA, 20 bp, mouse
gaacattgtgaggtcatggg

SEQ ID NO: 783185 - DNA, 20 bp, mouse
gtcctacatgaggattagtt

SEQ ID NO: 783186 - DNA, 20 bp, mouse
gctggccaaacagagttcgg

SEQ ID NO: 783187 - DNA, 20 bp, mouse
gaccgcccccgaactctgtt

SEQ ID NO: 783188 - DNA, 20 bp, mouse
gagggcaaagcccacaactt

SEQ ID NO: 783189 - DNA, 20 bp, mouse
gtacagggcctcagccactg

SEQ ID NO: 783190 - DNA, 20 bp, mouse
gacgcacacagtggcgtatg

SEQ ID NO: 783191 - DNA, 20 bp, mouse
gggagcgggtgggcgtcagg

SEQ ID NO: 783192 - DNA, 20 bp, mouse
gtcaaggaaacctaagttgt

SEQ ID NO: 783193 - DNA, 20 bp, mouse
gtgttccactacaggagaaa

SEQ ID NO: 783194 - DNA, 20 bp, mouse
ggcgggagcgggtgggcgtc

SEQ ID NO: 783195 - DNA, 20 bp, mouse
ggcccccttttctcctgtag

SEQ ID NO: 783196 - DNA, 20 bp, mouse
ggaaggtcgcaggccccccg

SEQ ID NO: 783197 - DNA, 20 bp, mouse
ggacggacaacggtgaccac

SEQ ID NO: 783198 - DNA, 20 bp, mouse
ggacgtgcagggacggacaa

SEQ ID NO: 783199 - DNA, 20 bp, mouse
gccgaactgcccacacaccg

SEQ ID NO: 783200 - DNA, 20 bp, mouse
gcgcaggccccccgcggtcc

SEQ ID NO: 783201 - DNA, 20 bp, mouse
ggtcaaccaggcggaggcgg

SEQ ID NO: 783202 - DNA, 20 bp, mouse
ggggcctggccgcaccttgg

SEQ ID NO: 783203 - DNA, 20 bp, mouse
gactgcccacacaccgaggc

SEQ ID NO: 783204 - DNA, 20 bp, mouse
gcagccgcaaggagtaagat

SEQ ID NO: 783205 - DNA, 20 bp, mouse
gctggttgacgacgagtgtg

SEQ ID NO: 783206 - DNA, 20 bp, mouse
gccgcagcggggctccagag

SEQ ID NO: 783207 - DNA, 20 bp, mouse
ggggcaggtgcgccccctac

SEQ ID NO: 783208 - DNA, 20 bp, mouse
gatgcccaggaaccctttga

SEQ ID NO: 783209 - DNA, 20 bp, mouse
ggggacgacgttcctagagt

SEQ ID NO: 783210 - DNA, 20 bp, mouse
ggcgttcctgacacccaatc

SEQ ID NO: 783211 - DNA, 20 bp, mouse
gtctaggaacgtcgtcccat

SEQ ID NO: 783212 - DNA, 20 bp, mouse
gtggtatgtagtggatgccc

SEQ ID NO: 783213 - DNA, 20 bp, mouse
ggacgcccagaaactgagtg

SEQ ID NO: 783214 - DNA, 20 bp, mouse
ggaggggcggggtaggcttt

SEQ ID NO: 783215 - DNA, 20 bp, mouse
gggaaaacaacgaacactga

SEQ ID NO: 783216 - DNA, 20 bp, mouse
gtcgggctcgagggaggcgg

SEQ ID NO: 783217 - DNA, 20 bp, mouse
gtcggctgccggccccccgg

SEQ ID NO: 783218 - DNA, 20 bp, mouse
ggccgcgtcgggctcgaggg

SEQ ID NO: 783219 - DNA, 20 bp, mouse
gcggccggcggaagaagggg

SEQ ID NO: 783220 - DNA, 20 bp, mouse
gtggctggcggggatgtgac

SEQ ID NO: 783221 - DNA, 20 bp, mouse
gggctcggccggcggaagaa

SEQ ID NO: 783222 - DNA, 20 bp, mouse
gcgcggaggaggagccccgg

SEQ ID NO: 783223 - DNA, 20 bp, mouse
gggcggggatgtgaccggac

SEQ ID NO: 783224 - DNA, 20 bp, mouse
gccggagcccgtcacgcgag

SEQ ID NO: 783225 - DNA, 20 bp, mouse
ggcgacgctcaggctccgcg

SEQ ID NO: 783226 - DNA, 20 bp, mouse
gaagccgtgcggccggtagg

SEQ ID NO: 783227 - DNA, 20 bp, mouse
gggggcgctgagaacccacg

SEQ ID NO: 783228 - DNA, 20 bp, mouse
gggctgctccaatcgaaccg

SEQ ID NO: 783229 - DNA, 20 bp, mouse
gccccaggcgctgtccgccg

SEQ ID NO: 783230 - DNA, 20 bp, mouse
gctccgccccacacacccgg

SEQ ID NO: 783231 - DNA, 20 bp, mouse
ggaacggcctggactggctg

SEQ ID NO: 783232 - DNA, 20 bp, mouse
gggcgctctgcctgcccccc

SEQ ID NO: 783233 - DNA, 20 bp, mouse
ggactggctgcggaagggga

SEQ ID NO: 783234 - DNA, 20 bp, mouse
gtgcgcgcccccgggtgtgt

SEQ ID NO: 783235 - DNA, 20 bp, mouse
ggcggaggaacggcctggac

SEQ ID NO: 783236 - DNA, 20 bp, mouse
gtgtcctcttcaaccctcct

SEQ ID NO: 783237 - DNA, 20 bp, mouse
gactagagccagtggctccg

SEQ ID NO: 783238 - DNA, 20 bp, mouse
ggacaaagcgtgcagaaatc

SEQ ID NO: 783239 - DNA, 20 bp, mouse
gcccgcgtaggacaacagtt

SEQ ID NO: 783240 - DNA, 20 bp, mouse
gaggcgaccgggtggggaac

SEQ ID NO: 783241 - DNA, 20 bp, mouse
gttgaagaggacaggcgacc

SEQ ID NO: 783242 - DNA, 20 bp, mouse
gtctgccccaagcccaaacc

SEQ ID NO: 783243 - DNA, 20 bp, mouse
gttctggataaaagcggacg

SEQ ID NO: 783244 - DNA, 20 bp, mouse
gggagccggaagctgggcac

SEQ ID NO: 783245 - DNA, 20 bp, mouse
gcaaccctcctcggagccac

SEQ ID NO: 783246 - DNA, 20 bp, mouse
gagcctgtgccccaggacgt

SEQ ID NO: 783247 - DNA, 20 bp, mouse
gatgaccggaaggcgagaga

SEQ ID NO: 783248 - DNA, 20 bp, mouse
gcggaaggcgagagatggaa

SEQ ID NO: 783249 - DNA, 20 bp, mouse
ggggctagcggggtgccaaa

SEQ ID NO: 783250 - DNA, 20 bp, mouse
gctagcggggtgccaaaggg

SEQ ID NO: 783251 - DNA, 20 bp, mouse
gcaccgacgtcctggggcac

SEQ ID NO: 783252 - DNA, 20 bp, mouse
ggggtccgcggcgagatcgt

SEQ ID NO: 783253 - DNA, 20 bp, mouse
gccgagagcgcctagatcca

SEQ ID NO: 783254 - DNA, 20 bp, mouse
gctgccgtaaagataggggc

SEQ ID NO: 783255 - DNA, 20 bp, mouse
gcggcctgccgtaaagatag

SEQ ID NO: 783256 - DNA, 20 bp, mouse
ggaggactgccttaagaagg

SEQ ID NO: 783257 - DNA, 20 bp, mouse
gaacaagtgcaggtgttcgc

SEQ ID NO: 783258 - DNA, 20 bp, mouse
gggctctggggcaccccacg

SEQ ID NO: 783259 - DNA, 20 bp, mouse
ggctccagggtaaaccacgt

SEQ ID NO: 783260 - DNA, 20 bp, mouse
ggctgtggagctctccaaaa

SEQ ID NO: 783261 - DNA, 20 bp, mouse
gctggaggactgccttaaga

SEQ ID NO: 783262 - DNA, 20 bp, mouse
gtgccttaagaaggaggctt

SEQ ID NO: 783263 - DNA, 20 bp, mouse
ggccgccgtgccataggctc

SEQ ID NO: 783264 - DNA, 20 bp, mouse
gaagccggccgccgtgccat

SEQ ID NO: 783265 - DNA, 20 bp, mouse
gcctggagccatcattggcc

SEQ ID NO: 783266 - DNA, 20 bp, mouse
gtcattgcgacggtcgtcac

SEQ ID NO: 783267 - DNA, 20 bp, mouse
gccggcgtgacgcccaagta

SEQ ID NO: 783268 - DNA, 20 bp, mouse
gaagggtgagcgctggtctt

SEQ ID NO: 783269 - DNA, 20 bp, mouse
gcatgcgcaagggtgagcgc

SEQ ID NO: 783270 - DNA, 20 bp, mouse
gcggtcctaacgctgcttgg

SEQ ID NO: 783271 - DNA, 20 bp, mouse
gtccgccgtcaacaccggtc

SEQ ID NO: 783272 - DNA, 20 bp, mouse
ggaggccccgcccacccgac

SEQ ID NO: 783273 - DNA, 20 bp, mouse
gtggcaagaaccccgtctat

SEQ ID NO: 783274 - DNA, 20 bp, mouse
gagggaggacgccagaacag

SEQ ID NO: 783275 - DNA, 20 bp, mouse
ggagtcgatagtattttacc

SEQ ID NO: 783276 - DNA, 20 bp, mouse
ggcggcgaggggcgggctga

SEQ ID NO: 783277 - DNA, 20 bp, mouse
gctaacccgcgagtcccgcg

SEQ ID NO: 783278 - DNA, 20 bp, mouse
ggcgccgcgggccaaggagg

SEQ ID NO: 783279 - DNA, 20 bp, mouse
gcctcgccgcgcgggactcg

SEQ ID NO: 783280 - DNA, 20 bp, mouse
ggtcccgttgcccggagggg

SEQ ID NO: 783281 - DNA, 20 bp, mouse
gcacaggtcccgttgcccgg

SEQ ID NO: 783282 - DNA, 20 bp, mouse
gctcacaggcatctgatctc

SEQ ID NO: 783283 - DNA, 20 bp, mouse
gatctgcaaaaagggatgtg

SEQ ID NO: 783284 - DNA, 20 bp, mouse
gccccgcccctccgggcaac

SEQ ID NO: 783285 - DNA, 20 bp, mouse
gtactgaaagtaccgtgctg

SEQ ID NO: 783286 - DNA, 20 bp, mouse
gcgcgggcgccactagaagg

SEQ ID NO: 783287 - DNA, 20 bp, mouse
ggaccgcgggcgccactaga

SEQ ID NO: 783288 - DNA, 20 bp, mouse
ggcgactagaatttagtcga

SEQ ID NO: 783289 - DNA, 20 bp, mouse
ggaggcggggctacgaacac

SEQ ID NO: 783290 - DNA, 20 bp, mouse
gccgaaggagctcggagaaa

SEQ ID NO: 783291 - DNA, 20 bp, mouse
gggccgatcccgaaggagct

SEQ ID NO: 783292 - DNA, 20 bp, mouse
gaggtgctggccgatcccga

SEQ ID NO: 783293 - DNA, 20 bp, mouse
ggaccaggctgtctcttcat

SEQ ID NO: 783294 - DNA, 20 bp, mouse
ggagaaaggggcgggaccgc

SEQ ID NO: 783295 - DNA, 20 bp, mouse
ggcgctccctccgtggacaa

SEQ ID NO: 783296 - DNA, 20 bp, mouse
gtagctgctcctggtgatgt

SEQ ID NO: 783297 - DNA, 20 bp, mouse
gctgtgagcgagcgctgaga

SEQ ID NO: 783298 - DNA, 20 bp, mouse
ggagttgagtggaaggaccc

SEQ ID NO: 783299 - DNA, 20 bp, mouse
ggcgctcgctcacagagcac

SEQ ID NO: 783300 - DNA, 20 bp, mouse
gtacaccagaatccaccccc

SEQ ID NO: 783301 - DNA, 20 bp, mouse
gtccttccactcaactccct

SEQ ID NO: 783302 - DNA, 20 bp, mouse
gcagtcaacgctcagacccc

SEQ ID NO: 783303 - DNA, 20 bp, mouse
gaggaacagggggtcggagg

SEQ ID NO: 783304 - DNA, 20 bp, mouse
ggaagcctaggcaaagtaag

SEQ ID NO: 783305 - DNA, 20 bp, mouse
gggagactctcatctataaa

SEQ ID NO: 783306 - DNA, 20 bp, mouse
gaggctgtacgcgctccgat

SEQ ID NO: 783307 - DNA, 20 bp, mouse
gtgtacgcgctccgattggc

SEQ ID NO: 783308 - DNA, 20 bp, mouse
gacagggcgccagggaaggt

SEQ ID NO: 783309 - DNA, 20 bp, mouse
ggccagggaaggtcggtgag

SEQ ID NO: 783310 - DNA, 20 bp, mouse
gccggggcggagctctcttt

SEQ ID NO: 783311 - DNA, 20 bp, mouse
gcccagaggcgccagccaat

SEQ ID NO: 783312 - DNA, 20 bp, mouse
ggatgctcctaccaccctgc

SEQ ID NO: 783313 - DNA, 20 bp, mouse
gccctctcaccgaccttccc

SEQ ID NO: 783314 - DNA, 20 bp, mouse
gcggttggaacagggcgcca

SEQ ID NO: 783315 - DNA, 20 bp, mouse
gcgaagcggcgtcagcaata

SEQ ID NO: 783316 - DNA, 20 bp, mouse
gctggcctgaacatgaacat

SEQ ID NO: 783317 - DNA, 20 bp, mouse
gcacactgaaacaacggccc

SEQ ID NO: 783318 - DNA, 20 bp, mouse
gggccagcagatgagctcta

SEQ ID NO: 783319 - DNA, 20 bp, mouse
ggatgcctcctgtgaggctg

SEQ ID NO: 783320 - DNA, 20 bp, mouse
gcatgggcagagctgatgat

SEQ ID NO: 783321 - DNA, 20 bp, mouse
ggggtccccacggggtccag

SEQ ID NO: 783322 - DNA, 20 bp, mouse
gtctgcccatgttcatgttc

SEQ ID NO: 783323 - DNA, 20 bp, mouse
ggaggctggggtgtttgcct

SEQ ID NO: 783324 - DNA, 20 bp, mouse
gcttccccctggaccccgtg

SEQ ID NO: 783325 - DNA, 20 bp, mouse
ggccttggcaaaagaaggac

SEQ ID NO: 783326 - DNA, 20 bp, mouse
gactgagcgtcgtaagaggt

SEQ ID NO: 783327 - DNA, 20 bp, mouse
gaggtagggcgcaagacctg

SEQ ID NO: 783328 - DNA, 20 bp, mouse
gcaaggaagcattggggtaa

SEQ ID NO: 783329 - DNA, 20 bp, mouse
gagcaactgagcgtcgtaag

SEQ ID NO: 783330 - DNA, 20 bp, mouse
gagaaggcgtgactcgggag

SEQ ID NO: 783331 - DNA, 20 bp, mouse
gaagggttaaaggaattcga

SEQ ID NO: 783332 - DNA, 20 bp, mouse
ggggtaatggttaacagcaa

SEQ ID NO: 783333 - DNA, 20 bp, mouse
gacgctgcaaggaagcattg

SEQ ID NO: 783334 - DNA, 20 bp, mouse
gccttgcagcgtcttcaaga

SEQ ID NO: 783335 - DNA, 20 bp, mouse
ggcaagagcaaccccatccc

SEQ ID NO: 783336 - DNA, 20 bp, mouse
gggcctcaggagtcggcgca

SEQ ID NO: 783337 - DNA, 20 bp, mouse
gggaaggagtacagacattg

SEQ ID NO: 783338 - DNA, 20 bp, mouse
gcgcgcgcccgcagcaacag

SEQ ID NO: 783339 - DNA, 20 bp, mouse
gctccctgcgccgactcctg

SEQ ID NO: 783340 - DNA, 20 bp, mouse
gagaaggggcgcacgcgcgt

SEQ ID NO: 783341 - DNA, 20 bp, mouse
ggagtcggcgcagggagctg

SEQ ID NO: 783342 - DNA, 20 bp, mouse
gacacctcgccctcggacat

SEQ ID NO: 783343 - DNA, 20 bp, mouse
gcccgcagcaacagcggggg

SEQ ID NO: 783344 - DNA, 20 bp, mouse
ggactcctgaagagagttca

SEQ ID NO: 783345 - DNA, 20 bp, mouse
gagataatgccaatgtccga

SEQ ID NO: 783346 - DNA, 20 bp, mouse
gaccagttggggttcagagt

SEQ ID NO: 783347 - DNA, 20 bp, mouse
gtggggttcagagttggggc

SEQ ID NO: 783348 - DNA, 20 bp, mouse
gctgaaccccaactggtcgt

SEQ ID NO: 783349 - DNA, 20 bp, mouse
ggagcccagaggtatcagac

SEQ ID NO: 783350 - DNA, 20 bp, mouse
ggagaagctacaatccggac

SEQ ID NO: 783351 - DNA, 20 bp, mouse
gccagccagttccagagcct

SEQ ID NO: 783352 - DNA, 20 bp, mouse
ggagaccttagggatgacta

SEQ ID NO: 783353 - DNA, 20 bp, mouse
gcgcggtcctgggatcccat

SEQ ID NO: 783354 - DNA, 20 bp, mouse
gaggaaggaaagctggaaca

SEQ ID NO: 783355 - DNA, 20 bp, mouse
ggggttccaacgaccagttg

SEQ ID NO: 783356 - DNA, 20 bp, mouse
gtggaagcgcgccgagaggt

SEQ ID NO: 783357 - DNA, 20 bp, mouse
ggccggcggcaggaatgcag

SEQ ID NO: 783358 - DNA, 20 bp, mouse
ggacccgcgtccaagcgcgc

SEQ ID NO: 783359 - DNA, 20 bp, mouse
ggcaggaatgcaggggcgtg

SEQ ID NO: 783360 - DNA, 20 bp, mouse
gccgctcgcccaatgagcgc

SEQ ID NO: 783361 - DNA, 20 bp, mouse
ggagggcgcgagataacgga

SEQ ID NO: 783362 - DNA, 20 bp, mouse
gtccgtgcgtccgtcgtctc

SEQ ID NO: 783363 - DNA, 20 bp, mouse
gaatgagcgcaggctctgtg

SEQ ID NO: 783364 - DNA, 20 bp, mouse
gtccggagggcgcgagataa

SEQ ID NO: 783365 - DNA, 20 bp, mouse
gggggatgggcgcggaataa

SEQ ID NO: 783366 - DNA, 20 bp, mouse
gaagccgtgtggcaactacg

SEQ ID NO: 783367 - DNA, 20 bp, mouse
gcgaagagatggacggatcg

SEQ ID NO: 783368 - DNA, 20 bp, mouse
gcagccccgtagttgccaca

SEQ ID NO: 783369 - DNA, 20 bp, mouse
gacacggcttcagtagaccc

SEQ ID NO: 783370 - DNA, 20 bp, mouse
gacggggctgcccaaaatct

SEQ ID NO: 783371 - DNA, 20 bp, mouse
gtggcctgaggtcctcatct

SEQ ID NO: 783372 - DNA, 20 bp, mouse
gaagcctcttcattcattgt

SEQ ID NO: 783373 - DNA, 20 bp, mouse
ggacagagtgagagtataga

SEQ ID NO: 783374 - DNA, 20 bp, mouse
gactcttgccacattttcca

SEQ ID NO: 783375 - DNA, 20 bp, mouse
gcatatgtgagcaacaaggc

SEQ ID NO: 783376 - DNA, 20 bp, mouse
gcccaccccagcctaacaat

SEQ ID NO: 783377 - DNA, 20 bp, mouse
gcccagcctaacaatgggaa

SEQ ID NO: 783378 - DNA, 20 bp, mouse
ggcggggcttgattttactg

SEQ ID NO: 783379 - DNA, 20 bp, mouse
gctggccgggagcaggacag

SEQ ID NO: 783380 - DNA, 20 bp, mouse
gtgggaagggtagtagagaa

SEQ ID NO: 783381 - DNA, 20 bp, mouse
gtagcccctaccttgaccct

SEQ ID NO: 783382 - DNA, 20 bp, mouse
gctagcccagggtcaaggta

SEQ ID NO: 783383 - DNA, 20 bp, mouse
gtgtccctagcccagggtca

SEQ ID NO: 783384 - DNA, 20 bp, mouse
gagggtagtagagaaaggtg

SEQ ID NO: 783385 - DNA, 20 bp, mouse
ggcagccatcgggagagggg

SEQ ID NO: 783386 - DNA, 20 bp, mouse
ggcagagtgagtgtcggaga

SEQ ID NO: 783387 - DNA, 20 bp, mouse
gggggtgggcccagggaact

SEQ ID NO: 783388 - DNA, 20 bp, mouse
ggctcagaagaagacttctg

SEQ ID NO: 783389 - DNA, 20 bp, mouse
gcccagaactggtttctaaa

SEQ ID NO: 783390 - DNA, 20 bp, mouse
gggaggaaggactggcagac

SEQ ID NO: 783391 - DNA, 20 bp, mouse
gggaaatgagctgccgggcc

SEQ ID NO: 783392 - DNA, 20 bp, mouse
gggagcctagccccattgcc

SEQ ID NO: 783393 - DNA, 20 bp, mouse
ggagagcagtctgactctaa

SEQ ID NO: 783394 - DNA, 20 bp, mouse
gtctaaaggagaggttggat

SEQ ID NO: 783395 - DNA, 20 bp, mouse
gctgactctaaaggagaggt

SEQ ID NO: 783396 - DNA, 20 bp, mouse
ggacctgagcccaggtttct

SEQ ID NO: 783397 - DNA, 20 bp, mouse
ggggagagcttatagagcaa

SEQ ID NO: 783398 - DNA, 20 bp, mouse
ggcacatgattgctctgcaa

SEQ ID NO: 783399 - DNA, 20 bp, mouse
gaatgggaggggacctccca

SEQ ID NO: 783400 - DNA, 20 bp, mouse
ggccacagaagaaggaaaat

SEQ ID NO: 783401 - DNA, 20 bp, mouse
gcatgtgcatcttctactag

SEQ ID NO: 783402 - DNA, 20 bp, mouse
gccactctgtccaagaaacc

SEQ ID NO: 783403 - DNA, 20 bp, mouse
gaggcattgggaacaaccct

SEQ ID NO: 783404 - DNA, 20 bp, mouse
gaaggatatctccacaacat

SEQ ID NO: 783405 - DNA, 20 bp, mouse
gctactaggggttgctaacc

SEQ ID NO: 783406 - DNA, 20 bp, mouse
gcggagaggagaccctaaga

SEQ ID NO: 783407 - DNA, 20 bp, mouse
gctaagagggggcccatctc

SEQ ID NO: 783408 - DNA, 20 bp, mouse
gggggcccatctccggtctc

SEQ ID NO: 783409 - DNA, 20 bp, mouse
gcctccctatggccaaaaga

SEQ ID NO: 783410 - DNA, 20 bp, mouse
gagagaatcctccaagaaag

SEQ ID NO: 783411 - DNA, 20 bp, mouse
ggggggcctcgaggcacaag

SEQ ID NO: 783412 - DNA, 20 bp, mouse
ggggcctcacgaccctcttt

SEQ ID NO: 783413 - DNA, 20 bp, mouse
gcctcgaggccccctcccta

SEQ ID NO: 783414 - DNA, 20 bp, mouse
gtggccaaaagagggtcgtg

SEQ ID NO: 783415 - DNA, 20 bp, mouse
ggcgctcgagccaatacggc

SEQ ID NO: 783416 - DNA, 20 bp, mouse
gctggccctggcgcagcttg

SEQ ID NO: 783417 - DNA, 20 bp, mouse
gtccctcccaccactagcat

SEQ ID NO: 783418 - DNA, 20 bp, mouse
gtcacccccaagctgcgcca

SEQ ID NO: 783419 - DNA, 20 bp, mouse
gtacaaagccataaagaagt

SEQ ID NO: 783420 - DNA, 20 bp, mouse
gtcagcagcggtaagaccgc

SEQ ID NO: 783421 - DNA, 20 bp, mouse
ggaagcggggacaccccttt

SEQ ID NO: 783422 - DNA, 20 bp, mouse
ggcggtaagaccgctggccc

SEQ ID NO: 783423 - DNA, 20 bp, mouse
gctagaacttgagtccccca

SEQ ID NO: 783424 - DNA, 20 bp, mouse
ggcttggagtttcaaagctg

SEQ ID NO: 783425 - DNA, 20 bp, mouse
ggggatcaggatcttgtgtc

SEQ ID NO: 783426 - DNA, 20 bp, mouse
ggtgaccaaccaaaggtcag

SEQ ID NO: 783427 - DNA, 20 bp, mouse
gggcaggaaagtgacccatt

SEQ ID NO: 783428 - DNA, 20 bp, mouse
gtggaaggctcctaggatgg

SEQ ID NO: 783429 - DNA, 20 bp, mouse
gccagtcctgcccccatcct

SEQ ID NO: 783430 - DNA, 20 bp, mouse
gaggatcttctcacagttta

SEQ ID NO: 783431 - DNA, 20 bp, mouse
gcctggaaggcagatcaatt

SEQ ID NO: 783432 - DNA, 20 bp, mouse
gtccccggctctgacatcac

SEQ ID NO: 783433 - DNA, 20 bp, mouse
ggatggccaggacccctgga

SEQ ID NO: 783434 - DNA, 20 bp, mouse
gggctcaagctctgctccac

SEQ ID NO: 783435 - DNA, 20 bp, mouse
gctgccctctgacctttggt

SEQ ID NO: 783436 - DNA, 20 bp, mouse
ggggcaggaaagaggggcgt

SEQ ID NO: 783437 - DNA, 20 bp, mouse
gcgccgccgggcaggaaaga

SEQ ID NO: 783438 - DNA, 20 bp, mouse
gtcgcagacaggcgtgcgga

SEQ ID NO: 783439 - DNA, 20 bp, mouse
gccgcccaacctgacagccc

SEQ ID NO: 783440 - DNA, 20 bp, mouse
gggagccggggctgtcaggt

SEQ ID NO: 783441 - DNA, 20 bp, mouse
gggaccgcgacgccgggagc

SEQ ID NO: 783442 - DNA, 20 bp, mouse
gcccaggcaggaagtccgcg

SEQ ID NO: 783443 - DNA, 20 bp, mouse
gcgcctgtctgcgaagtgga

SEQ ID NO: 783444 - DNA, 20 bp, mouse
ggccccctggcggccttcag

SEQ ID NO: 783445 - DNA, 20 bp, mouse
gcagggtgcccctcccctga

SEQ ID NO: 783446 - DNA, 20 bp, mouse
gggtcactgcgaaacttcgc

SEQ ID NO: 783447 - DNA, 20 bp, mouse
ggtggtgcagattaatgttg

SEQ ID NO: 783448 - DNA, 20 bp, mouse
gtctccgggaactgcgaaat

SEQ ID NO: 783449 - DNA, 20 bp, mouse
gaaagcatggccttatctcc

SEQ ID NO: 783450 - DNA, 20 bp, mouse
gccgacctgcggttggtccc

SEQ ID NO: 783451 - DNA, 20 bp, mouse
gtcagccaatcagagagcga

SEQ ID NO: 783452 - DNA, 20 bp, mouse
ggccagtgcgtgcatggctg

SEQ ID NO: 783453 - DNA, 20 bp, mouse
gacactgattgattcccggg

SEQ ID NO: 783454 - DNA, 20 bp, mouse
gctgggcggtccgagcgcca

SEQ ID NO: 783455 - DNA, 20 bp, mouse
ggccgcctaaatgcccacac

SEQ ID NO: 783456 - DNA, 20 bp, mouse
ggagaggctgcgtcctccca

SEQ ID NO: 783457 - DNA, 20 bp, mouse
ggaagtgcttttagtttcaa

SEQ ID NO: 783458 - DNA, 20 bp, mouse
gggagaaagaattgttcctg

SEQ ID NO: 783459 - DNA, 20 bp, mouse
gcaagggacactatagacgc

SEQ ID NO: 783460 - DNA, 20 bp, mouse
gcaactgcacccatggaaac

SEQ ID NO: 783461 - DNA, 20 bp, mouse
gcagccttagaatccttggg

SEQ ID NO: 783462 - DNA, 20 bp, mouse
gcggagtgagtgccaacgtc

SEQ ID NO: 783463 - DNA, 20 bp, mouse
gcattcctcttctttttcaa

SEQ ID NO: 783464 - DNA, 20 bp, mouse
gaagcagttggctgttgggg

SEQ ID NO: 783465 - DNA, 20 bp, mouse
gacaggacaggggaagcagt

SEQ ID NO: 783466 - DNA, 20 bp, mouse
gctggccagtgcaggatagg

SEQ ID NO: 783467 - DNA, 20 bp, mouse
gaagtccccaaacccagatg

SEQ ID NO: 783468 - DNA, 20 bp, mouse
gaagctggccagtgcaggat

SEQ ID NO: 783469 - DNA, 20 bp, mouse
gtgcgcttctagcctcatct

SEQ ID NO: 783470 - DNA, 20 bp, mouse
gaaaacctccttgtcctgtc

SEQ ID NO: 783471 - DNA, 20 bp, mouse
ggagggaccactgaacccaa

SEQ ID NO: 783472 - DNA, 20 bp, mouse
gtggtggctcagtagaaaga

SEQ ID NO: 783473 - DNA, 20 bp, mouse
gtatggatacagcccccata

SEQ ID NO: 783474 - DNA, 20 bp, mouse
gaaatgactggccttccgga

SEQ ID NO: 783475 - DNA, 20 bp, mouse
gtcctgtgggctccctatgg

SEQ ID NO: 783476 - DNA, 20 bp, mouse
gctgggtcccagtgaaggtg

SEQ ID NO: 783477 - DNA, 20 bp, mouse
gctgaggatgcagacggctg

SEQ ID NO: 783478 - DNA, 20 bp, mouse
ggaggcctagcgcgccgcga

SEQ ID NO: 783479 - DNA, 20 bp, mouse
gcccagagctggaccgctcc

SEQ ID NO: 783480 - DNA, 20 bp, mouse
gctagcgcgccgcgaaggcg

SEQ ID NO: 783481 - DNA, 20 bp, mouse
gcgggaccacgcggacttag

SEQ ID NO: 783482 - DNA, 20 bp, mouse
ggcggtccagctctgggagg

SEQ ID NO: 783483 - DNA, 20 bp, mouse
ggcatcctcagcttccctcc

SEQ ID NO: 783484 - DNA, 20 bp, mouse
gagagctggaccgctcctgg

SEQ ID NO: 783485 - DNA, 20 bp, mouse
ggagtgagaaagaacgaaat

SEQ ID NO: 783486 - DNA, 20 bp, mouse
gagggctgggtaggagtgtc

SEQ ID NO: 783487 - DNA, 20 bp, mouse
gtgagctggtaccttacaga

SEQ ID NO: 783488 - DNA, 20 bp, mouse
gcaggcccgaggtccgctgc

SEQ ID NO: 783489 - DNA, 20 bp, mouse
gaaaaacaaacgagccacta

SEQ ID NO: 783490 - DNA, 20 bp, mouse
ggaagtgttgttgaccgtag

SEQ ID NO: 783491 - DNA, 20 bp, mouse
gaccttacagagggctgggt

SEQ ID NO: 783492 - DNA, 20 bp, mouse
ggccttgccaggttataata

SEQ ID NO: 783493 - DNA, 20 bp, mouse
gccagctgtagttatctaat

SEQ ID NO: 783494 - DNA, 20 bp, mouse
ggtcaacaaacggaagtcac

SEQ ID NO: 783495 - DNA, 20 bp, mouse
ggggtccgattgtgattgga

SEQ ID NO: 783496 - DNA, 20 bp, mouse
gggcagcatgggctcaggaa

SEQ ID NO: 783497 - DNA, 20 bp, mouse
gggggcggaggggggcgcgt

SEQ ID NO: 783498 - DNA, 20 bp, mouse
gggggtgcgcgatgctgaac

SEQ ID NO: 783499 - DNA, 20 bp, mouse
gccgccgctaggggcagcat

SEQ ID NO: 783500 - DNA, 20 bp, mouse
ggtaccccggaacccgagtg

SEQ ID NO: 783501 - DNA, 20 bp, mouse
gcgtgcttcgcgagcagcgg

SEQ ID NO: 783502 - DNA, 20 bp, mouse
gctgctttggcccgccgcta

SEQ ID NO: 783503 - DNA, 20 bp, mouse
gtgcttggacgggaaagggt

SEQ ID NO: 783504 - DNA, 20 bp, mouse
gggggaggatcgaggacggt

SEQ ID NO: 783505 - DNA, 20 bp, mouse
ggtaccagggcgtgcccaaa

SEQ ID NO: 783506 - DNA, 20 bp, mouse
ggcaggtgtggatccatatg

SEQ ID NO: 783507 - DNA, 20 bp, mouse
ggagggtgatgtggatcctg

SEQ ID NO: 783508 - DNA, 20 bp, mouse
gccaccattcttctaccaca

SEQ ID NO: 783509 - DNA, 20 bp, mouse
gatgtggatcctgatgtgga

SEQ ID NO: 783510 - DNA, 20 bp, mouse
gatagtaataccttacaggg

SEQ ID NO: 783511 - DNA, 20 bp, mouse
ggcacatcaggatccccata

SEQ ID NO: 783512 - DNA, 20 bp, mouse
gcattcttctaccacatggc

SEQ ID NO: 783513 - DNA, 20 bp, mouse
gcagaatttaccaccctgta

SEQ ID NO: 783514 - DNA, 20 bp, mouse
ggaggatggtgatgtggatc

SEQ ID NO: 783515 - DNA, 20 bp, mouse
gcctgagggggatctggatg

SEQ ID NO: 783516 - DNA, 20 bp, mouse
gacgcggaagctgggacctc

SEQ ID NO: 783517 - DNA, 20 bp, mouse
gaagctgggacctccgggca

SEQ ID NO: 783518 - DNA, 20 bp, mouse
gaaactgttgttcaacttac

SEQ ID NO: 783519 - DNA, 20 bp, mouse
gctgggtggaggccaagtct

SEQ ID NO: 783520 - DNA, 20 bp, mouse
ggccgcgggagccggaacct

SEQ ID NO: 783521 - DNA, 20 bp, mouse
gggcgcgcgctgtccctgcc

SEQ ID NO: 783522 - DNA, 20 bp, mouse
gcaacttacgggccaccaga

SEQ ID NO: 783523 - DNA, 20 bp, mouse
gggaggccaagtctgggacg

SEQ ID NO: 783524 - DNA, 20 bp, mouse
gagcatcgtctgccttctgg

SEQ ID NO: 783525 - DNA, 20 bp, mouse
gatagcagataaagctgggt

SEQ ID NO: 783526 - DNA, 20 bp, mouse
gcccaagcagagtctggaaa

SEQ ID NO: 783527 - DNA, 20 bp, mouse
gggcacggagttgacgtcaa

SEQ ID NO: 783528 - DNA, 20 bp, mouse
gagtctgattggcagggtgt

SEQ ID NO: 783529 - DNA, 20 bp, mouse
ggcgtggtgagggcccaaag

SEQ ID NO: 783530 - DNA, 20 bp, mouse
gagggcccaaagcggggaat

SEQ ID NO: 783531 - DNA, 20 bp, mouse
gggtgtgggaggcgtggtga

SEQ ID NO: 783532 - DNA, 20 bp, mouse
gttgacaacagcagtctgat

SEQ ID NO: 783533 - DNA, 20 bp, mouse
gggggcccccaagcagagtc

SEQ ID NO: 783534 - DNA, 20 bp, mouse
gacagcttggcgccaaggca

SEQ ID NO: 783535 - DNA, 20 bp, mouse
gaacagcagtctgattggca

SEQ ID NO: 783536 - DNA, 20 bp, mouse
gagggcggggcataagggta

SEQ ID NO: 783537 - DNA, 20 bp, mouse
gtgcacgcgcaagggggttg

SEQ ID NO: 783538 - DNA, 20 bp, mouse
gggcacttggaagtggttgg

SEQ ID NO: 783539 - DNA, 20 bp, mouse
gtcgcgaggcggtgccgaga

SEQ ID NO: 783540 - DNA, 20 bp, mouse
gcggtgccgagagggctctt

SEQ ID NO: 783541 - DNA, 20 bp, mouse
ggcagggccacatcgcgagg

SEQ ID NO: 783542 - DNA, 20 bp, mouse
gaagcaggagggactggctg

SEQ ID NO: 783543 - DNA, 20 bp, mouse
ggcgctgtgcacgcgcaagg

SEQ ID NO: 783544 - DNA, 20 bp, mouse
ggcgggagggcggggcataa

SEQ ID NO: 783545 - DNA, 20 bp, mouse
gtcactaagcctgaaggttc

SEQ ID NO: 783546 - DNA, 20 bp, mouse
gggaaggcaagcccttaaag

SEQ ID NO: 783547 - DNA, 20 bp, mouse
gaagcggggtccggatcccc

SEQ ID NO: 783548 - DNA, 20 bp, mouse
gccacgctccaacttttcgg

SEQ ID NO: 783549 - DNA, 20 bp, mouse
gggtccggatccccgggctg

SEQ ID NO: 783550 - DNA, 20 bp, mouse
gggggggggcgctaattgaa

SEQ ID NO: 783551 - DNA, 20 bp, mouse
gcccccacgctccaactttt

SEQ ID NO: 783552 - DNA, 20 bp, mouse
gcataacacggggcgctcgc

SEQ ID NO: 783553 - DNA, 20 bp, mouse
gggggggtgggcagtatgct

SEQ ID NO: 783554 - DNA, 20 bp, mouse
gcatggtgagctcggaggtg

SEQ ID NO: 783555 - DNA, 20 bp, mouse
gtatgtaaacatagagtaaa

SEQ ID NO: 783556 - DNA, 20 bp, mouse
gagaccccagaatgagggtg

SEQ ID NO: 783557 - DNA, 20 bp, mouse
ggtagtctgggaagccaaag

SEQ ID NO: 783558 - DNA, 20 bp, mouse
gggagcctggaataagagag

SEQ ID NO: 783559 - DNA, 20 bp, mouse
ggtgggcagtcgctagtctt

SEQ ID NO: 783560 - DNA, 20 bp, mouse
ggtcttgtagacaacctctt

SEQ ID NO: 783561 - DNA, 20 bp, mouse
gggagcctcggggtaaggtg

SEQ ID NO: 783562 - DNA, 20 bp, mouse
gctagaagaccccagaatga

SEQ ID NO: 783563 - DNA, 20 bp, mouse
gacacccgaggcccggagga

SEQ ID NO: 783564 - DNA, 20 bp, mouse
gggtaaggtggggcctctag

SEQ ID NO: 783565 - DNA, 20 bp, mouse
gttaagcctggctgtagtct

SEQ ID NO: 783566 - DNA, 20 bp, mouse
gcgcacgcaggcgcagtaaa

SEQ ID NO: 783567 - DNA, 20 bp, mouse
ggcaggcgcagtaaaaggaa

SEQ ID NO: 783568 - DNA, 20 bp, mouse
gaggccccgcctctctggta

SEQ ID NO: 783569 - DNA, 20 bp, mouse
gggtccctaccagagaggcg

SEQ ID NO: 783570 - DNA, 20 bp, mouse
gcgccctagataaacgtcaa

SEQ ID NO: 783571 - DNA, 20 bp, mouse
gcctagataaacgtcaaagg

SEQ ID NO: 783572 - DNA, 20 bp, mouse
gtctgagccaacaagctcgt

SEQ ID NO: 783573 - DNA, 20 bp, mouse
gagctcgtcggtctgagtgc

SEQ ID NO: 783574 - DNA, 20 bp, mouse
gcccggcgcaagtctgttgt

SEQ ID NO: 783575 - DNA, 20 bp, mouse
gtgaagctggcttcacgcta

SEQ ID NO: 783576 - DNA, 20 bp, mouse
gcggggctggacattcagga

SEQ ID NO: 783577 - DNA, 20 bp, mouse
gaagtcctggggtgcgaagg

SEQ ID NO: 783578 - DNA, 20 bp, mouse
gcagatccgggagaagtcct

SEQ ID NO: 783579 - DNA, 20 bp, mouse
ggagaagtcctggggtgcga

SEQ ID NO: 783580 - DNA, 20 bp, mouse
gaggatgcctggaggcgaga

SEQ ID NO: 783581 - DNA, 20 bp, mouse
gctcccggatctgggtagaa

SEQ ID NO: 783582 - DNA, 20 bp, mouse
gcctccgagaagcttgccgg

SEQ ID NO: 783583 - DNA, 20 bp, mouse
gccagcaaggagtaaaagcc

SEQ ID NO: 783584 - DNA, 20 bp, mouse
gtgagtccgctagcataaaa

SEQ ID NO: 783585 - DNA, 20 bp, mouse
gcccaaaggtggttggaagg

SEQ ID NO: 783586 - DNA, 20 bp, mouse
gtgggcgagcgccagcgttg

SEQ ID NO: 783587 - DNA, 20 bp, mouse
ggcgagcgccagcgttgggg

SEQ ID NO: 783588 - DNA, 20 bp, mouse
ggacacgtggtctgcaggaa

SEQ ID NO: 783589 - DNA, 20 bp, mouse
gctgctgggctggatgaatg

SEQ ID NO: 783590 - DNA, 20 bp, mouse
gtgagcgctgtagggcgggg

SEQ ID NO: 783591 - DNA, 20 bp, mouse
gtggtctgcaggaaaggcgc

SEQ ID NO: 783592 - DNA, 20 bp, mouse
ggctgcgcaggccggacacg

SEQ ID NO: 783593 - DNA, 20 bp, mouse
gggcttagtaatcctatcta

SEQ ID NO: 783594 - DNA, 20 bp, mouse
ggcttgcaaactgctaaccc

SEQ ID NO: 783595 - DNA, 20 bp, mouse
gggagggggcatgcgcaatg

SEQ ID NO: 783596 - DNA, 20 bp, mouse
ggaagagtatgcaattgcag

SEQ ID NO: 783597 - DNA, 20 bp, mouse
gcaggtgatcaatgcaaccc

SEQ ID NO: 783598 - DNA, 20 bp, mouse
gagtggggctgtctcagacc

SEQ ID NO: 783599 - DNA, 20 bp, mouse
ggggcacagtgtatgaaatg

SEQ ID NO: 783600 - DNA, 20 bp, mouse
ggctgtctcagaccggggac

SEQ ID NO: 783601 - DNA, 20 bp, mouse
gttgcagagggccactgtat

SEQ ID NO: 783602 - DNA, 20 bp, mouse
gcctggacactgggatagct

SEQ ID NO: 783603 - DNA, 20 bp, mouse
ggccagagtgccagacagcc

SEQ ID NO: 783604 - DNA, 20 bp, mouse
gagggggtcaacagcaccca

SEQ ID NO: 783605 - DNA, 20 bp, mouse
ggggccactgtatgggatga

SEQ ID NO: 783606 - DNA, 20 bp, mouse
gcacgcggccccgagggtgg

SEQ ID NO: 783607 - DNA, 20 bp, mouse
gactctggggaggacacgaa

SEQ ID NO: 783608 - DNA, 20 bp, mouse
gaccctcggggccgcgtgct

SEQ ID NO: 783609 - DNA, 20 bp, mouse
gccccagcacgcggccccga

SEQ ID NO: 783610 - DNA, 20 bp, mouse
gcgcgccgacgcctagcggg

SEQ ID NO: 783611 - DNA, 20 bp, mouse
gaacccgcgccgacgcctag

SEQ ID NO: 783612 - DNA, 20 bp, mouse
ggggacgtccccccagcacg

SEQ ID NO: 783613 - DNA, 20 bp, mouse
gggcgggtgcgagtgggcgc

SEQ ID NO: 783614 - DNA, 20 bp, mouse
gcgcgcgccccaatcgccgg

SEQ ID NO: 783615 - DNA, 20 bp, mouse
ggctcccccaccgagcagtt

SEQ ID NO: 783616 - DNA, 20 bp, mouse
gcgagggcgcatcccggctg

SEQ ID NO: 783617 - DNA, 20 bp, mouse
ggaccagcgtcctccataat

SEQ ID NO: 783618 - DNA, 20 bp, mouse
ggtaacgccctagcccatta

SEQ ID NO: 783619 - DNA, 20 bp, mouse
gcgcatcccggctgaggctg

SEQ ID NO: 783620 - DNA, 20 bp, mouse
gccccggaaccggaagtcac

SEQ ID NO: 783621 - DNA, 20 bp, mouse
gaagggaggcggggagctat

SEQ ID NO: 783622 - DNA, 20 bp, mouse
ggggatgcgccctcgtcccg

SEQ ID NO: 783623 - DNA, 20 bp, mouse
ggaagtcccgcgaccggtca

SEQ ID NO: 783624 - DNA, 20 bp, mouse
gggagcgccggaaagggagg

SEQ ID NO: 783625 - DNA, 20 bp, mouse
gtccctgcgagacccggcga

SEQ ID NO: 783626 - DNA, 20 bp, mouse
gccagggcgggatttttaat

SEQ ID NO: 783627 - DNA, 20 bp, mouse
gacttcacacccttaagtgg

SEQ ID NO: 783628 - DNA, 20 bp, mouse
gcggacttcacacccttaag

SEQ ID NO: 783629 - DNA, 20 bp, mouse
ggcaggactcctccacttaa

SEQ ID NO: 783630 - DNA, 20 bp, mouse
gcccaagagggaaagccttc

SEQ ID NO: 783631 - DNA, 20 bp, mouse
ggggcggcaacatacacaca

SEQ ID NO: 783632 - DNA, 20 bp, mouse
ggtgaagtccggagctggag

SEQ ID NO: 783633 - DNA, 20 bp, mouse
gcccgccccgtcctcctcag

SEQ ID NO: 783634 - DNA, 20 bp, mouse
ggggcgcatagaggactctt

SEQ ID NO: 783635 - DNA, 20 bp, mouse
ggttccttctagtttcttgt

SEQ ID NO: 783636 - DNA, 20 bp, mouse
gtgcacgcggagcggggcat

SEQ ID NO: 783637 - DNA, 20 bp, mouse
gggcgccccaactcgttgat

SEQ ID NO: 783638 - DNA, 20 bp, mouse
gctagggaggcgtgacagaa

SEQ ID NO: 783639 - DNA, 20 bp, mouse
gcacgtggctctatcactac

SEQ ID NO: 783640 - DNA, 20 bp, mouse
ggccaatggttgctttacaa

SEQ ID NO: 783641 - DNA, 20 bp, mouse
gatagagccacgtgagggcg

SEQ ID NO: 783642 - DNA, 20 bp, mouse
ggccctaaaaactttctcat

SEQ ID NO: 783643 - DNA, 20 bp, mouse
gtgacaggctatggcgtagt

SEQ ID NO: 783644 - DNA, 20 bp, mouse
gggttgtcatattgtccaat

SEQ ID NO: 783645 - DNA, 20 bp, mouse
gcgcggagcggggcatgggt

SEQ ID NO: 783646 - DNA, 20 bp, mouse
gacacagccctgacctcagt

SEQ ID NO: 783647 - DNA, 20 bp, mouse
gctggcccccactgaggtca

SEQ ID NO: 783648 - DNA, 20 bp, mouse
ggcacccaagtccacgtgca

SEQ ID NO: 783649 - DNA, 20 bp, mouse
gagggcccacgtgtcgttaa

SEQ ID NO: 783650 - DNA, 20 bp, mouse
gcgcaggccccgcccccggt

SEQ ID NO: 783651 - DNA, 20 bp, mouse
gtgagacatcctgatcgcat

SEQ ID NO: 783652 - DNA, 20 bp, mouse
ggctgactgagcggtgtctg

SEQ ID NO: 783653 - DNA, 20 bp, mouse
ggcggggcctgcggctcttc

SEQ ID NO: 783654 - DNA, 20 bp, mouse
gaaactaccccttttcaggg

SEQ ID NO: 783655 - DNA, 20 bp, mouse
gttggctaaggatctcttcc

SEQ ID NO: 783656 - DNA, 20 bp, mouse
gcccccgcgcccgggcgagt

SEQ ID NO: 783657 - DNA, 20 bp, mouse
gcgctcgtgcagccccggag

SEQ ID NO: 783658 - DNA, 20 bp, mouse
gaagtcccgcaggccggaag

SEQ ID NO: 783659 - DNA, 20 bp, mouse
gtggcccgctcgtgcagccc

SEQ ID NO: 783660 - DNA, 20 bp, mouse
gtggacgagcctactcgccc

SEQ ID NO: 783661 - DNA, 20 bp, mouse
ggcgcgcagcatcttcattg

SEQ ID NO: 783662 - DNA, 20 bp, mouse
gagctacgctcatcaattgg

SEQ ID NO: 783663 - DNA, 20 bp, mouse
gccgctgcgcaactcacagc

SEQ ID NO: 783664 - DNA, 20 bp, mouse
gcaatggcgcgcgcaggggc

SEQ ID NO: 783665 - DNA, 20 bp, mouse
gcttcattgaggaacccggg

SEQ ID NO: 783666 - DNA, 20 bp, mouse
gcccctgcgcgccagggatc

SEQ ID NO: 783667 - DNA, 20 bp, mouse
gcaatcgcgcggcgaagggg

SEQ ID NO: 783668 - DNA, 20 bp, mouse
ggcgaccaatcgcgcggcga

SEQ ID NO: 783669 - DNA, 20 bp, mouse
gggcgggtgggcgggtgcaa

SEQ ID NO: 783670 - DNA, 20 bp, mouse
gaggccgtccgcgtgcccag

SEQ ID NO: 783671 - DNA, 20 bp, mouse
gcgagctcccattggtcaga

SEQ ID NO: 783672 - DNA, 20 bp, mouse
gaccccgccctctgaccaat

SEQ ID NO: 783673 - DNA, 20 bp, mouse
gcggccactgggcacgcgga

SEQ ID NO: 783674 - DNA, 20 bp, mouse
gccgacccgcgcgttatgta

SEQ ID NO: 783675 - DNA, 20 bp, mouse
ggtaacagcgaccaatcgcg

SEQ ID NO: 783676 - DNA, 20 bp, mouse
ggggctggcggcaatctggt

SEQ ID NO: 783677 - DNA, 20 bp, mouse
gcacccgggcggcagagctc

SEQ ID NO: 783678 - DNA, 20 bp, mouse
gacctgctgggtcacccggg

SEQ ID NO: 783679 - DNA, 20 bp, mouse
gagcccagcgcacacacctg

SEQ ID NO: 783680 - DNA, 20 bp, mouse
ggtgacccagcaggtcgggg

SEQ ID NO: 783681 - DNA, 20 bp, mouse
gcgcaccgccccgacctgct

SEQ ID NO: 783682 - DNA, 20 bp, mouse
gagcctgagctctgccgccc

SEQ ID NO: 783683 - DNA, 20 bp, mouse
gcgccccgggctcgtcgcca

SEQ ID NO: 783684 - DNA, 20 bp, mouse
gcgggtgacccagcaggtcg

SEQ ID NO: 783685 - DNA, 20 bp, mouse
ggccgcccgggtgacccagc

SEQ ID NO: 783686 - DNA, 20 bp, mouse
gaccccacgccgccagctga

SEQ ID NO: 783687 - DNA, 20 bp, mouse
ggggatacagcaggactgaa

SEQ ID NO: 783688 - DNA, 20 bp, mouse
gctctaaagctcaacaattg

SEQ ID NO: 783689 - DNA, 20 bp, mouse
gtcagacagccctcagctgg

SEQ ID NO: 783690 - DNA, 20 bp, mouse
gagccctcagctggcggcgt

SEQ ID NO: 783691 - DNA, 20 bp, mouse
gtgctcaaacaaccgtgtct

SEQ ID NO: 783692 - DNA, 20 bp, mouse
gggcggcgtggggtccttca

SEQ ID NO: 783693 - DNA, 20 bp, mouse
gcccgcacgtgccctgccta

SEQ ID NO: 783694 - DNA, 20 bp, mouse
gtgtatcccaaaatgcactg

SEQ ID NO: 783695 - DNA, 20 bp, mouse
gagacagcccggagccttct

SEQ ID NO: 783696 - DNA, 20 bp, mouse
gaccggaagcaaaggggcgc

SEQ ID NO: 783697 - DNA, 20 bp, mouse
gagacagacccgttttctat

SEQ ID NO: 783698 - DNA, 20 bp, mouse
gggtggagggtgattcgcta

SEQ ID NO: 783699 - DNA, 20 bp, mouse
gaacgggtctgtctcgaaga

SEQ ID NO: 783700 - DNA, 20 bp, mouse
gggtctgtctcgaagagggc

SEQ ID NO: 783701 - DNA, 20 bp, mouse
gggccaatacggaagcggag

SEQ ID NO: 783702 - DNA, 20 bp, mouse
ggaagtgaccggaagcaaag

SEQ ID NO: 783703 - DNA, 20 bp, mouse
gtaagtctgcagcgaggtgg

SEQ ID NO: 783704 - DNA, 20 bp, mouse
gccaagggccaatacggaag

SEQ ID NO: 783705 - DNA, 20 bp, mouse
gggtctgtgacgtcatcttc

SEQ ID NO: 783706 - DNA, 20 bp, mouse
gaacccgtgtagctcttgac

SEQ ID NO: 783707 - DNA, 20 bp, mouse
gaggggcggaaccaaagaag

SEQ ID NO: 783708 - DNA, 20 bp, mouse
ggagcctcgcggcagaggga

SEQ ID NO: 783709 - DNA, 20 bp, mouse
gccggaactttgttagggag

SEQ ID NO: 783710 - DNA, 20 bp, mouse
gttccggcagcctttgaatt

SEQ ID NO: 783711 - DNA, 20 bp, mouse
gccgctaggaggagtcacac

SEQ ID NO: 783712 - DNA, 20 bp, mouse
gaccaaccttcccacttctt

SEQ ID NO: 783713 - DNA, 20 bp, mouse
gagctctccaactccccgct

SEQ ID NO: 783714 - DNA, 20 bp, mouse
gccagggagcctcgcggcag

SEQ ID NO: 783715 - DNA, 20 bp, mouse
ggctgggaacagtagtcttc

SEQ ID NO: 783716 - DNA, 20 bp, mouse
ggcccgcttcgctgcttctt

SEQ ID NO: 783717 - DNA, 20 bp, mouse
ggggccctggctttcctatt

SEQ ID NO: 783718 - DNA, 20 bp, mouse
gggctgctttggagtcgcga

SEQ ID NO: 783719 - DNA, 20 bp, mouse
gtcctccgtacatactccac

SEQ ID NO: 783720 - DNA, 20 bp, mouse
gaccaggaagtcgcagtgct

SEQ ID NO: 783721 - DNA, 20 bp, mouse
gtcgcagtgctgggctgctt

SEQ ID NO: 783722 - DNA, 20 bp, mouse
gaggacatctggtcgctatg

SEQ ID NO: 783723 - DNA, 20 bp, mouse
gaagcagcgaagcgggccag

SEQ ID NO: 783724 - DNA, 20 bp, mouse
ggagcgccgagcgtaacccc

SEQ ID NO: 783725 - DNA, 20 bp, mouse
gaggcaacaaggtgtagccg

SEQ ID NO: 783726 - DNA, 20 bp, mouse
gtacatcacagtagccgatg

SEQ ID NO: 783727 - DNA, 20 bp, mouse
gcgaaagcaaaatggtagac

SEQ ID NO: 783728 - DNA, 20 bp, mouse
gtcttaaagtgctgagagag

SEQ ID NO: 783729 - DNA, 20 bp, mouse
gggattggtctggtgttgtc

SEQ ID NO: 783730 - DNA, 20 bp, mouse
gagttcttatgtgagttttg

SEQ ID NO: 783731 - DNA, 20 bp, mouse
gttcaaccacacaaagtttt

SEQ ID NO: 783732 - DNA, 20 bp, mouse
gatatttgtggggtgtatga

SEQ ID NO: 783733 - DNA, 20 bp, mouse
gatattccaaaaactttgtg

SEQ ID NO: 783734 - DNA, 20 bp, mouse
gttttggaatattgttaact

SEQ ID NO: 783735 - DNA, 20 bp, mouse
gagggggttggggaagggaa

SEQ ID NO: 783736 - DNA, 20 bp, mouse
gggaccaggcgtgctaggat

SEQ ID NO: 783737 - DNA, 20 bp, mouse
ggccgggcgtgggaagaggg

SEQ ID NO: 783738 - DNA, 20 bp, mouse
gccgccccctagagcttcgg

SEQ ID NO: 783739 - DNA, 20 bp, mouse
gctcaggagatgatcgtcga

SEQ ID NO: 783740 - DNA, 20 bp, mouse
ggggcctgatcgatgttctc

SEQ ID NO: 783741 - DNA, 20 bp, mouse
ggccacctccgaagctctag

SEQ ID NO: 783742 - DNA, 20 bp, mouse
ggtgccgccccctagagctt

SEQ ID NO: 783743 - DNA, 20 bp, mouse
gcccggccgctgtcaccctc

SEQ ID NO: 783744 - DNA, 20 bp, mouse
gggtgacagcggccgggcgt

SEQ ID NO: 783745 - DNA, 20 bp, mouse
gccaccaggtttcccgtcac

SEQ ID NO: 783746 - DNA, 20 bp, mouse
gtgtccacgacataggggtg

SEQ ID NO: 783747 - DNA, 20 bp, mouse
gtgggcgtgtccacgacata

SEQ ID NO: 783748 - DNA, 20 bp, mouse
ggaagtggcgggtaatgaca

SEQ ID NO: 783749 - DNA, 20 bp, mouse
gagcctaggcgtgacatctg

SEQ ID NO: 783750 - DNA, 20 bp, mouse
gtagccccacccctatgtcg

SEQ ID NO: 783751 - DNA, 20 bp, mouse
gtgcgtccgtcgtggggctg

SEQ ID NO: 783752 - DNA, 20 bp, mouse
gtcgacgtgcgtccgtcgtg

SEQ ID NO: 783753 - DNA, 20 bp, mouse
gaacaccacgcgggcgaagg

SEQ ID NO: 783754 - DNA, 20 bp, mouse
gtctgtggaggcggagtagt

SEQ ID NO: 783755 - DNA, 20 bp, mouse
gaagcggcacagtgaagtgg

SEQ ID NO: 783756 - DNA, 20 bp, mouse
gtggaaaccaagacgggaga

SEQ ID NO: 783757 - DNA, 20 bp, mouse
gggtgtgcccacccccgtgt

SEQ ID NO: 783758 - DNA, 20 bp, mouse
gggtacccatgaaccccatc

SEQ ID NO: 783759 - DNA, 20 bp, mouse
gaatgctaaatggtcttctc

SEQ ID NO: 783760 - DNA, 20 bp, mouse
gtcgtggccttctcccgtct

SEQ ID NO: 783761 - DNA, 20 bp, mouse
gcgtctctccgcccacacgg

SEQ ID NO: 783762 - DNA, 20 bp, mouse
gccggaagtggtagttacta

SEQ ID NO: 783763 - DNA, 20 bp, mouse
gacacctggacgcctgaggc

SEQ ID NO: 783764 - DNA, 20 bp, mouse
gcaggcgtccaggtgtcccc

SEQ ID NO: 783765 - DNA, 20 bp, mouse
gcattcctgatggggttcat

SEQ ID NO: 783766 - DNA, 20 bp, mouse
gtaggggcgtgcttaaaagc

SEQ ID NO: 783767 - DNA, 20 bp, mouse
gggacgcgaagcgagatcgt

SEQ ID NO: 783768 - DNA, 20 bp, mouse
gcggcagctcacccttctct

SEQ ID NO: 783769 - DNA, 20 bp, mouse
gcggagaccatcccagagaa

SEQ ID NO: 783770 - DNA, 20 bp, mouse
gagctcacccttctctggga

SEQ ID NO: 783771 - DNA, 20 bp, mouse
gtccacttcaaggccggctc

SEQ ID NO: 783772 - DNA, 20 bp, mouse
ggagcaacggggcttcgcga

SEQ ID NO: 783773 - DNA, 20 bp, mouse
gaagcagaatgtgctcctag

SEQ ID NO: 783774 - DNA, 20 bp, mouse
ggcccaggaggcgtgacttg

SEQ ID NO: 783775 - DNA, 20 bp, mouse
ggggcttcgcgagggacaaa

SEQ ID NO: 783776 - DNA, 20 bp, mouse
gcggtggagcgaatttcaac

SEQ ID NO: 783777 - DNA, 20 bp, mouse
gtgggtgtccgtgggcaggg

SEQ ID NO: 783778 - DNA, 20 bp, mouse
gggtcattctgggtgtccgt

SEQ ID NO: 783779 - DNA, 20 bp, mouse
ggtagcagtactcggacaaa

SEQ ID NO: 783780 - DNA, 20 bp, mouse
gtgcggagttgcctaagcag

SEQ ID NO: 783781 - DNA, 20 bp, mouse
gaggcttagaaggtcattct

SEQ ID NO: 783782 - DNA, 20 bp, mouse
gccgagtactgctaccttgt

SEQ ID NO: 783783 - DNA, 20 bp, mouse
ggggtcaaactcctttggaa

SEQ ID NO: 783784 - DNA, 20 bp, mouse
gaattcattgcctacgggcg

SEQ ID NO: 783785 - DNA, 20 bp, mouse
gaaggtccgaaggtccgcgc

SEQ ID NO: 783786 - DNA, 20 bp, mouse
gaggacctccacacggcggg

SEQ ID NO: 783787 - DNA, 20 bp, mouse
gggaccccagctcggcacag

SEQ ID NO: 783788 - DNA, 20 bp, mouse
gtggggtccctgcctgacgc

SEQ ID NO: 783789 - DNA, 20 bp, mouse
gccacctggcagaaaggacc

SEQ ID NO: 783790 - DNA, 20 bp, mouse
gtctgagcgaagcttcctgg

SEQ ID NO: 783791 - DNA, 20 bp, mouse
gtcccatggcaaccggcgtc

SEQ ID NO: 783792 - DNA, 20 bp, mouse
gccccctgacgacgaggcga

SEQ ID NO: 783793 - DNA, 20 bp, mouse
gtagccctgagccggaactc

SEQ ID NO: 783794 - DNA, 20 bp, mouse
gaacccgtcgcctcgtcgtc

SEQ ID NO: 783795 - DNA, 20 bp, mouse
gggctcgagtaccgccctcc

SEQ ID NO: 783796 - DNA, 20 bp, mouse
gctcagggaagcgactgcga

SEQ ID NO: 783797 - DNA, 20 bp, mouse
gtaggtgccgagtccgtcgg

SEQ ID NO: 783798 - DNA, 20 bp, mouse
gcacgcctgacgtcaggcca

SEQ ID NO: 783799 - DNA, 20 bp, mouse
ggcagcagctactacgacct

SEQ ID NO: 783800 - DNA, 20 bp, mouse
ggcgtgtggtcaggcgaagc

SEQ ID NO: 783801 - DNA, 20 bp, mouse
gccagctccgctccggctca

SEQ ID NO: 783802 - DNA, 20 bp, mouse
gcaggccaaggcgtgtggtc

SEQ ID NO: 783803 - DNA, 20 bp, mouse
gttaaagggtcggccggcaa

SEQ ID NO: 783804 - DNA, 20 bp, mouse
gcccgcccacgcctgacgtc

SEQ ID NO: 783805 - DNA, 20 bp, mouse
ggaattctgcgagactccca

SEQ ID NO: 783806 - DNA, 20 bp, mouse
ggtcccgagcatgtcgatgg

SEQ ID NO: 783807 - DNA, 20 bp, mouse
gtgaacctggtgggtgatgt

SEQ ID NO: 783808 - DNA, 20 bp, mouse
gaaggtcccgagcatgtcga

SEQ ID NO: 783809 - DNA, 20 bp, mouse
gccgactagaccaaagtaga

SEQ ID NO: 783810 - DNA, 20 bp, mouse
gaggatcagaagttcatcta

SEQ ID NO: 783811 - DNA, 20 bp, mouse
gaaaaagagggtgaacctgg

SEQ ID NO: 783812 - DNA, 20 bp, mouse
gcgcccccatcgacatgctc

SEQ ID NO: 783813 - DNA, 20 bp, mouse
gaactagtgcaagcgctctt

SEQ ID NO: 783814 - DNA, 20 bp, mouse
ggagaaacttgggccagcgg

SEQ ID NO: 783815 - DNA, 20 bp, mouse
gtgctcgggaccttctactt

SEQ ID NO: 783816 - DNA, 20 bp, mouse
ggccgagagctcgaacggga

SEQ ID NO: 783817 - DNA, 20 bp, mouse
gccaagacagccaaccaagg

SEQ ID NO: 783818 - DNA, 20 bp, mouse
gggagctcccggtctcgggg

SEQ ID NO: 783819 - DNA, 20 bp, mouse
gggggtgaaggggcgttcag

SEQ ID NO: 783820 - DNA, 20 bp, mouse
gcgcgggtctaagtcctcct

SEQ ID NO: 783821 - DNA, 20 bp, mouse
gcgctagagatggggtgaag

SEQ ID NO: 783822 - DNA, 20 bp, mouse
gagagctcgaacgggagggt

SEQ ID NO: 783823 - DNA, 20 bp, mouse
ggggtgggagctcccggtct

SEQ ID NO: 783824 - DNA, 20 bp, mouse
gagcgcctcctccccgagac

SEQ ID NO: 783825 - DNA, 20 bp, mouse
gaaggagggctcaggacgca

SEQ ID NO: 783826 - DNA, 20 bp, mouse
ggggtcaagtagtttggaag

SEQ ID NO: 783827 - DNA, 20 bp, mouse
gagttcaaggcaaaccgctg

SEQ ID NO: 783828 - DNA, 20 bp, mouse
gtaaaaatggcggtcctgca

SEQ ID NO: 783829 - DNA, 20 bp, mouse
gttaatacgtgcaagaacct

SEQ ID NO: 783830 - DNA, 20 bp, mouse
gcaagctggtccagaaatcg

SEQ ID NO: 783831 - DNA, 20 bp, mouse
ggaggcccagctgtattgtg

SEQ ID NO: 783832 - DNA, 20 bp, mouse
gcacggtagaacgatattat

SEQ ID NO: 783833 - DNA, 20 bp, mouse
ggtgcaagaacctaggtttg

SEQ ID NO: 783834 - DNA, 20 bp, mouse
gcctcatgggtcaagtagtt

SEQ ID NO: 783835 - DNA, 20 bp, mouse
gtattggctgctcaagtcat

SEQ ID NO: 783836 - DNA, 20 bp, mouse
gaaaatgccgaggagccgaa

SEQ ID NO: 783837 - DNA, 20 bp, mouse
gaagggaagagacgcccaag

SEQ ID NO: 783838 - DNA, 20 bp, mouse
ggcgacggaagacccggaag

SEQ ID NO: 783839 - DNA, 20 bp, mouse
gagagcccagacctccctct

SEQ ID NO: 783840 - DNA, 20 bp, mouse
gacactccacgcactgggat

SEQ ID NO: 783841 - DNA, 20 bp, mouse
gagaagcaacaccgggtctg

SEQ ID NO: 783842 - DNA, 20 bp, mouse
gagcggtcagcgcggggtca

SEQ ID NO: 783843 - DNA, 20 bp, mouse
gaggctgcaggccacccgat

SEQ ID NO: 783844 - DNA, 20 bp, mouse
gtggcagaagcgtcaccgag

SEQ ID NO: 783845 - DNA, 20 bp, mouse
gaggaaagccggataaggcc

SEQ ID NO: 783846 - DNA, 20 bp, mouse
gcgacccagtgcgttctctc

SEQ ID NO: 783847 - DNA, 20 bp, mouse
gcacgcgcacgctggagcga

SEQ ID NO: 783848 - DNA, 20 bp, mouse
gaggaggtgtccaccgtcgt

SEQ ID NO: 783849 - DNA, 20 bp, mouse
gctaaccggaagaggacgaa

SEQ ID NO: 783850 - DNA, 20 bp, mouse
gtgaaggagtccgttgagaa

SEQ ID NO: 783851 - DNA, 20 bp, mouse
gtgcgtcgtagtggctaaga

SEQ ID NO: 783852 - DNA, 20 bp, mouse
gtcgtagtggctaagagggg

SEQ ID NO: 783853 - DNA, 20 bp, mouse
gcgctggagcgaaggattct

SEQ ID NO: 783854 - DNA, 20 bp, mouse
ggacaaaggcatttcactaa

SEQ ID NO: 783855 - DNA, 20 bp, mouse
gcactgggtcgccagctttg

SEQ ID NO: 783856 - DNA, 20 bp, mouse
gtctctgagcggcggaggta

SEQ ID NO: 783857 - DNA, 20 bp, mouse
gccgagggacgagagaagag

SEQ ID NO: 783858 - DNA, 20 bp, mouse
ggtcccggatcagtaagcgg

SEQ ID NO: 783859 - DNA, 20 bp, mouse
gcacgggccgtctggagtag

SEQ ID NO: 783860 - DNA, 20 bp, mouse
ggggccgtctggagtagtgg

SEQ ID NO: 783861 - DNA, 20 bp, mouse
gtcggcccggagtctctgag

SEQ ID NO: 783862 - DNA, 20 bp, mouse
ggggagcggaccttgcttcc

SEQ ID NO: 783863 - DNA, 20 bp, mouse
gggcggaggtatggaggaga

SEQ ID NO: 783864 - DNA, 20 bp, mouse
ggaggacagcggaacgcggc

SEQ ID NO: 783865 - DNA, 20 bp, mouse
gccgtccgcaaatagctccc

SEQ ID NO: 783866 - DNA, 20 bp, mouse
gcaagcttgcgcagcgtgat

SEQ ID NO: 783867 - DNA, 20 bp, mouse
ggcgctgcggcccagctcaa

SEQ ID NO: 783868 - DNA, 20 bp, mouse
gttccccaatccaactgtcc

SEQ ID NO: 783869 - DNA, 20 bp, mouse
gcggcccagctcaacggaaa

SEQ ID NO: 783870 - DNA, 20 bp, mouse
ggtcctggacagttggattg

SEQ ID NO: 783871 - DNA, 20 bp, mouse
ggcggagccgagatccttaa

SEQ ID NO: 783872 - DNA, 20 bp, mouse
gtcaacggaaacgggtaaag

SEQ ID NO: 783873 - DNA, 20 bp, mouse
ggcttgcgcagcgtgatggg

SEQ ID NO: 783874 - DNA, 20 bp, mouse
gggagacagtcctggacagt

SEQ ID NO: 783875 - DNA, 20 bp, mouse
gaataaatcctggcgttcta

SEQ ID NO: 783876 - DNA, 20 bp, mouse
gttagcgtctgagagacgaa

SEQ ID NO: 783877 - DNA, 20 bp, mouse
ggaaagggtgagaggactca

SEQ ID NO: 783878 - DNA, 20 bp, mouse
gtagtcagcctgagaaggct

SEQ ID NO: 783879 - DNA, 20 bp, mouse
gggggcagggcttatgtggg

SEQ ID NO: 783880 - DNA, 20 bp, mouse
gagggtgagaggactcaagg

SEQ ID NO: 783881 - DNA, 20 bp, mouse
gccactgtccaagtgtgagg

SEQ ID NO: 783882 - DNA, 20 bp, mouse
ggagggggcagggcttatgt

SEQ ID NO: 783883 - DNA, 20 bp, mouse
gagtttcaattgaggcaagg

SEQ ID NO: 783884 - DNA, 20 bp, mouse
gagcatcttaccagagctgt

SEQ ID NO: 783885 - DNA, 20 bp, mouse
gtgtaaaaggctttcagccc

SEQ ID NO: 783886 - DNA, 20 bp, mouse
ggcaggggactgaccaccaa

SEQ ID NO: 783887 - DNA, 20 bp, mouse
ggctctccctggtggttcag

SEQ ID NO: 783888 - DNA, 20 bp, mouse
gagcaagcggagcaccgtcc

SEQ ID NO: 783889 - DNA, 20 bp, mouse
gcaccaatgggaagtaaagt

SEQ ID NO: 783890 - DNA, 20 bp, mouse
gctactcctctgaaccacca

SEQ ID NO: 783891 - DNA, 20 bp, mouse
gcagcgagcgcgctcccgga

SEQ ID NO: 783892 - DNA, 20 bp, mouse
gtagatcctgagagctgtcc

SEQ ID NO: 783893 - DNA, 20 bp, mouse
gtctaaaagtccgcggttcc

SEQ ID NO: 783894 - DNA, 20 bp, mouse
gtgttggcgactccgaggca

SEQ ID NO: 783895 - DNA, 20 bp, mouse
gctgtccaggcctggaaccg

SEQ ID NO: 783896 - DNA, 20 bp, mouse
gcgtgcgtcgacaacaacgg

SEQ ID NO: 783897 - DNA, 20 bp, mouse
ggcgtcgacaacaacggagg

SEQ ID NO: 783898 - DNA, 20 bp, mouse
gaaagtgggcggggtgccga

SEQ ID NO: 783899 - DNA, 20 bp, mouse
gggcccctgagaagatgcac

SEQ ID NO: 783900 - DNA, 20 bp, mouse
ggccctttgaaactcagtgg

SEQ ID NO: 783901 - DNA, 20 bp, mouse
ggcgcgtgcgtcgacaacaa

SEQ ID NO: 783902 - DNA, 20 bp, mouse
gggcccacaccgattactct

SEQ ID NO: 783903 - DNA, 20 bp, mouse
gggggtgccgatggccaagt

SEQ ID NO: 783904 - DNA, 20 bp, mouse
gcggaggcggtcgtcaagcc

SEQ ID NO: 783905 - DNA, 20 bp, mouse
gagggggcggaaaaagtccg

SEQ ID NO: 783906 - DNA, 20 bp, mouse
gagcgagtatcttctctttt

SEQ ID NO: 783907 - DNA, 20 bp, mouse
gcggaatcctagattttgat

SEQ ID NO: 783908 - DNA, 20 bp, mouse
gaagcagttagtgagtccaa

SEQ ID NO: 783909 - DNA, 20 bp, mouse
gcgaggaccatttttctttt

SEQ ID NO: 783910 - DNA, 20 bp, mouse
gaagtgacgacgccgacgcc

SEQ ID NO: 783911 - DNA, 20 bp, mouse
gtgattgggctacatagaaa

SEQ ID NO: 783912 - DNA, 20 bp, mouse
ggggcaacgaatggagtact

SEQ ID NO: 783913 - DNA, 20 bp, mouse
gtgagtccaagggcaacgaa

SEQ ID NO: 783914 - DNA, 20 bp, mouse
gcggcgtcgtcacttccgcc

SEQ ID NO: 783915 - DNA, 20 bp, mouse
gaatctaggattccgggcgt

SEQ ID NO: 783916 - DNA, 20 bp, mouse
gacacttgtggaacagtaat

SEQ ID NO: 783917 - DNA, 20 bp, mouse
ggcagaagcaatgacacttg

SEQ ID NO: 783918 - DNA, 20 bp, mouse
gtagcaaaaggtatgctgta

SEQ ID NO: 783919 - DNA, 20 bp, mouse
gcggtcagcctcaccacaat

SEQ ID NO: 783920 - DNA, 20 bp, mouse
gcagcctcaccacaatcggc

SEQ ID NO: 783921 - DNA, 20 bp, mouse
gcgggagagcttccggatga

SEQ ID NO: 783922 - DNA, 20 bp, mouse
gtggaacagtaattgggatc

SEQ ID NO: 783923 - DNA, 20 bp, mouse
gtatcctgggtttccggact

SEQ ID NO: 783924 - DNA, 20 bp, mouse
gtgttgatatcaattcacat

SEQ ID NO: 783925 - DNA, 20 bp, mouse
gggacttggaatttagcaaa

SEQ ID NO: 783926 - DNA, 20 bp, mouse
ggtgccaaggctccccgcgg

SEQ ID NO: 783927 - DNA, 20 bp, mouse
gcccgcgcgaatcgcttctc

SEQ ID NO: 783928 - DNA, 20 bp, mouse
gggctccccgcggtgggttg

SEQ ID NO: 783929 - DNA, 20 bp, mouse
ggcggtgccaaggctccccg

SEQ ID NO: 783930 - DNA, 20 bp, mouse
gaaacagccccaacccaccg

SEQ ID NO: 783931 - DNA, 20 bp, mouse
ggattcgcgcgggccggctg

SEQ ID NO: 783932 - DNA, 20 bp, mouse
gcgaatcgcttctccggcgg

SEQ ID NO: 783933 - DNA, 20 bp, mouse
gggacttctaaaagagattc

SEQ ID NO: 783934 - DNA, 20 bp, mouse
ggccggagaagcgattcgcg

SEQ ID NO: 783935 - DNA, 20 bp, mouse
gcatcagagagcgccaccgc

SEQ ID NO: 783936 - DNA, 20 bp, mouse
gcacttgtctcgtagcagag

SEQ ID NO: 783937 - DNA, 20 bp, mouse
gcgtagcagagtggtagagt

SEQ ID NO: 783938 - DNA, 20 bp, mouse
gcattcagtccctgtctgtt

SEQ ID NO: 783939 - DNA, 20 bp, mouse
gtggaggttcacttttgcgc

SEQ ID NO: 783940 - DNA, 20 bp, mouse
ggagaaatccgggctagtgg

SEQ ID NO: 783941 - DNA, 20 bp, mouse
gtatacatccctaacagaca

SEQ ID NO: 783942 - DNA, 20 bp, mouse
gtaactgctgagatgtggct

SEQ ID NO: 783943 - DNA, 20 bp, mouse
gggcaagccggaaaggggtg

SEQ ID NO: 783944 - DNA, 20 bp, mouse
gacgtgtaactgctgagatg

SEQ ID NO: 783945 - DNA, 20 bp, mouse
ggtacttctaatggtcttac

SEQ ID NO: 783946 - DNA, 20 bp, mouse
gcaccgcagcgggcagggtt

SEQ ID NO: 783947 - DNA, 20 bp, mouse
gcgcgctaatcagagggcgg

SEQ ID NO: 783948 - DNA, 20 bp, mouse
ggagcgcaggagcaagtggg

SEQ ID NO: 783949 - DNA, 20 bp, mouse
gcaggagcgcaggagcaagt

SEQ ID NO: 783950 - DNA, 20 bp, mouse
gggaaggacgcgctaatcag

SEQ ID NO: 783951 - DNA, 20 bp, mouse
ggcacaagttaaagcatcgc

SEQ ID NO: 783952 - DNA, 20 bp, mouse
gagagggcgggggctcgggt

SEQ ID NO: 783953 - DNA, 20 bp, mouse
gtgggcggtaaccccccggc

SEQ ID NO: 783954 - DNA, 20 bp, mouse
gtcccaaaccctgcccgctg

SEQ ID NO: 783955 - DNA, 20 bp, mouse
gaatcagagggcgggggctc

SEQ ID NO: 783956 - DNA, 20 bp, mouse
gggctcgagagggacctcgg

SEQ ID NO: 783957 - DNA, 20 bp, mouse
gatggcggccaccatgaaga

SEQ ID NO: 783958 - DNA, 20 bp, mouse
gaagaaggcggtgagtgcgg

SEQ ID NO: 783959 - DNA, 20 bp, mouse
ggggcccgagatcccagcca

SEQ ID NO: 783960 - DNA, 20 bp, mouse
gtggactgaaccacggggcg

SEQ ID NO: 783961 - DNA, 20 bp, mouse
ggcgcgggggaaaaccactc

SEQ ID NO: 783962 - DNA, 20 bp, mouse
gtccgaggagccgtgggccg

SEQ ID NO: 783963 - DNA, 20 bp, mouse
gccggcataaataccaaaag

SEQ ID NO: 783964 - DNA, 20 bp, mouse
ggcactcaccgccttcttca

SEQ ID NO: 783965 - DNA, 20 bp, mouse
gaccaaaagcggccaatagt

SEQ ID NO: 783966 - DNA, 20 bp, mouse
gaaagctagcacggtaattt

SEQ ID NO: 783967 - DNA, 20 bp, mouse
gcaccacggaggtaacgcgg

SEQ ID NO: 783968 - DNA, 20 bp, mouse
gaagcttgagatccgaaaag

SEQ ID NO: 783969 - DNA, 20 bp, mouse
ggccctccgcgttacctccg

SEQ ID NO: 783970 - DNA, 20 bp, mouse
gcggcaccacggaggtaacg

SEQ ID NO: 783971 - DNA, 20 bp, mouse
gtacctccgtggtgccgcca

SEQ ID NO: 783972 - DNA, 20 bp, mouse
ggggcgcagagcgtatcccc

SEQ ID NO: 783973 - DNA, 20 bp, mouse
gaaaagcgggtccgaaacac

SEQ ID NO: 783974 - DNA, 20 bp, mouse
gacaggatcatagagacgac

SEQ ID NO: 783975 - DNA, 20 bp, mouse
gcgcagagcgtatcccctgg

SEQ ID NO: 783976 - DNA, 20 bp, mouse
gtgcccgcctaagcttcctt

SEQ ID NO: 783977 - DNA, 20 bp, mouse
gtggtaagctggaacatcaa

SEQ ID NO: 783978 - DNA, 20 bp, mouse
gcggtggaaacgcgagagga

SEQ ID NO: 783979 - DNA, 20 bp, mouse
gcggggagccagctcacttc

SEQ ID NO: 783980 - DNA, 20 bp, mouse
gggaaacgcgagaggaaggc

SEQ ID NO: 783981 - DNA, 20 bp, mouse
gttcccaaaggaagcttagg

SEQ ID NO: 783982 - DNA, 20 bp, mouse
gggaaggtgagaacgcccgg

SEQ ID NO: 783983 - DNA, 20 bp, mouse
gcgcccggtggaaacgcgag

SEQ ID NO: 783984 - DNA, 20 bp, mouse
gaggggaaggtgagaacgcc

SEQ ID NO: 783985 - DNA, 20 bp, mouse
gcctgcttgcgtcctgccgt

SEQ ID NO: 783986 - DNA, 20 bp, mouse
gccagcgtgcctccaggtga

SEQ ID NO: 783987 - DNA, 20 bp, mouse
ggggttggggcgagtcacgt

SEQ ID NO: 783988 - DNA, 20 bp, mouse
ggaccaatgaagcacctgca

SEQ ID NO: 783989 - DNA, 20 bp, mouse
gccggcccaggggagcttgg

SEQ ID NO: 783990 - DNA, 20 bp, mouse
gtgagggctgacgccagcgt

SEQ ID NO: 783991 - DNA, 20 bp, mouse
ggaggacctgtgacagccta

SEQ ID NO: 783992 - DNA, 20 bp, mouse
gtctcgcgagaataagggaa

SEQ ID NO: 783993 - DNA, 20 bp, mouse
gtcgcaaagcagccggccca

SEQ ID NO: 783994 - DNA, 20 bp, mouse
gaatgccaccaagctcccct

SEQ ID NO: 783995 - DNA, 20 bp, mouse
ggacagccttaggctgtcac

SEQ ID NO: 783996 - DNA, 20 bp, mouse
gttcacgtggagagaagggt

SEQ ID NO: 783997 - DNA, 20 bp, mouse
ggaggacgaaagaaccagcc

SEQ ID NO: 783998 - DNA, 20 bp, mouse
gtgctctcgtccacccgcag

SEQ ID NO: 783999 - DNA, 20 bp, mouse
gggctgggacgcaaagaatg

SEQ ID NO: 784000 - DNA, 20 bp, mouse
gaataaacttagggacggaa

SEQ ID NO: 784001 - DNA, 20 bp, mouse
ggcccttagggaataaactt

SEQ ID NO: 784002 - DNA, 20 bp, mouse
gtaagggcgcaagacaggaa

SEQ ID NO: 784003 - DNA, 20 bp, mouse
gaaacttagggacggaaagg

SEQ ID NO: 784004 - DNA, 20 bp, mouse
gagcctgctgccgccccctg

SEQ ID NO: 784005 - DNA, 20 bp, mouse
gccctttcacgtggagagaa

SEQ ID NO: 784006 - DNA, 20 bp, mouse
gggcccgccccagaactaat

SEQ ID NO: 784007 - DNA, 20 bp, mouse
ggggcggggtctgcataatc

SEQ ID NO: 784008 - DNA, 20 bp, mouse
gaactctggtttgacggatg

SEQ ID NO: 784009 - DNA, 20 bp, mouse
ggccagtgcctctttagttt

SEQ ID NO: 784010 - DNA, 20 bp, mouse
gggagccgctagagggtggg

SEQ ID NO: 784011 - DNA, 20 bp, mouse
gtgcataatccgggtgtcaa

SEQ ID NO: 784012 - DNA, 20 bp, mouse
gagtgcctctttagtttggg

SEQ ID NO: 784013 - DNA, 20 bp, mouse
ggggtggagcctattagttc

SEQ ID NO: 784014 - DNA, 20 bp, mouse
gccctgggcgggaccatgag

SEQ ID NO: 784015 - DNA, 20 bp, mouse
gcacgctggtccagactatc

SEQ ID NO: 784016 - DNA, 20 bp, mouse
ggtagctgcgctaagaaagg

SEQ ID NO: 784017 - DNA, 20 bp, mouse
gtacctggggagttcggtgg

SEQ ID NO: 784018 - DNA, 20 bp, mouse
ggacctggtcgcccctctag

SEQ ID NO: 784019 - DNA, 20 bp, mouse
gaatgtctgcgcagcggttc

SEQ ID NO: 784020 - DNA, 20 bp, mouse
ggctgggtacctggggagtt

SEQ ID NO: 784021 - DNA, 20 bp, mouse
ggggtacctggggagttcgg

SEQ ID NO: 784022 - DNA, 20 bp, mouse
ggcccgccaccgaactcccc

SEQ ID NO: 784023 - DNA, 20 bp, mouse
ggcctggggaaccagggttc

SEQ ID NO: 784024 - DNA, 20 bp, mouse
ggggcggggcgggacaaacc

SEQ ID NO: 784025 - DNA, 20 bp, mouse
gtctacaaatgtctgcgcag

SEQ ID NO: 784026 - DNA, 20 bp, mouse
gaggcatcagggttcttaag

SEQ ID NO: 784027 - DNA, 20 bp, mouse
gcatcagggttcttaagggg

SEQ ID NO: 784028 - DNA, 20 bp, mouse
gcagcggccacaaggcatca

SEQ ID NO: 784029 - DNA, 20 bp, mouse
ggaagcaagcatgcaagcag

SEQ ID NO: 784030 - DNA, 20 bp, mouse
gggagcctccttgccatttt

SEQ ID NO: 784031 - DNA, 20 bp, mouse
gcccaagataaagatgtgct

SEQ ID NO: 784032 - DNA, 20 bp, mouse
gtaggggtggtcaattgctg

SEQ ID NO: 784033 - DNA, 20 bp, mouse
gaacctctacaggccgaaaa

SEQ ID NO: 784034 - DNA, 20 bp, mouse
gtcccttgaaagcgcgatag

SEQ ID NO: 784035 - DNA, 20 bp, mouse
gcatgcaagcagcggccaca

SEQ ID NO: 784036 - DNA, 20 bp, mouse
gagaacaggcttaggtcgag

SEQ ID NO: 784037 - DNA, 20 bp, mouse
gaggcttaggtcgagaggaa

SEQ ID NO: 784038 - DNA, 20 bp, mouse
gaggttccagaaggggtggg

SEQ ID NO: 784039 - DNA, 20 bp, mouse
gcctccccatttcataaaaa

SEQ ID NO: 784040 - DNA, 20 bp, mouse
gtggaacctgtctttagaac

SEQ ID NO: 784041 - DNA, 20 bp, mouse
gtgtcccctcccaccccttc

SEQ ID NO: 784042 - DNA, 20 bp, mouse
gggacagggcagggtaagcc

SEQ ID NO: 784043 - DNA, 20 bp, mouse
gtgcacagcccagcattagt

SEQ ID NO: 784044 - DNA, 20 bp, mouse
gagcagatcggagtgcattt

SEQ ID NO: 784045 - DNA, 20 bp, mouse
gaatggggaggcattgcaga

SEQ ID NO: 784046 - DNA, 20 bp, mouse
ggcactctgcaggggtggac

SEQ ID NO: 784047 - DNA, 20 bp, mouse
ggcctctgcgcccacgtggt

SEQ ID NO: 784048 - DNA, 20 bp, mouse
ggccccgcccgagcgccaat

SEQ ID NO: 784049 - DNA, 20 bp, mouse
gaacccgactccacctctca

SEQ ID NO: 784050 - DNA, 20 bp, mouse
gatgggcgggactcacgcaa

SEQ ID NO: 784051 - DNA, 20 bp, mouse
gcgccaatgggctgtggcga

SEQ ID NO: 784052 - DNA, 20 bp, mouse
ggggatggagggattatagc

SEQ ID NO: 784053 - DNA, 20 bp, mouse
gctagagcaggtggggtaat

SEQ ID NO: 784054 - DNA, 20 bp, mouse
gtatggacacgcgttctgtt

SEQ ID NO: 784055 - DNA, 20 bp, mouse
gttctcaagcgggggatgga

SEQ ID NO: 784056 - DNA, 20 bp, mouse
gaggctatatagagtggtgg

SEQ ID NO: 784057 - DNA, 20 bp, mouse
ggcaaattttgcaaagtggg

SEQ ID NO: 784058 - DNA, 20 bp, mouse
ggagggagggaatggggcgc

SEQ ID NO: 784059 - DNA, 20 bp, mouse
gtcgctatctggcccggcgg

SEQ ID NO: 784060 - DNA, 20 bp, mouse
gcaaaggctatatagagtgg

SEQ ID NO: 784061 - DNA, 20 bp, mouse
gccagcgcgtggggcggttg

SEQ ID NO: 784062 - DNA, 20 bp, mouse
gcgtggctttccatcgaact

SEQ ID NO: 784063 - DNA, 20 bp, mouse
gtatatagagtggtggtggc

SEQ ID NO: 784064 - DNA, 20 bp, mouse
gaacccccacctccgcggga

SEQ ID NO: 784065 - DNA, 20 bp, mouse
gtcggcaaattttgcaaagt

SEQ ID NO: 784066 - DNA, 20 bp, mouse
gccctcccggggaccctcgc

SEQ ID NO: 784067 - DNA, 20 bp, mouse
ggagctgcggcggtgtgaga

SEQ ID NO: 784068 - DNA, 20 bp, mouse
ggacccgcagcggggagcgc

SEQ ID NO: 784069 - DNA, 20 bp, mouse
ggcggcggaggcctcaccac

SEQ ID NO: 784070 - DNA, 20 bp, mouse
gggcaccgaccgcccctctc

SEQ ID NO: 784071 - DNA, 20 bp, mouse
ggcggagcgacgctggcagc

SEQ ID NO: 784072 - DNA, 20 bp, mouse
gcgcccggcgctccccgctg

SEQ ID NO: 784073 - DNA, 20 bp, mouse
ggcccctctccggggaactg

SEQ ID NO: 784074 - DNA, 20 bp, mouse
gcgcggggctcaggagccgg

SEQ ID NO: 784075 - DNA, 20 bp, mouse
gataccgccggggacaatca

SEQ ID NO: 784076 - DNA, 20 bp, mouse
gagggcggggctgtgacgta

SEQ ID NO: 784077 - DNA, 20 bp, mouse
gtctaaaagtagcatgtagg

SEQ ID NO: 784078 - DNA, 20 bp, mouse
gaagaagatggatgagaggc

SEQ ID NO: 784079 - DNA, 20 bp, mouse
gaaggagagggcggtagagt

SEQ ID NO: 784080 - DNA, 20 bp, mouse
gggttctaaaagtagcatgt

SEQ ID NO: 784081 - DNA, 20 bp, mouse
gagagttggtgggggttcgg

SEQ ID NO: 784082 - DNA, 20 bp, mouse
gggccaaaagaggtgatgct

SEQ ID NO: 784083 - DNA, 20 bp, mouse
ggccccgccctgcgaacttc

SEQ ID NO: 784084 - DNA, 20 bp, mouse
gaactgagtgccattttcag

SEQ ID NO: 784085 - DNA, 20 bp, mouse
gtgggagttacaggctttgt

SEQ ID NO: 784086 - DNA, 20 bp, mouse
ggttccgaatccaaggtctc

SEQ ID NO: 784087 - DNA, 20 bp, mouse
gcgcacctcgccgaacagca

SEQ ID NO: 784088 - DNA, 20 bp, mouse
ggccgaggggcgcgtagggg

SEQ ID NO: 784089 - DNA, 20 bp, mouse
gcgcgttctcgtcttcccgc

SEQ ID NO: 784090 - DNA, 20 bp, mouse
gcccccgattcgcgattcgc

SEQ ID NO: 784091 - DNA, 20 bp, mouse
gcgctggccgaggggcgcgt

SEQ ID NO: 784092 - DNA, 20 bp, mouse
gaggggtggcgccgcgtccc

SEQ ID NO: 784093 - DNA, 20 bp, mouse
gggagcgaggcgagtcgaaa

SEQ ID NO: 784094 - DNA, 20 bp, mouse
gaggagacgaggctccgcta

SEQ ID NO: 784095 - DNA, 20 bp, mouse
gtcgtcttcccgctggccga

SEQ ID NO: 784096 - DNA, 20 bp, mouse
ggtggagatgatgttatctg

SEQ ID NO: 784097 - DNA, 20 bp, mouse
gtaagccaatgagaaatcta

SEQ ID NO: 784098 - DNA, 20 bp, mouse
gaccaaaggaaatggttagt

SEQ ID NO: 784099 - DNA, 20 bp, mouse
gcataagatagaaatacctt

SEQ ID NO: 784100 - DNA, 20 bp, mouse
gaaaggaaatggttagtggg

SEQ ID NO: 784101 - DNA, 20 bp, mouse
gtaaaattgagataatagag

SEQ ID NO: 784102 - DNA, 20 bp, mouse
gtgcttaggacaagacagac

SEQ ID NO: 784103 - DNA, 20 bp, mouse
gaagggtcaacttaccatcc

SEQ ID NO: 784104 - DNA, 20 bp, mouse
gtccaagcacctatgctttc

SEQ ID NO: 784105 - DNA, 20 bp, mouse
ggctttcaggctgatcattc

SEQ ID NO: 784106 - DNA, 20 bp, mouse
gaccctggagggccactaat

SEQ ID NO: 784107 - DNA, 20 bp, mouse
gagaatctagggagttttcg

SEQ ID NO: 784108 - DNA, 20 bp, mouse
ggcctgtcctcattagagag

SEQ ID NO: 784109 - DNA, 20 bp, mouse
gcgagggtaaagatgttatc

SEQ ID NO: 784110 - DNA, 20 bp, mouse
gtgctctaatcagaccctgg

SEQ ID NO: 784111 - DNA, 20 bp, mouse
gccccattagtggccctcca

SEQ ID NO: 784112 - DNA, 20 bp, mouse
gggttgctggcaggaacaga

SEQ ID NO: 784113 - DNA, 20 bp, mouse
gagcaacccactctctaatg

SEQ ID NO: 784114 - DNA, 20 bp, mouse
gaacctgagtttgatagcca

SEQ ID NO: 784115 - DNA, 20 bp, mouse
gtaatgaggacaggccagtg

SEQ ID NO: 784116 - DNA, 20 bp, mouse
ggcgcctcaggcaagttctg

SEQ ID NO: 784117 - DNA, 20 bp, mouse
gtctgcggcctgctaagggg

SEQ ID NO: 784118 - DNA, 20 bp, mouse
ggaagcgcggcgtgtccagt

SEQ ID NO: 784119 - DNA, 20 bp, mouse
gaagttctgcggcctgctaa

SEQ ID NO: 784120 - DNA, 20 bp, mouse
gcgtaagcaaggagcgcgga

SEQ ID NO: 784121 - DNA, 20 bp, mouse
gggcgcatgcgcacacgggg

SEQ ID NO: 784122 - DNA, 20 bp, mouse
gggggtgtagtgcaccgcgg

SEQ ID NO: 784123 - DNA, 20 bp, mouse
gcaaggagcgcggagggtgc

SEQ ID NO: 784124 - DNA, 20 bp, mouse
gcggcggtctgtcgagcgag

SEQ ID NO: 784125 - DNA, 20 bp, mouse
gcgcacgtaagcaaggagcg

SEQ ID NO: 784126 - DNA, 20 bp, mouse
ggcaaccagtagcagaactg

SEQ ID NO: 784127 - DNA, 20 bp, mouse
ggggggtggggtgtagtcca

SEQ ID NO: 784128 - DNA, 20 bp, mouse
gcaggtgccagctggttatg

SEQ ID NO: 784129 - DNA, 20 bp, mouse
ggacaagccccataaccagc

SEQ ID NO: 784130 - DNA, 20 bp, mouse
gacctggtaacaagccgcat

SEQ ID NO: 784131 - DNA, 20 bp, mouse
gccccatgcggcttgttacc

SEQ ID NO: 784132 - DNA, 20 bp, mouse
gttccaggagatacaggcag

SEQ ID NO: 784133 - DNA, 20 bp, mouse
gtgactcctgcccttcaccc

SEQ ID NO: 784134 - DNA, 20 bp, mouse
gtatctcctggaatgctgat

SEQ ID NO: 784135 - DNA, 20 bp, mouse
gccacatggagaacaccccc

SEQ ID NO: 784136 - DNA, 20 bp, mouse
ggccacctgccggtggtcgc

SEQ ID NO: 784137 - DNA, 20 bp, mouse
gcagatgcctgccctttagt

SEQ ID NO: 784138 - DNA, 20 bp, mouse
ggggtggaaatcaggcactg

SEQ ID NO: 784139 - DNA, 20 bp, mouse
gcccccccccccgacgaatc

SEQ ID NO: 784140 - DNA, 20 bp, mouse
gctaccctgcgaccaccggc

SEQ ID NO: 784141 - DNA, 20 bp, mouse
gcctgctaccctgcgaccac

SEQ ID NO: 784142 - DNA, 20 bp, mouse
gggtaggtgccagggactag

SEQ ID NO: 784143 - DNA, 20 bp, mouse
gatgcctgccctttagtggg

SEQ ID NO: 784144 - DNA, 20 bp, mouse
ggaatcaggaaacgcggccc

SEQ ID NO: 784145 - DNA, 20 bp, mouse
gcccgacgaatcaggaaacg

SEQ ID NO: 784146 - DNA, 20 bp, mouse
gggtgccgcccacggaggag

SEQ ID NO: 784147 - DNA, 20 bp, mouse
gcctccgtgggcggcaccgc

SEQ ID NO: 784148 - DNA, 20 bp, mouse
gcggctgctcgcagttgcgc

SEQ ID NO: 784149 - DNA, 20 bp, mouse
gactgcgagcagccggcccg

SEQ ID NO: 784150 - DNA, 20 bp, mouse
gtggaatgagaaagcggagt

SEQ ID NO: 784151 - DNA, 20 bp, mouse
gcggcccgcggtgccgccca

SEQ ID NO: 784152 - DNA, 20 bp, mouse
gtgagcggcaggcgaagggg

SEQ ID NO: 784153 - DNA, 20 bp, mouse
gaagagaggcggcacatcaa

SEQ ID NO: 784154 - DNA, 20 bp, mouse
gtaccgcaggaattggccag

SEQ ID NO: 784155 - DNA, 20 bp, mouse
gcagccccctcctccgtggg

SEQ ID NO: 784156 - DNA, 20 bp, mouse
ggggacagagccgaactact

SEQ ID NO: 784157 - DNA, 20 bp, mouse
gccaagcttccctagtagtt

SEQ ID NO: 784158 - DNA, 20 bp, mouse
gactagggaagcttggcttg

SEQ ID NO: 784159 - DNA, 20 bp, mouse
ggagtcccggaccccaaaat

SEQ ID NO: 784160 - DNA, 20 bp, mouse
ggaggagcaagtgttgaaac

SEQ ID NO: 784161 - DNA, 20 bp, mouse
gagtacgtgagagcagtcag

SEQ ID NO: 784162 - DNA, 20 bp, mouse
gtaaagaaagactggagtcc

SEQ ID NO: 784163 - DNA, 20 bp, mouse
gtgaggcggggccagcgctc

SEQ ID NO: 784164 - DNA, 20 bp, mouse
gagccacaggtaagatgaca

SEQ ID NO: 784165 - DNA, 20 bp, mouse
gggtagaggactggagaatc

SEQ ID NO: 784166 - DNA, 20 bp, mouse
ggaaaggagggacgatgggg

SEQ ID NO: 784167 - DNA, 20 bp, mouse
gcccactccctctgccgcaa

SEQ ID NO: 784168 - DNA, 20 bp, mouse
gacgcaccagccctcttcga

SEQ ID NO: 784169 - DNA, 20 bp, mouse
gggggaaaggagggacgatg

SEQ ID NO: 784170 - DNA, 20 bp, mouse
gggcccacaccgttattcat

SEQ ID NO: 784171 - DNA, 20 bp, mouse
gctctctcagccaaccgttg

SEQ ID NO: 784172 - DNA, 20 bp, mouse
gtctctgattaggaacggag

SEQ ID NO: 784173 - DNA, 20 bp, mouse
gtcacacaggcccctcgaag

SEQ ID NO: 784174 - DNA, 20 bp, mouse
gacccaatgaataacggtgt

SEQ ID NO: 784175 - DNA, 20 bp, mouse
gattaggaacggaggggaag

SEQ ID NO: 784176 - DNA, 20 bp, mouse
gagacagcagtatagaggtg

SEQ ID NO: 784177 - DNA, 20 bp, mouse
gtaaagtgggcgggcgtcag

SEQ ID NO: 784178 - DNA, 20 bp, mouse
ggtacccgcccactgaaatc

SEQ ID NO: 784179 - DNA, 20 bp, mouse
gaggtgctgtatatgaaaag

SEQ ID NO: 784180 - DNA, 20 bp, mouse
gtaagaaatggggataagtg

SEQ ID NO: 784181 - DNA, 20 bp, mouse
gatacagcacctaaggagaa

SEQ ID NO: 784182 - DNA, 20 bp, mouse
ggatgctgacataagaaatg

SEQ ID NO: 784183 - DNA, 20 bp, mouse
gaagagagtgggtgacagaa

SEQ ID NO: 784184 - DNA, 20 bp, mouse
gaaagttcccggatttcagt

SEQ ID NO: 784185 - DNA, 20 bp, mouse
gaggatgcaacgatgaacac

SEQ ID NO: 784186 - DNA, 20 bp, mouse
gaccaggagaggtgcgggtc

SEQ ID NO: 784187 - DNA, 20 bp, mouse
gccctcaggtacatcctaca

SEQ ID NO: 784188 - DNA, 20 bp, mouse
gcaccggtggagccaggtcg

SEQ ID NO: 784189 - DNA, 20 bp, mouse
gggtcaggaaaaccacgacc

SEQ ID NO: 784190 - DNA, 20 bp, mouse
gacaatctctggtgcaccgg

SEQ ID NO: 784191 - DNA, 20 bp, mouse
gtgcaccagagattgtcacc

SEQ ID NO: 784192 - DNA, 20 bp, mouse
ggattgtcaccaggcttcta

SEQ ID NO: 784193 - DNA, 20 bp, mouse
gcaagcaagagcgctccctc

SEQ ID NO: 784194 - DNA, 20 bp, mouse
gtcctgacccgcacctctcc

SEQ ID NO: 784195 - DNA, 20 bp, mouse
gagtctccagctccaactac

SEQ ID NO: 784196 - DNA, 20 bp, mouse
gtcctcggggcgtgacgcta

SEQ ID NO: 784197 - DNA, 20 bp, mouse
gaggtcgccctgcctcctcg

SEQ ID NO: 784198 - DNA, 20 bp, mouse
ggagagcgccggcctcgcgg

SEQ ID NO: 784199 - DNA, 20 bp, mouse
gcgagcggctatgagcttat

SEQ ID NO: 784200 - DNA, 20 bp, mouse
ggtcacgccccgaggaggca

SEQ ID NO: 784201 - DNA, 20 bp, mouse
gcggctatgagcttatgggc

SEQ ID NO: 784202 - DNA, 20 bp, mouse
gcatagccgctcgccggcgt

SEQ ID NO: 784203 - DNA, 20 bp, mouse
ggccgggcgcggctgcgcaa

SEQ ID NO: 784204 - DNA, 20 bp, mouse
gttgcgccgccgaccttccc

SEQ ID NO: 784205 - DNA, 20 bp, mouse
gaggggcgggccaaagagca

SEQ ID NO: 784206 - DNA, 20 bp, mouse
gcccaagccaagatgtccct

SEQ ID NO: 784207 - DNA, 20 bp, mouse
gaggaggtagctgcgatatg

SEQ ID NO: 784208 - DNA, 20 bp, mouse
gtggagtccaagggacatct

SEQ ID NO: 784209 - DNA, 20 bp, mouse
gttgcccaggctgggagtca

SEQ ID NO: 784210 - DNA, 20 bp, mouse
gtggggaggggagcaagtag

SEQ ID NO: 784211 - DNA, 20 bp, mouse
gaagcagccgcacagtgaag

SEQ ID NO: 784212 - DNA, 20 bp, mouse
ggtcctggtcctgctccaga

SEQ ID NO: 784213 - DNA, 20 bp, mouse
ggggggcggcatgcttgccc

SEQ ID NO: 784214 - DNA, 20 bp, mouse
ggggcctgggacctgacagt

SEQ ID NO: 784215 - DNA, 20 bp, mouse
gaggggctgggctagctcct

SEQ ID NO: 784216 - DNA, 20 bp, mouse
gctggagaggagcgtttaaa

SEQ ID NO: 784217 - DNA, 20 bp, mouse
gtagagcgccgagcagtcga

SEQ ID NO: 784218 - DNA, 20 bp, mouse
gtgccctcaggtggtataac

SEQ ID NO: 784219 - DNA, 20 bp, mouse
gagtcgatggcacctcgagc

SEQ ID NO: 784220 - DNA, 20 bp, mouse
gatggcacctcgagctggag

SEQ ID NO: 784221 - DNA, 20 bp, mouse
ggctcggcgctctacagatc

SEQ ID NO: 784222 - DNA, 20 bp, mouse
gctacagatctgggccccgg

SEQ ID NO: 784223 - DNA, 20 bp, mouse
gtgttctaggagcgtttaaa

SEQ ID NO: 784224 - DNA, 20 bp, mouse
ggctctacagatctgggccc

SEQ ID NO: 784225 - DNA, 20 bp, mouse
ggagcgggaggcatcgtgca

SEQ ID NO: 784226 - DNA, 20 bp, mouse
gaccccgcagggcgctgaag

SEQ ID NO: 784227 - DNA, 20 bp, mouse
gcgctcccgggctgctcctg

SEQ ID NO: 784228 - DNA, 20 bp, mouse
gtcgctgcgggctgaccctg

SEQ ID NO: 784229 - DNA, 20 bp, mouse
gggcgctgaaggggcgctgc

SEQ ID NO: 784230 - DNA, 20 bp, mouse
gggggcctcgagatagaagt

SEQ ID NO: 784231 - DNA, 20 bp, mouse
gctcctcccggggttgtgta

SEQ ID NO: 784232 - DNA, 20 bp, mouse
gtgagtgcgcgtgaccccgc

SEQ ID NO: 784233 - DNA, 20 bp, mouse
gggggccaggagatctgcgc

SEQ ID NO: 784234 - DNA, 20 bp, mouse
gcaaccttggctgtcgctgc

SEQ ID NO: 784235 - DNA, 20 bp, mouse
gaaccggctctcagcgctcc

SEQ ID NO: 784236 - DNA, 20 bp, mouse
ggggcgaagtgttccactga

SEQ ID NO: 784237 - DNA, 20 bp, mouse
ggaaaagactgtccaaacta

SEQ ID NO: 784238 - DNA, 20 bp, mouse
gtccaaactagggagaggag

SEQ ID NO: 784239 - DNA, 20 bp, mouse
gcagccaagacaacagtggg

SEQ ID NO: 784240 - DNA, 20 bp, mouse
gcgaccaccgaaaccctcag

SEQ ID NO: 784241 - DNA, 20 bp, mouse
ggttccactgagggtttcgg

SEQ ID NO: 784242 - DNA, 20 bp, mouse
ggcccctcctctccctagtt

SEQ ID NO: 784243 - DNA, 20 bp, mouse
ggactgtccaaactagggag

SEQ ID NO: 784244 - DNA, 20 bp, mouse
ggagggtttcggtggtcgac

SEQ ID NO: 784245 - DNA, 20 bp, mouse
gtccggaagcagttggggcg

SEQ ID NO: 784246 - DNA, 20 bp, mouse
gtcgtgcaggacgtgacaaa

SEQ ID NO: 784247 - DNA, 20 bp, mouse
gggaacttcctgactagggg

SEQ ID NO: 784248 - DNA, 20 bp, mouse
gcgggcgcccgaaggtcctc

SEQ ID NO: 784249 - DNA, 20 bp, mouse
gcccgcagctcgcgtcgtgc

SEQ ID NO: 784250 - DNA, 20 bp, mouse
ggggggaacttcctgactag

SEQ ID NO: 784251 - DNA, 20 bp, mouse
gctcactagtctcgtgcaga

SEQ ID NO: 784252 - DNA, 20 bp, mouse
gggaagcgggtaggcctttg

SEQ ID NO: 784253 - DNA, 20 bp, mouse
gagtagaaggtggcgcgaag

SEQ ID NO: 784254 - DNA, 20 bp, mouse
ggaaggagcaaagctgctat

SEQ ID NO: 784255 - DNA, 20 bp, mouse
gaggggaggcgcttttccca

SEQ ID NO: 784256 - DNA, 20 bp, mouse
gaaactctgtaataccctag

SEQ ID NO: 784257 - DNA, 20 bp, mouse
gaggctcccggtaataaagc

SEQ ID NO: 784258 - DNA, 20 bp, mouse
gaacataattgcagcaactc

SEQ ID NO: 784259 - DNA, 20 bp, mouse
gtgaaactcagccatacaat

SEQ ID NO: 784260 - DNA, 20 bp, mouse
gagagtctcattagtgataa

SEQ ID NO: 784261 - DNA, 20 bp, mouse
gtgcaaactgctctgagtca

SEQ ID NO: 784262 - DNA, 20 bp, mouse
ggggtattacagagtttctt

SEQ ID NO: 784263 - DNA, 20 bp, mouse
gtcaagccctgctttattac

SEQ ID NO: 784264 - DNA, 20 bp, mouse
gttattaccgggagcctcta

SEQ ID NO: 784265 - DNA, 20 bp, mouse
gttcttgaggatagaagacc

SEQ ID NO: 784266 - DNA, 20 bp, mouse
ggagagcttggggttagagt

SEQ ID NO: 784267 - DNA, 20 bp, mouse
gacagtaaaacggagagctt

SEQ ID NO: 784268 - DNA, 20 bp, mouse
gctaccaatggctattgtgc
